United States Patent 7,888,497 (BIOINFORMATICALLY DETECTABLE GROUP OF NOVEL REGULATORY OLIGONUCLEOTIDES AND USES THEREOF) - sequence listing, part 155

SEQ ID NO: 6573517 - DNA, 15 bp, Homo sapiens
ttctcaagtgcctta

SEQ ID NO: 6573518 - DNA, 13 bp, Homo sapiens
ttctcaagttcta

SEQ ID NO: 6573519 - DNA, 14 bp, Homo sapiens
ttctcaagttctaa

SEQ ID NO: 6573520 - DNA, 23 bp, Homo sapiens
ttctcaagttctaagattctaat

SEQ ID NO: 6573521 - DNA, 18 bp, Homo sapiens
ttctcaatagttcttaaa

SEQ ID NO: 6573522 - DNA, 19 bp, Homo sapiens
ttctcaatagttcttaaaa

SEQ ID NO: 6573523 - DNA, 15 bp, Homo sapiens
ttctcaatcagtgca

SEQ ID NO: 6573524 - DNA, 18 bp, Homo sapiens
ttctcaatgaaaaatagt

SEQ ID NO: 6573525 - DNA, 16 bp, Homo sapiens
ttctcaatgcttttct

SEQ ID NO: 6573526 - DNA, 23 bp, Homo sapiens
ttctcaattattggcctgctaat

SEQ ID NO: 6573527 - DNA, 13 bp, Homo sapiens
ttctcaattccaa

SEQ ID NO: 6573528 - DNA, 17 bp, Homo sapiens
ttctcaattccaacagt

SEQ ID NO: 6573529 - DNA, 22 bp, Homo sapiens
ttctcacaccaacagtgtgaag

SEQ ID NO: 6573530 - DNA, 21 bp, Homo sapiens
ttctcacactctaactgtata

SEQ ID NO: 6573531 - DNA, 22 bp, Homo sapiens
ttctcacagcacatgctggcca

SEQ ID NO: 6573532 - DNA, 18 bp, Homo sapiens
ttctcacaggtcccaaat

SEQ ID NO: 6573533 - DNA, 22 bp, Homo sapiens
ttctcacagtgggagccagggc

SEQ ID NO: 6573534 - DNA, 16 bp, Homo sapiens
ttctcacatccctcta

SEQ ID NO: 6573535 - DNA, 17 bp, Homo sapiens
ttctcacatccctctaa

SEQ ID NO: 6573536 - DNA, 20 bp, Homo sapiens
ttctcacatccctctaaaag

SEQ ID NO: 6573537 - DNA, 17 bp, Homo sapiens
ttctcaccagctgcaaa

SEQ ID NO: 6573538 - DNA, 19 bp, Homo sapiens
ttctcaccagctgcaaagt

SEQ ID NO: 6573539 - DNA, 20 bp, Homo sapiens
ttctcacctaaaccctctgt

SEQ ID NO: 6573540 - DNA, 20 bp, Homo sapiens
ttctcacctttcccacctct

SEQ ID NO: 6573541 - DNA, 21 bp, Homo sapiens
ttctcacgaaagtatttactt

SEQ ID NO: 6573542 - DNA, 14 bp, Homo sapiens
ttctcacgctttgt

SEQ ID NO: 6573543 - DNA, 17 bp, Homo sapiens
ttctcacgctttgttta

SEQ ID NO: 6573544 - DNA, 15 bp, Homo sapiens
ttctcactaatttgt

SEQ ID NO: 6573545 - DNA, 17 bp, Homo sapiens
ttctcactagctgtctc

SEQ ID NO: 6573546 - DNA, 16 bp, Homo sapiens
ttctcactatgtttct

SEQ ID NO: 6573547 - DNA, 14 bp, Homo sapiens
ttctcactcaccac

SEQ ID NO: 6573548 - DNA, 14 bp, Homo sapiens
ttctcactccacca

SEQ ID NO: 6573549 - DNA, 15 bp, Homo sapiens
ttctcactccaccac

SEQ ID NO: 6573550 - DNA, 16 bp, Homo sapiens
ttctcactccaccacc

SEQ ID NO: 6573551 - DNA, 16 bp, Homo sapiens
ttctcactcctacctg

SEQ ID NO: 6573552 - DNA, 19 bp, Homo sapiens
ttctcactccttttggtgt

SEQ ID NO: 6573553 - DNA, 14 bp, Homo sapiens
ttctcactgaagct

SEQ ID NO: 6573554 - DNA, 17 bp, Homo sapiens
ttctcactgaagctcaa

SEQ ID NO: 6573555 - DNA, 12 bp, Homo sapiens
ttctcactgcca

SEQ ID NO: 6573556 - DNA, 14 bp, Homo sapiens
ttctcactgccatg

SEQ ID NO: 6573557 - DNA, 14 bp, Homo sapiens
ttctcactgccttt

SEQ ID NO: 6573558 - DNA, 15 bp, Homo sapiens
ttctcactgcctttg

SEQ ID NO: 6573559 - DNA, 18 bp, Homo sapiens
ttctcacttatagagctc

SEQ ID NO: 6573560 - DNA, 20 bp, Homo sapiens
ttctcacttcaattaatgct

SEQ ID NO: 6573561 - DNA, 13 bp, Homo sapiens
ttctcagaacagc

SEQ ID NO: 6573562 - DNA, 22 bp, Homo sapiens
ttctcagaaggcaaatgacttt

SEQ ID NO: 6573563 - DNA, 17 bp, Homo sapiens
ttctcagaatccaaaga

SEQ ID NO: 6573564 - DNA, 20 bp, Homo sapiens
ttctcagaatccaaagatca

SEQ ID NO: 6573565 - DNA, 13 bp, Homo sapiens
ttctcagaatcta

SEQ ID NO: 6573566 - DNA, 22 bp, Homo sapiens
ttctcagaatctcaaataacta

SEQ ID NO: 6573567 - DNA, 21 bp, Homo sapiens
ttctcagaattcggtgtgctg

SEQ ID NO: 6573568 - DNA, 16 bp, Homo sapiens
ttctcagacactgagt

SEQ ID NO: 6573569 - DNA, 19 bp, Homo sapiens
ttctcagacgacacctgga

SEQ ID NO: 6573570 - DNA, 12 bp, Homo sapiens
ttctcagactct

SEQ ID NO: 6573571 - DNA, 19 bp, Homo sapiens
ttctcagacttgttgtcta

SEQ ID NO: 6573572 - DNA, 16 bp, Homo sapiens
ttctcagagattaaaa

SEQ ID NO: 6573573 - DNA, 18 bp, Homo sapiens
ttctcagagattaaaaaa

SEQ ID NO: 6573574 - DNA, 19 bp, Homo sapiens
ttctcagagctccacagaa

SEQ ID NO: 6573575 - DNA, 21 bp, Homo sapiens
ttctcagagctctcgaggaaa

SEQ ID NO: 6573576 - DNA, 12 bp, Homo sapiens
ttctcagagtgt

SEQ ID NO: 6573577 - DNA, 20 bp, Homo sapiens
ttctcagatatttatatttt

SEQ ID NO: 6573578 - DNA, 15 bp, Homo sapiens
ttctcagatccttgt

SEQ ID NO: 6573579 - DNA, 19 bp, Homo sapiens
ttctcagatccttgtttca

SEQ ID NO: 6573580 - DNA, 19 bp, Homo sapiens
ttctcagatctggtttcta

SEQ ID NO: 6573581 - DNA, 21 bp, Homo sapiens
ttctcagatggattgataatt

SEQ ID NO: 6573582 - DNA, 14 bp, Homo sapiens
ttctcagatttctg

SEQ ID NO: 6573583 - DNA, 19 bp, Homo sapiens
ttctcagcaagtgtacagt

SEQ ID NO: 6573584 - DNA, 16 bp, Homo sapiens
ttctcagcatatatat

SEQ ID NO: 6573585 - DNA, 16 bp, Homo sapiens
ttctcagccacaaacc

SEQ ID NO: 6573586 - DNA, 18 bp, Homo sapiens
ttctcagccaggcgtggt

SEQ ID NO: 6573587 - DNA, 18 bp, Homo sapiens
ttctcagccttggttcct

SEQ ID NO: 6573588 - DNA, 13 bp, Homo sapiens
ttctcagcgtttt

SEQ ID NO: 6573589 - DNA, 17 bp, Homo sapiens
ttctcagctccactctg

SEQ ID NO: 6573590 - DNA, 15 bp, Homo sapiens
ttctcagctccccct

SEQ ID NO: 6573591 - DNA, 16 bp, Homo sapiens
ttctcagctccccctg

SEQ ID NO: 6573592 - DNA, 20 bp, Homo sapiens
ttctcagctccccctgtccc

SEQ ID NO: 6573593 - DNA, 14 bp, Homo sapiens
ttctcagctcttct

SEQ ID NO: 6573594 - DNA, 18 bp, Homo sapiens
ttctcagctcttctgact

SEQ ID NO: 6573595 - DNA, 18 bp, Homo sapiens
ttctcaggacacaggcct

SEQ ID NO: 6573596 - DNA, 22 bp, Homo sapiens
ttctcaggacacaggcctgtgt

SEQ ID NO: 6573597 - DNA, 23 bp, Homo sapiens
ttctcaggacacaggcctgtgta

SEQ ID NO: 6573598 - DNA, 15 bp, Homo sapiens
ttctcaggagcttca

SEQ ID NO: 6573599 - DNA, 17 bp, Homo sapiens
ttctcaggagcttcaat

SEQ ID NO: 6573600 - DNA, 21 bp, Homo sapiens
ttctcaggctaggccagcagg

SEQ ID NO: 6573601 - DNA, 16 bp, Homo sapiens
ttctcaggctggcatc

SEQ ID NO: 6573602 - DNA, 23 bp, Homo sapiens
ttctcaggctggcatctccccca

SEQ ID NO: 6573603 - DNA, 15 bp, Homo sapiens
ttctcaggcttctca

SEQ ID NO: 6573604 - DNA, 12 bp, Homo sapiens
ttctcagggctg

SEQ ID NO: 6573605 - DNA, 23 bp, Homo sapiens
ttctcagggctggagcctggggt

SEQ ID NO: 6573606 - DNA, 18 bp, Homo sapiens
ttctcaggggtgctgggg

SEQ ID NO: 6573607 - DNA, 22 bp, Homo sapiens
ttctcagggtcactgtccttga

SEQ ID NO: 6573608 - DNA, 13 bp, Homo sapiens
ttctcagggtctc

SEQ ID NO: 6573609 - DNA, 17 bp, Homo sapiens
ttctcagggtctctgct

SEQ ID NO: 6573610 - DNA, 18 bp, Homo sapiens
ttctcagggtctctgctg

SEQ ID NO: 6573611 - DNA, 20 bp, Homo sapiens
ttctcagggtctctgctgcc

SEQ ID NO: 6573612 - DNA, 21 bp, Homo sapiens
ttctcagggtctctgctgccg

SEQ ID NO: 6573613 - DNA, 16 bp, Homo sapiens
ttctcaggtaatcatt

SEQ ID NO: 6573614 - DNA, 22 bp, Homo sapiens
ttctcagtcagtaattgccaaa

SEQ ID NO: 6573615 - DNA, 21 bp, Homo sapiens
ttctcagtccagcagtttcca

SEQ ID NO: 6573616 - DNA, 17 bp, Homo sapiens
ttctcagtcctttgtta

SEQ ID NO: 6573617 - DNA, 18 bp, Homo sapiens
ttctcagtcggtgtgtaa

SEQ ID NO: 6573618 - DNA, 16 bp, Homo sapiens
ttctcagtgatttcct

SEQ ID NO: 6573619 - DNA, 17 bp, Homo sapiens
ttctcagtgatttccta

SEQ ID NO: 6573620 - DNA, 22 bp, Homo sapiens
ttctcagtgccaactgtggctg

SEQ ID NO: 6573621 - DNA, 23 bp, Homo sapiens
ttctcagtgccaactgtggctgg

SEQ ID NO: 6573622 - DNA, 22 bp, Homo sapiens
ttctcagtgctctcctacccca

SEQ ID NO: 6573623 - DNA, 19 bp, Homo sapiens
ttctcagtggtcaccttcc

SEQ ID NO: 6573624 - DNA, 11 bp, Homo sapiens
ttctcagtgtg

SEQ ID NO: 6573625 - DNA, 12 bp, Homo sapiens
ttctcagtgtgc

SEQ ID NO: 6573626 - DNA, 13 bp, Homo sapiens
ttctcagttcatt

SEQ ID NO: 6573627 - DNA, 18 bp, Homo sapiens
ttctcagtttctgcctgg

SEQ ID NO: 6573628 - DNA, 20 bp, Homo sapiens
ttctcagtttctgcctgggc

SEQ ID NO: 6573629 - DNA, 14 bp, Homo sapiens
ttctcagtttttct

SEQ ID NO: 6573630 - DNA, 17 bp, Homo sapiens
ttctcagtttttgctga

SEQ ID NO: 6573631 - DNA, 16 bp, Homo sapiens
ttctcataattcctac

SEQ ID NO: 6573632 - DNA, 18 bp, Homo sapiens
ttctcatactacaggata

SEQ ID NO: 6573633 - DNA, 21 bp, Homo sapiens
ttctcatagaggaaattcaaa

SEQ ID NO: 6573634 - DNA, 22 bp, Homo sapiens
ttctcatagataagatataaat

SEQ ID NO: 6573635 - DNA, 13 bp, Homo sapiens
ttctcatagcatt

SEQ ID NO: 6573636 - DNA, 17 bp, Homo sapiens
ttctcatagcattaact

SEQ ID NO: 6573637 - DNA, 21 bp, Homo sapiens
ttctcatagcattaactaatc

SEQ ID NO: 6573638 - DNA, 21 bp, Homo sapiens
aagctttagattgaaatttat

SEQ ID NO: 6573639 - DNA, 23 bp, Homo sapiens
aagctttagattgaaatttatga

SEQ ID NO: 6573640 - DNA, 19 bp, Homo sapiens
aagctttatacgtgtagct

SEQ ID NO: 6573641 - DNA, 14 bp, Homo sapiens
aagctttatctttg

SEQ ID NO: 6573642 - DNA, 21 bp, Homo sapiens
aagctttatgattttcataac

SEQ ID NO: 6573643 - DNA, 20 bp, Homo sapiens
aagctttatttatagaaatg

SEQ ID NO: 6573644 - DNA, 13 bp, Homo sapiens
aagctttatttct

SEQ ID NO: 6573645 - DNA, 20 bp, Homo sapiens
aagctttatttctagctttt

SEQ ID NO: 6573646 - DNA, 15 bp, Homo sapiens
aagctttcaacatgt

SEQ ID NO: 6573647 - DNA, 18 bp, Homo sapiens
aagctttcctgccccagg

SEQ ID NO: 6573648 - DNA, 22 bp, Homo sapiens
aagctttcctgccccaggcctg

SEQ ID NO: 6573649 - DNA, 19 bp, Homo sapiens
aagctttcctgctgtcttc

SEQ ID NO: 6573650 - DNA, 22 bp, Homo sapiens
aagctttcctgctgtcttctcc

SEQ ID NO: 6573651 - DNA, 13 bp, Homo sapiens
aagctttcctgga

SEQ ID NO: 6573652 - DNA, 17 bp, Homo sapiens
aagctttcctgtttcca

SEQ ID NO: 6573653 - DNA, 21 bp, Homo sapiens
aagctttcctgtttccagggt

SEQ ID NO: 6573654 - DNA, 17 bp, Homo sapiens
aagctttctcagaatgt

SEQ ID NO: 6573655 - DNA, 15 bp, Homo sapiens
aagctttctgtctcc

SEQ ID NO: 6573656 - DNA, 20 bp, Homo sapiens
aagctttcttacaatgtgga

SEQ ID NO: 6573657 - DNA, 16 bp, Homo sapiens
aagctttcttttctaa

SEQ ID NO: 6573658 - DNA, 16 bp, Homo sapiens
aagctttgatttagat

SEQ ID NO: 6573659 - DNA, 17 bp, Homo sapiens
aagctttgccagctgct

SEQ ID NO: 6573660 - DNA, 21 bp, Homo sapiens
aagctttgccgcttttgtgcc

SEQ ID NO: 6573661 - DNA, 23 bp, Homo sapiens
aagctttgctacaaatttatgca

SEQ ID NO: 6573662 - DNA, 23 bp, Homo sapiens
aagctttgcttatggtaataaaa

SEQ ID NO: 6573663 - DNA, 15 bp, Homo sapiens
aagctttggaaaaat

SEQ ID NO: 6573664 - DNA, 19 bp, Homo sapiens
aagctttggaaaaatcttt

SEQ ID NO: 6573665 - DNA, 17 bp, Homo sapiens
aagctttggaagcagca

SEQ ID NO: 6573666 - DNA, 18 bp, Homo sapiens
aagctttgtcccctgctt

SEQ ID NO: 6573667 - DNA, 16 bp, Homo sapiens
aagctttgttctggga

SEQ ID NO: 6573668 - DNA, 16 bp, Homo sapiens
aagctttgtttgttct

SEQ ID NO: 6573669 - DNA, 17 bp, Homo sapiens
aagcttttaaaatgtag

SEQ ID NO: 6573670 - DNA, 16 bp, Homo sapiens
aagcttttaacttttt

SEQ ID NO: 6573671 - DNA, 16 bp, Homo sapiens
aagcttttaagaaaaa

SEQ ID NO: 6573672 - DNA, 18 bp, Homo sapiens
aagcttttagaaatactg

SEQ ID NO: 6573673 - DNA, 16 bp, Homo sapiens
aagcttttatgtgaaa

SEQ ID NO: 6573674 - DNA, 21 bp, Homo sapiens
aagcttttatgtgaaacatgt

SEQ ID NO: 6573675 - DNA, 13 bp, Homo sapiens
aagcttttattcg

SEQ ID NO: 6573676 - DNA, 13 bp, Homo sapiens
aagcttttatttc

SEQ ID NO: 6573677 - DNA, 17 bp, Homo sapiens
aagcttttcattttaat

SEQ ID NO: 6573678 - DNA, 23 bp, Homo sapiens
aagcttttcattttaatatataa

SEQ ID NO: 6573679 - DNA, 14 bp, Homo sapiens
aagcttttcctttc

SEQ ID NO: 6573680 - DNA, 13 bp, Homo sapiens
aagcttttctatt

SEQ ID NO: 6573681 - DNA, 17 bp, Homo sapiens
aagcttttctattttaa

SEQ ID NO: 6573682 - DNA, 23 bp, Homo sapiens
aagcttttgcttgatccagaaga

SEQ ID NO: 6573683 - DNA, 17 bp, Homo sapiens
aagcttttgtctgtagg

SEQ ID NO: 6573684 - DNA, 23 bp, Homo sapiens
aagcttttgttttgcttacaaag

SEQ ID NO: 6573685 - DNA, 12 bp, Homo sapiens
aagctttttgga

SEQ ID NO: 6573686 - DNA, 14 bp, Homo sapiens
aagctttttggaat

SEQ ID NO: 6573687 - DNA, 16 bp, Homo sapiens
aagctttttgtgagaa

SEQ ID NO: 6573688 - DNA, 18 bp, Homo sapiens
aagctttttgtgagaaag

SEQ ID NO: 6573689 - DNA, 17 bp, Homo sapiens
aagcttttttatttttt

SEQ ID NO: 6573690 - DNA, 15 bp, Homo sapiens
aaggaaaaaaagact

SEQ ID NO: 6573691 - DNA, 21 bp, Homo sapiens
aaggaaaaaaagactcttttt

SEQ ID NO: 6573692 - DNA, 15 bp, Homo sapiens
aaggaaaaaatgttg

SEQ ID NO: 6573693 - DNA, 15 bp, Homo sapiens
aaggaaaaaattatg

SEQ ID NO: 6573694 - DNA, 16 bp, Homo sapiens
aaggaaaaacagaaca

SEQ ID NO: 6573695 - DNA, 23 bp, Homo sapiens
aaggaaaaacagaacatttctca

SEQ ID NO: 6573696 - DNA, 18 bp, Homo sapiens
aaggaaaaagaaaataaa

SEQ ID NO: 6573697 - DNA, 19 bp, Homo sapiens
aaggaaaaagcacaagaag

SEQ ID NO: 6573698 - DNA, 21 bp, Homo sapiens
aaggaaaaagcacaagaagcg

SEQ ID NO: 6573699 - DNA, 13 bp, Homo sapiens
aaggaaaaagctc

SEQ ID NO: 6573700 - DNA, 23 bp, Homo sapiens
aaggaaaaataagtgggggcagg

SEQ ID NO: 6573701 - DNA, 13 bp, Homo sapiens
aaggaaaaattca

SEQ ID NO: 6573702 - DNA, 15 bp, Homo sapiens
aaggaaaaatttttt

SEQ ID NO: 6573703 - DNA, 14 bp, Homo sapiens
aaggaaaacaaaaa

SEQ ID NO: 6573704 - DNA, 18 bp, Homo sapiens
aaggaaaacctgaagact

SEQ ID NO: 6573705 - DNA, 20 bp, Homo sapiens
aaggaaaacgtgaacaaact

SEQ ID NO: 6573706 - DNA, 18 bp, Homo sapiens
aaggaaaactcttggcct

SEQ ID NO: 6573707 - DNA, 23 bp, Homo sapiens
aaggaaaactcttggcctctgct

SEQ ID NO: 6573708 - DNA, 14 bp, Homo sapiens
aaggaaaactgcat

SEQ ID NO: 6573709 - DNA, 16 bp, Homo sapiens
aaggaaaactgcatgg

SEQ ID NO: 6573710 - DNA, 20 bp, Homo sapiens
aaggaaaagaaaacaaaaaa

SEQ ID NO: 6573711 - DNA, 14 bp, Homo sapiens
aaggaaaagagaaa

SEQ ID NO: 6573712 - DNA, 16 bp, Homo sapiens
aaggaaaagattcctg

SEQ ID NO: 6573713 - DNA, 14 bp, Homo sapiens
aaggaaaaggagga

SEQ ID NO: 6573714 - DNA, 19 bp, Homo sapiens
aaggaaaaggttgttgtta

SEQ ID NO: 6573715 - DNA, 18 bp, Homo sapiens
aaggaaaatactacctgt

SEQ ID NO: 6573716 - DNA, 17 bp, Homo sapiens
aaggaaaatctatattt

SEQ ID NO: 6573717 - DNA, 14 bp, Homo sapiens
aaggaaaatgatac

SEQ ID NO: 6573718 - DNA, 16 bp, Homo sapiens
aaggaaaattaaacca

SEQ ID NO: 6573719 - DNA, 17 bp, Homo sapiens
aaggaaaattgaaagta

SEQ ID NO: 6573720 - DNA, 20 bp, Homo sapiens
aaggaaacaacaaaggaagt

SEQ ID NO: 6573721 - DNA, 19 bp, Homo sapiens
aaggaaacacgtttagaaa

SEQ ID NO: 6573722 - DNA, 16 bp, Homo sapiens
aaggaaacactaaggc

SEQ ID NO: 6573723 - DNA, 20 bp, Homo sapiens
aaggaaacacttctatttaa

SEQ ID NO: 6573724 - DNA, 18 bp, Homo sapiens
aaggaaacataagagctt

SEQ ID NO: 6573725 - DNA, 17 bp, Homo sapiens
aaggaaacatagaaaga

SEQ ID NO: 6573726 - DNA, 14 bp, Homo sapiens
aaggaaaccaaagg

SEQ ID NO: 6573727 - DNA, 17 bp, Homo sapiens
aaggaaaccacagctgc

SEQ ID NO: 6573728 - DNA, 18 bp, Homo sapiens
aaggaaaccacagctgct

SEQ ID NO: 6573729 - DNA, 17 bp, Homo sapiens
aaggaaacccagctctg

SEQ ID NO: 6573730 - DNA, 22 bp, Homo sapiens
aaggaaacccagctctggtcca

SEQ ID NO: 6573731 - DNA, 12 bp, Homo sapiens
aaggaaaccttt

SEQ ID NO: 6573732 - DNA, 23 bp, Homo sapiens
aaggaaactgaggcccagagagc

SEQ ID NO: 6573733 - DNA, 20 bp, Homo sapiens
aaggaaactgctttattttt

SEQ ID NO: 6573734 - DNA, 21 bp, Homo sapiens
aaggaaactttatttaaatgc

SEQ ID NO: 6573735 - DNA, 15 bp, Homo sapiens
aaggaaactttttaa

SEQ ID NO: 6573736 - DNA, 17 bp, Homo sapiens
aaggaaactttttaatt

SEQ ID NO: 6573737 - DNA, 20 bp, Homo sapiens
aaggaaactttttaattgtg

SEQ ID NO: 6573738 - DNA, 11 bp, Homo sapiens
aaggaaagaaa

SEQ ID NO: 6573739 - DNA, 14 bp, Homo sapiens
aaggaaagaaaata

SEQ ID NO: 6573740 - DNA, 20 bp, Homo sapiens
aaggaaagaagggggccctg

SEQ ID NO: 6573741 - DNA, 15 bp, Homo sapiens
aaggaaagatttgtg

SEQ ID NO: 6573742 - DNA, 17 bp, Homo sapiens
aaggaaagatttgtgaa

SEQ ID NO: 6573743 - DNA, 18 bp, Homo sapiens
aaggaaagccaaatttta

SEQ ID NO: 6573744 - DNA, 14 bp, Homo sapiens
aaggaaaggatgca

SEQ ID NO: 6573745 - DNA, 22 bp, Homo sapiens
aaggaaagggggtcccagtggg

SEQ ID NO: 6573746 - DNA, 19 bp, Homo sapiens
aaggaaagtcaagaagaat

SEQ ID NO: 6573747 - DNA, 21 bp, Homo sapiens
aaggaaagtcaagaagaatga

SEQ ID NO: 6573748 - DNA, 11 bp, Homo sapiens
aaggaaagttg

SEQ ID NO: 6573749 - DNA, 22 bp, Homo sapiens
aaggaaataaaaaagtctctat

SEQ ID NO: 6573750 - DNA, 15 bp, Homo sapiens
aaggaaataaaatca

SEQ ID NO: 6573751 - DNA, 15 bp, Homo sapiens
aaggaaataaaggta

SEQ ID NO: 6573752 - DNA, 14 bp, Homo sapiens
aaggaaataacatt

SEQ ID NO: 6573753 - DNA, 21 bp, Homo sapiens
aaggaaatacacttcttttga

SEQ ID NO: 6573754 - DNA, 23 bp, Homo sapiens
aaggaaatacccttcttttatga

SEQ ID NO: 6573755 - DNA, 14 bp, Homo sapiens
aaggaaatagactt

SEQ ID NO: 6573756 - DNA, 15 bp, Homo sapiens
aaggaaatatatttt

SEQ ID NO: 6573757 - DNA, 15 bp, Homo sapiens
aaggaaatattcttt

SEQ ID NO: 6573758 - DNA, 12 bp, Homo sapiens
aaggaaatccag

SEQ ID NO: 6573759 - DNA, 19 bp, Homo sapiens
aaggaaatctcctcttttg

SEQ ID NO: 6573760 - DNA, 20 bp, Homo sapiens
aaggaaattaagaactgaat

SEQ ID NO: 6573761 - DNA, 18 bp, Homo sapiens
aaggaacaaaaattacaa

SEQ ID NO: 6573762 - DNA, 14 bp, Homo sapiens
aaggaacaagagaa

SEQ ID NO: 6573763 - DNA, 16 bp, Homo sapiens
aaggaacacagagcag

SEQ ID NO: 6573764 - DNA, 13 bp, Homo sapiens
aaggaacactggc

SEQ ID NO: 6573765 - DNA, 18 bp, Homo sapiens
aaggaacagaagtgagga

SEQ ID NO: 6573766 - DNA, 21 bp, Homo sapiens
aaggaacagaagtgaggatga

SEQ ID NO: 6573767 - DNA, 23 bp, Homo sapiens
aaggaaccaaagcgaattttaaa

SEQ ID NO: 6573768 - DNA, 16 bp, Homo sapiens
aaggaaccaacaatct

SEQ ID NO: 6573769 - DNA, 16 bp, Homo sapiens
aaggaacccaattttc

SEQ ID NO: 6573770 - DNA, 22 bp, Homo sapiens
aaggaacccggtcccaggccgc

SEQ ID NO: 6573771 - DNA, 15 bp, Homo sapiens
aaggaaccgcccagt

SEQ ID NO: 6573772 - DNA, 17 bp, Homo sapiens
aaggaacctaattgaaa

SEQ ID NO: 6573773 - DNA, 13 bp, Homo sapiens
aaggaacctggga

SEQ ID NO: 6573774 - DNA, 12 bp, Homo sapiens
aaggaaccttcc

SEQ ID NO: 6573775 - DNA, 13 bp, Homo sapiens
aaggaaccttcct

SEQ ID NO: 6573776 - DNA, 18 bp, Homo sapiens
aaggaactgatacatctg

SEQ ID NO: 6573777 - DNA, 14 bp, Homo sapiens
aaggaactgcagca

SEQ ID NO: 6573778 - DNA, 13 bp, Homo sapiens
aaggaacttcatg

SEQ ID NO: 6573779 - DNA, 17 bp, Homo sapiens
aaggaacttttaaactg

SEQ ID NO: 6573780 - DNA, 19 bp, Homo sapiens
aaggaacttttaaactgca

SEQ ID NO: 6573781 - DNA, 13 bp, Homo sapiens
aaggaagaaaacg

SEQ ID NO: 6573782 - DNA, 16 bp, Homo sapiens
aaggaagacagttcta

SEQ ID NO: 6573783 - DNA, 15 bp, Homo sapiens
aaggaagacttcatc

SEQ ID NO: 6573784 - DNA, 17 bp, Homo sapiens
aaggaagagctatatcc

SEQ ID NO: 6573785 - DNA, 15 bp, Homo sapiens
aaggaagagggctga

SEQ ID NO: 6573786 - DNA, 22 bp, Homo sapiens
aaggaagataggacgtatttat

SEQ ID NO: 6573787 - DNA, 18 bp, Homo sapiens
aaggaagatatacatgaa

SEQ ID NO: 6573788 - DNA, 22 bp, Homo sapiens
aaggaagatcactttgctctga

SEQ ID NO: 6573789 - DNA, 19 bp, Homo sapiens
aaggaagatcctgaagcag

SEQ ID NO: 6573790 - DNA, 14 bp, Homo sapiens
aaggaagcaacaga

SEQ ID NO: 6573791 - DNA, 16 bp, Homo sapiens
aaggaagcacatgcct

SEQ ID NO: 6573792 - DNA, 20 bp, Homo sapiens
aaggaagcactctgtatatt

SEQ ID NO: 6573793 - DNA, 22 bp, Homo sapiens
aaggaagcattgtaaaataatt

SEQ ID NO: 6573794 - DNA, 18 bp, Homo sapiens
aaggaagccaaatttatc

SEQ ID NO: 6573795 - DNA, 18 bp, Homo sapiens
aaggaagccagtcacctt

SEQ ID NO: 6573796 - DNA, 17 bp, Homo sapiens
aaggaagccttgctcat

SEQ ID NO: 6573797 - DNA, 16 bp, Homo sapiens
aaggaagctaaaagca

SEQ ID NO: 6573798 - DNA, 15 bp, Homo sapiens
aaggaagctccagat

SEQ ID NO: 6573799 - DNA, 14 bp, Homo sapiens
aaggaagctgtgtt

SEQ ID NO: 6573800 - DNA, 22 bp, Homo sapiens
aaggaagctttggaagcagcaa

SEQ ID NO: 6573801 - DNA, 12 bp, Homo sapiens
aaggaaggaaaa

SEQ ID NO: 6573802 - DNA, 12 bp, Homo sapiens
aaggaaggacac

SEQ ID NO: 6573803 - DNA, 20 bp, Homo sapiens
aaggaaggagactcacctct

SEQ ID NO: 6573804 - DNA, 11 bp, Homo sapiens
aaggaaggagc

SEQ ID NO: 6573805 - DNA, 19 bp, Homo sapiens
aaggaaggagccagctccc

SEQ ID NO: 6573806 - DNA, 13 bp, Homo sapiens
aaggaaggatgcc

SEQ ID NO: 6573807 - DNA, 21 bp, Homo sapiens
aaggaaggctcttctccccag

SEQ ID NO: 6573808 - DNA, 12 bp, Homo sapiens
aaggaagggcag

SEQ ID NO: 6573809 - DNA, 19 bp, Homo sapiens
aaggaagggcaggaaatga

SEQ ID NO: 6573810 - DNA, 22 bp, Homo sapiens
aaggaagggcatccttctgcct

SEQ ID NO: 6573811 - DNA, 14 bp, Homo sapiens
aaggaaggggtttt

SEQ ID NO: 6573812 - DNA, 16 bp, Homo sapiens
aaggaaggttttctcc

SEQ ID NO: 6573813 - DNA, 18 bp, Homo sapiens
aaggaagtatcagcacta

SEQ ID NO: 6573814 - DNA, 18 bp, Homo sapiens
aaggaagtcttcaaattt

SEQ ID NO: 6573815 - DNA, 17 bp, Homo sapiens
aaggaagtggggacaga

SEQ ID NO: 6573816 - DNA, 19 bp, Homo sapiens
aaggaagtgggggccgctg

SEQ ID NO: 6573817 - DNA, 22 bp, Homo sapiens
ttctcatagcattaactaatct

SEQ ID NO: 6573818 - DNA, 18 bp, Homo sapiens
ttctcatatgtagccctc

SEQ ID NO: 6573819 - DNA, 12 bp, Homo sapiens
ttctcatatttg

SEQ ID NO: 6573820 - DNA, 15 bp, Homo sapiens
ttctcatcacacaca

SEQ ID NO: 6573821 - DNA, 15 bp, Homo sapiens
ttctcatcacatttg

SEQ ID NO: 6573822 - DNA, 17 bp, Homo sapiens
ttctcatcactcccctc

SEQ ID NO: 6573823 - DNA, 15 bp, Homo sapiens
ttctcatcatattgt

SEQ ID NO: 6573824 - DNA, 21 bp, Homo sapiens
ttctcatcatattgtatgtaa

SEQ ID NO: 6573825 - DNA, 14 bp, Homo sapiens
ttctcatcccagtc

SEQ ID NO: 6573826 - DNA, 14 bp, Homo sapiens
ttctcatctgcacc

SEQ ID NO: 6573827 - DNA, 19 bp, Homo sapiens
ttctcatctgcacccttct

SEQ ID NO: 6573828 - DNA, 23 bp, Homo sapiens
ttctcatctgtaaaaccaggctg

SEQ ID NO: 6573829 - DNA, 12 bp, Homo sapiens
ttctcatcttaa

SEQ ID NO: 6573830 - DNA, 23 bp, Homo sapiens
ttctcatcttgacagagcctgcc

SEQ ID NO: 6573831 - DNA, 18 bp, Homo sapiens
ttctcatcttgtgaaatg

SEQ ID NO: 6573832 - DNA, 20 bp, Homo sapiens
ttctcatgaaaagtttgatt

SEQ ID NO: 6573833 - DNA, 24 bp, Homo sapiens
ttctcatgaaagcagtgaagcaat

SEQ ID NO: 6573834 - DNA, 11 bp, Homo sapiens
ttctcatgcac

SEQ ID NO: 6573835 - DNA, 21 bp, Homo sapiens
ttctcatgcctcagcctcctg

SEQ ID NO: 6573836 - DNA, 23 bp, Homo sapiens
ttctcatgttaaatatttgtcct

SEQ ID NO: 6573837 - DNA, 13 bp, Homo sapiens
ttctcatgttgaa

SEQ ID NO: 6573838 - DNA, 14 bp, Homo sapiens
ttctcatgttgaag

SEQ ID NO: 6573839 - DNA, 14 bp, Homo sapiens
ttctcatgtttgtg

SEQ ID NO: 6573840 - DNA, 14 bp, Homo sapiens
ttctcattaaactc

SEQ ID NO: 6573841 - DNA, 21 bp, Homo sapiens
ttctcattaaagttgtttccc

SEQ ID NO: 6573842 - DNA, 19 bp, Homo sapiens
ttctcattatgaagatgtt

SEQ ID NO: 6573843 - DNA, 16 bp, Homo sapiens
ttctcattcctgttct

SEQ ID NO: 6573844 - DNA, 14 bp, Homo sapiens
ttctcattctgtgc

SEQ ID NO: 6573845 - DNA, 22 bp, Homo sapiens
ttctcattgatcacagatgtgc

SEQ ID NO: 6573846 - DNA, 14 bp, Homo sapiens
ttctcattgcctct

SEQ ID NO: 6573847 - DNA, 17 bp, Homo sapiens
ttctcattgctgcccgt

SEQ ID NO: 6573848 - DNA, 21 bp, Homo sapiens
ttctcatttatgttatttatg

SEQ ID NO: 6573849 - DNA, 16 bp, Homo sapiens
ttctcatttcacccct

SEQ ID NO: 6573850 - DNA, 21 bp, Homo sapiens
ttctcatttggtctgccagaa

SEQ ID NO: 6573851 - DNA, 16 bp, Homo sapiens
ttctcattttaaacaa

SEQ ID NO: 6573852 - DNA, 23 bp, Homo sapiens
ttctcattttttaaaaaagctta

SEQ ID NO: 6573853 - DNA, 21 bp, Homo sapiens
ttctccaaaggcactgaccct

SEQ ID NO: 6573854 - DNA, 21 bp, Homo sapiens
ttctccaaataaaaattagat

SEQ ID NO: 6573855 - DNA, 14 bp, Homo sapiens
ttctccaaatgaga

SEQ ID NO: 6573856 - DNA, 16 bp, Homo sapiens
ttctccaacccaaagt

SEQ ID NO: 6573857 - DNA, 19 bp, Homo sapiens
ttctccaacccaaagtatt

SEQ ID NO: 6573858 - DNA, 21 bp, Homo sapiens
ttctccaagcggatgctccat

SEQ ID NO: 6573859 - DNA, 21 bp, Homo sapiens
ttctccaatatcagtgctcga

SEQ ID NO: 6573860 - DNA, 16 bp, Homo sapiens
ttctccacaacactgt

SEQ ID NO: 6573861 - DNA, 17 bp, Homo sapiens
ttctccacaacactgtg

SEQ ID NO: 6573862 - DNA, 19 bp, Homo sapiens
ttctccacaacactgtgtc

SEQ ID NO: 6573863 - DNA, 20 bp, Homo sapiens
ttctccacaacagcctgggg

SEQ ID NO: 6573864 - DNA, 22 bp, Homo sapiens
ttctccacagcaaccccaggct

SEQ ID NO: 6573865 - DNA, 24 bp, Homo sapiens
ttctccaccagcccctcacaggct

SEQ ID NO: 6573866 - DNA, 22 bp, Homo sapiens
ttctccacccaaaccccttccc

SEQ ID NO: 6573867 - DNA, 23 bp, Homo sapiens
ttctccacccaaaccccttccca

SEQ ID NO: 6573868 - DNA, 13 bp, Homo sapiens
ttctccaccctgc

SEQ ID NO: 6573869 - DNA, 21 bp, Homo sapiens
ttctccacctagactgtaaac

SEQ ID NO: 6573870 - DNA, 12 bp, Homo sapiens
ttctccacctgc

SEQ ID NO: 6573871 - DNA, 14 bp, Homo sapiens
ttctccacctgcca

SEQ ID NO: 6573872 - DNA, 19 bp, Homo sapiens
ttctccactgtcataatct

SEQ ID NO: 6573873 - DNA, 17 bp, Homo sapiens
ttctccactttttctta

SEQ ID NO: 6573874 - DNA, 22 bp, Homo sapiens
ttctccagaaaaatcaatcatt

SEQ ID NO: 6573875 - DNA, 22 bp, Homo sapiens
ttctccagaaccagtgtctgaa

SEQ ID NO: 6573876 - DNA, 14 bp, Homo sapiens
ttctccagaaccca

SEQ ID NO: 6573877 - DNA, 11 bp, Homo sapiens
ttctccagacc

SEQ ID NO: 6573878 - DNA, 19 bp, Homo sapiens
ttctccagacccagaggcc

SEQ ID NO: 6573879 - DNA, 14 bp, Homo sapiens
ttctccagccagca

SEQ ID NO: 6573880 - DNA, 18 bp, Homo sapiens
ttctccagcccatgctgg

SEQ ID NO: 6573881 - DNA, 18 bp, Homo sapiens
ttctccagccctgactaa

SEQ ID NO: 6573882 - DNA, 14 bp, Homo sapiens
ttctccagctcaga

SEQ ID NO: 6573883 - DNA, 12 bp, Homo sapiens
ttctccagctgg

SEQ ID NO: 6573884 - DNA, 20 bp, Homo sapiens
ttctccagctgggctctgca

SEQ ID NO: 6573885 - DNA, 11 bp, Homo sapiens
ttctccaggct

SEQ ID NO: 6573886 - DNA, 18 bp, Homo sapiens
ttctccaggctctttggg

SEQ ID NO: 6573887 - DNA, 12 bp, Homo sapiens
ttctccaggctt

SEQ ID NO: 6573888 - DNA, 13 bp, Homo sapiens
ttctccaggcttc

SEQ ID NO: 6573889 - DNA, 21 bp, Homo sapiens
ttctccaggcttcacagtctg

SEQ ID NO: 6573890 - DNA, 21 bp, Homo sapiens
ttctccagggacagaagcagg

SEQ ID NO: 6573891 - DNA, 19 bp, Homo sapiens
ttctccagtcattatgtta

SEQ ID NO: 6573892 - DNA, 15 bp, Homo sapiens
ttctccagtccctgg

SEQ ID NO: 6573893 - DNA, 13 bp, Homo sapiens
ttctccagttgat

SEQ ID NO: 6573894 - DNA, 13 bp, Homo sapiens
ttctccatcagct

SEQ ID NO: 6573895 - DNA, 20 bp, Homo sapiens
ttctccatccacatgggagc

SEQ ID NO: 6573896 - DNA, 12 bp, Homo sapiens
ttctccatcccc

SEQ ID NO: 6573897 - DNA, 12 bp, Homo sapiens
ttctccatccct

SEQ ID NO: 6573898 - DNA, 15 bp, Homo sapiens
ttctccatctctctg

SEQ ID NO: 6573899 - DNA, 19 bp, Homo sapiens
ttctccatctctctggccc

SEQ ID NO: 6573900 - DNA, 18 bp, Homo sapiens
ttctccatctggcagggt

SEQ ID NO: 6573901 - DNA, 23 bp, Homo sapiens
ttctccatgagacacatctcctc

SEQ ID NO: 6573902 - DNA, 13 bp, Homo sapiens
ttctccatggagc

SEQ ID NO: 6573903 - DNA, 14 bp, Homo sapiens
ttctccatgggcca

SEQ ID NO: 6573904 - DNA, 17 bp, Homo sapiens
ttctcccaactcagcct

SEQ ID NO: 6573905 - DNA, 12 bp, Homo sapiens
ttctcccacccc

SEQ ID NO: 6573906 - DNA, 16 bp, Homo sapiens
ttctcccactctccta

SEQ ID NO: 6573907 - DNA, 20 bp, Homo sapiens
ttctcccagaatcccagccg

SEQ ID NO: 6573908 - DNA, 20 bp, Homo sapiens
ttctcccagcactgcctcct

SEQ ID NO: 6573909 - DNA, 22 bp, Homo sapiens
ttctcccagcactgcctcctgt

SEQ ID NO: 6573910 - DNA, 14 bp, Homo sapiens
ttctcccaggaagc

SEQ ID NO: 6573911 - DNA, 18 bp, Homo sapiens
ttctcccaggcctctgcc

SEQ ID NO: 6573912 - DNA, 19 bp, Homo sapiens
ttctcccaggcctctgccc

SEQ ID NO: 6573913 - DNA, 21 bp, Homo sapiens
ttctcccaggcctctgcccca

SEQ ID NO: 6573914 - DNA, 20 bp, Homo sapiens
ttctcccagggagtgagcag

SEQ ID NO: 6573915 - DNA, 22 bp, Homo sapiens
ttctcccagggagtgagcagct

SEQ ID NO: 6573916 - DNA, 14 bp, Homo sapiens
ttctcccagtatgt

SEQ ID NO: 6573917 - DNA, 17 bp, Homo sapiens
ttctcccagtatgtttt

SEQ ID NO: 6573918 - DNA, 14 bp, Homo sapiens
ttctcccatctagt

SEQ ID NO: 6573919 - DNA, 13 bp, Homo sapiens
ttctcccatttcc

SEQ ID NO: 6573920 - DNA, 16 bp, Homo sapiens
ttctcccatttcctga

SEQ ID NO: 6573921 - DNA, 22 bp, Homo sapiens
ttctccccacaccctggagtgg

SEQ ID NO: 6573922 - DNA, 15 bp, Homo sapiens
ttctccccacagcct

SEQ ID NO: 6573923 - DNA, 21 bp, Homo sapiens
ttctccccacgatgatatcta

SEQ ID NO: 6573924 - DNA, 22 bp, Homo sapiens
ttctccccacgatgatatctat

SEQ ID NO: 6573925 - DNA, 13 bp, Homo sapiens
ttctccccagaat

SEQ ID NO: 6573926 - DNA, 22 bp, Homo sapiens
ttctccccatccccttcctaaa

SEQ ID NO: 6573927 - DNA, 21 bp, Homo sapiens
ttctcccccccggggctgggt

SEQ ID NO: 6573928 - DNA, 14 bp, Homo sapiens
ttctccccctgggc

SEQ ID NO: 6573929 - DNA, 12 bp, Homo sapiens
ttctcccccttg

SEQ ID NO: 6573930 - DNA, 20 bp, Homo sapiens
ttctcccccttgtcttcccc

SEQ ID NO: 6573931 - DNA, 22 bp, Homo sapiens
ttctccccgcagcccgcctgcc

SEQ ID NO: 6573932 - DNA, 19 bp, Homo sapiens
ttctccccgctaaggaaga

SEQ ID NO: 6573933 - DNA, 16 bp, Homo sapiens
ttctcccctccaagtg

SEQ ID NO: 6573934 - DNA, 21 bp, Homo sapiens
ttctcccctccccgcctggcc

SEQ ID NO: 6573935 - DNA, 16 bp, Homo sapiens
ttctcccctccctcca

SEQ ID NO: 6573936 - DNA, 22 bp, Homo sapiens
ttctcccctctctttctaagag

SEQ ID NO: 6573937 - DNA, 17 bp, Homo sapiens
ttctcccctcttctgag

SEQ ID NO: 6573938 - DNA, 18 bp, Homo sapiens
ttctcccctcttctgagc

SEQ ID NO: 6573939 - DNA, 18 bp, Homo sapiens
ttctcccctgcactgtaa

SEQ ID NO: 6573940 - DNA, 13 bp, Homo sapiens
ttctcccctgccc

SEQ ID NO: 6573941 - DNA, 23 bp, Homo sapiens
ttctcccctgcccccaggactgg

SEQ ID NO: 6573942 - DNA, 23 bp, Homo sapiens
ttctccccttcctggacacactc

SEQ ID NO: 6573943 - DNA, 22 bp, Homo sapiens
ttctcccctttcaaattgcctt

SEQ ID NO: 6573944 - DNA, 19 bp, Homo sapiens
ttctcccgccattggcctt

SEQ ID NO: 6573945 - DNA, 18 bp, Homo sapiens
ttctcccgcctcagcctc

SEQ ID NO: 6573946 - DNA, 22 bp, Homo sapiens
ttctcccgcttcctggcctccc

SEQ ID NO: 6573947 - DNA, 22 bp, Homo sapiens
ttctcccgggggcagggtgggg

SEQ ID NO: 6573948 - DNA, 21 bp, Homo sapiens
ttctcccgttcacgttgccta

SEQ ID NO: 6573949 - DNA, 16 bp, Homo sapiens
ttctccctagcccttc

SEQ ID NO: 6573950 - DNA, 22 bp, Homo sapiens
ttctccctagcccttctacccc

SEQ ID NO: 6573951 - DNA, 22 bp, Homo sapiens
ttctccctcacccccaggtgtt

SEQ ID NO: 6573952 - DNA, 17 bp, Homo sapiens
ttctccctctcactgtc

SEQ ID NO: 6573953 - DNA, 12 bp, Homo sapiens
ttctccctgacc

SEQ ID NO: 6573954 - DNA, 12 bp, Homo sapiens
ttctccctggat

SEQ ID NO: 6573955 - DNA, 10 bp, Homo sapiens
ttctccctgt

SEQ ID NO: 6573956 - DNA, 18 bp, Homo sapiens
ttctcccttaaggaattg

SEQ ID NO: 6573957 - DNA, 22 bp, Homo sapiens
ttctcccttaggaatatacata

SEQ ID NO: 6573958 - DNA, 17 bp, Homo sapiens
ttctcccttcttgggtc

SEQ ID NO: 6573959 - DNA, 19 bp, Homo sapiens
ttctccctttatgtatctc

SEQ ID NO: 6573960 - DNA, 21 bp, Homo sapiens
ttctccgaaaggcaaaaatgt

SEQ ID NO: 6573961 - DNA, 15 bp, Homo sapiens
ttctccgccagcctc

SEQ ID NO: 6573962 - DNA, 16 bp, Homo sapiens
ttctccgccagcctcc

SEQ ID NO: 6573963 - DNA, 19 bp, Homo sapiens
ttctccgccagcctcctct

SEQ ID NO: 6573964 - DNA, 20 bp, Homo sapiens
ttctccgccagcctcctctg

SEQ ID NO: 6573965 - DNA, 16 bp, Homo sapiens
ttctccggggtctgtg

SEQ ID NO: 6573966 - DNA, 17 bp, Homo sapiens
ttctccgggtcctccta

SEQ ID NO: 6573967 - DNA, 16 bp, Homo sapiens
ttctccgttagctcct

SEQ ID NO: 6573968 - DNA, 17 bp, Homo sapiens
ttctccgttagctcctg

SEQ ID NO: 6573969 - DNA, 18 bp, Homo sapiens
ttctccgttagctcctgt

SEQ ID NO: 6573970 - DNA, 19 bp, Homo sapiens
ttctccgttagctcctgtg

SEQ ID NO: 6573971 - DNA, 14 bp, Homo sapiens
ttctcctatgtttg

SEQ ID NO: 6573972 - DNA, 18 bp, Homo sapiens
ttctcctcactgtatcca

SEQ ID NO: 6573973 - DNA, 13 bp, Homo sapiens
ttctcctcagtgg

SEQ ID NO: 6573974 - DNA, 13 bp, Homo sapiens
ttctcctccaaat

SEQ ID NO: 6573975 - DNA, 17 bp, Homo sapiens
ttctcctccattgctgt

SEQ ID NO: 6573976 - DNA, 18 bp, Homo sapiens
ttctcctcctcctccctc

SEQ ID NO: 6573977 - DNA, 13 bp, Homo sapiens
ttctcctctccca

SEQ ID NO: 6573978 - DNA, 15 bp, Homo sapiens
ttctcctctctgggc

SEQ ID NO: 6573979 - DNA, 22 bp, Homo sapiens
ttctcctcttgtaaataaagcc

SEQ ID NO: 6573980 - DNA, 15 bp, Homo sapiens
ttctcctgaatgcat

SEQ ID NO: 6573981 - DNA, 14 bp, Homo sapiens
ttctcctgaccagg

SEQ ID NO: 6573982 - DNA, 16 bp, Homo sapiens
ttctcctgcaaattta

SEQ ID NO: 6573983 - DNA, 22 bp, Homo sapiens
ttctcctgcaaatttagtttgt

SEQ ID NO: 6573984 - DNA, 15 bp, Homo sapiens
ttctcctgcagcctg

SEQ ID NO: 6573985 - DNA, 14 bp, Homo sapiens
ttctcctgcctcag

SEQ ID NO: 6573986 - DNA, 15 bp, Homo sapiens
ttctcctgcctcagc

SEQ ID NO: 6573987 - DNA, 22 bp, Homo sapiens
ttctcctgcgccccgcccacac

SEQ ID NO: 6573988 - DNA, 16 bp, Homo sapiens
ttctcctgctgctccc

SEQ ID NO: 6573989 - DNA, 19 bp, Homo sapiens
ttctcctgctgctccctca

SEQ ID NO: 6573990 - DNA, 23 bp, Homo sapiens
ttctcctgctgctccctcagact

SEQ ID NO: 6573991 - DNA, 18 bp, Homo sapiens
ttctcctgctgctcctgt

SEQ ID NO: 6573992 - DNA, 13 bp, Homo sapiens
ttctcctgcttgt

SEQ ID NO: 6573993 - DNA, 19 bp, Homo sapiens
ttctcctggcccctgcctg

SEQ ID NO: 6573994 - DNA, 20 bp, Homo sapiens
ttctcctgggaaacctgcct

SEQ ID NO: 6573995 - DNA, 22 bp, Homo sapiens
aaggaagttactgttatagagg

SEQ ID NO: 6573996 - DNA, 17 bp, Homo sapiens
aaggaagtttgattttt

SEQ ID NO: 6573997 - DNA, 21 bp, Homo sapiens
aaggaataaattgctccttga

SEQ ID NO: 6573998 - DNA, 20 bp, Homo sapiens
aaggaatacaatatatagct

SEQ ID NO: 6573999 - DNA, 17 bp, Homo sapiens
aaggaatacctgtcccc

SEQ ID NO: 6574000 - DNA, 17 bp, Homo sapiens
aaggaatagaagcaaat

SEQ ID NO: 6574001 - DNA, 17 bp, Homo sapiens
aaggaatagccagagag

SEQ ID NO: 6574002 - DNA, 21 bp, Homo sapiens
aaggaatagccagagaggagc

SEQ ID NO: 6574003 - DNA, 18 bp, Homo sapiens
aaggaataggtaggagac

SEQ ID NO: 6574004 - DNA, 13 bp, Homo sapiens
aaggaatataatg

SEQ ID NO: 6574005 - DNA, 16 bp, Homo sapiens
aaggaatatatatgga

SEQ ID NO: 6574006 - DNA, 13 bp, Homo sapiens
aaggaatatatgg

SEQ ID NO: 6574007 - DNA, 18 bp, Homo sapiens
aaggaatcactttagaaa

SEQ ID NO: 6574008 - DNA, 20 bp, Homo sapiens
aaggaatcactttagaaagc

SEQ ID NO: 6574009 - DNA, 20 bp, Homo sapiens
aaggaatcattccagtgcta

SEQ ID NO: 6574010 - DNA, 17 bp, Homo sapiens
aaggaatccatcctgca

SEQ ID NO: 6574011 - DNA, 14 bp, Homo sapiens
aaggaatctgaaag

SEQ ID NO: 6574012 - DNA, 20 bp, Homo sapiens
aaggaatctgaaagtatatt

SEQ ID NO: 6574013 - DNA, 23 bp, Homo sapiens
aaggaatctgaaagtatattttc

SEQ ID NO: 6574014 - DNA, 13 bp, Homo sapiens
aaggaatctggca

SEQ ID NO: 6574015 - DNA, 13 bp, Homo sapiens
aaggaatgcaaga

SEQ ID NO: 6574016 - DNA, 19 bp, Homo sapiens
aaggaatgcctgtgccaat

SEQ ID NO: 6574017 - DNA, 16 bp, Homo sapiens
aaggaatggaggctct

SEQ ID NO: 6574018 - DNA, 24 bp, Homo sapiens
aaggaatgtacgttgagaatcact

SEQ ID NO: 6574019 - DNA, 21 bp, Homo sapiens
aaggaatgtagctggtttcct

SEQ ID NO: 6574020 - DNA, 21 bp, Homo sapiens
aaggaatgtccatttgctgag

SEQ ID NO: 6574021 - DNA, 15 bp, Homo sapiens
aaggaatgtgtccaa

SEQ ID NO: 6574022 - DNA, 17 bp, Homo sapiens
aaggaatgtgtccaaga

SEQ ID NO: 6574023 - DNA, 16 bp, Homo sapiens
aaggaattaaactaaa

SEQ ID NO: 6574024 - DNA, 23 bp, Homo sapiens
aaggaattacattttatatgtga

SEQ ID NO: 6574025 - DNA, 16 bp, Homo sapiens
aaggaattatcaatta

SEQ ID NO: 6574026 - DNA, 13 bp, Homo sapiens
aaggaatttaaaa

SEQ ID NO: 6574027 - DNA, 17 bp, Homo sapiens
aaggaatttcctcccaa

SEQ ID NO: 6574028 - DNA, 19 bp, Homo sapiens
aaggaatttctaaggacat

SEQ ID NO: 6574029 - DNA, 14 bp, Homo sapiens
aaggaatttcttaa

SEQ ID NO: 6574030 - DNA, 17 bp, Homo sapiens
aaggaatttgattgctt

SEQ ID NO: 6574031 - DNA, 22 bp, Homo sapiens
aaggaatttgcatccagcagca

SEQ ID NO: 6574032 - DNA, 20 bp, Homo sapiens
aaggacaaataaaacatggc

SEQ ID NO: 6574033 - DNA, 23 bp, Homo sapiens
aaggacaaatctaaaatgcaaag

SEQ ID NO: 6574034 - DNA, 20 bp, Homo sapiens
aaggacaaattagcatgcaa

SEQ ID NO: 6574035 - DNA, 17 bp, Homo sapiens
aaggacaacagcatctt

SEQ ID NO: 6574036 - DNA, 21 bp, Homo sapiens
aaggacaacctgcccctcccc

SEQ ID NO: 6574037 - DNA, 13 bp, Homo sapiens
aaggacaccctcc

SEQ ID NO: 6574038 - DNA, 20 bp, Homo sapiens
aaggacactgatgggtcctg

SEQ ID NO: 6574039 - DNA, 14 bp, Homo sapiens
aaggacactggatc

SEQ ID NO: 6574040 - DNA, 12 bp, Homo sapiens
aaggacacttgt

SEQ ID NO: 6574041 - DNA, 15 bp, Homo sapiens
aaggacagcagctgg

SEQ ID NO: 6574042 - DNA, 16 bp, Homo sapiens
aaggacagctttgata

SEQ ID NO: 6574043 - DNA, 21 bp, Homo sapiens
aaggacagctttgataatgtc

SEQ ID NO: 6574044 - DNA, 18 bp, Homo sapiens
aaggacaggaccctcagg

SEQ ID NO: 6574045 - DNA, 14 bp, Homo sapiens
aaggacaggatggc

SEQ ID NO: 6574046 - DNA, 17 bp, Homo sapiens
aaggacaggcagaaaga

SEQ ID NO: 6574047 - DNA, 18 bp, Homo sapiens
aaggacaggcagaaagag

SEQ ID NO: 6574048 - DNA, 13 bp, Homo sapiens
aaggacagtccct

SEQ ID NO: 6574049 - DNA, 16 bp, Homo sapiens
aaggacagtgttcaaa

SEQ ID NO: 6574050 - DNA, 21 bp, Homo sapiens
aaggacagttcagagatcagg

SEQ ID NO: 6574051 - DNA, 13 bp, Homo sapiens
aaggacataaaat

SEQ ID NO: 6574052 - DNA, 17 bp, Homo sapiens
aaggacatgagatcagg

SEQ ID NO: 6574053 - DNA, 16 bp, Homo sapiens
aaggacatgatgcttt

SEQ ID NO: 6574054 - DNA, 23 bp, Homo sapiens
aaggacatggtgagtctattttt

SEQ ID NO: 6574055 - DNA, 15 bp, Homo sapiens
aaggacatgtgctat

SEQ ID NO: 6574056 - DNA, 17 bp, Homo sapiens
aaggacatgtgctattg

SEQ ID NO: 6574057 - DNA, 16 bp, Homo sapiens
aaggacattatgtgtg

SEQ ID NO: 6574058 - DNA, 18 bp, Homo sapiens
aaggacattgccccaaga

SEQ ID NO: 6574059 - DNA, 21 bp, Homo sapiens
aaggaccaacccatgccctgc

SEQ ID NO: 6574060 - DNA, 22 bp, Homo sapiens
aaggaccaacccatgccctgcc

SEQ ID NO: 6574061 - DNA, 22 bp, Homo sapiens
aaggaccaactggcttctgtgc

SEQ ID NO: 6574062 - DNA, 23 bp, Homo sapiens
aaggaccaactggcttctgtgca

SEQ ID NO: 6574063 - DNA, 14 bp, Homo sapiens
aaggaccagcgtcc

SEQ ID NO: 6574064 - DNA, 18 bp, Homo sapiens
aaggaccaggctggggcc

SEQ ID NO: 6574065 - DNA, 18 bp, Homo sapiens
aaggacccacccatcttc

SEQ ID NO: 6574066 - DNA, 15 bp, Homo sapiens
aaggacccagccctc

SEQ ID NO: 6574067 - DNA, 13 bp, Homo sapiens
aaggacccctcac

SEQ ID NO: 6574068 - DNA, 20 bp, Homo sapiens
aaggacccctcaccttgcaa

SEQ ID NO: 6574069 - DNA, 21 bp, Homo sapiens
aaggacccggaggggcctggc

SEQ ID NO: 6574070 - DNA, 14 bp, Homo sapiens
aaggaccctgtgag

SEQ ID NO: 6574071 - DNA, 22 bp, Homo sapiens
aaggaccctgtttctgtagaaa

SEQ ID NO: 6574072 - DNA, 15 bp, Homo sapiens
aaggacccttttaag

SEQ ID NO: 6574073 - DNA, 20 bp, Homo sapiens
aaggacccttttaagcatgt

SEQ ID NO: 6574074 - DNA, 22 bp, Homo sapiens
aaggacccttttaagcatgtga

SEQ ID NO: 6574075 - DNA, 16 bp, Homo sapiens
aaggaccgtttttact

SEQ ID NO: 6574076 - DNA, 17 bp, Homo sapiens
aaggaccgtttttacta

SEQ ID NO: 6574077 - DNA, 16 bp, Homo sapiens
aaggacctatgtttgc

SEQ ID NO: 6574078 - DNA, 17 bp, Homo sapiens
aaggacctatgtttgct

SEQ ID NO: 6574079 - DNA, 22 bp, Homo sapiens
aaggacctatgtttgctcagaa

SEQ ID NO: 6574080 - DNA, 14 bp, Homo sapiens
aaggacctccccct

SEQ ID NO: 6574081 - DNA, 21 bp, Homo sapiens
aaggacctctttactctctcc

SEQ ID NO: 6574082 - DNA, 18 bp, Homo sapiens
aaggacctgaaattccaa

SEQ ID NO: 6574083 - DNA, 24 bp, Homo sapiens
aaggaccttcactctaagatgtta

SEQ ID NO: 6574084 - DNA, 15 bp, Homo sapiens
aaggacgcctgcagg

SEQ ID NO: 6574085 - DNA, 23 bp, Homo sapiens
aaggacggctgagcatgtggagc

SEQ ID NO: 6574086 - DNA, 17 bp, Homo sapiens
aaggacgggttggggcc

SEQ ID NO: 6574087 - DNA, 17 bp, Homo sapiens
aaggacggtgccaaggg

SEQ ID NO: 6574088 - DNA, 15 bp, Homo sapiens
aaggacgtaaaattt

SEQ ID NO: 6574089 - DNA, 18 bp, Homo sapiens
aaggactaacataaaatc

SEQ ID NO: 6574090 - DNA, 21 bp, Homo sapiens
aaggactaacgaacgttttaa

SEQ ID NO: 6574091 - DNA, 18 bp, Homo sapiens
aaggactaatagaaaagt

SEQ ID NO: 6574092 - DNA, 19 bp, Homo sapiens
aaggactaatagaaaagta

SEQ ID NO: 6574093 - DNA, 14 bp, Homo sapiens
aaggactacagaat

SEQ ID NO: 6574094 - DNA, 16 bp, Homo sapiens
aaggactacagaattg

SEQ ID NO: 6574095 - DNA, 17 bp, Homo sapiens
aaggactagatactact

SEQ ID NO: 6574096 - DNA, 16 bp, Homo sapiens
aaggactataagaata

SEQ ID NO: 6574097 - DNA, 17 bp, Homo sapiens
aaggactattaattcca

SEQ ID NO: 6574098 - DNA, 14 bp, Homo sapiens
aaggactattatgt

SEQ ID NO: 6574099 - DNA, 13 bp, Homo sapiens
aaggactccaccc

SEQ ID NO: 6574100 - DNA, 17 bp, Homo sapiens
aaggactcccggagcct

SEQ ID NO: 6574101 - DNA, 13 bp, Homo sapiens
aaggactctggaa

SEQ ID NO: 6574102 - DNA, 12 bp, Homo sapiens
aaggactctggg

SEQ ID NO: 6574103 - DNA, 13 bp, Homo sapiens
aaggactgaagaa

SEQ ID NO: 6574104 - DNA, 21 bp, Homo sapiens
aaggactgactgagacacgat

SEQ ID NO: 6574105 - DNA, 21 bp, Homo sapiens
aaggactgagcaccctctgga

SEQ ID NO: 6574106 - DNA, 17 bp, Homo sapiens
aaggactgagggactct

SEQ ID NO: 6574107 - DNA, 21 bp, Homo sapiens
aaggactgcatggtaatttat

SEQ ID NO: 6574108 - DNA, 22 bp, Homo sapiens
aaggactgccgaccgaggctgg

SEQ ID NO: 6574109 - DNA, 16 bp, Homo sapiens
aaggactggaaaaatg

SEQ ID NO: 6574110 - DNA, 21 bp, Homo sapiens
aaggactggccgtggctccag

SEQ ID NO: 6574111 - DNA, 20 bp, Homo sapiens
aaggactggtgcgacccccc

SEQ ID NO: 6574112 - DNA, 15 bp, Homo sapiens
aaggactgtaaacat

SEQ ID NO: 6574113 - DNA, 14 bp, Homo sapiens
aaggactgtaagca

SEQ ID NO: 6574114 - DNA, 20 bp, Homo sapiens
aaggactgtgacaggcagca

SEQ ID NO: 6574115 - DNA, 16 bp, Homo sapiens
aaggactgtggctgca

SEQ ID NO: 6574116 - DNA, 18 bp, Homo sapiens
aaggacttagctggccac

SEQ ID NO: 6574117 - DNA, 14 bp, Homo sapiens
aaggacttccacat

SEQ ID NO: 6574118 - DNA, 15 bp, Homo sapiens
aaggacttccacatt

SEQ ID NO: 6574119 - DNA, 13 bp, Homo sapiens
aaggacttcctga

SEQ ID NO: 6574120 - DNA, 17 bp, Homo sapiens
aaggacttcctgtccag

SEQ ID NO: 6574121 - DNA, 14 bp, Homo sapiens
aaggacttctttaa

SEQ ID NO: 6574122 - DNA, 15 bp, Homo sapiens
aaggacttctttaat

SEQ ID NO: 6574123 - DNA, 23 bp, Homo sapiens
aaggacttctttaattttggaat

SEQ ID NO: 6574124 - DNA, 19 bp, Homo sapiens
aaggacttgaaagcatcca

SEQ ID NO: 6574125 - DNA, 22 bp, Homo sapiens
aaggacttgaaagcatccatgt

SEQ ID NO: 6574126 - DNA, 17 bp, Homo sapiens
aaggacttgacttgcaa

SEQ ID NO: 6574127 - DNA, 14 bp, Homo sapiens
aaggacttgtgcct

SEQ ID NO: 6574128 - DNA, 23 bp, Homo sapiens
aaggacttgtgcctcttgggaga

SEQ ID NO: 6574129 - DNA, 14 bp, Homo sapiens
aaggactttccagt

SEQ ID NO: 6574130 - DNA, 17 bp, Homo sapiens
aaggactttgtacattt

SEQ ID NO: 6574131 - DNA, 12 bp, Homo sapiens
aaggagaaaaaa

SEQ ID NO: 6574132 - DNA, 20 bp, Homo sapiens
aaggagaaaatgcattatgt

SEQ ID NO: 6574133 - DNA, 15 bp, Homo sapiens
aaggagaaagaaagt

SEQ ID NO: 6574134 - DNA, 18 bp, Homo sapiens
aaggagaaaggagccgga

SEQ ID NO: 6574135 - DNA, 12 bp, Homo sapiens
aaggagaaatga

SEQ ID NO: 6574136 - DNA, 21 bp, Homo sapiens
aaggagaaatgataagtgaca

SEQ ID NO: 6574137 - DNA, 13 bp, Homo sapiens
aaggagaacaaat

SEQ ID NO: 6574138 - DNA, 15 bp, Homo sapiens
aaggagaaggctgga

SEQ ID NO: 6574139 - DNA, 12 bp, Homo sapiens
aaggagaataag

SEQ ID NO: 6574140 - DNA, 16 bp, Homo sapiens
aaggagaatcatcagg

SEQ ID NO: 6574141 - DNA, 17 bp, Homo sapiens
aaggagaatcatcagga

SEQ ID NO: 6574142 - DNA, 18 bp, Homo sapiens
aaggagaatcatgtttct

SEQ ID NO: 6574143 - DNA, 15 bp, Homo sapiens
aaggagaatggcatg

SEQ ID NO: 6574144 - DNA, 13 bp, Homo sapiens
aaggagaatttaa

SEQ ID NO: 6574145 - DNA, 20 bp, Homo sapiens
aaggagaatttaataaagat

SEQ ID NO: 6574146 - DNA, 18 bp, Homo sapiens
aaggagacaaagcaggag

SEQ ID NO: 6574147 - DNA, 15 bp, Homo sapiens
aaggagacacagatg

SEQ ID NO: 6574148 - DNA, 16 bp, Homo sapiens
aaggagacagaatgag

SEQ ID NO: 6574149 - DNA, 14 bp, Homo sapiens
aaggagacaggcag

SEQ ID NO: 6574150 - DNA, 17 bp, Homo sapiens
aaggagactcacctctg

SEQ ID NO: 6574151 - DNA, 19 bp, Homo sapiens
aaggagactggtaggagga

SEQ ID NO: 6574152 - DNA, 18 bp, Homo sapiens
aaggagacttctgtcttc

SEQ ID NO: 6574153 - DNA, 18 bp, Homo sapiens
aaggagagatgaccccta

SEQ ID NO: 6574154 - DNA, 22 bp, Homo sapiens
aaggagagatgacccctacccc

SEQ ID NO: 6574155 - DNA, 14 bp, Homo sapiens
aaggagagcaagaa

SEQ ID NO: 6574156 - DNA, 14 bp, Homo sapiens
aaggagaggaggca

SEQ ID NO: 6574157 - DNA, 19 bp, Homo sapiens
aaggagaggttaaagcaaa

SEQ ID NO: 6574158 - DNA, 20 bp, Homo sapiens
aaggagaggttaaagcaaac

SEQ ID NO: 6574159 - DNA, 21 bp, Homo sapiens
aaggagagtcttgcagtgatt

SEQ ID NO: 6574160 - DNA, 17 bp, Homo sapiens
aaggagataagaaagca

SEQ ID NO: 6574161 - DNA, 23 bp, Homo sapiens
aaggagatagacgggttgaaaga

SEQ ID NO: 6574162 - DNA, 16 bp, Homo sapiens
aaggagatataaaatc

SEQ ID NO: 6574163 - DNA, 19 bp, Homo sapiens
aaggagatgaatagaagaa

SEQ ID NO: 6574164 - DNA, 21 bp, Homo sapiens
aaggagatgggtgattccttc

SEQ ID NO: 6574165 - DNA, 23 bp, Homo sapiens
aaggagattcaggcagactggtg

SEQ ID NO: 6574166 - DNA, 16 bp, Homo sapiens
aaggagattccacaca

SEQ ID NO: 6574167 - DNA, 18 bp, Homo sapiens
aaggagattgtggggaga

SEQ ID NO: 6574168 - DNA, 20 bp, Homo sapiens
aaggagcaaaaatctgagaa

SEQ ID NO: 6574169 - DNA, 21 bp, Homo sapiens
aaggagcaaaaatctgagaaa

SEQ ID NO: 6574170 - DNA, 21 bp, Homo sapiens
aaggagcacaggtcccacctc

SEQ ID NO: 6574171 - DNA, 15 bp, Homo sapiens
aaggagcacatacta

SEQ ID NO: 6574172 - DNA, 20 bp, Homo sapiens
aaggagcacatactacctag

SEQ ID NO: 6574173 - DNA, 13 bp, Homo sapiens
ttctcctggtaga

SEQ ID NO: 6574174 - DNA, 12 bp, Homo sapiens
ttctcctggtgt

SEQ ID NO: 6574175 - DNA, 13 bp, Homo sapiens
ttctcctggtgtt

SEQ ID NO: 6574176 - DNA, 21 bp, Homo sapiens
ttctcctgtccctccatccca

SEQ ID NO: 6574177 - DNA, 21 bp, Homo sapiens
ttctcctgtctcagcctcctg

SEQ ID NO: 6574178 - DNA, 19 bp, Homo sapiens
ttctcctgtgatgtcccag

SEQ ID NO: 6574179 - DNA, 13 bp, Homo sapiens
ttctcctgtgccc

SEQ ID NO: 6574180 - DNA, 14 bp, Homo sapiens
ttctcctgtttaca

SEQ ID NO: 6574181 - DNA, 19 bp, Homo sapiens
ttctcctgtttatgggttt

SEQ ID NO: 6574182 - DNA, 13 bp, Homo sapiens
ttctcctgtttta

SEQ ID NO: 6574183 - DNA, 20 bp, Homo sapiens
ttctccttagtcttctcata

SEQ ID NO: 6574184 - DNA, 22 bp, Homo sapiens
ttctccttagttggctggaaac

SEQ ID NO: 6574185 - DNA, 20 bp, Homo sapiens
ttctccttcagccctcaccc

SEQ ID NO: 6574186 - DNA, 13 bp, Homo sapiens
ttctccttcccaa

SEQ ID NO: 6574187 - DNA, 16 bp, Homo sapiens
ttctccttcccaaggc

SEQ ID NO: 6574188 - DNA, 20 bp, Homo sapiens
ttctccttcccaaggcagct

SEQ ID NO: 6574189 - DNA, 17 bp, Homo sapiens
ttctccttccccaggat

SEQ ID NO: 6574190 - DNA, 14 bp, Homo sapiens
ttctccttctcctt

SEQ ID NO: 6574191 - DNA, 13 bp, Homo sapiens
ttctccttggagg

SEQ ID NO: 6574192 - DNA, 18 bp, Homo sapiens
ttctccttgtacttgaat

SEQ ID NO: 6574193 - DNA, 21 bp, Homo sapiens
ttctccttgtgttactaagtt

SEQ ID NO: 6574194 - DNA, 21 bp, Homo sapiens
ttctccttgttgttggttgtt

SEQ ID NO: 6574195 - DNA, 18 bp, Homo sapiens
ttctcctttaaattcttt

SEQ ID NO: 6574196 - DNA, 21 bp, Homo sapiens
ttctcctttaaattctttcct

SEQ ID NO: 6574197 - DNA, 18 bp, Homo sapiens
ttctcctttcacaacctt

SEQ ID NO: 6574198 - DNA, 22 bp, Homo sapiens
ttctcctttcacaaccttctgt

SEQ ID NO: 6574199 - DNA, 13 bp, Homo sapiens
ttctcctttcctt

SEQ ID NO: 6574200 - DNA, 15 bp, Homo sapiens
ttctcctttccttcc

SEQ ID NO: 6574201 - DNA, 16 bp, Homo sapiens
ttctcctttccttccc

SEQ ID NO: 6574202 - DNA, 20 bp, Homo sapiens
ttctcctttggcatgtttaa

SEQ ID NO: 6574203 - DNA, 15 bp, Homo sapiens
ttctcctttgtcaaa

SEQ ID NO: 6574204 - DNA, 16 bp, Homo sapiens
ttctcctttgtcaaat

SEQ ID NO: 6574205 - DNA, 13 bp, Homo sapiens
ttctccttttcct

SEQ ID NO: 6574206 - DNA, 18 bp, Homo sapiens
ttctccttttcctatcct

SEQ ID NO: 6574207 - DNA, 15 bp, Homo sapiens
ttctcgacttcagga

SEQ ID NO: 6574208 - DNA, 13 bp, Homo sapiens
ttctcgagtccaa

SEQ ID NO: 6574209 - DNA, 18 bp, Homo sapiens
ttctcgccccttccctct

SEQ ID NO: 6574210 - DNA, 21 bp, Homo sapiens
ttctcgccccttccctctctc

SEQ ID NO: 6574211 - DNA, 22 bp, Homo sapiens
ttctcgcctaggatttcagcca

SEQ ID NO: 6574212 - DNA, 18 bp, Homo sapiens
ttctcgcctcactttcca

SEQ ID NO: 6574213 - DNA, 17 bp, Homo sapiens
ttctcggaggccaggcc

SEQ ID NO: 6574214 - DNA, 13 bp, Homo sapiens
ttctcggccagcc

SEQ ID NO: 6574215 - DNA, 12 bp, Homo sapiens
ttctcgggctga

SEQ ID NO: 6574216 - DNA, 18 bp, Homo sapiens
ttctcggtccactcttgt

SEQ ID NO: 6574217 - DNA, 21 bp, Homo sapiens
ttctcggtccactcttgttga

SEQ ID NO: 6574218 - DNA, 16 bp, Homo sapiens
ttctcgtactttcaca

SEQ ID NO: 6574219 - DNA, 20 bp, Homo sapiens
ttctcgtagatgctgcctag

SEQ ID NO: 6574220 - DNA, 20 bp, Homo sapiens
ttctcgtccccctccctgcc

SEQ ID NO: 6574221 - DNA, 19 bp, Homo sapiens
ttctcgtgacccagtggca

SEQ ID NO: 6574222 - DNA, 20 bp, Homo sapiens
ttctcgtgctgcatccctgt

SEQ ID NO: 6574223 - DNA, 21 bp, Homo sapiens
ttctcgttgcctctgattttc

SEQ ID NO: 6574224 - DNA, 17 bp, Homo sapiens
ttctctaactcctgcca

SEQ ID NO: 6574225 - DNA, 24 bp, Homo sapiens
ttctctaagagaacaatgtgctat

SEQ ID NO: 6574226 - DNA, 15 bp, Homo sapiens
ttctctaagatgaat

SEQ ID NO: 6574227 - DNA, 20 bp, Homo sapiens
ttctctaagatgaatccaaa

SEQ ID NO: 6574228 - DNA, 21 bp, Homo sapiens
ttctctaagatgaatccaaat

SEQ ID NO: 6574229 - DNA, 20 bp, Homo sapiens
ttctctaagttccactgagc

SEQ ID NO: 6574230 - DNA, 21 bp, Homo sapiens
ttctctaagttccactgagct

SEQ ID NO: 6574231 - DNA, 15 bp, Homo sapiens
ttctctaataataaa

SEQ ID NO: 6574232 - DNA, 15 bp, Homo sapiens
ttctctaatgcttga

SEQ ID NO: 6574233 - DNA, 18 bp, Homo sapiens
ttctctaatgcttgattt

SEQ ID NO: 6574234 - DNA, 19 bp, Homo sapiens
ttctctaatgcttgattta

SEQ ID NO: 6574235 - DNA, 21 bp, Homo sapiens
ttctctaattcttcctttgta

SEQ ID NO: 6574236 - DNA, 20 bp, Homo sapiens
ttctctacagacttctccag

SEQ ID NO: 6574237 - DNA, 16 bp, Homo sapiens
ttctctacatgcataa

SEQ ID NO: 6574238 - DNA, 20 bp, Homo sapiens
ttctctacatgctctttttc

SEQ ID NO: 6574239 - DNA, 18 bp, Homo sapiens
ttctctactcatgccaga

SEQ ID NO: 6574240 - DNA, 14 bp, Homo sapiens
ttctctactgtctg

SEQ ID NO: 6574241 - DNA, 20 bp, Homo sapiens
ttctctactgtctggattaa

SEQ ID NO: 6574242 - DNA, 19 bp, Homo sapiens
ttctctacttgtcatatca

SEQ ID NO: 6574243 - DNA, 15 bp, Homo sapiens
ttctctagaagctcc

SEQ ID NO: 6574244 - DNA, 15 bp, Homo sapiens
ttctctagacaaaat

SEQ ID NO: 6574245 - DNA, 17 bp, Homo sapiens
ttctctagctctctagg

SEQ ID NO: 6574246 - DNA, 15 bp, Homo sapiens
ttctctagtgtatta

SEQ ID NO: 6574247 - DNA, 16 bp, Homo sapiens
ttctctataaagggtc

SEQ ID NO: 6574248 - DNA, 21 bp, Homo sapiens
ttctctataggtcatgatttc

SEQ ID NO: 6574249 - DNA, 22 bp, Homo sapiens
ttctctatatttttatttcatt

SEQ ID NO: 6574250 - DNA, 20 bp, Homo sapiens
ttctctatgacatgaaatga

SEQ ID NO: 6574251 - DNA, 22 bp, Homo sapiens
ttctctatgacatgaaatgaaa

SEQ ID NO: 6574252 - DNA, 16 bp, Homo sapiens
ttctctatgataatta

SEQ ID NO: 6574253 - DNA, 18 bp, Homo sapiens
ttctctatgtacagatga

SEQ ID NO: 6574254 - DNA, 19 bp, Homo sapiens
ttctctatgtacagatgat

SEQ ID NO: 6574255 - DNA, 17 bp, Homo sapiens
ttctctattctttccat

SEQ ID NO: 6574256 - DNA, 13 bp, Homo sapiens
ttctctattgtaa

SEQ ID NO: 6574257 - DNA, 22 bp, Homo sapiens
ttctctattttacttttctgcc

SEQ ID NO: 6574258 - DNA, 15 bp, Homo sapiens
ttctctcaacaccat

SEQ ID NO: 6574259 - DNA, 13 bp, Homo sapiens
ttctctcacctcc

SEQ ID NO: 6574260 - DNA, 18 bp, Homo sapiens
ttctctcacttctaaatt

SEQ ID NO: 6574261 - DNA, 11 bp, Homo sapiens
ttctctcagac

SEQ ID NO: 6574262 - DNA, 22 bp, Homo sapiens
ttctctcagaccgtcttcctcc

SEQ ID NO: 6574263 - DNA, 23 bp, Homo sapiens
ttctctcagaccgtcttcctcca

SEQ ID NO: 6574264 - DNA, 16 bp, Homo sapiens
ttctctcagccagctg

SEQ ID NO: 6574265 - DNA, 17 bp, Homo sapiens
ttctctcatctcttagc

SEQ ID NO: 6574266 - DNA, 16 bp, Homo sapiens
ttctctccacagtgtt

SEQ ID NO: 6574267 - DNA, 18 bp, Homo sapiens
ttctctccaccttagtac

SEQ ID NO: 6574268 - DNA, 13 bp, Homo sapiens
ttctctccagccc

SEQ ID NO: 6574269 - DNA, 19 bp, Homo sapiens
ttctctccagctgactaaa

SEQ ID NO: 6574270 - DNA, 22 bp, Homo sapiens
ttctctcccacacaagcagtct

SEQ ID NO: 6574271 - DNA, 21 bp, Homo sapiens
ttctctcccaggggctggctt

SEQ ID NO: 6574272 - DNA, 13 bp, Homo sapiens
ttctctccccagc

SEQ ID NO: 6574273 - DNA, 15 bp, Homo sapiens
ttctctccccagccc

SEQ ID NO: 6574274 - DNA, 22 bp, Homo sapiens
ttctctccccagccccctccca

SEQ ID NO: 6574275 - DNA, 20 bp, Homo sapiens
ttctctccccctatttattg

SEQ ID NO: 6574276 - DNA, 22 bp, Homo sapiens
ttctctcccctcacatcctcct

SEQ ID NO: 6574277 - DNA, 19 bp, Homo sapiens
ttctctcccctcctctgaa

SEQ ID NO: 6574278 - DNA, 18 bp, Homo sapiens
ttctctccccttgcactg

SEQ ID NO: 6574279 - DNA, 17 bp, Homo sapiens
ttctctccgcgggtggg

SEQ ID NO: 6574280 - DNA, 20 bp, Homo sapiens
ttctctcctcagtttacatc

SEQ ID NO: 6574281 - DNA, 14 bp, Homo sapiens
ttctctcctcccca

SEQ ID NO: 6574282 - DNA, 19 bp, Homo sapiens
ttctctcctgtacctcttg

SEQ ID NO: 6574283 - DNA, 19 bp, Homo sapiens
ttctctcctgtcctccctc

SEQ ID NO: 6574284 - DNA, 21 bp, Homo sapiens
ttctctcctgtcctccctcac

SEQ ID NO: 6574285 - DNA, 22 bp, Homo sapiens
ttctctcctgtcctccctcacc

SEQ ID NO: 6574286 - DNA, 19 bp, Homo sapiens
ttctctccttccctctcca

SEQ ID NO: 6574287 - DNA, 20 bp, Homo sapiens
ttctctccttccctctttcc

SEQ ID NO: 6574288 - DNA, 20 bp, Homo sapiens
ttctctctactggtcctctt

SEQ ID NO: 6574289 - DNA, 12 bp, Homo sapiens
ttctctctcacc

SEQ ID NO: 6574290 - DNA, 20 bp, Homo sapiens
ttctctctcactctcttcct

SEQ ID NO: 6574291 - DNA, 21 bp, Homo sapiens
ttctctctcactctcttcctt

SEQ ID NO: 6574292 - DNA, 24 bp, Homo sapiens
ttctctctcactctcttcctttca

SEQ ID NO: 6574293 - DNA, 10 bp, Homo sapiens
ttctctctcc

SEQ ID NO: 6574294 - DNA, 15 bp, Homo sapiens
ttctctctccacccc

SEQ ID NO: 6574295 - DNA, 23 bp, Homo sapiens
ttctctctccagaaacagctgct

SEQ ID NO: 6574296 - DNA, 18 bp, Homo sapiens
ttctctctccagggtgct

SEQ ID NO: 6574297 - DNA, 19 bp, Homo sapiens
ttctctctccagggtgctt

SEQ ID NO: 6574298 - DNA, 14 bp, Homo sapiens
ttctctctcctctc

SEQ ID NO: 6574299 - DNA, 19 bp, Homo sapiens
ttctctctcctctctgctt

SEQ ID NO: 6574300 - DNA, 13 bp, Homo sapiens
ttctctctcctgg

SEQ ID NO: 6574301 - DNA, 14 bp, Homo sapiens
ttctctctcctggt

SEQ ID NO: 6574302 - DNA, 16 bp, Homo sapiens
ttctctctcctgtcca

SEQ ID NO: 6574303 - DNA, 14 bp, Homo sapiens
ttctctctctctca

SEQ ID NO: 6574304 - DNA, 20 bp, Homo sapiens
ttctctctctctcacacaca

SEQ ID NO: 6574305 - DNA, 11 bp, Homo sapiens
ttctctctgag

SEQ ID NO: 6574306 - DNA, 11 bp, Homo sapiens
ttctctctgcc

SEQ ID NO: 6574307 - DNA, 12 bp, Homo sapiens
ttctctctgccc

SEQ ID NO: 6574308 - DNA, 14 bp, Homo sapiens
ttctctctgcccaa

SEQ ID NO: 6574309 - DNA, 15 bp, Homo sapiens
ttctctctgctcagt

SEQ ID NO: 6574310 - DNA, 21 bp, Homo sapiens
ttctctctggacccttctgaa

SEQ ID NO: 6574311 - DNA, 11 bp, Homo sapiens
ttctctctgtg

SEQ ID NO: 6574312 - DNA, 13 bp, Homo sapiens
ttctctcttaaca

SEQ ID NO: 6574313 - DNA, 16 bp, Homo sapiens
ttctctcttccctcag

SEQ ID NO: 6574314 - DNA, 15 bp, Homo sapiens
ttctctcttgttgtc

SEQ ID NO: 6574315 - DNA, 17 bp, Homo sapiens
ttctctctttatacagc

SEQ ID NO: 6574316 - DNA, 18 bp, Homo sapiens
ttctctctttatacagct

SEQ ID NO: 6574317 - DNA, 11 bp, Homo sapiens
ttctctctttt

SEQ ID NO: 6574318 - DNA, 17 bp, Homo sapiens
ttctctcttttaaagta

SEQ ID NO: 6574319 - DNA, 13 bp, Homo sapiens
ttctctcttttcc

SEQ ID NO: 6574320 - DNA, 23 bp, Homo sapiens
ttctctgaagagtgggtttcaca

SEQ ID NO: 6574321 - DNA, 17 bp, Homo sapiens
ttctctgacttctgcct

SEQ ID NO: 6574322 - DNA, 22 bp, Homo sapiens
ttctctgagaaccaaaagatgc

SEQ ID NO: 6574323 - DNA, 19 bp, Homo sapiens
ttctctgagctttgttact

SEQ ID NO: 6574324 - DNA, 13 bp, Homo sapiens
ttctctgaggaca

SEQ ID NO: 6574325 - DNA, 16 bp, Homo sapiens
ttctctgaggacaaga

SEQ ID NO: 6574326 - DNA, 20 bp, Homo sapiens
ttctctgaggacaagagaaa

SEQ ID NO: 6574327 - DNA, 14 bp, Homo sapiens
ttctctgaggacac

SEQ ID NO: 6574328 - DNA, 22 bp, Homo sapiens
ttctctgagtggtggttccttt

SEQ ID NO: 6574329 - DNA, 23 bp, Homo sapiens
ttctctgagtggtggttcctttg

SEQ ID NO: 6574330 - DNA, 14 bp, Homo sapiens
ttctctgatacaga

SEQ ID NO: 6574331 - DNA, 17 bp, Homo sapiens
ttctctgatacagaaaa

SEQ ID NO: 6574332 - DNA, 16 bp, Homo sapiens
ttctctgatcaaaatt

SEQ ID NO: 6574333 - DNA, 22 bp, Homo sapiens
ttctctgatcacaacttttctg

SEQ ID NO: 6574334 - DNA, 20 bp, Homo sapiens
ttctctgcaatgcttctgta

SEQ ID NO: 6574335 - DNA, 19 bp, Homo sapiens
ttctctgcaattttactgt

SEQ ID NO: 6574336 - DNA, 10 bp, Homo sapiens
ttctctgcag

SEQ ID NO: 6574337 - DNA, 11 bp, Homo sapiens
ttctctgcagt

SEQ ID NO: 6574338 - DNA, 21 bp, Homo sapiens
ttctctgcagtaaaacacatt

SEQ ID NO: 6574339 - DNA, 12 bp, Homo sapiens
ttctctgccagt

SEQ ID NO: 6574340 - DNA, 13 bp, Homo sapiens
ttctctgcccagc

SEQ ID NO: 6574341 - DNA, 19 bp, Homo sapiens
ttctctgcccagccgggca

SEQ ID NO: 6574342 - DNA, 11 bp, Homo sapiens
ttctctgccct

SEQ ID NO: 6574343 - DNA, 19 bp, Homo sapiens
ttctctgccctgccctggc

SEQ ID NO: 6574344 - DNA, 23 bp, Homo sapiens
ttctctgccgctacctccctccc

SEQ ID NO: 6574345 - DNA, 12 bp, Homo sapiens
ttctctgcctcc

SEQ ID NO: 6574346 - DNA, 13 bp, Homo sapiens
ttctctgcctctg

SEQ ID NO: 6574347 - DNA, 12 bp, Homo sapiens
ttctctgcctgg

SEQ ID NO: 6574348 - DNA, 14 bp, Homo sapiens
ttctctgcctggca

SEQ ID NO: 6574349 - DNA, 12 bp, Homo sapiens
ttctctgccttc

SEQ ID NO: 6574350 - DNA, 14 bp, Homo sapiens
ttctctgccttctt

SEQ ID NO: 6574351 - DNA, 12 bp, Homo sapiens
ttctctgccttt

SEQ ID NO: 6574352 - DNA, 21 bp, Homo sapiens
ttctctgcctttgacatttaa

SEQ ID NO: 6574353 - DNA, 17 bp, Homo sapiens
ttctctgctcacagaag

SEQ ID NO: 6574354 - DNA, 19 bp, Homo sapiens
ttctctgctcttgtttcac

SEQ ID NO: 6574355 - DNA, 11 bp, Homo sapiens
ttctctgctgc

SEQ ID NO: 6574356 - DNA, 14 bp, Homo sapiens
ttctctgctgcctc

SEQ ID NO: 6574357 - DNA, 16 bp, Homo sapiens
ttctctgctgcctctg

SEQ ID NO: 6574358 - DNA, 15 bp, Homo sapiens
ttctctgcttcagct

SEQ ID NO: 6574359 - DNA, 15 bp, Homo sapiens
ttctctgcttttcca

SEQ ID NO: 6574360 - DNA, 14 bp, Homo sapiens
ttctctggacacac

SEQ ID NO: 6574361 - DNA, 15 bp, Homo sapiens
ttctctggagccaag

SEQ ID NO: 6574362 - DNA, 17 bp, Homo sapiens
ttctctggagccaagtc

SEQ ID NO: 6574363 - DNA, 20 bp, Homo sapiens
ttctctggctgtaaggctct

SEQ ID NO: 6574364 - DNA, 16 bp, Homo sapiens
ttctctgggagaaaat

SEQ ID NO: 6574365 - DNA, 20 bp, Homo sapiens
ttctctgggagaaaatcatc

SEQ ID NO: 6574366 - DNA, 16 bp, Homo sapiens
ttctctgggtcccggg

SEQ ID NO: 6574367 - DNA, 23 bp, Homo sapiens
ttctctgggtctgattttctcac

SEQ ID NO: 6574368 - DNA, 15 bp, Homo sapiens
ttctctggtctcctt

SEQ ID NO: 6574369 - DNA, 18 bp, Homo sapiens
ttctctggtggtcttcct

SEQ ID NO: 6574370 - DNA, 18 bp, Homo sapiens
ttctctggtttcaccagc

SEQ ID NO: 6574371 - DNA, 21 bp, Homo sapiens
ttctctgtaagtgtagctcaa

SEQ ID NO: 6574372 - DNA, 21 bp, Homo sapiens
ttctctgtagttcctaatgga

SEQ ID NO: 6574373 - DNA, 10 bp, Homo sapiens
ttctctgtat

SEQ ID NO: 6574374 - DNA, 14 bp, Homo sapiens
ttctctgtatagta

SEQ ID NO: 6574375 - DNA, 13 bp, Homo sapiens
ttctctgtatatt

SEQ ID NO: 6574376 - DNA, 15 bp, Homo sapiens
ttctctgtatattta

SEQ ID NO: 6574377 - DNA, 11 bp, Homo sapiens
ttctctgtcca

SEQ ID NO: 6574378 - DNA, 17 bp, Homo sapiens
ttctctgtccagggctt

SEQ ID NO: 6574379 - DNA, 17 bp, Homo sapiens
ttctctgtctcatccat

SEQ ID NO: 6574380 - DNA, 19 bp, Homo sapiens
ttctctgtctgcctctcca

SEQ ID NO: 6574381 - DNA, 11 bp, Homo sapiens
ttctctgtgaa

SEQ ID NO: 6574382 - DNA, 13 bp, Homo sapiens
ttctctgtgaaag

SEQ ID NO: 6574383 - DNA, 13 bp, Homo sapiens
ttctctgtgaatc

SEQ ID NO: 6574384 - DNA, 22 bp, Homo sapiens
ttctctgtgaatccatgggtct

SEQ ID NO: 6574385 - DNA, 16 bp, Homo sapiens
ttctctgtgcaggagc

SEQ ID NO: 6574386 - DNA, 16 bp, Homo sapiens
ttctctgtgtctaaga

SEQ ID NO: 6574387 - DNA, 20 bp, Homo sapiens
ttctctgtgtctaagattct

SEQ ID NO: 6574388 - DNA, 12 bp, Homo sapiens
ttctctgtgtgg

SEQ ID NO: 6574389 - DNA, 21 bp, Homo sapiens
ttctctgtgtggttcagctac

SEQ ID NO: 6574390 - DNA, 12 bp, Homo sapiens
ttctctgttcta

SEQ ID NO: 6574391 - DNA, 22 bp, Homo sapiens
ttctctgttgtcgtaaagattt

SEQ ID NO: 6574392 - DNA, 23 bp, Homo sapiens
ttctctgtttttcttctgaaata

SEQ ID NO: 6574393 - DNA, 17 bp, Homo sapiens
ttctcttaaaatgacaa

SEQ ID NO: 6574394 - DNA, 22 bp, Homo sapiens
ttctcttaaaatgacaaaaagt

SEQ ID NO: 6574395 - DNA, 18 bp, Homo sapiens
ttctcttaaacttgtgaa

SEQ ID NO: 6574396 - DNA, 17 bp, Homo sapiens
ttctcttaagctgccca

SEQ ID NO: 6574397 - DNA, 15 bp, Homo sapiens
ttctcttaagtggtc

SEQ ID NO: 6574398 - DNA, 18 bp, Homo sapiens
ttctcttaatcactactg

SEQ ID NO: 6574399 - DNA, 19 bp, Homo sapiens
ttctcttaatcactactgt

SEQ ID NO: 6574400 - DNA, 23 bp, Homo sapiens
ttctcttacattttcgtcctgta

SEQ ID NO: 6574401 - DNA, 22 bp, Homo sapiens
ttctcttacgctctctgtctgg

SEQ ID NO: 6574402 - DNA, 23 bp, Homo sapiens
ttctcttactgcaaatgtcatca

SEQ ID NO: 6574403 - DNA, 14 bp, Homo sapiens
ttctcttactgccg

SEQ ID NO: 6574404 - DNA, 11 bp, Homo sapiens
ttctcttagag

SEQ ID NO: 6574405 - DNA, 21 bp, Homo sapiens
ttctcttagagattttcattt

SEQ ID NO: 6574406 - DNA, 18 bp, Homo sapiens
ttctcttagcaactcaga

SEQ ID NO: 6574407 - DNA, 18 bp, Homo sapiens
ttctcttatcctctctct

SEQ ID NO: 6574408 - DNA, 16 bp, Homo sapiens
ttctcttcagtgtgtt

SEQ ID NO: 6574409 - DNA, 20 bp, Homo sapiens
ttctcttcagtgtgttgact

SEQ ID NO: 6574410 - DNA, 12 bp, Homo sapiens
ttctcttcattt

SEQ ID NO: 6574411 - DNA, 16 bp, Homo sapiens
ttctcttccaggcagc

SEQ ID NO: 6574412 - DNA, 20 bp, Homo sapiens
ttctcttccagtttctgtaa

SEQ ID NO: 6574413 - DNA, 21 bp, Homo sapiens
ttctcttccagtttctgtaag

SEQ ID NO: 6574414 - DNA, 12 bp, Homo sapiens
ttctcttcccag

SEQ ID NO: 6574415 - DNA, 17 bp, Homo sapiens
ttctcttcccaggcctt

SEQ ID NO: 6574416 - DNA, 19 bp, Homo sapiens
ttctcttccctccttccct

SEQ ID NO: 6574417 - DNA, 22 bp, Homo sapiens
ttctcttcctagatctgcaggc

SEQ ID NO: 6574418 - DNA, 14 bp, Homo sapiens
ttctcttcgctgtg

SEQ ID NO: 6574419 - DNA, 17 bp, Homo sapiens
ttctcttcgctgtgatg

SEQ ID NO: 6574420 - DNA, 21 bp, Homo sapiens
ttctcttctaacatgaaatat

SEQ ID NO: 6574421 - DNA, 18 bp, Homo sapiens
ttctcttctacccttttc

SEQ ID NO: 6574422 - DNA, 12 bp, Homo sapiens
ttctcttctagg

SEQ ID NO: 6574423 - DNA, 15 bp, Homo sapiens
ttctcttctatcctg

SEQ ID NO: 6574424 - DNA, 19 bp, Homo sapiens
ttctcttctccccttccat

SEQ ID NO: 6574425 - DNA, 12 bp, Homo sapiens
ttctcttctctg

SEQ ID NO: 6574426 - DNA, 15 bp, Homo sapiens
ttctcttctctgcaa

SEQ ID NO: 6574427 - DNA, 14 bp, Homo sapiens
ttctcttctgtcca

SEQ ID NO: 6574428 - DNA, 19 bp, Homo sapiens
ttctcttcttgctatatga

SEQ ID NO: 6574429 - DNA, 19 bp, Homo sapiens
ttctcttctttattgcact

SEQ ID NO: 6574430 - DNA, 24 bp, Homo sapiens
ttctcttctttattgcactaggaa

SEQ ID NO: 6574431 - DNA, 21 bp, Homo sapiens
ttctcttgaaaagttcaggga

SEQ ID NO: 6574432 - DNA, 17 bp, Homo sapiens
ttctcttgaaggtgctg

SEQ ID NO: 6574433 - DNA, 20 bp, Homo sapiens
ttctcttgaaggtgctgcca

SEQ ID NO: 6574434 - DNA, 15 bp, Homo sapiens
ttctcttgaataaag

SEQ ID NO: 6574435 - DNA, 22 bp, Homo sapiens
ttctcttgagataaggttttaa

SEQ ID NO: 6574436 - DNA, 16 bp, Homo sapiens
ttctcttgagctggcc

SEQ ID NO: 6574437 - DNA, 20 bp, Homo sapiens
ttctcttgagctggcctctc

SEQ ID NO: 6574438 - DNA, 19 bp, Homo sapiens
ttctcttgaggcctgtgct

SEQ ID NO: 6574439 - DNA, 13 bp, Homo sapiens
ttctcttgcctca

SEQ ID NO: 6574440 - DNA, 22 bp, Homo sapiens
ttctcttgcctcagcttcccca

SEQ ID NO: 6574441 - DNA, 17 bp, Homo sapiens
ttctcttgggaactgaa

SEQ ID NO: 6574442 - DNA, 18 bp, Homo sapiens
ttctcttggtgaaataat

SEQ ID NO: 6574443 - DNA, 19 bp, Homo sapiens
ttctcttggtgaaataata

SEQ ID NO: 6574444 - DNA, 23 bp, Homo sapiens
ttctcttggtgaaataataaaat

SEQ ID NO: 6574445 - DNA, 21 bp, Homo sapiens
ttctcttggtgttaaaacact

SEQ ID NO: 6574446 - DNA, 13 bp, Homo sapiens
ttctcttgtacca

SEQ ID NO: 6574447 - DNA, 15 bp, Homo sapiens
ttctcttgtaccata

SEQ ID NO: 6574448 - DNA, 14 bp, Homo sapiens
ttctcttgtctggc

SEQ ID NO: 6574449 - DNA, 21 bp, Homo sapiens
ttctcttgtgatttggttgca

SEQ ID NO: 6574450 - DNA, 14 bp, Homo sapiens
ttctctttaaaata

SEQ ID NO: 6574451 - DNA, 20 bp, Homo sapiens
ttctctttaattttaactga

SEQ ID NO: 6574452 - DNA, 18 bp, Homo sapiens
ttctctttaccttctaaa

SEQ ID NO: 6574453 - DNA, 15 bp, Homo sapiens
ttctctttaggagaa

SEQ ID NO: 6574454 - DNA, 17 bp, Homo sapiens
ttctctttaggagaaat

SEQ ID NO: 6574455 - DNA, 15 bp, Homo sapiens
ttctctttcaatgtg

SEQ ID NO: 6574456 - DNA, 12 bp, Homo sapiens
ttctctttcaca

SEQ ID NO: 6574457 - DNA, 14 bp, Homo sapiens
ttctctttccccca

SEQ ID NO: 6574458 - DNA, 21 bp, Homo sapiens
ttctctttccctggtcccttg

SEQ ID NO: 6574459 - DNA, 12 bp, Homo sapiens
ttctctttcctc

SEQ ID NO: 6574460 - DNA, 19 bp, Homo sapiens
ttctctttcttattttgta

SEQ ID NO: 6574461 - DNA, 14 bp, Homo sapiens
ttctctttcttcct

SEQ ID NO: 6574462 - DNA, 17 bp, Homo sapiens
ttctctttctttttctg

SEQ ID NO: 6574463 - DNA, 22 bp, Homo sapiens
ttctctttgacttaggttttta

SEQ ID NO: 6574464 - DNA, 19 bp, Homo sapiens
ttctctttgattatttgca

SEQ ID NO: 6574465 - DNA, 20 bp, Homo sapiens
ttctctttgattatttgcat

SEQ ID NO: 6574466 - DNA, 11 bp, Homo sapiens
ttctctttgcc

SEQ ID NO: 6574467 - DNA, 14 bp, Homo sapiens
ttctctttgcctca

SEQ ID NO: 6574468 - DNA, 15 bp, Homo sapiens
ttctctttgcctcaa

SEQ ID NO: 6574469 - DNA, 19 bp, Homo sapiens
ttctctttggaaatagcat

SEQ ID NO: 6574470 - DNA, 20 bp, Homo sapiens
ttctctttggaaatagcatg

SEQ ID NO: 6574471 - DNA, 17 bp, Homo sapiens
ttctctttggggctcct

SEQ ID NO: 6574472 - DNA, 19 bp, Homo sapiens
ttctctttgtaaggacttg

SEQ ID NO: 6574473 - DNA, 21 bp, Homo sapiens
ttctctttgttcttcaatgtg

SEQ ID NO: 6574474 - DNA, 14 bp, Homo sapiens
ttctctttgtttct

SEQ ID NO: 6574475 - DNA, 18 bp, Homo sapiens
ttctctttgtttctgttt

SEQ ID NO: 6574476 - DNA, 21 bp, Homo sapiens
ttctcttttcaaacacacaca

SEQ ID NO: 6574477 - DNA, 14 bp, Homo sapiens
ttctcttttcacag

SEQ ID NO: 6574478 - DNA, 17 bp, Homo sapiens
ttctcttttcacagcaa

SEQ ID NO: 6574479 - DNA, 15 bp, Homo sapiens
ttctcttttctaaaa

SEQ ID NO: 6574480 - DNA, 16 bp, Homo sapiens
ttctcttttctttctg

SEQ ID NO: 6574481 - DNA, 14 bp, Homo sapiens
ttctcttttgaaag

SEQ ID NO: 6574482 - DNA, 18 bp, Homo sapiens
ttctcttttgctttctgt

SEQ ID NO: 6574483 - DNA, 22 bp, Homo sapiens
ttctcttttgctttctgtttct

SEQ ID NO: 6574484 - DNA, 15 bp, Homo sapiens
ttctcttttgtcctc

SEQ ID NO: 6574485 - DNA, 16 bp, Homo sapiens
ttctctttttgaaaaa

SEQ ID NO: 6574486 - DNA, 18 bp, Homo sapiens
ttctcttttttaaaaaca

SEQ ID NO: 6574487 - DNA, 18 bp, Homo sapiens
ttctcttttttcagagaa

SEQ ID NO: 6574488 - DNA, 16 bp, Homo sapiens
ttctctttttttaaaa

SEQ ID NO: 6574489 - DNA, 15 bp, Homo sapiens
ttctgaaaaagacat

SEQ ID NO: 6574490 - DNA, 16 bp, Homo sapiens
ttctgaaaaagacata

SEQ ID NO: 6574491 - DNA, 23 bp, Homo sapiens
ttctgaaaaagacataaaacaga

SEQ ID NO: 6574492 - DNA, 14 bp, Homo sapiens
ttctgaaaaagaga

SEQ ID NO: 6574493 - DNA, 13 bp, Homo sapiens
ttctgaaaaatga

SEQ ID NO: 6574494 - DNA, 17 bp, Homo sapiens
ttctgaaaaatgaatgt

SEQ ID NO: 6574495 - DNA, 12 bp, Homo sapiens
ttctgaaaacac

SEQ ID NO: 6574496 - DNA, 17 bp, Homo sapiens
ttctgaaaactgaatgt

SEQ ID NO: 6574497 - DNA, 22 bp, Homo sapiens
ttctgaaaactgaatgtcaaga

SEQ ID NO: 6574498 - DNA, 15 bp, Homo sapiens
ttctgaaaactgttt

SEQ ID NO: 6574499 - DNA, 15 bp, Homo sapiens
ttctgaaaagaaata

SEQ ID NO: 6574500 - DNA, 16 bp, Homo sapiens
ttctgaaaattccaga

SEQ ID NO: 6574501 - DNA, 17 bp, Homo sapiens
ttctgaaaccacagttt

SEQ ID NO: 6574502 - DNA, 13 bp, Homo sapiens
ttctgaaacctta

SEQ ID NO: 6574503 - DNA, 17 bp, Homo sapiens
ttctgaaactaatgaaa

SEQ ID NO: 6574504 - DNA, 17 bp, Homo sapiens
ttctgaaacttcataaa

SEQ ID NO: 6574505 - DNA, 12 bp, Homo sapiens
ttctgaaagagc

SEQ ID NO: 6574506 - DNA, 12 bp, Homo sapiens
ttctgaaagagt

SEQ ID NO: 6574507 - DNA, 23 bp, Homo sapiens
ttctgaaaggaaatacacttctt

SEQ ID NO: 6574508 - DNA, 15 bp, Homo sapiens
ttctgaaagggacgc

SEQ ID NO: 6574509 - DNA, 16 bp, Homo sapiens
ttctgaaatacaacca

SEQ ID NO: 6574510 - DNA, 16 bp, Homo sapiens
ttctgaaatacttttg

SEQ ID NO: 6574511 - DNA, 20 bp, Homo sapiens
ttctgaaatgtcagttctga

SEQ ID NO: 6574512 - DNA, 17 bp, Homo sapiens
ttctgaacactttaggt

SEQ ID NO: 6574513 - DNA, 11 bp, Homo sapiens
ttctgaacagc

SEQ ID NO: 6574514 - DNA, 14 bp, Homo sapiens
ttctgaacagctgg

SEQ ID NO: 6574515 - DNA, 18 bp, Homo sapiens
ttctgaacagctggtgta

SEQ ID NO: 6574516 - DNA, 21 bp, Homo sapiens
ttctgaacatgagtgtcaact

SEQ ID NO: 6574517 - DNA, 16 bp, Homo sapiens
ttctgaactcaaactg

SEQ ID NO: 6574518 - DNA, 17 bp, Homo sapiens
ttctgaactcaaactga

SEQ ID NO: 6574519 - DNA, 22 bp, Homo sapiens
ttctgaactcaaactgaggaat

SEQ ID NO: 6574520 - DNA, 15 bp, Homo sapiens
ttctgaactccattt

SEQ ID NO: 6574521 - DNA, 19 bp, Homo sapiens
ttctgaacttggcgctgcc

SEQ ID NO: 6574522 - DNA, 12 bp, Homo sapiens
ttctgaagaagt

SEQ ID NO: 6574523 - DNA, 19 bp, Homo sapiens
ttctgaagaagttaattct

SEQ ID NO: 6574524 - DNA, 20 bp, Homo sapiens
ttctgaagaagttaattctt

SEQ ID NO: 6574525 - DNA, 14 bp, Homo sapiens
ttctgaagactgag

SEQ ID NO: 6574526 - DNA, 14 bp, Homo sapiens
ttctgaagatctca

SEQ ID NO: 6574527 - DNA, 19 bp, Homo sapiens
ttctgaagccatgtagcca

SEQ ID NO: 6574528 - DNA, 14 bp, Homo sapiens
ttctgaagcctcta

SEQ ID NO: 6574529 - DNA, 22 bp, Homo sapiens
ttctgaagcctctaacaaatga

SEQ ID NO: 6574530 - DNA, 21 bp, Homo sapiens
ttctgaagctagaaacaatct

SEQ ID NO: 6574531 - DNA, 17 bp, Homo sapiens
ttctgaagctgctgcag

SEQ ID NO: 6574532 - DNA, 20 bp, Homo sapiens
ttctgaagcttatgtttctt

SEQ ID NO: 6574533 - DNA, 21 bp, Homo sapiens
aaggagcactagaatgagaaa

SEQ ID NO: 6574534 - DNA, 22 bp, Homo sapiens
aaggagcactagaatgagaaat

SEQ ID NO: 6574535 - DNA, 16 bp, Homo sapiens
aaggagcagaataaat

SEQ ID NO: 6574536 - DNA, 12 bp, Homo sapiens
aaggagcagaga

SEQ ID NO: 6574537 - DNA, 20 bp, Homo sapiens
aaggagcaggccctgggcct

SEQ ID NO: 6574538 - DNA, 12 bp, Homo sapiens
aaggagcagtgg

SEQ ID NO: 6574539 - DNA, 20 bp, Homo sapiens
aaggagcatccctaattctt

SEQ ID NO: 6574540 - DNA, 13 bp, Homo sapiens
aaggagcatcctt

SEQ ID NO: 6574541 - DNA, 22 bp, Homo sapiens
aaggagcctccgttcccacctc

SEQ ID NO: 6574542 - DNA, 22 bp, Homo sapiens
aaggagcctgtgaacccaggac

SEQ ID NO: 6574543 - DNA, 19 bp, Homo sapiens
aaggagccttgttggtgga

SEQ ID NO: 6574544 - DNA, 17 bp, Homo sapiens
aaggagcgctagtgcct

SEQ ID NO: 6574545 - DNA, 18 bp, Homo sapiens
aaggagctgcctggaccc

SEQ ID NO: 6574546 - DNA, 21 bp, Homo sapiens
aaggagctgctatagcctggg

SEQ ID NO: 6574547 - DNA, 23 bp, Homo sapiens
aaggagctgggggaaggcaggag

SEQ ID NO: 6574548 - DNA, 17 bp, Homo sapiens
aaggagctgttggggca

SEQ ID NO: 6574549 - DNA, 21 bp, Homo sapiens
aaggagcttacctcccacctt

SEQ ID NO: 6574550 - DNA, 19 bp, Homo sapiens
aaggagctttcttgtttct

SEQ ID NO: 6574551 - DNA, 21 bp, Homo sapiens
aaggagctttcttgtttctta

SEQ ID NO: 6574552 - DNA, 11 bp, Homo sapiens
aaggaggaaaa

SEQ ID NO: 6574553 - DNA, 17 bp, Homo sapiens
aaggaggaagcttattg

SEQ ID NO: 6574554 - DNA, 16 bp, Homo sapiens
aaggaggaagggactg

SEQ ID NO: 6574555 - DNA, 21 bp, Homo sapiens
aaggaggaagggactggtcca

SEQ ID NO: 6574556 - DNA, 19 bp, Homo sapiens
aaggaggaatagtgcttgc

SEQ ID NO: 6574557 - DNA, 18 bp, Homo sapiens
aaggaggaatttactttc

SEQ ID NO: 6574558 - DNA, 17 bp, Homo sapiens
aaggaggacaagaccct

SEQ ID NO: 6574559 - DNA, 22 bp, Homo sapiens
aaggaggaccagtcaggatgag

SEQ ID NO: 6574560 - DNA, 13 bp, Homo sapiens
aaggaggacccag

SEQ ID NO: 6574561 - DNA, 17 bp, Homo sapiens
aaggaggacccaggaca

SEQ ID NO: 6574562 - DNA, 21 bp, Homo sapiens
aaggaggacccaggacaggat

SEQ ID NO: 6574563 - DNA, 9 bp, Homo sapiens
aaggaggag

SEQ ID NO: 6574564 - DNA, 15 bp, Homo sapiens
aaggaggagacagag

SEQ ID NO: 6574565 - DNA, 17 bp, Homo sapiens
aaggaggagagggaaaa

SEQ ID NO: 6574566 - DNA, 15 bp, Homo sapiens
aaggaggatagaaaa

SEQ ID NO: 6574567 - DNA, 16 bp, Homo sapiens
aaggaggcatgcctct

SEQ ID NO: 6574568 - DNA, 16 bp, Homo sapiens
aaggaggccaaccagc

SEQ ID NO: 6574569 - DNA, 19 bp, Homo sapiens
aaggaggccaaccagcccg

SEQ ID NO: 6574570 - DNA, 12 bp, Homo sapiens
aaggaggccacc

SEQ ID NO: 6574571 - DNA, 15 bp, Homo sapiens
aaggaggccacctcc

SEQ ID NO: 6574572 - DNA, 16 bp, Homo sapiens
aaggaggccacctcct

SEQ ID NO: 6574573 - DNA, 19 bp, Homo sapiens
aaggaggccataagctaca

SEQ ID NO: 6574574 - DNA, 18 bp, Homo sapiens
aaggaggccgccagactc

SEQ ID NO: 6574575 - DNA, 17 bp, Homo sapiens
aaggaggcctccactcc

SEQ ID NO: 6574576 - DNA, 18 bp, Homo sapiens
aaggaggctatgctcagg

SEQ ID NO: 6574577 - DNA, 14 bp, Homo sapiens
aaggaggctccagg

SEQ ID NO: 6574578 - DNA, 18 bp, Homo sapiens
aaggaggctccaggcagc

SEQ ID NO: 6574579 - DNA, 19 bp, Homo sapiens
aaggaggctccaggcagca

SEQ ID NO: 6574580 - DNA, 20 bp, Homo sapiens
aaggagggaaagttccagca

SEQ ID NO: 6574581 - DNA, 16 bp, Homo sapiens
aaggagggacaagaat

SEQ ID NO: 6574582 - DNA, 17 bp, Homo sapiens
aaggagggacaagaatc

SEQ ID NO: 6574583 - DNA, 13 bp, Homo sapiens
aaggagggagctg

SEQ ID NO: 6574584 - DNA, 16 bp, Homo sapiens
aaggagggagctgctc

SEQ ID NO: 6574585 - DNA, 13 bp, Homo sapiens
aaggagggcagag

SEQ ID NO: 6574586 - DNA, 15 bp, Homo sapiens
aaggagggcagagcc

SEQ ID NO: 6574587 - DNA, 17 bp, Homo sapiens
aaggagggcctcagaga

SEQ ID NO: 6574588 - DNA, 16 bp, Homo sapiens
aaggagggcctctggt

SEQ ID NO: 6574589 - DNA, 21 bp, Homo sapiens
aaggaggggaaaaaaatgttg

SEQ ID NO: 6574590 - DNA, 13 bp, Homo sapiens
aaggaggggaacc

SEQ ID NO: 6574591 - DNA, 20 bp, Homo sapiens
aaggaggggatagagagaga

SEQ ID NO: 6574592 - DNA, 18 bp, Homo sapiens
aaggagggtacagctggg

SEQ ID NO: 6574593 - DNA, 12 bp, Homo sapiens
aaggagggtgag

SEQ ID NO: 6574594 - DNA, 19 bp, Homo sapiens
aaggagggttagggagggg

SEQ ID NO: 6574595 - DNA, 21 bp, Homo sapiens
aaggaggttaggtcttaggaa

SEQ ID NO: 6574596 - DNA, 17 bp, Homo sapiens
aaggagtcactgagacc

SEQ ID NO: 6574597 - DNA, 21 bp, Homo sapiens
aaggagtcttctaatgtaaat

SEQ ID NO: 6574598 - DNA, 23 bp, Homo sapiens
aaggagtgcatggccacagccac

SEQ ID NO: 6574599 - DNA, 12 bp, Homo sapiens
aaggagtgccat

SEQ ID NO: 6574600 - DNA, 17 bp, Homo sapiens
aaggagtgcccgccttg

SEQ ID NO: 6574601 - DNA, 22 bp, Homo sapiens
aaggagttacagggaagtggtc

SEQ ID NO: 6574602 - DNA, 14 bp, Homo sapiens
aaggagttggtgta

SEQ ID NO: 6574603 - DNA, 14 bp, Homo sapiens
aaggagtttatgtt

SEQ ID NO: 6574604 - DNA, 12 bp, Homo sapiens
aaggataaagaa

SEQ ID NO: 6574605 - DNA, 13 bp, Homo sapiens
aaggataaagaag

SEQ ID NO: 6574606 - DNA, 19 bp, Homo sapiens
aaggataaagccacttctg

SEQ ID NO: 6574607 - DNA, 23 bp, Homo sapiens
aaggataaagttggtaaaccttt

SEQ ID NO: 6574608 - DNA, 15 bp, Homo sapiens
aaggataaatcataa

SEQ ID NO: 6574609 - DNA, 20 bp, Homo sapiens
aaggataaatcataaagtca

SEQ ID NO: 6574610 - DNA, 14 bp, Homo sapiens
aaggataaattttt

SEQ ID NO: 6574611 - DNA, 15 bp, Homo sapiens
aaggataactctgta

SEQ ID NO: 6574612 - DNA, 13 bp, Homo sapiens
aaggataatgaat

SEQ ID NO: 6574613 - DNA, 13 bp, Homo sapiens
aaggatacaaaag

SEQ ID NO: 6574614 - DNA, 21 bp, Homo sapiens
aaggatacaaaagcatgtgag

SEQ ID NO: 6574615 - DNA, 20 bp, Homo sapiens
aaggatacacttatttgtca

SEQ ID NO: 6574616 - DNA, 23 bp, Homo sapiens
aaggatactgtaacactttacaa

SEQ ID NO: 6574617 - DNA, 15 bp, Homo sapiens
aaggatagatgctgg

SEQ ID NO: 6574618 - DNA, 17 bp, Homo sapiens
aaggatagcctttgtag

SEQ ID NO: 6574619 - DNA, 17 bp, Homo sapiens
aaggatagtatttttat

SEQ ID NO: 6574620 - DNA, 15 bp, Homo sapiens
aaggatataaaagga

SEQ ID NO: 6574621 - DNA, 14 bp, Homo sapiens
aaggatatactgca

SEQ ID NO: 6574622 - DNA, 23 bp, Homo sapiens
aaggatatgaaactctacattta

SEQ ID NO: 6574623 - DNA, 14 bp, Homo sapiens
aaggatatgcatta

SEQ ID NO: 6574624 - DNA, 22 bp, Homo sapiens
aaggatattatctacctgttct

SEQ ID NO: 6574625 - DNA, 19 bp, Homo sapiens
aaggatatttaagaaaata

SEQ ID NO: 6574626 - DNA, 15 bp, Homo sapiens
aaggatcaattgtaa

SEQ ID NO: 6574627 - DNA, 17 bp, Homo sapiens
aaggatcaccccagccc

SEQ ID NO: 6574628 - DNA, 15 bp, Homo sapiens
aaggatcagaagtat

SEQ ID NO: 6574629 - DNA, 23 bp, Homo sapiens
aaggatccagagacttggggacc

SEQ ID NO: 6574630 - DNA, 19 bp, Homo sapiens
aaggatccagatagcctag

SEQ ID NO: 6574631 - DNA, 20 bp, Homo sapiens
aaggatccaggaatatgaca

SEQ ID NO: 6574632 - DNA, 13 bp, Homo sapiens
aaggatccatctt

SEQ ID NO: 6574633 - DNA, 16 bp, Homo sapiens
aaggatccggaaagaa

SEQ ID NO: 6574634 - DNA, 17 bp, Homo sapiens
aaggatccggaaagaag

SEQ ID NO: 6574635 - DNA, 12 bp, Homo sapiens
aaggatcctgag

SEQ ID NO: 6574636 - DNA, 22 bp, Homo sapiens
aaggatcctgagccagatttca

SEQ ID NO: 6574637 - DNA, 19 bp, Homo sapiens
aaggatcctggaaccactg

SEQ ID NO: 6574638 - DNA, 18 bp, Homo sapiens
aaggatccttccctgtaa

SEQ ID NO: 6574639 - DNA, 15 bp, Homo sapiens
aaggatccttttcct

SEQ ID NO: 6574640 - DNA, 17 bp, Homo sapiens
aaggatcggactctgcc

SEQ ID NO: 6574641 - DNA, 12 bp, Homo sapiens
aaggatctgctg

SEQ ID NO: 6574642 - DNA, 20 bp, Homo sapiens
aaggatctgctgaggcccag

SEQ ID NO: 6574643 - DNA, 22 bp, Homo sapiens
aaggatctgtgattggctggtt

SEQ ID NO: 6574644 - DNA, 21 bp, Homo sapiens
aaggatctgtttttaaaaatc

SEQ ID NO: 6574645 - DNA, 23 bp, Homo sapiens
aaggatctgtttttaaaaatcat

SEQ ID NO: 6574646 - DNA, 12 bp, Homo sapiens
aaggatcttttg

SEQ ID NO: 6574647 - DNA, 16 bp, Homo sapiens
aaggatcttttgtaaa

SEQ ID NO: 6574648 - DNA, 18 bp, Homo sapiens
aaggatcttttgtaaatg

SEQ ID NO: 6574649 - DNA, 14 bp, Homo sapiens
aaggatgaaagaaa

SEQ ID NO: 6574650 - DNA, 16 bp, Homo sapiens
aaggatgaaagacaaa

SEQ ID NO: 6574651 - DNA, 19 bp, Homo sapiens
aaggatgaagggcccgaga

SEQ ID NO: 6574652 - DNA, 15 bp, Homo sapiens
aaggatgaccacacc

SEQ ID NO: 6574653 - DNA, 12 bp, Homo sapiens
aaggatgacttt

SEQ ID NO: 6574654 - DNA, 17 bp, Homo sapiens
aaggatgacttttttat

SEQ ID NO: 6574655 - DNA, 13 bp, Homo sapiens
aaggatgagcaga

SEQ ID NO: 6574656 - DNA, 11 bp, Homo sapiens
aaggatgaggg

SEQ ID NO: 6574657 - DNA, 15 bp, Homo sapiens
aaggatgagggttca

SEQ ID NO: 6574658 - DNA, 22 bp, Homo sapiens
aaggatgatcgcccgataaaga

SEQ ID NO: 6574659 - DNA, 17 bp, Homo sapiens
aaggatgatggaaaaat

SEQ ID NO: 6574660 - DNA, 22 bp, Homo sapiens
aaggatgcacagagttgttaca

SEQ ID NO: 6574661 - DNA, 15 bp, Homo sapiens
aaggatgcacatata

SEQ ID NO: 6574662 - DNA, 22 bp, Homo sapiens
aaggatgccaagaagtttaagg

SEQ ID NO: 6574663 - DNA, 14 bp, Homo sapiens
aaggatgcccaaag

SEQ ID NO: 6574664 - DNA, 19 bp, Homo sapiens
aaggatgcccaaagatgca

SEQ ID NO: 6574665 - DNA, 18 bp, Homo sapiens
aaggatgctctttccctt

SEQ ID NO: 6574666 - DNA, 15 bp, Homo sapiens
aaggatgcttgtaca

SEQ ID NO: 6574667 - DNA, 16 bp, Homo sapiens
aaggatgcttgtacat

SEQ ID NO: 6574668 - DNA, 17 bp, Homo sapiens
aaggatgcttgtacata

SEQ ID NO: 6574669 - DNA, 19 bp, Homo sapiens
aaggatgcttgtacataat

SEQ ID NO: 6574670 - DNA, 16 bp, Homo sapiens
aaggatggaagaaaga

SEQ ID NO: 6574671 - DNA, 12 bp, Homo sapiens
aaggatggatgg

SEQ ID NO: 6574672 - DNA, 16 bp, Homo sapiens
aaggatggatggcacc

SEQ ID NO: 6574673 - DNA, 20 bp, Homo sapiens
aaggatggatggcaccctgg

SEQ ID NO: 6574674 - DNA, 21 bp, Homo sapiens
aaggatggatggcaccctgga

SEQ ID NO: 6574675 - DNA, 21 bp, Homo sapiens
aaggatggcagcctcagggct

SEQ ID NO: 6574676 - DNA, 19 bp, Homo sapiens
aaggatggtggggccccca

SEQ ID NO: 6574677 - DNA, 17 bp, Homo sapiens
aaggatgtaaacagtgc

SEQ ID NO: 6574678 - DNA, 19 bp, Homo sapiens
aaggatgtaaacagtgcct

SEQ ID NO: 6574679 - DNA, 16 bp, Homo sapiens
aaggatgtacatttcc

SEQ ID NO: 6574680 - DNA, 22 bp, Homo sapiens
aaggatgtagcttttcaccttt

SEQ ID NO: 6574681 - DNA, 14 bp, Homo sapiens
aaggatgtcacagg

SEQ ID NO: 6574682 - DNA, 15 bp, Homo sapiens
aaggatgtcacaggg

SEQ ID NO: 6574683 - DNA, 16 bp, Homo sapiens
aaggatgtcacagggc

SEQ ID NO: 6574684 - DNA, 17 bp, Homo sapiens
aaggatgtcacagggcc

SEQ ID NO: 6574685 - DNA, 23 bp, Homo sapiens
aaggatgtcgggagcatcctgct

SEQ ID NO: 6574686 - DNA, 17 bp, Homo sapiens
aaggatgtgattgtgga

SEQ ID NO: 6574687 - DNA, 15 bp, Homo sapiens
aaggatgttggtgtt

SEQ ID NO: 6574688 - DNA, 16 bp, Homo sapiens
aaggatgttgttatga

SEQ ID NO: 6574689 - DNA, 13 bp, Homo sapiens
aaggatgttttta

SEQ ID NO: 6574690 - DNA, 20 bp, Homo sapiens
aaggattaagatacactcct

SEQ ID NO: 6574691 - DNA, 22 bp, Homo sapiens
aaggattaattgctgcaaggac

SEQ ID NO: 6574692 - DNA, 13 bp, Homo sapiens
aaggattataaac

SEQ ID NO: 6574693 - DNA, 16 bp, Homo sapiens
aaggattcatgtggaa

SEQ ID NO: 6574694 - DNA, 15 bp, Homo sapiens
aaggattctgcagaa

SEQ ID NO: 6574695 - DNA, 22 bp, Homo sapiens
aaggattctgctggcctctgcg

SEQ ID NO: 6574696 - DNA, 23 bp, Homo sapiens
aaggattctgttctgcaactcca

SEQ ID NO: 6574697 - DNA, 14 bp, Homo sapiens
aaggattcttctga

SEQ ID NO: 6574698 - DNA, 17 bp, Homo sapiens
aaggattcttttttcaa

SEQ ID NO: 6574699 - DNA, 20 bp, Homo sapiens
aaggattcttttttcaatgt

SEQ ID NO: 6574700 - DNA, 13 bp, Homo sapiens
aaggattgaaaat

SEQ ID NO: 6574701 - DNA, 14 bp, Homo sapiens
aaggattgaaaatt

SEQ ID NO: 6574702 - DNA, 22 bp, Homo sapiens
aaggattgcctttgtagttaat

SEQ ID NO: 6574703 - DNA, 23 bp, Homo sapiens
aaggattgtaaaaaaaaatgcct

SEQ ID NO: 6574704 - DNA, 14 bp, Homo sapiens
aaggattgtgatat

SEQ ID NO: 6574705 - DNA, 17 bp, Homo sapiens
aaggattgtgatatttt

SEQ ID NO: 6574706 - DNA, 22 bp, Homo sapiens
aaggattgtttctggtgactgc

SEQ ID NO: 6574707 - DNA, 16 bp, Homo sapiens
aaggatttgaaaacac

SEQ ID NO: 6574708 - DNA, 22 bp, Homo sapiens
aaggatttgaaaacaccaagag

SEQ ID NO: 6574709 - DNA, 15 bp, Homo sapiens
aaggatttgatgctt

SEQ ID NO: 6574710 - DNA, 22 bp, Homo sapiens
aaggatttgatgcttttctctc

SEQ ID NO: 6574711 - DNA, 13 bp, Homo sapiens
aaggattttatgc

SEQ ID NO: 6574712 - DNA, 21 bp, Homo sapiens
ttctgaagcttatgtttctta

SEQ ID NO: 6574713 - DNA, 16 bp, Homo sapiens
ttctgaaggaagagaa

SEQ ID NO: 6574714 - DNA, 20 bp, Homo sapiens
ttctgaaggggaaaacctca

SEQ ID NO: 6574715 - DNA, 22 bp, Homo sapiens
ttctgaaggggaaaacctcagt

SEQ ID NO: 6574716 - DNA, 15 bp, Homo sapiens
ttctgaagtctgagc

SEQ ID NO: 6574717 - DNA, 20 bp, Homo sapiens
ttctgaagtctgagcccatt

SEQ ID NO: 6574718 - DNA, 18 bp, Homo sapiens
ttctgaagtgcttgtata

SEQ ID NO: 6574719 - DNA, 19 bp, Homo sapiens
ttctgaagtgtgtccatcc

SEQ ID NO: 6574720 - DNA, 21 bp, Homo sapiens
ttctgaagtgtgtccatcctg

SEQ ID NO: 6574721 - DNA, 19 bp, Homo sapiens
ttctgaagttatatttcct

SEQ ID NO: 6574722 - DNA, 18 bp, Homo sapiens
ttctgaagtttcctatga

SEQ ID NO: 6574723 - DNA, 14 bp, Homo sapiens
ttctgaataaaaaa

SEQ ID NO: 6574724 - DNA, 21 bp, Homo sapiens
ttctgaataaaaaagattcta

SEQ ID NO: 6574725 - DNA, 22 bp, Homo sapiens
ttctgaataaaaaagattctac

SEQ ID NO: 6574726 - DNA, 16 bp, Homo sapiens
ttctgaataaagcaat

SEQ ID NO: 6574727 - DNA, 17 bp, Homo sapiens
ttctgaataacttgaag

SEQ ID NO: 6574728 - DNA, 16 bp, Homo sapiens
ttctgaataatttctt

SEQ ID NO: 6574729 - DNA, 15 bp, Homo sapiens
ttctgaatatgctgc

SEQ ID NO: 6574730 - DNA, 20 bp, Homo sapiens
ttctgaatctagagaacagt

SEQ ID NO: 6574731 - DNA, 14 bp, Homo sapiens
ttctgaatctgaaa

SEQ ID NO: 6574732 - DNA, 16 bp, Homo sapiens
ttctgaatcttctgaa

SEQ ID NO: 6574733 - DNA, 16 bp, Homo sapiens
ttctgaatgctgctac

SEQ ID NO: 6574734 - DNA, 15 bp, Homo sapiens
ttctgaatgcttcta

SEQ ID NO: 6574735 - DNA, 23 bp, Homo sapiens
ttctgaatgtttgtgtctgtggt

SEQ ID NO: 6574736 - DNA, 14 bp, Homo sapiens
ttctgaattattat

SEQ ID NO: 6574737 - DNA, 17 bp, Homo sapiens
ttctgaattcaaagctt

SEQ ID NO: 6574738 - DNA, 19 bp, Homo sapiens
ttctgaattcaaagcttgt

SEQ ID NO: 6574739 - DNA, 22 bp, Homo sapiens
ttctgaattcaaagcttgtgaa

SEQ ID NO: 6574740 - DNA, 13 bp, Homo sapiens
ttctgaattcata

SEQ ID NO: 6574741 - DNA, 15 bp, Homo sapiens
ttctgaattggaagg

SEQ ID NO: 6574742 - DNA, 16 bp, Homo sapiens
ttctgaattgtccttt

SEQ ID NO: 6574743 - DNA, 19 bp, Homo sapiens
ttctgacaaaaagtttcca

SEQ ID NO: 6574744 - DNA, 14 bp, Homo sapiens
ttctgacaaactgt

SEQ ID NO: 6574745 - DNA, 20 bp, Homo sapiens
ttctgacaaactgtgtacat

SEQ ID NO: 6574746 - DNA, 19 bp, Homo sapiens
ttctgacaaaggtggtaaa

SEQ ID NO: 6574747 - DNA, 14 bp, Homo sapiens
ttctgacagcccaa

SEQ ID NO: 6574748 - DNA, 13 bp, Homo sapiens
ttctgacagcctc

SEQ ID NO: 6574749 - DNA, 15 bp, Homo sapiens
ttctgacagtgtttt

SEQ ID NO: 6574750 - DNA, 18 bp, Homo sapiens
ttctgacagtttttctgt

SEQ ID NO: 6574751 - DNA, 19 bp, Homo sapiens
ttctgacatcaaaacttgg

SEQ ID NO: 6574752 - DNA, 15 bp, Homo sapiens
ttctgacatccacat

SEQ ID NO: 6574753 - DNA, 16 bp, Homo sapiens
ttctgacatgcattgt

SEQ ID NO: 6574754 - DNA, 20 bp, Homo sapiens
ttctgacattaacagttttc

SEQ ID NO: 6574755 - DNA, 23 bp, Homo sapiens
ttctgacattaacagttttccat

SEQ ID NO: 6574756 - DNA, 18 bp, Homo sapiens
ttctgacatttatatttg

SEQ ID NO: 6574757 - DNA, 22 bp, Homo sapiens
ttctgacatttatatttgtgta

SEQ ID NO: 6574758 - DNA, 13 bp, Homo sapiens
ttctgaccaaaat

SEQ ID NO: 6574759 - DNA, 14 bp, Homo sapiens
ttctgaccaaaatg

SEQ ID NO: 6574760 - DNA, 19 bp, Homo sapiens
ttctgaccaaaatgtgttt

SEQ ID NO: 6574761 - DNA, 13 bp, Homo sapiens
ttctgaccacact

SEQ ID NO: 6574762 - DNA, 14 bp, Homo sapiens
ttctgacccatgct

SEQ ID NO: 6574763 - DNA, 15 bp, Homo sapiens
ttctgacctcagcat

SEQ ID NO: 6574764 - DNA, 15 bp, Homo sapiens
ttctgacctgggctg

SEQ ID NO: 6574765 - DNA, 16 bp, Homo sapiens
ttctgacgcagcctga

SEQ ID NO: 6574766 - DNA, 17 bp, Homo sapiens
ttctgacgcagcctgag

SEQ ID NO: 6574767 - DNA, 18 bp, Homo sapiens
ttctgactcggtttctcc

SEQ ID NO: 6574768 - DNA, 15 bp, Homo sapiens
ttctgactctgagct

SEQ ID NO: 6574769 - DNA, 13 bp, Homo sapiens
ttctgactgcccc

SEQ ID NO: 6574770 - DNA, 13 bp, Homo sapiens
ttctgactgctga

SEQ ID NO: 6574771 - DNA, 13 bp, Homo sapiens
ttctgactgtcca

SEQ ID NO: 6574772 - DNA, 14 bp, Homo sapiens
ttctgactgtccct

SEQ ID NO: 6574773 - DNA, 16 bp, Homo sapiens
ttctgactgtccctgc

SEQ ID NO: 6574774 - DNA, 14 bp, Homo sapiens
ttctgactgtttat

SEQ ID NO: 6574775 - DNA, 23 bp, Homo sapiens
ttctgactgtttatttaaggatg

SEQ ID NO: 6574776 - DNA, 15 bp, Homo sapiens
ttctgacttatgaat

SEQ ID NO: 6574777 - DNA, 12 bp, Homo sapiens
ttctgacttgac

SEQ ID NO: 6574778 - DNA, 16 bp, Homo sapiens
ttctgagaaagactat

SEQ ID NO: 6574779 - DNA, 19 bp, Homo sapiens
ttctgagaactgactttct

SEQ ID NO: 6574780 - DNA, 19 bp, Homo sapiens
ttctgagaagcgctgccct

SEQ ID NO: 6574781 - DNA, 14 bp, Homo sapiens
ttctgagacagctt

SEQ ID NO: 6574782 - DNA, 15 bp, Homo sapiens
ttctgagaccacagt

SEQ ID NO: 6574783 - DNA, 15 bp, Homo sapiens
ttctgagacttggat

SEQ ID NO: 6574784 - DNA, 17 bp, Homo sapiens
ttctgagacttggatta

SEQ ID NO: 6574785 - DNA, 23 bp, Homo sapiens
ttctgagagttggctcaggcaga

SEQ ID NO: 6574786 - DNA, 16 bp, Homo sapiens
ttctgagataagtgtt

SEQ ID NO: 6574787 - DNA, 16 bp, Homo sapiens
ttctgagatctgttga

SEQ ID NO: 6574788 - DNA, 19 bp, Homo sapiens
ttctgagattcaatattga

SEQ ID NO: 6574789 - DNA, 21 bp, Homo sapiens
ttctgagattcaatattgaat

SEQ ID NO: 6574790 - DNA, 15 bp, Homo sapiens
ttctgagattttagt

SEQ ID NO: 6574791 - DNA, 15 bp, Homo sapiens
ttctgagcaaagcat

SEQ ID NO: 6574792 - DNA, 13 bp, Homo sapiens
ttctgagcagttt

SEQ ID NO: 6574793 - DNA, 21 bp, Homo sapiens
ttctgagcagttttccaggag

SEQ ID NO: 6574794 - DNA, 15 bp, Homo sapiens
ttctgagcattcgct

SEQ ID NO: 6574795 - DNA, 14 bp, Homo sapiens
ttctgagcatttaa

SEQ ID NO: 6574796 - DNA, 21 bp, Homo sapiens
ttctgagcccgggctgcctgg

SEQ ID NO: 6574797 - DNA, 22 bp, Homo sapiens
ttctgagcccggtaagagcaaa

SEQ ID NO: 6574798 - DNA, 15 bp, Homo sapiens
ttctgagctccacct

SEQ ID NO: 6574799 - DNA, 17 bp, Homo sapiens
ttctgagctccacctct

SEQ ID NO: 6574800 - DNA, 15 bp, Homo sapiens
ttctgagctcctgtc

SEQ ID NO: 6574801 - DNA, 19 bp, Homo sapiens
ttctgagctcctgtcccct

SEQ ID NO: 6574802 - DNA, 13 bp, Homo sapiens
ttctgagctgggc

SEQ ID NO: 6574803 - DNA, 21 bp, Homo sapiens
ttctgaggacattccaagaca

SEQ ID NO: 6574804 - DNA, 20 bp, Homo sapiens
ttctgaggaggaaataaatt

SEQ ID NO: 6574805 - DNA, 16 bp, Homo sapiens
ttctgaggccagaaag

SEQ ID NO: 6574806 - DNA, 20 bp, Homo sapiens
ttctgagggcccgtgtaaat

SEQ ID NO: 6574807 - DNA, 13 bp, Homo sapiens
ttctgagtacaga

SEQ ID NO: 6574808 - DNA, 22 bp, Homo sapiens
ttctgagtacttgatttcaggt

SEQ ID NO: 6574809 - DNA, 17 bp, Homo sapiens
ttctgagtgaatgttaa

SEQ ID NO: 6574810 - DNA, 23 bp, Homo sapiens
ttctgagtgacatgggtgtgcca

SEQ ID NO: 6574811 - DNA, 16 bp, Homo sapiens
ttctgagtgccttctg

SEQ ID NO: 6574812 - DNA, 20 bp, Homo sapiens
ttctgagtgtttttactaca

SEQ ID NO: 6574813 - DNA, 15 bp, Homo sapiens
ttctgagttctggtg

SEQ ID NO: 6574814 - DNA, 23 bp, Homo sapiens
ttctgagtttcattctcctgcct

SEQ ID NO: 6574815 - DNA, 16 bp, Homo sapiens
ttctgagttttaccaa

SEQ ID NO: 6574816 - DNA, 22 bp, Homo sapiens
ttctgataactagatggtgctg

SEQ ID NO: 6574817 - DNA, 16 bp, Homo sapiens
ttctgataatgaaaat

SEQ ID NO: 6574818 - DNA, 20 bp, Homo sapiens
ttctgataatttattgtctt

SEQ ID NO: 6574819 - DNA, 22 bp, Homo sapiens
ttctgataatttattgtcttta

SEQ ID NO: 6574820 - DNA, 13 bp, Homo sapiens
ttctgatagagga

SEQ ID NO: 6574821 - DNA, 21 bp, Homo sapiens
ttctgatagaggaagcctgat

SEQ ID NO: 6574822 - DNA, 15 bp, Homo sapiens
ttctgataggagggg

SEQ ID NO: 6574823 - DNA, 17 bp, Homo sapiens
ttctgatagtagtcttt

SEQ ID NO: 6574824 - DNA, 22 bp, Homo sapiens
ttctgatatgcagttttcctta

SEQ ID NO: 6574825 - DNA, 14 bp, Homo sapiens
ttctgatcaaggcc

SEQ ID NO: 6574826 - DNA, 22 bp, Homo sapiens
ttctgatcaaggccttattgga

SEQ ID NO: 6574827 - DNA, 19 bp, Homo sapiens
ttctgatcactgaaataaa

SEQ ID NO: 6574828 - DNA, 21 bp, Homo sapiens
ttctgatcagaggtgtacact

SEQ ID NO: 6574829 - DNA, 20 bp, Homo sapiens
ttctgatcgtctcggcccct

SEQ ID NO: 6574830 - DNA, 14 bp, Homo sapiens
ttctgatgaaatgt

SEQ ID NO: 6574831 - DNA, 13 bp, Homo sapiens
ttctgatgaatct

SEQ ID NO: 6574832 - DNA, 15 bp, Homo sapiens
ttctgatgaatcttg

SEQ ID NO: 6574833 - DNA, 23 bp, Homo sapiens
ttctgatgacgcctgtctgtgtg

SEQ ID NO: 6574834 - DNA, 22 bp, Homo sapiens
ttctgatgatgtcggtcttgca

SEQ ID NO: 6574835 - DNA, 22 bp, Homo sapiens
ttctgatgggtcccaaaagctt

SEQ ID NO: 6574836 - DNA, 21 bp, Homo sapiens
ttctgatgtctctaaagcact

SEQ ID NO: 6574837 - DNA, 15 bp, Homo sapiens
ttctgatgttgcctt

SEQ ID NO: 6574838 - DNA, 12 bp, Homo sapiens
ttctgatgtttc

SEQ ID NO: 6574839 - DNA, 15 bp, Homo sapiens
ttctgatgtttctgt

SEQ ID NO: 6574840 - DNA, 20 bp, Homo sapiens
ttctgattatgtaagcattt

SEQ ID NO: 6574841 - DNA, 22 bp, Homo sapiens
ttctgattatgtaagcatttgt

SEQ ID NO: 6574842 - DNA, 22 bp, Homo sapiens
ttctgattattacaacaagcaa

SEQ ID NO: 6574843 - DNA, 20 bp, Homo sapiens
ttctgattcccctccaccaa

SEQ ID NO: 6574844 - DNA, 14 bp, Homo sapiens
ttctgattctgatt

SEQ ID NO: 6574845 - DNA, 11 bp, Homo sapiens
ttctgattctt

SEQ ID NO: 6574846 - DNA, 21 bp, Homo sapiens
ttctgattgtaacgttgctgt

SEQ ID NO: 6574847 - DNA, 18 bp, Homo sapiens
ttctgattgtgttgaaga

SEQ ID NO: 6574848 - DNA, 13 bp, Homo sapiens
ttctgatttcttt

SEQ ID NO: 6574849 - DNA, 20 bp, Homo sapiens
ttctgatttcttttcaccat

SEQ ID NO: 6574850 - DNA, 17 bp, Homo sapiens
ttctgatttgtattaaa

SEQ ID NO: 6574851 - DNA, 24 bp, Homo sapiens
ttctgattttaggagctaaggctc

SEQ ID NO: 6574852 - DNA, 14 bp, Homo sapiens
ttctgattttatgt

SEQ ID NO: 6574853 - DNA, 16 bp, Homo sapiens
ttctgattttatgtaa

SEQ ID NO: 6574854 - DNA, 18 bp, Homo sapiens
ttctgatttttaatttgt

SEQ ID NO: 6574855 - DNA, 19 bp, Homo sapiens
ttctgcaaaaatatttata

SEQ ID NO: 6574856 - DNA, 13 bp, Homo sapiens
ttctgcaaaatag

SEQ ID NO: 6574857 - DNA, 22 bp, Homo sapiens
ttctgcaaagtgtatgtgacca

SEQ ID NO: 6574858 - DNA, 15 bp, Homo sapiens
ttctgcaaatagaaa

SEQ ID NO: 6574859 - DNA, 19 bp, Homo sapiens
ttctgcaaatagaaaacag

SEQ ID NO: 6574860 - DNA, 15 bp, Homo sapiens
ttctgcaactagcca

SEQ ID NO: 6574861 - DNA, 17 bp, Homo sapiens
ttctgcaactagccaag

SEQ ID NO: 6574862 - DNA, 20 bp, Homo sapiens
ttctgcaactagccaaggct

SEQ ID NO: 6574863 - DNA, 17 bp, Homo sapiens
ttctgcaactccatcct

SEQ ID NO: 6574864 - DNA, 16 bp, Homo sapiens
ttctgcaagaattaaa

SEQ ID NO: 6574865 - DNA, 21 bp, Homo sapiens
ttctgcaagaattaaaactga

SEQ ID NO: 6574866 - DNA, 23 bp, Homo sapiens
ttctgcaagaattaaaactgagt

SEQ ID NO: 6574867 - DNA, 22 bp, Homo sapiens
ttctgcaagcacatctgcattt

SEQ ID NO: 6574868 - DNA, 18 bp, Homo sapiens
ttctgcaagcctcatgcc

SEQ ID NO: 6574869 - DNA, 13 bp, Homo sapiens
ttctgcaagcctg

SEQ ID NO: 6574870 - DNA, 16 bp, Homo sapiens
ttctgcaataacagtt

SEQ ID NO: 6574871 - DNA, 15 bp, Homo sapiens
ttctgcacacagcac

SEQ ID NO: 6574872 - DNA, 17 bp, Homo sapiens
ttctgcacagcttttcc

SEQ ID NO: 6574873 - DNA, 20 bp, Homo sapiens
ttctgcacagcttttccaaa

SEQ ID NO: 6574874 - DNA, 13 bp, Homo sapiens
ttctgcacataca

SEQ ID NO: 6574875 - DNA, 15 bp, Homo sapiens
ttctgcacatacaga

SEQ ID NO: 6574876 - DNA, 13 bp, Homo sapiens
ttctgcacccaga

SEQ ID NO: 6574877 - DNA, 17 bp, Homo sapiens
ttctgcacccagccaaa

SEQ ID NO: 6574878 - DNA, 17 bp, Homo sapiens
ttctgcaccttgccagg

SEQ ID NO: 6574879 - DNA, 16 bp, Homo sapiens
ttctgcactccagata

SEQ ID NO: 6574880 - DNA, 14 bp, Homo sapiens
ttctgcactgaaaa

SEQ ID NO: 6574881 - DNA, 14 bp, Homo sapiens
ttctgcactgttgc

SEQ ID NO: 6574882 - DNA, 17 bp, Homo sapiens
ttctgcactttgacaca

SEQ ID NO: 6574883 - DNA, 13 bp, Homo sapiens
ttctgcagaaaaa

SEQ ID NO: 6574884 - DNA, 14 bp, Homo sapiens
ttctgcagaaaatt

SEQ ID NO: 6574885 - DNA, 15 bp, Homo sapiens
ttctgcagaagagga

SEQ ID NO: 6574886 - DNA, 21 bp, Homo sapiens
ttctgcagacgtctgccttgg

SEQ ID NO: 6574887 - DNA, 12 bp, Homo sapiens
ttctgcagaggc

SEQ ID NO: 6574888 - DNA, 13 bp, Homo sapiens
ttctgcagaggca

SEQ ID NO: 6574889 - DNA, 16 bp, Homo sapiens
ttctgcagcaactccc

SEQ ID NO: 6574890 - DNA, 17 bp, Homo sapiens
ttctgcagcaactccca

SEQ ID NO: 6574891 - DNA, 23 bp, Homo sapiens
ttctgcagcatgacctgtgacca

SEQ ID NO: 6574892 - DNA, 17 bp, Homo sapiens
ttctgcagcctcggcct

SEQ ID NO: 6574893 - DNA, 18 bp, Homo sapiens
ttctgcagcggcagagca

SEQ ID NO: 6574894 - DNA, 12 bp, Homo sapiens
ttctgcagctgt

SEQ ID NO: 6574895 - DNA, 15 bp, Homo sapiens
ttctgcagctgtttc

SEQ ID NO: 6574896 - DNA, 15 bp, Homo sapiens
ttctgcagctgtttt

SEQ ID NO: 6574897 - DNA, 16 bp, Homo sapiens
ttctgcagctgtttta

SEQ ID NO: 6574898 - DNA, 18 bp, Homo sapiens
ttctgcagtaaatctttt

SEQ ID NO: 6574899 - DNA, 22 bp, Homo sapiens
ttctgcagtaaatcttttacaa

SEQ ID NO: 6574900 - DNA, 20 bp, Homo sapiens
ttctgcagtagtctctgtgc

SEQ ID NO: 6574901 - DNA, 14 bp, Homo sapiens
ttctgcagtattct

SEQ ID NO: 6574902 - DNA, 16 bp, Homo sapiens
ttctgcagtattctgt

SEQ ID NO: 6574903 - DNA, 18 bp, Homo sapiens
ttctgcagtattctgtag

SEQ ID NO: 6574904 - DNA, 15 bp, Homo sapiens
ttctgcagtcagact

SEQ ID NO: 6574905 - DNA, 14 bp, Homo sapiens
ttctgcagttctca

SEQ ID NO: 6574906 - DNA, 22 bp, Homo sapiens
ttctgcatactaacctattttt

SEQ ID NO: 6574907 - DNA, 15 bp, Homo sapiens
ttctgcatcaaagga

SEQ ID NO: 6574908 - DNA, 18 bp, Homo sapiens
ttctgcatcagttcactg

SEQ ID NO: 6574909 - DNA, 13 bp, Homo sapiens
ttctgcatgccct

SEQ ID NO: 6574910 - DNA, 18 bp, Homo sapiens
ttctgcatggattcagca

SEQ ID NO: 6574911 - DNA, 14 bp, Homo sapiens
ttctgcatgtacta

SEQ ID NO: 6574912 - DNA, 16 bp, Homo sapiens
ttctgcatgtactagt

SEQ ID NO: 6574913 - DNA, 13 bp, Homo sapiens
ttctgcattacta

SEQ ID NO: 6574914 - DNA, 19 bp, Homo sapiens
ttctgcattcatttttata

SEQ ID NO: 6574915 - DNA, 14 bp, Homo sapiens
ttctgcatttagct

SEQ ID NO: 6574916 - DNA, 16 bp, Homo sapiens
ttctgcatttggtaaa

SEQ ID NO: 6574917 - DNA, 20 bp, Homo sapiens
ttctgccaacgcctcctgtc

SEQ ID NO: 6574918 - DNA, 14 bp, Homo sapiens
ttctgccacataaa

SEQ ID NO: 6574919 - DNA, 17 bp, Homo sapiens
ttctgccacccctaaac

SEQ ID NO: 6574920 - DNA, 21 bp, Homo sapiens
ttctgccaccctgctgagtct

SEQ ID NO: 6574921 - DNA, 16 bp, Homo sapiens
ttctgccactgaggag

SEQ ID NO: 6574922 - DNA, 17 bp, Homo sapiens
ttctgccacttcccagg

SEQ ID NO: 6574923 - DNA, 22 bp, Homo sapiens
ttctgccacttgcactgtgctt

SEQ ID NO: 6574924 - DNA, 22 bp, Homo sapiens
ttctgccagatgtcctaatggt

SEQ ID NO: 6574925 - DNA, 15 bp, Homo sapiens
ttctgccagggagct

SEQ ID NO: 6574926 - DNA, 15 bp, Homo sapiens
ttctgccatattctg

SEQ ID NO: 6574927 - DNA, 19 bp, Homo sapiens
ttctgccatctagccagcc

SEQ ID NO: 6574928 - DNA, 17 bp, Homo sapiens
ttctgccatgggagagt

SEQ ID NO: 6574929 - DNA, 16 bp, Homo sapiens
ttctgccatttcatgt

SEQ ID NO: 6574930 - DNA, 18 bp, Homo sapiens
ttctgcccaaatcccctc

SEQ ID NO: 6574931 - DNA, 19 bp, Homo sapiens
ttctgcccacattggaccc

SEQ ID NO: 6574932 - DNA, 21 bp, Homo sapiens
ttctgcccaccccgcctctgg

SEQ ID NO: 6574933 - DNA, 14 bp, Homo sapiens
ttctgccccagagt

SEQ ID NO: 6574934 - DNA, 13 bp, Homo sapiens
ttctgcccccagc

SEQ ID NO: 6574935 - DNA, 17 bp, Homo sapiens
ttctgccccccagggct

SEQ ID NO: 6574936 - DNA, 16 bp, Homo sapiens
ttctgccccctcaggg

SEQ ID NO: 6574937 - DNA, 16 bp, Homo sapiens
ttctgccccctgcaga

SEQ ID NO: 6574938 - DNA, 23 bp, Homo sapiens
ttctgcccctctactgttgcaca

SEQ ID NO: 6574939 - DNA, 19 bp, Homo sapiens
ttctgccctgagccctcca

SEQ ID NO: 6574940 - DNA, 22 bp, Homo sapiens
ttctgccctgccctcagcctgt

SEQ ID NO: 6574941 - DNA, 16 bp, Homo sapiens
ttctgccctgcctgag

SEQ ID NO: 6574942 - DNA, 17 bp, Homo sapiens
ttctgccctgcctgagg

SEQ ID NO: 6574943 - DNA, 18 bp, Homo sapiens
ttctgccctgcctgagga

SEQ ID NO: 6574944 - DNA, 18 bp, Homo sapiens
ttctgccctggctgctgc

SEQ ID NO: 6574945 - DNA, 19 bp, Homo sapiens
ttctgccctggctgctgcc

SEQ ID NO: 6574946 - DNA, 23 bp, Homo sapiens
ttctgccctgtgggaccccaggc

SEQ ID NO: 6574947 - DNA, 12 bp, Homo sapiens
ttctgcccttct

SEQ ID NO: 6574948 - DNA, 22 bp, Homo sapiens
ttctgccctttcctaggcccag

SEQ ID NO: 6574949 - DNA, 22 bp, Homo sapiens
ttctgccgacccctagttccct

SEQ ID NO: 6574950 - DNA, 14 bp, Homo sapiens
ttctgccgcagccc

SEQ ID NO: 6574951 - DNA, 20 bp, Homo sapiens
ttctgccgctgtcaaggccg

SEQ ID NO: 6574952 - DNA, 16 bp, Homo sapiens
ttctgccgtgtgccct

SEQ ID NO: 6574953 - DNA, 18 bp, Homo sapiens
ttctgcctaacagaaatt

SEQ ID NO: 6574954 - DNA, 16 bp, Homo sapiens
ttctgcctataaattt

SEQ ID NO: 6574955 - DNA, 17 bp, Homo sapiens
ttctgcctataaattta

SEQ ID NO: 6574956 - DNA, 21 bp, Homo sapiens
ttctgcctataaatttactct

SEQ ID NO: 6574957 - DNA, 14 bp, Homo sapiens
ttctgcctcagcct

SEQ ID NO: 6574958 - DNA, 19 bp, Homo sapiens
ttctgcctcagcctcctga

SEQ ID NO: 6574959 - DNA, 14 bp, Homo sapiens
ttctgcctcctggc

SEQ ID NO: 6574960 - DNA, 14 bp, Homo sapiens
ttctgcctccttta

SEQ ID NO: 6574961 - DNA, 14 bp, Homo sapiens
ttctgcctctgagg

SEQ ID NO: 6574962 - DNA, 14 bp, Homo sapiens
ttctgcctgagatt

SEQ ID NO: 6574963 - DNA, 17 bp, Homo sapiens
ttctgcctgagattctt

SEQ ID NO: 6574964 - DNA, 18 bp, Homo sapiens
ttctgcctgagattcttt

SEQ ID NO: 6574965 - DNA, 19 bp, Homo sapiens
ttctgcctgccagctgcac

SEQ ID NO: 6574966 - DNA, 17 bp, Homo sapiens
ttctgcctgcccaggcc

SEQ ID NO: 6574967 - DNA, 18 bp, Homo sapiens
ttctgcctgcccaggccc

SEQ ID NO: 6574968 - DNA, 16 bp, Homo sapiens
ttctgcctgcctggga

SEQ ID NO: 6574969 - DNA, 12 bp, Homo sapiens
ttctgcctgctc

SEQ ID NO: 6574970 - DNA, 13 bp, Homo sapiens
ttctgcctgttat

SEQ ID NO: 6574971 - DNA, 14 bp, Homo sapiens
ttctgcctgttata

SEQ ID NO: 6574972 - DNA, 24 bp, Homo sapiens
ttctgcctgttataactctgcact

SEQ ID NO: 6574973 - DNA, 20 bp, Homo sapiens
ttctgccttggattcctaga

SEQ ID NO: 6574974 - DNA, 15 bp, Homo sapiens
ttctgccttggcctc

SEQ ID NO: 6574975 - DNA, 15 bp, Homo sapiens
ttctgcctttccccc

SEQ ID NO: 6574976 - DNA, 22 bp, Homo sapiens
ttctgcctttcccccctcacac

SEQ ID NO: 6574977 - DNA, 23 bp, Homo sapiens
ttctgcctttgatgttacagatt

SEQ ID NO: 6574978 - DNA, 21 bp, Homo sapiens
ttctgcgccacttcctttgtg

SEQ ID NO: 6574979 - DNA, 18 bp, Homo sapiens
ttctgcgctgtgtacaat

SEQ ID NO: 6574980 - DNA, 23 bp, Homo sapiens
ttctgcgctgtgtacaatgtgag

SEQ ID NO: 6574981 - DNA, 19 bp, Homo sapiens
ttctgcggagcttctccag

SEQ ID NO: 6574982 - DNA, 20 bp, Homo sapiens
ttctgcggagcttctccagc

SEQ ID NO: 6574983 - DNA, 21 bp, Homo sapiens
ttctgcggagcttctccagcc

SEQ ID NO: 6574984 - DNA, 16 bp, Homo sapiens
ttctgctaaatttcaa

SEQ ID NO: 6574985 - DNA, 14 bp, Homo sapiens
ttctgctaatttat

SEQ ID NO: 6574986 - DNA, 16 bp, Homo sapiens
ttctgctacctcactg

SEQ ID NO: 6574987 - DNA, 21 bp, Homo sapiens
ttctgctactttgctgctatg

SEQ ID NO: 6574988 - DNA, 19 bp, Homo sapiens
ttctgctagagcagacagg

SEQ ID NO: 6574989 - DNA, 23 bp, Homo sapiens
ttctgctagagcagacaggcctg

SEQ ID NO: 6574990 - DNA, 14 bp, Homo sapiens
ttctgctatgtgtg

SEQ ID NO: 6574991 - DNA, 15 bp, Homo sapiens
ttctgctcacattcc

SEQ ID NO: 6574992 - DNA, 14 bp, Homo sapiens
ttctgctcagctct

SEQ ID NO: 6574993 - DNA, 15 bp, Homo sapiens
ttctgctcagctctg

SEQ ID NO: 6574994 - DNA, 19 bp, Homo sapiens
ttctgctcatcattctctg

SEQ ID NO: 6574995 - DNA, 20 bp, Homo sapiens
ttctgctcatcattctctgt

SEQ ID NO: 6574996 - DNA, 19 bp, Homo sapiens
ttctgctcattctaatgat

SEQ ID NO: 6574997 - DNA, 19 bp, Homo sapiens
ttctgctccaaattttcaa

SEQ ID NO: 6574998 - DNA, 13 bp, Homo sapiens
ttctgctccaccc

SEQ ID NO: 6574999 - DNA, 18 bp, Homo sapiens
ttctgctccacccttggc

SEQ ID NO: 6575000 - DNA, 20 bp, Homo sapiens
ttctgctccacccttggcct

SEQ ID NO: 6575001 - DNA, 15 bp, Homo sapiens
ttctgctccagacag

SEQ ID NO: 6575002 - DNA, 14 bp, Homo sapiens
ttctgctccagccc

SEQ ID NO: 6575003 - DNA, 15 bp, Homo sapiens
ttctgctccagcccc

SEQ ID NO: 6575004 - DNA, 16 bp, Homo sapiens
ttctgctcccacccca

SEQ ID NO: 6575005 - DNA, 18 bp, Homo sapiens
ttctgctcccaccccaga

SEQ ID NO: 6575006 - DNA, 11 bp, Homo sapiens
ttctgctcctc

SEQ ID NO: 6575007 - DNA, 13 bp, Homo sapiens
ttctgctcctctc

SEQ ID NO: 6575008 - DNA, 14 bp, Homo sapiens
ttctgctcctctcc

SEQ ID NO: 6575009 - DNA, 19 bp, Homo sapiens
ttctgctcctgaaaaatga

SEQ ID NO: 6575010 - DNA, 12 bp, Homo sapiens
ttctgctcctgc

SEQ ID NO: 6575011 - DNA, 18 bp, Homo sapiens
ttctgctcctgcttttct

SEQ ID NO: 6575012 - DNA, 15 bp, Homo sapiens
ttctgctctcagctc

SEQ ID NO: 6575013 - DNA, 14 bp, Homo sapiens
ttctgctctggaat

SEQ ID NO: 6575014 - DNA, 23 bp, Homo sapiens
ttctgctctggaataaagttgca

SEQ ID NO: 6575015 - DNA, 22 bp, Homo sapiens
ttctgctctggttgtttctgtt

SEQ ID NO: 6575016 - DNA, 21 bp, Homo sapiens
ttctgctcttccaaagctcct

SEQ ID NO: 6575017 - DNA, 17 bp, Homo sapiens
ttctgctcttttcctgg

SEQ ID NO: 6575018 - DNA, 21 bp, Homo sapiens
ttctgctgaaagactcgagaa

SEQ ID NO: 6575019 - DNA, 20 bp, Homo sapiens
ttctgctgaattttcacatg

SEQ ID NO: 6575020 - DNA, 13 bp, Homo sapiens
ttctgctgcccag

SEQ ID NO: 6575021 - DNA, 13 bp, Homo sapiens
ttctgctgcccct

SEQ ID NO: 6575022 - DNA, 17 bp, Homo sapiens
ttctgctgcccctgcag

SEQ ID NO: 6575023 - DNA, 12 bp, Homo sapiens
ttctgctgcttg

SEQ ID NO: 6575024 - DNA, 17 bp, Homo sapiens
ttctgctggcatcaaga

SEQ ID NO: 6575025 - DNA, 14 bp, Homo sapiens
ttctgctggccaag

SEQ ID NO: 6575026 - DNA, 14 bp, Homo sapiens
ttctgctggctgat

SEQ ID NO: 6575027 - DNA, 17 bp, Homo sapiens
ttctgctgtacagatat

SEQ ID NO: 6575028 - DNA, 18 bp, Homo sapiens
ttctgctgtctgggactc

SEQ ID NO: 6575029 - DNA, 23 bp, Homo sapiens
ttctgctgtggtctataaaataa

SEQ ID NO: 6575030 - DNA, 14 bp, Homo sapiens
ttctgctgttctct

SEQ ID NO: 6575031 - DNA, 14 bp, Homo sapiens
ttctgctgttcttc

SEQ ID NO: 6575032 - DNA, 17 bp, Homo sapiens
ttctgctgttcttcact

SEQ ID NO: 6575033 - DNA, 19 bp, Homo sapiens
ttctgctgttgactcttcc

SEQ ID NO: 6575034 - DNA, 14 bp, Homo sapiens
ttctgcttaggaga

SEQ ID NO: 6575035 - DNA, 19 bp, Homo sapiens
ttctgcttcaataaatctt

SEQ ID NO: 6575036 - DNA, 14 bp, Homo sapiens
ttctgcttcagcct

SEQ ID NO: 6575037 - DNA, 13 bp, Homo sapiens
ttctgcttcctta

SEQ ID NO: 6575038 - DNA, 17 bp, Homo sapiens
ttctgcttcgaagtatt

SEQ ID NO: 6575039 - DNA, 19 bp, Homo sapiens
ttctgcttgctcccaagcc

SEQ ID NO: 6575040 - DNA, 12 bp, Homo sapiens
ttctgctttaaa

SEQ ID NO: 6575041 - DNA, 14 bp, Homo sapiens
ttctgctttaaatt

SEQ ID NO: 6575042 - DNA, 17 bp, Homo sapiens
ttctgctttagacttga

SEQ ID NO: 6575043 - DNA, 19 bp, Homo sapiens
ttctgctttagacttgaaa

SEQ ID NO: 6575044 - DNA, 15 bp, Homo sapiens
ttctgctttcatctt

SEQ ID NO: 6575045 - DNA, 18 bp, Homo sapiens
ttctgctttcctcttcct

SEQ ID NO: 6575046 - DNA, 13 bp, Homo sapiens
ttctgctttctat

SEQ ID NO: 6575047 - DNA, 21 bp, Homo sapiens
ttctgctttctattacccctc

SEQ ID NO: 6575048 - DNA, 22 bp, Homo sapiens
ttctgctttctccccaatgaga

SEQ ID NO: 6575049 - DNA, 14 bp, Homo sapiens
ttctgctttctgat

SEQ ID NO: 6575050 - DNA, 14 bp, Homo sapiens
ttctgctttgctct

SEQ ID NO: 6575051 - DNA, 12 bp, Homo sapiens
ttctgctttgtt

SEQ ID NO: 6575052 - DNA, 19 bp, Homo sapiens
ttctgctttgttgtgtgcc

SEQ ID NO: 6575053 - DNA, 14 bp, Homo sapiens
ttctgcttttaagt

SEQ ID NO: 6575054 - DNA, 21 bp, Homo sapiens
ttctgcttttaccatgcccct

SEQ ID NO: 6575055 - DNA, 13 bp, Homo sapiens
ttctgcttttctg

SEQ ID NO: 6575056 - DNA, 19 bp, Homo sapiens
ttctgcttttgaaatctgt

SEQ ID NO: 6575057 - DNA, 14 bp, Homo sapiens
ttctgcttttgcat

SEQ ID NO: 6575058 - DNA, 10 bp, Homo sapiens
ttctggaaaa

SEQ ID NO: 6575059 - DNA, 19 bp, Homo sapiens
ttctggaaattttgtccat

SEQ ID NO: 6575060 - DNA, 21 bp, Homo sapiens
ttctggaaattttgtccattt

SEQ ID NO: 6575061 - DNA, 18 bp, Homo sapiens
ttctggaactgtctgaat

SEQ ID NO: 6575062 - DNA, 13 bp, Homo sapiens
ttctggaagaaag

SEQ ID NO: 6575063 - DNA, 13 bp, Homo sapiens
ttctggaagactg

SEQ ID NO: 6575064 - DNA, 13 bp, Homo sapiens
ttctggaaggaat

SEQ ID NO: 6575065 - DNA, 22 bp, Homo sapiens
ttctggaagggcagcatataaa

SEQ ID NO: 6575066 - DNA, 20 bp, Homo sapiens
ttctggaatgtaatcaatgt

SEQ ID NO: 6575067 - DNA, 22 bp, Homo sapiens
ttctggaatgtaatcaatgttt

SEQ ID NO: 6575068 - DNA, 20 bp, Homo sapiens
ttctggaatttgttcaagtt

SEQ ID NO: 6575069 - DNA, 21 bp, Homo sapiens
ttctggacattctctttgata

SEQ ID NO: 6575070 - DNA, 20 bp, Homo sapiens
ttctggaccaaggtgaagca

SEQ ID NO: 6575071 - DNA, 16 bp, Homo sapiens
aaggattttatgcttt

SEQ ID NO: 6575072 - DNA, 20 bp, Homo sapiens
aaggattttatgctttaaac

SEQ ID NO: 6575073 - DNA, 18 bp, Homo sapiens
aaggatttttcaagagat

SEQ ID NO: 6575074 - DNA, 15 bp, Homo sapiens
aaggattttttaaag

SEQ ID NO: 6575075 - DNA, 14 bp, Homo sapiens
aaggcaaaaaaggt

SEQ ID NO: 6575076 - DNA, 13 bp, Homo sapiens
aaggcaaaaatag

SEQ ID NO: 6575077 - DNA, 15 bp, Homo sapiens
aaggcaaaaatgtat

SEQ ID NO: 6575078 - DNA, 12 bp, Homo sapiens
aaggcaaaagac

SEQ ID NO: 6575079 - DNA, 13 bp, Homo sapiens
aaggcaaaagact

SEQ ID NO: 6575080 - DNA, 15 bp, Homo sapiens
aaggcaaacatttga

SEQ ID NO: 6575081 - DNA, 9 bp, Homo sapiens
aaggcaaag

SEQ ID NO: 6575082 - DNA, 18 bp, Homo sapiens
aaggcaaagcccctggaa

SEQ ID NO: 6575083 - DNA, 17 bp, Homo sapiens
aaggcaaagtttacaga

SEQ ID NO: 6575084 - DNA, 16 bp, Homo sapiens
aaggcaaatattgaag

SEQ ID NO: 6575085 - DNA, 12 bp, Homo sapiens
aaggcaaatgtc

SEQ ID NO: 6575086 - DNA, 13 bp, Homo sapiens
aaggcaaatgtcc

SEQ ID NO: 6575087 - DNA, 17 bp, Homo sapiens
aaggcaaatgtccaagc

SEQ ID NO: 6575088 - DNA, 20 bp, Homo sapiens
aaggcaaattgattcaaatg

SEQ ID NO: 6575089 - DNA, 21 bp, Homo sapiens
aaggcaacaaaagaagcccgg

SEQ ID NO: 6575090 - DNA, 22 bp, Homo sapiens
aaggcaacaaaagaagcccggc

SEQ ID NO: 6575091 - DNA, 18 bp, Homo sapiens
aaggcaacatttccgaag

SEQ ID NO: 6575092 - DNA, 16 bp, Homo sapiens
aaggcaaccaataaaa

SEQ ID NO: 6575093 - DNA, 16 bp, Homo sapiens
aaggcaacttgaagaa

SEQ ID NO: 6575094 - DNA, 16 bp, Homo sapiens
aaggcaagaagtggga

SEQ ID NO: 6575095 - DNA, 13 bp, Homo sapiens
aaggcaagagggg

SEQ ID NO: 6575096 - DNA, 18 bp, Homo sapiens
aaggcaagcacttgtggg

SEQ ID NO: 6575097 - DNA, 15 bp, Homo sapiens
aaggcaagcatgaat

SEQ ID NO: 6575098 - DNA, 23 bp, Homo sapiens
aaggcaagcatgaataaaattag

SEQ ID NO: 6575099 - DNA, 14 bp, Homo sapiens
aaggcaagccagca

SEQ ID NO: 6575100 - DNA, 23 bp, Homo sapiens
aaggcaagccaggctcactcaca

SEQ ID NO: 6575101 - DNA, 16 bp, Homo sapiens
aaggcaaggccctgcc

SEQ ID NO: 6575102 - DNA, 18 bp, Homo sapiens
aaggcaaggccctgccct

SEQ ID NO: 6575103 - DNA, 15 bp, Homo sapiens
aaggcaaggctgtca

SEQ ID NO: 6575104 - DNA, 17 bp, Homo sapiens
aaggcaaggctgtcaat

SEQ ID NO: 6575105 - DNA, 18 bp, Homo sapiens
aaggcaaggctgtcaatt

SEQ ID NO: 6575106 - DNA, 19 bp, Homo sapiens
aaggcaagttaagagaaac

SEQ ID NO: 6575107 - DNA, 14 bp, Homo sapiens
aaggcaataaaact

SEQ ID NO: 6575108 - DNA, 15 bp, Homo sapiens
aaggcaatgatatgg

SEQ ID NO: 6575109 - DNA, 22 bp, Homo sapiens
aaggcaatgccatcctcaaaca

SEQ ID NO: 6575110 - DNA, 21 bp, Homo sapiens
aaggcaatggtttcacatggt

SEQ ID NO: 6575111 - DNA, 18 bp, Homo sapiens
aaggcaatttctctgcac

SEQ ID NO: 6575112 - DNA, 12 bp, Homo sapiens
aaggcacagcta

SEQ ID NO: 6575113 - DNA, 12 bp, Homo sapiens
aaggcacagtgg

SEQ ID NO: 6575114 - DNA, 17 bp, Homo sapiens
aaggcacagtgggagct

SEQ ID NO: 6575115 - DNA, 19 bp, Homo sapiens
aaggcacagtgggagctga

SEQ ID NO: 6575116 - DNA, 18 bp, Homo sapiens
aaggcacattgaaatact

SEQ ID NO: 6575117 - DNA, 15 bp, Homo sapiens
aaggcaccagcaaat

SEQ ID NO: 6575118 - DNA, 22 bp, Homo sapiens
aaggcacccatctgtctgccaa

SEQ ID NO: 6575119 - DNA, 19 bp, Homo sapiens
aaggcacccccgtcaagag

SEQ ID NO: 6575120 - DNA, 23 bp, Homo sapiens
aaggcacccgccctttccttgcc

SEQ ID NO: 6575121 - DNA, 16 bp, Homo sapiens
aaggcacctgccccca

SEQ ID NO: 6575122 - DNA, 12 bp, Homo sapiens
aaggcacctgct

SEQ ID NO: 6575123 - DNA, 13 bp, Homo sapiens
aaggcacctgctc

SEQ ID NO: 6575124 - DNA, 16 bp, Homo sapiens
aaggcacctgctccca

SEQ ID NO: 6575125 - DNA, 15 bp, Homo sapiens
aaggcactctagatt

SEQ ID NO: 6575126 - DNA, 16 bp, Homo sapiens
aaggcactctagattc

SEQ ID NO: 6575127 - DNA, 16 bp, Homo sapiens
aaggcactgagcgcct

SEQ ID NO: 6575128 - DNA, 14 bp, Homo sapiens
aaggcactgcctga

SEQ ID NO: 6575129 - DNA, 11 bp, Homo sapiens
aaggcactgtc

SEQ ID NO: 6575130 - DNA, 18 bp, Homo sapiens
aaggcactgtgaactatt

SEQ ID NO: 6575131 - DNA, 16 bp, Homo sapiens
aaggcagacaggaagg

SEQ ID NO: 6575132 - DNA, 15 bp, Homo sapiens
aaggcagagaaatct

SEQ ID NO: 6575133 - DNA, 18 bp, Homo sapiens
aaggcagaggcctgggct

SEQ ID NO: 6575134 - DNA, 22 bp, Homo sapiens
aaggcagcaaagaggggcgctg

SEQ ID NO: 6575135 - DNA, 13 bp, Homo sapiens
aaggcagcaggcg

SEQ ID NO: 6575136 - DNA, 16 bp, Homo sapiens
aaggcagcatgtatag

SEQ ID NO: 6575137 - DNA, 14 bp, Homo sapiens
aaggcagcattcca

SEQ ID NO: 6575138 - DNA, 20 bp, Homo sapiens
aaggcagcatttgaatactc

SEQ ID NO: 6575139 - DNA, 15 bp, Homo sapiens
aaggcagccagatcc

SEQ ID NO: 6575140 - DNA, 21 bp, Homo sapiens
aaggcagccagatccccaggg

SEQ ID NO: 6575141 - DNA, 21 bp, Homo sapiens
aaggcagccctcacctctgag

SEQ ID NO: 6575142 - DNA, 18 bp, Homo sapiens
aaggcagcctccagagcc

SEQ ID NO: 6575143 - DNA, 23 bp, Homo sapiens
aaggcagcctccagagccagcct

SEQ ID NO: 6575144 - DNA, 17 bp, Homo sapiens
aaggcagcctgaacact

SEQ ID NO: 6575145 - DNA, 21 bp, Homo sapiens
aaggcagcgtgccgagccagc

SEQ ID NO: 6575146 - DNA, 21 bp, Homo sapiens
aaggcagctcttctggagttt

SEQ ID NO: 6575147 - DNA, 10 bp, Homo sapiens
aaggcagctg

SEQ ID NO: 6575148 - DNA, 21 bp, Homo sapiens
aaggcagctgcctctgctccc

SEQ ID NO: 6575149 - DNA, 13 bp, Homo sapiens
aaggcagctgctc

SEQ ID NO: 6575150 - DNA, 14 bp, Homo sapiens
aaggcagctgctct

SEQ ID NO: 6575151 - DNA, 15 bp, Homo sapiens
aaggcagctgtgtct

SEQ ID NO: 6575152 - DNA, 21 bp, Homo sapiens
aaggcagctgttgtctcttct

SEQ ID NO: 6575153 - DNA, 19 bp, Homo sapiens
aaggcaggaagggaagcgt

SEQ ID NO: 6575154 - DNA, 16 bp, Homo sapiens
aaggcaggaatgtgtg

SEQ ID NO: 6575155 - DNA, 12 bp, Homo sapiens
aaggcaggacca

SEQ ID NO: 6575156 - DNA, 17 bp, Homo sapiens
aaggcaggaggatcact

SEQ ID NO: 6575157 - DNA, 22 bp, Homo sapiens
aaggcaggcagggctctcctgg

SEQ ID NO: 6575158 - DNA, 19 bp, Homo sapiens
aaggcaggcctttcctaca

SEQ ID NO: 6575159 - DNA, 19 bp, Homo sapiens
aaggcagggaatgcctgga

SEQ ID NO: 6575160 - DNA, 19 bp, Homo sapiens
aaggcagggaggaggcaga

SEQ ID NO: 6575161 - DNA, 22 bp, Homo sapiens
aaggcagggcccttggggctgg

SEQ ID NO: 6575162 - DNA, 18 bp, Homo sapiens
aaggcaggggaatgtatg

SEQ ID NO: 6575163 - DNA, 20 bp, Homo sapiens
aaggcaggtgcctccaggtg

SEQ ID NO: 6575164 - DNA, 22 bp, Homo sapiens
aaggcaggtgcctccaggtgtg

SEQ ID NO: 6575165 - DNA, 12 bp, Homo sapiens
aaggcaggtgct

SEQ ID NO: 6575166 - DNA, 17 bp, Homo sapiens
aaggcagtattcccttt

SEQ ID NO: 6575167 - DNA, 22 bp, Homo sapiens
aaggcagtctctatattatgtc

SEQ ID NO: 6575168 - DNA, 15 bp, Homo sapiens
aaggcagtgcatgca

SEQ ID NO: 6575169 - DNA, 16 bp, Homo sapiens
aaggcagtgcatgcat

SEQ ID NO: 6575170 - DNA, 20 bp, Homo sapiens
aaggcagtgcctgctctgct

SEQ ID NO: 6575171 - DNA, 21 bp, Homo sapiens
aaggcagtggcaggggagcag

SEQ ID NO: 6575172 - DNA, 17 bp, Homo sapiens
aaggcagttctgtgtcc

SEQ ID NO: 6575173 - DNA, 15 bp, Homo sapiens
aaggcagtttgcaaa

SEQ ID NO: 6575174 - DNA, 19 bp, Homo sapiens
aaggcatatcagtctctga

SEQ ID NO: 6575175 - DNA, 16 bp, Homo sapiens
aaggcatatttaacaa

SEQ ID NO: 6575176 - DNA, 17 bp, Homo sapiens
aaggcatcacagttcac

SEQ ID NO: 6575177 - DNA, 23 bp, Homo sapiens
aaggcatcactttcctggatcca

SEQ ID NO: 6575178 - DNA, 17 bp, Homo sapiens
aaggcatccaggccagg

SEQ ID NO: 6575179 - DNA, 13 bp, Homo sapiens
aaggcatcccagc

SEQ ID NO: 6575180 - DNA, 22 bp, Homo sapiens
aaggcatccccagtgccagctg

SEQ ID NO: 6575181 - DNA, 14 bp, Homo sapiens
aaggcatctaagac

SEQ ID NO: 6575182 - DNA, 17 bp, Homo sapiens
aaggcatctgacatgca

SEQ ID NO: 6575183 - DNA, 20 bp, Homo sapiens
aaggcatgtacaaaaattat

SEQ ID NO: 6575184 - DNA, 22 bp, Homo sapiens
aaggcatgtggcctttatctca

SEQ ID NO: 6575185 - DNA, 19 bp, Homo sapiens
aaggcatgttcccagaaag

SEQ ID NO: 6575186 - DNA, 19 bp, Homo sapiens
aaggcattataaaaagaat

SEQ ID NO: 6575187 - DNA, 14 bp, Homo sapiens
aaggcattccacag

SEQ ID NO: 6575188 - DNA, 14 bp, Homo sapiens
aaggcattctccca

SEQ ID NO: 6575189 - DNA, 15 bp, Homo sapiens
aaggcattctcccag

SEQ ID NO: 6575190 - DNA, 12 bp, Homo sapiens
aaggcattctct

SEQ ID NO: 6575191 - DNA, 17 bp, Homo sapiens
aaggcattgagggctct

SEQ ID NO: 6575192 - DNA, 15 bp, Homo sapiens
aaggcattgcacaga

SEQ ID NO: 6575193 - DNA, 17 bp, Homo sapiens
aaggcatttattgccat

SEQ ID NO: 6575194 - DNA, 15 bp, Homo sapiens
aaggcatttcccacc

SEQ ID NO: 6575195 - DNA, 13 bp, Homo sapiens
aaggcattttatt

SEQ ID NO: 6575196 - DNA, 17 bp, Homo sapiens
aaggccaaacctctgtt

SEQ ID NO: 6575197 - DNA, 17 bp, Homo sapiens
aaggccaaactgctgga

SEQ ID NO: 6575198 - DNA, 20 bp, Homo sapiens
aaggccaaagataaaaggtt

SEQ ID NO: 6575199 - DNA, 16 bp, Homo sapiens
aaggccaaaggaagca

SEQ ID NO: 6575200 - DNA, 13 bp, Homo sapiens
aaggccaaggtgc

SEQ ID NO: 6575201 - DNA, 18 bp, Homo sapiens
aaggccaatgggctagag

SEQ ID NO: 6575202 - DNA, 21 bp, Homo sapiens
aaggccaattcctatacgcag

SEQ ID NO: 6575203 - DNA, 14 bp, Homo sapiens
aaggccacaaaaac

SEQ ID NO: 6575204 - DNA, 17 bp, Homo sapiens
aaggccacaaaaacaat

SEQ ID NO: 6575205 - DNA, 13 bp, Homo sapiens
aaggccacactgg

SEQ ID NO: 6575206 - DNA, 14 bp, Homo sapiens
aaggccacactggc

SEQ ID NO: 6575207 - DNA, 15 bp, Homo sapiens
aaggccacaggagac

SEQ ID NO: 6575208 - DNA, 20 bp, Homo sapiens
aaggccacatacctctctga

SEQ ID NO: 6575209 - DNA, 15 bp, Homo sapiens
aaggccacctctgcc

SEQ ID NO: 6575210 - DNA, 19 bp, Homo sapiens
aaggccacctctgcctcta

SEQ ID NO: 6575211 - DNA, 14 bp, Homo sapiens
aaggccacctcttc

SEQ ID NO: 6575212 - DNA, 23 bp, Homo sapiens
aaggccacgtatagtcctagctg

SEQ ID NO: 6575213 - DNA, 15 bp, Homo sapiens
aaggccagaaaaaga

SEQ ID NO: 6575214 - DNA, 19 bp, Homo sapiens
aaggccagaaaaggcagcc

SEQ ID NO: 6575215 - DNA, 13 bp, Homo sapiens
aaggccagaagga

SEQ ID NO: 6575216 - DNA, 19 bp, Homo sapiens
aaggccagagtggcctggc

SEQ ID NO: 6575217 - DNA, 21 bp, Homo sapiens
aaggccagagtggcctggcca

SEQ ID NO: 6575218 - DNA, 19 bp, Homo sapiens
aaggccagcacccaaaggg

SEQ ID NO: 6575219 - DNA, 18 bp, Homo sapiens
aaggccagcagccttcca

SEQ ID NO: 6575220 - DNA, 19 bp, Homo sapiens
aaggccagcagctgatgct

SEQ ID NO: 6575221 - DNA, 20 bp, Homo sapiens
aaggccagccacaccacagg

SEQ ID NO: 6575222 - DNA, 13 bp, Homo sapiens
aaggccagccatt

SEQ ID NO: 6575223 - DNA, 15 bp, Homo sapiens
aaggccagccatttt

SEQ ID NO: 6575224 - DNA, 15 bp, Homo sapiens
aaggccagcccactg

SEQ ID NO: 6575225 - DNA, 20 bp, Homo sapiens
aaggccagcccactgggccc

SEQ ID NO: 6575226 - DNA, 24 bp, Homo sapiens
aaggccagccttgtacagtctgct

SEQ ID NO: 6575227 - DNA, 17 bp, Homo sapiens
aaggccagctggcagca

SEQ ID NO: 6575228 - DNA, 22 bp, Homo sapiens
aaggccaggagtaagcccaagc

SEQ ID NO: 6575229 - DNA, 20 bp, Homo sapiens
aaggccaggccctgtgtgaa

SEQ ID NO: 6575230 - DNA, 18 bp, Homo sapiens
aaggccagtggaaattca

SEQ ID NO: 6575231 - DNA, 16 bp, Homo sapiens
aaggccagtggaagaa

SEQ ID NO: 6575232 - DNA, 14 bp, Homo sapiens
aaggccataaaaca

SEQ ID NO: 6575233 - DNA, 17 bp, Homo sapiens
aaggccataaaacaggt

SEQ ID NO: 6575234 - DNA, 24 bp, Homo sapiens
aaggccataaaacaggtaatataa

SEQ ID NO: 6575235 - DNA, 22 bp, Homo sapiens
aaggccatattttaaaaaatca

SEQ ID NO: 6575236 - DNA, 22 bp, Homo sapiens
aaggccatccttccctgtctgc

SEQ ID NO: 6575237 - DNA, 22 bp, Homo sapiens
aaggccatctgggctcctccag

SEQ ID NO: 6575238 - DNA, 15 bp, Homo sapiens
aaggccatggggcag

SEQ ID NO: 6575239 - DNA, 20 bp, Homo sapiens
aaggccatggggcagcctcc

SEQ ID NO: 6575240 - DNA, 14 bp, Homo sapiens
aaggccattgggtt

SEQ ID NO: 6575241 - DNA, 15 bp, Homo sapiens
aaggcccaagagcag

SEQ ID NO: 6575242 - DNA, 18 bp, Homo sapiens
aaggcccagaagcctgat

SEQ ID NO: 6575243 - DNA, 18 bp, Homo sapiens
aaggcccagacctggcct

SEQ ID NO: 6575244 - DNA, 20 bp, Homo sapiens
aaggcccagacctggcctct

SEQ ID NO: 6575245 - DNA, 15 bp, Homo sapiens
aaggcccagccccta

SEQ ID NO: 6575246 - DNA, 16 bp, Homo sapiens
aaggcccagcccctag

SEQ ID NO: 6575247 - DNA, 17 bp, Homo sapiens
aaggcccagccctgggc

SEQ ID NO: 6575248 - DNA, 23 bp, Homo sapiens
aaggcccagctatggccccaggg

SEQ ID NO: 6575249 - DNA, 14 bp, Homo sapiens
aaggcccagctgcc

SEQ ID NO: 6575250 - DNA, 15 bp, Homo sapiens
aaggcccagctgcca

SEQ ID NO: 6575251 - DNA, 15 bp, Homo sapiens
ttctggacctctggg

SEQ ID NO: 6575252 - DNA, 16 bp, Homo sapiens
ttctggacctctgggt

SEQ ID NO: 6575253 - DNA, 20 bp, Homo sapiens
ttctggactatagctgttct

SEQ ID NO: 6575254 - DNA, 21 bp, Homo sapiens
ttctggactcccactctttga

SEQ ID NO: 6575255 - DNA, 15 bp, Homo sapiens
ttctggactctgccc

SEQ ID NO: 6575256 - DNA, 17 bp, Homo sapiens
ttctggactctgcccca

SEQ ID NO: 6575257 - DNA, 18 bp, Homo sapiens
ttctggactctgccccaa

SEQ ID NO: 6575258 - DNA, 20 bp, Homo sapiens
ttctggactctgccccaatc

SEQ ID NO: 6575259 - DNA, 21 bp, Homo sapiens
ttctggagcagaactttccag

SEQ ID NO: 6575260 - DNA, 19 bp, Homo sapiens
ttctggagcaggtggcttg

SEQ ID NO: 6575261 - DNA, 12 bp, Homo sapiens
ttctggagctgc

SEQ ID NO: 6575262 - DNA, 20 bp, Homo sapiens
ttctggagctgggagacaaa

SEQ ID NO: 6575263 - DNA, 13 bp, Homo sapiens
ttctggaggagga

SEQ ID NO: 6575264 - DNA, 19 bp, Homo sapiens
ttctggaggggagagcttt

SEQ ID NO: 6575265 - DNA, 17 bp, Homo sapiens
ttctggagtctccagtg

SEQ ID NO: 6575266 - DNA, 17 bp, Homo sapiens
ttctggagtttctctaa

SEQ ID NO: 6575267 - DNA, 13 bp, Homo sapiens
ttctggatccatg

SEQ ID NO: 6575268 - DNA, 18 bp, Homo sapiens
ttctggatctcctgctgc

SEQ ID NO: 6575269 - DNA, 20 bp, Homo sapiens
ttctggatctcctgctgcct

SEQ ID NO: 6575270 - DNA, 22 bp, Homo sapiens
ttctggatggccgggctgctgc

SEQ ID NO: 6575271 - DNA, 14 bp, Homo sapiens
ttctggatgggaca

SEQ ID NO: 6575272 - DNA, 23 bp, Homo sapiens
ttctggatggtgtgccttccaga

SEQ ID NO: 6575273 - DNA, 14 bp, Homo sapiens
ttctggatgtctgg

SEQ ID NO: 6575274 - DNA, 14 bp, Homo sapiens
ttctggcaagagca

SEQ ID NO: 6575275 - DNA, 11 bp, Homo sapiens
ttctggcaccg

SEQ ID NO: 6575276 - DNA, 20 bp, Homo sapiens
ttctggcagagttgaagaca

SEQ ID NO: 6575277 - DNA, 19 bp, Homo sapiens
ttctggcaggtcctcccct

SEQ ID NO: 6575278 - DNA, 23 bp, Homo sapiens
ttctggcagttttgacatcagcc

SEQ ID NO: 6575279 - DNA, 21 bp, Homo sapiens
ttctggccaaggggtgggcct

SEQ ID NO: 6575280 - DNA, 16 bp, Homo sapiens
ttctggccaccccaga

SEQ ID NO: 6575281 - DNA, 18 bp, Homo sapiens
ttctggccagtgtttaaa

SEQ ID NO: 6575282 - DNA, 12 bp, Homo sapiens
ttctggcccagc

SEQ ID NO: 6575283 - DNA, 15 bp, Homo sapiens
ttctggcccagccaa

SEQ ID NO: 6575284 - DNA, 12 bp, Homo sapiens
ttctggcctcag

SEQ ID NO: 6575285 - DNA, 13 bp, Homo sapiens
ttctggcctcagc

SEQ ID NO: 6575286 - DNA, 13 bp, Homo sapiens
ttctggcctccag

SEQ ID NO: 6575287 - DNA, 16 bp, Homo sapiens
ttctggcctccagcct

SEQ ID NO: 6575288 - DNA, 15 bp, Homo sapiens
ttctggcctcctaag

SEQ ID NO: 6575289 - DNA, 14 bp, Homo sapiens
ttctggcctctggc

SEQ ID NO: 6575290 - DNA, 14 bp, Homo sapiens
ttctggcctgcctt

SEQ ID NO: 6575291 - DNA, 11 bp, Homo sapiens
ttctggcctgt

SEQ ID NO: 6575292 - DNA, 17 bp, Homo sapiens
ttctggcctttcctctc

SEQ ID NO: 6575293 - DNA, 19 bp, Homo sapiens
ttctggcgcccctgcctgt

SEQ ID NO: 6575294 - DNA, 17 bp, Homo sapiens
ttctggctacctgtttg

SEQ ID NO: 6575295 - DNA, 10 bp, Homo sapiens
ttctggctca

SEQ ID NO: 6575296 - DNA, 15 bp, Homo sapiens
ttctggctcacagga

SEQ ID NO: 6575297 - DNA, 17 bp, Homo sapiens
ttctggctcagggaggt

SEQ ID NO: 6575298 - DNA, 24 bp, Homo sapiens
ttctggctcctaccactggacagt

SEQ ID NO: 6575299 - DNA, 17 bp, Homo sapiens
ttctggctcctcaaaca

SEQ ID NO: 6575300 - DNA, 13 bp, Homo sapiens
ttctggctcctcc

SEQ ID NO: 6575301 - DNA, 17 bp, Homo sapiens
ttctggctcctccttcc

SEQ ID NO: 6575302 - DNA, 12 bp, Homo sapiens
ttctggctcctg

SEQ ID NO: 6575303 - DNA, 22 bp, Homo sapiens
ttctggctctcccatttcctga

SEQ ID NO: 6575304 - DNA, 18 bp, Homo sapiens
ttctggctgaaaaaggcc

SEQ ID NO: 6575305 - DNA, 14 bp, Homo sapiens
ttctggctgaaaat

SEQ ID NO: 6575306 - DNA, 12 bp, Homo sapiens
ttctggctgcaa

SEQ ID NO: 6575307 - DNA, 20 bp, Homo sapiens
ttctggcttaaacaacacct

SEQ ID NO: 6575308 - DNA, 20 bp, Homo sapiens
ttctggcttccttctctcaa

SEQ ID NO: 6575309 - DNA, 15 bp, Homo sapiens
ttctggcttctagtc

SEQ ID NO: 6575310 - DNA, 21 bp, Homo sapiens
ttctggctttgttcttgtcat

SEQ ID NO: 6575311 - DNA, 19 bp, Homo sapiens
ttctgggaaatgttttaat

SEQ ID NO: 6575312 - DNA, 14 bp, Homo sapiens
ttctgggaaattga

SEQ ID NO: 6575313 - DNA, 22 bp, Homo sapiens
ttctgggaaattgaagtgtctt

SEQ ID NO: 6575314 - DNA, 22 bp, Homo sapiens
ttctgggaagaaaatgagatgg

SEQ ID NO: 6575315 - DNA, 13 bp, Homo sapiens
ttctgggaagcaa

SEQ ID NO: 6575316 - DNA, 21 bp, Homo sapiens
ttctgggaagcttgagcctcc

SEQ ID NO: 6575317 - DNA, 22 bp, Homo sapiens
ttctgggaagcttgagcctccc

SEQ ID NO: 6575318 - DNA, 13 bp, Homo sapiens
ttctgggaaggga

SEQ ID NO: 6575319 - DNA, 14 bp, Homo sapiens
ttctgggaagggag

SEQ ID NO: 6575320 - DNA, 19 bp, Homo sapiens
ttctgggaagtcctagccc

SEQ ID NO: 6575321 - DNA, 23 bp, Homo sapiens
ttctgggaatgtatagtatttga

SEQ ID NO: 6575322 - DNA, 11 bp, Homo sapiens
ttctgggacac

SEQ ID NO: 6575323 - DNA, 15 bp, Homo sapiens
ttctgggacccactc

SEQ ID NO: 6575324 - DNA, 14 bp, Homo sapiens
ttctgggacttgaa

SEQ ID NO: 6575325 - DNA, 22 bp, Homo sapiens
ttctgggagctgcgccggacag

SEQ ID NO: 6575326 - DNA, 14 bp, Homo sapiens
ttctgggagggcag

SEQ ID NO: 6575327 - DNA, 21 bp, Homo sapiens
ttctgggagggcagcagggct

SEQ ID NO: 6575328 - DNA, 19 bp, Homo sapiens
ttctgggagtcctgtcagc

SEQ ID NO: 6575329 - DNA, 13 bp, Homo sapiens
ttctgggatgcaa

SEQ ID NO: 6575330 - DNA, 15 bp, Homo sapiens
ttctgggatgtcaca

SEQ ID NO: 6575331 - DNA, 19 bp, Homo sapiens
ttctgggatgtcacagtcc

SEQ ID NO: 6575332 - DNA, 17 bp, Homo sapiens
ttctgggcaaggtgagg

SEQ ID NO: 6575333 - DNA, 17 bp, Homo sapiens
ttctgggcagagcctgt

SEQ ID NO: 6575334 - DNA, 19 bp, Homo sapiens
ttctgggcagctaaaagca

SEQ ID NO: 6575335 - DNA, 18 bp, Homo sapiens
ttctgggccagtgagcca

SEQ ID NO: 6575336 - DNA, 22 bp, Homo sapiens
ttctgggcgtctgagctggggt

SEQ ID NO: 6575337 - DNA, 23 bp, Homo sapiens
ttctgggcgtctgagctggggtg

SEQ ID NO: 6575338 - DNA, 18 bp, Homo sapiens
ttctgggctctggactcc

SEQ ID NO: 6575339 - DNA, 16 bp, Homo sapiens
ttctgggctctttcct

SEQ ID NO: 6575340 - DNA, 10 bp, Homo sapiens
ttctgggctg

SEQ ID NO: 6575341 - DNA, 14 bp, Homo sapiens
ttctgggcttcatt

SEQ ID NO: 6575342 - DNA, 13 bp, Homo sapiens
ttctgggctttct

SEQ ID NO: 6575343 - DNA, 22 bp, Homo sapiens
ttctgggcttttccttttgcac

SEQ ID NO: 6575344 - DNA, 20 bp, Homo sapiens
ttctggggaaaaaaaagaga

SEQ ID NO: 6575345 - DNA, 20 bp, Homo sapiens
ttctggggaaagacactgcc

SEQ ID NO: 6575346 - DNA, 14 bp, Homo sapiens
ttctggggaggaag

SEQ ID NO: 6575347 - DNA, 18 bp, Homo sapiens
ttctggggcaactgagag

SEQ ID NO: 6575348 - DNA, 17 bp, Homo sapiens
ttctggggcaggctggg

SEQ ID NO: 6575349 - DNA, 22 bp, Homo sapiens
ttctggggcccaggaagcccac

SEQ ID NO: 6575350 - DNA, 21 bp, Homo sapiens
ttctggggcccctttttactc

SEQ ID NO: 6575351 - DNA, 19 bp, Homo sapiens
ttctggggcccgcctgcca

SEQ ID NO: 6575352 - DNA, 20 bp, Homo sapiens
ttctggggcccgcctgccac

SEQ ID NO: 6575353 - DNA, 22 bp, Homo sapiens
ttctggggcccgcctgccacct

SEQ ID NO: 6575354 - DNA, 21 bp, Homo sapiens
ttctggggcctaataaaactg

SEQ ID NO: 6575355 - DNA, 23 bp, Homo sapiens
ttctggggcctaataaaactgat

SEQ ID NO: 6575356 - DNA, 23 bp, Homo sapiens
ttctggggctgagagtggggcta

SEQ ID NO: 6575357 - DNA, 16 bp, Homo sapiens
ttctggggctgtgtta

SEQ ID NO: 6575358 - DNA, 20 bp, Homo sapiens
ttctgggggagacatgctct

SEQ ID NO: 6575359 - DNA, 21 bp, Homo sapiens
ttctggggggacccagtgcag

SEQ ID NO: 6575360 - DNA, 22 bp, Homo sapiens
ttctggggggacccagtgcaga

SEQ ID NO: 6575361 - DNA, 23 bp, Homo sapiens
ttctggggggacccagtgcagaa

SEQ ID NO: 6575362 - DNA, 22 bp, Homo sapiens
ttctggggggagaaaaaaaaag

SEQ ID NO: 6575363 - DNA, 21 bp, Homo sapiens
ttctggggtcaggtgccactg

SEQ ID NO: 6575364 - DNA, 14 bp, Homo sapiens
ttctggggtcccca

SEQ ID NO: 6575365 - DNA, 16 bp, Homo sapiens
ttctggggttggaagt

SEQ ID NO: 6575366 - DNA, 14 bp, Homo sapiens
ttctgggtagaagc

SEQ ID NO: 6575367 - DNA, 23 bp, Homo sapiens
ttctgggtagtcccctgttgatt

SEQ ID NO: 6575368 - DNA, 15 bp, Homo sapiens
ttctgggtccctgct

SEQ ID NO: 6575369 - DNA, 17 bp, Homo sapiens
ttctgggtccctgctcc

SEQ ID NO: 6575370 - DNA, 23 bp, Homo sapiens
ttctgggtgatggaaactgccaa

SEQ ID NO: 6575371 - DNA, 14 bp, Homo sapiens
ttctgggtggcctc

SEQ ID NO: 6575372 - DNA, 15 bp, Homo sapiens
ttctgggtggctcct

SEQ ID NO: 6575373 - DNA, 16 bp, Homo sapiens
ttctgggtggctcctg

SEQ ID NO: 6575374 - DNA, 17 bp, Homo sapiens
ttctgggtggctcctgc

SEQ ID NO: 6575375 - DNA, 19 bp, Homo sapiens
ttctgggtggctcctgcca

SEQ ID NO: 6575376 - DNA, 13 bp, Homo sapiens
ttctgggtgtcca

SEQ ID NO: 6575377 - DNA, 22 bp, Homo sapiens
ttctgggtgttgaccactccag

SEQ ID NO: 6575378 - DNA, 17 bp, Homo sapiens
ttctgggttctgggtgg

SEQ ID NO: 6575379 - DNA, 16 bp, Homo sapiens
ttctgggtttgatact

SEQ ID NO: 6575380 - DNA, 14 bp, Homo sapiens
ttctgggtttgccc

SEQ ID NO: 6575381 - DNA, 18 bp, Homo sapiens
ttctggtaacctgtggtg

SEQ ID NO: 6575382 - DNA, 17 bp, Homo sapiens
ttctggtactttctgtt

SEQ ID NO: 6575383 - DNA, 18 bp, Homo sapiens
ttctggtagatagaaata

SEQ ID NO: 6575384 - DNA, 14 bp, Homo sapiens
ttctggtaggttct

SEQ ID NO: 6575385 - DNA, 15 bp, Homo sapiens
ttctggtatcttgtt

SEQ ID NO: 6575386 - DNA, 21 bp, Homo sapiens
ttctggtatgaacttgaggac

SEQ ID NO: 6575387 - DNA, 22 bp, Homo sapiens
ttctggtatgaacttgaggaca

SEQ ID NO: 6575388 - DNA, 20 bp, Homo sapiens
ttctggtatgcattctttat

SEQ ID NO: 6575389 - DNA, 18 bp, Homo sapiens
ttctggtatttcccctgt

SEQ ID NO: 6575390 - DNA, 19 bp, Homo sapiens
ttctggtatttcccctgtc

SEQ ID NO: 6575391 - DNA, 21 bp, Homo sapiens
ttctggtcacattccatttct

SEQ ID NO: 6575392 - DNA, 14 bp, Homo sapiens
ttctggtccctctt

SEQ ID NO: 6575393 - DNA, 18 bp, Homo sapiens
ttctggtccctcttctct

SEQ ID NO: 6575394 - DNA, 21 bp, Homo sapiens
ttctggtcctgttttctaaaa

SEQ ID NO: 6575395 - DNA, 20 bp, Homo sapiens
ttctggtccttagtaaattc

SEQ ID NO: 6575396 - DNA, 13 bp, Homo sapiens
ttctggtctcgtc

SEQ ID NO: 6575397 - DNA, 22 bp, Homo sapiens
ttctggtctcgtcttccgtctc

SEQ ID NO: 6575398 - DNA, 21 bp, Homo sapiens
ttctggtctctaggctgggga

SEQ ID NO: 6575399 - DNA, 15 bp, Homo sapiens
ttctggtcttcactg

SEQ ID NO: 6575400 - DNA, 15 bp, Homo sapiens
ttctggtgctgctgg

SEQ ID NO: 6575401 - DNA, 18 bp, Homo sapiens
ttctggtggcagtaacat

SEQ ID NO: 6575402 - DNA, 21 bp, Homo sapiens
ttctggtggccccagctgtga

SEQ ID NO: 6575403 - DNA, 21 bp, Homo sapiens
ttctggtggtggcctgtttga

SEQ ID NO: 6575404 - DNA, 14 bp, Homo sapiens
ttctggtgtgaact

SEQ ID NO: 6575405 - DNA, 20 bp, Homo sapiens
ttctggtgtgaactaaactt

SEQ ID NO: 6575406 - DNA, 21 bp, Homo sapiens
ttctggtgttcctaccaggac

SEQ ID NO: 6575407 - DNA, 13 bp, Homo sapiens
ttctggtgtttta

SEQ ID NO: 6575408 - DNA, 15 bp, Homo sapiens
ttctggttagctcag

SEQ ID NO: 6575409 - DNA, 12 bp, Homo sapiens
ttctggttccaa

SEQ ID NO: 6575410 - DNA, 13 bp, Homo sapiens
ttctggttccaaa

SEQ ID NO: 6575411 - DNA, 21 bp, Homo sapiens
ttctggttctaactgctgtta

SEQ ID NO: 6575412 - DNA, 15 bp, Homo sapiens
ttctggttcttgaaa

SEQ ID NO: 6575413 - DNA, 22 bp, Homo sapiens
ttctggttgatgcctgtgaact

SEQ ID NO: 6575414 - DNA, 13 bp, Homo sapiens
ttctggttgtatt

SEQ ID NO: 6575415 - DNA, 17 bp, Homo sapiens
ttctggttgtatttcta

SEQ ID NO: 6575416 - DNA, 18 bp, Homo sapiens
ttctggttgtatttctat

SEQ ID NO: 6575417 - DNA, 22 bp, Homo sapiens
ttctggtttaaacttgtttgct

SEQ ID NO: 6575418 - DNA, 10 bp, Homo sapiens
ttctgtaaaa

SEQ ID NO: 6575419 - DNA, 15 bp, Homo sapiens
ttctgtaaaatttgt

SEQ ID NO: 6575420 - DNA, 21 bp, Homo sapiens
ttctgtaaacctaatgtctgt

SEQ ID NO: 6575421 - DNA, 20 bp, Homo sapiens
ttctgtaaactcaaaactta

SEQ ID NO: 6575422 - DNA, 23 bp, Homo sapiens
ttctgtaaactcaaaacttaaca

SEQ ID NO: 6575423 - DNA, 22 bp, Homo sapiens
ttctgtaaactctgcatccaga

SEQ ID NO: 6575424 - DNA, 13 bp, Homo sapiens
ttctgtaaactta

SEQ ID NO: 6575425 - DNA, 13 bp, Homo sapiens
ttctgtaaatgaa

SEQ ID NO: 6575426 - DNA, 14 bp, Homo sapiens
ttctgtaaattcat

SEQ ID NO: 6575427 - DNA, 15 bp, Homo sapiens
ttctgtaagaaacct

SEQ ID NO: 6575428 - DNA, 18 bp, Homo sapiens
ttctgtaatgtaaataaa

SEQ ID NO: 6575429 - DNA, 12 bp, Homo sapiens
aaggcccaggag

SEQ ID NO: 6575430 - DNA, 16 bp, Homo sapiens
aaggcccagggaggca

SEQ ID NO: 6575431 - DNA, 20 bp, Homo sapiens
aaggcccatgcccccttcgc

SEQ ID NO: 6575432 - DNA, 15 bp, Homo sapiens
aaggccccagagaga

SEQ ID NO: 6575433 - DNA, 14 bp, Homo sapiens
aaggccccagggac

SEQ ID NO: 6575434 - DNA, 16 bp, Homo sapiens
aaggccccagggacag

SEQ ID NO: 6575435 - DNA, 17 bp, Homo sapiens
aaggccccagggacaga

SEQ ID NO: 6575436 - DNA, 18 bp, Homo sapiens
aaggccccagggacagag

SEQ ID NO: 6575437 - DNA, 21 bp, Homo sapiens
aaggccccagggacagaggcc

SEQ ID NO: 6575438 - DNA, 20 bp, Homo sapiens
aaggcccccaaacatagccc

SEQ ID NO: 6575439 - DNA, 23 bp, Homo sapiens
aaggcccccaaacatagcccctg

SEQ ID NO: 6575440 - DNA, 17 bp, Homo sapiens
aaggcccccacctctgt

SEQ ID NO: 6575441 - DNA, 17 bp, Homo sapiens
aaggcccccacttctcc

SEQ ID NO: 6575442 - DNA, 21 bp, Homo sapiens
aaggccccctctcaggagcca

SEQ ID NO: 6575443 - DNA, 22 bp, Homo sapiens
aaggccccctctcaggagccat

SEQ ID NO: 6575444 - DNA, 19 bp, Homo sapiens
aaggcccctctgtggagcg

SEQ ID NO: 6575445 - DNA, 14 bp, Homo sapiens
aaggcccctgcaat

SEQ ID NO: 6575446 - DNA, 16 bp, Homo sapiens
aaggcccctgcaatgt

SEQ ID NO: 6575447 - DNA, 12 bp, Homo sapiens
aaggccccttcc

SEQ ID NO: 6575448 - DNA, 14 bp, Homo sapiens
aaggccccttccac

SEQ ID NO: 6575449 - DNA, 14 bp, Homo sapiens
aaggccccttccca

SEQ ID NO: 6575450 - DNA, 14 bp, Homo sapiens
aaggccccttccct

SEQ ID NO: 6575451 - DNA, 22 bp, Homo sapiens
aaggccccttccctggcaggtg

SEQ ID NO: 6575452 - DNA, 14 bp, Homo sapiens
aaggcccgagcagc

SEQ ID NO: 6575453 - DNA, 21 bp, Homo sapiens
aaggcccgagcagctgagcag

SEQ ID NO: 6575454 - DNA, 23 bp, Homo sapiens
aaggccctagctaataaacctgt

SEQ ID NO: 6575455 - DNA, 18 bp, Homo sapiens
aaggccctgcatgtgtat

SEQ ID NO: 6575456 - DNA, 13 bp, Homo sapiens
aaggccctgctga

SEQ ID NO: 6575457 - DNA, 12 bp, Homo sapiens
aaggccctgtgg

SEQ ID NO: 6575458 - DNA, 17 bp, Homo sapiens
aaggcccttagagggaa

SEQ ID NO: 6575459 - DNA, 22 bp, Homo sapiens
aaggcccttcagccagaagact

SEQ ID NO: 6575460 - DNA, 13 bp, Homo sapiens
aaggccctttcct

SEQ ID NO: 6575461 - DNA, 15 bp, Homo sapiens
aaggccctttttcct

SEQ ID NO: 6575462 - DNA, 16 bp, Homo sapiens
aaggccctttttccta

SEQ ID NO: 6575463 - DNA, 19 bp, Homo sapiens
aaggccgaagctctggctg

SEQ ID NO: 6575464 - DNA, 17 bp, Homo sapiens
aaggccgacaccactcc

SEQ ID NO: 6575465 - DNA, 23 bp, Homo sapiens
aaggccgacaccactcctgccag

SEQ ID NO: 6575466 - DNA, 17 bp, Homo sapiens
aaggccgagcccacacc

SEQ ID NO: 6575467 - DNA, 13 bp, Homo sapiens
aaggccgagggcc

SEQ ID NO: 6575468 - DNA, 16 bp, Homo sapiens
aaggccgagggccagg

SEQ ID NO: 6575469 - DNA, 20 bp, Homo sapiens
aaggccgagggccaggcaga

SEQ ID NO: 6575470 - DNA, 19 bp, Homo sapiens
aaggccggagacccacagc

SEQ ID NO: 6575471 - DNA, 21 bp, Homo sapiens
aaggccgtgtgtttagaagcc

SEQ ID NO: 6575472 - DNA, 14 bp, Homo sapiens
aaggccgttaggga

SEQ ID NO: 6575473 - DNA, 16 bp, Homo sapiens
aaggcctaaggaagcc

SEQ ID NO: 6575474 - DNA, 20 bp, Homo sapiens
aaggcctaatgcattatttt

SEQ ID NO: 6575475 - DNA, 23 bp, Homo sapiens
aaggcctaccccagttcctagca

SEQ ID NO: 6575476 - DNA, 19 bp, Homo sapiens
aaggcctaggacctatgtt

SEQ ID NO: 6575477 - DNA, 16 bp, Homo sapiens
aaggcctatgccacct

SEQ ID NO: 6575478 - DNA, 19 bp, Homo sapiens
aaggcctcactcaagcctg

SEQ ID NO: 6575479 - DNA, 18 bp, Homo sapiens
aaggcctcatctccttta

SEQ ID NO: 6575480 - DNA, 14 bp, Homo sapiens
aaggcctcccacag

SEQ ID NO: 6575481 - DNA, 13 bp, Homo sapiens
aaggcctcccctg

SEQ ID NO: 6575482 - DNA, 14 bp, Homo sapiens
aaggcctcccctga

SEQ ID NO: 6575483 - DNA, 24 bp, Homo sapiens
aaggcctccctcaggctctgtgga

SEQ ID NO: 6575484 - DNA, 14 bp, Homo sapiens
aaggcctcctcccc

SEQ ID NO: 6575485 - DNA, 21 bp, Homo sapiens
aaggcctcctcccccacccct

SEQ ID NO: 6575486 - DNA, 17 bp, Homo sapiens
aaggcctcgcaggaaga

SEQ ID NO: 6575487 - DNA, 14 bp, Homo sapiens
aaggcctctcaccc

SEQ ID NO: 6575488 - DNA, 14 bp, Homo sapiens
aaggcctctctctg

SEQ ID NO: 6575489 - DNA, 19 bp, Homo sapiens
aaggcctctctctgcctga

SEQ ID NO: 6575490 - DNA, 22 bp, Homo sapiens
aaggcctgagggaagcccaccc

SEQ ID NO: 6575491 - DNA, 16 bp, Homo sapiens
aaggcctgcccccctt

SEQ ID NO: 6575492 - DNA, 18 bp, Homo sapiens
aaggcctgccccccttcc

SEQ ID NO: 6575493 - DNA, 19 bp, Homo sapiens
aaggcctgccccccttccc

SEQ ID NO: 6575494 - DNA, 20 bp, Homo sapiens
aaggcctgccccccttccca

SEQ ID NO: 6575495 - DNA, 22 bp, Homo sapiens
aaggcctgcgtgtgtctgtgtt

SEQ ID NO: 6575496 - DNA, 21 bp, Homo sapiens
aaggcctgcttgactttccag

SEQ ID NO: 6575497 - DNA, 19 bp, Homo sapiens
aaggcctggaaccagggag

SEQ ID NO: 6575498 - DNA, 23 bp, Homo sapiens
aaggcctgggctggcctggcagt

SEQ ID NO: 6575499 - DNA, 21 bp, Homo sapiens
aaggcctggggtgacccggca

SEQ ID NO: 6575500 - DNA, 22 bp, Homo sapiens
aaggcctggggtgacccggcac

SEQ ID NO: 6575501 - DNA, 12 bp, Homo sapiens
aaggcctgggtg

SEQ ID NO: 6575502 - DNA, 15 bp, Homo sapiens
aaggcctggtctggg

SEQ ID NO: 6575503 - DNA, 20 bp, Homo sapiens
aaggcctgtcagctaaagaa

SEQ ID NO: 6575504 - DNA, 23 bp, Homo sapiens
aaggcctgtccctggccatctct

SEQ ID NO: 6575505 - DNA, 18 bp, Homo sapiens
aaggcctgtgatccagga

SEQ ID NO: 6575506 - DNA, 17 bp, Homo sapiens
aaggcctgtgctgcatg

SEQ ID NO: 6575507 - DNA, 11 bp, Homo sapiens
aaggccttaag

SEQ ID NO: 6575508 - DNA, 15 bp, Homo sapiens
aaggccttaatatgt

SEQ ID NO: 6575509 - DNA, 21 bp, Homo sapiens
aaggccttattctacatttca

SEQ ID NO: 6575510 - DNA, 21 bp, Homo sapiens
aaggccttcagtttatttcca

SEQ ID NO: 6575511 - DNA, 20 bp, Homo sapiens
aaggccttcatggccccagc

SEQ ID NO: 6575512 - DNA, 15 bp, Homo sapiens
aaggccttccctgtc

SEQ ID NO: 6575513 - DNA, 18 bp, Homo sapiens
aaggccttctcaggctgg

SEQ ID NO: 6575514 - DNA, 16 bp, Homo sapiens
aaggccttgcctggcc

SEQ ID NO: 6575515 - DNA, 15 bp, Homo sapiens
aaggccttgccttgt

SEQ ID NO: 6575516 - DNA, 19 bp, Homo sapiens
aaggccttggtggagcagc

SEQ ID NO: 6575517 - DNA, 21 bp, Homo sapiens
aaggccttggtggagcagcca

SEQ ID NO: 6575518 - DNA, 22 bp, Homo sapiens
aaggccttggtggagcagccag

SEQ ID NO: 6575519 - DNA, 17 bp, Homo sapiens
aaggcctttaaaatttt

SEQ ID NO: 6575520 - DNA, 13 bp, Homo sapiens
aaggcctttcttc

SEQ ID NO: 6575521 - DNA, 14 bp, Homo sapiens
aaggcctttcttct

SEQ ID NO: 6575522 - DNA, 23 bp, Homo sapiens
aaggccttttgcccgttgaggta

SEQ ID NO: 6575523 - DNA, 16 bp, Homo sapiens
aaggcgaggagagtgg

SEQ ID NO: 6575524 - DNA, 20 bp, Homo sapiens
aaggcgagtccaggagctca

SEQ ID NO: 6575525 - DNA, 17 bp, Homo sapiens
aaggcgcccccgcccca

SEQ ID NO: 6575526 - DNA, 21 bp, Homo sapiens
aaggcgcccccgccccaggct

SEQ ID NO: 6575527 - DNA, 23 bp, Homo sapiens
aaggcgcccccgccccaggcttc

SEQ ID NO: 6575528 - DNA, 23 bp, Homo sapiens
aaggcgctaacttgcttaaatgt

SEQ ID NO: 6575529 - DNA, 13 bp, Homo sapiens
aaggcgctggagc

SEQ ID NO: 6575530 - DNA, 13 bp, Homo sapiens
aaggcggagggtc

SEQ ID NO: 6575531 - DNA, 21 bp, Homo sapiens
aaggcggagggtctccctggg

SEQ ID NO: 6575532 - DNA, 15 bp, Homo sapiens
aaggcgggctgagga

SEQ ID NO: 6575533 - DNA, 16 bp, Homo sapiens
aaggcgggctgaggag

SEQ ID NO: 6575534 - DNA, 22 bp, Homo sapiens
aaggcggggtattcccactcac

SEQ ID NO: 6575535 - DNA, 22 bp, Homo sapiens
aaggcggtggacttgaactttc

SEQ ID NO: 6575536 - DNA, 22 bp, Homo sapiens
aaggcgtagcatcatcctgcag

SEQ ID NO: 6575537 - DNA, 20 bp, Homo sapiens
aaggcgtgagccactgcgcc

SEQ ID NO: 6575538 - DNA, 17 bp, Homo sapiens
aaggcgtgcaaggggct

SEQ ID NO: 6575539 - DNA, 19 bp, Homo sapiens
aaggcgtgcaggggcggtc

SEQ ID NO: 6575540 - DNA, 18 bp, Homo sapiens
aaggcgtggagctgcctg

SEQ ID NO: 6575541 - DNA, 15 bp, Homo sapiens
aaggcgtggcttctg

SEQ ID NO: 6575542 - DNA, 16 bp, Homo sapiens
aaggctaaaaagcaac

SEQ ID NO: 6575543 - DNA, 19 bp, Homo sapiens
aaggctaacaaattttaag

SEQ ID NO: 6575544 - DNA, 16 bp, Homo sapiens
aaggctaagggactgg

SEQ ID NO: 6575545 - DNA, 15 bp, Homo sapiens
aaggctacaggctcc

SEQ ID NO: 6575546 - DNA, 21 bp, Homo sapiens
aaggctaccttattgtacgtt

SEQ ID NO: 6575547 - DNA, 19 bp, Homo sapiens
aaggctactacagagaagg

SEQ ID NO: 6575548 - DNA, 15 bp, Homo sapiens
aaggctactcacctt

SEQ ID NO: 6575549 - DNA, 15 bp, Homo sapiens
aaggctatgtaaaca

SEQ ID NO: 6575550 - DNA, 15 bp, Homo sapiens
aaggctcagaggagc

SEQ ID NO: 6575551 - DNA, 12 bp, Homo sapiens
aaggctcagccc

SEQ ID NO: 6575552 - DNA, 22 bp, Homo sapiens
aaggctcagcttggatttgtgt

SEQ ID NO: 6575553 - DNA, 18 bp, Homo sapiens
aaggctccaggagcagcc

SEQ ID NO: 6575554 - DNA, 16 bp, Homo sapiens
aaggctccccaccccg

SEQ ID NO: 6575555 - DNA, 20 bp, Homo sapiens
aaggctcccgtactgtctgt

SEQ ID NO: 6575556 - DNA, 18 bp, Homo sapiens
aaggctcctgatcattct

SEQ ID NO: 6575557 - DNA, 19 bp, Homo sapiens
aaggctcgagcatgcctgg

SEQ ID NO: 6575558 - DNA, 11 bp, Homo sapiens
aaggctctaga

SEQ ID NO: 6575559 - DNA, 16 bp, Homo sapiens
aaggctctatgagtct

SEQ ID NO: 6575560 - DNA, 13 bp, Homo sapiens
aaggctctcaccc

SEQ ID NO: 6575561 - DNA, 14 bp, Homo sapiens
aaggctctcccctc

SEQ ID NO: 6575562 - DNA, 17 bp, Homo sapiens
aaggctctgaaagccag

SEQ ID NO: 6575563 - DNA, 18 bp, Homo sapiens
aaggctctgaaagccagc

SEQ ID NO: 6575564 - DNA, 16 bp, Homo sapiens
aaggctctgagagtct

SEQ ID NO: 6575565 - DNA, 22 bp, Homo sapiens
aaggctctgagagtctagattc

SEQ ID NO: 6575566 - DNA, 13 bp, Homo sapiens
aaggctgaaaaga

SEQ ID NO: 6575567 - DNA, 17 bp, Homo sapiens
aaggctgaactcttcag

SEQ ID NO: 6575568 - DNA, 13 bp, Homo sapiens
aaggctgaatcaa

SEQ ID NO: 6575569 - DNA, 18 bp, Homo sapiens
aaggctgaatcaaagaca

SEQ ID NO: 6575570 - DNA, 21 bp, Homo sapiens
aaggctgaatcaaagacattt

SEQ ID NO: 6575571 - DNA, 15 bp, Homo sapiens
aaggctgaccaagag

SEQ ID NO: 6575572 - DNA, 19 bp, Homo sapiens
aaggctgaccaagagagaa

SEQ ID NO: 6575573 - DNA, 12 bp, Homo sapiens
aaggctgagagc

SEQ ID NO: 6575574 - DNA, 23 bp, Homo sapiens
aaggctgaggaaaggccagctgg

SEQ ID NO: 6575575 - DNA, 16 bp, Homo sapiens
aaggctgaggctgccc

SEQ ID NO: 6575576 - DNA, 14 bp, Homo sapiens
aaggctgatttatg

SEQ ID NO: 6575577 - DNA, 13 bp, Homo sapiens
aaggctgcacact

SEQ ID NO: 6575578 - DNA, 18 bp, Homo sapiens
aaggctgcagataacaga

SEQ ID NO: 6575579 - DNA, 22 bp, Homo sapiens
aaggctgcagctaatttgtgaa

SEQ ID NO: 6575580 - DNA, 13 bp, Homo sapiens
aaggctgccggct

SEQ ID NO: 6575581 - DNA, 11 bp, Homo sapiens
aaggctgcctg

SEQ ID NO: 6575582 - DNA, 16 bp, Homo sapiens
aaggctgcctggagaa

SEQ ID NO: 6575583 - DNA, 16 bp, Homo sapiens
aaggctgctggcttca

SEQ ID NO: 6575584 - DNA, 22 bp, Homo sapiens
aaggctgctggcttcagggagg

SEQ ID NO: 6575585 - DNA, 11 bp, Homo sapiens
aaggctgctgt

SEQ ID NO: 6575586 - DNA, 15 bp, Homo sapiens
aaggctgcttagaat

SEQ ID NO: 6575587 - DNA, 17 bp, Homo sapiens
aaggctggaaggcagca

SEQ ID NO: 6575588 - DNA, 18 bp, Homo sapiens
aaggctggagtgcagtgg

SEQ ID NO: 6575589 - DNA, 20 bp, Homo sapiens
aaggctggccagcaaggcag

SEQ ID NO: 6575590 - DNA, 23 bp, Homo sapiens
aaggctggccagcaaggcaggtt

SEQ ID NO: 6575591 - DNA, 21 bp, Homo sapiens
aaggctggctgaaaatcacta

SEQ ID NO: 6575592 - DNA, 16 bp, Homo sapiens
aaggctggctgagtgg

SEQ ID NO: 6575593 - DNA, 15 bp, Homo sapiens
aaggctggggcatgg

SEQ ID NO: 6575594 - DNA, 14 bp, Homo sapiens
aaggctggggccag

SEQ ID NO: 6575595 - DNA, 22 bp, Homo sapiens
aaggctgggggaagaagctctc

SEQ ID NO: 6575596 - DNA, 22 bp, Homo sapiens
aaggctggtgaggtcctggtgc

SEQ ID NO: 6575597 - DNA, 13 bp, Homo sapiens
aaggctgtacata

SEQ ID NO: 6575598 - DNA, 12 bp, Homo sapiens
aaggctgtattc

SEQ ID NO: 6575599 - DNA, 24 bp, Homo sapiens
aaggctgtccacgtacttaattta

SEQ ID NO: 6575600 - DNA, 22 bp, Homo sapiens
aaggctgtccttacccatctgc

SEQ ID NO: 6575601 - DNA, 21 bp, Homo sapiens
aaggctgtcttagtgcaaaaa

SEQ ID NO: 6575602 - DNA, 22 bp, Homo sapiens
aaggctgtcttctcccagagca

SEQ ID NO: 6575603 - DNA, 23 bp, Homo sapiens
aaggctgtgccaggctgggaggc

SEQ ID NO: 6575604 - DNA, 21 bp, Homo sapiens
aaggctgtgctcttcctctgg

SEQ ID NO: 6575605 - DNA, 22 bp, Homo sapiens
aaggctgtgctcttcctctggt

SEQ ID NO: 6575606 - DNA, 23 bp, Homo sapiens
aaggctgtgctcttcctctggtt

SEQ ID NO: 6575607 - DNA, 20 bp, Homo sapiens
ttctgtaatgtaaataaact

SEQ ID NO: 6575608 - DNA, 15 bp, Homo sapiens
ttctgtaattacata

SEQ ID NO: 6575609 - DNA, 11 bp, Homo sapiens
ttctgtaattc

SEQ ID NO: 6575610 - DNA, 16 bp, Homo sapiens
ttctgtaattcaggtt

SEQ ID NO: 6575611 - DNA, 13 bp, Homo sapiens
ttctgtaattctt

SEQ ID NO: 6575612 - DNA, 21 bp, Homo sapiens
ttctgtaattggcttttgaat

SEQ ID NO: 6575613 - DNA, 13 bp, Homo sapiens
ttctgtaattgtg

SEQ ID NO: 6575614 - DNA, 11 bp, Homo sapiens
ttctgtaattt

SEQ ID NO: 6575615 - DNA, 18 bp, Homo sapiens
ttctgtacatagcctata

SEQ ID NO: 6575616 - DNA, 19 bp, Homo sapiens
ttctgtacatagcctatat

SEQ ID NO: 6575617 - DNA, 22 bp, Homo sapiens
ttctgtacatagcctatattta

SEQ ID NO: 6575618 - DNA, 11 bp, Homo sapiens
ttctgtaccag

SEQ ID NO: 6575619 - DNA, 17 bp, Homo sapiens
ttctgtactaaacattt

SEQ ID NO: 6575620 - DNA, 14 bp, Homo sapiens
ttctgtactgattt

SEQ ID NO: 6575621 - DNA, 21 bp, Homo sapiens
ttctgtactgttactgggccc

SEQ ID NO: 6575622 - DNA, 22 bp, Homo sapiens
ttctgtagaaaagaaaacattt

SEQ ID NO: 6575623 - DNA, 21 bp, Homo sapiens
ttctgtagaaatggttgtatt

SEQ ID NO: 6575624 - DNA, 20 bp, Homo sapiens
ttctgtagcttatctgcccc

SEQ ID NO: 6575625 - DNA, 17 bp, Homo sapiens
ttctgtagctttctgga

SEQ ID NO: 6575626 - DNA, 15 bp, Homo sapiens
ttctgtagtcattta

SEQ ID NO: 6575627 - DNA, 15 bp, Homo sapiens
ttctgtagttgcagc

SEQ ID NO: 6575628 - DNA, 23 bp, Homo sapiens
ttctgtatacaaccctggcatta

SEQ ID NO: 6575629 - DNA, 13 bp, Homo sapiens
ttctgtatactgt

SEQ ID NO: 6575630 - DNA, 14 bp, Homo sapiens
ttctgtatactgta

SEQ ID NO: 6575631 - DNA, 18 bp, Homo sapiens
ttctgtatagacaggaga

SEQ ID NO: 6575632 - DNA, 13 bp, Homo sapiens
ttctgtatagatt

SEQ ID NO: 6575633 - DNA, 15 bp, Homo sapiens
ttctgtatatacttt

SEQ ID NO: 6575634 - DNA, 21 bp, Homo sapiens
ttctgtatatttgtcatgaca

SEQ ID NO: 6575635 - DNA, 19 bp, Homo sapiens
ttctgtatcaagcccctgt

SEQ ID NO: 6575636 - DNA, 22 bp, Homo sapiens
ttctgtatcaagcccctgtcta

SEQ ID NO: 6575637 - DNA, 22 bp, Homo sapiens
ttctgtatccgtgaattgcttt

SEQ ID NO: 6575638 - DNA, 17 bp, Homo sapiens
ttctgtatctactttaa

SEQ ID NO: 6575639 - DNA, 12 bp, Homo sapiens
ttctgtatttaa

SEQ ID NO: 6575640 - DNA, 14 bp, Homo sapiens
ttctgtatttaatt

SEQ ID NO: 6575641 - DNA, 13 bp, Homo sapiens
ttctgtatttgaa

SEQ ID NO: 6575642 - DNA, 16 bp, Homo sapiens
ttctgtatttgaaagt

SEQ ID NO: 6575643 - DNA, 15 bp, Homo sapiens
ttctgtattttaaga

SEQ ID NO: 6575644 - DNA, 16 bp, Homo sapiens
ttctgtattttaagaa

SEQ ID NO: 6575645 - DNA, 22 bp, Homo sapiens
ttctgtattttttgtttgtatt

SEQ ID NO: 6575646 - DNA, 14 bp, Homo sapiens
ttctgtcaaatgtg

SEQ ID NO: 6575647 - DNA, 19 bp, Homo sapiens
ttctgtcactcaggctgga

SEQ ID NO: 6575648 - DNA, 19 bp, Homo sapiens
ttctgtcagatgagaacaa

SEQ ID NO: 6575649 - DNA, 21 bp, Homo sapiens
ttctgtcatcccgctcctgct

SEQ ID NO: 6575650 - DNA, 13 bp, Homo sapiens
ttctgtcattgtt

SEQ ID NO: 6575651 - DNA, 20 bp, Homo sapiens
ttctgtcattgttaaataca

SEQ ID NO: 6575652 - DNA, 22 bp, Homo sapiens
ttctgtcattgttaaatacaca

SEQ ID NO: 6575653 - DNA, 17 bp, Homo sapiens
ttctgtccaccagaccc

SEQ ID NO: 6575654 - DNA, 19 bp, Homo sapiens
ttctgtccatcagtgcatg

SEQ ID NO: 6575655 - DNA, 16 bp, Homo sapiens
ttctgtcccctcttcc

SEQ ID NO: 6575656 - DNA, 15 bp, Homo sapiens
ttctgtccctcacag

SEQ ID NO: 6575657 - DNA, 15 bp, Homo sapiens
ttctgtccctgtccc

SEQ ID NO: 6575658 - DNA, 18 bp, Homo sapiens
ttctgtccctgtccctgc

SEQ ID NO: 6575659 - DNA, 14 bp, Homo sapiens
ttctgtcccttcca

SEQ ID NO: 6575660 - DNA, 15 bp, Homo sapiens
ttctgtcccttccac

SEQ ID NO: 6575661 - DNA, 19 bp, Homo sapiens
ttctgtccctttgctcccg

SEQ ID NO: 6575662 - DNA, 17 bp, Homo sapiens
ttctgtcctagcaagta

SEQ ID NO: 6575663 - DNA, 20 bp, Homo sapiens
ttctgtcctcttctctgcat

SEQ ID NO: 6575664 - DNA, 14 bp, Homo sapiens
ttctgtcctgggca

SEQ ID NO: 6575665 - DNA, 22 bp, Homo sapiens
ttctgtccttttggcactgaga

SEQ ID NO: 6575666 - DNA, 21 bp, Homo sapiens
ttctgtcgccttagcatgttt

SEQ ID NO: 6575667 - DNA, 14 bp, Homo sapiens
ttctgtcgtcccca

SEQ ID NO: 6575668 - DNA, 15 bp, Homo sapiens
ttctgtctactaagt

SEQ ID NO: 6575669 - DNA, 16 bp, Homo sapiens
ttctgtctactaagtg

SEQ ID NO: 6575670 - DNA, 18 bp, Homo sapiens
ttctgtctactaagtgat

SEQ ID NO: 6575671 - DNA, 13 bp, Homo sapiens
ttctgtctctctc

SEQ ID NO: 6575672 - DNA, 13 bp, Homo sapiens
ttctgtctctctt

SEQ ID NO: 6575673 - DNA, 18 bp, Homo sapiens
ttctgtctctgcttggct

SEQ ID NO: 6575674 - DNA, 17 bp, Homo sapiens
ttctgtctgaattattc

SEQ ID NO: 6575675 - DNA, 19 bp, Homo sapiens
ttctgtctggggacgaagg

SEQ ID NO: 6575676 - DNA, 14 bp, Homo sapiens
ttctgtctgtaaga

SEQ ID NO: 6575677 - DNA, 22 bp, Homo sapiens
ttctgtcttcatcccctcagaa

SEQ ID NO: 6575678 - DNA, 17 bp, Homo sapiens
ttctgtcttccaggccc

SEQ ID NO: 6575679 - DNA, 12 bp, Homo sapiens
ttctgtcttgtc

SEQ ID NO: 6575680 - DNA, 15 bp, Homo sapiens
ttctgtctttcaaaa

SEQ ID NO: 6575681 - DNA, 18 bp, Homo sapiens
ttctgtctttctgctatg

SEQ ID NO: 6575682 - DNA, 13 bp, Homo sapiens
ttctgtgaaattc

SEQ ID NO: 6575683 - DNA, 19 bp, Homo sapiens
ttctgtgaaattctcagag

SEQ ID NO: 6575684 - DNA, 13 bp, Homo sapiens
ttctgtgaagaat

SEQ ID NO: 6575685 - DNA, 21 bp, Homo sapiens
ttctgtgaagccctttgcctg

SEQ ID NO: 6575686 - DNA, 22 bp, Homo sapiens
ttctgtgaagccctttgcctgt

SEQ ID NO: 6575687 - DNA, 15 bp, Homo sapiens
ttctgtgaagctaat

SEQ ID NO: 6575688 - DNA, 17 bp, Homo sapiens
ttctgtgacccatctgt

SEQ ID NO: 6575689 - DNA, 16 bp, Homo sapiens
ttctgtgagataaatg

SEQ ID NO: 6575690 - DNA, 16 bp, Homo sapiens
ttctgtgattaaatct

SEQ ID NO: 6575691 - DNA, 15 bp, Homo sapiens
ttctgtgcactgtag

SEQ ID NO: 6575692 - DNA, 23 bp, Homo sapiens
ttctgtgcatctggcctgggggc

SEQ ID NO: 6575693 - DNA, 12 bp, Homo sapiens
ttctgtgcatgt

SEQ ID NO: 6575694 - DNA, 14 bp, Homo sapiens
ttctgtgcatgtgc

SEQ ID NO: 6575695 - DNA, 22 bp, Homo sapiens
ttctgtgcatttgtgtctgcct

SEQ ID NO: 6575696 - DNA, 24 bp, Homo sapiens
ttctgtgcatttgtgtctgcctgc

SEQ ID NO: 6575697 - DNA, 19 bp, Homo sapiens
ttctgtgcccagaatactg

SEQ ID NO: 6575698 - DNA, 20 bp, Homo sapiens
ttctgtgcccagaatactga

SEQ ID NO: 6575699 - DNA, 13 bp, Homo sapiens
ttctgtgcccagg

SEQ ID NO: 6575700 - DNA, 11 bp, Homo sapiens
ttctgtgcctc

SEQ ID NO: 6575701 - DNA, 15 bp, Homo sapiens
ttctgtgcctccccc

SEQ ID NO: 6575702 - DNA, 13 bp, Homo sapiens
ttctgtgcctctt

SEQ ID NO: 6575703 - DNA, 23 bp, Homo sapiens
ttctgtgcctcttatcaagtgtt

SEQ ID NO: 6575704 - DNA, 16 bp, Homo sapiens
ttctgtgcctgaatat

SEQ ID NO: 6575705 - DNA, 18 bp, Homo sapiens
ttctgtggaaaacaattt

SEQ ID NO: 6575706 - DNA, 21 bp, Homo sapiens
ttctgtggaaagtgtaaagca

SEQ ID NO: 6575707 - DNA, 19 bp, Homo sapiens
ttctgtggagagtgagaat

SEQ ID NO: 6575708 - DNA, 14 bp, Homo sapiens
ttctgtggagtaaa

SEQ ID NO: 6575709 - DNA, 21 bp, Homo sapiens
ttctgtgggcttggccttgtg

SEQ ID NO: 6575710 - DNA, 22 bp, Homo sapiens
ttctgtgggtccgataatatct

SEQ ID NO: 6575711 - DNA, 17 bp, Homo sapiens
ttctgtggtcacagtga

SEQ ID NO: 6575712 - DNA, 17 bp, Homo sapiens
ttctgtggttcctctgc

SEQ ID NO: 6575713 - DNA, 22 bp, Homo sapiens
ttctgtggtttcatgttagtta

SEQ ID NO: 6575714 - DNA, 18 bp, Homo sapiens
ttctgtggttttcccctc

SEQ ID NO: 6575715 - DNA, 22 bp, Homo sapiens
ttctgtggttttcccctccctg

SEQ ID NO: 6575716 - DNA, 17 bp, Homo sapiens
ttctgtgtaaccatttt

SEQ ID NO: 6575717 - DNA, 18 bp, Homo sapiens
ttctgtgtaaccatttta

SEQ ID NO: 6575718 - DNA, 15 bp, Homo sapiens
ttctgtgtacatttt

SEQ ID NO: 6575719 - DNA, 22 bp, Homo sapiens
ttctgtgtaccacttcctgagg

SEQ ID NO: 6575720 - DNA, 13 bp, Homo sapiens
ttctgtgtacttt

SEQ ID NO: 6575721 - DNA, 15 bp, Homo sapiens
ttctgtgtagagaat

SEQ ID NO: 6575722 - DNA, 16 bp, Homo sapiens
ttctgtgtagagaatg

SEQ ID NO: 6575723 - DNA, 16 bp, Homo sapiens
ttctgtgtatttaatt

SEQ ID NO: 6575724 - DNA, 20 bp, Homo sapiens
ttctgtgtatttaattgtaa

SEQ ID NO: 6575725 - DNA, 12 bp, Homo sapiens
ttctgtgtcacg

SEQ ID NO: 6575726 - DNA, 19 bp, Homo sapiens
ttctgtgtcccatgtcccg

SEQ ID NO: 6575727 - DNA, 12 bp, Homo sapiens
ttctgtgtcttt

SEQ ID NO: 6575728 - DNA, 23 bp, Homo sapiens
ttctgtgtctttcacagctcctc

SEQ ID NO: 6575729 - DNA, 23 bp, Homo sapiens
ttctgtgtgcaccttaccaactt

SEQ ID NO: 6575730 - DNA, 18 bp, Homo sapiens
ttctgtgtggagtatttt

SEQ ID NO: 6575731 - DNA, 17 bp, Homo sapiens
ttctgtgtggtgcattc

SEQ ID NO: 6575732 - DNA, 20 bp, Homo sapiens
ttctgtgtgtacatgtacat

SEQ ID NO: 6575733 - DNA, 16 bp, Homo sapiens
ttctgtgtgtcagttt

SEQ ID NO: 6575734 - DNA, 18 bp, Homo sapiens
ttctgtgtgtcagttttc

SEQ ID NO: 6575735 - DNA, 12 bp, Homo sapiens
ttctgtgtgtga

SEQ ID NO: 6575736 - DNA, 22 bp, Homo sapiens
ttctgtgtgtgatgtgcatggg

SEQ ID NO: 6575737 - DNA, 17 bp, Homo sapiens
ttctgtgtttaatttct

SEQ ID NO: 6575738 - DNA, 14 bp, Homo sapiens
ttctgtgtttagct

SEQ ID NO: 6575739 - DNA, 17 bp, Homo sapiens
ttctgtgtttagctatt

SEQ ID NO: 6575740 - DNA, 21 bp, Homo sapiens
ttctgtgtttagctatttaat

SEQ ID NO: 6575741 - DNA, 18 bp, Homo sapiens
ttctgtgtttataaaata

SEQ ID NO: 6575742 - DNA, 17 bp, Homo sapiens
ttctgtgtttattcaaa

SEQ ID NO: 6575743 - DNA, 17 bp, Homo sapiens
ttctgtgtttctggagt

SEQ ID NO: 6575744 - DNA, 14 bp, Homo sapiens
ttctgttaaaatgg

SEQ ID NO: 6575745 - DNA, 24 bp, Homo sapiens
ttctgttaaaatggggataataat

SEQ ID NO: 6575746 - DNA, 22 bp, Homo sapiens
ttctgttaaatatttttgtaca

SEQ ID NO: 6575747 - DNA, 17 bp, Homo sapiens
ttctgttaactcttgaa

SEQ ID NO: 6575748 - DNA, 15 bp, Homo sapiens
ttctgttaactgaat

SEQ ID NO: 6575749 - DNA, 21 bp, Homo sapiens
ttctgttaactgaataccact

SEQ ID NO: 6575750 - DNA, 15 bp, Homo sapiens
ttctgttaagaaagg

SEQ ID NO: 6575751 - DNA, 13 bp, Homo sapiens
ttctgttacaaaa

SEQ ID NO: 6575752 - DNA, 15 bp, Homo sapiens
ttctgttacaaaatg

SEQ ID NO: 6575753 - DNA, 16 bp, Homo sapiens
ttctgttacaaaatgt

SEQ ID NO: 6575754 - DNA, 18 bp, Homo sapiens
ttctgttacacaatatgt

SEQ ID NO: 6575755 - DNA, 14 bp, Homo sapiens
ttctgttagctgct

SEQ ID NO: 6575756 - DNA, 17 bp, Homo sapiens
ttctgttagctgctcac

SEQ ID NO: 6575757 - DNA, 18 bp, Homo sapiens
ttctgttagctgctcact

SEQ ID NO: 6575758 - DNA, 20 bp, Homo sapiens
ttctgttaggggccaataaa

SEQ ID NO: 6575759 - DNA, 21 bp, Homo sapiens
ttctgttaggggccaataaaa

SEQ ID NO: 6575760 - DNA, 22 bp, Homo sapiens
ttctgttaggggccaataaaat

SEQ ID NO: 6575761 - DNA, 23 bp, Homo sapiens
ttctgttaggggccaataaaatg

SEQ ID NO: 6575762 - DNA, 19 bp, Homo sapiens
ttctgttatttttaagctt

SEQ ID NO: 6575763 - DNA, 14 bp, Homo sapiens
ttctgttcactttt

SEQ ID NO: 6575764 - DNA, 16 bp, Homo sapiens
ttctgttcagattaaa

SEQ ID NO: 6575765 - DNA, 23 bp, Homo sapiens
ttctgttcatctctttgtcctga

SEQ ID NO: 6575766 - DNA, 9 bp, Homo sapiens
ttctgttcc

SEQ ID NO: 6575767 - DNA, 17 bp, Homo sapiens
ttctgttccaaattcag

SEQ ID NO: 6575768 - DNA, 12 bp, Homo sapiens
ttctgttcccaa

SEQ ID NO: 6575769 - DNA, 19 bp, Homo sapiens
ttctgttccctatggagag

SEQ ID NO: 6575770 - DNA, 13 bp, Homo sapiens
ttctgttctactt

SEQ ID NO: 6575771 - DNA, 17 bp, Homo sapiens
ttctgttctgcaactcc

SEQ ID NO: 6575772 - DNA, 12 bp, Homo sapiens
ttctgttctgcc

SEQ ID NO: 6575773 - DNA, 12 bp, Homo sapiens
ttctgttctggg

SEQ ID NO: 6575774 - DNA, 13 bp, Homo sapiens
ttctgttctgtgg

SEQ ID NO: 6575775 - DNA, 16 bp, Homo sapiens
ttctgttctgtggaaa

SEQ ID NO: 6575776 - DNA, 21 bp, Homo sapiens
ttctgttctgtggaaagtgta

SEQ ID NO: 6575777 - DNA, 11 bp, Homo sapiens
ttctgttcttt

SEQ ID NO: 6575778 - DNA, 22 bp, Homo sapiens
ttctgttgaaacttacactgtt

SEQ ID NO: 6575779 - DNA, 14 bp, Homo sapiens
ttctgttgaaggtg

SEQ ID NO: 6575780 - DNA, 14 bp, Homo sapiens
ttctgttgagagaa

SEQ ID NO: 6575781 - DNA, 11 bp, Homo sapiens
ttctgttgctg

SEQ ID NO: 6575782 - DNA, 17 bp, Homo sapiens
ttctgttgctgcctcat

SEQ ID NO: 6575783 - DNA, 22 bp, Homo sapiens
ttctgttggattccatgctaag

SEQ ID NO: 6575784 - DNA, 11 bp, Homo sapiens
ttctgttgtaa

SEQ ID NO: 6575785 - DNA, 15 bp, Homo sapiens
ttctgttgtaactta

SEQ ID NO: 6575786 - DNA, 16 bp, Homo sapiens
ttctgttgtaatagtc

SEQ ID NO: 6575787 - DNA, 19 bp, Homo sapiens
aaggctgtgtacactgaca

SEQ ID NO: 6575788 - DNA, 21 bp, Homo sapiens
aaggctgtgtttagattgtat

SEQ ID NO: 6575789 - DNA, 23 bp, Homo sapiens
aaggctgtgtttagattgtatta

SEQ ID NO: 6575790 - DNA, 20 bp, Homo sapiens
aaggctgttaaatacaggaa

SEQ ID NO: 6575791 - DNA, 21 bp, Homo sapiens
aaggctgttaaatacaggaaa

SEQ ID NO: 6575792 - DNA, 23 bp, Homo sapiens
aaggcttcaatttattgcacaaa

SEQ ID NO: 6575793 - DNA, 15 bp, Homo sapiens
aaggcttcactctta

SEQ ID NO: 6575794 - DNA, 13 bp, Homo sapiens
aaggcttcagtct

SEQ ID NO: 6575795 - DNA, 18 bp, Homo sapiens
aaggcttctctctgtggg

SEQ ID NO: 6575796 - DNA, 16 bp, Homo sapiens
aaggcttgaagctgtg

SEQ ID NO: 6575797 - DNA, 21 bp, Homo sapiens
aaggcttgccgcacatgaaac

SEQ ID NO: 6575798 - DNA, 15 bp, Homo sapiens
aaggcttgctgcaga

SEQ ID NO: 6575799 - DNA, 17 bp, Homo sapiens
aaggcttgttgtgcttt

SEQ ID NO: 6575800 - DNA, 16 bp, Homo sapiens
aaggctttaaagctga

SEQ ID NO: 6575801 - DNA, 16 bp, Homo sapiens
aaggctttcagggcct

SEQ ID NO: 6575802 - DNA, 22 bp, Homo sapiens
aaggcttttcaaccacaaaact

SEQ ID NO: 6575803 - DNA, 11 bp, Homo sapiens
aagggaaaaaa

SEQ ID NO: 6575804 - DNA, 21 bp, Homo sapiens
aagggaaaaaagcaactttcc

SEQ ID NO: 6575805 - DNA, 13 bp, Homo sapiens
aagggaaaaaata

SEQ ID NO: 6575806 - DNA, 17 bp, Homo sapiens
aagggaaaaaataaaaa

SEQ ID NO: 6575807 - DNA, 13 bp, Homo sapiens
aagggaaaaatca

SEQ ID NO: 6575808 - DNA, 16 bp, Homo sapiens
aagggaaaagtctctt

SEQ ID NO: 6575809 - DNA, 16 bp, Homo sapiens
aagggaaacaaagaag

SEQ ID NO: 6575810 - DNA, 14 bp, Homo sapiens
aagggaaacagtca

SEQ ID NO: 6575811 - DNA, 17 bp, Homo sapiens
aagggaaactgccagca

SEQ ID NO: 6575812 - DNA, 23 bp, Homo sapiens
aagggaaactgccagcaacgcag

SEQ ID NO: 6575813 - DNA, 17 bp, Homo sapiens
aagggaaactgggaaac

SEQ ID NO: 6575814 - DNA, 15 bp, Homo sapiens
aagggaaagaaaatg

SEQ ID NO: 6575815 - DNA, 22 bp, Homo sapiens
aagggaaagaaattcttttcaa

SEQ ID NO: 6575816 - DNA, 13 bp, Homo sapiens
aagggaaagctgt

SEQ ID NO: 6575817 - DNA, 16 bp, Homo sapiens
aagggaaaggcaagct

SEQ ID NO: 6575818 - DNA, 12 bp, Homo sapiens
aagggaaataga

SEQ ID NO: 6575819 - DNA, 15 bp, Homo sapiens
aagggaaatatcatt

SEQ ID NO: 6575820 - DNA, 16 bp, Homo sapiens
aagggaacaggaaaag

SEQ ID NO: 6575821 - DNA, 23 bp, Homo sapiens
aagggaacagtgaggtgcccagc

SEQ ID NO: 6575822 - DNA, 14 bp, Homo sapiens
aagggaaccagccc

SEQ ID NO: 6575823 - DNA, 16 bp, Homo sapiens
aagggaaccagccctc

SEQ ID NO: 6575824 - DNA, 20 bp, Homo sapiens
aagggaacccccaaatttaa

SEQ ID NO: 6575825 - DNA, 21 bp, Homo sapiens
aagggaactagataacatact

SEQ ID NO: 6575826 - DNA, 14 bp, Homo sapiens
aagggaagacattt

SEQ ID NO: 6575827 - DNA, 17 bp, Homo sapiens
aagggaagagcctttat

SEQ ID NO: 6575828 - DNA, 23 bp, Homo sapiens
aagggaagcacatgatcatggga

SEQ ID NO: 6575829 - DNA, 15 bp, Homo sapiens
aagggaagcccagcc

SEQ ID NO: 6575830 - DNA, 20 bp, Homo sapiens
aagggaagcgtatatactta

SEQ ID NO: 6575831 - DNA, 14 bp, Homo sapiens
aagggaaggacagc

SEQ ID NO: 6575832 - DNA, 19 bp, Homo sapiens
aagggaaggctgctgtgta

SEQ ID NO: 6575833 - DNA, 20 bp, Homo sapiens
aagggaagtagttatcatgt

SEQ ID NO: 6575834 - DNA, 22 bp, Homo sapiens
aagggaagtagttatcatgtta

SEQ ID NO: 6575835 - DNA, 15 bp, Homo sapiens
aagggaagtgaggcc

SEQ ID NO: 6575836 - DNA, 18 bp, Homo sapiens
aagggaagtgaggcccaa

SEQ ID NO: 6575837 - DNA, 16 bp, Homo sapiens
aagggaataaaatctg

SEQ ID NO: 6575838 - DNA, 19 bp, Homo sapiens
aagggaatactcacatttt

SEQ ID NO: 6575839 - DNA, 14 bp, Homo sapiens
aagggaatgcatta

SEQ ID NO: 6575840 - DNA, 14 bp, Homo sapiens
aagggaattgctca

SEQ ID NO: 6575841 - DNA, 17 bp, Homo sapiens
aagggaattgtttttat

SEQ ID NO: 6575842 - DNA, 19 bp, Homo sapiens
aagggaattgtttttataa

SEQ ID NO: 6575843 - DNA, 12 bp, Homo sapiens
aagggacacaat

SEQ ID NO: 6575844 - DNA, 13 bp, Homo sapiens
aagggacacacac

SEQ ID NO: 6575845 - DNA, 22 bp, Homo sapiens
aagggacacccctacacacacc

SEQ ID NO: 6575846 - DNA, 15 bp, Homo sapiens
aagggacagcatgcc

SEQ ID NO: 6575847 - DNA, 15 bp, Homo sapiens
aagggacaggaaggt

SEQ ID NO: 6575848 - DNA, 18 bp, Homo sapiens
aagggacaggtgggcctg

SEQ ID NO: 6575849 - DNA, 19 bp, Homo sapiens
aagggacaggtgggcctgg

SEQ ID NO: 6575850 - DNA, 23 bp, Homo sapiens
aagggacatgtctttggcttcag

SEQ ID NO: 6575851 - DNA, 16 bp, Homo sapiens
aagggacatgttttga

SEQ ID NO: 6575852 - DNA, 19 bp, Homo sapiens
aagggacatgttttgataa

SEQ ID NO: 6575853 - DNA, 17 bp, Homo sapiens
aagggacattgaagtgt

SEQ ID NO: 6575854 - DNA, 21 bp, Homo sapiens
aagggacatttctataaaaat

SEQ ID NO: 6575855 - DNA, 20 bp, Homo sapiens
aagggaccaagcgaccaagg

SEQ ID NO: 6575856 - DNA, 15 bp, Homo sapiens
aagggaccagccctt

SEQ ID NO: 6575857 - DNA, 19 bp, Homo sapiens
aagggaccagcccttcatg

SEQ ID NO: 6575858 - DNA, 22 bp, Homo sapiens
aagggaccatctgctgcagtta

SEQ ID NO: 6575859 - DNA, 16 bp, Homo sapiens
aagggacgggggtggg

SEQ ID NO: 6575860 - DNA, 15 bp, Homo sapiens
aagggactacctctg

SEQ ID NO: 6575861 - DNA, 20 bp, Homo sapiens
aagggactacctctgtgcct

SEQ ID NO: 6575862 - DNA, 19 bp, Homo sapiens
aagggactctgggctgtgc

SEQ ID NO: 6575863 - DNA, 17 bp, Homo sapiens
aagggactgagaaattt

SEQ ID NO: 6575864 - DNA, 13 bp, Homo sapiens
aagggactttgga

SEQ ID NO: 6575865 - DNA, 23 bp, Homo sapiens
aagggactttggaaaactacttt

SEQ ID NO: 6575866 - DNA, 13 bp, Homo sapiens
aagggagaaaaaa

SEQ ID NO: 6575867 - DNA, 23 bp, Homo sapiens
aagggagaagacaacagaaagag

SEQ ID NO: 6575868 - DNA, 22 bp, Homo sapiens
aagggagaagacactgcagtga

SEQ ID NO: 6575869 - DNA, 23 bp, Homo sapiens
aagggagaataaaattcctatct

SEQ ID NO: 6575870 - DNA, 13 bp, Homo sapiens
aagggagacaggc

SEQ ID NO: 6575871 - DNA, 14 bp, Homo sapiens
aagggagacaggcc

SEQ ID NO: 6575872 - DNA, 13 bp, Homo sapiens
aagggagagaaaa

SEQ ID NO: 6575873 - DNA, 19 bp, Homo sapiens
aagggagagaaaagctgga

SEQ ID NO: 6575874 - DNA, 17 bp, Homo sapiens
aagggagaggaagagaa

SEQ ID NO: 6575875 - DNA, 19 bp, Homo sapiens
aagggagatgtcaggatgt

SEQ ID NO: 6575876 - DNA, 15 bp, Homo sapiens
aagggaggaacacta

SEQ ID NO: 6575877 - DNA, 22 bp, Homo sapiens
aagggaggattttgggtggcca

SEQ ID NO: 6575878 - DNA, 22 bp, Homo sapiens
aagggaggcacttcctcccctc

SEQ ID NO: 6575879 - DNA, 19 bp, Homo sapiens
aagggaggcccagccgcag

SEQ ID NO: 6575880 - DNA, 14 bp, Homo sapiens
aagggaggcctgag

SEQ ID NO: 6575881 - DNA, 17 bp, Homo sapiens
aagggaggcctgagggg

SEQ ID NO: 6575882 - DNA, 20 bp, Homo sapiens
aagggagggagctgaggcct

SEQ ID NO: 6575883 - DNA, 15 bp, Homo sapiens
aagggaggggaagag

SEQ ID NO: 6575884 - DNA, 15 bp, Homo sapiens
aagggaggggaaggg

SEQ ID NO: 6575885 - DNA, 16 bp, Homo sapiens
aagggagggggctggc

SEQ ID NO: 6575886 - DNA, 23 bp, Homo sapiens
aagggagggggctggctctgaga

SEQ ID NO: 6575887 - DNA, 21 bp, Homo sapiens
aagggagggtgcagccctctt

SEQ ID NO: 6575888 - DNA, 12 bp, Homo sapiens
aagggagggtgg

SEQ ID NO: 6575889 - DNA, 13 bp, Homo sapiens
aagggagggtggc

SEQ ID NO: 6575890 - DNA, 15 bp, Homo sapiens
aagggagggtggcag

SEQ ID NO: 6575891 - DNA, 17 bp, Homo sapiens
aagggagggtggcagag

SEQ ID NO: 6575892 - DNA, 16 bp, Homo sapiens
aagggaggtaaaaaat

SEQ ID NO: 6575893 - DNA, 18 bp, Homo sapiens
aagggagtaagtagaggt

SEQ ID NO: 6575894 - DNA, 16 bp, Homo sapiens
aagggagtaggctgta

SEQ ID NO: 6575895 - DNA, 19 bp, Homo sapiens
aagggagtaggctgtattt

SEQ ID NO: 6575896 - DNA, 16 bp, Homo sapiens
aagggagtgaaaacct

SEQ ID NO: 6575897 - DNA, 23 bp, Homo sapiens
aagggagtggggctggggaaagg

SEQ ID NO: 6575898 - DNA, 18 bp, Homo sapiens
aagggagttgctcactca

SEQ ID NO: 6575899 - DNA, 20 bp, Homo sapiens
aagggagttgctcactcagg

SEQ ID NO: 6575900 - DNA, 16 bp, Homo sapiens
aagggatataaaatga

SEQ ID NO: 6575901 - DNA, 16 bp, Homo sapiens
aagggatcatcatgca

SEQ ID NO: 6575902 - DNA, 22 bp, Homo sapiens
aagggatccagagacctgctcc

SEQ ID NO: 6575903 - DNA, 14 bp, Homo sapiens
aagggatccctaac

SEQ ID NO: 6575904 - DNA, 20 bp, Homo sapiens
aagggatcctaatcccttcc

SEQ ID NO: 6575905 - DNA, 15 bp, Homo sapiens
aagggatctggtcct

SEQ ID NO: 6575906 - DNA, 18 bp, Homo sapiens
aagggatgatgtggtttt

SEQ ID NO: 6575907 - DNA, 21 bp, Homo sapiens
aagggatggaaaaggaagact

SEQ ID NO: 6575908 - DNA, 14 bp, Homo sapiens
aagggatggtcagg

SEQ ID NO: 6575909 - DNA, 18 bp, Homo sapiens
aagggattacccaagcaa

SEQ ID NO: 6575910 - DNA, 11 bp, Homo sapiens
aagggattctg

SEQ ID NO: 6575911 - DNA, 20 bp, Homo sapiens
aagggattggtttggcaaga

SEQ ID NO: 6575912 - DNA, 16 bp, Homo sapiens
aagggatttcttaggg

SEQ ID NO: 6575913 - DNA, 18 bp, Homo sapiens
aagggcaagatgtaaagc

SEQ ID NO: 6575914 - DNA, 18 bp, Homo sapiens
aagggcaatcagcaatca

SEQ ID NO: 6575915 - DNA, 13 bp, Homo sapiens
aagggcacacaca

SEQ ID NO: 6575916 - DNA, 16 bp, Homo sapiens
aagggcacatagaaag

SEQ ID NO: 6575917 - DNA, 14 bp, Homo sapiens
aagggcactcccaa

SEQ ID NO: 6575918 - DNA, 18 bp, Homo sapiens
aagggcactcccaaccct

SEQ ID NO: 6575919 - DNA, 18 bp, Homo sapiens
aagggcacttaatttgta

SEQ ID NO: 6575920 - DNA, 19 bp, Homo sapiens
aagggcacttaatttgtaa

SEQ ID NO: 6575921 - DNA, 11 bp, Homo sapiens
aagggcagaga

SEQ ID NO: 6575922 - DNA, 15 bp, Homo sapiens
aagggcagaggcaag

SEQ ID NO: 6575923 - DNA, 16 bp, Homo sapiens
aagggcagccaggggc

SEQ ID NO: 6575924 - DNA, 11 bp, Homo sapiens
aagggcagccc

SEQ ID NO: 6575925 - DNA, 14 bp, Homo sapiens
aagggcagcccctc

SEQ ID NO: 6575926 - DNA, 15 bp, Homo sapiens
aagggcagccctcca

SEQ ID NO: 6575927 - DNA, 15 bp, Homo sapiens
aagggcagctgtgat

SEQ ID NO: 6575928 - DNA, 22 bp, Homo sapiens
aagggcaggaagacttccagct

SEQ ID NO: 6575929 - DNA, 22 bp, Homo sapiens
aagggcaggaaggagagcctgc

SEQ ID NO: 6575930 - DNA, 16 bp, Homo sapiens
aagggcaggagcctag

SEQ ID NO: 6575931 - DNA, 22 bp, Homo sapiens
aagggcaggcccaaattatcaa

SEQ ID NO: 6575932 - DNA, 18 bp, Homo sapiens
aagggcaggtcttcatat

SEQ ID NO: 6575933 - DNA, 11 bp, Homo sapiens
aagggcagtgc

SEQ ID NO: 6575934 - DNA, 13 bp, Homo sapiens
aagggcagtgccc

SEQ ID NO: 6575935 - DNA, 22 bp, Homo sapiens
aagggcagtgcccatgtgtaca

SEQ ID NO: 6575936 - DNA, 20 bp, Homo sapiens
aagggcagttttgaggcatg

SEQ ID NO: 6575937 - DNA, 15 bp, Homo sapiens
aagggcataaagtaa

SEQ ID NO: 6575938 - DNA, 18 bp, Homo sapiens
aagggcatcaggcactgg

SEQ ID NO: 6575939 - DNA, 19 bp, Homo sapiens
aagggcatgcacgggcatg

SEQ ID NO: 6575940 - DNA, 16 bp, Homo sapiens
aagggcatgccttgtg

SEQ ID NO: 6575941 - DNA, 17 bp, Homo sapiens
aagggcatgccttgtgc

SEQ ID NO: 6575942 - DNA, 18 bp, Homo sapiens
aagggcatgggtcgggag

SEQ ID NO: 6575943 - DNA, 20 bp, Homo sapiens
aagggcatgggtcgggagag

SEQ ID NO: 6575944 - DNA, 21 bp, Homo sapiens
aagggcatgggtcgggagagg

SEQ ID NO: 6575945 - DNA, 22 bp, Homo sapiens
aagggcatgggtcgggagaggg

SEQ ID NO: 6575946 - DNA, 21 bp, Homo sapiens
aagggcatgttgggataaata

SEQ ID NO: 6575947 - DNA, 14 bp, Homo sapiens
aagggcattttaaa

SEQ ID NO: 6575948 - DNA, 16 bp, Homo sapiens
aagggcattttaaaag

SEQ ID NO: 6575949 - DNA, 14 bp, Homo sapiens
aagggcattttacc

SEQ ID NO: 6575950 - DNA, 17 bp, Homo sapiens
aagggccaaacccactt

SEQ ID NO: 6575951 - DNA, 22 bp, Homo sapiens
aagggccaatggagaaaatgaa

SEQ ID NO: 6575952 - DNA, 22 bp, Homo sapiens
aagggccacctacaatacatct

SEQ ID NO: 6575953 - DNA, 20 bp, Homo sapiens
aagggccagaaaaaagtgtt

SEQ ID NO: 6575954 - DNA, 17 bp, Homo sapiens
aagggccagaaaaattt

SEQ ID NO: 6575955 - DNA, 17 bp, Homo sapiens
aagggccagacagacct

SEQ ID NO: 6575956 - DNA, 22 bp, Homo sapiens
aagggccagacagaccttcaca

SEQ ID NO: 6575957 - DNA, 15 bp, Homo sapiens
aagggccagcatata

SEQ ID NO: 6575958 - DNA, 16 bp, Homo sapiens
aagggccaggagagag

SEQ ID NO: 6575959 - DNA, 22 bp, Homo sapiens
aagggccagtcctgcctggcca

SEQ ID NO: 6575960 - DNA, 18 bp, Homo sapiens
aagggccagtctgggctg

SEQ ID NO: 6575961 - DNA, 16 bp, Homo sapiens
aagggcccacacctgg

SEQ ID NO: 6575962 - DNA, 12 bp, Homo sapiens
aagggcccagac

SEQ ID NO: 6575963 - DNA, 11 bp, Homo sapiens
aagggcccagg

SEQ ID NO: 6575964 - DNA, 12 bp, Homo sapiens
aagggccccagg

SEQ ID NO: 6575965 - DNA, 14 bp, Homo sapiens
aagggccccagggg

SEQ ID NO: 6575966 - DNA, 19 bp, Homo sapiens
ttctgttgtaatagtccat

SEQ ID NO: 6575967 - DNA, 20 bp, Homo sapiens
ttctgttgtaatttaatgac

SEQ ID NO: 6575968 - DNA, 21 bp, Homo sapiens
ttctgttgtgttcaccagaga

SEQ ID NO: 6575969 - DNA, 24 bp, Homo sapiens
ttctgttgttcagtcctctgcact

SEQ ID NO: 6575970 - DNA, 20 bp, Homo sapiens
ttctgttgttccattttatg

SEQ ID NO: 6575971 - DNA, 14 bp, Homo sapiens
ttctgttgtttctt

SEQ ID NO: 6575972 - DNA, 19 bp, Homo sapiens
ttctgtttacatcagtttt

SEQ ID NO: 6575973 - DNA, 13 bp, Homo sapiens
ttctgtttagata

SEQ ID NO: 6575974 - DNA, 13 bp, Homo sapiens
ttctgtttaggaa

SEQ ID NO: 6575975 - DNA, 14 bp, Homo sapiens
ttctgtttaggaag

SEQ ID NO: 6575976 - DNA, 19 bp, Homo sapiens
ttctgtttattcttccaga

SEQ ID NO: 6575977 - DNA, 16 bp, Homo sapiens
ttctgtttcaaagcac

SEQ ID NO: 6575978 - DNA, 23 bp, Homo sapiens
ttctgtttctaatttgctgctga

SEQ ID NO: 6575979 - DNA, 15 bp, Homo sapiens
ttctgtttctagttg

SEQ ID NO: 6575980 - DNA, 20 bp, Homo sapiens
ttctgtttctattctctcct

SEQ ID NO: 6575981 - DNA, 18 bp, Homo sapiens
ttctgtttctgtttataa

SEQ ID NO: 6575982 - DNA, 17 bp, Homo sapiens
ttctgtttcttcttgtg

SEQ ID NO: 6575983 - DNA, 17 bp, Homo sapiens
ttctgtttgaattttca

SEQ ID NO: 6575984 - DNA, 20 bp, Homo sapiens
ttctgtttgaattttcaaag

SEQ ID NO: 6575985 - DNA, 13 bp, Homo sapiens
ttctgtttggcac

SEQ ID NO: 6575986 - DNA, 18 bp, Homo sapiens
ttctgtttggcacttgta

SEQ ID NO: 6575987 - DNA, 15 bp, Homo sapiens
ttctgtttgtaaatt

SEQ ID NO: 6575988 - DNA, 16 bp, Homo sapiens
ttctgtttgtaaatta

SEQ ID NO: 6575989 - DNA, 14 bp, Homo sapiens
ttctgtttgttaaa

SEQ ID NO: 6575990 - DNA, 15 bp, Homo sapiens
ttctgttttagagtt

SEQ ID NO: 6575991 - DNA, 16 bp, Homo sapiens
ttctgttttataattt

SEQ ID NO: 6575992 - DNA, 14 bp, Homo sapiens
ttctgttttcaatc

SEQ ID NO: 6575993 - DNA, 22 bp, Homo sapiens
ttctgttttcgtaccttcccac

SEQ ID NO: 6575994 - DNA, 11 bp, Homo sapiens
ttctgttttct

SEQ ID NO: 6575995 - DNA, 21 bp, Homo sapiens
ttctgttttctaaaggagcag

SEQ ID NO: 6575996 - DNA, 12 bp, Homo sapiens
ttctgttttctg

SEQ ID NO: 6575997 - DNA, 17 bp, Homo sapiens
ttctgttttcttctcag

SEQ ID NO: 6575998 - DNA, 22 bp, Homo sapiens
ttctgttttcttctcagtcttt

SEQ ID NO: 6575999 - DNA, 21 bp, Homo sapiens
ttctgttttgttaatataccc

SEQ ID NO: 6576000 - DNA, 15 bp, Homo sapiens
ttctgtttttatgtt

SEQ ID NO: 6576001 - DNA, 16 bp, Homo sapiens
ttctgtttttctcaaa

SEQ ID NO: 6576002 - DNA, 23 bp, Homo sapiens
ttctgttttttttttttgtattt

SEQ ID NO: 6576003 - DNA, 15 bp, Homo sapiens
ttcttaaaaaaataa

SEQ ID NO: 6576004 - DNA, 12 bp, Homo sapiens
ttcttaaaaact

SEQ ID NO: 6576005 - DNA, 14 bp, Homo sapiens
ttcttaaaaagtaa

SEQ ID NO: 6576006 - DNA, 14 bp, Homo sapiens
ttcttaaaaagtta

SEQ ID NO: 6576007 - DNA, 21 bp, Homo sapiens
ttcttaaaaatattttttctg

SEQ ID NO: 6576008 - DNA, 16 bp, Homo sapiens
ttcttaaaacacatga

SEQ ID NO: 6576009 - DNA, 18 bp, Homo sapiens
ttcttaaaaccaatcaat

SEQ ID NO: 6576010 - DNA, 19 bp, Homo sapiens
ttcttaaaactataacatt

SEQ ID NO: 6576011 - DNA, 13 bp, Homo sapiens
ttcttaaaagaaa

SEQ ID NO: 6576012 - DNA, 18 bp, Homo sapiens
ttcttaaaagaaatcttg

SEQ ID NO: 6576013 - DNA, 11 bp, Homo sapiens
ttcttaaaagt

SEQ ID NO: 6576014 - DNA, 14 bp, Homo sapiens
ttcttaaaagtact

SEQ ID NO: 6576015 - DNA, 16 bp, Homo sapiens
ttcttaaaagtttcta

SEQ ID NO: 6576016 - DNA, 16 bp, Homo sapiens
ttcttaaaatattgtg

SEQ ID NO: 6576017 - DNA, 18 bp, Homo sapiens
ttcttaaaatcaaatgta

SEQ ID NO: 6576018 - DNA, 22 bp, Homo sapiens
ttcttaaaatcaaatgtaaatc

SEQ ID NO: 6576019 - DNA, 21 bp, Homo sapiens
ttcttaaaatgcaatatttgt

SEQ ID NO: 6576020 - DNA, 23 bp, Homo sapiens
ttcttaaaatgcaatatttgtaa

SEQ ID NO: 6576021 - DNA, 19 bp, Homo sapiens
ttcttaaaatgtttcattt

SEQ ID NO: 6576022 - DNA, 14 bp, Homo sapiens
ttcttaaaattagt

SEQ ID NO: 6576023 - DNA, 19 bp, Homo sapiens
ttcttaaactgaaagcttt

SEQ ID NO: 6576024 - DNA, 12 bp, Homo sapiens
ttcttaaatatc

SEQ ID NO: 6576025 - DNA, 15 bp, Homo sapiens
ttcttaaatatcttt

SEQ ID NO: 6576026 - DNA, 17 bp, Homo sapiens
ttcttaaatatctttta

SEQ ID NO: 6576027 - DNA, 19 bp, Homo sapiens
ttcttaaatatcttttatg

SEQ ID NO: 6576028 - DNA, 15 bp, Homo sapiens
ttcttaaatctttct

SEQ ID NO: 6576029 - DNA, 19 bp, Homo sapiens
ttcttaaatctttcttcaa

SEQ ID NO: 6576030 - DNA, 21 bp, Homo sapiens
ttcttaaatctttcttcaaat

SEQ ID NO: 6576031 - DNA, 13 bp, Homo sapiens
ttcttaaatggaa

SEQ ID NO: 6576032 - DNA, 14 bp, Homo sapiens
ttcttaaatggaat

SEQ ID NO: 6576033 - DNA, 12 bp, Homo sapiens
ttcttaaatgtt

SEQ ID NO: 6576034 - DNA, 18 bp, Homo sapiens
ttcttaaatgttttcatt

SEQ ID NO: 6576035 - DNA, 17 bp, Homo sapiens
ttcttaacaaactcttc

SEQ ID NO: 6576036 - DNA, 16 bp, Homo sapiens
ttcttaacaacctggc

SEQ ID NO: 6576037 - DNA, 19 bp, Homo sapiens
ttcttaacaagatatttat

SEQ ID NO: 6576038 - DNA, 18 bp, Homo sapiens
ttcttaacacagccttcc

SEQ ID NO: 6576039 - DNA, 19 bp, Homo sapiens
ttcttaacacagccttcct

SEQ ID NO: 6576040 - DNA, 19 bp, Homo sapiens
ttcttaaccagatggttgt

SEQ ID NO: 6576041 - DNA, 22 bp, Homo sapiens
ttcttaacccctaagactgcct

SEQ ID NO: 6576042 - DNA, 15 bp, Homo sapiens
ttcttaaccctgaac

SEQ ID NO: 6576043 - DNA, 13 bp, Homo sapiens
ttcttaacctttg

SEQ ID NO: 6576044 - DNA, 17 bp, Homo sapiens
ttcttaactctgcagga

SEQ ID NO: 6576045 - DNA, 18 bp, Homo sapiens
ttcttaagaaatgccagt

SEQ ID NO: 6576046 - DNA, 15 bp, Homo sapiens
ttcttaagcactttg

SEQ ID NO: 6576047 - DNA, 19 bp, Homo sapiens
ttcttaagcactttgaaaa

SEQ ID NO: 6576048 - DNA, 22 bp, Homo sapiens
ttcttaagccctttgctctgga

SEQ ID NO: 6576049 - DNA, 17 bp, Homo sapiens
ttcttaaggaattttgt

SEQ ID NO: 6576050 - DNA, 22 bp, Homo sapiens
ttcttaaggacagtgttcaaat

SEQ ID NO: 6576051 - DNA, 20 bp, Homo sapiens
ttcttaaggattgtgatatt

SEQ ID NO: 6576052 - DNA, 17 bp, Homo sapiens
ttcttaagggcacacac

SEQ ID NO: 6576053 - DNA, 15 bp, Homo sapiens
ttcttaaggtccctg

SEQ ID NO: 6576054 - DNA, 16 bp, Homo sapiens
ttcttaaggtccctgc

SEQ ID NO: 6576055 - DNA, 13 bp, Homo sapiens
ttcttaaggtttt

SEQ ID NO: 6576056 - DNA, 16 bp, Homo sapiens
ttcttaatacaggaga

SEQ ID NO: 6576057 - DNA, 22 bp, Homo sapiens
ttcttaataggctttatcgttt

SEQ ID NO: 6576058 - DNA, 14 bp, Homo sapiens
ttcttaatgtacat

SEQ ID NO: 6576059 - DNA, 16 bp, Homo sapiens
ttcttaattaatttga

SEQ ID NO: 6576060 - DNA, 19 bp, Homo sapiens
ttcttaattattataaaaa

SEQ ID NO: 6576061 - DNA, 19 bp, Homo sapiens
ttcttaattcatgaggagg

SEQ ID NO: 6576062 - DNA, 11 bp, Homo sapiens
ttcttaatttg

SEQ ID NO: 6576063 - DNA, 21 bp, Homo sapiens
ttcttacaaaaagaaatgtca

SEQ ID NO: 6576064 - DNA, 16 bp, Homo sapiens
ttcttacaagcttaaa

SEQ ID NO: 6576065 - DNA, 20 bp, Homo sapiens
ttcttacaagcttaaagctt

SEQ ID NO: 6576066 - DNA, 18 bp, Homo sapiens
ttcttacacacccccaga

SEQ ID NO: 6576067 - DNA, 22 bp, Homo sapiens
ttcttacacgactaagttgaat

SEQ ID NO: 6576068 - DNA, 21 bp, Homo sapiens
ttcttacactgcctgtatact

SEQ ID NO: 6576069 - DNA, 21 bp, Homo sapiens
ttcttacagcacatcacctct

SEQ ID NO: 6576070 - DNA, 22 bp, Homo sapiens
ttcttacagcacatcacctctt

SEQ ID NO: 6576071 - DNA, 13 bp, Homo sapiens
ttcttacataatt

SEQ ID NO: 6576072 - DNA, 12 bp, Homo sapiens
ttcttaccagtc

SEQ ID NO: 6576073 - DNA, 14 bp, Homo sapiens
ttcttacccaaagc

SEQ ID NO: 6576074 - DNA, 18 bp, Homo sapiens
ttcttacccaaagcacat

SEQ ID NO: 6576075 - DNA, 21 bp, Homo sapiens
ttcttacccagattgtgtaca

SEQ ID NO: 6576076 - DNA, 15 bp, Homo sapiens
ttcttaccctctctt

SEQ ID NO: 6576077 - DNA, 17 bp, Homo sapiens
ttcttaccctctctttc

SEQ ID NO: 6576078 - DNA, 16 bp, Homo sapiens
ttcttaccgaaatgaa

SEQ ID NO: 6576079 - DNA, 22 bp, Homo sapiens
ttcttaccgagaaaaggagaaa

SEQ ID NO: 6576080 - DNA, 17 bp, Homo sapiens
ttcttacctcatttgca

SEQ ID NO: 6576081 - DNA, 18 bp, Homo sapiens
ttcttacctcatttgcat

SEQ ID NO: 6576082 - DNA, 17 bp, Homo sapiens
ttcttaccttttgtggt

SEQ ID NO: 6576083 - DNA, 15 bp, Homo sapiens
ttcttactaaaaagt

SEQ ID NO: 6576084 - DNA, 15 bp, Homo sapiens
ttcttactaaacatt

SEQ ID NO: 6576085 - DNA, 18 bp, Homo sapiens
ttcttactaaacattttg

SEQ ID NO: 6576086 - DNA, 17 bp, Homo sapiens
ttcttactcattactgc

SEQ ID NO: 6576087 - DNA, 12 bp, Homo sapiens
ttcttactcctc

SEQ ID NO: 6576088 - DNA, 19 bp, Homo sapiens
ttcttactcctcctctttc

SEQ ID NO: 6576089 - DNA, 14 bp, Homo sapiens
ttcttactgcttaa

SEQ ID NO: 6576090 - DNA, 19 bp, Homo sapiens
ttcttactgttctgaaatt

SEQ ID NO: 6576091 - DNA, 19 bp, Homo sapiens
ttcttactgttttgtatca

SEQ ID NO: 6576092 - DNA, 22 bp, Homo sapiens
ttcttacttgagtatcataata

SEQ ID NO: 6576093 - DNA, 23 bp, Homo sapiens
ttcttacttgatgagtgtaacaa

SEQ ID NO: 6576094 - DNA, 23 bp, Homo sapiens
ttcttacttttcctggacttaaa

SEQ ID NO: 6576095 - DNA, 15 bp, Homo sapiens
ttcttagaacagtgg

SEQ ID NO: 6576096 - DNA, 22 bp, Homo sapiens
ttcttagaacagtggaaactat

SEQ ID NO: 6576097 - DNA, 22 bp, Homo sapiens
ttcttagagtgtagctgtaagg

SEQ ID NO: 6576098 - DNA, 22 bp, Homo sapiens
ttcttagcatacattcagacgt

SEQ ID NO: 6576099 - DNA, 15 bp, Homo sapiens
ttcttagctcaatga

SEQ ID NO: 6576100 - DNA, 17 bp, Homo sapiens
ttcttagctcttgggat

SEQ ID NO: 6576101 - DNA, 15 bp, Homo sapiens
ttcttagctttttaa

SEQ ID NO: 6576102 - DNA, 17 bp, Homo sapiens
ttcttagggaaggatac

SEQ ID NO: 6576103 - DNA, 18 bp, Homo sapiens
ttcttaggggaaggagaa

SEQ ID NO: 6576104 - DNA, 15 bp, Homo sapiens
ttcttagtagatttt

SEQ ID NO: 6576105 - DNA, 24 bp, Homo sapiens
ttcttagtccagttgtgttgacac

SEQ ID NO: 6576106 - DNA, 21 bp, Homo sapiens
ttcttagttgacaacctagaa

SEQ ID NO: 6576107 - DNA, 14 bp, Homo sapiens
ttcttagttgctgt

SEQ ID NO: 6576108 - DNA, 23 bp, Homo sapiens
ttcttagttgctgtatgtctcgt

SEQ ID NO: 6576109 - DNA, 22 bp, Homo sapiens
ttcttataaatatgaagctcac

SEQ ID NO: 6576110 - DNA, 12 bp, Homo sapiens
ttcttataatac

SEQ ID NO: 6576111 - DNA, 21 bp, Homo sapiens
ttcttatacatttgataaagt

SEQ ID NO: 6576112 - DNA, 22 bp, Homo sapiens
ttcttataccttctgacagccc

SEQ ID NO: 6576113 - DNA, 16 bp, Homo sapiens
ttcttatacgcttttc

SEQ ID NO: 6576114 - DNA, 20 bp, Homo sapiens
ttcttatagaataaaagctg

SEQ ID NO: 6576115 - DNA, 14 bp, Homo sapiens
ttcttatagatttt

SEQ ID NO: 6576116 - DNA, 20 bp, Homo sapiens
ttcttatattaaagaagttg

SEQ ID NO: 6576117 - DNA, 22 bp, Homo sapiens
ttcttatcacacttgcaaatga

SEQ ID NO: 6576118 - DNA, 12 bp, Homo sapiens
ttcttatctaaa

SEQ ID NO: 6576119 - DNA, 16 bp, Homo sapiens
ttcttatctctagctc

SEQ ID NO: 6576120 - DNA, 14 bp, Homo sapiens
ttcttatgaggagg

SEQ ID NO: 6576121 - DNA, 16 bp, Homo sapiens
ttcttatgatgttttc

SEQ ID NO: 6576122 - DNA, 18 bp, Homo sapiens
ttcttatggggtgagaat

SEQ ID NO: 6576123 - DNA, 12 bp, Homo sapiens
ttcttatggtat

SEQ ID NO: 6576124 - DNA, 19 bp, Homo sapiens
ttcttatgtgacattaaca

SEQ ID NO: 6576125 - DNA, 13 bp, Homo sapiens
ttcttatgttgaa

SEQ ID NO: 6576126 - DNA, 17 bp, Homo sapiens
ttcttatgttgcccagt

SEQ ID NO: 6576127 - DNA, 22 bp, Homo sapiens
ttcttattaattcttcacctgt

SEQ ID NO: 6576128 - DNA, 14 bp, Homo sapiens
ttcttattacccaa

SEQ ID NO: 6576129 - DNA, 17 bp, Homo sapiens
ttcttattaggcctcag

SEQ ID NO: 6576130 - DNA, 14 bp, Homo sapiens
ttcttattcacttt

SEQ ID NO: 6576131 - DNA, 19 bp, Homo sapiens
ttcttattcccccctaagc

SEQ ID NO: 6576132 - DNA, 18 bp, Homo sapiens
ttcttatttaatcttttc

SEQ ID NO: 6576133 - DNA, 23 bp, Homo sapiens
ttcttatttaatgaaagactgta

SEQ ID NO: 6576134 - DNA, 16 bp, Homo sapiens
ttcttatttcatgaaa

SEQ ID NO: 6576135 - DNA, 15 bp, Homo sapiens
ttcttatttcatttc

SEQ ID NO: 6576136 - DNA, 12 bp, Homo sapiens
ttcttattttag

SEQ ID NO: 6576137 - DNA, 19 bp, Homo sapiens
ttcttattttagattgcta

SEQ ID NO: 6576138 - DNA, 15 bp, Homo sapiens
ttcttattttagtat

SEQ ID NO: 6576139 - DNA, 15 bp, Homo sapiens
ttcttattttgtaat

SEQ ID NO: 6576140 - DNA, 17 bp, Homo sapiens
ttcttatttttgtactt

SEQ ID NO: 6576141 - DNA, 19 bp, Homo sapiens
ttcttcaaaaagcatttta

SEQ ID NO: 6576142 - DNA, 11 bp, Homo sapiens
ttcttcaaaat

SEQ ID NO: 6576143 - DNA, 14 bp, Homo sapiens
ttcttcaaaatgta

SEQ ID NO: 6576144 - DNA, 14 bp, Homo sapiens
ttcttcaaacacaa

SEQ ID NO: 6576145 - DNA, 15 bp, Homo sapiens
ttcttcaaatacaaa

SEQ ID NO: 6576146 - DNA, 17 bp, Homo sapiens
ttcttcaaatacaaagt

SEQ ID NO: 6576147 - DNA, 19 bp, Homo sapiens
ttcttcaaatacaaagtaa

SEQ ID NO: 6576148 - DNA, 23 bp, Homo sapiens
ttcttcaaatctcccacaagtat

SEQ ID NO: 6576149 - DNA, 21 bp, Homo sapiens
ttcttcaacatgctccaaata

SEQ ID NO: 6576150 - DNA, 15 bp, Homo sapiens
ttcttcaactcctgg

SEQ ID NO: 6576151 - DNA, 20 bp, Homo sapiens
ttcttcaagcacctgcagat

SEQ ID NO: 6576152 - DNA, 17 bp, Homo sapiens
ttcttcaagccagctct

SEQ ID NO: 6576153 - DNA, 18 bp, Homo sapiens
ttcttcacacagacacta

SEQ ID NO: 6576154 - DNA, 15 bp, Homo sapiens
ttcttcacaggcact

SEQ ID NO: 6576155 - DNA, 17 bp, Homo sapiens
ttcttcacctgttatgt

SEQ ID NO: 6576156 - DNA, 22 bp, Homo sapiens
ttcttcactgtcctccaagcca

SEQ ID NO: 6576157 - DNA, 17 bp, Homo sapiens
ttcttcagaagacactg

SEQ ID NO: 6576158 - DNA, 17 bp, Homo sapiens
ttcttcagaattatcca

SEQ ID NO: 6576159 - DNA, 13 bp, Homo sapiens
ttcttcagagact

SEQ ID NO: 6576160 - DNA, 18 bp, Homo sapiens
ttcttcagagtttgtcat

SEQ ID NO: 6576161 - DNA, 18 bp, Homo sapiens
ttcttcagctgccagtgt

SEQ ID NO: 6576162 - DNA, 18 bp, Homo sapiens
ttcttcagcttgatcctg

SEQ ID NO: 6576163 - DNA, 13 bp, Homo sapiens
ttcttcaggaaaa

SEQ ID NO: 6576164 - DNA, 20 bp, Homo sapiens
ttcttcaggtaacactacag

SEQ ID NO: 6576165 - DNA, 20 bp, Homo sapiens
ttcttcaggtcgtagcattt

SEQ ID NO: 6576166 - DNA, 15 bp, Homo sapiens
ttcttcagtgcctag

SEQ ID NO: 6576167 - DNA, 22 bp, Homo sapiens
ttcttcatcccttgcttaagaa

SEQ ID NO: 6576168 - DNA, 12 bp, Homo sapiens
ttcttcatgaaa

SEQ ID NO: 6576169 - DNA, 22 bp, Homo sapiens
ttcttcatgcattacttactgt

SEQ ID NO: 6576170 - DNA, 24 bp, Homo sapiens
ttcttcatgtcatcaaaatctgca

SEQ ID NO: 6576171 - DNA, 12 bp, Homo sapiens
ttcttcatgtgc

SEQ ID NO: 6576172 - DNA, 15 bp, Homo sapiens
ttcttcatgttcaat

SEQ ID NO: 6576173 - DNA, 20 bp, Homo sapiens
ttcttcattcaatacaagtg

SEQ ID NO: 6576174 - DNA, 18 bp, Homo sapiens
ttcttccaaaaggaagca

SEQ ID NO: 6576175 - DNA, 19 bp, Homo sapiens
ttcttccaaaaggaagcac

SEQ ID NO: 6576176 - DNA, 23 bp, Homo sapiens
ttcttccaaacttttgcagaaaa

SEQ ID NO: 6576177 - DNA, 23 bp, Homo sapiens
ttcttccaaatgcagttcattgc

SEQ ID NO: 6576178 - DNA, 23 bp, Homo sapiens
ttcttccacccacaaactccagg

SEQ ID NO: 6576179 - DNA, 14 bp, Homo sapiens
ttcttccactgtgt

SEQ ID NO: 6576180 - DNA, 16 bp, Homo sapiens
ttcttccagaatgctg

SEQ ID NO: 6576181 - DNA, 20 bp, Homo sapiens
ttcttccagcagaacagaga

SEQ ID NO: 6576182 - DNA, 20 bp, Homo sapiens
ttcttccaggatcaggggtt

SEQ ID NO: 6576183 - DNA, 16 bp, Homo sapiens
ttcttccagtgcaaca

SEQ ID NO: 6576184 - DNA, 11 bp, Homo sapiens
ttcttccagtt

SEQ ID NO: 6576185 - DNA, 12 bp, Homo sapiens
ttcttccagtta

SEQ ID NO: 6576186 - DNA, 16 bp, Homo sapiens
ttcttccatcagctct

SEQ ID NO: 6576187 - DNA, 19 bp, Homo sapiens
ttcttccattccttcatgt

SEQ ID NO: 6576188 - DNA, 17 bp, Homo sapiens
ttcttcccaaatcaaaa

SEQ ID NO: 6576189 - DNA, 21 bp, Homo sapiens
ttcttcccaacttgcctttga

SEQ ID NO: 6576190 - DNA, 21 bp, Homo sapiens
ttcttcccatttgtaatgtat

SEQ ID NO: 6576191 - DNA, 22 bp, Homo sapiens
ttcttccccagggttctgtatt

SEQ ID NO: 6576192 - DNA, 12 bp, Homo sapiens
ttcttccccagt

SEQ ID NO: 6576193 - DNA, 16 bp, Homo sapiens
ttcttcccgtgtgtat

SEQ ID NO: 6576194 - DNA, 20 bp, Homo sapiens
ttcttcccgtgtgtatttct

SEQ ID NO: 6576195 - DNA, 13 bp, Homo sapiens
ttcttccctgctt

SEQ ID NO: 6576196 - DNA, 21 bp, Homo sapiens
ttcttccctgctttgcatctt

SEQ ID NO: 6576197 - DNA, 12 bp, Homo sapiens
ttcttccctggg

SEQ ID NO: 6576198 - DNA, 20 bp, Homo sapiens
ttcttccctggtctggctct

SEQ ID NO: 6576199 - DNA, 15 bp, Homo sapiens
ttcttccctgtcagc

SEQ ID NO: 6576200 - DNA, 22 bp, Homo sapiens
ttcttcccttttacatactgct

SEQ ID NO: 6576201 - DNA, 13 bp, Homo sapiens
ttcttcccttttc

SEQ ID NO: 6576202 - DNA, 14 bp, Homo sapiens
ttcttcccttttcc

SEQ ID NO: 6576203 - DNA, 15 bp, Homo sapiens
ttcttccggcccctc

SEQ ID NO: 6576204 - DNA, 12 bp, Homo sapiens
ttcttcctcacc

SEQ ID NO: 6576205 - DNA, 16 bp, Homo sapiens
ttcttcctcagccagc

SEQ ID NO: 6576206 - DNA, 15 bp, Homo sapiens
ttcttcctcattccc

SEQ ID NO: 6576207 - DNA, 13 bp, Homo sapiens
ttcttcctcccct

SEQ ID NO: 6576208 - DNA, 15 bp, Homo sapiens
ttcttcctcccctca

SEQ ID NO: 6576209 - DNA, 14 bp, Homo sapiens
ttcttcctcctctg

SEQ ID NO: 6576210 - DNA, 20 bp, Homo sapiens
ttcttcctctccttcccaca

SEQ ID NO: 6576211 - DNA, 20 bp, Homo sapiens
ttcttcctctcggctggaag

SEQ ID NO: 6576212 - DNA, 20 bp, Homo sapiens
ttcttcctggatggggcaga

SEQ ID NO: 6576213 - DNA, 13 bp, Homo sapiens
ttcttcctggccg

SEQ ID NO: 6576214 - DNA, 11 bp, Homo sapiens
ttcttcctggt

SEQ ID NO: 6576215 - DNA, 11 bp, Homo sapiens
ttcttcctgtg

SEQ ID NO: 6576216 - DNA, 13 bp, Homo sapiens
ttcttcctgttct

SEQ ID NO: 6576217 - DNA, 18 bp, Homo sapiens
ttcttccttaaactcctg

SEQ ID NO: 6576218 - DNA, 11 bp, Homo sapiens
ttcttccttcc

SEQ ID NO: 6576219 - DNA, 22 bp, Homo sapiens
ttcttccttcccaactcactgt

SEQ ID NO: 6576220 - DNA, 13 bp, Homo sapiens
ttcttccttccta

SEQ ID NO: 6576221 - DNA, 14 bp, Homo sapiens
ttcttccttcctag

SEQ ID NO: 6576222 - DNA, 15 bp, Homo sapiens
ttcttccttcctaga

SEQ ID NO: 6576223 - DNA, 20 bp, Homo sapiens
ttcttccttctttctcttcc

SEQ ID NO: 6576224 - DNA, 22 bp, Homo sapiens
ttcttccttgattgtgtagctg

SEQ ID NO: 6576225 - DNA, 15 bp, Homo sapiens
ttcttccttgccaca

SEQ ID NO: 6576226 - DNA, 20 bp, Homo sapiens
ttcttccttgccacaatcac

SEQ ID NO: 6576227 - DNA, 21 bp, Homo sapiens
ttcttccttgttgtttgcttt

SEQ ID NO: 6576228 - DNA, 19 bp, Homo sapiens
ttcttcctttgaagcttta

SEQ ID NO: 6576229 - DNA, 14 bp, Homo sapiens
ttcttcctttggta

SEQ ID NO: 6576230 - DNA, 16 bp, Homo sapiens
ttcttccttttcactg

SEQ ID NO: 6576231 - DNA, 21 bp, Homo sapiens
ttcttccttttcactgctgtt

SEQ ID NO: 6576232 - DNA, 14 bp, Homo sapiens
ttcttcgaaaatct

SEQ ID NO: 6576233 - DNA, 18 bp, Homo sapiens
ttcttcgcagctcatctt

SEQ ID NO: 6576234 - DNA, 21 bp, Homo sapiens
ttcttcgcagctcatcttttc

SEQ ID NO: 6576235 - DNA, 18 bp, Homo sapiens
ttcttcgctgctagagaa

SEQ ID NO: 6576236 - DNA, 20 bp, Homo sapiens
ttcttcgctgctctagctgg

SEQ ID NO: 6576237 - DNA, 23 bp, Homo sapiens
ttcttcgctgctctagctggcag

SEQ ID NO: 6576238 - DNA, 21 bp, Homo sapiens
ttcttcgctggactattgtgc

SEQ ID NO: 6576239 - DNA, 16 bp, Homo sapiens
ttcttcggaggtggca

SEQ ID NO: 6576240 - DNA, 17 bp, Homo sapiens
ttcttcgtccttttggt

SEQ ID NO: 6576241 - DNA, 12 bp, Homo sapiens
ttcttctaaaat

SEQ ID NO: 6576242 - DNA, 18 bp, Homo sapiens
ttcttctaaaatgctttt

SEQ ID NO: 6576243 - DNA, 14 bp, Homo sapiens
ttcttctaaatgag

SEQ ID NO: 6576244 - DNA, 14 bp, Homo sapiens
ttcttctaagaaga

SEQ ID NO: 6576245 - DNA, 17 bp, Homo sapiens
ttcttctaagaagacat

SEQ ID NO: 6576246 - DNA, 21 bp, Homo sapiens
ttcttctaagaagacattttg

SEQ ID NO: 6576247 - DNA, 21 bp, Homo sapiens
ttcttctaattatttaaataa

SEQ ID NO: 6576248 - DNA, 20 bp, Homo sapiens
ttcttctacaaccagagccc

SEQ ID NO: 6576249 - DNA, 14 bp, Homo sapiens
ttcttctagagttc

SEQ ID NO: 6576250 - DNA, 22 bp, Homo sapiens
ttcttctagctttgttgtcctc

SEQ ID NO: 6576251 - DNA, 21 bp, Homo sapiens
ttcttctaggttctaaaaatt

SEQ ID NO: 6576252 - DNA, 16 bp, Homo sapiens
ttcttctattgtgctt

SEQ ID NO: 6576253 - DNA, 16 bp, Homo sapiens
ttcttctcaaggacac

SEQ ID NO: 6576254 - DNA, 16 bp, Homo sapiens
ttcttctcatatccat

SEQ ID NO: 6576255 - DNA, 18 bp, Homo sapiens
ttcttctcctatgtgtaa

SEQ ID NO: 6576256 - DNA, 21 bp, Homo sapiens
ttcttctcctttgtcaaatgg

SEQ ID NO: 6576257 - DNA, 14 bp, Homo sapiens
ttcttctctctgtt

SEQ ID NO: 6576258 - DNA, 14 bp, Homo sapiens
ttcttctctgcctc

SEQ ID NO: 6576259 - DNA, 17 bp, Homo sapiens
ttcttctctgcctcctc

SEQ ID NO: 6576260 - DNA, 19 bp, Homo sapiens
ttcttctctggagaagttt

SEQ ID NO: 6576261 - DNA, 13 bp, Homo sapiens
ttcttctgaactc

SEQ ID NO: 6576262 - DNA, 23 bp, Homo sapiens
ttcttctgaactcaaactgagga

SEQ ID NO: 6576263 - DNA, 19 bp, Homo sapiens
ttcttctgatcactgaaat

SEQ ID NO: 6576264 - DNA, 20 bp, Homo sapiens
ttcttctgcaacatttgaca

SEQ ID NO: 6576265 - DNA, 16 bp, Homo sapiens
ttcttctgcacaaaga

SEQ ID NO: 6576266 - DNA, 21 bp, Homo sapiens
ttcttctgccacttctgcggg

SEQ ID NO: 6576267 - DNA, 19 bp, Homo sapiens
ttcttctgcccctctactg

SEQ ID NO: 6576268 - DNA, 13 bp, Homo sapiens
ttcttctgccctt

SEQ ID NO: 6576269 - DNA, 19 bp, Homo sapiens
ttcttctgcgtttgtccct

SEQ ID NO: 6576270 - DNA, 13 bp, Homo sapiens
ttcttctgcttca

SEQ ID NO: 6576271 - DNA, 20 bp, Homo sapiens
ttcttctgcttcagcctccc

SEQ ID NO: 6576272 - DNA, 12 bp, Homo sapiens
ttcttctggctt

SEQ ID NO: 6576273 - DNA, 16 bp, Homo sapiens
ttcttctggtgctact

SEQ ID NO: 6576274 - DNA, 23 bp, Homo sapiens
ttcttctggtgctactccatgca

SEQ ID NO: 6576275 - DNA, 21 bp, Homo sapiens
ttcttctgtgtttataaaata

SEQ ID NO: 6576276 - DNA, 23 bp, Homo sapiens
ttcttcttacattattaatcatt

SEQ ID NO: 6576277 - DNA, 22 bp, Homo sapiens
ttcttcttcacatccattgtct

SEQ ID NO: 6576278 - DNA, 15 bp, Homo sapiens
ttcttcttcagaaga

SEQ ID NO: 6576279 - DNA, 22 bp, Homo sapiens
ttcttcttccaacgtggcccag

SEQ ID NO: 6576280 - DNA, 13 bp, Homo sapiens
ttcttcttccctc

SEQ ID NO: 6576281 - DNA, 14 bp, Homo sapiens
ttcttcttcctggt

SEQ ID NO: 6576282 - DNA, 14 bp, Homo sapiens
ttcttcttctaaga

SEQ ID NO: 6576283 - DNA, 14 bp, Homo sapiens
ttcttcttctcgtc

SEQ ID NO: 6576284 - DNA, 16 bp, Homo sapiens
ttcttcttgaggggaa

SEQ ID NO: 6576285 - DNA, 14 bp, Homo sapiens
ttcttcttgggccc

SEQ ID NO: 6576286 - DNA, 12 bp, Homo sapiens
ttcttctttaat

SEQ ID NO: 6576287 - DNA, 20 bp, Homo sapiens
ttcttctttaatttttctgt

SEQ ID NO: 6576288 - DNA, 13 bp, Homo sapiens
ttcttctttctag

SEQ ID NO: 6576289 - DNA, 15 bp, Homo sapiens
ttcttctttctagag

SEQ ID NO: 6576290 - DNA, 12 bp, Homo sapiens
ttcttctttctt

SEQ ID NO: 6576291 - DNA, 15 bp, Homo sapiens
ttcttctttctttct

SEQ ID NO: 6576292 - DNA, 12 bp, Homo sapiens
ttcttcttttcc

SEQ ID NO: 6576293 - DNA, 15 bp, Homo sapiens
ttcttctttttgctg

SEQ ID NO: 6576294 - DNA, 13 bp, Homo sapiens
ttcttgaaaagcc

SEQ ID NO: 6576295 - DNA, 14 bp, Homo sapiens
ttcttgaaaagcct

SEQ ID NO: 6576296 - DNA, 16 bp, Homo sapiens
ttcttgaaaagccttg

SEQ ID NO: 6576297 - DNA, 20 bp, Homo sapiens
ttcttgaaaagccttggaga

SEQ ID NO: 6576298 - DNA, 19 bp, Homo sapiens
ttcttgaaagaattttcct

SEQ ID NO: 6576299 - DNA, 15 bp, Homo sapiens
ttcttgaaagctgtg

SEQ ID NO: 6576300 - DNA, 22 bp, Homo sapiens
ttcttgaaaggtgtaggtttga

SEQ ID NO: 6576301 - DNA, 13 bp, Homo sapiens
ttcttgaaattga

SEQ ID NO: 6576302 - DNA, 17 bp, Homo sapiens
ttcttgaagtccagtgt

SEQ ID NO: 6576303 - DNA, 17 bp, Homo sapiens
ttcttgaagttcatggt

SEQ ID NO: 6576304 - DNA, 17 bp, Homo sapiens
ttcttgaatataaaaaa

SEQ ID NO: 6576305 - DNA, 21 bp, Homo sapiens
ttcttgaatcctctattaatt

SEQ ID NO: 6576306 - DNA, 22 bp, Homo sapiens
ttcttgaatttttttctgcaca

SEQ ID NO: 6576307 - DNA, 20 bp, Homo sapiens
ttcttgacaaaacctaactt

SEQ ID NO: 6576308 - DNA, 13 bp, Homo sapiens
ttcttgacaagct

SEQ ID NO: 6576309 - DNA, 13 bp, Homo sapiens
ttcttgacagtga

SEQ ID NO: 6576310 - DNA, 13 bp, Homo sapiens
ttcttgactctgt

SEQ ID NO: 6576311 - DNA, 20 bp, Homo sapiens
ttcttgactgtcttccctct

SEQ ID NO: 6576312 - DNA, 18 bp, Homo sapiens
ttcttgacttcacagcag

SEQ ID NO: 6576313 - DNA, 20 bp, Homo sapiens
ttcttgaggggaccaggagt

SEQ ID NO: 6576314 - DNA, 17 bp, Homo sapiens
ttcttgagtaatttaaa

SEQ ID NO: 6576315 - DNA, 16 bp, Homo sapiens
ttcttgagtagatctg

SEQ ID NO: 6576316 - DNA, 16 bp, Homo sapiens
ttcttgataggcctag

SEQ ID NO: 6576317 - DNA, 20 bp, Homo sapiens
ttcttgatcagtagtttgca

SEQ ID NO: 6576318 - DNA, 22 bp, Homo sapiens
ttcttgatcagtagtttgcatt

SEQ ID NO: 6576319 - DNA, 17 bp, Homo sapiens
ttcttgatcttaaagat

SEQ ID NO: 6576320 - DNA, 18 bp, Homo sapiens
ttcttgatcttaaagatc

SEQ ID NO: 6576321 - DNA, 21 bp, Homo sapiens
ttcttgatgactggaattttt

SEQ ID NO: 6576322 - DNA, 21 bp, Homo sapiens
ttcttgatggagattaagatg

SEQ ID NO: 6576323 - DNA, 14 bp, Homo sapiens
ttcttgatgtcatg

SEQ ID NO: 6576324 - DNA, 15 bp, Homo sapiens
ttcttgattcctggc

SEQ ID NO: 6576325 - DNA, 15 bp, Homo sapiens
aagggccccaggggc

SEQ ID NO: 6576326 - DNA, 18 bp, Homo sapiens
aagggccccaggggcagc

SEQ ID NO: 6576327 - DNA, 22 bp, Homo sapiens
aagggcccccggctcggcctct

SEQ ID NO: 6576328 - DNA, 17 bp, Homo sapiens
aagggccctgccctgta

SEQ ID NO: 6576329 - DNA, 20 bp, Homo sapiens
aagggccctgccctgtactg

SEQ ID NO: 6576330 - DNA, 12 bp, Homo sapiens
aagggccctggc

SEQ ID NO: 6576331 - DNA, 13 bp, Homo sapiens
aagggccctggca

SEQ ID NO: 6576332 - DNA, 20 bp, Homo sapiens
aagggcccttcccctccccc

SEQ ID NO: 6576333 - DNA, 18 bp, Homo sapiens
aagggcccttctctactg

SEQ ID NO: 6576334 - DNA, 23 bp, Homo sapiens
aagggccgtgcccttgcccttgg

SEQ ID NO: 6576335 - DNA, 21 bp, Homo sapiens
aagggcctcctcacccaccct

SEQ ID NO: 6576336 - DNA, 23 bp, Homo sapiens
aagggcctcctcacccaccctgt

SEQ ID NO: 6576337 - DNA, 23 bp, Homo sapiens
aagggcctgcccagttgcactca

SEQ ID NO: 6576338 - DNA, 19 bp, Homo sapiens
aagggcctgcctggcccct

SEQ ID NO: 6576339 - DNA, 12 bp, Homo sapiens
aagggcctggac

SEQ ID NO: 6576340 - DNA, 13 bp, Homo sapiens
aagggcctggcca

SEQ ID NO: 6576341 - DNA, 18 bp, Homo sapiens
aagggccttgagcatctg

SEQ ID NO: 6576342 - DNA, 19 bp, Homo sapiens
aagggccttgagcatctgg

SEQ ID NO: 6576343 - DNA, 18 bp, Homo sapiens
aagggcgctgagggcagg

SEQ ID NO: 6576344 - DNA, 16 bp, Homo sapiens
aagggcggaagagtta

SEQ ID NO: 6576345 - DNA, 22 bp, Homo sapiens
aagggctaaggcctcttgctgg

SEQ ID NO: 6576346 - DNA, 20 bp, Homo sapiens
aagggctataagtagaaact

SEQ ID NO: 6576347 - DNA, 19 bp, Homo sapiens
aagggctatgcctccattt

SEQ ID NO: 6576348 - DNA, 17 bp, Homo sapiens
aagggctcagagaggac

SEQ ID NO: 6576349 - DNA, 19 bp, Homo sapiens
aagggctcagagaggacaa

SEQ ID NO: 6576350 - DNA, 22 bp, Homo sapiens
aagggctcagagctgctgagca

SEQ ID NO: 6576351 - DNA, 21 bp, Homo sapiens
aagggctccagcatccagcct

SEQ ID NO: 6576352 - DNA, 23 bp, Homo sapiens
aagggctccagcatccagcctgt

SEQ ID NO: 6576353 - DNA, 24 bp, Homo sapiens
aagggctccagcatccagcctgtg

SEQ ID NO: 6576354 - DNA, 23 bp, Homo sapiens
aagggctgaaccctcagccttga

SEQ ID NO: 6576355 - DNA, 17 bp, Homo sapiens
aagggctgacctgcctc

SEQ ID NO: 6576356 - DNA, 12 bp, Homo sapiens
aagggctgcaat

SEQ ID NO: 6576357 - DNA, 13 bp, Homo sapiens
aagggctgcatga

SEQ ID NO: 6576358 - DNA, 13 bp, Homo sapiens
aagggctgggcca

SEQ ID NO: 6576359 - DNA, 21 bp, Homo sapiens
aagggctggggccggggctga

SEQ ID NO: 6576360 - DNA, 13 bp, Homo sapiens
aagggctgggtgt

SEQ ID NO: 6576361 - DNA, 21 bp, Homo sapiens
aagggcttacacgtggaggaa

SEQ ID NO: 6576362 - DNA, 17 bp, Homo sapiens
aagggcttgaattgaag

SEQ ID NO: 6576363 - DNA, 22 bp, Homo sapiens
aagggcttgtttttcttcagca

SEQ ID NO: 6576364 - DNA, 13 bp, Homo sapiens
aagggctttaaat

SEQ ID NO: 6576365 - DNA, 18 bp, Homo sapiens
aagggctttaaataaaag

SEQ ID NO: 6576366 - DNA, 18 bp, Homo sapiens
aagggctttgagggtgga

SEQ ID NO: 6576367 - DNA, 23 bp, Homo sapiens
aagggctttggttccttctctgg

SEQ ID NO: 6576368 - DNA, 18 bp, Homo sapiens
aagggctttgttttgcac

SEQ ID NO: 6576369 - DNA, 20 bp, Homo sapiens
aaggggaaacgtctcccaga

SEQ ID NO: 6576370 - DNA, 16 bp, Homo sapiens
aaggggaatctggagg

SEQ ID NO: 6576371 - DNA, 13 bp, Homo sapiens
aaggggaatggaa

SEQ ID NO: 6576372 - DNA, 11 bp, Homo sapiens
aaggggacagc

SEQ ID NO: 6576373 - DNA, 16 bp, Homo sapiens
aaggggacaggcctca

SEQ ID NO: 6576374 - DNA, 16 bp, Homo sapiens
aaggggacccccgccc

SEQ ID NO: 6576375 - DNA, 14 bp, Homo sapiens
aaggggactaaagt

SEQ ID NO: 6576376 - DNA, 23 bp, Homo sapiens
aaggggagaaactgaaagtgttt

SEQ ID NO: 6576377 - DNA, 16 bp, Homo sapiens
aaggggagaagggaat

SEQ ID NO: 6576378 - DNA, 19 bp, Homo sapiens
aaggggagaagggccagcc

SEQ ID NO: 6576379 - DNA, 22 bp, Homo sapiens
aaggggagaagggccagcccta

SEQ ID NO: 6576380 - DNA, 12 bp, Homo sapiens
aaggggagagcc

SEQ ID NO: 6576381 - DNA, 13 bp, Homo sapiens
aaggggagagtaa

SEQ ID NO: 6576382 - DNA, 13 bp, Homo sapiens
aaggggagcccac

SEQ ID NO: 6576383 - DNA, 16 bp, Homo sapiens
aaggggagcccactgt

SEQ ID NO: 6576384 - DNA, 21 bp, Homo sapiens
aaggggaggacactggtggtt

SEQ ID NO: 6576385 - DNA, 19 bp, Homo sapiens
aaggggaggacctctgggc

SEQ ID NO: 6576386 - DNA, 21 bp, Homo sapiens
aaggggaggaggggaagaagg

SEQ ID NO: 6576387 - DNA, 16 bp, Homo sapiens
aaggggaggcagccgg

SEQ ID NO: 6576388 - DNA, 22 bp, Homo sapiens
aaggggagtaggtgggggaaca

SEQ ID NO: 6576389 - DNA, 21 bp, Homo sapiens
aaggggagtcaccttcccttg

SEQ ID NO: 6576390 - DNA, 12 bp, Homo sapiens
aaggggatggac

SEQ ID NO: 6576391 - DNA, 22 bp, Homo sapiens
aaggggatggacacccccagct

SEQ ID NO: 6576392 - DNA, 19 bp, Homo sapiens
aaggggatggaggccagag

SEQ ID NO: 6576393 - DNA, 22 bp, Homo sapiens
aaggggatggagtgagcccatg

SEQ ID NO: 6576394 - DNA, 20 bp, Homo sapiens
aaggggatgggaaataaaga

SEQ ID NO: 6576395 - DNA, 20 bp, Homo sapiens
aaggggatttttatgtctgg

SEQ ID NO: 6576396 - DNA, 16 bp, Homo sapiens
aaggggcacctgggaa

SEQ ID NO: 6576397 - DNA, 19 bp, Homo sapiens
aaggggccagagccttgga

SEQ ID NO: 6576398 - DNA, 21 bp, Homo sapiens
aaggggccaggaaggggacag

SEQ ID NO: 6576399 - DNA, 22 bp, Homo sapiens
aaggggccaggaaggggacagg

SEQ ID NO: 6576400 - DNA, 21 bp, Homo sapiens
aaggggcccaagagagacagc

SEQ ID NO: 6576401 - DNA, 21 bp, Homo sapiens
aaggggcccattcagcctcgt

SEQ ID NO: 6576402 - DNA, 17 bp, Homo sapiens
aaggggccccggggctg

SEQ ID NO: 6576403 - DNA, 22 bp, Homo sapiens
aaggggcccctccttgtgctgc

SEQ ID NO: 6576404 - DNA, 23 bp, Homo sapiens
aaggggcccctccttgtgctgcc

SEQ ID NO: 6576405 - DNA, 14 bp, Homo sapiens
aaggggccctggtc

SEQ ID NO: 6576406 - DNA, 14 bp, Homo sapiens
aaggggcccttgga

SEQ ID NO: 6576407 - DNA, 21 bp, Homo sapiens
aaggggcccttggagcgtgga

SEQ ID NO: 6576408 - DNA, 23 bp, Homo sapiens
aaggggcctcaccgagtgggggc

SEQ ID NO: 6576409 - DNA, 18 bp, Homo sapiens
aaggggccttgctctgag

SEQ ID NO: 6576410 - DNA, 16 bp, Homo sapiens
aaggggcgcgcgcccc

SEQ ID NO: 6576411 - DNA, 18 bp, Homo sapiens
aaggggctatcctgggac

SEQ ID NO: 6576412 - DNA, 19 bp, Homo sapiens
aaggggctatcctgggacc

SEQ ID NO: 6576413 - DNA, 17 bp, Homo sapiens
aaggggctcagcaaggt

SEQ ID NO: 6576414 - DNA, 20 bp, Homo sapiens
aaggggctgcgctagcagcc

SEQ ID NO: 6576415 - DNA, 18 bp, Homo sapiens
aaggggctggtggagatg

SEQ ID NO: 6576416 - DNA, 15 bp, Homo sapiens
aaggggcttctaatg

SEQ ID NO: 6576417 - DNA, 21 bp, Homo sapiens
aaggggcttctaatgacccag

SEQ ID NO: 6576418 - DNA, 13 bp, Homo sapiens
aaggggcttctgg

SEQ ID NO: 6576419 - DNA, 14 bp, Homo sapiens
aagggggaaggctg

SEQ ID NO: 6576420 - DNA, 19 bp, Homo sapiens
aagggggaatattttaaaa

SEQ ID NO: 6576421 - DNA, 20 bp, Homo sapiens
aagggggacctcgggctgtt

SEQ ID NO: 6576422 - DNA, 15 bp, Homo sapiens
aagggggaggagtca

SEQ ID NO: 6576423 - DNA, 15 bp, Homo sapiens
aagggggaggggaag

SEQ ID NO: 6576424 - DNA, 21 bp, Homo sapiens
aagggggatatgaatggagat

SEQ ID NO: 6576425 - DNA, 12 bp, Homo sapiens
aagggggccctg

SEQ ID NO: 6576426 - DNA, 15 bp, Homo sapiens
aagggggccctgcta

SEQ ID NO: 6576427 - DNA, 21 bp, Homo sapiens
aagggggctattccctggaga

SEQ ID NO: 6576428 - DNA, 16 bp, Homo sapiens
aagggggctctgcccc

SEQ ID NO: 6576429 - DNA, 19 bp, Homo sapiens
aagggggggctacattata

SEQ ID NO: 6576430 - DNA, 14 bp, Homo sapiens
aaggggggtgggag

SEQ ID NO: 6576431 - DNA, 18 bp, Homo sapiens
aaggggggtgggagggga

SEQ ID NO: 6576432 - DNA, 18 bp, Homo sapiens
aagggggtagaagtagtt

SEQ ID NO: 6576433 - DNA, 17 bp, Homo sapiens
aagggggtcaaaggaag

SEQ ID NO: 6576434 - DNA, 19 bp, Homo sapiens
aagggggtcccagtgggag

SEQ ID NO: 6576435 - DNA, 14 bp, Homo sapiens
aagggggtctctgt

SEQ ID NO: 6576436 - DNA, 15 bp, Homo sapiens
aagggggtctctgtt

SEQ ID NO: 6576437 - DNA, 14 bp, Homo sapiens
aagggggtgactgg

SEQ ID NO: 6576438 - DNA, 21 bp, Homo sapiens
aagggggtgcaaagactctga

SEQ ID NO: 6576439 - DNA, 16 bp, Homo sapiens
aaggggtcacttacag

SEQ ID NO: 6576440 - DNA, 18 bp, Homo sapiens
aaggggtgcacccacctg

SEQ ID NO: 6576441 - DNA, 19 bp, Homo sapiens
aaggggtgcacccacctgt

SEQ ID NO: 6576442 - DNA, 15 bp, Homo sapiens
aaggggtgccctctg

SEQ ID NO: 6576443 - DNA, 17 bp, Homo sapiens
aaggggtgcctgggaac

SEQ ID NO: 6576444 - DNA, 14 bp, Homo sapiens
aaggggtgctttta

SEQ ID NO: 6576445 - DNA, 17 bp, Homo sapiens
aaggggtgcttttatag

SEQ ID NO: 6576446 - DNA, 15 bp, Homo sapiens
aaggggtggaagggc

SEQ ID NO: 6576447 - DNA, 12 bp, Homo sapiens
aaggggtggccg

SEQ ID NO: 6576448 - DNA, 14 bp, Homo sapiens
aaggggttcctcaa

SEQ ID NO: 6576449 - DNA, 18 bp, Homo sapiens
aaggggttcctcaaattt

SEQ ID NO: 6576450 - DNA, 19 bp, Homo sapiens
aaggggttcctcaaatttt

SEQ ID NO: 6576451 - DNA, 20 bp, Homo sapiens
aaggggttggttgaggtgga

SEQ ID NO: 6576452 - DNA, 23 bp, Homo sapiens
aaggggtttctatccttccagaa

SEQ ID NO: 6576453 - DNA, 16 bp, Homo sapiens
aagggtaaacaatata

SEQ ID NO: 6576454 - DNA, 15 bp, Homo sapiens
aagggtaacttgttt

SEQ ID NO: 6576455 - DNA, 14 bp, Homo sapiens
aagggtaagggaga

SEQ ID NO: 6576456 - DNA, 17 bp, Homo sapiens
aagggtagaaaacttca

SEQ ID NO: 6576457 - DNA, 13 bp, Homo sapiens
aagggtagctggg

SEQ ID NO: 6576458 - DNA, 13 bp, Homo sapiens
aagggtaggatgt

SEQ ID NO: 6576459 - DNA, 16 bp, Homo sapiens
aagggtaggatgttgc

SEQ ID NO: 6576460 - DNA, 17 bp, Homo sapiens
aagggtagttcaaagag

SEQ ID NO: 6576461 - DNA, 19 bp, Homo sapiens
aagggtatcaggtgctgcc

SEQ ID NO: 6576462 - DNA, 15 bp, Homo sapiens
aagggtatctgctgc

SEQ ID NO: 6576463 - DNA, 14 bp, Homo sapiens
aagggtatgagctg

SEQ ID NO: 6576464 - DNA, 19 bp, Homo sapiens
aagggtatgagctggagct

SEQ ID NO: 6576465 - DNA, 15 bp, Homo sapiens
aagggtcaaacctgt

SEQ ID NO: 6576466 - DNA, 17 bp, Homo sapiens
aagggtcatagaaaggg

SEQ ID NO: 6576467 - DNA, 16 bp, Homo sapiens
aagggtcccttttgca

SEQ ID NO: 6576468 - DNA, 12 bp, Homo sapiens
aagggtcctctt

SEQ ID NO: 6576469 - DNA, 19 bp, Homo sapiens
aagggtcgaaagctctaga

SEQ ID NO: 6576470 - DNA, 16 bp, Homo sapiens
aagggtcgcctatttt

SEQ ID NO: 6576471 - DNA, 17 bp, Homo sapiens
aagggtctagggagaga

SEQ ID NO: 6576472 - DNA, 20 bp, Homo sapiens
aagggtctagggagagaccc

SEQ ID NO: 6576473 - DNA, 23 bp, Homo sapiens
aagggtctccgaaatgctgtctt

SEQ ID NO: 6576474 - DNA, 15 bp, Homo sapiens
aagggtctgataaac

SEQ ID NO: 6576475 - DNA, 16 bp, Homo sapiens
aagggtcttcttggca

SEQ ID NO: 6576476 - DNA, 15 bp, Homo sapiens
aagggtcttgggaaa

SEQ ID NO: 6576477 - DNA, 15 bp, Homo sapiens
aagggtgcaagcccc

SEQ ID NO: 6576478 - DNA, 16 bp, Homo sapiens
aagggtgcccatttgt

SEQ ID NO: 6576479 - DNA, 15 bp, Homo sapiens
aagggtgcctggctg

SEQ ID NO: 6576480 - DNA, 17 bp, Homo sapiens
aagggtgcctggctggg

SEQ ID NO: 6576481 - DNA, 19 bp, Homo sapiens
aagggtgcctggctgggct

SEQ ID NO: 6576482 - DNA, 20 bp, Homo sapiens
aagggtgctcagtctccttg

SEQ ID NO: 6576483 - DNA, 16 bp, Homo sapiens
aagggtgctgcttccc

SEQ ID NO: 6576484 - DNA, 23 bp, Homo sapiens
aagggtgctgcttccctctgcct

SEQ ID NO: 6576485 - DNA, 22 bp, Homo sapiens
aagggtggaaatcaaccctctc

SEQ ID NO: 6576486 - DNA, 19 bp, Homo sapiens
aagggtggatgtgctggag

SEQ ID NO: 6576487 - DNA, 22 bp, Homo sapiens
aagggtggatgtgctggagggg

SEQ ID NO: 6576488 - DNA, 18 bp, Homo sapiens
aagggtggcaggtcactg

SEQ ID NO: 6576489 - DNA, 16 bp, Homo sapiens
aagggtggcctgttcc

SEQ ID NO: 6576490 - DNA, 23 bp, Homo sapiens
aagggtggcctgttccctagaga

SEQ ID NO: 6576491 - DNA, 20 bp, Homo sapiens
aagggtgggagtggggcctt

SEQ ID NO: 6576492 - DNA, 18 bp, Homo sapiens
aagggtgggcatcaaaga

SEQ ID NO: 6576493 - DNA, 12 bp, Homo sapiens
aagggtgggccc

SEQ ID NO: 6576494 - DNA, 22 bp, Homo sapiens
aagggtggggatatcagggcac

SEQ ID NO: 6576495 - DNA, 17 bp, Homo sapiens
aagggtgggtgctcaga

SEQ ID NO: 6576496 - DNA, 19 bp, Homo sapiens
aagggtgtaggggccacct

SEQ ID NO: 6576497 - DNA, 19 bp, Homo sapiens
aagggtgtgggtcagggag

SEQ ID NO: 6576498 - DNA, 16 bp, Homo sapiens
aagggttaaggcctga

SEQ ID NO: 6576499 - DNA, 12 bp, Homo sapiens
aagggttagaca

SEQ ID NO: 6576500 - DNA, 22 bp, Homo sapiens
aagggttagacaagcctggagg

SEQ ID NO: 6576501 - DNA, 16 bp, Homo sapiens
aagggttctgccctgc

SEQ ID NO: 6576502 - DNA, 19 bp, Homo sapiens
ttcttgattttcaagcttt

SEQ ID NO: 6576503 - DNA, 23 bp, Homo sapiens
ttcttgcaagcaacaagctattt

SEQ ID NO: 6576504 - DNA, 13 bp, Homo sapiens
ttcttgcaagctc

SEQ ID NO: 6576505 - DNA, 20 bp, Homo sapiens
ttcttgcaagctccagtagc

SEQ ID NO: 6576506 - DNA, 16 bp, Homo sapiens
ttcttgcaatttgaag

SEQ ID NO: 6576507 - DNA, 17 bp, Homo sapiens
ttcttgcaatttgaagg

SEQ ID NO: 6576508 - DNA, 18 bp, Homo sapiens
ttcttgcactccttccct

SEQ ID NO: 6576509 - DNA, 15 bp, Homo sapiens
ttcttgcactgtcca

SEQ ID NO: 6576510 - DNA, 22 bp, Homo sapiens
ttcttgcataggctcttaagca

SEQ ID NO: 6576511 - DNA, 23 bp, Homo sapiens
ttcttgcataggctcttaagcag

SEQ ID NO: 6576512 - DNA, 17 bp, Homo sapiens
ttcttgcatattttgta

SEQ ID NO: 6576513 - DNA, 20 bp, Homo sapiens
ttcttgcatattttgtaact

SEQ ID NO: 6576514 - DNA, 16 bp, Homo sapiens
ttcttgcatccttcct

SEQ ID NO: 6576515 - DNA, 20 bp, Homo sapiens
ttcttgcatccttcctataa

SEQ ID NO: 6576516 - DNA, 11 bp, Homo sapiens
ttcttgcatct

SEQ ID NO: 6576517 - DNA, 16 bp, Homo sapiens
ttcttgcatctaatga

SEQ ID NO: 6576518 - DNA, 12 bp, Homo sapiens
ttcttgcattga

SEQ ID NO: 6576519 - DNA, 16 bp, Homo sapiens
ttcttgccatcactgg

SEQ ID NO: 6576520 - DNA, 12 bp, Homo sapiens
ttcttgcccaga

SEQ ID NO: 6576521 - DNA, 18 bp, Homo sapiens
ttcttgccccttgggcct

SEQ ID NO: 6576522 - DNA, 12 bp, Homo sapiens
ttcttgccctga

SEQ ID NO: 6576523 - DNA, 13 bp, Homo sapiens
ttcttgccctgag

SEQ ID NO: 6576524 - DNA, 16 bp, Homo sapiens
ttcttgccctgagctt

SEQ ID NO: 6576525 - DNA, 12 bp, Homo sapiens
ttcttgcctcat

SEQ ID NO: 6576526 - DNA, 15 bp, Homo sapiens
ttcttgcctctgtgc

SEQ ID NO: 6576527 - DNA, 17 bp, Homo sapiens
ttcttgcctctgtgctg

SEQ ID NO: 6576528 - DNA, 15 bp, Homo sapiens
ttcttgcctgaggct

SEQ ID NO: 6576529 - DNA, 14 bp, Homo sapiens
ttcttgcctgctgg

SEQ ID NO: 6576530 - DNA, 12 bp, Homo sapiens
ttcttgccttca

SEQ ID NO: 6576531 - DNA, 14 bp, Homo sapiens
ttcttgccttttgt

SEQ ID NO: 6576532 - DNA, 21 bp, Homo sapiens
ttcttgcggcaccgcccaccc

SEQ ID NO: 6576533 - DNA, 23 bp, Homo sapiens
ttcttgctactgaaaaaaatgga

SEQ ID NO: 6576534 - DNA, 13 bp, Homo sapiens
ttcttgctagtat

SEQ ID NO: 6576535 - DNA, 22 bp, Homo sapiens
ttcttgctagtattcgctgtgt

SEQ ID NO: 6576536 - DNA, 17 bp, Homo sapiens
ttcttgctcccttcagc

SEQ ID NO: 6576537 - DNA, 22 bp, Homo sapiens
ttcttgctcgggtcccttcacc

SEQ ID NO: 6576538 - DNA, 20 bp, Homo sapiens
ttcttgctctctctccctgc

SEQ ID NO: 6576539 - DNA, 18 bp, Homo sapiens
ttcttgctctgctcatct

SEQ ID NO: 6576540 - DNA, 12 bp, Homo sapiens
ttcttgctgccc

SEQ ID NO: 6576541 - DNA, 14 bp, Homo sapiens
ttcttgctgccctg

SEQ ID NO: 6576542 - DNA, 18 bp, Homo sapiens
ttcttgctgccctgcccc

SEQ ID NO: 6576543 - DNA, 12 bp, Homo sapiens
ttcttgctgcta

SEQ ID NO: 6576544 - DNA, 15 bp, Homo sapiens
ttcttgctgctagaa

SEQ ID NO: 6576545 - DNA, 16 bp, Homo sapiens
ttcttgctgctagaac

SEQ ID NO: 6576546 - DNA, 17 bp, Homo sapiens
ttcttgctgctagaact

SEQ ID NO: 6576547 - DNA, 19 bp, Homo sapiens
ttcttgctgctagaacttt

SEQ ID NO: 6576548 - DNA, 20 bp, Homo sapiens
ttcttgctgctagaactttt

SEQ ID NO: 6576549 - DNA, 15 bp, Homo sapiens
ttcttgctgttcagt

SEQ ID NO: 6576550 - DNA, 16 bp, Homo sapiens
ttcttgctgttcagtg

SEQ ID NO: 6576551 - DNA, 19 bp, Homo sapiens
ttcttgcttcccgtccccc

SEQ ID NO: 6576552 - DNA, 17 bp, Homo sapiens
ttcttgcttggaagcca

SEQ ID NO: 6576553 - DNA, 15 bp, Homo sapiens
ttcttgctttcaatt

SEQ ID NO: 6576554 - DNA, 17 bp, Homo sapiens
ttcttgctttcacaaat

SEQ ID NO: 6576555 - DNA, 12 bp, Homo sapiens
ttcttggaaaaa

SEQ ID NO: 6576556 - DNA, 16 bp, Homo sapiens
ttcttggaaaaaaatt

SEQ ID NO: 6576557 - DNA, 19 bp, Homo sapiens
ttcttggaactgtcccagc

SEQ ID NO: 6576558 - DNA, 18 bp, Homo sapiens
ttcttggaattttgtaaa

SEQ ID NO: 6576559 - DNA, 23 bp, Homo sapiens
ttcttggaattttgtaaaaagaa

SEQ ID NO: 6576560 - DNA, 19 bp, Homo sapiens
ttcttggacacttaattct

SEQ ID NO: 6576561 - DNA, 22 bp, Homo sapiens
ttcttggacacttaattctgtt

SEQ ID NO: 6576562 - DNA, 22 bp, Homo sapiens
ttcttggaccagtttgcagagt

SEQ ID NO: 6576563 - DNA, 14 bp, Homo sapiens
ttcttggagaactt

SEQ ID NO: 6576564 - DNA, 19 bp, Homo sapiens
ttcttggagtgccaagttt

SEQ ID NO: 6576565 - DNA, 21 bp, Homo sapiens
ttcttggagtgccaagtttgc

SEQ ID NO: 6576566 - DNA, 22 bp, Homo sapiens
ttcttggatcctcagaactctt

SEQ ID NO: 6576567 - DNA, 21 bp, Homo sapiens
ttcttggatggcgttctccta

SEQ ID NO: 6576568 - DNA, 22 bp, Homo sapiens
ttcttggcaataaattttgaaa

SEQ ID NO: 6576569 - DNA, 19 bp, Homo sapiens
ttcttggcctcaagttcaa

SEQ ID NO: 6576570 - DNA, 16 bp, Homo sapiens
ttcttggcgttcctgc

SEQ ID NO: 6576571 - DNA, 18 bp, Homo sapiens
ttcttggcgttcctgcca

SEQ ID NO: 6576572 - DNA, 15 bp, Homo sapiens
ttcttggcttcctgg

SEQ ID NO: 6576573 - DNA, 14 bp, Homo sapiens
ttcttggctttgtt

SEQ ID NO: 6576574 - DNA, 16 bp, Homo sapiens
ttcttgggactgctgt

SEQ ID NO: 6576575 - DNA, 18 bp, Homo sapiens
ttcttgggagaaaatcaa

SEQ ID NO: 6576576 - DNA, 15 bp, Homo sapiens
ttcttgggaggacac

SEQ ID NO: 6576577 - DNA, 18 bp, Homo sapiens
ttcttgggatagtgttct

SEQ ID NO: 6576578 - DNA, 22 bp, Homo sapiens
ttcttgggatagtgttctgctc

SEQ ID NO: 6576579 - DNA, 14 bp, Homo sapiens
ttcttgggccctcc

SEQ ID NO: 6576580 - DNA, 20 bp, Homo sapiens
ttcttggggccctacacctt

SEQ ID NO: 6576581 - DNA, 16 bp, Homo sapiens
ttcttgggtagggcag

SEQ ID NO: 6576582 - DNA, 16 bp, Homo sapiens
ttcttgggtctgccct

SEQ ID NO: 6576583 - DNA, 17 bp, Homo sapiens
ttcttgggtctgccctg

SEQ ID NO: 6576584 - DNA, 15 bp, Homo sapiens
ttcttgggtggttcc

SEQ ID NO: 6576585 - DNA, 19 bp, Homo sapiens
ttcttgggtggttcctaag

SEQ ID NO: 6576586 - DNA, 14 bp, Homo sapiens
ttcttggtaaagtc

SEQ ID NO: 6576587 - DNA, 14 bp, Homo sapiens
ttcttggtagagat

SEQ ID NO: 6576588 - DNA, 16 bp, Homo sapiens
ttcttggtatgatcat

SEQ ID NO: 6576589 - DNA, 22 bp, Homo sapiens
ttcttggtatttggatatctgt

SEQ ID NO: 6576590 - DNA, 16 bp, Homo sapiens
ttcttggtcaagaaag

SEQ ID NO: 6576591 - DNA, 17 bp, Homo sapiens
ttcttggtcaagttttt

SEQ ID NO: 6576592 - DNA, 18 bp, Homo sapiens
ttcttggtggattagaca

SEQ ID NO: 6576593 - DNA, 21 bp, Homo sapiens
ttcttggtgtttgactgtaat

SEQ ID NO: 6576594 - DNA, 23 bp, Homo sapiens
ttcttggttattctgccataaca

SEQ ID NO: 6576595 - DNA, 18 bp, Homo sapiens
ttcttggttcataaatga

SEQ ID NO: 6576596 - DNA, 15 bp, Homo sapiens
ttcttggttcttatt

SEQ ID NO: 6576597 - DNA, 16 bp, Homo sapiens
ttcttggttgttaatt

SEQ ID NO: 6576598 - DNA, 15 bp, Homo sapiens
ttcttggtttcagcc

SEQ ID NO: 6576599 - DNA, 18 bp, Homo sapiens
ttcttgtaaatctttttg

SEQ ID NO: 6576600 - DNA, 15 bp, Homo sapiens
ttcttgtaaatgtgt

SEQ ID NO: 6576601 - DNA, 16 bp, Homo sapiens
ttcttgtaaatgtgtt

SEQ ID NO: 6576602 - DNA, 22 bp, Homo sapiens
ttcttgtaaatgtgttggacaa

SEQ ID NO: 6576603 - DNA, 14 bp, Homo sapiens
ttcttgtaaatgtt

SEQ ID NO: 6576604 - DNA, 20 bp, Homo sapiens
ttcttgtaagccatcagaag

SEQ ID NO: 6576605 - DNA, 11 bp, Homo sapiens
ttcttgtaatt

SEQ ID NO: 6576606 - DNA, 19 bp, Homo sapiens
ttcttgtactctacaaaat

SEQ ID NO: 6576607 - DNA, 12 bp, Homo sapiens
ttcttgtatctg

SEQ ID NO: 6576608 - DNA, 13 bp, Homo sapiens
ttcttgtattaag

SEQ ID NO: 6576609 - DNA, 19 bp, Homo sapiens
ttcttgtattggtgaaaga

SEQ ID NO: 6576610 - DNA, 13 bp, Homo sapiens
ttcttgtatttat

SEQ ID NO: 6576611 - DNA, 14 bp, Homo sapiens
ttcttgtcaaaaaa

SEQ ID NO: 6576612 - DNA, 16 bp, Homo sapiens
ttcttgtcacaataaa

SEQ ID NO: 6576613 - DNA, 15 bp, Homo sapiens
ttcttgtcagacata

SEQ ID NO: 6576614 - DNA, 22 bp, Homo sapiens
ttcttgtcatcagtaagtataa

SEQ ID NO: 6576615 - DNA, 23 bp, Homo sapiens
ttcttgtccacattctacttcag

SEQ ID NO: 6576616 - DNA, 18 bp, Homo sapiens
ttcttgtcgtttgtgaac

SEQ ID NO: 6576617 - DNA, 22 bp, Homo sapiens
ttcttgtctataaagcatttaa

SEQ ID NO: 6576618 - DNA, 14 bp, Homo sapiens
ttcttgtctatagt

SEQ ID NO: 6576619 - DNA, 14 bp, Homo sapiens
ttcttgtctctgag

SEQ ID NO: 6576620 - DNA, 15 bp, Homo sapiens
ttcttgtctctgagg

SEQ ID NO: 6576621 - DNA, 16 bp, Homo sapiens
ttcttgtctttcctcc

SEQ ID NO: 6576622 - DNA, 20 bp, Homo sapiens
ttcttgtgaaaccacaggcc

SEQ ID NO: 6576623 - DNA, 19 bp, Homo sapiens
ttcttgtgaatatgtacat

SEQ ID NO: 6576624 - DNA, 22 bp, Homo sapiens
ttcttgtgacagattatacaga

SEQ ID NO: 6576625 - DNA, 17 bp, Homo sapiens
ttcttgtgatcctttgg

SEQ ID NO: 6576626 - DNA, 23 bp, Homo sapiens
ttcttgtgcatgtttactttatt

SEQ ID NO: 6576627 - DNA, 17 bp, Homo sapiens
ttcttgtgcccttaaaa

SEQ ID NO: 6576628 - DNA, 12 bp, Homo sapiens
ttcttgtgcctc

SEQ ID NO: 6576629 - DNA, 21 bp, Homo sapiens
ttcttgtgctgactaactata

SEQ ID NO: 6576630 - DNA, 21 bp, Homo sapiens
ttcttgtggtgtaaagctggc

SEQ ID NO: 6576631 - DNA, 22 bp, Homo sapiens
ttcttgtggtgtaaagctggcc

SEQ ID NO: 6576632 - DNA, 16 bp, Homo sapiens
ttcttgtggttgtata

SEQ ID NO: 6576633 - DNA, 13 bp, Homo sapiens
ttcttgtgtcctg

SEQ ID NO: 6576634 - DNA, 16 bp, Homo sapiens
ttcttgtgtcctggta

SEQ ID NO: 6576635 - DNA, 11 bp, Homo sapiens
ttcttgtgtgt

SEQ ID NO: 6576636 - DNA, 20 bp, Homo sapiens
ttcttgtgttgttttctctg

SEQ ID NO: 6576637 - DNA, 18 bp, Homo sapiens
ttcttgtgtttgaaacac

SEQ ID NO: 6576638 - DNA, 16 bp, Homo sapiens
ttcttgttacggcagt

SEQ ID NO: 6576639 - DNA, 13 bp, Homo sapiens
ttcttgttctgtt

SEQ ID NO: 6576640 - DNA, 17 bp, Homo sapiens
ttcttgttggtgcacag

SEQ ID NO: 6576641 - DNA, 15 bp, Homo sapiens
ttcttgttgttctgt

SEQ ID NO: 6576642 - DNA, 15 bp, Homo sapiens
ttcttgttgtttata

SEQ ID NO: 6576643 - DNA, 13 bp, Homo sapiens
ttcttgtttctcc

SEQ ID NO: 6576644 - DNA, 12 bp, Homo sapiens
ttcttgtttctt

SEQ ID NO: 6576645 - DNA, 13 bp, Homo sapiens
ttcttgtttgaat

SEQ ID NO: 6576646 - DNA, 14 bp, Homo sapiens
ttcttgtttgtcag

SEQ ID NO: 6576647 - DNA, 15 bp, Homo sapiens
ttcttgtttgtcagc

SEQ ID NO: 6576648 - DNA, 21 bp, Homo sapiens
ttcttgtttgtcagcatctga

SEQ ID NO: 6576649 - DNA, 17 bp, Homo sapiens
ttctttaaaagaatgac

SEQ ID NO: 6576650 - DNA, 15 bp, Homo sapiens
ttctttaaaattaca

SEQ ID NO: 6576651 - DNA, 12 bp, Homo sapiens
ttctttaaacaa

SEQ ID NO: 6576652 - DNA, 14 bp, Homo sapiens
ttctttaaacactc

SEQ ID NO: 6576653 - DNA, 14 bp, Homo sapiens
ttctttaaagaagt

SEQ ID NO: 6576654 - DNA, 13 bp, Homo sapiens
ttctttaaagatg

SEQ ID NO: 6576655 - DNA, 13 bp, Homo sapiens
ttctttaaagcca

SEQ ID NO: 6576656 - DNA, 18 bp, Homo sapiens
ttctttaaatatatatta

SEQ ID NO: 6576657 - DNA, 13 bp, Homo sapiens
ttctttaaatcaa

SEQ ID NO: 6576658 - DNA, 15 bp, Homo sapiens
ttctttaaatcaaaa

SEQ ID NO: 6576659 - DNA, 17 bp, Homo sapiens
ttctttaaatcaaaagc

SEQ ID NO: 6576660 - DNA, 19 bp, Homo sapiens
ttctttaaatttcaaatgt

SEQ ID NO: 6576661 - DNA, 19 bp, Homo sapiens
ttctttaacatacatctaa

SEQ ID NO: 6576662 - DNA, 15 bp, Homo sapiens
ttctttaacatatca

SEQ ID NO: 6576663 - DNA, 12 bp, Homo sapiens
ttctttaactgc

SEQ ID NO: 6576664 - DNA, 15 bp, Homo sapiens
ttctttaagactttt

SEQ ID NO: 6576665 - DNA, 13 bp, Homo sapiens
ttctttaattgtt

SEQ ID NO: 6576666 - DNA, 11 bp, Homo sapiens
ttctttacaaa

SEQ ID NO: 6576667 - DNA, 22 bp, Homo sapiens
ttctttacaaaacaaactcatt

SEQ ID NO: 6576668 - DNA, 18 bp, Homo sapiens
ttctttacaaaatgaatg

SEQ ID NO: 6576669 - DNA, 15 bp, Homo sapiens
ttctttacaaactga

SEQ ID NO: 6576670 - DNA, 23 bp, Homo sapiens
ttctttacaaactgaagataatg

SEQ ID NO: 6576671 - DNA, 21 bp, Homo sapiens
ttctttaccaaaaccatccat

SEQ ID NO: 6576672 - DNA, 23 bp, Homo sapiens
ttctttactactgcaagttcaag

SEQ ID NO: 6576673 - DNA, 15 bp, Homo sapiens
ttctttactattaaa

SEQ ID NO: 6576674 - DNA, 17 bp, Homo sapiens
ttctttactattaaaat

SEQ ID NO: 6576675 - DNA, 21 bp, Homo sapiens
ttctttactggtgatttctga

SEQ ID NO: 6576676 - DNA, 22 bp, Homo sapiens
ttctttagaaaacccaagtttt

SEQ ID NO: 6576677 - DNA, 14 bp, Homo sapiens
ttctttagagaact

SEQ ID NO: 6576678 - DNA, 18 bp, Homo sapiens
ttctttagagaactgaaa

SEQ ID NO: 6576679 - DNA, 21 bp, Homo sapiens
ttctttagagattataacaaa

SEQ ID NO: 6576680 - DNA, 17 bp, Homo sapiens
ttctttagatggtggca

SEQ ID NO: 6576681 - DNA, 21 bp, Homo sapiens
ttctttagatttttaaattgg

SEQ ID NO: 6576682 - DNA, 18 bp, Homo sapiens
ttctttagcttacctggg

SEQ ID NO: 6576683 - DNA, 21 bp, Homo sapiens
ttctttagtcatttaagaatt

SEQ ID NO: 6576684 - DNA, 13 bp, Homo sapiens
ttctttataaaat

SEQ ID NO: 6576685 - DNA, 16 bp, Homo sapiens
ttctttataaaccata

SEQ ID NO: 6576686 - DNA, 14 bp, Homo sapiens
ttctttataatggc

SEQ ID NO: 6576687 - DNA, 19 bp, Homo sapiens
ttctttatacaacagtgct

SEQ ID NO: 6576688 - DNA, 17 bp, Homo sapiens
ttctttatactctcttc

SEQ ID NO: 6576689 - DNA, 19 bp, Homo sapiens
ttctttatatatggacagc

SEQ ID NO: 6576690 - DNA, 16 bp, Homo sapiens
ttctttatcacatgtt

SEQ ID NO: 6576691 - DNA, 17 bp, Homo sapiens
ttctttattagctttct

SEQ ID NO: 6576692 - DNA, 23 bp, Homo sapiens
ttctttattatttttctctctct

SEQ ID NO: 6576693 - DNA, 13 bp, Homo sapiens
ttctttattcaca

SEQ ID NO: 6576694 - DNA, 13 bp, Homo sapiens
ttctttattcttt

SEQ ID NO: 6576695 - DNA, 13 bp, Homo sapiens
ttctttattgcac

SEQ ID NO: 6576696 - DNA, 14 bp, Homo sapiens
ttctttatttttgt

SEQ ID NO: 6576697 - DNA, 22 bp, Homo sapiens
ttctttcaacctatacaaccta

SEQ ID NO: 6576698 - DNA, 18 bp, Homo sapiens
ttctttcaagatcttcaa

SEQ ID NO: 6576699 - DNA, 22 bp, Homo sapiens
ttctttcaagatcttcaaccat

SEQ ID NO: 6576700 - DNA, 19 bp, Homo sapiens
ttctttcacaaaaaagaag

SEQ ID NO: 6576701 - DNA, 18 bp, Homo sapiens
ttctttcacttgatgttt

SEQ ID NO: 6576702 - DNA, 11 bp, Homo sapiens
ttctttcagat

SEQ ID NO: 6576703 - DNA, 19 bp, Homo sapiens
ttctttcagttctttggat

SEQ ID NO: 6576704 - DNA, 16 bp, Homo sapiens
ttctttcatacattat

SEQ ID NO: 6576705 - DNA, 14 bp, Homo sapiens
ttctttcatttctt

SEQ ID NO: 6576706 - DNA, 19 bp, Homo sapiens
ttctttccaaaacatttct

SEQ ID NO: 6576707 - DNA, 16 bp, Homo sapiens
ttctttccaagtcatt

SEQ ID NO: 6576708 - DNA, 18 bp, Homo sapiens
ttctttccacagaagctc

SEQ ID NO: 6576709 - DNA, 16 bp, Homo sapiens
ttctttccacctttct

SEQ ID NO: 6576710 - DNA, 12 bp, Homo sapiens
ttctttccagag

SEQ ID NO: 6576711 - DNA, 13 bp, Homo sapiens
ttctttccatgaa

SEQ ID NO: 6576712 - DNA, 20 bp, Homo sapiens
ttctttccattatgattctt

SEQ ID NO: 6576713 - DNA, 20 bp, Homo sapiens
ttctttcccacactgaaatt

SEQ ID NO: 6576714 - DNA, 13 bp, Homo sapiens
ttctttcccagtg

SEQ ID NO: 6576715 - DNA, 16 bp, Homo sapiens
ttctttcccagtgagt

SEQ ID NO: 6576716 - DNA, 16 bp, Homo sapiens
ttctttccccagaggc

SEQ ID NO: 6576717 - DNA, 21 bp, Homo sapiens
ttctttccctggacaggcagc

SEQ ID NO: 6576718 - DNA, 19 bp, Homo sapiens
ttctttccgtcaccctggg

SEQ ID NO: 6576719 - DNA, 11 bp, Homo sapiens
ttctttcctaa

SEQ ID NO: 6576720 - DNA, 19 bp, Homo sapiens
ttctttcctccccctgcaa

SEQ ID NO: 6576721 - DNA, 22 bp, Homo sapiens
ttctttcctctccaattgtaaa

SEQ ID NO: 6576722 - DNA, 13 bp, Homo sapiens
ttctttcctctta

SEQ ID NO: 6576723 - DNA, 22 bp, Homo sapiens
ttctttcctcttccccttgccc

SEQ ID NO: 6576724 - DNA, 21 bp, Homo sapiens
ttctttcctgaggctgggctc

SEQ ID NO: 6576725 - DNA, 12 bp, Homo sapiens
ttctttcctgcc

SEQ ID NO: 6576726 - DNA, 14 bp, Homo sapiens
ttctttcctgccct

SEQ ID NO: 6576727 - DNA, 12 bp, Homo sapiens
ttctttccttcc

SEQ ID NO: 6576728 - DNA, 14 bp, Homo sapiens
ttctttccttgttc

SEQ ID NO: 6576729 - DNA, 15 bp, Homo sapiens
ttctttccttgttca

SEQ ID NO: 6576730 - DNA, 12 bp, Homo sapiens
ttctttcctttt

SEQ ID NO: 6576731 - DNA, 17 bp, Homo sapiens
ttctttctaaaacacat

SEQ ID NO: 6576732 - DNA, 12 bp, Homo sapiens
ttctttctagaa

SEQ ID NO: 6576733 - DNA, 18 bp, Homo sapiens
ttctttctagtggtcttt

SEQ ID NO: 6576734 - DNA, 21 bp, Homo sapiens
ttctttctagtggtctttgta

SEQ ID NO: 6576735 - DNA, 19 bp, Homo sapiens
ttctttctagttcagctgc

SEQ ID NO: 6576736 - DNA, 13 bp, Homo sapiens
ttctttctagttt

SEQ ID NO: 6576737 - DNA, 17 bp, Homo sapiens
ttctttctatgtagaac

SEQ ID NO: 6576738 - DNA, 17 bp, Homo sapiens
ttctttctccatggagc

SEQ ID NO: 6576739 - DNA, 23 bp, Homo sapiens
ttctttctctcagccttacattt

SEQ ID NO: 6576740 - DNA, 22 bp, Homo sapiens
ttctttctctttctgtttcctg

SEQ ID NO: 6576741 - DNA, 14 bp, Homo sapiens
ttctttctctttga

SEQ ID NO: 6576742 - DNA, 12 bp, Homo sapiens
ttctttctgaga

SEQ ID NO: 6576743 - DNA, 22 bp, Homo sapiens
ttctttctgattttaagtttgc

SEQ ID NO: 6576744 - DNA, 13 bp, Homo sapiens
ttctttctggact

SEQ ID NO: 6576745 - DNA, 14 bp, Homo sapiens
ttctttctggactg

SEQ ID NO: 6576746 - DNA, 16 bp, Homo sapiens
ttctttctgtctccct

SEQ ID NO: 6576747 - DNA, 18 bp, Homo sapiens
ttctttctgtctcccttc

SEQ ID NO: 6576748 - DNA, 12 bp, Homo sapiens
ttctttctgtta

SEQ ID NO: 6576749 - DNA, 14 bp, Homo sapiens
ttctttcttagaaa

SEQ ID NO: 6576750 - DNA, 12 bp, Homo sapiens
ttctttcttcca

SEQ ID NO: 6576751 - DNA, 15 bp, Homo sapiens
ttctttcttcctcca

SEQ ID NO: 6576752 - DNA, 16 bp, Homo sapiens
ttctttctttgggaat

SEQ ID NO: 6576753 - DNA, 13 bp, Homo sapiens
ttctttcttttgc

SEQ ID NO: 6576754 - DNA, 15 bp, Homo sapiens
ttctttgaaatgcta

SEQ ID NO: 6576755 - DNA, 14 bp, Homo sapiens
ttctttgaataaat

SEQ ID NO: 6576756 - DNA, 15 bp, Homo sapiens
ttctttgaattttca

SEQ ID NO: 6576757 - DNA, 17 bp, Homo sapiens
ttctttgaattttcatt

SEQ ID NO: 6576758 - DNA, 19 bp, Homo sapiens
ttctttgaccagcacatta

SEQ ID NO: 6576759 - DNA, 17 bp, Homo sapiens
ttctttgagactgggtc

SEQ ID NO: 6576760 - DNA, 17 bp, Homo sapiens
ttctttgataatgttaa

SEQ ID NO: 6576761 - DNA, 17 bp, Homo sapiens
ttctttgatttgtacca

SEQ ID NO: 6576762 - DNA, 15 bp, Homo sapiens
ttctttgcaaaaatc

SEQ ID NO: 6576763 - DNA, 22 bp, Homo sapiens
ttctttgcaacaataataaatg

SEQ ID NO: 6576764 - DNA, 17 bp, Homo sapiens
ttctttgcaacagcagt

SEQ ID NO: 6576765 - DNA, 20 bp, Homo sapiens
ttctttgcaacagcagtgtt

SEQ ID NO: 6576766 - DNA, 12 bp, Homo sapiens
ttctttgcaata

SEQ ID NO: 6576767 - DNA, 17 bp, Homo sapiens
ttctttgcaatactgct

SEQ ID NO: 6576768 - DNA, 14 bp, Homo sapiens
ttctttgcacttaa

SEQ ID NO: 6576769 - DNA, 16 bp, Homo sapiens
ttctttgcacttaaaa

SEQ ID NO: 6576770 - DNA, 19 bp, Homo sapiens
ttctttgccatctctgctc

SEQ ID NO: 6576771 - DNA, 21 bp, Homo sapiens
ttctttgccatctctgctcca

SEQ ID NO: 6576772 - DNA, 12 bp, Homo sapiens
ttctttgcctct

SEQ ID NO: 6576773 - DNA, 13 bp, Homo sapiens
ttctttgcctctg

SEQ ID NO: 6576774 - DNA, 17 bp, Homo sapiens
ttctttgcctgttcagt

SEQ ID NO: 6576775 - DNA, 14 bp, Homo sapiens
ttctttgctgcccc

SEQ ID NO: 6576776 - DNA, 15 bp, Homo sapiens
ttctttgctgtaaga

SEQ ID NO: 6576777 - DNA, 15 bp, Homo sapiens
ttctttgctgtgcca

SEQ ID NO: 6576778 - DNA, 12 bp, Homo sapiens
ttctttgctgtt

SEQ ID NO: 6576779 - DNA, 17 bp, Homo sapiens
ttctttgcttgaacaca

SEQ ID NO: 6576780 - DNA, 22 bp, Homo sapiens
ttctttggaatgaaattcctcc

SEQ ID NO: 6576781 - DNA, 18 bp, Homo sapiens
ttctttggacttctgaag

SEQ ID NO: 6576782 - DNA, 16 bp, Homo sapiens
ttctttggagttaaaa

SEQ ID NO: 6576783 - DNA, 17 bp, Homo sapiens
ttctttggcctacattc

SEQ ID NO: 6576784 - DNA, 13 bp, Homo sapiens
ttctttggctcta

SEQ ID NO: 6576785 - DNA, 18 bp, Homo sapiens
ttctttgggaatatttga

SEQ ID NO: 6576786 - DNA, 22 bp, Homo sapiens
ttctttgggaatatttgaatct

SEQ ID NO: 6576787 - DNA, 16 bp, Homo sapiens
ttctttggtaattttt

SEQ ID NO: 6576788 - DNA, 20 bp, Homo sapiens
ttctttggtaggtaaatcta

SEQ ID NO: 6576789 - DNA, 19 bp, Homo sapiens
ttctttggtgcctttcctg

SEQ ID NO: 6576790 - DNA, 22 bp, Homo sapiens
ttctttggtggagataaagatt

SEQ ID NO: 6576791 - DNA, 15 bp, Homo sapiens
ttctttggttgtgaa

SEQ ID NO: 6576792 - DNA, 15 bp, Homo sapiens
ttctttgtaatgaaa

SEQ ID NO: 6576793 - DNA, 16 bp, Homo sapiens
ttctttgtaatgaaaa

SEQ ID NO: 6576794 - DNA, 15 bp, Homo sapiens
ttctttgtacctttt

SEQ ID NO: 6576795 - DNA, 16 bp, Homo sapiens
ttctttgtactaatac

SEQ ID NO: 6576796 - DNA, 12 bp, Homo sapiens
ttctttgtatca

SEQ ID NO: 6576797 - DNA, 15 bp, Homo sapiens
ttctttgtatcttaa

SEQ ID NO: 6576798 - DNA, 19 bp, Homo sapiens
ttctttgtattaccaaagc

SEQ ID NO: 6576799 - DNA, 15 bp, Homo sapiens
ttctttgtcattcag

SEQ ID NO: 6576800 - DNA, 18 bp, Homo sapiens
ttctttgtcattcagttc

SEQ ID NO: 6576801 - DNA, 15 bp, Homo sapiens
ttctttgtgcctgag

SEQ ID NO: 6576802 - DNA, 13 bp, Homo sapiens
ttctttgtgcctt

SEQ ID NO: 6576803 - DNA, 19 bp, Homo sapiens
ttctttgtgtcaacatgaa

SEQ ID NO: 6576804 - DNA, 11 bp, Homo sapiens
ttctttgtgtt

SEQ ID NO: 6576805 - DNA, 15 bp, Homo sapiens
ttctttgttcctgct

SEQ ID NO: 6576806 - DNA, 16 bp, Homo sapiens
ttctttgttcctgctt

SEQ ID NO: 6576807 - DNA, 17 bp, Homo sapiens
ttctttgttcctgcttt

SEQ ID NO: 6576808 - DNA, 22 bp, Homo sapiens
ttctttgttcctgctttctctt

SEQ ID NO: 6576809 - DNA, 15 bp, Homo sapiens
ttctttgttctgttt

SEQ ID NO: 6576810 - DNA, 14 bp, Homo sapiens
ttctttgtttcttt

SEQ ID NO: 6576811 - DNA, 17 bp, Homo sapiens
ttctttgtttctttctt

SEQ ID NO: 6576812 - DNA, 18 bp, Homo sapiens
ttcttttaaattagaaaa

SEQ ID NO: 6576813 - DNA, 18 bp, Homo sapiens
ttcttttaagtatacaac

SEQ ID NO: 6576814 - DNA, 13 bp, Homo sapiens
ttcttttagaaaa

SEQ ID NO: 6576815 - DNA, 20 bp, Homo sapiens
ttcttttagatgtttacctt

SEQ ID NO: 6576816 - DNA, 17 bp, Homo sapiens
ttcttttagtcagaaat

SEQ ID NO: 6576817 - DNA, 22 bp, Homo sapiens
ttcttttatatataaaataaat

SEQ ID NO: 6576818 - DNA, 19 bp, Homo sapiens
ttcttttatggcaaaagta

SEQ ID NO: 6576819 - DNA, 14 bp, Homo sapiens
ttcttttattaata

SEQ ID NO: 6576820 - DNA, 18 bp, Homo sapiens
ttcttttcaatgcaatgc

SEQ ID NO: 6576821 - DNA, 21 bp, Homo sapiens
ttcttttcacattaggctgtt

SEQ ID NO: 6576822 - DNA, 17 bp, Homo sapiens
ttcttttcagcttgttt

SEQ ID NO: 6576823 - DNA, 18 bp, Homo sapiens
ttcttttccaagctcctt

SEQ ID NO: 6576824 - DNA, 13 bp, Homo sapiens
ttcttttccccct

SEQ ID NO: 6576825 - DNA, 19 bp, Homo sapiens
ttcttttcctccatgatgt

SEQ ID NO: 6576826 - DNA, 16 bp, Homo sapiens
ttcttttcctctctta

SEQ ID NO: 6576827 - DNA, 11 bp, Homo sapiens
ttcttttcctt

SEQ ID NO: 6576828 - DNA, 12 bp, Homo sapiens
ttcttttccttt

SEQ ID NO: 6576829 - DNA, 13 bp, Homo sapiens
ttcttttctaact

SEQ ID NO: 6576830 - DNA, 21 bp, Homo sapiens
ttcttttctctatgaaaagca

SEQ ID NO: 6576831 - DNA, 21 bp, Homo sapiens
ttcttttctggaatgtaatca

SEQ ID NO: 6576832 - DNA, 14 bp, Homo sapiens
ttcttttcttttgt

SEQ ID NO: 6576833 - DNA, 14 bp, Homo sapiens
ttcttttcttttta

SEQ ID NO: 6576834 - DNA, 14 bp, Homo sapiens
ttcttttgatacat

SEQ ID NO: 6576835 - DNA, 16 bp, Homo sapiens
ttcttttgatacattt

SEQ ID NO: 6576836 - DNA, 17 bp, Homo sapiens
ttcttttgccaactgaa

SEQ ID NO: 6576837 - DNA, 18 bp, Homo sapiens
ttcttttgccacatccct

SEQ ID NO: 6576838 - DNA, 14 bp, Homo sapiens
ttcttttgccatga

SEQ ID NO: 6576839 - DNA, 22 bp, Homo sapiens
ttcttttgcccttcacagtgtt

SEQ ID NO: 6576840 - DNA, 23 bp, Homo sapiens
ttcttttgcccttcacagtgttt

SEQ ID NO: 6576841 - DNA, 21 bp, Homo sapiens
ttcttttgctgaacaggaaag

SEQ ID NO: 6576842 - DNA, 13 bp, Homo sapiens
ttcttttggaaat

SEQ ID NO: 6576843 - DNA, 22 bp, Homo sapiens
ttcttttggctttgaaacttgc

SEQ ID NO: 6576844 - DNA, 22 bp, Homo sapiens
ttcttttgggaggatttgatgt

SEQ ID NO: 6576845 - DNA, 15 bp, Homo sapiens
ttcttttgtaaagag

SEQ ID NO: 6576846 - DNA, 16 bp, Homo sapiens
ttcttttgtaaagaga

SEQ ID NO: 6576847 - DNA, 13 bp, Homo sapiens
ttcttttgtaatt

SEQ ID NO: 6576848 - DNA, 16 bp, Homo sapiens
ttcttttgtgcatatg

SEQ ID NO: 6576849 - DNA, 17 bp, Homo sapiens
ttcttttgtgcccctgc

SEQ ID NO: 6576850 - DNA, 17 bp, Homo sapiens
ttcttttgtggtgtctt

SEQ ID NO: 6576851 - DNA, 17 bp, Homo sapiens
ttcttttgttactgttc

SEQ ID NO: 6576852 - DNA, 13 bp, Homo sapiens
ttcttttgtttca

SEQ ID NO: 6576853 - DNA, 15 bp, Homo sapiens
ttcttttgtttggta

SEQ ID NO: 6576854 - DNA, 20 bp, Homo sapiens
ttcttttgttttcttcattt

SEQ ID NO: 6576855 - DNA, 19 bp, Homo sapiens
ttcttttgttttttgaagt

SEQ ID NO: 6576856 - DNA, 14 bp, Homo sapiens
ttctttttaaaata

SEQ ID NO: 6576857 - DNA, 20 bp, Homo sapiens
ttctttttaaaatggtgctt

SEQ ID NO: 6576858 - DNA, 20 bp, Homo sapiens
ttctttttaaagcttttgat

SEQ ID NO: 6576859 - DNA, 18 bp, Homo sapiens
ttctttttaaagtttgtt

SEQ ID NO: 6576860 - DNA, 20 bp, Homo sapiens
ttctttttaattattttaaa

SEQ ID NO: 6576861 - DNA, 18 bp, Homo sapiens
ttctttttacagcattgt

SEQ ID NO: 6576862 - DNA, 20 bp, Homo sapiens
ttctttttacagcattgtct

SEQ ID NO: 6576863 - DNA, 21 bp, Homo sapiens
ttctttttacagcattgtctt

SEQ ID NO: 6576864 - DNA, 22 bp, Homo sapiens
ttctttttacagcattgtcttt

SEQ ID NO: 6576865 - DNA, 20 bp, Homo sapiens
aagggttctgccctgcctga

SEQ ID NO: 6576866 - DNA, 23 bp, Homo sapiens
aagggttctgccctgcctgagga

SEQ ID NO: 6576867 - DNA, 17 bp, Homo sapiens
aagggttctggctgccc

SEQ ID NO: 6576868 - DNA, 15 bp, Homo sapiens
aagggttgaaggcag

SEQ ID NO: 6576869 - DNA, 15 bp, Homo sapiens
aagggttgagagcca

SEQ ID NO: 6576870 - DNA, 14 bp, Homo sapiens
aagggttgggcccc

SEQ ID NO: 6576871 - DNA, 20 bp, Homo sapiens
aagggtttcgactggtccag

SEQ ID NO: 6576872 - DNA, 14 bp, Homo sapiens
aagggtttctctat

SEQ ID NO: 6576873 - DNA, 23 bp, Homo sapiens
aagggtttctgacccaagaggtg

SEQ ID NO: 6576874 - DNA, 20 bp, Homo sapiens
aagggtttgtggctgggggc

SEQ ID NO: 6576875 - DNA, 15 bp, Homo sapiens
aagggttttgtgtgt

SEQ ID NO: 6576876 - DNA, 19 bp, Homo sapiens
aagggtttttagagaatgt

SEQ ID NO: 6576877 - DNA, 23 bp, Homo sapiens
aagggttttttttttttcctttt

SEQ ID NO: 6576878 - DNA, 14 bp, Homo sapiens
aaggtaaaaagtta

SEQ ID NO: 6576879 - DNA, 15 bp, Homo sapiens
aaggtaaaatcactt

SEQ ID NO: 6576880 - DNA, 18 bp, Homo sapiens
aaggtaaaatgccatgat

SEQ ID NO: 6576881 - DNA, 16 bp, Homo sapiens
aaggtaaaattctaaa

SEQ ID NO: 6576882 - DNA, 17 bp, Homo sapiens
aaggtaaaattctaaat

SEQ ID NO: 6576883 - DNA, 20 bp, Homo sapiens
aaggtaacatttatagaaga

SEQ ID NO: 6576884 - DNA, 16 bp, Homo sapiens
aaggtaactaactgct

SEQ ID NO: 6576885 - DNA, 16 bp, Homo sapiens
aaggtaactattagaa

SEQ ID NO: 6576886 - DNA, 22 bp, Homo sapiens
aaggtaagaggttggtgtggag

SEQ ID NO: 6576887 - DNA, 17 bp, Homo sapiens
aaggtaataaatacaca

SEQ ID NO: 6576888 - DNA, 23 bp, Homo sapiens
aaggtaatactataaatatattg

SEQ ID NO: 6576889 - DNA, 17 bp, Homo sapiens
aaggtaatctgaaacac

SEQ ID NO: 6576890 - DNA, 17 bp, Homo sapiens
aaggtaatgcacatcct

SEQ ID NO: 6576891 - DNA, 12 bp, Homo sapiens
aaggtaattctg

SEQ ID NO: 6576892 - DNA, 12 bp, Homo sapiens
aaggtaattgtt

SEQ ID NO: 6576893 - DNA, 19 bp, Homo sapiens
aaggtaattgttttttaaa

SEQ ID NO: 6576894 - DNA, 23 bp, Homo sapiens
aaggtaatttgatggtatttctt

SEQ ID NO: 6576895 - DNA, 20 bp, Homo sapiens
aaggtaatttttttttgtaa

SEQ ID NO: 6576896 - DNA, 20 bp, Homo sapiens
aaggtacaactgtatttatt

SEQ ID NO: 6576897 - DNA, 19 bp, Homo sapiens
aaggtacaagaagcatttt

SEQ ID NO: 6576898 - DNA, 14 bp, Homo sapiens
aaggtacaatcaaa

SEQ ID NO: 6576899 - DNA, 19 bp, Homo sapiens
aaggtaccaaacaaggaag

SEQ ID NO: 6576900 - DNA, 18 bp, Homo sapiens
aaggtaccgatttctgct

SEQ ID NO: 6576901 - DNA, 21 bp, Homo sapiens
aaggtaccgatttctgctaag

SEQ ID NO: 6576902 - DNA, 22 bp, Homo sapiens
aaggtactgtatgatcaaatgt

SEQ ID NO: 6576903 - DNA, 15 bp, Homo sapiens
aaggtactgtggggt

SEQ ID NO: 6576904 - DNA, 16 bp, Homo sapiens
aaggtactgtggggtg

SEQ ID NO: 6576905 - DNA, 13 bp, Homo sapiens
aaggtacttcaaa

SEQ ID NO: 6576906 - DNA, 18 bp, Homo sapiens
aaggtactttcatatttt

SEQ ID NO: 6576907 - DNA, 22 bp, Homo sapiens
aaggtactttcatattttaaac

SEQ ID NO: 6576908 - DNA, 14 bp, Homo sapiens
aaggtagaaataga

SEQ ID NO: 6576909 - DNA, 20 bp, Homo sapiens
aaggtagaaatatctgaaaa

SEQ ID NO: 6576910 - DNA, 15 bp, Homo sapiens
aaggtagaaggcaca

SEQ ID NO: 6576911 - DNA, 20 bp, Homo sapiens
aaggtagaatgaccttgtaa

SEQ ID NO: 6576912 - DNA, 22 bp, Homo sapiens
aaggtagaatgaccttgtaatg

SEQ ID NO: 6576913 - DNA, 13 bp, Homo sapiens
aaggtagaatgtt

SEQ ID NO: 6576914 - DNA, 22 bp, Homo sapiens
aaggtagacatggatttgatga

SEQ ID NO: 6576915 - DNA, 19 bp, Homo sapiens
aaggtagatcatcttgaat

SEQ ID NO: 6576916 - DNA, 14 bp, Homo sapiens
aaggtagcattcat

SEQ ID NO: 6576917 - DNA, 23 bp, Homo sapiens
aaggtagcattcattacctgttt

SEQ ID NO: 6576918 - DNA, 20 bp, Homo sapiens
aaggtagcattctttggagt

SEQ ID NO: 6576919 - DNA, 17 bp, Homo sapiens
aaggtagcccagcactg

SEQ ID NO: 6576920 - DNA, 18 bp, Homo sapiens
aaggtagcccagcactgt

SEQ ID NO: 6576921 - DNA, 20 bp, Homo sapiens
aaggtaggggccgtgtcccg

SEQ ID NO: 6576922 - DNA, 15 bp, Homo sapiens
aaggtagttcaagaa

SEQ ID NO: 6576923 - DNA, 22 bp, Homo sapiens
aaggtagtttttacctaccaca

SEQ ID NO: 6576924 - DNA, 22 bp, Homo sapiens
aaggtataaggatcttttgtaa

SEQ ID NO: 6576925 - DNA, 18 bp, Homo sapiens
aaggtataataaaattat

SEQ ID NO: 6576926 - DNA, 21 bp, Homo sapiens
aaggtatacacccagttctga

SEQ ID NO: 6576927 - DNA, 17 bp, Homo sapiens
aaggtatatcaggaggg

SEQ ID NO: 6576928 - DNA, 22 bp, Homo sapiens
aaggtatatctaggtttatgac

SEQ ID NO: 6576929 - DNA, 23 bp, Homo sapiens
aaggtatggtggggatattttta

SEQ ID NO: 6576930 - DNA, 15 bp, Homo sapiens
aaggtatgtaaactt

SEQ ID NO: 6576931 - DNA, 20 bp, Homo sapiens
aaggtatgtaaactttcctg

SEQ ID NO: 6576932 - DNA, 18 bp, Homo sapiens
aaggtattaaattgatgt

SEQ ID NO: 6576933 - DNA, 22 bp, Homo sapiens
aaggtattaagattataattgt

SEQ ID NO: 6576934 - DNA, 16 bp, Homo sapiens
aaggtattatacatgt

SEQ ID NO: 6576935 - DNA, 19 bp, Homo sapiens
aaggtattccttgttcttc

SEQ ID NO: 6576936 - DNA, 19 bp, Homo sapiens
aaggtatttcgaaactgcc

SEQ ID NO: 6576937 - DNA, 21 bp, Homo sapiens
aaggtatttgggaaacttgtc

SEQ ID NO: 6576938 - DNA, 15 bp, Homo sapiens
aaggtattttgaata

SEQ ID NO: 6576939 - DNA, 20 bp, Homo sapiens
aaggtattttgtagatgtga

SEQ ID NO: 6576940 - DNA, 15 bp, Homo sapiens
aaggtcacctcactc

SEQ ID NO: 6576941 - DNA, 17 bp, Homo sapiens
aaggtcactactgcatt

SEQ ID NO: 6576942 - DNA, 14 bp, Homo sapiens
aaggtcagaatttt

SEQ ID NO: 6576943 - DNA, 17 bp, Homo sapiens
aaggtcagattagggcg

SEQ ID NO: 6576944 - DNA, 19 bp, Homo sapiens
aaggtcagcccgtttcaga

SEQ ID NO: 6576945 - DNA, 23 bp, Homo sapiens
aaggtcagcccgtttcagaagga

SEQ ID NO: 6576946 - DNA, 22 bp, Homo sapiens
aaggtcagggacacatcccctt

SEQ ID NO: 6576947 - DNA, 21 bp, Homo sapiens
aaggtcagtaatgctgcagga

SEQ ID NO: 6576948 - DNA, 22 bp, Homo sapiens
aaggtcagtgttataaaatctg

SEQ ID NO: 6576949 - DNA, 14 bp, Homo sapiens
aaggtcatatgcac

SEQ ID NO: 6576950 - DNA, 20 bp, Homo sapiens
aaggtcattgtggctatctg

SEQ ID NO: 6576951 - DNA, 14 bp, Homo sapiens
aaggtcatttcttc

SEQ ID NO: 6576952 - DNA, 19 bp, Homo sapiens
aaggtcattttttttaaga

SEQ ID NO: 6576953 - DNA, 13 bp, Homo sapiens
aaggtccagtgga

SEQ ID NO: 6576954 - DNA, 14 bp, Homo sapiens
aaggtcccacagcc

SEQ ID NO: 6576955 - DNA, 20 bp, Homo sapiens
aaggtcccacagccctgaga

SEQ ID NO: 6576956 - DNA, 16 bp, Homo sapiens
aaggtcccatgctcca

SEQ ID NO: 6576957 - DNA, 16 bp, Homo sapiens
aaggtcccatggcctg

SEQ ID NO: 6576958 - DNA, 15 bp, Homo sapiens
aaggtccccagcaga

SEQ ID NO: 6576959 - DNA, 14 bp, Homo sapiens
aaggtcccctggca

SEQ ID NO: 6576960 - DNA, 17 bp, Homo sapiens
aaggtccggatgtcact

SEQ ID NO: 6576961 - DNA, 17 bp, Homo sapiens
aaggtcctaagggagtg

SEQ ID NO: 6576962 - DNA, 23 bp, Homo sapiens
aaggtcctctcagttctctccct

SEQ ID NO: 6576963 - DNA, 15 bp, Homo sapiens
aaggtcctcttgaaa

SEQ ID NO: 6576964 - DNA, 20 bp, Homo sapiens
aaggtcctcttgaaatgtta

SEQ ID NO: 6576965 - DNA, 13 bp, Homo sapiens
aaggtccttgact

SEQ ID NO: 6576966 - DNA, 20 bp, Homo sapiens
aaggtcggaggcttgggacc

SEQ ID NO: 6576967 - DNA, 16 bp, Homo sapiens
aaggtcgggacagctg

SEQ ID NO: 6576968 - DNA, 18 bp, Homo sapiens
aaggtcgtttttttcatt

SEQ ID NO: 6576969 - DNA, 16 bp, Homo sapiens
aaggtctaactgtgga

SEQ ID NO: 6576970 - DNA, 19 bp, Homo sapiens
aaggtctaatcagtgatta

SEQ ID NO: 6576971 - DNA, 20 bp, Homo sapiens
aaggtctcacactcctcctg

SEQ ID NO: 6576972 - DNA, 16 bp, Homo sapiens
aaggtctcatgcctga

SEQ ID NO: 6576973 - DNA, 18 bp, Homo sapiens
aaggtctcatttgatatt

SEQ ID NO: 6576974 - DNA, 22 bp, Homo sapiens
aaggtctccaagggagggtgca

SEQ ID NO: 6576975 - DNA, 21 bp, Homo sapiens
aaggtctccttactctgagcc

SEQ ID NO: 6576976 - DNA, 21 bp, Homo sapiens
aaggtctctctggctctagga

SEQ ID NO: 6576977 - DNA, 12 bp, Homo sapiens
aaggtctctctt

SEQ ID NO: 6576978 - DNA, 20 bp, Homo sapiens
aaggtctctctttggactct

SEQ ID NO: 6576979 - DNA, 19 bp, Homo sapiens
aaggtctgagccacagcag

SEQ ID NO: 6576980 - DNA, 16 bp, Homo sapiens
aaggtctggcctcagg

SEQ ID NO: 6576981 - DNA, 21 bp, Homo sapiens
aaggtctgtggctcctcccga

SEQ ID NO: 6576982 - DNA, 21 bp, Homo sapiens
aaggtctgtggtgcagtgtgt

SEQ ID NO: 6576983 - DNA, 18 bp, Homo sapiens
aaggtcttacattgcctg

SEQ ID NO: 6576984 - DNA, 19 bp, Homo sapiens
aaggtcttcttgtgtcctg

SEQ ID NO: 6576985 - DNA, 20 bp, Homo sapiens
aaggtcttcttgtgtcctga

SEQ ID NO: 6576986 - DNA, 23 bp, Homo sapiens
aaggtcttcttgtgtcctgatga

SEQ ID NO: 6576987 - DNA, 23 bp, Homo sapiens
aaggtcttgcagtggcttttcat

SEQ ID NO: 6576988 - DNA, 22 bp, Homo sapiens
aaggtcttgcatttaaaagaca

SEQ ID NO: 6576989 - DNA, 14 bp, Homo sapiens
aaggtcttgcctga

SEQ ID NO: 6576990 - DNA, 12 bp, Homo sapiens
aaggtctttcag

SEQ ID NO: 6576991 - DNA, 18 bp, Homo sapiens
aaggtctttcagtacttt

SEQ ID NO: 6576992 - DNA, 19 bp, Homo sapiens
aaggtctttcagtactttt

SEQ ID NO: 6576993 - DNA, 12 bp, Homo sapiens
aaggtctttgca

SEQ ID NO: 6576994 - DNA, 11 bp, Homo sapiens
aaggtctttgt

SEQ ID NO: 6576995 - DNA, 20 bp, Homo sapiens
aaggtctttgtaaaatcttg

SEQ ID NO: 6576996 - DNA, 18 bp, Homo sapiens
aaggtgaaaatgttttat

SEQ ID NO: 6576997 - DNA, 16 bp, Homo sapiens
aaggtgaaacacacac

SEQ ID NO: 6576998 - DNA, 17 bp, Homo sapiens
aaggtgaaacattttct

SEQ ID NO: 6576999 - DNA, 22 bp, Homo sapiens
aaggtgaaacattttctccctg

SEQ ID NO: 6577000 - DNA, 22 bp, Homo sapiens
aaggtgaaacgactcaaaatga

SEQ ID NO: 6577001 - DNA, 12 bp, Homo sapiens
aaggtgaagaat

SEQ ID NO: 6577002 - DNA, 13 bp, Homo sapiens
aaggtgaagcaca

SEQ ID NO: 6577003 - DNA, 14 bp, Homo sapiens
aaggtgaaggaata

SEQ ID NO: 6577004 - DNA, 15 bp, Homo sapiens
aaggtgaaggaatat

SEQ ID NO: 6577005 - DNA, 22 bp, Homo sapiens
aaggtgaaggatctgtccgaca

SEQ ID NO: 6577006 - DNA, 14 bp, Homo sapiens
aaggtgaagtgagg

SEQ ID NO: 6577007 - DNA, 21 bp, Homo sapiens
aaggtgaagtgaggacaaaat

SEQ ID NO: 6577008 - DNA, 21 bp, Homo sapiens
aaggtgacacattacaaagcc

SEQ ID NO: 6577009 - DNA, 20 bp, Homo sapiens
aaggtgacagaaggaccagc

SEQ ID NO: 6577010 - DNA, 15 bp, Homo sapiens
aaggtgactgtgtgt

SEQ ID NO: 6577011 - DNA, 18 bp, Homo sapiens
aaggtgacttcctctggt

SEQ ID NO: 6577012 - DNA, 18 bp, Homo sapiens
aaggtgagaattaagttt

SEQ ID NO: 6577013 - DNA, 14 bp, Homo sapiens
aaggtgagctcagc

SEQ ID NO: 6577014 - DNA, 20 bp, Homo sapiens
aaggtgaggagcttgaaacc

SEQ ID NO: 6577015 - DNA, 19 bp, Homo sapiens
aaggtgaggtgaactccag

SEQ ID NO: 6577016 - DNA, 20 bp, Homo sapiens
aaggtgaggtgaactccagg

SEQ ID NO: 6577017 - DNA, 22 bp, Homo sapiens
aaggtgaggtgaactccaggca

SEQ ID NO: 6577018 - DNA, 16 bp, Homo sapiens
aaggtgagtgtgactt

SEQ ID NO: 6577019 - DNA, 21 bp, Homo sapiens
aaggtgagtttgagctgcctt

SEQ ID NO: 6577020 - DNA, 22 bp, Homo sapiens
aaggtgagtttgagctgccttc

SEQ ID NO: 6577021 - DNA, 15 bp, Homo sapiens
aaggtgataaaatca

SEQ ID NO: 6577022 - DNA, 18 bp, Homo sapiens
aaggtgattaaatattta

SEQ ID NO: 6577023 - DNA, 17 bp, Homo sapiens
aaggtgcactgagaagc

SEQ ID NO: 6577024 - DNA, 18 bp, Homo sapiens
aaggtgcagtaggagcaa

SEQ ID NO: 6577025 - DNA, 23 bp, Homo sapiens
aaggtgcagttcccccaacctca

SEQ ID NO: 6577026 - DNA, 20 bp, Homo sapiens
aaggtgcagttgctcattgt

SEQ ID NO: 6577027 - DNA, 21 bp, Homo sapiens
aaggtgccaccaccctgcccc

SEQ ID NO: 6577028 - DNA, 18 bp, Homo sapiens
aaggtgccagaaggaagg

SEQ ID NO: 6577029 - DNA, 19 bp, Homo sapiens
aaggtgccagaaggaaggt

SEQ ID NO: 6577030 - DNA, 14 bp, Homo sapiens
aaggtgccatggaa

SEQ ID NO: 6577031 - DNA, 22 bp, Homo sapiens
aaggtgccattttaaattttat

SEQ ID NO: 6577032 - DNA, 15 bp, Homo sapiens
aaggtgcccaggagc

SEQ ID NO: 6577033 - DNA, 13 bp, Homo sapiens
aaggtgcctcaga

SEQ ID NO: 6577034 - DNA, 12 bp, Homo sapiens
aaggtgcctgcc

SEQ ID NO: 6577035 - DNA, 15 bp, Homo sapiens
aaggtgcctgccata

SEQ ID NO: 6577036 - DNA, 19 bp, Homo sapiens
aaggtgcctgccatagcca

SEQ ID NO: 6577037 - DNA, 20 bp, Homo sapiens
aaggtgcctgtgaggcaggg

SEQ ID NO: 6577038 - DNA, 21 bp, Homo sapiens
aaggtgctcaaagatgtactg

SEQ ID NO: 6577039 - DNA, 23 bp, Homo sapiens
aaggtgctcttctcattttttcc

SEQ ID NO: 6577040 - DNA, 14 bp, Homo sapiens
aaggtgctgagctt

SEQ ID NO: 6577041 - DNA, 13 bp, Homo sapiens
ttctttttacata

SEQ ID NO: 6577042 - DNA, 14 bp, Homo sapiens
ttctttttacataa

SEQ ID NO: 6577043 - DNA, 18 bp, Homo sapiens
ttctttttacataactgc

SEQ ID NO: 6577044 - DNA, 19 bp, Homo sapiens
ttctttttaggctctgaga

SEQ ID NO: 6577045 - DNA, 20 bp, Homo sapiens
ttctttttataactcatggc

SEQ ID NO: 6577046 - DNA, 15 bp, Homo sapiens
ttctttttattgaat

SEQ ID NO: 6577047 - DNA, 18 bp, Homo sapiens
ttctttttattttaacca

SEQ ID NO: 6577048 - DNA, 16 bp, Homo sapiens
ttctttttattttagt

SEQ ID NO: 6577049 - DNA, 12 bp, Homo sapiens
ttctttttcaaa

SEQ ID NO: 6577050 - DNA, 16 bp, Homo sapiens
ttctttttccctttcc

SEQ ID NO: 6577051 - DNA, 19 bp, Homo sapiens
ttctttttctgagacagct

SEQ ID NO: 6577052 - DNA, 13 bp, Homo sapiens
ttctttttctgga

SEQ ID NO: 6577053 - DNA, 16 bp, Homo sapiens
ttctttttctggactc

SEQ ID NO: 6577054 - DNA, 15 bp, Homo sapiens
ttctttttctttctt

SEQ ID NO: 6577055 - DNA, 15 bp, Homo sapiens
ttctttttgaaatgt

SEQ ID NO: 6577056 - DNA, 16 bp, Homo sapiens
ttctttttgactgatt

SEQ ID NO: 6577057 - DNA, 17 bp, Homo sapiens
ttctttttgatcatctt

SEQ ID NO: 6577058 - DNA, 13 bp, Homo sapiens
ttctttttgattt

SEQ ID NO: 6577059 - DNA, 14 bp, Homo sapiens
ttctttttgccagt

SEQ ID NO: 6577060 - DNA, 13 bp, Homo sapiens
ttctttttgctgt

SEQ ID NO: 6577061 - DNA, 23 bp, Homo sapiens
ttctttttgctgttgtttctaaa

SEQ ID NO: 6577062 - DNA, 18 bp, Homo sapiens
ttctttttgggagagact

SEQ ID NO: 6577063 - DNA, 21 bp, Homo sapiens
ttctttttgggagagacttgt

SEQ ID NO: 6577064 - DNA, 15 bp, Homo sapiens
ttctttttgtacact

SEQ ID NO: 6577065 - DNA, 17 bp, Homo sapiens
ttcttttttaaaccagt

SEQ ID NO: 6577066 - DNA, 14 bp, Homo sapiens
ttcttttttaaagt

SEQ ID NO: 6577067 - DNA, 19 bp, Homo sapiens
ttcttttttaaattttctt

SEQ ID NO: 6577068 - DNA, 17 bp, Homo sapiens
ttcttttttaatagaat

SEQ ID NO: 6577069 - DNA, 23 bp, Homo sapiens
ttcttttttatgcagaatttgat

SEQ ID NO: 6577070 - DNA, 15 bp, Homo sapiens
ttcttttttattaat

SEQ ID NO: 6577071 - DNA, 16 bp, Homo sapiens
ttcttttttattaatc

SEQ ID NO: 6577072 - DNA, 21 bp, Homo sapiens
ttcttttttcaatgtactgta

SEQ ID NO: 6577073 - DNA, 22 bp, Homo sapiens
ttcttttttcaatgtactgtat

SEQ ID NO: 6577074 - DNA, 14 bp, Homo sapiens
ttcttttttcagtt

SEQ ID NO: 6577075 - DNA, 22 bp, Homo sapiens
ttcttttttgtacttttctggt

SEQ ID NO: 6577076 - DNA, 14 bp, Homo sapiens
ttctttttttaact

SEQ ID NO: 6577077 - DNA, 15 bp, Homo sapiens
ttctttttttatgac

SEQ ID NO: 6577078 - DNA, 16 bp, Homo sapiens
ttctttttttcttggc

SEQ ID NO: 6577079 - DNA, 21 bp, Homo sapiens
ttcttttttttaataaggaaa

SEQ ID NO: 6577080 - DNA, 18 bp, Homo sapiens
ttcttttttttaatgttt

SEQ ID NO: 6577081 - DNA, 18 bp, Homo sapiens
ttcttttttttcattata

SEQ ID NO: 6577082 - DNA, 20 bp, Homo sapiens
ttctttttttttaagttctt

SEQ ID NO: 6577083 - DNA, 22 bp, Homo sapiens
ttcttttttttttttttgagac

SEQ ID NO: 6577084 - DNA, 16 bp, Homo sapiens
ttgaaaaaaaaaaaca

SEQ ID NO: 6577085 - DNA, 22 bp, Homo sapiens
ttgaaaaaaaaaaacacaaaaa

SEQ ID NO: 6577086 - DNA, 18 bp, Homo sapiens
ttgaaaaaaaaaatgttg

SEQ ID NO: 6577087 - DNA, 13 bp, Homo sapiens
ttgaaaaaaaata

SEQ ID NO: 6577088 - DNA, 10 bp, Homo sapiens
ttgaaaaaac

SEQ ID NO: 6577089 - DNA, 17 bp, Homo sapiens
ttgaaaaaactttctct

SEQ ID NO: 6577090 - DNA, 14 bp, Homo sapiens
ttgaaaaaagctca

SEQ ID NO: 6577091 - DNA, 17 bp, Homo sapiens
ttgaaaaaagctcattt

SEQ ID NO: 6577092 - DNA, 13 bp, Homo sapiens
ttgaaaaaatcaa

SEQ ID NO: 6577093 - DNA, 20 bp, Homo sapiens
ttgaaaaaccattttgctgt

SEQ ID NO: 6577094 - DNA, 23 bp, Homo sapiens
ttgaaaaagaaaacaaccaaaga

SEQ ID NO: 6577095 - DNA, 18 bp, Homo sapiens
ttgaaaaagataaagagt

SEQ ID NO: 6577096 - DNA, 13 bp, Homo sapiens
ttgaaaaaggaaa

SEQ ID NO: 6577097 - DNA, 21 bp, Homo sapiens
ttgaaaaaggaaaaatgtaga

SEQ ID NO: 6577098 - DNA, 22 bp, Homo sapiens
ttgaaaaaggaaaaatgtagac

SEQ ID NO: 6577099 - DNA, 16 bp, Homo sapiens
ttgaaaaagtaggctg

SEQ ID NO: 6577100 - DNA, 17 bp, Homo sapiens
ttgaaaaagtgtacatg

SEQ ID NO: 6577101 - DNA, 14 bp, Homo sapiens
ttgaaaaataaaaa

SEQ ID NO: 6577102 - DNA, 19 bp, Homo sapiens
ttgaaaaatagcatatgcc

SEQ ID NO: 6577103 - DNA, 14 bp, Homo sapiens
ttgaaaaatattgc

SEQ ID NO: 6577104 - DNA, 15 bp, Homo sapiens
ttgaaaaatattgct

SEQ ID NO: 6577105 - DNA, 18 bp, Homo sapiens
ttgaaaaatattgctaaa

SEQ ID NO: 6577106 - DNA, 15 bp, Homo sapiens
ttgaaaaatctagtt

SEQ ID NO: 6577107 - DNA, 18 bp, Homo sapiens
ttgaaaaatctcattatt

SEQ ID NO: 6577108 - DNA, 20 bp, Homo sapiens
ttgaaaaatgttataactta

SEQ ID NO: 6577109 - DNA, 18 bp, Homo sapiens
ttgaaaaattatcagtta

SEQ ID NO: 6577110 - DNA, 23 bp, Homo sapiens
ttgaaaaattcctattgtgattt

SEQ ID NO: 6577111 - DNA, 21 bp, Homo sapiens
ttgaaaacaaaaaaaatgtta

SEQ ID NO: 6577112 - DNA, 16 bp, Homo sapiens
ttgaaaacaaacttct

SEQ ID NO: 6577113 - DNA, 13 bp, Homo sapiens
ttgaaaacaaaga

SEQ ID NO: 6577114 - DNA, 15 bp, Homo sapiens
ttgaaaacaaagaca

SEQ ID NO: 6577115 - DNA, 20 bp, Homo sapiens
ttgaaaacacactcaaaaga

SEQ ID NO: 6577116 - DNA, 11 bp, Homo sapiens
ttgaaaacacc

SEQ ID NO: 6577117 - DNA, 22 bp, Homo sapiens
ttgaaaacactgttctctgccc

SEQ ID NO: 6577118 - DNA, 18 bp, Homo sapiens
ttgaaaacataatctgca

SEQ ID NO: 6577119 - DNA, 16 bp, Homo sapiens
ttgaaaaccaaaatga

SEQ ID NO: 6577120 - DNA, 19 bp, Homo sapiens
ttgaaaaccaaaatgacat

SEQ ID NO: 6577121 - DNA, 20 bp, Homo sapiens
ttgaaaaccaaaatgacatc

SEQ ID NO: 6577122 - DNA, 23 bp, Homo sapiens
ttgaaaaccaaaatgacatcttt

SEQ ID NO: 6577123 - DNA, 24 bp, Homo sapiens
ttgaaaaccaacaccatcacagct

SEQ ID NO: 6577124 - DNA, 14 bp, Homo sapiens
ttgaaaacccctgg

SEQ ID NO: 6577125 - DNA, 21 bp, Homo sapiens
ttgaaaactacattttaacat

SEQ ID NO: 6577126 - DNA, 13 bp, Homo sapiens
ttgaaaactgaca

SEQ ID NO: 6577127 - DNA, 20 bp, Homo sapiens
ttgaaaactgacatcagatt

SEQ ID NO: 6577128 - DNA, 12 bp, Homo sapiens
ttgaaaactgga

SEQ ID NO: 6577129 - DNA, 18 bp, Homo sapiens
ttgaaaactgtgcaactt

SEQ ID NO: 6577130 - DNA, 21 bp, Homo sapiens
ttgaaaacttctcatttatgt

SEQ ID NO: 6577131 - DNA, 16 bp, Homo sapiens
ttgaaaacttttctca

SEQ ID NO: 6577132 - DNA, 14 bp, Homo sapiens
ttgaaaagaatcta

SEQ ID NO: 6577133 - DNA, 13 bp, Homo sapiens
ttgaaaagaattt

SEQ ID NO: 6577134 - DNA, 19 bp, Homo sapiens
ttgaaaagaccaagacttt

SEQ ID NO: 6577135 - DNA, 18 bp, Homo sapiens
ttgaaaagactccaaaga

SEQ ID NO: 6577136 - DNA, 13 bp, Homo sapiens
ttgaaaagaggtg

SEQ ID NO: 6577137 - DNA, 21 bp, Homo sapiens
ttgaaaagaggtgtgcaagag

SEQ ID NO: 6577138 - DNA, 19 bp, Homo sapiens
ttgaaaagattctgaaacc

SEQ ID NO: 6577139 - DNA, 16 bp, Homo sapiens
ttgaaaagcacagagg

SEQ ID NO: 6577140 - DNA, 14 bp, Homo sapiens
ttgaaaagccaaag

SEQ ID NO: 6577141 - DNA, 16 bp, Homo sapiens
ttgaaaagccatgttt

SEQ ID NO: 6577142 - DNA, 19 bp, Homo sapiens
ttgaaaagccatgtttaag

SEQ ID NO: 6577143 - DNA, 20 bp, Homo sapiens
ttgaaaagccatgtttaaga

SEQ ID NO: 6577144 - DNA, 12 bp, Homo sapiens
ttgaaaagctat

SEQ ID NO: 6577145 - DNA, 13 bp, Homo sapiens
ttgaaaagctatt

SEQ ID NO: 6577146 - DNA, 14 bp, Homo sapiens
ttgaaaagctatta

SEQ ID NO: 6577147 - DNA, 12 bp, Homo sapiens
ttgaaaagctga

SEQ ID NO: 6577148 - DNA, 17 bp, Homo sapiens
ttgaaaagcttcttaat

SEQ ID NO: 6577149 - DNA, 16 bp, Homo sapiens
ttgaaaagtgttctgt

SEQ ID NO: 6577150 - DNA, 16 bp, Homo sapiens
ttgaaaagttggaagg

SEQ ID NO: 6577151 - DNA, 17 bp, Homo sapiens
ttgaaaataaaaagaga

SEQ ID NO: 6577152 - DNA, 23 bp, Homo sapiens
ttgaaaataaatcttagtgttca

SEQ ID NO: 6577153 - DNA, 18 bp, Homo sapiens
ttgaaaatacattcttaa

SEQ ID NO: 6577154 - DNA, 15 bp, Homo sapiens
ttgaaaataggattt

SEQ ID NO: 6577155 - DNA, 21 bp, Homo sapiens
ttgaaaatatttctatgtaaa

SEQ ID NO: 6577156 - DNA, 21 bp, Homo sapiens
ttgaaaatcttataatttaaa

SEQ ID NO: 6577157 - DNA, 15 bp, Homo sapiens
ttgaaaatcttgtgt

SEQ ID NO: 6577158 - DNA, 13 bp, Homo sapiens
ttgaaaatgcatt

SEQ ID NO: 6577159 - DNA, 15 bp, Homo sapiens
ttgaaaatgccacca

SEQ ID NO: 6577160 - DNA, 13 bp, Homo sapiens
ttgaaaatgctct

SEQ ID NO: 6577161 - DNA, 19 bp, Homo sapiens
ttgaaaatggacagaatgt

SEQ ID NO: 6577162 - DNA, 22 bp, Homo sapiens
ttgaaaatggtttcaagttatt

SEQ ID NO: 6577163 - DNA, 19 bp, Homo sapiens
ttgaaaatgtatttcctga

SEQ ID NO: 6577164 - DNA, 13 bp, Homo sapiens
ttgaaaatgtcac

SEQ ID NO: 6577165 - DNA, 19 bp, Homo sapiens
ttgaaaatgtcactgttat

SEQ ID NO: 6577166 - DNA, 18 bp, Homo sapiens
ttgaaaatgttttggaac

SEQ ID NO: 6577167 - DNA, 18 bp, Homo sapiens
ttgaaaattcaaaaagtg

SEQ ID NO: 6577168 - DNA, 16 bp, Homo sapiens
ttgaaaattgaaaagt

SEQ ID NO: 6577169 - DNA, 12 bp, Homo sapiens
ttgaaaattgta

SEQ ID NO: 6577170 - DNA, 16 bp, Homo sapiens
ttgaaaattgtatacc

SEQ ID NO: 6577171 - DNA, 12 bp, Homo sapiens
ttgaaacaaagt

SEQ ID NO: 6577172 - DNA, 18 bp, Homo sapiens
ttgaaacaacattatttt

SEQ ID NO: 6577173 - DNA, 22 bp, Homo sapiens
ttgaaacacacagtgaccaagg

SEQ ID NO: 6577174 - DNA, 15 bp, Homo sapiens
ttgaaacactggttt

SEQ ID NO: 6577175 - DNA, 13 bp, Homo sapiens
ttgaaacagaacc

SEQ ID NO: 6577176 - DNA, 18 bp, Homo sapiens
ttgaaacattgcttttaa

SEQ ID NO: 6577177 - DNA, 19 bp, Homo sapiens
ttgaaaccaccttttatta

SEQ ID NO: 6577178 - DNA, 15 bp, Homo sapiens
ttgaaaccaggacat

SEQ ID NO: 6577179 - DNA, 14 bp, Homo sapiens
ttgaaacccacagt

SEQ ID NO: 6577180 - DNA, 17 bp, Homo sapiens
ttgaaacccacagtttt

SEQ ID NO: 6577181 - DNA, 14 bp, Homo sapiens
ttgaaacctcaggg

SEQ ID NO: 6577182 - DNA, 14 bp, Homo sapiens
ttgaaacctgtata

SEQ ID NO: 6577183 - DNA, 14 bp, Homo sapiens
ttgaaacctgttaa

SEQ ID NO: 6577184 - DNA, 16 bp, Homo sapiens
ttgaaacggatgattt

SEQ ID NO: 6577185 - DNA, 19 bp, Homo sapiens
ttgaaacggatgatttcta

SEQ ID NO: 6577186 - DNA, 18 bp, Homo sapiens
ttgaaactagttatttta

SEQ ID NO: 6577187 - DNA, 19 bp, Homo sapiens
ttgaaactctctgttcaga

SEQ ID NO: 6577188 - DNA, 16 bp, Homo sapiens
ttgaaactgcatttgt

SEQ ID NO: 6577189 - DNA, 18 bp, Homo sapiens
ttgaaactgcatttgtgc

SEQ ID NO: 6577190 - DNA, 20 bp, Homo sapiens
ttgaaactgtaaatatgttt

SEQ ID NO: 6577191 - DNA, 12 bp, Homo sapiens
ttgaaactgtat

SEQ ID NO: 6577192 - DNA, 20 bp, Homo sapiens
ttgaaacttacactgtttca

SEQ ID NO: 6577193 - DNA, 14 bp, Homo sapiens
ttgaaactttaaga

SEQ ID NO: 6577194 - DNA, 22 bp, Homo sapiens
ttgaaactttgggaaaacatgt

SEQ ID NO: 6577195 - DNA, 11 bp, Homo sapiens
ttgaaagaaaa

SEQ ID NO: 6577196 - DNA, 17 bp, Homo sapiens
ttgaaagaaaggactct

SEQ ID NO: 6577197 - DNA, 18 bp, Homo sapiens
ttgaaagaagtattaaaa

SEQ ID NO: 6577198 - DNA, 17 bp, Homo sapiens
ttgaaagaagtcaaatg

SEQ ID NO: 6577199 - DNA, 20 bp, Homo sapiens
ttgaaagaagtcaaatgaat

SEQ ID NO: 6577200 - DNA, 18 bp, Homo sapiens
ttgaaagaattctatttt

SEQ ID NO: 6577201 - DNA, 17 bp, Homo sapiens
ttgaaagacaaaattta

SEQ ID NO: 6577202 - DNA, 12 bp, Homo sapiens
ttgaaagacatc

SEQ ID NO: 6577203 - DNA, 14 bp, Homo sapiens
ttgaaagacatcaa

SEQ ID NO: 6577204 - DNA, 19 bp, Homo sapiens
ttgaaagacatcaatgaaa

SEQ ID NO: 6577205 - DNA, 21 bp, Homo sapiens
ttgaaagaccagatccttaga

SEQ ID NO: 6577206 - DNA, 13 bp, Homo sapiens
ttgaaagaccttc

SEQ ID NO: 6577207 - DNA, 22 bp, Homo sapiens
ttgaaagactgtgctgtccttt

SEQ ID NO: 6577208 - DNA, 15 bp, Homo sapiens
ttgaaagagaagcac

SEQ ID NO: 6577209 - DNA, 14 bp, Homo sapiens
ttgaaagagatggc

SEQ ID NO: 6577210 - DNA, 14 bp, Homo sapiens
ttgaaagagttaag

SEQ ID NO: 6577211 - DNA, 22 bp, Homo sapiens
ttgaaagattcaggtatgttgc

SEQ ID NO: 6577212 - DNA, 22 bp, Homo sapiens
ttgaaagccaacaactctgcct

SEQ ID NO: 6577213 - DNA, 21 bp, Homo sapiens
ttgaaagcgaaatacttgaaa

SEQ ID NO: 6577214 - DNA, 12 bp, Homo sapiens
ttgaaagctgtg

SEQ ID NO: 6577215 - DNA, 19 bp, Homo sapiens
ttgaaagcttcaaagttta

SEQ ID NO: 6577216 - DNA, 15 bp, Homo sapiens
ttgaaagctttgaaa

SEQ ID NO: 6577217 - DNA, 21 bp, Homo sapiens
ttgaaaggcaatttttgagta

SEQ ID NO: 6577218 - DNA, 19 bp, Homo sapiens
ttgaaaggcattctctgaa

SEQ ID NO: 6577219 - DNA, 20 bp, Homo sapiens
ttgaaaggcattctctgaag

SEQ ID NO: 6577220 - DNA, 21 bp, Homo sapiens
ttgaaaggcattctctgaaga

SEQ ID NO: 6577221 - DNA, 16 bp, Homo sapiens
aaggtgctgccacccc

SEQ ID NO: 6577222 - DNA, 19 bp, Homo sapiens
aaggtgctggtgggtctga

SEQ ID NO: 6577223 - DNA, 20 bp, Homo sapiens
aaggtgctgttgtcattgct

SEQ ID NO: 6577224 - DNA, 22 bp, Homo sapiens
aaggtgctgttgtcattgcttt

SEQ ID NO: 6577225 - DNA, 16 bp, Homo sapiens
aaggtgcttggagttt

SEQ ID NO: 6577226 - DNA, 14 bp, Homo sapiens
aaggtgcttgggct

SEQ ID NO: 6577227 - DNA, 22 bp, Homo sapiens
aaggtggaaaatggactggctt

SEQ ID NO: 6577228 - DNA, 17 bp, Homo sapiens
aaggtggaataaacatt

SEQ ID NO: 6577229 - DNA, 21 bp, Homo sapiens
aaggtggaataaacattaatt

SEQ ID NO: 6577230 - DNA, 20 bp, Homo sapiens
aaggtggacagcagacaaga

SEQ ID NO: 6577231 - DNA, 16 bp, Homo sapiens
aaggtggagggaagga

SEQ ID NO: 6577232 - DNA, 18 bp, Homo sapiens
aaggtggcaatgcttaaa

SEQ ID NO: 6577233 - DNA, 15 bp, Homo sapiens
aaggtggcagcttgt

SEQ ID NO: 6577234 - DNA, 12 bp, Homo sapiens
aaggtggcttct

SEQ ID NO: 6577235 - DNA, 22 bp, Homo sapiens
aaggtgggccttgctacctcaa

SEQ ID NO: 6577236 - DNA, 12 bp, Homo sapiens
aaggtgggcgga

SEQ ID NO: 6577237 - DNA, 16 bp, Homo sapiens
aaggtgggctgagccc

SEQ ID NO: 6577238 - DNA, 18 bp, Homo sapiens
aaggtgggctgagccctg

SEQ ID NO: 6577239 - DNA, 23 bp, Homo sapiens
aaggtggggacctggggggaggg

SEQ ID NO: 6577240 - DNA, 15 bp, Homo sapiens
aaggtggggagaagg

SEQ ID NO: 6577241 - DNA, 18 bp, Homo sapiens
aaggtggggccctgcccc

SEQ ID NO: 6577242 - DNA, 17 bp, Homo sapiens
aaggtgggggagcctgg

SEQ ID NO: 6577243 - DNA, 15 bp, Homo sapiens
aaggtgggtccagga

SEQ ID NO: 6577244 - DNA, 22 bp, Homo sapiens
aaggtgggtgaggctgggcagg

SEQ ID NO: 6577245 - DNA, 17 bp, Homo sapiens
aaggtggtatgtgtgtg

SEQ ID NO: 6577246 - DNA, 23 bp, Homo sapiens
aaggtggtctgcttttgctgggg

SEQ ID NO: 6577247 - DNA, 23 bp, Homo sapiens
aaggtggtcttggagaggaggtg

SEQ ID NO: 6577248 - DNA, 13 bp, Homo sapiens
aaggtggtggcat

SEQ ID NO: 6577249 - DNA, 13 bp, Homo sapiens
aaggtggttttat

SEQ ID NO: 6577250 - DNA, 21 bp, Homo sapiens
aaggtggttttattttccctt

SEQ ID NO: 6577251 - DNA, 17 bp, Homo sapiens
aaggtgtaactctaatt

SEQ ID NO: 6577252 - DNA, 20 bp, Homo sapiens
aaggtgtagccacaccagga

SEQ ID NO: 6577253 - DNA, 22 bp, Homo sapiens
aaggtgtaggtcagatatttga

SEQ ID NO: 6577254 - DNA, 16 bp, Homo sapiens
aaggtgtcatttgaca

SEQ ID NO: 6577255 - DNA, 15 bp, Homo sapiens
aaggtgtccagggtc

SEQ ID NO: 6577256 - DNA, 20 bp, Homo sapiens
aaggtgtcctacagaaaaac

SEQ ID NO: 6577257 - DNA, 16 bp, Homo sapiens
aaggtgtcttcctccc

SEQ ID NO: 6577258 - DNA, 20 bp, Homo sapiens
aaggtgtcttcctcccaagt

SEQ ID NO: 6577259 - DNA, 15 bp, Homo sapiens
aaggtgtgaaatcat

SEQ ID NO: 6577260 - DNA, 14 bp, Homo sapiens
aaggtgtgatggtc

SEQ ID NO: 6577261 - DNA, 13 bp, Homo sapiens
aaggtgtgctaca

SEQ ID NO: 6577262 - DNA, 21 bp, Homo sapiens
aaggtgtgctctgagccacag

SEQ ID NO: 6577263 - DNA, 18 bp, Homo sapiens
aaggtgtggaggctcctg

SEQ ID NO: 6577264 - DNA, 13 bp, Homo sapiens
aaggtgtggtctg

SEQ ID NO: 6577265 - DNA, 20 bp, Homo sapiens
aaggtgtgtccttgaactga

SEQ ID NO: 6577266 - DNA, 23 bp, Homo sapiens
aaggtgttgggtcagtggccagg

SEQ ID NO: 6577267 - DNA, 16 bp, Homo sapiens
aaggtgtttaaagagt

SEQ ID NO: 6577268 - DNA, 21 bp, Homo sapiens
aaggtgtttccatttctcaat

SEQ ID NO: 6577269 - DNA, 16 bp, Homo sapiens
aaggtgttttctgtgt

SEQ ID NO: 6577270 - DNA, 14 bp, Homo sapiens
aaggttaaaggaaa

SEQ ID NO: 6577271 - DNA, 15 bp, Homo sapiens
aaggttaataaagta

SEQ ID NO: 6577272 - DNA, 15 bp, Homo sapiens
aaggttactgagtga

SEQ ID NO: 6577273 - DNA, 18 bp, Homo sapiens
aaggttagaaacattttg

SEQ ID NO: 6577274 - DNA, 21 bp, Homo sapiens
aaggttagaggtttgtcaaca

SEQ ID NO: 6577275 - DNA, 18 bp, Homo sapiens
aaggttaggatttaacag

SEQ ID NO: 6577276 - DNA, 20 bp, Homo sapiens
aaggttaggtttgtcaacac

SEQ ID NO: 6577277 - DNA, 17 bp, Homo sapiens
aaggttatgaaacatat

SEQ ID NO: 6577278 - DNA, 19 bp, Homo sapiens
aaggttatgttcatttttc

SEQ ID NO: 6577279 - DNA, 21 bp, Homo sapiens
aaggttatgttcatttttcaa

SEQ ID NO: 6577280 - DNA, 17 bp, Homo sapiens
aaggttcagaaaattaa

SEQ ID NO: 6577281 - DNA, 13 bp, Homo sapiens
aaggttcagactt

SEQ ID NO: 6577282 - DNA, 18 bp, Homo sapiens
aaggttccaactgtatat

SEQ ID NO: 6577283 - DNA, 16 bp, Homo sapiens
aaggttccattcagtg

SEQ ID NO: 6577284 - DNA, 15 bp, Homo sapiens
aaggttcccaaggac

SEQ ID NO: 6577285 - DNA, 16 bp, Homo sapiens
aaggttccctctgaga

SEQ ID NO: 6577286 - DNA, 22 bp, Homo sapiens
aaggttcctaggcattgcagga

SEQ ID NO: 6577287 - DNA, 13 bp, Homo sapiens
aaggttctatctg

SEQ ID NO: 6577288 - DNA, 17 bp, Homo sapiens
aaggttctatgatatac

SEQ ID NO: 6577289 - DNA, 13 bp, Homo sapiens
aaggttctcagac

SEQ ID NO: 6577290 - DNA, 21 bp, Homo sapiens
aaggttctctcctccccaagg

SEQ ID NO: 6577291 - DNA, 21 bp, Homo sapiens
aaggttcttcccttttacata

SEQ ID NO: 6577292 - DNA, 21 bp, Homo sapiens
aaggttgactcaagtttttac

SEQ ID NO: 6577293 - DNA, 14 bp, Homo sapiens
aaggttgcacagca

SEQ ID NO: 6577294 - DNA, 18 bp, Homo sapiens
aaggttggagcccagggc

SEQ ID NO: 6577295 - DNA, 17 bp, Homo sapiens
aaggttggcgtgccctg

SEQ ID NO: 6577296 - DNA, 21 bp, Homo sapiens
aaggttggcgtgccctggagg

SEQ ID NO: 6577297 - DNA, 22 bp, Homo sapiens
aaggttgggttagcaatattta

SEQ ID NO: 6577298 - DNA, 13 bp, Homo sapiens
aaggttgtacata

SEQ ID NO: 6577299 - DNA, 16 bp, Homo sapiens
aaggttgtacatagtg

SEQ ID NO: 6577300 - DNA, 16 bp, Homo sapiens
aaggttgtatgtaaat

SEQ ID NO: 6577301 - DNA, 14 bp, Homo sapiens
aaggtttaaatgaa

SEQ ID NO: 6577302 - DNA, 16 bp, Homo sapiens
aaggtttaaatgaaca

SEQ ID NO: 6577303 - DNA, 20 bp, Homo sapiens
aaggtttaggctggtggccc

SEQ ID NO: 6577304 - DNA, 21 bp, Homo sapiens
aaggtttaggctggtggccca

SEQ ID NO: 6577305 - DNA, 17 bp, Homo sapiens
aaggtttataaagcaga

SEQ ID NO: 6577306 - DNA, 14 bp, Homo sapiens
aaggtttattgtta

SEQ ID NO: 6577307 - DNA, 21 bp, Homo sapiens
aaggtttattgttaatacaag

SEQ ID NO: 6577308 - DNA, 17 bp, Homo sapiens
aaggtttatttttctgt

SEQ ID NO: 6577309 - DNA, 22 bp, Homo sapiens
aaggtttcaacaaatttcattg

SEQ ID NO: 6577310 - DNA, 12 bp, Homo sapiens
aaggtttcagat

SEQ ID NO: 6577311 - DNA, 20 bp, Homo sapiens
aaggtttcccagtgagcctc

SEQ ID NO: 6577312 - DNA, 22 bp, Homo sapiens
aaggtttcccagtgagcctctg

SEQ ID NO: 6577313 - DNA, 16 bp, Homo sapiens
aaggtttcctgctcca

SEQ ID NO: 6577314 - DNA, 19 bp, Homo sapiens
aaggtttgcaaattaaaaa

SEQ ID NO: 6577315 - DNA, 17 bp, Homo sapiens
aaggtttggaaaactaa

SEQ ID NO: 6577316 - DNA, 17 bp, Homo sapiens
aaggtttgtatattgtc

SEQ ID NO: 6577317 - DNA, 21 bp, Homo sapiens
aaggtttgttttcattaaatt

SEQ ID NO: 6577318 - DNA, 20 bp, Homo sapiens
aaggttttaatttagtaaac

SEQ ID NO: 6577319 - DNA, 19 bp, Homo sapiens
aaggttttaggttctaaag

SEQ ID NO: 6577320 - DNA, 13 bp, Homo sapiens
aaggttttctcca

SEQ ID NO: 6577321 - DNA, 23 bp, Homo sapiens
aaggttttggatcttgaatgtgg

SEQ ID NO: 6577322 - DNA, 12 bp, Homo sapiens
aaggttttgtat

SEQ ID NO: 6577323 - DNA, 13 bp, Homo sapiens
aaggtttttagca

SEQ ID NO: 6577324 - DNA, 14 bp, Homo sapiens
aaggtttttgatag

SEQ ID NO: 6577325 - DNA, 17 bp, Homo sapiens
aaggtttttgtaaagat

SEQ ID NO: 6577326 - DNA, 17 bp, Homo sapiens
aaggttttttttcagtt

SEQ ID NO: 6577327 - DNA, 21 bp, Homo sapiens
aaggttttttttttaagtgca

SEQ ID NO: 6577328 - DNA, 15 bp, Homo sapiens
aagtaaaaaaatatg

SEQ ID NO: 6577329 - DNA, 14 bp, Homo sapiens
aagtaaaaaagtta

SEQ ID NO: 6577330 - DNA, 13 bp, Homo sapiens
aagtaaaaacact

SEQ ID NO: 6577331 - DNA, 12 bp, Homo sapiens
aagtaaaaagaa

SEQ ID NO: 6577332 - DNA, 12 bp, Homo sapiens
aagtaaaaatat

SEQ ID NO: 6577333 - DNA, 13 bp, Homo sapiens
aagtaaaaattaa

SEQ ID NO: 6577334 - DNA, 22 bp, Homo sapiens
aagtaaaacactctaaataaat

SEQ ID NO: 6577335 - DNA, 22 bp, Homo sapiens
aagtaaaacagatttgttcatt

SEQ ID NO: 6577336 - DNA, 13 bp, Homo sapiens
aagtaaaacagtc

SEQ ID NO: 6577337 - DNA, 14 bp, Homo sapiens
aagtaaaacagtca

SEQ ID NO: 6577338 - DNA, 14 bp, Homo sapiens
aagtaaaaccacag

SEQ ID NO: 6577339 - DNA, 15 bp, Homo sapiens
aagtaaaaccacagc

SEQ ID NO: 6577340 - DNA, 18 bp, Homo sapiens
aagtaaaaccacagcagt

SEQ ID NO: 6577341 - DNA, 18 bp, Homo sapiens
aagtaaaaccttttttct

SEQ ID NO: 6577342 - DNA, 22 bp, Homo sapiens
aagtaaaagctaattaggattt

SEQ ID NO: 6577343 - DNA, 13 bp, Homo sapiens
aagtaaaatatgt

SEQ ID NO: 6577344 - DNA, 15 bp, Homo sapiens
aagtaaaatgaacat

SEQ ID NO: 6577345 - DNA, 12 bp, Homo sapiens
aagtaaaatgtc

SEQ ID NO: 6577346 - DNA, 13 bp, Homo sapiens
aagtaaaatgttt

SEQ ID NO: 6577347 - DNA, 17 bp, Homo sapiens
aagtaaacctgaacaaa

SEQ ID NO: 6577348 - DNA, 19 bp, Homo sapiens
aagtaaactggatactgta

SEQ ID NO: 6577349 - DNA, 12 bp, Homo sapiens
aagtaaagatgc

SEQ ID NO: 6577350 - DNA, 14 bp, Homo sapiens
aagtaaaggcctcc

SEQ ID NO: 6577351 - DNA, 19 bp, Homo sapiens
aagtaaaggcctcctcccc

SEQ ID NO: 6577352 - DNA, 18 bp, Homo sapiens
aagtaaagtttatttcat

SEQ ID NO: 6577353 - DNA, 12 bp, Homo sapiens
aagtaaatacaa

SEQ ID NO: 6577354 - DNA, 16 bp, Homo sapiens
aagtaaatacaagact

SEQ ID NO: 6577355 - DNA, 15 bp, Homo sapiens
aagtaaatacaattt

SEQ ID NO: 6577356 - DNA, 18 bp, Homo sapiens
aagtaaatacatgcatat

SEQ ID NO: 6577357 - DNA, 15 bp, Homo sapiens
aagtaaatagcaaca

SEQ ID NO: 6577358 - DNA, 15 bp, Homo sapiens
aagtaaatatatatg

SEQ ID NO: 6577359 - DNA, 17 bp, Homo sapiens
aagtaaatccacaggct

SEQ ID NO: 6577360 - DNA, 13 bp, Homo sapiens
aagtaaatctatc

SEQ ID NO: 6577361 - DNA, 14 bp, Homo sapiens
aagtaaatctatct

SEQ ID NO: 6577362 - DNA, 17 bp, Homo sapiens
aagtaaatctatctcta

SEQ ID NO: 6577363 - DNA, 12 bp, Homo sapiens
aagtaaatctct

SEQ ID NO: 6577364 - DNA, 13 bp, Homo sapiens
aagtaaatctctt

SEQ ID NO: 6577365 - DNA, 14 bp, Homo sapiens
aagtaaatctgaga

SEQ ID NO: 6577366 - DNA, 12 bp, Homo sapiens
aagtaaatgcta

SEQ ID NO: 6577367 - DNA, 19 bp, Homo sapiens
aagtaaatgctacctctga

SEQ ID NO: 6577368 - DNA, 16 bp, Homo sapiens
aagtaaatgggagggc

SEQ ID NO: 6577369 - DNA, 13 bp, Homo sapiens
aagtaaattattt

SEQ ID NO: 6577370 - DNA, 16 bp, Homo sapiens
aagtaaattattttat

SEQ ID NO: 6577371 - DNA, 13 bp, Homo sapiens
aagtaaattttac

SEQ ID NO: 6577372 - DNA, 18 bp, Homo sapiens
aagtaaattttctttaag

SEQ ID NO: 6577373 - DNA, 13 bp, Homo sapiens
aagtaacaaaaat

SEQ ID NO: 6577374 - DNA, 16 bp, Homo sapiens
aagtaacaaaaataaa

SEQ ID NO: 6577375 - DNA, 17 bp, Homo sapiens
aagtaacaagagtgatt

SEQ ID NO: 6577376 - DNA, 20 bp, Homo sapiens
aagtaacaagagtgattctt

SEQ ID NO: 6577377 - DNA, 21 bp, Homo sapiens
aagtaacagttgaagaaaaaa

SEQ ID NO: 6577378 - DNA, 15 bp, Homo sapiens
aagtaacataactag

SEQ ID NO: 6577379 - DNA, 20 bp, Homo sapiens
aagtaacctctacaggcatt

SEQ ID NO: 6577380 - DNA, 14 bp, Homo sapiens
aagtaactcccact

SEQ ID NO: 6577381 - DNA, 23 bp, Homo sapiens
aagtaactgggattacaggcatg

SEQ ID NO: 6577382 - DNA, 19 bp, Homo sapiens
aagtaactgttttcttctt

SEQ ID NO: 6577383 - DNA, 20 bp, Homo sapiens
aagtaactgttttcttcttg

SEQ ID NO: 6577384 - DNA, 14 bp, Homo sapiens
aagtaacttctgac

SEQ ID NO: 6577385 - DNA, 21 bp, Homo sapiens
aagtaacttgtcaaggaatgt

SEQ ID NO: 6577386 - DNA, 21 bp, Homo sapiens
aagtaacttttaaaatttgtc

SEQ ID NO: 6577387 - DNA, 12 bp, Homo sapiens
aagtaagaaaat

SEQ ID NO: 6577388 - DNA, 14 bp, Homo sapiens
aagtaagaaaatat

SEQ ID NO: 6577389 - DNA, 16 bp, Homo sapiens
aagtaagaaaatattt

SEQ ID NO: 6577390 - DNA, 21 bp, Homo sapiens
aagtaagaaagtgaagcaaat

SEQ ID NO: 6577391 - DNA, 13 bp, Homo sapiens
aagtaagaaattt

SEQ ID NO: 6577392 - DNA, 18 bp, Homo sapiens
aagtaagaaatttctagt

SEQ ID NO: 6577393 - DNA, 19 bp, Homo sapiens
aagtaagaacactgagata

SEQ ID NO: 6577394 - DNA, 14 bp, Homo sapiens
aagtaagaagacat

SEQ ID NO: 6577395 - DNA, 20 bp, Homo sapiens
aagtaagaagaggagcctca

SEQ ID NO: 6577396 - DNA, 22 bp, Homo sapiens
aagtaagaagaggagcctcaga

SEQ ID NO: 6577397 - DNA, 23 bp, Homo sapiens
aagtaagactttctgaaaacact

SEQ ID NO: 6577398 - DNA, 16 bp, Homo sapiens
aagtaagacttttatt

SEQ ID NO: 6577399 - DNA, 21 bp, Homo sapiens
aagtaagagctaagttctaag

SEQ ID NO: 6577400 - DNA, 15 bp, Homo sapiens
aagtaagaggctgga

SEQ ID NO: 6577401 - DNA, 17 bp, Homo sapiens
ttgaaagggacaagtat

SEQ ID NO: 6577402 - DNA, 17 bp, Homo sapiens
ttgaaagggcaatatga

SEQ ID NO: 6577403 - DNA, 22 bp, Homo sapiens
ttgaaaggggacacctgtacat

SEQ ID NO: 6577404 - DNA, 21 bp, Homo sapiens
ttgaaaggttttttttcagtt

SEQ ID NO: 6577405 - DNA, 18 bp, Homo sapiens
ttgaaagtaaaaaaataa

SEQ ID NO: 6577406 - DNA, 15 bp, Homo sapiens
ttgaaagtagagcta

SEQ ID NO: 6577407 - DNA, 16 bp, Homo sapiens
ttgaaagtattcagaa

SEQ ID NO: 6577408 - DNA, 18 bp, Homo sapiens
ttgaaagtgaataaactt

SEQ ID NO: 6577409 - DNA, 17 bp, Homo sapiens
ttgaaagtgcctttgca

SEQ ID NO: 6577410 - DNA, 14 bp, Homo sapiens
ttgaaagtttaaca

SEQ ID NO: 6577411 - DNA, 19 bp, Homo sapiens
ttgaaagtttaacaaatga

SEQ ID NO: 6577412 - DNA, 16 bp, Homo sapiens
ttgaaataagaattca

SEQ ID NO: 6577413 - DNA, 21 bp, Homo sapiens
ttgaaataagaattcagacat

SEQ ID NO: 6577414 - DNA, 15 bp, Homo sapiens
ttgaaataagctatt

SEQ ID NO: 6577415 - DNA, 22 bp, Homo sapiens
ttgaaataattatgcagacaca

SEQ ID NO: 6577416 - DNA, 13 bp, Homo sapiens
ttgaaatacctca

SEQ ID NO: 6577417 - DNA, 17 bp, Homo sapiens
ttgaaatacctcatgtt

SEQ ID NO: 6577418 - DNA, 18 bp, Homo sapiens
ttgaaatactctacaaga

SEQ ID NO: 6577419 - DNA, 19 bp, Homo sapiens
ttgaaatactctacaagaa

SEQ ID NO: 6577420 - DNA, 17 bp, Homo sapiens
ttgaaatagtatacatt

SEQ ID NO: 6577421 - DNA, 23 bp, Homo sapiens
ttgaaatagtatacattgtcttg

SEQ ID NO: 6577422 - DNA, 18 bp, Homo sapiens
ttgaaatatagttgaaag

SEQ ID NO: 6577423 - DNA, 19 bp, Homo sapiens
ttgaaatatagttgaaagt

SEQ ID NO: 6577424 - DNA, 22 bp, Homo sapiens
ttgaaatatagttgaaagtaaa

SEQ ID NO: 6577425 - DNA, 14 bp, Homo sapiens
ttgaaatatataat

SEQ ID NO: 6577426 - DNA, 14 bp, Homo sapiens
ttgaaatatcatgt

SEQ ID NO: 6577427 - DNA, 15 bp, Homo sapiens
ttgaaatatgcatgt

SEQ ID NO: 6577428 - DNA, 20 bp, Homo sapiens
ttgaaatatggaactgtaat

SEQ ID NO: 6577429 - DNA, 18 bp, Homo sapiens
ttgaaatattcagaaatt

SEQ ID NO: 6577430 - DNA, 19 bp, Homo sapiens
ttgaaatcaccttttctaa

SEQ ID NO: 6577431 - DNA, 20 bp, Homo sapiens
ttgaaatcaccttttctaaa

SEQ ID NO: 6577432 - DNA, 15 bp, Homo sapiens
ttgaaatccaaacta

SEQ ID NO: 6577433 - DNA, 11 bp, Homo sapiens
ttgaaatcttt

SEQ ID NO: 6577434 - DNA, 13 bp, Homo sapiens
ttgaaatctttta

SEQ ID NO: 6577435 - DNA, 13 bp, Homo sapiens
ttgaaatgaaagg

SEQ ID NO: 6577436 - DNA, 14 bp, Homo sapiens
ttgaaatgaaattt

SEQ ID NO: 6577437 - DNA, 19 bp, Homo sapiens
ttgaaatgaaatttaaaca

SEQ ID NO: 6577438 - DNA, 16 bp, Homo sapiens
ttgaaatgaactttgt

SEQ ID NO: 6577439 - DNA, 18 bp, Homo sapiens
ttgaaatgaactttgtca

SEQ ID NO: 6577440 - DNA, 16 bp, Homo sapiens
ttgaaatgatttcaca

SEQ ID NO: 6577441 - DNA, 18 bp, Homo sapiens
ttgaaatgcattgctctg

SEQ ID NO: 6577442 - DNA, 20 bp, Homo sapiens
ttgaaatgcattgctctgga

SEQ ID NO: 6577443 - DNA, 13 bp, Homo sapiens
ttgaaatgggcat

SEQ ID NO: 6577444 - DNA, 15 bp, Homo sapiens
ttgaaatgggcattt

SEQ ID NO: 6577445 - DNA, 20 bp, Homo sapiens
ttgaaatgtaaggctgtgta

SEQ ID NO: 6577446 - DNA, 21 bp, Homo sapiens
ttgaaatgtaaggctgtgtaa

SEQ ID NO: 6577447 - DNA, 14 bp, Homo sapiens
ttgaaatgtaattt

SEQ ID NO: 6577448 - DNA, 21 bp, Homo sapiens
ttgaaatgtataattaactta

SEQ ID NO: 6577449 - DNA, 19 bp, Homo sapiens
ttgaaatgtgtttctgtat

SEQ ID NO: 6577450 - DNA, 20 bp, Homo sapiens
ttgaaattaagaaggcaaaa

SEQ ID NO: 6577451 - DNA, 16 bp, Homo sapiens
ttgaaattactgtgta

SEQ ID NO: 6577452 - DNA, 19 bp, Homo sapiens
ttgaaattatatctgtggt

SEQ ID NO: 6577453 - DNA, 18 bp, Homo sapiens
ttgaaattatgtatgttt

SEQ ID NO: 6577454 - DNA, 12 bp, Homo sapiens
ttgaaattctga

SEQ ID NO: 6577455 - DNA, 16 bp, Homo sapiens
ttgaaattctgaattt

SEQ ID NO: 6577456 - DNA, 17 bp, Homo sapiens
ttgaaattctgaatttg

SEQ ID NO: 6577457 - DNA, 14 bp, Homo sapiens
ttgaaattgaagag

SEQ ID NO: 6577458 - DNA, 17 bp, Homo sapiens
ttgaaattgtagtgcaa

SEQ ID NO: 6577459 - DNA, 21 bp, Homo sapiens
ttgaaattgtagtgcaaaatg

SEQ ID NO: 6577460 - DNA, 21 bp, Homo sapiens
ttgaaatttaaaaataaagct

SEQ ID NO: 6577461 - DNA, 14 bp, Homo sapiens
ttgaaatttacaca

SEQ ID NO: 6577462 - DNA, 18 bp, Homo sapiens
ttgaaattttctgtacag

SEQ ID NO: 6577463 - DNA, 17 bp, Homo sapiens
ttgaaattttgcaaata

SEQ ID NO: 6577464 - DNA, 21 bp, Homo sapiens
ttgaaatttttattaaattat

SEQ ID NO: 6577465 - DNA, 20 bp, Homo sapiens
ttgaacaaaaatgtttccac

SEQ ID NO: 6577466 - DNA, 16 bp, Homo sapiens
ttgaacaaaataaatt

SEQ ID NO: 6577467 - DNA, 15 bp, Homo sapiens
ttgaacaataaagtt

SEQ ID NO: 6577468 - DNA, 18 bp, Homo sapiens
ttgaacacaaactgtaaa

SEQ ID NO: 6577469 - DNA, 21 bp, Homo sapiens
ttgaacacaaactgtaaataa

SEQ ID NO: 6577470 - DNA, 13 bp, Homo sapiens
ttgaacacagtat

SEQ ID NO: 6577471 - DNA, 18 bp, Homo sapiens
ttgaacacagtattttcc

SEQ ID NO: 6577472 - DNA, 18 bp, Homo sapiens
ttgaacacatttccttta

SEQ ID NO: 6577473 - DNA, 19 bp, Homo sapiens
ttgaacactcatgctgaaa

SEQ ID NO: 6577474 - DNA, 11 bp, Homo sapiens
ttgaacactgg

SEQ ID NO: 6577475 - DNA, 22 bp, Homo sapiens
ttgaacagatatgtttttattt

SEQ ID NO: 6577476 - DNA, 15 bp, Homo sapiens
ttgaacagctgtgag

SEQ ID NO: 6577477 - DNA, 22 bp, Homo sapiens
ttgaacaggtcaaagatgtgtt

SEQ ID NO: 6577478 - DNA, 21 bp, Homo sapiens
ttgaacatgtgccttttctga

SEQ ID NO: 6577479 - DNA, 23 bp, Homo sapiens
ttgaacatttgggttactatttc

SEQ ID NO: 6577480 - DNA, 14 bp, Homo sapiens
ttgaaccaaaacat

SEQ ID NO: 6577481 - DNA, 15 bp, Homo sapiens
ttgaaccaaacctcc

SEQ ID NO: 6577482 - DNA, 21 bp, Homo sapiens
ttgaaccacgtgaaactgctg

SEQ ID NO: 6577483 - DNA, 16 bp, Homo sapiens
ttgaaccacttccctc

SEQ ID NO: 6577484 - DNA, 21 bp, Homo sapiens
ttgaaccataaaatgtccagt

SEQ ID NO: 6577485 - DNA, 16 bp, Homo sapiens
ttgaaccattatactt

SEQ ID NO: 6577486 - DNA, 18 bp, Homo sapiens
ttgaacccaggaggtgga

SEQ ID NO: 6577487 - DNA, 17 bp, Homo sapiens
ttgaacccaggagttca

SEQ ID NO: 6577488 - DNA, 20 bp, Homo sapiens
ttgaaccccctccctgtccc

SEQ ID NO: 6577489 - DNA, 14 bp, Homo sapiens
ttgaacccctgtgt

SEQ ID NO: 6577490 - DNA, 18 bp, Homo sapiens
ttgaacccgggaggcaga

SEQ ID NO: 6577491 - DNA, 11 bp, Homo sapiens
ttgaaccctaa

SEQ ID NO: 6577492 - DNA, 22 bp, Homo sapiens
ttgaaccctcggtgtacacaga

SEQ ID NO: 6577493 - DNA, 23 bp, Homo sapiens
ttgaaccgtcaatgtgaaataaa

SEQ ID NO: 6577494 - DNA, 15 bp, Homo sapiens
ttgaacctatttctc

SEQ ID NO: 6577495 - DNA, 16 bp, Homo sapiens
ttgaacctatttctct

SEQ ID NO: 6577496 - DNA, 20 bp, Homo sapiens
ttgaacctgatgaaaataaa

SEQ ID NO: 6577497 - DNA, 19 bp, Homo sapiens
ttgaacctgtcacctggcc

SEQ ID NO: 6577498 - DNA, 14 bp, Homo sapiens
ttgaaccttggtaa

SEQ ID NO: 6577499 - DNA, 17 bp, Homo sapiens
ttgaacctttgtgccct

SEQ ID NO: 6577500 - DNA, 21 bp, Homo sapiens
ttgaacctttttttttgaaac

SEQ ID NO: 6577501 - DNA, 21 bp, Homo sapiens
ttgaacgactgtatattgcta

SEQ ID NO: 6577502 - DNA, 23 bp, Homo sapiens
ttgaacgactgtatattgctaag

SEQ ID NO: 6577503 - DNA, 22 bp, Homo sapiens
ttgaacgcacatagctcaatca

SEQ ID NO: 6577504 - DNA, 15 bp, Homo sapiens
ttgaacgtatgtgct

SEQ ID NO: 6577505 - DNA, 21 bp, Homo sapiens
ttgaacgtgccagcagccctt

SEQ ID NO: 6577506 - DNA, 17 bp, Homo sapiens
ttgaacgttttctaatt

SEQ ID NO: 6577507 - DNA, 19 bp, Homo sapiens
ttgaacgttttctaattgc

SEQ ID NO: 6577508 - DNA, 16 bp, Homo sapiens
ttgaactaagaaactt

SEQ ID NO: 6577509 - DNA, 19 bp, Homo sapiens
ttgaactaagaaacttttg

SEQ ID NO: 6577510 - DNA, 17 bp, Homo sapiens
ttgaactagcaatgcct

SEQ ID NO: 6577511 - DNA, 12 bp, Homo sapiens
ttgaactatgaa

SEQ ID NO: 6577512 - DNA, 15 bp, Homo sapiens
ttgaactcacgagcc

SEQ ID NO: 6577513 - DNA, 15 bp, Homo sapiens
ttgaactcagatctg

SEQ ID NO: 6577514 - DNA, 20 bp, Homo sapiens
ttgaactcagatctgtctga

SEQ ID NO: 6577515 - DNA, 13 bp, Homo sapiens
ttgaactccaaga

SEQ ID NO: 6577516 - DNA, 22 bp, Homo sapiens
ttgaactccatgggattttatc

SEQ ID NO: 6577517 - DNA, 13 bp, Homo sapiens
ttgaactcctaac

SEQ ID NO: 6577518 - DNA, 17 bp, Homo sapiens
ttgaactcctgacctca

SEQ ID NO: 6577519 - DNA, 16 bp, Homo sapiens
ttgaactctgggctca

SEQ ID NO: 6577520 - DNA, 15 bp, Homo sapiens
ttgaactctggtggc

SEQ ID NO: 6577521 - DNA, 16 bp, Homo sapiens
ttgaactcttctcatt

SEQ ID NO: 6577522 - DNA, 19 bp, Homo sapiens
ttgaactcttctcattact

SEQ ID NO: 6577523 - DNA, 14 bp, Homo sapiens
ttgaactcttggcc

SEQ ID NO: 6577524 - DNA, 18 bp, Homo sapiens
ttgaactgaaacttttct

SEQ ID NO: 6577525 - DNA, 21 bp, Homo sapiens
ttgaactgaaacttttctaaa

SEQ ID NO: 6577526 - DNA, 12 bp, Homo sapiens
ttgaactgaggc

SEQ ID NO: 6577527 - DNA, 17 bp, Homo sapiens
ttgaactgcaggaagag

SEQ ID NO: 6577528 - DNA, 18 bp, Homo sapiens
ttgaactggaataatatt

SEQ ID NO: 6577529 - DNA, 18 bp, Homo sapiens
ttgaactgggtacttgtg

SEQ ID NO: 6577530 - DNA, 20 bp, Homo sapiens
ttgaactgtaccatgtgcta

SEQ ID NO: 6577531 - DNA, 17 bp, Homo sapiens
ttgaactgttagaatgt

SEQ ID NO: 6577532 - DNA, 18 bp, Homo sapiens
ttgaactgttagaatgta

SEQ ID NO: 6577533 - DNA, 17 bp, Homo sapiens
ttgaactgttagatgct

SEQ ID NO: 6577534 - DNA, 18 bp, Homo sapiens
ttgaactgttagatgctg

SEQ ID NO: 6577535 - DNA, 15 bp, Homo sapiens
ttgaactgtttaaca

SEQ ID NO: 6577536 - DNA, 16 bp, Homo sapiens
ttgaactgtttaacac

SEQ ID NO: 6577537 - DNA, 22 bp, Homo sapiens
ttgaacttaaataaatgtcatt

SEQ ID NO: 6577538 - DNA, 22 bp, Homo sapiens
ttgaacttgaaatctaatattt

SEQ ID NO: 6577539 - DNA, 13 bp, Homo sapiens
ttgaactttagtt

SEQ ID NO: 6577540 - DNA, 13 bp, Homo sapiens
ttgaactttgtag

SEQ ID NO: 6577541 - DNA, 15 bp, Homo sapiens
ttgaactttgtagga

SEQ ID NO: 6577542 - DNA, 19 bp, Homo sapiens
ttgaacttttcattccctg

SEQ ID NO: 6577543 - DNA, 22 bp, Homo sapiens
ttgaacttttcattccctgtag

SEQ ID NO: 6577544 - DNA, 13 bp, Homo sapiens
ttgaacttttgta

SEQ ID NO: 6577545 - DNA, 13 bp, Homo sapiens
ttgaactttttaa

SEQ ID NO: 6577546 - DNA, 22 bp, Homo sapiens
ttgaacttttttccactgaagt

SEQ ID NO: 6577547 - DNA, 17 bp, Homo sapiens
ttgaagaaaaaatggca

SEQ ID NO: 6577548 - DNA, 17 bp, Homo sapiens
ttgaagaaacagagtgg

SEQ ID NO: 6577549 - DNA, 14 bp, Homo sapiens
ttgaagaaacagat

SEQ ID NO: 6577550 - DNA, 19 bp, Homo sapiens
ttgaagaaaggaacctggg

SEQ ID NO: 6577551 - DNA, 22 bp, Homo sapiens
ttgaagaaaggcaaatctgact

SEQ ID NO: 6577552 - DNA, 19 bp, Homo sapiens
ttgaagaaagtcagctctt

SEQ ID NO: 6577553 - DNA, 19 bp, Homo sapiens
ttgaagaacaaaaggcttt

SEQ ID NO: 6577554 - DNA, 18 bp, Homo sapiens
ttgaagaactgcactttt

SEQ ID NO: 6577555 - DNA, 16 bp, Homo sapiens
ttgaagaactgcaggc

SEQ ID NO: 6577556 - DNA, 19 bp, Homo sapiens
ttgaagaactgcaggccct

SEQ ID NO: 6577557 - DNA, 18 bp, Homo sapiens
ttgaagaagctcttttgg

SEQ ID NO: 6577558 - DNA, 22 bp, Homo sapiens
ttgaagaaggaggaattttaga

SEQ ID NO: 6577559 - DNA, 18 bp, Homo sapiens
ttgaagaagggaaattca

SEQ ID NO: 6577560 - DNA, 19 bp, Homo sapiens
ttgaagaaggtggaccttt

SEQ ID NO: 6577561 - DNA, 21 bp, Homo sapiens
ttgaagaagttcagaaattta

SEQ ID NO: 6577562 - DNA, 16 bp, Homo sapiens
ttgaagaatctgcccc

SEQ ID NO: 6577563 - DNA, 17 bp, Homo sapiens
ttgaagaatctgcccct

SEQ ID NO: 6577564 - DNA, 18 bp, Homo sapiens
ttgaagaatctgcccctg

SEQ ID NO: 6577565 - DNA, 12 bp, Homo sapiens
ttgaagaatgaa

SEQ ID NO: 6577566 - DNA, 16 bp, Homo sapiens
ttgaagaatgaacaaa

SEQ ID NO: 6577567 - DNA, 15 bp, Homo sapiens
ttgaagaatgttaag

SEQ ID NO: 6577568 - DNA, 23 bp, Homo sapiens
ttgaagaatgttaagacttgaca

SEQ ID NO: 6577569 - DNA, 22 bp, Homo sapiens
ttgaagacaaaaatactctaat

SEQ ID NO: 6577570 - DNA, 16 bp, Homo sapiens
ttgaagacacagcctc

SEQ ID NO: 6577571 - DNA, 18 bp, Homo sapiens
ttgaagacacagcctccc

SEQ ID NO: 6577572 - DNA, 16 bp, Homo sapiens
ttgaagacaccagact

SEQ ID NO: 6577573 - DNA, 22 bp, Homo sapiens
ttgaagacagagcaaagcgccc

SEQ ID NO: 6577574 - DNA, 17 bp, Homo sapiens
ttgaagacagcttccca

SEQ ID NO: 6577575 - DNA, 14 bp, Homo sapiens
ttgaagaccagctt

SEQ ID NO: 6577576 - DNA, 16 bp, Homo sapiens
ttgaagacttcaaaat

SEQ ID NO: 6577577 - DNA, 15 bp, Homo sapiens
ttgaagacttcctct

SEQ ID NO: 6577578 - DNA, 16 bp, Homo sapiens
ttgaagacttcctctc

SEQ ID NO: 6577579 - DNA, 23 bp, Homo sapiens
aagtaagagtactgggagaatca

SEQ ID NO: 6577580 - DNA, 18 bp, Homo sapiens
aagtaagcaaacaaatat

SEQ ID NO: 6577581 - DNA, 19 bp, Homo sapiens
aagtaagggaataaatttt

SEQ ID NO: 6577582 - DNA, 20 bp, Homo sapiens
aagtaagggaataaattttt

SEQ ID NO: 6577583 - DNA, 20 bp, Homo sapiens
aagtaagtaccactcaggcc

SEQ ID NO: 6577584 - DNA, 14 bp, Homo sapiens
aagtaagtcttttt

SEQ ID NO: 6577585 - DNA, 20 bp, Homo sapiens
aagtaagtcttttttttttc

SEQ ID NO: 6577586 - DNA, 21 bp, Homo sapiens
aagtaagtttatccaaatctt

SEQ ID NO: 6577587 - DNA, 19 bp, Homo sapiens
aagtaagtttcattctaaa

SEQ ID NO: 6577588 - DNA, 17 bp, Homo sapiens
aagtaagtttcttcctg

SEQ ID NO: 6577589 - DNA, 20 bp, Homo sapiens
aagtaataaaattcaacaaa

SEQ ID NO: 6577590 - DNA, 15 bp, Homo sapiens
aagtaataaattcca

SEQ ID NO: 6577591 - DNA, 15 bp, Homo sapiens
aagtaataatgtgca

SEQ ID NO: 6577592 - DNA, 24 bp, Homo sapiens
aagtaatatatcaaatccaggact

SEQ ID NO: 6577593 - DNA, 12 bp, Homo sapiens
aagtaatatgca

SEQ ID NO: 6577594 - DNA, 17 bp, Homo sapiens
aagtaatatgcacacat

SEQ ID NO: 6577595 - DNA, 20 bp, Homo sapiens
aagtaatatgcacacatttt

SEQ ID NO: 6577596 - DNA, 13 bp, Homo sapiens
aagtaatattatt

SEQ ID NO: 6577597 - DNA, 22 bp, Homo sapiens
aagtaatatttattaaattttt

SEQ ID NO: 6577598 - DNA, 15 bp, Homo sapiens
aagtaatcacttaaa

SEQ ID NO: 6577599 - DNA, 16 bp, Homo sapiens
aagtaatcctagggaa

SEQ ID NO: 6577600 - DNA, 14 bp, Homo sapiens
aagtaatcttttta

SEQ ID NO: 6577601 - DNA, 17 bp, Homo sapiens
aagtaatgaagaatcac

SEQ ID NO: 6577602 - DNA, 16 bp, Homo sapiens
aagtaatgaattttat

SEQ ID NO: 6577603 - DNA, 20 bp, Homo sapiens
aagtaatgacttagaaactg

SEQ ID NO: 6577604 - DNA, 19 bp, Homo sapiens
aagtaatgataactggaaa

SEQ ID NO: 6577605 - DNA, 21 bp, Homo sapiens
aagtaatgatactgtgtgttt

SEQ ID NO: 6577606 - DNA, 15 bp, Homo sapiens
aagtaatgcctctgt

SEQ ID NO: 6577607 - DNA, 22 bp, Homo sapiens
aagtaatggaggtcccagccct

SEQ ID NO: 6577608 - DNA, 20 bp, Homo sapiens
aagtaatggttaagttttct

SEQ ID NO: 6577609 - DNA, 22 bp, Homo sapiens
aagtaatggttaagttttcttg

SEQ ID NO: 6577610 - DNA, 21 bp, Homo sapiens
aagtaattaaggtacatcatt

SEQ ID NO: 6577611 - DNA, 16 bp, Homo sapiens
aagtaattatgcacta

SEQ ID NO: 6577612 - DNA, 19 bp, Homo sapiens
aagtaattatgcactaaat

SEQ ID NO: 6577613 - DNA, 19 bp, Homo sapiens
aagtaattattttttagat

SEQ ID NO: 6577614 - DNA, 20 bp, Homo sapiens
aagtaattattttttagata

SEQ ID NO: 6577615 - DNA, 23 bp, Homo sapiens
aagtaattattttttagataata

SEQ ID NO: 6577616 - DNA, 13 bp, Homo sapiens
aagtaattgcatg

SEQ ID NO: 6577617 - DNA, 18 bp, Homo sapiens
aagtaattgcatttctgc

SEQ ID NO: 6577618 - DNA, 20 bp, Homo sapiens
aagtaattgcatttctgctc

SEQ ID NO: 6577619 - DNA, 19 bp, Homo sapiens
aagtaattgcctacaataa

SEQ ID NO: 6577620 - DNA, 12 bp, Homo sapiens
aagtaatttaat

SEQ ID NO: 6577621 - DNA, 21 bp, Homo sapiens
aagtaatttcaagaatgtttc

SEQ ID NO: 6577622 - DNA, 14 bp, Homo sapiens
aagtaatttcatgc

SEQ ID NO: 6577623 - DNA, 16 bp, Homo sapiens
aagtaatttggaaatt

SEQ ID NO: 6577624 - DNA, 22 bp, Homo sapiens
aagtaatttgtaaaaaagattt

SEQ ID NO: 6577625 - DNA, 19 bp, Homo sapiens
aagtaattttcatattaaa

SEQ ID NO: 6577626 - DNA, 12 bp, Homo sapiens
aagtacaaaatt

SEQ ID NO: 6577627 - DNA, 17 bp, Homo sapiens
aagtacaaatgaagaaa

SEQ ID NO: 6577628 - DNA, 23 bp, Homo sapiens
aagtacaatgaactgcttttcct

SEQ ID NO: 6577629 - DNA, 18 bp, Homo sapiens
aagtacaatgtgtttttc

SEQ ID NO: 6577630 - DNA, 19 bp, Homo sapiens
aagtacaatgtgtttttct

SEQ ID NO: 6577631 - DNA, 16 bp, Homo sapiens
aagtacacaataagca

SEQ ID NO: 6577632 - DNA, 17 bp, Homo sapiens
aagtacacaataagcaa

SEQ ID NO: 6577633 - DNA, 16 bp, Homo sapiens
aagtacactctgctgt

SEQ ID NO: 6577634 - DNA, 18 bp, Homo sapiens
aagtacactgtttcaaac

SEQ ID NO: 6577635 - DNA, 22 bp, Homo sapiens
aagtacagaacagtaaagttaa

SEQ ID NO: 6577636 - DNA, 17 bp, Homo sapiens
aagtacagaacatatcc

SEQ ID NO: 6577637 - DNA, 23 bp, Homo sapiens
aagtacagaatagaatacattga

SEQ ID NO: 6577638 - DNA, 11 bp, Homo sapiens
aagtacagaga

SEQ ID NO: 6577639 - DNA, 14 bp, Homo sapiens
aagtacagagaagc

SEQ ID NO: 6577640 - DNA, 20 bp, Homo sapiens
aagtacagcagtagactggg

SEQ ID NO: 6577641 - DNA, 22 bp, Homo sapiens
aagtacagcggctcccctctgc

SEQ ID NO: 6577642 - DNA, 23 bp, Homo sapiens
aagtacagggcagaaccaagaac

SEQ ID NO: 6577643 - DNA, 23 bp, Homo sapiens
aagtacagtcccagcacatttcc

SEQ ID NO: 6577644 - DNA, 15 bp, Homo sapiens
aagtacataaagtaa

SEQ ID NO: 6577645 - DNA, 20 bp, Homo sapiens
aagtacatattaggaaaata

SEQ ID NO: 6577646 - DNA, 17 bp, Homo sapiens
aagtacatgaatacaaa

SEQ ID NO: 6577647 - DNA, 17 bp, Homo sapiens
aagtacattgcttaaaa

SEQ ID NO: 6577648 - DNA, 13 bp, Homo sapiens
aagtacattgtaa

SEQ ID NO: 6577649 - DNA, 16 bp, Homo sapiens
aagtacattgtaaaat

SEQ ID NO: 6577650 - DNA, 12 bp, Homo sapiens
aagtacatttaa

SEQ ID NO: 6577651 - DNA, 21 bp, Homo sapiens
aagtacattttttgaaatgct

SEQ ID NO: 6577652 - DNA, 16 bp, Homo sapiens
aagtaccaaagtttta

SEQ ID NO: 6577653 - DNA, 14 bp, Homo sapiens
aagtaccacactga

SEQ ID NO: 6577654 - DNA, 16 bp, Homo sapiens
aagtaccacactgaaa

SEQ ID NO: 6577655 - DNA, 19 bp, Homo sapiens
aagtaccacactgaaaatt

SEQ ID NO: 6577656 - DNA, 15 bp, Homo sapiens
aagtaccacactgag

SEQ ID NO: 6577657 - DNA, 12 bp, Homo sapiens
aagtaccagact

SEQ ID NO: 6577658 - DNA, 13 bp, Homo sapiens
aagtaccagacta

SEQ ID NO: 6577659 - DNA, 18 bp, Homo sapiens
aagtacccgttcacattt

SEQ ID NO: 6577660 - DNA, 23 bp, Homo sapiens
aagtaccctcttttaccaacttc

SEQ ID NO: 6577661 - DNA, 22 bp, Homo sapiens
aagtaccctgatgccttttgga

SEQ ID NO: 6577662 - DNA, 21 bp, Homo sapiens
aagtacctatattgatttaaa

SEQ ID NO: 6577663 - DNA, 12 bp, Homo sapiens
aagtacctgtag

SEQ ID NO: 6577664 - DNA, 22 bp, Homo sapiens
aagtaccttgaactcttagtga

SEQ ID NO: 6577665 - DNA, 15 bp, Homo sapiens
aagtaccttgacttt

SEQ ID NO: 6577666 - DNA, 22 bp, Homo sapiens
aagtacctttcctacattttct

SEQ ID NO: 6577667 - DNA, 18 bp, Homo sapiens
aagtacgtcccagcggcc

SEQ ID NO: 6577668 - DNA, 16 bp, Homo sapiens
aagtactactgtagaa

SEQ ID NO: 6577669 - DNA, 22 bp, Homo sapiens
aagtactagcaataagttgaat

SEQ ID NO: 6577670 - DNA, 18 bp, Homo sapiens
aagtactaggttgtccat

SEQ ID NO: 6577671 - DNA, 16 bp, Homo sapiens
aagtactatgtatcaa

SEQ ID NO: 6577672 - DNA, 20 bp, Homo sapiens
aagtactgctgtaaataaat

SEQ ID NO: 6577673 - DNA, 23 bp, Homo sapiens
aagtactgctgtaaataaatgct

SEQ ID NO: 6577674 - DNA, 20 bp, Homo sapiens
aagtactggtaagattgtta

SEQ ID NO: 6577675 - DNA, 20 bp, Homo sapiens
aagtactgtaataatacctc

SEQ ID NO: 6577676 - DNA, 21 bp, Homo sapiens
aagtactgtactttcccaggt

SEQ ID NO: 6577677 - DNA, 19 bp, Homo sapiens
aagtactgtttaccatttt

SEQ ID NO: 6577678 - DNA, 14 bp, Homo sapiens
aagtacttaacata

SEQ ID NO: 6577679 - DNA, 17 bp, Homo sapiens
aagtacttacattccag

SEQ ID NO: 6577680 - DNA, 19 bp, Homo sapiens
aagtacttctccaccctgc

SEQ ID NO: 6577681 - DNA, 20 bp, Homo sapiens
aagtacttctccaccctgct

SEQ ID NO: 6577682 - DNA, 23 bp, Homo sapiens
aagtacttgagtaaatctaaaga

SEQ ID NO: 6577683 - DNA, 21 bp, Homo sapiens
aagtacttgagtgtaatgttt

SEQ ID NO: 6577684 - DNA, 19 bp, Homo sapiens
aagtacttgctctctgaga

SEQ ID NO: 6577685 - DNA, 17 bp, Homo sapiens
aagtacttgtagttcca

SEQ ID NO: 6577686 - DNA, 20 bp, Homo sapiens
aagtactttcttataaattt

SEQ ID NO: 6577687 - DNA, 14 bp, Homo sapiens
aagtacttttaacg

SEQ ID NO: 6577688 - DNA, 14 bp, Homo sapiens
aagtacttttggca

SEQ ID NO: 6577689 - DNA, 20 bp, Homo sapiens
aagtagaaaaaaaaataaca

SEQ ID NO: 6577690 - DNA, 15 bp, Homo sapiens
aagtagaaatcatag

SEQ ID NO: 6577691 - DNA, 13 bp, Homo sapiens
aagtagaaatggt

SEQ ID NO: 6577692 - DNA, 16 bp, Homo sapiens
aagtagaacaaaaaac

SEQ ID NO: 6577693 - DNA, 16 bp, Homo sapiens
aagtagaacaaaaact

SEQ ID NO: 6577694 - DNA, 15 bp, Homo sapiens
aagtagaactttgta

SEQ ID NO: 6577695 - DNA, 16 bp, Homo sapiens
aagtagaactttgtat

SEQ ID NO: 6577696 - DNA, 21 bp, Homo sapiens
aagtagaactttgtatagtta

SEQ ID NO: 6577697 - DNA, 23 bp, Homo sapiens
aagtagaactttgtatagttatg

SEQ ID NO: 6577698 - DNA, 12 bp, Homo sapiens
aagtagaagagg

SEQ ID NO: 6577699 - DNA, 16 bp, Homo sapiens
aagtagaagaggagga

SEQ ID NO: 6577700 - DNA, 16 bp, Homo sapiens
aagtagaagcatgttt

SEQ ID NO: 6577701 - DNA, 21 bp, Homo sapiens
aagtagaagtaatatgctctc

SEQ ID NO: 6577702 - DNA, 19 bp, Homo sapiens
aagtagaagtcttagatgt

SEQ ID NO: 6577703 - DNA, 19 bp, Homo sapiens
aagtagaatggcagctgga

SEQ ID NO: 6577704 - DNA, 15 bp, Homo sapiens
aagtagaattatatc

SEQ ID NO: 6577705 - DNA, 17 bp, Homo sapiens
aagtagaattatatcta

SEQ ID NO: 6577706 - DNA, 17 bp, Homo sapiens
aagtagacaatcattgt

SEQ ID NO: 6577707 - DNA, 19 bp, Homo sapiens
aagtagacacgagcttaat

SEQ ID NO: 6577708 - DNA, 21 bp, Homo sapiens
aagtagacagttttgagaacg

SEQ ID NO: 6577709 - DNA, 16 bp, Homo sapiens
aagtagaccaaatctt

SEQ ID NO: 6577710 - DNA, 19 bp, Homo sapiens
aagtagactactgttcagc

SEQ ID NO: 6577711 - DNA, 23 bp, Homo sapiens
aagtagacttcatttttcctaac

SEQ ID NO: 6577712 - DNA, 14 bp, Homo sapiens
aagtagagaagtat

SEQ ID NO: 6577713 - DNA, 15 bp, Homo sapiens
aagtagagaagtatc

SEQ ID NO: 6577714 - DNA, 21 bp, Homo sapiens
aagtagagccctttgagaata

SEQ ID NO: 6577715 - DNA, 22 bp, Homo sapiens
aagtagagtatattgaaaagaa

SEQ ID NO: 6577716 - DNA, 22 bp, Homo sapiens
aagtagagtgagttctttttca

SEQ ID NO: 6577717 - DNA, 18 bp, Homo sapiens
aagtagatctgctttctg

SEQ ID NO: 6577718 - DNA, 19 bp, Homo sapiens
aagtagatgataaaggcca

SEQ ID NO: 6577719 - DNA, 19 bp, Homo sapiens
aagtagcaaaacaaattca

SEQ ID NO: 6577720 - DNA, 16 bp, Homo sapiens
aagtagcaaatgttta

SEQ ID NO: 6577721 - DNA, 20 bp, Homo sapiens
aagtagcaaatgtttactgt

SEQ ID NO: 6577722 - DNA, 19 bp, Homo sapiens
aagtagcaaccctgtgata

SEQ ID NO: 6577723 - DNA, 21 bp, Homo sapiens
aagtagcaaccttcattttac

SEQ ID NO: 6577724 - DNA, 22 bp, Homo sapiens
aagtagcaaccttcattttaca

SEQ ID NO: 6577725 - DNA, 20 bp, Homo sapiens
aagtagcaataggctgtaat

SEQ ID NO: 6577726 - DNA, 15 bp, Homo sapiens
aagtagcacaggctg

SEQ ID NO: 6577727 - DNA, 20 bp, Homo sapiens
aagtagcaccaaataaatta

SEQ ID NO: 6577728 - DNA, 15 bp, Homo sapiens
aagtagcaggactag

SEQ ID NO: 6577729 - DNA, 18 bp, Homo sapiens
aagtagcaggcccagctg

SEQ ID NO: 6577730 - DNA, 17 bp, Homo sapiens
aagtagcatttactgtg

SEQ ID NO: 6577731 - DNA, 14 bp, Homo sapiens
aagtagcctctcct

SEQ ID NO: 6577732 - DNA, 19 bp, Homo sapiens
aagtagcctcttgtgtaac

SEQ ID NO: 6577733 - DNA, 21 bp, Homo sapiens
aagtagcctgatctttctaga

SEQ ID NO: 6577734 - DNA, 19 bp, Homo sapiens
aagtagctgggattttaaa

SEQ ID NO: 6577735 - DNA, 14 bp, Homo sapiens
aagtaggaaagaat

SEQ ID NO: 6577736 - DNA, 18 bp, Homo sapiens
aagtaggaaggaaaaaat

SEQ ID NO: 6577737 - DNA, 13 bp, Homo sapiens
aagtaggaagtaa

SEQ ID NO: 6577738 - DNA, 15 bp, Homo sapiens
aagtaggcatgaggg

SEQ ID NO: 6577739 - DNA, 21 bp, Homo sapiens
aagtagggacttctgtcttca

SEQ ID NO: 6577740 - DNA, 20 bp, Homo sapiens
aagtagggatgcggatcctg

SEQ ID NO: 6577741 - DNA, 15 bp, Homo sapiens
aagtagggggtctaa

SEQ ID NO: 6577742 - DNA, 14 bp, Homo sapiens
aagtaggtatacaa

SEQ ID NO: 6577743 - DNA, 20 bp, Homo sapiens
aagtaggtatacaaaagact

SEQ ID NO: 6577744 - DNA, 21 bp, Homo sapiens
aagtaggtggcttgagctaga

SEQ ID NO: 6577745 - DNA, 16 bp, Homo sapiens
aagtaggttctgtttt

SEQ ID NO: 6577746 - DNA, 22 bp, Homo sapiens
aagtaggttctgttttgttttg

SEQ ID NO: 6577747 - DNA, 13 bp, Homo sapiens
aagtagtaaaaat

SEQ ID NO: 6577748 - DNA, 15 bp, Homo sapiens
aagtagtaaaaatta

SEQ ID NO: 6577749 - DNA, 19 bp, Homo sapiens
aagtagtaaaaattaaaaa

SEQ ID NO: 6577750 - DNA, 14 bp, Homo sapiens
aagtagtaattgca

SEQ ID NO: 6577751 - DNA, 18 bp, Homo sapiens
aagtagtccagccttcca

SEQ ID NO: 6577752 - DNA, 17 bp, Homo sapiens
aagtagtccaggctgtc

SEQ ID NO: 6577753 - DNA, 15 bp, Homo sapiens
aagtagtgatgaaaa

SEQ ID NO: 6577754 - DNA, 22 bp, Homo sapiens
aagtagtgtctggatcagtaaa

SEQ ID NO: 6577755 - DNA, 17 bp, Homo sapiens
ttgaagacttcctctct

SEQ ID NO: 6577756 - DNA, 19 bp, Homo sapiens
ttgaagacttttctttcag

SEQ ID NO: 6577757 - DNA, 20 bp, Homo sapiens
ttgaagagacagagacaagt

SEQ ID NO: 6577758 - DNA, 18 bp, Homo sapiens
ttgaagagagatatatct

SEQ ID NO: 6577759 - DNA, 20 bp, Homo sapiens
ttgaagagagatatatctga

SEQ ID NO: 6577760 - DNA, 21 bp, Homo sapiens
ttgaagagagatatatctgaa

SEQ ID NO: 6577761 - DNA, 18 bp, Homo sapiens
ttgaagagcagctccttc

SEQ ID NO: 6577762 - DNA, 18 bp, Homo sapiens
ttgaagaggatattcttc

SEQ ID NO: 6577763 - DNA, 16 bp, Homo sapiens
ttgaagaggttttaaa

SEQ ID NO: 6577764 - DNA, 20 bp, Homo sapiens
ttgaagatcgttagtatcta

SEQ ID NO: 6577765 - DNA, 14 bp, Homo sapiens
ttgaagatctgatt

SEQ ID NO: 6577766 - DNA, 18 bp, Homo sapiens
ttgaagatgctgaaacag

SEQ ID NO: 6577767 - DNA, 11 bp, Homo sapiens
ttgaagatgta

SEQ ID NO: 6577768 - DNA, 16 bp, Homo sapiens
ttgaagcaaacagttg

SEQ ID NO: 6577769 - DNA, 13 bp, Homo sapiens
ttgaagcaaatgt

SEQ ID NO: 6577770 - DNA, 20 bp, Homo sapiens
ttgaagcaactacaacttct

SEQ ID NO: 6577771 - DNA, 21 bp, Homo sapiens
ttgaagcaactacaacttctc

SEQ ID NO: 6577772 - DNA, 15 bp, Homo sapiens
ttgaagcaactgtga

SEQ ID NO: 6577773 - DNA, 12 bp, Homo sapiens
ttgaagcaataa

SEQ ID NO: 6577774 - DNA, 13 bp, Homo sapiens
ttgaagcaataac

SEQ ID NO: 6577775 - DNA, 14 bp, Homo sapiens
ttgaagcaccatgg

SEQ ID NO: 6577776 - DNA, 11 bp, Homo sapiens
ttgaagcactt

SEQ ID NO: 6577777 - DNA, 14 bp, Homo sapiens
ttgaagcagagtgg

SEQ ID NO: 6577778 - DNA, 12 bp, Homo sapiens
ttgaagcagctc

SEQ ID NO: 6577779 - DNA, 18 bp, Homo sapiens
ttgaagcagctctgcctt

SEQ ID NO: 6577780 - DNA, 23 bp, Homo sapiens
ttgaagcattttataaatcgctt

SEQ ID NO: 6577781 - DNA, 15 bp, Homo sapiens
ttgaagccaaagaaa

SEQ ID NO: 6577782 - DNA, 20 bp, Homo sapiens
ttgaagccaagtggggtgct

SEQ ID NO: 6577783 - DNA, 16 bp, Homo sapiens
ttgaagccatctaaag

SEQ ID NO: 6577784 - DNA, 18 bp, Homo sapiens
ttgaagccgactctggcc

SEQ ID NO: 6577785 - DNA, 16 bp, Homo sapiens
ttgaagcctcctgaat

SEQ ID NO: 6577786 - DNA, 21 bp, Homo sapiens
ttgaagcctgcccttgtctga

SEQ ID NO: 6577787 - DNA, 15 bp, Homo sapiens
ttgaagcctgctcct

SEQ ID NO: 6577788 - DNA, 19 bp, Homo sapiens
ttgaagcctgctccttccc

SEQ ID NO: 6577789 - DNA, 12 bp, Homo sapiens
ttgaagcctgtg

SEQ ID NO: 6577790 - DNA, 13 bp, Homo sapiens
ttgaagcctgtgc

SEQ ID NO: 6577791 - DNA, 15 bp, Homo sapiens
ttgaagcctgtgcct

SEQ ID NO: 6577792 - DNA, 20 bp, Homo sapiens
ttgaagcctgtgcctcccag

SEQ ID NO: 6577793 - DNA, 16 bp, Homo sapiens
ttgaagctaaaacact

SEQ ID NO: 6577794 - DNA, 16 bp, Homo sapiens
ttgaagctaattattt

SEQ ID NO: 6577795 - DNA, 14 bp, Homo sapiens
ttgaagctcagaaa

SEQ ID NO: 6577796 - DNA, 23 bp, Homo sapiens
ttgaagctctggtgacaccagcc

SEQ ID NO: 6577797 - DNA, 19 bp, Homo sapiens
ttgaagctgggctgtctct

SEQ ID NO: 6577798 - DNA, 17 bp, Homo sapiens
ttgaagctgttgctatt

SEQ ID NO: 6577799 - DNA, 15 bp, Homo sapiens
ttgaagcttgtatct

SEQ ID NO: 6577800 - DNA, 17 bp, Homo sapiens
ttgaagcttgtatctga

SEQ ID NO: 6577801 - DNA, 14 bp, Homo sapiens
ttgaaggaaacagt

SEQ ID NO: 6577802 - DNA, 13 bp, Homo sapiens
ttgaaggaagagg

SEQ ID NO: 6577803 - DNA, 16 bp, Homo sapiens
ttgaaggaagagggac

SEQ ID NO: 6577804 - DNA, 19 bp, Homo sapiens
ttgaaggacctaaattcgt

SEQ ID NO: 6577805 - DNA, 18 bp, Homo sapiens
ttgaaggagaaaatgcat

SEQ ID NO: 6577806 - DNA, 18 bp, Homo sapiens
ttgaaggaggtgagggat

SEQ ID NO: 6577807 - DNA, 14 bp, Homo sapiens
ttgaaggagtttaa

SEQ ID NO: 6577808 - DNA, 15 bp, Homo sapiens
ttgaaggatctgttt

SEQ ID NO: 6577809 - DNA, 12 bp, Homo sapiens
ttgaaggattgc

SEQ ID NO: 6577810 - DNA, 18 bp, Homo sapiens
ttgaaggattgcatcctg

SEQ ID NO: 6577811 - DNA, 13 bp, Homo sapiens
ttgaaggcagtct

SEQ ID NO: 6577812 - DNA, 11 bp, Homo sapiens
ttgaaggccag

SEQ ID NO: 6577813 - DNA, 12 bp, Homo sapiens
ttgaaggccagc

SEQ ID NO: 6577814 - DNA, 23 bp, Homo sapiens
ttgaaggcccaggtcaacatcta

SEQ ID NO: 6577815 - DNA, 11 bp, Homo sapiens
ttgaaggctta

SEQ ID NO: 6577816 - DNA, 23 bp, Homo sapiens
ttgaaggctttaataaaggccac

SEQ ID NO: 6577817 - DNA, 20 bp, Homo sapiens
ttgaagggaaacaaagaagt

SEQ ID NO: 6577818 - DNA, 19 bp, Homo sapiens
ttgaagggagaagacactg

SEQ ID NO: 6577819 - DNA, 20 bp, Homo sapiens
ttgaagggaggggctgtgtt

SEQ ID NO: 6577820 - DNA, 17 bp, Homo sapiens
ttgaaggggcttctaat

SEQ ID NO: 6577821 - DNA, 18 bp, Homo sapiens
ttgaaggggcttctaatg

SEQ ID NO: 6577822 - DNA, 20 bp, Homo sapiens
ttgaaggggcttctaatgac

SEQ ID NO: 6577823 - DNA, 21 bp, Homo sapiens
ttgaaggggcttctaatgacc

SEQ ID NO: 6577824 - DNA, 19 bp, Homo sapiens
ttgaagggtctttctcaaa

SEQ ID NO: 6577825 - DNA, 22 bp, Homo sapiens
ttgaaggttgtatgtaaatctg

SEQ ID NO: 6577826 - DNA, 21 bp, Homo sapiens
ttgaagtaaattaaacatttt

SEQ ID NO: 6577827 - DNA, 22 bp, Homo sapiens
ttgaagtaactataacaaaaaa

SEQ ID NO: 6577828 - DNA, 17 bp, Homo sapiens
ttgaagtaatgaatttt

SEQ ID NO: 6577829 - DNA, 20 bp, Homo sapiens
ttgaagtaattcttctgcct

SEQ ID NO: 6577830 - DNA, 22 bp, Homo sapiens
ttgaagtaccaggccgtttgct

SEQ ID NO: 6577831 - DNA, 16 bp, Homo sapiens
ttgaagtagctctttt

SEQ ID NO: 6577832 - DNA, 23 bp, Homo sapiens
ttgaagtaggtggcttgagctag

SEQ ID NO: 6577833 - DNA, 17 bp, Homo sapiens
ttgaagtatattcttat

SEQ ID NO: 6577834 - DNA, 20 bp, Homo sapiens
ttgaagtatattcttattgg

SEQ ID NO: 6577835 - DNA, 19 bp, Homo sapiens
ttgaagtcaccttgtgtgt

SEQ ID NO: 6577836 - DNA, 13 bp, Homo sapiens
ttgaagtccagga

SEQ ID NO: 6577837 - DNA, 18 bp, Homo sapiens
ttgaagtcccaatttaag

SEQ ID NO: 6577838 - DNA, 19 bp, Homo sapiens
ttgaagtcttcttatctaa

SEQ ID NO: 6577839 - DNA, 21 bp, Homo sapiens
ttgaagtcttcttatctaaac

SEQ ID NO: 6577840 - DNA, 16 bp, Homo sapiens
ttgaagtcttgtataa

SEQ ID NO: 6577841 - DNA, 22 bp, Homo sapiens
ttgaagtgaaatctgtgcaata

SEQ ID NO: 6577842 - DNA, 16 bp, Homo sapiens
ttgaagtgactgttgt

SEQ ID NO: 6577843 - DNA, 14 bp, Homo sapiens
ttgaagtgcagctc

SEQ ID NO: 6577844 - DNA, 15 bp, Homo sapiens
ttgaagtgcagctca

SEQ ID NO: 6577845 - DNA, 19 bp, Homo sapiens
ttgaagtgcagctcatgtt

SEQ ID NO: 6577846 - DNA, 14 bp, Homo sapiens
ttgaagtgcatgtt

SEQ ID NO: 6577847 - DNA, 19 bp, Homo sapiens
ttgaagtgcatgttaaaat

SEQ ID NO: 6577848 - DNA, 16 bp, Homo sapiens
ttgaagtgggaaagca

SEQ ID NO: 6577849 - DNA, 22 bp, Homo sapiens
ttgaagtgtaggcagacacagg

SEQ ID NO: 6577850 - DNA, 21 bp, Homo sapiens
ttgaagtgtataatataaaaa

SEQ ID NO: 6577851 - DNA, 15 bp, Homo sapiens
ttgaagtgtcttctg

SEQ ID NO: 6577852 - DNA, 18 bp, Homo sapiens
ttgaagtgtcttctgttc

SEQ ID NO: 6577853 - DNA, 15 bp, Homo sapiens
ttgaagtgttccctt

SEQ ID NO: 6577854 - DNA, 21 bp, Homo sapiens
ttgaagtgttctgagctgtat

SEQ ID NO: 6577855 - DNA, 13 bp, Homo sapiens
ttgaagttctaac

SEQ ID NO: 6577856 - DNA, 17 bp, Homo sapiens
ttgaagttctgaaattt

SEQ ID NO: 6577857 - DNA, 16 bp, Homo sapiens
ttgaagttctggcaag

SEQ ID NO: 6577858 - DNA, 23 bp, Homo sapiens
ttgaagttgactctgctcttgca

SEQ ID NO: 6577859 - DNA, 16 bp, Homo sapiens
ttgaagtttattattt

SEQ ID NO: 6577860 - DNA, 19 bp, Homo sapiens
ttgaagtttattattttca

SEQ ID NO: 6577861 - DNA, 20 bp, Homo sapiens
ttgaagtttattattttcaa

SEQ ID NO: 6577862 - DNA, 21 bp, Homo sapiens
ttgaataaaaactttgctaaa

SEQ ID NO: 6577863 - DNA, 16 bp, Homo sapiens
ttgaataaaaagtgaa

SEQ ID NO: 6577864 - DNA, 16 bp, Homo sapiens
ttgaataaaaatgcac

SEQ ID NO: 6577865 - DNA, 14 bp, Homo sapiens
ttgaataaaagtgc

SEQ ID NO: 6577866 - DNA, 15 bp, Homo sapiens
ttgaataaaatgaca

SEQ ID NO: 6577867 - DNA, 22 bp, Homo sapiens
ttgaataaacaccactggatta

SEQ ID NO: 6577868 - DNA, 18 bp, Homo sapiens
ttgaataaagaatacttg

SEQ ID NO: 6577869 - DNA, 13 bp, Homo sapiens
ttgaataaagtct

SEQ ID NO: 6577870 - DNA, 14 bp, Homo sapiens
ttgaataaagtctg

SEQ ID NO: 6577871 - DNA, 17 bp, Homo sapiens
ttgaataaagtctgagt

SEQ ID NO: 6577872 - DNA, 19 bp, Homo sapiens
ttgaataaagttgaagcta

SEQ ID NO: 6577873 - DNA, 16 bp, Homo sapiens
ttgaataaatgagaaa

SEQ ID NO: 6577874 - DNA, 12 bp, Homo sapiens
ttgaataaatgt

SEQ ID NO: 6577875 - DNA, 22 bp, Homo sapiens
ttgaataaatgtatctgaatat

SEQ ID NO: 6577876 - DNA, 17 bp, Homo sapiens
ttgaataaatgtcactt

SEQ ID NO: 6577877 - DNA, 22 bp, Homo sapiens
ttgaataaattttcaaatcctt

SEQ ID NO: 6577878 - DNA, 18 bp, Homo sapiens
ttgaataactctttttca

SEQ ID NO: 6577879 - DNA, 12 bp, Homo sapiens
ttgaataagcag

SEQ ID NO: 6577880 - DNA, 22 bp, Homo sapiens
ttgaataagcagaacatactgt

SEQ ID NO: 6577881 - DNA, 20 bp, Homo sapiens
ttgaataataagcaggatgt

SEQ ID NO: 6577882 - DNA, 19 bp, Homo sapiens
ttgaataatggtaccagat

SEQ ID NO: 6577883 - DNA, 22 bp, Homo sapiens
ttgaataatggtaccagataaa

SEQ ID NO: 6577884 - DNA, 21 bp, Homo sapiens
ttgaataatgtctagattttg

SEQ ID NO: 6577885 - DNA, 13 bp, Homo sapiens
ttgaatacacaaa

SEQ ID NO: 6577886 - DNA, 18 bp, Homo sapiens
ttgaatacattaaaagaa

SEQ ID NO: 6577887 - DNA, 18 bp, Homo sapiens
ttgaatactctgccctct

SEQ ID NO: 6577888 - DNA, 16 bp, Homo sapiens
ttgaatactgtctgta

SEQ ID NO: 6577889 - DNA, 15 bp, Homo sapiens
ttgaatacttacatt

SEQ ID NO: 6577890 - DNA, 14 bp, Homo sapiens
ttgaatacttgaac

SEQ ID NO: 6577891 - DNA, 17 bp, Homo sapiens
ttgaatacttgaaccat

SEQ ID NO: 6577892 - DNA, 13 bp, Homo sapiens
ttgaatactttga

SEQ ID NO: 6577893 - DNA, 20 bp, Homo sapiens
ttgaatactttgaatgtgtt

SEQ ID NO: 6577894 - DNA, 12 bp, Homo sapiens
ttgaatactttt

SEQ ID NO: 6577895 - DNA, 18 bp, Homo sapiens
ttgaatagagaagtgtga

SEQ ID NO: 6577896 - DNA, 21 bp, Homo sapiens
ttgaatagaggccaaattaat

SEQ ID NO: 6577897 - DNA, 22 bp, Homo sapiens
ttgaatagaggccaaattaatc

SEQ ID NO: 6577898 - DNA, 19 bp, Homo sapiens
ttgaatagattttctctgg

SEQ ID NO: 6577899 - DNA, 20 bp, Homo sapiens
ttgaatagattttctctgga

SEQ ID NO: 6577900 - DNA, 20 bp, Homo sapiens
ttgaataggaaataaaatta

SEQ ID NO: 6577901 - DNA, 21 bp, Homo sapiens
ttgaataggcattaaatgcaa

SEQ ID NO: 6577902 - DNA, 22 bp, Homo sapiens
ttgaataggcattaaatgcaaa

SEQ ID NO: 6577903 - DNA, 23 bp, Homo sapiens
ttgaatagttgcttaattttgat

SEQ ID NO: 6577904 - DNA, 21 bp, Homo sapiens
ttgaatagtttatttctgtga

SEQ ID NO: 6577905 - DNA, 13 bp, Homo sapiens
ttgaatataaaaa

SEQ ID NO: 6577906 - DNA, 15 bp, Homo sapiens
ttgaatataaacact

SEQ ID NO: 6577907 - DNA, 16 bp, Homo sapiens
ttgaatataaacacta

SEQ ID NO: 6577908 - DNA, 12 bp, Homo sapiens
ttgaatataata

SEQ ID NO: 6577909 - DNA, 22 bp, Homo sapiens
ttgaatataatatatttgtgta

SEQ ID NO: 6577910 - DNA, 19 bp, Homo sapiens
ttgaatatagcctgcctca

SEQ ID NO: 6577911 - DNA, 13 bp, Homo sapiens
ttgaatatatgat

SEQ ID NO: 6577912 - DNA, 14 bp, Homo sapiens
ttgaatatatttta

SEQ ID NO: 6577913 - DNA, 16 bp, Homo sapiens
ttgaatatcccctccc

SEQ ID NO: 6577914 - DNA, 15 bp, Homo sapiens
ttgaatatgattaaa

SEQ ID NO: 6577915 - DNA, 17 bp, Homo sapiens
ttgaatatggacaagag

SEQ ID NO: 6577916 - DNA, 13 bp, Homo sapiens
ttgaatatgtagc

SEQ ID NO: 6577917 - DNA, 14 bp, Homo sapiens
ttgaatattactgg

SEQ ID NO: 6577918 - DNA, 23 bp, Homo sapiens
ttgaatattattcctcaaaaaat

SEQ ID NO: 6577919 - DNA, 12 bp, Homo sapiens
ttgaatattgtg

SEQ ID NO: 6577920 - DNA, 17 bp, Homo sapiens
ttgaatatttaagcaat

SEQ ID NO: 6577921 - DNA, 21 bp, Homo sapiens
ttgaatatttagcataaattt

SEQ ID NO: 6577922 - DNA, 21 bp, Homo sapiens
ttgaatatttgcttaaaattg

SEQ ID NO: 6577923 - DNA, 21 bp, Homo sapiens
ttgaatattttattaaaacat

SEQ ID NO: 6577924 - DNA, 12 bp, Homo sapiens
ttgaatattttt

SEQ ID NO: 6577925 - DNA, 14 bp, Homo sapiens
ttgaatcaataata

SEQ ID NO: 6577926 - DNA, 20 bp, Homo sapiens
ttgaatcaggaggagattaa

SEQ ID NO: 6577927 - DNA, 18 bp, Homo sapiens
ttgaatccattgaaagtg

SEQ ID NO: 6577928 - DNA, 15 bp, Homo sapiens
ttgaatcctctctct

SEQ ID NO: 6577929 - DNA, 22 bp, Homo sapiens
ttgaatcgatataggcatttgg

SEQ ID NO: 6577930 - DNA, 20 bp, Homo sapiens
ttgaatctatttaagtaaaa

SEQ ID NO: 6577931 - DNA, 20 bp, Homo sapiens
ttgaatctatttatcttcat

SEQ ID NO: 6577932 - DNA, 13 bp, Homo sapiens
ttgaatctatttt

SEQ ID NO: 6577933 - DNA, 16 bp, Homo sapiens
ttgaatcttgtctcaa

SEQ ID NO: 6577934 - DNA, 13 bp, Homo sapiens
aagtagttatcat

SEQ ID NO: 6577935 - DNA, 15 bp, Homo sapiens
aagtagttatcatgt

SEQ ID NO: 6577936 - DNA, 13 bp, Homo sapiens
aagtagttatttt

SEQ ID NO: 6577937 - DNA, 17 bp, Homo sapiens
aagtagttattttatag

SEQ ID NO: 6577938 - DNA, 18 bp, Homo sapiens
aagtagttattttatagg

SEQ ID NO: 6577939 - DNA, 20 bp, Homo sapiens
aagtagttctgtatttgaaa

SEQ ID NO: 6577940 - DNA, 22 bp, Homo sapiens
aagtagttctgtatttgaaagt

SEQ ID NO: 6577941 - DNA, 23 bp, Homo sapiens
aagtagttctgtatttgaaagtg

SEQ ID NO: 6577942 - DNA, 19 bp, Homo sapiens
aagtagttgattcagccct

SEQ ID NO: 6577943 - DNA, 20 bp, Homo sapiens
aagtagtttaagtctccttt

SEQ ID NO: 6577944 - DNA, 18 bp, Homo sapiens
aagtagttttattttaat

SEQ ID NO: 6577945 - DNA, 14 bp, Homo sapiens
aagtataaacctta

SEQ ID NO: 6577946 - DNA, 20 bp, Homo sapiens
aagtataaatttgtgtaata

SEQ ID NO: 6577947 - DNA, 14 bp, Homo sapiens
aagtataatctttc

SEQ ID NO: 6577948 - DNA, 20 bp, Homo sapiens
aagtataatttgctggaaca

SEQ ID NO: 6577949 - DNA, 20 bp, Homo sapiens
aagtatacaacaggagagag

SEQ ID NO: 6577950 - DNA, 15 bp, Homo sapiens
aagtatacataagtt

SEQ ID NO: 6577951 - DNA, 13 bp, Homo sapiens
aagtatacattta

SEQ ID NO: 6577952 - DNA, 18 bp, Homo sapiens
aagtatacctatcactta

SEQ ID NO: 6577953 - DNA, 16 bp, Homo sapiens
aagtatacctggcttt

SEQ ID NO: 6577954 - DNA, 22 bp, Homo sapiens
aagtatacctggctttttaaaa

SEQ ID NO: 6577955 - DNA, 18 bp, Homo sapiens
aagtatactgtattttta

SEQ ID NO: 6577956 - DNA, 14 bp, Homo sapiens
aagtatacttttcc

SEQ ID NO: 6577957 - DNA, 22 bp, Homo sapiens
aagtatagaaaagatttaagta

SEQ ID NO: 6577958 - DNA, 12 bp, Homo sapiens
aagtatagagag

SEQ ID NO: 6577959 - DNA, 13 bp, Homo sapiens
aagtatagagaga

SEQ ID NO: 6577960 - DNA, 17 bp, Homo sapiens
aagtatagagagaagtt

SEQ ID NO: 6577961 - DNA, 22 bp, Homo sapiens
aagtataggataaattacatta

SEQ ID NO: 6577962 - DNA, 13 bp, Homo sapiens
aagtatataaata

SEQ ID NO: 6577963 - DNA, 12 bp, Homo sapiens
aagtatataatg

SEQ ID NO: 6577964 - DNA, 13 bp, Homo sapiens
aagtatatacaga

SEQ ID NO: 6577965 - DNA, 21 bp, Homo sapiens
aagtatatagtatatttatac

SEQ ID NO: 6577966 - DNA, 23 bp, Homo sapiens
aagtatatagtatatttatactc

SEQ ID NO: 6577967 - DNA, 11 bp, Homo sapiens
aagtatatata

SEQ ID NO: 6577968 - DNA, 22 bp, Homo sapiens
aagtatatattcccctaagatt

SEQ ID NO: 6577969 - DNA, 22 bp, Homo sapiens
aagtatatctctagatgcaaat

SEQ ID NO: 6577970 - DNA, 13 bp, Homo sapiens
aagtatatgtcat

SEQ ID NO: 6577971 - DNA, 12 bp, Homo sapiens
aagtatattaaa

SEQ ID NO: 6577972 - DNA, 21 bp, Homo sapiens
aagtatattatatggcaggag

SEQ ID NO: 6577973 - DNA, 23 bp, Homo sapiens
aagtatattatatggcaggagct

SEQ ID NO: 6577974 - DNA, 16 bp, Homo sapiens
aagtatattcttattg

SEQ ID NO: 6577975 - DNA, 17 bp, Homo sapiens
aagtatattgaaagttt

SEQ ID NO: 6577976 - DNA, 16 bp, Homo sapiens
aagtatatttgtaaaa

SEQ ID NO: 6577977 - DNA, 20 bp, Homo sapiens
aagtatcaaagaaaaacaat

SEQ ID NO: 6577978 - DNA, 17 bp, Homo sapiens
aagtatcaagtatagaa

SEQ ID NO: 6577979 - DNA, 19 bp, Homo sapiens
aagtatcatctaaatatta

SEQ ID NO: 6577980 - DNA, 21 bp, Homo sapiens
aagtatcatctaaatattatg

SEQ ID NO: 6577981 - DNA, 11 bp, Homo sapiens
aagtatcatgc

SEQ ID NO: 6577982 - DNA, 14 bp, Homo sapiens
aagtatcatgcatt

SEQ ID NO: 6577983 - DNA, 16 bp, Homo sapiens
aagtatcatggaaata

SEQ ID NO: 6577984 - DNA, 17 bp, Homo sapiens
aagtatcatggaaatat

SEQ ID NO: 6577985 - DNA, 16 bp, Homo sapiens
aagtatccaattatgt

SEQ ID NO: 6577986 - DNA, 18 bp, Homo sapiens
aagtatccaattatgtga

SEQ ID NO: 6577987 - DNA, 17 bp, Homo sapiens
aagtatctaaatttgga

SEQ ID NO: 6577988 - DNA, 22 bp, Homo sapiens
aagtatctaactcttctggaaa

SEQ ID NO: 6577989 - DNA, 19 bp, Homo sapiens
aagtatctcaacaacatgt

SEQ ID NO: 6577990 - DNA, 19 bp, Homo sapiens
aagtatctctactttcctg

SEQ ID NO: 6577991 - DNA, 22 bp, Homo sapiens
aagtatctgacatctctgcaat

SEQ ID NO: 6577992 - DNA, 19 bp, Homo sapiens
aagtatctgggattattct

SEQ ID NO: 6577993 - DNA, 23 bp, Homo sapiens
aagtatcttctatttttatcatg

SEQ ID NO: 6577994 - DNA, 19 bp, Homo sapiens
aagtatcttgtgcttcttc

SEQ ID NO: 6577995 - DNA, 24 bp, Homo sapiens
aagtatctttaacaattgtcttaa

SEQ ID NO: 6577996 - DNA, 12 bp, Homo sapiens
aagtatgaatat

SEQ ID NO: 6577997 - DNA, 13 bp, Homo sapiens
aagtatgaatatt

SEQ ID NO: 6577998 - DNA, 22 bp, Homo sapiens
aagtatgaatatttcattttga

SEQ ID NO: 6577999 - DNA, 16 bp, Homo sapiens
aagtatgaatctatgc

SEQ ID NO: 6578000 - DNA, 11 bp, Homo sapiens
aagtatgcaaa

SEQ ID NO: 6578001 - DNA, 14 bp, Homo sapiens
aagtatgcaaaata

SEQ ID NO: 6578002 - DNA, 20 bp, Homo sapiens
aagtatgcaaaataaagaat

SEQ ID NO: 6578003 - DNA, 18 bp, Homo sapiens
aagtatgcatgcaggcct

SEQ ID NO: 6578004 - DNA, 18 bp, Homo sapiens
aagtatgcattattaaat

SEQ ID NO: 6578005 - DNA, 21 bp, Homo sapiens
aagtatgcattattaaattgt

SEQ ID NO: 6578006 - DNA, 16 bp, Homo sapiens
aagtatgccttaagca

SEQ ID NO: 6578007 - DNA, 22 bp, Homo sapiens
aagtatgccttaagcagaacaa

SEQ ID NO: 6578008 - DNA, 13 bp, Homo sapiens
aagtatgctgtgg

SEQ ID NO: 6578009 - DNA, 15 bp, Homo sapiens
aagtatggaattttc

SEQ ID NO: 6578010 - DNA, 22 bp, Homo sapiens
aagtatgtaaagtatgtaaaca

SEQ ID NO: 6578011 - DNA, 19 bp, Homo sapiens
aagtatgtatattaaaaaa

SEQ ID NO: 6578012 - DNA, 21 bp, Homo sapiens
aagtatgtattatttacattt

SEQ ID NO: 6578013 - DNA, 13 bp, Homo sapiens
aagtatgtgagtg

SEQ ID NO: 6578014 - DNA, 13 bp, Homo sapiens
aagtatgtggtac

SEQ ID NO: 6578015 - DNA, 18 bp, Homo sapiens
aagtatgtggttttgtaa

SEQ ID NO: 6578016 - DNA, 18 bp, Homo sapiens
aagtatgtgtaaaatgtg

SEQ ID NO: 6578017 - DNA, 18 bp, Homo sapiens
aagtatgttagtgcaaat

SEQ ID NO: 6578018 - DNA, 20 bp, Homo sapiens
aagtatgtttttacattatg

SEQ ID NO: 6578019 - DNA, 14 bp, Homo sapiens
aagtattaaaacat

SEQ ID NO: 6578020 - DNA, 15 bp, Homo sapiens
aagtattaaaacatt

SEQ ID NO: 6578021 - DNA, 17 bp, Homo sapiens
aagtattaaaatgcata

SEQ ID NO: 6578022 - DNA, 12 bp, Homo sapiens
aagtattaaact

SEQ ID NO: 6578023 - DNA, 18 bp, Homo sapiens
aagtattaaactgtaaat

SEQ ID NO: 6578024 - DNA, 15 bp, Homo sapiens
aagtattaacttaca

SEQ ID NO: 6578025 - DNA, 14 bp, Homo sapiens
aagtattaagcagt

SEQ ID NO: 6578026 - DNA, 20 bp, Homo sapiens
aagtattaagcagttcattc

SEQ ID NO: 6578027 - DNA, 13 bp, Homo sapiens
aagtattaagcat

SEQ ID NO: 6578028 - DNA, 15 bp, Homo sapiens
aagtattaagcatat

SEQ ID NO: 6578029 - DNA, 17 bp, Homo sapiens
aagtattaagcatatat

SEQ ID NO: 6578030 - DNA, 17 bp, Homo sapiens
aagtattacatgattta

SEQ ID NO: 6578031 - DNA, 16 bp, Homo sapiens
aagtattactaaattg

SEQ ID NO: 6578032 - DNA, 13 bp, Homo sapiens
aagtattagaata

SEQ ID NO: 6578033 - DNA, 19 bp, Homo sapiens
aagtattagcatgagcttt

SEQ ID NO: 6578034 - DNA, 20 bp, Homo sapiens
aagtattataaacaagaatg

SEQ ID NO: 6578035 - DNA, 13 bp, Homo sapiens
aagtattataaat

SEQ ID NO: 6578036 - DNA, 15 bp, Homo sapiens
aagtattataccttt

SEQ ID NO: 6578037 - DNA, 16 bp, Homo sapiens
aagtattatctgtaaa

SEQ ID NO: 6578038 - DNA, 18 bp, Homo sapiens
aagtattatgtttcttct

SEQ ID NO: 6578039 - DNA, 12 bp, Homo sapiens
aagtattattag

SEQ ID NO: 6578040 - DNA, 13 bp, Homo sapiens
aagtattattcaa

SEQ ID NO: 6578041 - DNA, 17 bp, Homo sapiens
aagtattcagaaattaa

SEQ ID NO: 6578042 - DNA, 21 bp, Homo sapiens
aagtattcagaaattaaaata

SEQ ID NO: 6578043 - DNA, 21 bp, Homo sapiens
aagtattcatacaccttgcta

SEQ ID NO: 6578044 - DNA, 18 bp, Homo sapiens
aagtattccaccttaaat

SEQ ID NO: 6578045 - DNA, 18 bp, Homo sapiens
aagtattcctgttgctgt

SEQ ID NO: 6578046 - DNA, 22 bp, Homo sapiens
aagtattcctttcctgatcact

SEQ ID NO: 6578047 - DNA, 18 bp, Homo sapiens
aagtattcgttacatctt

SEQ ID NO: 6578048 - DNA, 21 bp, Homo sapiens
aagtattctaagccaagtttt

SEQ ID NO: 6578049 - DNA, 18 bp, Homo sapiens
aagtattctcttttcaag

SEQ ID NO: 6578050 - DNA, 14 bp, Homo sapiens
aagtattctgcctt

SEQ ID NO: 6578051 - DNA, 18 bp, Homo sapiens
aagtattctgcctttgca

SEQ ID NO: 6578052 - DNA, 22 bp, Homo sapiens
aagtattctgcctttgcagaaa

SEQ ID NO: 6578053 - DNA, 21 bp, Homo sapiens
aagtattcttatttaatgaaa

SEQ ID NO: 6578054 - DNA, 23 bp, Homo sapiens
aagtattcttatttaatgaaaga

SEQ ID NO: 6578055 - DNA, 13 bp, Homo sapiens
aagtattcttcat

SEQ ID NO: 6578056 - DNA, 13 bp, Homo sapiens
aagtattgccaaa

SEQ ID NO: 6578057 - DNA, 18 bp, Homo sapiens
aagtattgcgaatgtgca

SEQ ID NO: 6578058 - DNA, 14 bp, Homo sapiens
aagtattgtaaatt

SEQ ID NO: 6578059 - DNA, 22 bp, Homo sapiens
aagtattgtaaattatatttgt

SEQ ID NO: 6578060 - DNA, 17 bp, Homo sapiens
aagtattgtacaaataa

SEQ ID NO: 6578061 - DNA, 18 bp, Homo sapiens
aagtattgtgaaagtatt

SEQ ID NO: 6578062 - DNA, 14 bp, Homo sapiens
aagtattgtttaca

SEQ ID NO: 6578063 - DNA, 16 bp, Homo sapiens
aagtattgtttacatt

SEQ ID NO: 6578064 - DNA, 22 bp, Homo sapiens
aagtattgtttacattaaactc

SEQ ID NO: 6578065 - DNA, 13 bp, Homo sapiens
aagtatttaaatg

SEQ ID NO: 6578066 - DNA, 13 bp, Homo sapiens
aagtatttaagcc

SEQ ID NO: 6578067 - DNA, 20 bp, Homo sapiens
aagtatttaagcctaaagat

SEQ ID NO: 6578068 - DNA, 21 bp, Homo sapiens
aagtatttaattagtgctaag

SEQ ID NO: 6578069 - DNA, 22 bp, Homo sapiens
aagtatttaattagtgctaagt

SEQ ID NO: 6578070 - DNA, 15 bp, Homo sapiens
aagtatttacttttt

SEQ ID NO: 6578071 - DNA, 23 bp, Homo sapiens
aagtatttactttttaaaaataa

SEQ ID NO: 6578072 - DNA, 14 bp, Homo sapiens
aagtatttataaaa

SEQ ID NO: 6578073 - DNA, 16 bp, Homo sapiens
aagtatttataaaaat

SEQ ID NO: 6578074 - DNA, 13 bp, Homo sapiens
aagtatttataat

SEQ ID NO: 6578075 - DNA, 16 bp, Homo sapiens
aagtatttcatgtaat

SEQ ID NO: 6578076 - DNA, 20 bp, Homo sapiens
aagtatttcatgtaatataa

SEQ ID NO: 6578077 - DNA, 16 bp, Homo sapiens
aagtattttaatttta

SEQ ID NO: 6578078 - DNA, 17 bp, Homo sapiens
aagtattttaattttaa

SEQ ID NO: 6578079 - DNA, 20 bp, Homo sapiens
aagtattttaattttaaaga

SEQ ID NO: 6578080 - DNA, 22 bp, Homo sapiens
aagtattttcataagtatttca

SEQ ID NO: 6578081 - DNA, 11 bp, Homo sapiens
aagtattttga

SEQ ID NO: 6578082 - DNA, 21 bp, Homo sapiens
aagtattttgaagtttacatt

SEQ ID NO: 6578083 - DNA, 11 bp, Homo sapiens
aagtattttgc

SEQ ID NO: 6578084 - DNA, 15 bp, Homo sapiens
aagtatttttaatta

SEQ ID NO: 6578085 - DNA, 13 bp, Homo sapiens
aagtatttttgaa

SEQ ID NO: 6578086 - DNA, 14 bp, Homo sapiens
aagtatttttgaaa

SEQ ID NO: 6578087 - DNA, 16 bp, Homo sapiens
aagtatttttgaaaga

SEQ ID NO: 6578088 - DNA, 15 bp, Homo sapiens
aagtatttttttatc

SEQ ID NO: 6578089 - DNA, 13 bp, Homo sapiens
aagtcaaaaaatt

SEQ ID NO: 6578090 - DNA, 14 bp, Homo sapiens
aagtcaaaaggaac

SEQ ID NO: 6578091 - DNA, 16 bp, Homo sapiens
aagtcaaaaggtgcct

SEQ ID NO: 6578092 - DNA, 15 bp, Homo sapiens
aagtcaaaatatgta

SEQ ID NO: 6578093 - DNA, 18 bp, Homo sapiens
aagtcaaaatatttttaa

SEQ ID NO: 6578094 - DNA, 16 bp, Homo sapiens
aagtcaaacacttgtg

SEQ ID NO: 6578095 - DNA, 16 bp, Homo sapiens
aagtcaaacagtgtgg

SEQ ID NO: 6578096 - DNA, 18 bp, Homo sapiens
aagtcaaacgactaacct

SEQ ID NO: 6578097 - DNA, 17 bp, Homo sapiens
aagtcaaataaatgttt

SEQ ID NO: 6578098 - DNA, 22 bp, Homo sapiens
aagtcaaataaatgtttccccc

SEQ ID NO: 6578099 - DNA, 17 bp, Homo sapiens
aagtcaaatgtcacata

SEQ ID NO: 6578100 - DNA, 15 bp, Homo sapiens
aagtcaaattaataa

SEQ ID NO: 6578101 - DNA, 16 bp, Homo sapiens
aagtcaaatttacttt

SEQ ID NO: 6578102 - DNA, 20 bp, Homo sapiens
aagtcaacaaccatgccagg

SEQ ID NO: 6578103 - DNA, 17 bp, Homo sapiens
aagtcaacactcttctt

SEQ ID NO: 6578104 - DNA, 15 bp, Homo sapiens
aagtcaacagtaaac

SEQ ID NO: 6578105 - DNA, 21 bp, Homo sapiens
aagtcaacagtaaaccactga

SEQ ID NO: 6578106 - DNA, 14 bp, Homo sapiens
aagtcaacatcttc

SEQ ID NO: 6578107 - DNA, 16 bp, Homo sapiens
aagtcaaccaatgtag

SEQ ID NO: 6578108 - DNA, 22 bp, Homo sapiens
aagtcaaccaatgtagaaagct

SEQ ID NO: 6578109 - DNA, 21 bp, Homo sapiens
aagtcaactcttcagcctcat

SEQ ID NO: 6578110 - DNA, 14 bp, Homo sapiens
aagtcaagaagaat

SEQ ID NO: 6578111 - DNA, 12 bp, Homo sapiens
aagtcaagcaca

SEQ ID NO: 6578112 - DNA, 22 bp, Homo sapiens
aagtcaagcacatgtaataaat

SEQ ID NO: 6578113 - DNA, 23 bp, Homo sapiens
aagtcaataaaagagctgtctga

SEQ ID NO: 6578114 - DNA, 20 bp, Homo sapiens
ttgaatcttgtctcaatgct

SEQ ID NO: 6578115 - DNA, 13 bp, Homo sapiens
ttgaatctttaat

SEQ ID NO: 6578116 - DNA, 15 bp, Homo sapiens
ttgaatgaaaaattt

SEQ ID NO: 6578117 - DNA, 20 bp, Homo sapiens
ttgaatgaaaaatttaagca

SEQ ID NO: 6578118 - DNA, 16 bp, Homo sapiens
ttgaatgaaaacattt

SEQ ID NO: 6578119 - DNA, 12 bp, Homo sapiens
ttgaatgaaatt

SEQ ID NO: 6578120 - DNA, 15 bp, Homo sapiens
ttgaatgaataaaac

SEQ ID NO: 6578121 - DNA, 22 bp, Homo sapiens
ttgaatgagatgattcagaagg

SEQ ID NO: 6578122 - DNA, 16 bp, Homo sapiens
ttgaatgatgccatga

SEQ ID NO: 6578123 - DNA, 23 bp, Homo sapiens
ttgaatgcaaaagaaatttagag

SEQ ID NO: 6578124 - DNA, 23 bp, Homo sapiens
ttgaatgcagaagcaaacaagct

SEQ ID NO: 6578125 - DNA, 20 bp, Homo sapiens
ttgaatgctttttgaatgtt

SEQ ID NO: 6578126 - DNA, 23 bp, Homo sapiens
ttgaatgctttttgaatgttatt

SEQ ID NO: 6578127 - DNA, 19 bp, Homo sapiens
ttgaatggatcaatacaca

SEQ ID NO: 6578128 - DNA, 18 bp, Homo sapiens
ttgaatggattaaatggc

SEQ ID NO: 6578129 - DNA, 15 bp, Homo sapiens
ttgaatgggtccatt

SEQ ID NO: 6578130 - DNA, 11 bp, Homo sapiens
ttgaatgtaac

SEQ ID NO: 6578131 - DNA, 18 bp, Homo sapiens
ttgaatgtaagaacatga

SEQ ID NO: 6578132 - DNA, 19 bp, Homo sapiens
ttgaatgtacaaagatact

SEQ ID NO: 6578133 - DNA, 18 bp, Homo sapiens
ttgaatgtatgcttcata

SEQ ID NO: 6578134 - DNA, 20 bp, Homo sapiens
ttgaatgtatttgatttata

SEQ ID NO: 6578135 - DNA, 18 bp, Homo sapiens
ttgaatgtcaatatgaga

SEQ ID NO: 6578136 - DNA, 20 bp, Homo sapiens
ttgaatgtccccattctata

SEQ ID NO: 6578137 - DNA, 15 bp, Homo sapiens
ttgaatgtgaaacat

SEQ ID NO: 6578138 - DNA, 12 bp, Homo sapiens
ttgaatgtgatc

SEQ ID NO: 6578139 - DNA, 18 bp, Homo sapiens
ttgaatgtgatcatcttt

SEQ ID NO: 6578140 - DNA, 23 bp, Homo sapiens
ttgaatgtgatcatctttgctga

SEQ ID NO: 6578141 - DNA, 21 bp, Homo sapiens
ttgaatgtggataaaactgtg

SEQ ID NO: 6578142 - DNA, 22 bp, Homo sapiens
ttgaatgtggcttgagaaatat

SEQ ID NO: 6578143 - DNA, 22 bp, Homo sapiens
ttgaatgttaaagggatatttt

SEQ ID NO: 6578144 - DNA, 15 bp, Homo sapiens
ttgaatgttaaataa

SEQ ID NO: 6578145 - DNA, 16 bp, Homo sapiens
ttgaatgttaagaatt

SEQ ID NO: 6578146 - DNA, 12 bp, Homo sapiens
ttgaattaaaac

SEQ ID NO: 6578147 - DNA, 17 bp, Homo sapiens
ttgaattaaattaggaa

SEQ ID NO: 6578148 - DNA, 23 bp, Homo sapiens
ttgaattaaattaggaataaata

SEQ ID NO: 6578149 - DNA, 19 bp, Homo sapiens
ttgaattacagagatataa

SEQ ID NO: 6578150 - DNA, 12 bp, Homo sapiens
ttgaattagaaa

SEQ ID NO: 6578151 - DNA, 14 bp, Homo sapiens
ttgaattagaaaat

SEQ ID NO: 6578152 - DNA, 15 bp, Homo sapiens
ttgaattagaaaatt

SEQ ID NO: 6578153 - DNA, 17 bp, Homo sapiens
ttgaattagaaaattag

SEQ ID NO: 6578154 - DNA, 23 bp, Homo sapiens
ttgaattagaaacataaataaaa

SEQ ID NO: 6578155 - DNA, 21 bp, Homo sapiens
ttgaattaggctaaaaggtct

SEQ ID NO: 6578156 - DNA, 16 bp, Homo sapiens
ttgaattagtatttca

SEQ ID NO: 6578157 - DNA, 20 bp, Homo sapiens
ttgaattatcttggttgaaa

SEQ ID NO: 6578158 - DNA, 20 bp, Homo sapiens
ttgaattatgttttgacaca

SEQ ID NO: 6578159 - DNA, 18 bp, Homo sapiens
ttgaattatttctttatt

SEQ ID NO: 6578160 - DNA, 18 bp, Homo sapiens
ttgaattattttgttact

SEQ ID NO: 6578161 - DNA, 13 bp, Homo sapiens
ttgaattcagtaa

SEQ ID NO: 6578162 - DNA, 15 bp, Homo sapiens
ttgaattcatagaaa

SEQ ID NO: 6578163 - DNA, 12 bp, Homo sapiens
ttgaattcattt

SEQ ID NO: 6578164 - DNA, 21 bp, Homo sapiens
ttgaattccaagtgtatttta

SEQ ID NO: 6578165 - DNA, 22 bp, Homo sapiens
ttgaattcctaaaattatggaa

SEQ ID NO: 6578166 - DNA, 15 bp, Homo sapiens
ttgaattcctctcaa

SEQ ID NO: 6578167 - DNA, 12 bp, Homo sapiens
ttgaattctgga

SEQ ID NO: 6578168 - DNA, 23 bp, Homo sapiens
ttgaattcttcacatgtaacttt

SEQ ID NO: 6578169 - DNA, 16 bp, Homo sapiens
ttgaattgatacctgt

SEQ ID NO: 6578170 - DNA, 23 bp, Homo sapiens
ttgaattgtgtattgatgcaata

SEQ ID NO: 6578171 - DNA, 18 bp, Homo sapiens
ttgaattgtgtcttaatc

SEQ ID NO: 6578172 - DNA, 14 bp, Homo sapiens
ttgaattgttacat

SEQ ID NO: 6578173 - DNA, 14 bp, Homo sapiens
ttgaatttatataa

SEQ ID NO: 6578174 - DNA, 18 bp, Homo sapiens
ttgaatttatataaagta

SEQ ID NO: 6578175 - DNA, 17 bp, Homo sapiens
ttgaatttcactgtctt

SEQ ID NO: 6578176 - DNA, 19 bp, Homo sapiens
ttgaatttgtattaaaaag

SEQ ID NO: 6578177 - DNA, 15 bp, Homo sapiens
ttgaattttaaatct

SEQ ID NO: 6578178 - DNA, 19 bp, Homo sapiens
ttgaattttattgaaagct

SEQ ID NO: 6578179 - DNA, 11 bp, Homo sapiens
ttgaattttca

SEQ ID NO: 6578180 - DNA, 23 bp, Homo sapiens
ttgaattttcaagcatctcctga

SEQ ID NO: 6578181 - DNA, 12 bp, Homo sapiens
ttgaattttcat

SEQ ID NO: 6578182 - DNA, 18 bp, Homo sapiens
ttgaattttgatgaacaa

SEQ ID NO: 6578183 - DNA, 20 bp, Homo sapiens
ttgaattttgttctctggga

SEQ ID NO: 6578184 - DNA, 18 bp, Homo sapiens
ttgaatttttaagcaaat

SEQ ID NO: 6578185 - DNA, 17 bp, Homo sapiens
ttgaatttttcctatgc

SEQ ID NO: 6578186 - DNA, 16 bp, Homo sapiens
ttgaattttttgaaat

SEQ ID NO: 6578187 - DNA, 20 bp, Homo sapiens
ttgaattttttgaaatgggc

SEQ ID NO: 6578188 - DNA, 21 bp, Homo sapiens
ttgaatttttttctgcacagc

SEQ ID NO: 6578189 - DNA, 19 bp, Homo sapiens
ttgaattttttttaacatt

SEQ ID NO: 6578190 - DNA, 22 bp, Homo sapiens
ttgaattttttttaacattcct

SEQ ID NO: 6578191 - DNA, 11 bp, Homo sapiens
ttgacaaaaaa

SEQ ID NO: 6578192 - DNA, 13 bp, Homo sapiens
ttgacaaaaatgt

SEQ ID NO: 6578193 - DNA, 15 bp, Homo sapiens
ttgacaaaagtaaat

SEQ ID NO: 6578194 - DNA, 17 bp, Homo sapiens
ttgacaaaagtaaatgg

SEQ ID NO: 6578195 - DNA, 19 bp, Homo sapiens
ttgacaaaataacatttga

SEQ ID NO: 6578196 - DNA, 21 bp, Homo sapiens
ttgacaaaatgactggctcct

SEQ ID NO: 6578197 - DNA, 14 bp, Homo sapiens
ttgacaaaatgtta

SEQ ID NO: 6578198 - DNA, 12 bp, Homo sapiens
ttgacaaaattt

SEQ ID NO: 6578199 - DNA, 18 bp, Homo sapiens
ttgacaaaattttctcat

SEQ ID NO: 6578200 - DNA, 20 bp, Homo sapiens
ttgacaaacttctttcactc

SEQ ID NO: 6578201 - DNA, 18 bp, Homo sapiens
ttgacaaaggcaagcact

SEQ ID NO: 6578202 - DNA, 19 bp, Homo sapiens
ttgacaaagtcaagccaca

SEQ ID NO: 6578203 - DNA, 20 bp, Homo sapiens
ttgacaaatgacagatcttt

SEQ ID NO: 6578204 - DNA, 13 bp, Homo sapiens
ttgacaacatctg

SEQ ID NO: 6578205 - DNA, 17 bp, Homo sapiens
ttgacaacatggcttct

SEQ ID NO: 6578206 - DNA, 16 bp, Homo sapiens
ttgacaacattttatt

SEQ ID NO: 6578207 - DNA, 18 bp, Homo sapiens
ttgacaacctagaatgtc

SEQ ID NO: 6578208 - DNA, 18 bp, Homo sapiens
ttgacaactggcaggcag

SEQ ID NO: 6578209 - DNA, 14 bp, Homo sapiens
ttgacaactgtgac

SEQ ID NO: 6578210 - DNA, 20 bp, Homo sapiens
ttgacaagctgacttggcac

SEQ ID NO: 6578211 - DNA, 22 bp, Homo sapiens
ttgacaagctgacttggcactt

SEQ ID NO: 6578212 - DNA, 16 bp, Homo sapiens
ttgacaagtgtctttt

SEQ ID NO: 6578213 - DNA, 15 bp, Homo sapiens
ttgacaataaaatat

SEQ ID NO: 6578214 - DNA, 19 bp, Homo sapiens
ttgacaataaaatattatt

SEQ ID NO: 6578215 - DNA, 14 bp, Homo sapiens
ttgacaataagaaa

SEQ ID NO: 6578216 - DNA, 20 bp, Homo sapiens
ttgacaataagaaacagttt

SEQ ID NO: 6578217 - DNA, 18 bp, Homo sapiens
ttgacaataatttcaggt

SEQ ID NO: 6578218 - DNA, 13 bp, Homo sapiens
ttgacaatgacaa

SEQ ID NO: 6578219 - DNA, 19 bp, Homo sapiens
ttgacaattactcaggttt

SEQ ID NO: 6578220 - DNA, 15 bp, Homo sapiens
ttgacaattctgggt

SEQ ID NO: 6578221 - DNA, 13 bp, Homo sapiens
ttgacaattttgt

SEQ ID NO: 6578222 - DNA, 14 bp, Homo sapiens
ttgacacaagtgga

SEQ ID NO: 6578223 - DNA, 17 bp, Homo sapiens
ttgacacaagtggacct

SEQ ID NO: 6578224 - DNA, 18 bp, Homo sapiens
ttgacacaagtggacctt

SEQ ID NO: 6578225 - DNA, 16 bp, Homo sapiens
ttgacacacagaaatg

SEQ ID NO: 6578226 - DNA, 16 bp, Homo sapiens
ttgacacacagcactc

SEQ ID NO: 6578227 - DNA, 17 bp, Homo sapiens
ttgacacaccagttttg

SEQ ID NO: 6578228 - DNA, 16 bp, Homo sapiens
ttgacacagaaaatgt

SEQ ID NO: 6578229 - DNA, 13 bp, Homo sapiens
ttgacacaggtct

SEQ ID NO: 6578230 - DNA, 22 bp, Homo sapiens
ttgacacaggtctttcctaagg

SEQ ID NO: 6578231 - DNA, 20 bp, Homo sapiens
ttgacacatccgccttttgt

SEQ ID NO: 6578232 - DNA, 19 bp, Homo sapiens
ttgacaccattctcctgcc

SEQ ID NO: 6578233 - DNA, 17 bp, Homo sapiens
ttgacactaagaaaata

SEQ ID NO: 6578234 - DNA, 18 bp, Homo sapiens
ttgacactatatctgtat

SEQ ID NO: 6578235 - DNA, 17 bp, Homo sapiens
ttgacactctgcagact

SEQ ID NO: 6578236 - DNA, 12 bp, Homo sapiens
ttgacactgaaa

SEQ ID NO: 6578237 - DNA, 17 bp, Homo sapiens
ttgacactgaaagtttt

SEQ ID NO: 6578238 - DNA, 22 bp, Homo sapiens
ttgacactgaaagttttgtaaa

SEQ ID NO: 6578239 - DNA, 22 bp, Homo sapiens
ttgacactgaacttaataactg

SEQ ID NO: 6578240 - DNA, 15 bp, Homo sapiens
ttgacactgctctaa

SEQ ID NO: 6578241 - DNA, 16 bp, Homo sapiens
ttgacactgctctaac

SEQ ID NO: 6578242 - DNA, 18 bp, Homo sapiens
ttgacactggaatgagtt

SEQ ID NO: 6578243 - DNA, 19 bp, Homo sapiens
ttgacactggtatcttatt

SEQ ID NO: 6578244 - DNA, 14 bp, Homo sapiens
ttgacactttttgt

SEQ ID NO: 6578245 - DNA, 15 bp, Homo sapiens
ttgacagaacactgt

SEQ ID NO: 6578246 - DNA, 20 bp, Homo sapiens
ttgacagatactttgtattt

SEQ ID NO: 6578247 - DNA, 18 bp, Homo sapiens
ttgacagatcaagctgtg

SEQ ID NO: 6578248 - DNA, 16 bp, Homo sapiens
ttgacagcaaaatgtt

SEQ ID NO: 6578249 - DNA, 13 bp, Homo sapiens
ttgacagcaattc

SEQ ID NO: 6578250 - DNA, 12 bp, Homo sapiens
ttgacagcatga

SEQ ID NO: 6578251 - DNA, 12 bp, Homo sapiens
ttgacagccttc

SEQ ID NO: 6578252 - DNA, 17 bp, Homo sapiens
ttgacaggggctcagga

SEQ ID NO: 6578253 - DNA, 20 bp, Homo sapiens
ttgacaggttttccaaaagt

SEQ ID NO: 6578254 - DNA, 19 bp, Homo sapiens
ttgacagtaacttggttat

SEQ ID NO: 6578255 - DNA, 22 bp, Homo sapiens
ttgacagtaacttggttataca

SEQ ID NO: 6578256 - DNA, 23 bp, Homo sapiens
ttgacagtaacttggttatacat

SEQ ID NO: 6578257 - DNA, 12 bp, Homo sapiens
ttgacagtctga

SEQ ID NO: 6578258 - DNA, 13 bp, Homo sapiens
ttgacagttactt

SEQ ID NO: 6578259 - DNA, 17 bp, Homo sapiens
ttgacagttctgaagaa

SEQ ID NO: 6578260 - DNA, 18 bp, Homo sapiens
ttgacagttctgaagaat

SEQ ID NO: 6578261 - DNA, 19 bp, Homo sapiens
ttgacataaagttgataaa

SEQ ID NO: 6578262 - DNA, 19 bp, Homo sapiens
ttgacataactatcttttt

SEQ ID NO: 6578263 - DNA, 20 bp, Homo sapiens
ttgacatacctaccagtatt

SEQ ID NO: 6578264 - DNA, 12 bp, Homo sapiens
ttgacatagcct

SEQ ID NO: 6578265 - DNA, 14 bp, Homo sapiens
ttgacatagccttt

SEQ ID NO: 6578266 - DNA, 15 bp, Homo sapiens
ttgacatagcctttg

SEQ ID NO: 6578267 - DNA, 20 bp, Homo sapiens
ttgacataggtcataaagca

SEQ ID NO: 6578268 - DNA, 21 bp, Homo sapiens
ttgacataggtcataaagcat

SEQ ID NO: 6578269 - DNA, 23 bp, Homo sapiens
ttgacataggtcataaagcattg

SEQ ID NO: 6578270 - DNA, 14 bp, Homo sapiens
ttgacatagtctgg

SEQ ID NO: 6578271 - DNA, 17 bp, Homo sapiens
ttgacatatttaatgtt

SEQ ID NO: 6578272 - DNA, 16 bp, Homo sapiens
ttgacatcagccagct

SEQ ID NO: 6578273 - DNA, 16 bp, Homo sapiens
ttgacatcatgtaaac

SEQ ID NO: 6578274 - DNA, 17 bp, Homo sapiens
ttgacatgaccctctgt

SEQ ID NO: 6578275 - DNA, 22 bp, Homo sapiens
ttgacatgacgtggtaaaatgt

SEQ ID NO: 6578276 - DNA, 18 bp, Homo sapiens
ttgacatgagtctccaga

SEQ ID NO: 6578277 - DNA, 16 bp, Homo sapiens
ttgacatggaaatgaa

SEQ ID NO: 6578278 - DNA, 11 bp, Homo sapiens
ttgacatgtga

SEQ ID NO: 6578279 - DNA, 15 bp, Homo sapiens
ttgacattatagaca

SEQ ID NO: 6578280 - DNA, 14 bp, Homo sapiens
ttgacattatgttt

SEQ ID NO: 6578281 - DNA, 13 bp, Homo sapiens
ttgacattctcta

SEQ ID NO: 6578282 - DNA, 19 bp, Homo sapiens
ttgacattctctattgtaa

SEQ ID NO: 6578283 - DNA, 16 bp, Homo sapiens
ttgacattctgaatgc

SEQ ID NO: 6578284 - DNA, 14 bp, Homo sapiens
ttgacattgaaatc

SEQ ID NO: 6578285 - DNA, 23 bp, Homo sapiens
ttgacattgaaatctaggaaaat

SEQ ID NO: 6578286 - DNA, 14 bp, Homo sapiens
ttgacattgcgttt

SEQ ID NO: 6578287 - DNA, 18 bp, Homo sapiens
ttgacattgcgtttgacc

SEQ ID NO: 6578288 - DNA, 21 bp, Homo sapiens
ttgacattgtatgtatctatt

SEQ ID NO: 6578289 - DNA, 20 bp, Homo sapiens
ttgacattgtcagaatgttg

SEQ ID NO: 6578290 - DNA, 13 bp, Homo sapiens
ttgacatttaata

SEQ ID NO: 6578291 - DNA, 18 bp, Homo sapiens
ttgacatttacaggaggg

SEQ ID NO: 6578292 - DNA, 17 bp, Homo sapiens
ttgacatttagaacttt

SEQ ID NO: 6578293 - DNA, 22 bp, Homo sapiens
aagtcaatattgattttaaata

SEQ ID NO: 6578294 - DNA, 21 bp, Homo sapiens
aagtcaatctatcttcagttt

SEQ ID NO: 6578295 - DNA, 14 bp, Homo sapiens
aagtcaatgtactt

SEQ ID NO: 6578296 - DNA, 18 bp, Homo sapiens
aagtcacaatgttcttta

SEQ ID NO: 6578297 - DNA, 14 bp, Homo sapiens
aagtcacacagaca

SEQ ID NO: 6578298 - DNA, 16 bp, Homo sapiens
aagtcacacagacaca

SEQ ID NO: 6578299 - DNA, 14 bp, Homo sapiens
aagtcacacagcta

SEQ ID NO: 6578300 - DNA, 19 bp, Homo sapiens
aagtcacagctgcagctgg

SEQ ID NO: 6578301 - DNA, 17 bp, Homo sapiens
aagtcacatataaaagt

SEQ ID NO: 6578302 - DNA, 16 bp, Homo sapiens
aagtcacatcacagga

SEQ ID NO: 6578303 - DNA, 22 bp, Homo sapiens
aagtcacattccacatctgttt

SEQ ID NO: 6578304 - DNA, 20 bp, Homo sapiens
aagtcacattcctgaacagg

SEQ ID NO: 6578305 - DNA, 16 bp, Homo sapiens
aagtcaccaaatagtg

SEQ ID NO: 6578306 - DNA, 19 bp, Homo sapiens
aagtcaccactccattccc

SEQ ID NO: 6578307 - DNA, 23 bp, Homo sapiens
aagtcacccaaacacttctgctt

SEQ ID NO: 6578308 - DNA, 19 bp, Homo sapiens
aagtcacccagagcacagg

SEQ ID NO: 6578309 - DNA, 16 bp, Homo sapiens
aagtcacccggccccc

SEQ ID NO: 6578310 - DNA, 16 bp, Homo sapiens
aagtcaccctagccct

SEQ ID NO: 6578311 - DNA, 22 bp, Homo sapiens
aagtcaccctagccctctccct

SEQ ID NO: 6578312 - DNA, 23 bp, Homo sapiens
aagtcaccctagccctctccctc

SEQ ID NO: 6578313 - DNA, 21 bp, Homo sapiens
aagtcaccttagggtggcttt

SEQ ID NO: 6578314 - DNA, 18 bp, Homo sapiens
aagtcacgtcatttgttt

SEQ ID NO: 6578315 - DNA, 19 bp, Homo sapiens
aagtcactaaatttctcag

SEQ ID NO: 6578316 - DNA, 16 bp, Homo sapiens
aagtcactgaacaaaa

SEQ ID NO: 6578317 - DNA, 15 bp, Homo sapiens
aagtcacttccagtg

SEQ ID NO: 6578318 - DNA, 15 bp, Homo sapiens
aagtcacttctccat

SEQ ID NO: 6578319 - DNA, 13 bp, Homo sapiens
aagtcagaagttt

SEQ ID NO: 6578320 - DNA, 18 bp, Homo sapiens
aagtcagaatcagaagat

SEQ ID NO: 6578321 - DNA, 19 bp, Homo sapiens
aagtcagaatttttaactg

SEQ ID NO: 6578322 - DNA, 12 bp, Homo sapiens
aagtcagacaga

SEQ ID NO: 6578323 - DNA, 20 bp, Homo sapiens
aagtcagacagatgtcagct

SEQ ID NO: 6578324 - DNA, 17 bp, Homo sapiens
aagtcagactgctggga

SEQ ID NO: 6578325 - DNA, 16 bp, Homo sapiens
aagtcagagaaaacac

SEQ ID NO: 6578326 - DNA, 15 bp, Homo sapiens
aagtcagagacagat

SEQ ID NO: 6578327 - DNA, 12 bp, Homo sapiens
aagtcagagctc

SEQ ID NO: 6578328 - DNA, 22 bp, Homo sapiens
aagtcagaggatggccagtgtc

SEQ ID NO: 6578329 - DNA, 13 bp, Homo sapiens
aagtcagatgtgg

SEQ ID NO: 6578330 - DNA, 15 bp, Homo sapiens
aagtcagcatatgag

SEQ ID NO: 6578331 - DNA, 21 bp, Homo sapiens
aagtcagccacactgggcctg

SEQ ID NO: 6578332 - DNA, 20 bp, Homo sapiens
aagtcagcgggcccaggcct

SEQ ID NO: 6578333 - DNA, 22 bp, Homo sapiens
aagtcagctaattggactttta

SEQ ID NO: 6578334 - DNA, 22 bp, Homo sapiens
aagtcagctactctagttctgt

SEQ ID NO: 6578335 - DNA, 20 bp, Homo sapiens
aagtcagctttcagagccag

SEQ ID NO: 6578336 - DNA, 16 bp, Homo sapiens
aagtcaggacagcttg

SEQ ID NO: 6578337 - DNA, 18 bp, Homo sapiens
aagtcaggacctggcttg

SEQ ID NO: 6578338 - DNA, 12 bp, Homo sapiens
aagtcaggagcc

SEQ ID NO: 6578339 - DNA, 17 bp, Homo sapiens
aagtcaggagccagcag

SEQ ID NO: 6578340 - DNA, 18 bp, Homo sapiens
aagtcaggagccagcagg

SEQ ID NO: 6578341 - DNA, 15 bp, Homo sapiens
aagtcaggccaggtg

SEQ ID NO: 6578342 - DNA, 17 bp, Homo sapiens
aagtcagtacgatcaag

SEQ ID NO: 6578343 - DNA, 15 bp, Homo sapiens
aagtcagtaggagag

SEQ ID NO: 6578344 - DNA, 16 bp, Homo sapiens
aagtcagtaggagagg

SEQ ID NO: 6578345 - DNA, 18 bp, Homo sapiens
aagtcagtcaacatttac

SEQ ID NO: 6578346 - DNA, 21 bp, Homo sapiens
aagtcagtgtagacctgagct

SEQ ID NO: 6578347 - DNA, 22 bp, Homo sapiens
aagtcagttgctcaaaaagaaa

SEQ ID NO: 6578348 - DNA, 16 bp, Homo sapiens
aagtcataatgaataa

SEQ ID NO: 6578349 - DNA, 17 bp, Homo sapiens
aagtcataatgaataaa

SEQ ID NO: 6578350 - DNA, 21 bp, Homo sapiens
aagtcatacctttttcttaaa

SEQ ID NO: 6578351 - DNA, 19 bp, Homo sapiens
aagtcatagtttttttctt

SEQ ID NO: 6578352 - DNA, 15 bp, Homo sapiens
aagtcatcatctcca

SEQ ID NO: 6578353 - DNA, 17 bp, Homo sapiens
aagtcatcatctccaaa

SEQ ID NO: 6578354 - DNA, 15 bp, Homo sapiens
aagtcatccaatcta

SEQ ID NO: 6578355 - DNA, 12 bp, Homo sapiens
aagtcatccaca

SEQ ID NO: 6578356 - DNA, 16 bp, Homo sapiens
aagtcatccagtgaaa

SEQ ID NO: 6578357 - DNA, 20 bp, Homo sapiens
aagtcatcccctctcaggag

SEQ ID NO: 6578358 - DNA, 21 bp, Homo sapiens
aagtcatctgtttaatttaca

SEQ ID NO: 6578359 - DNA, 23 bp, Homo sapiens
aagtcatcttagctttccacagg

SEQ ID NO: 6578360 - DNA, 23 bp, Homo sapiens
aagtcatcttgctaccagtattt

SEQ ID NO: 6578361 - DNA, 14 bp, Homo sapiens
aagtcatgaacaca

SEQ ID NO: 6578362 - DNA, 11 bp, Homo sapiens
aagtcatgagc

SEQ ID NO: 6578363 - DNA, 18 bp, Homo sapiens
aagtcatgatgtttttaa

SEQ ID NO: 6578364 - DNA, 19 bp, Homo sapiens
aagtcatgatgtttttaaa

SEQ ID NO: 6578365 - DNA, 22 bp, Homo sapiens
aagtcatgatgtttttaaaatc

SEQ ID NO: 6578366 - DNA, 21 bp, Homo sapiens
aagtcatgctcccctgtgcca

SEQ ID NO: 6578367 - DNA, 14 bp, Homo sapiens
aagtcatggcccaa

SEQ ID NO: 6578368 - DNA, 17 bp, Homo sapiens
aagtcatgggaacgcag

SEQ ID NO: 6578369 - DNA, 16 bp, Homo sapiens
aagtcatggtcacagt

SEQ ID NO: 6578370 - DNA, 19 bp, Homo sapiens
aagtcatggtcacagtaaa

SEQ ID NO: 6578371 - DNA, 18 bp, Homo sapiens
aagtcatggtcctggctg

SEQ ID NO: 6578372 - DNA, 17 bp, Homo sapiens
aagtcatgtaaatactg

SEQ ID NO: 6578373 - DNA, 16 bp, Homo sapiens
aagtcatgtatgtttc

SEQ ID NO: 6578374 - DNA, 22 bp, Homo sapiens
aagtcatgtcagaaggagacag

SEQ ID NO: 6578375 - DNA, 15 bp, Homo sapiens
aagtcattaaagaca

SEQ ID NO: 6578376 - DNA, 19 bp, Homo sapiens
aagtcattccacacatttc

SEQ ID NO: 6578377 - DNA, 13 bp, Homo sapiens
aagtcattcctaa

SEQ ID NO: 6578378 - DNA, 21 bp, Homo sapiens
aagtcattcctaatcttggtc

SEQ ID NO: 6578379 - DNA, 19 bp, Homo sapiens
aagtcattccttcttttta

SEQ ID NO: 6578380 - DNA, 17 bp, Homo sapiens
aagtcattgagtgactt

SEQ ID NO: 6578381 - DNA, 13 bp, Homo sapiens
aagtcattggctt

SEQ ID NO: 6578382 - DNA, 20 bp, Homo sapiens
aagtcattggctttatcctc

SEQ ID NO: 6578383 - DNA, 16 bp, Homo sapiens
aagtcatttttgtatt

SEQ ID NO: 6578384 - DNA, 20 bp, Homo sapiens
aagtcatttttgtatttttc

SEQ ID NO: 6578385 - DNA, 22 bp, Homo sapiens
aagtcatttttgtatttttcat

SEQ ID NO: 6578386 - DNA, 14 bp, Homo sapiens
aagtcattttttac

SEQ ID NO: 6578387 - DNA, 18 bp, Homo sapiens
aagtcattttttacttga

SEQ ID NO: 6578388 - DNA, 21 bp, Homo sapiens
aagtccaaatgtttacaggga

SEQ ID NO: 6578389 - DNA, 16 bp, Homo sapiens
aagtccaacctgcctg

SEQ ID NO: 6578390 - DNA, 19 bp, Homo sapiens
aagtccaacctgcctgtgc

SEQ ID NO: 6578391 - DNA, 13 bp, Homo sapiens
aagtccaactaca

SEQ ID NO: 6578392 - DNA, 16 bp, Homo sapiens
aagtccaactactaaa

SEQ ID NO: 6578393 - DNA, 20 bp, Homo sapiens
aagtccaagccgtaggaccc

SEQ ID NO: 6578394 - DNA, 18 bp, Homo sapiens
aagtccaattttaattta

SEQ ID NO: 6578395 - DNA, 19 bp, Homo sapiens
aagtccaattttaatttag

SEQ ID NO: 6578396 - DNA, 14 bp, Homo sapiens
aagtccacagtgga

SEQ ID NO: 6578397 - DNA, 13 bp, Homo sapiens
aagtccactgtcc

SEQ ID NO: 6578398 - DNA, 19 bp, Homo sapiens
aagtccagatttacactgg

SEQ ID NO: 6578399 - DNA, 21 bp, Homo sapiens
aagtccagctctcccctgcgc

SEQ ID NO: 6578400 - DNA, 14 bp, Homo sapiens
aagtccaggactgg

SEQ ID NO: 6578401 - DNA, 21 bp, Homo sapiens
aagtccaggtcgggctcagct

SEQ ID NO: 6578402 - DNA, 20 bp, Homo sapiens
aagtccagtccagtcctatc

SEQ ID NO: 6578403 - DNA, 21 bp, Homo sapiens
aagtccagtgaccctggagct

SEQ ID NO: 6578404 - DNA, 23 bp, Homo sapiens
aagtccagtgtttccacggctgg

SEQ ID NO: 6578405 - DNA, 20 bp, Homo sapiens
aagtccatagctgagctgga

SEQ ID NO: 6578406 - DNA, 15 bp, Homo sapiens
aagtccatgaatgtt

SEQ ID NO: 6578407 - DNA, 17 bp, Homo sapiens
aagtccatgaatgttca

SEQ ID NO: 6578408 - DNA, 20 bp, Homo sapiens
aagtccatgaatgttcatat

SEQ ID NO: 6578409 - DNA, 14 bp, Homo sapiens
aagtccatgtgata

SEQ ID NO: 6578410 - DNA, 23 bp, Homo sapiens
aagtccattatgtaatagtgaca

SEQ ID NO: 6578411 - DNA, 21 bp, Homo sapiens
aagtcccaaattcattgactt

SEQ ID NO: 6578412 - DNA, 15 bp, Homo sapiens
aagtcccatcataga

SEQ ID NO: 6578413 - DNA, 20 bp, Homo sapiens
aagtccccagcccctcaacc

SEQ ID NO: 6578414 - DNA, 14 bp, Homo sapiens
aagtccccaggccc

SEQ ID NO: 6578415 - DNA, 18 bp, Homo sapiens
aagtccccaggccccagg

SEQ ID NO: 6578416 - DNA, 23 bp, Homo sapiens
aagtccccaggccccaggaagcc

SEQ ID NO: 6578417 - DNA, 23 bp, Homo sapiens
aagtcccccctcgccccaaagtt

SEQ ID NO: 6578418 - DNA, 18 bp, Homo sapiens
aagtccccctcctcagcc

SEQ ID NO: 6578419 - DNA, 19 bp, Homo sapiens
aagtccccctcctcagcca

SEQ ID NO: 6578420 - DNA, 22 bp, Homo sapiens
aagtccccgagggcgaaggcca

SEQ ID NO: 6578421 - DNA, 21 bp, Homo sapiens
aagtcccctctcctccacatt

SEQ ID NO: 6578422 - DNA, 21 bp, Homo sapiens
aagtccccttctgtgtttctg

SEQ ID NO: 6578423 - DNA, 16 bp, Homo sapiens
aagtcccgaggcagca

SEQ ID NO: 6578424 - DNA, 20 bp, Homo sapiens
aagtcccgccctggctcttt

SEQ ID NO: 6578425 - DNA, 20 bp, Homo sapiens
aagtccctataataaaggct

SEQ ID NO: 6578426 - DNA, 13 bp, Homo sapiens
aagtccctcagag

SEQ ID NO: 6578427 - DNA, 13 bp, Homo sapiens
aagtccctgcccc

SEQ ID NO: 6578428 - DNA, 14 bp, Homo sapiens
aagtccctgccccc

SEQ ID NO: 6578429 - DNA, 21 bp, Homo sapiens
aagtccctgttctcagctccg

SEQ ID NO: 6578430 - DNA, 18 bp, Homo sapiens
aagtccgcagaagccctg

SEQ ID NO: 6578431 - DNA, 19 bp, Homo sapiens
aagtccgcagaagccctga

SEQ ID NO: 6578432 - DNA, 15 bp, Homo sapiens
aagtcctaaaagttc

SEQ ID NO: 6578433 - DNA, 14 bp, Homo sapiens
aagtcctaaagtga

SEQ ID NO: 6578434 - DNA, 20 bp, Homo sapiens
aagtcctaacttcctgtgcc

SEQ ID NO: 6578435 - DNA, 19 bp, Homo sapiens
aagtcctccctcctgcagg

SEQ ID NO: 6578436 - DNA, 19 bp, Homo sapiens
aagtcctccctctctactg

SEQ ID NO: 6578437 - DNA, 19 bp, Homo sapiens
aagtcctcgccccccgccc

SEQ ID NO: 6578438 - DNA, 18 bp, Homo sapiens
aagtcctctaaacacact

SEQ ID NO: 6578439 - DNA, 17 bp, Homo sapiens
aagtcctctgctccagc

SEQ ID NO: 6578440 - DNA, 19 bp, Homo sapiens
aagtcctctgctccagcaa

SEQ ID NO: 6578441 - DNA, 23 bp, Homo sapiens
aagtcctgaagaggcgggccagc

SEQ ID NO: 6578442 - DNA, 17 bp, Homo sapiens
aagtcctgactgggctg

SEQ ID NO: 6578443 - DNA, 15 bp, Homo sapiens
aagtcctgcctttgg

SEQ ID NO: 6578444 - DNA, 12 bp, Homo sapiens
aagtcctgcttt

SEQ ID NO: 6578445 - DNA, 12 bp, Homo sapiens
aagtcctggcta

SEQ ID NO: 6578446 - DNA, 15 bp, Homo sapiens
aagtcctggctacat

SEQ ID NO: 6578447 - DNA, 19 bp, Homo sapiens
aagtcctggctacatccca

SEQ ID NO: 6578448 - DNA, 23 bp, Homo sapiens
aagtcctggctacatcccagcct

SEQ ID NO: 6578449 - DNA, 17 bp, Homo sapiens
aagtcctggcttcaggc

SEQ ID NO: 6578450 - DNA, 20 bp, Homo sapiens
aagtcctgggaggatcctga

SEQ ID NO: 6578451 - DNA, 20 bp, Homo sapiens
aagtcctgtatgtctgtcat

SEQ ID NO: 6578452 - DNA, 18 bp, Homo sapiens
aagtcctgtcagttcaga

SEQ ID NO: 6578453 - DNA, 21 bp, Homo sapiens
aagtccttaaccgtggactct

SEQ ID NO: 6578454 - DNA, 16 bp, Homo sapiens
aagtccttaagcagag

SEQ ID NO: 6578455 - DNA, 20 bp, Homo sapiens
aagtccttcagtgagcccct

SEQ ID NO: 6578456 - DNA, 14 bp, Homo sapiens
aagtccttcagttt

SEQ ID NO: 6578457 - DNA, 20 bp, Homo sapiens
aagtccttgacctctataaa

SEQ ID NO: 6578458 - DNA, 15 bp, Homo sapiens
aagtccttggactgt

SEQ ID NO: 6578459 - DNA, 22 bp, Homo sapiens
aagtccttggactgttttgaaa

SEQ ID NO: 6578460 - DNA, 22 bp, Homo sapiens
aagtccttggcttgccattttt

SEQ ID NO: 6578461 - DNA, 16 bp, Homo sapiens
aagtccttttgtaaag

SEQ ID NO: 6578462 - DNA, 22 bp, Homo sapiens
aagtcgcttttggtgcctggct

SEQ ID NO: 6578463 - DNA, 23 bp, Homo sapiens
aagtcgcttttggtgcctggctg

SEQ ID NO: 6578464 - DNA, 18 bp, Homo sapiens
aagtcggggcctgggaca

SEQ ID NO: 6578465 - DNA, 21 bp, Homo sapiens
aagtcgggtcaaaaataaaat

SEQ ID NO: 6578466 - DNA, 21 bp, Homo sapiens
aagtcgtccttactcctgtgg

SEQ ID NO: 6578467 - DNA, 23 bp, Homo sapiens
aagtctaaacaaaattgcaattt

SEQ ID NO: 6578468 - DNA, 13 bp, Homo sapiens
aagtctaaagttt

SEQ ID NO: 6578469 - DNA, 16 bp, Homo sapiens
ttgacatttagtagaa

SEQ ID NO: 6578470 - DNA, 15 bp, Homo sapiens
ttgacatttatatta

SEQ ID NO: 6578471 - DNA, 23 bp, Homo sapiens
ttgacattttctttttaaatttt

SEQ ID NO: 6578472 - DNA, 16 bp, Homo sapiens
ttgacattttgtagct

SEQ ID NO: 6578473 - DNA, 14 bp, Homo sapiens
ttgaccaaactgtg

SEQ ID NO: 6578474 - DNA, 14 bp, Homo sapiens
ttgaccaagaactg

SEQ ID NO: 6578475 - DNA, 18 bp, Homo sapiens
ttgaccaagaactgcatg

SEQ ID NO: 6578476 - DNA, 13 bp, Homo sapiens
ttgaccaatttgc

SEQ ID NO: 6578477 - DNA, 14 bp, Homo sapiens
ttgaccaatttgca

SEQ ID NO: 6578478 - DNA, 22 bp, Homo sapiens
ttgaccaatttgcaccagtttt

SEQ ID NO: 6578479 - DNA, 21 bp, Homo sapiens
ttgaccaccagttaacgtatt

SEQ ID NO: 6578480 - DNA, 13 bp, Homo sapiens
ttgaccactccag

SEQ ID NO: 6578481 - DNA, 23 bp, Homo sapiens
ttgaccactgtctttttcttacc

SEQ ID NO: 6578482 - DNA, 19 bp, Homo sapiens
ttgaccagaactttttcct

SEQ ID NO: 6578483 - DNA, 15 bp, Homo sapiens
ttgaccagacctaga

SEQ ID NO: 6578484 - DNA, 22 bp, Homo sapiens
ttgaccagacctagacctgggc

SEQ ID NO: 6578485 - DNA, 23 bp, Homo sapiens
ttgaccagacctagacctgggcc

SEQ ID NO: 6578486 - DNA, 22 bp, Homo sapiens
ttgaccagataaatagaactat

SEQ ID NO: 6578487 - DNA, 19 bp, Homo sapiens
ttgaccagatctttctctt

SEQ ID NO: 6578488 - DNA, 22 bp, Homo sapiens
ttgaccagatctttctcttccc

SEQ ID NO: 6578489 - DNA, 22 bp, Homo sapiens
ttgaccagcagatcccagctca

SEQ ID NO: 6578490 - DNA, 20 bp, Homo sapiens
ttgaccagctctcttcctgt

SEQ ID NO: 6578491 - DNA, 14 bp, Homo sapiens
ttgaccagtttctt

SEQ ID NO: 6578492 - DNA, 18 bp, Homo sapiens
ttgaccattctccacctg

SEQ ID NO: 6578493 - DNA, 19 bp, Homo sapiens
ttgacccaaatgtgtaata

SEQ ID NO: 6578494 - DNA, 20 bp, Homo sapiens
ttgacccactcacacttgga

SEQ ID NO: 6578495 - DNA, 16 bp, Homo sapiens
ttgaccccttcctgtc

SEQ ID NO: 6578496 - DNA, 19 bp, Homo sapiens
ttgacccctttcccccacc

SEQ ID NO: 6578497 - DNA, 14 bp, Homo sapiens
ttgaccctattttt

SEQ ID NO: 6578498 - DNA, 13 bp, Homo sapiens
ttgaccctgaaat

SEQ ID NO: 6578499 - DNA, 21 bp, Homo sapiens
ttgaccctttcctcccccagc

SEQ ID NO: 6578500 - DNA, 18 bp, Homo sapiens
ttgacccttttttgaacc

SEQ ID NO: 6578501 - DNA, 14 bp, Homo sapiens
ttgaccggctgccg

SEQ ID NO: 6578502 - DNA, 16 bp, Homo sapiens
ttgaccgtactctcac

SEQ ID NO: 6578503 - DNA, 18 bp, Homo sapiens
ttgacctaagatttattt

SEQ ID NO: 6578504 - DNA, 18 bp, Homo sapiens
ttgacctcagctgcacat

SEQ ID NO: 6578505 - DNA, 23 bp, Homo sapiens
ttgacctcagctgcacattcctg

SEQ ID NO: 6578506 - DNA, 21 bp, Homo sapiens
ttgacctcaggtgatccaccc

SEQ ID NO: 6578507 - DNA, 15 bp, Homo sapiens
ttgacctcatcatta

SEQ ID NO: 6578508 - DNA, 16 bp, Homo sapiens
ttgacctcatcattaa

SEQ ID NO: 6578509 - DNA, 19 bp, Homo sapiens
ttgacctcctccctgttat

SEQ ID NO: 6578510 - DNA, 17 bp, Homo sapiens
ttgacctctcagggcct

SEQ ID NO: 6578511 - DNA, 14 bp, Homo sapiens
ttgacctctccagc

SEQ ID NO: 6578512 - DNA, 16 bp, Homo sapiens
ttgacctctccagcat

SEQ ID NO: 6578513 - DNA, 16 bp, Homo sapiens
ttgacctctgtgacca

SEQ ID NO: 6578514 - DNA, 19 bp, Homo sapiens
ttgacctctgtgaccaact

SEQ ID NO: 6578515 - DNA, 18 bp, Homo sapiens
ttgacctgaactctgcaa

SEQ ID NO: 6578516 - DNA, 19 bp, Homo sapiens
ttgacctgaggcccttctc

SEQ ID NO: 6578517 - DNA, 22 bp, Homo sapiens
ttgacctgaggcccttctctcc

SEQ ID NO: 6578518 - DNA, 17 bp, Homo sapiens
ttgacctgcattgtaaa

SEQ ID NO: 6578519 - DNA, 14 bp, Homo sapiens
ttgacctgtttcac

SEQ ID NO: 6578520 - DNA, 15 bp, Homo sapiens
ttgaccttatgccat

SEQ ID NO: 6578521 - DNA, 20 bp, Homo sapiens
ttgaccttcatttcatgtat

SEQ ID NO: 6578522 - DNA, 22 bp, Homo sapiens
ttgaccttctgtcgtccccaga

SEQ ID NO: 6578523 - DNA, 23 bp, Homo sapiens
ttgaccttctgtcgtccccagac

SEQ ID NO: 6578524 - DNA, 14 bp, Homo sapiens
ttgaccttgtattg

SEQ ID NO: 6578525 - DNA, 17 bp, Homo sapiens
ttgacctttatttatta

SEQ ID NO: 6578526 - DNA, 22 bp, Homo sapiens
ttgacgacctacatctgaaatc

SEQ ID NO: 6578527 - DNA, 18 bp, Homo sapiens
ttgacgagtcaccttcca

SEQ ID NO: 6578528 - DNA, 14 bp, Homo sapiens
ttgacgccatccca

SEQ ID NO: 6578529 - DNA, 15 bp, Homo sapiens
ttgacgccatcccag

SEQ ID NO: 6578530 - DNA, 18 bp, Homo sapiens
ttgacgccatcccagccc

SEQ ID NO: 6578531 - DNA, 22 bp, Homo sapiens
ttgacgccatcccagccccaat

SEQ ID NO: 6578532 - DNA, 23 bp, Homo sapiens
ttgacgccctgcatcctcctccc

SEQ ID NO: 6578533 - DNA, 17 bp, Homo sapiens
ttgacgggaggcctcag

SEQ ID NO: 6578534 - DNA, 19 bp, Homo sapiens
ttgacgggaggcctcagtt

SEQ ID NO: 6578535 - DNA, 16 bp, Homo sapiens
ttgacgggccaggccc

SEQ ID NO: 6578536 - DNA, 20 bp, Homo sapiens
ttgacggtttatgctgggca

SEQ ID NO: 6578537 - DNA, 20 bp, Homo sapiens
ttgactaaaatgctgctttt

SEQ ID NO: 6578538 - DNA, 15 bp, Homo sapiens
ttgactaaagctatg

SEQ ID NO: 6578539 - DNA, 13 bp, Homo sapiens
ttgactaaataaa

SEQ ID NO: 6578540 - DNA, 15 bp, Homo sapiens
ttgactaaataaaaa

SEQ ID NO: 6578541 - DNA, 20 bp, Homo sapiens
ttgactaactcaaatacaca

SEQ ID NO: 6578542 - DNA, 22 bp, Homo sapiens
ttgactaactcaaatacacatt

SEQ ID NO: 6578543 - DNA, 21 bp, Homo sapiens
ttgactaagaattttgtttta

SEQ ID NO: 6578544 - DNA, 23 bp, Homo sapiens
ttgactagatgatggatgccaat

SEQ ID NO: 6578545 - DNA, 21 bp, Homo sapiens
ttgactagccatctcaagcaa

SEQ ID NO: 6578546 - DNA, 15 bp, Homo sapiens
ttgactataacaaaa

SEQ ID NO: 6578547 - DNA, 13 bp, Homo sapiens
ttgactatcacat

SEQ ID NO: 6578548 - DNA, 17 bp, Homo sapiens
ttgactattacactgcc

SEQ ID NO: 6578549 - DNA, 15 bp, Homo sapiens
ttgactatttataca

SEQ ID NO: 6578550 - DNA, 13 bp, Homo sapiens
ttgactcaagttt

SEQ ID NO: 6578551 - DNA, 14 bp, Homo sapiens
ttgactcagaggct

SEQ ID NO: 6578552 - DNA, 21 bp, Homo sapiens
ttgactcagaggctgggagca

SEQ ID NO: 6578553 - DNA, 13 bp, Homo sapiens
ttgactcaggagc

SEQ ID NO: 6578554 - DNA, 20 bp, Homo sapiens
ttgactcaggagcctgtgac

SEQ ID NO: 6578555 - DNA, 13 bp, Homo sapiens
ttgactcatctta

SEQ ID NO: 6578556 - DNA, 17 bp, Homo sapiens
ttgactcattaatttct

SEQ ID NO: 6578557 - DNA, 16 bp, Homo sapiens
ttgactcccaagtttc

SEQ ID NO: 6578558 - DNA, 19 bp, Homo sapiens
ttgactcccaagtttccat

SEQ ID NO: 6578559 - DNA, 23 bp, Homo sapiens
ttgactccttgtggtttatgtca

SEQ ID NO: 6578560 - DNA, 16 bp, Homo sapiens
ttgactcctttccaat

SEQ ID NO: 6578561 - DNA, 21 bp, Homo sapiens
ttgactcctttggtatttcac

SEQ ID NO: 6578562 - DNA, 18 bp, Homo sapiens
ttgactccttttggaacc

SEQ ID NO: 6578563 - DNA, 14 bp, Homo sapiens
ttgactctaaatgc

SEQ ID NO: 6578564 - DNA, 13 bp, Homo sapiens
ttgactctaatat

SEQ ID NO: 6578565 - DNA, 21 bp, Homo sapiens
ttgactctagtactgtgaatc

SEQ ID NO: 6578566 - DNA, 19 bp, Homo sapiens
ttgactctggcaaagcttt

SEQ ID NO: 6578567 - DNA, 12 bp, Homo sapiens
ttgactctgggg

SEQ ID NO: 6578568 - DNA, 12 bp, Homo sapiens
ttgactctgggt

SEQ ID NO: 6578569 - DNA, 13 bp, Homo sapiens
ttgactctgggtc

SEQ ID NO: 6578570 - DNA, 18 bp, Homo sapiens
ttgactcttatttataga

SEQ ID NO: 6578571 - DNA, 14 bp, Homo sapiens
ttgactctttcaaa

SEQ ID NO: 6578572 - DNA, 15 bp, Homo sapiens
ttgactcttttgcca

SEQ ID NO: 6578573 - DNA, 21 bp, Homo sapiens
ttgactcttttgccattaaac

SEQ ID NO: 6578574 - DNA, 15 bp, Homo sapiens
ttgactgaaattact

SEQ ID NO: 6578575 - DNA, 20 bp, Homo sapiens
ttgactgaagatgcagctca

SEQ ID NO: 6578576 - DNA, 15 bp, Homo sapiens
ttgactgaagcacag

SEQ ID NO: 6578577 - DNA, 20 bp, Homo sapiens
ttgactgaagcgaacatctt

SEQ ID NO: 6578578 - DNA, 23 bp, Homo sapiens
ttgactgccctcttactgttttg

SEQ ID NO: 6578579 - DNA, 15 bp, Homo sapiens
ttgactgctgctccc

SEQ ID NO: 6578580 - DNA, 18 bp, Homo sapiens
ttgactgcttctctgcag

SEQ ID NO: 6578581 - DNA, 19 bp, Homo sapiens
ttgactggctgtgtgacct

SEQ ID NO: 6578582 - DNA, 12 bp, Homo sapiens
ttgactggcttg

SEQ ID NO: 6578583 - DNA, 11 bp, Homo sapiens
ttgactgtaat

SEQ ID NO: 6578584 - DNA, 13 bp, Homo sapiens
ttgactgtacaga

SEQ ID NO: 6578585 - DNA, 21 bp, Homo sapiens
ttgactgtctagccactccct

SEQ ID NO: 6578586 - DNA, 17 bp, Homo sapiens
ttgactgtctttcctat

SEQ ID NO: 6578587 - DNA, 17 bp, Homo sapiens
ttgactgtgctggagaa

SEQ ID NO: 6578588 - DNA, 10 bp, Homo sapiens
ttgactgtta

SEQ ID NO: 6578589 - DNA, 15 bp, Homo sapiens
ttgactgttatctcg

SEQ ID NO: 6578590 - DNA, 20 bp, Homo sapiens
ttgactgttatttgttgaga

SEQ ID NO: 6578591 - DNA, 12 bp, Homo sapiens
ttgactgttttt

SEQ ID NO: 6578592 - DNA, 23 bp, Homo sapiens
ttgactgtttttacccatatccc

SEQ ID NO: 6578593 - DNA, 17 bp, Homo sapiens
ttgacttagatattaaa

SEQ ID NO: 6578594 - DNA, 20 bp, Homo sapiens
ttgacttaggtgtgaagacc

SEQ ID NO: 6578595 - DNA, 15 bp, Homo sapiens
ttgacttattttctc

SEQ ID NO: 6578596 - DNA, 21 bp, Homo sapiens
ttgacttcagaaactttttct

SEQ ID NO: 6578597 - DNA, 16 bp, Homo sapiens
ttgacttctatcctgt

SEQ ID NO: 6578598 - DNA, 20 bp, Homo sapiens
ttgacttctatcctgttaac

SEQ ID NO: 6578599 - DNA, 14 bp, Homo sapiens
ttgacttctcttga

SEQ ID NO: 6578600 - DNA, 21 bp, Homo sapiens
ttgacttcttgcttcagtcat

SEQ ID NO: 6578601 - DNA, 22 bp, Homo sapiens
ttgacttcttggtgctgttgaa

SEQ ID NO: 6578602 - DNA, 14 bp, Homo sapiens
ttgacttcttggtt

SEQ ID NO: 6578603 - DNA, 20 bp, Homo sapiens
ttgacttgacagaacactgt

SEQ ID NO: 6578604 - DNA, 21 bp, Homo sapiens
ttgacttgacagaacactgtc

SEQ ID NO: 6578605 - DNA, 17 bp, Homo sapiens
ttgacttgccactgcca

SEQ ID NO: 6578606 - DNA, 18 bp, Homo sapiens
ttgacttgccactgccat

SEQ ID NO: 6578607 - DNA, 22 bp, Homo sapiens
ttgacttgtataacatcactgt

SEQ ID NO: 6578608 - DNA, 13 bp, Homo sapiens
ttgactttaattt

SEQ ID NO: 6578609 - DNA, 23 bp, Homo sapiens
ttgactttacgcccatctcagga

SEQ ID NO: 6578610 - DNA, 15 bp, Homo sapiens
ttgactttagtgaaa

SEQ ID NO: 6578611 - DNA, 16 bp, Homo sapiens
ttgactttcaaaatat

SEQ ID NO: 6578612 - DNA, 12 bp, Homo sapiens
ttgactttcagg

SEQ ID NO: 6578613 - DNA, 15 bp, Homo sapiens
ttgactttcaggtac

SEQ ID NO: 6578614 - DNA, 14 bp, Homo sapiens
ttgactttccagaa

SEQ ID NO: 6578615 - DNA, 15 bp, Homo sapiens
ttgactttcttaaaa

SEQ ID NO: 6578616 - DNA, 11 bp, Homo sapiens
ttgactttgtc

SEQ ID NO: 6578617 - DNA, 20 bp, Homo sapiens
ttgacttttataaagcatgt

SEQ ID NO: 6578618 - DNA, 17 bp, Homo sapiens
ttgactttttttgtatg

SEQ ID NO: 6578619 - DNA, 11 bp, Homo sapiens
ttgagaaaaat

SEQ ID NO: 6578620 - DNA, 23 bp, Homo sapiens
ttgagaaaaatagagcaaaatca

SEQ ID NO: 6578621 - DNA, 17 bp, Homo sapiens
ttgagaaaataaagcta

SEQ ID NO: 6578622 - DNA, 16 bp, Homo sapiens
ttgagaaaatataata

SEQ ID NO: 6578623 - DNA, 17 bp, Homo sapiens
ttgagaaaatgcaggag

SEQ ID NO: 6578624 - DNA, 13 bp, Homo sapiens
ttgagaaacagtt

SEQ ID NO: 6578625 - DNA, 22 bp, Homo sapiens
ttgagaaaccttattgtacctc

SEQ ID NO: 6578626 - DNA, 19 bp, Homo sapiens
ttgagaaataattactaat

SEQ ID NO: 6578627 - DNA, 15 bp, Homo sapiens
ttgagaaatgaataa

SEQ ID NO: 6578628 - DNA, 19 bp, Homo sapiens
ttgagaaatgcatattgta

SEQ ID NO: 6578629 - DNA, 21 bp, Homo sapiens
ttgagaacattccctggaatt

SEQ ID NO: 6578630 - DNA, 19 bp, Homo sapiens
ttgagaaccagtctcctca

SEQ ID NO: 6578631 - DNA, 21 bp, Homo sapiens
ttgagaactgcatatgtttcg

SEQ ID NO: 6578632 - DNA, 16 bp, Homo sapiens
ttgagaagaggacatt

SEQ ID NO: 6578633 - DNA, 22 bp, Homo sapiens
ttgagaagataatcattgctta

SEQ ID NO: 6578634 - DNA, 21 bp, Homo sapiens
ttgagaagccttcagctccag

SEQ ID NO: 6578635 - DNA, 15 bp, Homo sapiens
ttgagaagcgttttt

SEQ ID NO: 6578636 - DNA, 13 bp, Homo sapiens
ttgagaagctgct

SEQ ID NO: 6578637 - DNA, 14 bp, Homo sapiens
ttgagaaggagaga

SEQ ID NO: 6578638 - DNA, 18 bp, Homo sapiens
ttgagaaggtgcctgcca

SEQ ID NO: 6578639 - DNA, 19 bp, Homo sapiens
ttgagaaggtgcctgccat

SEQ ID NO: 6578640 - DNA, 20 bp, Homo sapiens
ttgagaaggtgcctgccata

SEQ ID NO: 6578641 - DNA, 20 bp, Homo sapiens
ttgagaagtctaattcacag

SEQ ID NO: 6578642 - DNA, 16 bp, Homo sapiens
ttgagaagttttgtac

SEQ ID NO: 6578643 - DNA, 19 bp, Homo sapiens
ttgagaagttttgtacaga

SEQ ID NO: 6578644 - DNA, 13 bp, Homo sapiens
ttgagaataaatg

SEQ ID NO: 6578645 - DNA, 20 bp, Homo sapiens
ttgagaataaatgagcattt

SEQ ID NO: 6578646 - DNA, 19 bp, Homo sapiens
ttgagaataagaatttgag

SEQ ID NO: 6578647 - DNA, 14 bp, Homo sapiens
aagtctaaagttta

SEQ ID NO: 6578648 - DNA, 15 bp, Homo sapiens
aagtctaattcacag

SEQ ID NO: 6578649 - DNA, 23 bp, Homo sapiens
aagtctacctgccttgcctgtta

SEQ ID NO: 6578650 - DNA, 13 bp, Homo sapiens
aagtctagaatca

SEQ ID NO: 6578651 - DNA, 14 bp, Homo sapiens
aagtctagaatcat

SEQ ID NO: 6578652 - DNA, 13 bp, Homo sapiens
aagtctagagtct

SEQ ID NO: 6578653 - DNA, 19 bp, Homo sapiens
aagtctaggagctgggagg

SEQ ID NO: 6578654 - DNA, 20 bp, Homo sapiens
aagtctaggttggtagagtt

SEQ ID NO: 6578655 - DNA, 14 bp, Homo sapiens
aagtctagtcttct

SEQ ID NO: 6578656 - DNA, 18 bp, Homo sapiens
aagtctatctggtattaa

SEQ ID NO: 6578657 - DNA, 17 bp, Homo sapiens
aagtctatgatgctgtt

SEQ ID NO: 6578658 - DNA, 12 bp, Homo sapiens
aagtctatttta

SEQ ID NO: 6578659 - DNA, 21 bp, Homo sapiens
aagtctattttaaagacgctc

SEQ ID NO: 6578660 - DNA, 14 bp, Homo sapiens
aagtctattttatt

SEQ ID NO: 6578661 - DNA, 23 bp, Homo sapiens
aagtctatttttttaactgaaaa

SEQ ID NO: 6578662 - DNA, 21 bp, Homo sapiens
aagtctcactggctgtcagta

SEQ ID NO: 6578663 - DNA, 13 bp, Homo sapiens
aagtctcagcctg

SEQ ID NO: 6578664 - DNA, 16 bp, Homo sapiens
aagtctcagcctgggc

SEQ ID NO: 6578665 - DNA, 12 bp, Homo sapiens
aagtctcagcta

SEQ ID NO: 6578666 - DNA, 17 bp, Homo sapiens
aagtctcatctggggag

SEQ ID NO: 6578667 - DNA, 16 bp, Homo sapiens
aagtctcatgggaagc

SEQ ID NO: 6578668 - DNA, 12 bp, Homo sapiens
aagtctcattcg

SEQ ID NO: 6578669 - DNA, 22 bp, Homo sapiens
aagtctcattcgcctttgtctt

SEQ ID NO: 6578670 - DNA, 13 bp, Homo sapiens
aagtctccacccc

SEQ ID NO: 6578671 - DNA, 16 bp, Homo sapiens
aagtctccagcccacg

SEQ ID NO: 6578672 - DNA, 14 bp, Homo sapiens
aagtctccccgcag

SEQ ID NO: 6578673 - DNA, 18 bp, Homo sapiens
aagtctccccgcagccct

SEQ ID NO: 6578674 - DNA, 23 bp, Homo sapiens
aagtctccccgcagccctctcca

SEQ ID NO: 6578675 - DNA, 15 bp, Homo sapiens
aagtctccctgcaca

SEQ ID NO: 6578676 - DNA, 23 bp, Homo sapiens
aagtctcctgtcttatggtccag

SEQ ID NO: 6578677 - DNA, 18 bp, Homo sapiens
aagtctcgaatgtaattg

SEQ ID NO: 6578678 - DNA, 15 bp, Homo sapiens
aagtctctaattcta

SEQ ID NO: 6578679 - DNA, 17 bp, Homo sapiens
aagtctctaggttctga

SEQ ID NO: 6578680 - DNA, 19 bp, Homo sapiens
aagtctctctaagacaaat

SEQ ID NO: 6578681 - DNA, 15 bp, Homo sapiens
aagtctctctgtgaa

SEQ ID NO: 6578682 - DNA, 16 bp, Homo sapiens
aagtctctctgtgaat

SEQ ID NO: 6578683 - DNA, 14 bp, Homo sapiens
aagtctctgactct

SEQ ID NO: 6578684 - DNA, 22 bp, Homo sapiens
aagtctctgactcttgcctttc

SEQ ID NO: 6578685 - DNA, 23 bp, Homo sapiens
aagtctctgattagttgacagta

SEQ ID NO: 6578686 - DNA, 14 bp, Homo sapiens
aagtctctgtgaat

SEQ ID NO: 6578687 - DNA, 15 bp, Homo sapiens
aagtctcttaattct

SEQ ID NO: 6578688 - DNA, 18 bp, Homo sapiens
aagtctcttaattctgat

SEQ ID NO: 6578689 - DNA, 19 bp, Homo sapiens
aagtctcttcctgcctccc

SEQ ID NO: 6578690 - DNA, 20 bp, Homo sapiens
aagtctcttcctgcctccca

SEQ ID NO: 6578691 - DNA, 18 bp, Homo sapiens
aagtctcttttctttaga

SEQ ID NO: 6578692 - DNA, 15 bp, Homo sapiens
aagtctctttttctt

SEQ ID NO: 6578693 - DNA, 19 bp, Homo sapiens
aagtctctttttcttcctc

SEQ ID NO: 6578694 - DNA, 18 bp, Homo sapiens
aagtctcttttttacaaa

SEQ ID NO: 6578695 - DNA, 21 bp, Homo sapiens
aagtctctttttttactctta

SEQ ID NO: 6578696 - DNA, 22 bp, Homo sapiens
aagtctctttttttggcccagg

SEQ ID NO: 6578697 - DNA, 20 bp, Homo sapiens
aagtctgagaaatttacaaa

SEQ ID NO: 6578698 - DNA, 21 bp, Homo sapiens
aagtctgagaaatttacaaaa

SEQ ID NO: 6578699 - DNA, 23 bp, Homo sapiens
aagtctgagttctctttcttagt

SEQ ID NO: 6578700 - DNA, 15 bp, Homo sapiens
aagtctgatccatat

SEQ ID NO: 6578701 - DNA, 20 bp, Homo sapiens
aagtctgatgttctttccat

SEQ ID NO: 6578702 - DNA, 15 bp, Homo sapiens
aagtctgctcattcc

SEQ ID NO: 6578703 - DNA, 17 bp, Homo sapiens
aagtctgcttaccaaaa

SEQ ID NO: 6578704 - DNA, 19 bp, Homo sapiens
aagtctgcttaccaaaaca

SEQ ID NO: 6578705 - DNA, 19 bp, Homo sapiens
aagtctggacaaatgtata

SEQ ID NO: 6578706 - DNA, 17 bp, Homo sapiens
aagtctgggaaattcta

SEQ ID NO: 6578707 - DNA, 18 bp, Homo sapiens
aagtctgggatgtagaac

SEQ ID NO: 6578708 - DNA, 17 bp, Homo sapiens
aagtctggtcagagcca

SEQ ID NO: 6578709 - DNA, 18 bp, Homo sapiens
aagtctggtcagagccac

SEQ ID NO: 6578710 - DNA, 18 bp, Homo sapiens
aagtctgtacctcaaatg

SEQ ID NO: 6578711 - DNA, 16 bp, Homo sapiens
aagtctgtatggcatg

SEQ ID NO: 6578712 - DNA, 17 bp, Homo sapiens
aagtctgtatggcatga

SEQ ID NO: 6578713 - DNA, 19 bp, Homo sapiens
aagtctgtccaaatttaaa

SEQ ID NO: 6578714 - DNA, 21 bp, Homo sapiens
aagtctgtccatatgaaaatg

SEQ ID NO: 6578715 - DNA, 16 bp, Homo sapiens
aagtctgtccttgaag

SEQ ID NO: 6578716 - DNA, 23 bp, Homo sapiens
aagtctgtctttctatagaaata

SEQ ID NO: 6578717 - DNA, 22 bp, Homo sapiens
aagtctgtgagattcattcatg

SEQ ID NO: 6578718 - DNA, 21 bp, Homo sapiens
aagtctgtgagtgcgtctgag

SEQ ID NO: 6578719 - DNA, 18 bp, Homo sapiens
aagtctgtgcctggagct

SEQ ID NO: 6578720 - DNA, 16 bp, Homo sapiens
aagtctgtggactgca

SEQ ID NO: 6578721 - DNA, 15 bp, Homo sapiens
aagtctgtgtccaat

SEQ ID NO: 6578722 - DNA, 17 bp, Homo sapiens
aagtctgtgtccaatta

SEQ ID NO: 6578723 - DNA, 22 bp, Homo sapiens
aagtctgtgtgatgaactttct

SEQ ID NO: 6578724 - DNA, 15 bp, Homo sapiens
aagtctgttattgtt

SEQ ID NO: 6578725 - DNA, 14 bp, Homo sapiens
aagtctgtttactg

SEQ ID NO: 6578726 - DNA, 13 bp, Homo sapiens
aagtctgttttat

SEQ ID NO: 6578727 - DNA, 17 bp, Homo sapiens
aagtcttaaaataactt

SEQ ID NO: 6578728 - DNA, 20 bp, Homo sapiens
aagtcttaacaaaccaacat

SEQ ID NO: 6578729 - DNA, 17 bp, Homo sapiens
aagtcttaacaacagct

SEQ ID NO: 6578730 - DNA, 18 bp, Homo sapiens
aagtcttacttaaaaaaa

SEQ ID NO: 6578731 - DNA, 22 bp, Homo sapiens
aagtcttatatattgtagataa

SEQ ID NO: 6578732 - DNA, 22 bp, Homo sapiens
aagtcttcaagggctgcttcaa

SEQ ID NO: 6578733 - DNA, 12 bp, Homo sapiens
aagtcttcaggg

SEQ ID NO: 6578734 - DNA, 20 bp, Homo sapiens
aagtcttccatcagcagtga

SEQ ID NO: 6578735 - DNA, 22 bp, Homo sapiens
aagtcttccatcagcagtgatt

SEQ ID NO: 6578736 - DNA, 11 bp, Homo sapiens
aagtcttccta

SEQ ID NO: 6578737 - DNA, 19 bp, Homo sapiens
aagtcttcttatctaaacc

SEQ ID NO: 6578738 - DNA, 15 bp, Homo sapiens
aagtcttgctgtgct

SEQ ID NO: 6578739 - DNA, 21 bp, Homo sapiens
aagtcttgctgtggtctcttt

SEQ ID NO: 6578740 - DNA, 22 bp, Homo sapiens
aagtcttgggtctgaatttatt

SEQ ID NO: 6578741 - DNA, 9 bp, Homo sapiens
aagtcttgt

SEQ ID NO: 6578742 - DNA, 16 bp, Homo sapiens
aagtcttgtctggtga

SEQ ID NO: 6578743 - DNA, 23 bp, Homo sapiens
aagtctttaggtctttgtaagaa

SEQ ID NO: 6578744 - DNA, 19 bp, Homo sapiens
aagtctttagtgttcaaat

SEQ ID NO: 6578745 - DNA, 17 bp, Homo sapiens
aagtctttcaagaatga

SEQ ID NO: 6578746 - DNA, 16 bp, Homo sapiens
aagtctttcacattta

SEQ ID NO: 6578747 - DNA, 20 bp, Homo sapiens
aagtcttttaaaaagtattg

SEQ ID NO: 6578748 - DNA, 21 bp, Homo sapiens
aagtcttttccacatggcaga

SEQ ID NO: 6578749 - DNA, 12 bp, Homo sapiens
aagtcttttgtc

SEQ ID NO: 6578750 - DNA, 18 bp, Homo sapiens
aagtcttttgtctgattt

SEQ ID NO: 6578751 - DNA, 14 bp, Homo sapiens
aagtcttttgttcg

SEQ ID NO: 6578752 - DNA, 23 bp, Homo sapiens
aagtctttttcattttgcagaag

SEQ ID NO: 6578753 - DNA, 15 bp, Homo sapiens
aagtcttttttttcc

SEQ ID NO: 6578754 - DNA, 20 bp, Homo sapiens
aagtcttttttttttccaaa

SEQ ID NO: 6578755 - DNA, 14 bp, Homo sapiens
aagtgaaaaaaaga

SEQ ID NO: 6578756 - DNA, 17 bp, Homo sapiens
aagtgaaaaacagaaaa

SEQ ID NO: 6578757 - DNA, 16 bp, Homo sapiens
aagtgaaaacaaatct

SEQ ID NO: 6578758 - DNA, 12 bp, Homo sapiens
aagtgaaaatat

SEQ ID NO: 6578759 - DNA, 14 bp, Homo sapiens
aagtgaaaatatag

SEQ ID NO: 6578760 - DNA, 23 bp, Homo sapiens
aagtgaaaatgccactctctcca

SEQ ID NO: 6578761 - DNA, 14 bp, Homo sapiens
aagtgaaaatggtc

SEQ ID NO: 6578762 - DNA, 15 bp, Homo sapiens
aagtgaaagacattt

SEQ ID NO: 6578763 - DNA, 16 bp, Homo sapiens
aagtgaaagacatttc

SEQ ID NO: 6578764 - DNA, 13 bp, Homo sapiens
aagtgaaagcaaa

SEQ ID NO: 6578765 - DNA, 22 bp, Homo sapiens
aagtgaaatctgtgcaataaaa

SEQ ID NO: 6578766 - DNA, 18 bp, Homo sapiens
aagtgaaattaagcattt

SEQ ID NO: 6578767 - DNA, 14 bp, Homo sapiens
aagtgaaattaggc

SEQ ID NO: 6578768 - DNA, 17 bp, Homo sapiens
aagtgaaattagtattt

SEQ ID NO: 6578769 - DNA, 17 bp, Homo sapiens
aagtgaacaaatttcaa

SEQ ID NO: 6578770 - DNA, 23 bp, Homo sapiens
aagtgaacattacattgccattt

SEQ ID NO: 6578771 - DNA, 18 bp, Homo sapiens
aagtgaacttgattttaa

SEQ ID NO: 6578772 - DNA, 12 bp, Homo sapiens
aagtgaactttt

SEQ ID NO: 6578773 - DNA, 16 bp, Homo sapiens
aagtgaacttttgtaa

SEQ ID NO: 6578774 - DNA, 23 bp, Homo sapiens
aagtgaacttttgtaatttgaat

SEQ ID NO: 6578775 - DNA, 16 bp, Homo sapiens
aagtgaagaagccatc

SEQ ID NO: 6578776 - DNA, 19 bp, Homo sapiens
aagtgaagaatacatcaga

SEQ ID NO: 6578777 - DNA, 23 bp, Homo sapiens
aagtgaagaatccttttgtagaa

SEQ ID NO: 6578778 - DNA, 21 bp, Homo sapiens
aagtgaagaatttatctcttt

SEQ ID NO: 6578779 - DNA, 16 bp, Homo sapiens
aagtgaagactggaag

SEQ ID NO: 6578780 - DNA, 17 bp, Homo sapiens
aagtgaagagtcagaac

SEQ ID NO: 6578781 - DNA, 16 bp, Homo sapiens
aagtgaagcatggcat

SEQ ID NO: 6578782 - DNA, 19 bp, Homo sapiens
aagtgaagccccttgtcct

SEQ ID NO: 6578783 - DNA, 12 bp, Homo sapiens
aagtgaaggaaa

SEQ ID NO: 6578784 - DNA, 13 bp, Homo sapiens
aagtgaaggaaat

SEQ ID NO: 6578785 - DNA, 21 bp, Homo sapiens
aagtgaaggttcccaaggaca

SEQ ID NO: 6578786 - DNA, 17 bp, Homo sapiens
aagtgaaggtttacaat

SEQ ID NO: 6578787 - DNA, 18 bp, Homo sapiens
aagtgaaggtttacaatt

SEQ ID NO: 6578788 - DNA, 14 bp, Homo sapiens
aagtgaataaactt

SEQ ID NO: 6578789 - DNA, 15 bp, Homo sapiens
aagtgaataaacttc

SEQ ID NO: 6578790 - DNA, 17 bp, Homo sapiens
aagtgaataaacttcag

SEQ ID NO: 6578791 - DNA, 20 bp, Homo sapiens
aagtgaataaacttcagcac

SEQ ID NO: 6578792 - DNA, 22 bp, Homo sapiens
aagtgaatacattttataattt

SEQ ID NO: 6578793 - DNA, 15 bp, Homo sapiens
aagtgaatattttaa

SEQ ID NO: 6578794 - DNA, 18 bp, Homo sapiens
aagtgaatctaataaaat

SEQ ID NO: 6578795 - DNA, 18 bp, Homo sapiens
aagtgaatctgattgcac

SEQ ID NO: 6578796 - DNA, 21 bp, Homo sapiens
aagtgaatctttctcctggtg

SEQ ID NO: 6578797 - DNA, 22 bp, Homo sapiens
aagtgaatctttctcctggtga

SEQ ID NO: 6578798 - DNA, 15 bp, Homo sapiens
aagtgaatgctggga

SEQ ID NO: 6578799 - DNA, 16 bp, Homo sapiens
aagtgaatgggaaagg

SEQ ID NO: 6578800 - DNA, 14 bp, Homo sapiens
aagtgaatttgaat

SEQ ID NO: 6578801 - DNA, 17 bp, Homo sapiens
aagtgaatttgaatgaa

SEQ ID NO: 6578802 - DNA, 20 bp, Homo sapiens
aagtgaatttgaatgaaaaa

SEQ ID NO: 6578803 - DNA, 23 bp, Homo sapiens
aagtgaatttgaatgaaaaattt

SEQ ID NO: 6578804 - DNA, 16 bp, Homo sapiens
aagtgaatttgcctgt

SEQ ID NO: 6578805 - DNA, 17 bp, Homo sapiens
aagtgaatttgcctgta

SEQ ID NO: 6578806 - DNA, 19 bp, Homo sapiens
aagtgaatttttctctaac

SEQ ID NO: 6578807 - DNA, 14 bp, Homo sapiens
aagtgacaaaagct

SEQ ID NO: 6578808 - DNA, 17 bp, Homo sapiens
aagtgacaaataagatt

SEQ ID NO: 6578809 - DNA, 22 bp, Homo sapiens
aagtgacaagatgctctggtca

SEQ ID NO: 6578810 - DNA, 16 bp, Homo sapiens
aagtgacaaggcccca

SEQ ID NO: 6578811 - DNA, 18 bp, Homo sapiens
aagtgacaaggccccaga

SEQ ID NO: 6578812 - DNA, 21 bp, Homo sapiens
aagtgacaaggccccagagac

SEQ ID NO: 6578813 - DNA, 16 bp, Homo sapiens
aagtgacagggaagct

SEQ ID NO: 6578814 - DNA, 20 bp, Homo sapiens
aagtgacagggaagctacag

SEQ ID NO: 6578815 - DNA, 13 bp, Homo sapiens
aagtgacatgcca

SEQ ID NO: 6578816 - DNA, 10 bp, Homo sapiens
aagtgaccaa

SEQ ID NO: 6578817 - DNA, 15 bp, Homo sapiens
aagtgaccaaggagg

SEQ ID NO: 6578818 - DNA, 14 bp, Homo sapiens
aagtgaccaaggtg

SEQ ID NO: 6578819 - DNA, 12 bp, Homo sapiens
aagtgaccagca

SEQ ID NO: 6578820 - DNA, 13 bp, Homo sapiens
aagtgaccaggga

SEQ ID NO: 6578821 - DNA, 23 bp, Homo sapiens
aagtgaccagggaagtgtgtgtg

SEQ ID NO: 6578822 - DNA, 18 bp, Homo sapiens
aagtgaccatcatttcac

SEQ ID NO: 6578823 - DNA, 19 bp, Homo sapiens
aagtgaccccagggcctgt

SEQ ID NO: 6578824 - DNA, 20 bp, Homo sapiens
aagtgaccgcacctcacact

SEQ ID NO: 6578825 - DNA, 19 bp, Homo sapiens
aagtgacctcactggcctg

SEQ ID NO: 6578826 - DNA, 17 bp, Homo sapiens
ttgagaatacaagatat

SEQ ID NO: 6578827 - DNA, 15 bp, Homo sapiens
ttgagaatagaaatt

SEQ ID NO: 6578828 - DNA, 16 bp, Homo sapiens
ttgagaatagaaattt

SEQ ID NO: 6578829 - DNA, 23 bp, Homo sapiens
ttgagaatagaaatttgcccctg

SEQ ID NO: 6578830 - DNA, 19 bp, Homo sapiens
ttgagaatattataaaaat

SEQ ID NO: 6578831 - DNA, 19 bp, Homo sapiens
ttgagaatcactgctccag

SEQ ID NO: 6578832 - DNA, 20 bp, Homo sapiens
ttgagaatcccttaaaatta

SEQ ID NO: 6578833 - DNA, 22 bp, Homo sapiens
ttgagaatcccttaaaattacc

SEQ ID NO: 6578834 - DNA, 17 bp, Homo sapiens
ttgagaatggaaaccac

SEQ ID NO: 6578835 - DNA, 13 bp, Homo sapiens
ttgagaattagat

SEQ ID NO: 6578836 - DNA, 19 bp, Homo sapiens
ttgagaattcaaatcctct

SEQ ID NO: 6578837 - DNA, 22 bp, Homo sapiens
ttgagaatttggatacactctc

SEQ ID NO: 6578838 - DNA, 17 bp, Homo sapiens
ttgagaattttgtttca

SEQ ID NO: 6578839 - DNA, 17 bp, Homo sapiens
ttgagacaaaaattatc

SEQ ID NO: 6578840 - DNA, 15 bp, Homo sapiens
ttgagacaagccctg

SEQ ID NO: 6578841 - DNA, 19 bp, Homo sapiens
ttgagacaagccctggcaa

SEQ ID NO: 6578842 - DNA, 13 bp, Homo sapiens
ttgagacactgtc

SEQ ID NO: 6578843 - DNA, 10 bp, Homo sapiens
ttgagacaga

SEQ ID NO: 6578844 - DNA, 22 bp, Homo sapiens
ttgagacagagtctcgctctgt

SEQ ID NO: 6578845 - DNA, 17 bp, Homo sapiens
ttgagacagtttcttag

SEQ ID NO: 6578846 - DNA, 22 bp, Homo sapiens
ttgagacagtttcttagctttt

SEQ ID NO: 6578847 - DNA, 12 bp, Homo sapiens
ttgagacataaa

SEQ ID NO: 6578848 - DNA, 19 bp, Homo sapiens
ttgagacataaatgttcac

SEQ ID NO: 6578849 - DNA, 15 bp, Homo sapiens
ttgagaccagaagaa

SEQ ID NO: 6578850 - DNA, 17 bp, Homo sapiens
ttgagaccagaagaaaa

SEQ ID NO: 6578851 - DNA, 20 bp, Homo sapiens
ttgagaccagaagaaaagac

SEQ ID NO: 6578852 - DNA, 23 bp, Homo sapiens
ttgagaccatccattctcctcag

SEQ ID NO: 6578853 - DNA, 16 bp, Homo sapiens
ttgagacccaggcctg

SEQ ID NO: 6578854 - DNA, 17 bp, Homo sapiens
ttgagaccccagtgcct

SEQ ID NO: 6578855 - DNA, 19 bp, Homo sapiens
ttgagaccccagtgcctgc

SEQ ID NO: 6578856 - DNA, 16 bp, Homo sapiens
ttgagaccctcttctc

SEQ ID NO: 6578857 - DNA, 14 bp, Homo sapiens
ttgagacctcagcc

SEQ ID NO: 6578858 - DNA, 14 bp, Homo sapiens
ttgagacctcagct

SEQ ID NO: 6578859 - DNA, 22 bp, Homo sapiens
ttgagacctcagcttggcactc

SEQ ID NO: 6578860 - DNA, 17 bp, Homo sapiens
ttgagacctttcctctc

SEQ ID NO: 6578861 - DNA, 13 bp, Homo sapiens
ttgagactcccca

SEQ ID NO: 6578862 - DNA, 21 bp, Homo sapiens
ttgagactcctcagcacccct

SEQ ID NO: 6578863 - DNA, 18 bp, Homo sapiens
ttgagactcggccgcagc

SEQ ID NO: 6578864 - DNA, 18 bp, Homo sapiens
ttgagactgaaatttagt

SEQ ID NO: 6578865 - DNA, 23 bp, Homo sapiens
ttgagactgagtctctctctgtt

SEQ ID NO: 6578866 - DNA, 13 bp, Homo sapiens
ttgagacttaaaa

SEQ ID NO: 6578867 - DNA, 14 bp, Homo sapiens
ttgagactttcttc

SEQ ID NO: 6578868 - DNA, 15 bp, Homo sapiens
ttgagactttttggt

SEQ ID NO: 6578869 - DNA, 16 bp, Homo sapiens
ttgagactttttggtg

SEQ ID NO: 6578870 - DNA, 15 bp, Homo sapiens
ttgagagaaaagaaa

SEQ ID NO: 6578871 - DNA, 23 bp, Homo sapiens
ttgagagaaatatgaagaactga

SEQ ID NO: 6578872 - DNA, 17 bp, Homo sapiens
ttgagagaccaggcaaa

SEQ ID NO: 6578873 - DNA, 21 bp, Homo sapiens
ttgagagagatgtgtaatttt

SEQ ID NO: 6578874 - DNA, 19 bp, Homo sapiens
ttgagagcagatgccattt

SEQ ID NO: 6578875 - DNA, 12 bp, Homo sapiens
ttgagagccagt

SEQ ID NO: 6578876 - DNA, 22 bp, Homo sapiens
ttgagagcctctatgtgcaagg

SEQ ID NO: 6578877 - DNA, 17 bp, Homo sapiens
ttgagagcgctggcctc

SEQ ID NO: 6578878 - DNA, 21 bp, Homo sapiens
ttgagagcgctggcctcttcc

SEQ ID NO: 6578879 - DNA, 16 bp, Homo sapiens
ttgagagctgctgagg

SEQ ID NO: 6578880 - DNA, 14 bp, Homo sapiens
ttgagagctttatt

SEQ ID NO: 6578881 - DNA, 14 bp, Homo sapiens
ttgagagctttctg

SEQ ID NO: 6578882 - DNA, 17 bp, Homo sapiens
ttgagaggcatgacagc

SEQ ID NO: 6578883 - DNA, 17 bp, Homo sapiens
ttgagagggggatgccc

SEQ ID NO: 6578884 - DNA, 22 bp, Homo sapiens
ttgagagttccggggagaaacc

SEQ ID NO: 6578885 - DNA, 19 bp, Homo sapiens
ttgagagttcgtgaagagg

SEQ ID NO: 6578886 - DNA, 19 bp, Homo sapiens
ttgagataatacattccga

SEQ ID NO: 6578887 - DNA, 18 bp, Homo sapiens
ttgagataatatctgtga

SEQ ID NO: 6578888 - DNA, 19 bp, Homo sapiens
ttgagataatatctgtgag

SEQ ID NO: 6578889 - DNA, 21 bp, Homo sapiens
ttgagataatatctgtgaggt

SEQ ID NO: 6578890 - DNA, 15 bp, Homo sapiens
ttgagatactatttt

SEQ ID NO: 6578891 - DNA, 16 bp, Homo sapiens
ttgagatactattttc

SEQ ID NO: 6578892 - DNA, 17 bp, Homo sapiens
ttgagatactattttca

SEQ ID NO: 6578893 - DNA, 21 bp, Homo sapiens
ttgagatactattttcatttt

SEQ ID NO: 6578894 - DNA, 18 bp, Homo sapiens
ttgagatagaagaactgc

SEQ ID NO: 6578895 - DNA, 13 bp, Homo sapiens
ttgagatccagtg

SEQ ID NO: 6578896 - DNA, 22 bp, Homo sapiens
ttgagatctgctgacagatgtt

SEQ ID NO: 6578897 - DNA, 15 bp, Homo sapiens
ttgagatctgtataa

SEQ ID NO: 6578898 - DNA, 23 bp, Homo sapiens
ttgagatggagtctcgctctgct

SEQ ID NO: 6578899 - DNA, 13 bp, Homo sapiens
ttgagatggggat

SEQ ID NO: 6578900 - DNA, 22 bp, Homo sapiens
ttgagatggggtctcgctctgt

SEQ ID NO: 6578901 - DNA, 15 bp, Homo sapiens
ttgagatggtaacag

SEQ ID NO: 6578902 - DNA, 17 bp, Homo sapiens
ttgagatggtaacagat

SEQ ID NO: 6578903 - DNA, 14 bp, Homo sapiens
ttgagatgtacatc

SEQ ID NO: 6578904 - DNA, 13 bp, Homo sapiens
ttgagatgtatga

SEQ ID NO: 6578905 - DNA, 17 bp, Homo sapiens
ttgagatgtatgaaggc

SEQ ID NO: 6578906 - DNA, 18 bp, Homo sapiens
ttgagatgtgatgctggt

SEQ ID NO: 6578907 - DNA, 23 bp, Homo sapiens
ttgagatgtgctttgctgcacaa

SEQ ID NO: 6578908 - DNA, 16 bp, Homo sapiens
ttgagatgtgttcaca

SEQ ID NO: 6578909 - DNA, 20 bp, Homo sapiens
ttgagatgtgttcctcctgc

SEQ ID NO: 6578910 - DNA, 23 bp, Homo sapiens
ttgagattcaaacccaggctgtc

SEQ ID NO: 6578911 - DNA, 23 bp, Homo sapiens
ttgagattcaagacaagagctgt

SEQ ID NO: 6578912 - DNA, 17 bp, Homo sapiens
ttgagattgccccaggt

SEQ ID NO: 6578913 - DNA, 20 bp, Homo sapiens
ttgagattgtactgttcata

SEQ ID NO: 6578914 - DNA, 22 bp, Homo sapiens
ttgagattttccattaactatt

SEQ ID NO: 6578915 - DNA, 17 bp, Homo sapiens
ttgagatttttaagaac

SEQ ID NO: 6578916 - DNA, 19 bp, Homo sapiens
ttgagatttttaagaactt

SEQ ID NO: 6578917 - DNA, 16 bp, Homo sapiens
ttgagattttttttcc

SEQ ID NO: 6578918 - DNA, 17 bp, Homo sapiens
ttgagcaaataaactta

SEQ ID NO: 6578919 - DNA, 18 bp, Homo sapiens
ttgagcaaataaacttac

SEQ ID NO: 6578920 - DNA, 15 bp, Homo sapiens
ttgagcaaggcaaga

SEQ ID NO: 6578921 - DNA, 22 bp, Homo sapiens
ttgagcaagtatccttcattgt

SEQ ID NO: 6578922 - DNA, 19 bp, Homo sapiens
ttgagcaatgtttttctca

SEQ ID NO: 6578923 - DNA, 21 bp, Homo sapiens
ttgagcaatgtttttctcaaa

SEQ ID NO: 6578924 - DNA, 18 bp, Homo sapiens
ttgagcaattcatttcac

SEQ ID NO: 6578925 - DNA, 22 bp, Homo sapiens
ttgagcaattcatttcacttta

SEQ ID NO: 6578926 - DNA, 15 bp, Homo sapiens
ttgagcaatttcccc

SEQ ID NO: 6578927 - DNA, 21 bp, Homo sapiens
ttgagcacaatctgttctact

SEQ ID NO: 6578928 - DNA, 22 bp, Homo sapiens
ttgagcacttttcaaacaatca

SEQ ID NO: 6578929 - DNA, 16 bp, Homo sapiens
ttgagcagaatacaat

SEQ ID NO: 6578930 - DNA, 19 bp, Homo sapiens
ttgagcaggagcagaaaga

SEQ ID NO: 6578931 - DNA, 16 bp, Homo sapiens
ttgagcatcaatcttg

SEQ ID NO: 6578932 - DNA, 19 bp, Homo sapiens
ttgagcatgacagcctgca

SEQ ID NO: 6578933 - DNA, 22 bp, Homo sapiens
ttgagcatgcacagctgcttgt

SEQ ID NO: 6578934 - DNA, 20 bp, Homo sapiens
ttgagcatgcccaaatataa

SEQ ID NO: 6578935 - DNA, 23 bp, Homo sapiens
ttgagcatgcccaaatataacat

SEQ ID NO: 6578936 - DNA, 16 bp, Homo sapiens
ttgagcatttttaagg

SEQ ID NO: 6578937 - DNA, 20 bp, Homo sapiens
ttgagccactccttccttca

SEQ ID NO: 6578938 - DNA, 13 bp, Homo sapiens
ttgagccagcaga

SEQ ID NO: 6578939 - DNA, 17 bp, Homo sapiens
ttgagccagcagacatt

SEQ ID NO: 6578940 - DNA, 13 bp, Homo sapiens
ttgagccaggcct

SEQ ID NO: 6578941 - DNA, 21 bp, Homo sapiens
ttgagccagttacctttgctg

SEQ ID NO: 6578942 - DNA, 16 bp, Homo sapiens
ttgagccatccaaaga

SEQ ID NO: 6578943 - DNA, 15 bp, Homo sapiens
ttgagccatgagtgg

SEQ ID NO: 6578944 - DNA, 23 bp, Homo sapiens
ttgagccccaagtcctgaagagg

SEQ ID NO: 6578945 - DNA, 15 bp, Homo sapiens
ttgagccccagaggc

SEQ ID NO: 6578946 - DNA, 16 bp, Homo sapiens
ttgagcccctgaggac

SEQ ID NO: 6578947 - DNA, 15 bp, Homo sapiens
ttgagccctccccag

SEQ ID NO: 6578948 - DNA, 13 bp, Homo sapiens
ttgagccctggct

SEQ ID NO: 6578949 - DNA, 15 bp, Homo sapiens
ttgagccctggctgt

SEQ ID NO: 6578950 - DNA, 20 bp, Homo sapiens
ttgagccgggcccctgggct

SEQ ID NO: 6578951 - DNA, 12 bp, Homo sapiens
ttgagcctcaga

SEQ ID NO: 6578952 - DNA, 18 bp, Homo sapiens
ttgagcctccatttctgg

SEQ ID NO: 6578953 - DNA, 12 bp, Homo sapiens
ttgagcctcccc

SEQ ID NO: 6578954 - DNA, 11 bp, Homo sapiens
ttgagcctggg

SEQ ID NO: 6578955 - DNA, 15 bp, Homo sapiens
ttgagcctgtcaaga

SEQ ID NO: 6578956 - DNA, 18 bp, Homo sapiens
ttgagcctgtgaccttgg

SEQ ID NO: 6578957 - DNA, 17 bp, Homo sapiens
ttgagccttattaaaat

SEQ ID NO: 6578958 - DNA, 15 bp, Homo sapiens
ttgagccttgaactt

SEQ ID NO: 6578959 - DNA, 19 bp, Homo sapiens
ttgagccttgaactttgac

SEQ ID NO: 6578960 - DNA, 21 bp, Homo sapiens
ttgagccttgcatgtacttga

SEQ ID NO: 6578961 - DNA, 14 bp, Homo sapiens
ttgagctatgactt

SEQ ID NO: 6578962 - DNA, 16 bp, Homo sapiens
ttgagctatgacttaa

SEQ ID NO: 6578963 - DNA, 20 bp, Homo sapiens
ttgagctattcacctcagta

SEQ ID NO: 6578964 - DNA, 21 bp, Homo sapiens
ttgagctcagccccaactctt

SEQ ID NO: 6578965 - DNA, 19 bp, Homo sapiens
ttgagctcaggaggtcaag

SEQ ID NO: 6578966 - DNA, 12 bp, Homo sapiens
ttgagctcccac

SEQ ID NO: 6578967 - DNA, 18 bp, Homo sapiens
ttgagctcccctggagcc

SEQ ID NO: 6578968 - DNA, 16 bp, Homo sapiens
ttgagctcctaagctg

SEQ ID NO: 6578969 - DNA, 13 bp, Homo sapiens
ttgagctctgtaa

SEQ ID NO: 6578970 - DNA, 22 bp, Homo sapiens
ttgagctgaaatgctgcatttt

SEQ ID NO: 6578971 - DNA, 22 bp, Homo sapiens
ttgagctgagttccttataaga

SEQ ID NO: 6578972 - DNA, 11 bp, Homo sapiens
ttgagctgcct

SEQ ID NO: 6578973 - DNA, 16 bp, Homo sapiens
ttgagctgcctccagc

SEQ ID NO: 6578974 - DNA, 18 bp, Homo sapiens
ttgagctgcctccagcct

SEQ ID NO: 6578975 - DNA, 19 bp, Homo sapiens
ttgagctgcctccagcctg

SEQ ID NO: 6578976 - DNA, 21 bp, Homo sapiens
ttgagctgcctccagcctggt

SEQ ID NO: 6578977 - DNA, 22 bp, Homo sapiens
ttgagctgcctccagcctggtg

SEQ ID NO: 6578978 - DNA, 19 bp, Homo sapiens
ttgagctgccttccctagc

SEQ ID NO: 6578979 - DNA, 13 bp, Homo sapiens
ttgagctggcctc

SEQ ID NO: 6578980 - DNA, 17 bp, Homo sapiens
ttgagctggttttctct

SEQ ID NO: 6578981 - DNA, 18 bp, Homo sapiens
ttgagctggttttctctg

SEQ ID NO: 6578982 - DNA, 14 bp, Homo sapiens
ttgagctgtatata

SEQ ID NO: 6578983 - DNA, 22 bp, Homo sapiens
ttgagctgtatatatatatgtg

SEQ ID NO: 6578984 - DNA, 21 bp, Homo sapiens
ttgagctgttgcctcagtccc

SEQ ID NO: 6578985 - DNA, 18 bp, Homo sapiens
ttgagcttagtgaaatta

SEQ ID NO: 6578986 - DNA, 12 bp, Homo sapiens
ttgagcttgctg

SEQ ID NO: 6578987 - DNA, 14 bp, Homo sapiens
ttgagctttccatg

SEQ ID NO: 6578988 - DNA, 15 bp, Homo sapiens
ttgaggaaaaactga

SEQ ID NO: 6578989 - DNA, 13 bp, Homo sapiens
ttgaggaaaacaa

SEQ ID NO: 6578990 - DNA, 15 bp, Homo sapiens
ttgaggaaagaaata

SEQ ID NO: 6578991 - DNA, 11 bp, Homo sapiens
ttgaggaacat

SEQ ID NO: 6578992 - DNA, 19 bp, Homo sapiens
ttgaggaactgtacagaaa

SEQ ID NO: 6578993 - DNA, 18 bp, Homo sapiens
ttgaggaagcccaggctc

SEQ ID NO: 6578994 - DNA, 17 bp, Homo sapiens
ttgaggaagctctccct

SEQ ID NO: 6578995 - DNA, 21 bp, Homo sapiens
ttgaggaagtcaggctgttgg

SEQ ID NO: 6578996 - DNA, 20 bp, Homo sapiens
ttgaggaagtggctgtccct

SEQ ID NO: 6578997 - DNA, 20 bp, Homo sapiens
ttgaggaataaatgccttta

SEQ ID NO: 6578998 - DNA, 11 bp, Homo sapiens
ttgaggacaca

SEQ ID NO: 6578999 - DNA, 13 bp, Homo sapiens
ttgaggacacatg

SEQ ID NO: 6579000 - DNA, 15 bp, Homo sapiens
ttgaggacacatgtc

SEQ ID NO: 6579001 - DNA, 14 bp, Homo sapiens
ttgaggacactgat

SEQ ID NO: 6579002 - DNA, 15 bp, Homo sapiens
ttgaggacaggagag

SEQ ID NO: 6579003 - DNA, 23 bp, Homo sapiens
ttgaggacctccacctgggagat

SEQ ID NO: 6579004 - DNA, 14 bp, Homo sapiens
aagtgacggttcct

SEQ ID NO: 6579005 - DNA, 17 bp, Homo sapiens
aagtgacggttcctaca

SEQ ID NO: 6579006 - DNA, 19 bp, Homo sapiens
aagtgactaatggcatgag

SEQ ID NO: 6579007 - DNA, 20 bp, Homo sapiens
aagtgactaccacttatttc

SEQ ID NO: 6579008 - DNA, 19 bp, Homo sapiens
aagtgactgaaaatggcat

SEQ ID NO: 6579009 - DNA, 15 bp, Homo sapiens
aagtgactgaccatg

SEQ ID NO: 6579010 - DNA, 19 bp, Homo sapiens
aagtgactgcacaagtaaa

SEQ ID NO: 6579011 - DNA, 17 bp, Homo sapiens
aagtgactgtatctgtg

SEQ ID NO: 6579012 - DNA, 14 bp, Homo sapiens
aagtgactgttgta

SEQ ID NO: 6579013 - DNA, 19 bp, Homo sapiens
aagtgacttgaatgtacaa

SEQ ID NO: 6579014 - DNA, 23 bp, Homo sapiens
aagtgacttgaatgtacaaagat

SEQ ID NO: 6579015 - DNA, 13 bp, Homo sapiens
aagtgactttaaa

SEQ ID NO: 6579016 - DNA, 19 bp, Homo sapiens
aagtgactttaaaagaaaa

SEQ ID NO: 6579017 - DNA, 18 bp, Homo sapiens
aagtgagactttgagggt

SEQ ID NO: 6579018 - DNA, 13 bp, Homo sapiens
aagtgagagggga

SEQ ID NO: 6579019 - DNA, 23 bp, Homo sapiens
aagtgagagtagtcagaactata

SEQ ID NO: 6579020 - DNA, 18 bp, Homo sapiens
aagtgagatggtatgaaa

SEQ ID NO: 6579021 - DNA, 15 bp, Homo sapiens
aagtgagcaaacctg

SEQ ID NO: 6579022 - DNA, 17 bp, Homo sapiens
aagtgagcagaacaggt

SEQ ID NO: 6579023 - DNA, 22 bp, Homo sapiens
aagtgagcagagatgtactgca

SEQ ID NO: 6579024 - DNA, 13 bp, Homo sapiens
aagtgagcccccc

SEQ ID NO: 6579025 - DNA, 14 bp, Homo sapiens
aagtgagccccccc

SEQ ID NO: 6579026 - DNA, 18 bp, Homo sapiens
aagtgagctttgctgcta

SEQ ID NO: 6579027 - DNA, 22 bp, Homo sapiens
aagtgaggatgagacccagccc

SEQ ID NO: 6579028 - DNA, 21 bp, Homo sapiens
aagtgaggccactgaagagga

SEQ ID NO: 6579029 - DNA, 12 bp, Homo sapiens
aagtgaggccca

SEQ ID NO: 6579030 - DNA, 19 bp, Homo sapiens
aagtgaggcccaaggagct

SEQ ID NO: 6579031 - DNA, 20 bp, Homo sapiens
aagtgaggcccaaggagctt

SEQ ID NO: 6579032 - DNA, 12 bp, Homo sapiens
aagtgaggcctg

SEQ ID NO: 6579033 - DNA, 14 bp, Homo sapiens
aagtgaggcctggg

SEQ ID NO: 6579034 - DNA, 19 bp, Homo sapiens
aagtgagggctcactcagc

SEQ ID NO: 6579035 - DNA, 17 bp, Homo sapiens
aagtgagggctttttaa

SEQ ID NO: 6579036 - DNA, 18 bp, Homo sapiens
aagtgagggtcagagagg

SEQ ID NO: 6579037 - DNA, 15 bp, Homo sapiens
aagtgagtactgtta

SEQ ID NO: 6579038 - DNA, 14 bp, Homo sapiens
aagtgagttttaca

SEQ ID NO: 6579039 - DNA, 13 bp, Homo sapiens
aagtgataaattc

SEQ ID NO: 6579040 - DNA, 13 bp, Homo sapiens
aagtgataagtgc

SEQ ID NO: 6579041 - DNA, 15 bp, Homo sapiens
aagtgatatatgtat

SEQ ID NO: 6579042 - DNA, 16 bp, Homo sapiens
aagtgatatcacctct

SEQ ID NO: 6579043 - DNA, 22 bp, Homo sapiens
aagtgatcaataaaatgtgatt

SEQ ID NO: 6579044 - DNA, 23 bp, Homo sapiens
aagtgatccacccacctcggcct

SEQ ID NO: 6579045 - DNA, 23 bp, Homo sapiens
aagtgatcctaaatatgacagtg

SEQ ID NO: 6579046 - DNA, 19 bp, Homo sapiens
aagtgatcctcccacctca

SEQ ID NO: 6579047 - DNA, 20 bp, Homo sapiens
aagtgatcctcccacctcag

SEQ ID NO: 6579048 - DNA, 20 bp, Homo sapiens
aagtgatccttccacctcag

SEQ ID NO: 6579049 - DNA, 22 bp, Homo sapiens
aagtgatctacatgaggaactg

SEQ ID NO: 6579050 - DNA, 18 bp, Homo sapiens
aagtgatctgtcccctct

SEQ ID NO: 6579051 - DNA, 19 bp, Homo sapiens
aagtgatctgtcccctctc

SEQ ID NO: 6579052 - DNA, 17 bp, Homo sapiens
aagtgatctgtgttcaa

SEQ ID NO: 6579053 - DNA, 18 bp, Homo sapiens
aagtgatggtcattcata

SEQ ID NO: 6579054 - DNA, 20 bp, Homo sapiens
aagtgatgtattttcatagt

SEQ ID NO: 6579055 - DNA, 20 bp, Homo sapiens
aagtgatgtgatttatgcat

SEQ ID NO: 6579056 - DNA, 22 bp, Homo sapiens
aagtgatgtgatttatgcattt

SEQ ID NO: 6579057 - DNA, 23 bp, Homo sapiens
aagtgatgtgatttatgcattta

SEQ ID NO: 6579058 - DNA, 17 bp, Homo sapiens
aagtgattcactgtgct

SEQ ID NO: 6579059 - DNA, 18 bp, Homo sapiens
aagtgattctcctgcctc

SEQ ID NO: 6579060 - DNA, 14 bp, Homo sapiens
aagtgattcttttt

SEQ ID NO: 6579061 - DNA, 13 bp, Homo sapiens
aagtgattgacat

SEQ ID NO: 6579062 - DNA, 13 bp, Homo sapiens
aagtgattgtatg

SEQ ID NO: 6579063 - DNA, 18 bp, Homo sapiens
aagtgattgtatgaattt

SEQ ID NO: 6579064 - DNA, 22 bp, Homo sapiens
aagtgatttgggggtgcaatga

SEQ ID NO: 6579065 - DNA, 20 bp, Homo sapiens
aagtgatttgtaatatgatt

SEQ ID NO: 6579066 - DNA, 21 bp, Homo sapiens
aagtgatttgtaatatgattt

SEQ ID NO: 6579067 - DNA, 16 bp, Homo sapiens
aagtgcaaacacagca

SEQ ID NO: 6579068 - DNA, 16 bp, Homo sapiens
aagtgcaaagctgctt

SEQ ID NO: 6579069 - DNA, 12 bp, Homo sapiens
aagtgcaaagtt

SEQ ID NO: 6579070 - DNA, 14 bp, Homo sapiens
aagtgcaaatactc

SEQ ID NO: 6579071 - DNA, 18 bp, Homo sapiens
aagtgcaacatttctgta

SEQ ID NO: 6579072 - DNA, 14 bp, Homo sapiens
aagtgcaaggacca

SEQ ID NO: 6579073 - DNA, 23 bp, Homo sapiens
aagtgcaataaatctgacccagt

SEQ ID NO: 6579074 - DNA, 16 bp, Homo sapiens
aagtgcaatagattac

SEQ ID NO: 6579075 - DNA, 22 bp, Homo sapiens
aagtgcaatatgggcgggcagt

SEQ ID NO: 6579076 - DNA, 17 bp, Homo sapiens
aagtgcaatgccccctc

SEQ ID NO: 6579077 - DNA, 18 bp, Homo sapiens
aagtgcaatgccccctcc

SEQ ID NO: 6579078 - DNA, 17 bp, Homo sapiens
aagtgcaatgggtaagg

SEQ ID NO: 6579079 - DNA, 17 bp, Homo sapiens
aagtgcaattgcacaaa

SEQ ID NO: 6579080 - DNA, 14 bp, Homo sapiens
aagtgcacacacac

SEQ ID NO: 6579081 - DNA, 21 bp, Homo sapiens
aagtgcaccaggtcactctga

SEQ ID NO: 6579082 - DNA, 23 bp, Homo sapiens
aagtgcacctacaccaactgctc

SEQ ID NO: 6579083 - DNA, 16 bp, Homo sapiens
aagtgcactttctaat

SEQ ID NO: 6579084 - DNA, 17 bp, Homo sapiens
aagtgcagcccttcctc

SEQ ID NO: 6579085 - DNA, 14 bp, Homo sapiens
aagtgcagctcatg

SEQ ID NO: 6579086 - DNA, 12 bp, Homo sapiens
aagtgcagtcag

SEQ ID NO: 6579087 - DNA, 15 bp, Homo sapiens
aagtgcagtcatttg

SEQ ID NO: 6579088 - DNA, 18 bp, Homo sapiens
aagtgcagtcatttgtgg

SEQ ID NO: 6579089 - DNA, 14 bp, Homo sapiens
aagtgcagttctta

SEQ ID NO: 6579090 - DNA, 22 bp, Homo sapiens
aagtgcagttcttagccctcta

SEQ ID NO: 6579091 - DNA, 19 bp, Homo sapiens
aagtgcatccaaaggtgct

SEQ ID NO: 6579092 - DNA, 14 bp, Homo sapiens
aagtgcatcctgat

SEQ ID NO: 6579093 - DNA, 14 bp, Homo sapiens
aagtgcatgatggt

SEQ ID NO: 6579094 - DNA, 16 bp, Homo sapiens
aagtgcatgatggtga

SEQ ID NO: 6579095 - DNA, 23 bp, Homo sapiens
aagtgcatgatggtgagagccca

SEQ ID NO: 6579096 - DNA, 19 bp, Homo sapiens
aagtgcatgtcacatgcca

SEQ ID NO: 6579097 - DNA, 13 bp, Homo sapiens
aagtgcatgttaa

SEQ ID NO: 6579098 - DNA, 22 bp, Homo sapiens
aagtgcatgttaaaataattat

SEQ ID NO: 6579099 - DNA, 12 bp, Homo sapiens
aagtgcattcaa

SEQ ID NO: 6579100 - DNA, 13 bp, Homo sapiens
aagtgcattcaac

SEQ ID NO: 6579101 - DNA, 14 bp, Homo sapiens
aagtgcatttctga

SEQ ID NO: 6579102 - DNA, 22 bp, Homo sapiens
aagtgcatttctgaatagaaat

SEQ ID NO: 6579103 - DNA, 23 bp, Homo sapiens
aagtgcatttctgaatagaaatg

SEQ ID NO: 6579104 - DNA, 19 bp, Homo sapiens
aagtgcatttctgggcctt

SEQ ID NO: 6579105 - DNA, 16 bp, Homo sapiens
aagtgcatttttctta

SEQ ID NO: 6579106 - DNA, 14 bp, Homo sapiens
aagtgcatttttgt

SEQ ID NO: 6579107 - DNA, 15 bp, Homo sapiens
aagtgccaaaataaa

SEQ ID NO: 6579108 - DNA, 17 bp, Homo sapiens
aagtgccaaaataaagt

SEQ ID NO: 6579109 - DNA, 20 bp, Homo sapiens
aagtgccactcattcctgta

SEQ ID NO: 6579110 - DNA, 23 bp, Homo sapiens
aagtgccactgcccgagctggtg

SEQ ID NO: 6579111 - DNA, 18 bp, Homo sapiens
aagtgccagaggtgggca

SEQ ID NO: 6579112 - DNA, 16 bp, Homo sapiens
aagtgccagcattcca

SEQ ID NO: 6579113 - DNA, 22 bp, Homo sapiens
aagtgccagcattccagacttc

SEQ ID NO: 6579114 - DNA, 14 bp, Homo sapiens
aagtgccagtattt

SEQ ID NO: 6579115 - DNA, 23 bp, Homo sapiens
aagtgccagtattttaaaatagc

SEQ ID NO: 6579116 - DNA, 13 bp, Homo sapiens
aagtgccatccca

SEQ ID NO: 6579117 - DNA, 22 bp, Homo sapiens
aagtgccatcccacattcggac

SEQ ID NO: 6579118 - DNA, 14 bp, Homo sapiens
aagtgccatctcaa

SEQ ID NO: 6579119 - DNA, 15 bp, Homo sapiens
aagtgccatctcaat

SEQ ID NO: 6579120 - DNA, 16 bp, Homo sapiens
aagtgccattcatcct

SEQ ID NO: 6579121 - DNA, 13 bp, Homo sapiens
aagtgcccaaagt

SEQ ID NO: 6579122 - DNA, 16 bp, Homo sapiens
aagtgcccacatttga

SEQ ID NO: 6579123 - DNA, 22 bp, Homo sapiens
aagtgccccaccactccccaac

SEQ ID NO: 6579124 - DNA, 12 bp, Homo sapiens
aagtgccccctc

SEQ ID NO: 6579125 - DNA, 16 bp, Homo sapiens
aagtgccccctcacct

SEQ ID NO: 6579126 - DNA, 17 bp, Homo sapiens
aagtgccccctcacctc

SEQ ID NO: 6579127 - DNA, 22 bp, Homo sapiens
aagtgccccctcacctctccag

SEQ ID NO: 6579128 - DNA, 13 bp, Homo sapiens
aagtgccctctcc

SEQ ID NO: 6579129 - DNA, 23 bp, Homo sapiens
aagtgccctctcccaccctcttc

SEQ ID NO: 6579130 - DNA, 15 bp, Homo sapiens
aagtgcccttcctgc

SEQ ID NO: 6579131 - DNA, 14 bp, Homo sapiens
aagtgcctataaag

SEQ ID NO: 6579132 - DNA, 21 bp, Homo sapiens
aagtgcctataaccatgttct

SEQ ID NO: 6579133 - DNA, 20 bp, Homo sapiens
aagtgcctcaagaggaatga

SEQ ID NO: 6579134 - DNA, 18 bp, Homo sapiens
aagtgcctcacatttttt

SEQ ID NO: 6579135 - DNA, 23 bp, Homo sapiens
aagtgcctcacatttttttctac

SEQ ID NO: 6579136 - DNA, 12 bp, Homo sapiens
aagtgcctgcct

SEQ ID NO: 6579137 - DNA, 14 bp, Homo sapiens
aagtgcctgctggg

SEQ ID NO: 6579138 - DNA, 18 bp, Homo sapiens
aagtgcctgcttttgatg

SEQ ID NO: 6579139 - DNA, 13 bp, Homo sapiens
aagtgcctgggaa

SEQ ID NO: 6579140 - DNA, 14 bp, Homo sapiens
aagtgcctgggaag

SEQ ID NO: 6579141 - DNA, 17 bp, Homo sapiens
aagtgcctgggctcagc

SEQ ID NO: 6579142 - DNA, 12 bp, Homo sapiens
aagtgccttaat

SEQ ID NO: 6579143 - DNA, 16 bp, Homo sapiens
aagtgccttagcatgt

SEQ ID NO: 6579144 - DNA, 21 bp, Homo sapiens
aagtgccttcagccaagacca

SEQ ID NO: 6579145 - DNA, 22 bp, Homo sapiens
aagtgccttcagccaagaccat

SEQ ID NO: 6579146 - DNA, 20 bp, Homo sapiens
aagtgccttctccttcccca

SEQ ID NO: 6579147 - DNA, 16 bp, Homo sapiens
aagtgccttgagctgc

SEQ ID NO: 6579148 - DNA, 22 bp, Homo sapiens
aagtgccttgctcatttgaaaa

SEQ ID NO: 6579149 - DNA, 19 bp, Homo sapiens
aagtgccttggatgagaag

SEQ ID NO: 6579150 - DNA, 19 bp, Homo sapiens
aagtgcctttcaggatcta

SEQ ID NO: 6579151 - DNA, 21 bp, Homo sapiens
aagtgcctttcaggatctatt

SEQ ID NO: 6579152 - DNA, 18 bp, Homo sapiens
aagtgcctttctgcagtt

SEQ ID NO: 6579153 - DNA, 20 bp, Homo sapiens
aagtgccttttgctgcgcac

SEQ ID NO: 6579154 - DNA, 22 bp, Homo sapiens
aagtgcggggtaggggaagaag

SEQ ID NO: 6579155 - DNA, 17 bp, Homo sapiens
aagtgcggtgctttagc

SEQ ID NO: 6579156 - DNA, 18 bp, Homo sapiens
aagtgcgtggtataatct

SEQ ID NO: 6579157 - DNA, 16 bp, Homo sapiens
aagtgctaaggttcta

SEQ ID NO: 6579158 - DNA, 19 bp, Homo sapiens
aagtgctaaggttctaagg

SEQ ID NO: 6579159 - DNA, 20 bp, Homo sapiens
aagtgctaaggttctaaggc

SEQ ID NO: 6579160 - DNA, 17 bp, Homo sapiens
aagtgctacttgagagt

SEQ ID NO: 6579161 - DNA, 21 bp, Homo sapiens
aagtgctagccactggaaatg

SEQ ID NO: 6579162 - DNA, 20 bp, Homo sapiens
aagtgctaggattacaggca

SEQ ID NO: 6579163 - DNA, 11 bp, Homo sapiens
aagtgctcagg

SEQ ID NO: 6579164 - DNA, 12 bp, Homo sapiens
aagtgctcaggg

SEQ ID NO: 6579165 - DNA, 22 bp, Homo sapiens
aagtgctcagggaaatggcctt

SEQ ID NO: 6579166 - DNA, 16 bp, Homo sapiens
aagtgctcagttccaa

SEQ ID NO: 6579167 - DNA, 15 bp, Homo sapiens
aagtgctccccacac

SEQ ID NO: 6579168 - DNA, 17 bp, Homo sapiens
aagtgctccctggaggc

SEQ ID NO: 6579169 - DNA, 21 bp, Homo sapiens
aagtgctcttggctgacccct

SEQ ID NO: 6579170 - DNA, 11 bp, Homo sapiens
aagtgctcttt

SEQ ID NO: 6579171 - DNA, 21 bp, Homo sapiens
aagtgctctttccaccccaaa

SEQ ID NO: 6579172 - DNA, 17 bp, Homo sapiens
aagtgctgcacaaaagc

SEQ ID NO: 6579173 - DNA, 14 bp, Homo sapiens
aagtgctgcactca

SEQ ID NO: 6579174 - DNA, 14 bp, Homo sapiens
aagtgctgcattta

SEQ ID NO: 6579175 - DNA, 16 bp, Homo sapiens
aagtgctgctgtggag

SEQ ID NO: 6579176 - DNA, 13 bp, Homo sapiens
aagtgctggattg

SEQ ID NO: 6579177 - DNA, 20 bp, Homo sapiens
aagtgctggattgtccttgg

SEQ ID NO: 6579178 - DNA, 23 bp, Homo sapiens
aagtgctgggattacagacatga

SEQ ID NO: 6579179 - DNA, 22 bp, Homo sapiens
aagtgctgtacccttccacctc

SEQ ID NO: 6579180 - DNA, 22 bp, Homo sapiens
aagtgctgtataaaatcagcca

SEQ ID NO: 6579181 - DNA, 23 bp, Homo sapiens
aagtgctgtcttgatgactgctg

SEQ ID NO: 6579182 - DNA, 17 bp, Homo sapiens
ttgaggactatggaaat

SEQ ID NO: 6579183 - DNA, 13 bp, Homo sapiens
ttgaggacttctt

SEQ ID NO: 6579184 - DNA, 17 bp, Homo sapiens
ttgaggaggggagcaag

SEQ ID NO: 6579185 - DNA, 13 bp, Homo sapiens
ttgaggagtgtga

SEQ ID NO: 6579186 - DNA, 15 bp, Homo sapiens
ttgaggagtttccta

SEQ ID NO: 6579187 - DNA, 22 bp, Homo sapiens
ttgaggataaattgccataata

SEQ ID NO: 6579188 - DNA, 18 bp, Homo sapiens
ttgaggataactttttaa

SEQ ID NO: 6579189 - DNA, 18 bp, Homo sapiens
ttgaggatatattttcac

SEQ ID NO: 6579190 - DNA, 21 bp, Homo sapiens
ttgaggatatattttcacttt

SEQ ID NO: 6579191 - DNA, 16 bp, Homo sapiens
ttgaggatcatatgaa

SEQ ID NO: 6579192 - DNA, 16 bp, Homo sapiens
ttgaggatgcactggc

SEQ ID NO: 6579193 - DNA, 17 bp, Homo sapiens
ttgaggattgtggaaaa

SEQ ID NO: 6579194 - DNA, 18 bp, Homo sapiens
ttgaggattgtggaaaac

SEQ ID NO: 6579195 - DNA, 21 bp, Homo sapiens
ttgaggattgtggaaaaccag

SEQ ID NO: 6579196 - DNA, 18 bp, Homo sapiens
ttgaggatttagaagtgt

SEQ ID NO: 6579197 - DNA, 16 bp, Homo sapiens
ttgaggcaaaagaagg

SEQ ID NO: 6579198 - DNA, 13 bp, Homo sapiens
ttgaggccaggag

SEQ ID NO: 6579199 - DNA, 14 bp, Homo sapiens
ttgaggctgcagcg

SEQ ID NO: 6579200 - DNA, 22 bp, Homo sapiens
ttgaggcttggttccttcccaa

SEQ ID NO: 6579201 - DNA, 18 bp, Homo sapiens
ttgaggctttaaaaagaa

SEQ ID NO: 6579202 - DNA, 15 bp, Homo sapiens
ttgaggctttcaggt

SEQ ID NO: 6579203 - DNA, 14 bp, Homo sapiens
ttgaggctttgtgt

SEQ ID NO: 6579204 - DNA, 17 bp, Homo sapiens
ttgagggaaagagctta

SEQ ID NO: 6579205 - DNA, 15 bp, Homo sapiens
ttgagggaatgacac

SEQ ID NO: 6579206 - DNA, 11 bp, Homo sapiens
ttgagggacca

SEQ ID NO: 6579207 - DNA, 18 bp, Homo sapiens
ttgagggagctgggagac

SEQ ID NO: 6579208 - DNA, 16 bp, Homo sapiens
ttgagggcaagccacc

SEQ ID NO: 6579209 - DNA, 21 bp, Homo sapiens
ttgagggccagtgatgatgtt

SEQ ID NO: 6579210 - DNA, 16 bp, Homo sapiens
ttgagggcccagagca

SEQ ID NO: 6579211 - DNA, 23 bp, Homo sapiens
ttgagggcccagagcaggaagca

SEQ ID NO: 6579212 - DNA, 18 bp, Homo sapiens
ttgagggccttgcacata

SEQ ID NO: 6579213 - DNA, 17 bp, Homo sapiens
ttgaggggagcatgctt

SEQ ID NO: 6579214 - DNA, 15 bp, Homo sapiens
ttgaggggaggtggc

SEQ ID NO: 6579215 - DNA, 22 bp, Homo sapiens
ttgaggggaggtggccagcccg

SEQ ID NO: 6579216 - DNA, 22 bp, Homo sapiens
ttgaggggattaatatgaaaac

SEQ ID NO: 6579217 - DNA, 19 bp, Homo sapiens
ttgaggggccctggccagg

SEQ ID NO: 6579218 - DNA, 16 bp, Homo sapiens
ttgaggggttcttctg

SEQ ID NO: 6579219 - DNA, 18 bp, Homo sapiens
ttgagggtatgttttata

SEQ ID NO: 6579220 - DNA, 15 bp, Homo sapiens
ttgagggttccatgg

SEQ ID NO: 6579221 - DNA, 13 bp, Homo sapiens
ttgagggttgggc

SEQ ID NO: 6579222 - DNA, 16 bp, Homo sapiens
ttgaggtaaagatatg

SEQ ID NO: 6579223 - DNA, 18 bp, Homo sapiens
ttgaggtagaaatgcaag

SEQ ID NO: 6579224 - DNA, 14 bp, Homo sapiens
ttgaggtagaggaa

SEQ ID NO: 6579225 - DNA, 23 bp, Homo sapiens
ttgaggtaggagaggcgggagaa

SEQ ID NO: 6579226 - DNA, 16 bp, Homo sapiens
ttgaggtcaagtaaga

SEQ ID NO: 6579227 - DNA, 12 bp, Homo sapiens
ttgaggtccatg

SEQ ID NO: 6579228 - DNA, 17 bp, Homo sapiens
ttgaggtctagagagaa

SEQ ID NO: 6579229 - DNA, 22 bp, Homo sapiens
ttgaggtgcgctcacctcagag

SEQ ID NO: 6579230 - DNA, 22 bp, Homo sapiens
ttgaggtggcactttttcattt

SEQ ID NO: 6579231 - DNA, 11 bp, Homo sapiens
ttgaggtggct

SEQ ID NO: 6579232 - DNA, 21 bp, Homo sapiens
ttgaggtgggtgggcctgact

SEQ ID NO: 6579233 - DNA, 22 bp, Homo sapiens
ttgaggtgggtgggcctgactg

SEQ ID NO: 6579234 - DNA, 19 bp, Homo sapiens
ttgaggtggtgccttctca

SEQ ID NO: 6579235 - DNA, 15 bp, Homo sapiens
ttgagtaaaacacat

SEQ ID NO: 6579236 - DNA, 18 bp, Homo sapiens
ttgagtaaaataaatatt

SEQ ID NO: 6579237 - DNA, 13 bp, Homo sapiens
ttgagtaatttaa

SEQ ID NO: 6579238 - DNA, 16 bp, Homo sapiens
ttgagtaattttctga

SEQ ID NO: 6579239 - DNA, 18 bp, Homo sapiens
ttgagtacagtgaggagg

SEQ ID NO: 6579240 - DNA, 23 bp, Homo sapiens
ttgagtactagaatttgtatttt

SEQ ID NO: 6579241 - DNA, 20 bp, Homo sapiens
ttgagtagagagcaagggaa

SEQ ID NO: 6579242 - DNA, 13 bp, Homo sapiens
ttgagtagaggct

SEQ ID NO: 6579243 - DNA, 13 bp, Homo sapiens
ttgagtagatatt

SEQ ID NO: 6579244 - DNA, 16 bp, Homo sapiens
ttgagtagatattact

SEQ ID NO: 6579245 - DNA, 20 bp, Homo sapiens
ttgagtagatattactttat

SEQ ID NO: 6579246 - DNA, 21 bp, Homo sapiens
ttgagtagctgggattacagg

SEQ ID NO: 6579247 - DNA, 18 bp, Homo sapiens
ttgagtaggtaccttgta

SEQ ID NO: 6579248 - DNA, 21 bp, Homo sapiens
ttgagtaggtaccttgtagca

SEQ ID NO: 6579249 - DNA, 18 bp, Homo sapiens
ttgagtatattataatag

SEQ ID NO: 6579250 - DNA, 16 bp, Homo sapiens
ttgagtatgtgaagat

SEQ ID NO: 6579251 - DNA, 18 bp, Homo sapiens
ttgagtattacacattaa

SEQ ID NO: 6579252 - DNA, 13 bp, Homo sapiens
ttgagtattgttt

SEQ ID NO: 6579253 - DNA, 14 bp, Homo sapiens
ttgagtattgttta

SEQ ID NO: 6579254 - DNA, 16 bp, Homo sapiens
ttgagtcaaaaaatct

SEQ ID NO: 6579255 - DNA, 21 bp, Homo sapiens
ttgagtcaaaagcctgggtga

SEQ ID NO: 6579256 - DNA, 12 bp, Homo sapiens
ttgagtcagaaa

SEQ ID NO: 6579257 - DNA, 17 bp, Homo sapiens
ttgagtccagctttcct

SEQ ID NO: 6579258 - DNA, 15 bp, Homo sapiens
ttgagtcccttccag

SEQ ID NO: 6579259 - DNA, 18 bp, Homo sapiens
ttgagtcctacagtgtca

SEQ ID NO: 6579260 - DNA, 14 bp, Homo sapiens
ttgagtctattttt

SEQ ID NO: 6579261 - DNA, 23 bp, Homo sapiens
ttgagtctatttttgtacaaaag

SEQ ID NO: 6579262 - DNA, 17 bp, Homo sapiens
ttgagtctcctctctga

SEQ ID NO: 6579263 - DNA, 11 bp, Homo sapiens
ttgagtctctt

SEQ ID NO: 6579264 - DNA, 21 bp, Homo sapiens
ttgagtctcttttttattctg

SEQ ID NO: 6579265 - DNA, 17 bp, Homo sapiens
ttgagtctgtactaaac

SEQ ID NO: 6579266 - DNA, 14 bp, Homo sapiens
ttgagtctgtgcca

SEQ ID NO: 6579267 - DNA, 20 bp, Homo sapiens
ttgagtcttaactgtatttc

SEQ ID NO: 6579268 - DNA, 20 bp, Homo sapiens
ttgagtcttcacatttagaa

SEQ ID NO: 6579269 - DNA, 20 bp, Homo sapiens
ttgagtgaagctgggagaac

SEQ ID NO: 6579270 - DNA, 14 bp, Homo sapiens
ttgagtgactcgag

SEQ ID NO: 6579271 - DNA, 20 bp, Homo sapiens
ttgagtgactcgagggttgg

SEQ ID NO: 6579272 - DNA, 15 bp, Homo sapiens
ttgagtgagccggga

SEQ ID NO: 6579273 - DNA, 12 bp, Homo sapiens
ttgagtgattat

SEQ ID NO: 6579274 - DNA, 16 bp, Homo sapiens
ttgagtgcaacaagag

SEQ ID NO: 6579275 - DNA, 18 bp, Homo sapiens
ttgagtgcactgactgtg

SEQ ID NO: 6579276 - DNA, 22 bp, Homo sapiens
ttgagtggatggaggagaaata

SEQ ID NO: 6579277 - DNA, 18 bp, Homo sapiens
ttgagtgggccccctctc

SEQ ID NO: 6579278 - DNA, 13 bp, Homo sapiens
ttgagtgtatata

SEQ ID NO: 6579279 - DNA, 15 bp, Homo sapiens
ttgagtgtatgagta

SEQ ID NO: 6579280 - DNA, 22 bp, Homo sapiens
ttgagtgtattctatttgtgta

SEQ ID NO: 6579281 - DNA, 12 bp, Homo sapiens
ttgagtgtctgc

SEQ ID NO: 6579282 - DNA, 16 bp, Homo sapiens
ttgagtgtgcaatatg

SEQ ID NO: 6579283 - DNA, 19 bp, Homo sapiens
ttgagtgtgggactccagg

SEQ ID NO: 6579284 - DNA, 15 bp, Homo sapiens
ttgagtgtgtgtgtg

SEQ ID NO: 6579285 - DNA, 15 bp, Homo sapiens
ttgagtgttcatcag

SEQ ID NO: 6579286 - DNA, 18 bp, Homo sapiens
ttgagtgttcctttttaa

SEQ ID NO: 6579287 - DNA, 13 bp, Homo sapiens
ttgagtgtttaaa

SEQ ID NO: 6579288 - DNA, 17 bp, Homo sapiens
ttgagttaacaggacag

SEQ ID NO: 6579289 - DNA, 13 bp, Homo sapiens
ttgagttaatttt

SEQ ID NO: 6579290 - DNA, 20 bp, Homo sapiens
ttgagttacattaaaataaa

SEQ ID NO: 6579291 - DNA, 20 bp, Homo sapiens
ttgagttcaacctttagtac

SEQ ID NO: 6579292 - DNA, 13 bp, Homo sapiens
ttgagttcctcct

SEQ ID NO: 6579293 - DNA, 15 bp, Homo sapiens
ttgagttgctctgtc

SEQ ID NO: 6579294 - DNA, 17 bp, Homo sapiens
ttgagttggaacaacat

SEQ ID NO: 6579295 - DNA, 14 bp, Homo sapiens
ttgagttggctgtg

SEQ ID NO: 6579296 - DNA, 22 bp, Homo sapiens
ttgagttgggggtattttctaa

SEQ ID NO: 6579297 - DNA, 17 bp, Homo sapiens
ttgagtttaagtctctg

SEQ ID NO: 6579298 - DNA, 17 bp, Homo sapiens
ttgagtttacttataaa

SEQ ID NO: 6579299 - DNA, 16 bp, Homo sapiens
ttgagtttcagaataa

SEQ ID NO: 6579300 - DNA, 17 bp, Homo sapiens
ttgagtttcagaataaa

SEQ ID NO: 6579301 - DNA, 16 bp, Homo sapiens
ttgagtttcagctgga

SEQ ID NO: 6579302 - DNA, 14 bp, Homo sapiens
ttgagtttcatgtt

SEQ ID NO: 6579303 - DNA, 22 bp, Homo sapiens
ttgagtttcctcaggctgctgg

SEQ ID NO: 6579304 - DNA, 20 bp, Homo sapiens
ttgagtttcttctaaagagg

SEQ ID NO: 6579305 - DNA, 16 bp, Homo sapiens
ttgagtttgacattta

SEQ ID NO: 6579306 - DNA, 20 bp, Homo sapiens
ttgagttttatttattttat

SEQ ID NO: 6579307 - DNA, 14 bp, Homo sapiens
ttgagttttcagtg

SEQ ID NO: 6579308 - DNA, 15 bp, Homo sapiens
ttgagttttcatttc

SEQ ID NO: 6579309 - DNA, 12 bp, Homo sapiens
ttgagttttgta

SEQ ID NO: 6579310 - DNA, 14 bp, Homo sapiens
ttgagttttgtagc

SEQ ID NO: 6579311 - DNA, 21 bp, Homo sapiens
ttgagttttgttttaaaatta

SEQ ID NO: 6579312 - DNA, 16 bp, Homo sapiens
ttgagtttttcctccc

SEQ ID NO: 6579313 - DNA, 17 bp, Homo sapiens
ttgagtttttcctccca

SEQ ID NO: 6579314 - DNA, 21 bp, Homo sapiens
ttgagtttttcctcccagtga

SEQ ID NO: 6579315 - DNA, 23 bp, Homo sapiens
ttgagtttttcctcccagtgaga

SEQ ID NO: 6579316 - DNA, 16 bp, Homo sapiens
ttgataaaaacccaaa

SEQ ID NO: 6579317 - DNA, 15 bp, Homo sapiens
ttgataaaaatactg

SEQ ID NO: 6579318 - DNA, 11 bp, Homo sapiens
ttgataaaaga

SEQ ID NO: 6579319 - DNA, 18 bp, Homo sapiens
ttgataaaagattttcct

SEQ ID NO: 6579320 - DNA, 20 bp, Homo sapiens
ttgataaagattttttaata

SEQ ID NO: 6579321 - DNA, 13 bp, Homo sapiens
ttgataaagtttc

SEQ ID NO: 6579322 - DNA, 15 bp, Homo sapiens
ttgataaatagtgtt

SEQ ID NO: 6579323 - DNA, 15 bp, Homo sapiens
ttgataaatcatttt

SEQ ID NO: 6579324 - DNA, 15 bp, Homo sapiens
ttgataaatccatca

SEQ ID NO: 6579325 - DNA, 17 bp, Homo sapiens
ttgataaatggatatta

SEQ ID NO: 6579326 - DNA, 19 bp, Homo sapiens
ttgataaattccactggac

SEQ ID NO: 6579327 - DNA, 21 bp, Homo sapiens
ttgataaattccactggactt

SEQ ID NO: 6579328 - DNA, 13 bp, Homo sapiens
ttgataacaaaaa

SEQ ID NO: 6579329 - DNA, 22 bp, Homo sapiens
ttgataacaatgacactagaaa

SEQ ID NO: 6579330 - DNA, 11 bp, Homo sapiens
ttgataacagc

SEQ ID NO: 6579331 - DNA, 19 bp, Homo sapiens
ttgataacagcactgacta

SEQ ID NO: 6579332 - DNA, 13 bp, Homo sapiens
ttgataacagcta

SEQ ID NO: 6579333 - DNA, 15 bp, Homo sapiens
ttgataacattttgt

SEQ ID NO: 6579334 - DNA, 18 bp, Homo sapiens
ttgataaccttgaaaaaa

SEQ ID NO: 6579335 - DNA, 16 bp, Homo sapiens
ttgataagagggcaca

SEQ ID NO: 6579336 - DNA, 16 bp, Homo sapiens
ttgataagatctttta

SEQ ID NO: 6579337 - DNA, 16 bp, Homo sapiens
ttgataagatggtttc

SEQ ID NO: 6579338 - DNA, 16 bp, Homo sapiens
ttgataagttcataca

SEQ ID NO: 6579339 - DNA, 15 bp, Homo sapiens
ttgataatacttgac

SEQ ID NO: 6579340 - DNA, 21 bp, Homo sapiens
ttgataatatatattaagtgt

SEQ ID NO: 6579341 - DNA, 14 bp, Homo sapiens
ttgataatcttcag

SEQ ID NO: 6579342 - DNA, 15 bp, Homo sapiens
ttgataatcttcagg

SEQ ID NO: 6579343 - DNA, 13 bp, Homo sapiens
ttgataatgataa

SEQ ID NO: 6579344 - DNA, 15 bp, Homo sapiens
ttgataatgctttca

SEQ ID NO: 6579345 - DNA, 22 bp, Homo sapiens
ttgataatgttaaatttgtaag

SEQ ID NO: 6579346 - DNA, 12 bp, Homo sapiens
ttgataattctt

SEQ ID NO: 6579347 - DNA, 21 bp, Homo sapiens
ttgataattcttattttgtgg

SEQ ID NO: 6579348 - DNA, 23 bp, Homo sapiens
ttgataattgcattcatcttgtg

SEQ ID NO: 6579349 - DNA, 18 bp, Homo sapiens
ttgataattttcctttaa

SEQ ID NO: 6579350 - DNA, 22 bp, Homo sapiens
ttgataattttgaaatgattca

SEQ ID NO: 6579351 - DNA, 19 bp, Homo sapiens
ttgatacaaaccactgtga

SEQ ID NO: 6579352 - DNA, 12 bp, Homo sapiens
ttgatacaaatg

SEQ ID NO: 6579353 - DNA, 22 bp, Homo sapiens
ttgatacaacaggattttcaag

SEQ ID NO: 6579354 - DNA, 20 bp, Homo sapiens
ttgatacataaacttttgca

SEQ ID NO: 6579355 - DNA, 18 bp, Homo sapiens
ttgatacattcaaatttg

SEQ ID NO: 6579356 - DNA, 21 bp, Homo sapiens
ttgatacatttatcttctgtt

SEQ ID NO: 6579357 - DNA, 20 bp, Homo sapiens
ttgatacccctggggaacat

SEQ ID NO: 6579358 - DNA, 16 bp, Homo sapiens
ttgataccttcaatga

SEQ ID NO: 6579359 - DNA, 23 bp, Homo sapiens
ttgatacgtccgtgtgtcccaga

SEQ ID NO: 6579360 - DNA, 22 bp, Homo sapiens
ttgatacgtgtgtgaagtattt

SEQ ID NO: 6579361 - DNA, 15 bp, Homo sapiens
ttgatactacagttt

SEQ ID NO: 6579362 - DNA, 14 bp, Homo sapiens
aagtgctgtttatt

SEQ ID NO: 6579363 - DNA, 21 bp, Homo sapiens
aagtgctgtttattaatctta

SEQ ID NO: 6579364 - DNA, 15 bp, Homo sapiens
aagtgctgtttgaga

SEQ ID NO: 6579365 - DNA, 23 bp, Homo sapiens
aagtgctgtttgagatgtgatgc

SEQ ID NO: 6579366 - DNA, 20 bp, Homo sapiens
aagtgctgtttgggcaggag

SEQ ID NO: 6579367 - DNA, 20 bp, Homo sapiens
aagtgctgttttattactgt

SEQ ID NO: 6579368 - DNA, 17 bp, Homo sapiens
aagtgcttaaaaatact

SEQ ID NO: 6579369 - DNA, 17 bp, Homo sapiens
aagtgcttaacatttgt

SEQ ID NO: 6579370 - DNA, 22 bp, Homo sapiens
aagtgcttaacgttttcttaaa

SEQ ID NO: 6579371 - DNA, 19 bp, Homo sapiens
aagtgcttacattttaata

SEQ ID NO: 6579372 - DNA, 18 bp, Homo sapiens
aagtgcttagaaagttat

SEQ ID NO: 6579373 - DNA, 15 bp, Homo sapiens
aagtgcttaggaagg

SEQ ID NO: 6579374 - DNA, 18 bp, Homo sapiens
aagtgcttataatgtgtg

SEQ ID NO: 6579375 - DNA, 17 bp, Homo sapiens
aagtgcttccaaggcag

SEQ ID NO: 6579376 - DNA, 14 bp, Homo sapiens
aagtgcttcctaca

SEQ ID NO: 6579377 - DNA, 22 bp, Homo sapiens
aagtgcttgggggtttttgaag

SEQ ID NO: 6579378 - DNA, 21 bp, Homo sapiens
aagtgctttacctaagtgttg

SEQ ID NO: 6579379 - DNA, 11 bp, Homo sapiens
aagtggaaaaa

SEQ ID NO: 6579380 - DNA, 17 bp, Homo sapiens
aagtggaaaaaagagaa

SEQ ID NO: 6579381 - DNA, 19 bp, Homo sapiens
aagtggaaaaaagagaaaa

SEQ ID NO: 6579382 - DNA, 22 bp, Homo sapiens
aagtggaaaaagaaattctgtt

SEQ ID NO: 6579383 - DNA, 20 bp, Homo sapiens
aagtggaagacagagatggc

SEQ ID NO: 6579384 - DNA, 14 bp, Homo sapiens
aagtggaaggaaag

SEQ ID NO: 6579385 - DNA, 17 bp, Homo sapiens
aagtggaaggaaagatg

SEQ ID NO: 6579386 - DNA, 17 bp, Homo sapiens
aagtggaaggataatga

SEQ ID NO: 6579387 - DNA, 17 bp, Homo sapiens
aagtggaatttcttgtt

SEQ ID NO: 6579388 - DNA, 21 bp, Homo sapiens
aagtggacagagcgcccctcc

SEQ ID NO: 6579389 - DNA, 19 bp, Homo sapiens
aagtggaccaggacaggac

SEQ ID NO: 6579390 - DNA, 15 bp, Homo sapiens
aagtggacggcagac

SEQ ID NO: 6579391 - DNA, 18 bp, Homo sapiens
aagtggacgttaggccag

SEQ ID NO: 6579392 - DNA, 15 bp, Homo sapiens
aagtggactctctga

SEQ ID NO: 6579393 - DNA, 14 bp, Homo sapiens
aagtggactggagg

SEQ ID NO: 6579394 - DNA, 20 bp, Homo sapiens
aagtggactggcccctgggt

SEQ ID NO: 6579395 - DNA, 23 bp, Homo sapiens
aagtggacttctgaaaaatgaat

SEQ ID NO: 6579396 - DNA, 17 bp, Homo sapiens
aagtggagctgggaggt

SEQ ID NO: 6579397 - DNA, 20 bp, Homo sapiens
aagtggagctgtctgtctct

SEQ ID NO: 6579398 - DNA, 13 bp, Homo sapiens
aagtggcaaagct

SEQ ID NO: 6579399 - DNA, 23 bp, Homo sapiens
aagtggcaaagctgttcttcctg

SEQ ID NO: 6579400 - DNA, 12 bp, Homo sapiens
aagtggcaagct

SEQ ID NO: 6579401 - DNA, 19 bp, Homo sapiens
aagtggcaagctcttcatt

SEQ ID NO: 6579402 - DNA, 17 bp, Homo sapiens
aagtggcacctgtctgc

SEQ ID NO: 6579403 - DNA, 13 bp, Homo sapiens
aagtggcagctca

SEQ ID NO: 6579404 - DNA, 22 bp, Homo sapiens
aagtggcaggaggacaggtgga

SEQ ID NO: 6579405 - DNA, 14 bp, Homo sapiens
aagtggcataaaaa

SEQ ID NO: 6579406 - DNA, 20 bp, Homo sapiens
aagtggcatactttttaaaa

SEQ ID NO: 6579407 - DNA, 18 bp, Homo sapiens
aagtggcatgtgctgtga

SEQ ID NO: 6579408 - DNA, 14 bp, Homo sapiens
aagtggcatgtttt

SEQ ID NO: 6579409 - DNA, 16 bp, Homo sapiens
aagtggcatgttttgt

SEQ ID NO: 6579410 - DNA, 14 bp, Homo sapiens
aagtggccagggct

SEQ ID NO: 6579411 - DNA, 16 bp, Homo sapiens
aagtggcccccaccct

SEQ ID NO: 6579412 - DNA, 14 bp, Homo sapiens
aagtggcctctttg

SEQ ID NO: 6579413 - DNA, 17 bp, Homo sapiens
aagtggcctctttgtct

SEQ ID NO: 6579414 - DNA, 22 bp, Homo sapiens
aagtggcctctttgtctaaaac

SEQ ID NO: 6579415 - DNA, 18 bp, Homo sapiens
aagtggcctgagaagagt

SEQ ID NO: 6579416 - DNA, 21 bp, Homo sapiens
aagtggcctgagaagagtcga

SEQ ID NO: 6579417 - DNA, 12 bp, Homo sapiens
aagtggcgtgtg

SEQ ID NO: 6579418 - DNA, 16 bp, Homo sapiens
aagtggctatttcttt

SEQ ID NO: 6579419 - DNA, 18 bp, Homo sapiens
aagtggctcagacccctc

SEQ ID NO: 6579420 - DNA, 16 bp, Homo sapiens
aagtggctccccacct

SEQ ID NO: 6579421 - DNA, 19 bp, Homo sapiens
aagtggctccccacctgga

SEQ ID NO: 6579422 - DNA, 16 bp, Homo sapiens
aagtggctctggggtc

SEQ ID NO: 6579423 - DNA, 15 bp, Homo sapiens
aagtggctcttggga

SEQ ID NO: 6579424 - DNA, 12 bp, Homo sapiens
aagtggctgcct

SEQ ID NO: 6579425 - DNA, 18 bp, Homo sapiens
aagtggctggaagagtcc

SEQ ID NO: 6579426 - DNA, 18 bp, Homo sapiens
aagtggctgggtgccctc

SEQ ID NO: 6579427 - DNA, 14 bp, Homo sapiens
aagtggctggtctg

SEQ ID NO: 6579428 - DNA, 15 bp, Homo sapiens
aagtggctgtgacat

SEQ ID NO: 6579429 - DNA, 15 bp, Homo sapiens
aagtggctgtgatta

SEQ ID NO: 6579430 - DNA, 17 bp, Homo sapiens
aagtgggaaagttgcat

SEQ ID NO: 6579431 - DNA, 11 bp, Homo sapiens
aagtgggacat

SEQ ID NO: 6579432 - DNA, 19 bp, Homo sapiens
aagtgggagaagtggcccc

SEQ ID NO: 6579433 - DNA, 19 bp, Homo sapiens
aagtgggattcaggaatgg

SEQ ID NO: 6579434 - DNA, 16 bp, Homo sapiens
aagtgggccaggacag

SEQ ID NO: 6579435 - DNA, 11 bp, Homo sapiens
aagtgggccca

SEQ ID NO: 6579436 - DNA, 12 bp, Homo sapiens
aagtgggctgca

SEQ ID NO: 6579437 - DNA, 23 bp, Homo sapiens
aagtgggctggtattctctctat

SEQ ID NO: 6579438 - DNA, 22 bp, Homo sapiens
aagtgggcttgattctgcagta

SEQ ID NO: 6579439 - DNA, 15 bp, Homo sapiens
aagtggggacagagc

SEQ ID NO: 6579440 - DNA, 18 bp, Homo sapiens
aagtggggaccccacccc

SEQ ID NO: 6579441 - DNA, 23 bp, Homo sapiens
aagtggggaccccacccctcatc

SEQ ID NO: 6579442 - DNA, 18 bp, Homo sapiens
aagtggggagagagccct

SEQ ID NO: 6579443 - DNA, 20 bp, Homo sapiens
aagtggggagggacaaggga

SEQ ID NO: 6579444 - DNA, 17 bp, Homo sapiens
aagtggggatggggcct

SEQ ID NO: 6579445 - DNA, 23 bp, Homo sapiens
aagtggggcagatggcagggctg

SEQ ID NO: 6579446 - DNA, 23 bp, Homo sapiens
aagtggggcctccttgtccaggt

SEQ ID NO: 6579447 - DNA, 19 bp, Homo sapiens
aagtggggctaaatgaagt

SEQ ID NO: 6579448 - DNA, 19 bp, Homo sapiens
aagtgggggcagagggcag

SEQ ID NO: 6579449 - DNA, 17 bp, Homo sapiens
aagtgggggccgctggc

SEQ ID NO: 6579450 - DNA, 18 bp, Homo sapiens
aagtgggggccgctggcc

SEQ ID NO: 6579451 - DNA, 16 bp, Homo sapiens
aagtgggggtggagga

SEQ ID NO: 6579452 - DNA, 17 bp, Homo sapiens
aagtggggtctttcaga

SEQ ID NO: 6579453 - DNA, 18 bp, Homo sapiens
aagtggggtgctgggagg

SEQ ID NO: 6579454 - DNA, 14 bp, Homo sapiens
aagtggggtgttct

SEQ ID NO: 6579455 - DNA, 20 bp, Homo sapiens
aagtggggtgttcttcttgg

SEQ ID NO: 6579456 - DNA, 19 bp, Homo sapiens
aagtgggtacccccaggac

SEQ ID NO: 6579457 - DNA, 17 bp, Homo sapiens
aagtgggtggggacaga

SEQ ID NO: 6579458 - DNA, 23 bp, Homo sapiens
aagtgggtggggacagaccagcc

SEQ ID NO: 6579459 - DNA, 19 bp, Homo sapiens
aagtgggtgggtagattta

SEQ ID NO: 6579460 - DNA, 13 bp, Homo sapiens
aagtgggtgtgtg

SEQ ID NO: 6579461 - DNA, 19 bp, Homo sapiens
aagtgggttattctggagt

SEQ ID NO: 6579462 - DNA, 17 bp, Homo sapiens
aagtgggttcactagag

SEQ ID NO: 6579463 - DNA, 22 bp, Homo sapiens
aagtgggttcactagagctggg

SEQ ID NO: 6579464 - DNA, 23 bp, Homo sapiens
aagtgggttcgggaggtctctat

SEQ ID NO: 6579465 - DNA, 22 bp, Homo sapiens
aagtgggtttttatgaactgca

SEQ ID NO: 6579466 - DNA, 17 bp, Homo sapiens
aagtgggttttttagtt

SEQ ID NO: 6579467 - DNA, 15 bp, Homo sapiens
aagtggtaaatactg

SEQ ID NO: 6579468 - DNA, 19 bp, Homo sapiens
aagtggtaaatactgtgaa

SEQ ID NO: 6579469 - DNA, 23 bp, Homo sapiens
aagtggtaaatactgtgaaatac

SEQ ID NO: 6579470 - DNA, 19 bp, Homo sapiens
aagtggtaattgggaactg

SEQ ID NO: 6579471 - DNA, 18 bp, Homo sapiens
aagtggtaatttttgtac

SEQ ID NO: 6579472 - DNA, 19 bp, Homo sapiens
aagtggtaatttttgtaca

SEQ ID NO: 6579473 - DNA, 21 bp, Homo sapiens
aagtggtacaatctggctcac

SEQ ID NO: 6579474 - DNA, 15 bp, Homo sapiens
aagtggtagggatga

SEQ ID NO: 6579475 - DNA, 16 bp, Homo sapiens
aagtggtctctgctgg

SEQ ID NO: 6579476 - DNA, 15 bp, Homo sapiens
aagtggtctgaactg

SEQ ID NO: 6579477 - DNA, 21 bp, Homo sapiens
aagtggtctgaactgcttgct

SEQ ID NO: 6579478 - DNA, 19 bp, Homo sapiens
aagtggtcttaagaaatgt

SEQ ID NO: 6579479 - DNA, 23 bp, Homo sapiens
aagtggtgaccaaaatttttagg

SEQ ID NO: 6579480 - DNA, 22 bp, Homo sapiens
aagtggtgtaaacttgtacatg

SEQ ID NO: 6579481 - DNA, 17 bp, Homo sapiens
aagtggtgtttattgca

SEQ ID NO: 6579482 - DNA, 14 bp, Homo sapiens
aagtggttcagtct

SEQ ID NO: 6579483 - DNA, 19 bp, Homo sapiens
aagtggttctccttcctca

SEQ ID NO: 6579484 - DNA, 17 bp, Homo sapiens
aagtggttctctgcctt

SEQ ID NO: 6579485 - DNA, 18 bp, Homo sapiens
aagtggtttgcaggtcag

SEQ ID NO: 6579486 - DNA, 11 bp, Homo sapiens
aagtgtaaaaa

SEQ ID NO: 6579487 - DNA, 12 bp, Homo sapiens
aagtgtaaaaaa

SEQ ID NO: 6579488 - DNA, 14 bp, Homo sapiens
aagtgtaaaaaatg

SEQ ID NO: 6579489 - DNA, 15 bp, Homo sapiens
aagtgtaaaaaatgt

SEQ ID NO: 6579490 - DNA, 22 bp, Homo sapiens
aagtgtaaaatattttgaatca

SEQ ID NO: 6579491 - DNA, 12 bp, Homo sapiens
aagtgtaaatga

SEQ ID NO: 6579492 - DNA, 13 bp, Homo sapiens
aagtgtaataaat

SEQ ID NO: 6579493 - DNA, 15 bp, Homo sapiens
aagtgtaataatatg

SEQ ID NO: 6579494 - DNA, 22 bp, Homo sapiens
aagtgtaattccacatcatgtt

SEQ ID NO: 6579495 - DNA, 14 bp, Homo sapiens
aagtgtaattgaga

SEQ ID NO: 6579496 - DNA, 15 bp, Homo sapiens
aagtgtacaagttgc

SEQ ID NO: 6579497 - DNA, 16 bp, Homo sapiens
aagtgtacaagttgct

SEQ ID NO: 6579498 - DNA, 11 bp, Homo sapiens
aagtgtacaat

SEQ ID NO: 6579499 - DNA, 21 bp, Homo sapiens
aagtgtacaattgatcttttt

SEQ ID NO: 6579500 - DNA, 11 bp, Homo sapiens
aagtgtacaga

SEQ ID NO: 6579501 - DNA, 11 bp, Homo sapiens
aagtgtacagt

SEQ ID NO: 6579502 - DNA, 19 bp, Homo sapiens
aagtgtacatatgtaaaat

SEQ ID NO: 6579503 - DNA, 21 bp, Homo sapiens
aagtgtaccaacataagtgtt

SEQ ID NO: 6579504 - DNA, 14 bp, Homo sapiens
aagtgtagaagaaa

SEQ ID NO: 6579505 - DNA, 20 bp, Homo sapiens
aagtgtagatagttaaaaga

SEQ ID NO: 6579506 - DNA, 16 bp, Homo sapiens
aagtgtaggcagacac

SEQ ID NO: 6579507 - DNA, 19 bp, Homo sapiens
aagtgtataatataaaaaa

SEQ ID NO: 6579508 - DNA, 21 bp, Homo sapiens
aagtgtataatataaaaaatt

SEQ ID NO: 6579509 - DNA, 13 bp, Homo sapiens
aagtgtataatgt

SEQ ID NO: 6579510 - DNA, 17 bp, Homo sapiens
aagtgtataatgttggt

SEQ ID NO: 6579511 - DNA, 17 bp, Homo sapiens
aagtgtatgatgtcaca

SEQ ID NO: 6579512 - DNA, 17 bp, Homo sapiens
aagtgtatgcagtattc

SEQ ID NO: 6579513 - DNA, 17 bp, Homo sapiens
aagtgtattataacagt

SEQ ID NO: 6579514 - DNA, 15 bp, Homo sapiens
aagtgtatttggaaa

SEQ ID NO: 6579515 - DNA, 19 bp, Homo sapiens
aagtgtattttaaaataga

SEQ ID NO: 6579516 - DNA, 22 bp, Homo sapiens
aagtgtattttataaaattaaa

SEQ ID NO: 6579517 - DNA, 13 bp, Homo sapiens
aagtgtatttttc

SEQ ID NO: 6579518 - DNA, 16 bp, Homo sapiens
aagtgtcaactctttg

SEQ ID NO: 6579519 - DNA, 16 bp, Homo sapiens
aagtgtcacctccttc

SEQ ID NO: 6579520 - DNA, 20 bp, Homo sapiens
aagtgtcacctccttcccca

SEQ ID NO: 6579521 - DNA, 19 bp, Homo sapiens
aagtgtcactaagaatata

SEQ ID NO: 6579522 - DNA, 23 bp, Homo sapiens
aagtgtcatcaatttgtaatttt

SEQ ID NO: 6579523 - DNA, 21 bp, Homo sapiens
aagtgtccattgacatgtaca

SEQ ID NO: 6579524 - DNA, 13 bp, Homo sapiens
aagtgtcctggac

SEQ ID NO: 6579525 - DNA, 22 bp, Homo sapiens
aagtgtcctggaccctggccta

SEQ ID NO: 6579526 - DNA, 18 bp, Homo sapiens
aagtgtcgaaagcaactc

SEQ ID NO: 6579527 - DNA, 17 bp, Homo sapiens
aagtgtcgagtccagtc

SEQ ID NO: 6579528 - DNA, 21 bp, Homo sapiens
aagtgtctaatgcattaactt

SEQ ID NO: 6579529 - DNA, 19 bp, Homo sapiens
aagtgtctcactaaagcat

SEQ ID NO: 6579530 - DNA, 17 bp, Homo sapiens
aagtgtctcattctcag

SEQ ID NO: 6579531 - DNA, 16 bp, Homo sapiens
aagtgtctctgccttg

SEQ ID NO: 6579532 - DNA, 21 bp, Homo sapiens
aagtgtctcttgactggctca

SEQ ID NO: 6579533 - DNA, 21 bp, Homo sapiens
aagtgtctgtgatgctcccaa

SEQ ID NO: 6579534 - DNA, 15 bp, Homo sapiens
aagtgtcttaaattt

SEQ ID NO: 6579535 - DNA, 15 bp, Homo sapiens
aagtgtcttctgttc

SEQ ID NO: 6579536 - DNA, 20 bp, Homo sapiens
aagtgtcttctgttcccaag

SEQ ID NO: 6579537 - DNA, 11 bp, Homo sapiens
aagtgtctttt

SEQ ID NO: 6579538 - DNA, 14 bp, Homo sapiens
aagtgtcttttaaa

SEQ ID NO: 6579539 - DNA, 15 bp, Homo sapiens
aagtgtcttttaaac

SEQ ID NO: 6579540 - DNA, 20 bp, Homo sapiens
ttgatactgaatgcataaat

SEQ ID NO: 6579541 - DNA, 15 bp, Homo sapiens
ttgatactgttgcac

SEQ ID NO: 6579542 - DNA, 17 bp, Homo sapiens
ttgatactgttgcacgt

SEQ ID NO: 6579543 - DNA, 18 bp, Homo sapiens
ttgatactgttgcacgtg

SEQ ID NO: 6579544 - DNA, 16 bp, Homo sapiens
ttgatacttatatttt

SEQ ID NO: 6579545 - DNA, 20 bp, Homo sapiens
ttgatacttcaggtgctttt

SEQ ID NO: 6579546 - DNA, 16 bp, Homo sapiens
ttgatacttgtaactt

SEQ ID NO: 6579547 - DNA, 18 bp, Homo sapiens
ttgatacttgtaactttt

SEQ ID NO: 6579548 - DNA, 15 bp, Homo sapiens
ttgatagaaatgcca

SEQ ID NO: 6579549 - DNA, 17 bp, Homo sapiens
ttgatagatgcaagaga

SEQ ID NO: 6579550 - DNA, 13 bp, Homo sapiens
ttgatagatgttt

SEQ ID NO: 6579551 - DNA, 16 bp, Homo sapiens
ttgatagatgtttgac

SEQ ID NO: 6579552 - DNA, 20 bp, Homo sapiens
ttgatagcacagaccctgcc

SEQ ID NO: 6579553 - DNA, 18 bp, Homo sapiens
ttgatagctaaataactt

SEQ ID NO: 6579554 - DNA, 16 bp, Homo sapiens
ttgataggaactgtct

SEQ ID NO: 6579555 - DNA, 17 bp, Homo sapiens
ttgataggaactgtctc

SEQ ID NO: 6579556 - DNA, 18 bp, Homo sapiens
ttgataggagacttgtac

SEQ ID NO: 6579557 - DNA, 19 bp, Homo sapiens
ttgatagggtctaccaata

SEQ ID NO: 6579558 - DNA, 16 bp, Homo sapiens
ttgatagtatttataa

SEQ ID NO: 6579559 - DNA, 18 bp, Homo sapiens
ttgatagtgatgtatttt

SEQ ID NO: 6579560 - DNA, 12 bp, Homo sapiens
ttgatagtggga

SEQ ID NO: 6579561 - DNA, 18 bp, Homo sapiens
ttgatagttctataagaa

SEQ ID NO: 6579562 - DNA, 15 bp, Homo sapiens
ttgatagtttacaaa

SEQ ID NO: 6579563 - DNA, 20 bp, Homo sapiens
ttgatataattacttaatgt

SEQ ID NO: 6579564 - DNA, 16 bp, Homo sapiens
ttgatataattgtact

SEQ ID NO: 6579565 - DNA, 18 bp, Homo sapiens
ttgatataattgtactgt

SEQ ID NO: 6579566 - DNA, 19 bp, Homo sapiens
ttgatataccaaattaaaa

SEQ ID NO: 6579567 - DNA, 21 bp, Homo sapiens
ttgatatacttttttcttatt

SEQ ID NO: 6579568 - DNA, 13 bp, Homo sapiens
ttgatatatatta

SEQ ID NO: 6579569 - DNA, 14 bp, Homo sapiens
ttgatatattcttt

SEQ ID NO: 6579570 - DNA, 22 bp, Homo sapiens
ttgatatattctttccatgcag

SEQ ID NO: 6579571 - DNA, 17 bp, Homo sapiens
ttgatatatttcattct

SEQ ID NO: 6579572 - DNA, 18 bp, Homo sapiens
ttgatatcggtgctatgt

SEQ ID NO: 6579573 - DNA, 20 bp, Homo sapiens
ttgatatctcaatctgcagc

SEQ ID NO: 6579574 - DNA, 16 bp, Homo sapiens
ttgatatgaaaaatat

SEQ ID NO: 6579575 - DNA, 19 bp, Homo sapiens
ttgatatgactaattcagg

SEQ ID NO: 6579576 - DNA, 19 bp, Homo sapiens
ttgatatgattgtaacata

SEQ ID NO: 6579577 - DNA, 20 bp, Homo sapiens
ttgatatgattgtaacatat

SEQ ID NO: 6579578 - DNA, 18 bp, Homo sapiens
ttgatatgcaactgcagt

SEQ ID NO: 6579579 - DNA, 16 bp, Homo sapiens
ttgatatgcttataca

SEQ ID NO: 6579580 - DNA, 15 bp, Homo sapiens
ttgatattctaagaa

SEQ ID NO: 6579581 - DNA, 18 bp, Homo sapiens
ttgatattctaagaaata

SEQ ID NO: 6579582 - DNA, 23 bp, Homo sapiens
ttgatattctaagaaatatctgt

SEQ ID NO: 6579583 - DNA, 14 bp, Homo sapiens
ttgatattgaagga

SEQ ID NO: 6579584 - DNA, 12 bp, Homo sapiens
ttgatattgtga

SEQ ID NO: 6579585 - DNA, 19 bp, Homo sapiens
ttgatattgtgtaggaaat

SEQ ID NO: 6579586 - DNA, 15 bp, Homo sapiens
ttgatatttaaaaga

SEQ ID NO: 6579587 - DNA, 19 bp, Homo sapiens
ttgatatttaaaagatcca

SEQ ID NO: 6579588 - DNA, 23 bp, Homo sapiens
ttgatatttgcattgaggaaata

SEQ ID NO: 6579589 - DNA, 22 bp, Homo sapiens
ttgatatttgtatttattcttt

SEQ ID NO: 6579590 - DNA, 14 bp, Homo sapiens
ttgatatttgtgta

SEQ ID NO: 6579591 - DNA, 17 bp, Homo sapiens
ttgatatttgtgtaaag

SEQ ID NO: 6579592 - DNA, 18 bp, Homo sapiens
ttgatattttcccttttt

SEQ ID NO: 6579593 - DNA, 16 bp, Homo sapiens
ttgatcaaaatcaaaa

SEQ ID NO: 6579594 - DNA, 19 bp, Homo sapiens
ttgatcaaaatcaaaaggt

SEQ ID NO: 6579595 - DNA, 14 bp, Homo sapiens
ttgatcaaatatag

SEQ ID NO: 6579596 - DNA, 17 bp, Homo sapiens
ttgatcaaatatagaaa

SEQ ID NO: 6579597 - DNA, 12 bp, Homo sapiens
ttgatcaaatgt

SEQ ID NO: 6579598 - DNA, 17 bp, Homo sapiens
ttgatcaaattcatttt

SEQ ID NO: 6579599 - DNA, 17 bp, Homo sapiens
ttgatcacactatttta

SEQ ID NO: 6579600 - DNA, 17 bp, Homo sapiens
ttgatcacatgcttgaa

SEQ ID NO: 6579601 - DNA, 12 bp, Homo sapiens
ttgatcaccatg

SEQ ID NO: 6579602 - DNA, 21 bp, Homo sapiens
ttgatcagagcattgtgcaat

SEQ ID NO: 6579603 - DNA, 21 bp, Homo sapiens
ttgatcagccccaccctggcc

SEQ ID NO: 6579604 - DNA, 18 bp, Homo sapiens
ttgatcagtagtttgcat

SEQ ID NO: 6579605 - DNA, 14 bp, Homo sapiens
ttgatcagtataat

SEQ ID NO: 6579606 - DNA, 12 bp, Homo sapiens
ttgatcagttaa

SEQ ID NO: 6579607 - DNA, 23 bp, Homo sapiens
ttgatcataaactgactatcata

SEQ ID NO: 6579608 - DNA, 12 bp, Homo sapiens
ttgatcatagaa

SEQ ID NO: 6579609 - DNA, 13 bp, Homo sapiens
ttgatcatgcagg

SEQ ID NO: 6579610 - DNA, 15 bp, Homo sapiens
ttgatcatgtacttt

SEQ ID NO: 6579611 - DNA, 16 bp, Homo sapiens
ttgatcatgtactttt

SEQ ID NO: 6579612 - DNA, 21 bp, Homo sapiens
ttgatcattcataattttatc

SEQ ID NO: 6579613 - DNA, 13 bp, Homo sapiens
ttgatcatttctg

SEQ ID NO: 6579614 - DNA, 15 bp, Homo sapiens
ttgatcatttctgcc

SEQ ID NO: 6579615 - DNA, 22 bp, Homo sapiens
ttgatcattttccccccactct

SEQ ID NO: 6579616 - DNA, 22 bp, Homo sapiens
ttgatcatttttatatgaaata

SEQ ID NO: 6579617 - DNA, 17 bp, Homo sapiens
ttgatccagaaagaaaa

SEQ ID NO: 6579618 - DNA, 18 bp, Homo sapiens
ttgatccagtcattttat

SEQ ID NO: 6579619 - DNA, 21 bp, Homo sapiens
ttgatccatccagcttgccag

SEQ ID NO: 6579620 - DNA, 19 bp, Homo sapiens
ttgatccatctcagtcact

SEQ ID NO: 6579621 - DNA, 17 bp, Homo sapiens
ttgatccatttctaatt

SEQ ID NO: 6579622 - DNA, 23 bp, Homo sapiens
ttgatcccctctctgtggctcca

SEQ ID NO: 6579623 - DNA, 23 bp, Homo sapiens
ttgatccctaaccctacaaagag

SEQ ID NO: 6579624 - DNA, 23 bp, Homo sapiens
ttgatccttctgagctccacctc

SEQ ID NO: 6579625 - DNA, 20 bp, Homo sapiens
ttgatcctttgatcccagaa

SEQ ID NO: 6579626 - DNA, 20 bp, Homo sapiens
ttgatctacccgtgcctggg

SEQ ID NO: 6579627 - DNA, 19 bp, Homo sapiens
ttgatctatctacaaagaa

SEQ ID NO: 6579628 - DNA, 21 bp, Homo sapiens
ttgatctcagcatcctggaaa

SEQ ID NO: 6579629 - DNA, 16 bp, Homo sapiens
ttgatctccgtggctt

SEQ ID NO: 6579630 - DNA, 13 bp, Homo sapiens
ttgatctcctgag

SEQ ID NO: 6579631 - DNA, 17 bp, Homo sapiens
ttgatctctcttgtcct

SEQ ID NO: 6579632 - DNA, 13 bp, Homo sapiens
ttgatctctgctt

SEQ ID NO: 6579633 - DNA, 17 bp, Homo sapiens
ttgatctcttagaagcc

SEQ ID NO: 6579634 - DNA, 13 bp, Homo sapiens
ttgatctcttttt

SEQ ID NO: 6579635 - DNA, 16 bp, Homo sapiens
ttgatctgataagcaa

SEQ ID NO: 6579636 - DNA, 17 bp, Homo sapiens
ttgatctgcatatttct

SEQ ID NO: 6579637 - DNA, 18 bp, Homo sapiens
ttgatctgcatatttctg

SEQ ID NO: 6579638 - DNA, 21 bp, Homo sapiens
ttgatctgcatatttctgtat

SEQ ID NO: 6579639 - DNA, 23 bp, Homo sapiens
ttgatctgcatatttctgtatat

SEQ ID NO: 6579640 - DNA, 13 bp, Homo sapiens
ttgatctgctctg

SEQ ID NO: 6579641 - DNA, 12 bp, Homo sapiens
ttgatctggtgc

SEQ ID NO: 6579642 - DNA, 13 bp, Homo sapiens
ttgatctgtatta

SEQ ID NO: 6579643 - DNA, 14 bp, Homo sapiens
ttgatctgtattaa

SEQ ID NO: 6579644 - DNA, 18 bp, Homo sapiens
ttgatcttacaagatatt

SEQ ID NO: 6579645 - DNA, 11 bp, Homo sapiens
ttgatcttcaa

SEQ ID NO: 6579646 - DNA, 17 bp, Homo sapiens
ttgatcttcctctgcta

SEQ ID NO: 6579647 - DNA, 17 bp, Homo sapiens
ttgatctttgagtgtat

SEQ ID NO: 6579648 - DNA, 19 bp, Homo sapiens
ttgatctttgtttaaatgc

SEQ ID NO: 6579649 - DNA, 20 bp, Homo sapiens
ttgatctttgtttaaatgcc

SEQ ID NO: 6579650 - DNA, 22 bp, Homo sapiens
ttgatctttgtttaaatgccaa

SEQ ID NO: 6579651 - DNA, 14 bp, Homo sapiens
ttgatgaagaagtt

SEQ ID NO: 6579652 - DNA, 23 bp, Homo sapiens
ttgatgaagaagttgatatgcct

SEQ ID NO: 6579653 - DNA, 16 bp, Homo sapiens
ttgatgaagcaaggaa

SEQ ID NO: 6579654 - DNA, 23 bp, Homo sapiens
ttgatgaagcaaggaagatatac

SEQ ID NO: 6579655 - DNA, 22 bp, Homo sapiens
ttgatgaagcccgtgtcctgcc

SEQ ID NO: 6579656 - DNA, 14 bp, Homo sapiens
ttgatgaagcctgt

SEQ ID NO: 6579657 - DNA, 21 bp, Homo sapiens
ttgatgaagcctgtgccacct

SEQ ID NO: 6579658 - DNA, 15 bp, Homo sapiens
ttgatgaaggagttt

SEQ ID NO: 6579659 - DNA, 22 bp, Homo sapiens
ttgatgaataaaatgtttattt

SEQ ID NO: 6579660 - DNA, 19 bp, Homo sapiens
ttgatgaattcttcctctc

SEQ ID NO: 6579661 - DNA, 20 bp, Homo sapiens
ttgatgaccaaagtcctttt

SEQ ID NO: 6579662 - DNA, 18 bp, Homo sapiens
ttgatgaccaatctctgt

SEQ ID NO: 6579663 - DNA, 20 bp, Homo sapiens
ttgatgaccaatctctgtga

SEQ ID NO: 6579664 - DNA, 18 bp, Homo sapiens
ttgatgactcgaaactga

SEQ ID NO: 6579665 - DNA, 20 bp, Homo sapiens
ttgatgactcgaaactgaca

SEQ ID NO: 6579666 - DNA, 12 bp, Homo sapiens
ttgatgactgcc

SEQ ID NO: 6579667 - DNA, 13 bp, Homo sapiens
ttgatgactgcct

SEQ ID NO: 6579668 - DNA, 21 bp, Homo sapiens
ttgatgactgccttgcctcct

SEQ ID NO: 6579669 - DNA, 19 bp, Homo sapiens
ttgatgactggcattttat

SEQ ID NO: 6579670 - DNA, 19 bp, Homo sapiens
ttgatgagcactcctgatt

SEQ ID NO: 6579671 - DNA, 14 bp, Homo sapiens
ttgatgaggcctct

SEQ ID NO: 6579672 - DNA, 16 bp, Homo sapiens
ttgatgaggtttattc

SEQ ID NO: 6579673 - DNA, 19 bp, Homo sapiens
ttgatgataatacccacat

SEQ ID NO: 6579674 - DNA, 21 bp, Homo sapiens
ttgatgatacaatgaacactt

SEQ ID NO: 6579675 - DNA, 19 bp, Homo sapiens
ttgatgatgtctacagaaa

SEQ ID NO: 6579676 - DNA, 22 bp, Homo sapiens
ttgatgatgtctacagaaaatg

SEQ ID NO: 6579677 - DNA, 14 bp, Homo sapiens
ttgatgattcactg

SEQ ID NO: 6579678 - DNA, 20 bp, Homo sapiens
ttgatgattgccaacagtgg

SEQ ID NO: 6579679 - DNA, 17 bp, Homo sapiens
ttgatgattttgtaatt

SEQ ID NO: 6579680 - DNA, 19 bp, Homo sapiens
ttgatgatttttaactttt

SEQ ID NO: 6579681 - DNA, 19 bp, Homo sapiens
ttgatgcaatccttacaaa

SEQ ID NO: 6579682 - DNA, 20 bp, Homo sapiens
ttgatgcaatccttacaaat

SEQ ID NO: 6579683 - DNA, 21 bp, Homo sapiens
ttgatgcacagagaagctggg

SEQ ID NO: 6579684 - DNA, 18 bp, Homo sapiens
ttgatgcagataaaatat

SEQ ID NO: 6579685 - DNA, 15 bp, Homo sapiens
ttgatgcagcatttg

SEQ ID NO: 6579686 - DNA, 12 bp, Homo sapiens
ttgatgcatgtg

SEQ ID NO: 6579687 - DNA, 17 bp, Homo sapiens
ttgatgccaaagcagac

SEQ ID NO: 6579688 - DNA, 18 bp, Homo sapiens
ttgatgccagagggccag

SEQ ID NO: 6579689 - DNA, 20 bp, Homo sapiens
ttgatgccagagggccagca

SEQ ID NO: 6579690 - DNA, 20 bp, Homo sapiens
ttgatgccatttgtcttttg

SEQ ID NO: 6579691 - DNA, 17 bp, Homo sapiens
ttgatgcccagataata

SEQ ID NO: 6579692 - DNA, 18 bp, Homo sapiens
ttgatgcctgtgaagaac

SEQ ID NO: 6579693 - DNA, 24 bp, Homo sapiens
ttgatgccttttttttcatgacat

SEQ ID NO: 6579694 - DNA, 15 bp, Homo sapiens
ttgatgctaataaat

SEQ ID NO: 6579695 - DNA, 19 bp, Homo sapiens
ttgatgctgtttctacatt

SEQ ID NO: 6579696 - DNA, 13 bp, Homo sapiens
ttgatgcttttct

SEQ ID NO: 6579697 - DNA, 14 bp, Homo sapiens
ttgatgcttttctc

SEQ ID NO: 6579698 - DNA, 14 bp, Homo sapiens
ttgatggaaaataa

SEQ ID NO: 6579699 - DNA, 15 bp, Homo sapiens
ttgatggaaaataaa

SEQ ID NO: 6579700 - DNA, 21 bp, Homo sapiens
ttgatggaaaataaacatcag

SEQ ID NO: 6579701 - DNA, 12 bp, Homo sapiens
ttgatggagccc

SEQ ID NO: 6579702 - DNA, 19 bp, Homo sapiens
ttgatggagggtggaaata

SEQ ID NO: 6579703 - DNA, 21 bp, Homo sapiens
ttgatggagtgtgagccacct

SEQ ID NO: 6579704 - DNA, 21 bp, Homo sapiens
ttgatggcaaaaaaaaaaaag

SEQ ID NO: 6579705 - DNA, 22 bp, Homo sapiens
ttgatggcaaaaaaaaaaaagc

SEQ ID NO: 6579706 - DNA, 23 bp, Homo sapiens
ttgatggccaaagcaaaggagag

SEQ ID NO: 6579707 - DNA, 22 bp, Homo sapiens
ttgatggccccatctggatgta

SEQ ID NO: 6579708 - DNA, 12 bp, Homo sapiens
ttgatggctgcg

SEQ ID NO: 6579709 - DNA, 12 bp, Homo sapiens
ttgatggctggg

SEQ ID NO: 6579710 - DNA, 16 bp, Homo sapiens
ttgatggctgggtcct

SEQ ID NO: 6579711 - DNA, 14 bp, Homo sapiens
ttgatgggaaaagc

SEQ ID NO: 6579712 - DNA, 21 bp, Homo sapiens
ttgatgggaagaaaaggtaca

SEQ ID NO: 6579713 - DNA, 21 bp, Homo sapiens
ttgatgggatgattgaagaaa

SEQ ID NO: 6579714 - DNA, 17 bp, Homo sapiens
ttgatgggattctggac

SEQ ID NO: 6579715 - DNA, 18 bp, Homo sapiens
ttgatgggccttcagatt

SEQ ID NO: 6579716 - DNA, 22 bp, Homo sapiens
ttgatggggaatccgtgtgtgt

SEQ ID NO: 6579717 - DNA, 12 bp, Homo sapiens
ttgatggggaga

SEQ ID NO: 6579718 - DNA, 18 bp, Homo sapiens
ttgatgggggccaggaca

SEQ ID NO: 6579719 - DNA, 22 bp, Homo sapiens
ttgatgggggccaggacaccag

SEQ ID NO: 6579720 - DNA, 19 bp, Homo sapiens
ttgatggtagaaattttat

SEQ ID NO: 6579721 - DNA, 18 bp, Homo sapiens
ttgatggtgaatattaca

SEQ ID NO: 6579722 - DNA, 19 bp, Homo sapiens
ttgatggtggtatgttttc

SEQ ID NO: 6579723 - DNA, 12 bp, Homo sapiens
ttgatggtttat

SEQ ID NO: 6579724 - DNA, 14 bp, Homo sapiens
ttgatgtaaagatg

SEQ ID NO: 6579725 - DNA, 23 bp, Homo sapiens
ttgatgtaaagatgttctggata

SEQ ID NO: 6579726 - DNA, 17 bp, Homo sapiens
ttgatgtaaggactgta

SEQ ID NO: 6579727 - DNA, 18 bp, Homo sapiens
ttgatgtaaggactgtaa

SEQ ID NO: 6579728 - DNA, 16 bp, Homo sapiens
ttgatgtaatgaaatt

SEQ ID NO: 6579729 - DNA, 21 bp, Homo sapiens
ttgatgtacagattttatttg

SEQ ID NO: 6579730 - DNA, 20 bp, Homo sapiens
ttgatgtacagtctgtcatg

SEQ ID NO: 6579731 - DNA, 23 bp, Homo sapiens
ttgatgtacataactcctgtccc

SEQ ID NO: 6579732 - DNA, 15 bp, Homo sapiens
ttgatgtacatgtgt

SEQ ID NO: 6579733 - DNA, 20 bp, Homo sapiens
ttgatgtatatgtttatata

SEQ ID NO: 6579734 - DNA, 12 bp, Homo sapiens
ttgatgtatctg

SEQ ID NO: 6579735 - DNA, 15 bp, Homo sapiens
ttgatgtatctgagt

SEQ ID NO: 6579736 - DNA, 13 bp, Homo sapiens
ttgatgtatgtgt

SEQ ID NO: 6579737 - DNA, 17 bp, Homo sapiens
ttgatgtatgtgtgaaa

SEQ ID NO: 6579738 - DNA, 20 bp, Homo sapiens
ttgatgtatgtgtgaaacaa

SEQ ID NO: 6579739 - DNA, 23 bp, Homo sapiens
ttgatgtctccaagtagtccacc

SEQ ID NO: 6579740 - DNA, 11 bp, Homo sapiens
ttgatgtgaaa

SEQ ID NO: 6579741 - DNA, 16 bp, Homo sapiens
ttgatgtgaaattaaa

SEQ ID NO: 6579742 - DNA, 14 bp, Homo sapiens
ttgatgtgactttt

SEQ ID NO: 6579743 - DNA, 21 bp, Homo sapiens
ttgatgtgactttttttggta

SEQ ID NO: 6579744 - DNA, 17 bp, Homo sapiens
ttgatgtgcgtgctgtc

SEQ ID NO: 6579745 - DNA, 19 bp, Homo sapiens
ttgatgtggccctggctgc

SEQ ID NO: 6579746 - DNA, 20 bp, Homo sapiens
ttgatgtggccctggctgcc

SEQ ID NO: 6579747 - DNA, 18 bp, Homo sapiens
ttgatgtgtatgtgttta

SEQ ID NO: 6579748 - DNA, 19 bp, Homo sapiens
ttgatgtgtatgtgtttat

SEQ ID NO: 6579749 - DNA, 16 bp, Homo sapiens
ttgatgtgtgtctagg

SEQ ID NO: 6579750 - DNA, 16 bp, Homo sapiens
ttgatgttaacacatt

SEQ ID NO: 6579751 - DNA, 13 bp, Homo sapiens
ttgatgtttagaa

SEQ ID NO: 6579752 - DNA, 15 bp, Homo sapiens
ttgatgtttccagaa

SEQ ID NO: 6579753 - DNA, 18 bp, Homo sapiens
ttgatgtttccagaaaat

SEQ ID NO: 6579754 - DNA, 21 bp, Homo sapiens
ttgatgtttccagaaaatata

SEQ ID NO: 6579755 - DNA, 19 bp, Homo sapiens
ttgatgtttctatatgtaa

SEQ ID NO: 6579756 - DNA, 13 bp, Homo sapiens
ttgatgtttgtgg

SEQ ID NO: 6579757 - DNA, 15 bp, Homo sapiens
ttgatgtttgtggcc

SEQ ID NO: 6579758 - DNA, 16 bp, Homo sapiens
ttgatgtttgtggcct

SEQ ID NO: 6579759 - DNA, 17 bp, Homo sapiens
ttgatgtttgtggcctc

SEQ ID NO: 6579760 - DNA, 18 bp, Homo sapiens
ttgatgttttacgtgcaa

SEQ ID NO: 6579761 - DNA, 20 bp, Homo sapiens
ttgatgttttacgtgcaaac

SEQ ID NO: 6579762 - DNA, 21 bp, Homo sapiens
ttgatgttttacgtgcaaaca

SEQ ID NO: 6579763 - DNA, 13 bp, Homo sapiens
ttgattaaaatct

SEQ ID NO: 6579764 - DNA, 22 bp, Homo sapiens
ttgattaaacagcaaagccata

SEQ ID NO: 6579765 - DNA, 13 bp, Homo sapiens
ttgattaaactgt

SEQ ID NO: 6579766 - DNA, 13 bp, Homo sapiens
ttgattaaattct

SEQ ID NO: 6579767 - DNA, 14 bp, Homo sapiens
ttgattaaattctt

SEQ ID NO: 6579768 - DNA, 19 bp, Homo sapiens
ttgattaaccttttcaaat

SEQ ID NO: 6579769 - DNA, 18 bp, Homo sapiens
ttgattaagattttacaa

SEQ ID NO: 6579770 - DNA, 18 bp, Homo sapiens
ttgattaatccagaataa

SEQ ID NO: 6579771 - DNA, 20 bp, Homo sapiens
ttgattacataatcaaagct

SEQ ID NO: 6579772 - DNA, 16 bp, Homo sapiens
ttgattacataatgtt

SEQ ID NO: 6579773 - DNA, 18 bp, Homo sapiens
ttgattaggtatgtttgt

SEQ ID NO: 6579774 - DNA, 19 bp, Homo sapiens
ttgattaggtatgtttgta

SEQ ID NO: 6579775 - DNA, 22 bp, Homo sapiens
ttgattaggtatgtttgtaact

SEQ ID NO: 6579776 - DNA, 20 bp, Homo sapiens
ttgattatcttcagcccagg

SEQ ID NO: 6579777 - DNA, 16 bp, Homo sapiens
ttgattattagccagg

SEQ ID NO: 6579778 - DNA, 20 bp, Homo sapiens
ttgattattctgattccact

SEQ ID NO: 6579779 - DNA, 15 bp, Homo sapiens
ttgattatttgcatg

SEQ ID NO: 6579780 - DNA, 16 bp, Homo sapiens
ttgattatttgcatgt

SEQ ID NO: 6579781 - DNA, 15 bp, Homo sapiens
ttgattcaaaatatt

SEQ ID NO: 6579782 - DNA, 18 bp, Homo sapiens
ttgattcaaaatatttaa

SEQ ID NO: 6579783 - DNA, 22 bp, Homo sapiens
ttgattcaaaatatttaaaaat

SEQ ID NO: 6579784 - DNA, 15 bp, Homo sapiens
ttgattcaaatgtta

SEQ ID NO: 6579785 - DNA, 18 bp, Homo sapiens
ttgattcaaatgttacaa

SEQ ID NO: 6579786 - DNA, 22 bp, Homo sapiens
ttgattcaagggcctagatttg

SEQ ID NO: 6579787 - DNA, 19 bp, Homo sapiens
ttgattcacacttgttcaa

SEQ ID NO: 6579788 - DNA, 21 bp, Homo sapiens
ttgattcacagtggtcccatt

SEQ ID NO: 6579789 - DNA, 16 bp, Homo sapiens
ttgattcacatgtttt

SEQ ID NO: 6579790 - DNA, 18 bp, Homo sapiens
ttgattcacatgttttca

SEQ ID NO: 6579791 - DNA, 20 bp, Homo sapiens
ttgattcacctcctaaaaca

SEQ ID NO: 6579792 - DNA, 21 bp, Homo sapiens
ttgattcacctcctaaaacaa

SEQ ID NO: 6579793 - DNA, 15 bp, Homo sapiens
ttgattcagacagct

SEQ ID NO: 6579794 - DNA, 21 bp, Homo sapiens
ttgattcagctcattatgaaa

SEQ ID NO: 6579795 - DNA, 14 bp, Homo sapiens
ttgattcaggaggt

SEQ ID NO: 6579796 - DNA, 18 bp, Homo sapiens
ttgattcagtcttctgga

SEQ ID NO: 6579797 - DNA, 17 bp, Homo sapiens
ttgattcataatgactt

SEQ ID NO: 6579798 - DNA, 19 bp, Homo sapiens
ttgattcatagtaacttct

SEQ ID NO: 6579799 - DNA, 16 bp, Homo sapiens
ttgattcattttcctg

SEQ ID NO: 6579800 - DNA, 21 bp, Homo sapiens
ttgattccaatccaattatca

SEQ ID NO: 6579801 - DNA, 23 bp, Homo sapiens
ttgattccacttgtgtggaggga

SEQ ID NO: 6579802 - DNA, 13 bp, Homo sapiens
ttgattcctggct

SEQ ID NO: 6579803 - DNA, 13 bp, Homo sapiens
ttgattctccttc

SEQ ID NO: 6579804 - DNA, 20 bp, Homo sapiens
ttgattctccttttatgtgt

SEQ ID NO: 6579805 - DNA, 14 bp, Homo sapiens
ttgattctctccat

SEQ ID NO: 6579806 - DNA, 17 bp, Homo sapiens
ttgattctgaatctgaa

SEQ ID NO: 6579807 - DNA, 20 bp, Homo sapiens
ttgattctgcagtaaatctt

SEQ ID NO: 6579808 - DNA, 18 bp, Homo sapiens
ttgattctgcttgagaat

SEQ ID NO: 6579809 - DNA, 16 bp, Homo sapiens
ttgattcttaactaaa

SEQ ID NO: 6579810 - DNA, 19 bp, Homo sapiens
ttgattgactgcccattca

SEQ ID NO: 6579811 - DNA, 21 bp, Homo sapiens
ttgattgagagtaacttaagt

SEQ ID NO: 6579812 - DNA, 15 bp, Homo sapiens
ttgattgatgtacag

SEQ ID NO: 6579813 - DNA, 12 bp, Homo sapiens
ttgattgctaaa

SEQ ID NO: 6579814 - DNA, 15 bp, Homo sapiens
ttgattgctaaatgt

SEQ ID NO: 6579815 - DNA, 15 bp, Homo sapiens
ttgattgctgtgtcc

SEQ ID NO: 6579816 - DNA, 12 bp, Homo sapiens
ttgattgctttt

SEQ ID NO: 6579817 - DNA, 12 bp, Homo sapiens
ttgattggcttt

SEQ ID NO: 6579818 - DNA, 17 bp, Homo sapiens
ttgattgggaaaacatt

SEQ ID NO: 6579819 - DNA, 22 bp, Homo sapiens
ttgattgggcacatcatttcaa

SEQ ID NO: 6579820 - DNA, 22 bp, Homo sapiens
ttgattggttgtgccttccctt

SEQ ID NO: 6579821 - DNA, 17 bp, Homo sapiens
ttgattgtcagctacta

SEQ ID NO: 6579822 - DNA, 12 bp, Homo sapiens
ttgattgtcttt

SEQ ID NO: 6579823 - DNA, 13 bp, Homo sapiens
ttgattgtttaag

SEQ ID NO: 6579824 - DNA, 14 bp, Homo sapiens
ttgattgtttacag

SEQ ID NO: 6579825 - DNA, 17 bp, Homo sapiens
ttgattgtttgatgaat

SEQ ID NO: 6579826 - DNA, 14 bp, Homo sapiens
ttgatttaaaagtg

SEQ ID NO: 6579827 - DNA, 16 bp, Homo sapiens
ttgatttaataacata

SEQ ID NO: 6579828 - DNA, 18 bp, Homo sapiens
ttgatttacagtgcctgt

SEQ ID NO: 6579829 - DNA, 22 bp, Homo sapiens
ttgatttacctttggaattgtg

SEQ ID NO: 6579830 - DNA, 21 bp, Homo sapiens
ttgatttattaacttaataat

SEQ ID NO: 6579831 - DNA, 14 bp, Homo sapiens
ttgatttcaaagtt

SEQ ID NO: 6579832 - DNA, 20 bp, Homo sapiens
ttgatttcaaagttttgttg

SEQ ID NO: 6579833 - DNA, 14 bp, Homo sapiens
ttgatttcccaaaa

SEQ ID NO: 6579834 - DNA, 23 bp, Homo sapiens
ttgatttccgtgaactctggtgc

SEQ ID NO: 6579835 - DNA, 18 bp, Homo sapiens
ttgatttccgttaaaata

SEQ ID NO: 6579836 - DNA, 16 bp, Homo sapiens
ttgatttcctgtgtca

SEQ ID NO: 6579837 - DNA, 16 bp, Homo sapiens
ttgatttcctgtgtgt

SEQ ID NO: 6579838 - DNA, 13 bp, Homo sapiens
ttgatttctaagt

SEQ ID NO: 6579839 - DNA, 22 bp, Homo sapiens
ttgatttctagttatttattct

SEQ ID NO: 6579840 - DNA, 17 bp, Homo sapiens
ttgatttctttccagag

SEQ ID NO: 6579841 - DNA, 21 bp, Homo sapiens
ttgatttctttccttcccaat

SEQ ID NO: 6579842 - DNA, 11 bp, Homo sapiens
ttgatttgcat

SEQ ID NO: 6579843 - DNA, 12 bp, Homo sapiens
ttgatttgcatg

SEQ ID NO: 6579844 - DNA, 13 bp, Homo sapiens
ttgatttgcattg

SEQ ID NO: 6579845 - DNA, 14 bp, Homo sapiens
ttgatttgcattga

SEQ ID NO: 6579846 - DNA, 15 bp, Homo sapiens
ttgatttgcattgaa

SEQ ID NO: 6579847 - DNA, 16 bp, Homo sapiens
ttgatttgtaccattc

SEQ ID NO: 6579848 - DNA, 15 bp, Homo sapiens
ttgatttgtttagtt

SEQ ID NO: 6579849 - DNA, 13 bp, Homo sapiens
ttgattttacaat

SEQ ID NO: 6579850 - DNA, 20 bp, Homo sapiens
ttgattttcaagctttcaaa

SEQ ID NO: 6579851 - DNA, 23 bp, Homo sapiens
ttgattttcacagctttgaggaa

SEQ ID NO: 6579852 - DNA, 18 bp, Homo sapiens
ttgattttccatctaaaa

SEQ ID NO: 6579853 - DNA, 19 bp, Homo sapiens
ttgattttccatctaaaaa

SEQ ID NO: 6579854 - DNA, 16 bp, Homo sapiens
ttgattttggaaagat

SEQ ID NO: 6579855 - DNA, 16 bp, Homo sapiens
ttgatttttaaagttt

SEQ ID NO: 6579856 - DNA, 18 bp, Homo sapiens
ttgatttttaaagtttaa

SEQ ID NO: 6579857 - DNA, 16 bp, Homo sapiens
ttgatttttaaatcat

SEQ ID NO: 6579858 - DNA, 14 bp, Homo sapiens
ttgatttttaagaa

SEQ ID NO: 6579859 - DNA, 18 bp, Homo sapiens
ttgatttttaccgtttct

SEQ ID NO: 6579860 - DNA, 17 bp, Homo sapiens
ttgatttttactgtgtt

SEQ ID NO: 6579861 - DNA, 17 bp, Homo sapiens
ttgatttttctcttcat

SEQ ID NO: 6579862 - DNA, 14 bp, Homo sapiens
ttgatttttcttat

SEQ ID NO: 6579863 - DNA, 16 bp, Homo sapiens
ttgatttttgaagttg

SEQ ID NO: 6579864 - DNA, 20 bp, Homo sapiens
ttgatttttgtttttgtaat

SEQ ID NO: 6579865 - DNA, 18 bp, Homo sapiens
ttgatttttttgttcatt

SEQ ID NO: 6579866 - DNA, 19 bp, Homo sapiens
ttgcaaaaaatgtttttgg

SEQ ID NO: 6579867 - DNA, 20 bp, Homo sapiens
ttgcaaaaagtgaacagatt

SEQ ID NO: 6579868 - DNA, 13 bp, Homo sapiens
ttgcaaaaatcca

SEQ ID NO: 6579869 - DNA, 23 bp, Homo sapiens
ttgcaaaacggatgagttattat

SEQ ID NO: 6579870 - DNA, 20 bp, Homo sapiens
ttgcaaaactagacaaaagt

SEQ ID NO: 6579871 - DNA, 14 bp, Homo sapiens
ttgcaaaatacatg

SEQ ID NO: 6579872 - DNA, 16 bp, Homo sapiens
ttgcaaaatacatgaa

SEQ ID NO: 6579873 - DNA, 16 bp, Homo sapiens
ttgcaaaatagaagaa

SEQ ID NO: 6579874 - DNA, 17 bp, Homo sapiens
ttgcaaaatcacttagc

SEQ ID NO: 6579875 - DNA, 21 bp, Homo sapiens
ttgcaaaatttccagtacctt

SEQ ID NO: 6579876 - DNA, 19 bp, Homo sapiens
ttgcaaacaactgaaatgt

SEQ ID NO: 6579877 - DNA, 22 bp, Homo sapiens
ttgcaaacagaacactgtaata

SEQ ID NO: 6579878 - DNA, 12 bp, Homo sapiens
ttgcaaacatta

SEQ ID NO: 6579879 - DNA, 20 bp, Homo sapiens
ttgcaaacccaactaagcca

SEQ ID NO: 6579880 - DNA, 14 bp, Homo sapiens
ttgcaaacctcaga

SEQ ID NO: 6579881 - DNA, 19 bp, Homo sapiens
ttgcaaagaaagaaaaaaa

SEQ ID NO: 6579882 - DNA, 19 bp, Homo sapiens
ttgcaaagaactccagagt

SEQ ID NO: 6579883 - DNA, 19 bp, Homo sapiens
ttgcaaagaccacctccaa

SEQ ID NO: 6579884 - DNA, 21 bp, Homo sapiens
ttgcaaagacctacctccaga

SEQ ID NO: 6579885 - DNA, 20 bp, Homo sapiens
ttgcaaagagacatttcaaa

SEQ ID NO: 6579886 - DNA, 11 bp, Homo sapiens
ttgcaaagcaa

SEQ ID NO: 6579887 - DNA, 12 bp, Homo sapiens
ttgcaaagcaaa

SEQ ID NO: 6579888 - DNA, 18 bp, Homo sapiens
ttgcaaagcgacagattc

SEQ ID NO: 6579889 - DNA, 22 bp, Homo sapiens
ttgcaaaggagctcactgtggt

SEQ ID NO: 6579890 - DNA, 17 bp, Homo sapiens
ttgcaaagggaaacagg

SEQ ID NO: 6579891 - DNA, 13 bp, Homo sapiens
ttgcaaagtactg

SEQ ID NO: 6579892 - DNA, 18 bp, Homo sapiens
ttgcaaagtattgtaaat

SEQ ID NO: 6579893 - DNA, 19 bp, Homo sapiens
ttgcaaagtggaattaaag

SEQ ID NO: 6579894 - DNA, 16 bp, Homo sapiens
ttgcaaataagactct

SEQ ID NO: 6579895 - DNA, 12 bp, Homo sapiens
ttgcaaatataa

SEQ ID NO: 6579896 - DNA, 16 bp, Homo sapiens
ttgcaaatataaacat

SEQ ID NO: 6579897 - DNA, 22 bp, Homo sapiens
ttgcaaatgggagctgagcagc

SEQ ID NO: 6579898 - DNA, 22 bp, Homo sapiens
ttgcaaatgtagtatggcctgt

SEQ ID NO: 6579899 - DNA, 17 bp, Homo sapiens
ttgcaaattattctagt

SEQ ID NO: 6579900 - DNA, 18 bp, Homo sapiens
ttgcaaattatttattac

SEQ ID NO: 6579901 - DNA, 17 bp, Homo sapiens
ttgcaacaaaatacatt

SEQ ID NO: 6579902 - DNA, 21 bp, Homo sapiens
ttgcaacaataattcatcaag

SEQ ID NO: 6579903 - DNA, 16 bp, Homo sapiens
ttgcaacagcaaatta

SEQ ID NO: 6579904 - DNA, 17 bp, Homo sapiens
ttgcaacaggctgggct

SEQ ID NO: 6579905 - DNA, 23 bp, Homo sapiens
ttgcaacaggggaggaaaaaaga

SEQ ID NO: 6579906 - DNA, 15 bp, Homo sapiens
ttgcaacagtgccat

SEQ ID NO: 6579907 - DNA, 13 bp, Homo sapiens
ttgcaaccaggaa

SEQ ID NO: 6579908 - DNA, 20 bp, Homo sapiens
ttgcaacctcaccttcctgt

SEQ ID NO: 6579909 - DNA, 17 bp, Homo sapiens
ttgcaactaaggacaaa

SEQ ID NO: 6579910 - DNA, 21 bp, Homo sapiens
ttgcaactagtaaaatgctgg

SEQ ID NO: 6579911 - DNA, 17 bp, Homo sapiens
ttgcaactggtatatat

SEQ ID NO: 6579912 - DNA, 16 bp, Homo sapiens
ttgcaactttgtataa

SEQ ID NO: 6579913 - DNA, 14 bp, Homo sapiens
ttgcaagaatctaa

SEQ ID NO: 6579914 - DNA, 17 bp, Homo sapiens
ttgcaagaatgaaatga

SEQ ID NO: 6579915 - DNA, 13 bp, Homo sapiens
ttgcaagaatgga

SEQ ID NO: 6579916 - DNA, 13 bp, Homo sapiens
ttgcaagaggagg

SEQ ID NO: 6579917 - DNA, 21 bp, Homo sapiens
ttgcaagagtgatgggaaaga

SEQ ID NO: 6579918 - DNA, 15 bp, Homo sapiens
ttgcaagataatttt

SEQ ID NO: 6579919 - DNA, 13 bp, Homo sapiens
ttgcaagatctta

SEQ ID NO: 6579920 - DNA, 15 bp, Homo sapiens
ttgcaagatgtgaat

SEQ ID NO: 6579921 - DNA, 16 bp, Homo sapiens
ttgcaagatgtgaatt

SEQ ID NO: 6579922 - DNA, 19 bp, Homo sapiens
ttgcaagatgtgaattatt

SEQ ID NO: 6579923 - DNA, 20 bp, Homo sapiens
ttgcaagatgtgaattattg

SEQ ID NO: 6579924 - DNA, 21 bp, Homo sapiens
ttgcaagatgtgaattattga

SEQ ID NO: 6579925 - DNA, 18 bp, Homo sapiens
ttgcaagatttaacacta

SEQ ID NO: 6579926 - DNA, 22 bp, Homo sapiens
ttgcaagccagattttcctgaa

SEQ ID NO: 6579927 - DNA, 13 bp, Homo sapiens
ttgcaaggaagcc

SEQ ID NO: 6579928 - DNA, 16 bp, Homo sapiens
ttgcaaggcaaatgtt

SEQ ID NO: 6579929 - DNA, 23 bp, Homo sapiens
ttgcaaggccgctgttcacccac

SEQ ID NO: 6579930 - DNA, 13 bp, Homo sapiens
ttgcaagggaaaa

SEQ ID NO: 6579931 - DNA, 19 bp, Homo sapiens
ttgcaagggaaaagtctct

SEQ ID NO: 6579932 - DNA, 22 bp, Homo sapiens
ttgcaagggcggcctttcccac

SEQ ID NO: 6579933 - DNA, 19 bp, Homo sapiens
ttgcaaggttccacagagt

SEQ ID NO: 6579934 - DNA, 21 bp, Homo sapiens
ttgcaagtatgttttagcatg

SEQ ID NO: 6579935 - DNA, 22 bp, Homo sapiens
ttgcaagtatgttttagcatgt

SEQ ID NO: 6579936 - DNA, 16 bp, Homo sapiens
ttgcaagtcatggctg

SEQ ID NO: 6579937 - DNA, 15 bp, Homo sapiens
ttgcaagtgaaggtt

SEQ ID NO: 6579938 - DNA, 18 bp, Homo sapiens
ttgcaagtgaaggtttac

SEQ ID NO: 6579939 - DNA, 21 bp, Homo sapiens
ttgcaataaatggcttgattt

SEQ ID NO: 6579940 - DNA, 18 bp, Homo sapiens
ttgcaataacagctgcaa

SEQ ID NO: 6579941 - DNA, 23 bp, Homo sapiens
ttgcaataacttctatattttaa

SEQ ID NO: 6579942 - DNA, 20 bp, Homo sapiens
ttgcaataagatattaccct

SEQ ID NO: 6579943 - DNA, 18 bp, Homo sapiens
ttgcaataataataaatt

SEQ ID NO: 6579944 - DNA, 13 bp, Homo sapiens
ttgcaataatact

SEQ ID NO: 6579945 - DNA, 20 bp, Homo sapiens
ttgcaataatacttctcaaa

SEQ ID NO: 6579946 - DNA, 13 bp, Homo sapiens
ttgcaataatgca

SEQ ID NO: 6579947 - DNA, 14 bp, Homo sapiens
ttgcaataatgcag

SEQ ID NO: 6579948 - DNA, 21 bp, Homo sapiens
ttgcaataatgcagtatggta

SEQ ID NO: 6579949 - DNA, 15 bp, Homo sapiens
ttgcaataccaagta

SEQ ID NO: 6579950 - DNA, 22 bp, Homo sapiens
ttgcaatagcagttataacaga

SEQ ID NO: 6579951 - DNA, 20 bp, Homo sapiens
ttgcaatataacattctatt

SEQ ID NO: 6579952 - DNA, 22 bp, Homo sapiens
ttgcaatatctgaagccctccc

SEQ ID NO: 6579953 - DNA, 20 bp, Homo sapiens
ttgcaatccacaatctgaca

SEQ ID NO: 6579954 - DNA, 15 bp, Homo sapiens
ttgcaatccaggctg

SEQ ID NO: 6579955 - DNA, 21 bp, Homo sapiens
ttgcaatctaatctgaactga

SEQ ID NO: 6579956 - DNA, 16 bp, Homo sapiens
ttgcaatctataatat

SEQ ID NO: 6579957 - DNA, 13 bp, Homo sapiens
ttgcaatgcagag

SEQ ID NO: 6579958 - DNA, 14 bp, Homo sapiens
ttgcaatgtattta

SEQ ID NO: 6579959 - DNA, 22 bp, Homo sapiens
ttgcaatgtcacaacctctctg

SEQ ID NO: 6579960 - DNA, 16 bp, Homo sapiens
ttgcaattattctaat

SEQ ID NO: 6579961 - DNA, 21 bp, Homo sapiens
ttgcaattattctaattttat

SEQ ID NO: 6579962 - DNA, 15 bp, Homo sapiens
ttgcaattcctgctc

SEQ ID NO: 6579963 - DNA, 16 bp, Homo sapiens
ttgcaattctttttgg

SEQ ID NO: 6579964 - DNA, 16 bp, Homo sapiens
ttgcaattgctcttct

SEQ ID NO: 6579965 - DNA, 22 bp, Homo sapiens
ttgcacaaaaagataccttaaa

SEQ ID NO: 6579966 - DNA, 22 bp, Homo sapiens
ttgcacaactctactgttgcaa

SEQ ID NO: 6579967 - DNA, 18 bp, Homo sapiens
ttgcacaagcttgtatat

SEQ ID NO: 6579968 - DNA, 17 bp, Homo sapiens
ttgcacaatatttcttt

SEQ ID NO: 6579969 - DNA, 14 bp, Homo sapiens
ttgcacaattttgt

SEQ ID NO: 6579970 - DNA, 22 bp, Homo sapiens
ttgcacacaaaaataaagacta

SEQ ID NO: 6579971 - DNA, 20 bp, Homo sapiens
ttgcacacacagtctgttca

SEQ ID NO: 6579972 - DNA, 18 bp, Homo sapiens
ttgcacacactcagtgca

SEQ ID NO: 6579973 - DNA, 11 bp, Homo sapiens
ttgcacacagt

SEQ ID NO: 6579974 - DNA, 16 bp, Homo sapiens
ttgcacacagtacaca

SEQ ID NO: 6579975 - DNA, 17 bp, Homo sapiens
ttgcacaccagccttac

SEQ ID NO: 6579976 - DNA, 19 bp, Homo sapiens
ttgcacaccattttgtaaa

SEQ ID NO: 6579977 - DNA, 21 bp, Homo sapiens
ttgcacacccactcagctccg

SEQ ID NO: 6579978 - DNA, 22 bp, Homo sapiens
ttgcacactcccctgcactgga

SEQ ID NO: 6579979 - DNA, 23 bp, Homo sapiens
ttgcacactctcccattatattt

SEQ ID NO: 6579980 - DNA, 21 bp, Homo sapiens
ttgcacactttggcccagggt

SEQ ID NO: 6579981 - DNA, 14 bp, Homo sapiens
ttgcacactttggt

SEQ ID NO: 6579982 - DNA, 18 bp, Homo sapiens
ttgcacagaagtcctgta

SEQ ID NO: 6579983 - DNA, 23 bp, Homo sapiens
ttgcacagaagtcctgtatgtct

SEQ ID NO: 6579984 - DNA, 21 bp, Homo sapiens
ttgcacagagcacacttattt

SEQ ID NO: 6579985 - DNA, 20 bp, Homo sapiens
ttgcacagagggcgctcctg

SEQ ID NO: 6579986 - DNA, 19 bp, Homo sapiens
ttgcacagcatctcagctc

SEQ ID NO: 6579987 - DNA, 21 bp, Homo sapiens
ttgcacagccaacgagacaca

SEQ ID NO: 6579988 - DNA, 16 bp, Homo sapiens
ttgcacagctatgaag

SEQ ID NO: 6579989 - DNA, 18 bp, Homo sapiens
ttgcacagctgtttgaaa

SEQ ID NO: 6579990 - DNA, 17 bp, Homo sapiens
ttgcacagtcaaaacga

SEQ ID NO: 6579991 - DNA, 16 bp, Homo sapiens
ttgcacagttagcaaa

SEQ ID NO: 6579992 - DNA, 13 bp, Homo sapiens
ttgcacatatatt

SEQ ID NO: 6579993 - DNA, 20 bp, Homo sapiens
ttgcacatatattttttaca

SEQ ID NO: 6579994 - DNA, 14 bp, Homo sapiens
ttgcacatggattc

SEQ ID NO: 6579995 - DNA, 16 bp, Homo sapiens
ttgcacatgtcttaat

SEQ ID NO: 6579996 - DNA, 17 bp, Homo sapiens
ttgcacatgtcttaatg

SEQ ID NO: 6579997 - DNA, 21 bp, Homo sapiens
ttgcacatgtcttaatgaagt

SEQ ID NO: 6579998 - DNA, 13 bp, Homo sapiens
ttgcacatgtgac

SEQ ID NO: 6579999 - DNA, 15 bp, Homo sapiens
ttgcacatgtgacca

SEQ ID NO: 6580000 - DNA, 13 bp, Homo sapiens
ttgcacatttgaa

SEQ ID NO: 6580001 - DNA, 14 bp, Homo sapiens
ttgcacattttgat

SEQ ID NO: 6580002 - DNA, 14 bp, Homo sapiens
ttgcaccactgcac

SEQ ID NO: 6580003 - DNA, 18 bp, Homo sapiens
ttgcaccactgcactcca

SEQ ID NO: 6580004 - DNA, 21 bp, Homo sapiens
ttgcaccactgcactccagcc

SEQ ID NO: 6580005 - DNA, 22 bp, Homo sapiens
ttgcaccactgcactccagcct

SEQ ID NO: 6580006 - DNA, 18 bp, Homo sapiens
ttgcaccagaaatgttta

SEQ ID NO: 6580007 - DNA, 13 bp, Homo sapiens
ttgcaccagtttt

SEQ ID NO: 6580008 - DNA, 22 bp, Homo sapiens
ttgcaccagttttatccataat

SEQ ID NO: 6580009 - DNA, 16 bp, Homo sapiens
ttgcaccatctgcttg

SEQ ID NO: 6580010 - DNA, 13 bp, Homo sapiens
ttgcacccagccc

SEQ ID NO: 6580011 - DNA, 21 bp, Homo sapiens
ttgcaccccaaagctttcctg

SEQ ID NO: 6580012 - DNA, 22 bp, Homo sapiens
ttgcacccctcactctggcctc

SEQ ID NO: 6580013 - DNA, 19 bp, Homo sapiens
ttgcaccgcctgccctccc

SEQ ID NO: 6580014 - DNA, 18 bp, Homo sapiens
ttgcaccgtggtcagagg

SEQ ID NO: 6580015 - DNA, 17 bp, Homo sapiens
ttgcacctacctcacag

SEQ ID NO: 6580016 - DNA, 22 bp, Homo sapiens
ttgcacctacgggggcatctga

SEQ ID NO: 6580017 - DNA, 13 bp, Homo sapiens
ttgcacctgagcc

SEQ ID NO: 6580018 - DNA, 15 bp, Homo sapiens
ttgcacctgagcctg

SEQ ID NO: 6580019 - DNA, 16 bp, Homo sapiens
ttgcacctgagcctgt

SEQ ID NO: 6580020 - DNA, 14 bp, Homo sapiens
ttgcacctgcagcc

SEQ ID NO: 6580021 - DNA, 17 bp, Homo sapiens
ttgcacctgcagccaag

SEQ ID NO: 6580022 - DNA, 18 bp, Homo sapiens
ttgcacctgtccccaccc

SEQ ID NO: 6580023 - DNA, 23 bp, Homo sapiens
ttgcaccttatagttcatagcaa

SEQ ID NO: 6580024 - DNA, 15 bp, Homo sapiens
ttgcacctttctagt

SEQ ID NO: 6580025 - DNA, 16 bp, Homo sapiens
ttgcacgacgccctct

SEQ ID NO: 6580026 - DNA, 19 bp, Homo sapiens
ttgcacgacgccctctccc

SEQ ID NO: 6580027 - DNA, 18 bp, Homo sapiens
ttgcacgcccatgtgtga

SEQ ID NO: 6580028 - DNA, 18 bp, Homo sapiens
ttgcacgcgccctttcta

SEQ ID NO: 6580029 - DNA, 15 bp, Homo sapiens
ttgcacggctgctga

SEQ ID NO: 6580030 - DNA, 15 bp, Homo sapiens
ttgcacggtttgtga

SEQ ID NO: 6580031 - DNA, 19 bp, Homo sapiens
ttgcacgtattttaatagc

SEQ ID NO: 6580032 - DNA, 18 bp, Homo sapiens
ttgcacgtcttgctattt

SEQ ID NO: 6580033 - DNA, 18 bp, Homo sapiens
ttgcacgtgtgtttttct

SEQ ID NO: 6580034 - DNA, 17 bp, Homo sapiens
ttgcacgttaaaaatta

SEQ ID NO: 6580035 - DNA, 22 bp, Homo sapiens
ttgcacgtttggtttgcgcagt

SEQ ID NO: 6580036 - DNA, 15 bp, Homo sapiens
ttgcactaaaagtga

SEQ ID NO: 6580037 - DNA, 17 bp, Homo sapiens
ttgcactaaaagtgatg

SEQ ID NO: 6580038 - DNA, 19 bp, Homo sapiens
ttgcactaaagtatgtaaa

SEQ ID NO: 6580039 - DNA, 17 bp, Homo sapiens
ttgcactatgaaaatca

SEQ ID NO: 6580040 - DNA, 19 bp, Homo sapiens
ttgcactatgaaaatcagt

SEQ ID NO: 6580041 - DNA, 16 bp, Homo sapiens
ttgcactcaaatctta

SEQ ID NO: 6580042 - DNA, 18 bp, Homo sapiens
ttgcactcaaatcttaag

SEQ ID NO: 6580043 - DNA, 18 bp, Homo sapiens
ttgcactcaagttgttta

SEQ ID NO: 6580044 - DNA, 18 bp, Homo sapiens
ttgcactcagcttttttc

SEQ ID NO: 6580045 - DNA, 22 bp, Homo sapiens
ttgcactccacacatctttctt

SEQ ID NO: 6580046 - DNA, 14 bp, Homo sapiens
ttgcactccagcct

SEQ ID NO: 6580047 - DNA, 14 bp, Homo sapiens
ttgcactccagtct

SEQ ID NO: 6580048 - DNA, 12 bp, Homo sapiens
ttgcactcttta

SEQ ID NO: 6580049 - DNA, 16 bp, Homo sapiens
ttgcactctttaacac

SEQ ID NO: 6580050 - DNA, 19 bp, Homo sapiens
ttgcactgaagagagcatt

SEQ ID NO: 6580051 - DNA, 21 bp, Homo sapiens
ttgcactgaatatataaacac

SEQ ID NO: 6580052 - DNA, 18 bp, Homo sapiens
ttgcactgatgtccctcc

SEQ ID NO: 6580053 - DNA, 13 bp, Homo sapiens
ttgcactgctgtt

SEQ ID NO: 6580054 - DNA, 13 bp, Homo sapiens
ttgcactgtaatg

SEQ ID NO: 6580055 - DNA, 14 bp, Homo sapiens
ttgcactgtaatga

SEQ ID NO: 6580056 - DNA, 22 bp, Homo sapiens
ttgcactgtaatgaggaaaaaa

SEQ ID NO: 6580057 - DNA, 11 bp, Homo sapiens
ttgcactgtct

SEQ ID NO: 6580058 - DNA, 13 bp, Homo sapiens
ttgcactgtctgt

SEQ ID NO: 6580059 - DNA, 14 bp, Homo sapiens
ttgcactgtctgta

SEQ ID NO: 6580060 - DNA, 13 bp, Homo sapiens
ttgcactgtgctt

SEQ ID NO: 6580061 - DNA, 23 bp, Homo sapiens
ttgcactgtgcttgctcctaagc

SEQ ID NO: 6580062 - DNA, 21 bp, Homo sapiens
ttgcactgtgtgctgactgaa

SEQ ID NO: 6580063 - DNA, 13 bp, Homo sapiens
ttgcactgtttgc

SEQ ID NO: 6580064 - DNA, 14 bp, Homo sapiens
ttgcacttaaaaat

SEQ ID NO: 6580065 - DNA, 13 bp, Homo sapiens
ttgcacttatgta

SEQ ID NO: 6580066 - DNA, 16 bp, Homo sapiens
ttgcacttatgtactt

SEQ ID NO: 6580067 - DNA, 18 bp, Homo sapiens
ttgcacttatgtacttga

SEQ ID NO: 6580068 - DNA, 15 bp, Homo sapiens
ttgcacttctgttat

SEQ ID NO: 6580069 - DNA, 20 bp, Homo sapiens
ttgcacttgtggaatatgtt

SEQ ID NO: 6580070 - DNA, 12 bp, Homo sapiens
ttgcactttgta

SEQ ID NO: 6580071 - DNA, 13 bp, Homo sapiens
ttgcactttgtag

SEQ ID NO: 6580072 - DNA, 23 bp, Homo sapiens
ttgcacttttttgtttgaatgtt

SEQ ID NO: 6580073 - DNA, 13 bp, Homo sapiens
ttgcagaaaaaga

SEQ ID NO: 6580074 - DNA, 21 bp, Homo sapiens
ttgcagaaaagcacctgccga

SEQ ID NO: 6580075 - DNA, 12 bp, Homo sapiens
aagtgtcttttt

SEQ ID NO: 6580076 - DNA, 17 bp, Homo sapiens
aagtgtgaacaaaagat

SEQ ID NO: 6580077 - DNA, 12 bp, Homo sapiens
aagtgtgaagac

SEQ ID NO: 6580078 - DNA, 14 bp, Homo sapiens
aagtgtgaatactg

SEQ ID NO: 6580079 - DNA, 15 bp, Homo sapiens
aagtgtgacttctta

SEQ ID NO: 6580080 - DNA, 11 bp, Homo sapiens
aagtgtgattg

SEQ ID NO: 6580081 - DNA, 18 bp, Homo sapiens
aagtgtgccaaatcagtt

SEQ ID NO: 6580082 - DNA, 16 bp, Homo sapiens
aagtgtgctgggcaga

SEQ ID NO: 6580083 - DNA, 18 bp, Homo sapiens
aagtgtgctttataaaaa

SEQ ID NO: 6580084 - DNA, 13 bp, Homo sapiens
aagtgtggaattg

SEQ ID NO: 6580085 - DNA, 16 bp, Homo sapiens
aagtgtggatgttcag

SEQ ID NO: 6580086 - DNA, 17 bp, Homo sapiens
aagtgtggctggtgtcc

SEQ ID NO: 6580087 - DNA, 20 bp, Homo sapiens
aagtgtggctggtgtcccct

SEQ ID NO: 6580088 - DNA, 20 bp, Homo sapiens
aagtgtggggattttcactg

SEQ ID NO: 6580089 - DNA, 22 bp, Homo sapiens
aagtgtggggcgggggtctata

SEQ ID NO: 6580090 - DNA, 10 bp, Homo sapiens
aagtgtgggt

SEQ ID NO: 6580091 - DNA, 17 bp, Homo sapiens
aagtgtgggtctgtgtg

SEQ ID NO: 6580092 - DNA, 13 bp, Homo sapiens
aagtgtggtagag

SEQ ID NO: 6580093 - DNA, 22 bp, Homo sapiens
aagtgtgtaattatgtaaatac

SEQ ID NO: 6580094 - DNA, 15 bp, Homo sapiens
aagtgtgtataaaac

SEQ ID NO: 6580095 - DNA, 15 bp, Homo sapiens
aagtgtgtatatatt

SEQ ID NO: 6580096 - DNA, 12 bp, Homo sapiens
aagtgtgtatgt

SEQ ID NO: 6580097 - DNA, 22 bp, Homo sapiens
aagtgtgtatgtgcgtgtgtgc

SEQ ID NO: 6580098 - DNA, 16 bp, Homo sapiens
aagtgtgtattaaaaa

SEQ ID NO: 6580099 - DNA, 17 bp, Homo sapiens
aagtgtgtccatcctga

SEQ ID NO: 6580100 - DNA, 18 bp, Homo sapiens
aagtgtgtctcaaaaata

SEQ ID NO: 6580101 - DNA, 23 bp, Homo sapiens
aagtgtgtggtcccaagttggaa

SEQ ID NO: 6580102 - DNA, 16 bp, Homo sapiens
aagtgtgtgtagtttt

SEQ ID NO: 6580103 - DNA, 13 bp, Homo sapiens
aagtgtgtgtgcg

SEQ ID NO: 6580104 - DNA, 12 bp, Homo sapiens
aagtgtgtgttt

SEQ ID NO: 6580105 - DNA, 21 bp, Homo sapiens
aagtgtgtgtttttcataaag

SEQ ID NO: 6580106 - DNA, 21 bp, Homo sapiens
aagtgtgttctgatgaggcat

SEQ ID NO: 6580107 - DNA, 15 bp, Homo sapiens
aagtgtgttggatta

SEQ ID NO: 6580108 - DNA, 22 bp, Homo sapiens
aagtgtgttgggaattgcatgc

SEQ ID NO: 6580109 - DNA, 16 bp, Homo sapiens
aagtgtgttgttgctt

SEQ ID NO: 6580110 - DNA, 23 bp, Homo sapiens
aagtgttaaattattttttctat

SEQ ID NO: 6580111 - DNA, 19 bp, Homo sapiens
aagtgttaagtttttaatc

SEQ ID NO: 6580112 - DNA, 18 bp, Homo sapiens
aagtgttaatacatcaca

SEQ ID NO: 6580113 - DNA, 21 bp, Homo sapiens
aagtgttaattttaccttgtt

SEQ ID NO: 6580114 - DNA, 21 bp, Homo sapiens
aagtgttagactatagcccct

SEQ ID NO: 6580115 - DNA, 22 bp, Homo sapiens
aagtgttagccttttttcccca

SEQ ID NO: 6580116 - DNA, 21 bp, Homo sapiens
aagtgttatttttcaaggaag

SEQ ID NO: 6580117 - DNA, 18 bp, Homo sapiens
aagtgttcaagaaataaa

SEQ ID NO: 6580118 - DNA, 21 bp, Homo sapiens
aagtgttcaagaaataaaaat

SEQ ID NO: 6580119 - DNA, 23 bp, Homo sapiens
aagtgttcagtgttgacatagcc

SEQ ID NO: 6580120 - DNA, 13 bp, Homo sapiens
aagtgttcatttt

SEQ ID NO: 6580121 - DNA, 16 bp, Homo sapiens
aagtgttcctgtctca

SEQ ID NO: 6580122 - DNA, 12 bp, Homo sapiens
aagtgttctcat

SEQ ID NO: 6580123 - DNA, 20 bp, Homo sapiens
aagtgttctcatgaagcagg

SEQ ID NO: 6580124 - DNA, 21 bp, Homo sapiens
aagtgttctcatgaagcagga

SEQ ID NO: 6580125 - DNA, 18 bp, Homo sapiens
aagtgttctgtgcgtctg

SEQ ID NO: 6580126 - DNA, 17 bp, Homo sapiens
aagtgttctgtggctga

SEQ ID NO: 6580127 - DNA, 20 bp, Homo sapiens
aagtgttctgtggctgattt

SEQ ID NO: 6580128 - DNA, 21 bp, Homo sapiens
aagtgttctgttacaaaatgt

SEQ ID NO: 6580129 - DNA, 12 bp, Homo sapiens
aagtgttcttag

SEQ ID NO: 6580130 - DNA, 23 bp, Homo sapiens
aagtgttcttaggtttactgtga

SEQ ID NO: 6580131 - DNA, 16 bp, Homo sapiens
aagtgttcttcagtgt

SEQ ID NO: 6580132 - DNA, 12 bp, Homo sapiens
aagtgttgaaga

SEQ ID NO: 6580133 - DNA, 18 bp, Homo sapiens
aagtgttgaagggaggtg

SEQ ID NO: 6580134 - DNA, 16 bp, Homo sapiens
aagtgttgatcaacca

SEQ ID NO: 6580135 - DNA, 16 bp, Homo sapiens
aagtgttggaaaaaat

SEQ ID NO: 6580136 - DNA, 22 bp, Homo sapiens
aagtgttggccatcatttcatt

SEQ ID NO: 6580137 - DNA, 23 bp, Homo sapiens
aagtgttggggtttggttttgtt

SEQ ID NO: 6580138 - DNA, 11 bp, Homo sapiens
aagtgttggtc

SEQ ID NO: 6580139 - DNA, 16 bp, Homo sapiens
aagtgttgtaccatat

SEQ ID NO: 6580140 - DNA, 12 bp, Homo sapiens
aagtgttgtatc

SEQ ID NO: 6580141 - DNA, 16 bp, Homo sapiens
aagtgttgtggagaaa

SEQ ID NO: 6580142 - DNA, 18 bp, Homo sapiens
aagtgttgtgttcctggc

SEQ ID NO: 6580143 - DNA, 14 bp, Homo sapiens
aagtgtttaaaagc

SEQ ID NO: 6580144 - DNA, 15 bp, Homo sapiens
aagtgtttatttttc

SEQ ID NO: 6580145 - DNA, 19 bp, Homo sapiens
aagtgtttatttttcatat

SEQ ID NO: 6580146 - DNA, 13 bp, Homo sapiens
aagtgtttcacag

SEQ ID NO: 6580147 - DNA, 17 bp, Homo sapiens
aagtgtttcacagtgtc

SEQ ID NO: 6580148 - DNA, 15 bp, Homo sapiens
aagtgtttcagctaa

SEQ ID NO: 6580149 - DNA, 22 bp, Homo sapiens
aagtgtttctagtaacagtatt

SEQ ID NO: 6580150 - DNA, 23 bp, Homo sapiens
aagtgtttctcaaaagaggttac

SEQ ID NO: 6580151 - DNA, 15 bp, Homo sapiens
aagtgttttactctt

SEQ ID NO: 6580152 - DNA, 23 bp, Homo sapiens
aagtgttttattttcaaatctgg

SEQ ID NO: 6580153 - DNA, 22 bp, Homo sapiens
aagtgttttcatattgcttctc

SEQ ID NO: 6580154 - DNA, 14 bp, Homo sapiens
aagtgttttctctg

SEQ ID NO: 6580155 - DNA, 13 bp, Homo sapiens
aagtgttttgtat

SEQ ID NO: 6580156 - DNA, 20 bp, Homo sapiens
aagtgtttttctttaatcaa

SEQ ID NO: 6580157 - DNA, 19 bp, Homo sapiens
aagtgtttttgtgcagctg

SEQ ID NO: 6580158 - DNA, 20 bp, Homo sapiens
aagttaaaaaaaataataaa

SEQ ID NO: 6580159 - DNA, 15 bp, Homo sapiens
aagttaaaaaacagc

SEQ ID NO: 6580160 - DNA, 19 bp, Homo sapiens
aagttaaaaaacagctgca

SEQ ID NO: 6580161 - DNA, 23 bp, Homo sapiens
aagttaaaagtaaaattgtttca

SEQ ID NO: 6580162 - DNA, 22 bp, Homo sapiens
aagttaaaagtgttgattacat

SEQ ID NO: 6580163 - DNA, 18 bp, Homo sapiens
aagttaaacattgaagta

SEQ ID NO: 6580164 - DNA, 14 bp, Homo sapiens
aagttaaatatgta

SEQ ID NO: 6580165 - DNA, 15 bp, Homo sapiens
aagttaaatatgtag

SEQ ID NO: 6580166 - DNA, 21 bp, Homo sapiens
aagttaactgacttcactagg

SEQ ID NO: 6580167 - DNA, 20 bp, Homo sapiens
aagttaactgttccccttgg

SEQ ID NO: 6580168 - DNA, 21 bp, Homo sapiens
aagttaagagaaactttatac

SEQ ID NO: 6580169 - DNA, 15 bp, Homo sapiens
aagttaataagttga

SEQ ID NO: 6580170 - DNA, 21 bp, Homo sapiens
aagttaatagaaagttggcca

SEQ ID NO: 6580171 - DNA, 13 bp, Homo sapiens
aagttaatgaaat

SEQ ID NO: 6580172 - DNA, 17 bp, Homo sapiens
aagttaatgaatatgcc

SEQ ID NO: 6580173 - DNA, 16 bp, Homo sapiens
aagttaatgcttaaga

SEQ ID NO: 6580174 - DNA, 21 bp, Homo sapiens
aagttaatgcttaagagggaa

SEQ ID NO: 6580175 - DNA, 17 bp, Homo sapiens
aagttaatgtatataaa

SEQ ID NO: 6580176 - DNA, 19 bp, Homo sapiens
aagttaatgtatataaaaa

SEQ ID NO: 6580177 - DNA, 13 bp, Homo sapiens
aagttaattcacc

SEQ ID NO: 6580178 - DNA, 17 bp, Homo sapiens
aagttaatttaaagttg

SEQ ID NO: 6580179 - DNA, 17 bp, Homo sapiens
aagttacacatttttca

SEQ ID NO: 6580180 - DNA, 22 bp, Homo sapiens
aagttacacctccactcagcac

SEQ ID NO: 6580181 - DNA, 21 bp, Homo sapiens
aagttacacggggttacactg

SEQ ID NO: 6580182 - DNA, 13 bp, Homo sapiens
aagttacagaaat

SEQ ID NO: 6580183 - DNA, 14 bp, Homo sapiens
aagttacagtttgc

SEQ ID NO: 6580184 - DNA, 15 bp, Homo sapiens
aagttacatacattt

SEQ ID NO: 6580185 - DNA, 16 bp, Homo sapiens
aagttacccctgaaat

SEQ ID NO: 6580186 - DNA, 15 bp, Homo sapiens
aagttaccttttata

SEQ ID NO: 6580187 - DNA, 20 bp, Homo sapiens
aagttaccttttataagaca

SEQ ID NO: 6580188 - DNA, 15 bp, Homo sapiens
aagttacgcttttct

SEQ ID NO: 6580189 - DNA, 19 bp, Homo sapiens
aagttactaatatatctgt

SEQ ID NO: 6580190 - DNA, 18 bp, Homo sapiens
aagttactatcctggctt

SEQ ID NO: 6580191 - DNA, 13 bp, Homo sapiens
aagttactgtaaa

SEQ ID NO: 6580192 - DNA, 22 bp, Homo sapiens
aagttacttaattgccagcaaa

SEQ ID NO: 6580193 - DNA, 16 bp, Homo sapiens
aagttacttattctag

SEQ ID NO: 6580194 - DNA, 16 bp, Homo sapiens
aagttacttgaaataa

SEQ ID NO: 6580195 - DNA, 16 bp, Homo sapiens
aagttactttcttaat

SEQ ID NO: 6580196 - DNA, 12 bp, Homo sapiens
aagttactttgt

SEQ ID NO: 6580197 - DNA, 19 bp, Homo sapiens
aagttactttgtaattttt

SEQ ID NO: 6580198 - DNA, 19 bp, Homo sapiens
aagttactttgtcagaggc

SEQ ID NO: 6580199 - DNA, 22 bp, Homo sapiens
aagttagaactagccaaaccag

SEQ ID NO: 6580200 - DNA, 17 bp, Homo sapiens
aagttagagaatatatt

SEQ ID NO: 6580201 - DNA, 17 bp, Homo sapiens
aagttagagattttaca

SEQ ID NO: 6580202 - DNA, 21 bp, Homo sapiens
aagttagagattttacaaaat

SEQ ID NO: 6580203 - DNA, 17 bp, Homo sapiens
aagttagcctttgaatg

SEQ ID NO: 6580204 - DNA, 18 bp, Homo sapiens
aagttagggcatttttct

SEQ ID NO: 6580205 - DNA, 16 bp, Homo sapiens
aagttaggttataaga

SEQ ID NO: 6580206 - DNA, 15 bp, Homo sapiens
aagttagtaggatat

SEQ ID NO: 6580207 - DNA, 19 bp, Homo sapiens
aagttagtaggatatgcct

SEQ ID NO: 6580208 - DNA, 17 bp, Homo sapiens
aagttagtattaaaatc

SEQ ID NO: 6580209 - DNA, 21 bp, Homo sapiens
aagttagtattaaaatctaca

SEQ ID NO: 6580210 - DNA, 23 bp, Homo sapiens
aagttagtctactcttaagccat

SEQ ID NO: 6580211 - DNA, 23 bp, Homo sapiens
aagttagtgcttgttctaagatt

SEQ ID NO: 6580212 - DNA, 20 bp, Homo sapiens
aagttagtgtgttgtctgtg

SEQ ID NO: 6580213 - DNA, 19 bp, Homo sapiens
aagttagttccactgagac

SEQ ID NO: 6580214 - DNA, 15 bp, Homo sapiens
aagttagtttctcat

SEQ ID NO: 6580215 - DNA, 17 bp, Homo sapiens
aagttagtttgtatata

SEQ ID NO: 6580216 - DNA, 20 bp, Homo sapiens
aagttataaatcaatgtcac

SEQ ID NO: 6580217 - DNA, 15 bp, Homo sapiens
aagttataagaaaac

SEQ ID NO: 6580218 - DNA, 17 bp, Homo sapiens
aagttataataactgaa

SEQ ID NO: 6580219 - DNA, 18 bp, Homo sapiens
aagttataccagcaaaag

SEQ ID NO: 6580220 - DNA, 16 bp, Homo sapiens
aagttatagtatatct

SEQ ID NO: 6580221 - DNA, 15 bp, Homo sapiens
aagttatagtgaata

SEQ ID NO: 6580222 - DNA, 17 bp, Homo sapiens
aagttatagtgaatact

SEQ ID NO: 6580223 - DNA, 16 bp, Homo sapiens
aagttatataaagaga

SEQ ID NO: 6580224 - DNA, 22 bp, Homo sapiens
aagttatataaaggcaaggaaa

SEQ ID NO: 6580225 - DNA, 17 bp, Homo sapiens
aagttatatttcagatg

SEQ ID NO: 6580226 - DNA, 13 bp, Homo sapiens
aagttatcaactt

SEQ ID NO: 6580227 - DNA, 13 bp, Homo sapiens
aagttatcttaaa

SEQ ID NO: 6580228 - DNA, 17 bp, Homo sapiens
aagttatcttaaatatg

SEQ ID NO: 6580229 - DNA, 18 bp, Homo sapiens
aagttatcttaaatatga

SEQ ID NO: 6580230 - DNA, 15 bp, Homo sapiens
aagttatctttgaat

SEQ ID NO: 6580231 - DNA, 22 bp, Homo sapiens
aagttatctttgaatatgtagt

SEQ ID NO: 6580232 - DNA, 21 bp, Homo sapiens
aagttatgactgtgaaatgat

SEQ ID NO: 6580233 - DNA, 16 bp, Homo sapiens
aagttatgcatcccca

SEQ ID NO: 6580234 - DNA, 20 bp, Homo sapiens
aagttatgggaatacctgtg

SEQ ID NO: 6580235 - DNA, 13 bp, Homo sapiens
aagttatgggttt

SEQ ID NO: 6580236 - DNA, 19 bp, Homo sapiens
aagttatggtttcctcatt

SEQ ID NO: 6580237 - DNA, 21 bp, Homo sapiens
aagttatgtacgtatatataa

SEQ ID NO: 6580238 - DNA, 19 bp, Homo sapiens
aagttatgtgttaaattta

SEQ ID NO: 6580239 - DNA, 17 bp, Homo sapiens
aagttattaaaattgtt

SEQ ID NO: 6580240 - DNA, 20 bp, Homo sapiens
aagttattaacgggcatgta

SEQ ID NO: 6580241 - DNA, 23 bp, Homo sapiens
aagttattaacgggcatgtatta

SEQ ID NO: 6580242 - DNA, 19 bp, Homo sapiens
aagttattaatattttaat

SEQ ID NO: 6580243 - DNA, 17 bp, Homo sapiens
aagttattagtggttta

SEQ ID NO: 6580244 - DNA, 15 bp, Homo sapiens
aagttattcagaaat

SEQ ID NO: 6580245 - DNA, 16 bp, Homo sapiens
aagttattcagaaata

SEQ ID NO: 6580246 - DNA, 20 bp, Homo sapiens
aagttattcagaaatatccc

SEQ ID NO: 6580247 - DNA, 23 bp, Homo sapiens
aagttattccccatcttccaagg

SEQ ID NO: 6580248 - DNA, 19 bp, Homo sapiens
aagttattgataagttcat

SEQ ID NO: 6580249 - DNA, 17 bp, Homo sapiens
aagttattgcagtttat

SEQ ID NO: 6580250 - DNA, 13 bp, Homo sapiens
aagttattggcat

SEQ ID NO: 6580251 - DNA, 20 bp, Homo sapiens
aagttattggcatggttgtt

SEQ ID NO: 6580252 - DNA, 12 bp, Homo sapiens
aagttattgtac

SEQ ID NO: 6580253 - DNA, 15 bp, Homo sapiens
ttgcagaaacatttt

SEQ ID NO: 6580254 - DNA, 22 bp, Homo sapiens
ttgcagaaacattttgtggtca

SEQ ID NO: 6580255 - DNA, 20 bp, Homo sapiens
ttgcagaacatgagtgctga

SEQ ID NO: 6580256 - DNA, 21 bp, Homo sapiens
ttgcagaacttgaagcctgct

SEQ ID NO: 6580257 - DNA, 15 bp, Homo sapiens
ttgcagaagagggtg

SEQ ID NO: 6580258 - DNA, 21 bp, Homo sapiens
ttgcagaagagggtgtgtttg

SEQ ID NO: 6580259 - DNA, 12 bp, Homo sapiens
ttgcagaagcag

SEQ ID NO: 6580260 - DNA, 22 bp, Homo sapiens
ttgcagacaggcaagcacctcc

SEQ ID NO: 6580261 - DNA, 20 bp, Homo sapiens
ttgcagacgggcaagaagct

SEQ ID NO: 6580262 - DNA, 13 bp, Homo sapiens
ttgcagactagaa

SEQ ID NO: 6580263 - DNA, 19 bp, Homo sapiens
ttgcagactcagtttgtca

SEQ ID NO: 6580264 - DNA, 22 bp, Homo sapiens
ttgcagagaagcatcctccaca

SEQ ID NO: 6580265 - DNA, 23 bp, Homo sapiens
ttgcagagaagcatcctccacat

SEQ ID NO: 6580266 - DNA, 17 bp, Homo sapiens
ttgcagaggagcccagt

SEQ ID NO: 6580267 - DNA, 14 bp, Homo sapiens
ttgcagatgaaatg

SEQ ID NO: 6580268 - DNA, 19 bp, Homo sapiens
ttgcagatgacaaaaattc

SEQ ID NO: 6580269 - DNA, 14 bp, Homo sapiens
ttgcagattttctt

SEQ ID NO: 6580270 - DNA, 16 bp, Homo sapiens
ttgcagattttcttaa

SEQ ID NO: 6580271 - DNA, 17 bp, Homo sapiens
ttgcagcaattaaaaat

SEQ ID NO: 6580272 - DNA, 13 bp, Homo sapiens
ttgcagcagagga

SEQ ID NO: 6580273 - DNA, 16 bp, Homo sapiens
ttgcagcagataactt

SEQ ID NO: 6580274 - DNA, 11 bp, Homo sapiens
ttgcagcaggg

SEQ ID NO: 6580275 - DNA, 17 bp, Homo sapiens
ttgcagcagggctgggc

SEQ ID NO: 6580276 - DNA, 23 bp, Homo sapiens
ttgcagcagtgagtctcttcaga

SEQ ID NO: 6580277 - DNA, 13 bp, Homo sapiens
ttgcagcatgaga

SEQ ID NO: 6580278 - DNA, 20 bp, Homo sapiens
ttgcagcatgagactttctg

SEQ ID NO: 6580279 - DNA, 17 bp, Homo sapiens
ttgcagcatttactatg

SEQ ID NO: 6580280 - DNA, 17 bp, Homo sapiens
ttgcagccaggagaagg

SEQ ID NO: 6580281 - DNA, 20 bp, Homo sapiens
ttgcagcccaaaggctgcag

SEQ ID NO: 6580282 - DNA, 16 bp, Homo sapiens
ttgcagcccaaggaca

SEQ ID NO: 6580283 - DNA, 22 bp, Homo sapiens
ttgcagccctgctgctgcctgc

SEQ ID NO: 6580284 - DNA, 20 bp, Homo sapiens
ttgcagccggcacagggtct

SEQ ID NO: 6580285 - DNA, 18 bp, Homo sapiens
ttgcagcctaagaagaag

SEQ ID NO: 6580286 - DNA, 19 bp, Homo sapiens
ttgcagcctagtaggagct

SEQ ID NO: 6580287 - DNA, 20 bp, Homo sapiens
ttgcagctatggacaattta

SEQ ID NO: 6580288 - DNA, 18 bp, Homo sapiens
ttgcagctcagaaccaca

SEQ ID NO: 6580289 - DNA, 22 bp, Homo sapiens
ttgcagctcccattctatgtgt

SEQ ID NO: 6580290 - DNA, 23 bp, Homo sapiens
ttgcagctctccccttctctgta

SEQ ID NO: 6580291 - DNA, 18 bp, Homo sapiens
ttgcagctgatgcctgaa

SEQ ID NO: 6580292 - DNA, 11 bp, Homo sapiens
ttgcagctgct

SEQ ID NO: 6580293 - DNA, 13 bp, Homo sapiens
ttgcagctgctgt

SEQ ID NO: 6580294 - DNA, 14 bp, Homo sapiens
ttgcagctgggaga

SEQ ID NO: 6580295 - DNA, 13 bp, Homo sapiens
ttgcagctgtcac

SEQ ID NO: 6580296 - DNA, 13 bp, Homo sapiens
ttgcagctgtttt

SEQ ID NO: 6580297 - DNA, 21 bp, Homo sapiens
ttgcagctgttttgttgacat

SEQ ID NO: 6580298 - DNA, 14 bp, Homo sapiens
ttgcagctttatgt

SEQ ID NO: 6580299 - DNA, 17 bp, Homo sapiens
ttgcaggaagggaagag

SEQ ID NO: 6580300 - DNA, 16 bp, Homo sapiens
ttgcaggacacaagca

SEQ ID NO: 6580301 - DNA, 15 bp, Homo sapiens
ttgcaggagacattt

SEQ ID NO: 6580302 - DNA, 23 bp, Homo sapiens
ttgcaggagcagtatcatgaagc

SEQ ID NO: 6580303 - DNA, 22 bp, Homo sapiens
ttgcaggagcgtgaaggactta

SEQ ID NO: 6580304 - DNA, 23 bp, Homo sapiens
ttgcaggaggccaaactgtccct

SEQ ID NO: 6580305 - DNA, 15 bp, Homo sapiens
ttgcaggagttcctt

SEQ ID NO: 6580306 - DNA, 22 bp, Homo sapiens
ttgcaggagttcctttccctcc

SEQ ID NO: 6580307 - DNA, 19 bp, Homo sapiens
ttgcaggatctgtctgtgc

SEQ ID NO: 6580308 - DNA, 12 bp, Homo sapiens
ttgcaggatttt

SEQ ID NO: 6580309 - DNA, 19 bp, Homo sapiens
ttgcaggatttttagagca

SEQ ID NO: 6580310 - DNA, 12 bp, Homo sapiens
ttgcaggcaaat

SEQ ID NO: 6580311 - DNA, 15 bp, Homo sapiens
ttgcaggcaaatgta

SEQ ID NO: 6580312 - DNA, 11 bp, Homo sapiens
ttgcaggcagt

SEQ ID NO: 6580313 - DNA, 19 bp, Homo sapiens
ttgcaggccagtggacaga

SEQ ID NO: 6580314 - DNA, 14 bp, Homo sapiens
ttgcaggcggccct

SEQ ID NO: 6580315 - DNA, 21 bp, Homo sapiens
ttgcaggcggccctcagtgca

SEQ ID NO: 6580316 - DNA, 22 bp, Homo sapiens
ttgcaggcggccctcagtgcat

SEQ ID NO: 6580317 - DNA, 21 bp, Homo sapiens
ttgcaggctctgggctcaggg

SEQ ID NO: 6580318 - DNA, 22 bp, Homo sapiens
ttgcagggaagtcttacttaaa

SEQ ID NO: 6580319 - DNA, 21 bp, Homo sapiens
ttgcagggctaaggcccccaa

SEQ ID NO: 6580320 - DNA, 14 bp, Homo sapiens
ttgcaggggactgg

SEQ ID NO: 6580321 - DNA, 18 bp, Homo sapiens
ttgcaggggactgggcca

SEQ ID NO: 6580322 - DNA, 18 bp, Homo sapiens
ttgcaggggatactgaaa

SEQ ID NO: 6580323 - DNA, 22 bp, Homo sapiens
ttgcagggtgggtgagctctca

SEQ ID NO: 6580324 - DNA, 12 bp, Homo sapiens
ttgcaggtcagc

SEQ ID NO: 6580325 - DNA, 19 bp, Homo sapiens
ttgcaggtctggtttatat

SEQ ID NO: 6580326 - DNA, 16 bp, Homo sapiens
ttgcaggtgcctggct

SEQ ID NO: 6580327 - DNA, 19 bp, Homo sapiens
ttgcaggtggaactcagtc

SEQ ID NO: 6580328 - DNA, 23 bp, Homo sapiens
ttgcaggtgggggttgctgtata

SEQ ID NO: 6580329 - DNA, 22 bp, Homo sapiens
ttgcagtaaacttttaattaaa

SEQ ID NO: 6580330 - DNA, 15 bp, Homo sapiens
ttgcagtaactgttt

SEQ ID NO: 6580331 - DNA, 19 bp, Homo sapiens
ttgcagtacatcaaaggaa

SEQ ID NO: 6580332 - DNA, 17 bp, Homo sapiens
ttgcagtagattttctt

SEQ ID NO: 6580333 - DNA, 15 bp, Homo sapiens
ttgcagtatcagagg

SEQ ID NO: 6580334 - DNA, 14 bp, Homo sapiens
ttgcagtcactcta

SEQ ID NO: 6580335 - DNA, 14 bp, Homo sapiens
ttgcagtcactgtg

SEQ ID NO: 6580336 - DNA, 15 bp, Homo sapiens
ttgcagtcactgtga

SEQ ID NO: 6580337 - DNA, 13 bp, Homo sapiens
ttgcagtcagaag

SEQ ID NO: 6580338 - DNA, 13 bp, Homo sapiens
ttgcagtcccaag

SEQ ID NO: 6580339 - DNA, 23 bp, Homo sapiens
ttgcagtccttttactacagcta

SEQ ID NO: 6580340 - DNA, 18 bp, Homo sapiens
ttgcagtctaaaacttca

SEQ ID NO: 6580341 - DNA, 13 bp, Homo sapiens
ttgcagtctttcc

SEQ ID NO: 6580342 - DNA, 17 bp, Homo sapiens
ttgcagtctttccccca

SEQ ID NO: 6580343 - DNA, 13 bp, Homo sapiens
ttgcagtcttttg

SEQ ID NO: 6580344 - DNA, 14 bp, Homo sapiens
ttgcagtgaactga

SEQ ID NO: 6580345 - DNA, 17 bp, Homo sapiens
ttgcagtgaagtgttct

SEQ ID NO: 6580346 - DNA, 14 bp, Homo sapiens
ttgcagtgagctga

SEQ ID NO: 6580347 - DNA, 17 bp, Homo sapiens
ttgcagtggcctggccg

SEQ ID NO: 6580348 - DNA, 13 bp, Homo sapiens
ttgcagtgtctta

SEQ ID NO: 6580349 - DNA, 20 bp, Homo sapiens
ttgcagtgtggtgagatcat

SEQ ID NO: 6580350 - DNA, 16 bp, Homo sapiens
ttgcagttcatactga

SEQ ID NO: 6580351 - DNA, 16 bp, Homo sapiens
ttgcagttgtgatata

SEQ ID NO: 6580352 - DNA, 21 bp, Homo sapiens
ttgcagtttaagatgacactt

SEQ ID NO: 6580353 - DNA, 14 bp, Homo sapiens
ttgcagtttacagt

SEQ ID NO: 6580354 - DNA, 15 bp, Homo sapiens
ttgcagttttgtaag

SEQ ID NO: 6580355 - DNA, 19 bp, Homo sapiens
ttgcagttttgtaagccct

SEQ ID NO: 6580356 - DNA, 22 bp, Homo sapiens
ttgcagttttgtaagccctctt

SEQ ID NO: 6580357 - DNA, 14 bp, Homo sapiens
ttgcagtttttata

SEQ ID NO: 6580358 - DNA, 14 bp, Homo sapiens
ttgcataaaattgg

SEQ ID NO: 6580359 - DNA, 17 bp, Homo sapiens
ttgcataaacaatccaa

SEQ ID NO: 6580360 - DNA, 18 bp, Homo sapiens
ttgcataaacaatccaaa

SEQ ID NO: 6580361 - DNA, 12 bp, Homo sapiens
ttgcataaatta

SEQ ID NO: 6580362 - DNA, 13 bp, Homo sapiens
ttgcataaattaa

SEQ ID NO: 6580363 - DNA, 16 bp, Homo sapiens
ttgcataagattaaag

SEQ ID NO: 6580364 - DNA, 18 bp, Homo sapiens
ttgcataagattaaagga

SEQ ID NO: 6580365 - DNA, 15 bp, Homo sapiens
ttgcataataagcta

SEQ ID NO: 6580366 - DNA, 20 bp, Homo sapiens
ttgcataataagctaaagag

SEQ ID NO: 6580367 - DNA, 18 bp, Homo sapiens
ttgcataatgcaatcaaa

SEQ ID NO: 6580368 - DNA, 20 bp, Homo sapiens
ttgcatacaactgtgcatta

SEQ ID NO: 6580369 - DNA, 14 bp, Homo sapiens
ttgcatagaataaa

SEQ ID NO: 6580370 - DNA, 18 bp, Homo sapiens
ttgcatagattccctgag

SEQ ID NO: 6580371 - DNA, 15 bp, Homo sapiens
ttgcatagctctcct

SEQ ID NO: 6580372 - DNA, 15 bp, Homo sapiens
ttgcatatagttaaa

SEQ ID NO: 6580373 - DNA, 19 bp, Homo sapiens
ttgcatatagttaaactga

SEQ ID NO: 6580374 - DNA, 20 bp, Homo sapiens
ttgcatatagttaaactgag

SEQ ID NO: 6580375 - DNA, 14 bp, Homo sapiens
ttgcatatatacat

SEQ ID NO: 6580376 - DNA, 15 bp, Homo sapiens
ttgcatatcaccctt

SEQ ID NO: 6580377 - DNA, 20 bp, Homo sapiens
ttgcatatcacccttccctg

SEQ ID NO: 6580378 - DNA, 19 bp, Homo sapiens
ttgcatatgagcctgccct

SEQ ID NO: 6580379 - DNA, 15 bp, Homo sapiens
ttgcatattttgaga

SEQ ID NO: 6580380 - DNA, 16 bp, Homo sapiens
ttgcatattttgagaa

SEQ ID NO: 6580381 - DNA, 18 bp, Homo sapiens
ttgcatattttgagaaac

SEQ ID NO: 6580382 - DNA, 20 bp, Homo sapiens
ttgcatattttgagaaactg

SEQ ID NO: 6580383 - DNA, 21 bp, Homo sapiens
ttgcatattttgagaaactgc

SEQ ID NO: 6580384 - DNA, 22 bp, Homo sapiens
ttgcatattttgagaaactgct

SEQ ID NO: 6580385 - DNA, 18 bp, Homo sapiens
ttgcatattttgtaactt

SEQ ID NO: 6580386 - DNA, 20 bp, Homo sapiens
ttgcatcacaatttgttgaa

SEQ ID NO: 6580387 - DNA, 14 bp, Homo sapiens
ttgcatcacattgt

SEQ ID NO: 6580388 - DNA, 13 bp, Homo sapiens
ttgcatcagaaat

SEQ ID NO: 6580389 - DNA, 15 bp, Homo sapiens
ttgcatcagaaatgt

SEQ ID NO: 6580390 - DNA, 22 bp, Homo sapiens
ttgcatcagaaatgtctggaga

SEQ ID NO: 6580391 - DNA, 21 bp, Homo sapiens
ttgcatccacttcaggagccc

SEQ ID NO: 6580392 - DNA, 23 bp, Homo sapiens
ttgcatcccaaaccacgcctctt

SEQ ID NO: 6580393 - DNA, 18 bp, Homo sapiens
ttgcatcccccttagaat

SEQ ID NO: 6580394 - DNA, 15 bp, Homo sapiens
ttgcatccttcctat

SEQ ID NO: 6580395 - DNA, 18 bp, Homo sapiens
ttgcatccttcctataac

SEQ ID NO: 6580396 - DNA, 21 bp, Homo sapiens
ttgcatccttcctataacttg

SEQ ID NO: 6580397 - DNA, 13 bp, Homo sapiens
ttgcatctaatga

SEQ ID NO: 6580398 - DNA, 20 bp, Homo sapiens
ttgcatctaggtaattttta

SEQ ID NO: 6580399 - DNA, 18 bp, Homo sapiens
ttgcatctcaaaattatt

SEQ ID NO: 6580400 - DNA, 14 bp, Homo sapiens
ttgcatctgaaaat

SEQ ID NO: 6580401 - DNA, 14 bp, Homo sapiens
ttgcatctgcacat

SEQ ID NO: 6580402 - DNA, 20 bp, Homo sapiens
ttgcatctgggtagctgtaa

SEQ ID NO: 6580403 - DNA, 13 bp, Homo sapiens
ttgcatgaaacta

SEQ ID NO: 6580404 - DNA, 22 bp, Homo sapiens
ttgcatgaattactgtatataa

SEQ ID NO: 6580405 - DNA, 13 bp, Homo sapiens
ttgcatgaattca

SEQ ID NO: 6580406 - DNA, 21 bp, Homo sapiens
ttgcatgaattcacaaacaaa

SEQ ID NO: 6580407 - DNA, 14 bp, Homo sapiens
ttgcatgaggctag

SEQ ID NO: 6580408 - DNA, 17 bp, Homo sapiens
ttgcatgatatcttcaa

SEQ ID NO: 6580409 - DNA, 15 bp, Homo sapiens
ttgcatgatgtattt

SEQ ID NO: 6580410 - DNA, 13 bp, Homo sapiens
ttgcatgcatgca

SEQ ID NO: 6580411 - DNA, 20 bp, Homo sapiens
ttgcatgcgcccgaggcaga

SEQ ID NO: 6580412 - DNA, 19 bp, Homo sapiens
ttgcatgctgataatcatt

SEQ ID NO: 6580413 - DNA, 21 bp, Homo sapiens
ttgcatgctgctttaattgtg

SEQ ID NO: 6580414 - DNA, 16 bp, Homo sapiens
ttgcatggcagggcct

SEQ ID NO: 6580415 - DNA, 20 bp, Homo sapiens
ttgcatgggttttgtaggta

SEQ ID NO: 6580416 - DNA, 16 bp, Homo sapiens
ttgcatgtaaaatgca

SEQ ID NO: 6580417 - DNA, 19 bp, Homo sapiens
ttgcatgtaaaatgcagtc

SEQ ID NO: 6580418 - DNA, 22 bp, Homo sapiens
ttgcatgtattagctcactgaa

SEQ ID NO: 6580419 - DNA, 16 bp, Homo sapiens
ttgcatgtattgtaaa

SEQ ID NO: 6580420 - DNA, 16 bp, Homo sapiens
ttgcatgtcgcacaat

SEQ ID NO: 6580421 - DNA, 16 bp, Homo sapiens
ttgcatgtgactctga

SEQ ID NO: 6580422 - DNA, 21 bp, Homo sapiens
ttgcatgttatgtttaataag

SEQ ID NO: 6580423 - DNA, 22 bp, Homo sapiens
ttgcatgtttaataatatgtac

SEQ ID NO: 6580424 - DNA, 17 bp, Homo sapiens
ttgcattaaaagactgt

SEQ ID NO: 6580425 - DNA, 15 bp, Homo sapiens
ttgcattaaattaca

SEQ ID NO: 6580426 - DNA, 17 bp, Homo sapiens
ttgcattacgataaaca

SEQ ID NO: 6580427 - DNA, 20 bp, Homo sapiens
ttgcattagtaactttgaaa

SEQ ID NO: 6580428 - DNA, 22 bp, Homo sapiens
ttgcattagtccaaggcctttt

SEQ ID NO: 6580429 - DNA, 14 bp, Homo sapiens
ttgcattatgagta

SEQ ID NO: 6580430 - DNA, 17 bp, Homo sapiens
ttgcattattcatttag

SEQ ID NO: 6580431 - DNA, 13 bp, Homo sapiens
ttgcattcaaaat

SEQ ID NO: 6580432 - DNA, 13 bp, Homo sapiens
aagttatttactt

SEQ ID NO: 6580433 - DNA, 14 bp, Homo sapiens
aagttatttacttt

SEQ ID NO: 6580434 - DNA, 23 bp, Homo sapiens
aagttatttacttttaccactat

SEQ ID NO: 6580435 - DNA, 17 bp, Homo sapiens
aagttatttagaaatat

SEQ ID NO: 6580436 - DNA, 22 bp, Homo sapiens
aagttatttccttttataatac

SEQ ID NO: 6580437 - DNA, 13 bp, Homo sapiens
aagttatttgtct

SEQ ID NO: 6580438 - DNA, 14 bp, Homo sapiens
aagttattttacct

SEQ ID NO: 6580439 - DNA, 23 bp, Homo sapiens
aagttattttatttgcttatttt

SEQ ID NO: 6580440 - DNA, 15 bp, Homo sapiens
aagttattttcttgt

SEQ ID NO: 6580441 - DNA, 12 bp, Homo sapiens
aagttatttttc

SEQ ID NO: 6580442 - DNA, 22 bp, Homo sapiens
aagttatttttctttttaagag

SEQ ID NO: 6580443 - DNA, 15 bp, Homo sapiens
aagttatttttgtac

SEQ ID NO: 6580444 - DNA, 16 bp, Homo sapiens
aagttatttttgtaca

SEQ ID NO: 6580445 - DNA, 11 bp, Homo sapiens
aagttcaaact

SEQ ID NO: 6580446 - DNA, 20 bp, Homo sapiens
aagttcaacttatttcataa

SEQ ID NO: 6580447 - DNA, 22 bp, Homo sapiens
aagttcaagactgaaatggctt

SEQ ID NO: 6580448 - DNA, 15 bp, Homo sapiens
aagttcaaggaccaa

SEQ ID NO: 6580449 - DNA, 21 bp, Homo sapiens
aagttcaagggctctttctcc

SEQ ID NO: 6580450 - DNA, 17 bp, Homo sapiens
aagttcaagtgatcttt

SEQ ID NO: 6580451 - DNA, 21 bp, Homo sapiens
aagttcacgtaagatacaagt

SEQ ID NO: 6580452 - DNA, 15 bp, Homo sapiens
aagttcagatgtttc

SEQ ID NO: 6580453 - DNA, 23 bp, Homo sapiens
aagttcaggctctgagacacacc

SEQ ID NO: 6580454 - DNA, 16 bp, Homo sapiens
aagttcagggaagcag

SEQ ID NO: 6580455 - DNA, 20 bp, Homo sapiens
aagttcagggaagcaggcag

SEQ ID NO: 6580456 - DNA, 20 bp, Homo sapiens
aagttcataacagtgccatt

SEQ ID NO: 6580457 - DNA, 22 bp, Homo sapiens
aagttcatacctaagtactgta

SEQ ID NO: 6580458 - DNA, 23 bp, Homo sapiens
aagttcatacctaagtactgtaa

SEQ ID NO: 6580459 - DNA, 15 bp, Homo sapiens
aagttcatattccat

SEQ ID NO: 6580460 - DNA, 22 bp, Homo sapiens
aagttcatattccatatttatt

SEQ ID NO: 6580461 - DNA, 20 bp, Homo sapiens
aagttcatcaaacatgttta

SEQ ID NO: 6580462 - DNA, 17 bp, Homo sapiens
aagttcatctcatttgt

SEQ ID NO: 6580463 - DNA, 13 bp, Homo sapiens
aagttcatcttgc

SEQ ID NO: 6580464 - DNA, 14 bp, Homo sapiens
aagttcatcttgca

SEQ ID NO: 6580465 - DNA, 17 bp, Homo sapiens
aagttcatgctttgttc

SEQ ID NO: 6580466 - DNA, 13 bp, Homo sapiens
aagttcatgtcta

SEQ ID NO: 6580467 - DNA, 23 bp, Homo sapiens
aagttcatgtgtggaaatgggac

SEQ ID NO: 6580468 - DNA, 23 bp, Homo sapiens
aagttcatgttggccatggtgaa

SEQ ID NO: 6580469 - DNA, 19 bp, Homo sapiens
aagttcattcatactcaaa

SEQ ID NO: 6580470 - DNA, 24 bp, Homo sapiens
aagttcattcatactcaaagaggc

SEQ ID NO: 6580471 - DNA, 20 bp, Homo sapiens
aagttcattgcaattaaact

SEQ ID NO: 6580472 - DNA, 15 bp, Homo sapiens
aagttccaagagtct

SEQ ID NO: 6580473 - DNA, 17 bp, Homo sapiens
aagttccaagagtctaa

SEQ ID NO: 6580474 - DNA, 18 bp, Homo sapiens
aagttccagcagtttcat

SEQ ID NO: 6580475 - DNA, 17 bp, Homo sapiens
aagttccagctggtctt

SEQ ID NO: 6580476 - DNA, 19 bp, Homo sapiens
aagttccatgggatacaac

SEQ ID NO: 6580477 - DNA, 20 bp, Homo sapiens
aagttccattatgaaaatct

SEQ ID NO: 6580478 - DNA, 17 bp, Homo sapiens
aagttcccagttggagc

SEQ ID NO: 6580479 - DNA, 22 bp, Homo sapiens
aagttcccattattatttctgt

SEQ ID NO: 6580480 - DNA, 21 bp, Homo sapiens
aagttccccatccctgtcatt

SEQ ID NO: 6580481 - DNA, 17 bp, Homo sapiens
aagttccctacttcctg

SEQ ID NO: 6580482 - DNA, 20 bp, Homo sapiens
aagttccctacttcctgtga

SEQ ID NO: 6580483 - DNA, 19 bp, Homo sapiens
aagttccctatttgtgaat

SEQ ID NO: 6580484 - DNA, 11 bp, Homo sapiens
aagttcccttc

SEQ ID NO: 6580485 - DNA, 16 bp, Homo sapiens
aagttcctaggaaaaa

SEQ ID NO: 6580486 - DNA, 17 bp, Homo sapiens
aagttcctctcccttcc

SEQ ID NO: 6580487 - DNA, 21 bp, Homo sapiens
aagttcctctcccttcccttc

SEQ ID NO: 6580488 - DNA, 19 bp, Homo sapiens
aagttcctgcactccagaa

SEQ ID NO: 6580489 - DNA, 22 bp, Homo sapiens
aagttcctgttcaccttatgta

SEQ ID NO: 6580490 - DNA, 11 bp, Homo sapiens
aagttccttaa

SEQ ID NO: 6580491 - DNA, 13 bp, Homo sapiens
aagttccttctgt

SEQ ID NO: 6580492 - DNA, 14 bp, Homo sapiens
aagttccttctgta

SEQ ID NO: 6580493 - DNA, 23 bp, Homo sapiens
aagttccttctgtagcctgaaga

SEQ ID NO: 6580494 - DNA, 20 bp, Homo sapiens
aagttccttggccatgcaga

SEQ ID NO: 6580495 - DNA, 23 bp, Homo sapiens
aagttcgaacatgtttcacttaa

SEQ ID NO: 6580496 - DNA, 12 bp, Homo sapiens
aagttcgtctgt

SEQ ID NO: 6580497 - DNA, 15 bp, Homo sapiens
aagttcgtctgttgt

SEQ ID NO: 6580498 - DNA, 15 bp, Homo sapiens
aagttctaagattct

SEQ ID NO: 6580499 - DNA, 16 bp, Homo sapiens
aagttctaagttcatg

SEQ ID NO: 6580500 - DNA, 17 bp, Homo sapiens
aagttctaataatttct

SEQ ID NO: 6580501 - DNA, 18 bp, Homo sapiens
aagttctagagaagaggc

SEQ ID NO: 6580502 - DNA, 22 bp, Homo sapiens
aagttctaggcatacttttcaa

SEQ ID NO: 6580503 - DNA, 14 bp, Homo sapiens
aagttctattatct

SEQ ID NO: 6580504 - DNA, 16 bp, Homo sapiens
aagttctattatctgg

SEQ ID NO: 6580505 - DNA, 18 bp, Homo sapiens
aagttctattatctgggt

SEQ ID NO: 6580506 - DNA, 19 bp, Homo sapiens
aagttctatttcttgaaga

SEQ ID NO: 6580507 - DNA, 12 bp, Homo sapiens
aagttctcaaag

SEQ ID NO: 6580508 - DNA, 20 bp, Homo sapiens
aagttctcaaagttaattca

SEQ ID NO: 6580509 - DNA, 13 bp, Homo sapiens
aagttctcattgt

SEQ ID NO: 6580510 - DNA, 22 bp, Homo sapiens
aagttctccagcttcagctcaa

SEQ ID NO: 6580511 - DNA, 22 bp, Homo sapiens
aagttctcccaacaacatgaaa

SEQ ID NO: 6580512 - DNA, 17 bp, Homo sapiens
aagttctgcagataaac

SEQ ID NO: 6580513 - DNA, 22 bp, Homo sapiens
aagttctgcctctgatgtattt

SEQ ID NO: 6580514 - DNA, 15 bp, Homo sapiens
aagttctgtgtttaa

SEQ ID NO: 6580515 - DNA, 20 bp, Homo sapiens
aagttctgtgtttaatttct

SEQ ID NO: 6580516 - DNA, 17 bp, Homo sapiens
aagttcttaaaaaattt

SEQ ID NO: 6580517 - DNA, 18 bp, Homo sapiens
aagttcttagatatcttt

SEQ ID NO: 6580518 - DNA, 23 bp, Homo sapiens
aagttcttagatatctttttatt

SEQ ID NO: 6580519 - DNA, 16 bp, Homo sapiens
aagttcttaggcacca

SEQ ID NO: 6580520 - DNA, 16 bp, Homo sapiens
aagttcttcaagagga

SEQ ID NO: 6580521 - DNA, 14 bp, Homo sapiens
aagttcttcacctc

SEQ ID NO: 6580522 - DNA, 16 bp, Homo sapiens
aagttcttcacctcta

SEQ ID NO: 6580523 - DNA, 20 bp, Homo sapiens
aagttcttcacctctatcca

SEQ ID NO: 6580524 - DNA, 23 bp, Homo sapiens
aagttcttggaccagtttgcaga

SEQ ID NO: 6580525 - DNA, 14 bp, Homo sapiens
aagttctttgattc

SEQ ID NO: 6580526 - DNA, 19 bp, Homo sapiens
aagttctttgatttgtacc

SEQ ID NO: 6580527 - DNA, 23 bp, Homo sapiens
aagttctttgatttgtaccattc

SEQ ID NO: 6580528 - DNA, 20 bp, Homo sapiens
aagttcttttttgtacagta

SEQ ID NO: 6580529 - DNA, 11 bp, Homo sapiens
aagttgaaaaa

SEQ ID NO: 6580530 - DNA, 16 bp, Homo sapiens
aagttgaaaagccaaa

SEQ ID NO: 6580531 - DNA, 20 bp, Homo sapiens
aagttgaaaagtaaaaaata

SEQ ID NO: 6580532 - DNA, 16 bp, Homo sapiens
aagttgaaaatacatt

SEQ ID NO: 6580533 - DNA, 21 bp, Homo sapiens
aagttgaaaatcataggcacc

SEQ ID NO: 6580534 - DNA, 20 bp, Homo sapiens
aagttgaaagagtcctattt

SEQ ID NO: 6580535 - DNA, 18 bp, Homo sapiens
aagttgaaatgtgtaatt

SEQ ID NO: 6580536 - DNA, 14 bp, Homo sapiens
aagttgaagaagct

SEQ ID NO: 6580537 - DNA, 19 bp, Homo sapiens
aagttgaatatttaagaaa

SEQ ID NO: 6580538 - DNA, 21 bp, Homo sapiens
aagttgaatggcctgccttga

SEQ ID NO: 6580539 - DNA, 23 bp, Homo sapiens
aagttgaatttattggcttttct

SEQ ID NO: 6580540 - DNA, 13 bp, Homo sapiens
aagttgaccttta

SEQ ID NO: 6580541 - DNA, 20 bp, Homo sapiens
aagttgacttatagtacatg

SEQ ID NO: 6580542 - DNA, 21 bp, Homo sapiens
aagttgacttatagtacatga

SEQ ID NO: 6580543 - DNA, 17 bp, Homo sapiens
aagttgagaaaaattta

SEQ ID NO: 6580544 - DNA, 20 bp, Homo sapiens
aagttgagaaggtgcctgcc

SEQ ID NO: 6580545 - DNA, 16 bp, Homo sapiens
aagttgagatagtttt

SEQ ID NO: 6580546 - DNA, 21 bp, Homo sapiens
aagttgagatttttaagaact

SEQ ID NO: 6580547 - DNA, 16 bp, Homo sapiens
aagttgagcaaacatt

SEQ ID NO: 6580548 - DNA, 21 bp, Homo sapiens
aagttgagcgtgcgcactgca

SEQ ID NO: 6580549 - DNA, 20 bp, Homo sapiens
aagttgagctatgacttaac

SEQ ID NO: 6580550 - DNA, 20 bp, Homo sapiens
aagttgaggcttagctatgt

SEQ ID NO: 6580551 - DNA, 19 bp, Homo sapiens
aagttgagggaaagagctt

SEQ ID NO: 6580552 - DNA, 18 bp, Homo sapiens
aagttgaggggagaggaa

SEQ ID NO: 6580553 - DNA, 23 bp, Homo sapiens
aagttgaggggagcatgcttccc

SEQ ID NO: 6580554 - DNA, 16 bp, Homo sapiens
aagttgagtatccctt

SEQ ID NO: 6580555 - DNA, 19 bp, Homo sapiens
aagttgataggagacttgt

SEQ ID NO: 6580556 - DNA, 15 bp, Homo sapiens
aagttgatctcccca

SEQ ID NO: 6580557 - DNA, 21 bp, Homo sapiens
aagttgattaaaaatgctttt

SEQ ID NO: 6580558 - DNA, 16 bp, Homo sapiens
aagttgcagatgtatt

SEQ ID NO: 6580559 - DNA, 22 bp, Homo sapiens
aagttgcagatgttagatattt

SEQ ID NO: 6580560 - DNA, 19 bp, Homo sapiens
aagttgcagctgttttgtt

SEQ ID NO: 6580561 - DNA, 15 bp, Homo sapiens
aagttgcagtctttt

SEQ ID NO: 6580562 - DNA, 11 bp, Homo sapiens
aagttgcagtt

SEQ ID NO: 6580563 - DNA, 19 bp, Homo sapiens
aagttgcattcctttgtct

SEQ ID NO: 6580564 - DNA, 19 bp, Homo sapiens
aagttgcatttagaaatca

SEQ ID NO: 6580565 - DNA, 16 bp, Homo sapiens
aagttgccaagagttc

SEQ ID NO: 6580566 - DNA, 14 bp, Homo sapiens
aagttgcgacggag

SEQ ID NO: 6580567 - DNA, 16 bp, Homo sapiens
aagttgctaacctcaa

SEQ ID NO: 6580568 - DNA, 22 bp, Homo sapiens
aagttgctaacctcaatttatg

SEQ ID NO: 6580569 - DNA, 21 bp, Homo sapiens
aagttgctaactgggaagaac

SEQ ID NO: 6580570 - DNA, 18 bp, Homo sapiens
aagttgctaagtgtgctt

SEQ ID NO: 6580571 - DNA, 21 bp, Homo sapiens
aagttgctcaccgactcacct

SEQ ID NO: 6580572 - DNA, 22 bp, Homo sapiens
aagttgctctgacctcctctgg

SEQ ID NO: 6580573 - DNA, 14 bp, Homo sapiens
aagttgctctgtat

SEQ ID NO: 6580574 - DNA, 21 bp, Homo sapiens
aagttgctgcttctcccaggc

SEQ ID NO: 6580575 - DNA, 17 bp, Homo sapiens
aagttgctgcttgtgat

SEQ ID NO: 6580576 - DNA, 14 bp, Homo sapiens
aagttgctggaaag

SEQ ID NO: 6580577 - DNA, 13 bp, Homo sapiens
aagttgctgtaag

SEQ ID NO: 6580578 - DNA, 13 bp, Homo sapiens
aagttgctgttta

SEQ ID NO: 6580579 - DNA, 19 bp, Homo sapiens
aagttggaaacactaaatg

SEQ ID NO: 6580580 - DNA, 11 bp, Homo sapiens
aagttggaagg

SEQ ID NO: 6580581 - DNA, 14 bp, Homo sapiens
aagttggaaggatc

SEQ ID NO: 6580582 - DNA, 22 bp, Homo sapiens
aagttggactaaatgcctagtt

SEQ ID NO: 6580583 - DNA, 13 bp, Homo sapiens
aagttggactggg

SEQ ID NO: 6580584 - DNA, 18 bp, Homo sapiens
aagttgggaaaagtgtta

SEQ ID NO: 6580585 - DNA, 16 bp, Homo sapiens
aagttgggactctgga

SEQ ID NO: 6580586 - DNA, 17 bp, Homo sapiens
aagttgggcaatataac

SEQ ID NO: 6580587 - DNA, 17 bp, Homo sapiens
aagttgggcttgctatt

SEQ ID NO: 6580588 - DNA, 22 bp, Homo sapiens
aagttggggcccagtccttggc

SEQ ID NO: 6580589 - DNA, 18 bp, Homo sapiens
aagttggtaaagtattta

SEQ ID NO: 6580590 - DNA, 23 bp, Homo sapiens
aagttggtattttataagcacag

SEQ ID NO: 6580591 - DNA, 23 bp, Homo sapiens
aagttggtcctttacactcaggc

SEQ ID NO: 6580592 - DNA, 15 bp, Homo sapiens
aagttggtcttactt

SEQ ID NO: 6580593 - DNA, 17 bp, Homo sapiens
aagttggtcttactttg

SEQ ID NO: 6580594 - DNA, 18 bp, Homo sapiens
aagttggtcttactttgt

SEQ ID NO: 6580595 - DNA, 19 bp, Homo sapiens
aagttggtcttactttgtt

SEQ ID NO: 6580596 - DNA, 22 bp, Homo sapiens
aagttggtcttatagaaagcac

SEQ ID NO: 6580597 - DNA, 19 bp, Homo sapiens
aagttggtttagctttgga

SEQ ID NO: 6580598 - DNA, 22 bp, Homo sapiens
aagttggtttagctttggaaag

SEQ ID NO: 6580599 - DNA, 23 bp, Homo sapiens
aagttggtttagctttggaaagt

SEQ ID NO: 6580600 - DNA, 15 bp, Homo sapiens
aagttgtaaaataga

SEQ ID NO: 6580601 - DNA, 14 bp, Homo sapiens
aagttgtaaagtat

SEQ ID NO: 6580602 - DNA, 16 bp, Homo sapiens
aagttgtaaataattt

SEQ ID NO: 6580603 - DNA, 19 bp, Homo sapiens
aagttgtaaataattttct

SEQ ID NO: 6580604 - DNA, 17 bp, Homo sapiens
aagttgtaatagagaat

SEQ ID NO: 6580605 - DNA, 22 bp, Homo sapiens
aagttgtaatagagaatatttt

SEQ ID NO: 6580606 - DNA, 11 bp, Homo sapiens
aagttgtacaa

SEQ ID NO: 6580607 - DNA, 16 bp, Homo sapiens
aagttgtacaaatgta

SEQ ID NO: 6580608 - DNA, 10 bp, Homo sapiens
ttgcattcat

SEQ ID NO: 6580609 - DNA, 21 bp, Homo sapiens
ttgcattccactttttgttac

SEQ ID NO: 6580610 - DNA, 17 bp, Homo sapiens
ttgcattccagaatctt

SEQ ID NO: 6580611 - DNA, 17 bp, Homo sapiens
ttgcattccagcgtctg

SEQ ID NO: 6580612 - DNA, 21 bp, Homo sapiens
ttgcattccagcgtctgctgt

SEQ ID NO: 6580613 - DNA, 13 bp, Homo sapiens
ttgcattccatga

SEQ ID NO: 6580614 - DNA, 20 bp, Homo sapiens
ttgcattccttacttgcact

SEQ ID NO: 6580615 - DNA, 12 bp, Homo sapiens
ttgcattctatt

SEQ ID NO: 6580616 - DNA, 15 bp, Homo sapiens
ttgcattctattgcc

SEQ ID NO: 6580617 - DNA, 18 bp, Homo sapiens
ttgcattctattgccttc

SEQ ID NO: 6580618 - DNA, 15 bp, Homo sapiens
ttgcattcttttggc

SEQ ID NO: 6580619 - DNA, 14 bp, Homo sapiens
ttgcattgaacaca

SEQ ID NO: 6580620 - DNA, 22 bp, Homo sapiens
ttgcattgaacacaaactgtaa

SEQ ID NO: 6580621 - DNA, 13 bp, Homo sapiens
ttgcattgacttt

SEQ ID NO: 6580622 - DNA, 16 bp, Homo sapiens
ttgcattgagctgaga

SEQ ID NO: 6580623 - DNA, 20 bp, Homo sapiens
ttgcattggggttcctctgt

SEQ ID NO: 6580624 - DNA, 18 bp, Homo sapiens
ttgcattggtttgagaaa

SEQ ID NO: 6580625 - DNA, 16 bp, Homo sapiens
ttgcattgtgtgagct

SEQ ID NO: 6580626 - DNA, 20 bp, Homo sapiens
ttgcatttaaaacagacact

SEQ ID NO: 6580627 - DNA, 19 bp, Homo sapiens
ttgcatttaaacatgttta

SEQ ID NO: 6580628 - DNA, 17 bp, Homo sapiens
ttgcatttacgcctgta

SEQ ID NO: 6580629 - DNA, 24 bp, Homo sapiens
ttgcatttagttttatggcatgat

SEQ ID NO: 6580630 - DNA, 15 bp, Homo sapiens
ttgcatttatatgta

SEQ ID NO: 6580631 - DNA, 17 bp, Homo sapiens
ttgcatttatttataca

SEQ ID NO: 6580632 - DNA, 20 bp, Homo sapiens
ttgcatttcagaaagccttt

SEQ ID NO: 6580633 - DNA, 17 bp, Homo sapiens
ttgcatttccagctgtg

SEQ ID NO: 6580634 - DNA, 13 bp, Homo sapiens
ttgcatttctgct

SEQ ID NO: 6580635 - DNA, 16 bp, Homo sapiens
ttgcatttctgtattt

SEQ ID NO: 6580636 - DNA, 22 bp, Homo sapiens
ttgcatttctttatttctgtct

SEQ ID NO: 6580637 - DNA, 13 bp, Homo sapiens
ttgcatttgtaaa

SEQ ID NO: 6580638 - DNA, 16 bp, Homo sapiens
ttgcatttgtcaaagc

SEQ ID NO: 6580639 - DNA, 22 bp, Homo sapiens
ttgcatttgtggtaatctacac

SEQ ID NO: 6580640 - DNA, 20 bp, Homo sapiens
ttgcatttgtttatgtaatt

SEQ ID NO: 6580641 - DNA, 22 bp, Homo sapiens
ttgcattttacagtatcttcaa

SEQ ID NO: 6580642 - DNA, 15 bp, Homo sapiens
ttgcattttcacaaa

SEQ ID NO: 6580643 - DNA, 12 bp, Homo sapiens
ttgcatttttgc

SEQ ID NO: 6580644 - DNA, 17 bp, Homo sapiens
ttgcatttttttccttt

SEQ ID NO: 6580645 - DNA, 18 bp, Homo sapiens
ttgccaaaaaaaaaagaa

SEQ ID NO: 6580646 - DNA, 17 bp, Homo sapiens
ttgccaaaacccagctg

SEQ ID NO: 6580647 - DNA, 23 bp, Homo sapiens
ttgccaaaataatgtcttgttaa

SEQ ID NO: 6580648 - DNA, 19 bp, Homo sapiens
ttgccaaaataccagagcc

SEQ ID NO: 6580649 - DNA, 22 bp, Homo sapiens
ttgccaaaataccagagccttc

SEQ ID NO: 6580650 - DNA, 23 bp, Homo sapiens
ttgccaaaataccagagccttca

SEQ ID NO: 6580651 - DNA, 20 bp, Homo sapiens
ttgccaaaatgttggctgcg

SEQ ID NO: 6580652 - DNA, 13 bp, Homo sapiens
ttgccaaacatta

SEQ ID NO: 6580653 - DNA, 24 bp, Homo sapiens
ttgccaaacattaatgttgatttc

SEQ ID NO: 6580654 - DNA, 12 bp, Homo sapiens
ttgccaaagcag

SEQ ID NO: 6580655 - DNA, 14 bp, Homo sapiens
ttgccaaagcagat

SEQ ID NO: 6580656 - DNA, 20 bp, Homo sapiens
ttgccaaagcagattttcct

SEQ ID NO: 6580657 - DNA, 16 bp, Homo sapiens
ttgccaaagtacagaa

SEQ ID NO: 6580658 - DNA, 16 bp, Homo sapiens
ttgccaaatatgtcct

SEQ ID NO: 6580659 - DNA, 19 bp, Homo sapiens
ttgccaaattgctgcatat

SEQ ID NO: 6580660 - DNA, 22 bp, Homo sapiens
ttgccaacataagttaatagaa

SEQ ID NO: 6580661 - DNA, 19 bp, Homo sapiens
ttgccaaccgttgctttcg

SEQ ID NO: 6580662 - DNA, 15 bp, Homo sapiens
ttgccaactccatct

SEQ ID NO: 6580663 - DNA, 14 bp, Homo sapiens
ttgccaactcttct

SEQ ID NO: 6580664 - DNA, 22 bp, Homo sapiens
ttgccaagaaaatgaagggatt

SEQ ID NO: 6580665 - DNA, 14 bp, Homo sapiens
ttgccaagaaatcg

SEQ ID NO: 6580666 - DNA, 15 bp, Homo sapiens
ttgccaagagcccgt

SEQ ID NO: 6580667 - DNA, 18 bp, Homo sapiens
ttgccaagccctttgctg

SEQ ID NO: 6580668 - DNA, 18 bp, Homo sapiens
ttgccaaggcaaaaaact

SEQ ID NO: 6580669 - DNA, 16 bp, Homo sapiens
ttgccaaggcagaggc

SEQ ID NO: 6580670 - DNA, 18 bp, Homo sapiens
ttgccaaggcagcgggat

SEQ ID NO: 6580671 - DNA, 17 bp, Homo sapiens
ttgccaaggcatcccca

SEQ ID NO: 6580672 - DNA, 18 bp, Homo sapiens
ttgccaaggctctcccct

SEQ ID NO: 6580673 - DNA, 19 bp, Homo sapiens
ttgccaaggctctcccctc

SEQ ID NO: 6580674 - DNA, 21 bp, Homo sapiens
ttgccaagggcataaattatt

SEQ ID NO: 6580675 - DNA, 14 bp, Homo sapiens
ttgccaagtcagca

SEQ ID NO: 6580676 - DNA, 11 bp, Homo sapiens
ttgccaataaa

SEQ ID NO: 6580677 - DNA, 12 bp, Homo sapiens
ttgccaataaag

SEQ ID NO: 6580678 - DNA, 23 bp, Homo sapiens
ttgccaatcttgttttaagcaaa

SEQ ID NO: 6580679 - DNA, 20 bp, Homo sapiens
ttgccaatgaactctttccc

SEQ ID NO: 6580680 - DNA, 22 bp, Homo sapiens
ttgccaatggtgtagctgtcct

SEQ ID NO: 6580681 - DNA, 20 bp, Homo sapiens
ttgccacaagtccagctggg

SEQ ID NO: 6580682 - DNA, 20 bp, Homo sapiens
ttgccacaatgcctctccca

SEQ ID NO: 6580683 - DNA, 12 bp, Homo sapiens
ttgccacacagt

SEQ ID NO: 6580684 - DNA, 22 bp, Homo sapiens
ttgccacagctggagctctcaa

SEQ ID NO: 6580685 - DNA, 12 bp, Homo sapiens
ttgccacagctt

SEQ ID NO: 6580686 - DNA, 18 bp, Homo sapiens
ttgccacagtagaactgt

SEQ ID NO: 6580687 - DNA, 23 bp, Homo sapiens
ttgccacataattcattaaaaac

SEQ ID NO: 6580688 - DNA, 21 bp, Homo sapiens
ttgccacatggtgtctcccaa

SEQ ID NO: 6580689 - DNA, 21 bp, Homo sapiens
ttgccaccaactggccctctt

SEQ ID NO: 6580690 - DNA, 18 bp, Homo sapiens
ttgccaccacctctgtgg

SEQ ID NO: 6580691 - DNA, 19 bp, Homo sapiens
ttgccaccactagagctga

SEQ ID NO: 6580692 - DNA, 16 bp, Homo sapiens
ttgccaccaggagaac

SEQ ID NO: 6580693 - DNA, 22 bp, Homo sapiens
ttgccaccatgtattcatccag

SEQ ID NO: 6580694 - DNA, 18 bp, Homo sapiens
ttgccaccccaccctccc

SEQ ID NO: 6580695 - DNA, 19 bp, Homo sapiens
ttgccacccccagttccta

SEQ ID NO: 6580696 - DNA, 17 bp, Homo sapiens
ttgccacccctgtccag

SEQ ID NO: 6580697 - DNA, 15 bp, Homo sapiens
ttgccacctgttaaa

SEQ ID NO: 6580698 - DNA, 18 bp, Homo sapiens
ttgccactcccctaaact

SEQ ID NO: 6580699 - DNA, 13 bp, Homo sapiens
ttgccactctcct

SEQ ID NO: 6580700 - DNA, 14 bp, Homo sapiens
ttgccactgatatt

SEQ ID NO: 6580701 - DNA, 20 bp, Homo sapiens
ttgccactgatattcagaat

SEQ ID NO: 6580702 - DNA, 13 bp, Homo sapiens
ttgccactgccat

SEQ ID NO: 6580703 - DNA, 18 bp, Homo sapiens
ttgccactgcctcttcct

SEQ ID NO: 6580704 - DNA, 15 bp, Homo sapiens
ttgccactttgcacg

SEQ ID NO: 6580705 - DNA, 16 bp, Homo sapiens
ttgccactttgcacga

SEQ ID NO: 6580706 - DNA, 14 bp, Homo sapiens
ttgccactttggct

SEQ ID NO: 6580707 - DNA, 15 bp, Homo sapiens
ttgccactttggctt

SEQ ID NO: 6580708 - DNA, 17 bp, Homo sapiens
ttgccagaaagcataaa

SEQ ID NO: 6580709 - DNA, 17 bp, Homo sapiens
ttgccagacagagatca

SEQ ID NO: 6580710 - DNA, 24 bp, Homo sapiens
ttgccagactctaggttatacaat

SEQ ID NO: 6580711 - DNA, 14 bp, Homo sapiens
ttgccagacttaaa

SEQ ID NO: 6580712 - DNA, 21 bp, Homo sapiens
ttgccagagcaggagcccctg

SEQ ID NO: 6580713 - DNA, 20 bp, Homo sapiens
ttgccagaggaccaatgctt

SEQ ID NO: 6580714 - DNA, 14 bp, Homo sapiens
ttgccagaggccct

SEQ ID NO: 6580715 - DNA, 15 bp, Homo sapiens
ttgccagaggccctg

SEQ ID NO: 6580716 - DNA, 18 bp, Homo sapiens
ttgccagatgctgcagag

SEQ ID NO: 6580717 - DNA, 21 bp, Homo sapiens
ttgccagattaaatgaatata

SEQ ID NO: 6580718 - DNA, 17 bp, Homo sapiens
ttgccagcaaataaata

SEQ ID NO: 6580719 - DNA, 14 bp, Homo sapiens
ttgccagcacaggg

SEQ ID NO: 6580720 - DNA, 21 bp, Homo sapiens
ttgccagcacaggggccccag

SEQ ID NO: 6580721 - DNA, 12 bp, Homo sapiens
ttgccagcagag

SEQ ID NO: 6580722 - DNA, 15 bp, Homo sapiens
ttgccagcagagcca

SEQ ID NO: 6580723 - DNA, 20 bp, Homo sapiens
ttgccagcagagccagggca

SEQ ID NO: 6580724 - DNA, 12 bp, Homo sapiens
ttgccagccaga

SEQ ID NO: 6580725 - DNA, 18 bp, Homo sapiens
ttgccagccagaagcctc

SEQ ID NO: 6580726 - DNA, 21 bp, Homo sapiens
ttgccagccagaagcctctgc

SEQ ID NO: 6580727 - DNA, 12 bp, Homo sapiens
ttgccagcccat

SEQ ID NO: 6580728 - DNA, 20 bp, Homo sapiens
ttgccagcccatttgggcag

SEQ ID NO: 6580729 - DNA, 13 bp, Homo sapiens
ttgccagcctcct

SEQ ID NO: 6580730 - DNA, 24 bp, Homo sapiens
ttgccagcctccttgctgacccca

SEQ ID NO: 6580731 - DNA, 22 bp, Homo sapiens
ttgccagctgctgagccgcaga

SEQ ID NO: 6580732 - DNA, 20 bp, Homo sapiens
ttgccagcttttcctccctt

SEQ ID NO: 6580733 - DNA, 12 bp, Homo sapiens
ttgccaggctag

SEQ ID NO: 6580734 - DNA, 23 bp, Homo sapiens
ttgccaggctggagtgcagtggc

SEQ ID NO: 6580735 - DNA, 15 bp, Homo sapiens
ttgccagggctctgg

SEQ ID NO: 6580736 - DNA, 19 bp, Homo sapiens
ttgccagggctctgggggc

SEQ ID NO: 6580737 - DNA, 13 bp, Homo sapiens
ttgccaggggcat

SEQ ID NO: 6580738 - DNA, 18 bp, Homo sapiens
ttgccaggtatttttcta

SEQ ID NO: 6580739 - DNA, 21 bp, Homo sapiens
ttgccagtagtaccttgtttt

SEQ ID NO: 6580740 - DNA, 13 bp, Homo sapiens
ttgccagtcagca

SEQ ID NO: 6580741 - DNA, 14 bp, Homo sapiens
ttgccagtgtcttt

SEQ ID NO: 6580742 - DNA, 16 bp, Homo sapiens
ttgccagtgtctttct

SEQ ID NO: 6580743 - DNA, 17 bp, Homo sapiens
ttgccagtgtctttctt

SEQ ID NO: 6580744 - DNA, 14 bp, Homo sapiens
ttgccagttggaca

SEQ ID NO: 6580745 - DNA, 20 bp, Homo sapiens
ttgccagttgtcctccttcc

SEQ ID NO: 6580746 - DNA, 16 bp, Homo sapiens
ttgccagttttccctg

SEQ ID NO: 6580747 - DNA, 15 bp, Homo sapiens
ttgccagttttccga

SEQ ID NO: 6580748 - DNA, 21 bp, Homo sapiens
ttgccataactttatgaagtg

SEQ ID NO: 6580749 - DNA, 23 bp, Homo sapiens
ttgccatagaaagtataatttca

SEQ ID NO: 6580750 - DNA, 18 bp, Homo sapiens
ttgccatatggaggactg

SEQ ID NO: 6580751 - DNA, 15 bp, Homo sapiens
ttgccatattgcaca

SEQ ID NO: 6580752 - DNA, 17 bp, Homo sapiens
ttgccatcaatgatcat

SEQ ID NO: 6580753 - DNA, 18 bp, Homo sapiens
ttgccatcaccatttggt

SEQ ID NO: 6580754 - DNA, 13 bp, Homo sapiens
ttgccatcactgg

SEQ ID NO: 6580755 - DNA, 22 bp, Homo sapiens
ttgccatcccaagcccagtgac

SEQ ID NO: 6580756 - DNA, 14 bp, Homo sapiens
ttgccatccctccc

SEQ ID NO: 6580757 - DNA, 18 bp, Homo sapiens
ttgccatccctccctcca

SEQ ID NO: 6580758 - DNA, 14 bp, Homo sapiens
ttgccatccttgca

SEQ ID NO: 6580759 - DNA, 14 bp, Homo sapiens
ttgccatctgtgat

SEQ ID NO: 6580760 - DNA, 21 bp, Homo sapiens
ttgccatgaaggcacctgccc

SEQ ID NO: 6580761 - DNA, 22 bp, Homo sapiens
ttgccatgacatttcatctggg

SEQ ID NO: 6580762 - DNA, 23 bp, Homo sapiens
ttgccatgcaggaagaggcccac

SEQ ID NO: 6580763 - DNA, 21 bp, Homo sapiens
ttgccatggagatctgaaggg

SEQ ID NO: 6580764 - DNA, 20 bp, Homo sapiens
ttgccatggagttgtgatca

SEQ ID NO: 6580765 - DNA, 15 bp, Homo sapiens
ttgccatgggcctgc

SEQ ID NO: 6580766 - DNA, 22 bp, Homo sapiens
ttgccatgggcttcactgtata

SEQ ID NO: 6580767 - DNA, 20 bp, Homo sapiens
ttgccatgtgcttctgccac

SEQ ID NO: 6580768 - DNA, 16 bp, Homo sapiens
ttgccatgttggccag

SEQ ID NO: 6580769 - DNA, 20 bp, Homo sapiens
ttgccatgttggccaggctg

SEQ ID NO: 6580770 - DNA, 16 bp, Homo sapiens
ttgccattataatttt

SEQ ID NO: 6580771 - DNA, 14 bp, Homo sapiens
ttgccattattcta

SEQ ID NO: 6580772 - DNA, 17 bp, Homo sapiens
ttgccattctcttgcat

SEQ ID NO: 6580773 - DNA, 16 bp, Homo sapiens
ttgccattgccaggag

SEQ ID NO: 6580774 - DNA, 18 bp, Homo sapiens
ttgccatttcttcccaag

SEQ ID NO: 6580775 - DNA, 21 bp, Homo sapiens
ttgccatttgatacccctggg

SEQ ID NO: 6580776 - DNA, 23 bp, Homo sapiens
ttgccatttttctataaatcagt

SEQ ID NO: 6580777 - DNA, 13 bp, Homo sapiens
ttgcccaacctca

SEQ ID NO: 6580778 - DNA, 15 bp, Homo sapiens
ttgcccaacctcagc

SEQ ID NO: 6580779 - DNA, 22 bp, Homo sapiens
ttgcccacacacactccttccc

SEQ ID NO: 6580780 - DNA, 18 bp, Homo sapiens
ttgcccacacctgcctct

SEQ ID NO: 6580781 - DNA, 19 bp, Homo sapiens
ttgcccacccctcactccc

SEQ ID NO: 6580782 - DNA, 21 bp, Homo sapiens
ttgcccacgtacccaggtctg

SEQ ID NO: 6580783 - DNA, 21 bp, Homo sapiens
ttgcccactcctgctctgctc

SEQ ID NO: 6580784 - DNA, 22 bp, Homo sapiens
ttgcccactcctgctctgctcg

SEQ ID NO: 6580785 - DNA, 19 bp, Homo sapiens
ttgcccactgcctgcctcc

SEQ ID NO: 6580786 - DNA, 12 bp, Homo sapiens
aagttgtacatg

SEQ ID NO: 6580787 - DNA, 15 bp, Homo sapiens
aagttgtacatgata

SEQ ID NO: 6580788 - DNA, 16 bp, Homo sapiens
aagttgtacatgataa

SEQ ID NO: 6580789 - DNA, 17 bp, Homo sapiens
aagttgtacatgataag

SEQ ID NO: 6580790 - DNA, 21 bp, Homo sapiens
aagttgtacatgataagacat

SEQ ID NO: 6580791 - DNA, 19 bp, Homo sapiens
aagttgtacttcatttcta

SEQ ID NO: 6580792 - DNA, 14 bp, Homo sapiens
aagttgtactttaa

SEQ ID NO: 6580793 - DNA, 18 bp, Homo sapiens
aagttgtactttaaaaat

SEQ ID NO: 6580794 - DNA, 16 bp, Homo sapiens
aagttgtagcagattg

SEQ ID NO: 6580795 - DNA, 22 bp, Homo sapiens
aagttgtagtgaagctctcacc

SEQ ID NO: 6580796 - DNA, 15 bp, Homo sapiens
aagttgtatttcaaa

SEQ ID NO: 6580797 - DNA, 21 bp, Homo sapiens
aagttgtcaaagaagcttcca

SEQ ID NO: 6580798 - DNA, 15 bp, Homo sapiens
aagttgtcctttctg

SEQ ID NO: 6580799 - DNA, 18 bp, Homo sapiens
aagttgtctgtctgaatg

SEQ ID NO: 6580800 - DNA, 14 bp, Homo sapiens
aagttgtcttaaaa

SEQ ID NO: 6580801 - DNA, 17 bp, Homo sapiens
aagttgtgataaatttg

SEQ ID NO: 6580802 - DNA, 18 bp, Homo sapiens
aagttgtgataaatttga

SEQ ID NO: 6580803 - DNA, 19 bp, Homo sapiens
aagttgtgataaatttgat

SEQ ID NO: 6580804 - DNA, 19 bp, Homo sapiens
aagttgtgatctgttgtaa

SEQ ID NO: 6580805 - DNA, 22 bp, Homo sapiens
aagttgtgatctgttgtaatat

SEQ ID NO: 6580806 - DNA, 16 bp, Homo sapiens
aagttgtgattctttg

SEQ ID NO: 6580807 - DNA, 22 bp, Homo sapiens
aagttgtgcaacggccagggtt

SEQ ID NO: 6580808 - DNA, 19 bp, Homo sapiens
aagttgtgccttttatagc

SEQ ID NO: 6580809 - DNA, 13 bp, Homo sapiens
aagttgtgctaaa

SEQ ID NO: 6580810 - DNA, 20 bp, Homo sapiens
aagttgtgcttgagccagga

SEQ ID NO: 6580811 - DNA, 15 bp, Homo sapiens
aagttgtgcttgttt

SEQ ID NO: 6580812 - DNA, 18 bp, Homo sapiens
aagttgtgcttttctgtt

SEQ ID NO: 6580813 - DNA, 17 bp, Homo sapiens
aagttgtggatatcagg

SEQ ID NO: 6580814 - DNA, 15 bp, Homo sapiens
aagttgttaataaaa

SEQ ID NO: 6580815 - DNA, 15 bp, Homo sapiens
aagttgttgactgtg

SEQ ID NO: 6580816 - DNA, 14 bp, Homo sapiens
aagttgtttaacta

SEQ ID NO: 6580817 - DNA, 20 bp, Homo sapiens
aagttgtttaactgtgcatg

SEQ ID NO: 6580818 - DNA, 22 bp, Homo sapiens
aagttgtttaataagtatatct

SEQ ID NO: 6580819 - DNA, 23 bp, Homo sapiens
aagttgtttatgtatcagctctc

SEQ ID NO: 6580820 - DNA, 19 bp, Homo sapiens
aagttgtttcattgattta

SEQ ID NO: 6580821 - DNA, 22 bp, Homo sapiens
aagttgtttgagaaattaagta

SEQ ID NO: 6580822 - DNA, 17 bp, Homo sapiens
aagttgtttgtcatctt

SEQ ID NO: 6580823 - DNA, 18 bp, Homo sapiens
aagtttaaaacagtattt

SEQ ID NO: 6580824 - DNA, 17 bp, Homo sapiens
aagtttaaagctcgaaa

SEQ ID NO: 6580825 - DNA, 15 bp, Homo sapiens
aagtttaaagttgca

SEQ ID NO: 6580826 - DNA, 17 bp, Homo sapiens
aagtttaaagttgcaca

SEQ ID NO: 6580827 - DNA, 14 bp, Homo sapiens
aagtttaaatacca

SEQ ID NO: 6580828 - DNA, 17 bp, Homo sapiens
aagtttaaataccagta

SEQ ID NO: 6580829 - DNA, 18 bp, Homo sapiens
aagtttaaatctttgtta

SEQ ID NO: 6580830 - DNA, 17 bp, Homo sapiens
aagtttaaatgtatttt

SEQ ID NO: 6580831 - DNA, 20 bp, Homo sapiens
aagtttaacaaatgactgta

SEQ ID NO: 6580832 - DNA, 16 bp, Homo sapiens
aagtttaacaagtatt

SEQ ID NO: 6580833 - DNA, 15 bp, Homo sapiens
aagtttaactttaaa

SEQ ID NO: 6580834 - DNA, 17 bp, Homo sapiens
aagtttaagtgtgcagc

SEQ ID NO: 6580835 - DNA, 20 bp, Homo sapiens
aagtttaatggtgccttcat

SEQ ID NO: 6580836 - DNA, 21 bp, Homo sapiens
aagtttaattatctgcattta

SEQ ID NO: 6580837 - DNA, 14 bp, Homo sapiens
aagtttaattgact

SEQ ID NO: 6580838 - DNA, 23 bp, Homo sapiens
aagtttacaagtgtatatcagaa

SEQ ID NO: 6580839 - DNA, 20 bp, Homo sapiens
aagtttacacctttatcttt

SEQ ID NO: 6580840 - DNA, 12 bp, Homo sapiens
aagtttacagta

SEQ ID NO: 6580841 - DNA, 21 bp, Homo sapiens
aagtttacagtaaataaattg

SEQ ID NO: 6580842 - DNA, 18 bp, Homo sapiens
aagtttacattgtaaata

SEQ ID NO: 6580843 - DNA, 13 bp, Homo sapiens
aagtttacatttt

SEQ ID NO: 6580844 - DNA, 19 bp, Homo sapiens
aagtttactcaaccctctc

SEQ ID NO: 6580845 - DNA, 23 bp, Homo sapiens
aagtttagcccctgaaagccatg

SEQ ID NO: 6580846 - DNA, 15 bp, Homo sapiens
aagtttagctctgag

SEQ ID NO: 6580847 - DNA, 15 bp, Homo sapiens
aagtttatacagtac

SEQ ID NO: 6580848 - DNA, 18 bp, Homo sapiens
aagtttatacagtacagt

SEQ ID NO: 6580849 - DNA, 18 bp, Homo sapiens
aagtttattattttcaaa

SEQ ID NO: 6580850 - DNA, 16 bp, Homo sapiens
aagtttattctcattt

SEQ ID NO: 6580851 - DNA, 21 bp, Homo sapiens
aagtttattgtaaaagtgaca

SEQ ID NO: 6580852 - DNA, 14 bp, Homo sapiens
aagtttatttcctg

SEQ ID NO: 6580853 - DNA, 15 bp, Homo sapiens
aagtttatttgagaa

SEQ ID NO: 6580854 - DNA, 22 bp, Homo sapiens
aagtttattttttctacacagt

SEQ ID NO: 6580855 - DNA, 17 bp, Homo sapiens
aagtttcaaaaatctga

SEQ ID NO: 6580856 - DNA, 20 bp, Homo sapiens
aagtttcaaacttactattt

SEQ ID NO: 6580857 - DNA, 16 bp, Homo sapiens
aagtttcaatgtgatt

SEQ ID NO: 6580858 - DNA, 19 bp, Homo sapiens
aagtttcacaacagatttc

SEQ ID NO: 6580859 - DNA, 20 bp, Homo sapiens
aagtttcactgacttagaac

SEQ ID NO: 6580860 - DNA, 22 bp, Homo sapiens
aagtttcaggagattgttaatt

SEQ ID NO: 6580861 - DNA, 16 bp, Homo sapiens
aagtttcaggtgacat

SEQ ID NO: 6580862 - DNA, 22 bp, Homo sapiens
aagtttcaggtgacatgtgaaa

SEQ ID NO: 6580863 - DNA, 19 bp, Homo sapiens
aagtttcagtaatagctga

SEQ ID NO: 6580864 - DNA, 16 bp, Homo sapiens
aagtttcagttgattt

SEQ ID NO: 6580865 - DNA, 13 bp, Homo sapiens
aagtttcattcta

SEQ ID NO: 6580866 - DNA, 19 bp, Homo sapiens
aagtttcattctaaaatca

SEQ ID NO: 6580867 - DNA, 23 bp, Homo sapiens
aagtttcattctccctttcacta

SEQ ID NO: 6580868 - DNA, 15 bp, Homo sapiens
aagtttccaagcaaa

SEQ ID NO: 6580869 - DNA, 20 bp, Homo sapiens
aagtttccatagcaacagga

SEQ ID NO: 6580870 - DNA, 12 bp, Homo sapiens
aagtttccatat

SEQ ID NO: 6580871 - DNA, 16 bp, Homo sapiens
aagtttccatcatcta

SEQ ID NO: 6580872 - DNA, 14 bp, Homo sapiens
aagtttcccttcct

SEQ ID NO: 6580873 - DNA, 18 bp, Homo sapiens
aagtttccttccagccca

SEQ ID NO: 6580874 - DNA, 15 bp, Homo sapiens
aagtttccttttaat

SEQ ID NO: 6580875 - DNA, 18 bp, Homo sapiens
aagtttcgtatgcactcc

SEQ ID NO: 6580876 - DNA, 15 bp, Homo sapiens
aagtttctaagattc

SEQ ID NO: 6580877 - DNA, 17 bp, Homo sapiens
aagtttctaagattcta

SEQ ID NO: 6580878 - DNA, 23 bp, Homo sapiens
aagtttctaatgttattttcctt

SEQ ID NO: 6580879 - DNA, 17 bp, Homo sapiens
aagtttctacattctct

SEQ ID NO: 6580880 - DNA, 13 bp, Homo sapiens
aagtttctatatg

SEQ ID NO: 6580881 - DNA, 12 bp, Homo sapiens
aagtttctattc

SEQ ID NO: 6580882 - DNA, 13 bp, Homo sapiens
aagtttctcagat

SEQ ID NO: 6580883 - DNA, 23 bp, Homo sapiens
aagtttctcagatccttgtttca

SEQ ID NO: 6580884 - DNA, 13 bp, Homo sapiens
aagtttctcagct

SEQ ID NO: 6580885 - DNA, 16 bp, Homo sapiens
aagtttctcagctccc

SEQ ID NO: 6580886 - DNA, 15 bp, Homo sapiens
aagtttctcttcacc

SEQ ID NO: 6580887 - DNA, 13 bp, Homo sapiens
aagtttctcttct

SEQ ID NO: 6580888 - DNA, 13 bp, Homo sapiens
aagtttctgttga

SEQ ID NO: 6580889 - DNA, 14 bp, Homo sapiens
aagtttctgttgaa

SEQ ID NO: 6580890 - DNA, 14 bp, Homo sapiens
aagtttctgtttca

SEQ ID NO: 6580891 - DNA, 22 bp, Homo sapiens
aagtttctttgagggttccatg

SEQ ID NO: 6580892 - DNA, 16 bp, Homo sapiens
aagtttctttgcttca

SEQ ID NO: 6580893 - DNA, 13 bp, Homo sapiens
aagtttgaacatt

SEQ ID NO: 6580894 - DNA, 16 bp, Homo sapiens
aagtttgaatgttaaa

SEQ ID NO: 6580895 - DNA, 18 bp, Homo sapiens
aagtttgaatgttaaata

SEQ ID NO: 6580896 - DNA, 22 bp, Homo sapiens
aagtttgaatgttaaataaatt

SEQ ID NO: 6580897 - DNA, 15 bp, Homo sapiens
aagtttgaatttgta

SEQ ID NO: 6580898 - DNA, 16 bp, Homo sapiens
aagtttgaccagtgca

SEQ ID NO: 6580899 - DNA, 20 bp, Homo sapiens
aagtttgagatcagcctggg

SEQ ID NO: 6580900 - DNA, 21 bp, Homo sapiens
aagtttgataaatagtgttat

SEQ ID NO: 6580901 - DNA, 18 bp, Homo sapiens
aagtttgatcttcctctg

SEQ ID NO: 6580902 - DNA, 20 bp, Homo sapiens
aagtttgatttttgtttttg

SEQ ID NO: 6580903 - DNA, 15 bp, Homo sapiens
aagtttgcaaccttt

SEQ ID NO: 6580904 - DNA, 12 bp, Homo sapiens
aagtttgcaatt

SEQ ID NO: 6580905 - DNA, 21 bp, Homo sapiens
aagtttgcactgtatgctgga

SEQ ID NO: 6580906 - DNA, 16 bp, Homo sapiens
aagtttgcatatcagt

SEQ ID NO: 6580907 - DNA, 12 bp, Homo sapiens
aagtttgctaaa

SEQ ID NO: 6580908 - DNA, 15 bp, Homo sapiens
aagtttgctaaaaga

SEQ ID NO: 6580909 - DNA, 20 bp, Homo sapiens
aagtttgctaaaagaagaga

SEQ ID NO: 6580910 - DNA, 11 bp, Homo sapiens
aagtttgctgt

SEQ ID NO: 6580911 - DNA, 15 bp, Homo sapiens
aagtttgcttagaaa

SEQ ID NO: 6580912 - DNA, 16 bp, Homo sapiens
aagtttgcttagaaaa

SEQ ID NO: 6580913 - DNA, 15 bp, Homo sapiens
aagtttgcttgtttc

SEQ ID NO: 6580914 - DNA, 22 bp, Homo sapiens
aagtttggaagtacataaagta

SEQ ID NO: 6580915 - DNA, 15 bp, Homo sapiens
aagtttggagatttt

SEQ ID NO: 6580916 - DNA, 23 bp, Homo sapiens
aagtttggagcactagtttgatt

SEQ ID NO: 6580917 - DNA, 18 bp, Homo sapiens
aagtttggtattgtaaaa

SEQ ID NO: 6580918 - DNA, 22 bp, Homo sapiens
aagtttggtattgtaaaacatt

SEQ ID NO: 6580919 - DNA, 13 bp, Homo sapiens
aagtttgtagcca

SEQ ID NO: 6580920 - DNA, 20 bp, Homo sapiens
aagtttgtccatttgtaaaa

SEQ ID NO: 6580921 - DNA, 22 bp, Homo sapiens
aagtttgtctacactaaaattt

SEQ ID NO: 6580922 - DNA, 20 bp, Homo sapiens
aagtttgtgtctttgtctgg

SEQ ID NO: 6580923 - DNA, 19 bp, Homo sapiens
aagtttgtgttagaaaagt

SEQ ID NO: 6580924 - DNA, 22 bp, Homo sapiens
aagtttgttactttgaatagtc

SEQ ID NO: 6580925 - DNA, 21 bp, Homo sapiens
aagtttgtttatgcattgcct

SEQ ID NO: 6580926 - DNA, 14 bp, Homo sapiens
aagtttgtttttaa

SEQ ID NO: 6580927 - DNA, 19 bp, Homo sapiens
aagttttaaaaagccagtt

SEQ ID NO: 6580928 - DNA, 15 bp, Homo sapiens
aagttttaaagttca

SEQ ID NO: 6580929 - DNA, 15 bp, Homo sapiens
aagttttaacctcag

SEQ ID NO: 6580930 - DNA, 21 bp, Homo sapiens
aagttttaacttccagtggct

SEQ ID NO: 6580931 - DNA, 17 bp, Homo sapiens
aagttttaactttaata

SEQ ID NO: 6580932 - DNA, 20 bp, Homo sapiens
aagttttaactttaatacag

SEQ ID NO: 6580933 - DNA, 17 bp, Homo sapiens
aagttttactgataatt

SEQ ID NO: 6580934 - DNA, 17 bp, Homo sapiens
aagttttagttaaaact

SEQ ID NO: 6580935 - DNA, 19 bp, Homo sapiens
aagttttagttaaaactca

SEQ ID NO: 6580936 - DNA, 13 bp, Homo sapiens
aagttttatatat

SEQ ID NO: 6580937 - DNA, 16 bp, Homo sapiens
aagttttatatattat

SEQ ID NO: 6580938 - DNA, 21 bp, Homo sapiens
aagttttatatattatatgga

SEQ ID NO: 6580939 - DNA, 18 bp, Homo sapiens
aagttttattataaattc

SEQ ID NO: 6580940 - DNA, 19 bp, Homo sapiens
aagttttattgaaaatgtg

SEQ ID NO: 6580941 - DNA, 16 bp, Homo sapiens
aagttttcaaatttgt

SEQ ID NO: 6580942 - DNA, 13 bp, Homo sapiens
aagttttcagatt

SEQ ID NO: 6580943 - DNA, 22 bp, Homo sapiens
aagttttcagattgtaaaggta

SEQ ID NO: 6580944 - DNA, 15 bp, Homo sapiens
aagttttccagtatt

SEQ ID NO: 6580945 - DNA, 23 bp, Homo sapiens
aagttttccttgctatttcaata

SEQ ID NO: 6580946 - DNA, 13 bp, Homo sapiens
aagttttcctttg

SEQ ID NO: 6580947 - DNA, 22 bp, Homo sapiens
aagttttctgtagtcatttact

SEQ ID NO: 6580948 - DNA, 20 bp, Homo sapiens
aagttttcttcccagagaga

SEQ ID NO: 6580949 - DNA, 13 bp, Homo sapiens
aagttttcttgtt

SEQ ID NO: 6580950 - DNA, 18 bp, Homo sapiens
aagttttcttgtttctgc

SEQ ID NO: 6580951 - DNA, 13 bp, Homo sapiens
aagttttctttta

SEQ ID NO: 6580952 - DNA, 16 bp, Homo sapiens
aagttttgaaaagcta

SEQ ID NO: 6580953 - DNA, 19 bp, Homo sapiens
aagttttgacaagctggct

SEQ ID NO: 6580954 - DNA, 13 bp, Homo sapiens
aagttttgagaaa

SEQ ID NO: 6580955 - DNA, 14 bp, Homo sapiens
aagttttgatataa

SEQ ID NO: 6580956 - DNA, 11 bp, Homo sapiens
aagttttgcac

SEQ ID NO: 6580957 - DNA, 14 bp, Homo sapiens
aagttttggcagcc

SEQ ID NO: 6580958 - DNA, 23 bp, Homo sapiens
aagttttgggtatgtttaatctg

SEQ ID NO: 6580959 - DNA, 20 bp, Homo sapiens
aagttttggttattatatat

SEQ ID NO: 6580960 - DNA, 15 bp, Homo sapiens
aagttttgtaaattt

SEQ ID NO: 6580961 - DNA, 20 bp, Homo sapiens
aagttttgtataaataataa

SEQ ID NO: 6580962 - DNA, 21 bp, Homo sapiens
aagttttgtgaaatttttcat

SEQ ID NO: 6580963 - DNA, 14 bp, Homo sapiens
aagttttgttctgt

SEQ ID NO: 6580964 - DNA, 16 bp, Homo sapiens
aagtttttaatattta

SEQ ID NO: 6580965 - DNA, 12 bp, Homo sapiens
ttgcccacttct

SEQ ID NO: 6580966 - DNA, 16 bp, Homo sapiens
ttgcccagagatgcct

SEQ ID NO: 6580967 - DNA, 17 bp, Homo sapiens
ttgcccagagatgcctc

SEQ ID NO: 6580968 - DNA, 19 bp, Homo sapiens
ttgcccagagatgcctcca

SEQ ID NO: 6580969 - DNA, 13 bp, Homo sapiens
ttgcccagagcac

SEQ ID NO: 6580970 - DNA, 16 bp, Homo sapiens
ttgcccagcctctttc

SEQ ID NO: 6580971 - DNA, 19 bp, Homo sapiens
ttgcccagcctctttccct

SEQ ID NO: 6580972 - DNA, 13 bp, Homo sapiens
ttgcccaggagca

SEQ ID NO: 6580973 - DNA, 14 bp, Homo sapiens
ttgcccaggcaggt

SEQ ID NO: 6580974 - DNA, 18 bp, Homo sapiens
ttgcccaggcaggtcttg

SEQ ID NO: 6580975 - DNA, 11 bp, Homo sapiens
ttgcccaggcc

SEQ ID NO: 6580976 - DNA, 11 bp, Homo sapiens
ttgcccaggct

SEQ ID NO: 6580977 - DNA, 12 bp, Homo sapiens
ttgcccaggctg

SEQ ID NO: 6580978 - DNA, 17 bp, Homo sapiens
ttgcccaggctggcctg

SEQ ID NO: 6580979 - DNA, 17 bp, Homo sapiens
ttgcccagggcagcttt

SEQ ID NO: 6580980 - DNA, 17 bp, Homo sapiens
ttgcccagggctcagcc

SEQ ID NO: 6580981 - DNA, 18 bp, Homo sapiens
ttgcccagggctcagcct

SEQ ID NO: 6580982 - DNA, 18 bp, Homo sapiens
ttgcccagggtcctgtgc

SEQ ID NO: 6580983 - DNA, 16 bp, Homo sapiens
ttgcccagtcctgggt

SEQ ID NO: 6580984 - DNA, 17 bp, Homo sapiens
ttgcccagtgagccctg

SEQ ID NO: 6580985 - DNA, 19 bp, Homo sapiens
ttgcccagtgagccctgct

SEQ ID NO: 6580986 - DNA, 17 bp, Homo sapiens
ttgcccatcagccattt

SEQ ID NO: 6580987 - DNA, 13 bp, Homo sapiens
ttgcccatcctcc

SEQ ID NO: 6580988 - DNA, 20 bp, Homo sapiens
ttgcccatgctgggctcccg

SEQ ID NO: 6580989 - DNA, 15 bp, Homo sapiens
ttgccccaaatcaca

SEQ ID NO: 6580990 - DNA, 14 bp, Homo sapiens
ttgccccaaccccc

SEQ ID NO: 6580991 - DNA, 14 bp, Homo sapiens
ttgccccaagtcct

SEQ ID NO: 6580992 - DNA, 13 bp, Homo sapiens
ttgccccagagcc

SEQ ID NO: 6580993 - DNA, 20 bp, Homo sapiens
ttgccccagagccccactcc

SEQ ID NO: 6580994 - DNA, 12 bp, Homo sapiens
ttgccccaggac

SEQ ID NO: 6580995 - DNA, 18 bp, Homo sapiens
ttgccccaggactctggc

SEQ ID NO: 6580996 - DNA, 13 bp, Homo sapiens
ttgccccaggcca

SEQ ID NO: 6580997 - DNA, 14 bp, Homo sapiens
ttgccccaggccag

SEQ ID NO: 6580998 - DNA, 13 bp, Homo sapiens
ttgccccagtcct

SEQ ID NO: 6580999 - DNA, 21 bp, Homo sapiens
ttgccccatccagacctggct

SEQ ID NO: 6581000 - DNA, 15 bp, Homo sapiens
ttgcccccacctctg

SEQ ID NO: 6581001 - DNA, 17 bp, Homo sapiens
ttgcccccacctctggt

SEQ ID NO: 6581002 - DNA, 19 bp, Homo sapiens
ttgcccccacctctggtcc

SEQ ID NO: 6581003 - DNA, 15 bp, Homo sapiens
ttgcccccattccca

SEQ ID NO: 6581004 - DNA, 19 bp, Homo sapiens
ttgccccccaccccagcct

SEQ ID NO: 6581005 - DNA, 16 bp, Homo sapiens
ttgccccccgccctca

SEQ ID NO: 6581006 - DNA, 15 bp, Homo sapiens
ttgccccctctcact

SEQ ID NO: 6581007 - DNA, 17 bp, Homo sapiens
ttgcccccttgcccatc

SEQ ID NO: 6581008 - DNA, 23 bp, Homo sapiens
ttgccccggccccggccccagcc

SEQ ID NO: 6581009 - DNA, 17 bp, Homo sapiens
ttgccccgtctctgttc

SEQ ID NO: 6581010 - DNA, 13 bp, Homo sapiens
ttgcccctgctct

SEQ ID NO: 6581011 - DNA, 13 bp, Homo sapiens
ttgcccctggctt

SEQ ID NO: 6581012 - DNA, 14 bp, Homo sapiens
ttgcccctggcttt

SEQ ID NO: 6581013 - DNA, 20 bp, Homo sapiens
ttgcccctggctttgcctct

SEQ ID NO: 6581014 - DNA, 23 bp, Homo sapiens
ttgcccctggggcttccatccca

SEQ ID NO: 6581015 - DNA, 19 bp, Homo sapiens
ttgcccctttctcttttcc

SEQ ID NO: 6581016 - DNA, 19 bp, Homo sapiens
ttgcccgaaactaagccag

SEQ ID NO: 6581017 - DNA, 16 bp, Homo sapiens
ttgcccgcacccctcc

SEQ ID NO: 6581018 - DNA, 14 bp, Homo sapiens
ttgcccgccagcca

SEQ ID NO: 6581019 - DNA, 13 bp, Homo sapiens
ttgcccgctccca

SEQ ID NO: 6581020 - DNA, 14 bp, Homo sapiens
ttgcccgctcccac

SEQ ID NO: 6581021 - DNA, 16 bp, Homo sapiens
ttgccctaagaacttt

SEQ ID NO: 6581022 - DNA, 16 bp, Homo sapiens
ttgccctaagcagaaa

SEQ ID NO: 6581023 - DNA, 23 bp, Homo sapiens
ttgccctaattcatcttttaatc

SEQ ID NO: 6581024 - DNA, 15 bp, Homo sapiens
ttgccctcccatccc

SEQ ID NO: 6581025 - DNA, 15 bp, Homo sapiens
ttgccctcctgccca

SEQ ID NO: 6581026 - DNA, 13 bp, Homo sapiens
ttgccctcctggg

SEQ ID NO: 6581027 - DNA, 19 bp, Homo sapiens
ttgccctgagcactcctgg

SEQ ID NO: 6581028 - DNA, 13 bp, Homo sapiens
ttgccctgagggg

SEQ ID NO: 6581029 - DNA, 11 bp, Homo sapiens
ttgccctgcca

SEQ ID NO: 6581030 - DNA, 13 bp, Homo sapiens
ttgccctgccagg

SEQ ID NO: 6581031 - DNA, 13 bp, Homo sapiens
ttgccctgcgtcc

SEQ ID NO: 6581032 - DNA, 13 bp, Homo sapiens
ttgccctggagcc

SEQ ID NO: 6581033 - DNA, 19 bp, Homo sapiens
ttgccctggagcctcagca

SEQ ID NO: 6581034 - DNA, 21 bp, Homo sapiens
ttgccctggagcctcagcagc

SEQ ID NO: 6581035 - DNA, 23 bp, Homo sapiens
ttgccctggtttcactggcccaa

SEQ ID NO: 6581036 - DNA, 14 bp, Homo sapiens
ttgcccttcacagt

SEQ ID NO: 6581037 - DNA, 12 bp, Homo sapiens
ttgcccttcctg

SEQ ID NO: 6581038 - DNA, 15 bp, Homo sapiens
ttgcccttcctgacc

SEQ ID NO: 6581039 - DNA, 20 bp, Homo sapiens
ttgcccttctatactttctc

SEQ ID NO: 6581040 - DNA, 22 bp, Homo sapiens
ttgccctttacttgtctttctg

SEQ ID NO: 6581041 - DNA, 18 bp, Homo sapiens
ttgccctttccatattta

SEQ ID NO: 6581042 - DNA, 23 bp, Homo sapiens
ttgccctttccttttaaaaggcc

SEQ ID NO: 6581043 - DNA, 18 bp, Homo sapiens
ttgccctttctgtaccat

SEQ ID NO: 6581044 - DNA, 20 bp, Homo sapiens
ttgccctttctgtaccattt

SEQ ID NO: 6581045 - DNA, 16 bp, Homo sapiens
ttgccctttggccagt

SEQ ID NO: 6581046 - DNA, 14 bp, Homo sapiens
ttgcccttttcctt

SEQ ID NO: 6581047 - DNA, 19 bp, Homo sapiens
ttgccgacagcacagatgt

SEQ ID NO: 6581048 - DNA, 18 bp, Homo sapiens
ttgccgagcctaatgaaa

SEQ ID NO: 6581049 - DNA, 19 bp, Homo sapiens
ttgccgccccgtgcctgta

SEQ ID NO: 6581050 - DNA, 18 bp, Homo sapiens
ttgccgccgcgggtgtgc

SEQ ID NO: 6581051 - DNA, 12 bp, Homo sapiens
ttgccgctggga

SEQ ID NO: 6581052 - DNA, 14 bp, Homo sapiens
ttgccgctgggaga

SEQ ID NO: 6581053 - DNA, 24 bp, Homo sapiens
ttgccgctgggagagccaaggcct

SEQ ID NO: 6581054 - DNA, 18 bp, Homo sapiens
ttgccgggcctggactgt

SEQ ID NO: 6581055 - DNA, 15 bp, Homo sapiens
ttgccgtctctggcc

SEQ ID NO: 6581056 - DNA, 15 bp, Homo sapiens
ttgccgtgagcatgc

SEQ ID NO: 6581057 - DNA, 23 bp, Homo sapiens
ttgcctaaaatataatttttaat

SEQ ID NO: 6581058 - DNA, 13 bp, Homo sapiens
ttgcctaaatcca

SEQ ID NO: 6581059 - DNA, 22 bp, Homo sapiens
ttgcctaaatcccaagaaatgg

SEQ ID NO: 6581060 - DNA, 18 bp, Homo sapiens
ttgcctaaatttaatgct

SEQ ID NO: 6581061 - DNA, 18 bp, Homo sapiens
ttgcctaactaactggca

SEQ ID NO: 6581062 - DNA, 19 bp, Homo sapiens
ttgcctaagaataaacatt

SEQ ID NO: 6581063 - DNA, 19 bp, Homo sapiens
ttgcctaagcattgcctgg

SEQ ID NO: 6581064 - DNA, 20 bp, Homo sapiens
ttgcctaagcattgcctggc

SEQ ID NO: 6581065 - DNA, 20 bp, Homo sapiens
ttgcctaagtattaaaacat

SEQ ID NO: 6581066 - DNA, 15 bp, Homo sapiens
ttgcctacaataaaa

SEQ ID NO: 6581067 - DNA, 18 bp, Homo sapiens
ttgcctacaataaaaaga

SEQ ID NO: 6581068 - DNA, 23 bp, Homo sapiens
ttgcctagccccaggtcttttct

SEQ ID NO: 6581069 - DNA, 20 bp, Homo sapiens
ttgcctataagccaaaatta

SEQ ID NO: 6581070 - DNA, 17 bp, Homo sapiens
ttgcctatattttcctg

SEQ ID NO: 6581071 - DNA, 17 bp, Homo sapiens
ttgcctatctgacttca

SEQ ID NO: 6581072 - DNA, 17 bp, Homo sapiens
ttgcctcaactccagga

SEQ ID NO: 6581073 - DNA, 18 bp, Homo sapiens
ttgcctcagcttccccag

SEQ ID NO: 6581074 - DNA, 19 bp, Homo sapiens
ttgcctcagcttccccagt

SEQ ID NO: 6581075 - DNA, 13 bp, Homo sapiens
ttgcctcatgaac

SEQ ID NO: 6581076 - DNA, 15 bp, Homo sapiens
ttgcctcatttccct

SEQ ID NO: 6581077 - DNA, 18 bp, Homo sapiens
ttgcctcattttgcttcc

SEQ ID NO: 6581078 - DNA, 12 bp, Homo sapiens
ttgcctccacct

SEQ ID NO: 6581079 - DNA, 22 bp, Homo sapiens
ttgcctccaggaccttgcttcc

SEQ ID NO: 6581080 - DNA, 23 bp, Homo sapiens
ttgcctccaggaccttgcttcct

SEQ ID NO: 6581081 - DNA, 15 bp, Homo sapiens
ttgcctccaggtgca

SEQ ID NO: 6581082 - DNA, 20 bp, Homo sapiens
ttgcctccaggtgcagaggt

SEQ ID NO: 6581083 - DNA, 20 bp, Homo sapiens
ttgcctccatggtgcctctg

SEQ ID NO: 6581084 - DNA, 19 bp, Homo sapiens
ttgcctcccaggcaagcag

SEQ ID NO: 6581085 - DNA, 21 bp, Homo sapiens
ttgcctcccaggcaagcagct

SEQ ID NO: 6581086 - DNA, 20 bp, Homo sapiens
ttgcctccccatttcccatc

SEQ ID NO: 6581087 - DNA, 12 bp, Homo sapiens
ttgcctcccctc

SEQ ID NO: 6581088 - DNA, 22 bp, Homo sapiens
ttgcctccctgcacttcatccc

SEQ ID NO: 6581089 - DNA, 14 bp, Homo sapiens
ttgcctcctcagta

SEQ ID NO: 6581090 - DNA, 22 bp, Homo sapiens
ttgcctcctctctccctgcctc

SEQ ID NO: 6581091 - DNA, 15 bp, Homo sapiens
ttgcctccttttttc

SEQ ID NO: 6581092 - DNA, 18 bp, Homo sapiens
ttgcctcgagtcccccca

SEQ ID NO: 6581093 - DNA, 22 bp, Homo sapiens
ttgcctcgagtccccccacccc

SEQ ID NO: 6581094 - DNA, 14 bp, Homo sapiens
ttgcctcggctcct

SEQ ID NO: 6581095 - DNA, 19 bp, Homo sapiens
ttgcctcggctcctgctgc

SEQ ID NO: 6581096 - DNA, 20 bp, Homo sapiens
ttgcctcggctcctgctgca

SEQ ID NO: 6581097 - DNA, 22 bp, Homo sapiens
ttgcctcggctcctgctgcacc

SEQ ID NO: 6581098 - DNA, 12 bp, Homo sapiens
ttgcctctactt

SEQ ID NO: 6581099 - DNA, 19 bp, Homo sapiens
ttgcctctcggttgaaacc

SEQ ID NO: 6581100 - DNA, 13 bp, Homo sapiens
ttgcctctctctt

SEQ ID NO: 6581101 - DNA, 21 bp, Homo sapiens
ttgcctctcttgccccttgtc

SEQ ID NO: 6581102 - DNA, 18 bp, Homo sapiens
ttgcctctgagagcatca

SEQ ID NO: 6581103 - DNA, 18 bp, Homo sapiens
ttgcctctgattttctcc

SEQ ID NO: 6581104 - DNA, 13 bp, Homo sapiens
ttgcctctgcacg

SEQ ID NO: 6581105 - DNA, 19 bp, Homo sapiens
ttgcctctgcagtctcatt

SEQ ID NO: 6581106 - DNA, 15 bp, Homo sapiens
ttgcctctgcccaac

SEQ ID NO: 6581107 - DNA, 13 bp, Homo sapiens
ttgcctctgccct

SEQ ID NO: 6581108 - DNA, 16 bp, Homo sapiens
ttgcctctgcctctga

SEQ ID NO: 6581109 - DNA, 19 bp, Homo sapiens
ttgcctctgggtaggaaaa

SEQ ID NO: 6581110 - DNA, 20 bp, Homo sapiens
ttgcctctgtccgtgcccct

SEQ ID NO: 6581111 - DNA, 14 bp, Homo sapiens
ttgcctctgtcctc

SEQ ID NO: 6581112 - DNA, 14 bp, Homo sapiens
ttgcctctgtctta

SEQ ID NO: 6581113 - DNA, 14 bp, Homo sapiens
ttgcctctgtgctg

SEQ ID NO: 6581114 - DNA, 23 bp, Homo sapiens
ttgcctgaacatccttccttccc

SEQ ID NO: 6581115 - DNA, 15 bp, Homo sapiens
ttgcctgaactccag

SEQ ID NO: 6581116 - DNA, 16 bp, Homo sapiens
ttgcctgaactccaga

SEQ ID NO: 6581117 - DNA, 12 bp, Homo sapiens
ttgcctgaagaa

SEQ ID NO: 6581118 - DNA, 20 bp, Homo sapiens
ttgcctgaagttggagtgag

SEQ ID NO: 6581119 - DNA, 22 bp, Homo sapiens
ttgcctgaatccatcaggactt

SEQ ID NO: 6581120 - DNA, 15 bp, Homo sapiens
ttgcctgaggctgta

SEQ ID NO: 6581121 - DNA, 16 bp, Homo sapiens
ttgcctgatataaatg

SEQ ID NO: 6581122 - DNA, 18 bp, Homo sapiens
ttgcctgcacccttccct

SEQ ID NO: 6581123 - DNA, 19 bp, Homo sapiens
ttgcctgcacccttccctc

SEQ ID NO: 6581124 - DNA, 21 bp, Homo sapiens
ttgcctgcacccttccctctt

SEQ ID NO: 6581125 - DNA, 23 bp, Homo sapiens
ttgcctgcaggtcagttgtaata

SEQ ID NO: 6581126 - DNA, 22 bp, Homo sapiens
ttgcctgcagtttcttgtgtag

SEQ ID NO: 6581127 - DNA, 13 bp, Homo sapiens
ttgcctgccaggg

SEQ ID NO: 6581128 - DNA, 15 bp, Homo sapiens
ttgcctgccagggcc

SEQ ID NO: 6581129 - DNA, 12 bp, Homo sapiens
ttgcctgcctcc

SEQ ID NO: 6581130 - DNA, 13 bp, Homo sapiens
ttgcctgcctcct

SEQ ID NO: 6581131 - DNA, 14 bp, Homo sapiens
ttgcctgcctccta

SEQ ID NO: 6581132 - DNA, 16 bp, Homo sapiens
ttgcctgcctcctagg

SEQ ID NO: 6581133 - DNA, 15 bp, Homo sapiens
ttgcctgcctgggcc

SEQ ID NO: 6581134 - DNA, 20 bp, Homo sapiens
ttgcctgcctgggcctccca

SEQ ID NO: 6581135 - DNA, 23 bp, Homo sapiens
ttgcctgcctgggcctcccaaag

SEQ ID NO: 6581136 - DNA, 16 bp, Homo sapiens
ttgcctgcctttccat

SEQ ID NO: 6581137 - DNA, 18 bp, Homo sapiens
ttgcctgcggtcaaggcc

SEQ ID NO: 6581138 - DNA, 20 bp, Homo sapiens
ttgcctgctgagctgtgccc

SEQ ID NO: 6581139 - DNA, 11 bp, Homo sapiens
ttgcctgctgc

SEQ ID NO: 6581140 - DNA, 24 bp, Homo sapiens
ttgcctgctgcttggagtgcccca

SEQ ID NO: 6581141 - DNA, 12 bp, Homo sapiens
ttgcctgctggg

SEQ ID NO: 6581142 - DNA, 21 bp, Homo sapiens
ttgcctgctgtatttatagta

SEQ ID NO: 6581143 - DNA, 12 bp, Homo sapiens
ttgcctggactg

SEQ ID NO: 6581144 - DNA, 23 bp, Homo sapiens
ttgcctggactgaccacaccaac

SEQ ID NO: 6581145 - DNA, 22 bp, Homo sapiens
ttgcctggattgggagccattt

SEQ ID NO: 6581146 - DNA, 19 bp, Homo sapiens
aagtttttacaaaatacta

SEQ ID NO: 6581147 - DNA, 15 bp, Homo sapiens
aagtttttacagtgt

SEQ ID NO: 6581148 - DNA, 16 bp, Homo sapiens
aagtttttactagaaa

SEQ ID NO: 6581149 - DNA, 15 bp, Homo sapiens
aagtttttagaatgt

SEQ ID NO: 6581150 - DNA, 17 bp, Homo sapiens
aagtttttatagttatt

SEQ ID NO: 6581151 - DNA, 20 bp, Homo sapiens
aagtttttatggcttttgtg

SEQ ID NO: 6581152 - DNA, 23 bp, Homo sapiens
aagtttttattcaaagcagctgt

SEQ ID NO: 6581153 - DNA, 20 bp, Homo sapiens
aagtttttcagaaagtttga

SEQ ID NO: 6581154 - DNA, 21 bp, Homo sapiens
aagtttttcatactgtacaca

SEQ ID NO: 6581155 - DNA, 22 bp, Homo sapiens
aagtttttcatactgtacacat

SEQ ID NO: 6581156 - DNA, 23 bp, Homo sapiens
aagtttttcatactgtacacatt

SEQ ID NO: 6581157 - DNA, 13 bp, Homo sapiens
aagtttttccaaa

SEQ ID NO: 6581158 - DNA, 16 bp, Homo sapiens
aagtttttctttgtgt

SEQ ID NO: 6581159 - DNA, 15 bp, Homo sapiens
aagtttttgaaatac

SEQ ID NO: 6581160 - DNA, 22 bp, Homo sapiens
aagtttttgccattataatttt

SEQ ID NO: 6581161 - DNA, 17 bp, Homo sapiens
aagtttttgtactgtaa

SEQ ID NO: 6581162 - DNA, 14 bp, Homo sapiens
aagtttttgtatta

SEQ ID NO: 6581163 - DNA, 17 bp, Homo sapiens
aagttttttatgccttt

SEQ ID NO: 6581164 - DNA, 13 bp, Homo sapiens
aagtttttttgct

SEQ ID NO: 6581165 - DNA, 16 bp, Homo sapiens
aagtttttttttcctc

SEQ ID NO: 6581166 - DNA, 13 bp, Homo sapiens
aataaaaaaaaga

SEQ ID NO: 6581167 - DNA, 18 bp, Homo sapiens
aataaaaaaaagaaatga

SEQ ID NO: 6581168 - DNA, 17 bp, Homo sapiens
aataaaaaaagaaaaaa

SEQ ID NO: 6581169 - DNA, 16 bp, Homo sapiens
aataaaaaaatacagt

SEQ ID NO: 6581170 - DNA, 19 bp, Homo sapiens
aataaaaaaatacagtaaa

SEQ ID NO: 6581171 - DNA, 14 bp, Homo sapiens
aataaaaaaatata

SEQ ID NO: 6581172 - DNA, 20 bp, Homo sapiens
aataaaaaaatatatacaga

SEQ ID NO: 6581173 - DNA, 10 bp, Homo sapiens
aataaaaaac

SEQ ID NO: 6581174 - DNA, 16 bp, Homo sapiens
aataaaaaacaaatat

SEQ ID NO: 6581175 - DNA, 12 bp, Homo sapiens
aataaaaaacct

SEQ ID NO: 6581176 - DNA, 12 bp, Homo sapiens
aataaaaaagat

SEQ ID NO: 6581177 - DNA, 15 bp, Homo sapiens
aataaaaaagatccc

SEQ ID NO: 6581178 - DNA, 16 bp, Homo sapiens
aataaaaaagattcta

SEQ ID NO: 6581179 - DNA, 14 bp, Homo sapiens
aataaaaaagtgag

SEQ ID NO: 6581180 - DNA, 17 bp, Homo sapiens
aataaaaaatctgaaga

SEQ ID NO: 6581181 - DNA, 15 bp, Homo sapiens
aataaaaaccaaatt

SEQ ID NO: 6581182 - DNA, 16 bp, Homo sapiens
aataaaaaccagaatc

SEQ ID NO: 6581183 - DNA, 21 bp, Homo sapiens
aataaaaaccagaatcataat

SEQ ID NO: 6581184 - DNA, 19 bp, Homo sapiens
aataaaaactgactcctta

SEQ ID NO: 6581185 - DNA, 19 bp, Homo sapiens
aataaaaacttcagaaaaa

SEQ ID NO: 6581186 - DNA, 16 bp, Homo sapiens
aataaaaacttttgag

SEQ ID NO: 6581187 - DNA, 15 bp, Homo sapiens
aataaaaagaaaggc

SEQ ID NO: 6581188 - DNA, 14 bp, Homo sapiens
aataaaaagacaac

SEQ ID NO: 6581189 - DNA, 20 bp, Homo sapiens
aataaaaagagaaacaagta

SEQ ID NO: 6581190 - DNA, 17 bp, Homo sapiens
aataaaaagatcacttt

SEQ ID NO: 6581191 - DNA, 16 bp, Homo sapiens
aataaaaagcttttgt

SEQ ID NO: 6581192 - DNA, 21 bp, Homo sapiens
aataaaaaggaaatatttttc

SEQ ID NO: 6581193 - DNA, 22 bp, Homo sapiens
aataaaaaggaaatatttttca

SEQ ID NO: 6581194 - DNA, 13 bp, Homo sapiens
aataaaaaggcac

SEQ ID NO: 6581195 - DNA, 18 bp, Homo sapiens
aataaaaagggcagccct

SEQ ID NO: 6581196 - DNA, 12 bp, Homo sapiens
aataaaaaggtg

SEQ ID NO: 6581197 - DNA, 19 bp, Homo sapiens
aataaaaagtgacacagca

SEQ ID NO: 6581198 - DNA, 20 bp, Homo sapiens
aataaaaagtgacacagcag

SEQ ID NO: 6581199 - DNA, 15 bp, Homo sapiens
aataaaaagttcaga

SEQ ID NO: 6581200 - DNA, 13 bp, Homo sapiens
aataaaaataaat

SEQ ID NO: 6581201 - DNA, 14 bp, Homo sapiens
aataaaaataatag

SEQ ID NO: 6581202 - DNA, 19 bp, Homo sapiens
aataaaaatagttacagtg

SEQ ID NO: 6581203 - DNA, 13 bp, Homo sapiens
aataaaaatatat

SEQ ID NO: 6581204 - DNA, 15 bp, Homo sapiens
aataaaaatatatat

SEQ ID NO: 6581205 - DNA, 17 bp, Homo sapiens
aataaaaatatgtaatt

SEQ ID NO: 6581206 - DNA, 17 bp, Homo sapiens
aataaaaatcaggagcc

SEQ ID NO: 6581207 - DNA, 13 bp, Homo sapiens
aataaaaatgata

SEQ ID NO: 6581208 - DNA, 13 bp, Homo sapiens
aataaaaatgcta

SEQ ID NO: 6581209 - DNA, 13 bp, Homo sapiens
aataaaaatggat

SEQ ID NO: 6581210 - DNA, 14 bp, Homo sapiens
aataaaaatgttta

SEQ ID NO: 6581211 - DNA, 15 bp, Homo sapiens
aataaaaatgtttaa

SEQ ID NO: 6581212 - DNA, 17 bp, Homo sapiens
aataaaaattaaggcaa

SEQ ID NO: 6581213 - DNA, 17 bp, Homo sapiens
aataaaaattatgaaat

SEQ ID NO: 6581214 - DNA, 19 bp, Homo sapiens
aataaaaattggagctcat

SEQ ID NO: 6581215 - DNA, 23 bp, Homo sapiens
aataaaaattggagctcattttc

SEQ ID NO: 6581216 - DNA, 20 bp, Homo sapiens
aataaaacaaataaatatga

SEQ ID NO: 6581217 - DNA, 15 bp, Homo sapiens
aataaaacaataaat

SEQ ID NO: 6581218 - DNA, 15 bp, Homo sapiens
aataaaacacacctc

SEQ ID NO: 6581219 - DNA, 12 bp, Homo sapiens
aataaaacagta

SEQ ID NO: 6581220 - DNA, 13 bp, Homo sapiens
aataaaacatcac

SEQ ID NO: 6581221 - DNA, 20 bp, Homo sapiens
aataaaacatcactatcaat

SEQ ID NO: 6581222 - DNA, 13 bp, Homo sapiens
aataaaacatttt

SEQ ID NO: 6581223 - DNA, 17 bp, Homo sapiens
aataaaacattttcaca

SEQ ID NO: 6581224 - DNA, 19 bp, Homo sapiens
aataaaacattttcacaca

SEQ ID NO: 6581225 - DNA, 17 bp, Homo sapiens
aataaaaccaagcctct

SEQ ID NO: 6581226 - DNA, 21 bp, Homo sapiens
aataaaaccaagcctctggaa

SEQ ID NO: 6581227 - DNA, 20 bp, Homo sapiens
aataaaacccgttgattact

SEQ ID NO: 6581228 - DNA, 21 bp, Homo sapiens
aataaaaccgaaggtgaaaaa

SEQ ID NO: 6581229 - DNA, 13 bp, Homo sapiens
aataaaacctttc

SEQ ID NO: 6581230 - DNA, 23 bp, Homo sapiens
aataaaacctttcaaatttcaca

SEQ ID NO: 6581231 - DNA, 23 bp, Homo sapiens
aataaaacgttatctcattgcaa

SEQ ID NO: 6581232 - DNA, 22 bp, Homo sapiens
aataaaactaagctctttgaga

SEQ ID NO: 6581233 - DNA, 23 bp, Homo sapiens
aataaaactaagctctttgagaa

SEQ ID NO: 6581234 - DNA, 13 bp, Homo sapiens
aataaaactattt

SEQ ID NO: 6581235 - DNA, 14 bp, Homo sapiens
aataaaactattta

SEQ ID NO: 6581236 - DNA, 15 bp, Homo sapiens
aataaaactatttaa

SEQ ID NO: 6581237 - DNA, 17 bp, Homo sapiens
aataaaactcccttcct

SEQ ID NO: 6581238 - DNA, 13 bp, Homo sapiens
aataaaactgaat

SEQ ID NO: 6581239 - DNA, 15 bp, Homo sapiens
aataaaactgatgtg

SEQ ID NO: 6581240 - DNA, 18 bp, Homo sapiens
aataaaactgatgtgaaa

SEQ ID NO: 6581241 - DNA, 19 bp, Homo sapiens
aataaaactgcacagtgct

SEQ ID NO: 6581242 - DNA, 22 bp, Homo sapiens
aataaaactgcgaggacatcaa

SEQ ID NO: 6581243 - DNA, 22 bp, Homo sapiens
aataaaacttatgctagtttat

SEQ ID NO: 6581244 - DNA, 22 bp, Homo sapiens
aataaaactttatgtactgctg

SEQ ID NO: 6581245 - DNA, 13 bp, Homo sapiens
aataaaactttcc

SEQ ID NO: 6581246 - DNA, 18 bp, Homo sapiens
aataaaactttttaaaat

SEQ ID NO: 6581247 - DNA, 13 bp, Homo sapiens
aataaaagaacat

SEQ ID NO: 6581248 - DNA, 17 bp, Homo sapiens
aataaaagagctgtctg

SEQ ID NO: 6581249 - DNA, 21 bp, Homo sapiens
aataaaagagctgtctgactg

SEQ ID NO: 6581250 - DNA, 13 bp, Homo sapiens
aataaaagagctt

SEQ ID NO: 6581251 - DNA, 19 bp, Homo sapiens
aataaaagagctttatccc

SEQ ID NO: 6581252 - DNA, 16 bp, Homo sapiens
aataaaagatataaat

SEQ ID NO: 6581253 - DNA, 11 bp, Homo sapiens
aataaaagcac

SEQ ID NO: 6581254 - DNA, 18 bp, Homo sapiens
aataaaagcagcatctgc

SEQ ID NO: 6581255 - DNA, 21 bp, Homo sapiens
aataaaagcagcatctgctaa

SEQ ID NO: 6581256 - DNA, 14 bp, Homo sapiens
aataaaagcccagg

SEQ ID NO: 6581257 - DNA, 15 bp, Homo sapiens
aataaaagcccagga

SEQ ID NO: 6581258 - DNA, 17 bp, Homo sapiens
aataaaagcccaggagc

SEQ ID NO: 6581259 - DNA, 20 bp, Homo sapiens
aataaaagctataaagtata

SEQ ID NO: 6581260 - DNA, 13 bp, Homo sapiens
aataaaagctatt

SEQ ID NO: 6581261 - DNA, 17 bp, Homo sapiens
aataaaaggaaaagcaa

SEQ ID NO: 6581262 - DNA, 14 bp, Homo sapiens
aataaaagtacaaa

SEQ ID NO: 6581263 - DNA, 12 bp, Homo sapiens
aataaaagtcag

SEQ ID NO: 6581264 - DNA, 22 bp, Homo sapiens
aataaaagtgaagtgaatctga

SEQ ID NO: 6581265 - DNA, 12 bp, Homo sapiens
aataaaagtgac

SEQ ID NO: 6581266 - DNA, 16 bp, Homo sapiens
aataaaagtgaccttt

SEQ ID NO: 6581267 - DNA, 14 bp, Homo sapiens
aataaaagtgctgc

SEQ ID NO: 6581268 - DNA, 22 bp, Homo sapiens
aataaaagtggtaattgggaac

SEQ ID NO: 6581269 - DNA, 23 bp, Homo sapiens
aataaaagttaataacagctcct

SEQ ID NO: 6581270 - DNA, 14 bp, Homo sapiens
aataaaagttcctc

SEQ ID NO: 6581271 - DNA, 16 bp, Homo sapiens
aataaaagttcctctc

SEQ ID NO: 6581272 - DNA, 23 bp, Homo sapiens
aataaaagttcctctcccttccc

SEQ ID NO: 6581273 - DNA, 13 bp, Homo sapiens
aataaaataagtc

SEQ ID NO: 6581274 - DNA, 16 bp, Homo sapiens
aataaaataagttctt

SEQ ID NO: 6581275 - DNA, 16 bp, Homo sapiens
aataaaataattctaa

SEQ ID NO: 6581276 - DNA, 19 bp, Homo sapiens
aataaaataccttttatgt

SEQ ID NO: 6581277 - DNA, 22 bp, Homo sapiens
aataaaatatcataaagcattt

SEQ ID NO: 6581278 - DNA, 15 bp, Homo sapiens
aataaaatatcattc

SEQ ID NO: 6581279 - DNA, 17 bp, Homo sapiens
aataaaatatcattcag

SEQ ID NO: 6581280 - DNA, 15 bp, Homo sapiens
aataaaatattcact

SEQ ID NO: 6581281 - DNA, 22 bp, Homo sapiens
aataaaatattttctgtgtgtt

SEQ ID NO: 6581282 - DNA, 23 bp, Homo sapiens
aataaaatattttctgtgtgttc

SEQ ID NO: 6581283 - DNA, 16 bp, Homo sapiens
aataaaatcaattttt

SEQ ID NO: 6581284 - DNA, 14 bp, Homo sapiens
aataaaatgaacat

SEQ ID NO: 6581285 - DNA, 13 bp, Homo sapiens
aataaaatgcaaa

SEQ ID NO: 6581286 - DNA, 18 bp, Homo sapiens
aataaaatgcaaatgaat

SEQ ID NO: 6581287 - DNA, 20 bp, Homo sapiens
aataaaatgcaaatgaatca

SEQ ID NO: 6581288 - DNA, 22 bp, Homo sapiens
aataaaatgcaaatgaatcatt

SEQ ID NO: 6581289 - DNA, 17 bp, Homo sapiens
aataaaatgcatttaaa

SEQ ID NO: 6581290 - DNA, 14 bp, Homo sapiens
aataaaatgcctca

SEQ ID NO: 6581291 - DNA, 17 bp, Homo sapiens
aataaaatggatagaaa

SEQ ID NO: 6581292 - DNA, 18 bp, Homo sapiens
aataaaatggtacatttc

SEQ ID NO: 6581293 - DNA, 15 bp, Homo sapiens
aataaaatgtgtaca

SEQ ID NO: 6581294 - DNA, 16 bp, Homo sapiens
aataaaatgtgtacag

SEQ ID NO: 6581295 - DNA, 17 bp, Homo sapiens
aataaaatgtgtacagt

SEQ ID NO: 6581296 - DNA, 14 bp, Homo sapiens
aataaaatgtttac

SEQ ID NO: 6581297 - DNA, 18 bp, Homo sapiens
aataaaatgtttctctct

SEQ ID NO: 6581298 - DNA, 17 bp, Homo sapiens
aataaaattaagaatgt

SEQ ID NO: 6581299 - DNA, 19 bp, Homo sapiens
aataaaattatttgcaggt

SEQ ID NO: 6581300 - DNA, 15 bp, Homo sapiens
aataaaattattttg

SEQ ID NO: 6581301 - DNA, 17 bp, Homo sapiens
aataaaattcattccat

SEQ ID NO: 6581302 - DNA, 13 bp, Homo sapiens
aataaaattctgt

SEQ ID NO: 6581303 - DNA, 14 bp, Homo sapiens
aataaaattgtaaa

SEQ ID NO: 6581304 - DNA, 12 bp, Homo sapiens
aataaaatttaa

SEQ ID NO: 6581305 - DNA, 23 bp, Homo sapiens
aataaaatttaaaaaactcctgt

SEQ ID NO: 6581306 - DNA, 12 bp, Homo sapiens
aataaaatttat

SEQ ID NO: 6581307 - DNA, 11 bp, Homo sapiens
aataaaatttc

SEQ ID NO: 6581308 - DNA, 15 bp, Homo sapiens
aataaaatttctaag

SEQ ID NO: 6581309 - DNA, 21 bp, Homo sapiens
aataaaatttctaagagagct

SEQ ID NO: 6581310 - DNA, 13 bp, Homo sapiens
aataaaatttctt

SEQ ID NO: 6581311 - DNA, 12 bp, Homo sapiens
aataaaatttgt

SEQ ID NO: 6581312 - DNA, 18 bp, Homo sapiens
aataaaattttttttcat

SEQ ID NO: 6581313 - DNA, 13 bp, Homo sapiens
aataaacaaataa

SEQ ID NO: 6581314 - DNA, 21 bp, Homo sapiens
aataaacacatagattcacct

SEQ ID NO: 6581315 - DNA, 20 bp, Homo sapiens
aataaacactggctctggga

SEQ ID NO: 6581316 - DNA, 22 bp, Homo sapiens
aataaacactggctctgggact

SEQ ID NO: 6581317 - DNA, 20 bp, Homo sapiens
aataaacagatgtattatgc

SEQ ID NO: 6581318 - DNA, 14 bp, Homo sapiens
aataaacagctatt

SEQ ID NO: 6581319 - DNA, 19 bp, Homo sapiens
aataaacagctatttaagg

SEQ ID NO: 6581320 - DNA, 21 bp, Homo sapiens
aataaacagcttcatgccttt

SEQ ID NO: 6581321 - DNA, 18 bp, Homo sapiens
aataaacagtcactggaa

SEQ ID NO: 6581322 - DNA, 19 bp, Homo sapiens
aataaacatagcttgtaac

SEQ ID NO: 6581323 - DNA, 15 bp, Homo sapiens
aataaacatctgtgt

SEQ ID NO: 6581324 - DNA, 13 bp, Homo sapiens
aataaacattttt

SEQ ID NO: 6581325 - DNA, 18 bp, Homo sapiens
aataaacattttttaaga

SEQ ID NO: 6581326 - DNA, 18 bp, Homo sapiens
aataaaccaaaggaaaat

SEQ ID NO: 6581327 - DNA, 12 bp, Homo sapiens
ttgcctggcctt

SEQ ID NO: 6581328 - DNA, 11 bp, Homo sapiens
ttgcctggctg

SEQ ID NO: 6581329 - DNA, 19 bp, Homo sapiens
ttgcctggctgtggaggcc

SEQ ID NO: 6581330 - DNA, 22 bp, Homo sapiens
ttgcctggctgtggaggcctga

SEQ ID NO: 6581331 - DNA, 20 bp, Homo sapiens
ttgcctgggctgggcagcct

SEQ ID NO: 6581332 - DNA, 23 bp, Homo sapiens
ttgcctgggggcttttgccactc

SEQ ID NO: 6581333 - DNA, 12 bp, Homo sapiens
ttgcctggtaca

SEQ ID NO: 6581334 - DNA, 14 bp, Homo sapiens
ttgcctggtacagt

SEQ ID NO: 6581335 - DNA, 23 bp, Homo sapiens
ttgcctggtcaccctggggctgc

SEQ ID NO: 6581336 - DNA, 19 bp, Homo sapiens
ttgcctgtaacaagccaga

SEQ ID NO: 6581337 - DNA, 12 bp, Homo sapiens
ttgcctgtagtc

SEQ ID NO: 6581338 - DNA, 13 bp, Homo sapiens
ttgcctgtcaagt

SEQ ID NO: 6581339 - DNA, 17 bp, Homo sapiens
ttgcctgttctgcttcg

SEQ ID NO: 6581340 - DNA, 22 bp, Homo sapiens
ttgcctgttggctgctgcggct

SEQ ID NO: 6581341 - DNA, 12 bp, Homo sapiens
ttgcctgtttct

SEQ ID NO: 6581342 - DNA, 18 bp, Homo sapiens
ttgccttaaacctgaaga

SEQ ID NO: 6581343 - DNA, 22 bp, Homo sapiens
ttgccttaaacctgaagatgtc

SEQ ID NO: 6581344 - DNA, 13 bp, Homo sapiens
ttgccttaagttt

SEQ ID NO: 6581345 - DNA, 22 bp, Homo sapiens
ttgccttaataaatatgtaata

SEQ ID NO: 6581346 - DNA, 18 bp, Homo sapiens
ttgccttagcacttcttt

SEQ ID NO: 6581347 - DNA, 21 bp, Homo sapiens
ttgccttatcttgaaaagaat

SEQ ID NO: 6581348 - DNA, 15 bp, Homo sapiens
ttgccttatgggctg

SEQ ID NO: 6581349 - DNA, 13 bp, Homo sapiens
ttgccttatttcc

SEQ ID NO: 6581350 - DNA, 20 bp, Homo sapiens
ttgccttatttgtctgtaaa

SEQ ID NO: 6581351 - DNA, 14 bp, Homo sapiens
ttgccttcaactaa

SEQ ID NO: 6581352 - DNA, 20 bp, Homo sapiens
ttgccttccatttcccctct

SEQ ID NO: 6581353 - DNA, 15 bp, Homo sapiens
ttgccttcctaagcc

SEQ ID NO: 6581354 - DNA, 22 bp, Homo sapiens
ttgccttcctttctccaggacc

SEQ ID NO: 6581355 - DNA, 15 bp, Homo sapiens
ttgccttctactccc

SEQ ID NO: 6581356 - DNA, 18 bp, Homo sapiens
ttgccttctactcccctt

SEQ ID NO: 6581357 - DNA, 14 bp, Homo sapiens
ttgccttctcacca

SEQ ID NO: 6581358 - DNA, 21 bp, Homo sapiens
ttgccttctctgttcccttgc

SEQ ID NO: 6581359 - DNA, 15 bp, Homo sapiens
ttgccttctggttat

SEQ ID NO: 6581360 - DNA, 19 bp, Homo sapiens
ttgccttcttcacccagct

SEQ ID NO: 6581361 - DNA, 22 bp, Homo sapiens
ttgccttgaaatttacacagtg

SEQ ID NO: 6581362 - DNA, 17 bp, Homo sapiens
ttgccttgatgttgtgt

SEQ ID NO: 6581363 - DNA, 15 bp, Homo sapiens
ttgccttgcagaact

SEQ ID NO: 6581364 - DNA, 14 bp, Homo sapiens
ttgccttgcagcca

SEQ ID NO: 6581365 - DNA, 13 bp, Homo sapiens
ttgccttgcattt

SEQ ID NO: 6581366 - DNA, 13 bp, Homo sapiens
ttgccttgcttct

SEQ ID NO: 6581367 - DNA, 16 bp, Homo sapiens
ttgccttgcttctccc

SEQ ID NO: 6581368 - DNA, 16 bp, Homo sapiens
ttgcctttaggcagga

SEQ ID NO: 6581369 - DNA, 19 bp, Homo sapiens
ttgcctttaggcaggaagt

SEQ ID NO: 6581370 - DNA, 23 bp, Homo sapiens
ttgcctttcagtattgacactga

SEQ ID NO: 6581371 - DNA, 15 bp, Homo sapiens
ttgcctttccacctg

SEQ ID NO: 6581372 - DNA, 16 bp, Homo sapiens
ttgcctttccacctgc

SEQ ID NO: 6581373 - DNA, 21 bp, Homo sapiens
ttgcctttcctgctacatttg

SEQ ID NO: 6581374 - DNA, 17 bp, Homo sapiens
ttgcctttcgaggcctg

SEQ ID NO: 6581375 - DNA, 14 bp, Homo sapiens
ttgcctttctggga

SEQ ID NO: 6581376 - DNA, 20 bp, Homo sapiens
ttgcctttctgggagcagaa

SEQ ID NO: 6581377 - DNA, 14 bp, Homo sapiens
ttgcctttcttctg

SEQ ID NO: 6581378 - DNA, 18 bp, Homo sapiens
ttgcctttcttctgccct

SEQ ID NO: 6581379 - DNA, 14 bp, Homo sapiens
ttgcctttgaggtt

SEQ ID NO: 6581380 - DNA, 16 bp, Homo sapiens
ttgcctttggttcccc

SEQ ID NO: 6581381 - DNA, 16 bp, Homo sapiens
ttgccttttaaaagaa

SEQ ID NO: 6581382 - DNA, 15 bp, Homo sapiens
ttgccttttaatttt

SEQ ID NO: 6581383 - DNA, 19 bp, Homo sapiens
ttgccttttaatttttaat

SEQ ID NO: 6581384 - DNA, 18 bp, Homo sapiens
ttgccttttctagcccga

SEQ ID NO: 6581385 - DNA, 13 bp, Homo sapiens
ttgccttttgcaa

SEQ ID NO: 6581386 - DNA, 18 bp, Homo sapiens
ttgccttttgcaaacttt

SEQ ID NO: 6581387 - DNA, 22 bp, Homo sapiens
ttgccttttgttaatgcattgt

SEQ ID NO: 6581388 - DNA, 13 bp, Homo sapiens
ttgcctttttcat

SEQ ID NO: 6581389 - DNA, 16 bp, Homo sapiens
ttgcctttttcattat

SEQ ID NO: 6581390 - DNA, 15 bp, Homo sapiens
ttgcctttttctcta

SEQ ID NO: 6581391 - DNA, 13 bp, Homo sapiens
ttgccttttttat

SEQ ID NO: 6581392 - DNA, 20 bp, Homo sapiens
ttgcgaatccaagctccctg

SEQ ID NO: 6581393 - DNA, 17 bp, Homo sapiens
ttgcgaatggttccatt

SEQ ID NO: 6581394 - DNA, 15 bp, Homo sapiens
ttgcgaccaccaaca

SEQ ID NO: 6581395 - DNA, 22 bp, Homo sapiens
ttgcgaccaccaacacacagga

SEQ ID NO: 6581396 - DNA, 17 bp, Homo sapiens
ttgcgaccatgtgtaga

SEQ ID NO: 6581397 - DNA, 19 bp, Homo sapiens
ttgcgacggagagaaaaaa

SEQ ID NO: 6581398 - DNA, 17 bp, Homo sapiens
ttgcgagagatgtgtgt

SEQ ID NO: 6581399 - DNA, 19 bp, Homo sapiens
ttgcgatagagtctcactg

SEQ ID NO: 6581400 - DNA, 12 bp, Homo sapiens
ttgcgatgtgtt

SEQ ID NO: 6581401 - DNA, 22 bp, Homo sapiens
ttgcgcacttaccgccctgcgg

SEQ ID NO: 6581402 - DNA, 12 bp, Homo sapiens
ttgcgccactgc

SEQ ID NO: 6581403 - DNA, 13 bp, Homo sapiens
ttgcgccactgca

SEQ ID NO: 6581404 - DNA, 20 bp, Homo sapiens
ttgcgcctaatgtgtttgag

SEQ ID NO: 6581405 - DNA, 23 bp, Homo sapiens
ttgcgcctttgtattataaaagc

SEQ ID NO: 6581406 - DNA, 23 bp, Homo sapiens
ttgcgctggtggaccacaggcat

SEQ ID NO: 6581407 - DNA, 16 bp, Homo sapiens
ttgcgctgtcccaggc

SEQ ID NO: 6581408 - DNA, 12 bp, Homo sapiens
ttgcggaagcca

SEQ ID NO: 6581409 - DNA, 21 bp, Homo sapiens
ttgcggaagccatagggggct

SEQ ID NO: 6581410 - DNA, 13 bp, Homo sapiens
ttgcggccccagg

SEQ ID NO: 6581411 - DNA, 15 bp, Homo sapiens
ttgcggccccaggag

SEQ ID NO: 6581412 - DNA, 23 bp, Homo sapiens
ttgcggcgtcagtctttttctgt

SEQ ID NO: 6581413 - DNA, 14 bp, Homo sapiens
ttgcgggacagagt

SEQ ID NO: 6581414 - DNA, 17 bp, Homo sapiens
ttgcgtaactggctgtg

SEQ ID NO: 6581415 - DNA, 18 bp, Homo sapiens
ttgcgtaactggctgtgt

SEQ ID NO: 6581416 - DNA, 13 bp, Homo sapiens
ttgcgtagaggct

SEQ ID NO: 6581417 - DNA, 18 bp, Homo sapiens
ttgcgtagaggctacagg

SEQ ID NO: 6581418 - DNA, 21 bp, Homo sapiens
ttgcgtagctctcaaatgtgt

SEQ ID NO: 6581419 - DNA, 14 bp, Homo sapiens
ttgcgtatgtctgt

SEQ ID NO: 6581420 - DNA, 18 bp, Homo sapiens
ttgcgtatgtctgttacc

SEQ ID NO: 6581421 - DNA, 20 bp, Homo sapiens
ttgcgtatgtctgttaccat

SEQ ID NO: 6581422 - DNA, 14 bp, Homo sapiens
ttgcgtgacactct

SEQ ID NO: 6581423 - DNA, 18 bp, Homo sapiens
ttgcgtggactctgcaca

SEQ ID NO: 6581424 - DNA, 16 bp, Homo sapiens
ttgcgtggatcaagct

SEQ ID NO: 6581425 - DNA, 12 bp, Homo sapiens
ttgcgtgtctgt

SEQ ID NO: 6581426 - DNA, 14 bp, Homo sapiens
ttgcgtttttcctt

SEQ ID NO: 6581427 - DNA, 15 bp, Homo sapiens
ttgcgtttttccttg

SEQ ID NO: 6581428 - DNA, 16 bp, Homo sapiens
ttgcgtttttccttgt

SEQ ID NO: 6581429 - DNA, 14 bp, Homo sapiens
ttgctaaaaaaagt

SEQ ID NO: 6581430 - DNA, 18 bp, Homo sapiens
ttgctaaaaaaagtgcat

SEQ ID NO: 6581431 - DNA, 16 bp, Homo sapiens
ttgctaaaaaagcata

SEQ ID NO: 6581432 - DNA, 20 bp, Homo sapiens
ttgctaaaaaataaataaaa

SEQ ID NO: 6581433 - DNA, 21 bp, Homo sapiens
ttgctaaaaatagtggccaga

SEQ ID NO: 6581434 - DNA, 13 bp, Homo sapiens
ttgctaaaagaag

SEQ ID NO: 6581435 - DNA, 14 bp, Homo sapiens
ttgctaaaagaaga

SEQ ID NO: 6581436 - DNA, 16 bp, Homo sapiens
ttgctaaaagaagaga

SEQ ID NO: 6581437 - DNA, 17 bp, Homo sapiens
ttgctaaaagcatgtat

SEQ ID NO: 6581438 - DNA, 22 bp, Homo sapiens
ttgctaaaatattttagatgtt

SEQ ID NO: 6581439 - DNA, 13 bp, Homo sapiens
ttgctaaacactg

SEQ ID NO: 6581440 - DNA, 15 bp, Homo sapiens
ttgctaaatgtaaca

SEQ ID NO: 6581441 - DNA, 12 bp, Homo sapiens
ttgctaaattat

SEQ ID NO: 6581442 - DNA, 21 bp, Homo sapiens
ttgctaaattataaaattgaa

SEQ ID NO: 6581443 - DNA, 17 bp, Homo sapiens
ttgctaaattgattgaa

SEQ ID NO: 6581444 - DNA, 15 bp, Homo sapiens
ttgctaacaggatat

SEQ ID NO: 6581445 - DNA, 13 bp, Homo sapiens
ttgctaactgaac

SEQ ID NO: 6581446 - DNA, 13 bp, Homo sapiens
ttgctaactgggt

SEQ ID NO: 6581447 - DNA, 13 bp, Homo sapiens
ttgctaactggtt

SEQ ID NO: 6581448 - DNA, 14 bp, Homo sapiens
ttgctaactggtta

SEQ ID NO: 6581449 - DNA, 23 bp, Homo sapiens
ttgctaactttgcccttcactgt

SEQ ID NO: 6581450 - DNA, 15 bp, Homo sapiens
ttgctaagaagccta

SEQ ID NO: 6581451 - DNA, 22 bp, Homo sapiens
ttgctaagataattaaatgaaa

SEQ ID NO: 6581452 - DNA, 23 bp, Homo sapiens
ttgctaagataattaaatgaaat

SEQ ID NO: 6581453 - DNA, 13 bp, Homo sapiens
ttgctaagatgct

SEQ ID NO: 6581454 - DNA, 14 bp, Homo sapiens
ttgctaagatgctc

SEQ ID NO: 6581455 - DNA, 22 bp, Homo sapiens
ttgctaagtaaatctcttctgt

SEQ ID NO: 6581456 - DNA, 20 bp, Homo sapiens
ttgctaagtgaggatgaaaa

SEQ ID NO: 6581457 - DNA, 16 bp, Homo sapiens
ttgctaagtgtgctta

SEQ ID NO: 6581458 - DNA, 20 bp, Homo sapiens
ttgctaataaagatgtctgc

SEQ ID NO: 6581459 - DNA, 14 bp, Homo sapiens
ttgctaatcagtgt

SEQ ID NO: 6581460 - DNA, 15 bp, Homo sapiens
ttgctaatcagtgtc

SEQ ID NO: 6581461 - DNA, 18 bp, Homo sapiens
ttgctaatgctatgcaaa

SEQ ID NO: 6581462 - DNA, 15 bp, Homo sapiens
ttgctaatgtataat

SEQ ID NO: 6581463 - DNA, 18 bp, Homo sapiens
ttgctaattgctgttgaa

SEQ ID NO: 6581464 - DNA, 21 bp, Homo sapiens
ttgctaattgctgttgaaagc

SEQ ID NO: 6581465 - DNA, 21 bp, Homo sapiens
ttgctacaaatttatgcattt

SEQ ID NO: 6581466 - DNA, 13 bp, Homo sapiens
ttgctacaataaa

SEQ ID NO: 6581467 - DNA, 16 bp, Homo sapiens
ttgctacaataaatgc

SEQ ID NO: 6581468 - DNA, 13 bp, Homo sapiens
ttgctacacacac

SEQ ID NO: 6581469 - DNA, 16 bp, Homo sapiens
ttgctacatcagagtg

SEQ ID NO: 6581470 - DNA, 21 bp, Homo sapiens
ttgctaccaagtttcatacca

SEQ ID NO: 6581471 - DNA, 22 bp, Homo sapiens
ttgctaccaatctgtgagaagt

SEQ ID NO: 6581472 - DNA, 15 bp, Homo sapiens
ttgctaccacagact

SEQ ID NO: 6581473 - DNA, 22 bp, Homo sapiens
ttgctaccagtatttagaagcc

SEQ ID NO: 6581474 - DNA, 21 bp, Homo sapiens
ttgctacccatttacaaataa

SEQ ID NO: 6581475 - DNA, 21 bp, Homo sapiens
ttgctaccctgagttcatcca

SEQ ID NO: 6581476 - DNA, 13 bp, Homo sapiens
ttgctacctcagt

SEQ ID NO: 6581477 - DNA, 18 bp, Homo sapiens
ttgctacgtgcctcccga

SEQ ID NO: 6581478 - DNA, 20 bp, Homo sapiens
ttgctactacttacctacca

SEQ ID NO: 6581479 - DNA, 21 bp, Homo sapiens
ttgctactttatttgcctaaa

SEQ ID NO: 6581480 - DNA, 21 bp, Homo sapiens
ttgctagacaaggttgctgtt

SEQ ID NO: 6581481 - DNA, 18 bp, Homo sapiens
ttgctagactctagacaa

SEQ ID NO: 6581482 - DNA, 16 bp, Homo sapiens
ttgctagagctcctcc

SEQ ID NO: 6581483 - DNA, 21 bp, Homo sapiens
ttgctagagctcctccctctc

SEQ ID NO: 6581484 - DNA, 23 bp, Homo sapiens
ttgctagataaaagctgaagtta

SEQ ID NO: 6581485 - DNA, 13 bp, Homo sapiens
ttgctagccctgg

SEQ ID NO: 6581486 - DNA, 13 bp, Homo sapiens
ttgctagctagcc

SEQ ID NO: 6581487 - DNA, 19 bp, Homo sapiens
ttgctaggagccccagctt

SEQ ID NO: 6581488 - DNA, 20 bp, Homo sapiens
ttgctagggagagggaagag

SEQ ID NO: 6581489 - DNA, 13 bp, Homo sapiens
ttgctagtatttg

SEQ ID NO: 6581490 - DNA, 16 bp, Homo sapiens
ttgctagtatttgaat

SEQ ID NO: 6581491 - DNA, 19 bp, Homo sapiens
ttgctatataaataaagca

SEQ ID NO: 6581492 - DNA, 20 bp, Homo sapiens
ttgctatataaataaagcaa

SEQ ID NO: 6581493 - DNA, 13 bp, Homo sapiens
ttgctatcattgt

SEQ ID NO: 6581494 - DNA, 15 bp, Homo sapiens
ttgctatccgacatg

SEQ ID NO: 6581495 - DNA, 16 bp, Homo sapiens
ttgctatcggggaagc

SEQ ID NO: 6581496 - DNA, 18 bp, Homo sapiens
ttgctatcggggaagcca

SEQ ID NO: 6581497 - DNA, 15 bp, Homo sapiens
ttgctatctattgat

SEQ ID NO: 6581498 - DNA, 22 bp, Homo sapiens
ttgctatctggaggccttccag

SEQ ID NO: 6581499 - DNA, 21 bp, Homo sapiens
ttgctatgtgccttatgttga

SEQ ID NO: 6581500 - DNA, 16 bp, Homo sapiens
ttgctatgttactatt

SEQ ID NO: 6581501 - DNA, 23 bp, Homo sapiens
ttgctatgttactattttctaca

SEQ ID NO: 6581502 - DNA, 16 bp, Homo sapiens
ttgctatgttgcccaa

SEQ ID NO: 6581503 - DNA, 14 bp, Homo sapiens
ttgctattacatgt

SEQ ID NO: 6581504 - DNA, 22 bp, Homo sapiens
ttgctattagactgtaggaaga

SEQ ID NO: 6581505 - DNA, 18 bp, Homo sapiens
ttgctattgaattgagat

SEQ ID NO: 6581506 - DNA, 13 bp, Homo sapiens
ttgctattggaat

SEQ ID NO: 6581507 - DNA, 16 bp, Homo sapiens
aataaaccaaaggaca

SEQ ID NO: 6581508 - DNA, 17 bp, Homo sapiens
aataaaccaaaggacat

SEQ ID NO: 6581509 - DNA, 13 bp, Homo sapiens
aataaaccaaata

SEQ ID NO: 6581510 - DNA, 15 bp, Homo sapiens
aataaaccaaatatg

SEQ ID NO: 6581511 - DNA, 12 bp, Homo sapiens
aataaaccaaga

SEQ ID NO: 6581512 - DNA, 15 bp, Homo sapiens
aataaaccaagacaa

SEQ ID NO: 6581513 - DNA, 10 bp, Homo sapiens
aataaaccag

SEQ ID NO: 6581514 - DNA, 17 bp, Homo sapiens
aataaaccagatcaaat

SEQ ID NO: 6581515 - DNA, 11 bp, Homo sapiens
aataaaccagt

SEQ ID NO: 6581516 - DNA, 14 bp, Homo sapiens
aataaaccagtgtg

SEQ ID NO: 6581517 - DNA, 17 bp, Homo sapiens
aataaaccagtgtgaac

SEQ ID NO: 6581518 - DNA, 21 bp, Homo sapiens
aataaaccattggacagattt

SEQ ID NO: 6581519 - DNA, 14 bp, Homo sapiens
aataaaccattttt

SEQ ID NO: 6581520 - DNA, 14 bp, Homo sapiens
aataaaccctcctt

SEQ ID NO: 6581521 - DNA, 17 bp, Homo sapiens
aataaaccggatcctgt

SEQ ID NO: 6581522 - DNA, 16 bp, Homo sapiens
aataaacctgaggcag

SEQ ID NO: 6581523 - DNA, 13 bp, Homo sapiens
aataaacctggag

SEQ ID NO: 6581524 - DNA, 18 bp, Homo sapiens
aataaacctggagatgat

SEQ ID NO: 6581525 - DNA, 14 bp, Homo sapiens
aataaacctgtcat

SEQ ID NO: 6581526 - DNA, 21 bp, Homo sapiens
aataaaccttgtttctttctg

SEQ ID NO: 6581527 - DNA, 17 bp, Homo sapiens
aataaacgaaacacaga

SEQ ID NO: 6581528 - DNA, 17 bp, Homo sapiens
aataaacgatgttgtga

SEQ ID NO: 6581529 - DNA, 15 bp, Homo sapiens
aataaacgatttaat

SEQ ID NO: 6581530 - DNA, 15 bp, Homo sapiens
aataaacgtcttaaa

SEQ ID NO: 6581531 - DNA, 17 bp, Homo sapiens
aataaacgtcttaaata

SEQ ID NO: 6581532 - DNA, 15 bp, Homo sapiens
aataaacgtggattt

SEQ ID NO: 6581533 - DNA, 15 bp, Homo sapiens
aataaacgtttgaaa

SEQ ID NO: 6581534 - DNA, 13 bp, Homo sapiens
aataaactaaaga

SEQ ID NO: 6581535 - DNA, 18 bp, Homo sapiens
aataaactaataattgca

SEQ ID NO: 6581536 - DNA, 12 bp, Homo sapiens
aataaactacac

SEQ ID NO: 6581537 - DNA, 14 bp, Homo sapiens
aataaactactctt

SEQ ID NO: 6581538 - DNA, 19 bp, Homo sapiens
aataaactactctttgatt

SEQ ID NO: 6581539 - DNA, 15 bp, Homo sapiens
aataaactattggaa

SEQ ID NO: 6581540 - DNA, 13 bp, Homo sapiens
aataaactattta

SEQ ID NO: 6581541 - DNA, 11 bp, Homo sapiens
aataaactcat

SEQ ID NO: 6581542 - DNA, 18 bp, Homo sapiens
aataaactcataaaactc

SEQ ID NO: 6581543 - DNA, 19 bp, Homo sapiens
aataaactcataaaactca

SEQ ID NO: 6581544 - DNA, 21 bp, Homo sapiens
aataaactccccagcgtatcc

SEQ ID NO: 6581545 - DNA, 11 bp, Homo sapiens
aataaactctc

SEQ ID NO: 6581546 - DNA, 12 bp, Homo sapiens
aataaactctct

SEQ ID NO: 6581547 - DNA, 14 bp, Homo sapiens
aataaactctctag

SEQ ID NO: 6581548 - DNA, 20 bp, Homo sapiens
aataaactcttcaaggccaa

SEQ ID NO: 6581549 - DNA, 11 bp, Homo sapiens
aataaactgag

SEQ ID NO: 6581550 - DNA, 17 bp, Homo sapiens
aataaactgtaaactaa

SEQ ID NO: 6581551 - DNA, 14 bp, Homo sapiens
aataaactgtatta

SEQ ID NO: 6581552 - DNA, 13 bp, Homo sapiens
aataaactgttta

SEQ ID NO: 6581553 - DNA, 13 bp, Homo sapiens
aataaactgtttt

SEQ ID NO: 6581554 - DNA, 15 bp, Homo sapiens
aataaactgttttca

SEQ ID NO: 6581555 - DNA, 17 bp, Homo sapiens
aataaactgttttcaag

SEQ ID NO: 6581556 - DNA, 15 bp, Homo sapiens
aataaacttacagat

SEQ ID NO: 6581557 - DNA, 19 bp, Homo sapiens
aataaacttagaataaaat

SEQ ID NO: 6581558 - DNA, 20 bp, Homo sapiens
aataaacttagaggaaaatg

SEQ ID NO: 6581559 - DNA, 12 bp, Homo sapiens
aataaacttctt

SEQ ID NO: 6581560 - DNA, 13 bp, Homo sapiens
aataaacttgtgc

SEQ ID NO: 6581561 - DNA, 20 bp, Homo sapiens
aataaactttgaataaaaga

SEQ ID NO: 6581562 - DNA, 15 bp, Homo sapiens
aataaactttttttc

SEQ ID NO: 6581563 - DNA, 17 bp, Homo sapiens
aataaactttttttcaa

SEQ ID NO: 6581564 - DNA, 18 bp, Homo sapiens
aataaactttttttcaat

SEQ ID NO: 6581565 - DNA, 20 bp, Homo sapiens
aataaactttttttcaatgt

SEQ ID NO: 6581566 - DNA, 21 bp, Homo sapiens
aataaactttttttcaatgtg

SEQ ID NO: 6581567 - DNA, 12 bp, Homo sapiens
aataaagaaaaa

SEQ ID NO: 6581568 - DNA, 14 bp, Homo sapiens
aataaagaaaaaaa

SEQ ID NO: 6581569 - DNA, 13 bp, Homo sapiens
aataaagaaaaac

SEQ ID NO: 6581570 - DNA, 12 bp, Homo sapiens
aataaagaaaat

SEQ ID NO: 6581571 - DNA, 16 bp, Homo sapiens
aataaagaaaatgaac

SEQ ID NO: 6581572 - DNA, 12 bp, Homo sapiens
aataaagaaata

SEQ ID NO: 6581573 - DNA, 13 bp, Homo sapiens
aataaagaaattg

SEQ ID NO: 6581574 - DNA, 18 bp, Homo sapiens
aataaagaaatttggtac

SEQ ID NO: 6581575 - DNA, 19 bp, Homo sapiens
aataaagaaatttggtacc

SEQ ID NO: 6581576 - DNA, 12 bp, Homo sapiens
aataaagaagaa

SEQ ID NO: 6581577 - DNA, 18 bp, Homo sapiens
aataaagaagaaaataac

SEQ ID NO: 6581578 - DNA, 13 bp, Homo sapiens
aataaagaatact

SEQ ID NO: 6581579 - DNA, 19 bp, Homo sapiens
aataaagaatacttgaact

SEQ ID NO: 6581580 - DNA, 12 bp, Homo sapiens
aataaagacagg

SEQ ID NO: 6581581 - DNA, 15 bp, Homo sapiens
aataaagactagagc

SEQ ID NO: 6581582 - DNA, 13 bp, Homo sapiens
aataaagagaaat

SEQ ID NO: 6581583 - DNA, 17 bp, Homo sapiens
aataaagagaaccatgt

SEQ ID NO: 6581584 - DNA, 12 bp, Homo sapiens
aataaagaggag

SEQ ID NO: 6581585 - DNA, 17 bp, Homo sapiens
aataaagagtaaatata

SEQ ID NO: 6581586 - DNA, 18 bp, Homo sapiens
aataaagatatttccaag

SEQ ID NO: 6581587 - DNA, 14 bp, Homo sapiens
aataaagatcatgt

SEQ ID NO: 6581588 - DNA, 13 bp, Homo sapiens
aataaagatgagt

SEQ ID NO: 6581589 - DNA, 18 bp, Homo sapiens
aataaagatggttttgat

SEQ ID NO: 6581590 - DNA, 17 bp, Homo sapiens
aataaagatgtgaaaac

SEQ ID NO: 6581591 - DNA, 14 bp, Homo sapiens
aataaagcaaatat

SEQ ID NO: 6581592 - DNA, 14 bp, Homo sapiens
aataaagcacgcag

SEQ ID NO: 6581593 - DNA, 18 bp, Homo sapiens
aataaagcactattgttt

SEQ ID NO: 6581594 - DNA, 22 bp, Homo sapiens
aataaagcactattgtttagat

SEQ ID NO: 6581595 - DNA, 21 bp, Homo sapiens
aataaagcagagccaaggcca

SEQ ID NO: 6581596 - DNA, 14 bp, Homo sapiens
aataaagcagcctg

SEQ ID NO: 6581597 - DNA, 16 bp, Homo sapiens
aataaagcagcctgat

SEQ ID NO: 6581598 - DNA, 22 bp, Homo sapiens
aataaagcagcctgattgaaaa

SEQ ID NO: 6581599 - DNA, 14 bp, Homo sapiens
aataaagcagcgtt

SEQ ID NO: 6581600 - DNA, 16 bp, Homo sapiens
aataaagcagtcctgt

SEQ ID NO: 6581601 - DNA, 12 bp, Homo sapiens
aataaagcagtt

SEQ ID NO: 6581602 - DNA, 19 bp, Homo sapiens
aataaagcattttgcaaac

SEQ ID NO: 6581603 - DNA, 11 bp, Homo sapiens
aataaagccct

SEQ ID NO: 6581604 - DNA, 13 bp, Homo sapiens
aataaagcctgct

SEQ ID NO: 6581605 - DNA, 11 bp, Homo sapiens
aataaagcctt

SEQ ID NO: 6581606 - DNA, 18 bp, Homo sapiens
aataaagccttcaaactc

SEQ ID NO: 6581607 - DNA, 21 bp, Homo sapiens
aataaagccttgtgatcactt

SEQ ID NO: 6581608 - DNA, 12 bp, Homo sapiens
aataaagccttt

SEQ ID NO: 6581609 - DNA, 16 bp, Homo sapiens
aataaagccttttaaa

SEQ ID NO: 6581610 - DNA, 17 bp, Homo sapiens
aataaagcgtcctctca

SEQ ID NO: 6581611 - DNA, 19 bp, Homo sapiens
aataaagctaccatgttaa

SEQ ID NO: 6581612 - DNA, 20 bp, Homo sapiens
aataaagctcctctgctcca

SEQ ID NO: 6581613 - DNA, 11 bp, Homo sapiens
aataaagctgt

SEQ ID NO: 6581614 - DNA, 13 bp, Homo sapiens
aataaagctttat

SEQ ID NO: 6581615 - DNA, 11 bp, Homo sapiens
aataaaggaaa

SEQ ID NO: 6581616 - DNA, 18 bp, Homo sapiens
aataaaggaggaatcaga

SEQ ID NO: 6581617 - DNA, 18 bp, Homo sapiens
aataaaggataactctgt

SEQ ID NO: 6581618 - DNA, 16 bp, Homo sapiens
aataaaggatgtgatt

SEQ ID NO: 6581619 - DNA, 23 bp, Homo sapiens
aataaaggcagctgttgtctctt

SEQ ID NO: 6581620 - DNA, 20 bp, Homo sapiens
aataaaggtcccttagcccc

SEQ ID NO: 6581621 - DNA, 16 bp, Homo sapiens
aataaaggtctttgca

SEQ ID NO: 6581622 - DNA, 15 bp, Homo sapiens
aataaaggttaaaaa

SEQ ID NO: 6581623 - DNA, 12 bp, Homo sapiens
aataaaggttct

SEQ ID NO: 6581624 - DNA, 15 bp, Homo sapiens
aataaaggttctatg

SEQ ID NO: 6581625 - DNA, 19 bp, Homo sapiens
aataaaggttctatgatat

SEQ ID NO: 6581626 - DNA, 17 bp, Homo sapiens
aataaagtactacatca

SEQ ID NO: 6581627 - DNA, 19 bp, Homo sapiens
aataaagtactacatcagt

SEQ ID NO: 6581628 - DNA, 16 bp, Homo sapiens
aataaagtactgcaaa

SEQ ID NO: 6581629 - DNA, 12 bp, Homo sapiens
aataaagtataa

SEQ ID NO: 6581630 - DNA, 15 bp, Homo sapiens
aataaagtatataat

SEQ ID NO: 6581631 - DNA, 17 bp, Homo sapiens
aataaagtatcatgcat

SEQ ID NO: 6581632 - DNA, 19 bp, Homo sapiens
aataaagtattccacctta

SEQ ID NO: 6581633 - DNA, 14 bp, Homo sapiens
aataaagtattcta

SEQ ID NO: 6581634 - DNA, 13 bp, Homo sapiens
aataaagtattta

SEQ ID NO: 6581635 - DNA, 15 bp, Homo sapiens
aataaagtatttaat

SEQ ID NO: 6581636 - DNA, 23 bp, Homo sapiens
aataaagtatttaattagtgcta

SEQ ID NO: 6581637 - DNA, 13 bp, Homo sapiens
aataaagtatttt

SEQ ID NO: 6581638 - DNA, 17 bp, Homo sapiens
aataaagtattttcttt

SEQ ID NO: 6581639 - DNA, 13 bp, Homo sapiens
aataaagtcaaat

SEQ ID NO: 6581640 - DNA, 16 bp, Homo sapiens
aataaagtcctcttcc

SEQ ID NO: 6581641 - DNA, 14 bp, Homo sapiens
aataaagtctgagt

SEQ ID NO: 6581642 - DNA, 15 bp, Homo sapiens
aataaagtctgtcat

SEQ ID NO: 6581643 - DNA, 20 bp, Homo sapiens
aataaagtctgtctgcactg

SEQ ID NO: 6581644 - DNA, 19 bp, Homo sapiens
aataaagtgacaaaagctc

SEQ ID NO: 6581645 - DNA, 15 bp, Homo sapiens
aataaagtgatctgt

SEQ ID NO: 6581646 - DNA, 12 bp, Homo sapiens
aataaagtgcaa

SEQ ID NO: 6581647 - DNA, 19 bp, Homo sapiens
aataaagtgcaaacagaag

SEQ ID NO: 6581648 - DNA, 16 bp, Homo sapiens
aataaagtgccttctg

SEQ ID NO: 6581649 - DNA, 13 bp, Homo sapiens
aataaagtggcat

SEQ ID NO: 6581650 - DNA, 19 bp, Homo sapiens
aataaagtggcatttcttt

SEQ ID NO: 6581651 - DNA, 11 bp, Homo sapiens
aataaagtgta

SEQ ID NO: 6581652 - DNA, 15 bp, Homo sapiens
aataaagtgttttca

SEQ ID NO: 6581653 - DNA, 9 bp, Homo sapiens
aataaagtt

SEQ ID NO: 6581654 - DNA, 16 bp, Homo sapiens
aataaagttaaattgc

SEQ ID NO: 6581655 - DNA, 20 bp, Homo sapiens
aataaagttacttgaatttc

SEQ ID NO: 6581656 - DNA, 19 bp, Homo sapiens
aataaagttctgagtgttt

SEQ ID NO: 6581657 - DNA, 18 bp, Homo sapiens
aataaagttctgttttct

SEQ ID NO: 6581658 - DNA, 17 bp, Homo sapiens
aataaagttgaatatta

SEQ ID NO: 6581659 - DNA, 21 bp, Homo sapiens
aataaagttgaatattatata

SEQ ID NO: 6581660 - DNA, 15 bp, Homo sapiens
aataaagttgcagat

SEQ ID NO: 6581661 - DNA, 19 bp, Homo sapiens
aataaagttggtcttttga

SEQ ID NO: 6581662 - DNA, 14 bp, Homo sapiens
aataaagttgttgc

SEQ ID NO: 6581663 - DNA, 13 bp, Homo sapiens
aataaagtttatt

SEQ ID NO: 6581664 - DNA, 20 bp, Homo sapiens
aataaagtttggacttatct

SEQ ID NO: 6581665 - DNA, 14 bp, Homo sapiens
aataaataaaaatg

SEQ ID NO: 6581666 - DNA, 14 bp, Homo sapiens
aataaataaaagcc

SEQ ID NO: 6581667 - DNA, 14 bp, Homo sapiens
aataaataaagctt

SEQ ID NO: 6581668 - DNA, 13 bp, Homo sapiens
aataaataaataa

SEQ ID NO: 6581669 - DNA, 11 bp, Homo sapiens
aataaataatc

SEQ ID NO: 6581670 - DNA, 15 bp, Homo sapiens
aataaataccaaaga

SEQ ID NO: 6581671 - DNA, 14 bp, Homo sapiens
aataaatactcagt

SEQ ID NO: 6581672 - DNA, 13 bp, Homo sapiens
aataaatagattt

SEQ ID NO: 6581673 - DNA, 23 bp, Homo sapiens
aataaatagatttgattatttcc

SEQ ID NO: 6581674 - DNA, 22 bp, Homo sapiens
aataaatagggaagatggagac

SEQ ID NO: 6581675 - DNA, 12 bp, Homo sapiens
aataaatatacc

SEQ ID NO: 6581676 - DNA, 12 bp, Homo sapiens
aataaatatact

SEQ ID NO: 6581677 - DNA, 13 bp, Homo sapiens
aataaatatacta

SEQ ID NO: 6581678 - DNA, 15 bp, Homo sapiens
aataaatatactaat

SEQ ID NO: 6581679 - DNA, 18 bp, Homo sapiens
aataaatatactaataaa

SEQ ID NO: 6581680 - DNA, 13 bp, Homo sapiens
aataaatatactc

SEQ ID NO: 6581681 - DNA, 15 bp, Homo sapiens
aataaatatatataa

SEQ ID NO: 6581682 - DNA, 15 bp, Homo sapiens
aataaatatatatat

SEQ ID NO: 6581683 - DNA, 23 bp, Homo sapiens
aataaatatatctaccccagact

SEQ ID NO: 6581684 - DNA, 18 bp, Homo sapiens
aataaatatcacagtatt

SEQ ID NO: 6581685 - DNA, 10 bp, Homo sapiens
aataaatatg

SEQ ID NO: 6581686 - DNA, 11 bp, Homo sapiens
aataaatatgc

SEQ ID NO: 6581687 - DNA, 18 bp, Homo sapiens
aataaatattgtatttta

SEQ ID NO: 6581688 - DNA, 14 bp, Homo sapiens
aataaatatttatg

SEQ ID NO: 6581689 - DNA, 13 bp, Homo sapiens
aataaatatttta

SEQ ID NO: 6581690 - DNA, 13 bp, Homo sapiens
aataaatcacaca

SEQ ID NO: 6581691 - DNA, 16 bp, Homo sapiens
aataaatcatcctcat

SEQ ID NO: 6581692 - DNA, 21 bp, Homo sapiens
aataaatcattcttactaaaa

SEQ ID NO: 6581693 - DNA, 19 bp, Homo sapiens
aataaatccacccatgtta

SEQ ID NO: 6581694 - DNA, 23 bp, Homo sapiens
ttgctattgtaaggtctttgtaa

SEQ ID NO: 6581695 - DNA, 17 bp, Homo sapiens
ttgctattgtttatagg

SEQ ID NO: 6581696 - DNA, 12 bp, Homo sapiens
ttgctatttcca

SEQ ID NO: 6581697 - DNA, 17 bp, Homo sapiens
ttgctcaaaaaatgagc

SEQ ID NO: 6581698 - DNA, 23 bp, Homo sapiens
ttgctcaaaacacttccagtctg

SEQ ID NO: 6581699 - DNA, 16 bp, Homo sapiens
ttgctcaaaattgctt

SEQ ID NO: 6581700 - DNA, 18 bp, Homo sapiens
ttgctcaacagacaatta

SEQ ID NO: 6581701 - DNA, 15 bp, Homo sapiens
ttgctcaataaaggt

SEQ ID NO: 6581702 - DNA, 18 bp, Homo sapiens
ttgctcaatacctggcct

SEQ ID NO: 6581703 - DNA, 19 bp, Homo sapiens
ttgctcacagttattacat

SEQ ID NO: 6581704 - DNA, 22 bp, Homo sapiens
ttgctcacccaggacctctggg

SEQ ID NO: 6581705 - DNA, 19 bp, Homo sapiens
ttgctcacccagtgccctc

SEQ ID NO: 6581706 - DNA, 15 bp, Homo sapiens
ttgctcacctggggt

SEQ ID NO: 6581707 - DNA, 23 bp, Homo sapiens
ttgctcagagtgaagagtgaaga

SEQ ID NO: 6581708 - DNA, 22 bp, Homo sapiens
ttgctcagcccgcttggccacc

SEQ ID NO: 6581709 - DNA, 20 bp, Homo sapiens
ttgctcagctcctacctctg

SEQ ID NO: 6581710 - DNA, 19 bp, Homo sapiens
ttgctcaggtgcaagtgcc

SEQ ID NO: 6581711 - DNA, 19 bp, Homo sapiens
ttgctcagtccctctgggt

SEQ ID NO: 6581712 - DNA, 14 bp, Homo sapiens
ttgctcagtgcctc

SEQ ID NO: 6581713 - DNA, 18 bp, Homo sapiens
ttgctcagtgcctcctgg

SEQ ID NO: 6581714 - DNA, 20 bp, Homo sapiens
ttgctcagtgcctcctggcc

SEQ ID NO: 6581715 - DNA, 23 bp, Homo sapiens
ttgctcagtgtccagcttccaaa

SEQ ID NO: 6581716 - DNA, 23 bp, Homo sapiens
ttgctcatctcagtcctcaaagc

SEQ ID NO: 6581717 - DNA, 16 bp, Homo sapiens
ttgctcatgagctcct

SEQ ID NO: 6581718 - DNA, 16 bp, Homo sapiens
ttgctcatgccctgcc

SEQ ID NO: 6581719 - DNA, 23 bp, Homo sapiens
ttgctcatgtaatgtggtcacca

SEQ ID NO: 6581720 - DNA, 17 bp, Homo sapiens
ttgctccaataaaggaa

SEQ ID NO: 6581721 - DNA, 17 bp, Homo sapiens
ttgctccaccccactca

SEQ ID NO: 6581722 - DNA, 22 bp, Homo sapiens
ttgctccagataactctctttc

SEQ ID NO: 6581723 - DNA, 17 bp, Homo sapiens
ttgctccagattctgat

SEQ ID NO: 6581724 - DNA, 16 bp, Homo sapiens
ttgctccagcctgaca

SEQ ID NO: 6581725 - DNA, 17 bp, Homo sapiens
ttgctccagcctgacaa

SEQ ID NO: 6581726 - DNA, 15 bp, Homo sapiens
ttgctccattcctga

SEQ ID NO: 6581727 - DNA, 16 bp, Homo sapiens
ttgctccattttcttg

SEQ ID NO: 6581728 - DNA, 13 bp, Homo sapiens
ttgctcccaagcc

SEQ ID NO: 6581729 - DNA, 15 bp, Homo sapiens
ttgctcccaggatct

SEQ ID NO: 6581730 - DNA, 21 bp, Homo sapiens
ttgctccccttccccttcctt

SEQ ID NO: 6581731 - DNA, 18 bp, Homo sapiens
ttgctcccgccccagggt

SEQ ID NO: 6581732 - DNA, 21 bp, Homo sapiens
ttgctcccggggactcaagag

SEQ ID NO: 6581733 - DNA, 23 bp, Homo sapiens
ttgctccctctccaagacagcag

SEQ ID NO: 6581734 - DNA, 12 bp, Homo sapiens
ttgctccctctg

SEQ ID NO: 6581735 - DNA, 15 bp, Homo sapiens
ttgctccctctgtta

SEQ ID NO: 6581736 - DNA, 22 bp, Homo sapiens
ttgctccctgattaaagtgcct

SEQ ID NO: 6581737 - DNA, 17 bp, Homo sapiens
ttgctcccttcagcccc

SEQ ID NO: 6581738 - DNA, 19 bp, Homo sapiens
ttgctcccttcagccccca

SEQ ID NO: 6581739 - DNA, 13 bp, Homo sapiens
ttgctccgcctct

SEQ ID NO: 6581740 - DNA, 14 bp, Homo sapiens
ttgctcctaagcaa

SEQ ID NO: 6581741 - DNA, 11 bp, Homo sapiens
ttgctcctcct

SEQ ID NO: 6581742 - DNA, 14 bp, Homo sapiens
ttgctcctgccaac

SEQ ID NO: 6581743 - DNA, 10 bp, Homo sapiens
ttgctcctgg

SEQ ID NO: 6581744 - DNA, 22 bp, Homo sapiens
ttgctcctggaacctggcaggc

SEQ ID NO: 6581745 - DNA, 22 bp, Homo sapiens
ttgctcctgtttaactccctag

SEQ ID NO: 6581746 - DNA, 17 bp, Homo sapiens
ttgctccttcagttctg

SEQ ID NO: 6581747 - DNA, 17 bp, Homo sapiens
ttgctcctttccatcag

SEQ ID NO: 6581748 - DNA, 19 bp, Homo sapiens
ttgctcgcccagacaccat

SEQ ID NO: 6581749 - DNA, 15 bp, Homo sapiens
ttgctctaatgatca

SEQ ID NO: 6581750 - DNA, 19 bp, Homo sapiens
ttgctctaattcttttcaa

SEQ ID NO: 6581751 - DNA, 14 bp, Homo sapiens
ttgctctacagata

SEQ ID NO: 6581752 - DNA, 15 bp, Homo sapiens
ttgctctacctggcc

SEQ ID NO: 6581753 - DNA, 23 bp, Homo sapiens
ttgctctatctcacagcacactc

SEQ ID NO: 6581754 - DNA, 16 bp, Homo sapiens
ttgctctatgtctgcc

SEQ ID NO: 6581755 - DNA, 14 bp, Homo sapiens
ttgctctatgttag

SEQ ID NO: 6581756 - DNA, 22 bp, Homo sapiens
ttgctctcccggttcttccagt

SEQ ID NO: 6581757 - DNA, 23 bp, Homo sapiens
ttgctctcccggttcttccagtg

SEQ ID NO: 6581758 - DNA, 13 bp, Homo sapiens
ttgctctccctct

SEQ ID NO: 6581759 - DNA, 16 bp, Homo sapiens
ttgctctccctcttct

SEQ ID NO: 6581760 - DNA, 12 bp, Homo sapiens
ttgctctcctca

SEQ ID NO: 6581761 - DNA, 22 bp, Homo sapiens
ttgctctcctggagcaagctct

SEQ ID NO: 6581762 - DNA, 22 bp, Homo sapiens
ttgctctcgaccggccctgcat

SEQ ID NO: 6581763 - DNA, 19 bp, Homo sapiens
ttgctctctcattcccagg

SEQ ID NO: 6581764 - DNA, 18 bp, Homo sapiens
ttgctctctctccctgcc

SEQ ID NO: 6581765 - DNA, 19 bp, Homo sapiens
ttgctctgacctcctctgg

SEQ ID NO: 6581766 - DNA, 11 bp, Homo sapiens
ttgctctgagc

SEQ ID NO: 6581767 - DNA, 12 bp, Homo sapiens
ttgctctgaggt

SEQ ID NO: 6581768 - DNA, 17 bp, Homo sapiens
ttgctctgcaggcacct

SEQ ID NO: 6581769 - DNA, 11 bp, Homo sapiens
ttgctctgccc

SEQ ID NO: 6581770 - DNA, 9 bp, Homo sapiens
ttgctctgg

SEQ ID NO: 6581771 - DNA, 20 bp, Homo sapiens
ttgctctggaagcctgctga

SEQ ID NO: 6581772 - DNA, 15 bp, Homo sapiens
ttgctctggagcagc

SEQ ID NO: 6581773 - DNA, 19 bp, Homo sapiens
ttgctctggaggaagttct

SEQ ID NO: 6581774 - DNA, 13 bp, Homo sapiens
ttgctctgtggcc

SEQ ID NO: 6581775 - DNA, 22 bp, Homo sapiens
ttgctctgtggccttggccctg

SEQ ID NO: 6581776 - DNA, 16 bp, Homo sapiens
ttgctctgtgtatatc

SEQ ID NO: 6581777 - DNA, 20 bp, Homo sapiens
ttgctctgttacccaggctg

SEQ ID NO: 6581778 - DNA, 18 bp, Homo sapiens
ttgctctgttcacagtct

SEQ ID NO: 6581779 - DNA, 14 bp, Homo sapiens
ttgctcttaaaaat

SEQ ID NO: 6581780 - DNA, 17 bp, Homo sapiens
ttgctcttcagatgcca

SEQ ID NO: 6581781 - DNA, 18 bp, Homo sapiens
ttgctcttctttctgaga

SEQ ID NO: 6581782 - DNA, 17 bp, Homo sapiens
ttgctcttgatgcctgg

SEQ ID NO: 6581783 - DNA, 22 bp, Homo sapiens
ttgctcttgcagagaagccttg

SEQ ID NO: 6581784 - DNA, 16 bp, Homo sapiens
ttgctcttggaaagct

SEQ ID NO: 6581785 - DNA, 22 bp, Homo sapiens
ttgctcttggaattactgaaag

SEQ ID NO: 6581786 - DNA, 19 bp, Homo sapiens
ttgctcttgtcccacgtgt

SEQ ID NO: 6581787 - DNA, 19 bp, Homo sapiens
ttgctcttgtcggggtggg

SEQ ID NO: 6581788 - DNA, 13 bp, Homo sapiens
ttgctgaaaaatg

SEQ ID NO: 6581789 - DNA, 20 bp, Homo sapiens
ttgctgaaaactctatgtcc

SEQ ID NO: 6581790 - DNA, 17 bp, Homo sapiens
ttgctgaaaatggtatt

SEQ ID NO: 6581791 - DNA, 11 bp, Homo sapiens
ttgctgaaatt

SEQ ID NO: 6581792 - DNA, 14 bp, Homo sapiens
ttgctgaactcagc

SEQ ID NO: 6581793 - DNA, 20 bp, Homo sapiens
ttgctgaactcttaggcaca

SEQ ID NO: 6581794 - DNA, 12 bp, Homo sapiens
ttgctgaagatg

SEQ ID NO: 6581795 - DNA, 18 bp, Homo sapiens
ttgctgaagatgccttga

SEQ ID NO: 6581796 - DNA, 19 bp, Homo sapiens
ttgctgaagggcattcttt

SEQ ID NO: 6581797 - DNA, 21 bp, Homo sapiens
ttgctgaagggcattctttcc

SEQ ID NO: 6581798 - DNA, 19 bp, Homo sapiens
ttgctgaataacaacaatt

SEQ ID NO: 6581799 - DNA, 20 bp, Homo sapiens
ttgctgaataacaacaattt

SEQ ID NO: 6581800 - DNA, 18 bp, Homo sapiens
ttgctgaataggcgatca

SEQ ID NO: 6581801 - DNA, 22 bp, Homo sapiens
ttgctgaatcggaatctctggg

SEQ ID NO: 6581802 - DNA, 15 bp, Homo sapiens
ttgctgaatgcaaga

SEQ ID NO: 6581803 - DNA, 13 bp, Homo sapiens
ttgctgaattcat

SEQ ID NO: 6581804 - DNA, 19 bp, Homo sapiens
ttgctgaattcatctattt

SEQ ID NO: 6581805 - DNA, 15 bp, Homo sapiens
ttgctgacaataaag

SEQ ID NO: 6581806 - DNA, 23 bp, Homo sapiens
ttgctgacaataaagatatttcc

SEQ ID NO: 6581807 - DNA, 16 bp, Homo sapiens
ttgctgacacatcagt

SEQ ID NO: 6581808 - DNA, 19 bp, Homo sapiens
ttgctgacatggctttgct

SEQ ID NO: 6581809 - DNA, 14 bp, Homo sapiens
ttgctgaccccagg

SEQ ID NO: 6581810 - DNA, 23 bp, Homo sapiens
ttgctgaccccaggtcagccctg

SEQ ID NO: 6581811 - DNA, 15 bp, Homo sapiens
ttgctgaccctcccc

SEQ ID NO: 6581812 - DNA, 21 bp, Homo sapiens
ttgctgaccggaatggtcaaa

SEQ ID NO: 6581813 - DNA, 19 bp, Homo sapiens
ttgctgactactactctgc

SEQ ID NO: 6581814 - DNA, 20 bp, Homo sapiens
ttgctgactactactctgcc

SEQ ID NO: 6581815 - DNA, 22 bp, Homo sapiens
ttgctgactactactctgccaa

SEQ ID NO: 6581816 - DNA, 21 bp, Homo sapiens
ttgctgactgtagctttggaa

SEQ ID NO: 6581817 - DNA, 15 bp, Homo sapiens
ttgctgacttagaat

SEQ ID NO: 6581818 - DNA, 14 bp, Homo sapiens
ttgctgagcaccct

SEQ ID NO: 6581819 - DNA, 15 bp, Homo sapiens
ttgctgagcctctgc

SEQ ID NO: 6581820 - DNA, 17 bp, Homo sapiens
ttgctgagctgtttata

SEQ ID NO: 6581821 - DNA, 24 bp, Homo sapiens
ttgctgagctgtttatagagaatg

SEQ ID NO: 6581822 - DNA, 18 bp, Homo sapiens
ttgctgaggagctcaggg

SEQ ID NO: 6581823 - DNA, 19 bp, Homo sapiens
ttgctgaggggcagggaga

SEQ ID NO: 6581824 - DNA, 12 bp, Homo sapiens
ttgctgagtgaa

SEQ ID NO: 6581825 - DNA, 17 bp, Homo sapiens
ttgctgagttgttctaa

SEQ ID NO: 6581826 - DNA, 19 bp, Homo sapiens
ttgctgagtttcccttcct

SEQ ID NO: 6581827 - DNA, 23 bp, Homo sapiens
ttgctgatccctgctctctgagt

SEQ ID NO: 6581828 - DNA, 14 bp, Homo sapiens
ttgctgatctttgt

SEQ ID NO: 6581829 - DNA, 15 bp, Homo sapiens
ttgctgatctttgtc

SEQ ID NO: 6581830 - DNA, 21 bp, Homo sapiens
ttgctgatggcccctccagca

SEQ ID NO: 6581831 - DNA, 22 bp, Homo sapiens
ttgctgatggcttgacatgtgc

SEQ ID NO: 6581832 - DNA, 17 bp, Homo sapiens
ttgctgatggtgcaatg

SEQ ID NO: 6581833 - DNA, 20 bp, Homo sapiens
ttgctgatggtgcaatgacc

SEQ ID NO: 6581834 - DNA, 14 bp, Homo sapiens
ttgctgattgtcaa

SEQ ID NO: 6581835 - DNA, 17 bp, Homo sapiens
ttgctgatttcccctct

SEQ ID NO: 6581836 - DNA, 14 bp, Homo sapiens
ttgctgatttctag

SEQ ID NO: 6581837 - DNA, 18 bp, Homo sapiens
ttgctgattttaatggat

SEQ ID NO: 6581838 - DNA, 18 bp, Homo sapiens
ttgctgattttattcttg

SEQ ID NO: 6581839 - DNA, 20 bp, Homo sapiens
ttgctgattttattcttgat

SEQ ID NO: 6581840 - DNA, 14 bp, Homo sapiens
ttgctgcaaagaga

SEQ ID NO: 6581841 - DNA, 19 bp, Homo sapiens
ttgctgcaaagagaaaccg

SEQ ID NO: 6581842 - DNA, 20 bp, Homo sapiens
ttgctgcaagcacagccctt

SEQ ID NO: 6581843 - DNA, 16 bp, Homo sapiens
ttgctgcacagcagga

SEQ ID NO: 6581844 - DNA, 18 bp, Homo sapiens
ttgctgcacagcaggacc

SEQ ID NO: 6581845 - DNA, 20 bp, Homo sapiens
ttgctgcacagcaggacctg

SEQ ID NO: 6581846 - DNA, 17 bp, Homo sapiens
ttgctgcactcttgcac

SEQ ID NO: 6581847 - DNA, 12 bp, Homo sapiens
ttgctgcagaga

SEQ ID NO: 6581848 - DNA, 14 bp, Homo sapiens
ttgctgcagattcc

SEQ ID NO: 6581849 - DNA, 13 bp, Homo sapiens
ttgctgcagcctg

SEQ ID NO: 6581850 - DNA, 12 bp, Homo sapiens
ttgctgcagctt

SEQ ID NO: 6581851 - DNA, 12 bp, Homo sapiens
ttgctgcaggcc

SEQ ID NO: 6581852 - DNA, 14 bp, Homo sapiens
ttgctgcaggccct

SEQ ID NO: 6581853 - DNA, 19 bp, Homo sapiens
ttgctgcaggccctccctc

SEQ ID NO: 6581854 - DNA, 19 bp, Homo sapiens
ttgctgcagtcatctactt

SEQ ID NO: 6581855 - DNA, 21 bp, Homo sapiens
ttgctgcataaatttgtaata

SEQ ID NO: 6581856 - DNA, 19 bp, Homo sapiens
ttgctgcatatttgacctt

SEQ ID NO: 6581857 - DNA, 23 bp, Homo sapiens
ttgctgcattgatccaggagata

SEQ ID NO: 6581858 - DNA, 15 bp, Homo sapiens
ttgctgcattttaag

SEQ ID NO: 6581859 - DNA, 18 bp, Homo sapiens
ttgctgcattttaagcat

SEQ ID NO: 6581860 - DNA, 14 bp, Homo sapiens
ttgctgccaaaacc

SEQ ID NO: 6581861 - DNA, 23 bp, Homo sapiens
ttgctgccaaaaccacatgggct

SEQ ID NO: 6581862 - DNA, 12 bp, Homo sapiens
ttgctgccaagt

SEQ ID NO: 6581863 - DNA, 23 bp, Homo sapiens
ttgctgccataattctaagttat

SEQ ID NO: 6581864 - DNA, 20 bp, Homo sapiens
ttgctgccccatcagtgctc

SEQ ID NO: 6581865 - DNA, 11 bp, Homo sapiens
ttgctgccctg

SEQ ID NO: 6581866 - DNA, 14 bp, Homo sapiens
ttgctgccctgggg

SEQ ID NO: 6581867 - DNA, 11 bp, Homo sapiens
ttgctgcctca

SEQ ID NO: 6581868 - DNA, 22 bp, Homo sapiens
ttgctgcctcggatccccttcc

SEQ ID NO: 6581869 - DNA, 17 bp, Homo sapiens
ttgctgccttcaccctg

SEQ ID NO: 6581870 - DNA, 12 bp, Homo sapiens
ttgctgccttct

SEQ ID NO: 6581871 - DNA, 14 bp, Homo sapiens
ttgctgccttctgt

SEQ ID NO: 6581872 - DNA, 20 bp, Homo sapiens
ttgctgcgcaccaatgccca

SEQ ID NO: 6581873 - DNA, 19 bp, Homo sapiens
aataaatctaggatgtgat

SEQ ID NO: 6581874 - DNA, 18 bp, Homo sapiens
aataaatctgagcctaaa

SEQ ID NO: 6581875 - DNA, 20 bp, Homo sapiens
aataaatcttagtgttcaaa

SEQ ID NO: 6581876 - DNA, 11 bp, Homo sapiens
aataaatcttt

SEQ ID NO: 6581877 - DNA, 15 bp, Homo sapiens
aataaatctttggaa

SEQ ID NO: 6581878 - DNA, 13 bp, Homo sapiens
aataaatgaatct

SEQ ID NO: 6581879 - DNA, 12 bp, Homo sapiens
aataaatgacca

SEQ ID NO: 6581880 - DNA, 15 bp, Homo sapiens
aataaatgaccagtt

SEQ ID NO: 6581881 - DNA, 13 bp, Homo sapiens
aataaatgagaaa

SEQ ID NO: 6581882 - DNA, 22 bp, Homo sapiens
aataaatgagctatgtattaac

SEQ ID NO: 6581883 - DNA, 16 bp, Homo sapiens
aataaatgattatatt

SEQ ID NO: 6581884 - DNA, 22 bp, Homo sapiens
aataaatgattatattcacaga

SEQ ID NO: 6581885 - DNA, 16 bp, Homo sapiens
aataaatgcatagagc

SEQ ID NO: 6581886 - DNA, 15 bp, Homo sapiens
aataaatgccctctt

SEQ ID NO: 6581887 - DNA, 16 bp, Homo sapiens
aataaatgctgctttg

SEQ ID NO: 6581888 - DNA, 22 bp, Homo sapiens
aataaatggactacagtagctc

SEQ ID NO: 6581889 - DNA, 15 bp, Homo sapiens
aataaatggccagtg

SEQ ID NO: 6581890 - DNA, 16 bp, Homo sapiens
aataaatgggaaatgt

SEQ ID NO: 6581891 - DNA, 22 bp, Homo sapiens
aataaatgggtgtatataattt

SEQ ID NO: 6581892 - DNA, 21 bp, Homo sapiens
aataaatggtatagcaaatgt

SEQ ID NO: 6581893 - DNA, 13 bp, Homo sapiens
aataaatgtatca

SEQ ID NO: 6581894 - DNA, 13 bp, Homo sapiens
aataaatgtatct

SEQ ID NO: 6581895 - DNA, 16 bp, Homo sapiens
aataaatgtatctgaa

SEQ ID NO: 6581896 - DNA, 17 bp, Homo sapiens
aataaatgtatctgaat

SEQ ID NO: 6581897 - DNA, 12 bp, Homo sapiens
aataaatgtctt

SEQ ID NO: 6581898 - DNA, 20 bp, Homo sapiens
aataaatgttacctaattat

SEQ ID NO: 6581899 - DNA, 13 bp, Homo sapiens
aataaatgttcaa

SEQ ID NO: 6581900 - DNA, 18 bp, Homo sapiens
aataaatgttctcgtttt

SEQ ID NO: 6581901 - DNA, 18 bp, Homo sapiens
aataaatgtttcccccac

SEQ ID NO: 6581902 - DNA, 21 bp, Homo sapiens
aataaatgtttcccccactcc

SEQ ID NO: 6581903 - DNA, 22 bp, Homo sapiens
aataaatgtttgttatttacac

SEQ ID NO: 6581904 - DNA, 19 bp, Homo sapiens
aataaatgttttacaactc

SEQ ID NO: 6581905 - DNA, 21 bp, Homo sapiens
aataaatgttttacaactcct

SEQ ID NO: 6581906 - DNA, 15 bp, Homo sapiens
aataaatgttttagt

SEQ ID NO: 6581907 - DNA, 18 bp, Homo sapiens
aataaatgttttatttct

SEQ ID NO: 6581908 - DNA, 15 bp, Homo sapiens
aataaatgttttgga

SEQ ID NO: 6581909 - DNA, 20 bp, Homo sapiens
aataaattaaacatgctgtt

SEQ ID NO: 6581910 - DNA, 16 bp, Homo sapiens
aataaattaatattgt

SEQ ID NO: 6581911 - DNA, 17 bp, Homo sapiens
aataaattaatattgta

SEQ ID NO: 6581912 - DNA, 21 bp, Homo sapiens
aataaattaatattgtattgc

SEQ ID NO: 6581913 - DNA, 15 bp, Homo sapiens
aataaattatattaa

SEQ ID NO: 6581914 - DNA, 17 bp, Homo sapiens
aataaattatttattat

SEQ ID NO: 6581915 - DNA, 21 bp, Homo sapiens
aataaattcacatcctcagaa

SEQ ID NO: 6581916 - DNA, 23 bp, Homo sapiens
aataaattcacattttctcaaag

SEQ ID NO: 6581917 - DNA, 21 bp, Homo sapiens
aataaattccaatacaagtta

SEQ ID NO: 6581918 - DNA, 17 bp, Homo sapiens
aataaattcctaaactc

SEQ ID NO: 6581919 - DNA, 21 bp, Homo sapiens
aataaattcctacaacttaat

SEQ ID NO: 6581920 - DNA, 20 bp, Homo sapiens
aataaattctacctccttgt

SEQ ID NO: 6581921 - DNA, 14 bp, Homo sapiens
aataaattctctcc

SEQ ID NO: 6581922 - DNA, 20 bp, Homo sapiens
aataaattgcatgctgcttt

SEQ ID NO: 6581923 - DNA, 22 bp, Homo sapiens
aataaattgcctcccttcctcc

SEQ ID NO: 6581924 - DNA, 13 bp, Homo sapiens
aataaattgctta

SEQ ID NO: 6581925 - DNA, 16 bp, Homo sapiens
aataaattggattatt

SEQ ID NO: 6581926 - DNA, 18 bp, Homo sapiens
aataaattggattatttt

SEQ ID NO: 6581927 - DNA, 20 bp, Homo sapiens
aataaattggtgataagtgg

SEQ ID NO: 6581928 - DNA, 23 bp, Homo sapiens
aataaattggtgataagtggaaa

SEQ ID NO: 6581929 - DNA, 18 bp, Homo sapiens
aataaattgtacagccgg

SEQ ID NO: 6581930 - DNA, 12 bp, Homo sapiens
aataaattgtat

SEQ ID NO: 6581931 - DNA, 17 bp, Homo sapiens
aataaattgtatattca

SEQ ID NO: 6581932 - DNA, 15 bp, Homo sapiens
aataaattgtgaaaa

SEQ ID NO: 6581933 - DNA, 18 bp, Homo sapiens
aataaattgtgaaaaaaa

SEQ ID NO: 6581934 - DNA, 16 bp, Homo sapiens
aataaatttaataaat

SEQ ID NO: 6581935 - DNA, 21 bp, Homo sapiens
aataaatttataacaattgat

SEQ ID NO: 6581936 - DNA, 15 bp, Homo sapiens
aataaatttatatga

SEQ ID NO: 6581937 - DNA, 20 bp, Homo sapiens
aataaatttattttcttgga

SEQ ID NO: 6581938 - DNA, 21 bp, Homo sapiens
aataaatttcccagttaaaga

SEQ ID NO: 6581939 - DNA, 12 bp, Homo sapiens
aataaatttctg

SEQ ID NO: 6581940 - DNA, 13 bp, Homo sapiens
aataaatttctgg

SEQ ID NO: 6581941 - DNA, 13 bp, Homo sapiens
aataaatttgact

SEQ ID NO: 6581942 - DNA, 20 bp, Homo sapiens
aataaatttgcttttatttt

SEQ ID NO: 6581943 - DNA, 21 bp, Homo sapiens
aataaatttggttctaataga

SEQ ID NO: 6581944 - DNA, 15 bp, Homo sapiens
aataaatttgtaact

SEQ ID NO: 6581945 - DNA, 16 bp, Homo sapiens
aataaattttgtgcaa

SEQ ID NO: 6581946 - DNA, 19 bp, Homo sapiens
aataaattttttttggtca

SEQ ID NO: 6581947 - DNA, 16 bp, Homo sapiens
aataacaaaaaagaga

SEQ ID NO: 6581948 - DNA, 18 bp, Homo sapiens
aataacaaaaaagagaaa

SEQ ID NO: 6581949 - DNA, 19 bp, Homo sapiens
aataacaaaaaagagaaac

SEQ ID NO: 6581950 - DNA, 14 bp, Homo sapiens
aataacaaaatgga

SEQ ID NO: 6581951 - DNA, 14 bp, Homo sapiens
aataacaaacgtgt

SEQ ID NO: 6581952 - DNA, 15 bp, Homo sapiens
aataacaaagccctt

SEQ ID NO: 6581953 - DNA, 18 bp, Homo sapiens
aataacaacaacttaatg

SEQ ID NO: 6581954 - DNA, 19 bp, Homo sapiens
aataacaacaatttaggaa

SEQ ID NO: 6581955 - DNA, 21 bp, Homo sapiens
aataacaacagtttttatgtt

SEQ ID NO: 6581956 - DNA, 19 bp, Homo sapiens
aataacaactaacttgttt

SEQ ID NO: 6581957 - DNA, 19 bp, Homo sapiens
aataacaagcatgcataaa

SEQ ID NO: 6581958 - DNA, 15 bp, Homo sapiens
aataacaataaaaga

SEQ ID NO: 6581959 - DNA, 13 bp, Homo sapiens
aataacaatgtgc

SEQ ID NO: 6581960 - DNA, 14 bp, Homo sapiens
aataacaatgttaa

SEQ ID NO: 6581961 - DNA, 20 bp, Homo sapiens
aataacacacatataaacat

SEQ ID NO: 6581962 - DNA, 16 bp, Homo sapiens
aataacacagagagac

SEQ ID NO: 6581963 - DNA, 23 bp, Homo sapiens
aataacacagagagacagacttg

SEQ ID NO: 6581964 - DNA, 18 bp, Homo sapiens
aataacacagatattgtt

SEQ ID NO: 6581965 - DNA, 15 bp, Homo sapiens
aataacactatattt

SEQ ID NO: 6581966 - DNA, 11 bp, Homo sapiens
aataacactgc

SEQ ID NO: 6581967 - DNA, 12 bp, Homo sapiens
aataacactgca

SEQ ID NO: 6581968 - DNA, 11 bp, Homo sapiens
aataacactgt

SEQ ID NO: 6581969 - DNA, 15 bp, Homo sapiens
aataacactgtattt

SEQ ID NO: 6581970 - DNA, 17 bp, Homo sapiens
aataacactgtatttta

SEQ ID NO: 6581971 - DNA, 22 bp, Homo sapiens
aataacactgtattttaatgta

SEQ ID NO: 6581972 - DNA, 23 bp, Homo sapiens
aataacactgtattttaatgtac

SEQ ID NO: 6581973 - DNA, 13 bp, Homo sapiens
aataacagaaata

SEQ ID NO: 6581974 - DNA, 18 bp, Homo sapiens
aataacagaaatacatca

SEQ ID NO: 6581975 - DNA, 14 bp, Homo sapiens
aataacagatttct

SEQ ID NO: 6581976 - DNA, 15 bp, Homo sapiens
aataacagatttctc

SEQ ID NO: 6581977 - DNA, 14 bp, Homo sapiens
aataacagctcctt

SEQ ID NO: 6581978 - DNA, 16 bp, Homo sapiens
aataacataacaaata

SEQ ID NO: 6581979 - DNA, 14 bp, Homo sapiens
aataacatattctt

SEQ ID NO: 6581980 - DNA, 14 bp, Homo sapiens
aataacatctgaaa

SEQ ID NO: 6581981 - DNA, 12 bp, Homo sapiens
aataacatgttt

SEQ ID NO: 6581982 - DNA, 21 bp, Homo sapiens
aataacattgcactttataaa

SEQ ID NO: 6581983 - DNA, 13 bp, Homo sapiens
aataacatttaaa

SEQ ID NO: 6581984 - DNA, 21 bp, Homo sapiens
aataacatttaatttagatat

SEQ ID NO: 6581985 - DNA, 18 bp, Homo sapiens
aataacattttatacaat

SEQ ID NO: 6581986 - DNA, 21 bp, Homo sapiens
aataaccacttaaaaaatgtc

SEQ ID NO: 6581987 - DNA, 18 bp, Homo sapiens
aataacccataattgaag

SEQ ID NO: 6581988 - DNA, 15 bp, Homo sapiens
aataaccctgccagt

SEQ ID NO: 6581989 - DNA, 20 bp, Homo sapiens
aataaccgcttggtttgcaa

SEQ ID NO: 6581990 - DNA, 17 bp, Homo sapiens
aataaccggatatatac

SEQ ID NO: 6581991 - DNA, 11 bp, Homo sapiens
aataacctgcc

SEQ ID NO: 6581992 - DNA, 14 bp, Homo sapiens
aataacctttctgg

SEQ ID NO: 6581993 - DNA, 15 bp, Homo sapiens
aataactaatacaat

SEQ ID NO: 6581994 - DNA, 19 bp, Homo sapiens
aataactactgcaaaaagt

SEQ ID NO: 6581995 - DNA, 13 bp, Homo sapiens
aataactactgtg

SEQ ID NO: 6581996 - DNA, 14 bp, Homo sapiens
aataactactgtgt

SEQ ID NO: 6581997 - DNA, 15 bp, Homo sapiens
aataactactgtgtt

SEQ ID NO: 6581998 - DNA, 16 bp, Homo sapiens
aataactactgtgttc

SEQ ID NO: 6581999 - DNA, 12 bp, Homo sapiens
aataactagtga

SEQ ID NO: 6582000 - DNA, 19 bp, Homo sapiens
aataactagtgttgcttgg

SEQ ID NO: 6582001 - DNA, 22 bp, Homo sapiens
aataactatcaactagcagaaa

SEQ ID NO: 6582002 - DNA, 14 bp, Homo sapiens
aataactattttgt

SEQ ID NO: 6582003 - DNA, 14 bp, Homo sapiens
aataactcctccca

SEQ ID NO: 6582004 - DNA, 16 bp, Homo sapiens
aataactcctcccagg

SEQ ID NO: 6582005 - DNA, 21 bp, Homo sapiens
aataactccttcttgtagtag

SEQ ID NO: 6582006 - DNA, 14 bp, Homo sapiens
aataactctgattt

SEQ ID NO: 6582007 - DNA, 24 bp, Homo sapiens
aataactgaaccaaattgcactga

SEQ ID NO: 6582008 - DNA, 15 bp, Homo sapiens
aataactgaactgtt

SEQ ID NO: 6582009 - DNA, 15 bp, Homo sapiens
aataactgaataaaa

SEQ ID NO: 6582010 - DNA, 13 bp, Homo sapiens
aataactgaattt

SEQ ID NO: 6582011 - DNA, 15 bp, Homo sapiens
aataactgaatttgg

SEQ ID NO: 6582012 - DNA, 22 bp, Homo sapiens
aataactgagatattattttaa

SEQ ID NO: 6582013 - DNA, 21 bp, Homo sapiens
aataactgattagtaagtctt

SEQ ID NO: 6582014 - DNA, 23 bp, Homo sapiens
aataactgccttgggcaaggaca

SEQ ID NO: 6582015 - DNA, 19 bp, Homo sapiens
aataactgcttactcaaca

SEQ ID NO: 6582016 - DNA, 20 bp, Homo sapiens
aataactggaaaacagaaca

SEQ ID NO: 6582017 - DNA, 21 bp, Homo sapiens
aataactggaaaacagaacac

SEQ ID NO: 6582018 - DNA, 20 bp, Homo sapiens
aataactggaacaaattatt

SEQ ID NO: 6582019 - DNA, 16 bp, Homo sapiens
aataactgtgaagttt

SEQ ID NO: 6582020 - DNA, 15 bp, Homo sapiens
aataactgtgtactg

SEQ ID NO: 6582021 - DNA, 16 bp, Homo sapiens
aataactgtgtactgt

SEQ ID NO: 6582022 - DNA, 13 bp, Homo sapiens
aataactgtgtgg

SEQ ID NO: 6582023 - DNA, 23 bp, Homo sapiens
aataacttagactctagtattta

SEQ ID NO: 6582024 - DNA, 17 bp, Homo sapiens
aataacttcagagaagt

SEQ ID NO: 6582025 - DNA, 21 bp, Homo sapiens
aataacttcagtcctgctcca

SEQ ID NO: 6582026 - DNA, 24 bp, Homo sapiens
aataacttcagtcctgctccagaa

SEQ ID NO: 6582027 - DNA, 14 bp, Homo sapiens
aataacttctaggt

SEQ ID NO: 6582028 - DNA, 20 bp, Homo sapiens
aataacttctatattttaat

SEQ ID NO: 6582029 - DNA, 23 bp, Homo sapiens
aataacttctatattttaataga

SEQ ID NO: 6582030 - DNA, 19 bp, Homo sapiens
aataacttctatgttggtt

SEQ ID NO: 6582031 - DNA, 15 bp, Homo sapiens
aataacttctgacct

SEQ ID NO: 6582032 - DNA, 13 bp, Homo sapiens
aataacttgcatc

SEQ ID NO: 6582033 - DNA, 15 bp, Homo sapiens
aataacttgtgttac

SEQ ID NO: 6582034 - DNA, 14 bp, Homo sapiens
aataactttgctgg

SEQ ID NO: 6582035 - DNA, 17 bp, Homo sapiens
aataacttttatattaa

SEQ ID NO: 6582036 - DNA, 17 bp, Homo sapiens
aataagaaacagtttaa

SEQ ID NO: 6582037 - DNA, 13 bp, Homo sapiens
aataagaaacttt

SEQ ID NO: 6582038 - DNA, 13 bp, Homo sapiens
aataagaaagaat

SEQ ID NO: 6582039 - DNA, 17 bp, Homo sapiens
aataagaaagaattgca

SEQ ID NO: 6582040 - DNA, 20 bp, Homo sapiens
aataagaaagccctaaaata

SEQ ID NO: 6582041 - DNA, 11 bp, Homo sapiens
aataagaaagt

SEQ ID NO: 6582042 - DNA, 13 bp, Homo sapiens
aataagaaatgaa

SEQ ID NO: 6582043 - DNA, 15 bp, Homo sapiens
aataagaacaagttt

SEQ ID NO: 6582044 - DNA, 20 bp, Homo sapiens
aataagaagggggagtgaaa

SEQ ID NO: 6582045 - DNA, 22 bp, Homo sapiens
aataagaagggggagtgaaaca

SEQ ID NO: 6582046 - DNA, 12 bp, Homo sapiens
aataagaaggta

SEQ ID NO: 6582047 - DNA, 14 bp, Homo sapiens
aataagaataaagt

SEQ ID NO: 6582048 - DNA, 15 bp, Homo sapiens
aataagaatggaaaa

SEQ ID NO: 6582049 - DNA, 14 bp, Homo sapiens
aataagaatttagg

SEQ ID NO: 6582050 - DNA, 15 bp, Homo sapiens
aataagacaaaaata

SEQ ID NO: 6582051 - DNA, 23 bp, Homo sapiens
aataagacatgcttactttttaa

SEQ ID NO: 6582052 - DNA, 14 bp, Homo sapiens
aataagacttctgg

SEQ ID NO: 6582053 - DNA, 21 bp, Homo sapiens
aataagagatagcagaggaaa

SEQ ID NO: 6582054 - DNA, 17 bp, Homo sapiens
aataagagtctccttct

SEQ ID NO: 6582055 - DNA, 19 bp, Homo sapiens
aataagagtctccttctct

SEQ ID NO: 6582056 - DNA, 13 bp, Homo sapiens
aataagatattac

SEQ ID NO: 6582057 - DNA, 15 bp, Homo sapiens
aataagattaataag

SEQ ID NO: 6582058 - DNA, 13 bp, Homo sapiens
aataagattctaa

SEQ ID NO: 6582059 - DNA, 15 bp, Homo sapiens
aataagcaaaatcct

SEQ ID NO: 6582060 - DNA, 18 bp, Homo sapiens
aataagcaaataaacagt

SEQ ID NO: 6582061 - DNA, 18 bp, Homo sapiens
aataagcactcctttaaa

SEQ ID NO: 6582062 - DNA, 19 bp, Homo sapiens
aataagcactgtaaacttc

SEQ ID NO: 6582063 - DNA, 18 bp, Homo sapiens
aataagcacttgcctgga

SEQ ID NO: 6582064 - DNA, 20 bp, Homo sapiens
aataagcacttgcctggaat

SEQ ID NO: 6582065 - DNA, 14 bp, Homo sapiens
aataagcagaacat

SEQ ID NO: 6582066 - DNA, 20 bp, Homo sapiens
aataagcagaacatactgtt

SEQ ID NO: 6582067 - DNA, 14 bp, Homo sapiens
aataagcaggatgt

SEQ ID NO: 6582068 - DNA, 17 bp, Homo sapiens
aataagcatcaaactct

SEQ ID NO: 6582069 - DNA, 20 bp, Homo sapiens
aataagccaagggctaggct

SEQ ID NO: 6582070 - DNA, 15 bp, Homo sapiens
aataagcgtttaatg

SEQ ID NO: 6582071 - DNA, 16 bp, Homo sapiens
aataagctagttgaat

SEQ ID NO: 6582072 - DNA, 18 bp, Homo sapiens
aataagctatttgatgta

SEQ ID NO: 6582073 - DNA, 22 bp, Homo sapiens
aataagctctagttcttaacaa

SEQ ID NO: 6582074 - DNA, 17 bp, Homo sapiens
aataaggaaaaaataat

SEQ ID NO: 6582075 - DNA, 14 bp, Homo sapiens
aataaggaaaagct

SEQ ID NO: 6582076 - DNA, 15 bp, Homo sapiens
aataaggaaaagctt

SEQ ID NO: 6582077 - DNA, 16 bp, Homo sapiens
aataaggaaaagttta

SEQ ID NO: 6582078 - DNA, 22 bp, Homo sapiens
aataaggaaaagtttaatatta

SEQ ID NO: 6582079 - DNA, 18 bp, Homo sapiens
aataaggacacaaacttt

SEQ ID NO: 6582080 - DNA, 15 bp, Homo sapiens
aataaggaggaggag

SEQ ID NO: 6582081 - DNA, 20 bp, Homo sapiens
aataaggaggaggagggaga

SEQ ID NO: 6582082 - DNA, 14 bp, Homo sapiens
aataaggagggaca

SEQ ID NO: 6582083 - DNA, 23 bp, Homo sapiens
aataaggattctgaagttttatt

SEQ ID NO: 6582084 - DNA, 17 bp, Homo sapiens
aataaggccttaatatg

SEQ ID NO: 6582085 - DNA, 21 bp, Homo sapiens
aataagggaaaaatcaagtat

SEQ ID NO: 6582086 - DNA, 18 bp, Homo sapiens
aataaggtcaagggaaaa

SEQ ID NO: 6582087 - DNA, 19 bp, Homo sapiens
aataaggtgtggtctgttt

SEQ ID NO: 6582088 - DNA, 14 bp, Homo sapiens
aataaggttgaaca

SEQ ID NO: 6582089 - DNA, 14 bp, Homo sapiens
aataagtaaatgta

SEQ ID NO: 6582090 - DNA, 21 bp, Homo sapiens
aataagtaacatataaattaa

SEQ ID NO: 6582091 - DNA, 18 bp, Homo sapiens
aataagtatatcttaaga

SEQ ID NO: 6582092 - DNA, 18 bp, Homo sapiens
aataagtatttctgattt

SEQ ID NO: 6582093 - DNA, 14 bp, Homo sapiens
aataagtcaacagt

SEQ ID NO: 6582094 - DNA, 15 bp, Homo sapiens
aataagtcattgaaa

SEQ ID NO: 6582095 - DNA, 17 bp, Homo sapiens
aataagtcctaaagtga

SEQ ID NO: 6582096 - DNA, 22 bp, Homo sapiens
aataagtcctaaagtgaagaag

SEQ ID NO: 6582097 - DNA, 12 bp, Homo sapiens
aataagtctgat

SEQ ID NO: 6582098 - DNA, 20 bp, Homo sapiens
aataagtgaagaatacatca

SEQ ID NO: 6582099 - DNA, 17 bp, Homo sapiens
aataagtgccctctccc

SEQ ID NO: 6582100 - DNA, 14 bp, Homo sapiens
aataagtgctgttt

SEQ ID NO: 6582101 - DNA, 23 bp, Homo sapiens
aataagtggattttgtattttaa

SEQ ID NO: 6582102 - DNA, 18 bp, Homo sapiens
aataagtgtacatatgta

SEQ ID NO: 6582103 - DNA, 22 bp, Homo sapiens
aataagtgtacatatgtaaaat

SEQ ID NO: 6582104 - DNA, 16 bp, Homo sapiens
aataagtgtctttctg

SEQ ID NO: 6582105 - DNA, 23 bp, Homo sapiens
aataagtgtgtggtagaaacaaa

SEQ ID NO: 6582106 - DNA, 16 bp, Homo sapiens
aataagttacttgaaa

SEQ ID NO: 6582107 - DNA, 21 bp, Homo sapiens
aataagttcaaattcttctga

SEQ ID NO: 6582108 - DNA, 16 bp, Homo sapiens
aataagttcattaaac

SEQ ID NO: 6582109 - DNA, 17 bp, Homo sapiens
aataagttcattaaaca

SEQ ID NO: 6582110 - DNA, 20 bp, Homo sapiens
aataagttcattaaacagaa

SEQ ID NO: 6582111 - DNA, 23 bp, Homo sapiens
aataagttcctctgaagactgct

SEQ ID NO: 6582112 - DNA, 18 bp, Homo sapiens
aataagttgatgttttct

SEQ ID NO: 6582113 - DNA, 13 bp, Homo sapiens
aataagtttcata

SEQ ID NO: 6582114 - DNA, 22 bp, Homo sapiens
aataagtttcttttaatccaat

SEQ ID NO: 6582115 - DNA, 13 bp, Homo sapiens
aataagtttgaaa

SEQ ID NO: 6582116 - DNA, 15 bp, Homo sapiens
aataagtttgaaata

SEQ ID NO: 6582117 - DNA, 13 bp, Homo sapiens
aataagtttgtgt

SEQ ID NO: 6582118 - DNA, 18 bp, Homo sapiens
aataagtttgtgttagaa

SEQ ID NO: 6582119 - DNA, 22 bp, Homo sapiens
aataagtttgtgttagaaaagt

SEQ ID NO: 6582120 - DNA, 21 bp, Homo sapiens
aataagttttgatataatctt

SEQ ID NO: 6582121 - DNA, 13 bp, Homo sapiens
aataagtttttct

SEQ ID NO: 6582122 - DNA, 20 bp, Homo sapiens
aataagtttttgtttcacag

SEQ ID NO: 6582123 - DNA, 17 bp, Homo sapiens
aataataaaaaatttca

SEQ ID NO: 6582124 - DNA, 15 bp, Homo sapiens
aataataaaaagcaa

SEQ ID NO: 6582125 - DNA, 18 bp, Homo sapiens
aataataaaaccaaagaa

SEQ ID NO: 6582126 - DNA, 12 bp, Homo sapiens
aataataaaaga

SEQ ID NO: 6582127 - DNA, 13 bp, Homo sapiens
aataataaaagaa

SEQ ID NO: 6582128 - DNA, 16 bp, Homo sapiens
aataataaaagaatca

SEQ ID NO: 6582129 - DNA, 18 bp, Homo sapiens
aataataaaatacttttt

SEQ ID NO: 6582130 - DNA, 13 bp, Homo sapiens
aataataaaatca

SEQ ID NO: 6582131 - DNA, 14 bp, Homo sapiens
aataataaaatgca

SEQ ID NO: 6582132 - DNA, 17 bp, Homo sapiens
aataataaaatgcaaat

SEQ ID NO: 6582133 - DNA, 19 bp, Homo sapiens
aataataaaatgcaaatga

SEQ ID NO: 6582134 - DNA, 20 bp, Homo sapiens
aataataaaggttctatgat

SEQ ID NO: 6582135 - DNA, 16 bp, Homo sapiens
aataataaagtaattg

SEQ ID NO: 6582136 - DNA, 21 bp, Homo sapiens
aataataaagtagcaaaacaa

SEQ ID NO: 6582137 - DNA, 14 bp, Homo sapiens
aataataaagtgtt

SEQ ID NO: 6582138 - DNA, 12 bp, Homo sapiens
aataataaataa

SEQ ID NO: 6582139 - DNA, 13 bp, Homo sapiens
aataataaataca

SEQ ID NO: 6582140 - DNA, 13 bp, Homo sapiens
aataataaatagt

SEQ ID NO: 6582141 - DNA, 14 bp, Homo sapiens
aataataaatattt

SEQ ID NO: 6582142 - DNA, 11 bp, Homo sapiens
aataataaatc

SEQ ID NO: 6582143 - DNA, 14 bp, Homo sapiens
aataataaattaac

SEQ ID NO: 6582144 - DNA, 15 bp, Homo sapiens
aataataaattaaca

SEQ ID NO: 6582145 - DNA, 16 bp, Homo sapiens
aataataaattaacat

SEQ ID NO: 6582146 - DNA, 19 bp, Homo sapiens
aataataaattaacattat

SEQ ID NO: 6582147 - DNA, 23 bp, Homo sapiens
aataataagtccatctgtcactt

SEQ ID NO: 6582148 - DNA, 19 bp, Homo sapiens
aataataagtgatgtgctg

SEQ ID NO: 6582149 - DNA, 15 bp, Homo sapiens
aataataataaagtg

SEQ ID NO: 6582150 - DNA, 16 bp, Homo sapiens
aataataatagtacta

SEQ ID NO: 6582151 - DNA, 15 bp, Homo sapiens
aataataattaaaga

SEQ ID NO: 6582152 - DNA, 13 bp, Homo sapiens
aataatacatact

SEQ ID NO: 6582153 - DNA, 18 bp, Homo sapiens
aataatacctaagccttc

SEQ ID NO: 6582154 - DNA, 12 bp, Homo sapiens
aataatactaat

SEQ ID NO: 6582155 - DNA, 16 bp, Homo sapiens
aataatactttaggaa

SEQ ID NO: 6582156 - DNA, 21 bp, Homo sapiens
aataatactttaggaaatacg

SEQ ID NO: 6582157 - DNA, 16 bp, Homo sapiens
aataatagcaatgtaa

SEQ ID NO: 6582158 - DNA, 17 bp, Homo sapiens
aataatagcacatgatt

SEQ ID NO: 6582159 - DNA, 14 bp, Homo sapiens
aataatagggaaaa

SEQ ID NO: 6582160 - DNA, 18 bp, Homo sapiens
aataatagggaaaatacc

SEQ ID NO: 6582161 - DNA, 14 bp, Homo sapiens
aataatagttatta

SEQ ID NO: 6582162 - DNA, 18 bp, Homo sapiens
aataatagttattattta

SEQ ID NO: 6582163 - DNA, 11 bp, Homo sapiens
aataatataat

SEQ ID NO: 6582164 - DNA, 13 bp, Homo sapiens
aataatatatgtt

SEQ ID NO: 6582165 - DNA, 17 bp, Homo sapiens
aataatatattttaaat

SEQ ID NO: 6582166 - DNA, 15 bp, Homo sapiens
aataatatattttct

SEQ ID NO: 6582167 - DNA, 22 bp, Homo sapiens
aataatatccaggtcaacagaa

SEQ ID NO: 6582168 - DNA, 17 bp, Homo sapiens
aataatatgcattgtca

SEQ ID NO: 6582169 - DNA, 20 bp, Homo sapiens
aataatatgtaaatttttca

SEQ ID NO: 6582170 - DNA, 15 bp, Homo sapiens
aataatatgtacaaa

SEQ ID NO: 6582171 - DNA, 17 bp, Homo sapiens
aataatatgtactaaga

SEQ ID NO: 6582172 - DNA, 14 bp, Homo sapiens
aataatattgattt

SEQ ID NO: 6582173 - DNA, 12 bp, Homo sapiens
aataatattgta

SEQ ID NO: 6582174 - DNA, 12 bp, Homo sapiens
aataatattgtt

SEQ ID NO: 6582175 - DNA, 20 bp, Homo sapiens
aataatattgttgtataatt

SEQ ID NO: 6582176 - DNA, 13 bp, Homo sapiens
aataatattgttt

SEQ ID NO: 6582177 - DNA, 14 bp, Homo sapiens
aataatatttcaag

SEQ ID NO: 6582178 - DNA, 15 bp, Homo sapiens
aataatatttcaagt

SEQ ID NO: 6582179 - DNA, 16 bp, Homo sapiens
aataatatttcaagtg

SEQ ID NO: 6582180 - DNA, 22 bp, Homo sapiens
aataatatttcaagtgcctaga

SEQ ID NO: 6582181 - DNA, 14 bp, Homo sapiens
aataatcaaaccaa

SEQ ID NO: 6582182 - DNA, 17 bp, Homo sapiens
aataatcaagattttag

SEQ ID NO: 6582183 - DNA, 17 bp, Homo sapiens
aataatcacattgactt

SEQ ID NO: 6582184 - DNA, 22 bp, Homo sapiens
aataatcagaaaagtaattttg

SEQ ID NO: 6582185 - DNA, 19 bp, Homo sapiens
aataatccattccaaaata

SEQ ID NO: 6582186 - DNA, 20 bp, Homo sapiens
aataatccattccaaaatac

SEQ ID NO: 6582187 - DNA, 18 bp, Homo sapiens
aataatcccattctttat

SEQ ID NO: 6582188 - DNA, 13 bp, Homo sapiens
aataatctatatt

SEQ ID NO: 6582189 - DNA, 22 bp, Homo sapiens
aataatctcatccccccacccg

SEQ ID NO: 6582190 - DNA, 17 bp, Homo sapiens
aataatctgaaatgaca

SEQ ID NO: 6582191 - DNA, 20 bp, Homo sapiens
aataatctgtgagtgaaagt

SEQ ID NO: 6582192 - DNA, 19 bp, Homo sapiens
aataatcttattagggaga

SEQ ID NO: 6582193 - DNA, 23 bp, Homo sapiens
aataatcttattagggagaaaat

SEQ ID NO: 6582194 - DNA, 15 bp, Homo sapiens
aataatcttgtttct

SEQ ID NO: 6582195 - DNA, 14 bp, Homo sapiens
aataatctttgggt

SEQ ID NO: 6582196 - DNA, 16 bp, Homo sapiens
aataatgaacagcaga

SEQ ID NO: 6582197 - DNA, 11 bp, Homo sapiens
aataatgaaga

SEQ ID NO: 6582198 - DNA, 19 bp, Homo sapiens
aataatgaagatctttgtt

SEQ ID NO: 6582199 - DNA, 12 bp, Homo sapiens
aataatgaagta

SEQ ID NO: 6582200 - DNA, 19 bp, Homo sapiens
aataatgacagatggtgaa

SEQ ID NO: 6582201 - DNA, 21 bp, Homo sapiens
aataatgacgtattgtgaaat

SEQ ID NO: 6582202 - DNA, 12 bp, Homo sapiens
aataatgattta

SEQ ID NO: 6582203 - DNA, 14 bp, Homo sapiens
aataatgatttaag

SEQ ID NO: 6582204 - DNA, 19 bp, Homo sapiens
aataatgcaacgcaggagg

SEQ ID NO: 6582205 - DNA, 23 bp, Homo sapiens
aataatgcagtatggtacatttt

SEQ ID NO: 6582206 - DNA, 18 bp, Homo sapiens
aataatgcccttaatgtg

SEQ ID NO: 6582207 - DNA, 20 bp, Homo sapiens
aataatgcctaccttgtgag

SEQ ID NO: 6582208 - DNA, 23 bp, Homo sapiens
aataatgcctccaattttttctt

SEQ ID NO: 6582209 - DNA, 16 bp, Homo sapiens
aataatgccttgtatg

SEQ ID NO: 6582210 - DNA, 16 bp, Homo sapiens
aataatgcctttgtaa

SEQ ID NO: 6582211 - DNA, 21 bp, Homo sapiens
aataatgctacaattttaaga

SEQ ID NO: 6582212 - DNA, 16 bp, Homo sapiens
aataatgctttaaaat

SEQ ID NO: 6582213 - DNA, 13 bp, Homo sapiens
aataatgctttga

SEQ ID NO: 6582214 - DNA, 12 bp, Homo sapiens
aataatgctttt

SEQ ID NO: 6582215 - DNA, 16 bp, Homo sapiens
aataatgcttttctaa

SEQ ID NO: 6582216 - DNA, 13 bp, Homo sapiens
aataatggaaaaa

SEQ ID NO: 6582217 - DNA, 15 bp, Homo sapiens
aataatggaaaaaaa

SEQ ID NO: 6582218 - DNA, 22 bp, Homo sapiens
aataatggaaaaatagtaaaca

SEQ ID NO: 6582219 - DNA, 12 bp, Homo sapiens
aataatggaaac

SEQ ID NO: 6582220 - DNA, 13 bp, Homo sapiens
aataatggaaaca

SEQ ID NO: 6582221 - DNA, 16 bp, Homo sapiens
aataatggaaacatta

SEQ ID NO: 6582222 - DNA, 17 bp, Homo sapiens
aataatggagaatcact

SEQ ID NO: 6582223 - DNA, 21 bp, Homo sapiens
aataatggtcccatccaggca

SEQ ID NO: 6582224 - DNA, 15 bp, Homo sapiens
aataatgtaacatga

SEQ ID NO: 6582225 - DNA, 18 bp, Homo sapiens
aataatgtaacatgattt

SEQ ID NO: 6582226 - DNA, 12 bp, Homo sapiens
aataatgtaata

SEQ ID NO: 6582227 - DNA, 16 bp, Homo sapiens
aataatgtaattgtaa

SEQ ID NO: 6582228 - DNA, 16 bp, Homo sapiens
aataatgtactcacat

SEQ ID NO: 6582229 - DNA, 17 bp, Homo sapiens
aataatgtactcacata

SEQ ID NO: 6582230 - DNA, 19 bp, Homo sapiens
aataatgtactgaattctt

SEQ ID NO: 6582231 - DNA, 19 bp, Homo sapiens
aataatgtagttttgttta

SEQ ID NO: 6582232 - DNA, 19 bp, Homo sapiens
aataatgtattgtaatctt

SEQ ID NO: 6582233 - DNA, 13 bp, Homo sapiens
aataatgtattta

SEQ ID NO: 6582234 - DNA, 15 bp, Homo sapiens
aataatgtatttact

SEQ ID NO: 6582235 - DNA, 15 bp, Homo sapiens
ttgctgcgcttgcat

SEQ ID NO: 6582236 - DNA, 14 bp, Homo sapiens
ttgctgctagaact

SEQ ID NO: 6582237 - DNA, 15 bp, Homo sapiens
ttgctgctagaactt

SEQ ID NO: 6582238 - DNA, 18 bp, Homo sapiens
ttgctgctagaacttttt

SEQ ID NO: 6582239 - DNA, 16 bp, Homo sapiens
ttgctgctatgaaaat

SEQ ID NO: 6582240 - DNA, 21 bp, Homo sapiens
ttgctgctatgaaaatgagca

SEQ ID NO: 6582241 - DNA, 23 bp, Homo sapiens
ttgctgctattttactgtcttaa

SEQ ID NO: 6582242 - DNA, 15 bp, Homo sapiens
ttgctgctccatggt

SEQ ID NO: 6582243 - DNA, 14 bp, Homo sapiens
ttgctgctctctga

SEQ ID NO: 6582244 - DNA, 12 bp, Homo sapiens
ttgctgctcttc

SEQ ID NO: 6582245 - DNA, 17 bp, Homo sapiens
ttgctgctgataatgta

SEQ ID NO: 6582246 - DNA, 17 bp, Homo sapiens
ttgctgctgatttaaac

SEQ ID NO: 6582247 - DNA, 11 bp, Homo sapiens
ttgctgctgcc

SEQ ID NO: 6582248 - DNA, 11 bp, Homo sapiens
ttgctgctgct

SEQ ID NO: 6582249 - DNA, 17 bp, Homo sapiens
ttgctgctgtccagtgc

SEQ ID NO: 6582250 - DNA, 22 bp, Homo sapiens
ttgctgctgtccagtgcctaca

SEQ ID NO: 6582251 - DNA, 14 bp, Homo sapiens
ttgctgctgtggaa

SEQ ID NO: 6582252 - DNA, 13 bp, Homo sapiens
ttgctgcttctcc

SEQ ID NO: 6582253 - DNA, 21 bp, Homo sapiens
ttgctgcttctcccaggcaag

SEQ ID NO: 6582254 - DNA, 14 bp, Homo sapiens
ttgctgcttgaggc

SEQ ID NO: 6582255 - DNA, 16 bp, Homo sapiens
ttgctgcttgtacact

SEQ ID NO: 6582256 - DNA, 23 bp, Homo sapiens
ttgctgcttttccttggggcagg

SEQ ID NO: 6582257 - DNA, 14 bp, Homo sapiens
ttgctggaaaactg

SEQ ID NO: 6582258 - DNA, 17 bp, Homo sapiens
ttgctggaaaactgcca

SEQ ID NO: 6582259 - DNA, 17 bp, Homo sapiens
ttgctggaaaatcatat

SEQ ID NO: 6582260 - DNA, 17 bp, Homo sapiens
ttgctggaaaatctgta

SEQ ID NO: 6582261 - DNA, 21 bp, Homo sapiens
ttgctggaaaccaagtcaggc

SEQ ID NO: 6582262 - DNA, 17 bp, Homo sapiens
ttgctggaacacagggg

SEQ ID NO: 6582263 - DNA, 17 bp, Homo sapiens
ttgctggaagacagaga

SEQ ID NO: 6582264 - DNA, 19 bp, Homo sapiens
ttgctggaagacagagaaa

SEQ ID NO: 6582265 - DNA, 21 bp, Homo sapiens
ttgctggaagacgcaagggcc

SEQ ID NO: 6582266 - DNA, 15 bp, Homo sapiens
ttgctggactgagga

SEQ ID NO: 6582267 - DNA, 16 bp, Homo sapiens
ttgctggactgaggac

SEQ ID NO: 6582268 - DNA, 21 bp, Homo sapiens
ttgctggagaatgcttggact

SEQ ID NO: 6582269 - DNA, 19 bp, Homo sapiens
ttgctggagggaagatctt

SEQ ID NO: 6582270 - DNA, 16 bp, Homo sapiens
ttgctggagtcctgtt

SEQ ID NO: 6582271 - DNA, 20 bp, Homo sapiens
ttgctggagtcctgttctca

SEQ ID NO: 6582272 - DNA, 22 bp, Homo sapiens
ttgctggagtcctgttctcaga

SEQ ID NO: 6582273 - DNA, 18 bp, Homo sapiens
ttgctggagtgctggctc

SEQ ID NO: 6582274 - DNA, 16 bp, Homo sapiens
ttgctggatgcatttt

SEQ ID NO: 6582275 - DNA, 21 bp, Homo sapiens
ttgctggcaatgagtgtgcca

SEQ ID NO: 6582276 - DNA, 16 bp, Homo sapiens
ttgctggctctgagaa

SEQ ID NO: 6582277 - DNA, 11 bp, Homo sapiens
ttgctggcttg

SEQ ID NO: 6582278 - DNA, 15 bp, Homo sapiens
ttgctgggagctgaa

SEQ ID NO: 6582279 - DNA, 21 bp, Homo sapiens
ttgctgggagctgaaaaatca

SEQ ID NO: 6582280 - DNA, 11 bp, Homo sapiens
ttgctgggagg

SEQ ID NO: 6582281 - DNA, 22 bp, Homo sapiens
ttgctgggcatactttctctct

SEQ ID NO: 6582282 - DNA, 16 bp, Homo sapiens
ttgctgggcctcattc

SEQ ID NO: 6582283 - DNA, 15 bp, Homo sapiens
ttgctgggctttggg

SEQ ID NO: 6582284 - DNA, 15 bp, Homo sapiens
ttgctggggccaggc

SEQ ID NO: 6582285 - DNA, 18 bp, Homo sapiens
ttgctggggccaggcccc

SEQ ID NO: 6582286 - DNA, 20 bp, Homo sapiens
ttgctggggccgaaagaaca

SEQ ID NO: 6582287 - DNA, 15 bp, Homo sapiens
ttgctggtcactgcc

SEQ ID NO: 6582288 - DNA, 14 bp, Homo sapiens
ttgctggtcatcct

SEQ ID NO: 6582289 - DNA, 18 bp, Homo sapiens
ttgctggtcatccttggt

SEQ ID NO: 6582290 - DNA, 17 bp, Homo sapiens
ttgctggtcctgcacat

SEQ ID NO: 6582291 - DNA, 21 bp, Homo sapiens
ttgctggtcctgcacatgagt

SEQ ID NO: 6582292 - DNA, 17 bp, Homo sapiens
ttgctggtcttgtaaga

SEQ ID NO: 6582293 - DNA, 18 bp, Homo sapiens
ttgctggtcttgtaagag

SEQ ID NO: 6582294 - DNA, 23 bp, Homo sapiens
ttgctggtcttgtaagagctata

SEQ ID NO: 6582295 - DNA, 18 bp, Homo sapiens
ttgctggtgtactctagg

SEQ ID NO: 6582296 - DNA, 16 bp, Homo sapiens
ttgctggttgctgtgt

SEQ ID NO: 6582297 - DNA, 14 bp, Homo sapiens
ttgctggttggatt

SEQ ID NO: 6582298 - DNA, 20 bp, Homo sapiens
ttgctggttggattaatctt

SEQ ID NO: 6582299 - DNA, 21 bp, Homo sapiens
ttgctggttggattaatcttt

SEQ ID NO: 6582300 - DNA, 22 bp, Homo sapiens
ttgctggtttgaaagattatga

SEQ ID NO: 6582301 - DNA, 16 bp, Homo sapiens
ttgctgtaaaatttgt

SEQ ID NO: 6582302 - DNA, 16 bp, Homo sapiens
ttgctgtaagatgtct

SEQ ID NO: 6582303 - DNA, 17 bp, Homo sapiens
ttgctgtacaaaagcaa

SEQ ID NO: 6582304 - DNA, 23 bp, Homo sapiens
ttgctgtaccagcccagatgttt

SEQ ID NO: 6582305 - DNA, 14 bp, Homo sapiens
ttgctgtagagact

SEQ ID NO: 6582306 - DNA, 16 bp, Homo sapiens
ttgctgtaggatctaa

SEQ ID NO: 6582307 - DNA, 11 bp, Homo sapiens
ttgctgtatat

SEQ ID NO: 6582308 - DNA, 21 bp, Homo sapiens
ttgctgtatgctgatcatcgc

SEQ ID NO: 6582309 - DNA, 16 bp, Homo sapiens
ttgctgtcaaggaaga

SEQ ID NO: 6582310 - DNA, 23 bp, Homo sapiens
ttgctgtcacatagtttttcctg

SEQ ID NO: 6582311 - DNA, 12 bp, Homo sapiens
ttgctgtcactg

SEQ ID NO: 6582312 - DNA, 15 bp, Homo sapiens
ttgctgtcacttctt

SEQ ID NO: 6582313 - DNA, 19 bp, Homo sapiens
ttgctgtccaggcagctcc

SEQ ID NO: 6582314 - DNA, 17 bp, Homo sapiens
ttgctgtccccttccag

SEQ ID NO: 6582315 - DNA, 13 bp, Homo sapiens
ttgctgtcctcca

SEQ ID NO: 6582316 - DNA, 15 bp, Homo sapiens
ttgctgtcctccagg

SEQ ID NO: 6582317 - DNA, 16 bp, Homo sapiens
ttgctgtctagcctta

SEQ ID NO: 6582318 - DNA, 17 bp, Homo sapiens
ttgctgtctagccttag

SEQ ID NO: 6582319 - DNA, 20 bp, Homo sapiens
ttgctgtctgaaaaagtgtt

SEQ ID NO: 6582320 - DNA, 14 bp, Homo sapiens
ttgctgtctgcagc

SEQ ID NO: 6582321 - DNA, 15 bp, Homo sapiens
ttgctgtctggcttt

SEQ ID NO: 6582322 - DNA, 20 bp, Homo sapiens
ttgctgtcttggggtcccac

SEQ ID NO: 6582323 - DNA, 14 bp, Homo sapiens
ttgctgtgaaacag

SEQ ID NO: 6582324 - DNA, 12 bp, Homo sapiens
ttgctgtgaaat

SEQ ID NO: 6582325 - DNA, 14 bp, Homo sapiens
ttgctgtgaactga

SEQ ID NO: 6582326 - DNA, 20 bp, Homo sapiens
ttgctgtgagcaagaagtca

SEQ ID NO: 6582327 - DNA, 17 bp, Homo sapiens
ttgctgtgagccttgca

SEQ ID NO: 6582328 - DNA, 20 bp, Homo sapiens
ttgctgtgaggaatgctctg

SEQ ID NO: 6582329 - DNA, 18 bp, Homo sapiens
ttgctgtgaggctgtcct

SEQ ID NO: 6582330 - DNA, 19 bp, Homo sapiens
ttgctgtgaggctgtcctg

SEQ ID NO: 6582331 - DNA, 20 bp, Homo sapiens
ttgctgtgaggctgtcctgt

SEQ ID NO: 6582332 - DNA, 11 bp, Homo sapiens
ttgctgtgcca

SEQ ID NO: 6582333 - DNA, 16 bp, Homo sapiens
ttgctgtgccaggagg

SEQ ID NO: 6582334 - DNA, 16 bp, Homo sapiens
ttgctgtgcctcccaa

SEQ ID NO: 6582335 - DNA, 11 bp, Homo sapiens
ttgctgtgctt

SEQ ID NO: 6582336 - DNA, 16 bp, Homo sapiens
ttgctgtggaccaatg

SEQ ID NO: 6582337 - DNA, 21 bp, Homo sapiens
ttgctgtggagctccactgcc

SEQ ID NO: 6582338 - DNA, 12 bp, Homo sapiens
ttgctgtggctc

SEQ ID NO: 6582339 - DNA, 12 bp, Homo sapiens
ttgctgtgggaa

SEQ ID NO: 6582340 - DNA, 15 bp, Homo sapiens
ttgctgtgggaacga

SEQ ID NO: 6582341 - DNA, 17 bp, Homo sapiens
ttgctgtggtctctttg

SEQ ID NO: 6582342 - DNA, 20 bp, Homo sapiens
ttgctgtgtagttccctctg

SEQ ID NO: 6582343 - DNA, 17 bp, Homo sapiens
ttgctgtgtcacactct

SEQ ID NO: 6582344 - DNA, 23 bp, Homo sapiens
ttgctgtgtctcctctcagagtg

SEQ ID NO: 6582345 - DNA, 11 bp, Homo sapiens
ttgctgtgtga

SEQ ID NO: 6582346 - DNA, 20 bp, Homo sapiens
ttgctgtgtgaaatctttca

SEQ ID NO: 6582347 - DNA, 18 bp, Homo sapiens
ttgctgtgtgaccctggg

SEQ ID NO: 6582348 - DNA, 18 bp, Homo sapiens
ttgctgtgtttaatttga

SEQ ID NO: 6582349 - DNA, 20 bp, Homo sapiens
ttgctgtgtttcaaacctgc

SEQ ID NO: 6582350 - DNA, 15 bp, Homo sapiens
ttgctgttactgctt

SEQ ID NO: 6582351 - DNA, 19 bp, Homo sapiens
ttgctgttagttataaaac

SEQ ID NO: 6582352 - DNA, 13 bp, Homo sapiens
ttgctgttccaca

SEQ ID NO: 6582353 - DNA, 16 bp, Homo sapiens
ttgctgttgaaagcaa

SEQ ID NO: 6582354 - DNA, 21 bp, Homo sapiens
ttgctgttgaaagcaaaaatg

SEQ ID NO: 6582355 - DNA, 12 bp, Homo sapiens
ttgctgttgacg

SEQ ID NO: 6582356 - DNA, 20 bp, Homo sapiens
ttgctgttgatttctttcca

SEQ ID NO: 6582357 - DNA, 14 bp, Homo sapiens
ttgctgttgcttga

SEQ ID NO: 6582358 - DNA, 19 bp, Homo sapiens
ttgctgttgtgcagtgtgc

SEQ ID NO: 6582359 - DNA, 12 bp, Homo sapiens
ttgctgttgttg

SEQ ID NO: 6582360 - DNA, 21 bp, Homo sapiens
ttgctgttgttgttaattttg

SEQ ID NO: 6582361 - DNA, 22 bp, Homo sapiens
ttgctgttgtttctataaatga

SEQ ID NO: 6582362 - DNA, 20 bp, Homo sapiens
ttgctgtttaccgcccaccc

SEQ ID NO: 6582363 - DNA, 14 bp, Homo sapiens
ttgctgtttagagt

SEQ ID NO: 6582364 - DNA, 18 bp, Homo sapiens
ttgctgtttagcttcctc

SEQ ID NO: 6582365 - DNA, 20 bp, Homo sapiens
ttgctgtttagcttcctcca

SEQ ID NO: 6582366 - DNA, 15 bp, Homo sapiens
ttgctgtttatactt

SEQ ID NO: 6582367 - DNA, 12 bp, Homo sapiens
ttgctgtttatt

SEQ ID NO: 6582368 - DNA, 15 bp, Homo sapiens
ttgctgtttcctttt

SEQ ID NO: 6582369 - DNA, 18 bp, Homo sapiens
ttgctgttttaaacatta

SEQ ID NO: 6582370 - DNA, 16 bp, Homo sapiens
ttgctgttttcctccc

SEQ ID NO: 6582371 - DNA, 13 bp, Homo sapiens
ttgctgttttgat

SEQ ID NO: 6582372 - DNA, 17 bp, Homo sapiens
ttgctgtttttcttgtc

SEQ ID NO: 6582373 - DNA, 15 bp, Homo sapiens
ttgcttaaaagcatt

SEQ ID NO: 6582374 - DNA, 14 bp, Homo sapiens
ttgcttaaaatata

SEQ ID NO: 6582375 - DNA, 12 bp, Homo sapiens
ttgcttaaatgt

SEQ ID NO: 6582376 - DNA, 20 bp, Homo sapiens
ttgcttaacattagatgtca

SEQ ID NO: 6582377 - DNA, 16 bp, Homo sapiens
ttgcttaacttccatg

SEQ ID NO: 6582378 - DNA, 16 bp, Homo sapiens
ttgcttaagtatacct

SEQ ID NO: 6582379 - DNA, 18 bp, Homo sapiens
ttgcttaatctagagcta

SEQ ID NO: 6582380 - DNA, 16 bp, Homo sapiens
ttgcttaatgccagaa

SEQ ID NO: 6582381 - DNA, 14 bp, Homo sapiens
ttgcttaattgtga

SEQ ID NO: 6582382 - DNA, 16 bp, Homo sapiens
ttgcttacaaagtata

SEQ ID NO: 6582383 - DNA, 14 bp, Homo sapiens
ttgcttacaatttt

SEQ ID NO: 6582384 - DNA, 15 bp, Homo sapiens
ttgcttacaattttt

SEQ ID NO: 6582385 - DNA, 17 bp, Homo sapiens
ttgcttaccttgactgt

SEQ ID NO: 6582386 - DNA, 15 bp, Homo sapiens
ttgcttaccttttcc

SEQ ID NO: 6582387 - DNA, 23 bp, Homo sapiens
ttgcttactttggaatacatttc

SEQ ID NO: 6582388 - DNA, 22 bp, Homo sapiens
ttgcttagatgagggtgactgt

SEQ ID NO: 6582389 - DNA, 16 bp, Homo sapiens
ttgcttagcctgtgct

SEQ ID NO: 6582390 - DNA, 20 bp, Homo sapiens
ttgcttaggatgtgtgcatg

SEQ ID NO: 6582391 - DNA, 24 bp, Homo sapiens
ttgcttaggatgtttttcatgaaa

SEQ ID NO: 6582392 - DNA, 19 bp, Homo sapiens
ttgcttatcaacttcctaa

SEQ ID NO: 6582393 - DNA, 22 bp, Homo sapiens
ttgcttatgtgtaggtgaacag

SEQ ID NO: 6582394 - DNA, 18 bp, Homo sapiens
ttgcttattgttccaaga

SEQ ID NO: 6582395 - DNA, 20 bp, Homo sapiens
ttgcttatttattgtattct

SEQ ID NO: 6582396 - DNA, 23 bp, Homo sapiens
ttgcttatttttataattaaaga

SEQ ID NO: 6582397 - DNA, 14 bp, Homo sapiens
ttgcttcaaactga

SEQ ID NO: 6582398 - DNA, 15 bp, Homo sapiens
ttgcttcaaactgag

SEQ ID NO: 6582399 - DNA, 16 bp, Homo sapiens
ttgcttcaaactgaga

SEQ ID NO: 6582400 - DNA, 15 bp, Homo sapiens
ttgcttcaaattggt

SEQ ID NO: 6582401 - DNA, 15 bp, Homo sapiens
ttgcttcaattaaaa

SEQ ID NO: 6582402 - DNA, 17 bp, Homo sapiens
ttgcttcaccatggcct

SEQ ID NO: 6582403 - DNA, 21 bp, Homo sapiens
ttgcttcatagtattggagca

SEQ ID NO: 6582404 - DNA, 18 bp, Homo sapiens
ttgcttcatgtgtcccag

SEQ ID NO: 6582405 - DNA, 13 bp, Homo sapiens
ttgcttcatgttc

SEQ ID NO: 6582406 - DNA, 12 bp, Homo sapiens
ttgcttcattaa

SEQ ID NO: 6582407 - DNA, 11 bp, Homo sapiens
ttgcttcctga

SEQ ID NO: 6582408 - DNA, 19 bp, Homo sapiens
ttgcttcctgtgtaacatc

SEQ ID NO: 6582409 - DNA, 23 bp, Homo sapiens
ttgcttccttctcatcttgcctc

SEQ ID NO: 6582410 - DNA, 20 bp, Homo sapiens
ttgcttctaaaacaataaag

SEQ ID NO: 6582411 - DNA, 19 bp, Homo sapiens
ttgcttctactttcatctt

SEQ ID NO: 6582412 - DNA, 21 bp, Homo sapiens
ttgcttctaggagtcaactgg

SEQ ID NO: 6582413 - DNA, 11 bp, Homo sapiens
ttgcttctcaa

SEQ ID NO: 6582414 - DNA, 11 bp, Homo sapiens
ttgcttctccc

SEQ ID NO: 6582415 - DNA, 17 bp, Homo sapiens
ttgcttctcccatttcc

SEQ ID NO: 6582416 - DNA, 15 bp, Homo sapiens
aataatgtctagatt

SEQ ID NO: 6582417 - DNA, 20 bp, Homo sapiens
aataatgtctagattttgaa

SEQ ID NO: 6582418 - DNA, 11 bp, Homo sapiens
aataatgtctc

SEQ ID NO: 6582419 - DNA, 16 bp, Homo sapiens
aataatgtgaaactgg

SEQ ID NO: 6582420 - DNA, 17 bp, Homo sapiens
aataatgtgaaactgga

SEQ ID NO: 6582421 - DNA, 18 bp, Homo sapiens
aataatgtgcaaattttg

SEQ ID NO: 6582422 - DNA, 17 bp, Homo sapiens
aataatgtgcactgaat

SEQ ID NO: 6582423 - DNA, 19 bp, Homo sapiens
aataatgtgtagttcatgt

SEQ ID NO: 6582424 - DNA, 20 bp, Homo sapiens
aataatgtgtagttcatgta

SEQ ID NO: 6582425 - DNA, 21 bp, Homo sapiens
aataatgtgtagttcatgtaa

SEQ ID NO: 6582426 - DNA, 18 bp, Homo sapiens
aataatgtgttaaacatg

SEQ ID NO: 6582427 - DNA, 15 bp, Homo sapiens
aataatgttctgtca

SEQ ID NO: 6582428 - DNA, 16 bp, Homo sapiens
aataattaaataaatg

SEQ ID NO: 6582429 - DNA, 24 bp, Homo sapiens
aataattaattaattaacatcaaa

SEQ ID NO: 6582430 - DNA, 15 bp, Homo sapiens
aataattacttaatg

SEQ ID NO: 6582431 - DNA, 16 bp, Homo sapiens
aataattagctatatt

SEQ ID NO: 6582432 - DNA, 23 bp, Homo sapiens
aataattaggatctatgcaattt

SEQ ID NO: 6582433 - DNA, 14 bp, Homo sapiens
aataattatatgaa

SEQ ID NO: 6582434 - DNA, 20 bp, Homo sapiens
aataattatatgctatttct

SEQ ID NO: 6582435 - DNA, 22 bp, Homo sapiens
aataattatatgctatttctat

SEQ ID NO: 6582436 - DNA, 18 bp, Homo sapiens
aataattatttatttaat

SEQ ID NO: 6582437 - DNA, 15 bp, Homo sapiens
aataattatttcaga

SEQ ID NO: 6582438 - DNA, 15 bp, Homo sapiens
aataattcatatcta

SEQ ID NO: 6582439 - DNA, 19 bp, Homo sapiens
aataattcatattcttcat

SEQ ID NO: 6582440 - DNA, 17 bp, Homo sapiens
aataattccataaatct

SEQ ID NO: 6582441 - DNA, 19 bp, Homo sapiens
aataattctgagttttgtg

SEQ ID NO: 6582442 - DNA, 20 bp, Homo sapiens
aataattctgctttagatgt

SEQ ID NO: 6582443 - DNA, 23 bp, Homo sapiens
aataattcttccagtgcaacaaa

SEQ ID NO: 6582444 - DNA, 14 bp, Homo sapiens
aataattctttgat

SEQ ID NO: 6582445 - DNA, 15 bp, Homo sapiens
aataattctttgatt

SEQ ID NO: 6582446 - DNA, 20 bp, Homo sapiens
aataattcttttttattaat

SEQ ID NO: 6582447 - DNA, 21 bp, Homo sapiens
aataattcttttttattaatc

SEQ ID NO: 6582448 - DNA, 21 bp, Homo sapiens
aataattgaagtgttcccttt

SEQ ID NO: 6582449 - DNA, 19 bp, Homo sapiens
aataattgagactgaaaga

SEQ ID NO: 6582450 - DNA, 19 bp, Homo sapiens
aataattggagaagattta

SEQ ID NO: 6582451 - DNA, 14 bp, Homo sapiens
aataattgtggaga

SEQ ID NO: 6582452 - DNA, 16 bp, Homo sapiens
aataattgtggagagg

SEQ ID NO: 6582453 - DNA, 13 bp, Homo sapiens
aataattgtgtac

SEQ ID NO: 6582454 - DNA, 16 bp, Homo sapiens
aataattgttgtgtgt

SEQ ID NO: 6582455 - DNA, 16 bp, Homo sapiens
aataattgttgttctg

SEQ ID NO: 6582456 - DNA, 14 bp, Homo sapiens
aataattgtttcca

SEQ ID NO: 6582457 - DNA, 13 bp, Homo sapiens
aataatttaacta

SEQ ID NO: 6582458 - DNA, 14 bp, Homo sapiens
aataatttaactaa

SEQ ID NO: 6582459 - DNA, 18 bp, Homo sapiens
aataatttaactaccctt

SEQ ID NO: 6582460 - DNA, 13 bp, Homo sapiens
aataatttaagtt

SEQ ID NO: 6582461 - DNA, 14 bp, Homo sapiens
aataatttaagttg

SEQ ID NO: 6582462 - DNA, 15 bp, Homo sapiens
aataatttaagttgg

SEQ ID NO: 6582463 - DNA, 21 bp, Homo sapiens
aataatttagacttcaagcat

SEQ ID NO: 6582464 - DNA, 18 bp, Homo sapiens
aataatttatatgcatgc

SEQ ID NO: 6582465 - DNA, 23 bp, Homo sapiens
aataatttatatgcatgcacagg

SEQ ID NO: 6582466 - DNA, 19 bp, Homo sapiens
aataatttatcaaaaaaca

SEQ ID NO: 6582467 - DNA, 21 bp, Homo sapiens
aataatttcctggtgtgaagg

SEQ ID NO: 6582468 - DNA, 13 bp, Homo sapiens
aataatttccttc

SEQ ID NO: 6582469 - DNA, 12 bp, Homo sapiens
aataatttgaat

SEQ ID NO: 6582470 - DNA, 14 bp, Homo sapiens
aataatttgcactg

SEQ ID NO: 6582471 - DNA, 15 bp, Homo sapiens
aataatttgcactga

SEQ ID NO: 6582472 - DNA, 15 bp, Homo sapiens
aataatttgtacaat

SEQ ID NO: 6582473 - DNA, 17 bp, Homo sapiens
aataatttgtgtctgtg

SEQ ID NO: 6582474 - DNA, 19 bp, Homo sapiens
aataatttgtgtctgtgtt

SEQ ID NO: 6582475 - DNA, 15 bp, Homo sapiens
aataatttgttttca

SEQ ID NO: 6582476 - DNA, 16 bp, Homo sapiens
aataattttaaacaaa

SEQ ID NO: 6582477 - DNA, 19 bp, Homo sapiens
aataattttacatgtctca

SEQ ID NO: 6582478 - DNA, 21 bp, Homo sapiens
aataattttaggcacccatcc

SEQ ID NO: 6582479 - DNA, 11 bp, Homo sapiens
aataattttat

SEQ ID NO: 6582480 - DNA, 14 bp, Homo sapiens
aataattttatgaa

SEQ ID NO: 6582481 - DNA, 22 bp, Homo sapiens
aataattttattagaataattt

SEQ ID NO: 6582482 - DNA, 20 bp, Homo sapiens
aataattttccaagtaaagt

SEQ ID NO: 6582483 - DNA, 12 bp, Homo sapiens
aataattttcta

SEQ ID NO: 6582484 - DNA, 17 bp, Homo sapiens
aataattttctaagaca

SEQ ID NO: 6582485 - DNA, 19 bp, Homo sapiens
aataattttctaagacagt

SEQ ID NO: 6582486 - DNA, 21 bp, Homo sapiens
aataattttctaagacagttt

SEQ ID NO: 6582487 - DNA, 13 bp, Homo sapiens
aataattttgtaa

SEQ ID NO: 6582488 - DNA, 22 bp, Homo sapiens
aataatttttatatttaattat

SEQ ID NO: 6582489 - DNA, 17 bp, Homo sapiens
aataatttttatatttg

SEQ ID NO: 6582490 - DNA, 20 bp, Homo sapiens
aataatttttatatttgaaa

SEQ ID NO: 6582491 - DNA, 14 bp, Homo sapiens
aataatttttctta

SEQ ID NO: 6582492 - DNA, 20 bp, Homo sapiens
aatacaaaaaattagccaag

SEQ ID NO: 6582493 - DNA, 23 bp, Homo sapiens
aatacaaaaatgagctaggcatg

SEQ ID NO: 6582494 - DNA, 16 bp, Homo sapiens
aatacaaaatccttct

SEQ ID NO: 6582495 - DNA, 11 bp, Homo sapiens
aatacaaaatg

SEQ ID NO: 6582496 - DNA, 13 bp, Homo sapiens
aatacaaaatgat

SEQ ID NO: 6582497 - DNA, 13 bp, Homo sapiens
aatacaaacaatg

SEQ ID NO: 6582498 - DNA, 23 bp, Homo sapiens
aatacaaaggtgctaattaatag

SEQ ID NO: 6582499 - DNA, 17 bp, Homo sapiens
aatacaaaggttccatt

SEQ ID NO: 6582500 - DNA, 17 bp, Homo sapiens
aatacaaagtaaataca

SEQ ID NO: 6582501 - DNA, 17 bp, Homo sapiens
aatacaaatagattttt

SEQ ID NO: 6582502 - DNA, 13 bp, Homo sapiens
aatacaaatctgt

SEQ ID NO: 6582503 - DNA, 13 bp, Homo sapiens
aatacaaatggat

SEQ ID NO: 6582504 - DNA, 18 bp, Homo sapiens
aatacaaatggattttgg

SEQ ID NO: 6582505 - DNA, 13 bp, Homo sapiens
aatacaaattttg

SEQ ID NO: 6582506 - DNA, 19 bp, Homo sapiens
aatacaacaagaacaacaa

SEQ ID NO: 6582507 - DNA, 13 bp, Homo sapiens
aatacaacacatc

SEQ ID NO: 6582508 - DNA, 18 bp, Homo sapiens
aatacaacagaagttata

SEQ ID NO: 6582509 - DNA, 20 bp, Homo sapiens
aatacaaccagcccaaccat

SEQ ID NO: 6582510 - DNA, 20 bp, Homo sapiens
aatacaacttcattgctaca

SEQ ID NO: 6582511 - DNA, 16 bp, Homo sapiens
aatacaactttaccat

SEQ ID NO: 6582512 - DNA, 20 bp, Homo sapiens
aatacaactttaccataaag

SEQ ID NO: 6582513 - DNA, 17 bp, Homo sapiens
aatacaagcatatgtta

SEQ ID NO: 6582514 - DNA, 19 bp, Homo sapiens
aatacaagccaagctagaa

SEQ ID NO: 6582515 - DNA, 17 bp, Homo sapiens
aatacaaggtataataa

SEQ ID NO: 6582516 - DNA, 19 bp, Homo sapiens
aatacaaggtataataaaa

SEQ ID NO: 6582517 - DNA, 20 bp, Homo sapiens
aatacaagtaatattattac

SEQ ID NO: 6582518 - DNA, 19 bp, Homo sapiens
aatacaagttacatacatt

SEQ ID NO: 6582519 - DNA, 21 bp, Homo sapiens
aatacaagttacatacattta

SEQ ID NO: 6582520 - DNA, 15 bp, Homo sapiens
aatacaagttctttt

SEQ ID NO: 6582521 - DNA, 17 bp, Homo sapiens
aatacaagtttcatcca

SEQ ID NO: 6582522 - DNA, 14 bp, Homo sapiens
aatacaataagtta

SEQ ID NO: 6582523 - DNA, 12 bp, Homo sapiens
aatacaatgtac

SEQ ID NO: 6582524 - DNA, 13 bp, Homo sapiens
aatacaatgtaca

SEQ ID NO: 6582525 - DNA, 16 bp, Homo sapiens
aatacaatgtacaatt

SEQ ID NO: 6582526 - DNA, 17 bp, Homo sapiens
aatacaatgttatcaac

SEQ ID NO: 6582527 - DNA, 15 bp, Homo sapiens
aatacaattaaaggt

SEQ ID NO: 6582528 - DNA, 16 bp, Homo sapiens
aatacaattaaaggtc

SEQ ID NO: 6582529 - DNA, 17 bp, Homo sapiens
aatacaattactcacca

SEQ ID NO: 6582530 - DNA, 16 bp, Homo sapiens
aatacaattattgtat

SEQ ID NO: 6582531 - DNA, 17 bp, Homo sapiens
aatacaattcaaacaat

SEQ ID NO: 6582532 - DNA, 15 bp, Homo sapiens
aatacaattcaaatg

SEQ ID NO: 6582533 - DNA, 17 bp, Homo sapiens
aatacaattcaaatgct

SEQ ID NO: 6582534 - DNA, 20 bp, Homo sapiens
aatacaattcacagcacagt

SEQ ID NO: 6582535 - DNA, 15 bp, Homo sapiens
aatacaatttgtact

SEQ ID NO: 6582536 - DNA, 15 bp, Homo sapiens
aatacaattttgttt

SEQ ID NO: 6582537 - DNA, 18 bp, Homo sapiens
aatacaattttgtttctg

SEQ ID NO: 6582538 - DNA, 20 bp, Homo sapiens
aatacaattttgtttctgta

SEQ ID NO: 6582539 - DNA, 23 bp, Homo sapiens
aatacaattttgtttctgtactt

SEQ ID NO: 6582540 - DNA, 20 bp, Homo sapiens
aatacacaaggagctttctt

SEQ ID NO: 6582541 - DNA, 18 bp, Homo sapiens
aatacacacagttactga

SEQ ID NO: 6582542 - DNA, 20 bp, Homo sapiens
aatacacacagttactgact

SEQ ID NO: 6582543 - DNA, 22 bp, Homo sapiens
aatacacacagttactgactta

SEQ ID NO: 6582544 - DNA, 15 bp, Homo sapiens
aatacacagggaggg

SEQ ID NO: 6582545 - DNA, 14 bp, Homo sapiens
aatacacagtattc

SEQ ID NO: 6582546 - DNA, 13 bp, Homo sapiens
aatacacatacat

SEQ ID NO: 6582547 - DNA, 16 bp, Homo sapiens
aatacacatacatata

SEQ ID NO: 6582548 - DNA, 23 bp, Homo sapiens
aatacacatagcatgtaatggta

SEQ ID NO: 6582549 - DNA, 17 bp, Homo sapiens
aatacacatataaaaac

SEQ ID NO: 6582550 - DNA, 19 bp, Homo sapiens
aatacacatataaaaacaa

SEQ ID NO: 6582551 - DNA, 15 bp, Homo sapiens
aatacacatctctgt

SEQ ID NO: 6582552 - DNA, 23 bp, Homo sapiens
aatacacatgaaaacaagaaaga

SEQ ID NO: 6582553 - DNA, 14 bp, Homo sapiens
aatacacattatca

SEQ ID NO: 6582554 - DNA, 15 bp, Homo sapiens
aatacacatttgcta

SEQ ID NO: 6582555 - DNA, 22 bp, Homo sapiens
aatacaccacctcactcctgtt

SEQ ID NO: 6582556 - DNA, 18 bp, Homo sapiens
aatacaccactacattct

SEQ ID NO: 6582557 - DNA, 21 bp, Homo sapiens
aatacaccaggtagaacacaa

SEQ ID NO: 6582558 - DNA, 18 bp, Homo sapiens
aatacaccttccccaccc

SEQ ID NO: 6582559 - DNA, 14 bp, Homo sapiens
aatacacgtgtata

SEQ ID NO: 6582560 - DNA, 16 bp, Homo sapiens
aatacacgtgtatatg

SEQ ID NO: 6582561 - DNA, 16 bp, Homo sapiens
aatacacgtttatctt

SEQ ID NO: 6582562 - DNA, 14 bp, Homo sapiens
aatacactacaaat

SEQ ID NO: 6582563 - DNA, 14 bp, Homo sapiens
aatacacttctttt

SEQ ID NO: 6582564 - DNA, 22 bp, Homo sapiens
aatacacttgtgattataaaat

SEQ ID NO: 6582565 - DNA, 13 bp, Homo sapiens
aatacactttatt

SEQ ID NO: 6582566 - DNA, 19 bp, Homo sapiens
aatacacttttttccaaag

SEQ ID NO: 6582567 - DNA, 13 bp, Homo sapiens
aatacagaagaaa

SEQ ID NO: 6582568 - DNA, 13 bp, Homo sapiens
aatacagaattga

SEQ ID NO: 6582569 - DNA, 13 bp, Homo sapiens
aatacagacaaag

SEQ ID NO: 6582570 - DNA, 20 bp, Homo sapiens
aatacagacactaagttata

SEQ ID NO: 6582571 - DNA, 15 bp, Homo sapiens
aatacagactggatg

SEQ ID NO: 6582572 - DNA, 20 bp, Homo sapiens
aatacagagtacgttaaaag

SEQ ID NO: 6582573 - DNA, 17 bp, Homo sapiens
aatacagataacattag

SEQ ID NO: 6582574 - DNA, 21 bp, Homo sapiens
aatacagataattcatttgta

SEQ ID NO: 6582575 - DNA, 17 bp, Homo sapiens
aatacagcagcaagaaa

SEQ ID NO: 6582576 - DNA, 18 bp, Homo sapiens
aatacagcagcaagaaaa

SEQ ID NO: 6582577 - DNA, 19 bp, Homo sapiens
aatacagccaaagataatc

SEQ ID NO: 6582578 - DNA, 24 bp, Homo sapiens
aatacagccaaagataatctctca

SEQ ID NO: 6582579 - DNA, 21 bp, Homo sapiens
aatacagcctatagtaaatgt

SEQ ID NO: 6582580 - DNA, 21 bp, Homo sapiens
aatacagctaaggccttgcca

SEQ ID NO: 6582581 - DNA, 20 bp, Homo sapiens
aatacagctgaagtcaaaat

SEQ ID NO: 6582582 - DNA, 12 bp, Homo sapiens
aatacagctggc

SEQ ID NO: 6582583 - DNA, 14 bp, Homo sapiens
aatacagctggcta

SEQ ID NO: 6582584 - DNA, 16 bp, Homo sapiens
aatacagctggctatc

SEQ ID NO: 6582585 - DNA, 22 bp, Homo sapiens
aatacagcttcattatctgagt

SEQ ID NO: 6582586 - DNA, 13 bp, Homo sapiens
aatacagctttct

SEQ ID NO: 6582587 - DNA, 13 bp, Homo sapiens
aatacaggaaaca

SEQ ID NO: 6582588 - DNA, 15 bp, Homo sapiens
aatacaggaaacagt

SEQ ID NO: 6582589 - DNA, 12 bp, Homo sapiens
aatacaggaaat

SEQ ID NO: 6582590 - DNA, 13 bp, Homo sapiens
aatacaggacttt

SEQ ID NO: 6582591 - DNA, 18 bp, Homo sapiens
aatacaggacttttaaat

SEQ ID NO: 6582592 - DNA, 19 bp, Homo sapiens
aatacaggattattttgat

SEQ ID NO: 6582593 - DNA, 16 bp, Homo sapiens
aatacaggtaacatta

SEQ ID NO: 6582594 - DNA, 19 bp, Homo sapiens
aatacagtaagctgctcta

SEQ ID NO: 6582595 - DNA, 16 bp, Homo sapiens
aatacagtacaggcag

SEQ ID NO: 6582596 - DNA, 21 bp, Homo sapiens
ttgcttctcccatttcctgat

SEQ ID NO: 6582597 - DNA, 20 bp, Homo sapiens
ttgcttctctattgcaagca

SEQ ID NO: 6582598 - DNA, 14 bp, Homo sapiens
ttgcttctcttctt

SEQ ID NO: 6582599 - DNA, 13 bp, Homo sapiens
ttgcttctgaatc

SEQ ID NO: 6582600 - DNA, 14 bp, Homo sapiens
ttgcttctgcagca

SEQ ID NO: 6582601 - DNA, 22 bp, Homo sapiens
ttgcttctgcagcaactcccac

SEQ ID NO: 6582602 - DNA, 24 bp, Homo sapiens
ttgcttctgcagcaactcccacga

SEQ ID NO: 6582603 - DNA, 15 bp, Homo sapiens
ttgcttctgggaagg

SEQ ID NO: 6582604 - DNA, 19 bp, Homo sapiens
ttgcttctgggaaggggtt

SEQ ID NO: 6582605 - DNA, 15 bp, Homo sapiens
ttgcttcttactgat

SEQ ID NO: 6582606 - DNA, 18 bp, Homo sapiens
ttgcttcttactgataat

SEQ ID NO: 6582607 - DNA, 23 bp, Homo sapiens
ttgcttcttcaatggcaccttca

SEQ ID NO: 6582608 - DNA, 17 bp, Homo sapiens
ttgcttcttcaccagtt

SEQ ID NO: 6582609 - DNA, 23 bp, Homo sapiens
ttgcttcttcccttaaaatttat

SEQ ID NO: 6582610 - DNA, 18 bp, Homo sapiens
ttgcttcttgtgaaggcc

SEQ ID NO: 6582611 - DNA, 19 bp, Homo sapiens
ttgcttcttgtgtttgaaa

SEQ ID NO: 6582612 - DNA, 17 bp, Homo sapiens
ttgcttcttgtgtttta

SEQ ID NO: 6582613 - DNA, 17 bp, Homo sapiens
ttgcttctttctagaaa

SEQ ID NO: 6582614 - DNA, 21 bp, Homo sapiens
ttgcttgaaattactgtgtaa

SEQ ID NO: 6582615 - DNA, 14 bp, Homo sapiens
ttgcttgagcccag

SEQ ID NO: 6582616 - DNA, 21 bp, Homo sapiens
ttgcttgagcctggctgtcca

SEQ ID NO: 6582617 - DNA, 22 bp, Homo sapiens
ttgcttgagcctggctgtccaa

SEQ ID NO: 6582618 - DNA, 11 bp, Homo sapiens
ttgcttgcctc

SEQ ID NO: 6582619 - DNA, 16 bp, Homo sapiens
ttgcttgcctgatata

SEQ ID NO: 6582620 - DNA, 13 bp, Homo sapiens
ttgcttgcttttt

SEQ ID NO: 6582621 - DNA, 14 bp, Homo sapiens
ttgcttggcagaga

SEQ ID NO: 6582622 - DNA, 14 bp, Homo sapiens
ttgcttgggccact

SEQ ID NO: 6582623 - DNA, 16 bp, Homo sapiens
ttgcttgggtctctct

SEQ ID NO: 6582624 - DNA, 16 bp, Homo sapiens
ttgcttgggttccttt

SEQ ID NO: 6582625 - DNA, 14 bp, Homo sapiens
ttgcttggttcatt

SEQ ID NO: 6582626 - DNA, 15 bp, Homo sapiens
ttgcttgtacctctg

SEQ ID NO: 6582627 - DNA, 18 bp, Homo sapiens
ttgcttgtacctctggct

SEQ ID NO: 6582628 - DNA, 18 bp, Homo sapiens
ttgcttgtattgtaaatg

SEQ ID NO: 6582629 - DNA, 20 bp, Homo sapiens
ttgcttgtattgtaaatgtg

SEQ ID NO: 6582630 - DNA, 13 bp, Homo sapiens
ttgcttgtcattg

SEQ ID NO: 6582631 - DNA, 13 bp, Homo sapiens
ttgcttgtcctgc

SEQ ID NO: 6582632 - DNA, 22 bp, Homo sapiens
ttgcttgtgaatcttaacattt

SEQ ID NO: 6582633 - DNA, 21 bp, Homo sapiens
ttgcttgttatattaagcaga

SEQ ID NO: 6582634 - DNA, 16 bp, Homo sapiens
ttgctttaaaacaaag

SEQ ID NO: 6582635 - DNA, 15 bp, Homo sapiens
ttgctttaaaacaag

SEQ ID NO: 6582636 - DNA, 16 bp, Homo sapiens
ttgctttaaatcttaa

SEQ ID NO: 6582637 - DNA, 14 bp, Homo sapiens
ttgctttaagaaac

SEQ ID NO: 6582638 - DNA, 14 bp, Homo sapiens
ttgctttaatataa

SEQ ID NO: 6582639 - DNA, 23 bp, Homo sapiens
ttgctttaatgagtgcacctgcc

SEQ ID NO: 6582640 - DNA, 15 bp, Homo sapiens
ttgctttactgtcaa

SEQ ID NO: 6582641 - DNA, 16 bp, Homo sapiens
ttgctttactgtcaaa

SEQ ID NO: 6582642 - DNA, 20 bp, Homo sapiens
ttgctttatgccttcttatt

SEQ ID NO: 6582643 - DNA, 15 bp, Homo sapiens
ttgctttattccaga

SEQ ID NO: 6582644 - DNA, 18 bp, Homo sapiens
ttgctttatttttcatta

SEQ ID NO: 6582645 - DNA, 13 bp, Homo sapiens
ttgctttcctctt

SEQ ID NO: 6582646 - DNA, 17 bp, Homo sapiens
ttgctttcctgggcctt

SEQ ID NO: 6582647 - DNA, 11 bp, Homo sapiens
ttgctttctga

SEQ ID NO: 6582648 - DNA, 13 bp, Homo sapiens
ttgctttctgaaa

SEQ ID NO: 6582649 - DNA, 20 bp, Homo sapiens
ttgctttctgctcagcttct

SEQ ID NO: 6582650 - DNA, 21 bp, Homo sapiens
ttgctttgaaactagacttga

SEQ ID NO: 6582651 - DNA, 14 bp, Homo sapiens
ttgctttgaagcag

SEQ ID NO: 6582652 - DNA, 11 bp, Homo sapiens
ttgctttgagc

SEQ ID NO: 6582653 - DNA, 14 bp, Homo sapiens
ttgctttgccagag

SEQ ID NO: 6582654 - DNA, 16 bp, Homo sapiens
ttgctttgccagagca

SEQ ID NO: 6582655 - DNA, 14 bp, Homo sapiens
ttgctttgcccaag

SEQ ID NO: 6582656 - DNA, 16 bp, Homo sapiens
ttgctttgccctggag

SEQ ID NO: 6582657 - DNA, 13 bp, Homo sapiens
ttgctttgccctt

SEQ ID NO: 6582658 - DNA, 13 bp, Homo sapiens
ttgctttgctgca

SEQ ID NO: 6582659 - DNA, 23 bp, Homo sapiens
ttgctttgctgcacagcaggacc

SEQ ID NO: 6582660 - DNA, 15 bp, Homo sapiens
ttgctttggaaacac

SEQ ID NO: 6582661 - DNA, 17 bp, Homo sapiens
ttgctttgggattttct

SEQ ID NO: 6582662 - DNA, 14 bp, Homo sapiens
ttgctttggggggt

SEQ ID NO: 6582663 - DNA, 17 bp, Homo sapiens
ttgctttggttaaaaat

SEQ ID NO: 6582664 - DNA, 16 bp, Homo sapiens
ttgctttgtatgcact

SEQ ID NO: 6582665 - DNA, 18 bp, Homo sapiens
ttgctttgtctggcctca

SEQ ID NO: 6582666 - DNA, 19 bp, Homo sapiens
ttgcttttacggtgatatt

SEQ ID NO: 6582667 - DNA, 16 bp, Homo sapiens
ttgcttttcatgcaaa

SEQ ID NO: 6582668 - DNA, 16 bp, Homo sapiens
ttgcttttccctcttt

SEQ ID NO: 6582669 - DNA, 16 bp, Homo sapiens
ttgcttttgcctctgc

SEQ ID NO: 6582670 - DNA, 19 bp, Homo sapiens
ttgctttttaaactgatgt

SEQ ID NO: 6582671 - DNA, 14 bp, Homo sapiens
ttgctttttcaggt

SEQ ID NO: 6582672 - DNA, 22 bp, Homo sapiens
ttgctttttctaatgtggttat

SEQ ID NO: 6582673 - DNA, 15 bp, Homo sapiens
ttgctttttctgact

SEQ ID NO: 6582674 - DNA, 15 bp, Homo sapiens
ttgctttttgtgata

SEQ ID NO: 6582675 - DNA, 14 bp, Homo sapiens
ttgcttttttgact

SEQ ID NO: 6582676 - DNA, 17 bp, Homo sapiens
ttgcttttttttccttc

SEQ ID NO: 6582677 - DNA, 15 bp, Homo sapiens
ttggaaaaaactctg

SEQ ID NO: 6582678 - DNA, 22 bp, Homo sapiens
ttggaaaaacaacagcgacaaa

SEQ ID NO: 6582679 - DNA, 17 bp, Homo sapiens
ttggaaaaagtgatgga

SEQ ID NO: 6582680 - DNA, 21 bp, Homo sapiens
ttggaaaaatccagaaagaaa

SEQ ID NO: 6582681 - DNA, 22 bp, Homo sapiens
ttggaaaaatgggtcttttata

SEQ ID NO: 6582682 - DNA, 12 bp, Homo sapiens
ttggaaaaatgt

SEQ ID NO: 6582683 - DNA, 14 bp, Homo sapiens
ttggaaaaatgtca

SEQ ID NO: 6582684 - DNA, 19 bp, Homo sapiens
ttggaaaaatgtcactgaa

SEQ ID NO: 6582685 - DNA, 14 bp, Homo sapiens
ttggaaaaatgttt

SEQ ID NO: 6582686 - DNA, 17 bp, Homo sapiens
ttggaaaactaactcag

SEQ ID NO: 6582687 - DNA, 13 bp, Homo sapiens
ttggaaaagaaat

SEQ ID NO: 6582688 - DNA, 20 bp, Homo sapiens
ttggaaaagaaatcaatttt

SEQ ID NO: 6582689 - DNA, 17 bp, Homo sapiens
ttggaaaagacagaaaa

SEQ ID NO: 6582690 - DNA, 12 bp, Homo sapiens
ttggaaaataat

SEQ ID NO: 6582691 - DNA, 18 bp, Homo sapiens
ttggaaaataataaaaga

SEQ ID NO: 6582692 - DNA, 21 bp, Homo sapiens
ttggaaaataataaaagaatc

SEQ ID NO: 6582693 - DNA, 21 bp, Homo sapiens
ttggaaaatgtgtctctgctt

SEQ ID NO: 6582694 - DNA, 22 bp, Homo sapiens
ttggaaaatgttctgacagcat

SEQ ID NO: 6582695 - DNA, 16 bp, Homo sapiens
ttggaaacactaaatg

SEQ ID NO: 6582696 - DNA, 18 bp, Homo sapiens
ttggaaacactaaatgtt

SEQ ID NO: 6582697 - DNA, 20 bp, Homo sapiens
ttggaaacggtatcctccct

SEQ ID NO: 6582698 - DNA, 16 bp, Homo sapiens
ttggaaactaataaaa

SEQ ID NO: 6582699 - DNA, 17 bp, Homo sapiens
ttggaaactaataaaat

SEQ ID NO: 6582700 - DNA, 20 bp, Homo sapiens
ttggaaactaataaaatatt

SEQ ID NO: 6582701 - DNA, 14 bp, Homo sapiens
ttggaaagaacatt

SEQ ID NO: 6582702 - DNA, 16 bp, Homo sapiens
ttggaaagaacattta

SEQ ID NO: 6582703 - DNA, 18 bp, Homo sapiens
ttggaaagaagaaagact

SEQ ID NO: 6582704 - DNA, 11 bp, Homo sapiens
ttggaaagact

SEQ ID NO: 6582705 - DNA, 14 bp, Homo sapiens
ttggaaagagacca

SEQ ID NO: 6582706 - DNA, 18 bp, Homo sapiens
ttggaaagagaccagcac

SEQ ID NO: 6582707 - DNA, 18 bp, Homo sapiens
ttggaaagagtaggaaga

SEQ ID NO: 6582708 - DNA, 21 bp, Homo sapiens
ttggaaagcaggtggcatctc

SEQ ID NO: 6582709 - DNA, 22 bp, Homo sapiens
ttggaaagcatcacctcaggcc

SEQ ID NO: 6582710 - DNA, 19 bp, Homo sapiens
ttggaaagggaagatctta

SEQ ID NO: 6582711 - DNA, 17 bp, Homo sapiens
ttggaaagtacactctg

SEQ ID NO: 6582712 - DNA, 19 bp, Homo sapiens
ttggaaagtccaagccgta

SEQ ID NO: 6582713 - DNA, 15 bp, Homo sapiens
ttggaaagtgccagc

SEQ ID NO: 6582714 - DNA, 20 bp, Homo sapiens
ttggaaagtgccagcattcc

SEQ ID NO: 6582715 - DNA, 21 bp, Homo sapiens
ttggaaagtgccagcattcca

SEQ ID NO: 6582716 - DNA, 16 bp, Homo sapiens
ttggaaagttactgta

SEQ ID NO: 6582717 - DNA, 15 bp, Homo sapiens
ttggaaataaaagat

SEQ ID NO: 6582718 - DNA, 21 bp, Homo sapiens
ttggaaataaagtcagatgga

SEQ ID NO: 6582719 - DNA, 13 bp, Homo sapiens
ttggaaataataa

SEQ ID NO: 6582720 - DNA, 17 bp, Homo sapiens
ttggaaataataaatta

SEQ ID NO: 6582721 - DNA, 20 bp, Homo sapiens
ttggaaatagaaagaagcca

SEQ ID NO: 6582722 - DNA, 23 bp, Homo sapiens
ttggaaatagaaagaagccatat

SEQ ID NO: 6582723 - DNA, 22 bp, Homo sapiens
ttggaaatagaaatttccagag

SEQ ID NO: 6582724 - DNA, 21 bp, Homo sapiens
ttggaaatcaaatgtaaagtt

SEQ ID NO: 6582725 - DNA, 24 bp, Homo sapiens
ttggaaatcctagtttcctctcct

SEQ ID NO: 6582726 - DNA, 16 bp, Homo sapiens
ttggaaatgtgttttt

SEQ ID NO: 6582727 - DNA, 21 bp, Homo sapiens
ttggaaattaggttgaaacat

SEQ ID NO: 6582728 - DNA, 23 bp, Homo sapiens
ttggaaattaggttgaaacatat

SEQ ID NO: 6582729 - DNA, 22 bp, Homo sapiens
ttggaaattgggtgtgccctgg

SEQ ID NO: 6582730 - DNA, 14 bp, Homo sapiens
ttggaaattgttaa

SEQ ID NO: 6582731 - DNA, 16 bp, Homo sapiens
ttggaaatttggaaga

SEQ ID NO: 6582732 - DNA, 16 bp, Homo sapiens
ttggaacaaagtgaag

SEQ ID NO: 6582733 - DNA, 20 bp, Homo sapiens
ttggaacaacgcataggaaa

SEQ ID NO: 6582734 - DNA, 14 bp, Homo sapiens
ttggaacaattatt

SEQ ID NO: 6582735 - DNA, 23 bp, Homo sapiens
ttggaacagacctcactgctttg

SEQ ID NO: 6582736 - DNA, 20 bp, Homo sapiens
ttggaacagtaatcagtttg

SEQ ID NO: 6582737 - DNA, 14 bp, Homo sapiens
ttggaacatttctt

SEQ ID NO: 6582738 - DNA, 22 bp, Homo sapiens
ttggaacatttctttcttgctg

SEQ ID NO: 6582739 - DNA, 23 bp, Homo sapiens
ttggaacatttctttcttgctgg

SEQ ID NO: 6582740 - DNA, 22 bp, Homo sapiens
ttggaaccacggagatctcctt

SEQ ID NO: 6582741 - DNA, 13 bp, Homo sapiens
ttggaaccagact

SEQ ID NO: 6582742 - DNA, 21 bp, Homo sapiens
ttggaaccgtgtccagcacag

SEQ ID NO: 6582743 - DNA, 20 bp, Homo sapiens
ttggaactaacacgtgatgt

SEQ ID NO: 6582744 - DNA, 18 bp, Homo sapiens
ttggaactctaccctggt

SEQ ID NO: 6582745 - DNA, 17 bp, Homo sapiens
ttggaactgcaatgaaa

SEQ ID NO: 6582746 - DNA, 13 bp, Homo sapiens
ttggaactggagg

SEQ ID NO: 6582747 - DNA, 15 bp, Homo sapiens
ttggaactgtgtttc

SEQ ID NO: 6582748 - DNA, 22 bp, Homo sapiens
ttggaactgtgtttcaaatgga

SEQ ID NO: 6582749 - DNA, 19 bp, Homo sapiens
ttggaagaaaaaaatcttc

SEQ ID NO: 6582750 - DNA, 13 bp, Homo sapiens
ttggaagaattca

SEQ ID NO: 6582751 - DNA, 18 bp, Homo sapiens
ttggaagaattcatgatg

SEQ ID NO: 6582752 - DNA, 17 bp, Homo sapiens
ttggaagacatatatta

SEQ ID NO: 6582753 - DNA, 19 bp, Homo sapiens
ttggaagacatatattata

SEQ ID NO: 6582754 - DNA, 13 bp, Homo sapiens
ttggaagagaatc

SEQ ID NO: 6582755 - DNA, 14 bp, Homo sapiens
ttggaagagagaat

SEQ ID NO: 6582756 - DNA, 21 bp, Homo sapiens
ttggaagagaggcacctgctg

SEQ ID NO: 6582757 - DNA, 22 bp, Homo sapiens
ttggaagagaggcacctgctgg

SEQ ID NO: 6582758 - DNA, 22 bp, Homo sapiens
ttggaagagcagcacctcctca

SEQ ID NO: 6582759 - DNA, 19 bp, Homo sapiens
ttggaagatcctgtgagga

SEQ ID NO: 6582760 - DNA, 21 bp, Homo sapiens
ttggaagatcctgtgaggagc

SEQ ID NO: 6582761 - DNA, 23 bp, Homo sapiens
ttggaagatgcagaagcaataat

SEQ ID NO: 6582762 - DNA, 21 bp, Homo sapiens
ttggaagattctatttaattg

SEQ ID NO: 6582763 - DNA, 19 bp, Homo sapiens
ttggaagattttcagtcta

SEQ ID NO: 6582764 - DNA, 22 bp, Homo sapiens
ttggaagcacaccaatcttact

SEQ ID NO: 6582765 - DNA, 19 bp, Homo sapiens
ttggaagcagcaaggtggg

SEQ ID NO: 6582766 - DNA, 18 bp, Homo sapiens
ttggaagcaggttaaatg

SEQ ID NO: 6582767 - DNA, 19 bp, Homo sapiens
ttggaagcaggttaaatgt

SEQ ID NO: 6582768 - DNA, 20 bp, Homo sapiens
ttggaagcaggttaaatgtt

SEQ ID NO: 6582769 - DNA, 17 bp, Homo sapiens
ttggaagctaccagagc

SEQ ID NO: 6582770 - DNA, 22 bp, Homo sapiens
ttggaagctagctcccctcctc

SEQ ID NO: 6582771 - DNA, 17 bp, Homo sapiens
ttggaagctctgaagtc

SEQ ID NO: 6582772 - DNA, 18 bp, Homo sapiens
ttggaagctgtttggaaa

SEQ ID NO: 6582773 - DNA, 21 bp, Homo sapiens
ttggaagctgtttggaaaaga

SEQ ID NO: 6582774 - DNA, 22 bp, Homo sapiens
ttggaagctttggttatgaaac

SEQ ID NO: 6582775 - DNA, 13 bp, Homo sapiens
ttggaaggagaca

SEQ ID NO: 6582776 - DNA, 18 bp, Homo sapiens
ttggaaggatctgctgag

SEQ ID NO: 6582777 - DNA, 20 bp, Homo sapiens
ttggaaggatctgctgaggc

SEQ ID NO: 6582778 - DNA, 15 bp, Homo sapiens
ttggaagggaaaaaa

SEQ ID NO: 6582779 - DNA, 20 bp, Homo sapiens
ttggaagggaaaaaaaatgt

SEQ ID NO: 6582780 - DNA, 22 bp, Homo sapiens
ttggaagggtccaccctagcct

SEQ ID NO: 6582781 - DNA, 22 bp, Homo sapiens
ttggaaggtagagcccactgct

SEQ ID NO: 6582782 - DNA, 15 bp, Homo sapiens
ttggaagtacatgaa

SEQ ID NO: 6582783 - DNA, 16 bp, Homo sapiens
ttggaagtgaaattag

SEQ ID NO: 6582784 - DNA, 17 bp, Homo sapiens
ttggaagtttagctctg

SEQ ID NO: 6582785 - DNA, 13 bp, Homo sapiens
ttggaataaagag

SEQ ID NO: 6582786 - DNA, 22 bp, Homo sapiens
ttggaataataattttcctcct

SEQ ID NO: 6582787 - DNA, 15 bp, Homo sapiens
ttggaataatttcta

SEQ ID NO: 6582788 - DNA, 16 bp, Homo sapiens
ttggaatacacatgca

SEQ ID NO: 6582789 - DNA, 15 bp, Homo sapiens
ttggaataggaataa

SEQ ID NO: 6582790 - DNA, 15 bp, Homo sapiens
ttggaatattacaat

SEQ ID NO: 6582791 - DNA, 15 bp, Homo sapiens
ttggaatatttgaat

SEQ ID NO: 6582792 - DNA, 23 bp, Homo sapiens
ttggaatattttatcctgtattc

SEQ ID NO: 6582793 - DNA, 20 bp, Homo sapiens
ttggaatcccacttatcaaa

SEQ ID NO: 6582794 - DNA, 21 bp, Homo sapiens
ttggaatctagaagaaatgaa

SEQ ID NO: 6582795 - DNA, 14 bp, Homo sapiens
ttggaatcttcacc

SEQ ID NO: 6582796 - DNA, 21 bp, Homo sapiens
ttggaatgactataaacatta

SEQ ID NO: 6582797 - DNA, 21 bp, Homo sapiens
ttggaatgcactcagactgta

SEQ ID NO: 6582798 - DNA, 16 bp, Homo sapiens
ttggaatgcttcttct

SEQ ID NO: 6582799 - DNA, 22 bp, Homo sapiens
ttggaatggaactactgtactt

SEQ ID NO: 6582800 - DNA, 23 bp, Homo sapiens
ttggaatggaactactgtacttt

SEQ ID NO: 6582801 - DNA, 20 bp, Homo sapiens
ttggaatgggagtctgaaat

SEQ ID NO: 6582802 - DNA, 22 bp, Homo sapiens
ttggaatgggagtctgaaatgg

SEQ ID NO: 6582803 - DNA, 11 bp, Homo sapiens
ttggaatgttg

SEQ ID NO: 6582804 - DNA, 17 bp, Homo sapiens
ttggaattaacctggtg

SEQ ID NO: 6582805 - DNA, 20 bp, Homo sapiens
ttggaattaacctggtgctg

SEQ ID NO: 6582806 - DNA, 15 bp, Homo sapiens
ttggaattagatgtt

SEQ ID NO: 6582807 - DNA, 13 bp, Homo sapiens
ttggaattcaatg

SEQ ID NO: 6582808 - DNA, 19 bp, Homo sapiens
ttggaatttgtaacctcag

SEQ ID NO: 6582809 - DNA, 14 bp, Homo sapiens
ttggaattttaagt

SEQ ID NO: 6582810 - DNA, 13 bp, Homo sapiens
ttggaattttctt

SEQ ID NO: 6582811 - DNA, 20 bp, Homo sapiens
ttggacaaacctagaatttt

SEQ ID NO: 6582812 - DNA, 15 bp, Homo sapiens
ttggacaaatgtgaa

SEQ ID NO: 6582813 - DNA, 14 bp, Homo sapiens
ttggacaagaggaa

SEQ ID NO: 6582814 - DNA, 15 bp, Homo sapiens
ttggacaagaggaaa

SEQ ID NO: 6582815 - DNA, 17 bp, Homo sapiens
ttggacaagcttctgag

SEQ ID NO: 6582816 - DNA, 19 bp, Homo sapiens
ttggacaatctgcaaaatg

SEQ ID NO: 6582817 - DNA, 16 bp, Homo sapiens
ttggacacacacagct

SEQ ID NO: 6582818 - DNA, 17 bp, Homo sapiens
ttggacacactgtaaac

SEQ ID NO: 6582819 - DNA, 13 bp, Homo sapiens
ttggacacagtgt

SEQ ID NO: 6582820 - DNA, 15 bp, Homo sapiens
ttggacactgtacaa

SEQ ID NO: 6582821 - DNA, 18 bp, Homo sapiens
ttggacacttaattctgt

SEQ ID NO: 6582822 - DNA, 16 bp, Homo sapiens
ttggacagaaaatgca

SEQ ID NO: 6582823 - DNA, 16 bp, Homo sapiens
ttggacagaagcagct

SEQ ID NO: 6582824 - DNA, 14 bp, Homo sapiens
ttggacagacactg

SEQ ID NO: 6582825 - DNA, 17 bp, Homo sapiens
ttggacagacactgttg

SEQ ID NO: 6582826 - DNA, 22 bp, Homo sapiens
ttggacagacactgttgcaaag

SEQ ID NO: 6582827 - DNA, 23 bp, Homo sapiens
ttggacagacccacccccagcct

SEQ ID NO: 6582828 - DNA, 18 bp, Homo sapiens
ttggacagcaaaaccatt

SEQ ID NO: 6582829 - DNA, 23 bp, Homo sapiens
ttggacagcaaaaccattgcttc

SEQ ID NO: 6582830 - DNA, 13 bp, Homo sapiens
ttggacagccccc

SEQ ID NO: 6582831 - DNA, 12 bp, Homo sapiens
ttggacagctga

SEQ ID NO: 6582832 - DNA, 21 bp, Homo sapiens
ttggacagctgactgaatgca

SEQ ID NO: 6582833 - DNA, 13 bp, Homo sapiens
ttggacagctgct

SEQ ID NO: 6582834 - DNA, 18 bp, Homo sapiens
ttggacaggagatcagca

SEQ ID NO: 6582835 - DNA, 16 bp, Homo sapiens
ttggacagtctccctg

SEQ ID NO: 6582836 - DNA, 15 bp, Homo sapiens
ttggacagtggcctc

SEQ ID NO: 6582837 - DNA, 23 bp, Homo sapiens
ttggacatagatattttcacaat

SEQ ID NO: 6582838 - DNA, 20 bp, Homo sapiens
ttggacatcagtgtttgttg

SEQ ID NO: 6582839 - DNA, 14 bp, Homo sapiens
ttggacatcctcct

SEQ ID NO: 6582840 - DNA, 17 bp, Homo sapiens
ttggacatctctctggc

SEQ ID NO: 6582841 - DNA, 18 bp, Homo sapiens
ttggacatgggccccaga

SEQ ID NO: 6582842 - DNA, 18 bp, Homo sapiens
ttggacatttatgtacaa

SEQ ID NO: 6582843 - DNA, 19 bp, Homo sapiens
ttggacatttatgtacaaa

SEQ ID NO: 6582844 - DNA, 12 bp, Homo sapiens
ttggacatttta

SEQ ID NO: 6582845 - DNA, 17 bp, Homo sapiens
ttggaccacatctcttt

SEQ ID NO: 6582846 - DNA, 18 bp, Homo sapiens
ttggaccactcctgtccc

SEQ ID NO: 6582847 - DNA, 18 bp, Homo sapiens
ttggaccagtttgcagag

SEQ ID NO: 6582848 - DNA, 15 bp, Homo sapiens
ttggaccatgccaga

SEQ ID NO: 6582849 - DNA, 19 bp, Homo sapiens
ttggacccaaggaaaactg

SEQ ID NO: 6582850 - DNA, 10 bp, Homo sapiens
ttggacccac

SEQ ID NO: 6582851 - DNA, 14 bp, Homo sapiens
ttggacccacctgt

SEQ ID NO: 6582852 - DNA, 15 bp, Homo sapiens
ttggacccagggcct

SEQ ID NO: 6582853 - DNA, 16 bp, Homo sapiens
ttggacccagggcctg

SEQ ID NO: 6582854 - DNA, 19 bp, Homo sapiens
ttggacccagggcctgact

SEQ ID NO: 6582855 - DNA, 21 bp, Homo sapiens
ttggacccagggcctgacttg

SEQ ID NO: 6582856 - DNA, 14 bp, Homo sapiens
ttggaccccagaga

SEQ ID NO: 6582857 - DNA, 13 bp, Homo sapiens
ttggaccccagct

SEQ ID NO: 6582858 - DNA, 22 bp, Homo sapiens
ttggaccccagctgggaggcaa

SEQ ID NO: 6582859 - DNA, 17 bp, Homo sapiens
ttggacccgctctggac

SEQ ID NO: 6582860 - DNA, 21 bp, Homo sapiens
ttggaccctgaggcccagagg

SEQ ID NO: 6582861 - DNA, 16 bp, Homo sapiens
ttggacccttccatgg

SEQ ID NO: 6582862 - DNA, 15 bp, Homo sapiens
ttggacctccagggg

SEQ ID NO: 6582863 - DNA, 18 bp, Homo sapiens
ttggacctcgtgctttaa

SEQ ID NO: 6582864 - DNA, 13 bp, Homo sapiens
ttggacctctgct

SEQ ID NO: 6582865 - DNA, 17 bp, Homo sapiens
ttggacctctgctctga

SEQ ID NO: 6582866 - DNA, 21 bp, Homo sapiens
ttggacctctgctctgaggct

SEQ ID NO: 6582867 - DNA, 23 bp, Homo sapiens
ttggacctgcagttggcctcagc

SEQ ID NO: 6582868 - DNA, 15 bp, Homo sapiens
ttggacgcacacagc

SEQ ID NO: 6582869 - DNA, 21 bp, Homo sapiens
ttggacggcctgatgctccct

SEQ ID NO: 6582870 - DNA, 21 bp, Homo sapiens
ttggacgggatgacctccaga

SEQ ID NO: 6582871 - DNA, 23 bp, Homo sapiens
ttggactaaatgcctagttttta

SEQ ID NO: 6582872 - DNA, 15 bp, Homo sapiens
ttggactacctataa

SEQ ID NO: 6582873 - DNA, 18 bp, Homo sapiens
ttggactagccagaattc

SEQ ID NO: 6582874 - DNA, 13 bp, Homo sapiens
ttggactattata

SEQ ID NO: 6582875 - DNA, 14 bp, Homo sapiens
ttggactccaggcc

SEQ ID NO: 6582876 - DNA, 16 bp, Homo sapiens
ttggactccaggcctg

SEQ ID NO: 6582877 - DNA, 14 bp, Homo sapiens
ttggactcctccca

SEQ ID NO: 6582878 - DNA, 13 bp, Homo sapiens
ttggactctcagg

SEQ ID NO: 6582879 - DNA, 16 bp, Homo sapiens
ttggactctctgtggt

SEQ ID NO: 6582880 - DNA, 20 bp, Homo sapiens
ttggactctctgtggtccct

SEQ ID NO: 6582881 - DNA, 15 bp, Homo sapiens
ttggactcttgctct

SEQ ID NO: 6582882 - DNA, 16 bp, Homo sapiens
ttggactgagatttct

SEQ ID NO: 6582883 - DNA, 15 bp, Homo sapiens
ttggactgttttcaa

SEQ ID NO: 6582884 - DNA, 19 bp, Homo sapiens
ttggactgttttgaaaagt

SEQ ID NO: 6582885 - DNA, 14 bp, Homo sapiens
ttggactttcaaaa

SEQ ID NO: 6582886 - DNA, 12 bp, Homo sapiens
ttggagaaaaaa

SEQ ID NO: 6582887 - DNA, 14 bp, Homo sapiens
ttggagaaaagcac

SEQ ID NO: 6582888 - DNA, 23 bp, Homo sapiens
ttggagaaaagcacttaaagttt

SEQ ID NO: 6582889 - DNA, 12 bp, Homo sapiens
ttggagaaaatg

SEQ ID NO: 6582890 - DNA, 14 bp, Homo sapiens
ttggagaaattatt

SEQ ID NO: 6582891 - DNA, 17 bp, Homo sapiens
ttggagaagaactgaaa

SEQ ID NO: 6582892 - DNA, 19 bp, Homo sapiens
ttggagaaggtctgtggtg

SEQ ID NO: 6582893 - DNA, 22 bp, Homo sapiens
ttggagaaggtctgtggtgcag

SEQ ID NO: 6582894 - DNA, 18 bp, Homo sapiens
ttggagaatactgccaaa

SEQ ID NO: 6582895 - DNA, 22 bp, Homo sapiens
ttggagacccgcctggctaaca

SEQ ID NO: 6582896 - DNA, 13 bp, Homo sapiens
ttggagactctgt

SEQ ID NO: 6582897 - DNA, 20 bp, Homo sapiens
ttggagactctgtggggcct

SEQ ID NO: 6582898 - DNA, 23 bp, Homo sapiens
ttggagactggggtggcctcaag

SEQ ID NO: 6582899 - DNA, 21 bp, Homo sapiens
ttggagacttaacagcatttg

SEQ ID NO: 6582900 - DNA, 15 bp, Homo sapiens
ttggagagacacagc

SEQ ID NO: 6582901 - DNA, 22 bp, Homo sapiens
ttggagagagaggctgcctcag

SEQ ID NO: 6582902 - DNA, 12 bp, Homo sapiens
ttggagagccct

SEQ ID NO: 6582903 - DNA, 13 bp, Homo sapiens
ttggagagccctg

SEQ ID NO: 6582904 - DNA, 19 bp, Homo sapiens
ttggagagctcagtacagg

SEQ ID NO: 6582905 - DNA, 19 bp, Homo sapiens
ttggagagggacgaagaaa

SEQ ID NO: 6582906 - DNA, 13 bp, Homo sapiens
ttggagagtaaaa

SEQ ID NO: 6582907 - DNA, 17 bp, Homo sapiens
ttggagagttaaatggt

SEQ ID NO: 6582908 - DNA, 18 bp, Homo sapiens
ttggagagtttcctgaaa

SEQ ID NO: 6582909 - DNA, 20 bp, Homo sapiens
ttggagataatctagaacac

SEQ ID NO: 6582910 - DNA, 14 bp, Homo sapiens
ttggagatgcagcc

SEQ ID NO: 6582911 - DNA, 22 bp, Homo sapiens
ttggagatgctgagggtgtttc

SEQ ID NO: 6582912 - DNA, 20 bp, Homo sapiens
ttggagcaaagaaggagctg

SEQ ID NO: 6582913 - DNA, 14 bp, Homo sapiens
ttggagcaatcaga

SEQ ID NO: 6582914 - DNA, 21 bp, Homo sapiens
ttggagcacaaaattcaaagc

SEQ ID NO: 6582915 - DNA, 19 bp, Homo sapiens
ttggagcactagtttgatt

SEQ ID NO: 6582916 - DNA, 22 bp, Homo sapiens
ttggagcactgttctgggactc

SEQ ID NO: 6582917 - DNA, 20 bp, Homo sapiens
ttggagcagcaggcctctgg

SEQ ID NO: 6582918 - DNA, 17 bp, Homo sapiens
ttggagcattaactaaa

SEQ ID NO: 6582919 - DNA, 16 bp, Homo sapiens
ttggagcatttatgta

SEQ ID NO: 6582920 - DNA, 15 bp, Homo sapiens
ttggagcccagggca

SEQ ID NO: 6582921 - DNA, 15 bp, Homo sapiens
ttggagccccctggc

SEQ ID NO: 6582922 - DNA, 14 bp, Homo sapiens
ttggagcccgtgca

SEQ ID NO: 6582923 - DNA, 21 bp, Homo sapiens
ttggagcctcccttctgcctt

SEQ ID NO: 6582924 - DNA, 13 bp, Homo sapiens
ttggagcctgcag

SEQ ID NO: 6582925 - DNA, 18 bp, Homo sapiens
ttggagcctgcagagctg

SEQ ID NO: 6582926 - DNA, 16 bp, Homo sapiens
ttggagcgtggactgg

SEQ ID NO: 6582927 - DNA, 16 bp, Homo sapiens
ttggagctattcaaga

SEQ ID NO: 6582928 - DNA, 11 bp, Homo sapiens
ttggagctgac

SEQ ID NO: 6582929 - DNA, 21 bp, Homo sapiens
ttggagctgactgttcttggt

SEQ ID NO: 6582930 - DNA, 14 bp, Homo sapiens
ttggagcttcatgg

SEQ ID NO: 6582931 - DNA, 17 bp, Homo sapiens
ttggagctttggaatat

SEQ ID NO: 6582932 - DNA, 20 bp, Homo sapiens
ttggagctttggaatatttt

SEQ ID NO: 6582933 - DNA, 17 bp, Homo sapiens
ttggagctttttcaaaa

SEQ ID NO: 6582934 - DNA, 13 bp, Homo sapiens
ttggaggagagag

SEQ ID NO: 6582935 - DNA, 12 bp, Homo sapiens
ttggaggatttg

SEQ ID NO: 6582936 - DNA, 22 bp, Homo sapiens
ttggaggcaacctcccatttta

SEQ ID NO: 6582937 - DNA, 15 bp, Homo sapiens
ttggaggccagccag

SEQ ID NO: 6582938 - DNA, 20 bp, Homo sapiens
ttggaggcctcaccctgctt

SEQ ID NO: 6582939 - DNA, 22 bp, Homo sapiens
ttggaggcctcagatagacctg

SEQ ID NO: 6582940 - DNA, 16 bp, Homo sapiens
ttggaggccttccctg

SEQ ID NO: 6582941 - DNA, 18 bp, Homo sapiens
ttggaggctgagttctgg

SEQ ID NO: 6582942 - DNA, 16 bp, Homo sapiens
ttggaggctgcagtga

SEQ ID NO: 6582943 - DNA, 14 bp, Homo sapiens
ttggaggctgctgc

SEQ ID NO: 6582944 - DNA, 17 bp, Homo sapiens
ttggaggctgctgcccc

SEQ ID NO: 6582945 - DNA, 16 bp, Homo sapiens
ttggagggaaagccag

SEQ ID NO: 6582946 - DNA, 22 bp, Homo sapiens
ttggagggaaatcttggtgtaa

SEQ ID NO: 6582947 - DNA, 16 bp, Homo sapiens
ttggagggaagggaga

SEQ ID NO: 6582948 - DNA, 11 bp, Homo sapiens
ttggagggaga

SEQ ID NO: 6582949 - DNA, 16 bp, Homo sapiens
ttggaggggcaggcct

SEQ ID NO: 6582950 - DNA, 19 bp, Homo sapiens
ttggaggggtttatgctca

SEQ ID NO: 6582951 - DNA, 21 bp, Homo sapiens
ttggagggtcccaagctgggc

SEQ ID NO: 6582952 - DNA, 23 bp, Homo sapiens
ttggagggtcccaagctgggccc

SEQ ID NO: 6582953 - DNA, 17 bp, Homo sapiens
ttggagggtctgggggc

SEQ ID NO: 6582954 - DNA, 20 bp, Homo sapiens
aatacagtatctcagggcct

SEQ ID NO: 6582955 - DNA, 13 bp, Homo sapiens
aatacagtattat

SEQ ID NO: 6582956 - DNA, 22 bp, Homo sapiens
aatacagtattatttagtaaaa

SEQ ID NO: 6582957 - DNA, 15 bp, Homo sapiens
aatacagtcaactta

SEQ ID NO: 6582958 - DNA, 15 bp, Homo sapiens
aatacagtgagctct

SEQ ID NO: 6582959 - DNA, 16 bp, Homo sapiens
aatacagtggatctca

SEQ ID NO: 6582960 - DNA, 12 bp, Homo sapiens
aatacagtgtta

SEQ ID NO: 6582961 - DNA, 16 bp, Homo sapiens
aatacagttatttcat

SEQ ID NO: 6582962 - DNA, 17 bp, Homo sapiens
aatacagttctgctctg

SEQ ID NO: 6582963 - DNA, 18 bp, Homo sapiens
aatacagttgttggcctc

SEQ ID NO: 6582964 - DNA, 22 bp, Homo sapiens
aatacagtttataaagccaaga

SEQ ID NO: 6582965 - DNA, 13 bp, Homo sapiens
aatacataaaaga

SEQ ID NO: 6582966 - DNA, 14 bp, Homo sapiens
aatacataacttca

SEQ ID NO: 6582967 - DNA, 17 bp, Homo sapiens
aatacataacttcagtg

SEQ ID NO: 6582968 - DNA, 23 bp, Homo sapiens
aatacataacttcagtgcaagag

SEQ ID NO: 6582969 - DNA, 14 bp, Homo sapiens
aatacatacggtca

SEQ ID NO: 6582970 - DNA, 15 bp, Homo sapiens
aatacatacggtcag

SEQ ID NO: 6582971 - DNA, 21 bp, Homo sapiens
aatacatacggtcaggtttaa

SEQ ID NO: 6582972 - DNA, 14 bp, Homo sapiens
aatacatataaaga

SEQ ID NO: 6582973 - DNA, 23 bp, Homo sapiens
aatacatatatctacacatacag

SEQ ID NO: 6582974 - DNA, 22 bp, Homo sapiens
aatacatcacatcttatttatt

SEQ ID NO: 6582975 - DNA, 17 bp, Homo sapiens
aatacatcagaaaataa

SEQ ID NO: 6582976 - DNA, 18 bp, Homo sapiens
aatacatcagaaaataaa

SEQ ID NO: 6582977 - DNA, 11 bp, Homo sapiens
aatacatctgt

SEQ ID NO: 6582978 - DNA, 16 bp, Homo sapiens
aatacatctttatcat

SEQ ID NO: 6582979 - DNA, 23 bp, Homo sapiens
aatacatctttatcattaaacat

SEQ ID NO: 6582980 - DNA, 13 bp, Homo sapiens
aatacatctttcc

SEQ ID NO: 6582981 - DNA, 14 bp, Homo sapiens
aatacatctttccc

SEQ ID NO: 6582982 - DNA, 23 bp, Homo sapiens
aatacatgacatttatttttcat

SEQ ID NO: 6582983 - DNA, 20 bp, Homo sapiens
aatacatgcaacagaagtga

SEQ ID NO: 6582984 - DNA, 12 bp, Homo sapiens
aatacatgcaca

SEQ ID NO: 6582985 - DNA, 22 bp, Homo sapiens
aatacatgtaagtgtggttttg

SEQ ID NO: 6582986 - DNA, 22 bp, Homo sapiens
aatacatgtacctatagaaata

SEQ ID NO: 6582987 - DNA, 16 bp, Homo sapiens
aatacatgtttgttgg

SEQ ID NO: 6582988 - DNA, 13 bp, Homo sapiens
aatacattaaagc

SEQ ID NO: 6582989 - DNA, 17 bp, Homo sapiens
aatacattaacaagctc

SEQ ID NO: 6582990 - DNA, 23 bp, Homo sapiens
aatacattacatgtaaattaagt

SEQ ID NO: 6582991 - DNA, 22 bp, Homo sapiens
aatacattattgaaaagcaaat

SEQ ID NO: 6582992 - DNA, 18 bp, Homo sapiens
aatacattcaaattcttt

SEQ ID NO: 6582993 - DNA, 22 bp, Homo sapiens
aatacattccatcacagccagc

SEQ ID NO: 6582994 - DNA, 15 bp, Homo sapiens
aatacattccattgt

SEQ ID NO: 6582995 - DNA, 22 bp, Homo sapiens
aatacattctttttgctctaaa

SEQ ID NO: 6582996 - DNA, 17 bp, Homo sapiens
aatacatttaaaacatt

SEQ ID NO: 6582997 - DNA, 21 bp, Homo sapiens
aatacatttaaaacattaaaa

SEQ ID NO: 6582998 - DNA, 22 bp, Homo sapiens
aatacatttagaacctgcattt

SEQ ID NO: 6582999 - DNA, 11 bp, Homo sapiens
aatacatttat

SEQ ID NO: 6583000 - DNA, 12 bp, Homo sapiens
aatacattttaa

SEQ ID NO: 6583001 - DNA, 12 bp, Homo sapiens
aatacattttat

SEQ ID NO: 6583002 - DNA, 23 bp, Homo sapiens
aatacattttgcacaaagtaagc

SEQ ID NO: 6583003 - DNA, 18 bp, Homo sapiens
aatacattttgtatatta

SEQ ID NO: 6583004 - DNA, 18 bp, Homo sapiens
aataccaaagataatgca

SEQ ID NO: 6583005 - DNA, 16 bp, Homo sapiens
aataccaaatatttta

SEQ ID NO: 6583006 - DNA, 17 bp, Homo sapiens
aataccaaatgcctgtt

SEQ ID NO: 6583007 - DNA, 20 bp, Homo sapiens
aataccaaatgcctgttgta

SEQ ID NO: 6583008 - DNA, 15 bp, Homo sapiens
aataccaactatttc

SEQ ID NO: 6583009 - DNA, 22 bp, Homo sapiens
aataccaagagcaatttacctg

SEQ ID NO: 6583010 - DNA, 16 bp, Homo sapiens
aataccacaagcctga

SEQ ID NO: 6583011 - DNA, 20 bp, Homo sapiens
aataccacagctatttagaa

SEQ ID NO: 6583012 - DNA, 19 bp, Homo sapiens
aataccacatcaaataaga

SEQ ID NO: 6583013 - DNA, 13 bp, Homo sapiens
aataccaccaaca

SEQ ID NO: 6583014 - DNA, 14 bp, Homo sapiens
aataccaccaacaa

SEQ ID NO: 6583015 - DNA, 17 bp, Homo sapiens
aataccactctgtaatt

SEQ ID NO: 6583016 - DNA, 18 bp, Homo sapiens
aataccactctgtaattg

SEQ ID NO: 6583017 - DNA, 14 bp, Homo sapiens
aataccactgtaat

SEQ ID NO: 6583018 - DNA, 17 bp, Homo sapiens
aataccacttacctcaa

SEQ ID NO: 6583019 - DNA, 16 bp, Homo sapiens
aataccagactgcagg

SEQ ID NO: 6583020 - DNA, 20 bp, Homo sapiens
aataccagagccttcaagtg

SEQ ID NO: 6583021 - DNA, 22 bp, Homo sapiens
aataccagagccttcaagtgcc

SEQ ID NO: 6583022 - DNA, 17 bp, Homo sapiens
aataccagatcactcaa

SEQ ID NO: 6583023 - DNA, 17 bp, Homo sapiens
aataccagccagtaaat

SEQ ID NO: 6583024 - DNA, 19 bp, Homo sapiens
aataccagccagtaaatgg

SEQ ID NO: 6583025 - DNA, 14 bp, Homo sapiens
aataccagtacttg

SEQ ID NO: 6583026 - DNA, 13 bp, Homo sapiens
aataccagttctg

SEQ ID NO: 6583027 - DNA, 18 bp, Homo sapiens
aataccattaaaactgct

SEQ ID NO: 6583028 - DNA, 16 bp, Homo sapiens
aataccattgaaatca

SEQ ID NO: 6583029 - DNA, 15 bp, Homo sapiens
aataccatttagtaa

SEQ ID NO: 6583030 - DNA, 12 bp, Homo sapiens
aatacccacatt

SEQ ID NO: 6583031 - DNA, 11 bp, Homo sapiens
aataccccacc

SEQ ID NO: 6583032 - DNA, 14 bp, Homo sapiens
aatacccccagaga

SEQ ID NO: 6583033 - DNA, 17 bp, Homo sapiens
aatacccccagagacct

SEQ ID NO: 6583034 - DNA, 14 bp, Homo sapiens
aatacccgtcctct

SEQ ID NO: 6583035 - DNA, 15 bp, Homo sapiens
aataccctactgtgg

SEQ ID NO: 6583036 - DNA, 21 bp, Homo sapiens
aataccctgtacatatctttg

SEQ ID NO: 6583037 - DNA, 20 bp, Homo sapiens
aataccctgtctttaaaaat

SEQ ID NO: 6583038 - DNA, 21 bp, Homo sapiens
aataccgacgtctatcctttc

SEQ ID NO: 6583039 - DNA, 16 bp, Homo sapiens
aataccgctcagtatt

SEQ ID NO: 6583040 - DNA, 15 bp, Homo sapiens
aatacctcaatgttt

SEQ ID NO: 6583041 - DNA, 14 bp, Homo sapiens
aatacctcatgttt

SEQ ID NO: 6583042 - DNA, 19 bp, Homo sapiens
aatacctcatgtttatgaa

SEQ ID NO: 6583043 - DNA, 19 bp, Homo sapiens
aatacctccattaaatggt

SEQ ID NO: 6583044 - DNA, 15 bp, Homo sapiens
aatacctctaatagt

SEQ ID NO: 6583045 - DNA, 13 bp, Homo sapiens
aatacctctgtgt

SEQ ID NO: 6583046 - DNA, 19 bp, Homo sapiens
aatacctcttactttgctt

SEQ ID NO: 6583047 - DNA, 19 bp, Homo sapiens
aatacctctttgaaagaag

SEQ ID NO: 6583048 - DNA, 17 bp, Homo sapiens
aatacctgaatgctctg

SEQ ID NO: 6583049 - DNA, 18 bp, Homo sapiens
aatacctgaatgctctgt

SEQ ID NO: 6583050 - DNA, 18 bp, Homo sapiens
aatacctgattgatcaca

SEQ ID NO: 6583051 - DNA, 20 bp, Homo sapiens
aatacctggcctcatttaaa

SEQ ID NO: 6583052 - DNA, 17 bp, Homo sapiens
aataccttctatgtatt

SEQ ID NO: 6583053 - DNA, 16 bp, Homo sapiens
aatacctttaaatatc

SEQ ID NO: 6583054 - DNA, 19 bp, Homo sapiens
aatacctttaaatatcatt

SEQ ID NO: 6583055 - DNA, 15 bp, Homo sapiens
aatacctttggaaaa

SEQ ID NO: 6583056 - DNA, 16 bp, Homo sapiens
aatacctttggaaaaa

SEQ ID NO: 6583057 - DNA, 17 bp, Homo sapiens
aatacctttggaaaaat

SEQ ID NO: 6583058 - DNA, 18 bp, Homo sapiens
aatacctttgtagttact

SEQ ID NO: 6583059 - DNA, 20 bp, Homo sapiens
aatacgatcctgcagggtag

SEQ ID NO: 6583060 - DNA, 21 bp, Homo sapiens
aatacgctaagcctggaagcc

SEQ ID NO: 6583061 - DNA, 13 bp, Homo sapiens
aatacgcttgagc

SEQ ID NO: 6583062 - DNA, 17 bp, Homo sapiens
aatacgtaattcttcct

SEQ ID NO: 6583063 - DNA, 20 bp, Homo sapiens
aatacgtaattcttcctgtt

SEQ ID NO: 6583064 - DNA, 17 bp, Homo sapiens
aatacgtgccagatata

SEQ ID NO: 6583065 - DNA, 20 bp, Homo sapiens
aatacgtgccagatataact

SEQ ID NO: 6583066 - DNA, 14 bp, Homo sapiens
aatacgtgttcaaa

SEQ ID NO: 6583067 - DNA, 18 bp, Homo sapiens
aatacgttaggaggacaa

SEQ ID NO: 6583068 - DNA, 18 bp, Homo sapiens
aatacgttgttaaatggt

SEQ ID NO: 6583069 - DNA, 15 bp, Homo sapiens
aatacgttttgacat

SEQ ID NO: 6583070 - DNA, 21 bp, Homo sapiens
aatacgttttgtgtatatttg

SEQ ID NO: 6583071 - DNA, 16 bp, Homo sapiens
aatactaaaactcaga

SEQ ID NO: 6583072 - DNA, 19 bp, Homo sapiens
aatactaaaagcaaatcta

SEQ ID NO: 6583073 - DNA, 14 bp, Homo sapiens
aatactaaatatga

SEQ ID NO: 6583074 - DNA, 16 bp, Homo sapiens
aatactaaatatgaaa

SEQ ID NO: 6583075 - DNA, 13 bp, Homo sapiens
aatactaaatggt

SEQ ID NO: 6583076 - DNA, 18 bp, Homo sapiens
aatactaataaaatacat

SEQ ID NO: 6583077 - DNA, 21 bp, Homo sapiens
aatactaatagcctaaaagat

SEQ ID NO: 6583078 - DNA, 14 bp, Homo sapiens
aatactaatgtaaa

SEQ ID NO: 6583079 - DNA, 18 bp, Homo sapiens
aatactaatgttatttct

SEQ ID NO: 6583080 - DNA, 19 bp, Homo sapiens
aatactaatgttatttctt

SEQ ID NO: 6583081 - DNA, 18 bp, Homo sapiens
aatactaattttccataa

SEQ ID NO: 6583082 - DNA, 18 bp, Homo sapiens
aatactacaatagtttta

SEQ ID NO: 6583083 - DNA, 16 bp, Homo sapiens
aatactacacatccaa

SEQ ID NO: 6583084 - DNA, 21 bp, Homo sapiens
aatactaccttgaaaataaga

SEQ ID NO: 6583085 - DNA, 22 bp, Homo sapiens
aatactaggatacagaaatgca

SEQ ID NO: 6583086 - DNA, 14 bp, Homo sapiens
aatactagttgtga

SEQ ID NO: 6583087 - DNA, 20 bp, Homo sapiens
aatactatagttatatagat

SEQ ID NO: 6583088 - DNA, 17 bp, Homo sapiens
aatactatattaaattc

SEQ ID NO: 6583089 - DNA, 20 bp, Homo sapiens
aatactatattaaattctga

SEQ ID NO: 6583090 - DNA, 21 bp, Homo sapiens
aatactatatttatactgtat

SEQ ID NO: 6583091 - DNA, 14 bp, Homo sapiens
aatactatccaaat

SEQ ID NO: 6583092 - DNA, 17 bp, Homo sapiens
aatactatccatgtaat

SEQ ID NO: 6583093 - DNA, 22 bp, Homo sapiens
aatactatccatgtaataagca

SEQ ID NO: 6583094 - DNA, 21 bp, Homo sapiens
aatactatgcagtatctctta

SEQ ID NO: 6583095 - DNA, 14 bp, Homo sapiens
aatactatttaaga

SEQ ID NO: 6583096 - DNA, 21 bp, Homo sapiens
aatactatttttactgccact

SEQ ID NO: 6583097 - DNA, 14 bp, Homo sapiens
aatactcacatttt

SEQ ID NO: 6583098 - DNA, 22 bp, Homo sapiens
aatactcaccaaaatatagtta

SEQ ID NO: 6583099 - DNA, 14 bp, Homo sapiens
aatactcacctcct

SEQ ID NO: 6583100 - DNA, 16 bp, Homo sapiens
aatactcataatgtga

SEQ ID NO: 6583101 - DNA, 19 bp, Homo sapiens
aatactcataatgtgaagt

SEQ ID NO: 6583102 - DNA, 14 bp, Homo sapiens
aatactcatcagag

SEQ ID NO: 6583103 - DNA, 14 bp, Homo sapiens
aatactcatgtgca

SEQ ID NO: 6583104 - DNA, 13 bp, Homo sapiens
aatactcatgtgt

SEQ ID NO: 6583105 - DNA, 15 bp, Homo sapiens
aatactcatgtgtat

SEQ ID NO: 6583106 - DNA, 16 bp, Homo sapiens
aatactcatgtgtatg

SEQ ID NO: 6583107 - DNA, 16 bp, Homo sapiens
aatactccaagcttca

SEQ ID NO: 6583108 - DNA, 15 bp, Homo sapiens
aatactccagagaca

SEQ ID NO: 6583109 - DNA, 16 bp, Homo sapiens
aatactccattatttt

SEQ ID NO: 6583110 - DNA, 17 bp, Homo sapiens
aatactccctttaaaga

SEQ ID NO: 6583111 - DNA, 18 bp, Homo sapiens
aatactccctttaaagag

SEQ ID NO: 6583112 - DNA, 19 bp, Homo sapiens
aatactccctttaaagaga

SEQ ID NO: 6583113 - DNA, 17 bp, Homo sapiens
aatactctaattctaac

SEQ ID NO: 6583114 - DNA, 17 bp, Homo sapiens
aatactctacttacagt

SEQ ID NO: 6583115 - DNA, 12 bp, Homo sapiens
aatactctattt

SEQ ID NO: 6583116 - DNA, 18 bp, Homo sapiens
aatactctatttttacat

SEQ ID NO: 6583117 - DNA, 13 bp, Homo sapiens
aatactctctgag

SEQ ID NO: 6583118 - DNA, 19 bp, Homo sapiens
aatactcttaaattttata

SEQ ID NO: 6583119 - DNA, 23 bp, Homo sapiens
aatactcttaggaagagaaacca

SEQ ID NO: 6583120 - DNA, 15 bp, Homo sapiens
aatactcttgaaagg

SEQ ID NO: 6583121 - DNA, 22 bp, Homo sapiens
aatactctttcaataaatgtat

SEQ ID NO: 6583122 - DNA, 16 bp, Homo sapiens
aatactgaaaaagaat

SEQ ID NO: 6583123 - DNA, 13 bp, Homo sapiens
aatactgaaccac

SEQ ID NO: 6583124 - DNA, 15 bp, Homo sapiens
aatactgaaccactt

SEQ ID NO: 6583125 - DNA, 22 bp, Homo sapiens
aatactgaaccactttgatatt

SEQ ID NO: 6583126 - DNA, 22 bp, Homo sapiens
aatactgacaatgtattttgga

SEQ ID NO: 6583127 - DNA, 11 bp, Homo sapiens
aatactgacct

SEQ ID NO: 6583128 - DNA, 18 bp, Homo sapiens
aatactgagaaaacctgt

SEQ ID NO: 6583129 - DNA, 19 bp, Homo sapiens
aatactgagatgctgggct

SEQ ID NO: 6583130 - DNA, 15 bp, Homo sapiens
aatactgagtgcctg

SEQ ID NO: 6583131 - DNA, 18 bp, Homo sapiens
aatactgatggtgcattt

SEQ ID NO: 6583132 - DNA, 14 bp, Homo sapiens
aatactgcaaatca

SEQ ID NO: 6583133 - DNA, 20 bp, Homo sapiens
aatactgcacactgcacatt

SEQ ID NO: 6583134 - DNA, 23 bp, Homo sapiens
ttggagggtgggagagcccagcc

SEQ ID NO: 6583135 - DNA, 16 bp, Homo sapiens
ttggagggtgtcccaa

SEQ ID NO: 6583136 - DNA, 23 bp, Homo sapiens
ttggaggtgcttaagcagaagca

SEQ ID NO: 6583137 - DNA, 17 bp, Homo sapiens
ttggaggtgcttgatct

SEQ ID NO: 6583138 - DNA, 16 bp, Homo sapiens
ttggaggttgaatagg

SEQ ID NO: 6583139 - DNA, 23 bp, Homo sapiens
ttggagtaaatatatatgtcaat

SEQ ID NO: 6583140 - DNA, 23 bp, Homo sapiens
ttggagtcccctcacctcctcta

SEQ ID NO: 6583141 - DNA, 17 bp, Homo sapiens
ttggagtcgtgttgtca

SEQ ID NO: 6583142 - DNA, 20 bp, Homo sapiens
ttggagtgagtgtggctccc

SEQ ID NO: 6583143 - DNA, 16 bp, Homo sapiens
ttggagtgccaagttt

SEQ ID NO: 6583144 - DNA, 23 bp, Homo sapiens
ttggagtgccacatggccgctgc

SEQ ID NO: 6583145 - DNA, 17 bp, Homo sapiens
ttggagtgctgcagctt

SEQ ID NO: 6583146 - DNA, 18 bp, Homo sapiens
ttggagtgcttgtttact

SEQ ID NO: 6583147 - DNA, 19 bp, Homo sapiens
ttggagtggaggcattgtt

SEQ ID NO: 6583148 - DNA, 14 bp, Homo sapiens
ttggagtgtaaacc

SEQ ID NO: 6583149 - DNA, 16 bp, Homo sapiens
ttggagtgttatgtat

SEQ ID NO: 6583150 - DNA, 21 bp, Homo sapiens
ttggagttcattcatattaca

SEQ ID NO: 6583151 - DNA, 22 bp, Homo sapiens
ttggagtttaggaattggaggc

SEQ ID NO: 6583152 - DNA, 23 bp, Homo sapiens
ttggagtttaggaattggaggct

SEQ ID NO: 6583153 - DNA, 17 bp, Homo sapiens
ttggagtttgggctgga

SEQ ID NO: 6583154 - DNA, 16 bp, Homo sapiens
ttggataaacaacatt

SEQ ID NO: 6583155 - DNA, 17 bp, Homo sapiens
ttggataaatcatttca

SEQ ID NO: 6583156 - DNA, 16 bp, Homo sapiens
ttggataataaaaatt

SEQ ID NO: 6583157 - DNA, 18 bp, Homo sapiens
ttggataataggaattca

SEQ ID NO: 6583158 - DNA, 15 bp, Homo sapiens
ttggataatattcat

SEQ ID NO: 6583159 - DNA, 22 bp, Homo sapiens
ttggataatgctgttgcctcat

SEQ ID NO: 6583160 - DNA, 22 bp, Homo sapiens
ttggatacagcagtagacattt

SEQ ID NO: 6583161 - DNA, 14 bp, Homo sapiens
ttggatacagctgc

SEQ ID NO: 6583162 - DNA, 19 bp, Homo sapiens
ttggataggagcttccaga

SEQ ID NO: 6583163 - DNA, 15 bp, Homo sapiens
ttggatataaatctt

SEQ ID NO: 6583164 - DNA, 16 bp, Homo sapiens
ttggatatattattgt

SEQ ID NO: 6583165 - DNA, 15 bp, Homo sapiens
ttggatattctcctc

SEQ ID NO: 6583166 - DNA, 20 bp, Homo sapiens
ttggatatttgatatttggt

SEQ ID NO: 6583167 - DNA, 18 bp, Homo sapiens
ttggatatttttgtactt

SEQ ID NO: 6583168 - DNA, 18 bp, Homo sapiens
ttggatcataaactggaa

SEQ ID NO: 6583169 - DNA, 19 bp, Homo sapiens
ttggatccgtttgaccaat

SEQ ID NO: 6583170 - DNA, 22 bp, Homo sapiens
ttggatccgtttgaccaatttg

SEQ ID NO: 6583171 - DNA, 20 bp, Homo sapiens
ttggatctattgatttgaaa

SEQ ID NO: 6583172 - DNA, 14 bp, Homo sapiens
ttggatctatttat

SEQ ID NO: 6583173 - DNA, 23 bp, Homo sapiens
ttggatctcttcttaatgtacat

SEQ ID NO: 6583174 - DNA, 19 bp, Homo sapiens
ttggatcttttactttaaa

SEQ ID NO: 6583175 - DNA, 12 bp, Homo sapiens
ttggatcttttt

SEQ ID NO: 6583176 - DNA, 14 bp, Homo sapiens
ttggatctttttaa

SEQ ID NO: 6583177 - DNA, 15 bp, Homo sapiens
ttggatctttttgca

SEQ ID NO: 6583178 - DNA, 13 bp, Homo sapiens
ttggatgaatgca

SEQ ID NO: 6583179 - DNA, 20 bp, Homo sapiens
ttggatgacttgttcatttt

SEQ ID NO: 6583180 - DNA, 13 bp, Homo sapiens
ttggatgaggagt

SEQ ID NO: 6583181 - DNA, 18 bp, Homo sapiens
ttggatgatacagtgttt

SEQ ID NO: 6583182 - DNA, 21 bp, Homo sapiens
ttggatgattgttcataatac

SEQ ID NO: 6583183 - DNA, 18 bp, Homo sapiens
ttggatgattttttaagc

SEQ ID NO: 6583184 - DNA, 19 bp, Homo sapiens
ttggatgcgagcttggcct

SEQ ID NO: 6583185 - DNA, 21 bp, Homo sapiens
ttggatggagtccagggaaga

SEQ ID NO: 6583186 - DNA, 22 bp, Homo sapiens
ttggatggcttaagcctgtgta

SEQ ID NO: 6583187 - DNA, 20 bp, Homo sapiens
ttggatgggagtgagacaga

SEQ ID NO: 6583188 - DNA, 23 bp, Homo sapiens
ttggatgggagtgggcacctcag

SEQ ID NO: 6583189 - DNA, 24 bp, Homo sapiens
ttggatgggagtgggcacctcaga

SEQ ID NO: 6583190 - DNA, 16 bp, Homo sapiens
ttggatgttgagaggt

SEQ ID NO: 6583191 - DNA, 17 bp, Homo sapiens
ttggatgttgtaaataa

SEQ ID NO: 6583192 - DNA, 20 bp, Homo sapiens
ttggatgtttttagttctga

SEQ ID NO: 6583193 - DNA, 21 bp, Homo sapiens
ttggattaaatacatatggat

SEQ ID NO: 6583194 - DNA, 17 bp, Homo sapiens
ttggattattcatttaa

SEQ ID NO: 6583195 - DNA, 20 bp, Homo sapiens
ttggattattcatttaaaat

SEQ ID NO: 6583196 - DNA, 17 bp, Homo sapiens
ttggattattctttctc

SEQ ID NO: 6583197 - DNA, 18 bp, Homo sapiens
ttggattctttaaatata

SEQ ID NO: 6583198 - DNA, 20 bp, Homo sapiens
ttggattctttccatttgca

SEQ ID NO: 6583199 - DNA, 14 bp, Homo sapiens
ttggattgcatctc

SEQ ID NO: 6583200 - DNA, 21 bp, Homo sapiens
ttggattgcgcctttgtatta

SEQ ID NO: 6583201 - DNA, 21 bp, Homo sapiens
ttggattggacaaaatgactt

SEQ ID NO: 6583202 - DNA, 14 bp, Homo sapiens
ttggattggggtcc

SEQ ID NO: 6583203 - DNA, 20 bp, Homo sapiens
ttggatttagagcaggtctt

SEQ ID NO: 6583204 - DNA, 16 bp, Homo sapiens
ttggatttagtttcag

SEQ ID NO: 6583205 - DNA, 21 bp, Homo sapiens
ttggatttcctaatactgtca

SEQ ID NO: 6583206 - DNA, 20 bp, Homo sapiens
ttggatttcctttatactgt

SEQ ID NO: 6583207 - DNA, 20 bp, Homo sapiens
ttggatttcgtgtgccgctg

SEQ ID NO: 6583208 - DNA, 17 bp, Homo sapiens
ttggatttctgtgaagt

SEQ ID NO: 6583209 - DNA, 22 bp, Homo sapiens
ttggatttgacattgcgtttga

SEQ ID NO: 6583210 - DNA, 15 bp, Homo sapiens
ttggatttgcatttt

SEQ ID NO: 6583211 - DNA, 13 bp, Homo sapiens
ttggatttgtaat

SEQ ID NO: 6583212 - DNA, 13 bp, Homo sapiens
ttggattttatgt

SEQ ID NO: 6583213 - DNA, 21 bp, Homo sapiens
ttggatttttaattaaaaact

SEQ ID NO: 6583214 - DNA, 13 bp, Homo sapiens
ttggcaaaatggg

SEQ ID NO: 6583215 - DNA, 16 bp, Homo sapiens
ttggcaaactctccac

SEQ ID NO: 6583216 - DNA, 14 bp, Homo sapiens
ttggcaaagccaga

SEQ ID NO: 6583217 - DNA, 12 bp, Homo sapiens
ttggcaaagttt

SEQ ID NO: 6583218 - DNA, 16 bp, Homo sapiens
ttggcaaatttgtgaa

SEQ ID NO: 6583219 - DNA, 17 bp, Homo sapiens
ttggcaaatttgtgaac

SEQ ID NO: 6583220 - DNA, 17 bp, Homo sapiens
ttggcaaattttaaaac

SEQ ID NO: 6583221 - DNA, 19 bp, Homo sapiens
ttggcaacaggacagagtt

SEQ ID NO: 6583222 - DNA, 13 bp, Homo sapiens
ttggcaactttct

SEQ ID NO: 6583223 - DNA, 20 bp, Homo sapiens
ttggcaagaacttgtttaca

SEQ ID NO: 6583224 - DNA, 23 bp, Homo sapiens
ttggcaagaacttgtttacaaca

SEQ ID NO: 6583225 - DNA, 17 bp, Homo sapiens
ttggcaagatgaaataa

SEQ ID NO: 6583226 - DNA, 19 bp, Homo sapiens
ttggcacaccctctctgtc

SEQ ID NO: 6583227 - DNA, 15 bp, Homo sapiens
ttggcacagaacagg

SEQ ID NO: 6583228 - DNA, 17 bp, Homo sapiens
ttggcacatgcaggtag

SEQ ID NO: 6583229 - DNA, 18 bp, Homo sapiens
ttggcacatgcaggtagt

SEQ ID NO: 6583230 - DNA, 16 bp, Homo sapiens
ttggcacatgccacct

SEQ ID NO: 6583231 - DNA, 15 bp, Homo sapiens
ttggcaccaataaag

SEQ ID NO: 6583232 - DNA, 17 bp, Homo sapiens
ttggcaccaccagggtg

SEQ ID NO: 6583233 - DNA, 13 bp, Homo sapiens
ttggcaccagaca

SEQ ID NO: 6583234 - DNA, 22 bp, Homo sapiens
ttggcacccaaatcacatctca

SEQ ID NO: 6583235 - DNA, 15 bp, Homo sapiens
ttggcaccggcctct

SEQ ID NO: 6583236 - DNA, 19 bp, Homo sapiens
ttggcacctaatccaggca

SEQ ID NO: 6583237 - DNA, 15 bp, Homo sapiens
ttggcacctgcctag

SEQ ID NO: 6583238 - DNA, 20 bp, Homo sapiens
ttggcaccttcaatacttca

SEQ ID NO: 6583239 - DNA, 14 bp, Homo sapiens
ttggcactgctaaa

SEQ ID NO: 6583240 - DNA, 12 bp, Homo sapiens
ttggcactggat

SEQ ID NO: 6583241 - DNA, 14 bp, Homo sapiens
ttggcactgtaagg

SEQ ID NO: 6583242 - DNA, 22 bp, Homo sapiens
ttggcactgtggaactgccacc

SEQ ID NO: 6583243 - DNA, 20 bp, Homo sapiens
ttggcacttaagtgcacttt

SEQ ID NO: 6583244 - DNA, 15 bp, Homo sapiens
ttggcacttctgcca

SEQ ID NO: 6583245 - DNA, 16 bp, Homo sapiens
ttggcacttctgccat

SEQ ID NO: 6583246 - DNA, 20 bp, Homo sapiens
ttggcacttgccattccaaa

SEQ ID NO: 6583247 - DNA, 13 bp, Homo sapiens
ttggcacttgtat

SEQ ID NO: 6583248 - DNA, 15 bp, Homo sapiens
ttggcacttgtattt

SEQ ID NO: 6583249 - DNA, 17 bp, Homo sapiens
ttggcacttgtatttaa

SEQ ID NO: 6583250 - DNA, 17 bp, Homo sapiens
ttggcagaactgctggg

SEQ ID NO: 6583251 - DNA, 18 bp, Homo sapiens
ttggcagaactgctgggg

SEQ ID NO: 6583252 - DNA, 20 bp, Homo sapiens
ttggcagaactgctggggct

SEQ ID NO: 6583253 - DNA, 13 bp, Homo sapiens
ttggcagacagcc

SEQ ID NO: 6583254 - DNA, 19 bp, Homo sapiens
ttggcagacaggatgttca

SEQ ID NO: 6583255 - DNA, 19 bp, Homo sapiens
ttggcagaccgggcccccc

SEQ ID NO: 6583256 - DNA, 13 bp, Homo sapiens
ttggcagagaagg

SEQ ID NO: 6583257 - DNA, 14 bp, Homo sapiens
ttggcagagaaggc

SEQ ID NO: 6583258 - DNA, 12 bp, Homo sapiens
ttggcagcagat

SEQ ID NO: 6583259 - DNA, 18 bp, Homo sapiens
ttggcagcaggtgctgct

SEQ ID NO: 6583260 - DNA, 20 bp, Homo sapiens
ttggcagccaaggaatgtgt

SEQ ID NO: 6583261 - DNA, 23 bp, Homo sapiens
ttggcagccaaggaatgtgtcca

SEQ ID NO: 6583262 - DNA, 22 bp, Homo sapiens
ttggcagcccctgttttctgct

SEQ ID NO: 6583263 - DNA, 18 bp, Homo sapiens
ttggcagcccttgaactt

SEQ ID NO: 6583264 - DNA, 12 bp, Homo sapiens
ttggcagccttg

SEQ ID NO: 6583265 - DNA, 16 bp, Homo sapiens
ttggcagccttgtgat

SEQ ID NO: 6583266 - DNA, 23 bp, Homo sapiens
ttggcagcttaacattgacttct

SEQ ID NO: 6583267 - DNA, 19 bp, Homo sapiens
ttggcagctttttctgtgg

SEQ ID NO: 6583268 - DNA, 18 bp, Homo sapiens
ttggcaggagctcctgga

SEQ ID NO: 6583269 - DNA, 16 bp, Homo sapiens
ttggcaggaggcagga

SEQ ID NO: 6583270 - DNA, 13 bp, Homo sapiens
ttggcaggcccac

SEQ ID NO: 6583271 - DNA, 19 bp, Homo sapiens
ttggcaggctgaggtgaga

SEQ ID NO: 6583272 - DNA, 14 bp, Homo sapiens
ttggcaggctggcc

SEQ ID NO: 6583273 - DNA, 20 bp, Homo sapiens
ttggcaggtcctggccagat

SEQ ID NO: 6583274 - DNA, 18 bp, Homo sapiens
ttggcaggtgtgggctcc

SEQ ID NO: 6583275 - DNA, 16 bp, Homo sapiens
ttggcagtggcagaga

SEQ ID NO: 6583276 - DNA, 14 bp, Homo sapiens
ttggcagtgtgtca

SEQ ID NO: 6583277 - DNA, 16 bp, Homo sapiens
ttggcagtgtgtcaca

SEQ ID NO: 6583278 - DNA, 16 bp, Homo sapiens
ttggcagttcctggca

SEQ ID NO: 6583279 - DNA, 14 bp, Homo sapiens
ttggcagtttggta

SEQ ID NO: 6583280 - DNA, 15 bp, Homo sapiens
ttggcataagacaga

SEQ ID NO: 6583281 - DNA, 15 bp, Homo sapiens
ttggcatccctgggc

SEQ ID NO: 6583282 - DNA, 17 bp, Homo sapiens
ttggcatccctgggcct

SEQ ID NO: 6583283 - DNA, 14 bp, Homo sapiens
ttggcatctactct

SEQ ID NO: 6583284 - DNA, 22 bp, Homo sapiens
ttggcatctctccccatatata

SEQ ID NO: 6583285 - DNA, 21 bp, Homo sapiens
ttggcatggatttcctttgac

SEQ ID NO: 6583286 - DNA, 20 bp, Homo sapiens
ttggcatgggcgcaggccca

SEQ ID NO: 6583287 - DNA, 21 bp, Homo sapiens
ttggcatgggcgcaggcccag

SEQ ID NO: 6583288 - DNA, 12 bp, Homo sapiens
ttggcatggtga

SEQ ID NO: 6583289 - DNA, 22 bp, Homo sapiens
ttggcatgtctcctcaacccac

SEQ ID NO: 6583290 - DNA, 15 bp, Homo sapiens
ttggcatgtttaatt

SEQ ID NO: 6583291 - DNA, 15 bp, Homo sapiens
ttggcattaaaactt

SEQ ID NO: 6583292 - DNA, 13 bp, Homo sapiens
ttggcattccgca

SEQ ID NO: 6583293 - DNA, 16 bp, Homo sapiens
ttggcattctttgcaa

SEQ ID NO: 6583294 - DNA, 17 bp, Homo sapiens
ttggcatttgctggcct

SEQ ID NO: 6583295 - DNA, 19 bp, Homo sapiens
ttggcattttggctcagag

SEQ ID NO: 6583296 - DNA, 23 bp, Homo sapiens
ttggccaaaacttaaaagcaaga

SEQ ID NO: 6583297 - DNA, 24 bp, Homo sapiens
ttggccaaagccaaagctaggcct

SEQ ID NO: 6583298 - DNA, 22 bp, Homo sapiens
ttggccaatgcacctaaagaaa

SEQ ID NO: 6583299 - DNA, 11 bp, Homo sapiens
ttggccaatta

SEQ ID NO: 6583300 - DNA, 23 bp, Homo sapiens
ttggccaattttagtcttgctgt

SEQ ID NO: 6583301 - DNA, 22 bp, Homo sapiens
ttggccacaacctgaaagacaa

SEQ ID NO: 6583302 - DNA, 20 bp, Homo sapiens
ttggccaccccttgctctct

SEQ ID NO: 6583303 - DNA, 19 bp, Homo sapiens
ttggccacctgtagccatc

SEQ ID NO: 6583304 - DNA, 20 bp, Homo sapiens
ttggccacctgtagccatct

SEQ ID NO: 6583305 - DNA, 21 bp, Homo sapiens
ttggccactccgagaggtggg

SEQ ID NO: 6583306 - DNA, 22 bp, Homo sapiens
ttggccactccgagaggtgggc

SEQ ID NO: 6583307 - DNA, 12 bp, Homo sapiens
ttggccactggg

SEQ ID NO: 6583308 - DNA, 14 bp, Homo sapiens
ttggccactgtatt

SEQ ID NO: 6583309 - DNA, 16 bp, Homo sapiens
ttggccactgtatttg

SEQ ID NO: 6583310 - DNA, 22 bp, Homo sapiens
ttggccagaaaccttcctgctg

SEQ ID NO: 6583311 - DNA, 17 bp, Homo sapiens
ttggccagagggcccct

SEQ ID NO: 6583312 - DNA, 21 bp, Homo sapiens
ttggccagattgtggggtgca

SEQ ID NO: 6583313 - DNA, 18 bp, Homo sapiens
ttggccagcgctgttgag

SEQ ID NO: 6583314 - DNA, 14 bp, Homo sapiens
ttggccaggcctag

SEQ ID NO: 6583315 - DNA, 14 bp, Homo sapiens
ttggccaggctggt

SEQ ID NO: 6583316 - DNA, 21 bp, Homo sapiens
ttggccataagcaacaatttt

SEQ ID NO: 6583317 - DNA, 22 bp, Homo sapiens
ttggccatatttacctcagcct

SEQ ID NO: 6583318 - DNA, 18 bp, Homo sapiens
ttggccatcatttcattc

SEQ ID NO: 6583319 - DNA, 12 bp, Homo sapiens
ttggccatctgc

SEQ ID NO: 6583320 - DNA, 21 bp, Homo sapiens
ttggccatgatgtccttggac

SEQ ID NO: 6583321 - DNA, 14 bp, Homo sapiens
ttggcccagagagg

SEQ ID NO: 6583322 - DNA, 11 bp, Homo sapiens
ttggcccagcg

SEQ ID NO: 6583323 - DNA, 14 bp, Homo sapiens
ttggcccaggaaaa

SEQ ID NO: 6583324 - DNA, 23 bp, Homo sapiens
ttggcccaggaaaaacctgtggg

SEQ ID NO: 6583325 - DNA, 12 bp, Homo sapiens
ttggcccaggag

SEQ ID NO: 6583326 - DNA, 14 bp, Homo sapiens
ttggcccaggagct

SEQ ID NO: 6583327 - DNA, 15 bp, Homo sapiens
ttggcccaggagctc

SEQ ID NO: 6583328 - DNA, 14 bp, Homo sapiens
ttggcccaggagtt

SEQ ID NO: 6583329 - DNA, 15 bp, Homo sapiens
ttggcccaggagttt

SEQ ID NO: 6583330 - DNA, 20 bp, Homo sapiens
ttggcccaggagtttggcca

SEQ ID NO: 6583331 - DNA, 21 bp, Homo sapiens
ttggcccaggagtttggccag

SEQ ID NO: 6583332 - DNA, 15 bp, Homo sapiens
ttggcccatcccgcc

SEQ ID NO: 6583333 - DNA, 21 bp, Homo sapiens
ttggcccatcccgccttctcc

SEQ ID NO: 6583334 - DNA, 19 bp, Homo sapiens
ttggccccctttcccgggc

SEQ ID NO: 6583335 - DNA, 11 bp, Homo sapiens
ttggcccctca

SEQ ID NO: 6583336 - DNA, 12 bp, Homo sapiens
ttggcccctcac

SEQ ID NO: 6583337 - DNA, 15 bp, Homo sapiens
ttggcccctggaacc

SEQ ID NO: 6583338 - DNA, 21 bp, Homo sapiens
ttggcccctggaacctttccc

SEQ ID NO: 6583339 - DNA, 13 bp, Homo sapiens
ttggccctattta

SEQ ID NO: 6583340 - DNA, 14 bp, Homo sapiens
ttggccctcctcag

SEQ ID NO: 6583341 - DNA, 19 bp, Homo sapiens
ttggccctcctcagctccc

SEQ ID NO: 6583342 - DNA, 22 bp, Homo sapiens
ttggccctctcccatgcacaca

SEQ ID NO: 6583343 - DNA, 19 bp, Homo sapiens
ttggccctcttgcgggcct

SEQ ID NO: 6583344 - DNA, 14 bp, Homo sapiens
ttggccctgcccct

SEQ ID NO: 6583345 - DNA, 15 bp, Homo sapiens
ttggccctgcccctc

SEQ ID NO: 6583346 - DNA, 16 bp, Homo sapiens
ttggccctgcccctcc

SEQ ID NO: 6583347 - DNA, 11 bp, Homo sapiens
ttggccctgcg

SEQ ID NO: 6583348 - DNA, 10 bp, Homo sapiens
ttggccctgg

SEQ ID NO: 6583349 - DNA, 13 bp, Homo sapiens
ttggccctggagc

SEQ ID NO: 6583350 - DNA, 18 bp, Homo sapiens
ttggccctggagccaggg

SEQ ID NO: 6583351 - DNA, 14 bp, Homo sapiens
ttggcccttccagt

SEQ ID NO: 6583352 - DNA, 11 bp, Homo sapiens
ttggccgccat

SEQ ID NO: 6583353 - DNA, 19 bp, Homo sapiens
ttggccgctgtatgtctta

SEQ ID NO: 6583354 - DNA, 22 bp, Homo sapiens
ttggccggctctggtggccact

SEQ ID NO: 6583355 - DNA, 13 bp, Homo sapiens
ttggccggctggc

SEQ ID NO: 6583356 - DNA, 21 bp, Homo sapiens
ttggccggctgtgctcagaga

SEQ ID NO: 6583357 - DNA, 22 bp, Homo sapiens
ttggccgggtgcggtggctcac

SEQ ID NO: 6583358 - DNA, 19 bp, Homo sapiens
ttggcctagtcagatggat

SEQ ID NO: 6583359 - DNA, 19 bp, Homo sapiens
ttggcctcaagcaaggaag

SEQ ID NO: 6583360 - DNA, 20 bp, Homo sapiens
ttggcctccagctgttctta

SEQ ID NO: 6583361 - DNA, 22 bp, Homo sapiens
ttggcctccagctgttcttagt

SEQ ID NO: 6583362 - DNA, 14 bp, Homo sapiens
ttggcctccagggc

SEQ ID NO: 6583363 - DNA, 13 bp, Homo sapiens
ttggcctccatcc

SEQ ID NO: 6583364 - DNA, 13 bp, Homo sapiens
ttggcctcgcctg

SEQ ID NO: 6583365 - DNA, 16 bp, Homo sapiens
ttggcctctccttgga

SEQ ID NO: 6583366 - DNA, 12 bp, Homo sapiens
ttggcctctgcc

SEQ ID NO: 6583367 - DNA, 14 bp, Homo sapiens
ttggcctctgcccc

SEQ ID NO: 6583368 - DNA, 15 bp, Homo sapiens
ttggcctctgctttc

SEQ ID NO: 6583369 - DNA, 18 bp, Homo sapiens
ttggcctctgtatgcagt

SEQ ID NO: 6583370 - DNA, 13 bp, Homo sapiens
ttggcctctgtct

SEQ ID NO: 6583371 - DNA, 23 bp, Homo sapiens
ttggcctcttcaggcctgctagt

SEQ ID NO: 6583372 - DNA, 20 bp, Homo sapiens
ttggcctcttgtcccttggc

SEQ ID NO: 6583373 - DNA, 16 bp, Homo sapiens
ttggcctgacctggca

SEQ ID NO: 6583374 - DNA, 17 bp, Homo sapiens
ttggcctgatcagacca

SEQ ID NO: 6583375 - DNA, 14 bp, Homo sapiens
ttggcctggagcac

SEQ ID NO: 6583376 - DNA, 16 bp, Homo sapiens
ttggcctggagcacaa

SEQ ID NO: 6583377 - DNA, 12 bp, Homo sapiens
ttggcctggagg

SEQ ID NO: 6583378 - DNA, 14 bp, Homo sapiens
ttggcctggagttt

SEQ ID NO: 6583379 - DNA, 18 bp, Homo sapiens
ttggcctggcaaaataaa

SEQ ID NO: 6583380 - DNA, 11 bp, Homo sapiens
ttggcctggcc

SEQ ID NO: 6583381 - DNA, 15 bp, Homo sapiens
ttggcctggcctcca

SEQ ID NO: 6583382 - DNA, 18 bp, Homo sapiens
ttggcctggggtgcatct

SEQ ID NO: 6583383 - DNA, 21 bp, Homo sapiens
ttggcctggggtgcatctcct

SEQ ID NO: 6583384 - DNA, 23 bp, Homo sapiens
ttggcctgtctcatccccagggg

SEQ ID NO: 6583385 - DNA, 19 bp, Homo sapiens
ttggcctgtgtctggcccc

SEQ ID NO: 6583386 - DNA, 14 bp, Homo sapiens
ttggccttaagaac

SEQ ID NO: 6583387 - DNA, 11 bp, Homo sapiens
ttggccttctc

SEQ ID NO: 6583388 - DNA, 21 bp, Homo sapiens
ttggccttctcccctcttctg

SEQ ID NO: 6583389 - DNA, 23 bp, Homo sapiens
ttggccttctcccctcttctgag

SEQ ID NO: 6583390 - DNA, 17 bp, Homo sapiens
ttggccttgcagctggc

SEQ ID NO: 6583391 - DNA, 15 bp, Homo sapiens
ttggcctttccttgt

SEQ ID NO: 6583392 - DNA, 22 bp, Homo sapiens
ttggcgatgaggtaattctccc

SEQ ID NO: 6583393 - DNA, 17 bp, Homo sapiens
ttggcgatgccagccaa

SEQ ID NO: 6583394 - DNA, 19 bp, Homo sapiens
ttggcgcaccctcccctcc

SEQ ID NO: 6583395 - DNA, 15 bp, Homo sapiens
ttggcgctattacaa

SEQ ID NO: 6583396 - DNA, 13 bp, Homo sapiens
ttggcgctgaggt

SEQ ID NO: 6583397 - DNA, 23 bp, Homo sapiens
ttggcggcccggccggagggcag

SEQ ID NO: 6583398 - DNA, 20 bp, Homo sapiens
ttggcgggtccacttgccag

SEQ ID NO: 6583399 - DNA, 20 bp, Homo sapiens
ttggcgtaggctacagagaa

SEQ ID NO: 6583400 - DNA, 13 bp, Homo sapiens
ttggcgtgacccg

SEQ ID NO: 6583401 - DNA, 13 bp, Homo sapiens
ttggcgtggagca

SEQ ID NO: 6583402 - DNA, 14 bp, Homo sapiens
ttggcgtggagcag

SEQ ID NO: 6583403 - DNA, 23 bp, Homo sapiens
ttggcgtgtgtccctgtggtacc

SEQ ID NO: 6583404 - DNA, 14 bp, Homo sapiens
ttggcgttgtgggc

SEQ ID NO: 6583405 - DNA, 17 bp, Homo sapiens
ttggctaaagtgcattt

SEQ ID NO: 6583406 - DNA, 22 bp, Homo sapiens
ttggctactgactgtattttgt

SEQ ID NO: 6583407 - DNA, 14 bp, Homo sapiens
ttggctagagcttc

SEQ ID NO: 6583408 - DNA, 22 bp, Homo sapiens
ttggctagaggttcaaagatat

SEQ ID NO: 6583409 - DNA, 16 bp, Homo sapiens
ttggctagtctgtgcc

SEQ ID NO: 6583410 - DNA, 19 bp, Homo sapiens
ttggctagtctgtgcctca

SEQ ID NO: 6583411 - DNA, 18 bp, Homo sapiens
ttggctatataaaatgtg

SEQ ID NO: 6583412 - DNA, 21 bp, Homo sapiens
ttggctatgaaaatgagccct

SEQ ID NO: 6583413 - DNA, 23 bp, Homo sapiens
ttggctatgaaaatgagccctgg

SEQ ID NO: 6583414 - DNA, 16 bp, Homo sapiens
ttggctattgtccttg

SEQ ID NO: 6583415 - DNA, 16 bp, Homo sapiens
ttggctatttaaaact

SEQ ID NO: 6583416 - DNA, 16 bp, Homo sapiens
ttggctatttgaaata

SEQ ID NO: 6583417 - DNA, 13 bp, Homo sapiens
ttggctcaatcct

SEQ ID NO: 6583418 - DNA, 17 bp, Homo sapiens
ttggctcacactgagaa

SEQ ID NO: 6583419 - DNA, 12 bp, Homo sapiens
ttggctcaccca

SEQ ID NO: 6583420 - DNA, 13 bp, Homo sapiens
ttggctcagaaaa

SEQ ID NO: 6583421 - DNA, 14 bp, Homo sapiens
ttggctcagacatg

SEQ ID NO: 6583422 - DNA, 17 bp, Homo sapiens
ttggctcagcccgctga

SEQ ID NO: 6583423 - DNA, 16 bp, Homo sapiens
ttggctcctttcccac

SEQ ID NO: 6583424 - DNA, 15 bp, Homo sapiens
ttggctcgctgtggt

SEQ ID NO: 6583425 - DNA, 16 bp, Homo sapiens
ttggctcgctgtggtt

SEQ ID NO: 6583426 - DNA, 21 bp, Homo sapiens
ttggctctattggatttgtcc

SEQ ID NO: 6583427 - DNA, 22 bp, Homo sapiens
ttggctctctgacgtcaaccca

SEQ ID NO: 6583428 - DNA, 14 bp, Homo sapiens
ttggctctgaagaa

SEQ ID NO: 6583429 - DNA, 14 bp, Homo sapiens
ttggctctgccagt

SEQ ID NO: 6583430 - DNA, 16 bp, Homo sapiens
ttggctctgccagtcc

SEQ ID NO: 6583431 - DNA, 19 bp, Homo sapiens
ttggctctggagacagccc

SEQ ID NO: 6583432 - DNA, 22 bp, Homo sapiens
ttggctctggagacagccccag

SEQ ID NO: 6583433 - DNA, 14 bp, Homo sapiens
ttggctctttcaga

SEQ ID NO: 6583434 - DNA, 15 bp, Homo sapiens
ttggctgaaattatg

SEQ ID NO: 6583435 - DNA, 17 bp, Homo sapiens
ttggctgacttcatctg

SEQ ID NO: 6583436 - DNA, 23 bp, Homo sapiens
ttggctgagatatgaacatattg

SEQ ID NO: 6583437 - DNA, 19 bp, Homo sapiens
ttggctgaggggcttggga

SEQ ID NO: 6583438 - DNA, 20 bp, Homo sapiens
ttggctgagtactggaataa

SEQ ID NO: 6583439 - DNA, 19 bp, Homo sapiens
ttggctgatttaaaaagtg

SEQ ID NO: 6583440 - DNA, 11 bp, Homo sapiens
ttggctgcagg

SEQ ID NO: 6583441 - DNA, 13 bp, Homo sapiens
ttggctgcaggga

SEQ ID NO: 6583442 - DNA, 14 bp, Homo sapiens
ttggctgcaggtgt

SEQ ID NO: 6583443 - DNA, 13 bp, Homo sapiens
ttggctgccctgt

SEQ ID NO: 6583444 - DNA, 24 bp, Homo sapiens
ttggctgcgtactccactggtctg

SEQ ID NO: 6583445 - DNA, 16 bp, Homo sapiens
ttggctgctcttccag

SEQ ID NO: 6583446 - DNA, 16 bp, Homo sapiens
ttggctgctgaaggct

SEQ ID NO: 6583447 - DNA, 17 bp, Homo sapiens
ttggctggacccagcca

SEQ ID NO: 6583448 - DNA, 12 bp, Homo sapiens
ttggctggagcc

SEQ ID NO: 6583449 - DNA, 13 bp, Homo sapiens
ttggctggagccc

SEQ ID NO: 6583450 - DNA, 22 bp, Homo sapiens
ttggctggagcccggtgttcag

SEQ ID NO: 6583451 - DNA, 21 bp, Homo sapiens
ttggctggatgaaattttcta

SEQ ID NO: 6583452 - DNA, 13 bp, Homo sapiens
ttggctgggccca

SEQ ID NO: 6583453 - DNA, 18 bp, Homo sapiens
ttggctgggcccagaagg

SEQ ID NO: 6583454 - DNA, 22 bp, Homo sapiens
ttggctgggggcctcagtgcca

SEQ ID NO: 6583455 - DNA, 11 bp, Homo sapiens
ttggctgggta

SEQ ID NO: 6583456 - DNA, 22 bp, Homo sapiens
ttggctggtgtggtacagagaa

SEQ ID NO: 6583457 - DNA, 21 bp, Homo sapiens
ttggctgtccttccccttccc

SEQ ID NO: 6583458 - DNA, 11 bp, Homo sapiens
ttggctgtctg

SEQ ID NO: 6583459 - DNA, 21 bp, Homo sapiens
ttggctgtctgaccagagaat

SEQ ID NO: 6583460 - DNA, 24 bp, Homo sapiens
ttggctgtctgaccagagaatgca

SEQ ID NO: 6583461 - DNA, 20 bp, Homo sapiens
ttggctgtgatgtcacagtt

SEQ ID NO: 6583462 - DNA, 20 bp, Homo sapiens
ttggctgtgctgtattttga

SEQ ID NO: 6583463 - DNA, 18 bp, Homo sapiens
ttggctgtgtctaaactg

SEQ ID NO: 6583464 - DNA, 14 bp, Homo sapiens
ttggctgttccaga

SEQ ID NO: 6583465 - DNA, 21 bp, Homo sapiens
ttggctgttttccctctgctg

SEQ ID NO: 6583466 - DNA, 15 bp, Homo sapiens
ttggcttaaagtgaa

SEQ ID NO: 6583467 - DNA, 19 bp, Homo sapiens
ttggcttaaagtgaaggaa

SEQ ID NO: 6583468 - DNA, 21 bp, Homo sapiens
ttggcttaaagtgaaggaaat

SEQ ID NO: 6583469 - DNA, 16 bp, Homo sapiens
ttggcttaatcatttt

SEQ ID NO: 6583470 - DNA, 14 bp, Homo sapiens
ttggcttacctggc

SEQ ID NO: 6583471 - DNA, 17 bp, Homo sapiens
ttggcttactgcagcct

SEQ ID NO: 6583472 - DNA, 17 bp, Homo sapiens
ttggcttataaacacat

SEQ ID NO: 6583473 - DNA, 20 bp, Homo sapiens
ttggcttataaacacattga

SEQ ID NO: 6583474 - DNA, 18 bp, Homo sapiens
ttggcttataattctttc

SEQ ID NO: 6583475 - DNA, 20 bp, Homo sapiens
ttggcttcaaggatggagat

SEQ ID NO: 6583476 - DNA, 13 bp, Homo sapiens
ttggcttcatttc

SEQ ID NO: 6583477 - DNA, 14 bp, Homo sapiens
ttggcttcctctgc

SEQ ID NO: 6583478 - DNA, 21 bp, Homo sapiens
ttggcttcctggcgcccccta

SEQ ID NO: 6583479 - DNA, 14 bp, Homo sapiens
ttggcttctcctgt

SEQ ID NO: 6583480 - DNA, 21 bp, Homo sapiens
ttggcttctgatttttctctt

SEQ ID NO: 6583481 - DNA, 22 bp, Homo sapiens
ttggcttctgtgatgagctgat

SEQ ID NO: 6583482 - DNA, 17 bp, Homo sapiens
ttggcttctgtgcctga

SEQ ID NO: 6583483 - DNA, 20 bp, Homo sapiens
ttggcttctgtgcctgactc

SEQ ID NO: 6583484 - DNA, 17 bp, Homo sapiens
ttggcttcttaaaaact

SEQ ID NO: 6583485 - DNA, 19 bp, Homo sapiens
ttggcttctttgctttctc

SEQ ID NO: 6583486 - DNA, 13 bp, Homo sapiens
ttggcttgctgtt

SEQ ID NO: 6583487 - DNA, 14 bp, Homo sapiens
ttggcttgcttatg

SEQ ID NO: 6583488 - DNA, 20 bp, Homo sapiens
ttggcttgcttatgtgtagg

SEQ ID NO: 6583489 - DNA, 21 bp, Homo sapiens
ttggcttgtagaattgttata

SEQ ID NO: 6583490 - DNA, 13 bp, Homo sapiens
ttggcttgtttta

SEQ ID NO: 6583491 - DNA, 22 bp, Homo sapiens
ttggctttaaacacccttcaca

SEQ ID NO: 6583492 - DNA, 16 bp, Homo sapiens
aatactgccagatgct

SEQ ID NO: 6583493 - DNA, 18 bp, Homo sapiens
aatactgccagatgctga

SEQ ID NO: 6583494 - DNA, 22 bp, Homo sapiens
aatactgccagatgctgatgtt

SEQ ID NO: 6583495 - DNA, 20 bp, Homo sapiens
aatactgcttaattgctgat

SEQ ID NO: 6583496 - DNA, 15 bp, Homo sapiens
aatactgcttagcat

SEQ ID NO: 6583497 - DNA, 13 bp, Homo sapiens
aatactgcttgaa

SEQ ID NO: 6583498 - DNA, 22 bp, Homo sapiens
aatactgcttttgcaaacagaa

SEQ ID NO: 6583499 - DNA, 12 bp, Homo sapiens
aatactggaata

SEQ ID NO: 6583500 - DNA, 15 bp, Homo sapiens
aatactggaataatt

SEQ ID NO: 6583501 - DNA, 13 bp, Homo sapiens
aatactggactca

SEQ ID NO: 6583502 - DNA, 22 bp, Homo sapiens
aatactgggagagaagaggact

SEQ ID NO: 6583503 - DNA, 18 bp, Homo sapiens
aatactgggttcttagtt

SEQ ID NO: 6583504 - DNA, 16 bp, Homo sapiens
aatactggtctcaggc

SEQ ID NO: 6583505 - DNA, 22 bp, Homo sapiens
aatactgtacaatgactttatt

SEQ ID NO: 6583506 - DNA, 12 bp, Homo sapiens
aatactgtacat

SEQ ID NO: 6583507 - DNA, 14 bp, Homo sapiens
aatactgtctgtat

SEQ ID NO: 6583508 - DNA, 15 bp, Homo sapiens
aatactgtgaaatac

SEQ ID NO: 6583509 - DNA, 17 bp, Homo sapiens
aatactgtgcagaataa

SEQ ID NO: 6583510 - DNA, 19 bp, Homo sapiens
aatactgtgcagaataatg

SEQ ID NO: 6583511 - DNA, 21 bp, Homo sapiens
aatactgtgcagaataatgga

SEQ ID NO: 6583512 - DNA, 16 bp, Homo sapiens
aatactgtgtggaact

SEQ ID NO: 6583513 - DNA, 19 bp, Homo sapiens
aatactgttattctttgca

SEQ ID NO: 6583514 - DNA, 21 bp, Homo sapiens
aatactgttattctttgcact

SEQ ID NO: 6583515 - DNA, 22 bp, Homo sapiens
aatactgttattctttgcactt

SEQ ID NO: 6583516 - DNA, 16 bp, Homo sapiens
aatactgttctttcca

SEQ ID NO: 6583517 - DNA, 15 bp, Homo sapiens
aatactgtttcacta

SEQ ID NO: 6583518 - DNA, 13 bp, Homo sapiens
aatactgttttaa

SEQ ID NO: 6583519 - DNA, 20 bp, Homo sapiens
aatactgttttaaaatgtga

SEQ ID NO: 6583520 - DNA, 18 bp, Homo sapiens
aatactgttttatctcca

SEQ ID NO: 6583521 - DNA, 17 bp, Homo sapiens
aatacttaaaaatatgt

SEQ ID NO: 6583522 - DNA, 14 bp, Homo sapiens
aatacttaaataaa

SEQ ID NO: 6583523 - DNA, 20 bp, Homo sapiens
aatacttaacattgatttat

SEQ ID NO: 6583524 - DNA, 13 bp, Homo sapiens
aatacttaataaa

SEQ ID NO: 6583525 - DNA, 19 bp, Homo sapiens
aatacttactataatttga

SEQ ID NO: 6583526 - DNA, 18 bp, Homo sapiens
aatacttatgttgtattg

SEQ ID NO: 6583527 - DNA, 12 bp, Homo sapiens
aatacttatttt

SEQ ID NO: 6583528 - DNA, 22 bp, Homo sapiens
aatacttcattaatttcaatca

SEQ ID NO: 6583529 - DNA, 12 bp, Homo sapiens
aatacttccaga

SEQ ID NO: 6583530 - DNA, 22 bp, Homo sapiens
aatacttccatatggagcattt

SEQ ID NO: 6583531 - DNA, 18 bp, Homo sapiens
aatacttccttataaaaa

SEQ ID NO: 6583532 - DNA, 21 bp, Homo sapiens
aatacttctcaaacctgttta

SEQ ID NO: 6583533 - DNA, 22 bp, Homo sapiens
aatacttctcaaacctgtttaa

SEQ ID NO: 6583534 - DNA, 16 bp, Homo sapiens
aatacttctcattttt

SEQ ID NO: 6583535 - DNA, 23 bp, Homo sapiens
aatacttctgataatttattgtc

SEQ ID NO: 6583536 - DNA, 14 bp, Homo sapiens
aatacttcttgtgt

SEQ ID NO: 6583537 - DNA, 15 bp, Homo sapiens
aatacttctttgtta

SEQ ID NO: 6583538 - DNA, 20 bp, Homo sapiens
aatacttctttgttattata

SEQ ID NO: 6583539 - DNA, 12 bp, Homo sapiens
aatacttgaaaa

SEQ ID NO: 6583540 - DNA, 14 bp, Homo sapiens
aatacttgaaccat

SEQ ID NO: 6583541 - DNA, 17 bp, Homo sapiens
aatacttgaaccataaa

SEQ ID NO: 6583542 - DNA, 19 bp, Homo sapiens
aatacttgaatatggaaca

SEQ ID NO: 6583543 - DNA, 15 bp, Homo sapiens
aatacttgacctctg

SEQ ID NO: 6583544 - DNA, 16 bp, Homo sapiens
aatacttgactcattt

SEQ ID NO: 6583545 - DNA, 15 bp, Homo sapiens
aatacttgagaaatt

SEQ ID NO: 6583546 - DNA, 21 bp, Homo sapiens
aatacttgcaactaaggacaa

SEQ ID NO: 6583547 - DNA, 14 bp, Homo sapiens
aatacttgcagttg

SEQ ID NO: 6583548 - DNA, 15 bp, Homo sapiens
aatacttgcagttgt

SEQ ID NO: 6583549 - DNA, 16 bp, Homo sapiens
aatacttgcagttgtg

SEQ ID NO: 6583550 - DNA, 14 bp, Homo sapiens
aatacttggagggc

SEQ ID NO: 6583551 - DNA, 18 bp, Homo sapiens
aatacttgtcaatattta

SEQ ID NO: 6583552 - DNA, 20 bp, Homo sapiens
aatacttgtcaatatttaaa

SEQ ID NO: 6583553 - DNA, 14 bp, Homo sapiens
aatactttaaagga

SEQ ID NO: 6583554 - DNA, 16 bp, Homo sapiens
aatactttaaaggaaa

SEQ ID NO: 6583555 - DNA, 17 bp, Homo sapiens
aatactttaaaggaaaa

SEQ ID NO: 6583556 - DNA, 15 bp, Homo sapiens
aatactttaattcat

SEQ ID NO: 6583557 - DNA, 20 bp, Homo sapiens
aatactttcgaaatttcatt

SEQ ID NO: 6583558 - DNA, 19 bp, Homo sapiens
aatactttctatgtgacat

SEQ ID NO: 6583559 - DNA, 16 bp, Homo sapiens
aatactttcttagatt

SEQ ID NO: 6583560 - DNA, 15 bp, Homo sapiens
aatactttcttttat

SEQ ID NO: 6583561 - DNA, 22 bp, Homo sapiens
aatactttcttttattaatata

SEQ ID NO: 6583562 - DNA, 23 bp, Homo sapiens
aatactttcttttattaatatat

SEQ ID NO: 6583563 - DNA, 14 bp, Homo sapiens
aatactttgaatgt

SEQ ID NO: 6583564 - DNA, 16 bp, Homo sapiens
aatactttgaatgtgt

SEQ ID NO: 6583565 - DNA, 23 bp, Homo sapiens
aatactttgcagcacagctgaga

SEQ ID NO: 6583566 - DNA, 12 bp, Homo sapiens
aatactttgtat

SEQ ID NO: 6583567 - DNA, 14 bp, Homo sapiens
aatactttgtgtct

SEQ ID NO: 6583568 - DNA, 13 bp, Homo sapiens
aatacttttgcat

SEQ ID NO: 6583569 - DNA, 16 bp, Homo sapiens
aatacttttgtccaat

SEQ ID NO: 6583570 - DNA, 21 bp, Homo sapiens
aatacttttgtgtattctgtg

SEQ ID NO: 6583571 - DNA, 20 bp, Homo sapiens
aatactttttaaattacctt

SEQ ID NO: 6583572 - DNA, 15 bp, Homo sapiens
aatacttttttctag

SEQ ID NO: 6583573 - DNA, 17 bp, Homo sapiens
aatacttttttctagtt

SEQ ID NO: 6583574 - DNA, 17 bp, Homo sapiens
aatagaaaactgaaaat

SEQ ID NO: 6583575 - DNA, 19 bp, Homo sapiens
aatagaaaactgaaaatct

SEQ ID NO: 6583576 - DNA, 12 bp, Homo sapiens
aatagaaaagta

SEQ ID NO: 6583577 - DNA, 13 bp, Homo sapiens
aatagaaaagtag

SEQ ID NO: 6583578 - DNA, 15 bp, Homo sapiens
aatagaaaagttatt

SEQ ID NO: 6583579 - DNA, 14 bp, Homo sapiens
aatagaaaatggtc

SEQ ID NO: 6583580 - DNA, 12 bp, Homo sapiens
aatagaaacaag

SEQ ID NO: 6583581 - DNA, 13 bp, Homo sapiens
aatagaaactcac

SEQ ID NO: 6583582 - DNA, 17 bp, Homo sapiens
aatagaaagtcatcttt

SEQ ID NO: 6583583 - DNA, 20 bp, Homo sapiens
aatagaaataaattcctaaa

SEQ ID NO: 6583584 - DNA, 16 bp, Homo sapiens
aatagaaataagtggt

SEQ ID NO: 6583585 - DNA, 16 bp, Homo sapiens
aatagaaatccaattg

SEQ ID NO: 6583586 - DNA, 13 bp, Homo sapiens
aatagaaatgcat

SEQ ID NO: 6583587 - DNA, 13 bp, Homo sapiens
aatagaaattttc

SEQ ID NO: 6583588 - DNA, 19 bp, Homo sapiens
aatagaaattttgtaagaa

SEQ ID NO: 6583589 - DNA, 19 bp, Homo sapiens
aatagaacaacatatacaa

SEQ ID NO: 6583590 - DNA, 13 bp, Homo sapiens
aatagaacacaga

SEQ ID NO: 6583591 - DNA, 22 bp, Homo sapiens
aatagaacattgattgctgtgt

SEQ ID NO: 6583592 - DNA, 14 bp, Homo sapiens
aatagaagaaagaa

SEQ ID NO: 6583593 - DNA, 22 bp, Homo sapiens
aatagaagaaagaaaatggaaa

SEQ ID NO: 6583594 - DNA, 15 bp, Homo sapiens
aatagaagaaagaga

SEQ ID NO: 6583595 - DNA, 15 bp, Homo sapiens
aatagaagaacatcc

SEQ ID NO: 6583596 - DNA, 21 bp, Homo sapiens
aatagaagcttaaaataaagt

SEQ ID NO: 6583597 - DNA, 14 bp, Homo sapiens
aatagaatacattt

SEQ ID NO: 6583598 - DNA, 16 bp, Homo sapiens
aatagaatacattttg

SEQ ID NO: 6583599 - DNA, 14 bp, Homo sapiens
aatagaatatagca

SEQ ID NO: 6583600 - DNA, 14 bp, Homo sapiens
aatagaatatataa

SEQ ID NO: 6583601 - DNA, 13 bp, Homo sapiens
aatagaatgatag

SEQ ID NO: 6583602 - DNA, 21 bp, Homo sapiens
aatagaatgtggccacttatt

SEQ ID NO: 6583603 - DNA, 22 bp, Homo sapiens
aatagaattgacattgaaatct

SEQ ID NO: 6583604 - DNA, 15 bp, Homo sapiens
aatagaatttcctaa

SEQ ID NO: 6583605 - DNA, 17 bp, Homo sapiens
aatagaatttcctaatg

SEQ ID NO: 6583606 - DNA, 17 bp, Homo sapiens
aatagacaaaaagtata

SEQ ID NO: 6583607 - DNA, 19 bp, Homo sapiens
aatagacaaatagaaaatg

SEQ ID NO: 6583608 - DNA, 22 bp, Homo sapiens
aatagacaaatagaaaatggtc

SEQ ID NO: 6583609 - DNA, 20 bp, Homo sapiens
aatagacacatcaaatgccc

SEQ ID NO: 6583610 - DNA, 22 bp, Homo sapiens
aatagacactccccgaagtctt

SEQ ID NO: 6583611 - DNA, 23 bp, Homo sapiens
aatagacagaggtttcattttca

SEQ ID NO: 6583612 - DNA, 12 bp, Homo sapiens
aatagacataaa

SEQ ID NO: 6583613 - DNA, 17 bp, Homo sapiens
aatagacataaattgta

SEQ ID NO: 6583614 - DNA, 20 bp, Homo sapiens
aatagacataaattgtaatt

SEQ ID NO: 6583615 - DNA, 15 bp, Homo sapiens
aatagacatctttaa

SEQ ID NO: 6583616 - DNA, 13 bp, Homo sapiens
aatagacatgtag

SEQ ID NO: 6583617 - DNA, 22 bp, Homo sapiens
aatagacatttttttgttccaa

SEQ ID NO: 6583618 - DNA, 15 bp, Homo sapiens
aatagactaacttca

SEQ ID NO: 6583619 - DNA, 20 bp, Homo sapiens
aatagactcgctagtcagta

SEQ ID NO: 6583620 - DNA, 16 bp, Homo sapiens
aatagacttaaatctc

SEQ ID NO: 6583621 - DNA, 16 bp, Homo sapiens
aatagacttatatgca

SEQ ID NO: 6583622 - DNA, 16 bp, Homo sapiens
aatagactttgtatga

SEQ ID NO: 6583623 - DNA, 16 bp, Homo sapiens
aatagagacacagaga

SEQ ID NO: 6583624 - DNA, 15 bp, Homo sapiens
aatagagactgtaga

SEQ ID NO: 6583625 - DNA, 20 bp, Homo sapiens
aatagagagagaggtattta

SEQ ID NO: 6583626 - DNA, 21 bp, Homo sapiens
aatagagagtatgtaatcttt

SEQ ID NO: 6583627 - DNA, 14 bp, Homo sapiens
aatagagataagtc

SEQ ID NO: 6583628 - DNA, 15 bp, Homo sapiens
aatagagatgagctt

SEQ ID NO: 6583629 - DNA, 19 bp, Homo sapiens
aatagagattaattttaac

SEQ ID NO: 6583630 - DNA, 16 bp, Homo sapiens
aatagagcaaaatcaa

SEQ ID NO: 6583631 - DNA, 20 bp, Homo sapiens
aatagagcaaaattgatgtg

SEQ ID NO: 6583632 - DNA, 13 bp, Homo sapiens
aatagagcaagaa

SEQ ID NO: 6583633 - DNA, 13 bp, Homo sapiens
aatagagctgcca

SEQ ID NO: 6583634 - DNA, 12 bp, Homo sapiens
aatagaggaaga

SEQ ID NO: 6583635 - DNA, 15 bp, Homo sapiens
aatagaggaagaaat

SEQ ID NO: 6583636 - DNA, 22 bp, Homo sapiens
aatagaggccaaattaatcttt

SEQ ID NO: 6583637 - DNA, 19 bp, Homo sapiens
aatagagggagtagaaagc

SEQ ID NO: 6583638 - DNA, 19 bp, Homo sapiens
aatagaggtctgtaaagaa

SEQ ID NO: 6583639 - DNA, 22 bp, Homo sapiens
aatagaggtgatgctgctaaag

SEQ ID NO: 6583640 - DNA, 18 bp, Homo sapiens
aatagagtatatgcactt

SEQ ID NO: 6583641 - DNA, 19 bp, Homo sapiens
aatagagttgggacaattg

SEQ ID NO: 6583642 - DNA, 14 bp, Homo sapiens
aatagagttttcct

SEQ ID NO: 6583643 - DNA, 17 bp, Homo sapiens
aatagagtttttatatt

SEQ ID NO: 6583644 - DNA, 23 bp, Homo sapiens
aatagataacagagaatcttgat

SEQ ID NO: 6583645 - DNA, 20 bp, Homo sapiens
aatagataaccaattttcag

SEQ ID NO: 6583646 - DNA, 20 bp, Homo sapiens
aatagataagagtagaaact

SEQ ID NO: 6583647 - DNA, 23 bp, Homo sapiens
aatagatacttttgataatagat

SEQ ID NO: 6583648 - DNA, 13 bp, Homo sapiens
aatagatatataa

SEQ ID NO: 6583649 - DNA, 19 bp, Homo sapiens
aatagatggaatttggaac

SEQ ID NO: 6583650 - DNA, 20 bp, Homo sapiens
aatagatgtgaaaatgcttt

SEQ ID NO: 6583651 - DNA, 20 bp, Homo sapiens
aatagatgtgcagtttggaa

SEQ ID NO: 6583652 - DNA, 11 bp, Homo sapiens
aatagatgttt

SEQ ID NO: 6583653 - DNA, 19 bp, Homo sapiens
aatagatgtttgatagatt

SEQ ID NO: 6583654 - DNA, 22 bp, Homo sapiens
aatagatgtttgatagattttc

SEQ ID NO: 6583655 - DNA, 17 bp, Homo sapiens
aatagatgttttaactt

SEQ ID NO: 6583656 - DNA, 22 bp, Homo sapiens
aatagatgttttaacttattta

SEQ ID NO: 6583657 - DNA, 19 bp, Homo sapiens
aatagattactgatgtgat

SEQ ID NO: 6583658 - DNA, 20 bp, Homo sapiens
aatagattactgatgtgata

SEQ ID NO: 6583659 - DNA, 16 bp, Homo sapiens
aatagattaggtttgc

SEQ ID NO: 6583660 - DNA, 15 bp, Homo sapiens
aatagattatttcat

SEQ ID NO: 6583661 - DNA, 23 bp, Homo sapiens
aatagattatttcatatactata

SEQ ID NO: 6583662 - DNA, 12 bp, Homo sapiens
aatagattctct

SEQ ID NO: 6583663 - DNA, 20 bp, Homo sapiens
aatagattgtaatacacata

SEQ ID NO: 6583664 - DNA, 19 bp, Homo sapiens
aatagattgttttgccact

SEQ ID NO: 6583665 - DNA, 20 bp, Homo sapiens
aatagatttaggagcagaaa

SEQ ID NO: 6583666 - DNA, 17 bp, Homo sapiens
aatagatttgattattt

SEQ ID NO: 6583667 - DNA, 20 bp, Homo sapiens
aatagatttgattatttcct

SEQ ID NO: 6583668 - DNA, 21 bp, Homo sapiens
aatagatttgggtcatttaga

SEQ ID NO: 6583669 - DNA, 22 bp, Homo sapiens
aatagattttaagcttcattat

SEQ ID NO: 6583670 - DNA, 17 bp, Homo sapiens
aatagattttctctgga

SEQ ID NO: 6583671 - DNA, 14 bp, Homo sapiens
ttggctttatcctc

SEQ ID NO: 6583672 - DNA, 20 bp, Homo sapiens
ttggctttatcctctttaga

SEQ ID NO: 6583673 - DNA, 21 bp, Homo sapiens
ttggctttatcctctttagag

SEQ ID NO: 6583674 - DNA, 19 bp, Homo sapiens
ttggctttcacatttaaat

SEQ ID NO: 6583675 - DNA, 16 bp, Homo sapiens
ttggctttccagtcat

SEQ ID NO: 6583676 - DNA, 18 bp, Homo sapiens
ttggctttgcagctgctg

SEQ ID NO: 6583677 - DNA, 14 bp, Homo sapiens
ttggctttgtgctt

SEQ ID NO: 6583678 - DNA, 15 bp, Homo sapiens
ttggctttgtgcttg

SEQ ID NO: 6583679 - DNA, 15 bp, Homo sapiens
ttggcttttctgatc

SEQ ID NO: 6583680 - DNA, 19 bp, Homo sapiens
ttggcttttctgatccagt

SEQ ID NO: 6583681 - DNA, 22 bp, Homo sapiens
ttggcttttctgatccagtttt

SEQ ID NO: 6583682 - DNA, 14 bp, Homo sapiens
ttggctttttaaat

SEQ ID NO: 6583683 - DNA, 20 bp, Homo sapiens
ttggctttttccaaatgctt

SEQ ID NO: 6583684 - DNA, 15 bp, Homo sapiens
ttgggaaaacatttg

SEQ ID NO: 6583685 - DNA, 13 bp, Homo sapiens
ttgggaaaccaag

SEQ ID NO: 6583686 - DNA, 21 bp, Homo sapiens
ttgggaaacttgtcacttgca

SEQ ID NO: 6583687 - DNA, 15 bp, Homo sapiens
ttgggaaagcccaga

SEQ ID NO: 6583688 - DNA, 22 bp, Homo sapiens
ttgggaaagcccagactttagt

SEQ ID NO: 6583689 - DNA, 13 bp, Homo sapiens
ttgggaaagtatt

SEQ ID NO: 6583690 - DNA, 20 bp, Homo sapiens
ttgggaaattatctgcctta

SEQ ID NO: 6583691 - DNA, 22 bp, Homo sapiens
ttgggaaccaagctattccttt

SEQ ID NO: 6583692 - DNA, 10 bp, Homo sapiens
ttgggaagac

SEQ ID NO: 6583693 - DNA, 13 bp, Homo sapiens
ttgggaagcagtt

SEQ ID NO: 6583694 - DNA, 20 bp, Homo sapiens
ttgggaagcagtttcagata

SEQ ID NO: 6583695 - DNA, 11 bp, Homo sapiens
ttgggaagctg

SEQ ID NO: 6583696 - DNA, 13 bp, Homo sapiens
ttgggaaggacac

SEQ ID NO: 6583697 - DNA, 18 bp, Homo sapiens
ttgggaaggggtcctgca

SEQ ID NO: 6583698 - DNA, 20 bp, Homo sapiens
ttgggaaggggtcctgcagg

SEQ ID NO: 6583699 - DNA, 17 bp, Homo sapiens
ttgggaagtctcagcct

SEQ ID NO: 6583700 - DNA, 18 bp, Homo sapiens
ttgggaagtctcagcctg

SEQ ID NO: 6583701 - DNA, 16 bp, Homo sapiens
ttgggaagtgtgttta

SEQ ID NO: 6583702 - DNA, 17 bp, Homo sapiens
ttgggaataaatatgcc

SEQ ID NO: 6583703 - DNA, 16 bp, Homo sapiens
ttgggaatatttgaat

SEQ ID NO: 6583704 - DNA, 18 bp, Homo sapiens
ttgggaatggatcctgga

SEQ ID NO: 6583705 - DNA, 17 bp, Homo sapiens
ttgggaattgcatgcca

SEQ ID NO: 6583706 - DNA, 14 bp, Homo sapiens
ttgggaattttatt

SEQ ID NO: 6583707 - DNA, 13 bp, Homo sapiens
ttgggacagccag

SEQ ID NO: 6583708 - DNA, 16 bp, Homo sapiens
ttgggaccaggccaat

SEQ ID NO: 6583709 - DNA, 14 bp, Homo sapiens
ttgggacccctggt

SEQ ID NO: 6583710 - DNA, 15 bp, Homo sapiens
ttgggacccctggtg

SEQ ID NO: 6583711 - DNA, 20 bp, Homo sapiens
ttgggacccctggtggttca

SEQ ID NO: 6583712 - DNA, 20 bp, Homo sapiens
ttgggaccctgctttagagc

SEQ ID NO: 6583713 - DNA, 16 bp, Homo sapiens
ttgggaccgccagatg

SEQ ID NO: 6583714 - DNA, 15 bp, Homo sapiens
ttgggacctgctgct

SEQ ID NO: 6583715 - DNA, 19 bp, Homo sapiens
ttgggaccttgcgtgaaga

SEQ ID NO: 6583716 - DNA, 20 bp, Homo sapiens
ttgggacgtgtacagcacag

SEQ ID NO: 6583717 - DNA, 21 bp, Homo sapiens
ttgggacgtgtacagcacaga

SEQ ID NO: 6583718 - DNA, 14 bp, Homo sapiens
ttgggactagatca

SEQ ID NO: 6583719 - DNA, 19 bp, Homo sapiens
ttgggactcaggtctgtaa

SEQ ID NO: 6583720 - DNA, 15 bp, Homo sapiens
ttgggactgctgtga

SEQ ID NO: 6583721 - DNA, 23 bp, Homo sapiens
ttgggactgggtttggaccccag

SEQ ID NO: 6583722 - DNA, 14 bp, Homo sapiens
ttgggactgtcttg

SEQ ID NO: 6583723 - DNA, 19 bp, Homo sapiens
ttgggagacatggaccagc

SEQ ID NO: 6583724 - DNA, 14 bp, Homo sapiens
ttgggagacatgtg

SEQ ID NO: 6583725 - DNA, 13 bp, Homo sapiens
ttgggagagactt

SEQ ID NO: 6583726 - DNA, 16 bp, Homo sapiens
ttgggagagcaggaat

SEQ ID NO: 6583727 - DNA, 19 bp, Homo sapiens
ttgggagagcaggaatgaa

SEQ ID NO: 6583728 - DNA, 21 bp, Homo sapiens
ttgggagagccatacataaaa

SEQ ID NO: 6583729 - DNA, 15 bp, Homo sapiens
ttgggagagcccctg

SEQ ID NO: 6583730 - DNA, 16 bp, Homo sapiens
ttgggagagcccctgg

SEQ ID NO: 6583731 - DNA, 15 bp, Homo sapiens
ttgggagcactggag

SEQ ID NO: 6583732 - DNA, 16 bp, Homo sapiens
ttgggagcactggagt

SEQ ID NO: 6583733 - DNA, 18 bp, Homo sapiens
ttgggagccactgccact

SEQ ID NO: 6583734 - DNA, 18 bp, Homo sapiens
ttgggagccaggactccc

SEQ ID NO: 6583735 - DNA, 17 bp, Homo sapiens
ttgggagcttgggaatg

SEQ ID NO: 6583736 - DNA, 19 bp, Homo sapiens
ttgggagcttgggaatgga

SEQ ID NO: 6583737 - DNA, 17 bp, Homo sapiens
ttgggaggaagcagaat

SEQ ID NO: 6583738 - DNA, 18 bp, Homo sapiens
ttgggaggaagcagaata

SEQ ID NO: 6583739 - DNA, 19 bp, Homo sapiens
ttgggaggaagcagaataa

SEQ ID NO: 6583740 - DNA, 22 bp, Homo sapiens
ttgggaggaagcagaataaagc

SEQ ID NO: 6583741 - DNA, 15 bp, Homo sapiens
ttgggaggccaaggc

SEQ ID NO: 6583742 - DNA, 17 bp, Homo sapiens
ttgggaggccaaggcag

SEQ ID NO: 6583743 - DNA, 18 bp, Homo sapiens
ttgggaggccaaggcggg

SEQ ID NO: 6583744 - DNA, 16 bp, Homo sapiens
ttgggaggccatttgt

SEQ ID NO: 6583745 - DNA, 18 bp, Homo sapiens
ttgggaggccgaggcagg

SEQ ID NO: 6583746 - DNA, 15 bp, Homo sapiens
ttgggaggctgaggc

SEQ ID NO: 6583747 - DNA, 19 bp, Homo sapiens
ttgggaggctgaggcagga

SEQ ID NO: 6583748 - DNA, 15 bp, Homo sapiens
ttgggaggctggagt

SEQ ID NO: 6583749 - DNA, 17 bp, Homo sapiens
ttgggagggacagggct

SEQ ID NO: 6583750 - DNA, 23 bp, Homo sapiens
ttgggagggatgagagtggctta

SEQ ID NO: 6583751 - DNA, 20 bp, Homo sapiens
ttgggaggtccaggcaggag

SEQ ID NO: 6583752 - DNA, 11 bp, Homo sapiens
ttgggaggtgc

SEQ ID NO: 6583753 - DNA, 18 bp, Homo sapiens
ttgggagtatgttgtcat

SEQ ID NO: 6583754 - DNA, 17 bp, Homo sapiens
ttgggagtccaggcaca

SEQ ID NO: 6583755 - DNA, 18 bp, Homo sapiens
ttgggagtccaggcacag

SEQ ID NO: 6583756 - DNA, 19 bp, Homo sapiens
ttgggagtgagatgcctgc

SEQ ID NO: 6583757 - DNA, 18 bp, Homo sapiens
ttgggagttttgaatgtt

SEQ ID NO: 6583758 - DNA, 16 bp, Homo sapiens
ttgggatactgcaggg

SEQ ID NO: 6583759 - DNA, 23 bp, Homo sapiens
ttgggatactgcttattttatga

SEQ ID NO: 6583760 - DNA, 14 bp, Homo sapiens
ttgggatactgtaa

SEQ ID NO: 6583761 - DNA, 19 bp, Homo sapiens
ttgggatagcaaactccag

SEQ ID NO: 6583762 - DNA, 15 bp, Homo sapiens
ttgggatatctcctg

SEQ ID NO: 6583763 - DNA, 16 bp, Homo sapiens
ttgggatattaaaaca

SEQ ID NO: 6583764 - DNA, 19 bp, Homo sapiens
ttgggatccaggcccctcc

SEQ ID NO: 6583765 - DNA, 23 bp, Homo sapiens
ttgggatcgtcctggattcactg

SEQ ID NO: 6583766 - DNA, 17 bp, Homo sapiens
ttgggatgtcttatttt

SEQ ID NO: 6583767 - DNA, 18 bp, Homo sapiens
ttgggatgtcttattttt

SEQ ID NO: 6583768 - DNA, 23 bp, Homo sapiens
ttgggatgtcttatttttagatg

SEQ ID NO: 6583769 - DNA, 20 bp, Homo sapiens
ttgggatgtgagccccaggg

SEQ ID NO: 6583770 - DNA, 15 bp, Homo sapiens
ttgggattacaggtg

SEQ ID NO: 6583771 - DNA, 22 bp, Homo sapiens
ttgggattcctcccctggaagt

SEQ ID NO: 6583772 - DNA, 14 bp, Homo sapiens
ttgggatttgctgt

SEQ ID NO: 6583773 - DNA, 16 bp, Homo sapiens
ttgggatttgttgaaa

SEQ ID NO: 6583774 - DNA, 19 bp, Homo sapiens
ttgggcaaggacaccatag

SEQ ID NO: 6583775 - DNA, 14 bp, Homo sapiens
ttgggcaatataac

SEQ ID NO: 6583776 - DNA, 21 bp, Homo sapiens
ttgggcaatattctctgtaca

SEQ ID NO: 6583777 - DNA, 22 bp, Homo sapiens
ttgggcaccagcttctttctcg

SEQ ID NO: 6583778 - DNA, 18 bp, Homo sapiens
ttgggcacccccagcctg

SEQ ID NO: 6583779 - DNA, 11 bp, Homo sapiens
ttgggcagagc

SEQ ID NO: 6583780 - DNA, 21 bp, Homo sapiens
ttgggcagagctggctctgag

SEQ ID NO: 6583781 - DNA, 19 bp, Homo sapiens
ttgggcagcaatttaaatg

SEQ ID NO: 6583782 - DNA, 13 bp, Homo sapiens
ttgggcagccagg

SEQ ID NO: 6583783 - DNA, 19 bp, Homo sapiens
ttgggcagcgcccttcctc

SEQ ID NO: 6583784 - DNA, 22 bp, Homo sapiens
ttgggcagcgcccttcctctcc

SEQ ID NO: 6583785 - DNA, 23 bp, Homo sapiens
ttgggcagcgcccttcctctcca

SEQ ID NO: 6583786 - DNA, 17 bp, Homo sapiens
ttgggcatgtgggcttc

SEQ ID NO: 6583787 - DNA, 19 bp, Homo sapiens
ttgggcattagtgtccccc

SEQ ID NO: 6583788 - DNA, 21 bp, Homo sapiens
ttgggccaagccagctgccta

SEQ ID NO: 6583789 - DNA, 23 bp, Homo sapiens
ttgggccactgcactctagcctg

SEQ ID NO: 6583790 - DNA, 14 bp, Homo sapiens
ttgggccagacatg

SEQ ID NO: 6583791 - DNA, 21 bp, Homo sapiens
ttgggccataattatgaaaac

SEQ ID NO: 6583792 - DNA, 23 bp, Homo sapiens
ttgggccatactggcctcgcctg

SEQ ID NO: 6583793 - DNA, 17 bp, Homo sapiens
ttgggcccagctgggct

SEQ ID NO: 6583794 - DNA, 22 bp, Homo sapiens
ttgggcccaggaggtcaagcct

SEQ ID NO: 6583795 - DNA, 16 bp, Homo sapiens
ttgggcccagtagccc

SEQ ID NO: 6583796 - DNA, 17 bp, Homo sapiens
ttgggccccagggaact

SEQ ID NO: 6583797 - DNA, 19 bp, Homo sapiens
ttgggcccccatccctccc

SEQ ID NO: 6583798 - DNA, 16 bp, Homo sapiens
ttgggcccctcagagc

SEQ ID NO: 6583799 - DNA, 17 bp, Homo sapiens
ttgggccgaaagagaga

SEQ ID NO: 6583800 - DNA, 19 bp, Homo sapiens
ttgggccgaatcccccagg

SEQ ID NO: 6583801 - DNA, 12 bp, Homo sapiens
ttgggcctcagg

SEQ ID NO: 6583802 - DNA, 20 bp, Homo sapiens
ttgggcctcaggctctgcac

SEQ ID NO: 6583803 - DNA, 23 bp, Homo sapiens
ttgggcctcaggctctgcacaga

SEQ ID NO: 6583804 - DNA, 23 bp, Homo sapiens
ttgggcctccatgccccagctct

SEQ ID NO: 6583805 - DNA, 23 bp, Homo sapiens
ttgggcctcccactcccatggct

SEQ ID NO: 6583806 - DNA, 14 bp, Homo sapiens
ttgggcctctcctg

SEQ ID NO: 6583807 - DNA, 16 bp, Homo sapiens
ttgggcctctcctgcc

SEQ ID NO: 6583808 - DNA, 18 bp, Homo sapiens
ttgggcctctcctgccct

SEQ ID NO: 6583809 - DNA, 23 bp, Homo sapiens
ttgggcctctcctgccctctgct

SEQ ID NO: 6583810 - DNA, 16 bp, Homo sapiens
ttgggcctgctccaga

SEQ ID NO: 6583811 - DNA, 17 bp, Homo sapiens
ttgggcctgctccagac

SEQ ID NO: 6583812 - DNA, 16 bp, Homo sapiens
ttgggccttgctgctg

SEQ ID NO: 6583813 - DNA, 14 bp, Homo sapiens
ttgggcgtctcccc

SEQ ID NO: 6583814 - DNA, 20 bp, Homo sapiens
ttgggctaccctaaagggag

SEQ ID NO: 6583815 - DNA, 19 bp, Homo sapiens
ttgggctactggcagctcc

SEQ ID NO: 6583816 - DNA, 21 bp, Homo sapiens
ttgggctaggtagtggggacc

SEQ ID NO: 6583817 - DNA, 15 bp, Homo sapiens
ttgggctcaaagccc

SEQ ID NO: 6583818 - DNA, 14 bp, Homo sapiens
ttgggctcagggtt

SEQ ID NO: 6583819 - DNA, 19 bp, Homo sapiens
ttgggctcctggctgccag

SEQ ID NO: 6583820 - DNA, 17 bp, Homo sapiens
ttgggctcgcactgccc

SEQ ID NO: 6583821 - DNA, 22 bp, Homo sapiens
ttgggctctctctagctcccca

SEQ ID NO: 6583822 - DNA, 14 bp, Homo sapiens
ttgggctctgatga

SEQ ID NO: 6583823 - DNA, 16 bp, Homo sapiens
ttgggctgacacctac

SEQ ID NO: 6583824 - DNA, 15 bp, Homo sapiens
ttgggctgacccagc

SEQ ID NO: 6583825 - DNA, 16 bp, Homo sapiens
ttgggctgacccagca

SEQ ID NO: 6583826 - DNA, 17 bp, Homo sapiens
ttgggctgacccagcat

SEQ ID NO: 6583827 - DNA, 13 bp, Homo sapiens
ttgggctgagact

SEQ ID NO: 6583828 - DNA, 16 bp, Homo sapiens
ttgggctgagtgcagc

SEQ ID NO: 6583829 - DNA, 17 bp, Homo sapiens
ttgggctgagtgcagcc

SEQ ID NO: 6583830 - DNA, 13 bp, Homo sapiens
ttgggctggagct

SEQ ID NO: 6583831 - DNA, 19 bp, Homo sapiens
ttgggctggagctcctccc

SEQ ID NO: 6583832 - DNA, 20 bp, Homo sapiens
ttgggctggagctcctccct

SEQ ID NO: 6583833 - DNA, 13 bp, Homo sapiens
ttgggctggctct

SEQ ID NO: 6583834 - DNA, 20 bp, Homo sapiens
ttgggctgggacttcttacc

SEQ ID NO: 6583835 - DNA, 14 bp, Homo sapiens
ttgggctgtaaagc

SEQ ID NO: 6583836 - DNA, 21 bp, Homo sapiens
ttgggcttatttagaaaaaag

SEQ ID NO: 6583837 - DNA, 22 bp, Homo sapiens
ttgggcttatttagaaaaaagg

SEQ ID NO: 6583838 - DNA, 16 bp, Homo sapiens
ttgggcttccatgcct

SEQ ID NO: 6583839 - DNA, 18 bp, Homo sapiens
ttgggcttgacacctgtc

SEQ ID NO: 6583840 - DNA, 17 bp, Homo sapiens
ttgggcttgtgatttcc

SEQ ID NO: 6583841 - DNA, 16 bp, Homo sapiens
ttggggaaaaaagcac

SEQ ID NO: 6583842 - DNA, 22 bp, Homo sapiens
ttggggaaaaaagcacatacat

SEQ ID NO: 6583843 - DNA, 16 bp, Homo sapiens
ttggggaaaaagaatg

SEQ ID NO: 6583844 - DNA, 23 bp, Homo sapiens
ttggggaaacagcatctccaagc

SEQ ID NO: 6583845 - DNA, 16 bp, Homo sapiens
ttggggaaacttggga

SEQ ID NO: 6583846 - DNA, 14 bp, Homo sapiens
ttggggaaatgtgg

SEQ ID NO: 6583847 - DNA, 23 bp, Homo sapiens
ttggggaaccccgagctgggggg

SEQ ID NO: 6583848 - DNA, 14 bp, Homo sapiens
ttggggaagaccca

SEQ ID NO: 6583849 - DNA, 18 bp, Homo sapiens
ttggggaagttcaagtga

SEQ ID NO: 6583850 - DNA, 14 bp, Homo sapiens
ttggggacacatgt

SEQ ID NO: 6583851 - DNA, 20 bp, Homo sapiens
ttggggacacatgtatttgg

SEQ ID NO: 6583852 - DNA, 19 bp, Homo sapiens
ttggggacaccctcctgcc

SEQ ID NO: 6583853 - DNA, 22 bp, Homo sapiens
ttggggacaccctcctgccccc

SEQ ID NO: 6583854 - DNA, 17 bp, Homo sapiens
ttggggacagggggtgg

SEQ ID NO: 6583855 - DNA, 19 bp, Homo sapiens
ttggggacatctctttgaa

SEQ ID NO: 6583856 - DNA, 13 bp, Homo sapiens
ttggggaccagag

SEQ ID NO: 6583857 - DNA, 21 bp, Homo sapiens
ttggggagaaataaattttgt

SEQ ID NO: 6583858 - DNA, 23 bp, Homo sapiens
ttggggagacggtgttgcagaga

SEQ ID NO: 6583859 - DNA, 20 bp, Homo sapiens
ttggggaggacaaaacttct

SEQ ID NO: 6583860 - DNA, 12 bp, Homo sapiens
ttggggaggcaa

SEQ ID NO: 6583861 - DNA, 15 bp, Homo sapiens
ttggggagggagggg

SEQ ID NO: 6583862 - DNA, 13 bp, Homo sapiens
ttggggaggggcg

SEQ ID NO: 6583863 - DNA, 23 bp, Homo sapiens
ttggggagggggaagagaaattt

SEQ ID NO: 6583864 - DNA, 18 bp, Homo sapiens
ttggggagtacctgtcca

SEQ ID NO: 6583865 - DNA, 17 bp, Homo sapiens
ttggggagttaagacct

SEQ ID NO: 6583866 - DNA, 21 bp, Homo sapiens
ttggggagttaagacctggca

SEQ ID NO: 6583867 - DNA, 19 bp, Homo sapiens
ttggggatagtctggaaag

SEQ ID NO: 6583868 - DNA, 16 bp, Homo sapiens
ttggggcaagtcatgt

SEQ ID NO: 6583869 - DNA, 22 bp, Homo sapiens
ttggggcaggagtagctgagct

SEQ ID NO: 6583870 - DNA, 23 bp, Homo sapiens
ttggggcaggagtagctgagctc

SEQ ID NO: 6583871 - DNA, 15 bp, Homo sapiens
ttggggcatttgtaa

SEQ ID NO: 6583872 - DNA, 11 bp, Homo sapiens
ttggggcctgg

SEQ ID NO: 6583873 - DNA, 23 bp, Homo sapiens
ttggggcgcccacccggcccggc

SEQ ID NO: 6583874 - DNA, 19 bp, Homo sapiens
ttggggctacttatattct

SEQ ID NO: 6583875 - DNA, 18 bp, Homo sapiens
ttggggctcccagccagg

SEQ ID NO: 6583876 - DNA, 16 bp, Homo sapiens
ttggggctcttgatca

SEQ ID NO: 6583877 - DNA, 15 bp, Homo sapiens
ttggggcttatcaga

SEQ ID NO: 6583878 - DNA, 13 bp, Homo sapiens
ttggggcttcaca

SEQ ID NO: 6583879 - DNA, 21 bp, Homo sapiens
ttggggctttcccaggagaaa

SEQ ID NO: 6583880 - DNA, 17 bp, Homo sapiens
ttgggggaaaaaaaaga

SEQ ID NO: 6583881 - DNA, 20 bp, Homo sapiens
ttgggggaaaaaaaagaaaa

SEQ ID NO: 6583882 - DNA, 21 bp, Homo sapiens
ttgggggaaaaaaaagaaaaa

SEQ ID NO: 6583883 - DNA, 15 bp, Homo sapiens
ttgggggaaccagca

SEQ ID NO: 6583884 - DNA, 18 bp, Homo sapiens
ttgggggacagccttcag

SEQ ID NO: 6583885 - DNA, 17 bp, Homo sapiens
ttgggggacgcccagcc

SEQ ID NO: 6583886 - DNA, 23 bp, Homo sapiens
ttgggggacgcccagcccccacc

SEQ ID NO: 6583887 - DNA, 14 bp, Homo sapiens
ttgggggagggaag

SEQ ID NO: 6583888 - DNA, 19 bp, Homo sapiens
ttgggggattcaaatgcat

SEQ ID NO: 6583889 - DNA, 22 bp, Homo sapiens
ttgggggccctggggtccccac

SEQ ID NO: 6583890 - DNA, 19 bp, Homo sapiens
ttgggggctcatttttgct

SEQ ID NO: 6583891 - DNA, 17 bp, Homo sapiens
ttgggggctcggggagg

SEQ ID NO: 6583892 - DNA, 11 bp, Homo sapiens
ttgggggcttc

SEQ ID NO: 6583893 - DNA, 12 bp, Homo sapiens
ttggggggagag

SEQ ID NO: 6583894 - DNA, 22 bp, Homo sapiens
ttggggggagggggtgtctgca

SEQ ID NO: 6583895 - DNA, 13 bp, Homo sapiens
ttgggggggtggc

SEQ ID NO: 6583896 - DNA, 17 bp, Homo sapiens
ttggggggtgtgctgac

SEQ ID NO: 6583897 - DNA, 22 bp, Homo sapiens
ttgggggtcaggcagccagtga

SEQ ID NO: 6583898 - DNA, 20 bp, Homo sapiens
ttgggggtcagtgctgcctg

SEQ ID NO: 6583899 - DNA, 20 bp, Homo sapiens
ttgggggtcctcctccaggg

SEQ ID NO: 6583900 - DNA, 17 bp, Homo sapiens
ttgggggtgggaggtga

SEQ ID NO: 6583901 - DNA, 18 bp, Homo sapiens
ttgggggttaccaaaaat

SEQ ID NO: 6583902 - DNA, 19 bp, Homo sapiens
ttgggggttaccaaaaata

SEQ ID NO: 6583903 - DNA, 15 bp, Homo sapiens
ttgggggtttttaat

SEQ ID NO: 6583904 - DNA, 16 bp, Homo sapiens
ttggggtacaattgta

SEQ ID NO: 6583905 - DNA, 21 bp, Homo sapiens
ttggggtactcttgatgtgaa

SEQ ID NO: 6583906 - DNA, 16 bp, Homo sapiens
ttggggtagagaggac

SEQ ID NO: 6583907 - DNA, 21 bp, Homo sapiens
ttggggtagctagaggaacca

SEQ ID NO: 6583908 - DNA, 19 bp, Homo sapiens
ttggggtataggtctcatc

SEQ ID NO: 6583909 - DNA, 20 bp, Homo sapiens
ttggggtccctccaccccac

SEQ ID NO: 6583910 - DNA, 22 bp, Homo sapiens
ttggggtctcttttgtaaatta

SEQ ID NO: 6583911 - DNA, 17 bp, Homo sapiens
ttggggtctggcagcct

SEQ ID NO: 6583912 - DNA, 13 bp, Homo sapiens
ttggggtgacagt

SEQ ID NO: 6583913 - DNA, 13 bp, Homo sapiens
ttggggtgataag

SEQ ID NO: 6583914 - DNA, 10 bp, Homo sapiens
ttggggtgcc

SEQ ID NO: 6583915 - DNA, 14 bp, Homo sapiens
ttggggtgggggcc

SEQ ID NO: 6583916 - DNA, 21 bp, Homo sapiens
ttggggtggggggcaggatgg

SEQ ID NO: 6583917 - DNA, 21 bp, Homo sapiens
ttggggtgtttcaaaagtgga

SEQ ID NO: 6583918 - DNA, 16 bp, Homo sapiens
ttggggttaagtctcc

SEQ ID NO: 6583919 - DNA, 19 bp, Homo sapiens
ttggggttctacagtcgta

SEQ ID NO: 6583920 - DNA, 15 bp, Homo sapiens
ttggggttgtgttgt

SEQ ID NO: 6583921 - DNA, 15 bp, Homo sapiens
ttggggtttgatttg

SEQ ID NO: 6583922 - DNA, 16 bp, Homo sapiens
ttgggtactactgctg

SEQ ID NO: 6583923 - DNA, 19 bp, Homo sapiens
ttgggtactcgcacctctt

SEQ ID NO: 6583924 - DNA, 18 bp, Homo sapiens
ttgggtactggagctttt

SEQ ID NO: 6583925 - DNA, 16 bp, Homo sapiens
ttgggtagatgggtgg

SEQ ID NO: 6583926 - DNA, 18 bp, Homo sapiens
ttgggtagatgggtgggg

SEQ ID NO: 6583927 - DNA, 22 bp, Homo sapiens
ttgggtagctccctgatttgga

SEQ ID NO: 6583928 - DNA, 13 bp, Homo sapiens
ttgggtatcaaca

SEQ ID NO: 6583929 - DNA, 21 bp, Homo sapiens
ttgggtatgttaacctaggca

SEQ ID NO: 6583930 - DNA, 15 bp, Homo sapiens
ttgggtatttgattt

SEQ ID NO: 6583931 - DNA, 18 bp, Homo sapiens
ttgggtcacatgactctc

SEQ ID NO: 6583932 - DNA, 20 bp, Homo sapiens
ttgggtcaggttcttgcctt

SEQ ID NO: 6583933 - DNA, 18 bp, Homo sapiens
ttgggtcagtggccaggt

SEQ ID NO: 6583934 - DNA, 22 bp, Homo sapiens
ttgggtcataaatcagaaagtt

SEQ ID NO: 6583935 - DNA, 19 bp, Homo sapiens
ttgggtcattgacctctca

SEQ ID NO: 6583936 - DNA, 13 bp, Homo sapiens
ttgggtccaggag

SEQ ID NO: 6583937 - DNA, 17 bp, Homo sapiens
ttgggtccattcagatg

SEQ ID NO: 6583938 - DNA, 20 bp, Homo sapiens
ttgggtcccagctaaagagg

SEQ ID NO: 6583939 - DNA, 22 bp, Homo sapiens
ttgggtctacaagtatatgtga

SEQ ID NO: 6583940 - DNA, 18 bp, Homo sapiens
ttgggtctctctcggccc

SEQ ID NO: 6583941 - DNA, 13 bp, Homo sapiens
ttgggtctgccct

SEQ ID NO: 6583942 - DNA, 13 bp, Homo sapiens
ttgggtgaaaggt

SEQ ID NO: 6583943 - DNA, 15 bp, Homo sapiens
ttgggtgaatttcag

SEQ ID NO: 6583944 - DNA, 18 bp, Homo sapiens
ttgggtgacacctccgag

SEQ ID NO: 6583945 - DNA, 19 bp, Homo sapiens
ttgggtgctgctaattctt

SEQ ID NO: 6583946 - DNA, 21 bp, Homo sapiens
ttgggtggaattatatttgat

SEQ ID NO: 6583947 - DNA, 14 bp, Homo sapiens
ttgggtggagaagc

SEQ ID NO: 6583948 - DNA, 16 bp, Homo sapiens
ttgggtggatgcctgg

SEQ ID NO: 6583949 - DNA, 22 bp, Homo sapiens
ttgggtgggattttttcccttt

SEQ ID NO: 6583950 - DNA, 17 bp, Homo sapiens
ttgggtgggcaggaaaa

SEQ ID NO: 6583951 - DNA, 19 bp, Homo sapiens
ttgggtggggggcttcata

SEQ ID NO: 6583952 - DNA, 22 bp, Homo sapiens
ttgggtggtttgtgagccttgc

SEQ ID NO: 6583953 - DNA, 20 bp, Homo sapiens
ttgggtgtaacaggtctcct

SEQ ID NO: 6583954 - DNA, 15 bp, Homo sapiens
ttgggtgtagatttc

SEQ ID NO: 6583955 - DNA, 16 bp, Homo sapiens
ttgggtgtattgtgcg

SEQ ID NO: 6583956 - DNA, 15 bp, Homo sapiens
ttgggtgtgccctgg

SEQ ID NO: 6583957 - DNA, 17 bp, Homo sapiens
ttgggtgtgccctggct

SEQ ID NO: 6583958 - DNA, 21 bp, Homo sapiens
ttgggttaaaagatggttgta

SEQ ID NO: 6583959 - DNA, 18 bp, Homo sapiens
ttgggttactatttcttg

SEQ ID NO: 6583960 - DNA, 16 bp, Homo sapiens
ttgggttagacctaca

SEQ ID NO: 6583961 - DNA, 19 bp, Homo sapiens
ttgggttagcaatatttat

SEQ ID NO: 6583962 - DNA, 16 bp, Homo sapiens
ttgggttcatctgagc

SEQ ID NO: 6583963 - DNA, 17 bp, Homo sapiens
ttgggttcatgatgcag

SEQ ID NO: 6583964 - DNA, 12 bp, Homo sapiens
ttgggttccaga

SEQ ID NO: 6583965 - DNA, 13 bp, Homo sapiens
ttgggttccagac

SEQ ID NO: 6583966 - DNA, 14 bp, Homo sapiens
ttgggttccagaca

SEQ ID NO: 6583967 - DNA, 15 bp, Homo sapiens
ttgggttccagacag

SEQ ID NO: 6583968 - DNA, 16 bp, Homo sapiens
ttgggttccattctca

SEQ ID NO: 6583969 - DNA, 19 bp, Homo sapiens
ttgggttctttctgggggg

SEQ ID NO: 6583970 - DNA, 23 bp, Homo sapiens
ttgggttgatctcttagaagcca

SEQ ID NO: 6583971 - DNA, 13 bp, Homo sapiens
ttgggttgtttaa

SEQ ID NO: 6583972 - DNA, 17 bp, Homo sapiens
ttgggttgtttaaaaat

SEQ ID NO: 6583973 - DNA, 12 bp, Homo sapiens
ttgggtttattt

SEQ ID NO: 6583974 - DNA, 20 bp, Homo sapiens
ttgggtttggccagggaggc

SEQ ID NO: 6583975 - DNA, 22 bp, Homo sapiens
ttgggtttggccagggaggcgc

SEQ ID NO: 6583976 - DNA, 16 bp, Homo sapiens
ttgggttttcttccct

SEQ ID NO: 6583977 - DNA, 16 bp, Homo sapiens
ttgggtttttaactca

SEQ ID NO: 6583978 - DNA, 16 bp, Homo sapiens
ttgggtttttgctgtt

SEQ ID NO: 6583979 - DNA, 21 bp, Homo sapiens
ttggtaaaaacagcagctcat

SEQ ID NO: 6583980 - DNA, 19 bp, Homo sapiens
ttggtaaaacagtttcatc

SEQ ID NO: 6583981 - DNA, 22 bp, Homo sapiens
ttggtaaagggttaatagccag

SEQ ID NO: 6583982 - DNA, 17 bp, Homo sapiens
ttggtaaatgtttcttt

SEQ ID NO: 6583983 - DNA, 11 bp, Homo sapiens
ttggtaaattt

SEQ ID NO: 6583984 - DNA, 23 bp, Homo sapiens
ttggtaaatttccccaacagtgt

SEQ ID NO: 6583985 - DNA, 12 bp, Homo sapiens
ttggtaaatttt

SEQ ID NO: 6583986 - DNA, 19 bp, Homo sapiens
ttggtaacacaaattttca

SEQ ID NO: 6583987 - DNA, 16 bp, Homo sapiens
ttggtaacatcctttc

SEQ ID NO: 6583988 - DNA, 17 bp, Homo sapiens
ttggtaactaatgttat

SEQ ID NO: 6583989 - DNA, 19 bp, Homo sapiens
ttggtaacttgctgtgaaa

SEQ ID NO: 6583990 - DNA, 14 bp, Homo sapiens
ttggtaagagacag

SEQ ID NO: 6583991 - DNA, 15 bp, Homo sapiens
ttggtaatgcttgga

SEQ ID NO: 6583992 - DNA, 16 bp, Homo sapiens
ttggtaattaaaagac

SEQ ID NO: 6583993 - DNA, 15 bp, Homo sapiens
ttggtaattattttg

SEQ ID NO: 6583994 - DNA, 14 bp, Homo sapiens
ttggtacaaaaata

SEQ ID NO: 6583995 - DNA, 15 bp, Homo sapiens
ttggtacaaaaataa

SEQ ID NO: 6583996 - DNA, 14 bp, Homo sapiens
ttggtacacaacta

SEQ ID NO: 6583997 - DNA, 12 bp, Homo sapiens
ttggtacacatg

SEQ ID NO: 6583998 - DNA, 14 bp, Homo sapiens
ttggtacacatgtg

SEQ ID NO: 6583999 - DNA, 21 bp, Homo sapiens
ttggtacagttcataattcac

SEQ ID NO: 6584000 - DNA, 22 bp, Homo sapiens
ttggtacagttgcaggagcgtg

SEQ ID NO: 6584001 - DNA, 14 bp, Homo sapiens
ttggtaccagataa

SEQ ID NO: 6584002 - DNA, 14 bp, Homo sapiens
ttggtaccttgcac

SEQ ID NO: 6584003 - DNA, 21 bp, Homo sapiens
ttggtacctttctagccttag

SEQ ID NO: 6584004 - DNA, 23 bp, Homo sapiens
ttggtacctttctagccttagac

SEQ ID NO: 6584005 - DNA, 23 bp, Homo sapiens
ttggtagacttggacatctctct

SEQ ID NO: 6584006 - DNA, 13 bp, Homo sapiens
ttggtagagattc

SEQ ID NO: 6584007 - DNA, 15 bp, Homo sapiens
ttggtagagattcat

SEQ ID NO: 6584008 - DNA, 22 bp, Homo sapiens
ttggtagatcttcaatttggat

SEQ ID NO: 6584009 - DNA, 17 bp, Homo sapiens
ttggtagatgttctttt

SEQ ID NO: 6584010 - DNA, 13 bp, Homo sapiens
ttggtagattaaa

SEQ ID NO: 6584011 - DNA, 15 bp, Homo sapiens
ttggtagattaaata

SEQ ID NO: 6584012 - DNA, 16 bp, Homo sapiens
ttggtagcagcctggg

SEQ ID NO: 6584013 - DNA, 23 bp, Homo sapiens
ttggtaggagttttgttccagag

SEQ ID NO: 6584014 - DNA, 18 bp, Homo sapiens
ttggtaggcttatcaaaa

SEQ ID NO: 6584015 - DNA, 16 bp, Homo sapiens
ttggtaggtaaatcta

SEQ ID NO: 6584016 - DNA, 15 bp, Homo sapiens
ttggtagtgccccac

SEQ ID NO: 6584017 - DNA, 20 bp, Homo sapiens
ttggtagttctgtgcctccc

SEQ ID NO: 6584018 - DNA, 22 bp, Homo sapiens
ttggtagttctgtgcctccccc

SEQ ID NO: 6584019 - DNA, 21 bp, Homo sapiens
ttggtataatgtttaaatcat

SEQ ID NO: 6584020 - DNA, 13 bp, Homo sapiens
ttggtataggaat

SEQ ID NO: 6584021 - DNA, 16 bp, Homo sapiens
ttggtataggaatgta

SEQ ID NO: 6584022 - DNA, 17 bp, Homo sapiens
ttggtatatccttttct

SEQ ID NO: 6584023 - DNA, 13 bp, Homo sapiens
ttggtatccttat

SEQ ID NO: 6584024 - DNA, 17 bp, Homo sapiens
ttggtatctcaggtctg

SEQ ID NO: 6584025 - DNA, 13 bp, Homo sapiens
ttggtatgaaaca

SEQ ID NO: 6584026 - DNA, 21 bp, Homo sapiens
ttggtatgaaacaaatatact

SEQ ID NO: 6584027 - DNA, 13 bp, Homo sapiens
ttggtatggagtt

SEQ ID NO: 6584028 - DNA, 18 bp, Homo sapiens
aatagattttctctggaa

SEQ ID NO: 6584029 - DNA, 19 bp, Homo sapiens
aatagcaaaagaagaagtt

SEQ ID NO: 6584030 - DNA, 15 bp, Homo sapiens
aatagcaacttttgt

SEQ ID NO: 6584031 - DNA, 19 bp, Homo sapiens
aatagcaacttttgtgtaa

SEQ ID NO: 6584032 - DNA, 19 bp, Homo sapiens
aatagcaaggccagggcac

SEQ ID NO: 6584033 - DNA, 13 bp, Homo sapiens
aatagcacatgat

SEQ ID NO: 6584034 - DNA, 19 bp, Homo sapiens
aatagcacatgattttctt

SEQ ID NO: 6584035 - DNA, 17 bp, Homo sapiens
aatagcacccatatctg

SEQ ID NO: 6584036 - DNA, 19 bp, Homo sapiens
aatagcacccatatctgtg

SEQ ID NO: 6584037 - DNA, 13 bp, Homo sapiens
aatagcactaacc

SEQ ID NO: 6584038 - DNA, 14 bp, Homo sapiens
aatagcactttttg

SEQ ID NO: 6584039 - DNA, 18 bp, Homo sapiens
aatagcagtggcaaaata

SEQ ID NO: 6584040 - DNA, 21 bp, Homo sapiens
aatagcagtggcaaaatatta

SEQ ID NO: 6584041 - DNA, 16 bp, Homo sapiens
aatagcatactgtgta

SEQ ID NO: 6584042 - DNA, 18 bp, Homo sapiens
aatagcatactgtgtatg

SEQ ID NO: 6584043 - DNA, 20 bp, Homo sapiens
aatagcatactgtgtatgtt

SEQ ID NO: 6584044 - DNA, 12 bp, Homo sapiens
aatagcatgtca

SEQ ID NO: 6584045 - DNA, 15 bp, Homo sapiens
aatagcatgtcacta

SEQ ID NO: 6584046 - DNA, 15 bp, Homo sapiens
aatagcatgttgtag

SEQ ID NO: 6584047 - DNA, 17 bp, Homo sapiens
aatagcatgttgtagat

SEQ ID NO: 6584048 - DNA, 16 bp, Homo sapiens
aatagcattgttcttc

SEQ ID NO: 6584049 - DNA, 17 bp, Homo sapiens
aatagccaaagatttca

SEQ ID NO: 6584050 - DNA, 20 bp, Homo sapiens
aatagccaaagatttcatat

SEQ ID NO: 6584051 - DNA, 22 bp, Homo sapiens
aatagccaacacccatctgttt

SEQ ID NO: 6584052 - DNA, 20 bp, Homo sapiens
aatagccacatttggaatac

SEQ ID NO: 6584053 - DNA, 20 bp, Homo sapiens
aatagccactaaccttgcct

SEQ ID NO: 6584054 - DNA, 21 bp, Homo sapiens
aatagccactaaccttgcctg

SEQ ID NO: 6584055 - DNA, 23 bp, Homo sapiens
aatagccactaaccttgcctggt

SEQ ID NO: 6584056 - DNA, 23 bp, Homo sapiens
aatagccactgcataccaacctg

SEQ ID NO: 6584057 - DNA, 20 bp, Homo sapiens
aatagccacttaccttcaat

SEQ ID NO: 6584058 - DNA, 22 bp, Homo sapiens
aatagccacttaccttcaataa

SEQ ID NO: 6584059 - DNA, 22 bp, Homo sapiens
aatagccagagaggagcacctg

SEQ ID NO: 6584060 - DNA, 18 bp, Homo sapiens
aatagccatatttgtaaa

SEQ ID NO: 6584061 - DNA, 22 bp, Homo sapiens
aatagccatatttgtaaaatga

SEQ ID NO: 6584062 - DNA, 22 bp, Homo sapiens
aatagcccataaagtctgagaa

SEQ ID NO: 6584063 - DNA, 15 bp, Homo sapiens
aatagccccagactg

SEQ ID NO: 6584064 - DNA, 21 bp, Homo sapiens
aatagccgaactccaggctgg

SEQ ID NO: 6584065 - DNA, 15 bp, Homo sapiens
aatagcctaaaagat

SEQ ID NO: 6584066 - DNA, 14 bp, Homo sapiens
aatagcctcacctt

SEQ ID NO: 6584067 - DNA, 14 bp, Homo sapiens
aatagcctgaattt

SEQ ID NO: 6584068 - DNA, 20 bp, Homo sapiens
aatagcctgcctcttctcta

SEQ ID NO: 6584069 - DNA, 17 bp, Homo sapiens
aatagcggccctggagg

SEQ ID NO: 6584070 - DNA, 18 bp, Homo sapiens
aatagcggccctggagga

SEQ ID NO: 6584071 - DNA, 18 bp, Homo sapiens
aatagcgtcataactaga

SEQ ID NO: 6584072 - DNA, 17 bp, Homo sapiens
aatagctaagatataat

SEQ ID NO: 6584073 - DNA, 16 bp, Homo sapiens
aatagctaataataaa

SEQ ID NO: 6584074 - DNA, 17 bp, Homo sapiens
aatagctaataataaat

SEQ ID NO: 6584075 - DNA, 16 bp, Homo sapiens
aatagctaataatgtt

SEQ ID NO: 6584076 - DNA, 18 bp, Homo sapiens
aatagctatatccatgta

SEQ ID NO: 6584077 - DNA, 20 bp, Homo sapiens
aatagctatatccatgtact

SEQ ID NO: 6584078 - DNA, 20 bp, Homo sapiens
aatagctatcctaaatttga

SEQ ID NO: 6584079 - DNA, 22 bp, Homo sapiens
aatagctattgcatgtaaaatg

SEQ ID NO: 6584080 - DNA, 19 bp, Homo sapiens
aatagctcacagcacattt

SEQ ID NO: 6584081 - DNA, 21 bp, Homo sapiens
aatagctcacagcacatttgt

SEQ ID NO: 6584082 - DNA, 17 bp, Homo sapiens
aatagctccaagctgtt

SEQ ID NO: 6584083 - DNA, 20 bp, Homo sapiens
aatagctctactgccctccc

SEQ ID NO: 6584084 - DNA, 14 bp, Homo sapiens
aatagctctgtgtg

SEQ ID NO: 6584085 - DNA, 19 bp, Homo sapiens
aatagctctttcagggggg

SEQ ID NO: 6584086 - DNA, 12 bp, Homo sapiens
aatagctgaacc

SEQ ID NO: 6584087 - DNA, 13 bp, Homo sapiens
aatagctgaacct

SEQ ID NO: 6584088 - DNA, 22 bp, Homo sapiens
aatagctgaacctgttcaaaat

SEQ ID NO: 6584089 - DNA, 21 bp, Homo sapiens
aatagctgcccatttcgtgag

SEQ ID NO: 6584090 - DNA, 13 bp, Homo sapiens
aatagctgtcata

SEQ ID NO: 6584091 - DNA, 21 bp, Homo sapiens
aatagctgttttgtgtatatt

SEQ ID NO: 6584092 - DNA, 17 bp, Homo sapiens
aatagcttatgaaaaga

SEQ ID NO: 6584093 - DNA, 15 bp, Homo sapiens
aatagcttatgccta

SEQ ID NO: 6584094 - DNA, 18 bp, Homo sapiens
aatagcttctgtgtgtga

SEQ ID NO: 6584095 - DNA, 16 bp, Homo sapiens
aatagctttaatgata

SEQ ID NO: 6584096 - DNA, 20 bp, Homo sapiens
aatagctttactgtttctca

SEQ ID NO: 6584097 - DNA, 22 bp, Homo sapiens
aatagctttgagatttcagcta

SEQ ID NO: 6584098 - DNA, 17 bp, Homo sapiens
aatagcttttattgtat

SEQ ID NO: 6584099 - DNA, 20 bp, Homo sapiens
aatagcttttcacttcttaa

SEQ ID NO: 6584100 - DNA, 11 bp, Homo sapiens
aatagcttttt

SEQ ID NO: 6584101 - DNA, 24 bp, Homo sapiens
aatagcttttttctctgatacaga

SEQ ID NO: 6584102 - DNA, 19 bp, Homo sapiens
aataggaaagatttaatgt

SEQ ID NO: 6584103 - DNA, 20 bp, Homo sapiens
aataggaacaatctttgctg

SEQ ID NO: 6584104 - DNA, 16 bp, Homo sapiens
aataggaagaacagta

SEQ ID NO: 6584105 - DNA, 23 bp, Homo sapiens
aataggaagattaaaaccacaga

SEQ ID NO: 6584106 - DNA, 19 bp, Homo sapiens
aataggaatcattcagaaa

SEQ ID NO: 6584107 - DNA, 23 bp, Homo sapiens
aataggaatcattcagaaatgtt

SEQ ID NO: 6584108 - DNA, 15 bp, Homo sapiens
aataggaccagagcg

SEQ ID NO: 6584109 - DNA, 23 bp, Homo sapiens
aataggaccagagcggtatctct

SEQ ID NO: 6584110 - DNA, 23 bp, Homo sapiens
aataggagaggatgagagcccag

SEQ ID NO: 6584111 - DNA, 13 bp, Homo sapiens
aataggaggaaaa

SEQ ID NO: 6584112 - DNA, 18 bp, Homo sapiens
aataggaggacagaacca

SEQ ID NO: 6584113 - DNA, 17 bp, Homo sapiens
aataggagggaaacctt

SEQ ID NO: 6584114 - DNA, 19 bp, Homo sapiens
aataggagggaaacctttg

SEQ ID NO: 6584115 - DNA, 22 bp, Homo sapiens
aataggagtgggtattatgcaa

SEQ ID NO: 6584116 - DNA, 21 bp, Homo sapiens
aataggagtggtgatttgaaa

SEQ ID NO: 6584117 - DNA, 19 bp, Homo sapiens
aataggatataaaacacat

SEQ ID NO: 6584118 - DNA, 22 bp, Homo sapiens
aataggattgcttcaattaaaa

SEQ ID NO: 6584119 - DNA, 11 bp, Homo sapiens
aataggatttg

SEQ ID NO: 6584120 - DNA, 21 bp, Homo sapiens
aataggatttgcactgcttta

SEQ ID NO: 6584121 - DNA, 13 bp, Homo sapiens
aataggcaaaggg

SEQ ID NO: 6584122 - DNA, 16 bp, Homo sapiens
aataggcaaattaatc

SEQ ID NO: 6584123 - DNA, 15 bp, Homo sapiens
aataggcattttaag

SEQ ID NO: 6584124 - DNA, 22 bp, Homo sapiens
aataggcgatcacaacgtgcat

SEQ ID NO: 6584125 - DNA, 18 bp, Homo sapiens
aataggcggggcttgcct

SEQ ID NO: 6584126 - DNA, 17 bp, Homo sapiens
aataggctttttaggaa

SEQ ID NO: 6584127 - DNA, 22 bp, Homo sapiens
aatagggaaaatacctatttta

SEQ ID NO: 6584128 - DNA, 19 bp, Homo sapiens
aatagggaactgtaatggc

SEQ ID NO: 6584129 - DNA, 21 bp, Homo sapiens
aatagggaagtaaaaaaacaa

SEQ ID NO: 6584130 - DNA, 20 bp, Homo sapiens
aatagggctaaatgtttaaa

SEQ ID NO: 6584131 - DNA, 22 bp, Homo sapiens
aatagggctaaatgtttaaaga

SEQ ID NO: 6584132 - DNA, 18 bp, Homo sapiens
aatagggctaggaatata

SEQ ID NO: 6584133 - DNA, 21 bp, Homo sapiens
aatagggggatataatacata

SEQ ID NO: 6584134 - DNA, 22 bp, Homo sapiens
aatagggtagaatgattaatca

SEQ ID NO: 6584135 - DNA, 17 bp, Homo sapiens
aataggtaaatgtattt

SEQ ID NO: 6584136 - DNA, 20 bp, Homo sapiens
aataggtactgccatatttt

SEQ ID NO: 6584137 - DNA, 21 bp, Homo sapiens
aataggtagcctgctgtgggg

SEQ ID NO: 6584138 - DNA, 15 bp, Homo sapiens
aataggtatatagaa

SEQ ID NO: 6584139 - DNA, 19 bp, Homo sapiens
aataggtctttctctcagt

SEQ ID NO: 6584140 - DNA, 22 bp, Homo sapiens
aataggtgggggaaaatgaatt

SEQ ID NO: 6584141 - DNA, 23 bp, Homo sapiens
aataggtgggggaaaatgaattt

SEQ ID NO: 6584142 - DNA, 19 bp, Homo sapiens
aataggtgtgatttcctaa

SEQ ID NO: 6584143 - DNA, 16 bp, Homo sapiens
aataggttcttcttgt

SEQ ID NO: 6584144 - DNA, 14 bp, Homo sapiens
aataggtttcaaca

SEQ ID NO: 6584145 - DNA, 16 bp, Homo sapiens
aataggttttaaacga

SEQ ID NO: 6584146 - DNA, 22 bp, Homo sapiens
aatagtaaaagataacaagatc

SEQ ID NO: 6584147 - DNA, 15 bp, Homo sapiens
aatagtaaacattaa

SEQ ID NO: 6584148 - DNA, 19 bp, Homo sapiens
aatagtaaacattaagtaa

SEQ ID NO: 6584149 - DNA, 20 bp, Homo sapiens
aatagtaaactaaagtatgg

SEQ ID NO: 6584150 - DNA, 21 bp, Homo sapiens
aatagtaagcctccctcctcg

SEQ ID NO: 6584151 - DNA, 13 bp, Homo sapiens
aatagtaatataa

SEQ ID NO: 6584152 - DNA, 22 bp, Homo sapiens
aatagtaattttttacattttc

SEQ ID NO: 6584153 - DNA, 19 bp, Homo sapiens
aatagtaggctaaaaacat

SEQ ID NO: 6584154 - DNA, 18 bp, Homo sapiens
aatagtatacattgtctt

SEQ ID NO: 6584155 - DNA, 16 bp, Homo sapiens
aatagtatacatttta

SEQ ID NO: 6584156 - DNA, 13 bp, Homo sapiens
aatagtatagaaa

SEQ ID NO: 6584157 - DNA, 14 bp, Homo sapiens
aatagtatagaaaa

SEQ ID NO: 6584158 - DNA, 15 bp, Homo sapiens
aatagtatagaaaat

SEQ ID NO: 6584159 - DNA, 13 bp, Homo sapiens
aatagtatagaca

SEQ ID NO: 6584160 - DNA, 14 bp, Homo sapiens
aatagtatcctcca

SEQ ID NO: 6584161 - DNA, 15 bp, Homo sapiens
aatagtatcctccag

SEQ ID NO: 6584162 - DNA, 14 bp, Homo sapiens
aatagtattaacta

SEQ ID NO: 6584163 - DNA, 16 bp, Homo sapiens
aatagtatttcccatt

SEQ ID NO: 6584164 - DNA, 22 bp, Homo sapiens
aatagtatttctcctttgcaat

SEQ ID NO: 6584165 - DNA, 23 bp, Homo sapiens
aatagtatttgagagttctaaat

SEQ ID NO: 6584166 - DNA, 15 bp, Homo sapiens
aatagtcaaaaatta

SEQ ID NO: 6584167 - DNA, 21 bp, Homo sapiens
aatagtcaaaaattaaatata

SEQ ID NO: 6584168 - DNA, 16 bp, Homo sapiens
aatagtcaagaaaaat

SEQ ID NO: 6584169 - DNA, 15 bp, Homo sapiens
aatagtcagaaaaca

SEQ ID NO: 6584170 - DNA, 14 bp, Homo sapiens
aatagtcagagtgt

SEQ ID NO: 6584171 - DNA, 18 bp, Homo sapiens
aatagtcatatgtgaaga

SEQ ID NO: 6584172 - DNA, 16 bp, Homo sapiens
aatagtcatgattcta

SEQ ID NO: 6584173 - DNA, 15 bp, Homo sapiens
aatagtcatgtttct

SEQ ID NO: 6584174 - DNA, 14 bp, Homo sapiens
aatagtcattaaaa

SEQ ID NO: 6584175 - DNA, 14 bp, Homo sapiens
aatagtccaatatt

SEQ ID NO: 6584176 - DNA, 18 bp, Homo sapiens
aatagtcctccaaaacac

SEQ ID NO: 6584177 - DNA, 19 bp, Homo sapiens
aatagtctagactaaaaga

SEQ ID NO: 6584178 - DNA, 20 bp, Homo sapiens
aatagtctagactaaaagat

SEQ ID NO: 6584179 - DNA, 20 bp, Homo sapiens
aatagtctagatggctcctc

SEQ ID NO: 6584180 - DNA, 15 bp, Homo sapiens
aatagtctatatttt

SEQ ID NO: 6584181 - DNA, 24 bp, Homo sapiens
aatagtctctctgcaagacagaaa

SEQ ID NO: 6584182 - DNA, 22 bp, Homo sapiens
aatagtctctgggtttacaaca

SEQ ID NO: 6584183 - DNA, 21 bp, Homo sapiens
aatagtctgattttaatgaaa

SEQ ID NO: 6584184 - DNA, 16 bp, Homo sapiens
aatagtctgccacaag

SEQ ID NO: 6584185 - DNA, 14 bp, Homo sapiens
aatagtctgtgtga

SEQ ID NO: 6584186 - DNA, 15 bp, Homo sapiens
aatagtctgtgtgaa

SEQ ID NO: 6584187 - DNA, 18 bp, Homo sapiens
aatagtcttttgcatgtc

SEQ ID NO: 6584188 - DNA, 15 bp, Homo sapiens
aatagtgaaatgaat

SEQ ID NO: 6584189 - DNA, 22 bp, Homo sapiens
aatagtgatttccttaatgaaa

SEQ ID NO: 6584190 - DNA, 14 bp, Homo sapiens
aatagtgcctcagc

SEQ ID NO: 6584191 - DNA, 21 bp, Homo sapiens
aatagtgcctcagcgctgccc

SEQ ID NO: 6584192 - DNA, 15 bp, Homo sapiens
aatagtggaacattt

SEQ ID NO: 6584193 - DNA, 17 bp, Homo sapiens
aatagtggacatggtca

SEQ ID NO: 6584194 - DNA, 16 bp, Homo sapiens
aatagtggccagacca

SEQ ID NO: 6584195 - DNA, 18 bp, Homo sapiens
aatagtgggatcaaagct

SEQ ID NO: 6584196 - DNA, 16 bp, Homo sapiens
aatagtgtaagaactg

SEQ ID NO: 6584197 - DNA, 19 bp, Homo sapiens
aatagtgtaagaactgtac

SEQ ID NO: 6584198 - DNA, 23 bp, Homo sapiens
aatagtgtcaccaattccaccaa

SEQ ID NO: 6584199 - DNA, 23 bp, Homo sapiens
aatagtgtcatcctcacagtgaa

SEQ ID NO: 6584200 - DNA, 19 bp, Homo sapiens
aatagtgttaatcaattta

SEQ ID NO: 6584201 - DNA, 15 bp, Homo sapiens
aatagttaaaaatta

SEQ ID NO: 6584202 - DNA, 16 bp, Homo sapiens
aatagttaaaaattaa

SEQ ID NO: 6584203 - DNA, 20 bp, Homo sapiens
aatagttaaaaattaaatat

SEQ ID NO: 6584204 - DNA, 16 bp, Homo sapiens
ttggtattaataaaaa

SEQ ID NO: 6584205 - DNA, 18 bp, Homo sapiens
ttggtattaataaaaaga

SEQ ID NO: 6584206 - DNA, 12 bp, Homo sapiens
ttggtattgtat

SEQ ID NO: 6584207 - DNA, 13 bp, Homo sapiens
ttggtattgtatt

SEQ ID NO: 6584208 - DNA, 21 bp, Homo sapiens
ttggtattgtatttattcaat

SEQ ID NO: 6584209 - DNA, 12 bp, Homo sapiens
ttggtatttact

SEQ ID NO: 6584210 - DNA, 22 bp, Homo sapiens
ttggtatttatctattgtaaga

SEQ ID NO: 6584211 - DNA, 13 bp, Homo sapiens
ttggtcaaacttt

SEQ ID NO: 6584212 - DNA, 22 bp, Homo sapiens
ttggtcaaactttttccagcaa

SEQ ID NO: 6584213 - DNA, 18 bp, Homo sapiens
ttggtcaaatcaactgaa

SEQ ID NO: 6584214 - DNA, 17 bp, Homo sapiens
ttggtcaaggccacctc

SEQ ID NO: 6584215 - DNA, 21 bp, Homo sapiens
ttggtcaaggccacctctgcc

SEQ ID NO: 6584216 - DNA, 20 bp, Homo sapiens
ttggtcacaaagctatttaa

SEQ ID NO: 6584217 - DNA, 23 bp, Homo sapiens
ttggtcacaaagctatttaagtg

SEQ ID NO: 6584218 - DNA, 13 bp, Homo sapiens
ttggtcacatgga

SEQ ID NO: 6584219 - DNA, 14 bp, Homo sapiens
ttggtcactccagt

SEQ ID NO: 6584220 - DNA, 14 bp, Homo sapiens
ttggtcaggctggt

SEQ ID NO: 6584221 - DNA, 18 bp, Homo sapiens
ttggtcaggctggtctca

SEQ ID NO: 6584222 - DNA, 17 bp, Homo sapiens
ttggtcatctctcctgt

SEQ ID NO: 6584223 - DNA, 17 bp, Homo sapiens
ttggtccaaaaaaagga

SEQ ID NO: 6584224 - DNA, 19 bp, Homo sapiens
ttggtccaaaaaaaggaaa

SEQ ID NO: 6584225 - DNA, 23 bp, Homo sapiens
ttggtccaaagtgcgtgtgtgta

SEQ ID NO: 6584226 - DNA, 14 bp, Homo sapiens
ttggtccactgtgt

SEQ ID NO: 6584227 - DNA, 17 bp, Homo sapiens
ttggtccactgtgttta

SEQ ID NO: 6584228 - DNA, 17 bp, Homo sapiens
ttggtccacttttccag

SEQ ID NO: 6584229 - DNA, 12 bp, Homo sapiens
ttggtcccaagt

SEQ ID NO: 6584230 - DNA, 15 bp, Homo sapiens
ttggtcccctccctc

SEQ ID NO: 6584231 - DNA, 16 bp, Homo sapiens
ttggtcccctccctcg

SEQ ID NO: 6584232 - DNA, 19 bp, Homo sapiens
ttggtcccctccctcgtgg

SEQ ID NO: 6584233 - DNA, 21 bp, Homo sapiens
ttggtcccctccctcgtgggc

SEQ ID NO: 6584234 - DNA, 22 bp, Homo sapiens
ttggtcccctccctcgtgggct

SEQ ID NO: 6584235 - DNA, 20 bp, Homo sapiens
ttggtcccgtggatgctctt

SEQ ID NO: 6584236 - DNA, 12 bp, Homo sapiens
ttggtccctctc

SEQ ID NO: 6584237 - DNA, 12 bp, Homo sapiens
ttggtccctggt

SEQ ID NO: 6584238 - DNA, 20 bp, Homo sapiens
ttggtcctacctattatcct

SEQ ID NO: 6584239 - DNA, 17 bp, Homo sapiens
ttggtcctcttgccatc

SEQ ID NO: 6584240 - DNA, 21 bp, Homo sapiens
ttggtcctgcctaaatttcac

SEQ ID NO: 6584241 - DNA, 12 bp, Homo sapiens
ttggtcctgctg

SEQ ID NO: 6584242 - DNA, 13 bp, Homo sapiens
ttggtcctgctgc

SEQ ID NO: 6584243 - DNA, 21 bp, Homo sapiens
ttggtcctggaggctcaaatt

SEQ ID NO: 6584244 - DNA, 19 bp, Homo sapiens
ttggtcctggtgctgccga

SEQ ID NO: 6584245 - DNA, 22 bp, Homo sapiens
ttggtcctgtcaccctggcccc

SEQ ID NO: 6584246 - DNA, 23 bp, Homo sapiens
ttggtcctgtcaccctggcccca

SEQ ID NO: 6584247 - DNA, 16 bp, Homo sapiens
ttggtccttctttcct

SEQ ID NO: 6584248 - DNA, 18 bp, Homo sapiens
ttggtccttctttcctct

SEQ ID NO: 6584249 - DNA, 13 bp, Homo sapiens
ttggtcctttctc

SEQ ID NO: 6584250 - DNA, 14 bp, Homo sapiens
ttggtctctatttc

SEQ ID NO: 6584251 - DNA, 18 bp, Homo sapiens
ttggtctctatttcattt

SEQ ID NO: 6584252 - DNA, 14 bp, Homo sapiens
ttggtctctttctt

SEQ ID NO: 6584253 - DNA, 19 bp, Homo sapiens
ttggtctctttctttccaa

SEQ ID NO: 6584254 - DNA, 19 bp, Homo sapiens
ttggtctgccttctgctga

SEQ ID NO: 6584255 - DNA, 17 bp, Homo sapiens
ttggtctggactgacag

SEQ ID NO: 6584256 - DNA, 21 bp, Homo sapiens
ttggtctgttttggtcccctc

SEQ ID NO: 6584257 - DNA, 23 bp, Homo sapiens
ttggtcttactttgttaatttat

SEQ ID NO: 6584258 - DNA, 20 bp, Homo sapiens
ttggtcttcagcctccctca

SEQ ID NO: 6584259 - DNA, 14 bp, Homo sapiens
ttggtcttccatgg

SEQ ID NO: 6584260 - DNA, 17 bp, Homo sapiens
ttggtctttctaatgta

SEQ ID NO: 6584261 - DNA, 14 bp, Homo sapiens
ttggtctttgtatc

SEQ ID NO: 6584262 - DNA, 20 bp, Homo sapiens
ttggtgaaaataagaaagaa

SEQ ID NO: 6584263 - DNA, 19 bp, Homo sapiens
ttggtgaacagagagaacc

SEQ ID NO: 6584264 - DNA, 22 bp, Homo sapiens
ttggtgaatcggttgttctttc

SEQ ID NO: 6584265 - DNA, 21 bp, Homo sapiens
ttggtgaattttcaaggcctt

SEQ ID NO: 6584266 - DNA, 22 bp, Homo sapiens
ttggtgacaaaattcatttgct

SEQ ID NO: 6584267 - DNA, 18 bp, Homo sapiens
ttggtgactgggaaagtt

SEQ ID NO: 6584268 - DNA, 15 bp, Homo sapiens
ttggtgactgtccca

SEQ ID NO: 6584269 - DNA, 18 bp, Homo sapiens
ttggtgagaaacctgtat

SEQ ID NO: 6584270 - DNA, 12 bp, Homo sapiens
ttggtgagaagg

SEQ ID NO: 6584271 - DNA, 11 bp, Homo sapiens
ttggtgaggac

SEQ ID NO: 6584272 - DNA, 21 bp, Homo sapiens
ttggtgagtcttggttctaaa

SEQ ID NO: 6584273 - DNA, 22 bp, Homo sapiens
ttggtgagtcttggttctaaag

SEQ ID NO: 6584274 - DNA, 21 bp, Homo sapiens
ttggtgatgtaaaacagaata

SEQ ID NO: 6584275 - DNA, 21 bp, Homo sapiens
ttggtgattaaggtcctgctt

SEQ ID NO: 6584276 - DNA, 20 bp, Homo sapiens
ttggtgattccgcagtgaga

SEQ ID NO: 6584277 - DNA, 21 bp, Homo sapiens
ttggtgcaacccttacccctt

SEQ ID NO: 6584278 - DNA, 23 bp, Homo sapiens
ttggtgcacagattgctgaaact

SEQ ID NO: 6584279 - DNA, 17 bp, Homo sapiens
ttggtgcacagtgattt

SEQ ID NO: 6584280 - DNA, 18 bp, Homo sapiens
ttggtgcacagtgatttt

SEQ ID NO: 6584281 - DNA, 15 bp, Homo sapiens
ttggtgcatagaact

SEQ ID NO: 6584282 - DNA, 21 bp, Homo sapiens
ttggtgcatagaactgggtaa

SEQ ID NO: 6584283 - DNA, 21 bp, Homo sapiens
ttggtgccaccaaaagtgctc

SEQ ID NO: 6584284 - DNA, 18 bp, Homo sapiens
ttggtgccctcgcctcct

SEQ ID NO: 6584285 - DNA, 14 bp, Homo sapiens
ttggtgccctgaac

SEQ ID NO: 6584286 - DNA, 20 bp, Homo sapiens
ttggtgccgatgttgaactt

SEQ ID NO: 6584287 - DNA, 21 bp, Homo sapiens
ttggtgccgatgttgaacttt

SEQ ID NO: 6584288 - DNA, 12 bp, Homo sapiens
ttggtgcctctg

SEQ ID NO: 6584289 - DNA, 14 bp, Homo sapiens
ttggtgcctgcctc

SEQ ID NO: 6584290 - DNA, 13 bp, Homo sapiens
ttggtgcctggcc

SEQ ID NO: 6584291 - DNA, 16 bp, Homo sapiens
ttggtgcctttcctgt

SEQ ID NO: 6584292 - DNA, 17 bp, Homo sapiens
ttggtgcctttcctgtt

SEQ ID NO: 6584293 - DNA, 17 bp, Homo sapiens
ttggtgccttttgtgtg

SEQ ID NO: 6584294 - DNA, 18 bp, Homo sapiens
ttggtgccttttgtgtga

SEQ ID NO: 6584295 - DNA, 20 bp, Homo sapiens
ttggtgcgggcacaataaat

SEQ ID NO: 6584296 - DNA, 19 bp, Homo sapiens
ttggtgctatttgaagaaa

SEQ ID NO: 6584297 - DNA, 15 bp, Homo sapiens
ttggtgctctgtgtt

SEQ ID NO: 6584298 - DNA, 12 bp, Homo sapiens
ttggtgctttgt

SEQ ID NO: 6584299 - DNA, 14 bp, Homo sapiens
ttggtgctttgtgt

SEQ ID NO: 6584300 - DNA, 15 bp, Homo sapiens
ttggtgctttgtgtc

SEQ ID NO: 6584301 - DNA, 17 bp, Homo sapiens
ttggtgctttgtgtcta

SEQ ID NO: 6584302 - DNA, 19 bp, Homo sapiens
ttggtggagagtggaagga

SEQ ID NO: 6584303 - DNA, 23 bp, Homo sapiens
ttggtggagtcaggaaagacagg

SEQ ID NO: 6584304 - DNA, 14 bp, Homo sapiens
ttggtggatgtaaa

SEQ ID NO: 6584305 - DNA, 15 bp, Homo sapiens
ttggtggatgtaaat

SEQ ID NO: 6584306 - DNA, 22 bp, Homo sapiens
ttggtggcacacgcctgtaatc

SEQ ID NO: 6584307 - DNA, 21 bp, Homo sapiens
ttggtggcagattttacaaaa

SEQ ID NO: 6584308 - DNA, 18 bp, Homo sapiens
ttggtggcatcacagacc

SEQ ID NO: 6584309 - DNA, 17 bp, Homo sapiens
ttggtggccaagcctgg

SEQ ID NO: 6584310 - DNA, 18 bp, Homo sapiens
ttggtggctcacgcctgt

SEQ ID NO: 6584311 - DNA, 14 bp, Homo sapiens
ttggtggctttcct

SEQ ID NO: 6584312 - DNA, 17 bp, Homo sapiens
ttggtggcttttccttg

SEQ ID NO: 6584313 - DNA, 19 bp, Homo sapiens
ttggtgggctgatttacat

SEQ ID NO: 6584314 - DNA, 13 bp, Homo sapiens
ttggtgggctggc

SEQ ID NO: 6584315 - DNA, 16 bp, Homo sapiens
ttggtggggccaggcc

SEQ ID NO: 6584316 - DNA, 18 bp, Homo sapiens
ttggtggggccaggccag

SEQ ID NO: 6584317 - DNA, 20 bp, Homo sapiens
ttggtggggggtccagtctg

SEQ ID NO: 6584318 - DNA, 23 bp, Homo sapiens
ttggtggggtggcacctgtttcc

SEQ ID NO: 6584319 - DNA, 20 bp, Homo sapiens
ttggtgtaaagccaacaccc

SEQ ID NO: 6584320 - DNA, 17 bp, Homo sapiens
ttggtgtaatttgaaga

SEQ ID NO: 6584321 - DNA, 23 bp, Homo sapiens
ttggtgtatagaagtttgtccat

SEQ ID NO: 6584322 - DNA, 15 bp, Homo sapiens
ttggtgtctgatgtg

SEQ ID NO: 6584323 - DNA, 13 bp, Homo sapiens
ttggtgtcttggc

SEQ ID NO: 6584324 - DNA, 12 bp, Homo sapiens
ttggtgtgaaga

SEQ ID NO: 6584325 - DNA, 14 bp, Homo sapiens
ttggtgtgaagaaa

SEQ ID NO: 6584326 - DNA, 23 bp, Homo sapiens
ttggtgtgaatttgccagaggac

SEQ ID NO: 6584327 - DNA, 21 bp, Homo sapiens
ttggtgtgattgcacagaatt

SEQ ID NO: 6584328 - DNA, 14 bp, Homo sapiens
ttggtgtgctgagg

SEQ ID NO: 6584329 - DNA, 20 bp, Homo sapiens
ttggtgtgttcgtggagcca

SEQ ID NO: 6584330 - DNA, 19 bp, Homo sapiens
ttggtgtgttggacagaga

SEQ ID NO: 6584331 - DNA, 22 bp, Homo sapiens
ttggtgttacacagcccaagag

SEQ ID NO: 6584332 - DNA, 15 bp, Homo sapiens
ttggtgttcctggaa

SEQ ID NO: 6584333 - DNA, 16 bp, Homo sapiens
ttggtgttcctggaag

SEQ ID NO: 6584334 - DNA, 19 bp, Homo sapiens
ttggtgttctaagactctg

SEQ ID NO: 6584335 - DNA, 21 bp, Homo sapiens
ttggtgttttatctcctgtga

SEQ ID NO: 6584336 - DNA, 15 bp, Homo sapiens
ttggttaaaactgta

SEQ ID NO: 6584337 - DNA, 19 bp, Homo sapiens
ttggttaagctttgacact

SEQ ID NO: 6584338 - DNA, 23 bp, Homo sapiens
ttggttacaaatttttactcagg

SEQ ID NO: 6584339 - DNA, 14 bp, Homo sapiens
ttggttagaggaag

SEQ ID NO: 6584340 - DNA, 17 bp, Homo sapiens
ttggttagctcacagga

SEQ ID NO: 6584341 - DNA, 13 bp, Homo sapiens
ttggttagctgga

SEQ ID NO: 6584342 - DNA, 19 bp, Homo sapiens
ttggttaggcattgtggga

SEQ ID NO: 6584343 - DNA, 13 bp, Homo sapiens
ttggttatacatg

SEQ ID NO: 6584344 - DNA, 19 bp, Homo sapiens
ttggttatggagtcttgtg

SEQ ID NO: 6584345 - DNA, 12 bp, Homo sapiens
ttggttcaattt

SEQ ID NO: 6584346 - DNA, 13 bp, Homo sapiens
ttggttcaatttt

SEQ ID NO: 6584347 - DNA, 13 bp, Homo sapiens
ttggttcacctgt

SEQ ID NO: 6584348 - DNA, 14 bp, Homo sapiens
ttggttcagttttt

SEQ ID NO: 6584349 - DNA, 14 bp, Homo sapiens
ttggttcataaatg

SEQ ID NO: 6584350 - DNA, 15 bp, Homo sapiens
ttggttcataaatga

SEQ ID NO: 6584351 - DNA, 18 bp, Homo sapiens
ttggttcatcagtgttaa

SEQ ID NO: 6584352 - DNA, 20 bp, Homo sapiens
ttggttcatcagtgttaaaa

SEQ ID NO: 6584353 - DNA, 18 bp, Homo sapiens
ttggttcatgcctggggt

SEQ ID NO: 6584354 - DNA, 13 bp, Homo sapiens
ttggttcatgctt

SEQ ID NO: 6584355 - DNA, 18 bp, Homo sapiens
ttggttcattttcagatt

SEQ ID NO: 6584356 - DNA, 21 bp, Homo sapiens
ttggttccaagtctttgctat

SEQ ID NO: 6584357 - DNA, 15 bp, Homo sapiens
ttggttcctctctgg

SEQ ID NO: 6584358 - DNA, 12 bp, Homo sapiens
ttggttcctggg

SEQ ID NO: 6584359 - DNA, 19 bp, Homo sapiens
ttggttcctgtttgaaact

SEQ ID NO: 6584360 - DNA, 15 bp, Homo sapiens
ttggttccttcccaa

SEQ ID NO: 6584361 - DNA, 18 bp, Homo sapiens
ttggttctatgcaaataa

SEQ ID NO: 6584362 - DNA, 16 bp, Homo sapiens
ttggttctctccagga

SEQ ID NO: 6584363 - DNA, 13 bp, Homo sapiens
ttggttctggggc

SEQ ID NO: 6584364 - DNA, 14 bp, Homo sapiens
ttggttctgtgaac

SEQ ID NO: 6584365 - DNA, 13 bp, Homo sapiens
ttggttctgtgtc

SEQ ID NO: 6584366 - DNA, 23 bp, Homo sapiens
ttggttcttcctttccctggagc

SEQ ID NO: 6584367 - DNA, 15 bp, Homo sapiens
ttggttcttgagggg

SEQ ID NO: 6584368 - DNA, 23 bp, Homo sapiens
ttggttcttgaggggaccaggag

SEQ ID NO: 6584369 - DNA, 13 bp, Homo sapiens
ttggttgaataaa

SEQ ID NO: 6584370 - DNA, 20 bp, Homo sapiens
ttggttgctaagaagcctat

SEQ ID NO: 6584371 - DNA, 16 bp, Homo sapiens
ttggttgctttaatat

SEQ ID NO: 6584372 - DNA, 13 bp, Homo sapiens
ttggttggaagct

SEQ ID NO: 6584373 - DNA, 22 bp, Homo sapiens
ttggttggaagctaccagagct

SEQ ID NO: 6584374 - DNA, 12 bp, Homo sapiens
ttggttggaagg

SEQ ID NO: 6584375 - DNA, 22 bp, Homo sapiens
ttggttgggaatgaggaaaatt

SEQ ID NO: 6584376 - DNA, 18 bp, Homo sapiens
ttggttggtagggtggga

SEQ ID NO: 6584377 - DNA, 17 bp, Homo sapiens
ttggttggtgtgaagaa

SEQ ID NO: 6584378 - DNA, 22 bp, Homo sapiens
ttggttgtaaatgctcgtgtga

SEQ ID NO: 6584379 - DNA, 22 bp, Homo sapiens
ttggttgtcaatattaaataca

SEQ ID NO: 6584380 - DNA, 22 bp, Homo sapiens
ttggttgtgaaccaactgcctt

SEQ ID NO: 6584381 - DNA, 24 bp, Homo sapiens
ttggttgtgccttcccttctctgg

SEQ ID NO: 6584382 - DNA, 15 bp, Homo sapiens
ttggttgtgtctttt

SEQ ID NO: 6584383 - DNA, 19 bp, Homo sapiens
ttggtttaaaagtcacata

SEQ ID NO: 6584384 - DNA, 16 bp, Homo sapiens
ttggtttaaactttta

SEQ ID NO: 6584385 - DNA, 13 bp, Homo sapiens
ttggtttacattt

SEQ ID NO: 6584386 - DNA, 16 bp, Homo sapiens
ttggtttactttcaaa

SEQ ID NO: 6584387 - DNA, 22 bp, Homo sapiens
ttggtttagcccaagtggagcc

SEQ ID NO: 6584388 - DNA, 17 bp, Homo sapiens
ttggtttatttttgtaa

SEQ ID NO: 6584389 - DNA, 18 bp, Homo sapiens
ttggtttcacagataaca

SEQ ID NO: 6584390 - DNA, 12 bp, Homo sapiens
ttggtttcattt

SEQ ID NO: 6584391 - DNA, 13 bp, Homo sapiens
ttggtttccccaa

SEQ ID NO: 6584392 - DNA, 23 bp, Homo sapiens
ttggtttcccctgcactcccgac

SEQ ID NO: 6584393 - DNA, 22 bp, Homo sapiens
ttggtttgacaattttgtctta

SEQ ID NO: 6584394 - DNA, 18 bp, Homo sapiens
ttggtttgcagatgacaa

SEQ ID NO: 6584395 - DNA, 14 bp, Homo sapiens
ttggtttgtaaatt

SEQ ID NO: 6584396 - DNA, 14 bp, Homo sapiens
ttggtttgtatgag

SEQ ID NO: 6584397 - DNA, 22 bp, Homo sapiens
ttggtttgtggcgtctccctcg

SEQ ID NO: 6584398 - DNA, 20 bp, Homo sapiens
ttggtttgttaattcttatt

SEQ ID NO: 6584399 - DNA, 19 bp, Homo sapiens
ttggttttaattgaaggaa

SEQ ID NO: 6584400 - DNA, 22 bp, Homo sapiens
ttggttttaattgaaggaaaga

SEQ ID NO: 6584401 - DNA, 18 bp, Homo sapiens
ttggttttacacaggaag

SEQ ID NO: 6584402 - DNA, 13 bp, Homo sapiens
ttggttttatggt

SEQ ID NO: 6584403 - DNA, 20 bp, Homo sapiens
ttggttttcacattggaaac

SEQ ID NO: 6584404 - DNA, 15 bp, Homo sapiens
ttggttttcctgtat

SEQ ID NO: 6584405 - DNA, 17 bp, Homo sapiens
ttggttttcctgtggca

SEQ ID NO: 6584406 - DNA, 16 bp, Homo sapiens
ttggttttctccttcc

SEQ ID NO: 6584407 - DNA, 17 bp, Homo sapiens
ttggttttctctctgga

SEQ ID NO: 6584408 - DNA, 14 bp, Homo sapiens
ttggttttcttctt

SEQ ID NO: 6584409 - DNA, 12 bp, Homo sapiens
ttggttttcttg

SEQ ID NO: 6584410 - DNA, 13 bp, Homo sapiens
ttggttttgaaat

SEQ ID NO: 6584411 - DNA, 15 bp, Homo sapiens
ttggttttgactgga

SEQ ID NO: 6584412 - DNA, 17 bp, Homo sapiens
ttggttttgacttcaga

SEQ ID NO: 6584413 - DNA, 14 bp, Homo sapiens
ttggttttgccatt

SEQ ID NO: 6584414 - DNA, 13 bp, Homo sapiens
ttggtttttactc

SEQ ID NO: 6584415 - DNA, 23 bp, Homo sapiens
ttggtttttacttaactgtttca

SEQ ID NO: 6584416 - DNA, 15 bp, Homo sapiens
ttggtttttctcttt

SEQ ID NO: 6584417 - DNA, 15 bp, Homo sapiens
ttggttttttataaa

SEQ ID NO: 6584418 - DNA, 19 bp, Homo sapiens
ttggttttttataaagtct

SEQ ID NO: 6584419 - DNA, 17 bp, Homo sapiens
ttgtaaaaaaaaatgcc

SEQ ID NO: 6584420 - DNA, 19 bp, Homo sapiens
ttgtaaaaaaaaatgcctt

SEQ ID NO: 6584421 - DNA, 19 bp, Homo sapiens
ttgtaaaaaaagcaaaaat

SEQ ID NO: 6584422 - DNA, 19 bp, Homo sapiens
ttgtaaaaaagatttgtag

SEQ ID NO: 6584423 - DNA, 19 bp, Homo sapiens
ttgtaaaaacaaaaagaca

SEQ ID NO: 6584424 - DNA, 12 bp, Homo sapiens
ttgtaaaaactt

SEQ ID NO: 6584425 - DNA, 14 bp, Homo sapiens
ttgtaaaaactttt

SEQ ID NO: 6584426 - DNA, 15 bp, Homo sapiens
ttgtaaaaagggaaa

SEQ ID NO: 6584427 - DNA, 20 bp, Homo sapiens
ttgtaaaaagggaaaaagac

SEQ ID NO: 6584428 - DNA, 21 bp, Homo sapiens
ttgtaaaaatgaaagtgactt

SEQ ID NO: 6584429 - DNA, 18 bp, Homo sapiens
ttgtaaaaatgagacttt

SEQ ID NO: 6584430 - DNA, 22 bp, Homo sapiens
ttgtaaaaatgagactttttca

SEQ ID NO: 6584431 - DNA, 22 bp, Homo sapiens
ttgtaaaaattaaaagttatgg

SEQ ID NO: 6584432 - DNA, 13 bp, Homo sapiens
ttgtaaaacaggt

SEQ ID NO: 6584433 - DNA, 13 bp, Homo sapiens
ttgtaaaacagtg

SEQ ID NO: 6584434 - DNA, 13 bp, Homo sapiens
ttgtaaaactgtg

SEQ ID NO: 6584435 - DNA, 18 bp, Homo sapiens
ttgtaaaactgtgacatt

SEQ ID NO: 6584436 - DNA, 19 bp, Homo sapiens
ttgtaaaactgtgacattc

SEQ ID NO: 6584437 - DNA, 15 bp, Homo sapiens
ttgtaaaacttctgc

SEQ ID NO: 6584438 - DNA, 13 bp, Homo sapiens
ttgtaaaagaaat

SEQ ID NO: 6584439 - DNA, 15 bp, Homo sapiens
ttgtaaaagaaatca

SEQ ID NO: 6584440 - DNA, 18 bp, Homo sapiens
ttgtaaaagaaatcatgt

SEQ ID NO: 6584441 - DNA, 22 bp, Homo sapiens
ttgtaaaagaaatcatgtccat

SEQ ID NO: 6584442 - DNA, 14 bp, Homo sapiens
ttgtaaaagatgca

SEQ ID NO: 6584443 - DNA, 18 bp, Homo sapiens
ttgtaaaagcattttgta

SEQ ID NO: 6584444 - DNA, 14 bp, Homo sapiens
ttgtaaaagctaag

SEQ ID NO: 6584445 - DNA, 15 bp, Homo sapiens
ttgtaaaatagcttg

SEQ ID NO: 6584446 - DNA, 21 bp, Homo sapiens
ttgtaaaatagcttgtatagt

SEQ ID NO: 6584447 - DNA, 14 bp, Homo sapiens
ttgtaaaatatagc

SEQ ID NO: 6584448 - DNA, 18 bp, Homo sapiens
ttgtaaaatatagctgta

SEQ ID NO: 6584449 - DNA, 19 bp, Homo sapiens
ttgtaaaatgttctcttat

SEQ ID NO: 6584450 - DNA, 21 bp, Homo sapiens
ttgtaaaattccatggatctt

SEQ ID NO: 6584451 - DNA, 14 bp, Homo sapiens
ttgtaaacaaactc

SEQ ID NO: 6584452 - DNA, 16 bp, Homo sapiens
ttgtaaacagaaggag

SEQ ID NO: 6584453 - DNA, 19 bp, Homo sapiens
ttgtaaacagctaataatg

SEQ ID NO: 6584454 - DNA, 12 bp, Homo sapiens
ttgtaaacattt

SEQ ID NO: 6584455 - DNA, 18 bp, Homo sapiens
ttgtaaaccattgtaact

SEQ ID NO: 6584456 - DNA, 20 bp, Homo sapiens
ttgtaaaccattgtaactat

SEQ ID NO: 6584457 - DNA, 17 bp, Homo sapiens
ttgtaaacgtattttga

SEQ ID NO: 6584458 - DNA, 13 bp, Homo sapiens
ttgtaaacgtctt

SEQ ID NO: 6584459 - DNA, 13 bp, Homo sapiens
ttgtaaactaaag

SEQ ID NO: 6584460 - DNA, 15 bp, Homo sapiens
ttgtaaactgtatca

SEQ ID NO: 6584461 - DNA, 21 bp, Homo sapiens
ttgtaaactttgaaatatatg

SEQ ID NO: 6584462 - DNA, 20 bp, Homo sapiens
ttgtaaactttttcaatggt

SEQ ID NO: 6584463 - DNA, 17 bp, Homo sapiens
ttgtaaagaaaaatatt

SEQ ID NO: 6584464 - DNA, 18 bp, Homo sapiens
ttgtaaagaaatttacta

SEQ ID NO: 6584465 - DNA, 19 bp, Homo sapiens
ttgtaaagatattgtatct

SEQ ID NO: 6584466 - DNA, 17 bp, Homo sapiens
ttgtaaagatttctgtt

SEQ ID NO: 6584467 - DNA, 16 bp, Homo sapiens
ttgtaaaggcattcta

SEQ ID NO: 6584468 - DNA, 15 bp, Homo sapiens
ttgtaaaggtcagag

SEQ ID NO: 6584469 - DNA, 12 bp, Homo sapiens
ttgtaaagtaaa

SEQ ID NO: 6584470 - DNA, 13 bp, Homo sapiens
ttgtaaagtaaaa

SEQ ID NO: 6584471 - DNA, 16 bp, Homo sapiens
ttgtaaagtaaaatat

SEQ ID NO: 6584472 - DNA, 19 bp, Homo sapiens
ttgtaaagtaaaatatgtc

SEQ ID NO: 6584473 - DNA, 23 bp, Homo sapiens
ttgtaaagtatttgatgtacatt

SEQ ID NO: 6584474 - DNA, 22 bp, Homo sapiens
ttgtaaagtccccagagaaagc

SEQ ID NO: 6584475 - DNA, 17 bp, Homo sapiens
ttgtaaataaagtctat

SEQ ID NO: 6584476 - DNA, 18 bp, Homo sapiens
ttgtaaataaagtctatt

SEQ ID NO: 6584477 - DNA, 17 bp, Homo sapiens
ttgtaaataaatagatt

SEQ ID NO: 6584478 - DNA, 20 bp, Homo sapiens
ttgtaaataaattttgtgca

SEQ ID NO: 6584479 - DNA, 13 bp, Homo sapiens
ttgtaaataagag

SEQ ID NO: 6584480 - DNA, 15 bp, Homo sapiens
ttgtaaataagagat

SEQ ID NO: 6584481 - DNA, 23 bp, Homo sapiens
ttgtaaataagttttttttctgg

SEQ ID NO: 6584482 - DNA, 15 bp, Homo sapiens
ttgtaaataattttc

SEQ ID NO: 6584483 - DNA, 17 bp, Homo sapiens
ttgtaaataattttcta

SEQ ID NO: 6584484 - DNA, 19 bp, Homo sapiens
ttgtaaataattttctaag

SEQ ID NO: 6584485 - DNA, 23 bp, Homo sapiens
ttgtaaatacaagttctatttaa

SEQ ID NO: 6584486 - DNA, 15 bp, Homo sapiens
ttgtaaatacaattc

SEQ ID NO: 6584487 - DNA, 17 bp, Homo sapiens
ttgtaaatactgcttga

SEQ ID NO: 6584488 - DNA, 19 bp, Homo sapiens
ttgtaaatactgcttgacc

SEQ ID NO: 6584489 - DNA, 20 bp, Homo sapiens
ttgtaaatactggactcagg

SEQ ID NO: 6584490 - DNA, 21 bp, Homo sapiens
ttgtaaatactggactcagga

SEQ ID NO: 6584491 - DNA, 17 bp, Homo sapiens
ttgtaaatagctcaggt

SEQ ID NO: 6584492 - DNA, 17 bp, Homo sapiens
ttgtaaatataaagacg

SEQ ID NO: 6584493 - DNA, 12 bp, Homo sapiens
ttgtaaatatat

SEQ ID NO: 6584494 - DNA, 13 bp, Homo sapiens
ttgtaaatatata

SEQ ID NO: 6584495 - DNA, 22 bp, Homo sapiens
ttgtaaatatgtgacattcctg

SEQ ID NO: 6584496 - DNA, 23 bp, Homo sapiens
ttgtaaatattaaaccataagat

SEQ ID NO: 6584497 - DNA, 16 bp, Homo sapiens
ttgtaaatattgctaa

SEQ ID NO: 6584498 - DNA, 12 bp, Homo sapiens
ttgtaaatattt

SEQ ID NO: 6584499 - DNA, 16 bp, Homo sapiens
ttgtaaatatttatgt

SEQ ID NO: 6584500 - DNA, 15 bp, Homo sapiens
ttgtaaatcacttgt

SEQ ID NO: 6584501 - DNA, 19 bp, Homo sapiens
ttgtaaatccaacacaagt

SEQ ID NO: 6584502 - DNA, 15 bp, Homo sapiens
ttgtaaatcctgtgt

SEQ ID NO: 6584503 - DNA, 15 bp, Homo sapiens
ttgtaaatctgtact

SEQ ID NO: 6584504 - DNA, 17 bp, Homo sapiens
ttgtaaatctgtacttt

SEQ ID NO: 6584505 - DNA, 14 bp, Homo sapiens
ttgtaaatctttgt

SEQ ID NO: 6584506 - DNA, 20 bp, Homo sapiens
ttgtaaatgaaacttaagaa

SEQ ID NO: 6584507 - DNA, 21 bp, Homo sapiens
ttgtaaatgaaacttaagaat

SEQ ID NO: 6584508 - DNA, 13 bp, Homo sapiens
ttgtaaatgactt

SEQ ID NO: 6584509 - DNA, 17 bp, Homo sapiens
ttgtaaatgagacacat

SEQ ID NO: 6584510 - DNA, 21 bp, Homo sapiens
ttgtaaatgattttaatttta

SEQ ID NO: 6584511 - DNA, 21 bp, Homo sapiens
ttgtaaatgctattatactgt

SEQ ID NO: 6584512 - DNA, 12 bp, Homo sapiens
ttgtaaatgtaa

SEQ ID NO: 6584513 - DNA, 22 bp, Homo sapiens
ttgtaaatgtactggtaattgt

SEQ ID NO: 6584514 - DNA, 21 bp, Homo sapiens
ttgtaaatgtggtaaagagtt

SEQ ID NO: 6584515 - DNA, 18 bp, Homo sapiens
ttgtaaatgttatttctg

SEQ ID NO: 6584516 - DNA, 16 bp, Homo sapiens
ttgtaaattaactttt

SEQ ID NO: 6584517 - DNA, 15 bp, Homo sapiens
ttgtaaattaatctt

SEQ ID NO: 6584518 - DNA, 14 bp, Homo sapiens
ttgtaaattatatt

SEQ ID NO: 6584519 - DNA, 15 bp, Homo sapiens
ttgtaaattatattt

SEQ ID NO: 6584520 - DNA, 12 bp, Homo sapiens
ttgtaaattatt

SEQ ID NO: 6584521 - DNA, 16 bp, Homo sapiens
ttgtaaattattaatt

SEQ ID NO: 6584522 - DNA, 13 bp, Homo sapiens
ttgtaaattattt

SEQ ID NO: 6584523 - DNA, 16 bp, Homo sapiens
ttgtaaattatttgct

SEQ ID NO: 6584524 - DNA, 22 bp, Homo sapiens
ttgtaaattattttatgtcata

SEQ ID NO: 6584525 - DNA, 12 bp, Homo sapiens
ttgtaaattctg

SEQ ID NO: 6584526 - DNA, 19 bp, Homo sapiens
ttgtaaattctggaaatgt

SEQ ID NO: 6584527 - DNA, 22 bp, Homo sapiens
ttgtaaattctggaaatgtctt

SEQ ID NO: 6584528 - DNA, 12 bp, Homo sapiens
ttgtaaattggc

SEQ ID NO: 6584529 - DNA, 15 bp, Homo sapiens
ttgtaaatttggatt

SEQ ID NO: 6584530 - DNA, 16 bp, Homo sapiens
ttgtaacaaatatatt

SEQ ID NO: 6584531 - DNA, 20 bp, Homo sapiens
ttgtaacaactaattataat

SEQ ID NO: 6584532 - DNA, 16 bp, Homo sapiens
ttgtaacaagaaaaca

SEQ ID NO: 6584533 - DNA, 17 bp, Homo sapiens
ttgtaacagacattgtt

SEQ ID NO: 6584534 - DNA, 17 bp, Homo sapiens
ttgtaacattgtaaagt

SEQ ID NO: 6584535 - DNA, 20 bp, Homo sapiens
ttgtaaccatatgattgaaa

SEQ ID NO: 6584536 - DNA, 16 bp, Homo sapiens
ttgtaacctcagctct

SEQ ID NO: 6584537 - DNA, 17 bp, Homo sapiens
ttgtaacctgcattttt

SEQ ID NO: 6584538 - DNA, 20 bp, Homo sapiens
ttgtaacgttgctgtgggaa

SEQ ID NO: 6584539 - DNA, 22 bp, Homo sapiens
ttgtaactaaaataattttgta

SEQ ID NO: 6584540 - DNA, 23 bp, Homo sapiens
ttgtaactaaaataattttgtaa

SEQ ID NO: 6584541 - DNA, 11 bp, Homo sapiens
ttgtaactaca

SEQ ID NO: 6584542 - DNA, 21 bp, Homo sapiens
ttgtaactacaaagctttgct

SEQ ID NO: 6584543 - DNA, 23 bp, Homo sapiens
ttgtaactacaaagctttgctac

SEQ ID NO: 6584544 - DNA, 20 bp, Homo sapiens
ttgtaactaggctcagagat

SEQ ID NO: 6584545 - DNA, 20 bp, Homo sapiens
ttgtaactcacatgccttct

SEQ ID NO: 6584546 - DNA, 22 bp, Homo sapiens
ttgtaactcacatgccttctaa

SEQ ID NO: 6584547 - DNA, 19 bp, Homo sapiens
ttgtaactctttggctatt

SEQ ID NO: 6584548 - DNA, 22 bp, Homo sapiens
ttgtaactgtttagatgaatgt

SEQ ID NO: 6584549 - DNA, 21 bp, Homo sapiens
ttgtaacttagctttattttt

SEQ ID NO: 6584550 - DNA, 18 bp, Homo sapiens
ttgtaacttatgtagata

SEQ ID NO: 6584551 - DNA, 21 bp, Homo sapiens
ttgtaacttgaagatatttat

SEQ ID NO: 6584552 - DNA, 14 bp, Homo sapiens
ttgtaacttgggct

SEQ ID NO: 6584553 - DNA, 15 bp, Homo sapiens
ttgtaactttgcatg

SEQ ID NO: 6584554 - DNA, 12 bp, Homo sapiens
ttgtaagaaaat

SEQ ID NO: 6584555 - DNA, 20 bp, Homo sapiens
ttgtaagaaaccaatcaaga

SEQ ID NO: 6584556 - DNA, 13 bp, Homo sapiens
ttgtaagaaatac

SEQ ID NO: 6584557 - DNA, 15 bp, Homo sapiens
ttgtaagaaggcaat

SEQ ID NO: 6584558 - DNA, 20 bp, Homo sapiens
ttgtaagaaggcaatattaa

SEQ ID NO: 6584559 - DNA, 16 bp, Homo sapiens
ttgtaagacaatccat

SEQ ID NO: 6584560 - DNA, 18 bp, Homo sapiens
ttgtaagacacacagcct

SEQ ID NO: 6584561 - DNA, 15 bp, Homo sapiens
ttgtaagacatttgt

SEQ ID NO: 6584562 - DNA, 22 bp, Homo sapiens
aatagttagatctaccctgcct

SEQ ID NO: 6584563 - DNA, 15 bp, Homo sapiens
aatagttagccctca

SEQ ID NO: 6584564 - DNA, 21 bp, Homo sapiens
aatagttattatttaattgca

SEQ ID NO: 6584565 - DNA, 17 bp, Homo sapiens
aatagttcaaactgcag

SEQ ID NO: 6584566 - DNA, 19 bp, Homo sapiens
aatagttccattctatgac

SEQ ID NO: 6584567 - DNA, 15 bp, Homo sapiens
aatagttctatcctt

SEQ ID NO: 6584568 - DNA, 15 bp, Homo sapiens
aatagttctatttct

SEQ ID NO: 6584569 - DNA, 16 bp, Homo sapiens
aatagttctatttcta

SEQ ID NO: 6584570 - DNA, 19 bp, Homo sapiens
aatagttctatttctatct

SEQ ID NO: 6584571 - DNA, 20 bp, Homo sapiens
aatagttctatttctatctg

SEQ ID NO: 6584572 - DNA, 23 bp, Homo sapiens
aatagttctatttctatctgcaa

SEQ ID NO: 6584573 - DNA, 14 bp, Homo sapiens
aatagttcttaaaa

SEQ ID NO: 6584574 - DNA, 16 bp, Homo sapiens
aatagttcttaaaatt

SEQ ID NO: 6584575 - DNA, 12 bp, Homo sapiens
aatagttgaatt

SEQ ID NO: 6584576 - DNA, 15 bp, Homo sapiens
aatagttgaattagt

SEQ ID NO: 6584577 - DNA, 19 bp, Homo sapiens
aatagttgagccagcagac

SEQ ID NO: 6584578 - DNA, 20 bp, Homo sapiens
aatagttgagccagcagaca

SEQ ID NO: 6584579 - DNA, 23 bp, Homo sapiens
aatagttgctgtccccttccagg

SEQ ID NO: 6584580 - DNA, 18 bp, Homo sapiens
aatagttgtccatatttt

SEQ ID NO: 6584581 - DNA, 15 bp, Homo sapiens
aatagttgtctgtgc

SEQ ID NO: 6584582 - DNA, 14 bp, Homo sapiens
aatagttgttgatt

SEQ ID NO: 6584583 - DNA, 15 bp, Homo sapiens
aatagtttaaaaata

SEQ ID NO: 6584584 - DNA, 16 bp, Homo sapiens
aatagtttacttcact

SEQ ID NO: 6584585 - DNA, 22 bp, Homo sapiens
aatagtttattttaaaacaata

SEQ ID NO: 6584586 - DNA, 14 bp, Homo sapiens
aatagtttgtctat

SEQ ID NO: 6584587 - DNA, 17 bp, Homo sapiens
aatagtttgtctatttt

SEQ ID NO: 6584588 - DNA, 22 bp, Homo sapiens
aatagttttaaatatgaacaaa

SEQ ID NO: 6584589 - DNA, 16 bp, Homo sapiens
aatagttttacattaa

SEQ ID NO: 6584590 - DNA, 12 bp, Homo sapiens
aatagttttcta

SEQ ID NO: 6584591 - DNA, 14 bp, Homo sapiens
aatagttttctaaa

SEQ ID NO: 6584592 - DNA, 16 bp, Homo sapiens
aatagttttctaaatg

SEQ ID NO: 6584593 - DNA, 18 bp, Homo sapiens
aatagttttctaaatgtt

SEQ ID NO: 6584594 - DNA, 20 bp, Homo sapiens
aatagtttttcactttgtgt

SEQ ID NO: 6584595 - DNA, 22 bp, Homo sapiens
aatagtttttcactttgtgtat

SEQ ID NO: 6584596 - DNA, 23 bp, Homo sapiens
aatagtttttcactttgtgtatt

SEQ ID NO: 6584597 - DNA, 15 bp, Homo sapiens
aatataaaaacattt

SEQ ID NO: 6584598 - DNA, 16 bp, Homo sapiens
aatataaaaataatta

SEQ ID NO: 6584599 - DNA, 14 bp, Homo sapiens
aatataaaacagtc

SEQ ID NO: 6584600 - DNA, 11 bp, Homo sapiens
aatataaaact

SEQ ID NO: 6584601 - DNA, 18 bp, Homo sapiens
aatataaaactgaaataa

SEQ ID NO: 6584602 - DNA, 14 bp, Homo sapiens
aatataaaatatga

SEQ ID NO: 6584603 - DNA, 23 bp, Homo sapiens
aatataaaatatgaagacataaa

SEQ ID NO: 6584604 - DNA, 15 bp, Homo sapiens
aatataaaattatga

SEQ ID NO: 6584605 - DNA, 13 bp, Homo sapiens
aatataaaatttc

SEQ ID NO: 6584606 - DNA, 16 bp, Homo sapiens
aatataaacaatgttc

SEQ ID NO: 6584607 - DNA, 14 bp, Homo sapiens
aatataaacagcaa

SEQ ID NO: 6584608 - DNA, 20 bp, Homo sapiens
aatataaaccgtggtctcat

SEQ ID NO: 6584609 - DNA, 13 bp, Homo sapiens
aatataaactgaa

SEQ ID NO: 6584610 - DNA, 12 bp, Homo sapiens
aatataaactgt

SEQ ID NO: 6584611 - DNA, 13 bp, Homo sapiens
aatataaactgta

SEQ ID NO: 6584612 - DNA, 14 bp, Homo sapiens
aatataaactgtga

SEQ ID NO: 6584613 - DNA, 21 bp, Homo sapiens
aatataaactgtgagataaat

SEQ ID NO: 6584614 - DNA, 12 bp, Homo sapiens
aatataaacttg

SEQ ID NO: 6584615 - DNA, 12 bp, Homo sapiens
aatataaagacg

SEQ ID NO: 6584616 - DNA, 21 bp, Homo sapiens
aatataaagatggctgacttt

SEQ ID NO: 6584617 - DNA, 16 bp, Homo sapiens
aatataaagtattcaa

SEQ ID NO: 6584618 - DNA, 21 bp, Homo sapiens
aatataaagttttatatatta

SEQ ID NO: 6584619 - DNA, 22 bp, Homo sapiens
aatataaagttttatatattat

SEQ ID NO: 6584620 - DNA, 19 bp, Homo sapiens
aatataaataaataaaaat

SEQ ID NO: 6584621 - DNA, 23 bp, Homo sapiens
aatataaataaataaaaatattc

SEQ ID NO: 6584622 - DNA, 13 bp, Homo sapiens
aatataaatagct

SEQ ID NO: 6584623 - DNA, 21 bp, Homo sapiens
aatataaatagctgaaaacta

SEQ ID NO: 6584624 - DNA, 12 bp, Homo sapiens
aatataaatata

SEQ ID NO: 6584625 - DNA, 16 bp, Homo sapiens
aatataaatcacagat

SEQ ID NO: 6584626 - DNA, 14 bp, Homo sapiens
aatataaatgcaaa

SEQ ID NO: 6584627 - DNA, 13 bp, Homo sapiens
aatataaatgcat

SEQ ID NO: 6584628 - DNA, 18 bp, Homo sapiens
aatataaatgcatgattt

SEQ ID NO: 6584629 - DNA, 19 bp, Homo sapiens
aatataaatgtactacatt

SEQ ID NO: 6584630 - DNA, 19 bp, Homo sapiens
aatataaatgttaagaaaa

SEQ ID NO: 6584631 - DNA, 13 bp, Homo sapiens
aatataaatgttg

SEQ ID NO: 6584632 - DNA, 15 bp, Homo sapiens
aatataaattaagac

SEQ ID NO: 6584633 - DNA, 14 bp, Homo sapiens
aatataaattatct

SEQ ID NO: 6584634 - DNA, 17 bp, Homo sapiens
aatataaattcactttc

SEQ ID NO: 6584635 - DNA, 15 bp, Homo sapiens
aatataaattgtaca

SEQ ID NO: 6584636 - DNA, 16 bp, Homo sapiens
aatataaattgtacat

SEQ ID NO: 6584637 - DNA, 13 bp, Homo sapiens
aatataaattttg

SEQ ID NO: 6584638 - DNA, 15 bp, Homo sapiens
aatataacaatatat

SEQ ID NO: 6584639 - DNA, 14 bp, Homo sapiens
aatataacatgaaa

SEQ ID NO: 6584640 - DNA, 15 bp, Homo sapiens
aatataacatgaaag

SEQ ID NO: 6584641 - DNA, 16 bp, Homo sapiens
aatataaccaatgttt

SEQ ID NO: 6584642 - DNA, 15 bp, Homo sapiens
aatataaccattaca

SEQ ID NO: 6584643 - DNA, 21 bp, Homo sapiens
aatataactatgtggctgaaa

SEQ ID NO: 6584644 - DNA, 22 bp, Homo sapiens
aatataactatgtggctgaaaa

SEQ ID NO: 6584645 - DNA, 22 bp, Homo sapiens
aatataactgccttaaaacttt

SEQ ID NO: 6584646 - DNA, 21 bp, Homo sapiens
aatataagaaaagtaatgaag

SEQ ID NO: 6584647 - DNA, 20 bp, Homo sapiens
aatataagaacttgatatat

SEQ ID NO: 6584648 - DNA, 12 bp, Homo sapiens
aatataagacaa

SEQ ID NO: 6584649 - DNA, 13 bp, Homo sapiens
aatataagacaag

SEQ ID NO: 6584650 - DNA, 21 bp, Homo sapiens
aatataataatagttattatt

SEQ ID NO: 6584651 - DNA, 11 bp, Homo sapiens
aatataatatg

SEQ ID NO: 6584652 - DNA, 19 bp, Homo sapiens
aatataatgagtcacaaaa

SEQ ID NO: 6584653 - DNA, 19 bp, Homo sapiens
aatataatgggctgcaaaa

SEQ ID NO: 6584654 - DNA, 23 bp, Homo sapiens
aatataatgtattttctttttat

SEQ ID NO: 6584655 - DNA, 14 bp, Homo sapiens
aatataattatcgg

SEQ ID NO: 6584656 - DNA, 13 bp, Homo sapiens
aatataattctgt

SEQ ID NO: 6584657 - DNA, 15 bp, Homo sapiens
aatataattctgtaa

SEQ ID NO: 6584658 - DNA, 12 bp, Homo sapiens
aatataattgtt

SEQ ID NO: 6584659 - DNA, 18 bp, Homo sapiens
aatataatttataagcat

SEQ ID NO: 6584660 - DNA, 18 bp, Homo sapiens
aatataattttttagaga

SEQ ID NO: 6584661 - DNA, 14 bp, Homo sapiens
aatatacaaaactt

SEQ ID NO: 6584662 - DNA, 15 bp, Homo sapiens
aatatacaaacatgt

SEQ ID NO: 6584663 - DNA, 19 bp, Homo sapiens
aatatacaagcaagcaaaa

SEQ ID NO: 6584664 - DNA, 18 bp, Homo sapiens
aatatacaagtaaattct

SEQ ID NO: 6584665 - DNA, 21 bp, Homo sapiens
aatatacaagtaaattctgtt

SEQ ID NO: 6584666 - DNA, 17 bp, Homo sapiens
aatatacacattttgta

SEQ ID NO: 6584667 - DNA, 20 bp, Homo sapiens
aatatacacattttgtaaat

SEQ ID NO: 6584668 - DNA, 22 bp, Homo sapiens
aatatacacattttgtaaatct

SEQ ID NO: 6584669 - DNA, 13 bp, Homo sapiens
aatatacagtttg

SEQ ID NO: 6584670 - DNA, 22 bp, Homo sapiens
aatatacagtttttgtaaccat

SEQ ID NO: 6584671 - DNA, 15 bp, Homo sapiens
aatatacatctgtgt

SEQ ID NO: 6584672 - DNA, 13 bp, Homo sapiens
aatatacatttgt

SEQ ID NO: 6584673 - DNA, 21 bp, Homo sapiens
aatatacattttctaaataaa

SEQ ID NO: 6584674 - DNA, 22 bp, Homo sapiens
aatataccttatttatttttgt

SEQ ID NO: 6584675 - DNA, 16 bp, Homo sapiens
aatatacgaaaagcca

SEQ ID NO: 6584676 - DNA, 16 bp, Homo sapiens
aatatactaaccattt

SEQ ID NO: 6584677 - DNA, 21 bp, Homo sapiens
aatatactaataaaaaggttt

SEQ ID NO: 6584678 - DNA, 16 bp, Homo sapiens
aatatactcagggatt

SEQ ID NO: 6584679 - DNA, 20 bp, Homo sapiens
aatatactcagggattcctt

SEQ ID NO: 6584680 - DNA, 21 bp, Homo sapiens
aatatactcagggattccttc

SEQ ID NO: 6584681 - DNA, 18 bp, Homo sapiens
aatatactcatttggata

SEQ ID NO: 6584682 - DNA, 15 bp, Homo sapiens
aatatactccttaaa

SEQ ID NO: 6584683 - DNA, 12 bp, Homo sapiens
aatatactgtaa

SEQ ID NO: 6584684 - DNA, 15 bp, Homo sapiens
aatatactgtaaaga

SEQ ID NO: 6584685 - DNA, 17 bp, Homo sapiens
aatatactgtaaagaaa

SEQ ID NO: 6584686 - DNA, 23 bp, Homo sapiens
aatatactgtaaagaaagagaga

SEQ ID NO: 6584687 - DNA, 13 bp, Homo sapiens
aatatactgtctt

SEQ ID NO: 6584688 - DNA, 17 bp, Homo sapiens
aatatacttaaaaatta

SEQ ID NO: 6584689 - DNA, 18 bp, Homo sapiens
aatatacttaaaaattaa

SEQ ID NO: 6584690 - DNA, 17 bp, Homo sapiens
aatatacttagaaaggc

SEQ ID NO: 6584691 - DNA, 20 bp, Homo sapiens
aatatacttatgcaaaacct

SEQ ID NO: 6584692 - DNA, 21 bp, Homo sapiens
aatatacttctgctgtgggaa

SEQ ID NO: 6584693 - DNA, 18 bp, Homo sapiens
aatatacttgactctaat

SEQ ID NO: 6584694 - DNA, 15 bp, Homo sapiens
aatatacttgtggac

SEQ ID NO: 6584695 - DNA, 16 bp, Homo sapiens
aatatacttgtggact

SEQ ID NO: 6584696 - DNA, 22 bp, Homo sapiens
aatatacttgtggactaaaaga

SEQ ID NO: 6584697 - DNA, 22 bp, Homo sapiens
aatatactttttttgttataga

SEQ ID NO: 6584698 - DNA, 13 bp, Homo sapiens
aatatagaaaaaa

SEQ ID NO: 6584699 - DNA, 11 bp, Homo sapiens
aatatagagat

SEQ ID NO: 6584700 - DNA, 16 bp, Homo sapiens
aatatagagatatttt

SEQ ID NO: 6584701 - DNA, 23 bp, Homo sapiens
aatatagatgtaatttttcaaaa

SEQ ID NO: 6584702 - DNA, 15 bp, Homo sapiens
aatatagattaaatc

SEQ ID NO: 6584703 - DNA, 17 bp, Homo sapiens
aatatagattagaaaaa

SEQ ID NO: 6584704 - DNA, 18 bp, Homo sapiens
aatatagattagaaaaat

SEQ ID NO: 6584705 - DNA, 18 bp, Homo sapiens
aatatagcaaatgcagaa

SEQ ID NO: 6584706 - DNA, 17 bp, Homo sapiens
aatatagcatctttcat

SEQ ID NO: 6584707 - DNA, 18 bp, Homo sapiens
aatatagcatctttcata

SEQ ID NO: 6584708 - DNA, 19 bp, Homo sapiens
aatatagcatctttcatat

SEQ ID NO: 6584709 - DNA, 15 bp, Homo sapiens
aatatagcctttaaa

SEQ ID NO: 6584710 - DNA, 19 bp, Homo sapiens
aatatagctgtacaaatat

SEQ ID NO: 6584711 - DNA, 20 bp, Homo sapiens
aatatagctgtacaaatata

SEQ ID NO: 6584712 - DNA, 21 bp, Homo sapiens
aatatagctgtacaaatataa

SEQ ID NO: 6584713 - DNA, 22 bp, Homo sapiens
aatatagctgtacaaatataag

SEQ ID NO: 6584714 - DNA, 20 bp, Homo sapiens
aatatagctttcataacatc

SEQ ID NO: 6584715 - DNA, 14 bp, Homo sapiens
aatataggataaga

SEQ ID NO: 6584716 - DNA, 23 bp, Homo sapiens
aatataggatagacactggacat

SEQ ID NO: 6584717 - DNA, 20 bp, Homo sapiens
aatataggggttaaggaaaa

SEQ ID NO: 6584718 - DNA, 23 bp, Homo sapiens
aatatagggttttttttaatgtg

SEQ ID NO: 6584719 - DNA, 19 bp, Homo sapiens
aatatagtattcttcttcc

SEQ ID NO: 6584720 - DNA, 20 bp, Homo sapiens
aatatagtgaaatggccact

SEQ ID NO: 6584721 - DNA, 17 bp, Homo sapiens
aatatagtgttgtgtta

SEQ ID NO: 6584722 - DNA, 15 bp, Homo sapiens
aatatagttaattgt

SEQ ID NO: 6584723 - DNA, 20 bp, Homo sapiens
aatatagttattattgctgt

SEQ ID NO: 6584724 - DNA, 21 bp, Homo sapiens
aatatagttattattgctgtt

SEQ ID NO: 6584725 - DNA, 18 bp, Homo sapiens
aatatagttcctaagaag

SEQ ID NO: 6584726 - DNA, 20 bp, Homo sapiens
aatatagttcctaagaagct

SEQ ID NO: 6584727 - DNA, 13 bp, Homo sapiens
aatatagttgaac

SEQ ID NO: 6584728 - DNA, 16 bp, Homo sapiens
aatatagttgaacaag

SEQ ID NO: 6584729 - DNA, 11 bp, Homo sapiens
aatatataaaa

SEQ ID NO: 6584730 - DNA, 13 bp, Homo sapiens
aatatataaaaat

SEQ ID NO: 6584731 - DNA, 19 bp, Homo sapiens
aatatataaaaatatatat

SEQ ID NO: 6584732 - DNA, 19 bp, Homo sapiens
aatatataaacaaacaaac

SEQ ID NO: 6584733 - DNA, 15 bp, Homo sapiens
aatatataaacgata

SEQ ID NO: 6584734 - DNA, 20 bp, Homo sapiens
aatatataaagtatatgttc

SEQ ID NO: 6584735 - DNA, 13 bp, Homo sapiens
aatatataaatat

SEQ ID NO: 6584736 - DNA, 19 bp, Homo sapiens
aatatataatcaaatgatt

SEQ ID NO: 6584737 - DNA, 14 bp, Homo sapiens
aatatataatgcaa

SEQ ID NO: 6584738 - DNA, 18 bp, Homo sapiens
aatatataatttaatgta

SEQ ID NO: 6584739 - DNA, 14 bp, Homo sapiens
aatatataatttat

SEQ ID NO: 6584740 - DNA, 15 bp, Homo sapiens
aatatatacaaacct

SEQ ID NO: 6584741 - DNA, 21 bp, Homo sapiens
aatatatacacatagttctgt

SEQ ID NO: 6584742 - DNA, 18 bp, Homo sapiens
ttgtaagagctatacagt

SEQ ID NO: 6584743 - DNA, 21 bp, Homo sapiens
ttgtaagagctatacagtttt

SEQ ID NO: 6584744 - DNA, 15 bp, Homo sapiens
ttgtaagagtgtaga

SEQ ID NO: 6584745 - DNA, 21 bp, Homo sapiens
ttgtaagagtgtagaagcatt

SEQ ID NO: 6584746 - DNA, 18 bp, Homo sapiens
ttgtaagatccaccccct

SEQ ID NO: 6584747 - DNA, 15 bp, Homo sapiens
ttgtaagatgctggg

SEQ ID NO: 6584748 - DNA, 17 bp, Homo sapiens
ttgtaagatgctgggtt

SEQ ID NO: 6584749 - DNA, 22 bp, Homo sapiens
ttgtaagatggataatgtgtat

SEQ ID NO: 6584750 - DNA, 14 bp, Homo sapiens
ttgtaagattttga

SEQ ID NO: 6584751 - DNA, 15 bp, Homo sapiens
ttgtaagattttgaa

SEQ ID NO: 6584752 - DNA, 16 bp, Homo sapiens
ttgtaagattttgaaa

SEQ ID NO: 6584753 - DNA, 19 bp, Homo sapiens
ttgtaagccagagtcaaca

SEQ ID NO: 6584754 - DNA, 20 bp, Homo sapiens
ttgtaaggaatgattaatta

SEQ ID NO: 6584755 - DNA, 13 bp, Homo sapiens
ttgtaaggacttg

SEQ ID NO: 6584756 - DNA, 15 bp, Homo sapiens
ttgtaaggtactgaa

SEQ ID NO: 6584757 - DNA, 16 bp, Homo sapiens
ttgtaaggtctttgta

SEQ ID NO: 6584758 - DNA, 17 bp, Homo sapiens
ttgtaagtaacacagta

SEQ ID NO: 6584759 - DNA, 21 bp, Homo sapiens
ttgtaagtaataatttgtaaa

SEQ ID NO: 6584760 - DNA, 21 bp, Homo sapiens
ttgtaagtcagtgttgagatg

SEQ ID NO: 6584761 - DNA, 19 bp, Homo sapiens
ttgtaagtgaaaaacatga

SEQ ID NO: 6584762 - DNA, 16 bp, Homo sapiens
ttgtaagtgagtgtgc

SEQ ID NO: 6584763 - DNA, 19 bp, Homo sapiens
ttgtaagtgagtgtgctgc

SEQ ID NO: 6584764 - DNA, 17 bp, Homo sapiens
ttgtaagtgctacataa

SEQ ID NO: 6584765 - DNA, 17 bp, Homo sapiens
ttgtaagttgtacaaat

SEQ ID NO: 6584766 - DNA, 21 bp, Homo sapiens
ttgtaagttgtacaaatgtat

SEQ ID NO: 6584767 - DNA, 16 bp, Homo sapiens
ttgtaagtttgaattt

SEQ ID NO: 6584768 - DNA, 19 bp, Homo sapiens
ttgtaagtttgaatttgta

SEQ ID NO: 6584769 - DNA, 21 bp, Homo sapiens
ttgtaagtttttattgtgtaa

SEQ ID NO: 6584770 - DNA, 13 bp, Homo sapiens
ttgtaataaaact

SEQ ID NO: 6584771 - DNA, 14 bp, Homo sapiens
ttgtaataaactct

SEQ ID NO: 6584772 - DNA, 17 bp, Homo sapiens
ttgtaataaactctcta

SEQ ID NO: 6584773 - DNA, 12 bp, Homo sapiens
ttgtaataacat

SEQ ID NO: 6584774 - DNA, 14 bp, Homo sapiens
ttgtaataagcaat

SEQ ID NO: 6584775 - DNA, 22 bp, Homo sapiens
ttgtaataataaaaccaaagaa

SEQ ID NO: 6584776 - DNA, 15 bp, Homo sapiens
ttgtaataataaaga

SEQ ID NO: 6584777 - DNA, 14 bp, Homo sapiens
ttgtaatacacata

SEQ ID NO: 6584778 - DNA, 18 bp, Homo sapiens
ttgtaatacacatatcta

SEQ ID NO: 6584779 - DNA, 22 bp, Homo sapiens
ttgtaatactttctatgtgaca

SEQ ID NO: 6584780 - DNA, 20 bp, Homo sapiens
ttgtaatacttttgtaatct

SEQ ID NO: 6584781 - DNA, 12 bp, Homo sapiens
ttgtaatagtcc

SEQ ID NO: 6584782 - DNA, 14 bp, Homo sapiens
ttgtaatagtccat

SEQ ID NO: 6584783 - DNA, 15 bp, Homo sapiens
ttgtaatataagaca

SEQ ID NO: 6584784 - DNA, 15 bp, Homo sapiens
ttgtaatatacagtt

SEQ ID NO: 6584785 - DNA, 22 bp, Homo sapiens
ttgtaatatgacagataaccta

SEQ ID NO: 6584786 - DNA, 12 bp, Homo sapiens
ttgtaatatgcg

SEQ ID NO: 6584787 - DNA, 12 bp, Homo sapiens
ttgtaatattct

SEQ ID NO: 6584788 - DNA, 12 bp, Homo sapiens
ttgtaatatttc

SEQ ID NO: 6584789 - DNA, 21 bp, Homo sapiens
ttgtaatatttcttcaagtga

SEQ ID NO: 6584790 - DNA, 13 bp, Homo sapiens
ttgtaatattttg

SEQ ID NO: 6584791 - DNA, 15 bp, Homo sapiens
ttgtaatattttgct

SEQ ID NO: 6584792 - DNA, 18 bp, Homo sapiens
ttgtaatattttgctgct

SEQ ID NO: 6584793 - DNA, 14 bp, Homo sapiens
ttgtaatcactgtt

SEQ ID NO: 6584794 - DNA, 16 bp, Homo sapiens
ttgtaatcataaatac

SEQ ID NO: 6584795 - DNA, 19 bp, Homo sapiens
ttgtaatcattatctcact

SEQ ID NO: 6584796 - DNA, 18 bp, Homo sapiens
ttgtaatcctagcacttt

SEQ ID NO: 6584797 - DNA, 20 bp, Homo sapiens
ttgtaatcgttatgtgtgta

SEQ ID NO: 6584798 - DNA, 17 bp, Homo sapiens
ttgtaatctagttgtca

SEQ ID NO: 6584799 - DNA, 23 bp, Homo sapiens
ttgtaatctagttgtcaataaat

SEQ ID NO: 6584800 - DNA, 17 bp, Homo sapiens
ttgtaatctgaataaag

SEQ ID NO: 6584801 - DNA, 13 bp, Homo sapiens
ttgtaatgaaaac

SEQ ID NO: 6584802 - DNA, 23 bp, Homo sapiens
ttgtaatgcactgtttttaatct

SEQ ID NO: 6584803 - DNA, 21 bp, Homo sapiens
ttgtaatgccaatatgacaca

SEQ ID NO: 6584804 - DNA, 14 bp, Homo sapiens
ttgtaatgctgtac

SEQ ID NO: 6584805 - DNA, 21 bp, Homo sapiens
ttgtaatggatttttgacttt

SEQ ID NO: 6584806 - DNA, 19 bp, Homo sapiens
ttgtaatgtatacttgaaa

SEQ ID NO: 6584807 - DNA, 14 bp, Homo sapiens
ttgtaatgtcacca

SEQ ID NO: 6584808 - DNA, 19 bp, Homo sapiens
ttgtaatgtcttgagctct

SEQ ID NO: 6584809 - DNA, 20 bp, Homo sapiens
ttgtaatgtcttgagctcta

SEQ ID NO: 6584810 - DNA, 21 bp, Homo sapiens
ttgtaatgtgtgaaaaagatg

SEQ ID NO: 6584811 - DNA, 22 bp, Homo sapiens
ttgtaatgtttgtcagtaaata

SEQ ID NO: 6584812 - DNA, 17 bp, Homo sapiens
ttgtaattaaaagcaaa

SEQ ID NO: 6584813 - DNA, 23 bp, Homo sapiens
ttgtaattaaaagcaaatcattt

SEQ ID NO: 6584814 - DNA, 14 bp, Homo sapiens
ttgtaattatgatt

SEQ ID NO: 6584815 - DNA, 15 bp, Homo sapiens
ttgtaattatgattt

SEQ ID NO: 6584816 - DNA, 17 bp, Homo sapiens
ttgtaattatgatttgg

SEQ ID NO: 6584817 - DNA, 15 bp, Homo sapiens
ttgtaattatggagt

SEQ ID NO: 6584818 - DNA, 18 bp, Homo sapiens
ttgtaattattgtgattt

SEQ ID NO: 6584819 - DNA, 20 bp, Homo sapiens
ttgtaattcagaaatccttg

SEQ ID NO: 6584820 - DNA, 23 bp, Homo sapiens
ttgtaattccaaaatccaaaaag

SEQ ID NO: 6584821 - DNA, 23 bp, Homo sapiens
ttgtaattctaaatgaatgttta

SEQ ID NO: 6584822 - DNA, 14 bp, Homo sapiens
ttgtaattcttatg

SEQ ID NO: 6584823 - DNA, 22 bp, Homo sapiens
ttgtaattgcttttttaaatat

SEQ ID NO: 6584824 - DNA, 17 bp, Homo sapiens
ttgtaattgtggattaa

SEQ ID NO: 6584825 - DNA, 21 bp, Homo sapiens
ttgtaatttaaacaggcccag

SEQ ID NO: 6584826 - DNA, 13 bp, Homo sapiens
ttgtaatttaatg

SEQ ID NO: 6584827 - DNA, 17 bp, Homo sapiens
ttgtaatttaatgaaaa

SEQ ID NO: 6584828 - DNA, 11 bp, Homo sapiens
ttgtaatttat

SEQ ID NO: 6584829 - DNA, 16 bp, Homo sapiens
ttgtaattttaaaagt

SEQ ID NO: 6584830 - DNA, 23 bp, Homo sapiens
ttgtaattttagtattaactctg

SEQ ID NO: 6584831 - DNA, 15 bp, Homo sapiens
ttgtaattttcttga

SEQ ID NO: 6584832 - DNA, 23 bp, Homo sapiens
ttgtaattttcttgatgactgga

SEQ ID NO: 6584833 - DNA, 17 bp, Homo sapiens
ttgtaatttttttgaaa

SEQ ID NO: 6584834 - DNA, 14 bp, Homo sapiens
ttgtacaaaaaagt

SEQ ID NO: 6584835 - DNA, 18 bp, Homo sapiens
ttgtacaaaattaagcaa

SEQ ID NO: 6584836 - DNA, 21 bp, Homo sapiens
ttgtacaaagtattaagcata

SEQ ID NO: 6584837 - DNA, 15 bp, Homo sapiens
ttgtacaaataaacc

SEQ ID NO: 6584838 - DNA, 21 bp, Homo sapiens
ttgtacaaatgtaagcaaagg

SEQ ID NO: 6584839 - DNA, 14 bp, Homo sapiens
ttgtacaaatgtat

SEQ ID NO: 6584840 - DNA, 18 bp, Homo sapiens
ttgtacaaatgtattttg

SEQ ID NO: 6584841 - DNA, 20 bp, Homo sapiens
ttgtacaaatgtattttgaa

SEQ ID NO: 6584842 - DNA, 17 bp, Homo sapiens
ttgtacaactcataaat

SEQ ID NO: 6584843 - DNA, 14 bp, Homo sapiens
ttgtacaagctcag

SEQ ID NO: 6584844 - DNA, 21 bp, Homo sapiens
ttgtacaaggtaattgttttt

SEQ ID NO: 6584845 - DNA, 11 bp, Homo sapiens
ttgtacaataa

SEQ ID NO: 6584846 - DNA, 12 bp, Homo sapiens
ttgtacaataaa

SEQ ID NO: 6584847 - DNA, 18 bp, Homo sapiens
ttgtacaatcatgttctg

SEQ ID NO: 6584848 - DNA, 16 bp, Homo sapiens
ttgtacaatggtttat

SEQ ID NO: 6584849 - DNA, 21 bp, Homo sapiens
ttgtacaatggtttattccca

SEQ ID NO: 6584850 - DNA, 23 bp, Homo sapiens
ttgtacaattgaacttaaataaa

SEQ ID NO: 6584851 - DNA, 14 bp, Homo sapiens
ttgtacaattttaa

SEQ ID NO: 6584852 - DNA, 20 bp, Homo sapiens
ttgtacactcattcattact

SEQ ID NO: 6584853 - DNA, 11 bp, Homo sapiens
ttgtacacttt

SEQ ID NO: 6584854 - DNA, 21 bp, Homo sapiens
ttgtacagaatatttctattg

SEQ ID NO: 6584855 - DNA, 20 bp, Homo sapiens
ttgtacagaatcattgctta

SEQ ID NO: 6584856 - DNA, 18 bp, Homo sapiens
ttgtacagacgtatgctt

SEQ ID NO: 6584857 - DNA, 21 bp, Homo sapiens
ttgtacagactgttttactgt

SEQ ID NO: 6584858 - DNA, 16 bp, Homo sapiens
ttgtacagagaagaag

SEQ ID NO: 6584859 - DNA, 13 bp, Homo sapiens
ttgtacagcccag

SEQ ID NO: 6584860 - DNA, 15 bp, Homo sapiens
ttgtacagcccagag

SEQ ID NO: 6584861 - DNA, 18 bp, Homo sapiens
ttgtacagtatttttcag

SEQ ID NO: 6584862 - DNA, 24 bp, Homo sapiens
ttgtacagtatttttcagatataa

SEQ ID NO: 6584863 - DNA, 15 bp, Homo sapiens
ttgtacagttcagtt

SEQ ID NO: 6584864 - DNA, 17 bp, Homo sapiens
ttgtacagtttgctgta

SEQ ID NO: 6584865 - DNA, 11 bp, Homo sapiens
ttgtacataaa

SEQ ID NO: 6584866 - DNA, 23 bp, Homo sapiens
ttgtacataagtacctcagcatt

SEQ ID NO: 6584867 - DNA, 23 bp, Homo sapiens
ttgtacatacgatttaaggtatt

SEQ ID NO: 6584868 - DNA, 13 bp, Homo sapiens
ttgtacatagcaa

SEQ ID NO: 6584869 - DNA, 16 bp, Homo sapiens
ttgtacatagttattt

SEQ ID NO: 6584870 - DNA, 17 bp, Homo sapiens
ttgtacatatcaaatag

SEQ ID NO: 6584871 - DNA, 15 bp, Homo sapiens
ttgtacatatggaaa

SEQ ID NO: 6584872 - DNA, 14 bp, Homo sapiens
ttgtacatattatc

SEQ ID NO: 6584873 - DNA, 13 bp, Homo sapiens
ttgtacatattgt

SEQ ID NO: 6584874 - DNA, 21 bp, Homo sapiens
ttgtacatatttgtggaataa

SEQ ID NO: 6584875 - DNA, 13 bp, Homo sapiens
ttgtacatatttt

SEQ ID NO: 6584876 - DNA, 16 bp, Homo sapiens
ttgtacatatttttat

SEQ ID NO: 6584877 - DNA, 16 bp, Homo sapiens
ttgtacatcgcttctt

SEQ ID NO: 6584878 - DNA, 22 bp, Homo sapiens
ttgtacatcgcttctttttcaa

SEQ ID NO: 6584879 - DNA, 20 bp, Homo sapiens
ttgtacatctggcttatttt

SEQ ID NO: 6584880 - DNA, 12 bp, Homo sapiens
ttgtacatgata

SEQ ID NO: 6584881 - DNA, 21 bp, Homo sapiens
ttgtacatgataagacatttt

SEQ ID NO: 6584882 - DNA, 20 bp, Homo sapiens
ttgtacatgtgtagcctgtg

SEQ ID NO: 6584883 - DNA, 15 bp, Homo sapiens
ttgtacattacacta

SEQ ID NO: 6584884 - DNA, 17 bp, Homo sapiens
ttgtacattacactaaa

SEQ ID NO: 6584885 - DNA, 20 bp, Homo sapiens
ttgtacattacactaaatta

SEQ ID NO: 6584886 - DNA, 23 bp, Homo sapiens
ttgtacattacactaaattatta

SEQ ID NO: 6584887 - DNA, 17 bp, Homo sapiens
ttgtacattatgttatt

SEQ ID NO: 6584888 - DNA, 20 bp, Homo sapiens
ttgtacattatgttattgga

SEQ ID NO: 6584889 - DNA, 19 bp, Homo sapiens
ttgtacattcctgatactg

SEQ ID NO: 6584890 - DNA, 20 bp, Homo sapiens
ttgtacatttatgatttaat

SEQ ID NO: 6584891 - DNA, 20 bp, Homo sapiens
ttgtacatttgggagttttt

SEQ ID NO: 6584892 - DNA, 11 bp, Homo sapiens
ttgtacatttt

SEQ ID NO: 6584893 - DNA, 15 bp, Homo sapiens
ttgtaccaaaatttt

SEQ ID NO: 6584894 - DNA, 18 bp, Homo sapiens
ttgtaccaaaattttaaa

SEQ ID NO: 6584895 - DNA, 14 bp, Homo sapiens
ttgtaccaaagctg

SEQ ID NO: 6584896 - DNA, 18 bp, Homo sapiens
ttgtaccactgctaataa

SEQ ID NO: 6584897 - DNA, 23 bp, Homo sapiens
ttgtaccactgctaataaatgac

SEQ ID NO: 6584898 - DNA, 23 bp, Homo sapiens
ttgtaccagtgaatttttgcaat

SEQ ID NO: 6584899 - DNA, 19 bp, Homo sapiens
ttgtaccatagaaaaatgt

SEQ ID NO: 6584900 - DNA, 20 bp, Homo sapiens
ttgtaccattccttcaaata

SEQ ID NO: 6584901 - DNA, 21 bp, Homo sapiens
ttgtaccattccttcaaataa

SEQ ID NO: 6584902 - DNA, 13 bp, Homo sapiens
ttgtaccccatcc

SEQ ID NO: 6584903 - DNA, 18 bp, Homo sapiens
ttgtaccccatcccttcc

SEQ ID NO: 6584904 - DNA, 19 bp, Homo sapiens
ttgtacccttcttgtctct

SEQ ID NO: 6584905 - DNA, 16 bp, Homo sapiens
ttgtaccgcaatgtga

SEQ ID NO: 6584906 - DNA, 20 bp, Homo sapiens
ttgtacctatgtgacagaca

SEQ ID NO: 6584907 - DNA, 14 bp, Homo sapiens
ttgtacctatttct

SEQ ID NO: 6584908 - DNA, 16 bp, Homo sapiens
ttgtacctatttctga

SEQ ID NO: 6584909 - DNA, 23 bp, Homo sapiens
ttgtacctatttctgatgatgtc

SEQ ID NO: 6584910 - DNA, 17 bp, Homo sapiens
ttgtacgtaaagcttaa

SEQ ID NO: 6584911 - DNA, 16 bp, Homo sapiens
ttgtacgtaatgtatt

SEQ ID NO: 6584912 - DNA, 22 bp, Homo sapiens
ttgtacgtgggagaggcagaaa

SEQ ID NO: 6584913 - DNA, 15 bp, Homo sapiens
ttgtacgtttaaagt

SEQ ID NO: 6584914 - DNA, 21 bp, Homo sapiens
ttgtacgttttgcacattttg

SEQ ID NO: 6584915 - DNA, 16 bp, Homo sapiens
ttgtactaaagccaaa

SEQ ID NO: 6584916 - DNA, 11 bp, Homo sapiens
ttgtactatgt

SEQ ID NO: 6584917 - DNA, 21 bp, Homo sapiens
ttgtactattgtttaaaaaca

SEQ ID NO: 6584918 - DNA, 23 bp, Homo sapiens
ttgtactcagtggacagtgctgt

SEQ ID NO: 6584919 - DNA, 14 bp, Homo sapiens
ttgtactccagcct

SEQ ID NO: 6584920 - DNA, 19 bp, Homo sapiens
aatatatacagattcctgt

SEQ ID NO: 6584921 - DNA, 22 bp, Homo sapiens
aatatatacagattcctgttgt

SEQ ID NO: 6584922 - DNA, 14 bp, Homo sapiens
aatatatacataaa

SEQ ID NO: 6584923 - DNA, 15 bp, Homo sapiens
aatatatacataaaa

SEQ ID NO: 6584924 - DNA, 23 bp, Homo sapiens
aatatatacatattcaaagtata

SEQ ID NO: 6584925 - DNA, 13 bp, Homo sapiens
aatatatagcatt

SEQ ID NO: 6584926 - DNA, 20 bp, Homo sapiens
aatatatagctggcaagaat

SEQ ID NO: 6584927 - DNA, 16 bp, Homo sapiens
aatatatagcttgaaa

SEQ ID NO: 6584928 - DNA, 20 bp, Homo sapiens
aatatatagtgggtacatca

SEQ ID NO: 6584929 - DNA, 15 bp, Homo sapiens
aatatatataaataa

SEQ ID NO: 6584930 - DNA, 20 bp, Homo sapiens
aatatatataaatatatatt

SEQ ID NO: 6584931 - DNA, 20 bp, Homo sapiens
aatatatataatacttaaaa

SEQ ID NO: 6584932 - DNA, 13 bp, Homo sapiens
aatatatatacat

SEQ ID NO: 6584933 - DNA, 15 bp, Homo sapiens
aatatatatacatat

SEQ ID NO: 6584934 - DNA, 16 bp, Homo sapiens
aatatatatacatatg

SEQ ID NO: 6584935 - DNA, 19 bp, Homo sapiens
aatatatatatatataaaa

SEQ ID NO: 6584936 - DNA, 22 bp, Homo sapiens
aatatatatatatataaaataa

SEQ ID NO: 6584937 - DNA, 14 bp, Homo sapiens
aatatatatatcct

SEQ ID NO: 6584938 - DNA, 12 bp, Homo sapiens
aatatatatgta

SEQ ID NO: 6584939 - DNA, 16 bp, Homo sapiens
aatatatatgtcaata

SEQ ID NO: 6584940 - DNA, 16 bp, Homo sapiens
aatatatattaagtgt

SEQ ID NO: 6584941 - DNA, 16 bp, Homo sapiens
aatatatattatactt

SEQ ID NO: 6584942 - DNA, 16 bp, Homo sapiens
aatatatattatcttt

SEQ ID NO: 6584943 - DNA, 17 bp, Homo sapiens
aatatatattattctca

SEQ ID NO: 6584944 - DNA, 19 bp, Homo sapiens
aatatatattattctcatt

SEQ ID NO: 6584945 - DNA, 22 bp, Homo sapiens
aatatatattattctcatttag

SEQ ID NO: 6584946 - DNA, 23 bp, Homo sapiens
aatatatattattctcatttagt

SEQ ID NO: 6584947 - DNA, 22 bp, Homo sapiens
aatatatatttatcatatttaa

SEQ ID NO: 6584948 - DNA, 12 bp, Homo sapiens
aatatatatttc

SEQ ID NO: 6584949 - DNA, 12 bp, Homo sapiens
aatatatatttt

SEQ ID NO: 6584950 - DNA, 21 bp, Homo sapiens
aatatatattttaaggttgca

SEQ ID NO: 6584951 - DNA, 14 bp, Homo sapiens
aatatatattttgt

SEQ ID NO: 6584952 - DNA, 23 bp, Homo sapiens
aatatatatttttaatggaaagt

SEQ ID NO: 6584953 - DNA, 16 bp, Homo sapiens
aatatatatttttcaa

SEQ ID NO: 6584954 - DNA, 22 bp, Homo sapiens
aatatatatttttcaaatagat

SEQ ID NO: 6584955 - DNA, 19 bp, Homo sapiens
aatatatatttttcaacca

SEQ ID NO: 6584956 - DNA, 20 bp, Homo sapiens
aatatatccccactactcaa

SEQ ID NO: 6584957 - DNA, 14 bp, Homo sapiens
aatatatcctgtgt

SEQ ID NO: 6584958 - DNA, 13 bp, Homo sapiens
aatatatcctgtt

SEQ ID NO: 6584959 - DNA, 17 bp, Homo sapiens
aatatatcctgtttgta

SEQ ID NO: 6584960 - DNA, 18 bp, Homo sapiens
aatatatcctgtttgtat

SEQ ID NO: 6584961 - DNA, 20 bp, Homo sapiens
aatatatcctgtttgtattt

SEQ ID NO: 6584962 - DNA, 21 bp, Homo sapiens
aatatatctaaattgaataat

SEQ ID NO: 6584963 - DNA, 20 bp, Homo sapiens
aatatatctaccccagacta

SEQ ID NO: 6584964 - DNA, 12 bp, Homo sapiens
aatatatctgta

SEQ ID NO: 6584965 - DNA, 13 bp, Homo sapiens
aatatatctgtaa

SEQ ID NO: 6584966 - DNA, 18 bp, Homo sapiens
aatatatctgttggagaa

SEQ ID NO: 6584967 - DNA, 23 bp, Homo sapiens
aatatatctgttggagaaagaaa

SEQ ID NO: 6584968 - DNA, 13 bp, Homo sapiens
aatatatcttaag

SEQ ID NO: 6584969 - DNA, 14 bp, Homo sapiens
aatatatctttgta

SEQ ID NO: 6584970 - DNA, 12 bp, Homo sapiens
aatatatgaaat

SEQ ID NO: 6584971 - DNA, 13 bp, Homo sapiens
aatatatgacttc

SEQ ID NO: 6584972 - DNA, 17 bp, Homo sapiens
aatatatgatatataaa

SEQ ID NO: 6584973 - DNA, 13 bp, Homo sapiens
aatatatgattct

SEQ ID NO: 6584974 - DNA, 17 bp, Homo sapiens
aatatatgccttactat

SEQ ID NO: 6584975 - DNA, 21 bp, Homo sapiens
aatatatgccttactattgta

SEQ ID NO: 6584976 - DNA, 20 bp, Homo sapiens
aatatatgccttgtataata

SEQ ID NO: 6584977 - DNA, 14 bp, Homo sapiens
aatatatgcttttg

SEQ ID NO: 6584978 - DNA, 22 bp, Homo sapiens
aatatatggcagagttgtaaat

SEQ ID NO: 6584979 - DNA, 18 bp, Homo sapiens
aatatatggcatttgcag

SEQ ID NO: 6584980 - DNA, 23 bp, Homo sapiens
aatatatggggggagtgagctct

SEQ ID NO: 6584981 - DNA, 20 bp, Homo sapiens
aatatatggtctaatgttta

SEQ ID NO: 6584982 - DNA, 13 bp, Homo sapiens
aatatatgtaata

SEQ ID NO: 6584983 - DNA, 22 bp, Homo sapiens
aatatatgtaatatatacatat

SEQ ID NO: 6584984 - DNA, 11 bp, Homo sapiens
aatatatgtat

SEQ ID NO: 6584985 - DNA, 16 bp, Homo sapiens
aatatatgtatataca

SEQ ID NO: 6584986 - DNA, 16 bp, Homo sapiens
aatatatgtatatata

SEQ ID NO: 6584987 - DNA, 19 bp, Homo sapiens
aatatatgtatgtaaaaat

SEQ ID NO: 6584988 - DNA, 12 bp, Homo sapiens
aatatatgtatt

SEQ ID NO: 6584989 - DNA, 14 bp, Homo sapiens
aatatatgtattat

SEQ ID NO: 6584990 - DNA, 14 bp, Homo sapiens
aatatatgtatttt

SEQ ID NO: 6584991 - DNA, 12 bp, Homo sapiens
aatatatgtctg

SEQ ID NO: 6584992 - DNA, 12 bp, Homo sapiens
aatatatgttta

SEQ ID NO: 6584993 - DNA, 21 bp, Homo sapiens
aatatatgtttggctgaaatt

SEQ ID NO: 6584994 - DNA, 16 bp, Homo sapiens
aatatatgttttgaga

SEQ ID NO: 6584995 - DNA, 22 bp, Homo sapiens
aatatattaaaaatataaacaa

SEQ ID NO: 6584996 - DNA, 20 bp, Homo sapiens
aatatattaccagcaagaat

SEQ ID NO: 6584997 - DNA, 23 bp, Homo sapiens
aatatattaccagcaagaataaa

SEQ ID NO: 6584998 - DNA, 17 bp, Homo sapiens
aatatattactgattta

SEQ ID NO: 6584999 - DNA, 21 bp, Homo sapiens
aatatattagtaagatactgt

SEQ ID NO: 6585000 - DNA, 14 bp, Homo sapiens
aatatattatatat

SEQ ID NO: 6585001 - DNA, 20 bp, Homo sapiens
aatatattattacttgtaaa

SEQ ID NO: 6585002 - DNA, 22 bp, Homo sapiens
aatatattattacttgtaaata

SEQ ID NO: 6585003 - DNA, 15 bp, Homo sapiens
aatatattatttcct

SEQ ID NO: 6585004 - DNA, 16 bp, Homo sapiens
aatatattatttcctt

SEQ ID NO: 6585005 - DNA, 14 bp, Homo sapiens
aatatattctcttt

SEQ ID NO: 6585006 - DNA, 16 bp, Homo sapiens
aatatattctctttgg

SEQ ID NO: 6585007 - DNA, 19 bp, Homo sapiens
aatatattgaacttttgta

SEQ ID NO: 6585008 - DNA, 20 bp, Homo sapiens
aatatattgaacttttgtac

SEQ ID NO: 6585009 - DNA, 13 bp, Homo sapiens
aatatattgaata

SEQ ID NO: 6585010 - DNA, 23 bp, Homo sapiens
aatatattgccaaatattaagaa

SEQ ID NO: 6585011 - DNA, 14 bp, Homo sapiens
aatatattgccagt

SEQ ID NO: 6585012 - DNA, 21 bp, Homo sapiens
aatatattgccagtatataag

SEQ ID NO: 6585013 - DNA, 17 bp, Homo sapiens
aatatattgctgcattt

SEQ ID NO: 6585014 - DNA, 21 bp, Homo sapiens
aatatattgctgctggtaatt

SEQ ID NO: 6585015 - DNA, 20 bp, Homo sapiens
aatatattgtacaaatgtaa

SEQ ID NO: 6585016 - DNA, 14 bp, Homo sapiens
aatatatttaaaaa

SEQ ID NO: 6585017 - DNA, 16 bp, Homo sapiens
aatatatttaaaaata

SEQ ID NO: 6585018 - DNA, 19 bp, Homo sapiens
aatatatttaaagggaaat

SEQ ID NO: 6585019 - DNA, 17 bp, Homo sapiens
aatatatttaactattt

SEQ ID NO: 6585020 - DNA, 21 bp, Homo sapiens
aatatatttaatggttaaggg

SEQ ID NO: 6585021 - DNA, 14 bp, Homo sapiens
aatatatttaattg

SEQ ID NO: 6585022 - DNA, 14 bp, Homo sapiens
aatatatttatata

SEQ ID NO: 6585023 - DNA, 19 bp, Homo sapiens
aatatatttatatactttt

SEQ ID NO: 6585024 - DNA, 23 bp, Homo sapiens
aatatatttatatactttttcat

SEQ ID NO: 6585025 - DNA, 12 bp, Homo sapiens
aatatatttatg

SEQ ID NO: 6585026 - DNA, 20 bp, Homo sapiens
aatatatttatttaaagcat

SEQ ID NO: 6585027 - DNA, 15 bp, Homo sapiens
aatatatttcagata

SEQ ID NO: 6585028 - DNA, 16 bp, Homo sapiens
aatatatttcttcttc

SEQ ID NO: 6585029 - DNA, 23 bp, Homo sapiens
aatatatttgcataatatgcata

SEQ ID NO: 6585030 - DNA, 17 bp, Homo sapiens
aatatatttgtaaaaga

SEQ ID NO: 6585031 - DNA, 13 bp, Homo sapiens
aatatatttgtca

SEQ ID NO: 6585032 - DNA, 14 bp, Homo sapiens
aatatatttgtgta

SEQ ID NO: 6585033 - DNA, 19 bp, Homo sapiens
aatatatttgtgtatttaa

SEQ ID NO: 6585034 - DNA, 18 bp, Homo sapiens
aatatattttaaatgtgg

SEQ ID NO: 6585035 - DNA, 15 bp, Homo sapiens
aatatattttaagac

SEQ ID NO: 6585036 - DNA, 18 bp, Homo sapiens
aatatattttaagacgaa

SEQ ID NO: 6585037 - DNA, 16 bp, Homo sapiens
aatatattttatgatt

SEQ ID NO: 6585038 - DNA, 15 bp, Homo sapiens
aatatattttctgtt

SEQ ID NO: 6585039 - DNA, 17 bp, Homo sapiens
aatatattttctttcta

SEQ ID NO: 6585040 - DNA, 16 bp, Homo sapiens
aatatattttgaaata

SEQ ID NO: 6585041 - DNA, 23 bp, Homo sapiens
aatatatttttactgctttctga

SEQ ID NO: 6585042 - DNA, 20 bp, Homo sapiens
aatatatttttatatttagt

SEQ ID NO: 6585043 - DNA, 21 bp, Homo sapiens
aatatattttttgttattatt

SEQ ID NO: 6585044 - DNA, 17 bp, Homo sapiens
aatatcaaaaaggagct

SEQ ID NO: 6585045 - DNA, 20 bp, Homo sapiens
aatatcaaaaaggagctctt

SEQ ID NO: 6585046 - DNA, 15 bp, Homo sapiens
aatatcaaagcattt

SEQ ID NO: 6585047 - DNA, 12 bp, Homo sapiens
aatatcaaataa

SEQ ID NO: 6585048 - DNA, 17 bp, Homo sapiens
aatatcaaataataaag

SEQ ID NO: 6585049 - DNA, 20 bp, Homo sapiens
aatatcaaatgcagtatatt

SEQ ID NO: 6585050 - DNA, 22 bp, Homo sapiens
aatatcaactctcactcctgaa

SEQ ID NO: 6585051 - DNA, 20 bp, Homo sapiens
aatatcaagtactacatttt

SEQ ID NO: 6585052 - DNA, 13 bp, Homo sapiens
aatatcaatcatt

SEQ ID NO: 6585053 - DNA, 14 bp, Homo sapiens
aatatcaatcattt

SEQ ID NO: 6585054 - DNA, 20 bp, Homo sapiens
aatatcacaaagttgtttaa

SEQ ID NO: 6585055 - DNA, 16 bp, Homo sapiens
aatatcacactgaata

SEQ ID NO: 6585056 - DNA, 18 bp, Homo sapiens
aatatcaccaaaaaccta

SEQ ID NO: 6585057 - DNA, 20 bp, Homo sapiens
aatatcaccaaaaacctatt

SEQ ID NO: 6585058 - DNA, 22 bp, Homo sapiens
aatatcactaatttcttcttta

SEQ ID NO: 6585059 - DNA, 12 bp, Homo sapiens
aatatcacttgt

SEQ ID NO: 6585060 - DNA, 14 bp, Homo sapiens
aatatcactttgta

SEQ ID NO: 6585061 - DNA, 15 bp, Homo sapiens
aatatcagacaagca

SEQ ID NO: 6585062 - DNA, 16 bp, Homo sapiens
aatatcagacaagcac

SEQ ID NO: 6585063 - DNA, 17 bp, Homo sapiens
aatatcagctttgataa

SEQ ID NO: 6585064 - DNA, 23 bp, Homo sapiens
aatatcaggagcttttttacaca

SEQ ID NO: 6585065 - DNA, 18 bp, Homo sapiens
aatatcagtattctgaca

SEQ ID NO: 6585066 - DNA, 20 bp, Homo sapiens
aatatcagtattctgacatg

SEQ ID NO: 6585067 - DNA, 22 bp, Homo sapiens
aatatcagtattctgacatgta

SEQ ID NO: 6585068 - DNA, 17 bp, Homo sapiens
aatatcagttacagtgg

SEQ ID NO: 6585069 - DNA, 22 bp, Homo sapiens
aatatcagttactcagccctgg

SEQ ID NO: 6585070 - DNA, 13 bp, Homo sapiens
aatatcataaagc

SEQ ID NO: 6585071 - DNA, 19 bp, Homo sapiens
aatatcatataaacatttt

SEQ ID NO: 6585072 - DNA, 24 bp, Homo sapiens
aatatcatatgtatctaaatgaaa

SEQ ID NO: 6585073 - DNA, 22 bp, Homo sapiens
aatatcatctcaattttttcaa

SEQ ID NO: 6585074 - DNA, 18 bp, Homo sapiens
aatatcatctgtcattat

SEQ ID NO: 6585075 - DNA, 19 bp, Homo sapiens
aatatcatgtcttgtgcat

SEQ ID NO: 6585076 - DNA, 18 bp, Homo sapiens
aatatcatgtgtagatat

SEQ ID NO: 6585077 - DNA, 15 bp, Homo sapiens
aatatcattatagca

SEQ ID NO: 6585078 - DNA, 15 bp, Homo sapiens
aatatcattcagcaa

SEQ ID NO: 6585079 - DNA, 21 bp, Homo sapiens
aatatcattttatagaaaatg

SEQ ID NO: 6585080 - DNA, 16 bp, Homo sapiens
aatatcattttattca

SEQ ID NO: 6585081 - DNA, 22 bp, Homo sapiens
aatatccaacacaactatcaaa

SEQ ID NO: 6585082 - DNA, 13 bp, Homo sapiens
aatatccacagta

SEQ ID NO: 6585083 - DNA, 20 bp, Homo sapiens
aatatccaggtcaacagaat

SEQ ID NO: 6585084 - DNA, 16 bp, Homo sapiens
aatatccagtcaaaga

SEQ ID NO: 6585085 - DNA, 14 bp, Homo sapiens
aatatccatattaa

SEQ ID NO: 6585086 - DNA, 16 bp, Homo sapiens
aatatccattctgtag

SEQ ID NO: 6585087 - DNA, 16 bp, Homo sapiens
aatatccatttatctt

SEQ ID NO: 6585088 - DNA, 19 bp, Homo sapiens
aatatcccaacattctgca

SEQ ID NO: 6585089 - DNA, 20 bp, Homo sapiens
aatatcccagagaacaatca

SEQ ID NO: 6585090 - DNA, 22 bp, Homo sapiens
aatatcccagagaacaatcact

SEQ ID NO: 6585091 - DNA, 16 bp, Homo sapiens
aatatcccctcccagt

SEQ ID NO: 6585092 - DNA, 18 bp, Homo sapiens
aatatccctacatgtatt

SEQ ID NO: 6585093 - DNA, 19 bp, Homo sapiens
aatatccctcatttcatta

SEQ ID NO: 6585094 - DNA, 20 bp, Homo sapiens
aatatccctcccctctctcc

SEQ ID NO: 6585095 - DNA, 16 bp, Homo sapiens
aatatcccttacttta

SEQ ID NO: 6585096 - DNA, 21 bp, Homo sapiens
aatatcccttggacattttat

SEQ ID NO: 6585097 - DNA, 23 bp, Homo sapiens
aatatcccttggacattttatgt

SEQ ID NO: 6585098 - DNA, 14 bp, Homo sapiens
ttgtactgaatttt

SEQ ID NO: 6585099 - DNA, 22 bp, Homo sapiens
ttgtactgcatcttagtttact

SEQ ID NO: 6585100 - DNA, 12 bp, Homo sapiens
ttgtactgtaaa

SEQ ID NO: 6585101 - DNA, 20 bp, Homo sapiens
ttgtactgtatctattcttc

SEQ ID NO: 6585102 - DNA, 21 bp, Homo sapiens
ttgtactgttcatacagtttt

SEQ ID NO: 6585103 - DNA, 24 bp, Homo sapiens
ttgtactgtttaatgttctgtgat

SEQ ID NO: 6585104 - DNA, 15 bp, Homo sapiens
ttgtacttaaatggt

SEQ ID NO: 6585105 - DNA, 18 bp, Homo sapiens
ttgtacttacactgaaat

SEQ ID NO: 6585106 - DNA, 19 bp, Homo sapiens
ttgtacttacactgaaatc

SEQ ID NO: 6585107 - DNA, 19 bp, Homo sapiens
ttgtacttctgtgttcatt

SEQ ID NO: 6585108 - DNA, 14 bp, Homo sapiens
ttgtacttgaataa

SEQ ID NO: 6585109 - DNA, 14 bp, Homo sapiens
ttgtactttacaat

SEQ ID NO: 6585110 - DNA, 15 bp, Homo sapiens
ttgtactttctgtta

SEQ ID NO: 6585111 - DNA, 17 bp, Homo sapiens
ttgtactttctgttaaa

SEQ ID NO: 6585112 - DNA, 20 bp, Homo sapiens
ttgtactttctgttaaaatg

SEQ ID NO: 6585113 - DNA, 18 bp, Homo sapiens
ttgtactttgtggagaga

SEQ ID NO: 6585114 - DNA, 16 bp, Homo sapiens
ttgtactttgtttttc

SEQ ID NO: 6585115 - DNA, 19 bp, Homo sapiens
ttgtacttttagtagagac

SEQ ID NO: 6585116 - DNA, 20 bp, Homo sapiens
ttgtacttttggcatgaaag

SEQ ID NO: 6585117 - DNA, 21 bp, Homo sapiens
ttgtacttttgtgttactgca

SEQ ID NO: 6585118 - DNA, 13 bp, Homo sapiens
ttgtactttttaa

SEQ ID NO: 6585119 - DNA, 19 bp, Homo sapiens
ttgtagaaaaatccctcca

SEQ ID NO: 6585120 - DNA, 12 bp, Homo sapiens
ttgtagaaacac

SEQ ID NO: 6585121 - DNA, 11 bp, Homo sapiens
ttgtagaaagc

SEQ ID NO: 6585122 - DNA, 21 bp, Homo sapiens
ttgtagaaagcaaacaaaatt

SEQ ID NO: 6585123 - DNA, 19 bp, Homo sapiens
ttgtagaaagctaatacaa

SEQ ID NO: 6585124 - DNA, 17 bp, Homo sapiens
ttgtagaaattaaacat

SEQ ID NO: 6585125 - DNA, 22 bp, Homo sapiens
ttgtagaactcactctgggctg

SEQ ID NO: 6585126 - DNA, 13 bp, Homo sapiens
ttgtagaactgcc

SEQ ID NO: 6585127 - DNA, 14 bp, Homo sapiens
ttgtagaacttgtt

SEQ ID NO: 6585128 - DNA, 20 bp, Homo sapiens
ttgtagaagaaaatttaatt

SEQ ID NO: 6585129 - DNA, 13 bp, Homo sapiens
ttgtagaaggagc

SEQ ID NO: 6585130 - DNA, 22 bp, Homo sapiens
ttgtagaataaatggtttctca

SEQ ID NO: 6585131 - DNA, 20 bp, Homo sapiens
ttgtagaatgtattgtacct

SEQ ID NO: 6585132 - DNA, 22 bp, Homo sapiens
ttgtagaatgtattgtaccttt

SEQ ID NO: 6585133 - DNA, 16 bp, Homo sapiens
ttgtagaattgttata

SEQ ID NO: 6585134 - DNA, 15 bp, Homo sapiens
ttgtagacattttga

SEQ ID NO: 6585135 - DNA, 18 bp, Homo sapiens
ttgtagactgatgtttta

SEQ ID NO: 6585136 - DNA, 20 bp, Homo sapiens
ttgtagactgatgttttagc

SEQ ID NO: 6585137 - DNA, 20 bp, Homo sapiens
ttgtagagacagggtctcac

SEQ ID NO: 6585138 - DNA, 13 bp, Homo sapiens
ttgtagatatata

SEQ ID NO: 6585139 - DNA, 15 bp, Homo sapiens
ttgtagatatatatt

SEQ ID NO: 6585140 - DNA, 18 bp, Homo sapiens
ttgtagatgctaacgtgt

SEQ ID NO: 6585141 - DNA, 22 bp, Homo sapiens
ttgtagatgctattctttctga

SEQ ID NO: 6585142 - DNA, 18 bp, Homo sapiens
ttgtagatgtattttcaa

SEQ ID NO: 6585143 - DNA, 14 bp, Homo sapiens
ttgtagattcagtg

SEQ ID NO: 6585144 - DNA, 15 bp, Homo sapiens
ttgtagatttagtgt

SEQ ID NO: 6585145 - DNA, 18 bp, Homo sapiens
ttgtagattttgttatgt

SEQ ID NO: 6585146 - DNA, 22 bp, Homo sapiens
ttgtagattttgttatgttcaa

SEQ ID NO: 6585147 - DNA, 23 bp, Homo sapiens
ttgtagcacaatcctattactct

SEQ ID NO: 6585148 - DNA, 16 bp, Homo sapiens
ttgtagcactgacaga

SEQ ID NO: 6585149 - DNA, 16 bp, Homo sapiens
ttgtagcactgagggt

SEQ ID NO: 6585150 - DNA, 23 bp, Homo sapiens
ttgtagcagctatatatttcccc

SEQ ID NO: 6585151 - DNA, 14 bp, Homo sapiens
ttgtagcataactg

SEQ ID NO: 6585152 - DNA, 23 bp, Homo sapiens
ttgtagcatataggtgatgtttg

SEQ ID NO: 6585153 - DNA, 17 bp, Homo sapiens
ttgtagcatttaaaatg

SEQ ID NO: 6585154 - DNA, 22 bp, Homo sapiens
ttgtagcatttaaaatggaaaa

SEQ ID NO: 6585155 - DNA, 18 bp, Homo sapiens
ttgtagcctaatattcat

SEQ ID NO: 6585156 - DNA, 21 bp, Homo sapiens
ttgtagcctaatattcatgct

SEQ ID NO: 6585157 - DNA, 22 bp, Homo sapiens
ttgtagcctaatattcatgctg

SEQ ID NO: 6585158 - DNA, 19 bp, Homo sapiens
ttgtagccttttgactttc

SEQ ID NO: 6585159 - DNA, 21 bp, Homo sapiens
ttgtagcgtctttcttttttg

SEQ ID NO: 6585160 - DNA, 16 bp, Homo sapiens
ttgtagctaacagtga

SEQ ID NO: 6585161 - DNA, 19 bp, Homo sapiens
ttgtagctaacagtgaaga

SEQ ID NO: 6585162 - DNA, 16 bp, Homo sapiens
ttgtagctagtttaaa

SEQ ID NO: 6585163 - DNA, 12 bp, Homo sapiens
ttgtagctcctc

SEQ ID NO: 6585164 - DNA, 15 bp, Homo sapiens
ttgtagcttaaaaaa

SEQ ID NO: 6585165 - DNA, 19 bp, Homo sapiens
ttgtagctttcctggaagt

SEQ ID NO: 6585166 - DNA, 23 bp, Homo sapiens
ttgtaggaaaagctgttcccatg

SEQ ID NO: 6585167 - DNA, 21 bp, Homo sapiens
ttgtaggacttttaaacaaaa

SEQ ID NO: 6585168 - DNA, 15 bp, Homo sapiens
ttgtaggagacttgc

SEQ ID NO: 6585169 - DNA, 20 bp, Homo sapiens
ttgtaggagctgaggtttca

SEQ ID NO: 6585170 - DNA, 20 bp, Homo sapiens
ttgtaggcgaatcatttgtt

SEQ ID NO: 6585171 - DNA, 20 bp, Homo sapiens
ttgtaggggtcaaagaaatg

SEQ ID NO: 6585172 - DNA, 16 bp, Homo sapiens
ttgtagggttacagag

SEQ ID NO: 6585173 - DNA, 14 bp, Homo sapiens
ttgtagggtttcta

SEQ ID NO: 6585174 - DNA, 14 bp, Homo sapiens
ttgtaggtatacta

SEQ ID NO: 6585175 - DNA, 19 bp, Homo sapiens
ttgtaggtgagatgcaaca

SEQ ID NO: 6585176 - DNA, 22 bp, Homo sapiens
ttgtaggttattttatatttga

SEQ ID NO: 6585177 - DNA, 15 bp, Homo sapiens
ttgtagtaaaagtgg

SEQ ID NO: 6585178 - DNA, 19 bp, Homo sapiens
ttgtagtaaactattctta

SEQ ID NO: 6585179 - DNA, 16 bp, Homo sapiens
ttgtagtaagaaacat

SEQ ID NO: 6585180 - DNA, 15 bp, Homo sapiens
ttgtagtaagagctt

SEQ ID NO: 6585181 - DNA, 20 bp, Homo sapiens
ttgtagtagttgatgaccaa

SEQ ID NO: 6585182 - DNA, 16 bp, Homo sapiens
ttgtagtcttgtctta

SEQ ID NO: 6585183 - DNA, 16 bp, Homo sapiens
ttgtagtgtgtgctta

SEQ ID NO: 6585184 - DNA, 12 bp, Homo sapiens
ttgtagtgttct

SEQ ID NO: 6585185 - DNA, 23 bp, Homo sapiens
ttgtagttacgagttttccctca

SEQ ID NO: 6585186 - DNA, 17 bp, Homo sapiens
ttgtagttcttgtgcat

SEQ ID NO: 6585187 - DNA, 19 bp, Homo sapiens
ttgtagttcttgtgcatgt

SEQ ID NO: 6585188 - DNA, 22 bp, Homo sapiens
ttgtagtttgaaagttgtacat

SEQ ID NO: 6585189 - DNA, 16 bp, Homo sapiens
ttgtataaaaaggaaa

SEQ ID NO: 6585190 - DNA, 12 bp, Homo sapiens
ttgtataaaaat

SEQ ID NO: 6585191 - DNA, 17 bp, Homo sapiens
ttgtataaaaattaagc

SEQ ID NO: 6585192 - DNA, 13 bp, Homo sapiens
ttgtataaaataa

SEQ ID NO: 6585193 - DNA, 14 bp, Homo sapiens
ttgtataaaataga

SEQ ID NO: 6585194 - DNA, 13 bp, Homo sapiens
ttgtataaaatct

SEQ ID NO: 6585195 - DNA, 15 bp, Homo sapiens
ttgtataaaatctga

SEQ ID NO: 6585196 - DNA, 22 bp, Homo sapiens
ttgtataaaatctgaattttgc

SEQ ID NO: 6585197 - DNA, 19 bp, Homo sapiens
ttgtataaactgtattttg

SEQ ID NO: 6585198 - DNA, 21 bp, Homo sapiens
ttgtataaatgacaaagtgtt

SEQ ID NO: 6585199 - DNA, 12 bp, Homo sapiens
ttgtataaattt

SEQ ID NO: 6585200 - DNA, 15 bp, Homo sapiens
ttgtataaattttta

SEQ ID NO: 6585201 - DNA, 16 bp, Homo sapiens
ttgtataacaggttat

SEQ ID NO: 6585202 - DNA, 21 bp, Homo sapiens
ttgtataacttttgatgactt

SEQ ID NO: 6585203 - DNA, 14 bp, Homo sapiens
ttgtataagcatgc

SEQ ID NO: 6585204 - DNA, 21 bp, Homo sapiens
ttgtataagtccatgaatgtt

SEQ ID NO: 6585205 - DNA, 15 bp, Homo sapiens
ttgtataatattgaa

SEQ ID NO: 6585206 - DNA, 16 bp, Homo sapiens
ttgtataatattgaaa

SEQ ID NO: 6585207 - DNA, 11 bp, Homo sapiens
ttgtataattg

SEQ ID NO: 6585208 - DNA, 12 bp, Homo sapiens
ttgtataattgg

SEQ ID NO: 6585209 - DNA, 20 bp, Homo sapiens
ttgtataattggatttccta

SEQ ID NO: 6585210 - DNA, 17 bp, Homo sapiens
ttgtataattgtatcgt

SEQ ID NO: 6585211 - DNA, 14 bp, Homo sapiens
ttgtatacaaatat

SEQ ID NO: 6585212 - DNA, 16 bp, Homo sapiens
ttgtatacaagtactg

SEQ ID NO: 6585213 - DNA, 20 bp, Homo sapiens
ttgtatacaccatatactgt

SEQ ID NO: 6585214 - DNA, 15 bp, Homo sapiens
ttgtatacatcctgg

SEQ ID NO: 6585215 - DNA, 20 bp, Homo sapiens
ttgtataccttgtaatttga

SEQ ID NO: 6585216 - DNA, 15 bp, Homo sapiens
ttgtatactttaaat

SEQ ID NO: 6585217 - DNA, 21 bp, Homo sapiens
ttgtatactttaaataattta

SEQ ID NO: 6585218 - DNA, 22 bp, Homo sapiens
ttgtatagaaaattcttgagaa

SEQ ID NO: 6585219 - DNA, 17 bp, Homo sapiens
ttgtatagagatatgca

SEQ ID NO: 6585220 - DNA, 15 bp, Homo sapiens
ttgtataggccatct

SEQ ID NO: 6585221 - DNA, 18 bp, Homo sapiens
ttgtataggccatctgta

SEQ ID NO: 6585222 - DNA, 19 bp, Homo sapiens
ttgtataggccatctgtaa

SEQ ID NO: 6585223 - DNA, 20 bp, Homo sapiens
ttgtataggccatctgtaaa

SEQ ID NO: 6585224 - DNA, 21 bp, Homo sapiens
ttgtataggccatctgtaaat

SEQ ID NO: 6585225 - DNA, 22 bp, Homo sapiens
ttgtataggccatctgtaaata

SEQ ID NO: 6585226 - DNA, 14 bp, Homo sapiens
ttgtataggtaact

SEQ ID NO: 6585227 - DNA, 19 bp, Homo sapiens
ttgtatagttaacacacta

SEQ ID NO: 6585228 - DNA, 21 bp, Homo sapiens
ttgtatagttatatttgctga

SEQ ID NO: 6585229 - DNA, 17 bp, Homo sapiens
ttgtatagttatgtaaa

SEQ ID NO: 6585230 - DNA, 14 bp, Homo sapiens
ttgtatagttgctt

SEQ ID NO: 6585231 - DNA, 23 bp, Homo sapiens
ttgtatagttttataaaactcag

SEQ ID NO: 6585232 - DNA, 13 bp, Homo sapiens
ttgtatataaagt

SEQ ID NO: 6585233 - DNA, 14 bp, Homo sapiens
ttgtatataaatgg

SEQ ID NO: 6585234 - DNA, 16 bp, Homo sapiens
ttgtatatacagttat

SEQ ID NO: 6585235 - DNA, 16 bp, Homo sapiens
ttgtatatacatatta

SEQ ID NO: 6585236 - DNA, 20 bp, Homo sapiens
ttgtatatacatattataaa

SEQ ID NO: 6585237 - DNA, 23 bp, Homo sapiens
ttgtatatacatattataaataa

SEQ ID NO: 6585238 - DNA, 14 bp, Homo sapiens
ttgtatatatatgt

SEQ ID NO: 6585239 - DNA, 13 bp, Homo sapiens
ttgtatatatctg

SEQ ID NO: 6585240 - DNA, 21 bp, Homo sapiens
ttgtatatattattataatct

SEQ ID NO: 6585241 - DNA, 22 bp, Homo sapiens
ttgtatatattttatatgttca

SEQ ID NO: 6585242 - DNA, 20 bp, Homo sapiens
ttgtatatcactaaaagcat

SEQ ID NO: 6585243 - DNA, 22 bp, Homo sapiens
ttgtatatcactaaaagcatga

SEQ ID NO: 6585244 - DNA, 19 bp, Homo sapiens
ttgtatatgactgcatttg

SEQ ID NO: 6585245 - DNA, 15 bp, Homo sapiens
ttgtatatgctgcat

SEQ ID NO: 6585246 - DNA, 20 bp, Homo sapiens
ttgtatattacacatttgta

SEQ ID NO: 6585247 - DNA, 18 bp, Homo sapiens
ttgtatattatggaagat

SEQ ID NO: 6585248 - DNA, 20 bp, Homo sapiens
ttgtatattatggaagattt

SEQ ID NO: 6585249 - DNA, 19 bp, Homo sapiens
ttgtatattatgtttattt

SEQ ID NO: 6585250 - DNA, 22 bp, Homo sapiens
ttgtatattctattttacaact

SEQ ID NO: 6585251 - DNA, 16 bp, Homo sapiens
ttgtatattggtttta

SEQ ID NO: 6585252 - DNA, 19 bp, Homo sapiens
ttgtatattggttttatga

SEQ ID NO: 6585253 - DNA, 14 bp, Homo sapiens
ttgtatattgtatt

SEQ ID NO: 6585254 - DNA, 20 bp, Homo sapiens
ttgtatattgtggatgtgtt

SEQ ID NO: 6585255 - DNA, 19 bp, Homo sapiens
ttgtatattgtgtttgtgt

SEQ ID NO: 6585256 - DNA, 14 bp, Homo sapiens
ttgtatatttgtac

SEQ ID NO: 6585257 - DNA, 18 bp, Homo sapiens
ttgtatatttgtacaaaa

SEQ ID NO: 6585258 - DNA, 20 bp, Homo sapiens
ttgtatatttgttttatgct

SEQ ID NO: 6585259 - DNA, 22 bp, Homo sapiens
ttgtatcaaactcgtctgatgt

SEQ ID NO: 6585260 - DNA, 19 bp, Homo sapiens
ttgtatcaaatgttacagt

SEQ ID NO: 6585261 - DNA, 16 bp, Homo sapiens
ttgtatcacaaatctt

SEQ ID NO: 6585262 - DNA, 14 bp, Homo sapiens
ttgtatcccctgca

SEQ ID NO: 6585263 - DNA, 15 bp, Homo sapiens
ttgtatcccctgcag

SEQ ID NO: 6585264 - DNA, 21 bp, Homo sapiens
ttgtatcgatgttatgtaaaa

SEQ ID NO: 6585265 - DNA, 18 bp, Homo sapiens
ttgtatcgtatagctgta

SEQ ID NO: 6585266 - DNA, 22 bp, Homo sapiens
ttgtatcgtatagctgtattga

SEQ ID NO: 6585267 - DNA, 13 bp, Homo sapiens
ttgtatctagtgc

SEQ ID NO: 6585268 - DNA, 18 bp, Homo sapiens
ttgtatctagtgcagctg

SEQ ID NO: 6585269 - DNA, 20 bp, Homo sapiens
ttgtatctcatactgtctgg

SEQ ID NO: 6585270 - DNA, 21 bp, Homo sapiens
ttgtatctctgaagcatgttt

SEQ ID NO: 6585271 - DNA, 12 bp, Homo sapiens
ttgtatctctta

SEQ ID NO: 6585272 - DNA, 17 bp, Homo sapiens
ttgtatctcttaaagtg

SEQ ID NO: 6585273 - DNA, 20 bp, Homo sapiens
ttgtatctcttttgaatcca

SEQ ID NO: 6585274 - DNA, 15 bp, Homo sapiens
ttgtatcttaaatct

SEQ ID NO: 6585275 - DNA, 16 bp, Homo sapiens
aatatccgtgccagga

SEQ ID NO: 6585276 - DNA, 19 bp, Homo sapiens
aatatccgtgccaggaaaa

SEQ ID NO: 6585277 - DNA, 16 bp, Homo sapiens
aatatcctaaacatca

SEQ ID NO: 6585278 - DNA, 18 bp, Homo sapiens
aatatcctaaacatcatt

SEQ ID NO: 6585279 - DNA, 23 bp, Homo sapiens
aatatcctaagactaacaaaggc

SEQ ID NO: 6585280 - DNA, 12 bp, Homo sapiens
aatatcctaata

SEQ ID NO: 6585281 - DNA, 22 bp, Homo sapiens
aatatcctatactggttatagt

SEQ ID NO: 6585282 - DNA, 13 bp, Homo sapiens
aatatcctcaggg

SEQ ID NO: 6585283 - DNA, 13 bp, Homo sapiens
aatatcctgcttg

SEQ ID NO: 6585284 - DNA, 14 bp, Homo sapiens
aatatcctgtgtaa

SEQ ID NO: 6585285 - DNA, 21 bp, Homo sapiens
aatatcggatgggtgtgggag

SEQ ID NO: 6585286 - DNA, 17 bp, Homo sapiens
aatatcgtacctgtccc

SEQ ID NO: 6585287 - DNA, 19 bp, Homo sapiens
aatatcgtacctgtccctc

SEQ ID NO: 6585288 - DNA, 16 bp, Homo sapiens
aatatcgttagggtga

SEQ ID NO: 6585289 - DNA, 21 bp, Homo sapiens
aatatctaatatatatgaata

SEQ ID NO: 6585290 - DNA, 14 bp, Homo sapiens
aatatctagtgcta

SEQ ID NO: 6585291 - DNA, 15 bp, Homo sapiens
aatatctattaatat

SEQ ID NO: 6585292 - DNA, 22 bp, Homo sapiens
aatatctatttatctgtctgag

SEQ ID NO: 6585293 - DNA, 22 bp, Homo sapiens
aatatctatttgaataaattat

SEQ ID NO: 6585294 - DNA, 21 bp, Homo sapiens
aatatctccgtcaactcatat

SEQ ID NO: 6585295 - DNA, 20 bp, Homo sapiens
aatatctcctccaatgtcct

SEQ ID NO: 6585296 - DNA, 15 bp, Homo sapiens
aatatctctaaaata

SEQ ID NO: 6585297 - DNA, 15 bp, Homo sapiens
aatatctctatttaa

SEQ ID NO: 6585298 - DNA, 22 bp, Homo sapiens
aatatctcttgtgcttttttga

SEQ ID NO: 6585299 - DNA, 13 bp, Homo sapiens
aatatctgaaatg

SEQ ID NO: 6585300 - DNA, 15 bp, Homo sapiens
aatatctgaacattt

SEQ ID NO: 6585301 - DNA, 19 bp, Homo sapiens
aatatctgaacatttacta

SEQ ID NO: 6585302 - DNA, 18 bp, Homo sapiens
aatatctgagaagtgtat

SEQ ID NO: 6585303 - DNA, 23 bp, Homo sapiens
aatatctgagaagtgtatatagt

SEQ ID NO: 6585304 - DNA, 14 bp, Homo sapiens
aatatctgctttaa

SEQ ID NO: 6585305 - DNA, 14 bp, Homo sapiens
aatatctgtattta

SEQ ID NO: 6585306 - DNA, 21 bp, Homo sapiens
aatatctgtatttaattttga

SEQ ID NO: 6585307 - DNA, 14 bp, Homo sapiens
aatatctgtgaaat

SEQ ID NO: 6585308 - DNA, 22 bp, Homo sapiens
aatatctgtgaggtgctgatga

SEQ ID NO: 6585309 - DNA, 17 bp, Homo sapiens
aatatcttcacttgtca

SEQ ID NO: 6585310 - DNA, 18 bp, Homo sapiens
aatatcttcgttagtaat

SEQ ID NO: 6585311 - DNA, 19 bp, Homo sapiens
aatatctttaaatgatgta

SEQ ID NO: 6585312 - DNA, 15 bp, Homo sapiens
aatatctttctctta

SEQ ID NO: 6585313 - DNA, 21 bp, Homo sapiens
aatatctttgtgataatttaa

SEQ ID NO: 6585314 - DNA, 19 bp, Homo sapiens
aatatcttttatgtttgaa

SEQ ID NO: 6585315 - DNA, 20 bp, Homo sapiens
aatatcttttatgtttgaat

SEQ ID NO: 6585316 - DNA, 19 bp, Homo sapiens
aatatcttttttttaataa

SEQ ID NO: 6585317 - DNA, 18 bp, Homo sapiens
aatatgaaaaatgtaaat

SEQ ID NO: 6585318 - DNA, 20 bp, Homo sapiens
aatatgaaaaccgtaaagtg

SEQ ID NO: 6585319 - DNA, 13 bp, Homo sapiens
aatatgaaaactt

SEQ ID NO: 6585320 - DNA, 14 bp, Homo sapiens
aatatgaaagccac

SEQ ID NO: 6585321 - DNA, 14 bp, Homo sapiens
aatatgaaatgata

SEQ ID NO: 6585322 - DNA, 11 bp, Homo sapiens
aatatgaaatt

SEQ ID NO: 6585323 - DNA, 21 bp, Homo sapiens
aatatgaaattttaccatttt

SEQ ID NO: 6585324 - DNA, 10 bp, Homo sapiens
aatatgaaca

SEQ ID NO: 6585325 - DNA, 12 bp, Homo sapiens
aatatgaacaaa

SEQ ID NO: 6585326 - DNA, 13 bp, Homo sapiens
aatatgaacaaag

SEQ ID NO: 6585327 - DNA, 14 bp, Homo sapiens
aatatgaacaaaga

SEQ ID NO: 6585328 - DNA, 18 bp, Homo sapiens
aatatgaaccctttgttt

SEQ ID NO: 6585329 - DNA, 19 bp, Homo sapiens
aatatgaacctattttcat

SEQ ID NO: 6585330 - DNA, 22 bp, Homo sapiens
aatatgaacctattttcatttg

SEQ ID NO: 6585331 - DNA, 15 bp, Homo sapiens
aatatgaagcctttg

SEQ ID NO: 6585332 - DNA, 18 bp, Homo sapiens
aatatgaagctcacctgt

SEQ ID NO: 6585333 - DNA, 23 bp, Homo sapiens
aatatgaagttactttcttaatg

SEQ ID NO: 6585334 - DNA, 13 bp, Homo sapiens
aatatgaatgaat

SEQ ID NO: 6585335 - DNA, 22 bp, Homo sapiens
aatatgaatgtcacatttgaat

SEQ ID NO: 6585336 - DNA, 15 bp, Homo sapiens
aatatgaattctgtt

SEQ ID NO: 6585337 - DNA, 20 bp, Homo sapiens
aatatgacaaacatcattgt

SEQ ID NO: 6585338 - DNA, 11 bp, Homo sapiens
aatatgacaat

SEQ ID NO: 6585339 - DNA, 12 bp, Homo sapiens
aatatgacagat

SEQ ID NO: 6585340 - DNA, 17 bp, Homo sapiens
aatatgacctaaatcca

SEQ ID NO: 6585341 - DNA, 17 bp, Homo sapiens
aatatgaccttaaggaa

SEQ ID NO: 6585342 - DNA, 15 bp, Homo sapiens
aatatgactcctttc

SEQ ID NO: 6585343 - DNA, 19 bp, Homo sapiens
aatatgagaaatacagaag

SEQ ID NO: 6585344 - DNA, 20 bp, Homo sapiens
aatatgagaaatacagaaga

SEQ ID NO: 6585345 - DNA, 16 bp, Homo sapiens
aatatgagaatgtatt

SEQ ID NO: 6585346 - DNA, 15 bp, Homo sapiens
aatatgagattggaa

SEQ ID NO: 6585347 - DNA, 13 bp, Homo sapiens
aatatgagcttca

SEQ ID NO: 6585348 - DNA, 20 bp, Homo sapiens
aatatgagcttcaatataag

SEQ ID NO: 6585349 - DNA, 21 bp, Homo sapiens
aatatgagcttcaatataaga

SEQ ID NO: 6585350 - DNA, 23 bp, Homo sapiens
aatatgagcttcaatataagaag

SEQ ID NO: 6585351 - DNA, 19 bp, Homo sapiens
aatatgaggcatttggcat

SEQ ID NO: 6585352 - DNA, 19 bp, Homo sapiens
aatatgaggggactgcatg

SEQ ID NO: 6585353 - DNA, 17 bp, Homo sapiens
aatatgagtaatgttta

SEQ ID NO: 6585354 - DNA, 14 bp, Homo sapiens
aatatgagttactg

SEQ ID NO: 6585355 - DNA, 18 bp, Homo sapiens
aatatgatatatatgtat

SEQ ID NO: 6585356 - DNA, 17 bp, Homo sapiens
aatatgatattgcatat

SEQ ID NO: 6585357 - DNA, 19 bp, Homo sapiens
aatatgatcagagcttgaa

SEQ ID NO: 6585358 - DNA, 16 bp, Homo sapiens
aatatgatctgtggag

SEQ ID NO: 6585359 - DNA, 11 bp, Homo sapiens
aatatgatgac

SEQ ID NO: 6585360 - DNA, 16 bp, Homo sapiens
aatatgatgacaatca

SEQ ID NO: 6585361 - DNA, 14 bp, Homo sapiens
aatatgatgcaaac

SEQ ID NO: 6585362 - DNA, 20 bp, Homo sapiens
aatatgattagtaaagaaat

SEQ ID NO: 6585363 - DNA, 11 bp, Homo sapiens
aatatgattat

SEQ ID NO: 6585364 - DNA, 15 bp, Homo sapiens
aatatgattatacaa

SEQ ID NO: 6585365 - DNA, 21 bp, Homo sapiens
aatatgattattaatcagaat

SEQ ID NO: 6585366 - DNA, 16 bp, Homo sapiens
aatatgattcactatt

SEQ ID NO: 6585367 - DNA, 21 bp, Homo sapiens
aatatgattctcctctcccaa

SEQ ID NO: 6585368 - DNA, 18 bp, Homo sapiens
aatatgattttatatcca

SEQ ID NO: 6585369 - DNA, 22 bp, Homo sapiens
aatatgattttttaaaagaaat

SEQ ID NO: 6585370 - DNA, 23 bp, Homo sapiens
aatatgattttttaaaagaaatt

SEQ ID NO: 6585371 - DNA, 17 bp, Homo sapiens
aatatgcaaagcactga

SEQ ID NO: 6585372 - DNA, 24 bp, Homo sapiens
aatatgcaaagcactgacttctaa

SEQ ID NO: 6585373 - DNA, 16 bp, Homo sapiens
aatatgcaatttgtta

SEQ ID NO: 6585374 - DNA, 18 bp, Homo sapiens
aatatgcacacagtgctt

SEQ ID NO: 6585375 - DNA, 18 bp, Homo sapiens
aatatgcactaagtctct

SEQ ID NO: 6585376 - DNA, 22 bp, Homo sapiens
aatatgcactaagtctcttttt

SEQ ID NO: 6585377 - DNA, 13 bp, Homo sapiens
aatatgcactttc

SEQ ID NO: 6585378 - DNA, 15 bp, Homo sapiens
aatatgcatactaat

SEQ ID NO: 6585379 - DNA, 14 bp, Homo sapiens
aatatgcatatata

SEQ ID NO: 6585380 - DNA, 16 bp, Homo sapiens
aatatgcatatatatg

SEQ ID NO: 6585381 - DNA, 20 bp, Homo sapiens
aatatgcatcccacagccag

SEQ ID NO: 6585382 - DNA, 20 bp, Homo sapiens
aatatgcatctaataaaaaa

SEQ ID NO: 6585383 - DNA, 14 bp, Homo sapiens
aatatgcatgtact

SEQ ID NO: 6585384 - DNA, 15 bp, Homo sapiens
aatatgcatgtactt

SEQ ID NO: 6585385 - DNA, 19 bp, Homo sapiens
aatatgccatctatgcaga

SEQ ID NO: 6585386 - DNA, 24 bp, Homo sapiens
aatatgccccattcaacatctagt

SEQ ID NO: 6585387 - DNA, 16 bp, Homo sapiens
aatatgccttaattta

SEQ ID NO: 6585388 - DNA, 18 bp, Homo sapiens
aatatgccttaatttaga

SEQ ID NO: 6585389 - DNA, 23 bp, Homo sapiens
aatatgccttaatttagaaactg

SEQ ID NO: 6585390 - DNA, 14 bp, Homo sapiens
aatatgctaaatgt

SEQ ID NO: 6585391 - DNA, 16 bp, Homo sapiens
aatatgctaaatgtta

SEQ ID NO: 6585392 - DNA, 16 bp, Homo sapiens
aatatgctaattctca

SEQ ID NO: 6585393 - DNA, 17 bp, Homo sapiens
aatatgctgcaacaaaa

SEQ ID NO: 6585394 - DNA, 14 bp, Homo sapiens
aatatgctggctgg

SEQ ID NO: 6585395 - DNA, 21 bp, Homo sapiens
aatatgctgttatgtccagaa

SEQ ID NO: 6585396 - DNA, 10 bp, Homo sapiens
aatatgctta

SEQ ID NO: 6585397 - DNA, 18 bp, Homo sapiens
aatatgcttctgcctatt

SEQ ID NO: 6585398 - DNA, 23 bp, Homo sapiens
aatatgctttcatcttctgttgc

SEQ ID NO: 6585399 - DNA, 15 bp, Homo sapiens
aatatggaacatatg

SEQ ID NO: 6585400 - DNA, 18 bp, Homo sapiens
aatatggaacatatgcac

SEQ ID NO: 6585401 - DNA, 17 bp, Homo sapiens
aatatggaacttctaat

SEQ ID NO: 6585402 - DNA, 15 bp, Homo sapiens
aatatggacaaagaa

SEQ ID NO: 6585403 - DNA, 14 bp, Homo sapiens
aatatggacaagag

SEQ ID NO: 6585404 - DNA, 15 bp, Homo sapiens
aatatggacatgtaa

SEQ ID NO: 6585405 - DNA, 21 bp, Homo sapiens
aatatggactcagccttgcaa

SEQ ID NO: 6585406 - DNA, 17 bp, Homo sapiens
aatatggacttaaatgt

SEQ ID NO: 6585407 - DNA, 21 bp, Homo sapiens
aatatggacttaaatgttaat

SEQ ID NO: 6585408 - DNA, 19 bp, Homo sapiens
aatatggatcagagcattt

SEQ ID NO: 6585409 - DNA, 22 bp, Homo sapiens
aatatggatcagagcatttatt

SEQ ID NO: 6585410 - DNA, 22 bp, Homo sapiens
aatatggcttcaccaagaagca

SEQ ID NO: 6585411 - DNA, 23 bp, Homo sapiens
aatatggcttcaccaagaagcaa

SEQ ID NO: 6585412 - DNA, 17 bp, Homo sapiens
aatatgggaatgtctaa

SEQ ID NO: 6585413 - DNA, 21 bp, Homo sapiens
aatatgggggccttttgggaa

SEQ ID NO: 6585414 - DNA, 18 bp, Homo sapiens
aatatggtcttttggtta

SEQ ID NO: 6585415 - DNA, 16 bp, Homo sapiens
aatatggtgaggtcac

SEQ ID NO: 6585416 - DNA, 15 bp, Homo sapiens
aatatggtggaaaat

SEQ ID NO: 6585417 - DNA, 19 bp, Homo sapiens
aatatggtggccctgggga

SEQ ID NO: 6585418 - DNA, 15 bp, Homo sapiens
aatatggttacattt

SEQ ID NO: 6585419 - DNA, 19 bp, Homo sapiens
aatatggttggagagccct

SEQ ID NO: 6585420 - DNA, 18 bp, Homo sapiens
aatatggttttgttttca

SEQ ID NO: 6585421 - DNA, 12 bp, Homo sapiens
aatatgtaaact

SEQ ID NO: 6585422 - DNA, 14 bp, Homo sapiens
aatatgtaaacttt

SEQ ID NO: 6585423 - DNA, 15 bp, Homo sapiens
aatatgtaatataaa

SEQ ID NO: 6585424 - DNA, 18 bp, Homo sapiens
aatatgtaatataaattt

SEQ ID NO: 6585425 - DNA, 23 bp, Homo sapiens
aatatgtaatttcaaaatacatt

SEQ ID NO: 6585426 - DNA, 12 bp, Homo sapiens
aatatgtacaca

SEQ ID NO: 6585427 - DNA, 14 bp, Homo sapiens
aatatgtacatttc

SEQ ID NO: 6585428 - DNA, 18 bp, Homo sapiens
aatatgtacatttctaag

SEQ ID NO: 6585429 - DNA, 19 bp, Homo sapiens
aatatgtaccaagaatctt

SEQ ID NO: 6585430 - DNA, 13 bp, Homo sapiens
aatatgtactttt

SEQ ID NO: 6585431 - DNA, 16 bp, Homo sapiens
aatatgtacttttcca

SEQ ID NO: 6585432 - DNA, 16 bp, Homo sapiens
aatatgtagtatctat

SEQ ID NO: 6585433 - DNA, 17 bp, Homo sapiens
aatatgtatatatgtat

SEQ ID NO: 6585434 - DNA, 17 bp, Homo sapiens
aatatgtatatgacatt

SEQ ID NO: 6585435 - DNA, 13 bp, Homo sapiens
aatatgtatgcac

SEQ ID NO: 6585436 - DNA, 22 bp, Homo sapiens
aatatgtatgcctgcaatatgg

SEQ ID NO: 6585437 - DNA, 14 bp, Homo sapiens
aatatgtattgtaa

SEQ ID NO: 6585438 - DNA, 20 bp, Homo sapiens
aatatgtattgtaaacatgt

SEQ ID NO: 6585439 - DNA, 13 bp, Homo sapiens
aatatgtatttta

SEQ ID NO: 6585440 - DNA, 20 bp, Homo sapiens
aatatgtattttatgtatgt

SEQ ID NO: 6585441 - DNA, 17 bp, Homo sapiens
aatatgtccatatctaa

SEQ ID NO: 6585442 - DNA, 11 bp, Homo sapiens
aatatgtctgc

SEQ ID NO: 6585443 - DNA, 17 bp, Homo sapiens
aatatgtctgccacaga

SEQ ID NO: 6585444 - DNA, 17 bp, Homo sapiens
aatatgtgaaaatgatt

SEQ ID NO: 6585445 - DNA, 20 bp, Homo sapiens
aatatgtgaagcccagcatc

SEQ ID NO: 6585446 - DNA, 19 bp, Homo sapiens
aatatgtgacattcctgat

SEQ ID NO: 6585447 - DNA, 14 bp, Homo sapiens
aatatgtgagattt

SEQ ID NO: 6585448 - DNA, 18 bp, Homo sapiens
aatatgtgagatttttta

SEQ ID NO: 6585449 - DNA, 12 bp, Homo sapiens
aatatgtgattt

SEQ ID NO: 6585450 - DNA, 16 bp, Homo sapiens
aatatgtgccttaagt

SEQ ID NO: 6585451 - DNA, 23 bp, Homo sapiens
aatatgtgccttaagttttagtc

SEQ ID NO: 6585452 - DNA, 15 bp, Homo sapiens
aatatgtgtaacttt

SEQ ID NO: 6585453 - DNA, 19 bp, Homo sapiens
aatatgtgttttttaatat

SEQ ID NO: 6585454 - DNA, 18 bp, Homo sapiens
ttgtatctttaaagactt

SEQ ID NO: 6585455 - DNA, 21 bp, Homo sapiens
ttgtatctttttgaaaatgtt

SEQ ID NO: 6585456 - DNA, 15 bp, Homo sapiens
ttgtatgacttctgc

SEQ ID NO: 6585457 - DNA, 16 bp, Homo sapiens
ttgtatgatgtgttgt

SEQ ID NO: 6585458 - DNA, 18 bp, Homo sapiens
ttgtatgatgtgttgtga

SEQ ID NO: 6585459 - DNA, 21 bp, Homo sapiens
ttgtatgatgtgttgtgatag

SEQ ID NO: 6585460 - DNA, 13 bp, Homo sapiens
ttgtatgattcca

SEQ ID NO: 6585461 - DNA, 15 bp, Homo sapiens
ttgtatgcaaatgag

SEQ ID NO: 6585462 - DNA, 20 bp, Homo sapiens
ttgtatgcaagcagtttcaa

SEQ ID NO: 6585463 - DNA, 22 bp, Homo sapiens
ttgtatgcaagcagtttcaata

SEQ ID NO: 6585464 - DNA, 13 bp, Homo sapiens
ttgtatgcaggga

SEQ ID NO: 6585465 - DNA, 22 bp, Homo sapiens
ttgtatgccaatcttaaagaca

SEQ ID NO: 6585466 - DNA, 12 bp, Homo sapiens
ttgtatgccttt

SEQ ID NO: 6585467 - DNA, 18 bp, Homo sapiens
ttgtatgctaaatgagga

SEQ ID NO: 6585468 - DNA, 15 bp, Homo sapiens
ttgtatggctctcaa

SEQ ID NO: 6585469 - DNA, 19 bp, Homo sapiens
ttgtatggctctcaagtga

SEQ ID NO: 6585470 - DNA, 13 bp, Homo sapiens
ttgtatgtaaata

SEQ ID NO: 6585471 - DNA, 18 bp, Homo sapiens
ttgtatgtaaatgtgcat

SEQ ID NO: 6585472 - DNA, 13 bp, Homo sapiens
ttgtatgtacctg

SEQ ID NO: 6585473 - DNA, 15 bp, Homo sapiens
ttgtatgtcactatt

SEQ ID NO: 6585474 - DNA, 12 bp, Homo sapiens
ttgtatgtctgt

SEQ ID NO: 6585475 - DNA, 19 bp, Homo sapiens
ttgtatgttaagttacttc

SEQ ID NO: 6585476 - DNA, 15 bp, Homo sapiens
ttgtatgtttgctga

SEQ ID NO: 6585477 - DNA, 18 bp, Homo sapiens
ttgtatgtttttctgtat

SEQ ID NO: 6585478 - DNA, 13 bp, Homo sapiens
ttgtattaaactc

SEQ ID NO: 6585479 - DNA, 16 bp, Homo sapiens
ttgtattaaacttgaa

SEQ ID NO: 6585480 - DNA, 14 bp, Homo sapiens
ttgtattaaagaca

SEQ ID NO: 6585481 - DNA, 12 bp, Homo sapiens
ttgtattaagaa

SEQ ID NO: 6585482 - DNA, 15 bp, Homo sapiens
ttgtattaataaagc

SEQ ID NO: 6585483 - DNA, 17 bp, Homo sapiens
ttgtattaataaagcat

SEQ ID NO: 6585484 - DNA, 14 bp, Homo sapiens
ttgtattacaaatc

SEQ ID NO: 6585485 - DNA, 14 bp, Homo sapiens
ttgtattacagatg

SEQ ID NO: 6585486 - DNA, 15 bp, Homo sapiens
ttgtattactttctc

SEQ ID NO: 6585487 - DNA, 18 bp, Homo sapiens
ttgtattactttctctgt

SEQ ID NO: 6585488 - DNA, 24 bp, Homo sapiens
ttgtattactttctctgtagttcc

SEQ ID NO: 6585489 - DNA, 13 bp, Homo sapiens
ttgtattagatgt

SEQ ID NO: 6585490 - DNA, 20 bp, Homo sapiens
ttgtattagtaataaaacat

SEQ ID NO: 6585491 - DNA, 22 bp, Homo sapiens
ttgtattagtaataaaacatta

SEQ ID NO: 6585492 - DNA, 15 bp, Homo sapiens
ttgtattataattgt

SEQ ID NO: 6585493 - DNA, 21 bp, Homo sapiens
ttgtattatagtactgcttta

SEQ ID NO: 6585494 - DNA, 16 bp, Homo sapiens
ttgtattatcagtgaa

SEQ ID NO: 6585495 - DNA, 14 bp, Homo sapiens
ttgtattattgctg

SEQ ID NO: 6585496 - DNA, 19 bp, Homo sapiens
ttgtattattgctgttgct

SEQ ID NO: 6585497 - DNA, 22 bp, Homo sapiens
ttgtattattgctgttgcttga

SEQ ID NO: 6585498 - DNA, 22 bp, Homo sapiens
ttgtattcaaaaattatctata

SEQ ID NO: 6585499 - DNA, 12 bp, Homo sapiens
ttgtattcagat

SEQ ID NO: 6585500 - DNA, 23 bp, Homo sapiens
ttgtattcccttttatttccaaa

SEQ ID NO: 6585501 - DNA, 15 bp, Homo sapiens
ttgtattcctgcctt

SEQ ID NO: 6585502 - DNA, 20 bp, Homo sapiens
ttgtattcctgcctttgatg

SEQ ID NO: 6585503 - DNA, 16 bp, Homo sapiens
ttgtattctctcctgt

SEQ ID NO: 6585504 - DNA, 19 bp, Homo sapiens
ttgtattctctcctgtacc

SEQ ID NO: 6585505 - DNA, 16 bp, Homo sapiens
ttgtattctctgagct

SEQ ID NO: 6585506 - DNA, 21 bp, Homo sapiens
ttgtattctctgtccagggct

SEQ ID NO: 6585507 - DNA, 17 bp, Homo sapiens
ttgtattcttcatgaaa

SEQ ID NO: 6585508 - DNA, 12 bp, Homo sapiens
ttgtattcttct

SEQ ID NO: 6585509 - DNA, 18 bp, Homo sapiens
ttgtattcttctgtattt

SEQ ID NO: 6585510 - DNA, 18 bp, Homo sapiens
ttgtattctttgatgtta

SEQ ID NO: 6585511 - DNA, 19 bp, Homo sapiens
ttgtattctttgatgttaa

SEQ ID NO: 6585512 - DNA, 23 bp, Homo sapiens
ttgtattgatttttaagaaagta

SEQ ID NO: 6585513 - DNA, 13 bp, Homo sapiens
ttgtattggaagt

SEQ ID NO: 6585514 - DNA, 12 bp, Homo sapiens
ttgtattgtaaa

SEQ ID NO: 6585515 - DNA, 16 bp, Homo sapiens
ttgtattgtcctatta

SEQ ID NO: 6585516 - DNA, 23 bp, Homo sapiens
ttgtattgttaatgcatcatcat

SEQ ID NO: 6585517 - DNA, 18 bp, Homo sapiens
ttgtattgttgaaaaagt

SEQ ID NO: 6585518 - DNA, 13 bp, Homo sapiens
ttgtattgttttc

SEQ ID NO: 6585519 - DNA, 17 bp, Homo sapiens
ttgtatttaaaggtaca

SEQ ID NO: 6585520 - DNA, 22 bp, Homo sapiens
ttgtatttattaatttgaaacc

SEQ ID NO: 6585521 - DNA, 16 bp, Homo sapiens
ttgtatttatttccag

SEQ ID NO: 6585522 - DNA, 15 bp, Homo sapiens
ttgtatttcaaatat

SEQ ID NO: 6585523 - DNA, 15 bp, Homo sapiens
ttgtatttctcttgt

SEQ ID NO: 6585524 - DNA, 16 bp, Homo sapiens
ttgtatttctcttgtc

SEQ ID NO: 6585525 - DNA, 13 bp, Homo sapiens
ttgtatttctttt

SEQ ID NO: 6585526 - DNA, 21 bp, Homo sapiens
ttgtatttcttttatatataa

SEQ ID NO: 6585527 - DNA, 13 bp, Homo sapiens
ttgtatttgtgta

SEQ ID NO: 6585528 - DNA, 14 bp, Homo sapiens
ttgtattttaaatg

SEQ ID NO: 6585529 - DNA, 17 bp, Homo sapiens
ttgtattttcatgaaaa

SEQ ID NO: 6585530 - DNA, 22 bp, Homo sapiens
ttgtattttcttcccatttgta

SEQ ID NO: 6585531 - DNA, 23 bp, Homo sapiens
ttgtattttcttcccatttgtaa

SEQ ID NO: 6585532 - DNA, 14 bp, Homo sapiens
ttgtattttgcata

SEQ ID NO: 6585533 - DNA, 23 bp, Homo sapiens
ttgtattttgtgtgaccaactgt

SEQ ID NO: 6585534 - DNA, 15 bp, Homo sapiens
ttgtattttgttaaa

SEQ ID NO: 6585535 - DNA, 13 bp, Homo sapiens
ttgtatttttgaa

SEQ ID NO: 6585536 - DNA, 18 bp, Homo sapiens
ttgtatttttgaataaaa

SEQ ID NO: 6585537 - DNA, 17 bp, Homo sapiens
ttgtattttttaaaaca

SEQ ID NO: 6585538 - DNA, 16 bp, Homo sapiens
ttgtattttttcctta

SEQ ID NO: 6585539 - DNA, 21 bp, Homo sapiens
ttgtcaaaactccactcagca

SEQ ID NO: 6585540 - DNA, 22 bp, Homo sapiens
ttgtcaaaactccactcagcac

SEQ ID NO: 6585541 - DNA, 23 bp, Homo sapiens
ttgtcaaaataaagattctcaca

SEQ ID NO: 6585542 - DNA, 14 bp, Homo sapiens
ttgtcaaagaagct

SEQ ID NO: 6585543 - DNA, 20 bp, Homo sapiens
ttgtcaaagaagcttccaca

SEQ ID NO: 6585544 - DNA, 18 bp, Homo sapiens
ttgtcaacactatataaa

SEQ ID NO: 6585545 - DNA, 16 bp, Homo sapiens
ttgtcaacttcagttg

SEQ ID NO: 6585546 - DNA, 14 bp, Homo sapiens
ttgtcaatactgag

SEQ ID NO: 6585547 - DNA, 16 bp, Homo sapiens
ttgtcaatactgagcc

SEQ ID NO: 6585548 - DNA, 22 bp, Homo sapiens
ttgtcaatgcagttgtctctgt

SEQ ID NO: 6585549 - DNA, 18 bp, Homo sapiens
ttgtcaatgctggagaaa

SEQ ID NO: 6585550 - DNA, 18 bp, Homo sapiens
ttgtcaatggaagaaacc

SEQ ID NO: 6585551 - DNA, 16 bp, Homo sapiens
ttgtcacaaactgtgg

SEQ ID NO: 6585552 - DNA, 17 bp, Homo sapiens
ttgtcacaaactgtggt

SEQ ID NO: 6585553 - DNA, 13 bp, Homo sapiens
ttgtcacaataaa

SEQ ID NO: 6585554 - DNA, 23 bp, Homo sapiens
ttgtcacaatcctaacacattat

SEQ ID NO: 6585555 - DNA, 17 bp, Homo sapiens
ttgtcacacactttggc

SEQ ID NO: 6585556 - DNA, 17 bp, Homo sapiens
ttgtcacagaaatcaga

SEQ ID NO: 6585557 - DNA, 20 bp, Homo sapiens
ttgtcacagaaatcagagga

SEQ ID NO: 6585558 - DNA, 22 bp, Homo sapiens
ttgtcacagaatctccatttct

SEQ ID NO: 6585559 - DNA, 19 bp, Homo sapiens
ttgtcacagtctctactgt

SEQ ID NO: 6585560 - DNA, 16 bp, Homo sapiens
ttgtcacatcaagcat

SEQ ID NO: 6585561 - DNA, 22 bp, Homo sapiens
ttgtcacatgaaacatttgcaa

SEQ ID NO: 6585562 - DNA, 16 bp, Homo sapiens
ttgtcacattatttat

SEQ ID NO: 6585563 - DNA, 16 bp, Homo sapiens
ttgtcaccagcaacat

SEQ ID NO: 6585564 - DNA, 19 bp, Homo sapiens
ttgtcacccaaagcctgtc

SEQ ID NO: 6585565 - DNA, 19 bp, Homo sapiens
ttgtcacccaggctggagt

SEQ ID NO: 6585566 - DNA, 15 bp, Homo sapiens
ttgtcaccccagttc

SEQ ID NO: 6585567 - DNA, 19 bp, Homo sapiens
ttgtcacctagcagatatg

SEQ ID NO: 6585568 - DNA, 16 bp, Homo sapiens
ttgtcacctctctctg

SEQ ID NO: 6585569 - DNA, 19 bp, Homo sapiens
ttgtcacctgcttctctgc

SEQ ID NO: 6585570 - DNA, 18 bp, Homo sapiens
ttgtcacgatcacaggcc

SEQ ID NO: 6585571 - DNA, 14 bp, Homo sapiens
ttgtcactctacaa

SEQ ID NO: 6585572 - DNA, 14 bp, Homo sapiens
ttgtcactgaagat

SEQ ID NO: 6585573 - DNA, 17 bp, Homo sapiens
ttgtcactgcttttggc

SEQ ID NO: 6585574 - DNA, 18 bp, Homo sapiens
ttgtcactgtcttcacaa

SEQ ID NO: 6585575 - DNA, 14 bp, Homo sapiens
ttgtcacttatttc

SEQ ID NO: 6585576 - DNA, 14 bp, Homo sapiens
ttgtcacttctgct

SEQ ID NO: 6585577 - DNA, 13 bp, Homo sapiens
ttgtcacttgcca

SEQ ID NO: 6585578 - DNA, 22 bp, Homo sapiens
ttgtcagaatggaatccatctg

SEQ ID NO: 6585579 - DNA, 15 bp, Homo sapiens
ttgtcagacataaag

SEQ ID NO: 6585580 - DNA, 18 bp, Homo sapiens
ttgtcagacataaagcca

SEQ ID NO: 6585581 - DNA, 16 bp, Homo sapiens
ttgtcagaccataaga

SEQ ID NO: 6585582 - DNA, 13 bp, Homo sapiens
ttgtcagagctgg

SEQ ID NO: 6585583 - DNA, 18 bp, Homo sapiens
ttgtcagatatgatatgt

SEQ ID NO: 6585584 - DNA, 17 bp, Homo sapiens
ttgtcagatcgttcatt

SEQ ID NO: 6585585 - DNA, 17 bp, Homo sapiens
ttgtcagcaggcaggct

SEQ ID NO: 6585586 - DNA, 21 bp, Homo sapiens
ttgtcagcaggcaggctgggg

SEQ ID NO: 6585587 - DNA, 12 bp, Homo sapiens
ttgtcagcatct

SEQ ID NO: 6585588 - DNA, 14 bp, Homo sapiens
ttgtcagcatctga

SEQ ID NO: 6585589 - DNA, 16 bp, Homo sapiens
ttgtcagcatctgacc

SEQ ID NO: 6585590 - DNA, 19 bp, Homo sapiens
ttgtcagcatctgaccatc

SEQ ID NO: 6585591 - DNA, 18 bp, Homo sapiens
ttgtcagccatcgtcctg

SEQ ID NO: 6585592 - DNA, 21 bp, Homo sapiens
ttgtcagggatttagcccatg

SEQ ID NO: 6585593 - DNA, 16 bp, Homo sapiens
ttgtcagggtctcctt

SEQ ID NO: 6585594 - DNA, 15 bp, Homo sapiens
ttgtcaggtgggaga

SEQ ID NO: 6585595 - DNA, 14 bp, Homo sapiens
ttgtcagtattttt

SEQ ID NO: 6585596 - DNA, 15 bp, Homo sapiens
ttgtcagtgacagta

SEQ ID NO: 6585597 - DNA, 19 bp, Homo sapiens
ttgtcagtgtgtcagtttt

SEQ ID NO: 6585598 - DNA, 14 bp, Homo sapiens
ttgtcagttgtgaa

SEQ ID NO: 6585599 - DNA, 23 bp, Homo sapiens
ttgtcagttttgttcacttgtta

SEQ ID NO: 6585600 - DNA, 14 bp, Homo sapiens
ttgtcataaaatgc

SEQ ID NO: 6585601 - DNA, 15 bp, Homo sapiens
ttgtcataaaatgca

SEQ ID NO: 6585602 - DNA, 15 bp, Homo sapiens
ttgtcataaaatgct

SEQ ID NO: 6585603 - DNA, 13 bp, Homo sapiens
ttgtcataacatt

SEQ ID NO: 6585604 - DNA, 16 bp, Homo sapiens
ttgtcatataaacctg

SEQ ID NO: 6585605 - DNA, 15 bp, Homo sapiens
ttgtcatatattcat

SEQ ID NO: 6585606 - DNA, 13 bp, Homo sapiens
ttgtcatatgtag

SEQ ID NO: 6585607 - DNA, 21 bp, Homo sapiens
ttgtcatatgtagccttcaca

SEQ ID NO: 6585608 - DNA, 13 bp, Homo sapiens
ttgtcatatgtgt

SEQ ID NO: 6585609 - DNA, 19 bp, Homo sapiens
ttgtcatcagccaaaacgt

SEQ ID NO: 6585610 - DNA, 23 bp, Homo sapiens
ttgtcatcattgtatatatgtgt

SEQ ID NO: 6585611 - DNA, 23 bp, Homo sapiens
ttgtcatccctgatgaatgtaaa

SEQ ID NO: 6585612 - DNA, 17 bp, Homo sapiens
ttgtcatcgttccccac

SEQ ID NO: 6585613 - DNA, 18 bp, Homo sapiens
ttgtcatctttttctaga

SEQ ID NO: 6585614 - DNA, 21 bp, Homo sapiens
ttgtcatgactttcagattgt

SEQ ID NO: 6585615 - DNA, 13 bp, Homo sapiens
ttgtcatggtgaa

SEQ ID NO: 6585616 - DNA, 14 bp, Homo sapiens
ttgtcatggtgaaa

SEQ ID NO: 6585617 - DNA, 12 bp, Homo sapiens
ttgtcatggtta

SEQ ID NO: 6585618 - DNA, 16 bp, Homo sapiens
ttgtcatgtttattct

SEQ ID NO: 6585619 - DNA, 18 bp, Homo sapiens
ttgtcattagcctgagta

SEQ ID NO: 6585620 - DNA, 14 bp, Homo sapiens
ttgtcattatgatt

SEQ ID NO: 6585621 - DNA, 13 bp, Homo sapiens
ttgtcattatgta

SEQ ID NO: 6585622 - DNA, 21 bp, Homo sapiens
ttgtcattcaagcctgtgaat

SEQ ID NO: 6585623 - DNA, 15 bp, Homo sapiens
ttgtcattcagttct

SEQ ID NO: 6585624 - DNA, 15 bp, Homo sapiens
ttgtcattctgctaa

SEQ ID NO: 6585625 - DNA, 17 bp, Homo sapiens
ttgtcattgactcttgc

SEQ ID NO: 6585626 - DNA, 15 bp, Homo sapiens
ttgtcattgctgttg

SEQ ID NO: 6585627 - DNA, 22 bp, Homo sapiens
ttgtcattgtaaacaaactctt

SEQ ID NO: 6585628 - DNA, 20 bp, Homo sapiens
ttgtcattgtccagctggga

SEQ ID NO: 6585629 - DNA, 14 bp, Homo sapiens
ttgtcatttccaaa

SEQ ID NO: 6585630 - DNA, 22 bp, Homo sapiens
ttgtcatttcctttgttgtcta

SEQ ID NO: 6585631 - DNA, 19 bp, Homo sapiens
ttgtcattttaaaatctga

SEQ ID NO: 6585632 - DNA, 12 bp, Homo sapiens
ttgtcattttct

SEQ ID NO: 6585633 - DNA, 15 bp, Homo sapiens
ttgtcattttgaagc

SEQ ID NO: 6585634 - DNA, 16 bp, Homo sapiens
ttgtcattttgaagct

SEQ ID NO: 6585635 - DNA, 19 bp, Homo sapiens
ttgtcattttgaagctaat

SEQ ID NO: 6585636 - DNA, 21 bp, Homo sapiens
ttgtcattttgaagctaatta

SEQ ID NO: 6585637 - DNA, 16 bp, Homo sapiens
ttgtcatttttaatat

SEQ ID NO: 6585638 - DNA, 13 bp, Homo sapiens
ttgtccaaacagg

SEQ ID NO: 6585639 - DNA, 21 bp, Homo sapiens
ttgtccaaacaggtgctggcc

SEQ ID NO: 6585640 - DNA, 23 bp, Homo sapiens
ttgtccaaacaggtgctggccca

SEQ ID NO: 6585641 - DNA, 22 bp, Homo sapiens
ttgtccaaagctgaaaatgtgt

SEQ ID NO: 6585642 - DNA, 21 bp, Homo sapiens
ttgtccaaagttacctggaat

SEQ ID NO: 6585643 - DNA, 16 bp, Homo sapiens
ttgtccaaataaattc

SEQ ID NO: 6585644 - DNA, 20 bp, Homo sapiens
ttgtccaacaactccaggaa

SEQ ID NO: 6585645 - DNA, 17 bp, Homo sapiens
ttgtccaagttcacagt

SEQ ID NO: 6585646 - DNA, 17 bp, Homo sapiens
ttgtccaagttgtttca

SEQ ID NO: 6585647 - DNA, 19 bp, Homo sapiens
ttgtccaatggctgtaaac

SEQ ID NO: 6585648 - DNA, 20 bp, Homo sapiens
ttgtccaatgtacaggaagt

SEQ ID NO: 6585649 - DNA, 19 bp, Homo sapiens
ttgtccaattgtgtagacg

SEQ ID NO: 6585650 - DNA, 19 bp, Homo sapiens
ttgtccaattgttgacagt

SEQ ID NO: 6585651 - DNA, 19 bp, Homo sapiens
ttgtccacaaatcttcagt

SEQ ID NO: 6585652 - DNA, 15 bp, Homo sapiens
ttgtccacaaatgtc

SEQ ID NO: 6585653 - DNA, 21 bp, Homo sapiens
ttgtccacaaatgtcctcaga

SEQ ID NO: 6585654 - DNA, 22 bp, Homo sapiens
ttgtccacaaatgtcctcagag

SEQ ID NO: 6585655 - DNA, 23 bp, Homo sapiens
ttgtccacaaatgtcctcagagg

SEQ ID NO: 6585656 - DNA, 17 bp, Homo sapiens
ttgtccacagcaaaggg

SEQ ID NO: 6585657 - DNA, 14 bp, Homo sapiens
ttgtccacattcta

SEQ ID NO: 6585658 - DNA, 22 bp, Homo sapiens
ttgtccaccatgctctctcacc

SEQ ID NO: 6585659 - DNA, 13 bp, Homo sapiens
ttgtccagagata

SEQ ID NO: 6585660 - DNA, 18 bp, Homo sapiens
ttgtccagagataaaaat

SEQ ID NO: 6585661 - DNA, 21 bp, Homo sapiens
ttgtccagagataaaaatcat

SEQ ID NO: 6585662 - DNA, 21 bp, Homo sapiens
ttgtccaggagaaacctcaca

SEQ ID NO: 6585663 - DNA, 19 bp, Homo sapiens
ttgtccaggtgagaacatc

SEQ ID NO: 6585664 - DNA, 22 bp, Homo sapiens
ttgtccatatcagacctctgat

SEQ ID NO: 6585665 - DNA, 16 bp, Homo sapiens
ttgtccatattttcac

SEQ ID NO: 6585666 - DNA, 19 bp, Homo sapiens
ttgtccatcttgtttcatt

SEQ ID NO: 6585667 - DNA, 13 bp, Homo sapiens
ttgtccatgccta

SEQ ID NO: 6585668 - DNA, 14 bp, Homo sapiens
ttgtccatgtcccc

SEQ ID NO: 6585669 - DNA, 17 bp, Homo sapiens
ttgtccattacttgcca

SEQ ID NO: 6585670 - DNA, 22 bp, Homo sapiens
ttgtccattcatctcatgctct

SEQ ID NO: 6585671 - DNA, 14 bp, Homo sapiens
ttgtccattgcgtt

SEQ ID NO: 6585672 - DNA, 21 bp, Homo sapiens
ttgtccattgcgttattttct

SEQ ID NO: 6585673 - DNA, 13 bp, Homo sapiens
ttgtccattgtcc

SEQ ID NO: 6585674 - DNA, 15 bp, Homo sapiens
ttgtccatttaaaaa

SEQ ID NO: 6585675 - DNA, 21 bp, Homo sapiens
ttgtcccaaatccgccagtgt

SEQ ID NO: 6585676 - DNA, 11 bp, Homo sapiens
ttgtcccaagt

SEQ ID NO: 6585677 - DNA, 20 bp, Homo sapiens
ttgtcccaagtctgacagcc

SEQ ID NO: 6585678 - DNA, 14 bp, Homo sapiens
ttgtcccacagctt

SEQ ID NO: 6585679 - DNA, 11 bp, Homo sapiens
ttgtcccagac

SEQ ID NO: 6585680 - DNA, 17 bp, Homo sapiens
ttgtcccagcctggggc

SEQ ID NO: 6585681 - DNA, 23 bp, Homo sapiens
ttgtcccagcctggggctccctc

SEQ ID NO: 6585682 - DNA, 18 bp, Homo sapiens
ttgtcccatctctacccc

SEQ ID NO: 6585683 - DNA, 21 bp, Homo sapiens
ttgtcccatttattattttaa

SEQ ID NO: 6585684 - DNA, 14 bp, Homo sapiens
ttgtcccatttcct

SEQ ID NO: 6585685 - DNA, 17 bp, Homo sapiens
ttgtcccatttccttgg

SEQ ID NO: 6585686 - DNA, 23 bp, Homo sapiens
ttgtcccatttctaaaggcctct

SEQ ID NO: 6585687 - DNA, 18 bp, Homo sapiens
ttgtccccaatgaatata

SEQ ID NO: 6585688 - DNA, 11 bp, Homo sapiens
ttgtccccaca

SEQ ID NO: 6585689 - DNA, 17 bp, Homo sapiens
ttgtccccacacagcct

SEQ ID NO: 6585690 - DNA, 20 bp, Homo sapiens
ttgtccccacacagcctcta

SEQ ID NO: 6585691 - DNA, 17 bp, Homo sapiens
ttgtccccacactccta

SEQ ID NO: 6585692 - DNA, 14 bp, Homo sapiens
ttgtccccagggcc

SEQ ID NO: 6585693 - DNA, 15 bp, Homo sapiens
ttgtccccgaccctt

SEQ ID NO: 6585694 - DNA, 15 bp, Homo sapiens
ttgtcccctcacctc

SEQ ID NO: 6585695 - DNA, 12 bp, Homo sapiens
ttgtccctgcag

SEQ ID NO: 6585696 - DNA, 12 bp, Homo sapiens
ttgtccctgggg

SEQ ID NO: 6585697 - DNA, 16 bp, Homo sapiens
ttgtccgctgggtggt

SEQ ID NO: 6585698 - DNA, 20 bp, Homo sapiens
ttgtccggtggaaggccttc

SEQ ID NO: 6585699 - DNA, 21 bp, Homo sapiens
ttgtccggtttactttaactt

SEQ ID NO: 6585700 - DNA, 21 bp, Homo sapiens
ttgtcctaagtgtcaagtcct

SEQ ID NO: 6585701 - DNA, 17 bp, Homo sapiens
ttgtcctacgtccaagg

SEQ ID NO: 6585702 - DNA, 15 bp, Homo sapiens
ttgtcctatgtcaat

SEQ ID NO: 6585703 - DNA, 16 bp, Homo sapiens
ttgtcctcaaggccca

SEQ ID NO: 6585704 - DNA, 15 bp, Homo sapiens
ttgtcctcatttctc

SEQ ID NO: 6585705 - DNA, 13 bp, Homo sapiens
ttgtcctcccagg

SEQ ID NO: 6585706 - DNA, 14 bp, Homo sapiens
ttgtcctcccagga

SEQ ID NO: 6585707 - DNA, 22 bp, Homo sapiens
ttgtcctcccaggaaccaaaaa

SEQ ID NO: 6585708 - DNA, 17 bp, Homo sapiens
ttgtcctcctgctgcca

SEQ ID NO: 6585709 - DNA, 16 bp, Homo sapiens
ttgtcctccttttcac

SEQ ID NO: 6585710 - DNA, 18 bp, Homo sapiens
ttgtcctctcagagcctc

SEQ ID NO: 6585711 - DNA, 16 bp, Homo sapiens
ttgtcctgaactgtga

SEQ ID NO: 6585712 - DNA, 21 bp, Homo sapiens
ttgtcctgaatggctttgtct

SEQ ID NO: 6585713 - DNA, 19 bp, Homo sapiens
ttgtcctgatgcttttgtc

SEQ ID NO: 6585714 - DNA, 9 bp, Homo sapiens
ttgtcctgc

SEQ ID NO: 6585715 - DNA, 16 bp, Homo sapiens
ttgtcctgccagctgc

SEQ ID NO: 6585716 - DNA, 17 bp, Homo sapiens
ttgtcctgccagctgcc

SEQ ID NO: 6585717 - DNA, 19 bp, Homo sapiens
ttgtcctgccagctgcctt

SEQ ID NO: 6585718 - DNA, 18 bp, Homo sapiens
ttgtcctggcccttcagt

SEQ ID NO: 6585719 - DNA, 13 bp, Homo sapiens
ttgtcctgtgtca

SEQ ID NO: 6585720 - DNA, 19 bp, Homo sapiens
ttgtcctgtgtctatgtac

SEQ ID NO: 6585721 - DNA, 14 bp, Homo sapiens
ttgtccttaaaatt

SEQ ID NO: 6585722 - DNA, 17 bp, Homo sapiens
ttgtccttcagagctct

SEQ ID NO: 6585723 - DNA, 16 bp, Homo sapiens
ttgtccttgaagcttg

SEQ ID NO: 6585724 - DNA, 17 bp, Homo sapiens
ttgtccttgccccactc

SEQ ID NO: 6585725 - DNA, 15 bp, Homo sapiens
ttgtcctttatgtat

SEQ ID NO: 6585726 - DNA, 16 bp, Homo sapiens
ttgtcctttatgtatt

SEQ ID NO: 6585727 - DNA, 15 bp, Homo sapiens
ttgtcctttcccttc

SEQ ID NO: 6585728 - DNA, 18 bp, Homo sapiens
ttgtcctttctgatcctc

SEQ ID NO: 6585729 - DNA, 22 bp, Homo sapiens
ttgtcctttgaggccccaactc

SEQ ID NO: 6585730 - DNA, 17 bp, Homo sapiens
ttgtccttttgtcttct

SEQ ID NO: 6585731 - DNA, 21 bp, Homo sapiens
ttgtcgcaaagacgtaataaa

SEQ ID NO: 6585732 - DNA, 16 bp, Homo sapiens
ttgtcgcgcgtctccc

SEQ ID NO: 6585733 - DNA, 14 bp, Homo sapiens
ttgtcggctccagt

SEQ ID NO: 6585734 - DNA, 15 bp, Homo sapiens
ttgtcgggacagaga

SEQ ID NO: 6585735 - DNA, 17 bp, Homo sapiens
ttgtcgtggttcttaaa

SEQ ID NO: 6585736 - DNA, 22 bp, Homo sapiens
ttgtcgttgactttagggactc

SEQ ID NO: 6585737 - DNA, 17 bp, Homo sapiens
ttgtctaaaacaataaa

SEQ ID NO: 6585738 - DNA, 18 bp, Homo sapiens
ttgtctaaaacaataaaa

SEQ ID NO: 6585739 - DNA, 22 bp, Homo sapiens
ttgtctaaaataggttttccct

SEQ ID NO: 6585740 - DNA, 15 bp, Homo sapiens
ttgtctaaacaaggt

SEQ ID NO: 6585741 - DNA, 14 bp, Homo sapiens
ttgtctaaagatct

SEQ ID NO: 6585742 - DNA, 19 bp, Homo sapiens
ttgtctaaccccaggtttt

SEQ ID NO: 6585743 - DNA, 19 bp, Homo sapiens
ttgtctaactcagaattat

SEQ ID NO: 6585744 - DNA, 19 bp, Homo sapiens
ttgtctaagaaattgaata

SEQ ID NO: 6585745 - DNA, 18 bp, Homo sapiens
ttgtctacacaccctgca

SEQ ID NO: 6585746 - DNA, 18 bp, Homo sapiens
ttgtctacattaaatcac

SEQ ID NO: 6585747 - DNA, 22 bp, Homo sapiens
ttgtctacgggggcacttggag

SEQ ID NO: 6585748 - DNA, 19 bp, Homo sapiens
ttgtctagagctcatcagt

SEQ ID NO: 6585749 - DNA, 20 bp, Homo sapiens
ttgtctagagctcatcagta

SEQ ID NO: 6585750 - DNA, 21 bp, Homo sapiens
ttgtctagaggtgagaccaaa

SEQ ID NO: 6585751 - DNA, 20 bp, Homo sapiens
ttgtctaggagatgctttct

SEQ ID NO: 6585752 - DNA, 19 bp, Homo sapiens
ttgtctagggtgttctgta

SEQ ID NO: 6585753 - DNA, 23 bp, Homo sapiens
ttgtctagggtgttctgtactta

SEQ ID NO: 6585754 - DNA, 19 bp, Homo sapiens
ttgtctagtcattgtcata

SEQ ID NO: 6585755 - DNA, 15 bp, Homo sapiens
ttgtctatgaagttg

SEQ ID NO: 6585756 - DNA, 14 bp, Homo sapiens
ttgtctatgggact

SEQ ID NO: 6585757 - DNA, 18 bp, Homo sapiens
ttgtctattctgagcctt

SEQ ID NO: 6585758 - DNA, 19 bp, Homo sapiens
ttgtctattctgagccttg

SEQ ID NO: 6585759 - DNA, 23 bp, Homo sapiens
ttgtctatttttctcttcatatt

SEQ ID NO: 6585760 - DNA, 20 bp, Homo sapiens
ttgtctcaaagcatcaaata

SEQ ID NO: 6585761 - DNA, 23 bp, Homo sapiens
ttgtctcaaagcatcaaataata

SEQ ID NO: 6585762 - DNA, 16 bp, Homo sapiens
ttgtctcaccagctca

SEQ ID NO: 6585763 - DNA, 15 bp, Homo sapiens
ttgtctcacgcagcc

SEQ ID NO: 6585764 - DNA, 12 bp, Homo sapiens
ttgtctcacttt

SEQ ID NO: 6585765 - DNA, 12 bp, Homo sapiens
ttgtctcagaag

SEQ ID NO: 6585766 - DNA, 13 bp, Homo sapiens
ttgtctcagagca

SEQ ID NO: 6585767 - DNA, 13 bp, Homo sapiens
ttgtctcagggcc

SEQ ID NO: 6585768 - DNA, 15 bp, Homo sapiens
ttgtctcatgccagt

SEQ ID NO: 6585769 - DNA, 21 bp, Homo sapiens
ttgtctcattttggtctgttt

SEQ ID NO: 6585770 - DNA, 18 bp, Homo sapiens
ttgtctccctggccctca

SEQ ID NO: 6585771 - DNA, 15 bp, Homo sapiens
ttgtctcctaaattg

SEQ ID NO: 6585772 - DNA, 18 bp, Homo sapiens
ttgtctcctactcctgac

SEQ ID NO: 6585773 - DNA, 18 bp, Homo sapiens
ttgtctcctataatacca

SEQ ID NO: 6585774 - DNA, 12 bp, Homo sapiens
ttgtctccttcc

SEQ ID NO: 6585775 - DNA, 18 bp, Homo sapiens
ttgtctcgtgtacagctc

SEQ ID NO: 6585776 - DNA, 11 bp, Homo sapiens
ttgtctctcat

SEQ ID NO: 6585777 - DNA, 20 bp, Homo sapiens
ttgtctctcattctctttct

SEQ ID NO: 6585778 - DNA, 15 bp, Homo sapiens
ttgtctctcttcaga

SEQ ID NO: 6585779 - DNA, 15 bp, Homo sapiens
ttgtctctgatgcag

SEQ ID NO: 6585780 - DNA, 14 bp, Homo sapiens
ttgtctctgcatct

SEQ ID NO: 6585781 - DNA, 13 bp, Homo sapiens
ttgtctctgggct

SEQ ID NO: 6585782 - DNA, 19 bp, Homo sapiens
ttgtctctgggctgaggaa

SEQ ID NO: 6585783 - DNA, 14 bp, Homo sapiens
ttgtctctgttggt

SEQ ID NO: 6585784 - DNA, 13 bp, Homo sapiens
ttgtctcttagaa

SEQ ID NO: 6585785 - DNA, 15 bp, Homo sapiens
ttgtctcttctcctt

SEQ ID NO: 6585786 - DNA, 17 bp, Homo sapiens
ttgtctcttgcctgcca

SEQ ID NO: 6585787 - DNA, 13 bp, Homo sapiens
ttgtctcttggtg

SEQ ID NO: 6585788 - DNA, 15 bp, Homo sapiens
ttgtctgaaacatag

SEQ ID NO: 6585789 - DNA, 15 bp, Homo sapiens
ttgtctgaaacattt

SEQ ID NO: 6585790 - DNA, 19 bp, Homo sapiens
ttgtctgaacccaggcagc

SEQ ID NO: 6585791 - DNA, 20 bp, Homo sapiens
ttgtctgaacccaggcagct

SEQ ID NO: 6585792 - DNA, 22 bp, Homo sapiens
ttgtctgaacccaggcagctgg

SEQ ID NO: 6585793 - DNA, 13 bp, Homo sapiens
ttgtctgaacttg

SEQ ID NO: 6585794 - DNA, 20 bp, Homo sapiens
ttgtctgaagtcactgcaca

SEQ ID NO: 6585795 - DNA, 17 bp, Homo sapiens
ttgtctgaatgtattta

SEQ ID NO: 6585796 - DNA, 22 bp, Homo sapiens
ttgtctgaattgagaaaagagt

SEQ ID NO: 6585797 - DNA, 14 bp, Homo sapiens
ttgtctgaggcctc

SEQ ID NO: 6585798 - DNA, 12 bp, Homo sapiens
ttgtctgcagct

SEQ ID NO: 6585799 - DNA, 17 bp, Homo sapiens
ttgtctgccccaagttt

SEQ ID NO: 6585800 - DNA, 18 bp, Homo sapiens
ttgtctgccccaagtttt

SEQ ID NO: 6585801 - DNA, 21 bp, Homo sapiens
ttgtctgccccaagttttgtg

SEQ ID NO: 6585802 - DNA, 16 bp, Homo sapiens
ttgtctgcgcctgaaa

SEQ ID NO: 6585803 - DNA, 18 bp, Homo sapiens
ttgtctgctagtagtgtt

SEQ ID NO: 6585804 - DNA, 15 bp, Homo sapiens
ttgtctgctgcctcc

SEQ ID NO: 6585805 - DNA, 16 bp, Homo sapiens
ttgtctgctgcctcca

SEQ ID NO: 6585806 - DNA, 18 bp, Homo sapiens
ttgtctggctttggcact

SEQ ID NO: 6585807 - DNA, 15 bp, Homo sapiens
ttgtctgtaaaaaat

SEQ ID NO: 6585808 - DNA, 13 bp, Homo sapiens
ttgtctgtaaatc

SEQ ID NO: 6585809 - DNA, 11 bp, Homo sapiens
ttgtctgtaca

SEQ ID NO: 6585810 - DNA, 13 bp, Homo sapiens
ttgtctgtacagt

SEQ ID NO: 6585811 - DNA, 13 bp, Homo sapiens
ttgtctgtacata

SEQ ID NO: 6585812 - DNA, 15 bp, Homo sapiens
ttgtctgtacatact

SEQ ID NO: 6585813 - DNA, 21 bp, Homo sapiens
ttgtctgtacatactggcctc

SEQ ID NO: 6585814 - DNA, 13 bp, Homo sapiens
aatatgttcatta

SEQ ID NO: 6585815 - DNA, 22 bp, Homo sapiens
aatatgttcattaaattttcta

SEQ ID NO: 6585816 - DNA, 19 bp, Homo sapiens
aatatgttctctgaatgag

SEQ ID NO: 6585817 - DNA, 11 bp, Homo sapiens
aatatgttgac

SEQ ID NO: 6585818 - DNA, 13 bp, Homo sapiens
aatatgttgactt

SEQ ID NO: 6585819 - DNA, 18 bp, Homo sapiens
aatatgttgagtgttcat

SEQ ID NO: 6585820 - DNA, 18 bp, Homo sapiens
aatatgttgctttgaaaa

SEQ ID NO: 6585821 - DNA, 13 bp, Homo sapiens
aatatgtttcaaa

SEQ ID NO: 6585822 - DNA, 15 bp, Homo sapiens
aatatgtttcaaact

SEQ ID NO: 6585823 - DNA, 16 bp, Homo sapiens
aatatgtttcaaactt

SEQ ID NO: 6585824 - DNA, 14 bp, Homo sapiens
aatatgtttccttg

SEQ ID NO: 6585825 - DNA, 18 bp, Homo sapiens
aatatgtttccttgttta

SEQ ID NO: 6585826 - DNA, 24 bp, Homo sapiens
aatatgtttgaggttaaaatataa

SEQ ID NO: 6585827 - DNA, 14 bp, Homo sapiens
aatatgtttgtgcc

SEQ ID NO: 6585828 - DNA, 22 bp, Homo sapiens
aatatgtttgtgccttaaaagg

SEQ ID NO: 6585829 - DNA, 13 bp, Homo sapiens
aatattaaaaaac

SEQ ID NO: 6585830 - DNA, 20 bp, Homo sapiens
aatattaaaaagtcttttaa

SEQ ID NO: 6585831 - DNA, 18 bp, Homo sapiens
aatattaaaaattaattc

SEQ ID NO: 6585832 - DNA, 23 bp, Homo sapiens
aatattaaaaattaattctttat

SEQ ID NO: 6585833 - DNA, 16 bp, Homo sapiens
aatattaaaattgtta

SEQ ID NO: 6585834 - DNA, 16 bp, Homo sapiens
aatattaaagccatgt

SEQ ID NO: 6585835 - DNA, 18 bp, Homo sapiens
aatattaaagccatgttt

SEQ ID NO: 6585836 - DNA, 22 bp, Homo sapiens
aatattaaagcctcatgtgtga

SEQ ID NO: 6585837 - DNA, 22 bp, Homo sapiens
aatattaaatacagacactaag

SEQ ID NO: 6585838 - DNA, 14 bp, Homo sapiens
aatattaaatatta

SEQ ID NO: 6585839 - DNA, 19 bp, Homo sapiens
aatattaacacgctgcctg

SEQ ID NO: 6585840 - DNA, 21 bp, Homo sapiens
aatattaacacgctgcctggt

SEQ ID NO: 6585841 - DNA, 20 bp, Homo sapiens
aatattaacatattatttca

SEQ ID NO: 6585842 - DNA, 13 bp, Homo sapiens
aatattaacattc

SEQ ID NO: 6585843 - DNA, 14 bp, Homo sapiens
aatattaagaaaat

SEQ ID NO: 6585844 - DNA, 15 bp, Homo sapiens
aatattaagaaaata

SEQ ID NO: 6585845 - DNA, 19 bp, Homo sapiens
aatattaagaaaatattct

SEQ ID NO: 6585846 - DNA, 19 bp, Homo sapiens
aatattaagaaacaattta

SEQ ID NO: 6585847 - DNA, 14 bp, Homo sapiens
aatattaagaacat

SEQ ID NO: 6585848 - DNA, 16 bp, Homo sapiens
aatattaagaacattt

SEQ ID NO: 6585849 - DNA, 22 bp, Homo sapiens
aatattaagaacattttataaa

SEQ ID NO: 6585850 - DNA, 14 bp, Homo sapiens
aatattaagacaat

SEQ ID NO: 6585851 - DNA, 16 bp, Homo sapiens
aatattaagagctatt

SEQ ID NO: 6585852 - DNA, 19 bp, Homo sapiens
aatattaagagctatttta

SEQ ID NO: 6585853 - DNA, 14 bp, Homo sapiens
aatattaagcacat

SEQ ID NO: 6585854 - DNA, 22 bp, Homo sapiens
aatattaagcatgacagaaaat

SEQ ID NO: 6585855 - DNA, 20 bp, Homo sapiens
aatattaatatgtacttttc

SEQ ID NO: 6585856 - DNA, 20 bp, Homo sapiens
aatattaattagtttatatt

SEQ ID NO: 6585857 - DNA, 12 bp, Homo sapiens
aatattaattta

SEQ ID NO: 6585858 - DNA, 20 bp, Homo sapiens
aatattaatttatatttgtc

SEQ ID NO: 6585859 - DNA, 17 bp, Homo sapiens
aatattacatgtaaagc

SEQ ID NO: 6585860 - DNA, 15 bp, Homo sapiens
aatattacatttcat

SEQ ID NO: 6585861 - DNA, 14 bp, Homo sapiens
aatattaccaaaaa

SEQ ID NO: 6585862 - DNA, 17 bp, Homo sapiens
aatattaccatcttaat

SEQ ID NO: 6585863 - DNA, 17 bp, Homo sapiens
aatattactcctatttt

SEQ ID NO: 6585864 - DNA, 18 bp, Homo sapiens
aatattactctagtttat

SEQ ID NO: 6585865 - DNA, 21 bp, Homo sapiens
aatattactctcaaaatcttt

SEQ ID NO: 6585866 - DNA, 22 bp, Homo sapiens
aatattactctgcctgtcaagt

SEQ ID NO: 6585867 - DNA, 19 bp, Homo sapiens
aatattactggataaattg

SEQ ID NO: 6585868 - DNA, 16 bp, Homo sapiens
aatattactgtcttta

SEQ ID NO: 6585869 - DNA, 20 bp, Homo sapiens
aatattactgtttatttctg

SEQ ID NO: 6585870 - DNA, 14 bp, Homo sapiens
aatattactttgtc

SEQ ID NO: 6585871 - DNA, 13 bp, Homo sapiens
aatattagaaaca

SEQ ID NO: 6585872 - DNA, 17 bp, Homo sapiens
aatattagatgctctga

SEQ ID NO: 6585873 - DNA, 13 bp, Homo sapiens
aatattagatgtg

SEQ ID NO: 6585874 - DNA, 15 bp, Homo sapiens
aatattagatgtgat

SEQ ID NO: 6585875 - DNA, 16 bp, Homo sapiens
aatattagatgtgatt

SEQ ID NO: 6585876 - DNA, 15 bp, Homo sapiens
aatattagcttgctt

SEQ ID NO: 6585877 - DNA, 16 bp, Homo sapiens
aatattagcttgctta

SEQ ID NO: 6585878 - DNA, 19 bp, Homo sapiens
aatattagctttactgttt

SEQ ID NO: 6585879 - DNA, 21 bp, Homo sapiens
aatattagctttactgtttgt

SEQ ID NO: 6585880 - DNA, 20 bp, Homo sapiens
aatattagttggctttcata

SEQ ID NO: 6585881 - DNA, 22 bp, Homo sapiens
aatattagtttttattaaactc

SEQ ID NO: 6585882 - DNA, 15 bp, Homo sapiens
aatattataaatcca

SEQ ID NO: 6585883 - DNA, 15 bp, Homo sapiens
aatattatactaaga

SEQ ID NO: 6585884 - DNA, 14 bp, Homo sapiens
aatattatacttct

SEQ ID NO: 6585885 - DNA, 21 bp, Homo sapiens
aatattatacttctttattca

SEQ ID NO: 6585886 - DNA, 22 bp, Homo sapiens
aatattatgagatgctggcttg

SEQ ID NO: 6585887 - DNA, 17 bp, Homo sapiens
aatattatgcaaattcc

SEQ ID NO: 6585888 - DNA, 19 bp, Homo sapiens
aatattatgcaaattccca

SEQ ID NO: 6585889 - DNA, 16 bp, Homo sapiens
aatattatgttaaaac

SEQ ID NO: 6585890 - DNA, 16 bp, Homo sapiens
aatattatgttatgaa

SEQ ID NO: 6585891 - DNA, 17 bp, Homo sapiens
aatattatgttatgaaa

SEQ ID NO: 6585892 - DNA, 18 bp, Homo sapiens
aatattattaaaatctta

SEQ ID NO: 6585893 - DNA, 15 bp, Homo sapiens
aatattatttgatat

SEQ ID NO: 6585894 - DNA, 18 bp, Homo sapiens
aatattatttgatatctg

SEQ ID NO: 6585895 - DNA, 19 bp, Homo sapiens
aatattatttgtgtttcct

SEQ ID NO: 6585896 - DNA, 13 bp, Homo sapiens
aatattcaaatgt

SEQ ID NO: 6585897 - DNA, 17 bp, Homo sapiens
aatattcaagtaacact

SEQ ID NO: 6585898 - DNA, 19 bp, Homo sapiens
aatattcaagtaacacttt

SEQ ID NO: 6585899 - DNA, 15 bp, Homo sapiens
aatattcactctcca

SEQ ID NO: 6585900 - DNA, 15 bp, Homo sapiens
aatattcagaaaaat

SEQ ID NO: 6585901 - DNA, 13 bp, Homo sapiens
aatattcagaaat

SEQ ID NO: 6585902 - DNA, 21 bp, Homo sapiens
aatattcagaatctttgttaa

SEQ ID NO: 6585903 - DNA, 20 bp, Homo sapiens
aatattcagacaaaatggat

SEQ ID NO: 6585904 - DNA, 22 bp, Homo sapiens
aatattcagccagcttaaaccc

SEQ ID NO: 6585905 - DNA, 16 bp, Homo sapiens
aatattcagtggtgaa

SEQ ID NO: 6585906 - DNA, 19 bp, Homo sapiens
aatattcatagtagaactt

SEQ ID NO: 6585907 - DNA, 18 bp, Homo sapiens
aatattcatattggaaaa

SEQ ID NO: 6585908 - DNA, 23 bp, Homo sapiens
aatattcatattggaaaaatcac

SEQ ID NO: 6585909 - DNA, 16 bp, Homo sapiens
aatattcatgctgcct

SEQ ID NO: 6585910 - DNA, 22 bp, Homo sapiens
aatattcatgctgcctgccatg

SEQ ID NO: 6585911 - DNA, 12 bp, Homo sapiens
aatattccaagc

SEQ ID NO: 6585912 - DNA, 12 bp, Homo sapiens
aatattccagag

SEQ ID NO: 6585913 - DNA, 13 bp, Homo sapiens
aatattcccaagc

SEQ ID NO: 6585914 - DNA, 15 bp, Homo sapiens
aatattccctagaaa

SEQ ID NO: 6585915 - DNA, 16 bp, Homo sapiens
aatattctatatgaat

SEQ ID NO: 6585916 - DNA, 20 bp, Homo sapiens
aatattctatatgaatttaa

SEQ ID NO: 6585917 - DNA, 23 bp, Homo sapiens
aatattctattttcattttctgc

SEQ ID NO: 6585918 - DNA, 17 bp, Homo sapiens
aatattctctgatgttt

SEQ ID NO: 6585919 - DNA, 17 bp, Homo sapiens
aatattctctgtacata

SEQ ID NO: 6585920 - DNA, 14 bp, Homo sapiens
aatattctgaatca

SEQ ID NO: 6585921 - DNA, 18 bp, Homo sapiens
aatattctgataatgtat

SEQ ID NO: 6585922 - DNA, 19 bp, Homo sapiens
aatattctgataatgtatt

SEQ ID NO: 6585923 - DNA, 10 bp, Homo sapiens
aatattctgg

SEQ ID NO: 6585924 - DNA, 12 bp, Homo sapiens
aatattctgttt

SEQ ID NO: 6585925 - DNA, 13 bp, Homo sapiens
aatattctgtttt

SEQ ID NO: 6585926 - DNA, 16 bp, Homo sapiens
aatattcttctttgat

SEQ ID NO: 6585927 - DNA, 17 bp, Homo sapiens
aatattcttctttgata

SEQ ID NO: 6585928 - DNA, 15 bp, Homo sapiens
aatattcttgtccac

SEQ ID NO: 6585929 - DNA, 19 bp, Homo sapiens
aatattctttcaataacga

SEQ ID NO: 6585930 - DNA, 17 bp, Homo sapiens
aatattctttctcataa

SEQ ID NO: 6585931 - DNA, 16 bp, Homo sapiens
aatattgaaaatgtca

SEQ ID NO: 6585932 - DNA, 16 bp, Homo sapiens
aatattgaaaattgaa

SEQ ID NO: 6585933 - DNA, 16 bp, Homo sapiens
aatattgaaatgctgt

SEQ ID NO: 6585934 - DNA, 17 bp, Homo sapiens
aatattgaagttgttta

SEQ ID NO: 6585935 - DNA, 15 bp, Homo sapiens
aatattgaataagta

SEQ ID NO: 6585936 - DNA, 18 bp, Homo sapiens
aatattgaatttttccta

SEQ ID NO: 6585937 - DNA, 20 bp, Homo sapiens
aatattgacaagtgtctttt

SEQ ID NO: 6585938 - DNA, 19 bp, Homo sapiens
aatattgactcaaaccata

SEQ ID NO: 6585939 - DNA, 17 bp, Homo sapiens
aatattgacttgtatat

SEQ ID NO: 6585940 - DNA, 13 bp, Homo sapiens
aatattgagaatc

SEQ ID NO: 6585941 - DNA, 14 bp, Homo sapiens
aatattgagaatca

SEQ ID NO: 6585942 - DNA, 21 bp, Homo sapiens
aatattgagaatcaggttgca

SEQ ID NO: 6585943 - DNA, 16 bp, Homo sapiens
aatattgaggctttgt

SEQ ID NO: 6585944 - DNA, 17 bp, Homo sapiens
aatattgaggctttgtg

SEQ ID NO: 6585945 - DNA, 17 bp, Homo sapiens
aatattgatatgcttat

SEQ ID NO: 6585946 - DNA, 18 bp, Homo sapiens
aatattgatatgcttata

SEQ ID NO: 6585947 - DNA, 16 bp, Homo sapiens
aatattgcaaaataca

SEQ ID NO: 6585948 - DNA, 23 bp, Homo sapiens
aatattgcaaaatacatgaagct

SEQ ID NO: 6585949 - DNA, 18 bp, Homo sapiens
aatattgcccaaataata

SEQ ID NO: 6585950 - DNA, 19 bp, Homo sapiens
aatattgcccaaataatat

SEQ ID NO: 6585951 - DNA, 17 bp, Homo sapiens
aatattgccttgatgtt

SEQ ID NO: 6585952 - DNA, 18 bp, Homo sapiens
aatattgccttgatgttt

SEQ ID NO: 6585953 - DNA, 13 bp, Homo sapiens
aatattgctaaaa

SEQ ID NO: 6585954 - DNA, 22 bp, Homo sapiens
aatattgctaaaagcatgtata

SEQ ID NO: 6585955 - DNA, 21 bp, Homo sapiens
aatattgctaaaagtgcattt

SEQ ID NO: 6585956 - DNA, 22 bp, Homo sapiens
aatattgctattgtttatagga

SEQ ID NO: 6585957 - DNA, 23 bp, Homo sapiens
aatattgctattgtttataggaa

SEQ ID NO: 6585958 - DNA, 15 bp, Homo sapiens
aatattgctctaatt

SEQ ID NO: 6585959 - DNA, 21 bp, Homo sapiens
aatattgctctaattcttttc

SEQ ID NO: 6585960 - DNA, 22 bp, Homo sapiens
aatattgctctatgttagtata

SEQ ID NO: 6585961 - DNA, 11 bp, Homo sapiens
aatattgctga

SEQ ID NO: 6585962 - DNA, 12 bp, Homo sapiens
aatattgctgat

SEQ ID NO: 6585963 - DNA, 15 bp, Homo sapiens
aatattgctgatggt

SEQ ID NO: 6585964 - DNA, 18 bp, Homo sapiens
aatattgctgatggtgca

SEQ ID NO: 6585965 - DNA, 23 bp, Homo sapiens
aatattgcttactggtgaggttg

SEQ ID NO: 6585966 - DNA, 18 bp, Homo sapiens
aatattgcttcaatttca

SEQ ID NO: 6585967 - DNA, 18 bp, Homo sapiens
aatattggtaattaaaag

SEQ ID NO: 6585968 - DNA, 17 bp, Homo sapiens
aatattggtatgtaaca

SEQ ID NO: 6585969 - DNA, 17 bp, Homo sapiens
aatattggtattaaaga

SEQ ID NO: 6585970 - DNA, 20 bp, Homo sapiens
aatattggtgctatttaaca

SEQ ID NO: 6585971 - DNA, 12 bp, Homo sapiens
aatattggtgta

SEQ ID NO: 6585972 - DNA, 22 bp, Homo sapiens
aatattggttgaaagttagaga

SEQ ID NO: 6585973 - DNA, 18 bp, Homo sapiens
aatattgtaaatactgga

SEQ ID NO: 6585974 - DNA, 13 bp, Homo sapiens
aatattgtaaatg

SEQ ID NO: 6585975 - DNA, 20 bp, Homo sapiens
aatattgtatatttttatct

SEQ ID NO: 6585976 - DNA, 17 bp, Homo sapiens
aatattgtattttagat

SEQ ID NO: 6585977 - DNA, 18 bp, Homo sapiens
aatattgtattttagata

SEQ ID NO: 6585978 - DNA, 13 bp, Homo sapiens
aatattgtcatct

SEQ ID NO: 6585979 - DNA, 13 bp, Homo sapiens
aatattgtccatt

SEQ ID NO: 6585980 - DNA, 18 bp, Homo sapiens
aatattgtcctgtttctt

SEQ ID NO: 6585981 - DNA, 21 bp, Homo sapiens
aatattgtctttttgtatgtc

SEQ ID NO: 6585982 - DNA, 13 bp, Homo sapiens
aatattgtgcatg

SEQ ID NO: 6585983 - DNA, 20 bp, Homo sapiens
aatattgtgcatgctagtgt

SEQ ID NO: 6585984 - DNA, 17 bp, Homo sapiens
aatattgtggctccctg

SEQ ID NO: 6585985 - DNA, 16 bp, Homo sapiens
aatattgtgtaagaat

SEQ ID NO: 6585986 - DNA, 18 bp, Homo sapiens
aatattgtgttgtgaatg

SEQ ID NO: 6585987 - DNA, 22 bp, Homo sapiens
aatattgtgttgtgcagcatta

SEQ ID NO: 6585988 - DNA, 22 bp, Homo sapiens
aatattgttaaaaccttactta

SEQ ID NO: 6585989 - DNA, 14 bp, Homo sapiens
aatattgttcctaa

SEQ ID NO: 6585990 - DNA, 23 bp, Homo sapiens
aatattgttcctaagttcttaga

SEQ ID NO: 6585991 - DNA, 23 bp, Homo sapiens
aatattgttgtataatttcgaga

SEQ ID NO: 6585992 - DNA, 19 bp, Homo sapiens
aatattgtttaatgcaaat

SEQ ID NO: 6585993 - DNA, 21 bp, Homo sapiens
ttgtctgtaggtgaaagaaca

SEQ ID NO: 6585994 - DNA, 15 bp, Homo sapiens
ttgtctgtcaaatgt

SEQ ID NO: 6585995 - DNA, 22 bp, Homo sapiens
ttgtctgtccagccgtgtgtgc

SEQ ID NO: 6585996 - DNA, 16 bp, Homo sapiens
ttgtctgtcctggtca

SEQ ID NO: 6585997 - DNA, 21 bp, Homo sapiens
ttgtctgtctccctcccctct

SEQ ID NO: 6585998 - DNA, 13 bp, Homo sapiens
ttgtctgtctgct

SEQ ID NO: 6585999 - DNA, 11 bp, Homo sapiens
ttgtctgtgca

SEQ ID NO: 6586000 - DNA, 19 bp, Homo sapiens
ttgtctgtgtgctactaac

SEQ ID NO: 6586001 - DNA, 15 bp, Homo sapiens
ttgtctgtgttgctg

SEQ ID NO: 6586002 - DNA, 16 bp, Homo sapiens
ttgtctgtgttgctgt

SEQ ID NO: 6586003 - DNA, 17 bp, Homo sapiens
ttgtctgtgttgctgtt

SEQ ID NO: 6586004 - DNA, 16 bp, Homo sapiens
ttgtctgtttgtttca

SEQ ID NO: 6586005 - DNA, 16 bp, Homo sapiens
ttgtctgttttccttc

SEQ ID NO: 6586006 - DNA, 17 bp, Homo sapiens
ttgtcttaaaaaatgtg

SEQ ID NO: 6586007 - DNA, 15 bp, Homo sapiens
ttgtcttaaaaagtg

SEQ ID NO: 6586008 - DNA, 23 bp, Homo sapiens
ttgtcttaaaaatttatacacca

SEQ ID NO: 6586009 - DNA, 14 bp, Homo sapiens
ttgtcttaagtgtt

SEQ ID NO: 6586010 - DNA, 18 bp, Homo sapiens
ttgtcttaagtgtttctc

SEQ ID NO: 6586011 - DNA, 12 bp, Homo sapiens
ttgtcttaatat

SEQ ID NO: 6586012 - DNA, 13 bp, Homo sapiens
ttgtcttaatgga

SEQ ID NO: 6586013 - DNA, 15 bp, Homo sapiens
ttgtcttatatatat

SEQ ID NO: 6586014 - DNA, 15 bp, Homo sapiens
ttgtcttatctggcc

SEQ ID NO: 6586015 - DNA, 14 bp, Homo sapiens
ttgtcttattccct

SEQ ID NO: 6586016 - DNA, 14 bp, Homo sapiens
ttgtcttattctta

SEQ ID NO: 6586017 - DNA, 15 bp, Homo sapiens
ttgtcttattgaaaa

SEQ ID NO: 6586018 - DNA, 17 bp, Homo sapiens
ttgtcttcaaactgtga

SEQ ID NO: 6586019 - DNA, 19 bp, Homo sapiens
ttgtcttcgctggctccta

SEQ ID NO: 6586020 - DNA, 17 bp, Homo sapiens
ttgtcttctagtttaga

SEQ ID NO: 6586021 - DNA, 18 bp, Homo sapiens
ttgtcttgaaaaaaaata

SEQ ID NO: 6586022 - DNA, 21 bp, Homo sapiens
ttgtcttgaaaaaaaatagat

SEQ ID NO: 6586023 - DNA, 17 bp, Homo sapiens
ttgtcttgaaaactgtg

SEQ ID NO: 6586024 - DNA, 15 bp, Homo sapiens
ttgtcttgtaattgt

SEQ ID NO: 6586025 - DNA, 23 bp, Homo sapiens
ttgtcttgtacttctgtgttcat

SEQ ID NO: 6586026 - DNA, 13 bp, Homo sapiens
ttgtcttgttctg

SEQ ID NO: 6586027 - DNA, 11 bp, Homo sapiens
ttgtctttatg

SEQ ID NO: 6586028 - DNA, 13 bp, Homo sapiens
ttgtctttcagga

SEQ ID NO: 6586029 - DNA, 13 bp, Homo sapiens
ttgtctttcctcc

SEQ ID NO: 6586030 - DNA, 14 bp, Homo sapiens
ttgtctttctgggg

SEQ ID NO: 6586031 - DNA, 19 bp, Homo sapiens
ttgtctttggtgaacattg

SEQ ID NO: 6586032 - DNA, 19 bp, Homo sapiens
ttgtctttgttataaatga

SEQ ID NO: 6586033 - DNA, 15 bp, Homo sapiens
ttgtcttttagacaa

SEQ ID NO: 6586034 - DNA, 14 bp, Homo sapiens
ttgtcttttctgct

SEQ ID NO: 6586035 - DNA, 14 bp, Homo sapiens
ttgtcttttgagct

SEQ ID NO: 6586036 - DNA, 15 bp, Homo sapiens
ttgtctttttcctac

SEQ ID NO: 6586037 - DNA, 16 bp, Homo sapiens
ttgtctttttcctact

SEQ ID NO: 6586038 - DNA, 14 bp, Homo sapiens
ttgtctttttcctt

SEQ ID NO: 6586039 - DNA, 21 bp, Homo sapiens
ttgtcttttttttcctttgaa

SEQ ID NO: 6586040 - DNA, 16 bp, Homo sapiens
ttgtgaaaataattga

SEQ ID NO: 6586041 - DNA, 17 bp, Homo sapiens
ttgtgaaacacagctgt

SEQ ID NO: 6586042 - DNA, 23 bp, Homo sapiens
ttgtgaaaccacaggcccttggg

SEQ ID NO: 6586043 - DNA, 20 bp, Homo sapiens
ttgtgaaagtgtaatgtgcg

SEQ ID NO: 6586044 - DNA, 15 bp, Homo sapiens
ttgtgaaataatttt

SEQ ID NO: 6586045 - DNA, 23 bp, Homo sapiens
ttgtgaaatgaaaacatgtaata

SEQ ID NO: 6586046 - DNA, 14 bp, Homo sapiens
ttgtgaaatgatgg

SEQ ID NO: 6586047 - DNA, 11 bp, Homo sapiens
ttgtgaaatgt

SEQ ID NO: 6586048 - DNA, 19 bp, Homo sapiens
ttgtgaaattcaacctgtg

SEQ ID NO: 6586049 - DNA, 11 bp, Homo sapiens
ttgtgaaattg

SEQ ID NO: 6586050 - DNA, 15 bp, Homo sapiens
ttgtgaaatttcatg

SEQ ID NO: 6586051 - DNA, 19 bp, Homo sapiens
ttgtgaaatttgttaatat

SEQ ID NO: 6586052 - DNA, 15 bp, Homo sapiens
ttgtgaaatttttca

SEQ ID NO: 6586053 - DNA, 19 bp, Homo sapiens
ttgtgaacatgatagttaa

SEQ ID NO: 6586054 - DNA, 20 bp, Homo sapiens
ttgtgaacgctgtgatgctg

SEQ ID NO: 6586055 - DNA, 22 bp, Homo sapiens
ttgtgaactcagccaagcacag

SEQ ID NO: 6586056 - DNA, 13 bp, Homo sapiens
ttgtgaactcatt

SEQ ID NO: 6586057 - DNA, 19 bp, Homo sapiens
ttgtgaactggaagaaagc

SEQ ID NO: 6586058 - DNA, 12 bp, Homo sapiens
ttgtgaactttg

SEQ ID NO: 6586059 - DNA, 17 bp, Homo sapiens
ttgtgaactttttgtag

SEQ ID NO: 6586060 - DNA, 19 bp, Homo sapiens
ttgtgaagaaaaataaagt

SEQ ID NO: 6586061 - DNA, 19 bp, Homo sapiens
ttgtgaagaactattttat

SEQ ID NO: 6586062 - DNA, 18 bp, Homo sapiens
ttgtgaagactgggaagt

SEQ ID NO: 6586063 - DNA, 17 bp, Homo sapiens
ttgtgaagatgtttgca

SEQ ID NO: 6586064 - DNA, 21 bp, Homo sapiens
ttgtgaaggattatggaaaaa

SEQ ID NO: 6586065 - DNA, 13 bp, Homo sapiens
ttgtgaaggattt

SEQ ID NO: 6586066 - DNA, 22 bp, Homo sapiens
ttgtgaaggcctcgcaggaaga

SEQ ID NO: 6586067 - DNA, 18 bp, Homo sapiens
ttgtgaagtattcacaaa

SEQ ID NO: 6586068 - DNA, 23 bp, Homo sapiens
ttgtgaagtgaaggatttgtgtt

SEQ ID NO: 6586069 - DNA, 13 bp, Homo sapiens
ttgtgaagtgatt

SEQ ID NO: 6586070 - DNA, 21 bp, Homo sapiens
ttgtgaagtgattgacatttt

SEQ ID NO: 6586071 - DNA, 21 bp, Homo sapiens
ttgtgaataattacagtgcct

SEQ ID NO: 6586072 - DNA, 17 bp, Homo sapiens
ttgtgaatctattgttt

SEQ ID NO: 6586073 - DNA, 22 bp, Homo sapiens
ttgtgaatgattcatgttatat

SEQ ID NO: 6586074 - DNA, 22 bp, Homo sapiens
ttgtgaatgcaggttttatcag

SEQ ID NO: 6586075 - DNA, 14 bp, Homo sapiens
ttgtgaatggattg

SEQ ID NO: 6586076 - DNA, 15 bp, Homo sapiens
ttgtgaatggattgg

SEQ ID NO: 6586077 - DNA, 17 bp, Homo sapiens
ttgtgaatggttgcaaa

SEQ ID NO: 6586078 - DNA, 13 bp, Homo sapiens
ttgtgaatgtgac

SEQ ID NO: 6586079 - DNA, 17 bp, Homo sapiens
ttgtgaattaatgaaat

SEQ ID NO: 6586080 - DNA, 18 bp, Homo sapiens
ttgtgaattgcctgccat

SEQ ID NO: 6586081 - DNA, 13 bp, Homo sapiens
ttgtgacaaaaaa

SEQ ID NO: 6586082 - DNA, 18 bp, Homo sapiens
ttgtgacagctctttttg

SEQ ID NO: 6586083 - DNA, 15 bp, Homo sapiens
ttgtgacagtgcctc

SEQ ID NO: 6586084 - DNA, 19 bp, Homo sapiens
ttgtgacagtgcctcttcc

SEQ ID NO: 6586085 - DNA, 16 bp, Homo sapiens
ttgtgacattccttct

SEQ ID NO: 6586086 - DNA, 15 bp, Homo sapiens
ttgtgaccaatacat

SEQ ID NO: 6586087 - DNA, 19 bp, Homo sapiens
ttgtgaccaatacatttgt

SEQ ID NO: 6586088 - DNA, 22 bp, Homo sapiens
ttgtgaccaatacatttgtatt

SEQ ID NO: 6586089 - DNA, 23 bp, Homo sapiens
ttgtgaccaatacatttgtattt

SEQ ID NO: 6586090 - DNA, 21 bp, Homo sapiens
ttgtgaccagaaagcttcatc

SEQ ID NO: 6586091 - DNA, 16 bp, Homo sapiens
ttgtgacccctttcac

SEQ ID NO: 6586092 - DNA, 19 bp, Homo sapiens
ttgtgacccctttcactta

SEQ ID NO: 6586093 - DNA, 20 bp, Homo sapiens
ttgtgacctgaagttcacca

SEQ ID NO: 6586094 - DNA, 17 bp, Homo sapiens
ttgtgaccttagtgttt

SEQ ID NO: 6586095 - DNA, 17 bp, Homo sapiens
ttgtgaccttgacttgc

SEQ ID NO: 6586096 - DNA, 19 bp, Homo sapiens
ttgtgacgattatttattt

SEQ ID NO: 6586097 - DNA, 16 bp, Homo sapiens
ttgtgactaattgtat

SEQ ID NO: 6586098 - DNA, 19 bp, Homo sapiens
ttgtgactagaaattctta

SEQ ID NO: 6586099 - DNA, 16 bp, Homo sapiens
ttgtgactagtgctga

SEQ ID NO: 6586100 - DNA, 22 bp, Homo sapiens
ttgtgactagtgctgaagctta

SEQ ID NO: 6586101 - DNA, 19 bp, Homo sapiens
ttgtgactatatagagatg

SEQ ID NO: 6586102 - DNA, 17 bp, Homo sapiens
ttgtgactcagcagagg

SEQ ID NO: 6586103 - DNA, 22 bp, Homo sapiens
ttgtgactgtatataaaggaaa

SEQ ID NO: 6586104 - DNA, 13 bp, Homo sapiens
ttgtgactgtcac

SEQ ID NO: 6586105 - DNA, 17 bp, Homo sapiens
ttgtgactgtgtttgca

SEQ ID NO: 6586106 - DNA, 15 bp, Homo sapiens
ttgtgacttacaatt

SEQ ID NO: 6586107 - DNA, 16 bp, Homo sapiens
ttgtgacttacaattt

SEQ ID NO: 6586108 - DNA, 15 bp, Homo sapiens
ttgtgacttcactgt

SEQ ID NO: 6586109 - DNA, 13 bp, Homo sapiens
ttgtgacttggag

SEQ ID NO: 6586110 - DNA, 18 bp, Homo sapiens
ttgtgacttttgctttaa

SEQ ID NO: 6586111 - DNA, 20 bp, Homo sapiens
ttgtgagacttctgtttgat

SEQ ID NO: 6586112 - DNA, 19 bp, Homo sapiens
ttgtgagagcctgtgatcc

SEQ ID NO: 6586113 - DNA, 15 bp, Homo sapiens
ttgtgagagcgaggc

SEQ ID NO: 6586114 - DNA, 17 bp, Homo sapiens
ttgtgagcatcagaggg

SEQ ID NO: 6586115 - DNA, 18 bp, Homo sapiens
ttgtgagccaccacgtcc

SEQ ID NO: 6586116 - DNA, 13 bp, Homo sapiens
ttgtgagccttgc

SEQ ID NO: 6586117 - DNA, 19 bp, Homo sapiens
ttgtgagccttgctgccaa

SEQ ID NO: 6586118 - DNA, 21 bp, Homo sapiens
ttgtgagctctggttattttt

SEQ ID NO: 6586119 - DNA, 15 bp, Homo sapiens
ttgtgagctgcttct

SEQ ID NO: 6586120 - DNA, 13 bp, Homo sapiens
ttgtgagctggat

SEQ ID NO: 6586121 - DNA, 14 bp, Homo sapiens
ttgtgagctttttg

SEQ ID NO: 6586122 - DNA, 21 bp, Homo sapiens
ttgtgagctttttgttccctc

SEQ ID NO: 6586123 - DNA, 17 bp, Homo sapiens
ttgtgaggaagccgctg

SEQ ID NO: 6586124 - DNA, 18 bp, Homo sapiens
ttgtgaggaagccgctgg

SEQ ID NO: 6586125 - DNA, 13 bp, Homo sapiens
ttgtgaggacctt

SEQ ID NO: 6586126 - DNA, 23 bp, Homo sapiens
ttgtgaggattatgggtcctgca

SEQ ID NO: 6586127 - DNA, 22 bp, Homo sapiens
ttgtgagggagagaactgagca

SEQ ID NO: 6586128 - DNA, 18 bp, Homo sapiens
ttgtgaggtgaatgtctt

SEQ ID NO: 6586129 - DNA, 22 bp, Homo sapiens
ttgtgaggtgaatgtcttcctt

SEQ ID NO: 6586130 - DNA, 17 bp, Homo sapiens
ttgtgagtattctatgt

SEQ ID NO: 6586131 - DNA, 22 bp, Homo sapiens
ttgtgagtgactcggtgtaaaa

SEQ ID NO: 6586132 - DNA, 17 bp, Homo sapiens
ttgtgataatagcattt

SEQ ID NO: 6586133 - DNA, 14 bp, Homo sapiens
ttgtgataatttaa

SEQ ID NO: 6586134 - DNA, 19 bp, Homo sapiens
ttgtgatacaatgctgtgc

SEQ ID NO: 6586135 - DNA, 15 bp, Homo sapiens
ttgtgatagcacttt

SEQ ID NO: 6586136 - DNA, 16 bp, Homo sapiens
ttgtgatagcactttc

SEQ ID NO: 6586137 - DNA, 19 bp, Homo sapiens
ttgtgatagcactttctac

SEQ ID NO: 6586138 - DNA, 20 bp, Homo sapiens
ttgtgatagctaacatttta

SEQ ID NO: 6586139 - DNA, 16 bp, Homo sapiens
ttgtgatatgcacaat

SEQ ID NO: 6586140 - DNA, 16 bp, Homo sapiens
ttgtgatatggagccc

SEQ ID NO: 6586141 - DNA, 17 bp, Homo sapiens
ttgtgatattaaatttc

SEQ ID NO: 6586142 - DNA, 20 bp, Homo sapiens
ttgtgatattgaccatgtga

SEQ ID NO: 6586143 - DNA, 23 bp, Homo sapiens
ttgtgatcagaccataatgttac

SEQ ID NO: 6586144 - DNA, 20 bp, Homo sapiens
ttgtgatcagcattgtgact

SEQ ID NO: 6586145 - DNA, 14 bp, Homo sapiens
ttgtgatctgtcct

SEQ ID NO: 6586146 - DNA, 14 bp, Homo sapiens
ttgtgatctgttgt

SEQ ID NO: 6586147 - DNA, 18 bp, Homo sapiens
ttgtgatctgttgtaata

SEQ ID NO: 6586148 - DNA, 23 bp, Homo sapiens
ttgtgatgaaaaggcagcatttg

SEQ ID NO: 6586149 - DNA, 20 bp, Homo sapiens
ttgtgatgaatcaatgaaaa

SEQ ID NO: 6586150 - DNA, 22 bp, Homo sapiens
ttgtgatgaatcaatgaaaaat

SEQ ID NO: 6586151 - DNA, 21 bp, Homo sapiens
ttgtgatgaatctacatttgt

SEQ ID NO: 6586152 - DNA, 23 bp, Homo sapiens
ttgtgatgaatctacatttgttt

SEQ ID NO: 6586153 - DNA, 16 bp, Homo sapiens
ttgtgatgatgctgtg

SEQ ID NO: 6586154 - DNA, 14 bp, Homo sapiens
ttgtgatgcatttt

SEQ ID NO: 6586155 - DNA, 16 bp, Homo sapiens
ttgtgatggagtgctg

SEQ ID NO: 6586156 - DNA, 19 bp, Homo sapiens
ttgtgatgtatattccttt

SEQ ID NO: 6586157 - DNA, 18 bp, Homo sapiens
ttgtgatgtcccaacttg

SEQ ID NO: 6586158 - DNA, 22 bp, Homo sapiens
ttgtgatgtcccaacttgtaaa

SEQ ID NO: 6586159 - DNA, 18 bp, Homo sapiens
ttgtgatgtgagttgcac

SEQ ID NO: 6586160 - DNA, 12 bp, Homo sapiens
ttgtgatgtgtc

SEQ ID NO: 6586161 - DNA, 18 bp, Homo sapiens
ttgtgatgtttgctcaga

SEQ ID NO: 6586162 - DNA, 19 bp, Homo sapiens
ttgtgattcaatctgtaaa

SEQ ID NO: 6586163 - DNA, 23 bp, Homo sapiens
ttgtgattcaatctgtaaactgt

SEQ ID NO: 6586164 - DNA, 14 bp, Homo sapiens
ttgtgattcctacc

SEQ ID NO: 6586165 - DNA, 19 bp, Homo sapiens
ttgtgattctttgatatgt

SEQ ID NO: 6586166 - DNA, 15 bp, Homo sapiens
ttgtgattggctgca

SEQ ID NO: 6586167 - DNA, 23 bp, Homo sapiens
ttgtgatttcccgtggccccagc

SEQ ID NO: 6586168 - DNA, 16 bp, Homo sapiens
ttgtgattttgtacag

SEQ ID NO: 6586169 - DNA, 22 bp, Homo sapiens
ttgtgattttgtacagaatttt

SEQ ID NO: 6586170 - DNA, 16 bp, Homo sapiens
ttgtgatttttataat

SEQ ID NO: 6586171 - DNA, 21 bp, Homo sapiens
ttgtgcaaaaaggactggaaa

SEQ ID NO: 6586172 - DNA, 22 bp, Homo sapiens
ttgtgcaaaagcttcaaattaa

SEQ ID NO: 6586173 - DNA, 15 bp, Homo sapiens
ttgtgcaaaatattg

SEQ ID NO: 6586174 - DNA, 21 bp, Homo sapiens
ttgtgcaaacatggagaaatc

SEQ ID NO: 6586175 - DNA, 15 bp, Homo sapiens
ttgtgcaacggccag

SEQ ID NO: 6586176 - DNA, 22 bp, Homo sapiens
ttgtgcaatgtaaatattttaa

SEQ ID NO: 6586177 - DNA, 13 bp, Homo sapiens
ttgtgcaattgtc

SEQ ID NO: 6586178 - DNA, 17 bp, Homo sapiens
ttgtgcaattgtctttt

SEQ ID NO: 6586179 - DNA, 21 bp, Homo sapiens
ttgtgcacaagtctttccaga

SEQ ID NO: 6586180 - DNA, 18 bp, Homo sapiens
ttgtgcacatttatttcc

SEQ ID NO: 6586181 - DNA, 17 bp, Homo sapiens
ttgtgcagcttttggtc

SEQ ID NO: 6586182 - DNA, 14 bp, Homo sapiens
ttgtgcataatgct

SEQ ID NO: 6586183 - DNA, 21 bp, Homo sapiens
ttgtgcataatgctttggaaa

SEQ ID NO: 6586184 - DNA, 21 bp, Homo sapiens
ttgtgcatgctagtgttgtat

SEQ ID NO: 6586185 - DNA, 13 bp, Homo sapiens
ttgtgcattaaaa

SEQ ID NO: 6586186 - DNA, 17 bp, Homo sapiens
ttgtgcattatctagat

SEQ ID NO: 6586187 - DNA, 22 bp, Homo sapiens
ttgtgcattctttggtaatttt

SEQ ID NO: 6586188 - DNA, 16 bp, Homo sapiens
ttgtgcatttgttcag

SEQ ID NO: 6586189 - DNA, 19 bp, Homo sapiens
ttgtgcatttgttcagctc

SEQ ID NO: 6586190 - DNA, 21 bp, Homo sapiens
ttgtgcatttgttcagctccc

SEQ ID NO: 6586191 - DNA, 16 bp, Homo sapiens
ttgtgccaaactatat

SEQ ID NO: 6586192 - DNA, 14 bp, Homo sapiens
ttgtgccaaagata

SEQ ID NO: 6586193 - DNA, 19 bp, Homo sapiens
ttgtgccaaagatagcaga

SEQ ID NO: 6586194 - DNA, 16 bp, Homo sapiens
ttgtgccagaatgctt

SEQ ID NO: 6586195 - DNA, 21 bp, Homo sapiens
ttgtgccagaatgctttagga

SEQ ID NO: 6586196 - DNA, 10 bp, Homo sapiens
ttgtgccagc

SEQ ID NO: 6586197 - DNA, 12 bp, Homo sapiens
ttgtgccatctg

SEQ ID NO: 6586198 - DNA, 21 bp, Homo sapiens
ttgtgccatgtcaaacaaata

SEQ ID NO: 6586199 - DNA, 20 bp, Homo sapiens
ttgtgccattatatttgcat

SEQ ID NO: 6586200 - DNA, 18 bp, Homo sapiens
ttgtgcccacccagggaa

SEQ ID NO: 6586201 - DNA, 13 bp, Homo sapiens
ttgtgcccctaaa

SEQ ID NO: 6586202 - DNA, 12 bp, Homo sapiens
ttgtgcccctgc

SEQ ID NO: 6586203 - DNA, 16 bp, Homo sapiens
ttgtgccctgtagctc

SEQ ID NO: 6586204 - DNA, 15 bp, Homo sapiens
ttgtgcccttaaaac

SEQ ID NO: 6586205 - DNA, 15 bp, Homo sapiens
ttgtgcctaatgtgt

SEQ ID NO: 6586206 - DNA, 18 bp, Homo sapiens
ttgtgcctaatgtgtttg

SEQ ID NO: 6586207 - DNA, 16 bp, Homo sapiens
ttgtgcctacctggcc

SEQ ID NO: 6586208 - DNA, 22 bp, Homo sapiens
ttgtgcctatattaaaggtata

SEQ ID NO: 6586209 - DNA, 22 bp, Homo sapiens
ttgtgcctccttggtaaataca

SEQ ID NO: 6586210 - DNA, 15 bp, Homo sapiens
ttgtgcctcggcctc

SEQ ID NO: 6586211 - DNA, 17 bp, Homo sapiens
ttgtgcctcttgggaga

SEQ ID NO: 6586212 - DNA, 18 bp, Homo sapiens
ttgtgcctggttcgtgcc

SEQ ID NO: 6586213 - DNA, 18 bp, Homo sapiens
ttgtgccttcccttctct

SEQ ID NO: 6586214 - DNA, 14 bp, Homo sapiens
ttgtgcctttcaca

SEQ ID NO: 6586215 - DNA, 22 bp, Homo sapiens
ttgtgcctttgggcacggccct

SEQ ID NO: 6586216 - DNA, 15 bp, Homo sapiens
ttgtgcggtgtgtct

SEQ ID NO: 6586217 - DNA, 13 bp, Homo sapiens
ttgtgctaatttc

SEQ ID NO: 6586218 - DNA, 20 bp, Homo sapiens
ttgtgctaatttctgtccag

SEQ ID NO: 6586219 - DNA, 14 bp, Homo sapiens
ttgtgctacagatg

SEQ ID NO: 6586220 - DNA, 23 bp, Homo sapiens
ttgtgctacttagtaaaaattga

SEQ ID NO: 6586221 - DNA, 14 bp, Homo sapiens
ttgtgctagaatac

SEQ ID NO: 6586222 - DNA, 19 bp, Homo sapiens
ttgtgctatagtatttgat

SEQ ID NO: 6586223 - DNA, 15 bp, Homo sapiens
ttgtgctcagcatga

SEQ ID NO: 6586224 - DNA, 15 bp, Homo sapiens
ttgtgctcagtcgcc

SEQ ID NO: 6586225 - DNA, 16 bp, Homo sapiens
ttgtgctcatgtgtgt

SEQ ID NO: 6586226 - DNA, 14 bp, Homo sapiens
ttgtgctccataga

SEQ ID NO: 6586227 - DNA, 21 bp, Homo sapiens
ttgtgctccgtagcttctagt

SEQ ID NO: 6586228 - DNA, 21 bp, Homo sapiens
ttgtgctcctcttgattcctg

SEQ ID NO: 6586229 - DNA, 23 bp, Homo sapiens
ttgtgctctatagcagacactaa

SEQ ID NO: 6586230 - DNA, 13 bp, Homo sapiens
ttgtgctctttgt

SEQ ID NO: 6586231 - DNA, 18 bp, Homo sapiens
ttgtgctgagcctgccca

SEQ ID NO: 6586232 - DNA, 11 bp, Homo sapiens
ttgtgctgagt

SEQ ID NO: 6586233 - DNA, 22 bp, Homo sapiens
ttgtgctgatcgtgctaaattt

SEQ ID NO: 6586234 - DNA, 14 bp, Homo sapiens
ttgtgctgccattt

SEQ ID NO: 6586235 - DNA, 14 bp, Homo sapiens
ttgtgctgtgggca

SEQ ID NO: 6586236 - DNA, 21 bp, Homo sapiens
ttgtgctgtgggcagcaccct

SEQ ID NO: 6586237 - DNA, 14 bp, Homo sapiens
ttgtgcttaaatta

SEQ ID NO: 6586238 - DNA, 21 bp, Homo sapiens
ttgtgcttcacagtagagcca

SEQ ID NO: 6586239 - DNA, 12 bp, Homo sapiens
ttgtgcttctcc

SEQ ID NO: 6586240 - DNA, 14 bp, Homo sapiens
ttgtgcttctcccc

SEQ ID NO: 6586241 - DNA, 19 bp, Homo sapiens
ttgtgcttgtcattccaga

SEQ ID NO: 6586242 - DNA, 22 bp, Homo sapiens
ttgtgcttgtcattccagagtg

SEQ ID NO: 6586243 - DNA, 10 bp, Homo sapiens
ttgtgcttta

SEQ ID NO: 6586244 - DNA, 15 bp, Homo sapiens
ttgtgctttctatct

SEQ ID NO: 6586245 - DNA, 14 bp, Homo sapiens
ttgtgctttgaaaa

SEQ ID NO: 6586246 - DNA, 18 bp, Homo sapiens
ttgtgctttgaaaaaaag

SEQ ID NO: 6586247 - DNA, 19 bp, Homo sapiens
ttgtgctttgctcttgtcc

SEQ ID NO: 6586248 - DNA, 14 bp, Homo sapiens
ttgtgcttttcctg

SEQ ID NO: 6586249 - DNA, 21 bp, Homo sapiens
ttgtgcttttctgttttcaag

SEQ ID NO: 6586250 - DNA, 15 bp, Homo sapiens
ttgtgctttttctcc

SEQ ID NO: 6586251 - DNA, 17 bp, Homo sapiens
ttgtgctttttctcccc

SEQ ID NO: 6586252 - DNA, 15 bp, Homo sapiens
ttgtgctttttgtca

SEQ ID NO: 6586253 - DNA, 17 bp, Homo sapiens
ttgtgctttttgtcatg

SEQ ID NO: 6586254 - DNA, 14 bp, Homo sapiens
ttgtggaaacagct

SEQ ID NO: 6586255 - DNA, 17 bp, Homo sapiens
ttgtggaagatagaatt

SEQ ID NO: 6586256 - DNA, 21 bp, Homo sapiens
ttgtggaagcatgtagactgt

SEQ ID NO: 6586257 - DNA, 22 bp, Homo sapiens
ttgtggaataaatccttcgtcc

SEQ ID NO: 6586258 - DNA, 22 bp, Homo sapiens
ttgtggaatggagattcagttt

SEQ ID NO: 6586259 - DNA, 19 bp, Homo sapiens
ttgtggaatgttggataag

SEQ ID NO: 6586260 - DNA, 21 bp, Homo sapiens
ttgtggaattgggagcttggg

SEQ ID NO: 6586261 - DNA, 17 bp, Homo sapiens
ttgtggacacagctctt

SEQ ID NO: 6586262 - DNA, 20 bp, Homo sapiens
ttgtggacatgcataaaaat

SEQ ID NO: 6586263 - DNA, 17 bp, Homo sapiens
ttgtggaccccgcctgc

SEQ ID NO: 6586264 - DNA, 19 bp, Homo sapiens
ttgtggacctcaccagaga

SEQ ID NO: 6586265 - DNA, 13 bp, Homo sapiens
ttgtggactaaaa

SEQ ID NO: 6586266 - DNA, 18 bp, Homo sapiens
ttgtggactaaaagatat

SEQ ID NO: 6586267 - DNA, 17 bp, Homo sapiens
ttgtggactctctgcct

SEQ ID NO: 6586268 - DNA, 18 bp, Homo sapiens
ttgtggactctctgcctg

SEQ ID NO: 6586269 - DNA, 15 bp, Homo sapiens
ttgtggactgtgggt

SEQ ID NO: 6586270 - DNA, 12 bp, Homo sapiens
ttgtggacttta

SEQ ID NO: 6586271 - DNA, 18 bp, Homo sapiens
ttgtggactttatttaat

SEQ ID NO: 6586272 - DNA, 21 bp, Homo sapiens
ttgtggactttatttaatttc

SEQ ID NO: 6586273 - DNA, 17 bp, Homo sapiens
ttgtggacttttcccca

SEQ ID NO: 6586274 - DNA, 22 bp, Homo sapiens
ttgtggaggagctcaggacact

SEQ ID NO: 6586275 - DNA, 21 bp, Homo sapiens
ttgtggaggagggagagccct

SEQ ID NO: 6586276 - DNA, 15 bp, Homo sapiens
ttgtggataacaaag

SEQ ID NO: 6586277 - DNA, 16 bp, Homo sapiens
ttgtggataacaaaga

SEQ ID NO: 6586278 - DNA, 21 bp, Homo sapiens
ttgtggatgggaggctcctgg

SEQ ID NO: 6586279 - DNA, 18 bp, Homo sapiens
ttgtggatgttttaattc

SEQ ID NO: 6586280 - DNA, 20 bp, Homo sapiens
ttgtggatttaacagaaatg

SEQ ID NO: 6586281 - DNA, 23 bp, Homo sapiens
ttgtggatttaacagaaatgtac

SEQ ID NO: 6586282 - DNA, 18 bp, Homo sapiens
ttgtggcataaattacag

SEQ ID NO: 6586283 - DNA, 17 bp, Homo sapiens
ttgtggcgtctccctcg

SEQ ID NO: 6586284 - DNA, 19 bp, Homo sapiens
ttgtggctcctatctgtgt

SEQ ID NO: 6586285 - DNA, 14 bp, Homo sapiens
ttgtggctgggggc

SEQ ID NO: 6586286 - DNA, 11 bp, Homo sapiens
ttgtggctttc

SEQ ID NO: 6586287 - DNA, 19 bp, Homo sapiens
ttgtgggcactggcggtca

SEQ ID NO: 6586288 - DNA, 18 bp, Homo sapiens
ttgtgggcataaactgtt

SEQ ID NO: 6586289 - DNA, 18 bp, Homo sapiens
ttgtgggcctgggctcct

SEQ ID NO: 6586290 - DNA, 14 bp, Homo sapiens
ttgtgggcttcctg

SEQ ID NO: 6586291 - DNA, 22 bp, Homo sapiens
ttgtgggcttcctgctgggact

SEQ ID NO: 6586292 - DNA, 21 bp, Homo sapiens
ttgtggggaagaggggctggg

SEQ ID NO: 6586293 - DNA, 15 bp, Homo sapiens
ttgtggggacccagg

SEQ ID NO: 6586294 - DNA, 17 bp, Homo sapiens
ttgtggggacctcagcc

SEQ ID NO: 6586295 - DNA, 17 bp, Homo sapiens
ttgtggggatgatgaaa

SEQ ID NO: 6586296 - DNA, 21 bp, Homo sapiens
ttgtggggatggtgatggaga

SEQ ID NO: 6586297 - DNA, 20 bp, Homo sapiens
ttgtggggcctcaggctccg

SEQ ID NO: 6586298 - DNA, 14 bp, Homo sapiens
ttgtggggtgcagc

SEQ ID NO: 6586299 - DNA, 15 bp, Homo sapiens
ttgtggggtgcagct

SEQ ID NO: 6586300 - DNA, 18 bp, Homo sapiens
ttgtgggtttttatttcc

SEQ ID NO: 6586301 - DNA, 17 bp, Homo sapiens
ttgtggtaatctacacc

SEQ ID NO: 6586302 - DNA, 17 bp, Homo sapiens
ttgtggtaatttgttat

SEQ ID NO: 6586303 - DNA, 11 bp, Homo sapiens
ttgtggtccaa

SEQ ID NO: 6586304 - DNA, 14 bp, Homo sapiens
ttgtggtggctgct

SEQ ID NO: 6586305 - DNA, 14 bp, Homo sapiens
ttgtggtggtgcta

SEQ ID NO: 6586306 - DNA, 24 bp, Homo sapiens
ttgtggtggtgctaaaggaggcca

SEQ ID NO: 6586307 - DNA, 22 bp, Homo sapiens
ttgtggtgtaaagctggccctg

SEQ ID NO: 6586308 - DNA, 21 bp, Homo sapiens
ttgtggtgtgagtatcagaat

SEQ ID NO: 6586309 - DNA, 15 bp, Homo sapiens
ttgtggtgttcctga

SEQ ID NO: 6586310 - DNA, 16 bp, Homo sapiens
ttgtggtgttcctgaa

SEQ ID NO: 6586311 - DNA, 18 bp, Homo sapiens
ttgtggttatcactttaa

SEQ ID NO: 6586312 - DNA, 17 bp, Homo sapiens
ttgtggttccatgcagc

SEQ ID NO: 6586313 - DNA, 14 bp, Homo sapiens
ttgtggtttagtta

SEQ ID NO: 6586314 - DNA, 15 bp, Homo sapiens
ttgtggttttatgga

SEQ ID NO: 6586315 - DNA, 17 bp, Homo sapiens
ttgtggttttcaaattg

SEQ ID NO: 6586316 - DNA, 12 bp, Homo sapiens
ttgtgtaaaaaa

SEQ ID NO: 6586317 - DNA, 16 bp, Homo sapiens
ttgtgtaaaaaatgga

SEQ ID NO: 6586318 - DNA, 18 bp, Homo sapiens
ttgtgtaaaaaatggaaa

SEQ ID NO: 6586319 - DNA, 13 bp, Homo sapiens
ttgtgtaaaggaa

SEQ ID NO: 6586320 - DNA, 13 bp, Homo sapiens
ttgtgtaaatttg

SEQ ID NO: 6586321 - DNA, 13 bp, Homo sapiens
ttgtgtaactgtt

SEQ ID NO: 6586322 - DNA, 18 bp, Homo sapiens
ttgtgtaactgttctttg

SEQ ID NO: 6586323 - DNA, 20 bp, Homo sapiens
ttgtgtaagagaatgttgaa

SEQ ID NO: 6586324 - DNA, 22 bp, Homo sapiens
ttgtgtaagagaatgttgaata

SEQ ID NO: 6586325 - DNA, 19 bp, Homo sapiens
ttgtgtaataaagtgtttt

SEQ ID NO: 6586326 - DNA, 13 bp, Homo sapiens
ttgtgtaataaca

SEQ ID NO: 6586327 - DNA, 14 bp, Homo sapiens
ttgtgtaatattac

SEQ ID NO: 6586328 - DNA, 23 bp, Homo sapiens
ttgtgtaatgaaaatgaatatct

SEQ ID NO: 6586329 - DNA, 13 bp, Homo sapiens
ttgtgtaatttat

SEQ ID NO: 6586330 - DNA, 20 bp, Homo sapiens
ttgtgtaatttcctgctcct

SEQ ID NO: 6586331 - DNA, 17 bp, Homo sapiens
ttgtgtaattttaaagt

SEQ ID NO: 6586332 - DNA, 15 bp, Homo sapiens
ttgtgtacaagttgt

SEQ ID NO: 6586333 - DNA, 15 bp, Homo sapiens
ttgtgtacagtgtgt

SEQ ID NO: 6586334 - DNA, 20 bp, Homo sapiens
ttgtgtacatagagcaatgt

SEQ ID NO: 6586335 - DNA, 18 bp, Homo sapiens
ttgtgtactccgaaacaa

SEQ ID NO: 6586336 - DNA, 23 bp, Homo sapiens
ttgtgtactcggaaattaaagtt

SEQ ID NO: 6586337 - DNA, 15 bp, Homo sapiens
ttgtgtactttcttc

SEQ ID NO: 6586338 - DNA, 15 bp, Homo sapiens
ttgtgtacttttcct

SEQ ID NO: 6586339 - DNA, 20 bp, Homo sapiens
ttgtgtagattgtgtaaatt

SEQ ID NO: 6586340 - DNA, 16 bp, Homo sapiens
ttgtgtagatttgaaa

SEQ ID NO: 6586341 - DNA, 18 bp, Homo sapiens
ttgtgtagatttgaaaat

SEQ ID NO: 6586342 - DNA, 14 bp, Homo sapiens
ttgtgtaggaaatc

SEQ ID NO: 6586343 - DNA, 11 bp, Homo sapiens
ttgtgtagtat

SEQ ID NO: 6586344 - DNA, 19 bp, Homo sapiens
ttgtgtagtatcttgaaat

SEQ ID NO: 6586345 - DNA, 13 bp, Homo sapiens
ttgtgtataagtt

SEQ ID NO: 6586346 - DNA, 15 bp, Homo sapiens
ttgtgtataggggaa

SEQ ID NO: 6586347 - DNA, 14 bp, Homo sapiens
ttgtgtatatatct

SEQ ID NO: 6586348 - DNA, 16 bp, Homo sapiens
ttgtgtatatatctta

SEQ ID NO: 6586349 - DNA, 16 bp, Homo sapiens
ttgtgtatatattata

SEQ ID NO: 6586350 - DNA, 21 bp, Homo sapiens
ttgtgtatatattataaaaat

SEQ ID NO: 6586351 - DNA, 14 bp, Homo sapiens
ttgtgtatattaca

SEQ ID NO: 6586352 - DNA, 12 bp, Homo sapiens
aatattgtttct

SEQ ID NO: 6586353 - DNA, 15 bp, Homo sapiens
aatattgtttcttta

SEQ ID NO: 6586354 - DNA, 16 bp, Homo sapiens
aatattgtttggtaaa

SEQ ID NO: 6586355 - DNA, 16 bp, Homo sapiens
aatattgttttgcatt

SEQ ID NO: 6586356 - DNA, 15 bp, Homo sapiens
aatatttaaaaatgt

SEQ ID NO: 6586357 - DNA, 20 bp, Homo sapiens
aatatttaaaatttattgct

SEQ ID NO: 6586358 - DNA, 15 bp, Homo sapiens
aatatttaaacatgg

SEQ ID NO: 6586359 - DNA, 15 bp, Homo sapiens
aatatttaaaccttt

SEQ ID NO: 6586360 - DNA, 14 bp, Homo sapiens
aatatttaactttt

SEQ ID NO: 6586361 - DNA, 14 bp, Homo sapiens
aatatttaagaaaa

SEQ ID NO: 6586362 - DNA, 22 bp, Homo sapiens
aatatttaagaaaagcactttt

SEQ ID NO: 6586363 - DNA, 18 bp, Homo sapiens
aatatttaagcaataaaa

SEQ ID NO: 6586364 - DNA, 16 bp, Homo sapiens
aatatttaaggagatg

SEQ ID NO: 6586365 - DNA, 17 bp, Homo sapiens
aatatttaaggagatgt

SEQ ID NO: 6586366 - DNA, 22 bp, Homo sapiens
aatatttaaggagatgtaagag

SEQ ID NO: 6586367 - DNA, 13 bp, Homo sapiens
aatatttaagtat

SEQ ID NO: 6586368 - DNA, 19 bp, Homo sapiens
aatatttaagtgaaggaga

SEQ ID NO: 6586369 - DNA, 15 bp, Homo sapiens
aatatttaatatcaa

SEQ ID NO: 6586370 - DNA, 13 bp, Homo sapiens
aatatttaatgtt

SEQ ID NO: 6586371 - DNA, 14 bp, Homo sapiens
aatatttaatgttg

SEQ ID NO: 6586372 - DNA, 15 bp, Homo sapiens
aatatttacaatgta

SEQ ID NO: 6586373 - DNA, 17 bp, Homo sapiens
aatatttacataaagac

SEQ ID NO: 6586374 - DNA, 18 bp, Homo sapiens
aatatttactctttgcaa

SEQ ID NO: 6586375 - DNA, 14 bp, Homo sapiens
aatatttactgaga

SEQ ID NO: 6586376 - DNA, 15 bp, Homo sapiens
aatatttagaaaatt

SEQ ID NO: 6586377 - DNA, 17 bp, Homo sapiens
aatatttataaaacttc

SEQ ID NO: 6586378 - DNA, 19 bp, Homo sapiens
aatatttataaatgagcaa

SEQ ID NO: 6586379 - DNA, 17 bp, Homo sapiens
aatatttataacagcat

SEQ ID NO: 6586380 - DNA, 22 bp, Homo sapiens
aatatttataattaaagaaaat

SEQ ID NO: 6586381 - DNA, 16 bp, Homo sapiens
aatatttatagggctt

SEQ ID NO: 6586382 - DNA, 17 bp, Homo sapiens
aatatttatatatttat

SEQ ID NO: 6586383 - DNA, 14 bp, Homo sapiens
aatatttatatttc

SEQ ID NO: 6586384 - DNA, 18 bp, Homo sapiens
aatatttatatttcacta

SEQ ID NO: 6586385 - DNA, 18 bp, Homo sapiens
aatatttatgaagaaaat

SEQ ID NO: 6586386 - DNA, 21 bp, Homo sapiens
aatatttatgcttaaaatatg

SEQ ID NO: 6586387 - DNA, 12 bp, Homo sapiens
aatatttatgga

SEQ ID NO: 6586388 - DNA, 19 bp, Homo sapiens
aatatttatggatgcaaca

SEQ ID NO: 6586389 - DNA, 23 bp, Homo sapiens
aatatttatgtctatttaagcct

SEQ ID NO: 6586390 - DNA, 12 bp, Homo sapiens
aatatttatgtg

SEQ ID NO: 6586391 - DNA, 21 bp, Homo sapiens
aatatttatgtttaagtgctt

SEQ ID NO: 6586392 - DNA, 21 bp, Homo sapiens
aatatttattaaataaaatca

SEQ ID NO: 6586393 - DNA, 19 bp, Homo sapiens
aatatttattacacaaaga

SEQ ID NO: 6586394 - DNA, 17 bp, Homo sapiens
aatatttattacctctg

SEQ ID NO: 6586395 - DNA, 19 bp, Homo sapiens
aatatttattattttcacc

SEQ ID NO: 6586396 - DNA, 20 bp, Homo sapiens
aatatttattattttcacct

SEQ ID NO: 6586397 - DNA, 20 bp, Homo sapiens
aatatttattcattatttgt

SEQ ID NO: 6586398 - DNA, 22 bp, Homo sapiens
aatatttattgaattattttgt

SEQ ID NO: 6586399 - DNA, 13 bp, Homo sapiens
aatatttattgct

SEQ ID NO: 6586400 - DNA, 15 bp, Homo sapiens
aatatttattgcttt

SEQ ID NO: 6586401 - DNA, 13 bp, Homo sapiens
aatatttattgga

SEQ ID NO: 6586402 - DNA, 21 bp, Homo sapiens
aatatttattggatgatacag

SEQ ID NO: 6586403 - DNA, 18 bp, Homo sapiens
aatatttatttccagagt

SEQ ID NO: 6586404 - DNA, 15 bp, Homo sapiens
aatatttattttaat

SEQ ID NO: 6586405 - DNA, 15 bp, Homo sapiens
aatatttcaagacat

SEQ ID NO: 6586406 - DNA, 14 bp, Homo sapiens
aatatttcaagtgc

SEQ ID NO: 6586407 - DNA, 14 bp, Homo sapiens
aatatttcatgatt

SEQ ID NO: 6586408 - DNA, 12 bp, Homo sapiens
aatatttcattt

SEQ ID NO: 6586409 - DNA, 17 bp, Homo sapiens
aatatttcattttgaga

SEQ ID NO: 6586410 - DNA, 16 bp, Homo sapiens
aatatttccaatgtga

SEQ ID NO: 6586411 - DNA, 14 bp, Homo sapiens
aatatttccagaag

SEQ ID NO: 6586412 - DNA, 20 bp, Homo sapiens
aatatttccagaaggatttc

SEQ ID NO: 6586413 - DNA, 13 bp, Homo sapiens
aatatttccatat

SEQ ID NO: 6586414 - DNA, 19 bp, Homo sapiens
aatatttcctgacttgagt

SEQ ID NO: 6586415 - DNA, 19 bp, Homo sapiens
aatatttccttaaactgtg

SEQ ID NO: 6586416 - DNA, 21 bp, Homo sapiens
aatatttccttaaactgtgtg

SEQ ID NO: 6586417 - DNA, 15 bp, Homo sapiens
aatatttctaagctt

SEQ ID NO: 6586418 - DNA, 21 bp, Homo sapiens
aatatttctaagcttatttct

SEQ ID NO: 6586419 - DNA, 16 bp, Homo sapiens
aatatttctatgtaaa

SEQ ID NO: 6586420 - DNA, 12 bp, Homo sapiens
aatatttctatt

SEQ ID NO: 6586421 - DNA, 14 bp, Homo sapiens
aatatttcttaagt

SEQ ID NO: 6586422 - DNA, 20 bp, Homo sapiens
aatatttcttaatttggata

SEQ ID NO: 6586423 - DNA, 12 bp, Homo sapiens
aatatttcttca

SEQ ID NO: 6586424 - DNA, 16 bp, Homo sapiens
aatatttcttcaaata

SEQ ID NO: 6586425 - DNA, 20 bp, Homo sapiens
aatatttcttcaaatatctc

SEQ ID NO: 6586426 - DNA, 17 bp, Homo sapiens
aatatttcttttgttgt

SEQ ID NO: 6586427 - DNA, 21 bp, Homo sapiens
aatatttcttttgttgtactt

SEQ ID NO: 6586428 - DNA, 23 bp, Homo sapiens
aatatttcttttgttgtacttta

SEQ ID NO: 6586429 - DNA, 21 bp, Homo sapiens
aatatttgaaaattaccttta

SEQ ID NO: 6586430 - DNA, 20 bp, Homo sapiens
aatatttgaatcttgtctca

SEQ ID NO: 6586431 - DNA, 13 bp, Homo sapiens
aatatttgaattt

SEQ ID NO: 6586432 - DNA, 18 bp, Homo sapiens
aatatttgactattctgt

SEQ ID NO: 6586433 - DNA, 21 bp, Homo sapiens
aatatttgacttgcatgaaga

SEQ ID NO: 6586434 - DNA, 23 bp, Homo sapiens
aatatttgacttgcatgaagaga

SEQ ID NO: 6586435 - DNA, 14 bp, Homo sapiens
aatatttgagaata

SEQ ID NO: 6586436 - DNA, 20 bp, Homo sapiens
aatatttgcacacatttaaa

SEQ ID NO: 6586437 - DNA, 12 bp, Homo sapiens
aatatttgctga

SEQ ID NO: 6586438 - DNA, 15 bp, Homo sapiens
aatatttgcttattt

SEQ ID NO: 6586439 - DNA, 12 bp, Homo sapiens
aatatttggaat

SEQ ID NO: 6586440 - DNA, 23 bp, Homo sapiens
aatatttggagctatcagtgctt

SEQ ID NO: 6586441 - DNA, 12 bp, Homo sapiens
aatatttgtaca

SEQ ID NO: 6586442 - DNA, 20 bp, Homo sapiens
aatatttgtaggccaggcgt

SEQ ID NO: 6586443 - DNA, 16 bp, Homo sapiens
aatatttgtctgtgtg

SEQ ID NO: 6586444 - DNA, 18 bp, Homo sapiens
aatatttgtctgtgtgct

SEQ ID NO: 6586445 - DNA, 22 bp, Homo sapiens
aatatttgtctgtgtgctacta

SEQ ID NO: 6586446 - DNA, 22 bp, Homo sapiens
aatatttgttctggtttagtgt

SEQ ID NO: 6586447 - DNA, 12 bp, Homo sapiens
aatattttaaga

SEQ ID NO: 6586448 - DNA, 13 bp, Homo sapiens
aatattttaagaa

SEQ ID NO: 6586449 - DNA, 17 bp, Homo sapiens
aatattttaagaaagag

SEQ ID NO: 6586450 - DNA, 22 bp, Homo sapiens
aatattttaagaaagagaatga

SEQ ID NO: 6586451 - DNA, 14 bp, Homo sapiens
aatattttaagcat

SEQ ID NO: 6586452 - DNA, 13 bp, Homo sapiens
aatattttaagta

SEQ ID NO: 6586453 - DNA, 15 bp, Homo sapiens
aatattttaagtatt

SEQ ID NO: 6586454 - DNA, 14 bp, Homo sapiens
aatattttaataaa

SEQ ID NO: 6586455 - DNA, 21 bp, Homo sapiens
aatattttaatttttaaatgc

SEQ ID NO: 6586456 - DNA, 21 bp, Homo sapiens
aatattttactttgttgagta

SEQ ID NO: 6586457 - DNA, 17 bp, Homo sapiens
aatattttacttttaca

SEQ ID NO: 6586458 - DNA, 14 bp, Homo sapiens
aatattttaggaaa

SEQ ID NO: 6586459 - DNA, 17 bp, Homo sapiens
aatattttatgatccag

SEQ ID NO: 6586460 - DNA, 18 bp, Homo sapiens
aatattttatgatccagc

SEQ ID NO: 6586461 - DNA, 21 bp, Homo sapiens
aatattttatggttatgtttt

SEQ ID NO: 6586462 - DNA, 13 bp, Homo sapiens
aatattttattca

SEQ ID NO: 6586463 - DNA, 15 bp, Homo sapiens
aatattttattcaag

SEQ ID NO: 6586464 - DNA, 17 bp, Homo sapiens
aatattttattcaaggt

SEQ ID NO: 6586465 - DNA, 18 bp, Homo sapiens
aatattttatttgaaaaa

SEQ ID NO: 6586466 - DNA, 14 bp, Homo sapiens
aatattttcaaaat

SEQ ID NO: 6586467 - DNA, 14 bp, Homo sapiens
aatattttcaacta

SEQ ID NO: 6586468 - DNA, 13 bp, Homo sapiens
aatattttcaagc

SEQ ID NO: 6586469 - DNA, 16 bp, Homo sapiens
aatattttcaagcttt

SEQ ID NO: 6586470 - DNA, 22 bp, Homo sapiens
aatattttcaagctttttgtga

SEQ ID NO: 6586471 - DNA, 19 bp, Homo sapiens
aatattttcaagtttttca

SEQ ID NO: 6586472 - DNA, 14 bp, Homo sapiens
aatattttcagtaa

SEQ ID NO: 6586473 - DNA, 22 bp, Homo sapiens
aatattttctctgtacttttca

SEQ ID NO: 6586474 - DNA, 18 bp, Homo sapiens
aatattttctgcaatcca

SEQ ID NO: 6586475 - DNA, 13 bp, Homo sapiens
aatattttctgtg

SEQ ID NO: 6586476 - DNA, 15 bp, Homo sapiens
aatattttctgtgtg

SEQ ID NO: 6586477 - DNA, 17 bp, Homo sapiens
aatattttctgtgtgtt

SEQ ID NO: 6586478 - DNA, 21 bp, Homo sapiens
aatattttctgtgtgttcctg

SEQ ID NO: 6586479 - DNA, 22 bp, Homo sapiens
aatattttctgtgtgttcctgg

SEQ ID NO: 6586480 - DNA, 23 bp, Homo sapiens
aatattttctgtgtgttcctggc

SEQ ID NO: 6586481 - DNA, 14 bp, Homo sapiens
aatattttctttta

SEQ ID NO: 6586482 - DNA, 18 bp, Homo sapiens
aatattttgaatacacat

SEQ ID NO: 6586483 - DNA, 13 bp, Homo sapiens
aatattttgaatc

SEQ ID NO: 6586484 - DNA, 22 bp, Homo sapiens
aatattttgaatcaataatata

SEQ ID NO: 6586485 - DNA, 20 bp, Homo sapiens
aatattttgataataaattg

SEQ ID NO: 6586486 - DNA, 17 bp, Homo sapiens
aatattttgatacaaat

SEQ ID NO: 6586487 - DNA, 23 bp, Homo sapiens
aatattttgatcttcaacaaatt

SEQ ID NO: 6586488 - DNA, 20 bp, Homo sapiens
aatattttgctagtttttga

SEQ ID NO: 6586489 - DNA, 14 bp, Homo sapiens
aatattttggaaac

SEQ ID NO: 6586490 - DNA, 13 bp, Homo sapiens
aatattttggatg

SEQ ID NO: 6586491 - DNA, 12 bp, Homo sapiens
aatattttgtaa

SEQ ID NO: 6586492 - DNA, 14 bp, Homo sapiens
aatattttgtaata

SEQ ID NO: 6586493 - DNA, 19 bp, Homo sapiens
aatattttgtattattgct

SEQ ID NO: 6586494 - DNA, 20 bp, Homo sapiens
aatattttgtattattgctg

SEQ ID NO: 6586495 - DNA, 21 bp, Homo sapiens
aatattttgtattattgctgt

SEQ ID NO: 6586496 - DNA, 14 bp, Homo sapiens
aatattttgtattt

SEQ ID NO: 6586497 - DNA, 15 bp, Homo sapiens
aatattttgtctaaa

SEQ ID NO: 6586498 - DNA, 20 bp, Homo sapiens
aatattttgtctaaaatgcc

SEQ ID NO: 6586499 - DNA, 16 bp, Homo sapiens
aatattttgttcttat

SEQ ID NO: 6586500 - DNA, 22 bp, Homo sapiens
aatatttttaaatggacaatgg

SEQ ID NO: 6586501 - DNA, 14 bp, Homo sapiens
aatatttttaacaa

SEQ ID NO: 6586502 - DNA, 20 bp, Homo sapiens
aatatttttagctctgttct

SEQ ID NO: 6586503 - DNA, 23 bp, Homo sapiens
aatatttttatatcatgcaaaat

SEQ ID NO: 6586504 - DNA, 18 bp, Homo sapiens
aatatttttatatttcct

SEQ ID NO: 6586505 - DNA, 14 bp, Homo sapiens
aatatttttctaaa

SEQ ID NO: 6586506 - DNA, 13 bp, Homo sapiens
aatatttttctta

SEQ ID NO: 6586507 - DNA, 21 bp, Homo sapiens
aatatttttggcattcctcta

SEQ ID NO: 6586508 - DNA, 17 bp, Homo sapiens
aatatttttgtatttct

SEQ ID NO: 6586509 - DNA, 16 bp, Homo sapiens
aatatttttgtatttt

SEQ ID NO: 6586510 - DNA, 19 bp, Homo sapiens
aatatttttgtattttaca

SEQ ID NO: 6586511 - DNA, 23 bp, Homo sapiens
aatattttttatttctaagtatt

SEQ ID NO: 6586512 - DNA, 13 bp, Homo sapiens
aatattttttgaa

SEQ ID NO: 6586513 - DNA, 23 bp, Homo sapiens
aatattttttgaaggtttcagat

SEQ ID NO: 6586514 - DNA, 17 bp, Homo sapiens
aatattttttgcaagtt

SEQ ID NO: 6586515 - DNA, 17 bp, Homo sapiens
aatatttttttctagct

SEQ ID NO: 6586516 - DNA, 19 bp, Homo sapiens
aatatttttttctagctat

SEQ ID NO: 6586517 - DNA, 21 bp, Homo sapiens
aatatttttttgtagatgaaa

SEQ ID NO: 6586518 - DNA, 13 bp, Homo sapiens
aatcaaaaacttt

SEQ ID NO: 6586519 - DNA, 12 bp, Homo sapiens
aatcaaaagctg

SEQ ID NO: 6586520 - DNA, 16 bp, Homo sapiens
aatcaaaagctgaaat

SEQ ID NO: 6586521 - DNA, 13 bp, Homo sapiens
aatcaaaagctgc

SEQ ID NO: 6586522 - DNA, 15 bp, Homo sapiens
aatcaaaagctgctt

SEQ ID NO: 6586523 - DNA, 20 bp, Homo sapiens
aatcaaaaggtaatgcacat

SEQ ID NO: 6586524 - DNA, 15 bp, Homo sapiens
aatcaaaataaaaga

SEQ ID NO: 6586525 - DNA, 20 bp, Homo sapiens
aatcaaaataacgccccaga

SEQ ID NO: 6586526 - DNA, 15 bp, Homo sapiens
aatcaaaatccaaaa

SEQ ID NO: 6586527 - DNA, 19 bp, Homo sapiens
aatcaaaatctctccactt

SEQ ID NO: 6586528 - DNA, 22 bp, Homo sapiens
aatcaaaattgacctcaaaaga

SEQ ID NO: 6586529 - DNA, 14 bp, Homo sapiens
aatcaaaattgtct

SEQ ID NO: 6586530 - DNA, 13 bp, Homo sapiens
aatcaaacacaac

SEQ ID NO: 6586531 - DNA, 14 bp, Homo sapiens
aatcaaacagtaat

SEQ ID NO: 6586532 - DNA, 23 bp, Homo sapiens
ttgtgtatattggtgtatattat

SEQ ID NO: 6586533 - DNA, 18 bp, Homo sapiens
ttgtgtatatttgcttca

SEQ ID NO: 6586534 - DNA, 15 bp, Homo sapiens
ttgtgtatatttgta

SEQ ID NO: 6586535 - DNA, 16 bp, Homo sapiens
ttgtgtatcctgacag

SEQ ID NO: 6586536 - DNA, 12 bp, Homo sapiens
ttgtgtatctgt

SEQ ID NO: 6586537 - DNA, 22 bp, Homo sapiens
ttgtgtatggatatgtgtaaat

SEQ ID NO: 6586538 - DNA, 11 bp, Homo sapiens
ttgtgtatgtg

SEQ ID NO: 6586539 - DNA, 14 bp, Homo sapiens
ttgtgtatgtgtat

SEQ ID NO: 6586540 - DNA, 11 bp, Homo sapiens
ttgtgtatgtt

SEQ ID NO: 6586541 - DNA, 17 bp, Homo sapiens
ttgtgtattaaatggtt

SEQ ID NO: 6586542 - DNA, 17 bp, Homo sapiens
ttgtgtatttctctgtg

SEQ ID NO: 6586543 - DNA, 15 bp, Homo sapiens
ttgtgtattttcctg

SEQ ID NO: 6586544 - DNA, 19 bp, Homo sapiens
ttgtgtcaaccactaaagt

SEQ ID NO: 6586545 - DNA, 15 bp, Homo sapiens
ttgtgtcaagacatt

SEQ ID NO: 6586546 - DNA, 18 bp, Homo sapiens
ttgtgtcagcatgtctca

SEQ ID NO: 6586547 - DNA, 20 bp, Homo sapiens
ttgtgtcccaaaatcccctc

SEQ ID NO: 6586548 - DNA, 18 bp, Homo sapiens
ttgtgtcccatgatccct

SEQ ID NO: 6586549 - DNA, 22 bp, Homo sapiens
ttgtgtcccattcccccagtgc

SEQ ID NO: 6586550 - DNA, 19 bp, Homo sapiens
ttgtgtcctccaggagctt

SEQ ID NO: 6586551 - DNA, 24 bp, Homo sapiens
ttgtgtctagggcagagtatgttc

SEQ ID NO: 6586552 - DNA, 22 bp, Homo sapiens
ttgtgtctccttatggtacact

SEQ ID NO: 6586553 - DNA, 13 bp, Homo sapiens
ttgtgtctgactc

SEQ ID NO: 6586554 - DNA, 13 bp, Homo sapiens
ttgtgtctgcctg

SEQ ID NO: 6586555 - DNA, 12 bp, Homo sapiens
ttgtgtctgtgg

SEQ ID NO: 6586556 - DNA, 14 bp, Homo sapiens
ttgtgtctgtggtt

SEQ ID NO: 6586557 - DNA, 14 bp, Homo sapiens
ttgtgtctgttgct

SEQ ID NO: 6586558 - DNA, 16 bp, Homo sapiens
ttgtgtgaaaaaagaa

SEQ ID NO: 6586559 - DNA, 18 bp, Homo sapiens
ttgtgtgaaaaaagaaaa

SEQ ID NO: 6586560 - DNA, 17 bp, Homo sapiens
ttgtgtgaccaactgtg

SEQ ID NO: 6586561 - DNA, 18 bp, Homo sapiens
ttgtgtgaccaactgtgt

SEQ ID NO: 6586562 - DNA, 11 bp, Homo sapiens
ttgtgtgaccc

SEQ ID NO: 6586563 - DNA, 20 bp, Homo sapiens
ttgtgtgagacttaaaacat

SEQ ID NO: 6586564 - DNA, 22 bp, Homo sapiens
ttgtgtgagggcaaaccaggct

SEQ ID NO: 6586565 - DNA, 17 bp, Homo sapiens
ttgtgtgatatttcaga

SEQ ID NO: 6586566 - DNA, 17 bp, Homo sapiens
ttgtgtgcatttctgtc

SEQ ID NO: 6586567 - DNA, 20 bp, Homo sapiens
ttgtgtgcctctagctgaat

SEQ ID NO: 6586568 - DNA, 23 bp, Homo sapiens
ttgtgtgcctctagctgaattga

SEQ ID NO: 6586569 - DNA, 19 bp, Homo sapiens
ttgtgtgcgctgcctggcc

SEQ ID NO: 6586570 - DNA, 18 bp, Homo sapiens
ttgtgtgctgttgtttaa

SEQ ID NO: 6586571 - DNA, 11 bp, Homo sapiens
ttgtgtggaat

SEQ ID NO: 6586572 - DNA, 22 bp, Homo sapiens
ttgtgtggagaactcagtgcca

SEQ ID NO: 6586573 - DNA, 16 bp, Homo sapiens
ttgtgtggagaagtgt

SEQ ID NO: 6586574 - DNA, 13 bp, Homo sapiens
ttgtgtggattct

SEQ ID NO: 6586575 - DNA, 13 bp, Homo sapiens
ttgtgtggcccag

SEQ ID NO: 6586576 - DNA, 14 bp, Homo sapiens
ttgtgtggcccagc

SEQ ID NO: 6586577 - DNA, 16 bp, Homo sapiens
ttgtgtggctcctggt

SEQ ID NO: 6586578 - DNA, 17 bp, Homo sapiens
ttgtgtgggtttactct

SEQ ID NO: 6586579 - DNA, 15 bp, Homo sapiens
ttgtgtggtattcaa

SEQ ID NO: 6586580 - DNA, 21 bp, Homo sapiens
ttgtgtggtttcccctttctt

SEQ ID NO: 6586581 - DNA, 19 bp, Homo sapiens
ttgtgtgtatatgtattta

SEQ ID NO: 6586582 - DNA, 15 bp, Homo sapiens
ttgtgtgtatgtgta

SEQ ID NO: 6586583 - DNA, 16 bp, Homo sapiens
ttgtgtgtatttgcta

SEQ ID NO: 6586584 - DNA, 23 bp, Homo sapiens
ttgtgtgtatttgtattaataaa

SEQ ID NO: 6586585 - DNA, 23 bp, Homo sapiens
ttgtgtgtcaggccctctgcctg

SEQ ID NO: 6586586 - DNA, 19 bp, Homo sapiens
ttgtgtgtgctctgcttca

SEQ ID NO: 6586587 - DNA, 10 bp, Homo sapiens
ttgtgtgtgg

SEQ ID NO: 6586588 - DNA, 10 bp, Homo sapiens
ttgtgtgtgt

SEQ ID NO: 6586589 - DNA, 13 bp, Homo sapiens
ttgtgtgtgttct

SEQ ID NO: 6586590 - DNA, 16 bp, Homo sapiens
ttgtgtgtgttctgtc

SEQ ID NO: 6586591 - DNA, 17 bp, Homo sapiens
ttgtgtgttatattcca

SEQ ID NO: 6586592 - DNA, 15 bp, Homo sapiens
ttgtgtgttatttaa

SEQ ID NO: 6586593 - DNA, 15 bp, Homo sapiens
ttgtgtgttccaagt

SEQ ID NO: 6586594 - DNA, 17 bp, Homo sapiens
ttgtgtgttgcactcaa

SEQ ID NO: 6586595 - DNA, 17 bp, Homo sapiens
ttgtgtgttggctttgc

SEQ ID NO: 6586596 - DNA, 15 bp, Homo sapiens
ttgtgtgttgtctct

SEQ ID NO: 6586597 - DNA, 17 bp, Homo sapiens
ttgtgtgttgtctcttg

SEQ ID NO: 6586598 - DNA, 16 bp, Homo sapiens
ttgtgtgttgtgtcca

SEQ ID NO: 6586599 - DNA, 13 bp, Homo sapiens
ttgtgtgtttcac

SEQ ID NO: 6586600 - DNA, 23 bp, Homo sapiens
ttgtgttaacttgcctccatctt

SEQ ID NO: 6586601 - DNA, 18 bp, Homo sapiens
ttgtgttaattctttctc

SEQ ID NO: 6586602 - DNA, 13 bp, Homo sapiens
ttgtgttacaata

SEQ ID NO: 6586603 - DNA, 12 bp, Homo sapiens
ttgtgttcacca

SEQ ID NO: 6586604 - DNA, 15 bp, Homo sapiens
ttgtgttcaccagag

SEQ ID NO: 6586605 - DNA, 21 bp, Homo sapiens
ttgtgttcagttccagctttt

SEQ ID NO: 6586606 - DNA, 23 bp, Homo sapiens
ttgtgttcagttccagcttttgt

SEQ ID NO: 6586607 - DNA, 16 bp, Homo sapiens
ttgtgttcatttcatt

SEQ ID NO: 6586608 - DNA, 20 bp, Homo sapiens
ttgtgttcctggctgatgat

SEQ ID NO: 6586609 - DNA, 15 bp, Homo sapiens
ttgtgttccttctgt

SEQ ID NO: 6586610 - DNA, 16 bp, Homo sapiens
ttgtgttccttctgtg

SEQ ID NO: 6586611 - DNA, 19 bp, Homo sapiens
ttgtgttcctttttgcagc

SEQ ID NO: 6586612 - DNA, 13 bp, Homo sapiens
ttgtgttctgctc

SEQ ID NO: 6586613 - DNA, 14 bp, Homo sapiens
ttgtgttctttata

SEQ ID NO: 6586614 - DNA, 13 bp, Homo sapiens
ttgtgttctttgt

SEQ ID NO: 6586615 - DNA, 14 bp, Homo sapiens
ttgtgttgaagaag

SEQ ID NO: 6586616 - DNA, 13 bp, Homo sapiens
ttgtgttgaagag

SEQ ID NO: 6586617 - DNA, 17 bp, Homo sapiens
ttgtgttgcactgaaca

SEQ ID NO: 6586618 - DNA, 20 bp, Homo sapiens
ttgtgttgcctgctgagctg

SEQ ID NO: 6586619 - DNA, 12 bp, Homo sapiens
ttgtgttgtaat

SEQ ID NO: 6586620 - DNA, 16 bp, Homo sapiens
ttgtgtttaactgtga

SEQ ID NO: 6586621 - DNA, 22 bp, Homo sapiens
ttgtgtttacattttatggtgc

SEQ ID NO: 6586622 - DNA, 14 bp, Homo sapiens
ttgtgtttactttt

SEQ ID NO: 6586623 - DNA, 15 bp, Homo sapiens
ttgtgtttagatttt

SEQ ID NO: 6586624 - DNA, 18 bp, Homo sapiens
ttgtgtttatgcatttca

SEQ ID NO: 6586625 - DNA, 21 bp, Homo sapiens
ttgtgtttattcttgatgaaa

SEQ ID NO: 6586626 - DNA, 21 bp, Homo sapiens
ttgtgtttctagaatcacagc

SEQ ID NO: 6586627 - DNA, 14 bp, Homo sapiens
ttgtgtttgtatat

SEQ ID NO: 6586628 - DNA, 16 bp, Homo sapiens
ttgtgtttgtatataa

SEQ ID NO: 6586629 - DNA, 18 bp, Homo sapiens
ttgtgtttgtatataaat

SEQ ID NO: 6586630 - DNA, 14 bp, Homo sapiens
ttgtgtttgtcatt

SEQ ID NO: 6586631 - DNA, 15 bp, Homo sapiens
ttgtgttttaaaaaa

SEQ ID NO: 6586632 - DNA, 17 bp, Homo sapiens
ttgtgttttaaaaaaac

SEQ ID NO: 6586633 - DNA, 20 bp, Homo sapiens
ttgtgttttaaaaaaactga

SEQ ID NO: 6586634 - DNA, 21 bp, Homo sapiens
ttgtgttttaaaaaaactgaa

SEQ ID NO: 6586635 - DNA, 15 bp, Homo sapiens
ttgtgttttcctaaa

SEQ ID NO: 6586636 - DNA, 17 bp, Homo sapiens
ttgtgttttcttgtaaa

SEQ ID NO: 6586637 - DNA, 18 bp, Homo sapiens
ttgtgtttttaatttatt

SEQ ID NO: 6586638 - DNA, 15 bp, Homo sapiens
ttgtgtttttccaaa

SEQ ID NO: 6586639 - DNA, 22 bp, Homo sapiens
ttgtgtttttctatagaaaaag

SEQ ID NO: 6586640 - DNA, 15 bp, Homo sapiens
ttgtgttttttaaga

SEQ ID NO: 6586641 - DNA, 17 bp, Homo sapiens
ttgtgttttttaagata

SEQ ID NO: 6586642 - DNA, 23 bp, Homo sapiens
ttgttaaaaaaaaaaagattgta

SEQ ID NO: 6586643 - DNA, 17 bp, Homo sapiens
ttgttaaaaacactgct

SEQ ID NO: 6586644 - DNA, 21 bp, Homo sapiens
ttgttaaaaataaatcccatg

SEQ ID NO: 6586645 - DNA, 20 bp, Homo sapiens
ttgttaaaactggcatctga

SEQ ID NO: 6586646 - DNA, 13 bp, Homo sapiens
ttgttaaagaaac

SEQ ID NO: 6586647 - DNA, 14 bp, Homo sapiens
ttgttaaatattta

SEQ ID NO: 6586648 - DNA, 13 bp, Homo sapiens
ttgttaaatgcta

SEQ ID NO: 6586649 - DNA, 12 bp, Homo sapiens
ttgttaaatgtt

SEQ ID NO: 6586650 - DNA, 18 bp, Homo sapiens
ttgttaaatttagcagcc

SEQ ID NO: 6586651 - DNA, 13 bp, Homo sapiens
ttgttaacagcaa

SEQ ID NO: 6586652 - DNA, 19 bp, Homo sapiens
ttgttaacagtatttctct

SEQ ID NO: 6586653 - DNA, 22 bp, Homo sapiens
ttgttaacgtgatgtgccacta

SEQ ID NO: 6586654 - DNA, 18 bp, Homo sapiens
ttgttaactgtactgaag

SEQ ID NO: 6586655 - DNA, 11 bp, Homo sapiens
ttgttaacttt

SEQ ID NO: 6586656 - DNA, 18 bp, Homo sapiens
ttgttaagaagttgaact

SEQ ID NO: 6586657 - DNA, 12 bp, Homo sapiens
ttgttaagctca

SEQ ID NO: 6586658 - DNA, 14 bp, Homo sapiens
ttgttaagtgcttt

SEQ ID NO: 6586659 - DNA, 14 bp, Homo sapiens
ttgttaataaaagt

SEQ ID NO: 6586660 - DNA, 13 bp, Homo sapiens
ttgttaatacaag

SEQ ID NO: 6586661 - DNA, 16 bp, Homo sapiens
ttgttaatagttcctg

SEQ ID NO: 6586662 - DNA, 13 bp, Homo sapiens
ttgttaatataac

SEQ ID NO: 6586663 - DNA, 22 bp, Homo sapiens
ttgttaatatcactcattaatt

SEQ ID NO: 6586664 - DNA, 14 bp, Homo sapiens
ttgttaatatgcag

SEQ ID NO: 6586665 - DNA, 17 bp, Homo sapiens
ttgttaatattaattta

SEQ ID NO: 6586666 - DNA, 13 bp, Homo sapiens
ttgttaatattct

SEQ ID NO: 6586667 - DNA, 18 bp, Homo sapiens
ttgttaatcttcaatagt

SEQ ID NO: 6586668 - DNA, 17 bp, Homo sapiens
ttgttaatgaaaatgtc

SEQ ID NO: 6586669 - DNA, 18 bp, Homo sapiens
ttgttaatgaaaatgtca

SEQ ID NO: 6586670 - DNA, 18 bp, Homo sapiens
ttgttaatgattcttgtg

SEQ ID NO: 6586671 - DNA, 20 bp, Homo sapiens
ttgttaatgcctataacttt

SEQ ID NO: 6586672 - DNA, 22 bp, Homo sapiens
ttgttaatgctctatgtttgta

SEQ ID NO: 6586673 - DNA, 13 bp, Homo sapiens
ttgttaatgcttt

SEQ ID NO: 6586674 - DNA, 19 bp, Homo sapiens
ttgttaatggtttgaatat

SEQ ID NO: 6586675 - DNA, 13 bp, Homo sapiens
ttgttaatgtcat

SEQ ID NO: 6586676 - DNA, 16 bp, Homo sapiens
ttgttaatgtcattgc

SEQ ID NO: 6586677 - DNA, 19 bp, Homo sapiens
ttgttaatgtcattgctaa

SEQ ID NO: 6586678 - DNA, 15 bp, Homo sapiens
ttgttaattaaatat

SEQ ID NO: 6586679 - DNA, 15 bp, Homo sapiens
ttgttaattcttatt

SEQ ID NO: 6586680 - DNA, 20 bp, Homo sapiens
ttgttaatttagaaaacttt

SEQ ID NO: 6586681 - DNA, 13 bp, Homo sapiens
ttgttaatttctt

SEQ ID NO: 6586682 - DNA, 14 bp, Homo sapiens
ttgttaatttcttg

SEQ ID NO: 6586683 - DNA, 16 bp, Homo sapiens
ttgttacaagtgttct

SEQ ID NO: 6586684 - DNA, 19 bp, Homo sapiens
ttgttacaagtgttcttag

SEQ ID NO: 6586685 - DNA, 17 bp, Homo sapiens
ttgttacaattctagga

SEQ ID NO: 6586686 - DNA, 13 bp, Homo sapiens
ttgttacaatttt

SEQ ID NO: 6586687 - DNA, 17 bp, Homo sapiens
ttgttacagctactata

SEQ ID NO: 6586688 - DNA, 15 bp, Homo sapiens
ttgttacaggaagtc

SEQ ID NO: 6586689 - DNA, 17 bp, Homo sapiens
ttgttaccacagagttt

SEQ ID NO: 6586690 - DNA, 18 bp, Homo sapiens
ttgttacccatgaaaaac

SEQ ID NO: 6586691 - DNA, 15 bp, Homo sapiens
ttgttacctacctta

SEQ ID NO: 6586692 - DNA, 21 bp, Homo sapiens
ttgttacctccaacagaacta

SEQ ID NO: 6586693 - DNA, 21 bp, Homo sapiens
ttgttacctgtcattttgcac

SEQ ID NO: 6586694 - DNA, 23 bp, Homo sapiens
ttgttacctgtcattttgcactg

SEQ ID NO: 6586695 - DNA, 16 bp, Homo sapiens
ttgttacctttcccat

SEQ ID NO: 6586696 - DNA, 16 bp, Homo sapiens
ttgttacgtagcctaa

SEQ ID NO: 6586697 - DNA, 17 bp, Homo sapiens
ttgttactaactaaact

SEQ ID NO: 6586698 - DNA, 18 bp, Homo sapiens
ttgttactaactaaactc

SEQ ID NO: 6586699 - DNA, 15 bp, Homo sapiens
ttgttactcttacga

SEQ ID NO: 6586700 - DNA, 19 bp, Homo sapiens
ttgttactcttacgaatat

SEQ ID NO: 6586701 - DNA, 15 bp, Homo sapiens
ttgttactgaagtta

SEQ ID NO: 6586702 - DNA, 21 bp, Homo sapiens
ttgttactgtctgtagtgttt

SEQ ID NO: 6586703 - DNA, 11 bp, Homo sapiens
ttgttactgtt

SEQ ID NO: 6586704 - DNA, 16 bp, Homo sapiens
ttgttactgttcttgc

SEQ ID NO: 6586705 - DNA, 19 bp, Homo sapiens
ttgttactgttcttgctgc

SEQ ID NO: 6586706 - DNA, 16 bp, Homo sapiens
ttgttacttctctaat

SEQ ID NO: 6586707 - DNA, 14 bp, Homo sapiens
ttgttacttctgag

SEQ ID NO: 6586708 - DNA, 22 bp, Homo sapiens
ttgttactttgaatagtcctaa

SEQ ID NO: 6586709 - DNA, 16 bp, Homo sapiens
ttgttagaaaaatgga

SEQ ID NO: 6586710 - DNA, 17 bp, Homo sapiens
ttgttagatctagttca

SEQ ID NO: 6586711 - DNA, 12 bp, Homo sapiens
ttgttagatgtt

SEQ ID NO: 6586712 - DNA, 21 bp, Homo sapiens
ttgttagcaaactatttcagt

SEQ ID NO: 6586713 - DNA, 16 bp, Homo sapiens
ttgttagcccttcaga

SEQ ID NO: 6586714 - DNA, 16 bp, Homo sapiens
aatcaaacattttctg

SEQ ID NO: 6586715 - DNA, 17 bp, Homo sapiens
aatcaaacattttctgg

SEQ ID NO: 6586716 - DNA, 16 bp, Homo sapiens
aatcaaaccaaagagt

SEQ ID NO: 6586717 - DNA, 17 bp, Homo sapiens
aatcaaaccaaagagta

SEQ ID NO: 6586718 - DNA, 16 bp, Homo sapiens
aatcaaacctttttat

SEQ ID NO: 6586719 - DNA, 11 bp, Homo sapiens
aatcaaagaaa

SEQ ID NO: 6586720 - DNA, 17 bp, Homo sapiens
aatcaaagaaaagactt

SEQ ID NO: 6586721 - DNA, 16 bp, Homo sapiens
aatcaaagaattacag

SEQ ID NO: 6586722 - DNA, 17 bp, Homo sapiens
aatcaaagaattacagt

SEQ ID NO: 6586723 - DNA, 14 bp, Homo sapiens
aatcaaagacattt

SEQ ID NO: 6586724 - DNA, 18 bp, Homo sapiens
aatcaaagacatttcatc

SEQ ID NO: 6586725 - DNA, 21 bp, Homo sapiens
aatcaaagccggcctgagaaa

SEQ ID NO: 6586726 - DNA, 13 bp, Homo sapiens
aatcaaagctacc

SEQ ID NO: 6586727 - DNA, 22 bp, Homo sapiens
aatcaaagtgattttagcaatt

SEQ ID NO: 6586728 - DNA, 18 bp, Homo sapiens
aatcaaagtgtctagaca

SEQ ID NO: 6586729 - DNA, 16 bp, Homo sapiens
aatcaaataatacctt

SEQ ID NO: 6586730 - DNA, 21 bp, Homo sapiens
aatcaaataataccttagaag

SEQ ID NO: 6586731 - DNA, 16 bp, Homo sapiens
aatcaaatctgtgctc

SEQ ID NO: 6586732 - DNA, 14 bp, Homo sapiens
aatcaaatcttaca

SEQ ID NO: 6586733 - DNA, 21 bp, Homo sapiens
aatcaaatcttacaaaatcct

SEQ ID NO: 6586734 - DNA, 14 bp, Homo sapiens
aatcaaatgaatga

SEQ ID NO: 6586735 - DNA, 12 bp, Homo sapiens
aatcaaatgatt

SEQ ID NO: 6586736 - DNA, 16 bp, Homo sapiens
aatcaaatgatttcat

SEQ ID NO: 6586737 - DNA, 20 bp, Homo sapiens
aatcaaatgatttcatattg

SEQ ID NO: 6586738 - DNA, 15 bp, Homo sapiens
aatcaaatgtatgta

SEQ ID NO: 6586739 - DNA, 18 bp, Homo sapiens
aatcaaattgcttaaaaa

SEQ ID NO: 6586740 - DNA, 19 bp, Homo sapiens
aatcaaatttgtagggttt

SEQ ID NO: 6586741 - DNA, 22 bp, Homo sapiens
aatcaaatttgtagggtttcta

SEQ ID NO: 6586742 - DNA, 12 bp, Homo sapiens
aatcaacagaag

SEQ ID NO: 6586743 - DNA, 15 bp, Homo sapiens
aatcaacagaagcat

SEQ ID NO: 6586744 - DNA, 13 bp, Homo sapiens
aatcaacagatga

SEQ ID NO: 6586745 - DNA, 16 bp, Homo sapiens
aatcaacatgactggt

SEQ ID NO: 6586746 - DNA, 21 bp, Homo sapiens
aatcaacatggctacttgctt

SEQ ID NO: 6586747 - DNA, 13 bp, Homo sapiens
aatcaaccaaagt

SEQ ID NO: 6586748 - DNA, 20 bp, Homo sapiens
aatcaaccaaagttagttca

SEQ ID NO: 6586749 - DNA, 22 bp, Homo sapiens
aatcaaccaaagttagttcagt

SEQ ID NO: 6586750 - DNA, 20 bp, Homo sapiens
aatcaaccacctatttttga

SEQ ID NO: 6586751 - DNA, 21 bp, Homo sapiens
aatcaaccctctcctgtctgc

SEQ ID NO: 6586752 - DNA, 17 bp, Homo sapiens
aatcaaccctgcaatca

SEQ ID NO: 6586753 - DNA, 15 bp, Homo sapiens
aatcaacctatcaaa

SEQ ID NO: 6586754 - DNA, 14 bp, Homo sapiens
aatcaactctcttc

SEQ ID NO: 6586755 - DNA, 22 bp, Homo sapiens
aatcaactggagtctatgctta

SEQ ID NO: 6586756 - DNA, 17 bp, Homo sapiens
aatcaacttgcttatca

SEQ ID NO: 6586757 - DNA, 20 bp, Homo sapiens
aatcaactttatcatatgct

SEQ ID NO: 6586758 - DNA, 19 bp, Homo sapiens
aatcaactttttattgcct

SEQ ID NO: 6586759 - DNA, 20 bp, Homo sapiens
aatcaactttttattgcctt

SEQ ID NO: 6586760 - DNA, 21 bp, Homo sapiens
aatcaactttttattgccttc

SEQ ID NO: 6586761 - DNA, 22 bp, Homo sapiens
aatcaactttttattgccttct

SEQ ID NO: 6586762 - DNA, 23 bp, Homo sapiens
aatcaactttttattgccttctc

SEQ ID NO: 6586763 - DNA, 15 bp, Homo sapiens
aatcaagaaacttaa

SEQ ID NO: 6586764 - DNA, 20 bp, Homo sapiens
aatcaagaatattcaaatgt

SEQ ID NO: 6586765 - DNA, 14 bp, Homo sapiens
aatcaagaatcatt

SEQ ID NO: 6586766 - DNA, 21 bp, Homo sapiens
aatcaagacactagttcagag

SEQ ID NO: 6586767 - DNA, 10 bp, Homo sapiens
aatcaagaga

SEQ ID NO: 6586768 - DNA, 17 bp, Homo sapiens
aatcaagagccttaaaa

SEQ ID NO: 6586769 - DNA, 21 bp, Homo sapiens
aatcaagagccttaaaacatc

SEQ ID NO: 6586770 - DNA, 14 bp, Homo sapiens
aatcaagagctgcc

SEQ ID NO: 6586771 - DNA, 16 bp, Homo sapiens
aatcaagatgagatat

SEQ ID NO: 6586772 - DNA, 20 bp, Homo sapiens
aatcaagatttaatcctaga

SEQ ID NO: 6586773 - DNA, 19 bp, Homo sapiens
aatcaagatttttttcctg

SEQ ID NO: 6586774 - DNA, 20 bp, Homo sapiens
aatcaagatttttttcctga

SEQ ID NO: 6586775 - DNA, 16 bp, Homo sapiens
aatcaagcagttattt

SEQ ID NO: 6586776 - DNA, 22 bp, Homo sapiens
aatcaagccatgtataaatgtg

SEQ ID NO: 6586777 - DNA, 15 bp, Homo sapiens
aatcaagcttcagtt

SEQ ID NO: 6586778 - DNA, 18 bp, Homo sapiens
aatcaaggaaaggctcat

SEQ ID NO: 6586779 - DNA, 22 bp, Homo sapiens
aatcaaggaaaggctcatttaa

SEQ ID NO: 6586780 - DNA, 15 bp, Homo sapiens
aatcaaggataaata

SEQ ID NO: 6586781 - DNA, 15 bp, Homo sapiens
aatcaagggtcaggc

SEQ ID NO: 6586782 - DNA, 17 bp, Homo sapiens
aatcaaggttataattt

SEQ ID NO: 6586783 - DNA, 14 bp, Homo sapiens
aatcaagtaatgaa

SEQ ID NO: 6586784 - DNA, 13 bp, Homo sapiens
aatcaagtattta

SEQ ID NO: 6586785 - DNA, 14 bp, Homo sapiens
aatcaagtattttg

SEQ ID NO: 6586786 - DNA, 15 bp, Homo sapiens
aatcaagtctgttta

SEQ ID NO: 6586787 - DNA, 21 bp, Homo sapiens
aatcaagtctgtttactgcaa

SEQ ID NO: 6586788 - DNA, 21 bp, Homo sapiens
aatcaagtgcatttctgggcc

SEQ ID NO: 6586789 - DNA, 15 bp, Homo sapiens
aatcaagttgtaact

SEQ ID NO: 6586790 - DNA, 19 bp, Homo sapiens
aatcaataaaaaacaaata

SEQ ID NO: 6586791 - DNA, 13 bp, Homo sapiens
aatcaataaaaat

SEQ ID NO: 6586792 - DNA, 16 bp, Homo sapiens
aatcaataaacgattt

SEQ ID NO: 6586793 - DNA, 14 bp, Homo sapiens
aatcaatacactag

SEQ ID NO: 6586794 - DNA, 18 bp, Homo sapiens
aatcaatacactagttgt

SEQ ID NO: 6586795 - DNA, 12 bp, Homo sapiens
aatcaatacttt

SEQ ID NO: 6586796 - DNA, 15 bp, Homo sapiens
aatcaatactttgaa

SEQ ID NO: 6586797 - DNA, 15 bp, Homo sapiens
aatcaatatcccaac

SEQ ID NO: 6586798 - DNA, 13 bp, Homo sapiens
aatcaatcaatgg

SEQ ID NO: 6586799 - DNA, 22 bp, Homo sapiens
aatcaatcacttgaaagtgaac

SEQ ID NO: 6586800 - DNA, 15 bp, Homo sapiens
aatcaatctggcttc

SEQ ID NO: 6586801 - DNA, 16 bp, Homo sapiens
aatcaatctggcttct

SEQ ID NO: 6586802 - DNA, 21 bp, Homo sapiens
aatcaatctggcttctgcatt

SEQ ID NO: 6586803 - DNA, 20 bp, Homo sapiens
aatcaatcttgcatgtaacg

SEQ ID NO: 6586804 - DNA, 19 bp, Homo sapiens
aatcaatgaaaaatgtaat

SEQ ID NO: 6586805 - DNA, 13 bp, Homo sapiens
aatcaatgaatat

SEQ ID NO: 6586806 - DNA, 12 bp, Homo sapiens
aatcaatgcttt

SEQ ID NO: 6586807 - DNA, 13 bp, Homo sapiens
aatcaatggtgca

SEQ ID NO: 6586808 - DNA, 15 bp, Homo sapiens
aatcaatggtgcaaa

SEQ ID NO: 6586809 - DNA, 16 bp, Homo sapiens
aatcaatggtgcaaaa

SEQ ID NO: 6586810 - DNA, 18 bp, Homo sapiens
aatcaatggtgcaaaaaa

SEQ ID NO: 6586811 - DNA, 19 bp, Homo sapiens
aatcaatgtgacatgttgc

SEQ ID NO: 6586812 - DNA, 20 bp, Homo sapiens
aatcaattactggtccaaaa

SEQ ID NO: 6586813 - DNA, 12 bp, Homo sapiens
aatcaattattt

SEQ ID NO: 6586814 - DNA, 12 bp, Homo sapiens
aatcaatttaaa

SEQ ID NO: 6586815 - DNA, 18 bp, Homo sapiens
aatcaatttaaacccatt

SEQ ID NO: 6586816 - DNA, 17 bp, Homo sapiens
aatcaatttaaatgttt

SEQ ID NO: 6586817 - DNA, 19 bp, Homo sapiens
aatcaatttaaatgtttac

SEQ ID NO: 6586818 - DNA, 17 bp, Homo sapiens
aatcaatttcccagaag

SEQ ID NO: 6586819 - DNA, 16 bp, Homo sapiens
aatcaatttttaggaa

SEQ ID NO: 6586820 - DNA, 14 bp, Homo sapiens
aatcaattttttaa

SEQ ID NO: 6586821 - DNA, 14 bp, Homo sapiens
aatcacaaaaacaa

SEQ ID NO: 6586822 - DNA, 15 bp, Homo sapiens
aatcacaaaaacaaa

SEQ ID NO: 6586823 - DNA, 22 bp, Homo sapiens
aatcacaaaaacaaaaaaacta

SEQ ID NO: 6586824 - DNA, 13 bp, Homo sapiens
aatcacaaaagct

SEQ ID NO: 6586825 - DNA, 22 bp, Homo sapiens
aatcacaaaagctgtgtctctg

SEQ ID NO: 6586826 - DNA, 16 bp, Homo sapiens
aatcacaaacatatgt

SEQ ID NO: 6586827 - DNA, 21 bp, Homo sapiens
aatcacaaacatatgtatctt

SEQ ID NO: 6586828 - DNA, 18 bp, Homo sapiens
aatcacaaactgaatgac

SEQ ID NO: 6586829 - DNA, 22 bp, Homo sapiens
aatcacaaaggctgacattcac

SEQ ID NO: 6586830 - DNA, 14 bp, Homo sapiens
aatcacaactcagc

SEQ ID NO: 6586831 - DNA, 14 bp, Homo sapiens
aatcacaagcaata

SEQ ID NO: 6586832 - DNA, 17 bp, Homo sapiens
aatcacaattttcctgt

SEQ ID NO: 6586833 - DNA, 15 bp, Homo sapiens
aatcacaatttttaa

SEQ ID NO: 6586834 - DNA, 17 bp, Homo sapiens
aatcacactcaaacttt

SEQ ID NO: 6586835 - DNA, 14 bp, Homo sapiens
aatcacactgcggt

SEQ ID NO: 6586836 - DNA, 18 bp, Homo sapiens
aatcacagatgcatatag

SEQ ID NO: 6586837 - DNA, 16 bp, Homo sapiens
aatcacagatttccaa

SEQ ID NO: 6586838 - DNA, 23 bp, Homo sapiens
aatcacagattttttctttaaat

SEQ ID NO: 6586839 - DNA, 11 bp, Homo sapiens
aatcacagcca

SEQ ID NO: 6586840 - DNA, 13 bp, Homo sapiens
aatcacagggaat

SEQ ID NO: 6586841 - DNA, 17 bp, Homo sapiens
aatcacagggcatttaa

SEQ ID NO: 6586842 - DNA, 16 bp, Homo sapiens
aatcacagtgttatgt

SEQ ID NO: 6586843 - DNA, 15 bp, Homo sapiens
aatcacagttggcct

SEQ ID NO: 6586844 - DNA, 19 bp, Homo sapiens
aatcacattaacattttga

SEQ ID NO: 6586845 - DNA, 20 bp, Homo sapiens
aatcacattaacattttgag

SEQ ID NO: 6586846 - DNA, 18 bp, Homo sapiens
aatcaccaattaaaaacc

SEQ ID NO: 6586847 - DNA, 17 bp, Homo sapiens
aatcacccagttgtgct

SEQ ID NO: 6586848 - DNA, 13 bp, Homo sapiens
aatcacccctctg

SEQ ID NO: 6586849 - DNA, 16 bp, Homo sapiens
aatcacccctctgccc

SEQ ID NO: 6586850 - DNA, 21 bp, Homo sapiens
aatcacccctctgcccctgca

SEQ ID NO: 6586851 - DNA, 14 bp, Homo sapiens
aatcaccgaaaacg

SEQ ID NO: 6586852 - DNA, 23 bp, Homo sapiens
aatcaccgaaaacgtggctgctt

SEQ ID NO: 6586853 - DNA, 20 bp, Homo sapiens
aatcacctgaaccccagagg

SEQ ID NO: 6586854 - DNA, 16 bp, Homo sapiens
aatcacctggagggct

SEQ ID NO: 6586855 - DNA, 14 bp, Homo sapiens
aatcacctggtatt

SEQ ID NO: 6586856 - DNA, 16 bp, Homo sapiens
aatcacgctttcctga

SEQ ID NO: 6586857 - DNA, 18 bp, Homo sapiens
aatcacggcttttggtga

SEQ ID NO: 6586858 - DNA, 20 bp, Homo sapiens
aatcacggtggtaaagaaag

SEQ ID NO: 6586859 - DNA, 15 bp, Homo sapiens
aatcacgtaaagcta

SEQ ID NO: 6586860 - DNA, 17 bp, Homo sapiens
aatcactaaactttatt

SEQ ID NO: 6586861 - DNA, 15 bp, Homo sapiens
aatcactaacattat

SEQ ID NO: 6586862 - DNA, 14 bp, Homo sapiens
aatcactactgtat

SEQ ID NO: 6586863 - DNA, 13 bp, Homo sapiens
aatcactatatct

SEQ ID NO: 6586864 - DNA, 13 bp, Homo sapiens
aatcactattctt

SEQ ID NO: 6586865 - DNA, 17 bp, Homo sapiens
aatcactattgaaaaat

SEQ ID NO: 6586866 - DNA, 12 bp, Homo sapiens
aatcactcagag

SEQ ID NO: 6586867 - DNA, 15 bp, Homo sapiens
aatcactcatttatt

SEQ ID NO: 6586868 - DNA, 21 bp, Homo sapiens
aatcactcccatttttactta

SEQ ID NO: 6586869 - DNA, 16 bp, Homo sapiens
aatcactctgcaatgg

SEQ ID NO: 6586870 - DNA, 18 bp, Homo sapiens
aatcactctgtccttgga

SEQ ID NO: 6586871 - DNA, 16 bp, Homo sapiens
aatcactcttgtggat

SEQ ID NO: 6586872 - DNA, 18 bp, Homo sapiens
aatcactcttgtggatgt

SEQ ID NO: 6586873 - DNA, 13 bp, Homo sapiens
aatcactgaaaat

SEQ ID NO: 6586874 - DNA, 19 bp, Homo sapiens
aatcactgaggcattttta

SEQ ID NO: 6586875 - DNA, 15 bp, Homo sapiens
aatcactgagtttgt

SEQ ID NO: 6586876 - DNA, 21 bp, Homo sapiens
aatcactgcactgcatgcaaa

SEQ ID NO: 6586877 - DNA, 15 bp, Homo sapiens
aatcactgcagccca

SEQ ID NO: 6586878 - DNA, 16 bp, Homo sapiens
aatcactgcagcccag

SEQ ID NO: 6586879 - DNA, 20 bp, Homo sapiens
aatcactgcagcccaggagg

SEQ ID NO: 6586880 - DNA, 13 bp, Homo sapiens
aatcactgctccc

SEQ ID NO: 6586881 - DNA, 20 bp, Homo sapiens
aatcactgggcccagaggag

SEQ ID NO: 6586882 - DNA, 20 bp, Homo sapiens
aatcactggggatggtggca

SEQ ID NO: 6586883 - DNA, 17 bp, Homo sapiens
aatcactgtaacctgat

SEQ ID NO: 6586884 - DNA, 20 bp, Homo sapiens
aatcactgtaacctgattca

SEQ ID NO: 6586885 - DNA, 23 bp, Homo sapiens
aatcactgtattttcattttaat

SEQ ID NO: 6586886 - DNA, 14 bp, Homo sapiens
aatcactgtcaata

SEQ ID NO: 6586887 - DNA, 17 bp, Homo sapiens
aatcactgtgctcagcc

SEQ ID NO: 6586888 - DNA, 14 bp, Homo sapiens
aatcactgtgctta

SEQ ID NO: 6586889 - DNA, 22 bp, Homo sapiens
aatcactgtgcttaatttaaat

SEQ ID NO: 6586890 - DNA, 21 bp, Homo sapiens
aatcactgtttagaacacaca

SEQ ID NO: 6586891 - DNA, 16 bp, Homo sapiens
aatcacttcagatctc

SEQ ID NO: 6586892 - DNA, 18 bp, Homo sapiens
aatcacttgattcataaa

SEQ ID NO: 6586893 - DNA, 21 bp, Homo sapiens
aatcacttgattcataaagat

SEQ ID NO: 6586894 - DNA, 12 bp, Homo sapiens
aatcacttgggg

SEQ ID NO: 6586895 - DNA, 21 bp, Homo sapiens
ttgttagcccttcagattgtt

SEQ ID NO: 6586896 - DNA, 23 bp, Homo sapiens
ttgttaggatagatcttaagcag

SEQ ID NO: 6586897 - DNA, 17 bp, Homo sapiens
ttgttaggggtggggga

SEQ ID NO: 6586898 - DNA, 20 bp, Homo sapiens
ttgttagtgtgtcttagtgt

SEQ ID NO: 6586899 - DNA, 22 bp, Homo sapiens
ttgttagtttagtgtgtgtgca

SEQ ID NO: 6586900 - DNA, 14 bp, Homo sapiens
ttgttagttttaag

SEQ ID NO: 6586901 - DNA, 18 bp, Homo sapiens
ttgttataaaataacatg

SEQ ID NO: 6586902 - DNA, 14 bp, Homo sapiens
ttgttataaagaca

SEQ ID NO: 6586903 - DNA, 14 bp, Homo sapiens
ttgttataaataaa

SEQ ID NO: 6586904 - DNA, 14 bp, Homo sapiens
ttgttataattaga

SEQ ID NO: 6586905 - DNA, 20 bp, Homo sapiens
ttgttatacatttaaagatt

SEQ ID NO: 6586906 - DNA, 15 bp, Homo sapiens
ttgttatacttcaaa

SEQ ID NO: 6586907 - DNA, 22 bp, Homo sapiens
ttgttatatataataaatactc

SEQ ID NO: 6586908 - DNA, 17 bp, Homo sapiens
ttgttatatatatcaag

SEQ ID NO: 6586909 - DNA, 18 bp, Homo sapiens
ttgttatatcagcagaca

SEQ ID NO: 6586910 - DNA, 12 bp, Homo sapiens
ttgttatcaaaa

SEQ ID NO: 6586911 - DNA, 22 bp, Homo sapiens
ttgttatcagtcaatattttta

SEQ ID NO: 6586912 - DNA, 13 bp, Homo sapiens
ttgttatgatcta

SEQ ID NO: 6586913 - DNA, 13 bp, Homo sapiens
ttgttatgatgtg

SEQ ID NO: 6586914 - DNA, 15 bp, Homo sapiens
ttgttatgatgtgct

SEQ ID NO: 6586915 - DNA, 12 bp, Homo sapiens
ttgttatgctat

SEQ ID NO: 6586916 - DNA, 18 bp, Homo sapiens
ttgttatgtagataacaa

SEQ ID NO: 6586917 - DNA, 22 bp, Homo sapiens
ttgttatgtatatagatgtgca

SEQ ID NO: 6586918 - DNA, 23 bp, Homo sapiens
ttgttatgtctagaaagtaagaa

SEQ ID NO: 6586919 - DNA, 17 bp, Homo sapiens
ttgttatgtgtctggaa

SEQ ID NO: 6586920 - DNA, 14 bp, Homo sapiens
ttgttatgttcaat

SEQ ID NO: 6586921 - DNA, 17 bp, Homo sapiens
ttgttattaaaaaaaca

SEQ ID NO: 6586922 - DNA, 15 bp, Homo sapiens
ttgttattaaacaaa

SEQ ID NO: 6586923 - DNA, 13 bp, Homo sapiens
ttgttattaaatg

SEQ ID NO: 6586924 - DNA, 18 bp, Homo sapiens
ttgttattaatgtttctt

SEQ ID NO: 6586925 - DNA, 16 bp, Homo sapiens
ttgttattataacata

SEQ ID NO: 6586926 - DNA, 15 bp, Homo sapiens
ttgttattccatcaa

SEQ ID NO: 6586927 - DNA, 14 bp, Homo sapiens
ttgttatttgcact

SEQ ID NO: 6586928 - DNA, 13 bp, Homo sapiens
ttgttattttcag

SEQ ID NO: 6586929 - DNA, 12 bp, Homo sapiens
ttgttcaaaaat

SEQ ID NO: 6586930 - DNA, 14 bp, Homo sapiens
ttgttcaaacaata

SEQ ID NO: 6586931 - DNA, 20 bp, Homo sapiens
ttgttcaaagaacccccctc

SEQ ID NO: 6586932 - DNA, 21 bp, Homo sapiens
ttgttcaaagaacccccctcc

SEQ ID NO: 6586933 - DNA, 22 bp, Homo sapiens
ttgttcaaagaacccccctccc

SEQ ID NO: 6586934 - DNA, 19 bp, Homo sapiens
ttgttcaacagtttctcaa

SEQ ID NO: 6586935 - DNA, 11 bp, Homo sapiens
ttgttcaactc

SEQ ID NO: 6586936 - DNA, 15 bp, Homo sapiens
ttgttcaatgttcca

SEQ ID NO: 6586937 - DNA, 16 bp, Homo sapiens
ttgttcaatgttccat

SEQ ID NO: 6586938 - DNA, 19 bp, Homo sapiens
ttgttcacacaaagcctgt

SEQ ID NO: 6586939 - DNA, 13 bp, Homo sapiens
ttgttcacactcc

SEQ ID NO: 6586940 - DNA, 13 bp, Homo sapiens
ttgttcacactct

SEQ ID NO: 6586941 - DNA, 22 bp, Homo sapiens
ttgttcacatatgattctctta

SEQ ID NO: 6586942 - DNA, 14 bp, Homo sapiens
ttgttcacttaaat

SEQ ID NO: 6586943 - DNA, 15 bp, Homo sapiens
ttgttcagcatgcaa

SEQ ID NO: 6586944 - DNA, 16 bp, Homo sapiens
ttgttcagcatgcaat

SEQ ID NO: 6586945 - DNA, 16 bp, Homo sapiens
ttgttcagctccccca

SEQ ID NO: 6586946 - DNA, 17 bp, Homo sapiens
ttgttcagctcccccag

SEQ ID NO: 6586947 - DNA, 15 bp, Homo sapiens
ttgttcatagcccag

SEQ ID NO: 6586948 - DNA, 12 bp, Homo sapiens
ttgttcatatca

SEQ ID NO: 6586949 - DNA, 19 bp, Homo sapiens
ttgttcatattaagaatga

SEQ ID NO: 6586950 - DNA, 16 bp, Homo sapiens
ttgttcatcatccaga

SEQ ID NO: 6586951 - DNA, 12 bp, Homo sapiens
ttgttcatgttt

SEQ ID NO: 6586952 - DNA, 11 bp, Homo sapiens
ttgttcattta

SEQ ID NO: 6586953 - DNA, 13 bp, Homo sapiens
ttgttcattttga

SEQ ID NO: 6586954 - DNA, 21 bp, Homo sapiens
ttgttccaaatactaatgaaa

SEQ ID NO: 6586955 - DNA, 17 bp, Homo sapiens
ttgttccaagacattgt

SEQ ID NO: 6586956 - DNA, 22 bp, Homo sapiens
ttgttccaagacattgtcaata

SEQ ID NO: 6586957 - DNA, 20 bp, Homo sapiens
ttgttccacccgacctctga

SEQ ID NO: 6586958 - DNA, 21 bp, Homo sapiens
ttgttccactggaaacttaga

SEQ ID NO: 6586959 - DNA, 18 bp, Homo sapiens
ttgttccacttgtttgca

SEQ ID NO: 6586960 - DNA, 20 bp, Homo sapiens
ttgttccacttgtttgcact

SEQ ID NO: 6586961 - DNA, 23 bp, Homo sapiens
ttgttccacttgtttgcactgtg

SEQ ID NO: 6586962 - DNA, 12 bp, Homo sapiens
ttgttccagaga

SEQ ID NO: 6586963 - DNA, 13 bp, Homo sapiens
ttgttccagagct

SEQ ID NO: 6586964 - DNA, 12 bp, Homo sapiens
ttgttccagctc

SEQ ID NO: 6586965 - DNA, 14 bp, Homo sapiens
ttgttccaggctca

SEQ ID NO: 6586966 - DNA, 17 bp, Homo sapiens
ttgttccccactggagc

SEQ ID NO: 6586967 - DNA, 18 bp, Homo sapiens
ttgttccccactggagca

SEQ ID NO: 6586968 - DNA, 16 bp, Homo sapiens
ttgttcccctcctcca

SEQ ID NO: 6586969 - DNA, 18 bp, Homo sapiens
ttgttcccctcctccact

SEQ ID NO: 6586970 - DNA, 23 bp, Homo sapiens
ttgttcccctcctccactctccc

SEQ ID NO: 6586971 - DNA, 16 bp, Homo sapiens
ttgttccctcattctg

SEQ ID NO: 6586972 - DNA, 21 bp, Homo sapiens
ttgttccctcattctgcatta

SEQ ID NO: 6586973 - DNA, 22 bp, Homo sapiens
ttgttccctgtgtcatttcaaa

SEQ ID NO: 6586974 - DNA, 23 bp, Homo sapiens
ttgttcccttcctcttcctgccc

SEQ ID NO: 6586975 - DNA, 12 bp, Homo sapiens
ttgttcctcagc

SEQ ID NO: 6586976 - DNA, 13 bp, Homo sapiens
ttgttcctgaaat

SEQ ID NO: 6586977 - DNA, 23 bp, Homo sapiens
ttgttccttggagaaatgaaaac

SEQ ID NO: 6586978 - DNA, 14 bp, Homo sapiens
ttgttccttttgta

SEQ ID NO: 6586979 - DNA, 16 bp, Homo sapiens
ttgttcgggtgtgcaa

SEQ ID NO: 6586980 - DNA, 11 bp, Homo sapiens
ttgttctagaa

SEQ ID NO: 6586981 - DNA, 15 bp, Homo sapiens
ttgttctagtactgt

SEQ ID NO: 6586982 - DNA, 17 bp, Homo sapiens
ttgttctctctatggta

SEQ ID NO: 6586983 - DNA, 20 bp, Homo sapiens
ttgttctctgaattttcaga

SEQ ID NO: 6586984 - DNA, 14 bp, Homo sapiens
ttgttctctggaac

SEQ ID NO: 6586985 - DNA, 13 bp, Homo sapiens
ttgttctctggga

SEQ ID NO: 6586986 - DNA, 20 bp, Homo sapiens
ttgttctctgggagaaaatc

SEQ ID NO: 6586987 - DNA, 21 bp, Homo sapiens
ttgttctctgggagaaaatca

SEQ ID NO: 6586988 - DNA, 21 bp, Homo sapiens
ttgttctgaaatgtcagttct

SEQ ID NO: 6586989 - DNA, 22 bp, Homo sapiens
ttgttctgactttttgtttctt

SEQ ID NO: 6586990 - DNA, 18 bp, Homo sapiens
ttgttctgggtgatttct

SEQ ID NO: 6586991 - DNA, 23 bp, Homo sapiens
ttgttctgtattcgaaatgagct

SEQ ID NO: 6586992 - DNA, 15 bp, Homo sapiens
ttgttctgtattttc

SEQ ID NO: 6586993 - DNA, 12 bp, Homo sapiens
ttgttctgtccc

SEQ ID NO: 6586994 - DNA, 12 bp, Homo sapiens
ttgttctgtgca

SEQ ID NO: 6586995 - DNA, 17 bp, Homo sapiens
ttgttctgttaactgaa

SEQ ID NO: 6586996 - DNA, 18 bp, Homo sapiens
ttgttctgttaactgaat

SEQ ID NO: 6586997 - DNA, 18 bp, Homo sapiens
ttgttctgttgtctgcgc

SEQ ID NO: 6586998 - DNA, 21 bp, Homo sapiens
ttgttctgttgtctgcgcctg

SEQ ID NO: 6586999 - DNA, 17 bp, Homo sapiens
ttgttcttaaaaatgca

SEQ ID NO: 6587000 - DNA, 17 bp, Homo sapiens
ttgttcttcaatgtgaa

SEQ ID NO: 6587001 - DNA, 12 bp, Homo sapiens
ttgttcttcaga

SEQ ID NO: 6587002 - DNA, 19 bp, Homo sapiens
ttgttcttggtttgtaaat

SEQ ID NO: 6587003 - DNA, 20 bp, Homo sapiens
ttgttcttgtaaaactgtga

SEQ ID NO: 6587004 - DNA, 14 bp, Homo sapiens
ttgttcttgtattt

SEQ ID NO: 6587005 - DNA, 15 bp, Homo sapiens
ttgttctttcagaaa

SEQ ID NO: 6587006 - DNA, 15 bp, Homo sapiens
ttgttctttgttctt

SEQ ID NO: 6587007 - DNA, 14 bp, Homo sapiens
ttgttctttgtttc

SEQ ID NO: 6587008 - DNA, 15 bp, Homo sapiens
ttgttcttttataga

SEQ ID NO: 6587009 - DNA, 13 bp, Homo sapiens
ttgttctttttat

SEQ ID NO: 6587010 - DNA, 14 bp, Homo sapiens
ttgttctttttcct

SEQ ID NO: 6587011 - DNA, 22 bp, Homo sapiens
ttgttgaaaaagtttgtttttg

SEQ ID NO: 6587012 - DNA, 14 bp, Homo sapiens
ttgttgaaaaatgt

SEQ ID NO: 6587013 - DNA, 14 bp, Homo sapiens
ttgttgaagtttga

SEQ ID NO: 6587014 - DNA, 13 bp, Homo sapiens
ttgttgaataaat

SEQ ID NO: 6587015 - DNA, 21 bp, Homo sapiens
ttgttgaatgtattcttttat

SEQ ID NO: 6587016 - DNA, 15 bp, Homo sapiens
ttgttgacagcaaaa

SEQ ID NO: 6587017 - DNA, 17 bp, Homo sapiens
ttgttgacagcaaaatg

SEQ ID NO: 6587018 - DNA, 21 bp, Homo sapiens
ttgttgacagttctgaagaat

SEQ ID NO: 6587019 - DNA, 12 bp, Homo sapiens
ttgttgacatta

SEQ ID NO: 6587020 - DNA, 16 bp, Homo sapiens
ttgttgacattctgaa

SEQ ID NO: 6587021 - DNA, 20 bp, Homo sapiens
ttgttgacattctgaatgct

SEQ ID NO: 6587022 - DNA, 18 bp, Homo sapiens
ttgttgaccattttgtta

SEQ ID NO: 6587023 - DNA, 21 bp, Homo sapiens
ttgttgacccttttttgaacc

SEQ ID NO: 6587024 - DNA, 24 bp, Homo sapiens
ttgttgactgtgattagatcacat

SEQ ID NO: 6587025 - DNA, 17 bp, Homo sapiens
ttgttgacttattttct

SEQ ID NO: 6587026 - DNA, 20 bp, Homo sapiens
ttgttgagaattagatccca

SEQ ID NO: 6587027 - DNA, 19 bp, Homo sapiens
ttgttgagggtatgtttta

SEQ ID NO: 6587028 - DNA, 14 bp, Homo sapiens
ttgttgaggtggtc

SEQ ID NO: 6587029 - DNA, 17 bp, Homo sapiens
ttgttgaggttaagttt

SEQ ID NO: 6587030 - DNA, 16 bp, Homo sapiens
ttgttgagtctctgaa

SEQ ID NO: 6587031 - DNA, 21 bp, Homo sapiens
ttgttgataaattccactgga

SEQ ID NO: 6587032 - DNA, 18 bp, Homo sapiens
ttgttgatattgtttgct

SEQ ID NO: 6587033 - DNA, 23 bp, Homo sapiens
ttgttgatattttccctttttaa

SEQ ID NO: 6587034 - DNA, 19 bp, Homo sapiens
ttgttgcaagatgtgaatt

SEQ ID NO: 6587035 - DNA, 20 bp, Homo sapiens
ttgttgcaagatgtgaatta

SEQ ID NO: 6587036 - DNA, 19 bp, Homo sapiens
ttgttgcaccaattaagtg

SEQ ID NO: 6587037 - DNA, 21 bp, Homo sapiens
ttgttgcaccaattaagtgtt

SEQ ID NO: 6587038 - DNA, 16 bp, Homo sapiens
ttgttgcactaaaaag

SEQ ID NO: 6587039 - DNA, 13 bp, Homo sapiens
ttgttgcagtgta

SEQ ID NO: 6587040 - DNA, 17 bp, Homo sapiens
ttgttgcatatagttaa

SEQ ID NO: 6587041 - DNA, 18 bp, Homo sapiens
ttgttgcatctcagataa

SEQ ID NO: 6587042 - DNA, 17 bp, Homo sapiens
ttgttgcatcttttcta

SEQ ID NO: 6587043 - DNA, 20 bp, Homo sapiens
ttgttgccaggttgcagctg

SEQ ID NO: 6587044 - DNA, 23 bp, Homo sapiens
ttgttgcccccaaagcccatgcc

SEQ ID NO: 6587045 - DNA, 12 bp, Homo sapiens
ttgttgcctttt

SEQ ID NO: 6587046 - DNA, 14 bp, Homo sapiens
ttgttgccttttca

SEQ ID NO: 6587047 - DNA, 16 bp, Homo sapiens
ttgttgcgttcctttc

SEQ ID NO: 6587048 - DNA, 15 bp, Homo sapiens
ttgttgctgattttg

SEQ ID NO: 6587049 - DNA, 17 bp, Homo sapiens
ttgttgctgattttgac

SEQ ID NO: 6587050 - DNA, 21 bp, Homo sapiens
ttgttgctgattttgaccttg

SEQ ID NO: 6587051 - DNA, 15 bp, Homo sapiens
ttgttgctgctgctg

SEQ ID NO: 6587052 - DNA, 13 bp, Homo sapiens
ttgttggaatgaa

SEQ ID NO: 6587053 - DNA, 23 bp, Homo sapiens
ttgttggagagttaaatggtctc

SEQ ID NO: 6587054 - DNA, 21 bp, Homo sapiens
ttgttggatccgtttgaccaa

SEQ ID NO: 6587055 - DNA, 22 bp, Homo sapiens
ttgttggatccgtttgaccaat

SEQ ID NO: 6587056 - DNA, 18 bp, Homo sapiens
ttgttggcccttccagtg

SEQ ID NO: 6587057 - DNA, 19 bp, Homo sapiens
ttgttggcccttccagtgg

SEQ ID NO: 6587058 - DNA, 21 bp, Homo sapiens
ttgttggcccttccagtggga

SEQ ID NO: 6587059 - DNA, 17 bp, Homo sapiens
ttgttgggaaaggaaca

SEQ ID NO: 6587060 - DNA, 23 bp, Homo sapiens
ttgttgggaggcggtttgggaga

SEQ ID NO: 6587061 - DNA, 20 bp, Homo sapiens
ttgttgggcttgggggaaaa

SEQ ID NO: 6587062 - DNA, 22 bp, Homo sapiens
ttgttgggtaaaaatgaagcag

SEQ ID NO: 6587063 - DNA, 13 bp, Homo sapiens
ttgttggtaacta

SEQ ID NO: 6587064 - DNA, 14 bp, Homo sapiens
ttgttggtcacatg

SEQ ID NO: 6587065 - DNA, 20 bp, Homo sapiens
ttgttggtgaattttcaagg

SEQ ID NO: 6587066 - DNA, 19 bp, Homo sapiens
ttgttggtgtgttttgctc

SEQ ID NO: 6587067 - DNA, 16 bp, Homo sapiens
ttgttggttggttttc

SEQ ID NO: 6587068 - DNA, 15 bp, Homo sapiens
ttgttgtaaaaagaa

SEQ ID NO: 6587069 - DNA, 15 bp, Homo sapiens
ttgttgtaaagtatt

SEQ ID NO: 6587070 - DNA, 15 bp, Homo sapiens
ttgttgtaacctgct

SEQ ID NO: 6587071 - DNA, 12 bp, Homo sapiens
ttgttgtactta

SEQ ID NO: 6587072 - DNA, 20 bp, Homo sapiens
ttgttgtagattgattgtat

SEQ ID NO: 6587073 - DNA, 14 bp, Homo sapiens
ttgttgtattcctg

SEQ ID NO: 6587074 - DNA, 17 bp, Homo sapiens
ttgttgtcaagtataaa

SEQ ID NO: 6587075 - DNA, 15 bp, Homo sapiens
aatcactttcataat

SEQ ID NO: 6587076 - DNA, 17 bp, Homo sapiens
aatcacttttctagaca

SEQ ID NO: 6587077 - DNA, 17 bp, Homo sapiens
aatcagaaaaattaatt

SEQ ID NO: 6587078 - DNA, 15 bp, Homo sapiens
aatcagaaataggaa

SEQ ID NO: 6587079 - DNA, 16 bp, Homo sapiens
aatcagaacaaaactt

SEQ ID NO: 6587080 - DNA, 19 bp, Homo sapiens
aatcagaacaaaacttcta

SEQ ID NO: 6587081 - DNA, 23 bp, Homo sapiens
aatcagaactcaaatggggccag

SEQ ID NO: 6587082 - DNA, 15 bp, Homo sapiens
aatcagaagaaaggc

SEQ ID NO: 6587083 - DNA, 21 bp, Homo sapiens
aatcagaagatagtcttggaa

SEQ ID NO: 6587084 - DNA, 20 bp, Homo sapiens
aatcagaagtcatcttgcta

SEQ ID NO: 6587085 - DNA, 15 bp, Homo sapiens
aatcagaagtgcaaa

SEQ ID NO: 6587086 - DNA, 17 bp, Homo sapiens
aatcagaagtgcaaagg

SEQ ID NO: 6587087 - DNA, 12 bp, Homo sapiens
aatcagaataaa

SEQ ID NO: 6587088 - DNA, 18 bp, Homo sapiens
aatcagaataaattaata

SEQ ID NO: 6587089 - DNA, 23 bp, Homo sapiens
aatcagaataaattaatattgta

SEQ ID NO: 6587090 - DNA, 17 bp, Homo sapiens
aatcagaatcatggaga

SEQ ID NO: 6587091 - DNA, 14 bp, Homo sapiens
aatcagaatggaat

SEQ ID NO: 6587092 - DNA, 13 bp, Homo sapiens
aatcagaattaga

SEQ ID NO: 6587093 - DNA, 20 bp, Homo sapiens
aatcagaattgtgctttttc

SEQ ID NO: 6587094 - DNA, 14 bp, Homo sapiens
aatcagacatttta

SEQ ID NO: 6587095 - DNA, 16 bp, Homo sapiens
aatcagacattttaag

SEQ ID NO: 6587096 - DNA, 14 bp, Homo sapiens
aatcagagaataaa

SEQ ID NO: 6587097 - DNA, 20 bp, Homo sapiens
aatcagagcagtgattctct

SEQ ID NO: 6587098 - DNA, 14 bp, Homo sapiens
aatcagaggagaga

SEQ ID NO: 6587099 - DNA, 23 bp, Homo sapiens
aatcagagtggccaatccctgtg

SEQ ID NO: 6587100 - DNA, 16 bp, Homo sapiens
aatcagatagatattc

SEQ ID NO: 6587101 - DNA, 14 bp, Homo sapiens
aatcagatcatttc

SEQ ID NO: 6587102 - DNA, 17 bp, Homo sapiens
aatcagatgatggccat

SEQ ID NO: 6587103 - DNA, 14 bp, Homo sapiens
aatcagattttcct

SEQ ID NO: 6587104 - DNA, 15 bp, Homo sapiens
aatcagattttcctg

SEQ ID NO: 6587105 - DNA, 14 bp, Homo sapiens
aatcagcaagaaga

SEQ ID NO: 6587106 - DNA, 12 bp, Homo sapiens
aatcagcactga

SEQ ID NO: 6587107 - DNA, 16 bp, Homo sapiens
aatcagcagaacctgt

SEQ ID NO: 6587108 - DNA, 14 bp, Homo sapiens
aatcagcatgacaa

SEQ ID NO: 6587109 - DNA, 23 bp, Homo sapiens
aatcagcatgacaaaaataacac

SEQ ID NO: 6587110 - DNA, 17 bp, Homo sapiens
aatcagcatgattcttc

SEQ ID NO: 6587111 - DNA, 18 bp, Homo sapiens
aatcagccaagttttata

SEQ ID NO: 6587112 - DNA, 14 bp, Homo sapiens
aatcagccaattat

SEQ ID NO: 6587113 - DNA, 19 bp, Homo sapiens
aatcagccaattatgttaa

SEQ ID NO: 6587114 - DNA, 20 bp, Homo sapiens
aatcagccaattatgttaaa

SEQ ID NO: 6587115 - DNA, 13 bp, Homo sapiens
aatcagccagaca

SEQ ID NO: 6587116 - DNA, 15 bp, Homo sapiens
aatcagctattttgt

SEQ ID NO: 6587117 - DNA, 15 bp, Homo sapiens
aatcagctctcctgg

SEQ ID NO: 6587118 - DNA, 17 bp, Homo sapiens
aatcagctgttgcaggc

SEQ ID NO: 6587119 - DNA, 18 bp, Homo sapiens
aatcagctgttgcaggca

SEQ ID NO: 6587120 - DNA, 13 bp, Homo sapiens
aatcaggaaaaat

SEQ ID NO: 6587121 - DNA, 14 bp, Homo sapiens
aatcaggaaaaatg

SEQ ID NO: 6587122 - DNA, 20 bp, Homo sapiens
aatcaggaatattttccaaa

SEQ ID NO: 6587123 - DNA, 12 bp, Homo sapiens
aatcaggagcct

SEQ ID NO: 6587124 - DNA, 13 bp, Homo sapiens
aatcaggagcctg

SEQ ID NO: 6587125 - DNA, 20 bp, Homo sapiens
aatcaggattccttcttccc

SEQ ID NO: 6587126 - DNA, 13 bp, Homo sapiens
aatcaggcaagga

SEQ ID NO: 6587127 - DNA, 18 bp, Homo sapiens
aatcaggcaaggaggagg

SEQ ID NO: 6587128 - DNA, 17 bp, Homo sapiens
aatcaggcagaaatatt

SEQ ID NO: 6587129 - DNA, 22 bp, Homo sapiens
aatcaggcccctgttatgctta

SEQ ID NO: 6587130 - DNA, 22 bp, Homo sapiens
aatcaggcctgatgagggggaa

SEQ ID NO: 6587131 - DNA, 15 bp, Homo sapiens
aatcagggaccagct

SEQ ID NO: 6587132 - DNA, 21 bp, Homo sapiens
aatcaggggccagagagcagg

SEQ ID NO: 6587133 - DNA, 18 bp, Homo sapiens
aatcaggttgttaatgtt

SEQ ID NO: 6587134 - DNA, 21 bp, Homo sapiens
aatcaggttttcttttaagaa

SEQ ID NO: 6587135 - DNA, 16 bp, Homo sapiens
aatcagtaaacactgt

SEQ ID NO: 6587136 - DNA, 14 bp, Homo sapiens
aatcagtagaaagc

SEQ ID NO: 6587137 - DNA, 15 bp, Homo sapiens
aatcagtagaaagct

SEQ ID NO: 6587138 - DNA, 15 bp, Homo sapiens
aatcagtaggaccag

SEQ ID NO: 6587139 - DNA, 16 bp, Homo sapiens
aatcagtaggaccagg

SEQ ID NO: 6587140 - DNA, 17 bp, Homo sapiens
aatcagtataaacaaag

SEQ ID NO: 6587141 - DNA, 11 bp, Homo sapiens
aatcagtatat

SEQ ID NO: 6587142 - DNA, 22 bp, Homo sapiens
aatcagtatattttctgtattt

SEQ ID NO: 6587143 - DNA, 17 bp, Homo sapiens
aatcagtatgaagacac

SEQ ID NO: 6587144 - DNA, 17 bp, Homo sapiens
aatcagtatttccttcc

SEQ ID NO: 6587145 - DNA, 16 bp, Homo sapiens
aatcagtcccctccca

SEQ ID NO: 6587146 - DNA, 18 bp, Homo sapiens
aatcagtcccctcccatc

SEQ ID NO: 6587147 - DNA, 20 bp, Homo sapiens
aatcagtctatccacagaga

SEQ ID NO: 6587148 - DNA, 17 bp, Homo sapiens
aatcagtctcagaatgt

SEQ ID NO: 6587149 - DNA, 11 bp, Homo sapiens
aatcagtgaag

SEQ ID NO: 6587150 - DNA, 13 bp, Homo sapiens
aatcagtgataat

SEQ ID NO: 6587151 - DNA, 17 bp, Homo sapiens
aatcagtgatctatgtt

SEQ ID NO: 6587152 - DNA, 20 bp, Homo sapiens
aatcagtgatctatgtttgt

SEQ ID NO: 6587153 - DNA, 12 bp, Homo sapiens
aatcagtgcagt

SEQ ID NO: 6587154 - DNA, 17 bp, Homo sapiens
aatcagtgcagtgatac

SEQ ID NO: 6587155 - DNA, 18 bp, Homo sapiens
aatcagtgggcaggataa

SEQ ID NO: 6587156 - DNA, 20 bp, Homo sapiens
aatcagtggtgttacatttt

SEQ ID NO: 6587157 - DNA, 14 bp, Homo sapiens
aatcagtgtgttac

SEQ ID NO: 6587158 - DNA, 14 bp, Homo sapiens
aatcagtgtttaaa

SEQ ID NO: 6587159 - DNA, 23 bp, Homo sapiens
aatcagttcattagaaatatttt

SEQ ID NO: 6587160 - DNA, 14 bp, Homo sapiens
aatcagttctcaat

SEQ ID NO: 6587161 - DNA, 20 bp, Homo sapiens
aatcagttgattaagttaat

SEQ ID NO: 6587162 - DNA, 21 bp, Homo sapiens
aatcagttgtgaatacattct

SEQ ID NO: 6587163 - DNA, 23 bp, Homo sapiens
aatcagttgtttaataatttaca

SEQ ID NO: 6587164 - DNA, 12 bp, Homo sapiens
aatcagtttatc

SEQ ID NO: 6587165 - DNA, 14 bp, Homo sapiens
aatcagtttatcct

SEQ ID NO: 6587166 - DNA, 24 bp, Homo sapiens
aatcagtttctgaaatgtaagcat

SEQ ID NO: 6587167 - DNA, 11 bp, Homo sapiens
aatcagttttg

SEQ ID NO: 6587168 - DNA, 19 bp, Homo sapiens
aatcagttttggaatctaa

SEQ ID NO: 6587169 - DNA, 13 bp, Homo sapiens
aatcagttttgta

SEQ ID NO: 6587170 - DNA, 16 bp, Homo sapiens
aatcagttttgtgtac

SEQ ID NO: 6587171 - DNA, 13 bp, Homo sapiens
aatcagtttttgt

SEQ ID NO: 6587172 - DNA, 18 bp, Homo sapiens
aatcagtttttgttctta

SEQ ID NO: 6587173 - DNA, 23 bp, Homo sapiens
aatcagtttttgttcttaaaaat

SEQ ID NO: 6587174 - DNA, 20 bp, Homo sapiens
aatcataaactatattctgt

SEQ ID NO: 6587175 - DNA, 21 bp, Homo sapiens
aatcataaagtgcacaccttt

SEQ ID NO: 6587176 - DNA, 14 bp, Homo sapiens
aatcataaatactg

SEQ ID NO: 6587177 - DNA, 24 bp, Homo sapiens
aatcataaccaccctagctttata

SEQ ID NO: 6587178 - DNA, 12 bp, Homo sapiens
aatcataagtat

SEQ ID NO: 6587179 - DNA, 14 bp, Homo sapiens
aatcataagtattt

SEQ ID NO: 6587180 - DNA, 12 bp, Homo sapiens
aatcataatcat

SEQ ID NO: 6587181 - DNA, 13 bp, Homo sapiens
aatcataatgtaa

SEQ ID NO: 6587182 - DNA, 15 bp, Homo sapiens
aatcataattttcaa

SEQ ID NO: 6587183 - DNA, 13 bp, Homo sapiens
aatcatacaaact

SEQ ID NO: 6587184 - DNA, 14 bp, Homo sapiens
aatcatacaaactc

SEQ ID NO: 6587185 - DNA, 21 bp, Homo sapiens
aatcatacaaactctcaccat

SEQ ID NO: 6587186 - DNA, 17 bp, Homo sapiens
aatcatacaccagaaga

SEQ ID NO: 6587187 - DNA, 20 bp, Homo sapiens
aatcatacaccagaagacaa

SEQ ID NO: 6587188 - DNA, 19 bp, Homo sapiens
aatcatactgcctactgtt

SEQ ID NO: 6587189 - DNA, 13 bp, Homo sapiens
aatcatagagaaa

SEQ ID NO: 6587190 - DNA, 15 bp, Homo sapiens
aatcatagttactgt

SEQ ID NO: 6587191 - DNA, 17 bp, Homo sapiens
aatcatataaatagaat

SEQ ID NO: 6587192 - DNA, 20 bp, Homo sapiens
aatcatataaatagaatgta

SEQ ID NO: 6587193 - DNA, 21 bp, Homo sapiens
aatcatataaatagaatgtaa

SEQ ID NO: 6587194 - DNA, 23 bp, Homo sapiens
aatcatatgtgatctgtcttgta

SEQ ID NO: 6587195 - DNA, 21 bp, Homo sapiens
aatcatattaaaattacagat

SEQ ID NO: 6587196 - DNA, 22 bp, Homo sapiens
aatcatattaattattttccaa

SEQ ID NO: 6587197 - DNA, 20 bp, Homo sapiens
aatcatattctcatggcttt

SEQ ID NO: 6587198 - DNA, 17 bp, Homo sapiens
aatcatattgagaataa

SEQ ID NO: 6587199 - DNA, 20 bp, Homo sapiens
aatcatattgagaataatta

SEQ ID NO: 6587200 - DNA, 14 bp, Homo sapiens
aatcatattgatga

SEQ ID NO: 6587201 - DNA, 16 bp, Homo sapiens
aatcatattgatgaaa

SEQ ID NO: 6587202 - DNA, 19 bp, Homo sapiens
aatcatatttaaagggaat

SEQ ID NO: 6587203 - DNA, 15 bp, Homo sapiens
aatcatcaaaaagaa

SEQ ID NO: 6587204 - DNA, 21 bp, Homo sapiens
aatcatcaaaaagaaaaatca

SEQ ID NO: 6587205 - DNA, 14 bp, Homo sapiens
aatcatcaaaaagt

SEQ ID NO: 6587206 - DNA, 14 bp, Homo sapiens
aatcatcaaagtgt

SEQ ID NO: 6587207 - DNA, 16 bp, Homo sapiens
aatcatcaaagtgttt

SEQ ID NO: 6587208 - DNA, 15 bp, Homo sapiens
aatcatcaagagaat

SEQ ID NO: 6587209 - DNA, 15 bp, Homo sapiens
aatcatcagttcctt

SEQ ID NO: 6587210 - DNA, 17 bp, Homo sapiens
aatcatcattaatgact

SEQ ID NO: 6587211 - DNA, 15 bp, Homo sapiens
aatcatcattattat

SEQ ID NO: 6587212 - DNA, 15 bp, Homo sapiens
aatcatccaatgctc

SEQ ID NO: 6587213 - DNA, 19 bp, Homo sapiens
aatcatccccatcctccag

SEQ ID NO: 6587214 - DNA, 14 bp, Homo sapiens
aatcatccctcctt

SEQ ID NO: 6587215 - DNA, 19 bp, Homo sapiens
aatcatcgaaaattcattt

SEQ ID NO: 6587216 - DNA, 23 bp, Homo sapiens
aatcatcgaaaattcatttcaca

SEQ ID NO: 6587217 - DNA, 15 bp, Homo sapiens
aatcatctattgagt

SEQ ID NO: 6587218 - DNA, 23 bp, Homo sapiens
aatcatctgcagttctttttgta

SEQ ID NO: 6587219 - DNA, 16 bp, Homo sapiens
aatcatctggattttt

SEQ ID NO: 6587220 - DNA, 21 bp, Homo sapiens
aatcatgaaaagaggaacagg

SEQ ID NO: 6587221 - DNA, 16 bp, Homo sapiens
aatcatgaaattactt

SEQ ID NO: 6587222 - DNA, 19 bp, Homo sapiens
aatcatgaacagctctgag

SEQ ID NO: 6587223 - DNA, 20 bp, Homo sapiens
aatcatgaacagctctgaga

SEQ ID NO: 6587224 - DNA, 21 bp, Homo sapiens
aatcatgaacagctctgagat

SEQ ID NO: 6587225 - DNA, 23 bp, Homo sapiens
aatcatgaacagctctgagatcc

SEQ ID NO: 6587226 - DNA, 15 bp, Homo sapiens
aatcatgaagagact

SEQ ID NO: 6587227 - DNA, 23 bp, Homo sapiens
aatcatgaatatttcaaaataaa

SEQ ID NO: 6587228 - DNA, 15 bp, Homo sapiens
aatcatgaattagtt

SEQ ID NO: 6587229 - DNA, 23 bp, Homo sapiens
aatcatgaattagttttatatgc

SEQ ID NO: 6587230 - DNA, 16 bp, Homo sapiens
aatcatgagcctgttt

SEQ ID NO: 6587231 - DNA, 17 bp, Homo sapiens
aatcatgagcctgttta

SEQ ID NO: 6587232 - DNA, 16 bp, Homo sapiens
aatcatgatctgactt

SEQ ID NO: 6587233 - DNA, 15 bp, Homo sapiens
aatcatgccagtatt

SEQ ID NO: 6587234 - DNA, 18 bp, Homo sapiens
aatcatgccctgccttgt

SEQ ID NO: 6587235 - DNA, 12 bp, Homo sapiens
aatcatgctcat

SEQ ID NO: 6587236 - DNA, 16 bp, Homo sapiens
aatcatgctcatgtat

SEQ ID NO: 6587237 - DNA, 12 bp, Homo sapiens
aatcatggattt

SEQ ID NO: 6587238 - DNA, 13 bp, Homo sapiens
aatcatggattta

SEQ ID NO: 6587239 - DNA, 20 bp, Homo sapiens
aatcatggcggaaggtgaaa

SEQ ID NO: 6587240 - DNA, 21 bp, Homo sapiens
aatcatggctaagcttaaaaa

SEQ ID NO: 6587241 - DNA, 20 bp, Homo sapiens
aatcatggctcttagaaact

SEQ ID NO: 6587242 - DNA, 21 bp, Homo sapiens
aatcatggctcttagaaactc

SEQ ID NO: 6587243 - DNA, 22 bp, Homo sapiens
aatcatggctcttagaaactca

SEQ ID NO: 6587244 - DNA, 15 bp, Homo sapiens
aatcatgggaatttt

SEQ ID NO: 6587245 - DNA, 14 bp, Homo sapiens
aatcatgtaaatgc

SEQ ID NO: 6587246 - DNA, 15 bp, Homo sapiens
aatcatgtaaatgct

SEQ ID NO: 6587247 - DNA, 16 bp, Homo sapiens
aatcatgtacatttct

SEQ ID NO: 6587248 - DNA, 21 bp, Homo sapiens
aatcatgtacatttgaaaata

SEQ ID NO: 6587249 - DNA, 18 bp, Homo sapiens
aatcatgtagtatcaaat

SEQ ID NO: 6587250 - DNA, 12 bp, Homo sapiens
aatcatgtatgt

SEQ ID NO: 6587251 - DNA, 23 bp, Homo sapiens
aatcatgtatgttatgatattgt

SEQ ID NO: 6587252 - DNA, 16 bp, Homo sapiens
aatcatgtcaggcctg

SEQ ID NO: 6587253 - DNA, 22 bp, Homo sapiens
aatcatgtcagtctgcttagaa

SEQ ID NO: 6587254 - DNA, 23 bp, Homo sapiens
aatcatgtcagtctgcttagaaa

SEQ ID NO: 6587255 - DNA, 17 bp, Homo sapiens
ttgttgtcattgtccag

SEQ ID NO: 6587256 - DNA, 19 bp, Homo sapiens
ttgttgtcccaatgaaata

SEQ ID NO: 6587257 - DNA, 14 bp, Homo sapiens
ttgttgtccctgca

SEQ ID NO: 6587258 - DNA, 13 bp, Homo sapiens
ttgttgtcctccc

SEQ ID NO: 6587259 - DNA, 15 bp, Homo sapiens
ttgttgtcctcccag

SEQ ID NO: 6587260 - DNA, 14 bp, Homo sapiens
ttgttgtccttttc

SEQ ID NO: 6587261 - DNA, 16 bp, Homo sapiens
ttgttgtccttttcat

SEQ ID NO: 6587262 - DNA, 15 bp, Homo sapiens
ttgttgtgagaatgg

SEQ ID NO: 6587263 - DNA, 21 bp, Homo sapiens
ttgttgtgattttgtacagaa

SEQ ID NO: 6587264 - DNA, 22 bp, Homo sapiens
ttgttgtgggttctatgtttac

SEQ ID NO: 6587265 - DNA, 17 bp, Homo sapiens
ttgttgtgtacagactt

SEQ ID NO: 6587266 - DNA, 16 bp, Homo sapiens
ttgttgtgtataattt

SEQ ID NO: 6587267 - DNA, 13 bp, Homo sapiens
ttgttgtgtgtat

SEQ ID NO: 6587268 - DNA, 15 bp, Homo sapiens
ttgttgttgccaaag

SEQ ID NO: 6587269 - DNA, 15 bp, Homo sapiens
ttgttgttgctgctg

SEQ ID NO: 6587270 - DNA, 11 bp, Homo sapiens
ttgttgttgtt

SEQ ID NO: 6587271 - DNA, 15 bp, Homo sapiens
ttgttgttgttttat

SEQ ID NO: 6587272 - DNA, 13 bp, Homo sapiens
ttgttgtttgctt

SEQ ID NO: 6587273 - DNA, 17 bp, Homo sapiens
ttgttgtttgtttagtc

SEQ ID NO: 6587274 - DNA, 15 bp, Homo sapiens
ttgttgttttatata

SEQ ID NO: 6587275 - DNA, 12 bp, Homo sapiens
ttgttgttttct

SEQ ID NO: 6587276 - DNA, 9 bp, Homo sapiens
ttgtttaaa

SEQ ID NO: 6587277 - DNA, 21 bp, Homo sapiens
ttgtttaaaaaaataacatct

SEQ ID NO: 6587278 - DNA, 13 bp, Homo sapiens
ttgtttaaaaaca

SEQ ID NO: 6587279 - DNA, 15 bp, Homo sapiens
ttgtttaaaaagtaa

SEQ ID NO: 6587280 - DNA, 17 bp, Homo sapiens
ttgtttaaaaatgcagt

SEQ ID NO: 6587281 - DNA, 19 bp, Homo sapiens
ttgtttaaaaatttataac

SEQ ID NO: 6587282 - DNA, 17 bp, Homo sapiens
ttgtttaaaataaaagt

SEQ ID NO: 6587283 - DNA, 21 bp, Homo sapiens
ttgtttaaaatgtaatttaaa

SEQ ID NO: 6587284 - DNA, 13 bp, Homo sapiens
ttgtttaaaattc

SEQ ID NO: 6587285 - DNA, 16 bp, Homo sapiens
ttgtttaaaattcagt

SEQ ID NO: 6587286 - DNA, 15 bp, Homo sapiens
ttgtttaaaattctc

SEQ ID NO: 6587287 - DNA, 15 bp, Homo sapiens
ttgtttaaacaatct

SEQ ID NO: 6587288 - DNA, 21 bp, Homo sapiens
ttgtttaaagaagctctccag

SEQ ID NO: 6587289 - DNA, 13 bp, Homo sapiens
ttgtttaaatgcc

SEQ ID NO: 6587290 - DNA, 23 bp, Homo sapiens
ttgtttaacacttctgtatgcat

SEQ ID NO: 6587291 - DNA, 21 bp, Homo sapiens
ttgtttaacttgtctttttgt

SEQ ID NO: 6587292 - DNA, 17 bp, Homo sapiens
ttgtttaataagtatat

SEQ ID NO: 6587293 - DNA, 22 bp, Homo sapiens
ttgtttaataagtatatcttaa

SEQ ID NO: 6587294 - DNA, 16 bp, Homo sapiens
ttgtttaatagatttg

SEQ ID NO: 6587295 - DNA, 20 bp, Homo sapiens
ttgtttaatcagttctgtgt

SEQ ID NO: 6587296 - DNA, 14 bp, Homo sapiens
ttgtttaatgcaaa

SEQ ID NO: 6587297 - DNA, 23 bp, Homo sapiens
ttgtttaatgtgaacttgtagct

SEQ ID NO: 6587298 - DNA, 14 bp, Homo sapiens
ttgtttaattgtag

SEQ ID NO: 6587299 - DNA, 17 bp, Homo sapiens
ttgtttacaatatagat

SEQ ID NO: 6587300 - DNA, 15 bp, Homo sapiens
ttgtttacatgagtt

SEQ ID NO: 6587301 - DNA, 20 bp, Homo sapiens
ttgtttacatgagttcaaat

SEQ ID NO: 6587302 - DNA, 15 bp, Homo sapiens
ttgtttacatgctta

SEQ ID NO: 6587303 - DNA, 16 bp, Homo sapiens
ttgtttacatgcttat

SEQ ID NO: 6587304 - DNA, 22 bp, Homo sapiens
ttgtttacatgcttattccatg

SEQ ID NO: 6587305 - DNA, 20 bp, Homo sapiens
ttgtttagaagagagtagct

SEQ ID NO: 6587306 - DNA, 20 bp, Homo sapiens
ttgtttagattttgtgttta

SEQ ID NO: 6587307 - DNA, 15 bp, Homo sapiens
ttgtttataataaaa

SEQ ID NO: 6587308 - DNA, 20 bp, Homo sapiens
ttgtttatacacaactttgc

SEQ ID NO: 6587309 - DNA, 19 bp, Homo sapiens
ttgtttatatgcccattct

SEQ ID NO: 6587310 - DNA, 22 bp, Homo sapiens
ttgtttatatggataatctgag

SEQ ID NO: 6587311 - DNA, 22 bp, Homo sapiens
ttgtttatcagatacatcactg

SEQ ID NO: 6587312 - DNA, 17 bp, Homo sapiens
ttgtttatctagatgta

SEQ ID NO: 6587313 - DNA, 15 bp, Homo sapiens
ttgtttatgtaattt

SEQ ID NO: 6587314 - DNA, 15 bp, Homo sapiens
ttgtttattagatga

SEQ ID NO: 6587315 - DNA, 14 bp, Homo sapiens
ttgtttattccaaa

SEQ ID NO: 6587316 - DNA, 20 bp, Homo sapiens
ttgtttattctttttaaagt

SEQ ID NO: 6587317 - DNA, 23 bp, Homo sapiens
ttgtttatttgcaatttgagcca

SEQ ID NO: 6587318 - DNA, 13 bp, Homo sapiens
ttgtttcaaaaaa

SEQ ID NO: 6587319 - DNA, 21 bp, Homo sapiens
ttgtttcaaacagcatcaaaa

SEQ ID NO: 6587320 - DNA, 15 bp, Homo sapiens
ttgtttcaactttct

SEQ ID NO: 6587321 - DNA, 18 bp, Homo sapiens
ttgtttcaagaacctgga

SEQ ID NO: 6587322 - DNA, 21 bp, Homo sapiens
ttgtttcaatctctgactaaa

SEQ ID NO: 6587323 - DNA, 21 bp, Homo sapiens
ttgtttcaatgaggtgtccaa

SEQ ID NO: 6587324 - DNA, 16 bp, Homo sapiens
ttgtttcaattgcatc

SEQ ID NO: 6587325 - DNA, 12 bp, Homo sapiens
ttgtttcagtga

SEQ ID NO: 6587326 - DNA, 22 bp, Homo sapiens
ttgtttcagtgaatatgcctgt

SEQ ID NO: 6587327 - DNA, 15 bp, Homo sapiens
ttgtttcatgagttt

SEQ ID NO: 6587328 - DNA, 14 bp, Homo sapiens
ttgtttccagaaat

SEQ ID NO: 6587329 - DNA, 19 bp, Homo sapiens
ttgtttcccctagcttact

SEQ ID NO: 6587330 - DNA, 15 bp, Homo sapiens
ttgtttcctccttgt

SEQ ID NO: 6587331 - DNA, 18 bp, Homo sapiens
ttgtttcgctctttgaga

SEQ ID NO: 6587332 - DNA, 16 bp, Homo sapiens
ttgtttcgtggggagg

SEQ ID NO: 6587333 - DNA, 16 bp, Homo sapiens
ttgtttctacctccca

SEQ ID NO: 6587334 - DNA, 23 bp, Homo sapiens
ttgtttctactttgatatgactg

SEQ ID NO: 6587335 - DNA, 15 bp, Homo sapiens
ttgtttctatactgt

SEQ ID NO: 6587336 - DNA, 16 bp, Homo sapiens
ttgtttctccccctgg

SEQ ID NO: 6587337 - DNA, 23 bp, Homo sapiens
ttgtttctctagcgctgagctat

SEQ ID NO: 6587338 - DNA, 21 bp, Homo sapiens
ttgtttctgaaaattccagaa

SEQ ID NO: 6587339 - DNA, 14 bp, Homo sapiens
ttgtttctgaccca

SEQ ID NO: 6587340 - DNA, 22 bp, Homo sapiens
ttgtttctgggtccctgctccc

SEQ ID NO: 6587341 - DNA, 15 bp, Homo sapiens
ttgtttctgtttagt

SEQ ID NO: 6587342 - DNA, 11 bp, Homo sapiens
ttgtttcttcc

SEQ ID NO: 6587343 - DNA, 12 bp, Homo sapiens
ttgtttcttcct

SEQ ID NO: 6587344 - DNA, 20 bp, Homo sapiens
ttgtttctttctctgaggac

SEQ ID NO: 6587345 - DNA, 16 bp, Homo sapiens
ttgtttgaaaatatta

SEQ ID NO: 6587346 - DNA, 13 bp, Homo sapiens
ttgtttgaaagac

SEQ ID NO: 6587347 - DNA, 15 bp, Homo sapiens
ttgtttgagaaatta

SEQ ID NO: 6587348 - DNA, 21 bp, Homo sapiens
ttgtttgagaaattaagtatc

SEQ ID NO: 6587349 - DNA, 23 bp, Homo sapiens
ttgtttgaggcaaattaactgta

SEQ ID NO: 6587350 - DNA, 13 bp, Homo sapiens
ttgtttgatgtgt

SEQ ID NO: 6587351 - DNA, 14 bp, Homo sapiens
ttgtttgcacagag

SEQ ID NO: 6587352 - DNA, 19 bp, Homo sapiens
ttgtttgcggggcttttaa

SEQ ID NO: 6587353 - DNA, 23 bp, Homo sapiens
ttgtttgctcttttaagcagtct

SEQ ID NO: 6587354 - DNA, 16 bp, Homo sapiens
ttgtttgctgaaattt

SEQ ID NO: 6587355 - DNA, 11 bp, Homo sapiens
ttgtttgctgc

SEQ ID NO: 6587356 - DNA, 18 bp, Homo sapiens
ttgtttgcttaatttcct

SEQ ID NO: 6587357 - DNA, 18 bp, Homo sapiens
ttgtttgcttccattatt

SEQ ID NO: 6587358 - DNA, 20 bp, Homo sapiens
ttgtttggactgttttcaat

SEQ ID NO: 6587359 - DNA, 12 bp, Homo sapiens
ttgtttggagac

SEQ ID NO: 6587360 - DNA, 18 bp, Homo sapiens
ttgtttggagacagagtc

SEQ ID NO: 6587361 - DNA, 21 bp, Homo sapiens
ttgtttggagacgtttataaa

SEQ ID NO: 6587362 - DNA, 22 bp, Homo sapiens
ttgtttggaggagcaaagttaa

SEQ ID NO: 6587363 - DNA, 16 bp, Homo sapiens
ttgtttggatgtaatt

SEQ ID NO: 6587364 - DNA, 18 bp, Homo sapiens
ttgtttggcaatgcactg

SEQ ID NO: 6587365 - DNA, 16 bp, Homo sapiens
ttgtttggctgtccag

SEQ ID NO: 6587366 - DNA, 16 bp, Homo sapiens
ttgtttgggatcagct

SEQ ID NO: 6587367 - DNA, 22 bp, Homo sapiens
ttgtttggggaagttcaagtga

SEQ ID NO: 6587368 - DNA, 17 bp, Homo sapiens
ttgtttggtaaatgttt

SEQ ID NO: 6587369 - DNA, 19 bp, Homo sapiens
ttgtttggtaaatgtttct

SEQ ID NO: 6587370 - DNA, 21 bp, Homo sapiens
ttgtttggtattgtatttatt

SEQ ID NO: 6587371 - DNA, 16 bp, Homo sapiens
ttgtttggtcactgct

SEQ ID NO: 6587372 - DNA, 16 bp, Homo sapiens
ttgtttgtaaatgcct

SEQ ID NO: 6587373 - DNA, 13 bp, Homo sapiens
ttgtttgtacagt

SEQ ID NO: 6587374 - DNA, 17 bp, Homo sapiens
ttgtttgtagctttcct

SEQ ID NO: 6587375 - DNA, 20 bp, Homo sapiens
ttgtttgtagctttcctgga

SEQ ID NO: 6587376 - DNA, 13 bp, Homo sapiens
ttgtttgtatgta

SEQ ID NO: 6587377 - DNA, 19 bp, Homo sapiens
ttgtttgtatgtataattc

SEQ ID NO: 6587378 - DNA, 12 bp, Homo sapiens
ttgtttgtattc

SEQ ID NO: 6587379 - DNA, 16 bp, Homo sapiens
ttgtttgtcagcatct

SEQ ID NO: 6587380 - DNA, 21 bp, Homo sapiens
ttgtttgtcagcatctgacca

SEQ ID NO: 6587381 - DNA, 23 bp, Homo sapiens
ttgtttgtcagcatctgaccatc

SEQ ID NO: 6587382 - DNA, 15 bp, Homo sapiens
ttgtttgtgtccata

SEQ ID NO: 6587383 - DNA, 18 bp, Homo sapiens
ttgtttgtgtttatgaaa

SEQ ID NO: 6587384 - DNA, 19 bp, Homo sapiens
ttgtttgttaataaagtgc

SEQ ID NO: 6587385 - DNA, 12 bp, Homo sapiens
ttgtttgtttct

SEQ ID NO: 6587386 - DNA, 22 bp, Homo sapiens
ttgtttgtttcttcttttcctt

SEQ ID NO: 6587387 - DNA, 17 bp, Homo sapiens
ttgtttgttttggattc

SEQ ID NO: 6587388 - DNA, 13 bp, Homo sapiens
ttgttttaaaact

SEQ ID NO: 6587389 - DNA, 14 bp, Homo sapiens
ttgttttaaaactg

SEQ ID NO: 6587390 - DNA, 13 bp, Homo sapiens
ttgttttaaaagg

SEQ ID NO: 6587391 - DNA, 18 bp, Homo sapiens
ttgttttaaaattaaagc

SEQ ID NO: 6587392 - DNA, 20 bp, Homo sapiens
ttgttttaaaattaaagcta

SEQ ID NO: 6587393 - DNA, 15 bp, Homo sapiens
ttgttttaacacagt

SEQ ID NO: 6587394 - DNA, 19 bp, Homo sapiens
ttgttttaacctcccctct

SEQ ID NO: 6587395 - DNA, 15 bp, Homo sapiens
ttgttttaaggaaaa

SEQ ID NO: 6587396 - DNA, 22 bp, Homo sapiens
ttgttttaaggaaaaaagattt

SEQ ID NO: 6587397 - DNA, 21 bp, Homo sapiens
ttgttttaatctactttttgt

SEQ ID NO: 6587398 - DNA, 13 bp, Homo sapiens
ttgttttaatctg

SEQ ID NO: 6587399 - DNA, 13 bp, Homo sapiens
ttgttttaatctt

SEQ ID NO: 6587400 - DNA, 23 bp, Homo sapiens
ttgttttagatccaaatgtaaag

SEQ ID NO: 6587401 - DNA, 16 bp, Homo sapiens
ttgttttatatacctg

SEQ ID NO: 6587402 - DNA, 12 bp, Homo sapiens
ttgttttattca

SEQ ID NO: 6587403 - DNA, 22 bp, Homo sapiens
ttgttttattcaccatcatgta

SEQ ID NO: 6587404 - DNA, 16 bp, Homo sapiens
ttgttttatttaggca

SEQ ID NO: 6587405 - DNA, 16 bp, Homo sapiens
ttgttttcacttgtat

SEQ ID NO: 6587406 - DNA, 13 bp, Homo sapiens
ttgttttcagtgt

SEQ ID NO: 6587407 - DNA, 16 bp, Homo sapiens
ttgttttcagtgtaca

SEQ ID NO: 6587408 - DNA, 18 bp, Homo sapiens
ttgttttccactgtgcta

SEQ ID NO: 6587409 - DNA, 19 bp, Homo sapiens
ttgttttccatcatttggt

SEQ ID NO: 6587410 - DNA, 20 bp, Homo sapiens
ttgttttcggggagaaataa

SEQ ID NO: 6587411 - DNA, 14 bp, Homo sapiens
ttgttttcttaact

SEQ ID NO: 6587412 - DNA, 12 bp, Homo sapiens
ttgttttcttgg

SEQ ID NO: 6587413 - DNA, 20 bp, Homo sapiens
ttgttttgagctttccatgt

SEQ ID NO: 6587414 - DNA, 13 bp, Homo sapiens
ttgttttgcaaaa

SEQ ID NO: 6587415 - DNA, 14 bp, Homo sapiens
ttgttttgcttttg

SEQ ID NO: 6587416 - DNA, 14 bp, Homo sapiens
ttgttttgcttttt

SEQ ID NO: 6587417 - DNA, 19 bp, Homo sapiens
ttgttttgctttttctgac

SEQ ID NO: 6587418 - DNA, 18 bp, Homo sapiens
ttgttttggactctctgt

SEQ ID NO: 6587419 - DNA, 22 bp, Homo sapiens
ttgttttggactctctgtggtc

SEQ ID NO: 6587420 - DNA, 18 bp, Homo sapiens
ttgttttgggggtcaggc

SEQ ID NO: 6587421 - DNA, 21 bp, Homo sapiens
ttgttttgggttttcttccct

SEQ ID NO: 6587422 - DNA, 12 bp, Homo sapiens
ttgttttgtaga

SEQ ID NO: 6587423 - DNA, 13 bp, Homo sapiens
ttgttttgtattg

SEQ ID NO: 6587424 - DNA, 13 bp, Homo sapiens
ttgttttgtggat

SEQ ID NO: 6587425 - DNA, 19 bp, Homo sapiens
ttgttttgtgtctcttatg

SEQ ID NO: 6587426 - DNA, 16 bp, Homo sapiens
ttgttttgtgtttcat

SEQ ID NO: 6587427 - DNA, 10 bp, Homo sapiens
ttgttttgtt

SEQ ID NO: 6587428 - DNA, 14 bp, Homo sapiens
ttgttttgttgcac

SEQ ID NO: 6587429 - DNA, 13 bp, Homo sapiens
ttgttttgtttta

SEQ ID NO: 6587430 - DNA, 14 bp, Homo sapiens
ttgtttttaaactg

SEQ ID NO: 6587431 - DNA, 16 bp, Homo sapiens
ttgtttttaaactgta

SEQ ID NO: 6587432 - DNA, 14 bp, Homo sapiens
ttgtttttaaatca

SEQ ID NO: 6587433 - DNA, 14 bp, Homo sapiens
ttgtttttatttct

SEQ ID NO: 6587434 - DNA, 12 bp, Homo sapiens
ttgtttttcatt

SEQ ID NO: 6587435 - DNA, 17 bp, Homo sapiens
ttgtttttccatgtgtt

SEQ ID NO: 6587436 - DNA, 13 bp, Homo sapiens
ttgtttttctcac

SEQ ID NO: 6587437 - DNA, 15 bp, Homo sapiens
ttgtttttgctacta

SEQ ID NO: 6587438 - DNA, 16 bp, Homo sapiens
ttgtttttgctttctg

SEQ ID NO: 6587439 - DNA, 19 bp, Homo sapiens
ttgtttttgctttctgaaa

SEQ ID NO: 6587440 - DNA, 13 bp, Homo sapiens
ttgtttttgtaat

SEQ ID NO: 6587441 - DNA, 13 bp, Homo sapiens
ttgtttttgtata

SEQ ID NO: 6587442 - DNA, 16 bp, Homo sapiens
ttgttttttaaagtct

SEQ ID NO: 6587443 - DNA, 21 bp, Homo sapiens
ttgttttttaaagtcttgctg

SEQ ID NO: 6587444 - DNA, 21 bp, Homo sapiens
ttgttttttacttttttacac

SEQ ID NO: 6587445 - DNA, 21 bp, Homo sapiens
ttgttttttcaaaatagaaaa

SEQ ID NO: 6587446 - DNA, 13 bp, Homo sapiens
ttgttttttcata

SEQ ID NO: 6587447 - DNA, 14 bp, Homo sapiens
ttgttttttgaagt

SEQ ID NO: 6587448 - DNA, 17 bp, Homo sapiens
ttgttttttgaagtgtt

SEQ ID NO: 6587449 - DNA, 13 bp, Homo sapiens
ttgttttttgagt

SEQ ID NO: 6587450 - DNA, 13 bp, Homo sapiens
ttgttttttgttc

SEQ ID NO: 6587451 - DNA, 23 bp, Homo sapiens
ttgtttttttaaatcgccttgaa

SEQ ID NO: 6587452 - DNA, 13 bp, Homo sapiens
ttgtttttttcct

SEQ ID NO: 6587453 - DNA, 15 bp, Homo sapiens
ttgtttttttgagat

SEQ ID NO: 6587454 - DNA, 19 bp, Homo sapiens
ttgttttttttttccactt

SEQ ID NO: 6587455 - DNA, 22 bp, Homo sapiens
tttaaaaaaaaaagttacagaa

SEQ ID NO: 6587456 - DNA, 14 bp, Homo sapiens
tttaaaaaaaaagt

SEQ ID NO: 6587457 - DNA, 17 bp, Homo sapiens
tttaaaaaaaagaaact

SEQ ID NO: 6587458 - DNA, 21 bp, Homo sapiens
tttaaaaaaaatagaagctat

SEQ ID NO: 6587459 - DNA, 20 bp, Homo sapiens
tttaaaaaaaatattctgtc

SEQ ID NO: 6587460 - DNA, 14 bp, Homo sapiens
tttaaaaaaaatgt

SEQ ID NO: 6587461 - DNA, 21 bp, Homo sapiens
tttaaaaaaaatgtgaaattt

SEQ ID NO: 6587462 - DNA, 13 bp, Homo sapiens
tttaaaaaaactg

SEQ ID NO: 6587463 - DNA, 19 bp, Homo sapiens
tttaaaaaaataaaacagt

SEQ ID NO: 6587464 - DNA, 18 bp, Homo sapiens
tttaaaaaaataaaacat

SEQ ID NO: 6587465 - DNA, 21 bp, Homo sapiens
tttaaaaaaataaaacatttt

SEQ ID NO: 6587466 - DNA, 15 bp, Homo sapiens
tttaaaaaaataaca

SEQ ID NO: 6587467 - DNA, 19 bp, Homo sapiens
tttaaaaaaataatataaa

SEQ ID NO: 6587468 - DNA, 22 bp, Homo sapiens
tttaaaaaaatacagtattctg

SEQ ID NO: 6587469 - DNA, 16 bp, Homo sapiens
tttaaaaaaatttaag

SEQ ID NO: 6587470 - DNA, 18 bp, Homo sapiens
tttaaaaaaatttaagtg

SEQ ID NO: 6587471 - DNA, 16 bp, Homo sapiens
tttaaaaaaattttta

SEQ ID NO: 6587472 - DNA, 20 bp, Homo sapiens
tttaaaaaaatttttgcaaa

SEQ ID NO: 6587473 - DNA, 11 bp, Homo sapiens
tttaaaaaaca

SEQ ID NO: 6587474 - DNA, 19 bp, Homo sapiens
tttaaaaaacaaaaaaaga

SEQ ID NO: 6587475 - DNA, 23 bp, Homo sapiens
tttaaaaaaccacatggcacaga

SEQ ID NO: 6587476 - DNA, 14 bp, Homo sapiens
tttaaaaaactaaa

SEQ ID NO: 6587477 - DNA, 15 bp, Homo sapiens
tttaaaaaactaaaa

SEQ ID NO: 6587478 - DNA, 16 bp, Homo sapiens
tttaaaaaactctttg

SEQ ID NO: 6587479 - DNA, 11 bp, Homo sapiens
tttaaaaaagc

SEQ ID NO: 6587480 - DNA, 19 bp, Homo sapiens
tttaaaaaagcaacagaaa

SEQ ID NO: 6587481 - DNA, 20 bp, Homo sapiens
tttaaaaaagcttaaaactt

SEQ ID NO: 6587482 - DNA, 21 bp, Homo sapiens
tttaaaaaagcttaaaacttt

SEQ ID NO: 6587483 - DNA, 13 bp, Homo sapiens
tttaaaaaagttt

SEQ ID NO: 6587484 - DNA, 16 bp, Homo sapiens
tttaaaaaagtttaaa

SEQ ID NO: 6587485 - DNA, 12 bp, Homo sapiens
tttaaaaaataa

SEQ ID NO: 6587486 - DNA, 19 bp, Homo sapiens
tttaaaaaataaaaaaata

SEQ ID NO: 6587487 - DNA, 22 bp, Homo sapiens
tttaaaaaataaaaaaatacag

SEQ ID NO: 6587488 - DNA, 14 bp, Homo sapiens
tttaaaaaataaat

SEQ ID NO: 6587489 - DNA, 20 bp, Homo sapiens
tttaaaaaataaatataatt

SEQ ID NO: 6587490 - DNA, 14 bp, Homo sapiens
tttaaaaaataaca

SEQ ID NO: 6587491 - DNA, 15 bp, Homo sapiens
tttaaaaaataacat

SEQ ID NO: 6587492 - DNA, 20 bp, Homo sapiens
tttaaaaaataactaccaag

SEQ ID NO: 6587493 - DNA, 18 bp, Homo sapiens
tttaaaaaataatttaga

SEQ ID NO: 6587494 - DNA, 19 bp, Homo sapiens
tttaaaaaatacagtatta

SEQ ID NO: 6587495 - DNA, 22 bp, Homo sapiens
tttaaaaaatatttattaaata

SEQ ID NO: 6587496 - DNA, 21 bp, Homo sapiens
tttaaaaaatattttaagaaa

SEQ ID NO: 6587497 - DNA, 16 bp, Homo sapiens
tttaaaaaatattttc

SEQ ID NO: 6587498 - DNA, 17 bp, Homo sapiens
tttaaaaaatcaatcaa

SEQ ID NO: 6587499 - DNA, 19 bp, Homo sapiens
tttaaaaaatgaaaataag

SEQ ID NO: 6587500 - DNA, 20 bp, Homo sapiens
tttaaaaaatgaaatccttt

SEQ ID NO: 6587501 - DNA, 17 bp, Homo sapiens
tttaaaaaatgctgggt

SEQ ID NO: 6587502 - DNA, 16 bp, Homo sapiens
tttaaaaaatggtcac

SEQ ID NO: 6587503 - DNA, 12 bp, Homo sapiens
tttaaaaaatta

SEQ ID NO: 6587504 - DNA, 23 bp, Homo sapiens
tttaaaaaattatggaatatcat

SEQ ID NO: 6587505 - DNA, 18 bp, Homo sapiens
tttaaaaacaaaaggcaa

SEQ ID NO: 6587506 - DNA, 21 bp, Homo sapiens
tttaaaaacactacttttgct

SEQ ID NO: 6587507 - DNA, 15 bp, Homo sapiens
tttaaaaacaggaaa

SEQ ID NO: 6587508 - DNA, 19 bp, Homo sapiens
tttaaaaacatagaaaaat

SEQ ID NO: 6587509 - DNA, 18 bp, Homo sapiens
tttaaaaacatgagaaat

SEQ ID NO: 6587510 - DNA, 19 bp, Homo sapiens
tttaaaaacatgagaaatg

SEQ ID NO: 6587511 - DNA, 20 bp, Homo sapiens
tttaaaaacatgagaaatgt

SEQ ID NO: 6587512 - DNA, 21 bp, Homo sapiens
tttaaaaacatgagaaatgtg

SEQ ID NO: 6587513 - DNA, 23 bp, Homo sapiens
tttaaaaacattttttatacatt

SEQ ID NO: 6587514 - DNA, 23 bp, Homo sapiens
tttaaaaaccaatcattttaaga

SEQ ID NO: 6587515 - DNA, 13 bp, Homo sapiens
tttaaaaactctt

SEQ ID NO: 6587516 - DNA, 17 bp, Homo sapiens
tttaaaaactcttcagt

SEQ ID NO: 6587517 - DNA, 16 bp, Homo sapiens
tttaaaaacttaaata

SEQ ID NO: 6587518 - DNA, 10 bp, Homo sapiens
tttaaaaaga

SEQ ID NO: 6587519 - DNA, 11 bp, Homo sapiens
tttaaaaagaa

SEQ ID NO: 6587520 - DNA, 16 bp, Homo sapiens
tttaaaaagaaaaaaa

SEQ ID NO: 6587521 - DNA, 23 bp, Homo sapiens
tttaaaaagaaaatcagttgatt

SEQ ID NO: 6587522 - DNA, 13 bp, Homo sapiens
tttaaaaagattt

SEQ ID NO: 6587523 - DNA, 17 bp, Homo sapiens
tttaaaaagcaaatctt

SEQ ID NO: 6587524 - DNA, 14 bp, Homo sapiens
tttaaaaagccagt

SEQ ID NO: 6587525 - DNA, 14 bp, Homo sapiens
tttaaaaagctcac

SEQ ID NO: 6587526 - DNA, 21 bp, Homo sapiens
tttaaaaagctcactgctgat

SEQ ID NO: 6587527 - DNA, 18 bp, Homo sapiens
tttaaaaaggaaatttgt

SEQ ID NO: 6587528 - DNA, 16 bp, Homo sapiens
tttaaaaagggtaact

SEQ ID NO: 6587529 - DNA, 18 bp, Homo sapiens
tttaaaaaggtaaatggt

SEQ ID NO: 6587530 - DNA, 17 bp, Homo sapiens
tttaaaaagtattgcca

SEQ ID NO: 6587531 - DNA, 15 bp, Homo sapiens
tttaaaaagtcttca

SEQ ID NO: 6587532 - DNA, 16 bp, Homo sapiens
tttaaaaagtgtttaa

SEQ ID NO: 6587533 - DNA, 20 bp, Homo sapiens
tttaaaaagtgtttaaatgt

SEQ ID NO: 6587534 - DNA, 17 bp, Homo sapiens
tttaaaaagttaactct

SEQ ID NO: 6587535 - DNA, 21 bp, Homo sapiens
tttaaaaataaagctactgaa

SEQ ID NO: 6587536 - DNA, 22 bp, Homo sapiens
tttaaaaataagtcaacagtaa

SEQ ID NO: 6587537 - DNA, 17 bp, Homo sapiens
tttaaaaatacatagca

SEQ ID NO: 6587538 - DNA, 17 bp, Homo sapiens
tttaaaaatatttcaga

SEQ ID NO: 6587539 - DNA, 23 bp, Homo sapiens
tttaaaaatcaactttttattgc

SEQ ID NO: 6587540 - DNA, 20 bp, Homo sapiens
tttaaaaatcagaaagacat

SEQ ID NO: 6587541 - DNA, 12 bp, Homo sapiens
tttaaaaatcat

SEQ ID NO: 6587542 - DNA, 13 bp, Homo sapiens
tttaaaaatcata

SEQ ID NO: 6587543 - DNA, 22 bp, Homo sapiens
tttaaaaatctaccttctgtag

SEQ ID NO: 6587544 - DNA, 19 bp, Homo sapiens
tttaaaaatggtatcaaaa

SEQ ID NO: 6587545 - DNA, 14 bp, Homo sapiens
tttaaaaatgtata

SEQ ID NO: 6587546 - DNA, 12 bp, Homo sapiens
tttaaaaatgtc

SEQ ID NO: 6587547 - DNA, 18 bp, Homo sapiens
tttaaaaattaaagcagc

SEQ ID NO: 6587548 - DNA, 19 bp, Homo sapiens
tttaaaaattaaagcagca

SEQ ID NO: 6587549 - DNA, 23 bp, Homo sapiens
tttaaaaattagcctaagatata

SEQ ID NO: 6587550 - DNA, 18 bp, Homo sapiens
tttaaaaattattatata

SEQ ID NO: 6587551 - DNA, 12 bp, Homo sapiens
tttaaaaattgt

SEQ ID NO: 6587552 - DNA, 17 bp, Homo sapiens
tttaaaaattgtctctt

SEQ ID NO: 6587553 - DNA, 16 bp, Homo sapiens
tttaaaaattgtttct

SEQ ID NO: 6587554 - DNA, 16 bp, Homo sapiens
tttaaaaatttataac

SEQ ID NO: 6587555 - DNA, 21 bp, Homo sapiens
tttaaaacaagaaagtttccc

SEQ ID NO: 6587556 - DNA, 22 bp, Homo sapiens
tttaaaacaagaaagtttcccc

SEQ ID NO: 6587557 - DNA, 19 bp, Homo sapiens
tttaaaacaaggggttact

SEQ ID NO: 6587558 - DNA, 13 bp, Homo sapiens
tttaaaacaatga

SEQ ID NO: 6587559 - DNA, 19 bp, Homo sapiens
tttaaaacacagtattgta

SEQ ID NO: 6587560 - DNA, 15 bp, Homo sapiens
tttaaaacagacact

SEQ ID NO: 6587561 - DNA, 15 bp, Homo sapiens
tttaaaacatgtaat

SEQ ID NO: 6587562 - DNA, 12 bp, Homo sapiens
tttaaaacattt

SEQ ID NO: 6587563 - DNA, 17 bp, Homo sapiens
tttaaaaccacagctgg

SEQ ID NO: 6587564 - DNA, 23 bp, Homo sapiens
tttaaaaccactatgcaaagaac

SEQ ID NO: 6587565 - DNA, 15 bp, Homo sapiens
tttaaaaccagttac

SEQ ID NO: 6587566 - DNA, 16 bp, Homo sapiens
tttaaaaccattattt

SEQ ID NO: 6587567 - DNA, 17 bp, Homo sapiens
tttaaaacccaaacttc

SEQ ID NO: 6587568 - DNA, 15 bp, Homo sapiens
tttaaaacgtgtaaa

SEQ ID NO: 6587569 - DNA, 16 bp, Homo sapiens
tttaaaactacttagc

SEQ ID NO: 6587570 - DNA, 18 bp, Homo sapiens
tttaaaactagcaactct

SEQ ID NO: 6587571 - DNA, 20 bp, Homo sapiens
tttaaaactagttagattca

SEQ ID NO: 6587572 - DNA, 16 bp, Homo sapiens
tttaaaactcacctcc

SEQ ID NO: 6587573 - DNA, 20 bp, Homo sapiens
tttaaaactcagaatataac

SEQ ID NO: 6587574 - DNA, 23 bp, Homo sapiens
tttaaaactcagaatataacatg

SEQ ID NO: 6587575 - DNA, 15 bp, Homo sapiens
tttaaaactctttat

SEQ ID NO: 6587576 - DNA, 12 bp, Homo sapiens
tttaaaactgaa

SEQ ID NO: 6587577 - DNA, 18 bp, Homo sapiens
tttaaaactgcattttta

SEQ ID NO: 6587578 - DNA, 13 bp, Homo sapiens
tttaaaactgtta

SEQ ID NO: 6587579 - DNA, 16 bp, Homo sapiens
tttaaaactgttattt

SEQ ID NO: 6587580 - DNA, 11 bp, Homo sapiens
tttaaaacttg

SEQ ID NO: 6587581 - DNA, 21 bp, Homo sapiens
tttaaaagaaaaaaaccaaag

SEQ ID NO: 6587582 - DNA, 14 bp, Homo sapiens
tttaaaagaagctt

SEQ ID NO: 6587583 - DNA, 20 bp, Homo sapiens
tttaaaagaaggtaaataat

SEQ ID NO: 6587584 - DNA, 13 bp, Homo sapiens
tttaaaagacaaa

SEQ ID NO: 6587585 - DNA, 19 bp, Homo sapiens
tttaaaagacaagacttca

SEQ ID NO: 6587586 - DNA, 14 bp, Homo sapiens
tttaaaagacactg

SEQ ID NO: 6587587 - DNA, 14 bp, Homo sapiens
tttaaaagagacaa

SEQ ID NO: 6587588 - DNA, 12 bp, Homo sapiens
tttaaaagagta

SEQ ID NO: 6587589 - DNA, 18 bp, Homo sapiens
tttaaaagagtagaataa

SEQ ID NO: 6587590 - DNA, 13 bp, Homo sapiens
tttaaaagatgct

SEQ ID NO: 6587591 - DNA, 14 bp, Homo sapiens
tttaaaagcaaata

SEQ ID NO: 6587592 - DNA, 20 bp, Homo sapiens
tttaaaagcacaatcactaa

SEQ ID NO: 6587593 - DNA, 19 bp, Homo sapiens
tttaaaagcacgacagtgg

SEQ ID NO: 6587594 - DNA, 18 bp, Homo sapiens
tttaaaagcagagcattt

SEQ ID NO: 6587595 - DNA, 18 bp, Homo sapiens
tttaaaagcatatataaa

SEQ ID NO: 6587596 - DNA, 19 bp, Homo sapiens
tttaaaagccctttccaaa

SEQ ID NO: 6587597 - DNA, 13 bp, Homo sapiens
tttaaaagcctgc

SEQ ID NO: 6587598 - DNA, 14 bp, Homo sapiens
tttaaaagcctgct

SEQ ID NO: 6587599 - DNA, 13 bp, Homo sapiens
tttaaaaggaaaa

SEQ ID NO: 6587600 - DNA, 11 bp, Homo sapiens
tttaaaaggca

SEQ ID NO: 6587601 - DNA, 15 bp, Homo sapiens
tttaaaaggctccca

SEQ ID NO: 6587602 - DNA, 23 bp, Homo sapiens
tttaaaaggtaggttttaaaaat

SEQ ID NO: 6587603 - DNA, 20 bp, Homo sapiens
tttaaaaggtattttgaata

SEQ ID NO: 6587604 - DNA, 20 bp, Homo sapiens
tttaaaagtcagcattttct

SEQ ID NO: 6587605 - DNA, 18 bp, Homo sapiens
tttaaaagtcattattcc

SEQ ID NO: 6587606 - DNA, 22 bp, Homo sapiens
tttaaaagtgtattttattcag

SEQ ID NO: 6587607 - DNA, 20 bp, Homo sapiens
tttaaaagttactcctttta

SEQ ID NO: 6587608 - DNA, 15 bp, Homo sapiens
tttaaaagttattaa

SEQ ID NO: 6587609 - DNA, 17 bp, Homo sapiens
tttaaaagtttcaatgt

SEQ ID NO: 6587610 - DNA, 20 bp, Homo sapiens
tttaaaagtttcaatgtgat

SEQ ID NO: 6587611 - DNA, 21 bp, Homo sapiens
tttaaaagttttgaaggaaac

SEQ ID NO: 6587612 - DNA, 22 bp, Homo sapiens
tttaaaagttttgaaggaaacc

SEQ ID NO: 6587613 - DNA, 23 bp, Homo sapiens
tttaaaagttttgttcttttata

SEQ ID NO: 6587614 - DNA, 17 bp, Homo sapiens
tttaaaataaaatgaaa

SEQ ID NO: 6587615 - DNA, 22 bp, Homo sapiens
aatcatgtccatacactttgtt

SEQ ID NO: 6587616 - DNA, 18 bp, Homo sapiens
aatcatgtccatcccttt

SEQ ID NO: 6587617 - DNA, 18 bp, Homo sapiens
aatcatgtcgatcctggg

SEQ ID NO: 6587618 - DNA, 21 bp, Homo sapiens
aatcatgtctgtatccccagt

SEQ ID NO: 6587619 - DNA, 22 bp, Homo sapiens
aatcatgtggcctaatattgaa

SEQ ID NO: 6587620 - DNA, 21 bp, Homo sapiens
aatcatgtgggtgagccagtg

SEQ ID NO: 6587621 - DNA, 12 bp, Homo sapiens
aatcatgtgtgt

SEQ ID NO: 6587622 - DNA, 23 bp, Homo sapiens
aatcatgttatgataaaaaattt

SEQ ID NO: 6587623 - DNA, 13 bp, Homo sapiens
aatcatgttctgg

SEQ ID NO: 6587624 - DNA, 15 bp, Homo sapiens
aatcatgttgaaaca

SEQ ID NO: 6587625 - DNA, 22 bp, Homo sapiens
aatcatgttgttgtgtgtatat

SEQ ID NO: 6587626 - DNA, 16 bp, Homo sapiens
aatcatgtttctttga

SEQ ID NO: 6587627 - DNA, 17 bp, Homo sapiens
aatcatgtttctttgat

SEQ ID NO: 6587628 - DNA, 19 bp, Homo sapiens
aatcatgtttctttgatca

SEQ ID NO: 6587629 - DNA, 14 bp, Homo sapiens
aatcattagagctt

SEQ ID NO: 6587630 - DNA, 15 bp, Homo sapiens
aatcattagttttag

SEQ ID NO: 6587631 - DNA, 14 bp, Homo sapiens
aatcattatttgag

SEQ ID NO: 6587632 - DNA, 13 bp, Homo sapiens
aatcattcaaaac

SEQ ID NO: 6587633 - DNA, 14 bp, Homo sapiens
aatcattcaatatc

SEQ ID NO: 6587634 - DNA, 16 bp, Homo sapiens
aatcattcagaaatgt

SEQ ID NO: 6587635 - DNA, 18 bp, Homo sapiens
aatcattccactatacaa

SEQ ID NO: 6587636 - DNA, 12 bp, Homo sapiens
aatcattccagt

SEQ ID NO: 6587637 - DNA, 11 bp, Homo sapiens
aatcattccat

SEQ ID NO: 6587638 - DNA, 13 bp, Homo sapiens
aatcattccttcc

SEQ ID NO: 6587639 - DNA, 22 bp, Homo sapiens
aatcattgaagtatattcttat

SEQ ID NO: 6587640 - DNA, 20 bp, Homo sapiens
aatcattgactaaagccatt

SEQ ID NO: 6587641 - DNA, 13 bp, Homo sapiens
aatcattgcaaac

SEQ ID NO: 6587642 - DNA, 20 bp, Homo sapiens
aatcattgctgaaaatggta

SEQ ID NO: 6587643 - DNA, 21 bp, Homo sapiens
aatcattgctttgaagcagtt

SEQ ID NO: 6587644 - DNA, 20 bp, Homo sapiens
aatcattgtaaacattagtt

SEQ ID NO: 6587645 - DNA, 13 bp, Homo sapiens
aatcattgtacag

SEQ ID NO: 6587646 - DNA, 17 bp, Homo sapiens
aatcattgtacagtttg

SEQ ID NO: 6587647 - DNA, 13 bp, Homo sapiens
aatcattgtagaa

SEQ ID NO: 6587648 - DNA, 14 bp, Homo sapiens
aatcattgtagaaa

SEQ ID NO: 6587649 - DNA, 13 bp, Homo sapiens
aatcattgtatca

SEQ ID NO: 6587650 - DNA, 19 bp, Homo sapiens
aatcattgtcagagatgtt

SEQ ID NO: 6587651 - DNA, 16 bp, Homo sapiens
aatcattgtgcttaat

SEQ ID NO: 6587652 - DNA, 14 bp, Homo sapiens
aatcattgttgcct

SEQ ID NO: 6587653 - DNA, 17 bp, Homo sapiens
aatcattgttttgaata

SEQ ID NO: 6587654 - DNA, 18 bp, Homo sapiens
aatcatttatctggattt

SEQ ID NO: 6587655 - DNA, 17 bp, Homo sapiens
aatcatttccagcaaaa

SEQ ID NO: 6587656 - DNA, 12 bp, Homo sapiens
aatcatttctat

SEQ ID NO: 6587657 - DNA, 19 bp, Homo sapiens
aatcatttctatttctcct

SEQ ID NO: 6587658 - DNA, 13 bp, Homo sapiens
aatcatttctcac

SEQ ID NO: 6587659 - DNA, 21 bp, Homo sapiens
aatcatttcttgggccctcct

SEQ ID NO: 6587660 - DNA, 22 bp, Homo sapiens
aatcatttcttgggccctcctg

SEQ ID NO: 6587661 - DNA, 16 bp, Homo sapiens
aatcatttgtttacat

SEQ ID NO: 6587662 - DNA, 16 bp, Homo sapiens
aatcattttaattatt

SEQ ID NO: 6587663 - DNA, 14 bp, Homo sapiens
aatcattttagaat

SEQ ID NO: 6587664 - DNA, 19 bp, Homo sapiens
aatcattttaggaaaggat

SEQ ID NO: 6587665 - DNA, 19 bp, Homo sapiens
aatcattttatatgtcaaa

SEQ ID NO: 6587666 - DNA, 23 bp, Homo sapiens
aatcattttatatgtcaaagcag

SEQ ID NO: 6587667 - DNA, 14 bp, Homo sapiens
aatcattttatgct

SEQ ID NO: 6587668 - DNA, 13 bp, Homo sapiens
aatcattttatgt

SEQ ID NO: 6587669 - DNA, 17 bp, Homo sapiens
aatcattttcattccta

SEQ ID NO: 6587670 - DNA, 23 bp, Homo sapiens
aatcattttctagccctctccct

SEQ ID NO: 6587671 - DNA, 16 bp, Homo sapiens
aatcattttgatgtat

SEQ ID NO: 6587672 - DNA, 13 bp, Homo sapiens
aatcattttggag

SEQ ID NO: 6587673 - DNA, 20 bp, Homo sapiens
aatcatttttaattcacgtg

SEQ ID NO: 6587674 - DNA, 20 bp, Homo sapiens
aatcatttttatattataac

SEQ ID NO: 6587675 - DNA, 20 bp, Homo sapiens
aatcatttttcactgtacat

SEQ ID NO: 6587676 - DNA, 18 bp, Homo sapiens
aatcattttttatatata

SEQ ID NO: 6587677 - DNA, 22 bp, Homo sapiens
aatcattttttatatatatgca

SEQ ID NO: 6587678 - DNA, 15 bp, Homo sapiens
aatccaaaagacaaa

SEQ ID NO: 6587679 - DNA, 22 bp, Homo sapiens
aatccaaaagacaaaaatcaaa

SEQ ID NO: 6587680 - DNA, 13 bp, Homo sapiens
aatccaaaatgaa

SEQ ID NO: 6587681 - DNA, 13 bp, Homo sapiens
aatccaaactgct

SEQ ID NO: 6587682 - DNA, 18 bp, Homo sapiens
aatccaaactgctgtctc

SEQ ID NO: 6587683 - DNA, 14 bp, Homo sapiens
aatccaaacttgga

SEQ ID NO: 6587684 - DNA, 11 bp, Homo sapiens
aatccaaagaa

SEQ ID NO: 6587685 - DNA, 15 bp, Homo sapiens
aatccaaagaaaaag

SEQ ID NO: 6587686 - DNA, 14 bp, Homo sapiens
aatccaaatattgt

SEQ ID NO: 6587687 - DNA, 19 bp, Homo sapiens
aatccaaattccctctgga

SEQ ID NO: 6587688 - DNA, 17 bp, Homo sapiens
aatccaacacaagttgt

SEQ ID NO: 6587689 - DNA, 17 bp, Homo sapiens
aatccaacccatgatga

SEQ ID NO: 6587690 - DNA, 16 bp, Homo sapiens
aatccaactttcacag

SEQ ID NO: 6587691 - DNA, 21 bp, Homo sapiens
aatccaactttcacagtgaag

SEQ ID NO: 6587692 - DNA, 16 bp, Homo sapiens
aatccaagattctgct

SEQ ID NO: 6587693 - DNA, 20 bp, Homo sapiens
aatccaagctccctgcccca

SEQ ID NO: 6587694 - DNA, 23 bp, Homo sapiens
aatccaagggttgagagccagtg

SEQ ID NO: 6587695 - DNA, 21 bp, Homo sapiens
aatccaatcaatttaaatgtt

SEQ ID NO: 6587696 - DNA, 16 bp, Homo sapiens
aatccaatctgtaatt

SEQ ID NO: 6587697 - DNA, 18 bp, Homo sapiens
aatccacaaagccgtgcc

SEQ ID NO: 6587698 - DNA, 15 bp, Homo sapiens
aatccacaaatgatg

SEQ ID NO: 6587699 - DNA, 18 bp, Homo sapiens
aatccacaagccattttt

SEQ ID NO: 6587700 - DNA, 16 bp, Homo sapiens
aatccacacatatata

SEQ ID NO: 6587701 - DNA, 14 bp, Homo sapiens
aatccacacatatt

SEQ ID NO: 6587702 - DNA, 14 bp, Homo sapiens
aatccacctcggag

SEQ ID NO: 6587703 - DNA, 13 bp, Homo sapiens
aatccacctgcct

SEQ ID NO: 6587704 - DNA, 18 bp, Homo sapiens
aatccacctgcctcggcc

SEQ ID NO: 6587705 - DNA, 19 bp, Homo sapiens
aatccacctgcctcggcct

SEQ ID NO: 6587706 - DNA, 16 bp, Homo sapiens
aatccacctgccttgg

SEQ ID NO: 6587707 - DNA, 21 bp, Homo sapiens
aatccacctggtggccctgcg

SEQ ID NO: 6587708 - DNA, 22 bp, Homo sapiens
aatccacgaattcttctggggt

SEQ ID NO: 6587709 - DNA, 15 bp, Homo sapiens
aatccactcccaggc

SEQ ID NO: 6587710 - DNA, 14 bp, Homo sapiens
aatccactccttcc

SEQ ID NO: 6587711 - DNA, 13 bp, Homo sapiens
aatccactctcag

SEQ ID NO: 6587712 - DNA, 15 bp, Homo sapiens
aatccactgacagat

SEQ ID NO: 6587713 - DNA, 13 bp, Homo sapiens
aatccagaaagaa

SEQ ID NO: 6587714 - DNA, 13 bp, Homo sapiens
aatccagaaggaa

SEQ ID NO: 6587715 - DNA, 17 bp, Homo sapiens
aatccagacccggctgc

SEQ ID NO: 6587716 - DNA, 19 bp, Homo sapiens
aatccagactttctttttc

SEQ ID NO: 6587717 - DNA, 20 bp, Homo sapiens
aatccagagaagcgctgttg

SEQ ID NO: 6587718 - DNA, 11 bp, Homo sapiens
aatccagagag

SEQ ID NO: 6587719 - DNA, 16 bp, Homo sapiens
aatccagcaggtcaca

SEQ ID NO: 6587720 - DNA, 17 bp, Homo sapiens
aatccagcatcccaaga

SEQ ID NO: 6587721 - DNA, 11 bp, Homo sapiens
aatccagcccc

SEQ ID NO: 6587722 - DNA, 13 bp, Homo sapiens
aatccagccccat

SEQ ID NO: 6587723 - DNA, 20 bp, Homo sapiens
aatccagccccatagaaaac

SEQ ID NO: 6587724 - DNA, 13 bp, Homo sapiens
aatccagcctgct

SEQ ID NO: 6587725 - DNA, 20 bp, Homo sapiens
aatccaggcagatccaggac

SEQ ID NO: 6587726 - DNA, 20 bp, Homo sapiens
aatccaggccaaagccccat

SEQ ID NO: 6587727 - DNA, 19 bp, Homo sapiens
aatccaggctgttctcagc

SEQ ID NO: 6587728 - DNA, 18 bp, Homo sapiens
aatccagggtggtggtga

SEQ ID NO: 6587729 - DNA, 24 bp, Homo sapiens
aatccagtattatattatcatatc

SEQ ID NO: 6587730 - DNA, 13 bp, Homo sapiens
aatccagtattgc

SEQ ID NO: 6587731 - DNA, 17 bp, Homo sapiens
aatccagtgacctctct

SEQ ID NO: 6587732 - DNA, 18 bp, Homo sapiens
aatccagtggggaaaaaa

SEQ ID NO: 6587733 - DNA, 21 bp, Homo sapiens
aatccagtggtgggtaattgt

SEQ ID NO: 6587734 - DNA, 17 bp, Homo sapiens
aatccagtgtgcacccc

SEQ ID NO: 6587735 - DNA, 20 bp, Homo sapiens
aatccagtttgtgtttttct

SEQ ID NO: 6587736 - DNA, 20 bp, Homo sapiens
aatccataaatgtgttcctg

SEQ ID NO: 6587737 - DNA, 17 bp, Homo sapiens
aatccataccccctgcc

SEQ ID NO: 6587738 - DNA, 18 bp, Homo sapiens
aatccataccccctgccc

SEQ ID NO: 6587739 - DNA, 20 bp, Homo sapiens
aatccataccccctgcccca

SEQ ID NO: 6587740 - DNA, 15 bp, Homo sapiens
aatccatactgtaga

SEQ ID NO: 6587741 - DNA, 15 bp, Homo sapiens
aatccatatcagctc

SEQ ID NO: 6587742 - DNA, 13 bp, Homo sapiens
aatccatcagcaa

SEQ ID NO: 6587743 - DNA, 18 bp, Homo sapiens
aatccatcagcaatgctt

SEQ ID NO: 6587744 - DNA, 20 bp, Homo sapiens
aatccatcagcaatgcttct

SEQ ID NO: 6587745 - DNA, 18 bp, Homo sapiens
aatccatccatgtacttc

SEQ ID NO: 6587746 - DNA, 13 bp, Homo sapiens
aatccatcctgca

SEQ ID NO: 6587747 - DNA, 23 bp, Homo sapiens
aatccatcgtattaaaaaacaat

SEQ ID NO: 6587748 - DNA, 22 bp, Homo sapiens
aatccatctaaatacctgccct

SEQ ID NO: 6587749 - DNA, 14 bp, Homo sapiens
aatccatctttgta

SEQ ID NO: 6587750 - DNA, 19 bp, Homo sapiens
aatccatgaaagaacttaa

SEQ ID NO: 6587751 - DNA, 20 bp, Homo sapiens
aatccatgatcaaaatgcat

SEQ ID NO: 6587752 - DNA, 11 bp, Homo sapiens
aatccatgctt

SEQ ID NO: 6587753 - DNA, 14 bp, Homo sapiens
aatccatgcttcac

SEQ ID NO: 6587754 - DNA, 17 bp, Homo sapiens
aatccatgtatctgtat

SEQ ID NO: 6587755 - DNA, 15 bp, Homo sapiens
aatccatgtgaccat

SEQ ID NO: 6587756 - DNA, 19 bp, Homo sapiens
aatccatgtgaccattctg

SEQ ID NO: 6587757 - DNA, 20 bp, Homo sapiens
aatccatgtgattaatgttt

SEQ ID NO: 6587758 - DNA, 21 bp, Homo sapiens
aatccatgtgattaatgtttt

SEQ ID NO: 6587759 - DNA, 22 bp, Homo sapiens
aatccatgtgtcccccctgtgg

SEQ ID NO: 6587760 - DNA, 24 bp, Homo sapiens
aatccatgtgtcccccctgtggtc

SEQ ID NO: 6587761 - DNA, 17 bp, Homo sapiens
aatccatgttagttttt

SEQ ID NO: 6587762 - DNA, 22 bp, Homo sapiens
aatccatgttagtttttacttt

SEQ ID NO: 6587763 - DNA, 19 bp, Homo sapiens
aatccattgaactggaaga

SEQ ID NO: 6587764 - DNA, 15 bp, Homo sapiens
aatccattgtttaaa

SEQ ID NO: 6587765 - DNA, 16 bp, Homo sapiens
aatccatttatttcat

SEQ ID NO: 6587766 - DNA, 17 bp, Homo sapiens
aatccatttggaaatct

SEQ ID NO: 6587767 - DNA, 14 bp, Homo sapiens
aatcccaaaagtca

SEQ ID NO: 6587768 - DNA, 16 bp, Homo sapiens
aatcccaaatttgatt

SEQ ID NO: 6587769 - DNA, 19 bp, Homo sapiens
aatcccaacatttctcttc

SEQ ID NO: 6587770 - DNA, 20 bp, Homo sapiens
aatcccaagatctgtgcagc

SEQ ID NO: 6587771 - DNA, 18 bp, Homo sapiens
aatcccaatctttctata

SEQ ID NO: 6587772 - DNA, 21 bp, Homo sapiens
aatcccaattatttattttaa

SEQ ID NO: 6587773 - DNA, 21 bp, Homo sapiens
aatcccaccaaatcatcctga

SEQ ID NO: 6587774 - DNA, 12 bp, Homo sapiens
aatcccaccaga

SEQ ID NO: 6587775 - DNA, 17 bp, Homo sapiens
aatcccacccacatgtg

SEQ ID NO: 6587776 - DNA, 17 bp, Homo sapiens
aatcccacttatcaaat

SEQ ID NO: 6587777 - DNA, 14 bp, Homo sapiens
aatcccacttcagt

SEQ ID NO: 6587778 - DNA, 15 bp, Homo sapiens
aatcccagcactttg

SEQ ID NO: 6587779 - DNA, 20 bp, Homo sapiens
aatcccagcactttgggagg

SEQ ID NO: 6587780 - DNA, 15 bp, Homo sapiens
aatcccagcagcaga

SEQ ID NO: 6587781 - DNA, 14 bp, Homo sapiens
aatcccagctactc

SEQ ID NO: 6587782 - DNA, 21 bp, Homo sapiens
aatcccagctacttgggaggt

SEQ ID NO: 6587783 - DNA, 20 bp, Homo sapiens
aatcccagctattcaggagg

SEQ ID NO: 6587784 - DNA, 22 bp, Homo sapiens
aatcccagggaaggacttggag

SEQ ID NO: 6587785 - DNA, 13 bp, Homo sapiens
aatcccagttcat

SEQ ID NO: 6587786 - DNA, 16 bp, Homo sapiens
aatcccagttcttcct

SEQ ID NO: 6587787 - DNA, 19 bp, Homo sapiens
aatcccatcagtgaatcct

SEQ ID NO: 6587788 - DNA, 21 bp, Homo sapiens
aatcccatctattctctgcct

SEQ ID NO: 6587789 - DNA, 16 bp, Homo sapiens
aatcccatctctacaa

SEQ ID NO: 6587790 - DNA, 15 bp, Homo sapiens
aatcccattgtattt

SEQ ID NO: 6587791 - DNA, 17 bp, Homo sapiens
aatcccatttaaaaaaa

SEQ ID NO: 6587792 - DNA, 18 bp, Homo sapiens
aatccccaacatgcactg

SEQ ID NO: 6587793 - DNA, 12 bp, Homo sapiens
aatccccagcct

SEQ ID NO: 6587794 - DNA, 16 bp, Homo sapiens
aatccccatcattact

SEQ ID NO: 6587795 - DNA, 18 bp, Homo sapiens
tttaaaataaaatgaaaa

SEQ ID NO: 6587796 - DNA, 13 bp, Homo sapiens
tttaaaataaact

SEQ ID NO: 6587797 - DNA, 15 bp, Homo sapiens
tttaaaataaactgt

SEQ ID NO: 6587798 - DNA, 15 bp, Homo sapiens
tttaaaatactgtag

SEQ ID NO: 6587799 - DNA, 14 bp, Homo sapiens
tttaaaatacttgt

SEQ ID NO: 6587800 - DNA, 13 bp, Homo sapiens
tttaaaatagaaa

SEQ ID NO: 6587801 - DNA, 17 bp, Homo sapiens
tttaaaatagaggcttt

SEQ ID NO: 6587802 - DNA, 23 bp, Homo sapiens
tttaaaatagcgttcttgtaatt

SEQ ID NO: 6587803 - DNA, 16 bp, Homo sapiens
tttaaaatagtaattt

SEQ ID NO: 6587804 - DNA, 17 bp, Homo sapiens
tttaaaatagttttcta

SEQ ID NO: 6587805 - DNA, 21 bp, Homo sapiens
tttaaaatatattgaatattt

SEQ ID NO: 6587806 - DNA, 18 bp, Homo sapiens
tttaaaatatttagtcta

SEQ ID NO: 6587807 - DNA, 14 bp, Homo sapiens
tttaaaatatttgt

SEQ ID NO: 6587808 - DNA, 15 bp, Homo sapiens
tttaaaatcaactta

SEQ ID NO: 6587809 - DNA, 16 bp, Homo sapiens
tttaaaatcattcaat

SEQ ID NO: 6587810 - DNA, 18 bp, Homo sapiens
tttaaaatctcctaaatg

SEQ ID NO: 6587811 - DNA, 13 bp, Homo sapiens
tttaaaatctgat

SEQ ID NO: 6587812 - DNA, 15 bp, Homo sapiens
tttaaaatctgtcac

SEQ ID NO: 6587813 - DNA, 16 bp, Homo sapiens
tttaaaatcttgcatg

SEQ ID NO: 6587814 - DNA, 23 bp, Homo sapiens
tttaaaatcttgcatggcattaa

SEQ ID NO: 6587815 - DNA, 19 bp, Homo sapiens
tttaaaatgaaatgcattt

SEQ ID NO: 6587816 - DNA, 21 bp, Homo sapiens
tttaaaatgaaatgcattttg

SEQ ID NO: 6587817 - DNA, 17 bp, Homo sapiens
tttaaaatgaaatgttt

SEQ ID NO: 6587818 - DNA, 17 bp, Homo sapiens
tttaaaatgcagattca

SEQ ID NO: 6587819 - DNA, 11 bp, Homo sapiens
tttaaaatgcg

SEQ ID NO: 6587820 - DNA, 13 bp, Homo sapiens
tttaaaatgcgaa

SEQ ID NO: 6587821 - DNA, 22 bp, Homo sapiens
tttaaaatggaaaattttctcc

SEQ ID NO: 6587822 - DNA, 19 bp, Homo sapiens
tttaaaatggacttttgtt

SEQ ID NO: 6587823 - DNA, 12 bp, Homo sapiens
tttaaaatgtaa

SEQ ID NO: 6587824 - DNA, 17 bp, Homo sapiens
tttaaaatgtaaagcca

SEQ ID NO: 6587825 - DNA, 18 bp, Homo sapiens
tttaaaatgtaaagccat

SEQ ID NO: 6587826 - DNA, 20 bp, Homo sapiens
tttaaaatgtaaagccatgc

SEQ ID NO: 6587827 - DNA, 12 bp, Homo sapiens
tttaaaatgtac

SEQ ID NO: 6587828 - DNA, 13 bp, Homo sapiens
tttaaaatgtagt

SEQ ID NO: 6587829 - DNA, 12 bp, Homo sapiens
tttaaaatgtat

SEQ ID NO: 6587830 - DNA, 18 bp, Homo sapiens
tttaaaatgtataagttg

SEQ ID NO: 6587831 - DNA, 21 bp, Homo sapiens
tttaaaatgtttaggaaattt

SEQ ID NO: 6587832 - DNA, 23 bp, Homo sapiens
tttaaaatgtttaggaaatttat

SEQ ID NO: 6587833 - DNA, 20 bp, Homo sapiens
tttaaaattaaataaatttt

SEQ ID NO: 6587834 - DNA, 22 bp, Homo sapiens
tttaaaattaagtagaacaaaa

SEQ ID NO: 6587835 - DNA, 15 bp, Homo sapiens
tttaaaattactaac

SEQ ID NO: 6587836 - DNA, 14 bp, Homo sapiens
tttaaaattattaa

SEQ ID NO: 6587837 - DNA, 15 bp, Homo sapiens
tttaaaattcatgga

SEQ ID NO: 6587838 - DNA, 19 bp, Homo sapiens
tttaaaattccattatctt

SEQ ID NO: 6587839 - DNA, 12 bp, Homo sapiens
tttaaaattggc

SEQ ID NO: 6587840 - DNA, 17 bp, Homo sapiens
tttaaaattggtatatt

SEQ ID NO: 6587841 - DNA, 20 bp, Homo sapiens
tttaaaattgtcacctctgt

SEQ ID NO: 6587842 - DNA, 19 bp, Homo sapiens
tttaaaatttaagtatctt

SEQ ID NO: 6587843 - DNA, 17 bp, Homo sapiens
tttaaaatttatattgt

SEQ ID NO: 6587844 - DNA, 17 bp, Homo sapiens
tttaaaatttatttgca

SEQ ID NO: 6587845 - DNA, 20 bp, Homo sapiens
tttaaaatttcgttgtccaa

SEQ ID NO: 6587846 - DNA, 21 bp, Homo sapiens
tttaaaatttcgttgtccaat

SEQ ID NO: 6587847 - DNA, 13 bp, Homo sapiens
tttaaacaaaata

SEQ ID NO: 6587848 - DNA, 16 bp, Homo sapiens
tttaaacaaaatagaa

SEQ ID NO: 6587849 - DNA, 16 bp, Homo sapiens
tttaaacaaaatttat

SEQ ID NO: 6587850 - DNA, 23 bp, Homo sapiens
tttaaacaaaatttatgtcattt

SEQ ID NO: 6587851 - DNA, 15 bp, Homo sapiens
tttaaacaaacattg

SEQ ID NO: 6587852 - DNA, 16 bp, Homo sapiens
tttaaacaaatatgaa

SEQ ID NO: 6587853 - DNA, 17 bp, Homo sapiens
tttaaacaaatatgaaa

SEQ ID NO: 6587854 - DNA, 13 bp, Homo sapiens
tttaaacaaatgg

SEQ ID NO: 6587855 - DNA, 12 bp, Homo sapiens
tttaaacaaatt

SEQ ID NO: 6587856 - DNA, 18 bp, Homo sapiens
tttaaacaacgatttctc

SEQ ID NO: 6587857 - DNA, 17 bp, Homo sapiens
tttaaacaatctttcat

SEQ ID NO: 6587858 - DNA, 14 bp, Homo sapiens
tttaaacacattaa

SEQ ID NO: 6587859 - DNA, 15 bp, Homo sapiens
tttaaacacattaaa

SEQ ID NO: 6587860 - DNA, 13 bp, Homo sapiens
tttaaacagcagt

SEQ ID NO: 6587861 - DNA, 18 bp, Homo sapiens
tttaaacatgattatctt

SEQ ID NO: 6587862 - DNA, 19 bp, Homo sapiens
tttaaacattaaaaatgga

SEQ ID NO: 6587863 - DNA, 15 bp, Homo sapiens
tttaaacattaatag

SEQ ID NO: 6587864 - DNA, 23 bp, Homo sapiens
tttaaacccaaaatatatacaca

SEQ ID NO: 6587865 - DNA, 17 bp, Homo sapiens
tttaaacccaagtgctg

SEQ ID NO: 6587866 - DNA, 23 bp, Homo sapiens
tttaaacccttgctgctgaattt

SEQ ID NO: 6587867 - DNA, 20 bp, Homo sapiens
tttaaaccgctaaaagaaac

SEQ ID NO: 6587868 - DNA, 21 bp, Homo sapiens
tttaaacctttaatgagaaaa

SEQ ID NO: 6587869 - DNA, 14 bp, Homo sapiens
tttaaactaaatta

SEQ ID NO: 6587870 - DNA, 20 bp, Homo sapiens
tttaaactaaattactgttt

SEQ ID NO: 6587871 - DNA, 20 bp, Homo sapiens
tttaaactaaccttttatca

SEQ ID NO: 6587872 - DNA, 19 bp, Homo sapiens
tttaaactaagatctgtta

SEQ ID NO: 6587873 - DNA, 16 bp, Homo sapiens
tttaaactacctcaaa

SEQ ID NO: 6587874 - DNA, 16 bp, Homo sapiens
tttaaactagatgacc

SEQ ID NO: 6587875 - DNA, 19 bp, Homo sapiens
tttaaactagatgacctca

SEQ ID NO: 6587876 - DNA, 21 bp, Homo sapiens
tttaaactctgaatttatctt

SEQ ID NO: 6587877 - DNA, 14 bp, Homo sapiens
tttaaactctgcca

SEQ ID NO: 6587878 - DNA, 14 bp, Homo sapiens
tttaaactgatgta

SEQ ID NO: 6587879 - DNA, 15 bp, Homo sapiens
tttaaactgattcat

SEQ ID NO: 6587880 - DNA, 15 bp, Homo sapiens
tttaaactgtcgtgt

SEQ ID NO: 6587881 - DNA, 19 bp, Homo sapiens
tttaaactgtgtacataac

SEQ ID NO: 6587882 - DNA, 14 bp, Homo sapiens
tttaaacttataaa

SEQ ID NO: 6587883 - DNA, 21 bp, Homo sapiens
tttaaacttcagttttactgc

SEQ ID NO: 6587884 - DNA, 14 bp, Homo sapiens
tttaaacttgaaat

SEQ ID NO: 6587885 - DNA, 17 bp, Homo sapiens
tttaaacttgaaatata

SEQ ID NO: 6587886 - DNA, 11 bp, Homo sapiens
tttaaactttc

SEQ ID NO: 6587887 - DNA, 17 bp, Homo sapiens
tttaaagaaaagatgaa

SEQ ID NO: 6587888 - DNA, 15 bp, Homo sapiens
tttaaagaaaagttt

SEQ ID NO: 6587889 - DNA, 21 bp, Homo sapiens
tttaaagaaaagttttgtaaa

SEQ ID NO: 6587890 - DNA, 15 bp, Homo sapiens
tttaaagaaacacta

SEQ ID NO: 6587891 - DNA, 16 bp, Homo sapiens
tttaaagaaagtgtat

SEQ ID NO: 6587892 - DNA, 15 bp, Homo sapiens
tttaaagaacagtga

SEQ ID NO: 6587893 - DNA, 16 bp, Homo sapiens
tttaaagaagctttat

SEQ ID NO: 6587894 - DNA, 17 bp, Homo sapiens
tttaaagaagctttatc

SEQ ID NO: 6587895 - DNA, 15 bp, Homo sapiens
tttaaagaagtctct

SEQ ID NO: 6587896 - DNA, 18 bp, Homo sapiens
tttaaagaagtctcttaa

SEQ ID NO: 6587897 - DNA, 12 bp, Homo sapiens
tttaaagaataa

SEQ ID NO: 6587898 - DNA, 15 bp, Homo sapiens
tttaaagaataaagt

SEQ ID NO: 6587899 - DNA, 18 bp, Homo sapiens
tttaaagaatgagaaaca

SEQ ID NO: 6587900 - DNA, 19 bp, Homo sapiens
tttaaagaatgagaaacat

SEQ ID NO: 6587901 - DNA, 10 bp, Homo sapiens
tttaaagaca

SEQ ID NO: 6587902 - DNA, 17 bp, Homo sapiens
tttaaagaccaataaac

SEQ ID NO: 6587903 - DNA, 23 bp, Homo sapiens
tttaaagaccaataaacttcctt

SEQ ID NO: 6587904 - DNA, 20 bp, Homo sapiens
tttaaagacccaacttgcca

SEQ ID NO: 6587905 - DNA, 17 bp, Homo sapiens
tttaaagaccctcctat

SEQ ID NO: 6587906 - DNA, 18 bp, Homo sapiens
tttaaagactacaataaa

SEQ ID NO: 6587907 - DNA, 13 bp, Homo sapiens
tttaaagacttaa

SEQ ID NO: 6587908 - DNA, 12 bp, Homo sapiens
tttaaagagaag

SEQ ID NO: 6587909 - DNA, 14 bp, Homo sapiens
tttaaagagaggtt

SEQ ID NO: 6587910 - DNA, 13 bp, Homo sapiens
tttaaagcaaata

SEQ ID NO: 6587911 - DNA, 17 bp, Homo sapiens
tttaaagcaactgtcta

SEQ ID NO: 6587912 - DNA, 18 bp, Homo sapiens
tttaaagcaattgcataa

SEQ ID NO: 6587913 - DNA, 22 bp, Homo sapiens
tttaaagcaccgaggttgcatt

SEQ ID NO: 6587914 - DNA, 17 bp, Homo sapiens
tttaaagcatctgtaaa

SEQ ID NO: 6587915 - DNA, 21 bp, Homo sapiens
tttaaagccgtgctcttttaa

SEQ ID NO: 6587916 - DNA, 20 bp, Homo sapiens
tttaaagcctgaaaattcca

SEQ ID NO: 6587917 - DNA, 12 bp, Homo sapiens
tttaaagcctgg

SEQ ID NO: 6587918 - DNA, 17 bp, Homo sapiens
tttaaagctcaggaggg

SEQ ID NO: 6587919 - DNA, 22 bp, Homo sapiens
tttaaagctgagagaccctggc

SEQ ID NO: 6587920 - DNA, 15 bp, Homo sapiens
tttaaagctttgaat

SEQ ID NO: 6587921 - DNA, 15 bp, Homo sapiens
tttaaaggaaaaaat

SEQ ID NO: 6587922 - DNA, 13 bp, Homo sapiens
tttaaaggaaaca

SEQ ID NO: 6587923 - DNA, 13 bp, Homo sapiens
tttaaaggaaagt

SEQ ID NO: 6587924 - DNA, 19 bp, Homo sapiens
tttaaaggcccagccccta

SEQ ID NO: 6587925 - DNA, 23 bp, Homo sapiens
tttaaaggcccagcccctagaaa

SEQ ID NO: 6587926 - DNA, 18 bp, Homo sapiens
tttaaaggctttttggtg

SEQ ID NO: 6587927 - DNA, 21 bp, Homo sapiens
tttaaagggacagtttgtaac

SEQ ID NO: 6587928 - DNA, 21 bp, Homo sapiens
tttaaagggagccatgctctt

SEQ ID NO: 6587929 - DNA, 14 bp, Homo sapiens
tttaaaggttttta

SEQ ID NO: 6587930 - DNA, 23 bp, Homo sapiens
tttaaagtaaaaggcactgcaca

SEQ ID NO: 6587931 - DNA, 16 bp, Homo sapiens
tttaaagtaaacttgt

SEQ ID NO: 6587932 - DNA, 20 bp, Homo sapiens
tttaaagtaaacttgtgtat

SEQ ID NO: 6587933 - DNA, 17 bp, Homo sapiens
tttaaagtaaatctctt

SEQ ID NO: 6587934 - DNA, 18 bp, Homo sapiens
tttaaagtaaattattaa

SEQ ID NO: 6587935 - DNA, 13 bp, Homo sapiens
tttaaagtaattt

SEQ ID NO: 6587936 - DNA, 17 bp, Homo sapiens
tttaaagtacctgtagt

SEQ ID NO: 6587937 - DNA, 22 bp, Homo sapiens
tttaaagtactgagcagtatta

SEQ ID NO: 6587938 - DNA, 22 bp, Homo sapiens
tttaaagtatatgtgcagtctt

SEQ ID NO: 6587939 - DNA, 18 bp, Homo sapiens
tttaaagtcacatccctg

SEQ ID NO: 6587940 - DNA, 19 bp, Homo sapiens
tttaaagtctttccgtctc

SEQ ID NO: 6587941 - DNA, 15 bp, Homo sapiens
tttaaagtgtacatt

SEQ ID NO: 6587942 - DNA, 18 bp, Homo sapiens
tttaaagtgtttcagcta

SEQ ID NO: 6587943 - DNA, 16 bp, Homo sapiens
tttaaagttaaaactg

SEQ ID NO: 6587944 - DNA, 12 bp, Homo sapiens
tttaaagttctg

SEQ ID NO: 6587945 - DNA, 15 bp, Homo sapiens
tttaaagttctgtgt

SEQ ID NO: 6587946 - DNA, 21 bp, Homo sapiens
tttaaagttctgtgtatttaa

SEQ ID NO: 6587947 - DNA, 15 bp, Homo sapiens
tttaaagttcttatt

SEQ ID NO: 6587948 - DNA, 20 bp, Homo sapiens
tttaaagttcttattttagt

SEQ ID NO: 6587949 - DNA, 22 bp, Homo sapiens
tttaaagttggtgcatctagaa

SEQ ID NO: 6587950 - DNA, 14 bp, Homo sapiens
tttaaagtttaaat

SEQ ID NO: 6587951 - DNA, 15 bp, Homo sapiens
tttaaagtttaaata

SEQ ID NO: 6587952 - DNA, 15 bp, Homo sapiens
tttaaagtttccttt

SEQ ID NO: 6587953 - DNA, 15 bp, Homo sapiens
tttaaagtttgttca

SEQ ID NO: 6587954 - DNA, 14 bp, Homo sapiens
tttaaataaaagag

SEQ ID NO: 6587955 - DNA, 17 bp, Homo sapiens
tttaaataaaagcacaa

SEQ ID NO: 6587956 - DNA, 22 bp, Homo sapiens
tttaaataaactttttttcaat

SEQ ID NO: 6587957 - DNA, 21 bp, Homo sapiens
tttaaataaataaatagctag

SEQ ID NO: 6587958 - DNA, 18 bp, Homo sapiens
tttaaataaatgttattg

SEQ ID NO: 6587959 - DNA, 16 bp, Homo sapiens
tttaaataaattaaga

SEQ ID NO: 6587960 - DNA, 18 bp, Homo sapiens
tttaaataaattgtgaaa

SEQ ID NO: 6587961 - DNA, 21 bp, Homo sapiens
tttaaataaattgtgaaaaaa

SEQ ID NO: 6587962 - DNA, 12 bp, Homo sapiens
tttaaataacct

SEQ ID NO: 6587963 - DNA, 11 bp, Homo sapiens
tttaaataatt

SEQ ID NO: 6587964 - DNA, 14 bp, Homo sapiens
tttaaatacataaa

SEQ ID NO: 6587965 - DNA, 18 bp, Homo sapiens
tttaaatataaaaatggg

SEQ ID NO: 6587966 - DNA, 17 bp, Homo sapiens
tttaaatataaatgttt

SEQ ID NO: 6587967 - DNA, 22 bp, Homo sapiens
tttaaatataagtaatgaaggc

SEQ ID NO: 6587968 - DNA, 12 bp, Homo sapiens
tttaaatataat

SEQ ID NO: 6587969 - DNA, 13 bp, Homo sapiens
tttaaatataatt

SEQ ID NO: 6587970 - DNA, 23 bp, Homo sapiens
tttaaatatatattattctcatt

SEQ ID NO: 6587971 - DNA, 14 bp, Homo sapiens
tttaaatatcattc

SEQ ID NO: 6587972 - DNA, 20 bp, Homo sapiens
tttaaatatccatttatctt

SEQ ID NO: 6587973 - DNA, 12 bp, Homo sapiens
tttaaatatgaa

SEQ ID NO: 6587974 - DNA, 20 bp, Homo sapiens
tttaaatatgaaagcctagt

SEQ ID NO: 6587975 - DNA, 13 bp, Homo sapiens
tttaaatatgaat

SEQ ID NO: 6587976 - DNA, 14 bp, Homo sapiens
tttaaatatgaatg

SEQ ID NO: 6587977 - DNA, 17 bp, Homo sapiens
tttaaatatgaatgaac

SEQ ID NO: 6587978 - DNA, 14 bp, Homo sapiens
tttaaatattttct

SEQ ID NO: 6587979 - DNA, 15 bp, Homo sapiens
tttaaatattttcta

SEQ ID NO: 6587980 - DNA, 12 bp, Homo sapiens
tttaaatcaaaa

SEQ ID NO: 6587981 - DNA, 19 bp, Homo sapiens
tttaaatcaaaaacttttc

SEQ ID NO: 6587982 - DNA, 22 bp, Homo sapiens
tttaaatcaaactgtaaaactt

SEQ ID NO: 6587983 - DNA, 15 bp, Homo sapiens
tttaaatcaaggaaa

SEQ ID NO: 6587984 - DNA, 14 bp, Homo sapiens
tttaaatcatgtat

SEQ ID NO: 6587985 - DNA, 17 bp, Homo sapiens
tttaaatcatgtatgtt

SEQ ID NO: 6587986 - DNA, 21 bp, Homo sapiens
tttaaatcatgtatgttatga

SEQ ID NO: 6587987 - DNA, 14 bp, Homo sapiens
tttaaatcattcat

SEQ ID NO: 6587988 - DNA, 14 bp, Homo sapiens
tttaaatcatttca

SEQ ID NO: 6587989 - DNA, 19 bp, Homo sapiens
tttaaatctaaatctattt

SEQ ID NO: 6587990 - DNA, 23 bp, Homo sapiens
tttaaatctatctatataatgta

SEQ ID NO: 6587991 - DNA, 19 bp, Homo sapiens
tttaaatctgcagcacatt

SEQ ID NO: 6587992 - DNA, 16 bp, Homo sapiens
tttaaatcttcaatat

SEQ ID NO: 6587993 - DNA, 19 bp, Homo sapiens
tttaaatctttgttaaaat

SEQ ID NO: 6587994 - DNA, 22 bp, Homo sapiens
tttaaatctttgttaaaatata

SEQ ID NO: 6587995 - DNA, 14 bp, Homo sapiens
tttaaatcttttct

SEQ ID NO: 6587996 - DNA, 14 bp, Homo sapiens
tttaaatgaaagga

SEQ ID NO: 6587997 - DNA, 21 bp, Homo sapiens
tttaaatgaacaagagaagca

SEQ ID NO: 6587998 - DNA, 21 bp, Homo sapiens
tttaaatgacagcacctgaga

SEQ ID NO: 6587999 - DNA, 14 bp, Homo sapiens
tttaaatgacagta

SEQ ID NO: 6588000 - DNA, 20 bp, Homo sapiens
tttaaatgatgattccttga

SEQ ID NO: 6588001 - DNA, 11 bp, Homo sapiens
tttaaatgcac

SEQ ID NO: 6588002 - DNA, 17 bp, Homo sapiens
tttaaatgcacagttct

SEQ ID NO: 6588003 - DNA, 18 bp, Homo sapiens
tttaaatgcacagttcta

SEQ ID NO: 6588004 - DNA, 20 bp, Homo sapiens
tttaaatgcacagttctatt

SEQ ID NO: 6588005 - DNA, 18 bp, Homo sapiens
tttaaatgcataaatgca

SEQ ID NO: 6588006 - DNA, 23 bp, Homo sapiens
tttaaatgcatgtcttaaatgct

SEQ ID NO: 6588007 - DNA, 12 bp, Homo sapiens
tttaaatgccaa

SEQ ID NO: 6588008 - DNA, 13 bp, Homo sapiens
tttaaatgccaaa

SEQ ID NO: 6588009 - DNA, 12 bp, Homo sapiens
tttaaatgccat

SEQ ID NO: 6588010 - DNA, 14 bp, Homo sapiens
tttaaatgctttta

SEQ ID NO: 6588011 - DNA, 21 bp, Homo sapiens
tttaaatggcagtatttcatt

SEQ ID NO: 6588012 - DNA, 18 bp, Homo sapiens
tttaaatggtaagagttt

SEQ ID NO: 6588013 - DNA, 18 bp, Homo sapiens
tttaaatggttctgtgct

SEQ ID NO: 6588014 - DNA, 20 bp, Homo sapiens
tttaaatgtacagacatatt

SEQ ID NO: 6588015 - DNA, 18 bp, Homo sapiens
tttaaatgtacttatatt

SEQ ID NO: 6588016 - DNA, 13 bp, Homo sapiens
tttaaatgtcaaa

SEQ ID NO: 6588017 - DNA, 14 bp, Homo sapiens
tttaaatgtggaat

SEQ ID NO: 6588018 - DNA, 10 bp, Homo sapiens
tttaaatgtt

SEQ ID NO: 6588019 - DNA, 17 bp, Homo sapiens
tttaaatgttctaacag

SEQ ID NO: 6588020 - DNA, 16 bp, Homo sapiens
tttaaatgttgaaatc

SEQ ID NO: 6588021 - DNA, 15 bp, Homo sapiens
tttaaatgtttacta

SEQ ID NO: 6588022 - DNA, 18 bp, Homo sapiens
tttaaatgtttttctatg

SEQ ID NO: 6588023 - DNA, 19 bp, Homo sapiens
tttaaattaaaattttatg

SEQ ID NO: 6588024 - DNA, 19 bp, Homo sapiens
tttaaattaagtcattttg

SEQ ID NO: 6588025 - DNA, 13 bp, Homo sapiens
tttaaattacaat

SEQ ID NO: 6588026 - DNA, 14 bp, Homo sapiens
tttaaattagaaaa

SEQ ID NO: 6588027 - DNA, 20 bp, Homo sapiens
tttaaattataacttaaaat

SEQ ID NO: 6588028 - DNA, 19 bp, Homo sapiens
tttaaattataagatgtca

SEQ ID NO: 6588029 - DNA, 18 bp, Homo sapiens
tttaaattataaggactg

SEQ ID NO: 6588030 - DNA, 21 bp, Homo sapiens
tttaaattataaggactgcat

SEQ ID NO: 6588031 - DNA, 22 bp, Homo sapiens
tttaaattataaggactgcatg

SEQ ID NO: 6588032 - DNA, 19 bp, Homo sapiens
tttaaattatgttttactg

SEQ ID NO: 6588033 - DNA, 17 bp, Homo sapiens
tttaaattatttatatt

SEQ ID NO: 6588034 - DNA, 18 bp, Homo sapiens
tttaaattccactgaaaa

SEQ ID NO: 6588035 - DNA, 17 bp, Homo sapiens
tttaaattctgagacat

SEQ ID NO: 6588036 - DNA, 11 bp, Homo sapiens
tttaaattgca

SEQ ID NO: 6588037 - DNA, 23 bp, Homo sapiens
tttaaattgctcacagttattac

SEQ ID NO: 6588038 - DNA, 15 bp, Homo sapiens
tttaaattggagaaa

SEQ ID NO: 6588039 - DNA, 14 bp, Homo sapiens
tttaaattggttca

SEQ ID NO: 6588040 - DNA, 20 bp, Homo sapiens
tttaaattgtaaattttaga

SEQ ID NO: 6588041 - DNA, 11 bp, Homo sapiens
tttaaattgtg

SEQ ID NO: 6588042 - DNA, 15 bp, Homo sapiens
tttaaattgtggatg

SEQ ID NO: 6588043 - DNA, 12 bp, Homo sapiens
tttaaattgtgt

SEQ ID NO: 6588044 - DNA, 19 bp, Homo sapiens
tttaaattgttataacttc

SEQ ID NO: 6588045 - DNA, 17 bp, Homo sapiens
tttaaatttcttttatt

SEQ ID NO: 6588046 - DNA, 18 bp, Homo sapiens
tttaaatttgatttccat

SEQ ID NO: 6588047 - DNA, 11 bp, Homo sapiens
tttaaatttgg

SEQ ID NO: 6588048 - DNA, 16 bp, Homo sapiens
tttaaattttattatt

SEQ ID NO: 6588049 - DNA, 17 bp, Homo sapiens
tttaaattttcttcagt

SEQ ID NO: 6588050 - DNA, 21 bp, Homo sapiens
tttaaattttgcactgctcaa

SEQ ID NO: 6588051 - DNA, 15 bp, Homo sapiens
tttaaattttgtaat

SEQ ID NO: 6588052 - DNA, 23 bp, Homo sapiens
tttaacaaaaaacagattctata

SEQ ID NO: 6588053 - DNA, 16 bp, Homo sapiens
tttaacaaaaaatgta

SEQ ID NO: 6588054 - DNA, 12 bp, Homo sapiens
tttaacaaaaca

SEQ ID NO: 6588055 - DNA, 22 bp, Homo sapiens
tttaacaaaacaagaaagaaac

SEQ ID NO: 6588056 - DNA, 14 bp, Homo sapiens
tttaacaaactaaa

SEQ ID NO: 6588057 - DNA, 17 bp, Homo sapiens
tttaacaaactaaaaat

SEQ ID NO: 6588058 - DNA, 13 bp, Homo sapiens
tttaacaaatcta

SEQ ID NO: 6588059 - DNA, 17 bp, Homo sapiens
tttaacaaatctaatct

SEQ ID NO: 6588060 - DNA, 19 bp, Homo sapiens
tttaacaaatctaatctct

SEQ ID NO: 6588061 - DNA, 23 bp, Homo sapiens
tttaacaaatctaatctcttatt

SEQ ID NO: 6588062 - DNA, 21 bp, Homo sapiens
tttaacaagaagatgaatggc

SEQ ID NO: 6588063 - DNA, 17 bp, Homo sapiens
tttaacaagatttcagc

SEQ ID NO: 6588064 - DNA, 19 bp, Homo sapiens
tttaacaagtatttattcc

SEQ ID NO: 6588065 - DNA, 22 bp, Homo sapiens
tttaacaataactactgtgttc

SEQ ID NO: 6588066 - DNA, 21 bp, Homo sapiens
tttaacaatgacaagatgttc

SEQ ID NO: 6588067 - DNA, 11 bp, Homo sapiens
tttaacaatgc

SEQ ID NO: 6588068 - DNA, 18 bp, Homo sapiens
tttaacaatgcgaatggt

SEQ ID NO: 6588069 - DNA, 20 bp, Homo sapiens
tttaacaatgcgaatggtag

SEQ ID NO: 6588070 - DNA, 23 bp, Homo sapiens
tttaacaatttcctttatattta

SEQ ID NO: 6588071 - DNA, 18 bp, Homo sapiens
tttaacacacataaagga

SEQ ID NO: 6588072 - DNA, 19 bp, Homo sapiens
tttaacacataactagaaa

SEQ ID NO: 6588073 - DNA, 18 bp, Homo sapiens
tttaacacattctttata

SEQ ID NO: 6588074 - DNA, 18 bp, Homo sapiens
tttaacacctgatgtgta

SEQ ID NO: 6588075 - DNA, 12 bp, Homo sapiens
tttaacactgag

SEQ ID NO: 6588076 - DNA, 17 bp, Homo sapiens
tttaacactgagtgaaa

SEQ ID NO: 6588077 - DNA, 17 bp, Homo sapiens
tttaacacttaaatttc

SEQ ID NO: 6588078 - DNA, 20 bp, Homo sapiens
tttaacacttaaatttcttg

SEQ ID NO: 6588079 - DNA, 13 bp, Homo sapiens
tttaacactttgt

SEQ ID NO: 6588080 - DNA, 14 bp, Homo sapiens
tttaacactttgta

SEQ ID NO: 6588081 - DNA, 14 bp, Homo sapiens
tttaacagaaatgt

SEQ ID NO: 6588082 - DNA, 18 bp, Homo sapiens
tttaacagaaatgtacag

SEQ ID NO: 6588083 - DNA, 19 bp, Homo sapiens
tttaacagaaattgtatat

SEQ ID NO: 6588084 - DNA, 21 bp, Homo sapiens
tttaacagaaattgtatattg

SEQ ID NO: 6588085 - DNA, 15 bp, Homo sapiens
tttaacagaaccaga

SEQ ID NO: 6588086 - DNA, 17 bp, Homo sapiens
tttaacagaaccagagg

SEQ ID NO: 6588087 - DNA, 18 bp, Homo sapiens
tttaacagacatgtatac

SEQ ID NO: 6588088 - DNA, 15 bp, Homo sapiens
tttaacagatattta

SEQ ID NO: 6588089 - DNA, 24 bp, Homo sapiens
tttaacaggttttcttctaatcat

SEQ ID NO: 6588090 - DNA, 14 bp, Homo sapiens
tttaacagtaatgt

SEQ ID NO: 6588091 - DNA, 22 bp, Homo sapiens
tttaacagtatccccttctcat

SEQ ID NO: 6588092 - DNA, 15 bp, Homo sapiens
tttaacagtcattta

SEQ ID NO: 6588093 - DNA, 17 bp, Homo sapiens
tttaacagtcatttaaa

SEQ ID NO: 6588094 - DNA, 14 bp, Homo sapiens
tttaacagtgcaaa

SEQ ID NO: 6588095 - DNA, 12 bp, Homo sapiens
tttaacagtttt

SEQ ID NO: 6588096 - DNA, 14 bp, Homo sapiens
tttaacataaaggt

SEQ ID NO: 6588097 - DNA, 20 bp, Homo sapiens
tttaacataaattgtactgt

SEQ ID NO: 6588098 - DNA, 18 bp, Homo sapiens
tttaacataagctatttt

SEQ ID NO: 6588099 - DNA, 19 bp, Homo sapiens
tttaacataagctattttt

SEQ ID NO: 6588100 - DNA, 18 bp, Homo sapiens
tttaacatacaagaaaat

SEQ ID NO: 6588101 - DNA, 21 bp, Homo sapiens
tttaacatacaagaaaatgta

SEQ ID NO: 6588102 - DNA, 11 bp, Homo sapiens
tttaacatagc

SEQ ID NO: 6588103 - DNA, 20 bp, Homo sapiens
tttaacataggttttgattt

SEQ ID NO: 6588104 - DNA, 21 bp, Homo sapiens
tttaacatcactacaaaaaga

SEQ ID NO: 6588105 - DNA, 21 bp, Homo sapiens
tttaacatcagaactgaaata

SEQ ID NO: 6588106 - DNA, 19 bp, Homo sapiens
tttaacatccttattcagc

SEQ ID NO: 6588107 - DNA, 23 bp, Homo sapiens
tttaacatgaacacccttagaaa

SEQ ID NO: 6588108 - DNA, 12 bp, Homo sapiens
tttaacatgtga

SEQ ID NO: 6588109 - DNA, 13 bp, Homo sapiens
tttaacattcctc

SEQ ID NO: 6588110 - DNA, 23 bp, Homo sapiens
tttaacattcttttgtttatatt

SEQ ID NO: 6588111 - DNA, 16 bp, Homo sapiens
tttaacattgtttttg

SEQ ID NO: 6588112 - DNA, 17 bp, Homo sapiens
tttaacattttggaaat

SEQ ID NO: 6588113 - DNA, 21 bp, Homo sapiens
tttaacattttggaaattgtt

SEQ ID NO: 6588114 - DNA, 19 bp, Homo sapiens
tttaacattttgtttccaa

SEQ ID NO: 6588115 - DNA, 14 bp, Homo sapiens
tttaaccaaaacat

SEQ ID NO: 6588116 - DNA, 17 bp, Homo sapiens
tttaaccaaacaattat

SEQ ID NO: 6588117 - DNA, 19 bp, Homo sapiens
tttaaccaaacaattattt

SEQ ID NO: 6588118 - DNA, 12 bp, Homo sapiens
tttaaccaaagg

SEQ ID NO: 6588119 - DNA, 17 bp, Homo sapiens
tttaaccaaggaggggc

SEQ ID NO: 6588120 - DNA, 19 bp, Homo sapiens
tttaaccaagttgtttatt

SEQ ID NO: 6588121 - DNA, 21 bp, Homo sapiens
tttaaccaagttgtttattcc

SEQ ID NO: 6588122 - DNA, 20 bp, Homo sapiens
tttaaccaataactagcttc

SEQ ID NO: 6588123 - DNA, 22 bp, Homo sapiens
tttaaccaggggtcctaaccac

SEQ ID NO: 6588124 - DNA, 20 bp, Homo sapiens
tttaaccataaatcaattca

SEQ ID NO: 6588125 - DNA, 15 bp, Homo sapiens
tttaaccatctgata

SEQ ID NO: 6588126 - DNA, 20 bp, Homo sapiens
tttaaccattaaaactgaag

SEQ ID NO: 6588127 - DNA, 20 bp, Homo sapiens
tttaaccattattatgcaaa

SEQ ID NO: 6588128 - DNA, 22 bp, Homo sapiens
tttaaccattgtcttgttctgt

SEQ ID NO: 6588129 - DNA, 16 bp, Homo sapiens
tttaacccaaaagatt

SEQ ID NO: 6588130 - DNA, 16 bp, Homo sapiens
tttaaccccgtcaaca

SEQ ID NO: 6588131 - DNA, 13 bp, Homo sapiens
tttaacccctcca

SEQ ID NO: 6588132 - DNA, 18 bp, Homo sapiens
tttaaccctctcttccct

SEQ ID NO: 6588133 - DNA, 16 bp, Homo sapiens
tttaaccgtttttcaa

SEQ ID NO: 6588134 - DNA, 21 bp, Homo sapiens
tttaacctagatgtttaacaa

SEQ ID NO: 6588135 - DNA, 16 bp, Homo sapiens
tttaacctatgatatt

SEQ ID NO: 6588136 - DNA, 22 bp, Homo sapiens
tttaacctcaggttccaaattc

SEQ ID NO: 6588137 - DNA, 14 bp, Homo sapiens
tttaacctcttttt

SEQ ID NO: 6588138 - DNA, 22 bp, Homo sapiens
tttaacctctttttaaggacac

SEQ ID NO: 6588139 - DNA, 21 bp, Homo sapiens
tttaacctgcaagttgctctg

SEQ ID NO: 6588140 - DNA, 13 bp, Homo sapiens
tttaacctgtttt

SEQ ID NO: 6588141 - DNA, 16 bp, Homo sapiens
tttaacggcagtgtca

SEQ ID NO: 6588142 - DNA, 17 bp, Homo sapiens
tttaacggcagtgtcat

SEQ ID NO: 6588143 - DNA, 19 bp, Homo sapiens
tttaacgtggcttgtagaa

SEQ ID NO: 6588144 - DNA, 18 bp, Homo sapiens
tttaacgttctgctgctt

SEQ ID NO: 6588145 - DNA, 21 bp, Homo sapiens
tttaacgttgatgtaatgaaa

SEQ ID NO: 6588146 - DNA, 14 bp, Homo sapiens
tttaactaaatttt

SEQ ID NO: 6588147 - DNA, 17 bp, Homo sapiens
tttaactaaattttaaa

SEQ ID NO: 6588148 - DNA, 17 bp, Homo sapiens
tttaactacccttaatt

SEQ ID NO: 6588149 - DNA, 16 bp, Homo sapiens
tttaactagcacttta

SEQ ID NO: 6588150 - DNA, 18 bp, Homo sapiens
tttaactagcactttata

SEQ ID NO: 6588151 - DNA, 24 bp, Homo sapiens
tttaactcaatattttccatgaaa

SEQ ID NO: 6588152 - DNA, 18 bp, Homo sapiens
tttaactcaggactccag

SEQ ID NO: 6588153 - DNA, 22 bp, Homo sapiens
tttaactcataatttttgcaga

SEQ ID NO: 6588154 - DNA, 22 bp, Homo sapiens
tttaactcatacctttaaagga

SEQ ID NO: 6588155 - DNA, 22 bp, Homo sapiens
aatccccatcattactggtaaa

SEQ ID NO: 6588156 - DNA, 13 bp, Homo sapiens
aatcccccaggag

SEQ ID NO: 6588157 - DNA, 15 bp, Homo sapiens
aatcccccttgccac

SEQ ID NO: 6588158 - DNA, 22 bp, Homo sapiens
aatccccggctgcttccttctg

SEQ ID NO: 6588159 - DNA, 12 bp, Homo sapiens
aatcccctcctt

SEQ ID NO: 6588160 - DNA, 18 bp, Homo sapiens
aatcccctccttgggcac

SEQ ID NO: 6588161 - DNA, 19 bp, Homo sapiens
aatcccctccttgggcact

SEQ ID NO: 6588162 - DNA, 15 bp, Homo sapiens
aatccccttatgact

SEQ ID NO: 6588163 - DNA, 16 bp, Homo sapiens
aatccccttctcccct

SEQ ID NO: 6588164 - DNA, 17 bp, Homo sapiens
aatccccttctcccctg

SEQ ID NO: 6588165 - DNA, 17 bp, Homo sapiens
aatcccgccacctatct

SEQ ID NO: 6588166 - DNA, 17 bp, Homo sapiens
aatcccggctccagagc

SEQ ID NO: 6588167 - DNA, 18 bp, Homo sapiens
aatcccggctccagagca

SEQ ID NO: 6588168 - DNA, 15 bp, Homo sapiens
aatcccgggctaaga

SEQ ID NO: 6588169 - DNA, 18 bp, Homo sapiens
aatcccggtttcagaagc

SEQ ID NO: 6588170 - DNA, 16 bp, Homo sapiens
aatccctatgttgcta

SEQ ID NO: 6588171 - DNA, 10 bp, Homo sapiens
aatccctcaa

SEQ ID NO: 6588172 - DNA, 16 bp, Homo sapiens
aatccctctccactct

SEQ ID NO: 6588173 - DNA, 20 bp, Homo sapiens
aatccctcttcctccaaagc

SEQ ID NO: 6588174 - DNA, 23 bp, Homo sapiens
aatccctgccactgggctctgga

SEQ ID NO: 6588175 - DNA, 13 bp, Homo sapiens
aatccctgctttt

SEQ ID NO: 6588176 - DNA, 14 bp, Homo sapiens
aatccctggcaaag

SEQ ID NO: 6588177 - DNA, 19 bp, Homo sapiens
aatccctgggcattgcttt

SEQ ID NO: 6588178 - DNA, 18 bp, Homo sapiens
aatccctggggctgtgca

SEQ ID NO: 6588179 - DNA, 18 bp, Homo sapiens
aatccctgtgttaattta

SEQ ID NO: 6588180 - DNA, 19 bp, Homo sapiens
aatccctgtgttaatttaa

SEQ ID NO: 6588181 - DNA, 14 bp, Homo sapiens
aatccctgttcatt

SEQ ID NO: 6588182 - DNA, 23 bp, Homo sapiens
aatccctgtttaatatttaaaca

SEQ ID NO: 6588183 - DNA, 15 bp, Homo sapiens
aatcccttaaaatta

SEQ ID NO: 6588184 - DNA, 21 bp, Homo sapiens
aatcccttaatatcctaaaca

SEQ ID NO: 6588185 - DNA, 12 bp, Homo sapiens
aatcccttcata

SEQ ID NO: 6588186 - DNA, 18 bp, Homo sapiens
aatcccttcatacttgaa

SEQ ID NO: 6588187 - DNA, 16 bp, Homo sapiens
aatcccttcctctccc

SEQ ID NO: 6588188 - DNA, 18 bp, Homo sapiens
aatcccttcctctcccat

SEQ ID NO: 6588189 - DNA, 23 bp, Homo sapiens
aatcccttgtacctatggctgcc

SEQ ID NO: 6588190 - DNA, 23 bp, Homo sapiens
aatccctttattaccccctcctt

SEQ ID NO: 6588191 - DNA, 12 bp, Homo sapiens
aatccctttctg

SEQ ID NO: 6588192 - DNA, 23 bp, Homo sapiens
aatcccttttatctattagataa

SEQ ID NO: 6588193 - DNA, 20 bp, Homo sapiens
aatccgaacctcctctgtga

SEQ ID NO: 6588194 - DNA, 21 bp, Homo sapiens
aatccgaccactaattgccaa

SEQ ID NO: 6588195 - DNA, 18 bp, Homo sapiens
aatccgccagtgtttctg

SEQ ID NO: 6588196 - DNA, 12 bp, Homo sapiens
aatccgcccatc

SEQ ID NO: 6588197 - DNA, 17 bp, Homo sapiens
aatccgctctcttcctg

SEQ ID NO: 6588198 - DNA, 19 bp, Homo sapiens
aatccgctctcttcctgcc

SEQ ID NO: 6588199 - DNA, 20 bp, Homo sapiens
aatccgctctcttcctgccc

SEQ ID NO: 6588200 - DNA, 17 bp, Homo sapiens
aatccggtcagccaagt

SEQ ID NO: 6588201 - DNA, 23 bp, Homo sapiens
aatccggttttagttgagtcttc

SEQ ID NO: 6588202 - DNA, 19 bp, Homo sapiens
aatccgtattgaatttgtg

SEQ ID NO: 6588203 - DNA, 16 bp, Homo sapiens
aatcctaatttctcct

SEQ ID NO: 6588204 - DNA, 24 bp, Homo sapiens
aatcctaatttctcctcccttcct

SEQ ID NO: 6588205 - DNA, 16 bp, Homo sapiens
aatcctacagtgaaat

SEQ ID NO: 6588206 - DNA, 21 bp, Homo sapiens
aatcctacttctatatcatta

SEQ ID NO: 6588207 - DNA, 23 bp, Homo sapiens
aatcctagaaccaagcttcagag

SEQ ID NO: 6588208 - DNA, 15 bp, Homo sapiens
aatcctagaagcaaa

SEQ ID NO: 6588209 - DNA, 21 bp, Homo sapiens
aatcctagactgctcctgggc

SEQ ID NO: 6588210 - DNA, 22 bp, Homo sapiens
aatcctagactgctcctgggca

SEQ ID NO: 6588211 - DNA, 15 bp, Homo sapiens
aatcctagagattct

SEQ ID NO: 6588212 - DNA, 19 bp, Homo sapiens
aatcctagccattgacaat

SEQ ID NO: 6588213 - DNA, 20 bp, Homo sapiens
aatcctagtttgctgtggcc

SEQ ID NO: 6588214 - DNA, 15 bp, Homo sapiens
aatcctatatctgtt

SEQ ID NO: 6588215 - DNA, 23 bp, Homo sapiens
aatcctatctggggagctcctgg

SEQ ID NO: 6588216 - DNA, 21 bp, Homo sapiens
aatcctattaaaacacagctt

SEQ ID NO: 6588217 - DNA, 15 bp, Homo sapiens
aatcctattactctt

SEQ ID NO: 6588218 - DNA, 15 bp, Homo sapiens
aatcctatttaaaga

SEQ ID NO: 6588219 - DNA, 18 bp, Homo sapiens
aatcctcaggatttcatt

SEQ ID NO: 6588220 - DNA, 21 bp, Homo sapiens
aatcctcccaaccaaccagca

SEQ ID NO: 6588221 - DNA, 23 bp, Homo sapiens
aatcctcccaaccaaccagcagg

SEQ ID NO: 6588222 - DNA, 12 bp, Homo sapiens
aatcctccctgg

SEQ ID NO: 6588223 - DNA, 13 bp, Homo sapiens
aatcctccctgga

SEQ ID NO: 6588224 - DNA, 16 bp, Homo sapiens
aatcctccctggagaa

SEQ ID NO: 6588225 - DNA, 14 bp, Homo sapiens
aatcctcccttccc

SEQ ID NO: 6588226 - DNA, 11 bp, Homo sapiens
aatcctcctcc

SEQ ID NO: 6588227 - DNA, 11 bp, Homo sapiens
aatcctcctga

SEQ ID NO: 6588228 - DNA, 12 bp, Homo sapiens
aatcctcctgag

SEQ ID NO: 6588229 - DNA, 13 bp, Homo sapiens
aatcctcctgcct

SEQ ID NO: 6588230 - DNA, 17 bp, Homo sapiens
aatcctctgttaatgtg

SEQ ID NO: 6588231 - DNA, 13 bp, Homo sapiens
aatcctcttcctc

SEQ ID NO: 6588232 - DNA, 17 bp, Homo sapiens
aatcctcttcctctgag

SEQ ID NO: 6588233 - DNA, 20 bp, Homo sapiens
aatcctcttcctctgaggct

SEQ ID NO: 6588234 - DNA, 23 bp, Homo sapiens
aatcctcttttgtattgtttcta

SEQ ID NO: 6588235 - DNA, 17 bp, Homo sapiens
aatcctgaactttctcc

SEQ ID NO: 6588236 - DNA, 22 bp, Homo sapiens
aatcctgaagaaaccacaggtt

SEQ ID NO: 6588237 - DNA, 18 bp, Homo sapiens
aatcctgaataaaccagt

SEQ ID NO: 6588238 - DNA, 21 bp, Homo sapiens
aatcctgaggctggtagcaga

SEQ ID NO: 6588239 - DNA, 17 bp, Homo sapiens
aatcctgcaatgaaagg

SEQ ID NO: 6588240 - DNA, 13 bp, Homo sapiens
aatcctgcacaga

SEQ ID NO: 6588241 - DNA, 17 bp, Homo sapiens
aatcctgccactgtttt

SEQ ID NO: 6588242 - DNA, 16 bp, Homo sapiens
aatcctgccatttaaa

SEQ ID NO: 6588243 - DNA, 17 bp, Homo sapiens
aatcctgcccaaaatgt

SEQ ID NO: 6588244 - DNA, 22 bp, Homo sapiens
aatcctgcccaaaatgtgaagc

SEQ ID NO: 6588245 - DNA, 13 bp, Homo sapiens
aatcctgcctctc

SEQ ID NO: 6588246 - DNA, 19 bp, Homo sapiens
aatcctgcggcaggactgc

SEQ ID NO: 6588247 - DNA, 23 bp, Homo sapiens
aatcctgcggcaggactgcagag

SEQ ID NO: 6588248 - DNA, 19 bp, Homo sapiens
aatcctgctctaaaataca

SEQ ID NO: 6588249 - DNA, 21 bp, Homo sapiens
aatcctggaaggacacagtga

SEQ ID NO: 6588250 - DNA, 14 bp, Homo sapiens
aatcctggacagct

SEQ ID NO: 6588251 - DNA, 20 bp, Homo sapiens
aatcctggagtctcactgtc

SEQ ID NO: 6588252 - DNA, 19 bp, Homo sapiens
aatcctggccctctgtgtt

SEQ ID NO: 6588253 - DNA, 15 bp, Homo sapiens
aatcctggctctgat

SEQ ID NO: 6588254 - DNA, 13 bp, Homo sapiens
aatcctgggcccc

SEQ ID NO: 6588255 - DNA, 14 bp, Homo sapiens
aatcctggggaaca

SEQ ID NO: 6588256 - DNA, 19 bp, Homo sapiens
aatcctggtaaccaaatat

SEQ ID NO: 6588257 - DNA, 18 bp, Homo sapiens
aatcctgtaggaaggtac

SEQ ID NO: 6588258 - DNA, 22 bp, Homo sapiens
aatcctgtaggaaggtactgta

SEQ ID NO: 6588259 - DNA, 16 bp, Homo sapiens
aatcctgtaggcacaa

SEQ ID NO: 6588260 - DNA, 20 bp, Homo sapiens
aatcctgtcaatgtttgctt

SEQ ID NO: 6588261 - DNA, 15 bp, Homo sapiens
aatcctgtcctcagc

SEQ ID NO: 6588262 - DNA, 18 bp, Homo sapiens
aatcctgtcctcagcttc

SEQ ID NO: 6588263 - DNA, 14 bp, Homo sapiens
aatcctgtctgaaa

SEQ ID NO: 6588264 - DNA, 13 bp, Homo sapiens
aatcctgtgtttc

SEQ ID NO: 6588265 - DNA, 23 bp, Homo sapiens
aatcctgttaagagataattctt

SEQ ID NO: 6588266 - DNA, 18 bp, Homo sapiens
aatcctgttactctgtcc

SEQ ID NO: 6588267 - DNA, 19 bp, Homo sapiens
aatcctgttactctgtccc

SEQ ID NO: 6588268 - DNA, 22 bp, Homo sapiens
aatcctgtttttagtgctgact

SEQ ID NO: 6588269 - DNA, 13 bp, Homo sapiens
aatccttaacatt

SEQ ID NO: 6588270 - DNA, 22 bp, Homo sapiens
aatccttaatggccttaattaa

SEQ ID NO: 6588271 - DNA, 19 bp, Homo sapiens
aatccttacaaatgattgc

SEQ ID NO: 6588272 - DNA, 14 bp, Homo sapiens
aatccttacttcca

SEQ ID NO: 6588273 - DNA, 19 bp, Homo sapiens
aatccttagatctggcatg

SEQ ID NO: 6588274 - DNA, 20 bp, Homo sapiens
aatccttcaaaataaaaagt

SEQ ID NO: 6588275 - DNA, 12 bp, Homo sapiens
aatccttccaaa

SEQ ID NO: 6588276 - DNA, 15 bp, Homo sapiens
aatccttccatttct

SEQ ID NO: 6588277 - DNA, 17 bp, Homo sapiens
aatccttccatttcttc

SEQ ID NO: 6588278 - DNA, 21 bp, Homo sapiens
aatccttctagtttcccacaa

SEQ ID NO: 6588279 - DNA, 22 bp, Homo sapiens
aatccttctattctagcctgca

SEQ ID NO: 6588280 - DNA, 22 bp, Homo sapiens
aatccttctgcaactgaaatta

SEQ ID NO: 6588281 - DNA, 13 bp, Homo sapiens
aatccttgaagat

SEQ ID NO: 6588282 - DNA, 17 bp, Homo sapiens
aatccttgataatatat

SEQ ID NO: 6588283 - DNA, 16 bp, Homo sapiens
aatccttgccttcaaa

SEQ ID NO: 6588284 - DNA, 22 bp, Homo sapiens
aatccttggctgaattaaaatg

SEQ ID NO: 6588285 - DNA, 14 bp, Homo sapiens
aatccttgtattta

SEQ ID NO: 6588286 - DNA, 20 bp, Homo sapiens
aatccttgtgacttacaatt

SEQ ID NO: 6588287 - DNA, 13 bp, Homo sapiens
aatcctttcataa

SEQ ID NO: 6588288 - DNA, 21 bp, Homo sapiens
aatcctttctgccccccaggg

SEQ ID NO: 6588289 - DNA, 22 bp, Homo sapiens
aatcctttctgccccccagggc

SEQ ID NO: 6588290 - DNA, 23 bp, Homo sapiens
aatcctttctgccccccagggct

SEQ ID NO: 6588291 - DNA, 21 bp, Homo sapiens
aatcctttgagaatgtgattc

SEQ ID NO: 6588292 - DNA, 17 bp, Homo sapiens
aatccttttccttattt

SEQ ID NO: 6588293 - DNA, 13 bp, Homo sapiens
aatccttttgtag

SEQ ID NO: 6588294 - DNA, 20 bp, Homo sapiens
aatccttttgttttgaagct

SEQ ID NO: 6588295 - DNA, 20 bp, Homo sapiens
aatcctttttctttataaac

SEQ ID NO: 6588296 - DNA, 18 bp, Homo sapiens
aatcgaagtgtttatgta

SEQ ID NO: 6588297 - DNA, 16 bp, Homo sapiens
aatcgacctcactgtc

SEQ ID NO: 6588298 - DNA, 17 bp, Homo sapiens
aatcgagactgcaatgt

SEQ ID NO: 6588299 - DNA, 18 bp, Homo sapiens
aatcgaggaaccagagcc

SEQ ID NO: 6588300 - DNA, 14 bp, Homo sapiens
aatcgaggctgtgt

SEQ ID NO: 6588301 - DNA, 16 bp, Homo sapiens
aatcgaggctgtgtgt

SEQ ID NO: 6588302 - DNA, 14 bp, Homo sapiens
aatcgagtctacct

SEQ ID NO: 6588303 - DNA, 19 bp, Homo sapiens
aatcgagtgagacaaaatt

SEQ ID NO: 6588304 - DNA, 14 bp, Homo sapiens
aatcgatctgtact

SEQ ID NO: 6588305 - DNA, 18 bp, Homo sapiens
aatcgatctgtactgtaa

SEQ ID NO: 6588306 - DNA, 16 bp, Homo sapiens
aatcgcttgaacccag

SEQ ID NO: 6588307 - DNA, 20 bp, Homo sapiens
aatcgcttgaaccggggagg

SEQ ID NO: 6588308 - DNA, 12 bp, Homo sapiens
aatcggactgcc

SEQ ID NO: 6588309 - DNA, 22 bp, Homo sapiens
aatcggcaacagggcttctctt

SEQ ID NO: 6588310 - DNA, 18 bp, Homo sapiens
aatcggcagtattttctg

SEQ ID NO: 6588311 - DNA, 19 bp, Homo sapiens
aatcggcagtattttctgt

SEQ ID NO: 6588312 - DNA, 18 bp, Homo sapiens
aatcggcccacagctccc

SEQ ID NO: 6588313 - DNA, 22 bp, Homo sapiens
aatcggcccacagctcccaccc

SEQ ID NO: 6588314 - DNA, 17 bp, Homo sapiens
aatcggctcccgcttgc

SEQ ID NO: 6588315 - DNA, 19 bp, Homo sapiens
aatcggctcccgcttgctc

SEQ ID NO: 6588316 - DNA, 18 bp, Homo sapiens
aatcggctggggactgct

SEQ ID NO: 6588317 - DNA, 15 bp, Homo sapiens
aatcgggaaggatgg

SEQ ID NO: 6588318 - DNA, 17 bp, Homo sapiens
aatcgggaaggatggga

SEQ ID NO: 6588319 - DNA, 21 bp, Homo sapiens
aatcgtactacagaaattaag

SEQ ID NO: 6588320 - DNA, 13 bp, Homo sapiens
aatcgtgtgccat

SEQ ID NO: 6588321 - DNA, 23 bp, Homo sapiens
aatcgtgtgccatggatctgatc

SEQ ID NO: 6588322 - DNA, 17 bp, Homo sapiens
aatcgttatgtgtgtat

SEQ ID NO: 6588323 - DNA, 18 bp, Homo sapiens
aatcgttatgtgtgtata

SEQ ID NO: 6588324 - DNA, 17 bp, Homo sapiens
aatcgtttaatgtttat

SEQ ID NO: 6588325 - DNA, 14 bp, Homo sapiens
aatcgtttttaatt

SEQ ID NO: 6588326 - DNA, 19 bp, Homo sapiens
aatcgtttttgctgcagag

SEQ ID NO: 6588327 - DNA, 16 bp, Homo sapiens
aatctaaaaaatatct

SEQ ID NO: 6588328 - DNA, 14 bp, Homo sapiens
aatctaaaagcttt

SEQ ID NO: 6588329 - DNA, 15 bp, Homo sapiens
aatctaaaatgattg

SEQ ID NO: 6588330 - DNA, 20 bp, Homo sapiens
aatctaaaatggcagagaag

SEQ ID NO: 6588331 - DNA, 14 bp, Homo sapiens
aatctaaaatttca

SEQ ID NO: 6588332 - DNA, 19 bp, Homo sapiens
aatctaaaatttcataatt

SEQ ID NO: 6588333 - DNA, 14 bp, Homo sapiens
tttaactcatcttt

SEQ ID NO: 6588334 - DNA, 15 bp, Homo sapiens
tttaactcatcttta

SEQ ID NO: 6588335 - DNA, 19 bp, Homo sapiens
tttaactccctttttacac

SEQ ID NO: 6588336 - DNA, 18 bp, Homo sapiens
tttaactctactgtgtaa

SEQ ID NO: 6588337 - DNA, 19 bp, Homo sapiens
tttaactctataatgtgtt

SEQ ID NO: 6588338 - DNA, 12 bp, Homo sapiens
tttaactctgtc

SEQ ID NO: 6588339 - DNA, 14 bp, Homo sapiens
tttaactctgtctt

SEQ ID NO: 6588340 - DNA, 19 bp, Homo sapiens
tttaactgaagatgttgag

SEQ ID NO: 6588341 - DNA, 14 bp, Homo sapiens
tttaactgacaagc

SEQ ID NO: 6588342 - DNA, 15 bp, Homo sapiens
tttaactgcattcta

SEQ ID NO: 6588343 - DNA, 21 bp, Homo sapiens
tttaactgccaatccttaaat

SEQ ID NO: 6588344 - DNA, 21 bp, Homo sapiens
tttaactgcctaaaatgttct

SEQ ID NO: 6588345 - DNA, 17 bp, Homo sapiens
tttaactgcctttttgt

SEQ ID NO: 6588346 - DNA, 17 bp, Homo sapiens
tttaactggaaggctgc

SEQ ID NO: 6588347 - DNA, 12 bp, Homo sapiens
tttaactggcat

SEQ ID NO: 6588348 - DNA, 19 bp, Homo sapiens
tttaactggcatgtcattt

SEQ ID NO: 6588349 - DNA, 22 bp, Homo sapiens
tttaactggcatgtcatttgca

SEQ ID NO: 6588350 - DNA, 24 bp, Homo sapiens
tttaactggcttcattttaggaat

SEQ ID NO: 6588351 - DNA, 22 bp, Homo sapiens
tttaactggggtattaactttt

SEQ ID NO: 6588352 - DNA, 13 bp, Homo sapiens
tttaactggtgca

SEQ ID NO: 6588353 - DNA, 23 bp, Homo sapiens
tttaactggtgcactttgtaaat

SEQ ID NO: 6588354 - DNA, 17 bp, Homo sapiens
tttaactgtcccagcga

SEQ ID NO: 6588355 - DNA, 18 bp, Homo sapiens
tttaactgtggatattgt

SEQ ID NO: 6588356 - DNA, 21 bp, Homo sapiens
tttaactgtgttaaagtactt

SEQ ID NO: 6588357 - DNA, 13 bp, Homo sapiens
tttaacttaaata

SEQ ID NO: 6588358 - DNA, 16 bp, Homo sapiens
tttaacttaactctta

SEQ ID NO: 6588359 - DNA, 16 bp, Homo sapiens
tttaacttaactgaaa

SEQ ID NO: 6588360 - DNA, 17 bp, Homo sapiens
tttaacttagttttgca

SEQ ID NO: 6588361 - DNA, 13 bp, Homo sapiens
tttaacttattgt

SEQ ID NO: 6588362 - DNA, 13 bp, Homo sapiens
tttaacttattta

SEQ ID NO: 6588363 - DNA, 23 bp, Homo sapiens
tttaacttatttatatgaagcaa

SEQ ID NO: 6588364 - DNA, 16 bp, Homo sapiens
tttaactttaaaactg

SEQ ID NO: 6588365 - DNA, 14 bp, Homo sapiens
tttaactttaatac

SEQ ID NO: 6588366 - DNA, 14 bp, Homo sapiens
tttaactttaccat

SEQ ID NO: 6588367 - DNA, 23 bp, Homo sapiens
tttaactttaccatgctcaatga

SEQ ID NO: 6588368 - DNA, 14 bp, Homo sapiens
tttaactttctaga

SEQ ID NO: 6588369 - DNA, 15 bp, Homo sapiens
tttaactttgaaagt

SEQ ID NO: 6588370 - DNA, 22 bp, Homo sapiens
tttaactttgtggtaacttctt

SEQ ID NO: 6588371 - DNA, 17 bp, Homo sapiens
tttaactttgttttatt

SEQ ID NO: 6588372 - DNA, 13 bp, Homo sapiens
tttaacttttaaa

SEQ ID NO: 6588373 - DNA, 12 bp, Homo sapiens
tttaacttttct

SEQ ID NO: 6588374 - DNA, 12 bp, Homo sapiens
tttaacttttga

SEQ ID NO: 6588375 - DNA, 16 bp, Homo sapiens
tttaacttttggaatc

SEQ ID NO: 6588376 - DNA, 23 bp, Homo sapiens
tttaacttttgggatttgttgaa

SEQ ID NO: 6588377 - DNA, 18 bp, Homo sapiens
tttaactttttatttcta

SEQ ID NO: 6588378 - DNA, 24 bp, Homo sapiens
tttaactttttgtttttatttctt

SEQ ID NO: 6588379 - DNA, 16 bp, Homo sapiens
tttaagaaaaaaagct

SEQ ID NO: 6588380 - DNA, 17 bp, Homo sapiens
tttaagaaaaacaagtt

SEQ ID NO: 6588381 - DNA, 15 bp, Homo sapiens
tttaagaaaaacatg

SEQ ID NO: 6588382 - DNA, 20 bp, Homo sapiens
tttaagaaaaacatgtcatg

SEQ ID NO: 6588383 - DNA, 22 bp, Homo sapiens
tttaagaaaaatgaaaactttt

SEQ ID NO: 6588384 - DNA, 21 bp, Homo sapiens
tttaagaaaagtattttgaag

SEQ ID NO: 6588385 - DNA, 11 bp, Homo sapiens
tttaagaaaat

SEQ ID NO: 6588386 - DNA, 13 bp, Homo sapiens
tttaagaaaatac

SEQ ID NO: 6588387 - DNA, 21 bp, Homo sapiens
tttaagaaaatacaataaact

SEQ ID NO: 6588388 - DNA, 11 bp, Homo sapiens
tttaagaaaga

SEQ ID NO: 6588389 - DNA, 13 bp, Homo sapiens
tttaagaaagaga

SEQ ID NO: 6588390 - DNA, 15 bp, Homo sapiens
tttaagaaagagaat

SEQ ID NO: 6588391 - DNA, 17 bp, Homo sapiens
tttaagaaagagaatga

SEQ ID NO: 6588392 - DNA, 21 bp, Homo sapiens
tttaagaaagagaatgaactg

SEQ ID NO: 6588393 - DNA, 12 bp, Homo sapiens
tttaagaaagct

SEQ ID NO: 6588394 - DNA, 23 bp, Homo sapiens
tttaagaaaggcaaccaataaaa

SEQ ID NO: 6588395 - DNA, 17 bp, Homo sapiens
tttaagaaagtaattta

SEQ ID NO: 6588396 - DNA, 22 bp, Homo sapiens
tttaagaaagtaatttaatttg

SEQ ID NO: 6588397 - DNA, 14 bp, Homo sapiens
tttaagaaatagaa

SEQ ID NO: 6588398 - DNA, 23 bp, Homo sapiens
tttaagaaatctggcccagggtg

SEQ ID NO: 6588399 - DNA, 21 bp, Homo sapiens
tttaagaactaaaatgttcta

SEQ ID NO: 6588400 - DNA, 13 bp, Homo sapiens
tttaagaacttca

SEQ ID NO: 6588401 - DNA, 16 bp, Homo sapiens
tttaagaacttcattt

SEQ ID NO: 6588402 - DNA, 17 bp, Homo sapiens
tttaagaacttcatttt

SEQ ID NO: 6588403 - DNA, 18 bp, Homo sapiens
tttaagaacttcattttt

SEQ ID NO: 6588404 - DNA, 16 bp, Homo sapiens
tttaagaatattttta

SEQ ID NO: 6588405 - DNA, 17 bp, Homo sapiens
tttaagaatttattatt

SEQ ID NO: 6588406 - DNA, 20 bp, Homo sapiens
tttaagacaccaaatataac

SEQ ID NO: 6588407 - DNA, 18 bp, Homo sapiens
tttaagacagtctttggg

SEQ ID NO: 6588408 - DNA, 16 bp, Homo sapiens
tttaagaccctctcaa

SEQ ID NO: 6588409 - DNA, 16 bp, Homo sapiens
tttaagacgtgaatgt

SEQ ID NO: 6588410 - DNA, 17 bp, Homo sapiens
tttaagacgtgtttgtg

SEQ ID NO: 6588411 - DNA, 22 bp, Homo sapiens
tttaagactagtcccttggata

SEQ ID NO: 6588412 - DNA, 17 bp, Homo sapiens
tttaagactgaatgttt

SEQ ID NO: 6588413 - DNA, 11 bp, Homo sapiens
tttaagagaca

SEQ ID NO: 6588414 - DNA, 14 bp, Homo sapiens
tttaagagtgaagt

SEQ ID NO: 6588415 - DNA, 18 bp, Homo sapiens
tttaagataataatatat

SEQ ID NO: 6588416 - DNA, 23 bp, Homo sapiens
tttaagataataatatatgttta

SEQ ID NO: 6588417 - DNA, 15 bp, Homo sapiens
tttaagataattata

SEQ ID NO: 6588418 - DNA, 14 bp, Homo sapiens
tttaagatacaaat

SEQ ID NO: 6588419 - DNA, 21 bp, Homo sapiens
tttaagatacaaataaggaca

SEQ ID NO: 6588420 - DNA, 21 bp, Homo sapiens
tttaagatagacttattcttt

SEQ ID NO: 6588421 - DNA, 14 bp, Homo sapiens
tttaagatagtgta

SEQ ID NO: 6588422 - DNA, 18 bp, Homo sapiens
tttaagatatccatcttt

SEQ ID NO: 6588423 - DNA, 22 bp, Homo sapiens
tttaagatatccatctttttct

SEQ ID NO: 6588424 - DNA, 15 bp, Homo sapiens
tttaagatgtacatt

SEQ ID NO: 6588425 - DNA, 18 bp, Homo sapiens
tttaagatgtacatttaa

SEQ ID NO: 6588426 - DNA, 22 bp, Homo sapiens
tttaagattccttttcttgttt

SEQ ID NO: 6588427 - DNA, 18 bp, Homo sapiens
tttaagattgtaaaaata

SEQ ID NO: 6588428 - DNA, 16 bp, Homo sapiens
tttaagattgtacttt

SEQ ID NO: 6588429 - DNA, 15 bp, Homo sapiens
tttaagatttgtgtt

SEQ ID NO: 6588430 - DNA, 15 bp, Homo sapiens
tttaagcaaatgcat

SEQ ID NO: 6588431 - DNA, 19 bp, Homo sapiens
tttaagcaaatgcattcta

SEQ ID NO: 6588432 - DNA, 15 bp, Homo sapiens
tttaagcaagaccat

SEQ ID NO: 6588433 - DNA, 16 bp, Homo sapiens
tttaagcaagttaagt

SEQ ID NO: 6588434 - DNA, 17 bp, Homo sapiens
tttaagcacaaaaaatt

SEQ ID NO: 6588435 - DNA, 23 bp, Homo sapiens
tttaagcactacataaactgact

SEQ ID NO: 6588436 - DNA, 20 bp, Homo sapiens
tttaagcactcttaaagcaa

SEQ ID NO: 6588437 - DNA, 15 bp, Homo sapiens
tttaagcagaattgg

SEQ ID NO: 6588438 - DNA, 15 bp, Homo sapiens
tttaagcattactct

SEQ ID NO: 6588439 - DNA, 14 bp, Homo sapiens
tttaagcatttgta

SEQ ID NO: 6588440 - DNA, 15 bp, Homo sapiens
tttaagcatttgtat

SEQ ID NO: 6588441 - DNA, 20 bp, Homo sapiens
tttaagccaaaacaatgttt

SEQ ID NO: 6588442 - DNA, 17 bp, Homo sapiens
tttaagccaatataatg

SEQ ID NO: 6588443 - DNA, 21 bp, Homo sapiens
tttaagccaatataatgggct

SEQ ID NO: 6588444 - DNA, 23 bp, Homo sapiens
tttaagccctgctctttctctga

SEQ ID NO: 6588445 - DNA, 21 bp, Homo sapiens
tttaagccgcagacctggagc

SEQ ID NO: 6588446 - DNA, 16 bp, Homo sapiens
tttaagcctaaagatt

SEQ ID NO: 6588447 - DNA, 19 bp, Homo sapiens
tttaagcctcatatttaaa

SEQ ID NO: 6588448 - DNA, 16 bp, Homo sapiens
tttaagcctgaagagc

SEQ ID NO: 6588449 - DNA, 18 bp, Homo sapiens
tttaagcctgcattctta

SEQ ID NO: 6588450 - DNA, 21 bp, Homo sapiens
tttaagcctgcattcttaaca

SEQ ID NO: 6588451 - DNA, 18 bp, Homo sapiens
tttaagccttcaaaacta

SEQ ID NO: 6588452 - DNA, 16 bp, Homo sapiens
tttaagccttcatttg

SEQ ID NO: 6588453 - DNA, 21 bp, Homo sapiens
tttaagccttgacacactgtg

SEQ ID NO: 6588454 - DNA, 12 bp, Homo sapiens
tttaagcctttg

SEQ ID NO: 6588455 - DNA, 15 bp, Homo sapiens
tttaagcctttgaag

SEQ ID NO: 6588456 - DNA, 18 bp, Homo sapiens
tttaagcctttgttgaac

SEQ ID NO: 6588457 - DNA, 14 bp, Homo sapiens
tttaagctcaaaat

SEQ ID NO: 6588458 - DNA, 16 bp, Homo sapiens
tttaagctccagcttt

SEQ ID NO: 6588459 - DNA, 19 bp, Homo sapiens
tttaagctccatgtgcata

SEQ ID NO: 6588460 - DNA, 20 bp, Homo sapiens
tttaagctccttgagtaaaa

SEQ ID NO: 6588461 - DNA, 14 bp, Homo sapiens
tttaagctctgagc

SEQ ID NO: 6588462 - DNA, 20 bp, Homo sapiens
tttaagctgcaaatctgatg

SEQ ID NO: 6588463 - DNA, 11 bp, Homo sapiens
tttaagctgtt

SEQ ID NO: 6588464 - DNA, 18 bp, Homo sapiens
tttaagcttaacatttca

SEQ ID NO: 6588465 - DNA, 22 bp, Homo sapiens
tttaagcttatttaattaaaaa

SEQ ID NO: 6588466 - DNA, 14 bp, Homo sapiens
tttaagcttcagtt

SEQ ID NO: 6588467 - DNA, 13 bp, Homo sapiens
tttaagcttcatt

SEQ ID NO: 6588468 - DNA, 12 bp, Homo sapiens
tttaaggaaaat

SEQ ID NO: 6588469 - DNA, 17 bp, Homo sapiens
tttaaggaaagtagcaa

SEQ ID NO: 6588470 - DNA, 15 bp, Homo sapiens
tttaaggaagaaaaa

SEQ ID NO: 6588471 - DNA, 16 bp, Homo sapiens
tttaaggaagaaaaat

SEQ ID NO: 6588472 - DNA, 19 bp, Homo sapiens
tttaaggactgactgaggc

SEQ ID NO: 6588473 - DNA, 16 bp, Homo sapiens
tttaaggagcagtggc

SEQ ID NO: 6588474 - DNA, 11 bp, Homo sapiens
tttaaggagct

SEQ ID NO: 6588475 - DNA, 23 bp, Homo sapiens
tttaaggatagtgtgaagatctt

SEQ ID NO: 6588476 - DNA, 18 bp, Homo sapiens
tttaaggatgactttttt

SEQ ID NO: 6588477 - DNA, 16 bp, Homo sapiens
tttaaggatggatggc

SEQ ID NO: 6588478 - DNA, 18 bp, Homo sapiens
tttaaggatggatggcac

SEQ ID NO: 6588479 - DNA, 19 bp, Homo sapiens
tttaaggatggatggcacc

SEQ ID NO: 6588480 - DNA, 20 bp, Homo sapiens
tttaaggatggggttatgaa

SEQ ID NO: 6588481 - DNA, 14 bp, Homo sapiens
tttaaggcaaataa

SEQ ID NO: 6588482 - DNA, 22 bp, Homo sapiens
tttaaggcagattttacagagc

SEQ ID NO: 6588483 - DNA, 17 bp, Homo sapiens
tttaaggctctgtgcct

SEQ ID NO: 6588484 - DNA, 15 bp, Homo sapiens
tttaagggaaagaaa

SEQ ID NO: 6588485 - DNA, 18 bp, Homo sapiens
tttaagggaatgtgagca

SEQ ID NO: 6588486 - DNA, 17 bp, Homo sapiens
tttaagggatgttgcaa

SEQ ID NO: 6588487 - DNA, 18 bp, Homo sapiens
tttaagggccctttttca

SEQ ID NO: 6588488 - DNA, 23 bp, Homo sapiens
tttaagggccggggatggatctt

SEQ ID NO: 6588489 - DNA, 23 bp, Homo sapiens
tttaaggtactaattaacttaaa

SEQ ID NO: 6588490 - DNA, 18 bp, Homo sapiens
tttaaggtattgtgcatc

SEQ ID NO: 6588491 - DNA, 14 bp, Homo sapiens
tttaaggtctgttt

SEQ ID NO: 6588492 - DNA, 15 bp, Homo sapiens
tttaaggtgaatgaa

SEQ ID NO: 6588493 - DNA, 17 bp, Homo sapiens
tttaaggtgaatgaaag

SEQ ID NO: 6588494 - DNA, 21 bp, Homo sapiens
tttaaggttatttatttaaat

SEQ ID NO: 6588495 - DNA, 19 bp, Homo sapiens
tttaaggttgcacacagta

SEQ ID NO: 6588496 - DNA, 22 bp, Homo sapiens
tttaaggttgcacacagtacac

SEQ ID NO: 6588497 - DNA, 22 bp, Homo sapiens
tttaaggtttcaacaaatttca

SEQ ID NO: 6588498 - DNA, 19 bp, Homo sapiens
tttaagtaagtaagtttca

SEQ ID NO: 6588499 - DNA, 22 bp, Homo sapiens
tttaagtaatgtggaagaaaat

SEQ ID NO: 6588500 - DNA, 15 bp, Homo sapiens
tttaagtaatttcat

SEQ ID NO: 6588501 - DNA, 13 bp, Homo sapiens
tttaagtagaaaa

SEQ ID NO: 6588502 - DNA, 23 bp, Homo sapiens
tttaagtagtgggcatttcatag

SEQ ID NO: 6588503 - DNA, 16 bp, Homo sapiens
tttaagtatatagtat

SEQ ID NO: 6588504 - DNA, 18 bp, Homo sapiens
tttaagtattgtttcctg

SEQ ID NO: 6588505 - DNA, 12 bp, Homo sapiens
tttaagtattta

SEQ ID NO: 6588506 - DNA, 15 bp, Homo sapiens
tttaagtatttatat

SEQ ID NO: 6588507 - DNA, 20 bp, Homo sapiens
tttaagtatttatatattta

SEQ ID NO: 6588508 - DNA, 14 bp, Homo sapiens
tttaagtcattttt

SEQ ID NO: 6588509 - DNA, 19 bp, Homo sapiens
tttaagtcattttttactt

SEQ ID NO: 6588510 - DNA, 16 bp, Homo sapiens
tttaagtccctgtcac

SEQ ID NO: 6588511 - DNA, 21 bp, Homo sapiens
tttaagtcctctaaacacact

SEQ ID NO: 6588512 - DNA, 20 bp, Homo sapiens
aatctaaacgtggtcacctt

SEQ ID NO: 6588513 - DNA, 13 bp, Homo sapiens
aatctaaatataa

SEQ ID NO: 6588514 - DNA, 14 bp, Homo sapiens
aatctaaatataaa

SEQ ID NO: 6588515 - DNA, 19 bp, Homo sapiens
aatctaaatctatttatta

SEQ ID NO: 6588516 - DNA, 12 bp, Homo sapiens
aatctaaattaa

SEQ ID NO: 6588517 - DNA, 17 bp, Homo sapiens
aatctaaatttcttttg

SEQ ID NO: 6588518 - DNA, 18 bp, Homo sapiens
aatctaacaataatattt

SEQ ID NO: 6588519 - DNA, 16 bp, Homo sapiens
aatctaacaatggaag

SEQ ID NO: 6588520 - DNA, 14 bp, Homo sapiens
aatctaacattatt

SEQ ID NO: 6588521 - DNA, 20 bp, Homo sapiens
aatctaaccacatcaatatt

SEQ ID NO: 6588522 - DNA, 22 bp, Homo sapiens
aatctaagcagcatttctgaag

SEQ ID NO: 6588523 - DNA, 21 bp, Homo sapiens
aatctaagcagcttattgttt

SEQ ID NO: 6588524 - DNA, 22 bp, Homo sapiens
aatctaagctgtttgccaagct

SEQ ID NO: 6588525 - DNA, 14 bp, Homo sapiens
aatctaaggataat

SEQ ID NO: 6588526 - DNA, 20 bp, Homo sapiens
aatctaagtatatgtgagaa

SEQ ID NO: 6588527 - DNA, 17 bp, Homo sapiens
aatctaatattaaaaat

SEQ ID NO: 6588528 - DNA, 19 bp, Homo sapiens
aatctaatattaaaaatat

SEQ ID NO: 6588529 - DNA, 14 bp, Homo sapiens
aatctaatctgaac

SEQ ID NO: 6588530 - DNA, 18 bp, Homo sapiens
aatctaatgacattcaat

SEQ ID NO: 6588531 - DNA, 22 bp, Homo sapiens
aatctaatgtgagtgtgaagct

SEQ ID NO: 6588532 - DNA, 16 bp, Homo sapiens
aatctacaaaagtgaa

SEQ ID NO: 6588533 - DNA, 13 bp, Homo sapiens
aatctacaaactt

SEQ ID NO: 6588534 - DNA, 18 bp, Homo sapiens
aatctacaaacttttata

SEQ ID NO: 6588535 - DNA, 21 bp, Homo sapiens
aatctacaaacttttataaat

SEQ ID NO: 6588536 - DNA, 23 bp, Homo sapiens
aatctacaaacttttataaatgt

SEQ ID NO: 6588537 - DNA, 10 bp, Homo sapiens
aatctacacc

SEQ ID NO: 6588538 - DNA, 15 bp, Homo sapiens
aatctacactgcctt

SEQ ID NO: 6588539 - DNA, 18 bp, Homo sapiens
aatctacagatccttttt

SEQ ID NO: 6588540 - DNA, 19 bp, Homo sapiens
aatctacagatcctttttc

SEQ ID NO: 6588541 - DNA, 17 bp, Homo sapiens
aatctacattataataa

SEQ ID NO: 6588542 - DNA, 21 bp, Homo sapiens
aatctacattataataaaatt

SEQ ID NO: 6588543 - DNA, 13 bp, Homo sapiens
aatctacatttgt

SEQ ID NO: 6588544 - DNA, 21 bp, Homo sapiens
aatctacatttgtttgtattc

SEQ ID NO: 6588545 - DNA, 14 bp, Homo sapiens
aatctaccagtggt

SEQ ID NO: 6588546 - DNA, 22 bp, Homo sapiens
aatctaccttctgtagttttat

SEQ ID NO: 6588547 - DNA, 16 bp, Homo sapiens
aatctactcaaagcat

SEQ ID NO: 6588548 - DNA, 22 bp, Homo sapiens
aatctactgtatcaataaaatt

SEQ ID NO: 6588549 - DNA, 12 bp, Homo sapiens
aatctacttttt

SEQ ID NO: 6588550 - DNA, 21 bp, Homo sapiens
aatctactttttgtatttagt

SEQ ID NO: 6588551 - DNA, 13 bp, Homo sapiens
aatctagaaatgt

SEQ ID NO: 6588552 - DNA, 14 bp, Homo sapiens
aatctagaaatgtt

SEQ ID NO: 6588553 - DNA, 22 bp, Homo sapiens
aatctagaagaaatgaaatttt

SEQ ID NO: 6588554 - DNA, 13 bp, Homo sapiens
aatctagaagagt

SEQ ID NO: 6588555 - DNA, 15 bp, Homo sapiens
aatctagaagatgtg

SEQ ID NO: 6588556 - DNA, 18 bp, Homo sapiens
aatctagaagatgtgtaa

SEQ ID NO: 6588557 - DNA, 13 bp, Homo sapiens
aatctagaattta

SEQ ID NO: 6588558 - DNA, 17 bp, Homo sapiens
aatctagaatttagtga

SEQ ID NO: 6588559 - DNA, 12 bp, Homo sapiens
aatctagagcta

SEQ ID NO: 6588560 - DNA, 15 bp, Homo sapiens
aatctagagctatgc

SEQ ID NO: 6588561 - DNA, 17 bp, Homo sapiens
aatctagagctatgcac

SEQ ID NO: 6588562 - DNA, 22 bp, Homo sapiens
aatctagagtttatacagtgta

SEQ ID NO: 6588563 - DNA, 22 bp, Homo sapiens
aatctagccagtgaacataatt

SEQ ID NO: 6588564 - DNA, 19 bp, Homo sapiens
aatctagccgatggaaaat

SEQ ID NO: 6588565 - DNA, 16 bp, Homo sapiens
aatctagcttattttg

SEQ ID NO: 6588566 - DNA, 15 bp, Homo sapiens
aatctaggaaaatta

SEQ ID NO: 6588567 - DNA, 23 bp, Homo sapiens
aatctaggcatgaagagcaaaaa

SEQ ID NO: 6588568 - DNA, 21 bp, Homo sapiens
aatctaggcgaggcgaagctg

SEQ ID NO: 6588569 - DNA, 19 bp, Homo sapiens
aatctagtatttcatgctg

SEQ ID NO: 6588570 - DNA, 14 bp, Homo sapiens
aatctatagcattt

SEQ ID NO: 6588571 - DNA, 18 bp, Homo sapiens
aatctatagcatttaaag

SEQ ID NO: 6588572 - DNA, 12 bp, Homo sapiens
aatctatagtat

SEQ ID NO: 6588573 - DNA, 21 bp, Homo sapiens
aatctatagtatagaatgaac

SEQ ID NO: 6588574 - DNA, 17 bp, Homo sapiens
aatctatattaaagtgt

SEQ ID NO: 6588575 - DNA, 18 bp, Homo sapiens
aatctatatttttgtgaa

SEQ ID NO: 6588576 - DNA, 19 bp, Homo sapiens
aatctatatttttgtgaag

SEQ ID NO: 6588577 - DNA, 20 bp, Homo sapiens
aatctatgaacctgaaaagg

SEQ ID NO: 6588578 - DNA, 16 bp, Homo sapiens
aatctatgatatattt

SEQ ID NO: 6588579 - DNA, 20 bp, Homo sapiens
aatctatggcttatttctat

SEQ ID NO: 6588580 - DNA, 20 bp, Homo sapiens
aatctatggctttaaataaa

SEQ ID NO: 6588581 - DNA, 19 bp, Homo sapiens
aatctatgtcgtgttttca

SEQ ID NO: 6588582 - DNA, 19 bp, Homo sapiens
aatctatgtgtttctgtaa

SEQ ID NO: 6588583 - DNA, 20 bp, Homo sapiens
aatctatgtgtttctgtaac

SEQ ID NO: 6588584 - DNA, 23 bp, Homo sapiens
aatctattacttttgcaaactgt

SEQ ID NO: 6588585 - DNA, 22 bp, Homo sapiens
aatctattatttggagcctgcc

SEQ ID NO: 6588586 - DNA, 13 bp, Homo sapiens
aatctattcagac

SEQ ID NO: 6588587 - DNA, 16 bp, Homo sapiens
aatctattctgtgttg

SEQ ID NO: 6588588 - DNA, 20 bp, Homo sapiens
aatctattgacttttcaata

SEQ ID NO: 6588589 - DNA, 17 bp, Homo sapiens
aatctattgggttcatt

SEQ ID NO: 6588590 - DNA, 13 bp, Homo sapiens
aatctattgtttc

SEQ ID NO: 6588591 - DNA, 17 bp, Homo sapiens
aatctatttatcttcat

SEQ ID NO: 6588592 - DNA, 17 bp, Homo sapiens
aatctatttattaatat

SEQ ID NO: 6588593 - DNA, 23 bp, Homo sapiens
aatctatttattggacatgtcca

SEQ ID NO: 6588594 - DNA, 17 bp, Homo sapiens
aatctatttcacttatt

SEQ ID NO: 6588595 - DNA, 12 bp, Homo sapiens
aatctattttca

SEQ ID NO: 6588596 - DNA, 13 bp, Homo sapiens
aatctcaaaatta

SEQ ID NO: 6588597 - DNA, 14 bp, Homo sapiens
aatctcaaaattag

SEQ ID NO: 6588598 - DNA, 13 bp, Homo sapiens
aatctcaaataac

SEQ ID NO: 6588599 - DNA, 22 bp, Homo sapiens
aatctcaaataggctattaaaa

SEQ ID NO: 6588600 - DNA, 20 bp, Homo sapiens
aatctcaaattctcaaccta

SEQ ID NO: 6588601 - DNA, 12 bp, Homo sapiens
aatctcaaattt

SEQ ID NO: 6588602 - DNA, 14 bp, Homo sapiens
aatctcaaatttct

SEQ ID NO: 6588603 - DNA, 15 bp, Homo sapiens
aatctcaaatttcta

SEQ ID NO: 6588604 - DNA, 17 bp, Homo sapiens
aatctcaaatttctaaa

SEQ ID NO: 6588605 - DNA, 15 bp, Homo sapiens
aatctcaagattcta

SEQ ID NO: 6588606 - DNA, 15 bp, Homo sapiens
aatctcaaggaatct

SEQ ID NO: 6588607 - DNA, 16 bp, Homo sapiens
aatctcaaggaatctt

SEQ ID NO: 6588608 - DNA, 23 bp, Homo sapiens
aatctcacatatacaagtagctt

SEQ ID NO: 6588609 - DNA, 13 bp, Homo sapiens
aatctcaccccat

SEQ ID NO: 6588610 - DNA, 22 bp, Homo sapiens
aatctcaccccatcccacaccc

SEQ ID NO: 6588611 - DNA, 13 bp, Homo sapiens
aatctcactgtat

SEQ ID NO: 6588612 - DNA, 22 bp, Homo sapiens
aatctcactgtattaaagatgc

SEQ ID NO: 6588613 - DNA, 18 bp, Homo sapiens
aatctcacttaatacaga

SEQ ID NO: 6588614 - DNA, 19 bp, Homo sapiens
aatctcacttcatcaatca

SEQ ID NO: 6588615 - DNA, 15 bp, Homo sapiens
aatctcagagacagg

SEQ ID NO: 6588616 - DNA, 23 bp, Homo sapiens
aatctcagaggtagggctgccac

SEQ ID NO: 6588617 - DNA, 13 bp, Homo sapiens
aatctcagcaaag

SEQ ID NO: 6588618 - DNA, 11 bp, Homo sapiens
aatctcagcac

SEQ ID NO: 6588619 - DNA, 20 bp, Homo sapiens
aatctcagcactttgtttca

SEQ ID NO: 6588620 - DNA, 15 bp, Homo sapiens
aatctcagtgctttc

SEQ ID NO: 6588621 - DNA, 16 bp, Homo sapiens
aatctcatacctctga

SEQ ID NO: 6588622 - DNA, 23 bp, Homo sapiens
aatctcataggttgccaataata

SEQ ID NO: 6588623 - DNA, 18 bp, Homo sapiens
aatctcatccccccaccc

SEQ ID NO: 6588624 - DNA, 18 bp, Homo sapiens
aatctcatgattccatgc

SEQ ID NO: 6588625 - DNA, 14 bp, Homo sapiens
aatctcattactgc

SEQ ID NO: 6588626 - DNA, 14 bp, Homo sapiens
aatctcattatttc

SEQ ID NO: 6588627 - DNA, 16 bp, Homo sapiens
aatctcattatttcaa

SEQ ID NO: 6588628 - DNA, 12 bp, Homo sapiens
aatctcattccc

SEQ ID NO: 6588629 - DNA, 15 bp, Homo sapiens
aatctccactttttt

SEQ ID NO: 6588630 - DNA, 20 bp, Homo sapiens
aatctccacttttttcatag

SEQ ID NO: 6588631 - DNA, 20 bp, Homo sapiens
aatctccagggctgcccctg

SEQ ID NO: 6588632 - DNA, 15 bp, Homo sapiens
aatctccagtattct

SEQ ID NO: 6588633 - DNA, 22 bp, Homo sapiens
aatctcccattttggaatttgc

SEQ ID NO: 6588634 - DNA, 22 bp, Homo sapiens
aatctccccagtagagaaacat

SEQ ID NO: 6588635 - DNA, 17 bp, Homo sapiens
aatctcccgctgctgct

SEQ ID NO: 6588636 - DNA, 15 bp, Homo sapiens
aatctccgtagaatt

SEQ ID NO: 6588637 - DNA, 15 bp, Homo sapiens
aatctcctaacaaaa

SEQ ID NO: 6588638 - DNA, 15 bp, Homo sapiens
aatctcctaaccttg

SEQ ID NO: 6588639 - DNA, 17 bp, Homo sapiens
aatctcctctttgtgaa

SEQ ID NO: 6588640 - DNA, 15 bp, Homo sapiens
aatctcctcttttat

SEQ ID NO: 6588641 - DNA, 13 bp, Homo sapiens
aatctcctggctt

SEQ ID NO: 6588642 - DNA, 12 bp, Homo sapiens
aatctccttact

SEQ ID NO: 6588643 - DNA, 22 bp, Homo sapiens
aatctcctttggaaggtgacac

SEQ ID NO: 6588644 - DNA, 20 bp, Homo sapiens
aatctcgcactacatctgat

SEQ ID NO: 6588645 - DNA, 20 bp, Homo sapiens
aatctcgtatagaagtcttc

SEQ ID NO: 6588646 - DNA, 18 bp, Homo sapiens
aatctcgtcaggctgcca

SEQ ID NO: 6588647 - DNA, 19 bp, Homo sapiens
aatctcgtttcaaaaacac

SEQ ID NO: 6588648 - DNA, 19 bp, Homo sapiens
aatctctaaaatgctgttc

SEQ ID NO: 6588649 - DNA, 18 bp, Homo sapiens
aatctctaaaattctagt

SEQ ID NO: 6588650 - DNA, 19 bp, Homo sapiens
aatctctaaaattctagtc

SEQ ID NO: 6588651 - DNA, 18 bp, Homo sapiens
aatctctaaatcaagtat

SEQ ID NO: 6588652 - DNA, 21 bp, Homo sapiens
aatctctacaaaccctctgta

SEQ ID NO: 6588653 - DNA, 15 bp, Homo sapiens
aatctctaggaagtc

SEQ ID NO: 6588654 - DNA, 19 bp, Homo sapiens
aatctctaggaagtcaata

SEQ ID NO: 6588655 - DNA, 20 bp, Homo sapiens
aatctctccacctctagtca

SEQ ID NO: 6588656 - DNA, 18 bp, Homo sapiens
aatctctccaccttccaa

SEQ ID NO: 6588657 - DNA, 19 bp, Homo sapiens
aatctctccactttcagct

SEQ ID NO: 6588658 - DNA, 20 bp, Homo sapiens
aatctctccactttcagctg

SEQ ID NO: 6588659 - DNA, 23 bp, Homo sapiens
aatctctccactttcagctgtct

SEQ ID NO: 6588660 - DNA, 20 bp, Homo sapiens
aatctctccccaatgctctc

SEQ ID NO: 6588661 - DNA, 20 bp, Homo sapiens
aatctctcggttccacgtcc

SEQ ID NO: 6588662 - DNA, 11 bp, Homo sapiens
aatctctctct

SEQ ID NO: 6588663 - DNA, 14 bp, Homo sapiens
aatctctctctgtg

SEQ ID NO: 6588664 - DNA, 15 bp, Homo sapiens
aatctctctgcagct

SEQ ID NO: 6588665 - DNA, 13 bp, Homo sapiens
aatctctgcctcc

SEQ ID NO: 6588666 - DNA, 12 bp, Homo sapiens
aatctctgtaaa

SEQ ID NO: 6588667 - DNA, 14 bp, Homo sapiens
aatctctgtaggaa

SEQ ID NO: 6588668 - DNA, 20 bp, Homo sapiens
aatctctgttatgtactgta

SEQ ID NO: 6588669 - DNA, 17 bp, Homo sapiens
aatctcttccagtgtaa

SEQ ID NO: 6588670 - DNA, 17 bp, Homo sapiens
aatctcttgattataaa

SEQ ID NO: 6588671 - DNA, 19 bp, Homo sapiens
aatctcttgattataaatg

SEQ ID NO: 6588672 - DNA, 13 bp, Homo sapiens
aatctcttgtcat

SEQ ID NO: 6588673 - DNA, 22 bp, Homo sapiens
aatctcttgtcattctcatcca

SEQ ID NO: 6588674 - DNA, 20 bp, Homo sapiens
aatctctttccatcttactt

SEQ ID NO: 6588675 - DNA, 15 bp, Homo sapiens
aatctctttcccttc

SEQ ID NO: 6588676 - DNA, 15 bp, Homo sapiens
aatctctttttgact

SEQ ID NO: 6588677 - DNA, 18 bp, Homo sapiens
aatctctttttgtttgcc

SEQ ID NO: 6588678 - DNA, 20 bp, Homo sapiens
aatctcttttttcaactggc

SEQ ID NO: 6588679 - DNA, 20 bp, Homo sapiens
aatctgaaaaatggccatgt

SEQ ID NO: 6588680 - DNA, 19 bp, Homo sapiens
aatctgaaaccctccttct

SEQ ID NO: 6588681 - DNA, 15 bp, Homo sapiens
aatctgaaattctaa

SEQ ID NO: 6588682 - DNA, 16 bp, Homo sapiens
aatctgaaattctaaa

SEQ ID NO: 6588683 - DNA, 20 bp, Homo sapiens
aatctgaactctaagcagaa

SEQ ID NO: 6588684 - DNA, 22 bp, Homo sapiens
aatctgaactctaagcagaaga

SEQ ID NO: 6588685 - DNA, 15 bp, Homo sapiens
aatctgaactctcaa

SEQ ID NO: 6588686 - DNA, 16 bp, Homo sapiens
aatctgaactctcaaa

SEQ ID NO: 6588687 - DNA, 22 bp, Homo sapiens
aatctgaactctcaaaagtcta

SEQ ID NO: 6588688 - DNA, 15 bp, Homo sapiens
aatctgaactgctct

SEQ ID NO: 6588689 - DNA, 21 bp, Homo sapiens
aatctgaagaaagttattctt

SEQ ID NO: 6588690 - DNA, 23 bp, Homo sapiens
aatctgaagatatatttcacttt

SEQ ID NO: 6588691 - DNA, 21 bp, Homo sapiens
tttaagtctcctttactgaat

SEQ ID NO: 6588692 - DNA, 15 bp, Homo sapiens
tttaagtgaaaatgg

SEQ ID NO: 6588693 - DNA, 13 bp, Homo sapiens
tttaagtgaagga

SEQ ID NO: 6588694 - DNA, 16 bp, Homo sapiens
tttaagtgcaacattt

SEQ ID NO: 6588695 - DNA, 15 bp, Homo sapiens
tttaagtgcaattaa

SEQ ID NO: 6588696 - DNA, 20 bp, Homo sapiens
tttaagtgcgtgtgtagagt

SEQ ID NO: 6588697 - DNA, 19 bp, Homo sapiens
tttaagtgctatgcatatt

SEQ ID NO: 6588698 - DNA, 19 bp, Homo sapiens
tttaagtgcttcacatttg

SEQ ID NO: 6588699 - DNA, 18 bp, Homo sapiens
tttaagtgctttgtaatg

SEQ ID NO: 6588700 - DNA, 16 bp, Homo sapiens
tttaagtggactgtat

SEQ ID NO: 6588701 - DNA, 18 bp, Homo sapiens
tttaagtgggctcctgac

SEQ ID NO: 6588702 - DNA, 20 bp, Homo sapiens
tttaagtgggctcctgacaa

SEQ ID NO: 6588703 - DNA, 14 bp, Homo sapiens
tttaagtgtaactg

SEQ ID NO: 6588704 - DNA, 18 bp, Homo sapiens
tttaagtgtactggattt

SEQ ID NO: 6588705 - DNA, 13 bp, Homo sapiens
tttaagtgttctg

SEQ ID NO: 6588706 - DNA, 14 bp, Homo sapiens
tttaagtgttctgt

SEQ ID NO: 6588707 - DNA, 16 bp, Homo sapiens
tttaagtgtttagaaa

SEQ ID NO: 6588708 - DNA, 15 bp, Homo sapiens
tttaagttaatgaaa

SEQ ID NO: 6588709 - DNA, 16 bp, Homo sapiens
tttaagttaatgaaat

SEQ ID NO: 6588710 - DNA, 20 bp, Homo sapiens
tttaagttaatgaaataaaa

SEQ ID NO: 6588711 - DNA, 22 bp, Homo sapiens
tttaagttgagcgtgcgcactg

SEQ ID NO: 6588712 - DNA, 14 bp, Homo sapiens
tttaagttgtaaac

SEQ ID NO: 6588713 - DNA, 21 bp, Homo sapiens
tttaagttgtcaaagaagctt

SEQ ID NO: 6588714 - DNA, 21 bp, Homo sapiens
tttaagttgtttgcatgtgaa

SEQ ID NO: 6588715 - DNA, 19 bp, Homo sapiens
tttaagtttgcactcaaat

SEQ ID NO: 6588716 - DNA, 23 bp, Homo sapiens
tttaagtttgcactcaaatctta

SEQ ID NO: 6588717 - DNA, 12 bp, Homo sapiens
tttaagtttgtt

SEQ ID NO: 6588718 - DNA, 13 bp, Homo sapiens
tttaagttttgac

SEQ ID NO: 6588719 - DNA, 19 bp, Homo sapiens
tttaagttttgattaatgt

SEQ ID NO: 6588720 - DNA, 22 bp, Homo sapiens
tttaagttttgtttgttcacac

SEQ ID NO: 6588721 - DNA, 13 bp, Homo sapiens
tttaataaaaagg

SEQ ID NO: 6588722 - DNA, 17 bp, Homo sapiens
tttaataaaaaggaaat

SEQ ID NO: 6588723 - DNA, 19 bp, Homo sapiens
tttaataaaaatacacatg

SEQ ID NO: 6588724 - DNA, 11 bp, Homo sapiens
tttaataaaac

SEQ ID NO: 6588725 - DNA, 14 bp, Homo sapiens
tttaataaaagatt

SEQ ID NO: 6588726 - DNA, 13 bp, Homo sapiens
tttaataaaagta

SEQ ID NO: 6588727 - DNA, 16 bp, Homo sapiens
tttaataaaataataa

SEQ ID NO: 6588728 - DNA, 14 bp, Homo sapiens
tttaataaacagta

SEQ ID NO: 6588729 - DNA, 12 bp, Homo sapiens
tttaataaactg

SEQ ID NO: 6588730 - DNA, 14 bp, Homo sapiens
tttaataaactgca

SEQ ID NO: 6588731 - DNA, 13 bp, Homo sapiens
tttaataaacttt

SEQ ID NO: 6588732 - DNA, 17 bp, Homo sapiens
tttaataaagatgagtt

SEQ ID NO: 6588733 - DNA, 21 bp, Homo sapiens
tttaataaagcgaaaaactca

SEQ ID NO: 6588734 - DNA, 16 bp, Homo sapiens
tttaataaagcttgtg

SEQ ID NO: 6588735 - DNA, 16 bp, Homo sapiens
tttaataaagctttat

SEQ ID NO: 6588736 - DNA, 17 bp, Homo sapiens
tttaataaagctttata

SEQ ID NO: 6588737 - DNA, 13 bp, Homo sapiens
tttaataaagtat

SEQ ID NO: 6588738 - DNA, 20 bp, Homo sapiens
tttaataaattgcttactga

SEQ ID NO: 6588739 - DNA, 14 bp, Homo sapiens
tttaataaatttat

SEQ ID NO: 6588740 - DNA, 21 bp, Homo sapiens
tttaataacaatatatagaat

SEQ ID NO: 6588741 - DNA, 19 bp, Homo sapiens
tttaataacataacaaata

SEQ ID NO: 6588742 - DNA, 19 bp, Homo sapiens
tttaataacatatctaaag

SEQ ID NO: 6588743 - DNA, 15 bp, Homo sapiens
tttaataacattacc

SEQ ID NO: 6588744 - DNA, 23 bp, Homo sapiens
tttaataacattaccttactgtg

SEQ ID NO: 6588745 - DNA, 22 bp, Homo sapiens
tttaataactttgctggaaaat

SEQ ID NO: 6588746 - DNA, 14 bp, Homo sapiens
tttaataaggaaaa

SEQ ID NO: 6588747 - DNA, 13 bp, Homo sapiens
tttaataagtaat

SEQ ID NO: 6588748 - DNA, 15 bp, Homo sapiens
tttaataataatcta

SEQ ID NO: 6588749 - DNA, 15 bp, Homo sapiens
tttaataatatactt

SEQ ID NO: 6588750 - DNA, 23 bp, Homo sapiens
tttaataatgtacctattccttc

SEQ ID NO: 6588751 - DNA, 13 bp, Homo sapiens
tttaataatgttt

SEQ ID NO: 6588752 - DNA, 15 bp, Homo sapiens
tttaataatgtttca

SEQ ID NO: 6588753 - DNA, 18 bp, Homo sapiens
tttaataattatatgcta

SEQ ID NO: 6588754 - DNA, 20 bp, Homo sapiens
tttaataattatgtgccatt

SEQ ID NO: 6588755 - DNA, 21 bp, Homo sapiens
tttaataattattaagctgtt

SEQ ID NO: 6588756 - DNA, 20 bp, Homo sapiens
tttaataattatttttaatt

SEQ ID NO: 6588757 - DNA, 18 bp, Homo sapiens
tttaatacagattgaaag

SEQ ID NO: 6588758 - DNA, 14 bp, Homo sapiens
tttaatacaggaaa

SEQ ID NO: 6588759 - DNA, 16 bp, Homo sapiens
tttaatacaggaacac

SEQ ID NO: 6588760 - DNA, 14 bp, Homo sapiens
tttaatacaggact

SEQ ID NO: 6588761 - DNA, 14 bp, Homo sapiens
tttaatacagggta

SEQ ID NO: 6588762 - DNA, 17 bp, Homo sapiens
tttaatacagtttattt

SEQ ID NO: 6588763 - DNA, 13 bp, Homo sapiens
tttaatacattta

SEQ ID NO: 6588764 - DNA, 20 bp, Homo sapiens
tttaataccacaaacactgt

SEQ ID NO: 6588765 - DNA, 22 bp, Homo sapiens
tttaataccacaaacactgtgg

SEQ ID NO: 6588766 - DNA, 17 bp, Homo sapiens
tttaataccaccaacaa

SEQ ID NO: 6588767 - DNA, 13 bp, Homo sapiens
tttaataccctgt

SEQ ID NO: 6588768 - DNA, 16 bp, Homo sapiens
tttaatacctttaaat

SEQ ID NO: 6588769 - DNA, 20 bp, Homo sapiens
tttaatacctttaaatatca

SEQ ID NO: 6588770 - DNA, 20 bp, Homo sapiens
tttaatacctttggaaaaat

SEQ ID NO: 6588771 - DNA, 15 bp, Homo sapiens
tttaatacttgtaat

SEQ ID NO: 6588772 - DNA, 15 bp, Homo sapiens
tttaatagaaaatta

SEQ ID NO: 6588773 - DNA, 22 bp, Homo sapiens
tttaatagaaataaattcctaa

SEQ ID NO: 6588774 - DNA, 19 bp, Homo sapiens
tttaatagaatataattat

SEQ ID NO: 6588775 - DNA, 21 bp, Homo sapiens
tttaatagaatataattatcg

SEQ ID NO: 6588776 - DNA, 15 bp, Homo sapiens
tttaatagactgagt

SEQ ID NO: 6588777 - DNA, 17 bp, Homo sapiens
tttaatagcaaagaatt

SEQ ID NO: 6588778 - DNA, 12 bp, Homo sapiens
tttaatagcact

SEQ ID NO: 6588779 - DNA, 19 bp, Homo sapiens
tttaatagctatggaatca

SEQ ID NO: 6588780 - DNA, 18 bp, Homo sapiens
tttaatagtgttaatcaa

SEQ ID NO: 6588781 - DNA, 23 bp, Homo sapiens
tttaatagtgttctctgtattgt

SEQ ID NO: 6588782 - DNA, 13 bp, Homo sapiens
tttaatagtttct

SEQ ID NO: 6588783 - DNA, 15 bp, Homo sapiens
tttaatataaagcct

SEQ ID NO: 6588784 - DNA, 16 bp, Homo sapiens
tttaatataaagtttt

SEQ ID NO: 6588785 - DNA, 15 bp, Homo sapiens
tttaatataaatgca

SEQ ID NO: 6588786 - DNA, 21 bp, Homo sapiens
tttaatataagaatgagcctg

SEQ ID NO: 6588787 - DNA, 16 bp, Homo sapiens
tttaatatactcctta

SEQ ID NO: 6588788 - DNA, 21 bp, Homo sapiens
tttaatatagtgaaatggcca

SEQ ID NO: 6588789 - DNA, 14 bp, Homo sapiens
tttaatatataatt

SEQ ID NO: 6588790 - DNA, 18 bp, Homo sapiens
tttaatatataatttaat

SEQ ID NO: 6588791 - DNA, 13 bp, Homo sapiens
tttaatatatata

SEQ ID NO: 6588792 - DNA, 21 bp, Homo sapiens
tttaatatctggcactgttaa

SEQ ID NO: 6588793 - DNA, 16 bp, Homo sapiens
tttaatatgaaatttt

SEQ ID NO: 6588794 - DNA, 16 bp, Homo sapiens
tttaatatgcaaagtc

SEQ ID NO: 6588795 - DNA, 16 bp, Homo sapiens
tttaatattacagata

SEQ ID NO: 6588796 - DNA, 21 bp, Homo sapiens
tttaatattactgtctttatt

SEQ ID NO: 6588797 - DNA, 18 bp, Homo sapiens
tttaatattccagaagaa

SEQ ID NO: 6588798 - DNA, 20 bp, Homo sapiens
tttaatattccagaagaaca

SEQ ID NO: 6588799 - DNA, 22 bp, Homo sapiens
tttaatattgagaaagaaacta

SEQ ID NO: 6588800 - DNA, 14 bp, Homo sapiens
tttaatatttatgt

SEQ ID NO: 6588801 - DNA, 17 bp, Homo sapiens
tttaatatttattgaat

SEQ ID NO: 6588802 - DNA, 15 bp, Homo sapiens
tttaatatttccaat

SEQ ID NO: 6588803 - DNA, 14 bp, Homo sapiens
tttaatattttgca

SEQ ID NO: 6588804 - DNA, 17 bp, Homo sapiens
tttaatattttgtattt

SEQ ID NO: 6588805 - DNA, 17 bp, Homo sapiens
tttaatcaaatttgtag

SEQ ID NO: 6588806 - DNA, 14 bp, Homo sapiens
tttaatcatataaa

SEQ ID NO: 6588807 - DNA, 13 bp, Homo sapiens
tttaatcatgaaa

SEQ ID NO: 6588808 - DNA, 19 bp, Homo sapiens
tttaatcatgaaattactt

SEQ ID NO: 6588809 - DNA, 13 bp, Homo sapiens
tttaatcatgagc

SEQ ID NO: 6588810 - DNA, 19 bp, Homo sapiens
tttaatcatgagcctgttt

SEQ ID NO: 6588811 - DNA, 14 bp, Homo sapiens
tttaatcattgcct

SEQ ID NO: 6588812 - DNA, 21 bp, Homo sapiens
tttaatccagaattgaccttt

SEQ ID NO: 6588813 - DNA, 16 bp, Homo sapiens
tttaatcccagcactt

SEQ ID NO: 6588814 - DNA, 14 bp, Homo sapiens
tttaatcccaggaa

SEQ ID NO: 6588815 - DNA, 17 bp, Homo sapiens
tttaatcccctgcacta

SEQ ID NO: 6588816 - DNA, 12 bp, Homo sapiens
tttaatcgtaca

SEQ ID NO: 6588817 - DNA, 17 bp, Homo sapiens
tttaatctaaaatgatt

SEQ ID NO: 6588818 - DNA, 18 bp, Homo sapiens
tttaatctaaaatgattg

SEQ ID NO: 6588819 - DNA, 14 bp, Homo sapiens
tttaatctcctgtt

SEQ ID NO: 6588820 - DNA, 12 bp, Homo sapiens
tttaatctcttg

SEQ ID NO: 6588821 - DNA, 21 bp, Homo sapiens
tttaatctcttgtcattctca

SEQ ID NO: 6588822 - DNA, 17 bp, Homo sapiens
tttaatctgaaattcta

SEQ ID NO: 6588823 - DNA, 18 bp, Homo sapiens
tttaatctgttatgtact

SEQ ID NO: 6588824 - DNA, 15 bp, Homo sapiens
tttaatcttagcttt

SEQ ID NO: 6588825 - DNA, 15 bp, Homo sapiens
tttaatcttttatga

SEQ ID NO: 6588826 - DNA, 16 bp, Homo sapiens
tttaatgaaagactgt

SEQ ID NO: 6588827 - DNA, 23 bp, Homo sapiens
tttaatgaaagactgtacaaagt

SEQ ID NO: 6588828 - DNA, 15 bp, Homo sapiens
tttaatgaacaaatg

SEQ ID NO: 6588829 - DNA, 20 bp, Homo sapiens
tttaatgactttttataatg

SEQ ID NO: 6588830 - DNA, 14 bp, Homo sapiens
tttaatgagataat

SEQ ID NO: 6588831 - DNA, 23 bp, Homo sapiens
tttaatgagtgcacctgcctcca

SEQ ID NO: 6588832 - DNA, 14 bp, Homo sapiens
tttaatgataaaat

SEQ ID NO: 6588833 - DNA, 21 bp, Homo sapiens
tttaatgatactgtctaagaa

SEQ ID NO: 6588834 - DNA, 23 bp, Homo sapiens
tttaatgatctcggatgaccaaa

SEQ ID NO: 6588835 - DNA, 22 bp, Homo sapiens
tttaatgatggtgttaaagctg

SEQ ID NO: 6588836 - DNA, 20 bp, Homo sapiens
tttaatgcaaatgaaggaat

SEQ ID NO: 6588837 - DNA, 18 bp, Homo sapiens
tttaatgcattaaacctg

SEQ ID NO: 6588838 - DNA, 12 bp, Homo sapiens
tttaatgctgcc

SEQ ID NO: 6588839 - DNA, 14 bp, Homo sapiens
tttaatgctgcctt

SEQ ID NO: 6588840 - DNA, 13 bp, Homo sapiens
tttaatgctgtct

SEQ ID NO: 6588841 - DNA, 16 bp, Homo sapiens
tttaatgctgtctttg

SEQ ID NO: 6588842 - DNA, 17 bp, Homo sapiens
tttaatgcttaagattt

SEQ ID NO: 6588843 - DNA, 17 bp, Homo sapiens
tttaatgcttcattcaa

SEQ ID NO: 6588844 - DNA, 19 bp, Homo sapiens
tttaatggacacttttcac

SEQ ID NO: 6588845 - DNA, 21 bp, Homo sapiens
tttaatggacacttttcacct

SEQ ID NO: 6588846 - DNA, 18 bp, Homo sapiens
tttaatggatatttctca

SEQ ID NO: 6588847 - DNA, 21 bp, Homo sapiens
tttaatggattgttaatttca

SEQ ID NO: 6588848 - DNA, 21 bp, Homo sapiens
tttaatggcagcagaaaactt

SEQ ID NO: 6588849 - DNA, 20 bp, Homo sapiens
tttaatgggattgtgttaaa

SEQ ID NO: 6588850 - DNA, 21 bp, Homo sapiens
tttaatgggggtagcagctgg

SEQ ID NO: 6588851 - DNA, 16 bp, Homo sapiens
tttaatggtatctgtt

SEQ ID NO: 6588852 - DNA, 19 bp, Homo sapiens
tttaatggtatctgttact

SEQ ID NO: 6588853 - DNA, 21 bp, Homo sapiens
tttaatgtaaagaacttaaat

SEQ ID NO: 6588854 - DNA, 14 bp, Homo sapiens
tttaatgtaaagat

SEQ ID NO: 6588855 - DNA, 16 bp, Homo sapiens
tttaatgtaaagattt

SEQ ID NO: 6588856 - DNA, 12 bp, Homo sapiens
tttaatgtaaat

SEQ ID NO: 6588857 - DNA, 19 bp, Homo sapiens
tttaatgtaaataaaacat

SEQ ID NO: 6588858 - DNA, 16 bp, Homo sapiens
tttaatgtatctattt

SEQ ID NO: 6588859 - DNA, 23 bp, Homo sapiens
tttaatgtatcttaaaggacata

SEQ ID NO: 6588860 - DNA, 15 bp, Homo sapiens
tttaatgtctgttta

SEQ ID NO: 6588861 - DNA, 11 bp, Homo sapiens
tttaatgtgaa

SEQ ID NO: 6588862 - DNA, 12 bp, Homo sapiens
tttaatgtgaac

SEQ ID NO: 6588863 - DNA, 13 bp, Homo sapiens
tttaatgtgaact

SEQ ID NO: 6588864 - DNA, 19 bp, Homo sapiens
tttaatgtgaacttgtagc

SEQ ID NO: 6588865 - DNA, 20 bp, Homo sapiens
tttaatgtgaacttgtagct

SEQ ID NO: 6588866 - DNA, 12 bp, Homo sapiens
tttaatgtgaat

SEQ ID NO: 6588867 - DNA, 17 bp, Homo sapiens
tttaatgtgctgtgtaa

SEQ ID NO: 6588868 - DNA, 18 bp, Homo sapiens
tttaatgtgctgtgtaaa

SEQ ID NO: 6588869 - DNA, 19 bp, Homo sapiens
tttaatgtgctgtgtaaag

SEQ ID NO: 6588870 - DNA, 17 bp, Homo sapiens
tttaatgttacatagta

SEQ ID NO: 6588871 - DNA, 17 bp, Homo sapiens
tttaatgttatcctctt

SEQ ID NO: 6588872 - DNA, 15 bp, Homo sapiens
aatctgaagattgtt

SEQ ID NO: 6588873 - DNA, 21 bp, Homo sapiens
aatctgaagattgtttatcta

SEQ ID NO: 6588874 - DNA, 12 bp, Homo sapiens
aatctgaagcct

SEQ ID NO: 6588875 - DNA, 18 bp, Homo sapiens
aatctgaagcttcactca

SEQ ID NO: 6588876 - DNA, 21 bp, Homo sapiens
aatctgaaggagagagtcttt

SEQ ID NO: 6588877 - DNA, 13 bp, Homo sapiens
aatctgaatgtaa

SEQ ID NO: 6588878 - DNA, 14 bp, Homo sapiens
aatctgaatgtaat

SEQ ID NO: 6588879 - DNA, 16 bp, Homo sapiens
aatctgaatgtaattt

SEQ ID NO: 6588880 - DNA, 14 bp, Homo sapiens
aatctgaatgtatt

SEQ ID NO: 6588881 - DNA, 18 bp, Homo sapiens
aatctgaattggaatgca

SEQ ID NO: 6588882 - DNA, 14 bp, Homo sapiens
aatctgaattttgc

SEQ ID NO: 6588883 - DNA, 20 bp, Homo sapiens
aatctgaattttgcaatgta

SEQ ID NO: 6588884 - DNA, 21 bp, Homo sapiens
aatctgacagtctcaaatttt

SEQ ID NO: 6588885 - DNA, 12 bp, Homo sapiens
aatctgacatat

SEQ ID NO: 6588886 - DNA, 14 bp, Homo sapiens
aatctgacatatta

SEQ ID NO: 6588887 - DNA, 20 bp, Homo sapiens
aatctgacttctcacttcct

SEQ ID NO: 6588888 - DNA, 17 bp, Homo sapiens
aatctgactttttctgt

SEQ ID NO: 6588889 - DNA, 23 bp, Homo sapiens
aatctgagattgtgtttgttcat

SEQ ID NO: 6588890 - DNA, 12 bp, Homo sapiens
aatctgagcaaa

SEQ ID NO: 6588891 - DNA, 23 bp, Homo sapiens
aatctgagcaggtacatttctga

SEQ ID NO: 6588892 - DNA, 18 bp, Homo sapiens
aatctgagcctaaatcta

SEQ ID NO: 6588893 - DNA, 19 bp, Homo sapiens
aatctgagcctaaatctaa

SEQ ID NO: 6588894 - DNA, 20 bp, Homo sapiens
aatctgagctgcagcctggc

SEQ ID NO: 6588895 - DNA, 20 bp, Homo sapiens
aatctgaggcatcctctgac

SEQ ID NO: 6588896 - DNA, 20 bp, Homo sapiens
aatctgagggcactctctgc

SEQ ID NO: 6588897 - DNA, 20 bp, Homo sapiens
aatctgagggttaatttcta

SEQ ID NO: 6588898 - DNA, 21 bp, Homo sapiens
aatctgataggaaaagaaggc

SEQ ID NO: 6588899 - DNA, 22 bp, Homo sapiens
aatctgatcacccccctgctta

SEQ ID NO: 6588900 - DNA, 20 bp, Homo sapiens
aatctgatcccataaagaaa

SEQ ID NO: 6588901 - DNA, 15 bp, Homo sapiens
aatctgatggcctta

SEQ ID NO: 6588902 - DNA, 18 bp, Homo sapiens
aatctgattaatccattt

SEQ ID NO: 6588903 - DNA, 22 bp, Homo sapiens
aatctgattcagcatcactaaa

SEQ ID NO: 6588904 - DNA, 18 bp, Homo sapiens
aatctgattggacatttt

SEQ ID NO: 6588905 - DNA, 19 bp, Homo sapiens
aatctgatttaatgttttc

SEQ ID NO: 6588906 - DNA, 22 bp, Homo sapiens
aatctgatttcattacatttct

SEQ ID NO: 6588907 - DNA, 22 bp, Homo sapiens
aatctgatttgttttcctctta

SEQ ID NO: 6588908 - DNA, 23 bp, Homo sapiens
aatctgatttttatgatgatgaa

SEQ ID NO: 6588909 - DNA, 23 bp, Homo sapiens
aatctgcaaagcatgttttgcat

SEQ ID NO: 6588910 - DNA, 15 bp, Homo sapiens
aatctgcaattcaaa

SEQ ID NO: 6588911 - DNA, 20 bp, Homo sapiens
aatctgcacactccaggcct

SEQ ID NO: 6588912 - DNA, 14 bp, Homo sapiens
aatctgcacagtca

SEQ ID NO: 6588913 - DNA, 11 bp, Homo sapiens
aatctgcaggg

SEQ ID NO: 6588914 - DNA, 16 bp, Homo sapiens
aatctgcattattgga

SEQ ID NO: 6588915 - DNA, 17 bp, Homo sapiens
aatctgcatttagcaca

SEQ ID NO: 6588916 - DNA, 17 bp, Homo sapiens
aatctgccaagagagat

SEQ ID NO: 6588917 - DNA, 12 bp, Homo sapiens
aatctgccacct

SEQ ID NO: 6588918 - DNA, 23 bp, Homo sapiens
aatctgccctcagatgaaaataa

SEQ ID NO: 6588919 - DNA, 23 bp, Homo sapiens
aatctgccgctttgtctgtccag

SEQ ID NO: 6588920 - DNA, 10 bp, Homo sapiens
aatctgcctg

SEQ ID NO: 6588921 - DNA, 17 bp, Homo sapiens
aatctgctgagaggcac

SEQ ID NO: 6588922 - DNA, 17 bp, Homo sapiens
aatctgctgatctctgt

SEQ ID NO: 6588923 - DNA, 22 bp, Homo sapiens
aatctgcttcatccaatgtgaa

SEQ ID NO: 6588924 - DNA, 12 bp, Homo sapiens
aatctgctttag

SEQ ID NO: 6588925 - DNA, 14 bp, Homo sapiens
aatctgctttgtta

SEQ ID NO: 6588926 - DNA, 15 bp, Homo sapiens
aatctgctttgttaa

SEQ ID NO: 6588927 - DNA, 16 bp, Homo sapiens
aatctgctttgttaat

SEQ ID NO: 6588928 - DNA, 20 bp, Homo sapiens
aatctgctttgttaatgaaa

SEQ ID NO: 6588929 - DNA, 12 bp, Homo sapiens
aatctgcttttc

SEQ ID NO: 6588930 - DNA, 19 bp, Homo sapiens
aatctgcttttcctctgcc

SEQ ID NO: 6588931 - DNA, 22 bp, Homo sapiens
aatctgctttttaaagaatgct

SEQ ID NO: 6588932 - DNA, 11 bp, Homo sapiens
aatctggaaaa

SEQ ID NO: 6588933 - DNA, 23 bp, Homo sapiens
aatctggaccccatctgtgaata

SEQ ID NO: 6588934 - DNA, 17 bp, Homo sapiens
aatctggactcctctgt

SEQ ID NO: 6588935 - DNA, 20 bp, Homo sapiens
aatctggactcctctgtcca

SEQ ID NO: 6588936 - DNA, 14 bp, Homo sapiens
aatctggagaccag

SEQ ID NO: 6588937 - DNA, 17 bp, Homo sapiens
aatctggattcatattt

SEQ ID NO: 6588938 - DNA, 16 bp, Homo sapiens
aatctggcaaagttat

SEQ ID NO: 6588939 - DNA, 21 bp, Homo sapiens
aatctggcattctacacctgg

SEQ ID NO: 6588940 - DNA, 23 bp, Homo sapiens
aatctggccaccccagccagcag

SEQ ID NO: 6588941 - DNA, 13 bp, Homo sapiens
aatctggcccagg

SEQ ID NO: 6588942 - DNA, 13 bp, Homo sapiens
aatctggctcact

SEQ ID NO: 6588943 - DNA, 20 bp, Homo sapiens
aatctggctcactgcagcct

SEQ ID NO: 6588944 - DNA, 17 bp, Homo sapiens
aatctggcttagtgcca

SEQ ID NO: 6588945 - DNA, 22 bp, Homo sapiens
aatctgggaaggcaacacctgt

SEQ ID NO: 6588946 - DNA, 20 bp, Homo sapiens
aatctgggactgtgcctggc

SEQ ID NO: 6588947 - DNA, 17 bp, Homo sapiens
aatctgggcatctcgtg

SEQ ID NO: 6588948 - DNA, 19 bp, Homo sapiens
aatctggggaagaggtttt

SEQ ID NO: 6588949 - DNA, 16 bp, Homo sapiens
aatctgggtggtaact

SEQ ID NO: 6588950 - DNA, 19 bp, Homo sapiens
aatctggtaatggtgtccc

SEQ ID NO: 6588951 - DNA, 20 bp, Homo sapiens
aatctggtccatatttacat

SEQ ID NO: 6588952 - DNA, 23 bp, Homo sapiens
aatctggtctgaataacactgga

SEQ ID NO: 6588953 - DNA, 19 bp, Homo sapiens
aatctggtgttcttgctaa

SEQ ID NO: 6588954 - DNA, 11 bp, Homo sapiens
aatctgtaaaa

SEQ ID NO: 6588955 - DNA, 11 bp, Homo sapiens
aatctgtaaac

SEQ ID NO: 6588956 - DNA, 13 bp, Homo sapiens
aatctgtaaattt

SEQ ID NO: 6588957 - DNA, 18 bp, Homo sapiens
aatctgtaagctctttga

SEQ ID NO: 6588958 - DNA, 13 bp, Homo sapiens
aatctgtaattct

SEQ ID NO: 6588959 - DNA, 14 bp, Homo sapiens
aatctgtaatttca

SEQ ID NO: 6588960 - DNA, 18 bp, Homo sapiens
aatctgtacaaaatggtc

SEQ ID NO: 6588961 - DNA, 12 bp, Homo sapiens
aatctgtacatt

SEQ ID NO: 6588962 - DNA, 22 bp, Homo sapiens
aatctgtacattttgttgtaaa

SEQ ID NO: 6588963 - DNA, 13 bp, Homo sapiens
aatctgtactttt

SEQ ID NO: 6588964 - DNA, 20 bp, Homo sapiens
aatctgtagaggagcctgga

SEQ ID NO: 6588965 - DNA, 22 bp, Homo sapiens
aatctgtagaggagcctggagt

SEQ ID NO: 6588966 - DNA, 15 bp, Homo sapiens
aatctgtataaatgt

SEQ ID NO: 6588967 - DNA, 14 bp, Homo sapiens
aatctgtcaaaaca

SEQ ID NO: 6588968 - DNA, 16 bp, Homo sapiens
aatctgtcaaaacact

SEQ ID NO: 6588969 - DNA, 20 bp, Homo sapiens
aatctgtcaagagtagttat

SEQ ID NO: 6588970 - DNA, 22 bp, Homo sapiens
aatctgtcacgtagaacttgga

SEQ ID NO: 6588971 - DNA, 22 bp, Homo sapiens
aatctgtcactacaatttaaac

SEQ ID NO: 6588972 - DNA, 16 bp, Homo sapiens
aatctgtcagcatctg

SEQ ID NO: 6588973 - DNA, 22 bp, Homo sapiens
aatctgtcataagcattacttt

SEQ ID NO: 6588974 - DNA, 23 bp, Homo sapiens
aatctgtcataagcattacttta

SEQ ID NO: 6588975 - DNA, 20 bp, Homo sapiens
aatctgtccaaaggaggctg

SEQ ID NO: 6588976 - DNA, 14 bp, Homo sapiens
aatctgtccagaca

SEQ ID NO: 6588977 - DNA, 19 bp, Homo sapiens
aatctgtccagacaagccc

SEQ ID NO: 6588978 - DNA, 14 bp, Homo sapiens
aatctgtcctctgt

SEQ ID NO: 6588979 - DNA, 17 bp, Homo sapiens
aatctgtcctctgtagt

SEQ ID NO: 6588980 - DNA, 17 bp, Homo sapiens
aatctgtcgcatttcat

SEQ ID NO: 6588981 - DNA, 21 bp, Homo sapiens
aatctgtcgcatttcatcaag

SEQ ID NO: 6588982 - DNA, 19 bp, Homo sapiens
aatctgtctccccagaaga

SEQ ID NO: 6588983 - DNA, 14 bp, Homo sapiens
aatctgtctgattc

SEQ ID NO: 6588984 - DNA, 17 bp, Homo sapiens
aatctgtctgattctat

SEQ ID NO: 6588985 - DNA, 18 bp, Homo sapiens
aatctgtgaacttgaaat

SEQ ID NO: 6588986 - DNA, 21 bp, Homo sapiens
aatctgtgaagcctttatcta

SEQ ID NO: 6588987 - DNA, 16 bp, Homo sapiens
aatctgtgaattaaaa

SEQ ID NO: 6588988 - DNA, 23 bp, Homo sapiens
aatctgtgaattaaaaaagctca

SEQ ID NO: 6588989 - DNA, 20 bp, Homo sapiens
aatctgtgacctgtcagaat

SEQ ID NO: 6588990 - DNA, 22 bp, Homo sapiens
aatctgtgacctgtcagaataa

SEQ ID NO: 6588991 - DNA, 16 bp, Homo sapiens
aatctgtgagaagttt

SEQ ID NO: 6588992 - DNA, 12 bp, Homo sapiens
aatctgtgatga

SEQ ID NO: 6588993 - DNA, 15 bp, Homo sapiens
aatctgtgcaaacag

SEQ ID NO: 6588994 - DNA, 16 bp, Homo sapiens
aatctgtgcaataaaa

SEQ ID NO: 6588995 - DNA, 15 bp, Homo sapiens
aatctgtgctggcca

SEQ ID NO: 6588996 - DNA, 16 bp, Homo sapiens
aatctgtgctggccat

SEQ ID NO: 6588997 - DNA, 22 bp, Homo sapiens
aatctgtgctgtttcaaagttc

SEQ ID NO: 6588998 - DNA, 13 bp, Homo sapiens
aatctgtgtacaa

SEQ ID NO: 6588999 - DNA, 20 bp, Homo sapiens
aatctgtgtgaaactttcat

SEQ ID NO: 6589000 - DNA, 23 bp, Homo sapiens
aatctgtgtgaaactttcattcc

SEQ ID NO: 6589001 - DNA, 15 bp, Homo sapiens
aatctgtgtgtatat

SEQ ID NO: 6589002 - DNA, 19 bp, Homo sapiens
aatctgttagcattattgc

SEQ ID NO: 6589003 - DNA, 12 bp, Homo sapiens
aatctgttctac

SEQ ID NO: 6589004 - DNA, 20 bp, Homo sapiens
aatctgtttcaggtttccat

SEQ ID NO: 6589005 - DNA, 13 bp, Homo sapiens
aatctgtttgtgc

SEQ ID NO: 6589006 - DNA, 19 bp, Homo sapiens
aatctgtttgtgcaaacat

SEQ ID NO: 6589007 - DNA, 22 bp, Homo sapiens
aatctgtttgtgcaaacataat

SEQ ID NO: 6589008 - DNA, 21 bp, Homo sapiens
aatctgttttataccttgctt

SEQ ID NO: 6589009 - DNA, 15 bp, Homo sapiens
aatctgtttttctca

SEQ ID NO: 6589010 - DNA, 16 bp, Homo sapiens
aatcttaaatcagaat

SEQ ID NO: 6589011 - DNA, 21 bp, Homo sapiens
aatcttaaatcagaataaatt

SEQ ID NO: 6589012 - DNA, 14 bp, Homo sapiens
aatcttaacatttt

SEQ ID NO: 6589013 - DNA, 16 bp, Homo sapiens
aatcttaaccttcaaa

SEQ ID NO: 6589014 - DNA, 14 bp, Homo sapiens
aatcttaagaaata

SEQ ID NO: 6589015 - DNA, 15 bp, Homo sapiens
aatcttaagaaataa

SEQ ID NO: 6589016 - DNA, 20 bp, Homo sapiens
aatcttaagagaatccacat

SEQ ID NO: 6589017 - DNA, 18 bp, Homo sapiens
aatcttaaggtctaactg

SEQ ID NO: 6589018 - DNA, 19 bp, Homo sapiens
aatcttaaggtctaactgt

SEQ ID NO: 6589019 - DNA, 20 bp, Homo sapiens
aatcttaaggtgtagccaca

SEQ ID NO: 6589020 - DNA, 15 bp, Homo sapiens
aatcttaatactgtt

SEQ ID NO: 6589021 - DNA, 16 bp, Homo sapiens
aatcttaatactgtta

SEQ ID NO: 6589022 - DNA, 18 bp, Homo sapiens
aatcttaatactgttatt

SEQ ID NO: 6589023 - DNA, 22 bp, Homo sapiens
aatcttaatactgttattcttt

SEQ ID NO: 6589024 - DNA, 21 bp, Homo sapiens
aatcttaatcgatgaatgtaa

SEQ ID NO: 6589025 - DNA, 13 bp, Homo sapiens
aatcttaatgttc

SEQ ID NO: 6589026 - DNA, 15 bp, Homo sapiens
aatcttaatgttcct

SEQ ID NO: 6589027 - DNA, 15 bp, Homo sapiens
aatcttaccagatgc

SEQ ID NO: 6589028 - DNA, 20 bp, Homo sapiens
aatcttaccagatgctactg

SEQ ID NO: 6589029 - DNA, 13 bp, Homo sapiens
aatcttactttgt

SEQ ID NO: 6589030 - DNA, 14 bp, Homo sapiens
aatcttactttgta

SEQ ID NO: 6589031 - DNA, 17 bp, Homo sapiens
aatcttactttgtaaat

SEQ ID NO: 6589032 - DNA, 19 bp, Homo sapiens
aatcttactttgtaaattc

SEQ ID NO: 6589033 - DNA, 20 bp, Homo sapiens
aatcttagaacagatggctg

SEQ ID NO: 6589034 - DNA, 22 bp, Homo sapiens
aatcttagataacttcttgaaa

SEQ ID NO: 6589035 - DNA, 11 bp, Homo sapiens
aatcttagctt

SEQ ID NO: 6589036 - DNA, 19 bp, Homo sapiens
aatcttagcttttaatagt

SEQ ID NO: 6589037 - DNA, 22 bp, Homo sapiens
aatcttagtatagtagaaagac

SEQ ID NO: 6589038 - DNA, 18 bp, Homo sapiens
aatcttagtgaatgggaa

SEQ ID NO: 6589039 - DNA, 23 bp, Homo sapiens
aatcttagtgtatgattactggc

SEQ ID NO: 6589040 - DNA, 14 bp, Homo sapiens
aatcttagtgttca

SEQ ID NO: 6589041 - DNA, 14 bp, Homo sapiens
aatcttataattta

SEQ ID NO: 6589042 - DNA, 13 bp, Homo sapiens
aatcttatacaac

SEQ ID NO: 6589043 - DNA, 18 bp, Homo sapiens
aatcttatagttctaggc

SEQ ID NO: 6589044 - DNA, 14 bp, Homo sapiens
aatcttatggggcc

SEQ ID NO: 6589045 - DNA, 15 bp, Homo sapiens
aatcttattaaagtt

SEQ ID NO: 6589046 - DNA, 21 bp, Homo sapiens
aatcttattaaagtttcaaaa

SEQ ID NO: 6589047 - DNA, 18 bp, Homo sapiens
aatcttatttttcctgtc

SEQ ID NO: 6589048 - DNA, 19 bp, Homo sapiens
aatcttcaaggtgtaaaat

SEQ ID NO: 6589049 - DNA, 19 bp, Homo sapiens
aatcttcaatatgaaggac

SEQ ID NO: 6589050 - DNA, 11 bp, Homo sapiens
tttaatgttct

SEQ ID NO: 6589051 - DNA, 17 bp, Homo sapiens
tttaatgtttaaaacat

SEQ ID NO: 6589052 - DNA, 17 bp, Homo sapiens
tttaatgtttatacaga

SEQ ID NO: 6589053 - DNA, 19 bp, Homo sapiens
tttaatgtttatacagagt

SEQ ID NO: 6589054 - DNA, 20 bp, Homo sapiens
tttaatgtttattatttaca

SEQ ID NO: 6589055 - DNA, 15 bp, Homo sapiens
tttaatgttttaaat

SEQ ID NO: 6589056 - DNA, 13 bp, Homo sapiens
tttaatgttttct

SEQ ID NO: 6589057 - DNA, 22 bp, Homo sapiens
tttaatgttttctgctgtttaa

SEQ ID NO: 6589058 - DNA, 18 bp, Homo sapiens
tttaattaaaaactagta

SEQ ID NO: 6589059 - DNA, 19 bp, Homo sapiens
tttaattaaaaagaattct

SEQ ID NO: 6589060 - DNA, 15 bp, Homo sapiens
tttaattaaatgctc

SEQ ID NO: 6589061 - DNA, 20 bp, Homo sapiens
tttaattaaatgctcatctg

SEQ ID NO: 6589062 - DNA, 12 bp, Homo sapiens
tttaattacaac

SEQ ID NO: 6589063 - DNA, 16 bp, Homo sapiens
tttaattactgctata

SEQ ID NO: 6589064 - DNA, 14 bp, Homo sapiens
tttaattagtgcta

SEQ ID NO: 6589065 - DNA, 15 bp, Homo sapiens
tttaattagtgctaa

SEQ ID NO: 6589066 - DNA, 17 bp, Homo sapiens
tttaattagtgctaagt

SEQ ID NO: 6589067 - DNA, 19 bp, Homo sapiens
tttaattagtgctaagtgt

SEQ ID NO: 6589068 - DNA, 19 bp, Homo sapiens
tttaattattaactacatt

SEQ ID NO: 6589069 - DNA, 20 bp, Homo sapiens
tttaattattttaaaatatt

SEQ ID NO: 6589070 - DNA, 16 bp, Homo sapiens
tttaattcaagaaatg

SEQ ID NO: 6589071 - DNA, 18 bp, Homo sapiens
tttaattcacgtgctttg

SEQ ID NO: 6589072 - DNA, 19 bp, Homo sapiens
tttaattcagtacaaccca

SEQ ID NO: 6589073 - DNA, 11 bp, Homo sapiens
tttaattcata

SEQ ID NO: 6589074 - DNA, 14 bp, Homo sapiens
tttaattcataatt

SEQ ID NO: 6589075 - DNA, 14 bp, Homo sapiens
tttaattcatgttt

SEQ ID NO: 6589076 - DNA, 23 bp, Homo sapiens
tttaattcatgtttcttaaatgg

SEQ ID NO: 6589077 - DNA, 21 bp, Homo sapiens
tttaattccaatatgatgact

SEQ ID NO: 6589078 - DNA, 22 bp, Homo sapiens
tttaattccatgaatcgcttct

SEQ ID NO: 6589079 - DNA, 20 bp, Homo sapiens
tttaattcctggaaaactgg

SEQ ID NO: 6589080 - DNA, 20 bp, Homo sapiens
tttaattctgcttgtgacat

SEQ ID NO: 6589081 - DNA, 22 bp, Homo sapiens
tttaattgaaactagttatttt

SEQ ID NO: 6589082 - DNA, 20 bp, Homo sapiens
tttaattgaaagaatgtaaa

SEQ ID NO: 6589083 - DNA, 21 bp, Homo sapiens
tttaattgaaagaatgtaaag

SEQ ID NO: 6589084 - DNA, 19 bp, Homo sapiens
tttaattgaaggaaagatt

SEQ ID NO: 6589085 - DNA, 14 bp, Homo sapiens
tttaattgattatt

SEQ ID NO: 6589086 - DNA, 14 bp, Homo sapiens
tttaattgcaacaa

SEQ ID NO: 6589087 - DNA, 19 bp, Homo sapiens
tttaattgcaacaatgcaa

SEQ ID NO: 6589088 - DNA, 16 bp, Homo sapiens
tttaattgctttaaat

SEQ ID NO: 6589089 - DNA, 18 bp, Homo sapiens
tttaattgctttgaagca

SEQ ID NO: 6589090 - DNA, 19 bp, Homo sapiens
tttaattgctttgaagcat

SEQ ID NO: 6589091 - DNA, 17 bp, Homo sapiens
tttaattggagtctcaa

SEQ ID NO: 6589092 - DNA, 22 bp, Homo sapiens
tttaattggagtctcaaaatca

SEQ ID NO: 6589093 - DNA, 19 bp, Homo sapiens
tttaattgtaaactgtact

SEQ ID NO: 6589094 - DNA, 15 bp, Homo sapiens
tttaattgtaaagta

SEQ ID NO: 6589095 - DNA, 21 bp, Homo sapiens
tttaattgtagttctgtgtac

SEQ ID NO: 6589096 - DNA, 14 bp, Homo sapiens
tttaattgtataaa

SEQ ID NO: 6589097 - DNA, 14 bp, Homo sapiens
tttaattgtatttt

SEQ ID NO: 6589098 - DNA, 17 bp, Homo sapiens
tttaattgtatttttgt

SEQ ID NO: 6589099 - DNA, 21 bp, Homo sapiens
tttaattgtcatggttacaaa

SEQ ID NO: 6589100 - DNA, 20 bp, Homo sapiens
tttaattgtccagtttgtct

SEQ ID NO: 6589101 - DNA, 21 bp, Homo sapiens
tttaattgtgcaaaggataaa

SEQ ID NO: 6589102 - DNA, 19 bp, Homo sapiens
tttaattgtgtaactgttc

SEQ ID NO: 6589103 - DNA, 14 bp, Homo sapiens
tttaatttaaactg

SEQ ID NO: 6589104 - DNA, 15 bp, Homo sapiens
tttaatttaaactgt

SEQ ID NO: 6589105 - DNA, 13 bp, Homo sapiens
tttaatttaaagc

SEQ ID NO: 6589106 - DNA, 20 bp, Homo sapiens
tttaatttaacaaactaaaa

SEQ ID NO: 6589107 - DNA, 18 bp, Homo sapiens
tttaatttagtaaaccaa

SEQ ID NO: 6589108 - DNA, 22 bp, Homo sapiens
tttaatttataggcagatcttt

SEQ ID NO: 6589109 - DNA, 16 bp, Homo sapiens
tttaatttatatcagg

SEQ ID NO: 6589110 - DNA, 23 bp, Homo sapiens
tttaatttatatttgaaatttta

SEQ ID NO: 6589111 - DNA, 16 bp, Homo sapiens
tttaatttatgagttt

SEQ ID NO: 6589112 - DNA, 20 bp, Homo sapiens
tttaatttatgtaacttgaa

SEQ ID NO: 6589113 - DNA, 19 bp, Homo sapiens
tttaatttatttattaaga

SEQ ID NO: 6589114 - DNA, 19 bp, Homo sapiens
tttaatttattttgtgaac

SEQ ID NO: 6589115 - DNA, 13 bp, Homo sapiens
tttaatttcaagc

SEQ ID NO: 6589116 - DNA, 12 bp, Homo sapiens
tttaatttcagg

SEQ ID NO: 6589117 - DNA, 13 bp, Homo sapiens
tttaatttcagga

SEQ ID NO: 6589118 - DNA, 15 bp, Homo sapiens
tttaatttcaggaaa

SEQ ID NO: 6589119 - DNA, 16 bp, Homo sapiens
tttaatttcaggaaaa

SEQ ID NO: 6589120 - DNA, 14 bp, Homo sapiens
tttaatttcataaa

SEQ ID NO: 6589121 - DNA, 12 bp, Homo sapiens
tttaatttcatg

SEQ ID NO: 6589122 - DNA, 17 bp, Homo sapiens
tttaatttcctgtgagg

SEQ ID NO: 6589123 - DNA, 21 bp, Homo sapiens
tttaatttctacaaaataaca

SEQ ID NO: 6589124 - DNA, 16 bp, Homo sapiens
tttaatttgaatcaga

SEQ ID NO: 6589125 - DNA, 16 bp, Homo sapiens
tttaatttgatacaaa

SEQ ID NO: 6589126 - DNA, 19 bp, Homo sapiens
tttaatttggcttttctta

SEQ ID NO: 6589127 - DNA, 13 bp, Homo sapiens
tttaatttgtaaa

SEQ ID NO: 6589128 - DNA, 16 bp, Homo sapiens
tttaatttgtattgaa

SEQ ID NO: 6589129 - DNA, 14 bp, Homo sapiens
tttaattttaaaga

SEQ ID NO: 6589130 - DNA, 18 bp, Homo sapiens
tttaattttaactgattt

SEQ ID NO: 6589131 - DNA, 15 bp, Homo sapiens
tttaattttaatgct

SEQ ID NO: 6589132 - DNA, 12 bp, Homo sapiens
tttaattttaca

SEQ ID NO: 6589133 - DNA, 20 bp, Homo sapiens
tttaattttcacaaaatgtc

SEQ ID NO: 6589134 - DNA, 18 bp, Homo sapiens
tttaattttcctctaatt

SEQ ID NO: 6589135 - DNA, 15 bp, Homo sapiens
tttaattttgacact

SEQ ID NO: 6589136 - DNA, 14 bp, Homo sapiens
tttaattttggaat

SEQ ID NO: 6589137 - DNA, 17 bp, Homo sapiens
tttaattttggaatttt

SEQ ID NO: 6589138 - DNA, 15 bp, Homo sapiens
tttaattttgtattt

SEQ ID NO: 6589139 - DNA, 16 bp, Homo sapiens
tttaattttgtatttt

SEQ ID NO: 6589140 - DNA, 18 bp, Homo sapiens
tttaattttgtgttgcta

SEQ ID NO: 6589141 - DNA, 20 bp, Homo sapiens
tttaattttgtgttgctaaa

SEQ ID NO: 6589142 - DNA, 23 bp, Homo sapiens
tttaatttttaaaagactttgat

SEQ ID NO: 6589143 - DNA, 18 bp, Homo sapiens
tttaatttttacatgacc

SEQ ID NO: 6589144 - DNA, 14 bp, Homo sapiens
tttaatttttcctt

SEQ ID NO: 6589145 - DNA, 16 bp, Homo sapiens
tttaatttttcctttt

SEQ ID NO: 6589146 - DNA, 22 bp, Homo sapiens
tttaatttttgcttttagaaaa

SEQ ID NO: 6589147 - DNA, 21 bp, Homo sapiens
tttaattttttactttcagtt

SEQ ID NO: 6589148 - DNA, 18 bp, Homo sapiens
tttaattttttttagtat

SEQ ID NO: 6589149 - DNA, 17 bp, Homo sapiens
tttacaaaactgctttg

SEQ ID NO: 6589150 - DNA, 17 bp, Homo sapiens
tttacaaacaaaagcat

SEQ ID NO: 6589151 - DNA, 21 bp, Homo sapiens
tttacaaacatggaaaacaga

SEQ ID NO: 6589152 - DNA, 13 bp, Homo sapiens
tttacaaaccttt

SEQ ID NO: 6589153 - DNA, 17 bp, Homo sapiens
tttacaaacctttgttt

SEQ ID NO: 6589154 - DNA, 13 bp, Homo sapiens
tttacaaactgaa

SEQ ID NO: 6589155 - DNA, 15 bp, Homo sapiens
tttacaaactgaaga

SEQ ID NO: 6589156 - DNA, 16 bp, Homo sapiens
tttacaaactgaagag

SEQ ID NO: 6589157 - DNA, 16 bp, Homo sapiens
tttacaaactgaagat

SEQ ID NO: 6589158 - DNA, 15 bp, Homo sapiens
tttacaaataaagat

SEQ ID NO: 6589159 - DNA, 23 bp, Homo sapiens
tttacaaatataggttgtcttgt

SEQ ID NO: 6589160 - DNA, 20 bp, Homo sapiens
tttacaaatattaagaaaat

SEQ ID NO: 6589161 - DNA, 13 bp, Homo sapiens
tttacaaatgaag

SEQ ID NO: 6589162 - DNA, 16 bp, Homo sapiens
tttacaaattaatatt

SEQ ID NO: 6589163 - DNA, 13 bp, Homo sapiens
tttacaaattcct

SEQ ID NO: 6589164 - DNA, 23 bp, Homo sapiens
tttacaacacagtagtgttctgt

SEQ ID NO: 6589165 - DNA, 21 bp, Homo sapiens
tttacaacatcaccagtgcca

SEQ ID NO: 6589166 - DNA, 16 bp, Homo sapiens
tttacaacctagaagt

SEQ ID NO: 6589167 - DNA, 16 bp, Homo sapiens
tttacaactaaataac

SEQ ID NO: 6589168 - DNA, 11 bp, Homo sapiens
tttacaactca

SEQ ID NO: 6589169 - DNA, 20 bp, Homo sapiens
tttacaacttgattttttca

SEQ ID NO: 6589170 - DNA, 19 bp, Homo sapiens
tttacaagaaaaaatgaat

SEQ ID NO: 6589171 - DNA, 16 bp, Homo sapiens
tttacaagaagtttat

SEQ ID NO: 6589172 - DNA, 13 bp, Homo sapiens
tttacaagatatt

SEQ ID NO: 6589173 - DNA, 18 bp, Homo sapiens
tttacaagatccatttgc

SEQ ID NO: 6589174 - DNA, 15 bp, Homo sapiens
tttacaagccccccc

SEQ ID NO: 6589175 - DNA, 20 bp, Homo sapiens
tttacaagggcataaagtaa

SEQ ID NO: 6589176 - DNA, 15 bp, Homo sapiens
tttacaataaatatt

SEQ ID NO: 6589177 - DNA, 17 bp, Homo sapiens
tttacaatagttctgtg

SEQ ID NO: 6589178 - DNA, 17 bp, Homo sapiens
tttacaatattatgaaa

SEQ ID NO: 6589179 - DNA, 13 bp, Homo sapiens
tttacaatgattt

SEQ ID NO: 6589180 - DNA, 17 bp, Homo sapiens
tttacaatgtaattatt

SEQ ID NO: 6589181 - DNA, 12 bp, Homo sapiens
tttacaatgtgt

SEQ ID NO: 6589182 - DNA, 15 bp, Homo sapiens
tttacaattgaaatg

SEQ ID NO: 6589183 - DNA, 19 bp, Homo sapiens
tttacaattttttatcatg

SEQ ID NO: 6589184 - DNA, 22 bp, Homo sapiens
tttacacactgtacacataagc

SEQ ID NO: 6589185 - DNA, 14 bp, Homo sapiens
tttacacagtgaga

SEQ ID NO: 6589186 - DNA, 21 bp, Homo sapiens
tttacacatacaacttcatat

SEQ ID NO: 6589187 - DNA, 14 bp, Homo sapiens
tttacacatcttaa

SEQ ID NO: 6589188 - DNA, 15 bp, Homo sapiens
tttacacatcttaaa

SEQ ID NO: 6589189 - DNA, 21 bp, Homo sapiens
tttacacattcggctccctgg

SEQ ID NO: 6589190 - DNA, 20 bp, Homo sapiens
tttacaccgactagccagga

SEQ ID NO: 6589191 - DNA, 17 bp, Homo sapiens
tttacacgagatttctt

SEQ ID NO: 6589192 - DNA, 15 bp, Homo sapiens
tttacacgcttttgt

SEQ ID NO: 6589193 - DNA, 17 bp, Homo sapiens
tttacacgcttttgtga

SEQ ID NO: 6589194 - DNA, 18 bp, Homo sapiens
tttacactaatatatgga

SEQ ID NO: 6589195 - DNA, 16 bp, Homo sapiens
tttacactcaaccatg

SEQ ID NO: 6589196 - DNA, 18 bp, Homo sapiens
tttacactcggctttgga

SEQ ID NO: 6589197 - DNA, 18 bp, Homo sapiens
tttacactctctgtacaa

SEQ ID NO: 6589198 - DNA, 11 bp, Homo sapiens
tttacactgta

SEQ ID NO: 6589199 - DNA, 19 bp, Homo sapiens
tttacacttttgagacttt

SEQ ID NO: 6589200 - DNA, 12 bp, Homo sapiens
tttacagaaaaa

SEQ ID NO: 6589201 - DNA, 13 bp, Homo sapiens
tttacagaaatgg

SEQ ID NO: 6589202 - DNA, 17 bp, Homo sapiens
tttacagaagaaaagca

SEQ ID NO: 6589203 - DNA, 21 bp, Homo sapiens
tttacagaatgcattaaaaaa

SEQ ID NO: 6589204 - DNA, 14 bp, Homo sapiens
tttacagaattgct

SEQ ID NO: 6589205 - DNA, 19 bp, Homo sapiens
tttacagaattgcttgttt

SEQ ID NO: 6589206 - DNA, 13 bp, Homo sapiens
tttacagagacag

SEQ ID NO: 6589207 - DNA, 22 bp, Homo sapiens
tttacagagaggatacatttaa

SEQ ID NO: 6589208 - DNA, 20 bp, Homo sapiens
tttacagataaggaaactga

SEQ ID NO: 6589209 - DNA, 17 bp, Homo sapiens
tttacagatccagaatt

SEQ ID NO: 6589210 - DNA, 24 bp, Homo sapiens
tttacagatgagattccctctcct

SEQ ID NO: 6589211 - DNA, 21 bp, Homo sapiens
tttacagcactactctgtgcc

SEQ ID NO: 6589212 - DNA, 15 bp, Homo sapiens
tttacagcagcaata

SEQ ID NO: 6589213 - DNA, 18 bp, Homo sapiens
tttacagcagcaatattt

SEQ ID NO: 6589214 - DNA, 19 bp, Homo sapiens
tttacagcattgtctttgc

SEQ ID NO: 6589215 - DNA, 20 bp, Homo sapiens
tttacagcattgtctttgct

SEQ ID NO: 6589216 - DNA, 22 bp, Homo sapiens
tttacagcattgtctttgctgt

SEQ ID NO: 6589217 - DNA, 22 bp, Homo sapiens
tttacagccagtgggagatgtt

SEQ ID NO: 6589218 - DNA, 23 bp, Homo sapiens
tttacagccagtgggagatgtta

SEQ ID NO: 6589219 - DNA, 21 bp, Homo sapiens
tttacagctcattaaactttt

SEQ ID NO: 6589220 - DNA, 22 bp, Homo sapiens
tttacagctctgactttacact

SEQ ID NO: 6589221 - DNA, 16 bp, Homo sapiens
tttacagctgcctgca

SEQ ID NO: 6589222 - DNA, 23 bp, Homo sapiens
tttacagctgcctttcgtgatct

SEQ ID NO: 6589223 - DNA, 20 bp, Homo sapiens
tttacagctgtttacagaca

SEQ ID NO: 6589224 - DNA, 19 bp, Homo sapiens
tttacagctttacacacac

SEQ ID NO: 6589225 - DNA, 20 bp, Homo sapiens
tttacagctttcatgattag

SEQ ID NO: 6589226 - DNA, 16 bp, Homo sapiens
tttacagcttttctct

SEQ ID NO: 6589227 - DNA, 18 bp, Homo sapiens
tttacagcttttctcttt

SEQ ID NO: 6589228 - DNA, 23 bp, Homo sapiens
tttacaggaaaaaaaattctgtt

SEQ ID NO: 6589229 - DNA, 18 bp, Homo sapiens
tttacaggaaattgcaaa

SEQ ID NO: 6589230 - DNA, 18 bp, Homo sapiens
tttacaggaacttcatca

SEQ ID NO: 6589231 - DNA, 19 bp, Homo sapiens
tttacaggaacttcatcat

SEQ ID NO: 6589232 - DNA, 19 bp, Homo sapiens
tttacaggccctgctcctg

SEQ ID NO: 6589233 - DNA, 19 bp, Homo sapiens
tttacagggatttctgttt

SEQ ID NO: 6589234 - DNA, 15 bp, Homo sapiens
tttacagtaaataaa

SEQ ID NO: 6589235 - DNA, 20 bp, Homo sapiens
tttacagtaaataaattgtt

SEQ ID NO: 6589236 - DNA, 17 bp, Homo sapiens
tttacagtacttgtctt

SEQ ID NO: 6589237 - DNA, 22 bp, Homo sapiens
tttacagtatctacttgcatgt

SEQ ID NO: 6589238 - DNA, 15 bp, Homo sapiens
tttacagtatcttca

SEQ ID NO: 6589239 - DNA, 15 bp, Homo sapiens
tttacagtatttcta

SEQ ID NO: 6589240 - DNA, 20 bp, Homo sapiens
tttacagtctctgttgtaaa

SEQ ID NO: 6589241 - DNA, 19 bp, Homo sapiens
tttacagtgaagaaagcct

SEQ ID NO: 6589242 - DNA, 19 bp, Homo sapiens
tttacagtgaatttctgat

SEQ ID NO: 6589243 - DNA, 18 bp, Homo sapiens
tttacagtgaccttttct

SEQ ID NO: 6589244 - DNA, 13 bp, Homo sapiens
tttacagtgagga

SEQ ID NO: 6589245 - DNA, 15 bp, Homo sapiens
tttacagtgtattta

SEQ ID NO: 6589246 - DNA, 17 bp, Homo sapiens
tttacagtgtatttaag

SEQ ID NO: 6589247 - DNA, 19 bp, Homo sapiens
tttacagtgtatttaagaa

SEQ ID NO: 6589248 - DNA, 21 bp, Homo sapiens
tttacagttacttttccttgc

SEQ ID NO: 6589249 - DNA, 20 bp, Homo sapiens
tttacagttagggttttgca

SEQ ID NO: 6589250 - DNA, 15 bp, Homo sapiens
tttacagttatagaa

SEQ ID NO: 6589251 - DNA, 14 bp, Homo sapiens
tttacataaagact

SEQ ID NO: 6589252 - DNA, 19 bp, Homo sapiens
tttacataacggaaagttt

SEQ ID NO: 6589253 - DNA, 20 bp, Homo sapiens
tttacataacggaaagtttt

SEQ ID NO: 6589254 - DNA, 15 bp, Homo sapiens
tttacataactgcct

SEQ ID NO: 6589255 - DNA, 19 bp, Homo sapiens
tttacataactgccttgaa

SEQ ID NO: 6589256 - DNA, 17 bp, Homo sapiens
tttacataagaaatgta

SEQ ID NO: 6589257 - DNA, 18 bp, Homo sapiens
tttacataaggatacact

SEQ ID NO: 6589258 - DNA, 21 bp, Homo sapiens
tttacatacagtgatatggta

SEQ ID NO: 6589259 - DNA, 15 bp, Homo sapiens
tttacatactgctgt

SEQ ID NO: 6589260 - DNA, 17 bp, Homo sapiens
tttacatacttttgcaa

SEQ ID NO: 6589261 - DNA, 15 bp, Homo sapiens
tttacatagcatttg

SEQ ID NO: 6589262 - DNA, 13 bp, Homo sapiens
tttacatagtctg

SEQ ID NO: 6589263 - DNA, 23 bp, Homo sapiens
tttacatagtctgaagtgaagta

SEQ ID NO: 6589264 - DNA, 20 bp, Homo sapiens
tttacatagtgcaaaactgt

SEQ ID NO: 6589265 - DNA, 18 bp, Homo sapiens
tttacatagttcttacta

SEQ ID NO: 6589266 - DNA, 23 bp, Homo sapiens
tttacatagttgagattgtactg

SEQ ID NO: 6589267 - DNA, 14 bp, Homo sapiens
tttacatattcctt

SEQ ID NO: 6589268 - DNA, 20 bp, Homo sapiens
tttacatcagaagtttgcat

SEQ ID NO: 6589269 - DNA, 19 bp, Homo sapiens
tttacatccttcactgctc

SEQ ID NO: 6589270 - DNA, 18 bp, Homo sapiens
tttacatgaagcagaacc

SEQ ID NO: 6589271 - DNA, 17 bp, Homo sapiens
tttacatggctggagct

SEQ ID NO: 6589272 - DNA, 14 bp, Homo sapiens
tttacatgtatggt

SEQ ID NO: 6589273 - DNA, 21 bp, Homo sapiens
tttacatgtgtagcctatgtt

SEQ ID NO: 6589274 - DNA, 16 bp, Homo sapiens
tttacattaaagaaat

SEQ ID NO: 6589275 - DNA, 13 bp, Homo sapiens
tttacattatgca

SEQ ID NO: 6589276 - DNA, 15 bp, Homo sapiens
tttacattcatatct

SEQ ID NO: 6589277 - DNA, 18 bp, Homo sapiens
tttacattctagttcaga

SEQ ID NO: 6589278 - DNA, 16 bp, Homo sapiens
tttacattctgtgtgt

SEQ ID NO: 6589279 - DNA, 14 bp, Homo sapiens
tttacattcttgct

SEQ ID NO: 6589280 - DNA, 13 bp, Homo sapiens
tttacattgtaaa

SEQ ID NO: 6589281 - DNA, 15 bp, Homo sapiens
tttacattgtaaata

SEQ ID NO: 6589282 - DNA, 15 bp, Homo sapiens
tttacattgtcctgt

SEQ ID NO: 6589283 - DNA, 18 bp, Homo sapiens
tttacatttaaagcattg

SEQ ID NO: 6589284 - DNA, 10 bp, Homo sapiens
tttacatttc

SEQ ID NO: 6589285 - DNA, 13 bp, Homo sapiens
tttacattttaca

SEQ ID NO: 6589286 - DNA, 17 bp, Homo sapiens
tttacattttatggtgc

SEQ ID NO: 6589287 - DNA, 23 bp, Homo sapiens
tttacattttatggtgcctagta

SEQ ID NO: 6589288 - DNA, 13 bp, Homo sapiens
tttacattttatt

SEQ ID NO: 6589289 - DNA, 13 bp, Homo sapiens
tttacattttctt

SEQ ID NO: 6589290 - DNA, 16 bp, Homo sapiens
tttacattttctttca

SEQ ID NO: 6589291 - DNA, 17 bp, Homo sapiens
tttacattttgtgcagt

SEQ ID NO: 6589292 - DNA, 22 bp, Homo sapiens
tttacatttttatttatgaagt

SEQ ID NO: 6589293 - DNA, 16 bp, Homo sapiens
tttaccaaacagcaaa

SEQ ID NO: 6589294 - DNA, 11 bp, Homo sapiens
tttaccaaagc

SEQ ID NO: 6589295 - DNA, 14 bp, Homo sapiens
tttaccaaagcatc

SEQ ID NO: 6589296 - DNA, 21 bp, Homo sapiens
tttaccaaatgaaatgccaaa

SEQ ID NO: 6589297 - DNA, 21 bp, Homo sapiens
tttaccaacatgtatctgtct

SEQ ID NO: 6589298 - DNA, 23 bp, Homo sapiens
tttaccaacatgtatctgtctac

SEQ ID NO: 6589299 - DNA, 18 bp, Homo sapiens
tttaccaagagtaacttt

SEQ ID NO: 6589300 - DNA, 14 bp, Homo sapiens
tttaccaaggaaag

SEQ ID NO: 6589301 - DNA, 20 bp, Homo sapiens
tttaccaattcacccactcc

SEQ ID NO: 6589302 - DNA, 21 bp, Homo sapiens
tttaccacaaaagcaaaattt

SEQ ID NO: 6589303 - DNA, 14 bp, Homo sapiens
tttaccagaaatat

SEQ ID NO: 6589304 - DNA, 21 bp, Homo sapiens
tttaccagaagtttaaatctt

SEQ ID NO: 6589305 - DNA, 23 bp, Homo sapiens
tttaccataatcttatagcactt

SEQ ID NO: 6589306 - DNA, 19 bp, Homo sapiens
tttaccatcaaacaaatca

SEQ ID NO: 6589307 - DNA, 19 bp, Homo sapiens
tttaccattattttacagt

SEQ ID NO: 6589308 - DNA, 19 bp, Homo sapiens
tttaccatttgtaataaag

SEQ ID NO: 6589309 - DNA, 21 bp, Homo sapiens
tttacccaataagatacatca

SEQ ID NO: 6589310 - DNA, 17 bp, Homo sapiens
tttacccagtgggacag

SEQ ID NO: 6589311 - DNA, 17 bp, Homo sapiens
tttacccatatcccctc

SEQ ID NO: 6589312 - DNA, 22 bp, Homo sapiens
tttaccctaatgtcttcataaa

SEQ ID NO: 6589313 - DNA, 16 bp, Homo sapiens
tttaccctatatctat

SEQ ID NO: 6589314 - DNA, 14 bp, Homo sapiens
tttaccctccacac

SEQ ID NO: 6589315 - DNA, 15 bp, Homo sapiens
tttaccctcctctat

SEQ ID NO: 6589316 - DNA, 17 bp, Homo sapiens
tttaccctggcccctct

SEQ ID NO: 6589317 - DNA, 19 bp, Homo sapiens
tttaccctggcccctctcc

SEQ ID NO: 6589318 - DNA, 13 bp, Homo sapiens
tttaccctgtgtc

SEQ ID NO: 6589319 - DNA, 20 bp, Homo sapiens
tttacccttcttttctgact

SEQ ID NO: 6589320 - DNA, 15 bp, Homo sapiens
tttaccctttataga

SEQ ID NO: 6589321 - DNA, 17 bp, Homo sapiens
tttacccttttccccct

SEQ ID NO: 6589322 - DNA, 22 bp, Homo sapiens
tttacccttttcccccttccca

SEQ ID NO: 6589323 - DNA, 21 bp, Homo sapiens
tttaccgcccacccagcagcg

SEQ ID NO: 6589324 - DNA, 23 bp, Homo sapiens
tttacctaagtgttgattgtgcc

SEQ ID NO: 6589325 - DNA, 18 bp, Homo sapiens
tttacctaccacagtgtc

SEQ ID NO: 6589326 - DNA, 19 bp, Homo sapiens
tttacctaccaccttccct

SEQ ID NO: 6589327 - DNA, 23 bp, Homo sapiens
tttacctattctgaaaaagacat

SEQ ID NO: 6589328 - DNA, 18 bp, Homo sapiens
tttacctcactggtgcat

SEQ ID NO: 6589329 - DNA, 20 bp, Homo sapiens
tttacctcactggtgcattt

SEQ ID NO: 6589330 - DNA, 15 bp, Homo sapiens
tttacctcagcctgg

SEQ ID NO: 6589331 - DNA, 18 bp, Homo sapiens
tttacctccccttttcta

SEQ ID NO: 6589332 - DNA, 20 bp, Homo sapiens
tttacctctcattagaaagg

SEQ ID NO: 6589333 - DNA, 13 bp, Homo sapiens
tttacctgagacc

SEQ ID NO: 6589334 - DNA, 16 bp, Homo sapiens
tttacctgcaaaaaat

SEQ ID NO: 6589335 - DNA, 14 bp, Homo sapiens
tttacctgctgctt

SEQ ID NO: 6589336 - DNA, 17 bp, Homo sapiens
tttacctggaaaccaga

SEQ ID NO: 6589337 - DNA, 19 bp, Homo sapiens
tttacctggcctagaaagg

SEQ ID NO: 6589338 - DNA, 21 bp, Homo sapiens
tttacctggcttatttaatat

SEQ ID NO: 6589339 - DNA, 15 bp, Homo sapiens
tttacctgtcacatt

SEQ ID NO: 6589340 - DNA, 20 bp, Homo sapiens
tttacctgtcacattgcatt

SEQ ID NO: 6589341 - DNA, 21 bp, Homo sapiens
tttacctgtcacattgcattc

SEQ ID NO: 6589342 - DNA, 16 bp, Homo sapiens
tttaccttcagcagtt

SEQ ID NO: 6589343 - DNA, 20 bp, Homo sapiens
tttaccttcatttcatcctg

SEQ ID NO: 6589344 - DNA, 19 bp, Homo sapiens
tttaccttctaaaagccat

SEQ ID NO: 6589345 - DNA, 19 bp, Homo sapiens
tttaccttgaacaatcaag

SEQ ID NO: 6589346 - DNA, 16 bp, Homo sapiens
tttaccttgttttctc

SEQ ID NO: 6589347 - DNA, 17 bp, Homo sapiens
tttacctttcagtgcag

SEQ ID NO: 6589348 - DNA, 17 bp, Homo sapiens
tttaccttttaagacat

SEQ ID NO: 6589349 - DNA, 14 bp, Homo sapiens
tttaccttttttat

SEQ ID NO: 6589350 - DNA, 23 bp, Homo sapiens
tttacctttttttagttatatat

SEQ ID NO: 6589351 - DNA, 15 bp, Homo sapiens
tttacgctagattaa

SEQ ID NO: 6589352 - DNA, 18 bp, Homo sapiens
tttacgctagattaaaat

SEQ ID NO: 6589353 - DNA, 13 bp, Homo sapiens
tttacgctgtctg

SEQ ID NO: 6589354 - DNA, 13 bp, Homo sapiens
tttacggacaccc

SEQ ID NO: 6589355 - DNA, 17 bp, Homo sapiens
tttacggacaccccctc

SEQ ID NO: 6589356 - DNA, 16 bp, Homo sapiens
tttacgtactgtaact

SEQ ID NO: 6589357 - DNA, 20 bp, Homo sapiens
tttacgtagctatttttata

SEQ ID NO: 6589358 - DNA, 22 bp, Homo sapiens
tttacgtagctatttttataca

SEQ ID NO: 6589359 - DNA, 19 bp, Homo sapiens
tttacgtagtcatcaacaa

SEQ ID NO: 6589360 - DNA, 13 bp, Homo sapiens
tttacgtagtgta

SEQ ID NO: 6589361 - DNA, 20 bp, Homo sapiens
tttacgtgcaaacaacctga

SEQ ID NO: 6589362 - DNA, 17 bp, Homo sapiens
tttactaaagaaagatt

SEQ ID NO: 6589363 - DNA, 20 bp, Homo sapiens
tttactaaagagacatattt

SEQ ID NO: 6589364 - DNA, 13 bp, Homo sapiens
tttactaaagcag

SEQ ID NO: 6589365 - DNA, 14 bp, Homo sapiens
tttactaaagcagt

SEQ ID NO: 6589366 - DNA, 15 bp, Homo sapiens
tttactaaagcagtg

SEQ ID NO: 6589367 - DNA, 13 bp, Homo sapiens
tttactaacagta

SEQ ID NO: 6589368 - DNA, 21 bp, Homo sapiens
tttactaagatgacattgcta

SEQ ID NO: 6589369 - DNA, 16 bp, Homo sapiens
tttactaatatatatt

SEQ ID NO: 6589370 - DNA, 17 bp, Homo sapiens
tttactaatatatattt

SEQ ID NO: 6589371 - DNA, 19 bp, Homo sapiens
tttactacaatatgtacat

SEQ ID NO: 6589372 - DNA, 14 bp, Homo sapiens
tttactacagctat

SEQ ID NO: 6589373 - DNA, 21 bp, Homo sapiens
tttactacataattaaatttt

SEQ ID NO: 6589374 - DNA, 14 bp, Homo sapiens
tttactactgcaag

SEQ ID NO: 6589375 - DNA, 11 bp, Homo sapiens
tttactactgt

SEQ ID NO: 6589376 - DNA, 16 bp, Homo sapiens
tttactagaaatggga

SEQ ID NO: 6589377 - DNA, 21 bp, Homo sapiens
tttactagaaatgggaatcat

SEQ ID NO: 6589378 - DNA, 16 bp, Homo sapiens
tttactagctgtgcaa

SEQ ID NO: 6589379 - DNA, 20 bp, Homo sapiens
tttactataagactataaat

SEQ ID NO: 6589380 - DNA, 17 bp, Homo sapiens
tttactatcattctcag

SEQ ID NO: 6589381 - DNA, 13 bp, Homo sapiens
tttactatctttt

SEQ ID NO: 6589382 - DNA, 12 bp, Homo sapiens
tttactatgtaa

SEQ ID NO: 6589383 - DNA, 14 bp, Homo sapiens
tttactattgctat

SEQ ID NO: 6589384 - DNA, 14 bp, Homo sapiens
tttactatttgcca

SEQ ID NO: 6589385 - DNA, 21 bp, Homo sapiens
tttactcaaaatctgtcataa

SEQ ID NO: 6589386 - DNA, 19 bp, Homo sapiens
tttactcacagcacttgtt

SEQ ID NO: 6589387 - DNA, 22 bp, Homo sapiens
tttactcacagcacttgttttc

SEQ ID NO: 6589388 - DNA, 13 bp, Homo sapiens
tttactcacattg

SEQ ID NO: 6589389 - DNA, 19 bp, Homo sapiens
tttactcaccatatttgaa

SEQ ID NO: 6589390 - DNA, 13 bp, Homo sapiens
tttactcattgaa

SEQ ID NO: 6589391 - DNA, 19 bp, Homo sapiens
tttactcattgaaatgtca

SEQ ID NO: 6589392 - DNA, 22 bp, Homo sapiens
tttactcattgaaatgtcacgt

SEQ ID NO: 6589393 - DNA, 18 bp, Homo sapiens
tttactccccttgagctg

SEQ ID NO: 6589394 - DNA, 16 bp, Homo sapiens
tttactcctcacactt

SEQ ID NO: 6589395 - DNA, 17 bp, Homo sapiens
tttactcctcacactta

SEQ ID NO: 6589396 - DNA, 20 bp, Homo sapiens
tttactcctttttattcata

SEQ ID NO: 6589397 - DNA, 22 bp, Homo sapiens
tttactctatgccccaaatata

SEQ ID NO: 6589398 - DNA, 18 bp, Homo sapiens
tttactctgacttcccca

SEQ ID NO: 6589399 - DNA, 12 bp, Homo sapiens
tttactctgcct

SEQ ID NO: 6589400 - DNA, 17 bp, Homo sapiens
tttactctggtaggaat

SEQ ID NO: 6589401 - DNA, 15 bp, Homo sapiens
tttactctgtgttta

SEQ ID NO: 6589402 - DNA, 14 bp, Homo sapiens
tttactctttctaa

SEQ ID NO: 6589403 - DNA, 13 bp, Homo sapiens
tttactgaacaat

SEQ ID NO: 6589404 - DNA, 14 bp, Homo sapiens
tttactgaagcctt

SEQ ID NO: 6589405 - DNA, 18 bp, Homo sapiens
tttactgaatgatctatt

SEQ ID NO: 6589406 - DNA, 16 bp, Homo sapiens
tttactgacacttcct

SEQ ID NO: 6589407 - DNA, 19 bp, Homo sapiens
tttactgactgcttataaa

SEQ ID NO: 6589408 - DNA, 16 bp, Homo sapiens
aatcttcactttctta

SEQ ID NO: 6589409 - DNA, 12 bp, Homo sapiens
aatcttcagctg

SEQ ID NO: 6589410 - DNA, 14 bp, Homo sapiens
aatcttcagctggt

SEQ ID NO: 6589411 - DNA, 18 bp, Homo sapiens
aatcttcagtattttctc

SEQ ID NO: 6589412 - DNA, 12 bp, Homo sapiens
aatcttccaaag

SEQ ID NO: 6589413 - DNA, 16 bp, Homo sapiens
aatcttccatctgcat

SEQ ID NO: 6589414 - DNA, 17 bp, Homo sapiens
aatcttcccatgcattc

SEQ ID NO: 6589415 - DNA, 14 bp, Homo sapiens
aatcttcctctgga

SEQ ID NO: 6589416 - DNA, 14 bp, Homo sapiens
aatcttcctgttta

SEQ ID NO: 6589417 - DNA, 15 bp, Homo sapiens
aatcttcggccaatt

SEQ ID NO: 6589418 - DNA, 19 bp, Homo sapiens
aatcttcggggtgtgatga

SEQ ID NO: 6589419 - DNA, 18 bp, Homo sapiens
aatcttctacttttaact

SEQ ID NO: 6589420 - DNA, 16 bp, Homo sapiens
aatcttctccagattt

SEQ ID NO: 6589421 - DNA, 20 bp, Homo sapiens
aatcttctcccttgtcctgc

SEQ ID NO: 6589422 - DNA, 21 bp, Homo sapiens
aatcttctgctaaatttttgt

SEQ ID NO: 6589423 - DNA, 18 bp, Homo sapiens
aatcttgaaggaacacaa

SEQ ID NO: 6589424 - DNA, 22 bp, Homo sapiens
aatcttgaaggaacacaaagat

SEQ ID NO: 6589425 - DNA, 23 bp, Homo sapiens
aatcttgacacggtgaaatccag

SEQ ID NO: 6589426 - DNA, 19 bp, Homo sapiens
aatcttgaccaacagaaac

SEQ ID NO: 6589427 - DNA, 22 bp, Homo sapiens
aatcttgactacagtcaggaaa

SEQ ID NO: 6589428 - DNA, 21 bp, Homo sapiens
aatcttgagagtgttcctgag

SEQ ID NO: 6589429 - DNA, 19 bp, Homo sapiens
aatcttgatagctaaataa

SEQ ID NO: 6589430 - DNA, 19 bp, Homo sapiens
aatcttgcatggcattaat

SEQ ID NO: 6589431 - DNA, 14 bp, Homo sapiens
aatcttgcccactg

SEQ ID NO: 6589432 - DNA, 23 bp, Homo sapiens
aatcttgctgcaggccctccctc

SEQ ID NO: 6589433 - DNA, 15 bp, Homo sapiens
aatcttgctgtcaag

SEQ ID NO: 6589434 - DNA, 15 bp, Homo sapiens
aatcttgctgtgaaa

SEQ ID NO: 6589435 - DNA, 23 bp, Homo sapiens
aatcttgctgtgaaacagtgtgg

SEQ ID NO: 6589436 - DNA, 16 bp, Homo sapiens
aatcttgcttcattgt

SEQ ID NO: 6589437 - DNA, 18 bp, Homo sapiens
aatcttgcttcattgtta

SEQ ID NO: 6589438 - DNA, 13 bp, Homo sapiens
aatcttgctttct

SEQ ID NO: 6589439 - DNA, 16 bp, Homo sapiens
aatcttgctttcttta

SEQ ID NO: 6589440 - DNA, 21 bp, Homo sapiens
aatcttgctttctttagaatt

SEQ ID NO: 6589441 - DNA, 22 bp, Homo sapiens
aatcttgctttgtgtatctcat

SEQ ID NO: 6589442 - DNA, 19 bp, Homo sapiens
aatcttggcttcttaaaaa

SEQ ID NO: 6589443 - DNA, 20 bp, Homo sapiens
aatcttggcttcttaaaaac

SEQ ID NO: 6589444 - DNA, 22 bp, Homo sapiens
aatcttggcttcttaaaaactg

SEQ ID NO: 6589445 - DNA, 17 bp, Homo sapiens
aatcttggggctgatga

SEQ ID NO: 6589446 - DNA, 19 bp, Homo sapiens
aatcttggggggtttttac

SEQ ID NO: 6589447 - DNA, 13 bp, Homo sapiens
aatcttggtgtaa

SEQ ID NO: 6589448 - DNA, 15 bp, Homo sapiens
aatcttggtgtaact

SEQ ID NO: 6589449 - DNA, 16 bp, Homo sapiens
aatcttgtcatgtgta

SEQ ID NO: 6589450 - DNA, 18 bp, Homo sapiens
aatcttgtcatgtgtata

SEQ ID NO: 6589451 - DNA, 13 bp, Homo sapiens
aatcttgtccaca

SEQ ID NO: 6589452 - DNA, 17 bp, Homo sapiens
aatcttgtctcaatgct

SEQ ID NO: 6589453 - DNA, 20 bp, Homo sapiens
aatcttgtctcaatgctcat

SEQ ID NO: 6589454 - DNA, 21 bp, Homo sapiens
aatcttgtctcaatgctcata

SEQ ID NO: 6589455 - DNA, 14 bp, Homo sapiens
aatcttgtgaaaat

SEQ ID NO: 6589456 - DNA, 14 bp, Homo sapiens
aatcttgtgctaga

SEQ ID NO: 6589457 - DNA, 20 bp, Homo sapiens
aatcttgtgctagaatactt

SEQ ID NO: 6589458 - DNA, 15 bp, Homo sapiens
aatcttgttaaattg

SEQ ID NO: 6589459 - DNA, 21 bp, Homo sapiens
aatcttgttaatgtcattgct

SEQ ID NO: 6589460 - DNA, 22 bp, Homo sapiens
aatcttgttaatgtcattgcta

SEQ ID NO: 6589461 - DNA, 13 bp, Homo sapiens
aatcttgttactg

SEQ ID NO: 6589462 - DNA, 14 bp, Homo sapiens
aatcttgttactgc

SEQ ID NO: 6589463 - DNA, 21 bp, Homo sapiens
aatcttgtttacaaaatattc

SEQ ID NO: 6589464 - DNA, 15 bp, Homo sapiens
aatcttgtttatagc

SEQ ID NO: 6589465 - DNA, 16 bp, Homo sapiens
aatcttgtttatagca

SEQ ID NO: 6589466 - DNA, 13 bp, Homo sapiens
aatcttgtttgtt

SEQ ID NO: 6589467 - DNA, 13 bp, Homo sapiens
aatcttgttttaa

SEQ ID NO: 6589468 - DNA, 20 bp, Homo sapiens
aatcttgttttaagcaaatg

SEQ ID NO: 6589469 - DNA, 13 bp, Homo sapiens
aatcttgttttga

SEQ ID NO: 6589470 - DNA, 14 bp, Homo sapiens
aatcttgttttgaa

SEQ ID NO: 6589471 - DNA, 23 bp, Homo sapiens
aatcttgttttgaaaataaccta

SEQ ID NO: 6589472 - DNA, 23 bp, Homo sapiens
aatctttaaaccaattgctgcta

SEQ ID NO: 6589473 - DNA, 13 bp, Homo sapiens
aatctttaatata

SEQ ID NO: 6589474 - DNA, 14 bp, Homo sapiens
aatctttaatataa

SEQ ID NO: 6589475 - DNA, 17 bp, Homo sapiens
aatctttaatggttaat

SEQ ID NO: 6589476 - DNA, 15 bp, Homo sapiens
aatctttacctgtat

SEQ ID NO: 6589477 - DNA, 18 bp, Homo sapiens
aatctttacctgtataca

SEQ ID NO: 6589478 - DNA, 20 bp, Homo sapiens
aatctttacctgtatacagt

SEQ ID NO: 6589479 - DNA, 23 bp, Homo sapiens
aatctttacctgtatacagtgca

SEQ ID NO: 6589480 - DNA, 21 bp, Homo sapiens
aatctttagagaagtatacat

SEQ ID NO: 6589481 - DNA, 22 bp, Homo sapiens
aatctttagagaagtatacata

SEQ ID NO: 6589482 - DNA, 17 bp, Homo sapiens
aatctttagcctgggca

SEQ ID NO: 6589483 - DNA, 15 bp, Homo sapiens
aatctttatgtattt

SEQ ID NO: 6589484 - DNA, 17 bp, Homo sapiens
aatctttattatgcatt

SEQ ID NO: 6589485 - DNA, 15 bp, Homo sapiens
aatctttattttatt

SEQ ID NO: 6589486 - DNA, 19 bp, Homo sapiens
aatctttattttattattc

SEQ ID NO: 6589487 - DNA, 12 bp, Homo sapiens
aatctttcaaaa

SEQ ID NO: 6589488 - DNA, 11 bp, Homo sapiens
aatctttcaac

SEQ ID NO: 6589489 - DNA, 13 bp, Homo sapiens
aatctttcaccaa

SEQ ID NO: 6589490 - DNA, 20 bp, Homo sapiens
aatctttcacttgaaagatt

SEQ ID NO: 6589491 - DNA, 14 bp, Homo sapiens
aatctttcagaata

SEQ ID NO: 6589492 - DNA, 16 bp, Homo sapiens
aatctttcagaataca

SEQ ID NO: 6589493 - DNA, 15 bp, Homo sapiens
aatctttcatacata

SEQ ID NO: 6589494 - DNA, 18 bp, Homo sapiens
aatctttcatccaaaata

SEQ ID NO: 6589495 - DNA, 13 bp, Homo sapiens
aatctttcatgtc

SEQ ID NO: 6589496 - DNA, 20 bp, Homo sapiens
aatctttcatgtcttgtcat

SEQ ID NO: 6589497 - DNA, 13 bp, Homo sapiens
aatctttccaaat

SEQ ID NO: 6589498 - DNA, 17 bp, Homo sapiens
aatctttccatatccat

SEQ ID NO: 6589499 - DNA, 18 bp, Homo sapiens
aatctttcctactttcta

SEQ ID NO: 6589500 - DNA, 13 bp, Homo sapiens
aatctttctcctg

SEQ ID NO: 6589501 - DNA, 20 bp, Homo sapiens
aatctttctgtaaacagaat

SEQ ID NO: 6589502 - DNA, 14 bp, Homo sapiens
aatctttcttacta

SEQ ID NO: 6589503 - DNA, 23 bp, Homo sapiens
aatctttcttctcgcctaggatt

SEQ ID NO: 6589504 - DNA, 15 bp, Homo sapiens
aatctttctttacct

SEQ ID NO: 6589505 - DNA, 19 bp, Homo sapiens
aatctttctttacctgaga

SEQ ID NO: 6589506 - DNA, 12 bp, Homo sapiens
aatctttctttc

SEQ ID NO: 6589507 - DNA, 13 bp, Homo sapiens
aatctttctttct

SEQ ID NO: 6589508 - DNA, 17 bp, Homo sapiens
aatctttctttcttaga

SEQ ID NO: 6589509 - DNA, 21 bp, Homo sapiens
aatctttgaaaggttagagaa

SEQ ID NO: 6589510 - DNA, 17 bp, Homo sapiens
aatctttgattcagaca

SEQ ID NO: 6589511 - DNA, 11 bp, Homo sapiens
aatctttgctg

SEQ ID NO: 6589512 - DNA, 12 bp, Homo sapiens
aatctttgctgt

SEQ ID NO: 6589513 - DNA, 13 bp, Homo sapiens
aatctttgttaaa

SEQ ID NO: 6589514 - DNA, 19 bp, Homo sapiens
aatctttgttgaagtttga

SEQ ID NO: 6589515 - DNA, 23 bp, Homo sapiens
aatctttgttgaagtttgaacca

SEQ ID NO: 6589516 - DNA, 22 bp, Homo sapiens
aatcttttaaaaatgatgataa

SEQ ID NO: 6589517 - DNA, 18 bp, Homo sapiens
aatcttttagtgtttact

SEQ ID NO: 6589518 - DNA, 18 bp, Homo sapiens
aatcttttataatgattc

SEQ ID NO: 6589519 - DNA, 21 bp, Homo sapiens
aatcttttataatgattcata

SEQ ID NO: 6589520 - DNA, 14 bp, Homo sapiens
aatcttttcacaaa

SEQ ID NO: 6589521 - DNA, 16 bp, Homo sapiens
aatcttttcacaaata

SEQ ID NO: 6589522 - DNA, 22 bp, Homo sapiens
aatcttttctgaatcttctgaa

SEQ ID NO: 6589523 - DNA, 13 bp, Homo sapiens
aatcttttctgag

SEQ ID NO: 6589524 - DNA, 13 bp, Homo sapiens
aatcttttcttat

SEQ ID NO: 6589525 - DNA, 14 bp, Homo sapiens
aatcttttcttatt

SEQ ID NO: 6589526 - DNA, 14 bp, Homo sapiens
aatcttttgtgaaa

SEQ ID NO: 6589527 - DNA, 19 bp, Homo sapiens
aatctttttgcttctactt

SEQ ID NO: 6589528 - DNA, 17 bp, Homo sapiens
aatctttttgtttttct

SEQ ID NO: 6589529 - DNA, 22 bp, Homo sapiens
aatcttttttctaaacctgtgc

SEQ ID NO: 6589530 - DNA, 18 bp, Homo sapiens
aatcttttttttatataa

SEQ ID NO: 6589531 - DNA, 22 bp, Homo sapiens
aatcttttttttatataaatat

SEQ ID NO: 6589532 - DNA, 19 bp, Homo sapiens
aatgaaaaaaaaaaacaat

SEQ ID NO: 6589533 - DNA, 22 bp, Homo sapiens
aatgaaaaaaaaaggggggtgg

SEQ ID NO: 6589534 - DNA, 14 bp, Homo sapiens
aatgaaaaaagctt

SEQ ID NO: 6589535 - DNA, 14 bp, Homo sapiens
aatgaaaaaatgta

SEQ ID NO: 6589536 - DNA, 16 bp, Homo sapiens
aatgaaaaacaaccaa

SEQ ID NO: 6589537 - DNA, 18 bp, Homo sapiens
aatgaaaaatataatgtt

SEQ ID NO: 6589538 - DNA, 23 bp, Homo sapiens
aatgaaaaatcaggcagaaatat

SEQ ID NO: 6589539 - DNA, 21 bp, Homo sapiens
aatgaaaaatctcaattgaaa

SEQ ID NO: 6589540 - DNA, 14 bp, Homo sapiens
aatgaaaaatctga

SEQ ID NO: 6589541 - DNA, 15 bp, Homo sapiens
aatgaaaaatctgaa

SEQ ID NO: 6589542 - DNA, 18 bp, Homo sapiens
aatgaaaaatctgaattt

SEQ ID NO: 6589543 - DNA, 16 bp, Homo sapiens
aatgaaaaatgaaaga

SEQ ID NO: 6589544 - DNA, 23 bp, Homo sapiens
aatgaaaaatgtaatttagaaac

SEQ ID NO: 6589545 - DNA, 14 bp, Homo sapiens
aatgaaaaattcca

SEQ ID NO: 6589546 - DNA, 12 bp, Homo sapiens
aatgaaaacaat

SEQ ID NO: 6589547 - DNA, 13 bp, Homo sapiens
aatgaaaacaata

SEQ ID NO: 6589548 - DNA, 17 bp, Homo sapiens
aatgaaaacaatgcagt

SEQ ID NO: 6589549 - DNA, 15 bp, Homo sapiens
aatgaaaacatgtac

SEQ ID NO: 6589550 - DNA, 18 bp, Homo sapiens
aatgaaaacattttattt

SEQ ID NO: 6589551 - DNA, 16 bp, Homo sapiens
aatgaaaacttttgta

SEQ ID NO: 6589552 - DNA, 17 bp, Homo sapiens
aatgaaaacttttgtaa

SEQ ID NO: 6589553 - DNA, 19 bp, Homo sapiens
aatgaaaacttttgtaaat

SEQ ID NO: 6589554 - DNA, 17 bp, Homo sapiens
aatgaaaagagaaactt

SEQ ID NO: 6589555 - DNA, 12 bp, Homo sapiens
aatgaaaagcaa

SEQ ID NO: 6589556 - DNA, 21 bp, Homo sapiens
aatgaaaataaaacacacctc

SEQ ID NO: 6589557 - DNA, 18 bp, Homo sapiens
aatgaaaatacatctttt

SEQ ID NO: 6589558 - DNA, 16 bp, Homo sapiens
aatgaaaatgcagtcc

SEQ ID NO: 6589559 - DNA, 17 bp, Homo sapiens
aatgaaaatgcagtcct

SEQ ID NO: 6589560 - DNA, 15 bp, Homo sapiens
aatgaaaatgtccat

SEQ ID NO: 6589561 - DNA, 15 bp, Homo sapiens
aatgaaaatgtcttg

SEQ ID NO: 6589562 - DNA, 16 bp, Homo sapiens
aatgaaaatgtcttgt

SEQ ID NO: 6589563 - DNA, 14 bp, Homo sapiens
aatgaaaattgtat

SEQ ID NO: 6589564 - DNA, 14 bp, Homo sapiens
aatgaaaattttaa

SEQ ID NO: 6589565 - DNA, 15 bp, Homo sapiens
aatgaaaattttaag

SEQ ID NO: 6589566 - DNA, 21 bp, Homo sapiens
aatgaaacaaaaaaaaaatga

SEQ ID NO: 6589567 - DNA, 13 bp, Homo sapiens
aatgaaacaaaga

SEQ ID NO: 6589568 - DNA, 17 bp, Homo sapiens
aatgaaacaaagaaaga

SEQ ID NO: 6589569 - DNA, 20 bp, Homo sapiens
aatgaaacaaagaaagagat

SEQ ID NO: 6589570 - DNA, 20 bp, Homo sapiens
aatgaaacaccttctctgga

SEQ ID NO: 6589571 - DNA, 13 bp, Homo sapiens
aatgaaacatggg

SEQ ID NO: 6589572 - DNA, 21 bp, Homo sapiens
aatgaaacatgggctgtgatt

SEQ ID NO: 6589573 - DNA, 12 bp, Homo sapiens
aatgaaaccaaa

SEQ ID NO: 6589574 - DNA, 14 bp, Homo sapiens
aatgaaaccaaagc

SEQ ID NO: 6589575 - DNA, 15 bp, Homo sapiens
aatgaaacttaagaa

SEQ ID NO: 6589576 - DNA, 16 bp, Homo sapiens
aatgaaacttaagaat

SEQ ID NO: 6589577 - DNA, 14 bp, Homo sapiens
aatgaaacttggat

SEQ ID NO: 6589578 - DNA, 16 bp, Homo sapiens
aatgaaagaaaattga

SEQ ID NO: 6589579 - DNA, 16 bp, Homo sapiens
aatgaaagactgtaca

SEQ ID NO: 6589580 - DNA, 12 bp, Homo sapiens
aatgaaagagaa

SEQ ID NO: 6589581 - DNA, 19 bp, Homo sapiens
aatgaaagagtaaaggaaa

SEQ ID NO: 6589582 - DNA, 16 bp, Homo sapiens
aatgaaagattaaaca

SEQ ID NO: 6589583 - DNA, 18 bp, Homo sapiens
aatgaaagctactcatag

SEQ ID NO: 6589584 - DNA, 16 bp, Homo sapiens
aatgaaagctgttcct

SEQ ID NO: 6589585 - DNA, 20 bp, Homo sapiens
aatgaaaggaagtataaagt

SEQ ID NO: 6589586 - DNA, 14 bp, Homo sapiens
aatgaaagggaaac

SEQ ID NO: 6589587 - DNA, 23 bp, Homo sapiens
aatgaaaggtactatatttgcta

SEQ ID NO: 6589588 - DNA, 15 bp, Homo sapiens
aatgaaagtggtaat

SEQ ID NO: 6589589 - DNA, 16 bp, Homo sapiens
tttactgagacttcga

SEQ ID NO: 6589590 - DNA, 12 bp, Homo sapiens
tttactgagaga

SEQ ID NO: 6589591 - DNA, 22 bp, Homo sapiens
tttactgagagaaggtgaaata

SEQ ID NO: 6589592 - DNA, 18 bp, Homo sapiens
tttactgagcttctctgt

SEQ ID NO: 6589593 - DNA, 19 bp, Homo sapiens
tttactgatgagagaatgt

SEQ ID NO: 6589594 - DNA, 21 bp, Homo sapiens
tttactgcactcagatttaag

SEQ ID NO: 6589595 - DNA, 14 bp, Homo sapiens
tttactgcattctt

SEQ ID NO: 6589596 - DNA, 17 bp, Homo sapiens
tttactgcattttcaca

SEQ ID NO: 6589597 - DNA, 22 bp, Homo sapiens
tttactgccaaagggaaatatc

SEQ ID NO: 6589598 - DNA, 11 bp, Homo sapiens
tttactgccac

SEQ ID NO: 6589599 - DNA, 13 bp, Homo sapiens
tttactgctgtca

SEQ ID NO: 6589600 - DNA, 22 bp, Homo sapiens
tttactgctgtcattgtccatg

SEQ ID NO: 6589601 - DNA, 13 bp, Homo sapiens
tttactgcttttc

SEQ ID NO: 6589602 - DNA, 16 bp, Homo sapiens
tttactgcttttcatt

SEQ ID NO: 6589603 - DNA, 22 bp, Homo sapiens
tttactggttgcatggaaatca

SEQ ID NO: 6589604 - DNA, 18 bp, Homo sapiens
tttactgtaactgtcagt

SEQ ID NO: 6589605 - DNA, 13 bp, Homo sapiens
tttactgtaatat

SEQ ID NO: 6589606 - DNA, 23 bp, Homo sapiens
tttactgtaatataaagtattca

SEQ ID NO: 6589607 - DNA, 18 bp, Homo sapiens
tttactgtcagattaaat

SEQ ID NO: 6589608 - DNA, 13 bp, Homo sapiens
tttactgtcccag

SEQ ID NO: 6589609 - DNA, 18 bp, Homo sapiens
tttactgtctatggattt

SEQ ID NO: 6589610 - DNA, 23 bp, Homo sapiens
tttactgtctattaatattcagg

SEQ ID NO: 6589611 - DNA, 14 bp, Homo sapiens
tttactgtctgtaa

SEQ ID NO: 6589612 - DNA, 16 bp, Homo sapiens
tttactgtcttaatta

SEQ ID NO: 6589613 - DNA, 17 bp, Homo sapiens
tttactgtgactttatt

SEQ ID NO: 6589614 - DNA, 16 bp, Homo sapiens
tttactgtgcatacat

SEQ ID NO: 6589615 - DNA, 12 bp, Homo sapiens
tttactgtgttt

SEQ ID NO: 6589616 - DNA, 18 bp, Homo sapiens
tttactgttatcctattt

SEQ ID NO: 6589617 - DNA, 20 bp, Homo sapiens
tttactgttgtacaatcatg

SEQ ID NO: 6589618 - DNA, 14 bp, Homo sapiens
tttactgtttctca

SEQ ID NO: 6589619 - DNA, 13 bp, Homo sapiens
tttactgtttgaa

SEQ ID NO: 6589620 - DNA, 11 bp, Homo sapiens
tttacttaaac

SEQ ID NO: 6589621 - DNA, 16 bp, Homo sapiens
tttacttaagtgttca

SEQ ID NO: 6589622 - DNA, 17 bp, Homo sapiens
tttacttaagtgttcat

SEQ ID NO: 6589623 - DNA, 13 bp, Homo sapiens
tttacttaattca

SEQ ID NO: 6589624 - DNA, 12 bp, Homo sapiens
tttacttacaaa

SEQ ID NO: 6589625 - DNA, 23 bp, Homo sapiens
tttacttcaatgggctcttccaa

SEQ ID NO: 6589626 - DNA, 13 bp, Homo sapiens
tttacttcacttt

SEQ ID NO: 6589627 - DNA, 13 bp, Homo sapiens
tttacttcatgag

SEQ ID NO: 6589628 - DNA, 20 bp, Homo sapiens
tttacttctaagtcattcat

SEQ ID NO: 6589629 - DNA, 16 bp, Homo sapiens
tttacttctaatctta

SEQ ID NO: 6589630 - DNA, 14 bp, Homo sapiens
tttacttcttatac

SEQ ID NO: 6589631 - DNA, 15 bp, Homo sapiens
tttacttcttataca

SEQ ID NO: 6589632 - DNA, 18 bp, Homo sapiens
tttacttgaatagtattg

SEQ ID NO: 6589633 - DNA, 12 bp, Homo sapiens
tttacttgaatc

SEQ ID NO: 6589634 - DNA, 17 bp, Homo sapiens
tttacttgattaaggac

SEQ ID NO: 6589635 - DNA, 18 bp, Homo sapiens
tttacttgattaaggact

SEQ ID NO: 6589636 - DNA, 18 bp, Homo sapiens
tttacttgcattgaatat

SEQ ID NO: 6589637 - DNA, 14 bp, Homo sapiens
tttacttggaaata

SEQ ID NO: 6589638 - DNA, 16 bp, Homo sapiens
tttacttgtctttgat

SEQ ID NO: 6589639 - DNA, 20 bp, Homo sapiens
tttacttgtggtgtgaccat

SEQ ID NO: 6589640 - DNA, 22 bp, Homo sapiens
tttactttaaagtagtgatgaa

SEQ ID NO: 6589641 - DNA, 14 bp, Homo sapiens
tttactttaaatcc

SEQ ID NO: 6589642 - DNA, 15 bp, Homo sapiens
tttactttaaatcct

SEQ ID NO: 6589643 - DNA, 20 bp, Homo sapiens
tttactttagaagcacagta

SEQ ID NO: 6589644 - DNA, 21 bp, Homo sapiens
tttactttatccaatcctcag

SEQ ID NO: 6589645 - DNA, 12 bp, Homo sapiens
tttactttcaaa

SEQ ID NO: 6589646 - DNA, 20 bp, Homo sapiens
tttactttcccttgcttttc

SEQ ID NO: 6589647 - DNA, 21 bp, Homo sapiens
tttactttctcccagtatgtt

SEQ ID NO: 6589648 - DNA, 12 bp, Homo sapiens
tttactttctct

SEQ ID NO: 6589649 - DNA, 21 bp, Homo sapiens
tttactttctctctcctcttt

SEQ ID NO: 6589650 - DNA, 15 bp, Homo sapiens
tttactttgtacttg

SEQ ID NO: 6589651 - DNA, 15 bp, Homo sapiens
tttacttttaaactg

SEQ ID NO: 6589652 - DNA, 20 bp, Homo sapiens
tttactttttccatttggca

SEQ ID NO: 6589653 - DNA, 18 bp, Homo sapiens
tttacttttttaacatgt

SEQ ID NO: 6589654 - DNA, 23 bp, Homo sapiens
tttactttttttctgtgacattt

SEQ ID NO: 6589655 - DNA, 21 bp, Homo sapiens
tttactttttttttattttat

SEQ ID NO: 6589656 - DNA, 21 bp, Homo sapiens
tttagaaaaacatttaaactt

SEQ ID NO: 6589657 - DNA, 20 bp, Homo sapiens
tttagaaaacccaagttttt

SEQ ID NO: 6589658 - DNA, 13 bp, Homo sapiens
tttagaaaacttt

SEQ ID NO: 6589659 - DNA, 13 bp, Homo sapiens
tttagaaaatata

SEQ ID NO: 6589660 - DNA, 18 bp, Homo sapiens
tttagaaaatgtttggaa

SEQ ID NO: 6589661 - DNA, 16 bp, Homo sapiens
tttagaaaattttatg

SEQ ID NO: 6589662 - DNA, 12 bp, Homo sapiens
tttagaaacaca

SEQ ID NO: 6589663 - DNA, 20 bp, Homo sapiens
tttagaaacacaactatatt

SEQ ID NO: 6589664 - DNA, 13 bp, Homo sapiens
tttagaaactgaa

SEQ ID NO: 6589665 - DNA, 14 bp, Homo sapiens
tttagaaactgaaa

SEQ ID NO: 6589666 - DNA, 15 bp, Homo sapiens
tttagaaactgaaaa

SEQ ID NO: 6589667 - DNA, 16 bp, Homo sapiens
tttagaaactgaaaaa

SEQ ID NO: 6589668 - DNA, 20 bp, Homo sapiens
tttagaaactgaaaaatatc

SEQ ID NO: 6589669 - DNA, 20 bp, Homo sapiens
tttagaaactgatttcttca

SEQ ID NO: 6589670 - DNA, 20 bp, Homo sapiens
tttagaaacttatcttacaa

SEQ ID NO: 6589671 - DNA, 22 bp, Homo sapiens
tttagaaacttatcttacaaag

SEQ ID NO: 6589672 - DNA, 22 bp, Homo sapiens
tttagaaagaaaattatattct

SEQ ID NO: 6589673 - DNA, 15 bp, Homo sapiens
tttagaaagaatatt

SEQ ID NO: 6589674 - DNA, 14 bp, Homo sapiens
tttagaaagcattt

SEQ ID NO: 6589675 - DNA, 16 bp, Homo sapiens
tttagaaagcatttga

SEQ ID NO: 6589676 - DNA, 22 bp, Homo sapiens
tttagaaagcatttgaatgcat

SEQ ID NO: 6589677 - DNA, 17 bp, Homo sapiens
tttagaaagctaaatga

SEQ ID NO: 6589678 - DNA, 16 bp, Homo sapiens
tttagaaataaaagat

SEQ ID NO: 6589679 - DNA, 17 bp, Homo sapiens
tttagaaataaaagatg

SEQ ID NO: 6589680 - DNA, 20 bp, Homo sapiens
tttagaaataaaccttaata

SEQ ID NO: 6589681 - DNA, 19 bp, Homo sapiens
tttagaaatactgcaagaa

SEQ ID NO: 6589682 - DNA, 11 bp, Homo sapiens
tttagaaatta

SEQ ID NO: 6589683 - DNA, 14 bp, Homo sapiens
tttagaaattacaa

SEQ ID NO: 6589684 - DNA, 17 bp, Homo sapiens
tttagaacagaaaacaa

SEQ ID NO: 6589685 - DNA, 22 bp, Homo sapiens
tttagaacagaaaacaacaaaa

SEQ ID NO: 6589686 - DNA, 13 bp, Homo sapiens
tttagaacagagg

SEQ ID NO: 6589687 - DNA, 17 bp, Homo sapiens
tttagaacaggagactt

SEQ ID NO: 6589688 - DNA, 15 bp, Homo sapiens
tttagaacaggtttt

SEQ ID NO: 6589689 - DNA, 13 bp, Homo sapiens
tttagaaccagcc

SEQ ID NO: 6589690 - DNA, 23 bp, Homo sapiens
tttagaacccagcagttacctta

SEQ ID NO: 6589691 - DNA, 17 bp, Homo sapiens
tttagaaccccaggtga

SEQ ID NO: 6589692 - DNA, 20 bp, Homo sapiens
tttagaacctacaaaagctt

SEQ ID NO: 6589693 - DNA, 14 bp, Homo sapiens
tttagaactactga

SEQ ID NO: 6589694 - DNA, 22 bp, Homo sapiens
tttagaactctagagagcctta

SEQ ID NO: 6589695 - DNA, 12 bp, Homo sapiens
tttagaagaaaa

SEQ ID NO: 6589696 - DNA, 17 bp, Homo sapiens
tttagaagaagtgtgtc

SEQ ID NO: 6589697 - DNA, 19 bp, Homo sapiens
tttagaagaagtgtgtcac

SEQ ID NO: 6589698 - DNA, 14 bp, Homo sapiens
tttagaagactcta

SEQ ID NO: 6589699 - DNA, 15 bp, Homo sapiens
tttagaagactctac

SEQ ID NO: 6589700 - DNA, 18 bp, Homo sapiens
tttagaagattctatgtt

SEQ ID NO: 6589701 - DNA, 23 bp, Homo sapiens
tttagaagcaaagatttcagtag

SEQ ID NO: 6589702 - DNA, 18 bp, Homo sapiens
tttagaagcagagggaca

SEQ ID NO: 6589703 - DNA, 14 bp, Homo sapiens
tttagaagcctgca

SEQ ID NO: 6589704 - DNA, 20 bp, Homo sapiens
tttagaataagaatttgcat

SEQ ID NO: 6589705 - DNA, 23 bp, Homo sapiens
tttagaataaggaggaggaggga

SEQ ID NO: 6589706 - DNA, 11 bp, Homo sapiens
tttagaataat

SEQ ID NO: 6589707 - DNA, 19 bp, Homo sapiens
tttagaatattaaaaatta

SEQ ID NO: 6589708 - DNA, 17 bp, Homo sapiens
tttagaatcagaataaa

SEQ ID NO: 6589709 - DNA, 13 bp, Homo sapiens
tttagaattaaaa

SEQ ID NO: 6589710 - DNA, 12 bp, Homo sapiens
tttagaattaca

SEQ ID NO: 6589711 - DNA, 21 bp, Homo sapiens
tttagaattacaccacaagta

SEQ ID NO: 6589712 - DNA, 22 bp, Homo sapiens
tttagaattacaccacaagtat

SEQ ID NO: 6589713 - DNA, 19 bp, Homo sapiens
tttagaattctaattgtca

SEQ ID NO: 6589714 - DNA, 19 bp, Homo sapiens
tttagaatttgaaaggaaa

SEQ ID NO: 6589715 - DNA, 24 bp, Homo sapiens
tttagacaaagccttaagcaaatt

SEQ ID NO: 6589716 - DNA, 20 bp, Homo sapiens
tttagacaaatactcatgtg

SEQ ID NO: 6589717 - DNA, 23 bp, Homo sapiens
tttagacaaccatagaactgtcc

SEQ ID NO: 6589718 - DNA, 18 bp, Homo sapiens
tttagacaacctgaaatt

SEQ ID NO: 6589719 - DNA, 19 bp, Homo sapiens
tttagacaactagatttgt

SEQ ID NO: 6589720 - DNA, 16 bp, Homo sapiens
tttagacaccttcatt

SEQ ID NO: 6589721 - DNA, 20 bp, Homo sapiens
tttagacagtctcactttgt

SEQ ID NO: 6589722 - DNA, 21 bp, Homo sapiens
tttagacatgtaatttgtgta

SEQ ID NO: 6589723 - DNA, 18 bp, Homo sapiens
tttagaccaaggaacaaa

SEQ ID NO: 6589724 - DNA, 23 bp, Homo sapiens
tttagactaagggcaggaagact

SEQ ID NO: 6589725 - DNA, 20 bp, Homo sapiens
tttagactaattgtgtttgt

SEQ ID NO: 6589726 - DNA, 23 bp, Homo sapiens
tttagactgtggccatatatgct

SEQ ID NO: 6589727 - DNA, 15 bp, Homo sapiens
tttagacttcaagca

SEQ ID NO: 6589728 - DNA, 12 bp, Homo sapiens
tttagacttgaa

SEQ ID NO: 6589729 - DNA, 22 bp, Homo sapiens
tttagacttggattctttccat

SEQ ID NO: 6589730 - DNA, 13 bp, Homo sapiens
tttagagaaatac

SEQ ID NO: 6589731 - DNA, 14 bp, Homo sapiens
tttagagaactgaa

SEQ ID NO: 6589732 - DNA, 15 bp, Homo sapiens
tttagagaactgaaa

SEQ ID NO: 6589733 - DNA, 22 bp, Homo sapiens
tttagagagcctgtcaccagag

SEQ ID NO: 6589734 - DNA, 16 bp, Homo sapiens
tttagagataaatatt

SEQ ID NO: 6589735 - DNA, 21 bp, Homo sapiens
tttagagataagagttggctg

SEQ ID NO: 6589736 - DNA, 21 bp, Homo sapiens
tttagagatgctaaaattctt

SEQ ID NO: 6589737 - DNA, 18 bp, Homo sapiens
tttagagattaatttgtg

SEQ ID NO: 6589738 - DNA, 18 bp, Homo sapiens
tttagagcattaaaataa

SEQ ID NO: 6589739 - DNA, 16 bp, Homo sapiens
tttagagcattgccat

SEQ ID NO: 6589740 - DNA, 21 bp, Homo sapiens
tttagaggggcaaaaatattt

SEQ ID NO: 6589741 - DNA, 13 bp, Homo sapiens
tttagagtaaact

SEQ ID NO: 6589742 - DNA, 19 bp, Homo sapiens
tttagagtaagaaatttca

SEQ ID NO: 6589743 - DNA, 23 bp, Homo sapiens
tttagagtgtaggtgaaatgaat

SEQ ID NO: 6589744 - DNA, 18 bp, Homo sapiens
tttagagttagactgttg

SEQ ID NO: 6589745 - DNA, 18 bp, Homo sapiens
tttagataatttgaaaaa

SEQ ID NO: 6589746 - DNA, 19 bp, Homo sapiens
tttagatagcagcctggct

SEQ ID NO: 6589747 - DNA, 22 bp, Homo sapiens
tttagatagccctgtcctggtg

SEQ ID NO: 6589748 - DNA, 23 bp, Homo sapiens
tttagatatttgcctgtctgttt

SEQ ID NO: 6589749 - DNA, 16 bp, Homo sapiens
tttagatcaaatactt

SEQ ID NO: 6589750 - DNA, 17 bp, Homo sapiens
tttagatcaaatacttt

SEQ ID NO: 6589751 - DNA, 17 bp, Homo sapiens
tttagatgaggaaatga

SEQ ID NO: 6589752 - DNA, 19 bp, Homo sapiens
tttagatgggaagcctgtg

SEQ ID NO: 6589753 - DNA, 20 bp, Homo sapiens
tttagatggtggcacattcc

SEQ ID NO: 6589754 - DNA, 17 bp, Homo sapiens
tttagatggttacactg

SEQ ID NO: 6589755 - DNA, 20 bp, Homo sapiens
tttagatgtgcaacctgtgg

SEQ ID NO: 6589756 - DNA, 17 bp, Homo sapiens
tttagattaagcttttc

SEQ ID NO: 6589757 - DNA, 15 bp, Homo sapiens
tttagattattttat

SEQ ID NO: 6589758 - DNA, 20 bp, Homo sapiens
tttagattattttatctggt

SEQ ID NO: 6589759 - DNA, 14 bp, Homo sapiens
tttagattccagga

SEQ ID NO: 6589760 - DNA, 20 bp, Homo sapiens
tttagattcctacttaaaca

SEQ ID NO: 6589761 - DNA, 21 bp, Homo sapiens
tttagattcctacttaaacaa

SEQ ID NO: 6589762 - DNA, 12 bp, Homo sapiens
tttagatttcaa

SEQ ID NO: 6589763 - DNA, 20 bp, Homo sapiens
tttagatttcaagaaaaaat

SEQ ID NO: 6589764 - DNA, 13 bp, Homo sapiens
tttagattttatg

SEQ ID NO: 6589765 - DNA, 19 bp, Homo sapiens
tttagattttctggttcta

SEQ ID NO: 6589766 - DNA, 17 bp, Homo sapiens
tttagatttttaaattg

SEQ ID NO: 6589767 - DNA, 15 bp, Homo sapiens
tttagcaataaataa

SEQ ID NO: 6589768 - DNA, 18 bp, Homo sapiens
tttagcaatgctgtgaat

SEQ ID NO: 6589769 - DNA, 18 bp, Homo sapiens
tttagcacatcactgaga

SEQ ID NO: 6589770 - DNA, 19 bp, Homo sapiens
tttagcacgtttaaagttc

SEQ ID NO: 6589771 - DNA, 21 bp, Homo sapiens
tttagcactatttaaaataag

SEQ ID NO: 6589772 - DNA, 11 bp, Homo sapiens
tttagcagcac

SEQ ID NO: 6589773 - DNA, 13 bp, Homo sapiens
tttagcagcactt

SEQ ID NO: 6589774 - DNA, 22 bp, Homo sapiens
tttagcagttaaaagtgtattt

SEQ ID NO: 6589775 - DNA, 21 bp, Homo sapiens
tttagcagttctgcaaataga

SEQ ID NO: 6589776 - DNA, 22 bp, Homo sapiens
tttagcagtttcctcagtgatg

SEQ ID NO: 6589777 - DNA, 17 bp, Homo sapiens
tttagcattaaaaataa

SEQ ID NO: 6589778 - DNA, 20 bp, Homo sapiens
tttagcattgtagtgctttg

SEQ ID NO: 6589779 - DNA, 19 bp, Homo sapiens
tttagccagcgtttattgt

SEQ ID NO: 6589780 - DNA, 13 bp, Homo sapiens
tttagccagtgac

SEQ ID NO: 6589781 - DNA, 10 bp, Homo sapiens
tttagccata

SEQ ID NO: 6589782 - DNA, 17 bp, Homo sapiens
tttagcccagtgttttc

SEQ ID NO: 6589783 - DNA, 12 bp, Homo sapiens
tttagcctggct

SEQ ID NO: 6589784 - DNA, 21 bp, Homo sapiens
tttagcctggtacctagcaca

SEQ ID NO: 6589785 - DNA, 16 bp, Homo sapiens
tttagccttaaatttt

SEQ ID NO: 6589786 - DNA, 19 bp, Homo sapiens
tttagctaccaacggccag

SEQ ID NO: 6589787 - DNA, 17 bp, Homo sapiens
tttagctagaatccaca

SEQ ID NO: 6589788 - DNA, 19 bp, Homo sapiens
tttagctagtatcttcaaa

SEQ ID NO: 6589789 - DNA, 13 bp, Homo sapiens
tttagctatttaa

SEQ ID NO: 6589790 - DNA, 14 bp, Homo sapiens
tttagctatttaat

SEQ ID NO: 6589791 - DNA, 16 bp, Homo sapiens
tttagctatttattgt

SEQ ID NO: 6589792 - DNA, 21 bp, Homo sapiens
tttagctctgaagcaagagtg

SEQ ID NO: 6589793 - DNA, 14 bp, Homo sapiens
tttagctctgagaa

SEQ ID NO: 6589794 - DNA, 16 bp, Homo sapiens
tttagctctgttcttt

SEQ ID NO: 6589795 - DNA, 17 bp, Homo sapiens
tttagctctgttcttta

SEQ ID NO: 6589796 - DNA, 13 bp, Homo sapiens
tttagctggccac

SEQ ID NO: 6589797 - DNA, 13 bp, Homo sapiens
tttagctggtgtc

SEQ ID NO: 6589798 - DNA, 13 bp, Homo sapiens
tttagctgtagat

SEQ ID NO: 6589799 - DNA, 12 bp, Homo sapiens
tttagcttacct

SEQ ID NO: 6589800 - DNA, 22 bp, Homo sapiens
tttagcttacctgggcacaaac

SEQ ID NO: 6589801 - DNA, 21 bp, Homo sapiens
tttagcttcagttgttcttta

SEQ ID NO: 6589802 - DNA, 23 bp, Homo sapiens
tttagcttcagttgttctttaga

SEQ ID NO: 6589803 - DNA, 13 bp, Homo sapiens
tttagcttcattt

SEQ ID NO: 6589804 - DNA, 13 bp, Homo sapiens
tttagcttcctcc

SEQ ID NO: 6589805 - DNA, 15 bp, Homo sapiens
tttagcttcctccag

SEQ ID NO: 6589806 - DNA, 12 bp, Homo sapiens
tttagctttgga

SEQ ID NO: 6589807 - DNA, 13 bp, Homo sapiens
tttagctttggaa

SEQ ID NO: 6589808 - DNA, 13 bp, Homo sapiens
tttagcttttcct

SEQ ID NO: 6589809 - DNA, 14 bp, Homo sapiens
tttagcttttcctt

SEQ ID NO: 6589810 - DNA, 14 bp, Homo sapiens
tttagcttttttat

SEQ ID NO: 6589811 - DNA, 13 bp, Homo sapiens
tttaggaaaagca

SEQ ID NO: 6589812 - DNA, 21 bp, Homo sapiens
tttaggaaacaccattataaa

SEQ ID NO: 6589813 - DNA, 15 bp, Homo sapiens
tttaggaacttcaga

SEQ ID NO: 6589814 - DNA, 13 bp, Homo sapiens
tttaggaagtgtt

SEQ ID NO: 6589815 - DNA, 13 bp, Homo sapiens
tttaggaataata

SEQ ID NO: 6589816 - DNA, 16 bp, Homo sapiens
tttaggaatatgttca

SEQ ID NO: 6589817 - DNA, 16 bp, Homo sapiens
tttaggaatgctcaat

SEQ ID NO: 6589818 - DNA, 11 bp, Homo sapiens
tttaggagaag

SEQ ID NO: 6589819 - DNA, 14 bp, Homo sapiens
tttaggagacagtc

SEQ ID NO: 6589820 - DNA, 13 bp, Homo sapiens
tttaggagcagtg

SEQ ID NO: 6589821 - DNA, 23 bp, Homo sapiens
tttaggagctaaggctctatgag

SEQ ID NO: 6589822 - DNA, 17 bp, Homo sapiens
tttaggataaaataatg

SEQ ID NO: 6589823 - DNA, 21 bp, Homo sapiens
tttaggatctcaggcttctgc

SEQ ID NO: 6589824 - DNA, 13 bp, Homo sapiens
tttaggattgaag

SEQ ID NO: 6589825 - DNA, 16 bp, Homo sapiens
tttaggcaaagataat

SEQ ID NO: 6589826 - DNA, 16 bp, Homo sapiens
tttaggcaagagaaaa

SEQ ID NO: 6589827 - DNA, 21 bp, Homo sapiens
tttaggcacccctttccccag

SEQ ID NO: 6589828 - DNA, 22 bp, Homo sapiens
tttaggcacccctttccccagc

SEQ ID NO: 6589829 - DNA, 20 bp, Homo sapiens
tttaggcactcttaaatgat

SEQ ID NO: 6589830 - DNA, 22 bp, Homo sapiens
tttaggcactcttaaatgatct

SEQ ID NO: 6589831 - DNA, 11 bp, Homo sapiens
tttaggcagcc

SEQ ID NO: 6589832 - DNA, 13 bp, Homo sapiens
tttaggcagcctg

SEQ ID NO: 6589833 - DNA, 22 bp, Homo sapiens
tttaggcaggttacagttaact

SEQ ID NO: 6589834 - DNA, 20 bp, Homo sapiens
tttaggcatatgcttcttta

SEQ ID NO: 6589835 - DNA, 16 bp, Homo sapiens
tttaggcctcatttct

SEQ ID NO: 6589836 - DNA, 23 bp, Homo sapiens
tttaggcgtgggctgaccaggct

SEQ ID NO: 6589837 - DNA, 14 bp, Homo sapiens
tttaggctattata

SEQ ID NO: 6589838 - DNA, 18 bp, Homo sapiens
tttaggctggtggcccag

SEQ ID NO: 6589839 - DNA, 20 bp, Homo sapiens
tttaggctgttccttgtact

SEQ ID NO: 6589840 - DNA, 17 bp, Homo sapiens
tttagggaacaatttgg

SEQ ID NO: 6589841 - DNA, 21 bp, Homo sapiens
tttagggagagtcatattttg

SEQ ID NO: 6589842 - DNA, 15 bp, Homo sapiens
tttagggatctgggg

SEQ ID NO: 6589843 - DNA, 13 bp, Homo sapiens
tttagggcagctt

SEQ ID NO: 6589844 - DNA, 14 bp, Homo sapiens
tttagggccaggca

SEQ ID NO: 6589845 - DNA, 16 bp, Homo sapiens
tttagggctgttgcta

SEQ ID NO: 6589846 - DNA, 19 bp, Homo sapiens
tttaggggtagaaaatgtt

SEQ ID NO: 6589847 - DNA, 15 bp, Homo sapiens
tttagggttctaaat

SEQ ID NO: 6589848 - DNA, 20 bp, Homo sapiens
tttagggttctaaatgcaat

SEQ ID NO: 6589849 - DNA, 17 bp, Homo sapiens
tttaggtaaataaagct

SEQ ID NO: 6589850 - DNA, 18 bp, Homo sapiens
tttaggtatgctattatc

SEQ ID NO: 6589851 - DNA, 17 bp, Homo sapiens
tttaggtctttgtaaga

SEQ ID NO: 6589852 - DNA, 13 bp, Homo sapiens
tttaggtgcctcc

SEQ ID NO: 6589853 - DNA, 15 bp, Homo sapiens
tttaggttctaaagt

SEQ ID NO: 6589854 - DNA, 16 bp, Homo sapiens
tttaggttctaaagtt

SEQ ID NO: 6589855 - DNA, 18 bp, Homo sapiens
tttagtaaaaaagagaat

SEQ ID NO: 6589856 - DNA, 13 bp, Homo sapiens
tttagtaaaccaa

SEQ ID NO: 6589857 - DNA, 20 bp, Homo sapiens
tttagtaaatacatcactgt

SEQ ID NO: 6589858 - DNA, 14 bp, Homo sapiens
tttagtaatctgta

SEQ ID NO: 6589859 - DNA, 18 bp, Homo sapiens
tttagtacaataatctct

SEQ ID NO: 6589860 - DNA, 21 bp, Homo sapiens
tttagtacaatagtatacatt

SEQ ID NO: 6589861 - DNA, 15 bp, Homo sapiens
tttagtaccctgcag

SEQ ID NO: 6589862 - DNA, 16 bp, Homo sapiens
tttagtaccctgcagg

SEQ ID NO: 6589863 - DNA, 15 bp, Homo sapiens
tttagtaccttcaaa

SEQ ID NO: 6589864 - DNA, 12 bp, Homo sapiens
tttagtactcaa

SEQ ID NO: 6589865 - DNA, 20 bp, Homo sapiens
tttagtactcaatgtttctg

SEQ ID NO: 6589866 - DNA, 15 bp, Homo sapiens
tttagtagagacagg

SEQ ID NO: 6589867 - DNA, 15 bp, Homo sapiens
tttagtagagacagt

SEQ ID NO: 6589868 - DNA, 21 bp, Homo sapiens
tttagtagctgataaagaaac

SEQ ID NO: 6589869 - DNA, 18 bp, Homo sapiens
tttagtataaatgtacat

SEQ ID NO: 6589870 - DNA, 19 bp, Homo sapiens
tttagtatacgtataaata

SEQ ID NO: 6589871 - DNA, 17 bp, Homo sapiens
tttagtatatgaaatat

SEQ ID NO: 6589872 - DNA, 14 bp, Homo sapiens
tttagtatgtaaat

SEQ ID NO: 6589873 - DNA, 14 bp, Homo sapiens
tttagtattctctt

SEQ ID NO: 6589874 - DNA, 20 bp, Homo sapiens
tttagtattctcttgtgcat

SEQ ID NO: 6589875 - DNA, 21 bp, Homo sapiens
tttagtattgaatacttacat

SEQ ID NO: 6589876 - DNA, 16 bp, Homo sapiens
tttagtcaatcactgc

SEQ ID NO: 6589877 - DNA, 19 bp, Homo sapiens
tttagtcaattgtttaatg

SEQ ID NO: 6589878 - DNA, 20 bp, Homo sapiens
tttagtcacgtgtattttca

SEQ ID NO: 6589879 - DNA, 18 bp, Homo sapiens
tttagtcactaagacttt

SEQ ID NO: 6589880 - DNA, 13 bp, Homo sapiens
tttagtcagaaat

SEQ ID NO: 6589881 - DNA, 16 bp, Homo sapiens
tttagtcagaaatgat

SEQ ID NO: 6589882 - DNA, 16 bp, Homo sapiens
tttagtcattccaagt

SEQ ID NO: 6589883 - DNA, 16 bp, Homo sapiens
tttagtcctcaccttc

SEQ ID NO: 6589884 - DNA, 17 bp, Homo sapiens
tttagtctaagatgatt

SEQ ID NO: 6589885 - DNA, 13 bp, Homo sapiens
tttagtctgtcat

SEQ ID NO: 6589886 - DNA, 18 bp, Homo sapiens
tttagtcttgatgtggaa

SEQ ID NO: 6589887 - DNA, 17 bp, Homo sapiens
tttagtcttgtctcaga

SEQ ID NO: 6589888 - DNA, 19 bp, Homo sapiens
tttagtctttagaactcta

SEQ ID NO: 6589889 - DNA, 17 bp, Homo sapiens
tttagtctttagctatt

SEQ ID NO: 6589890 - DNA, 15 bp, Homo sapiens
tttagtgaattaaat

SEQ ID NO: 6589891 - DNA, 12 bp, Homo sapiens
tttagtgactaa

SEQ ID NO: 6589892 - DNA, 13 bp, Homo sapiens
tttagtgattgct

SEQ ID NO: 6589893 - DNA, 15 bp, Homo sapiens
tttagtgcaatttct

SEQ ID NO: 6589894 - DNA, 17 bp, Homo sapiens
tttagtgccaatgttgt

SEQ ID NO: 6589895 - DNA, 13 bp, Homo sapiens
tttagtggaaaat

SEQ ID NO: 6589896 - DNA, 21 bp, Homo sapiens
tttagtggaccctgaaatgtg

SEQ ID NO: 6589897 - DNA, 15 bp, Homo sapiens
tttagtgtaaaaatg

SEQ ID NO: 6589898 - DNA, 17 bp, Homo sapiens
tttagtgtaaaaatgag

SEQ ID NO: 6589899 - DNA, 15 bp, Homo sapiens
tttagtgtacattta

SEQ ID NO: 6589900 - DNA, 22 bp, Homo sapiens
tttagtgtatatgtgattttca

SEQ ID NO: 6589901 - DNA, 23 bp, Homo sapiens
tttagtgtatatgtgattttcaa

SEQ ID NO: 6589902 - DNA, 13 bp, Homo sapiens
tttagtgtctgac

SEQ ID NO: 6589903 - DNA, 14 bp, Homo sapiens
tttagtgtgtaaaa

SEQ ID NO: 6589904 - DNA, 19 bp, Homo sapiens
tttagtgtgtgtgcagagt

SEQ ID NO: 6589905 - DNA, 16 bp, Homo sapiens
tttagtgttagttata

SEQ ID NO: 6589906 - DNA, 18 bp, Homo sapiens
tttagtgtttttttattt

SEQ ID NO: 6589907 - DNA, 13 bp, Homo sapiens
tttagttaataaa

SEQ ID NO: 6589908 - DNA, 19 bp, Homo sapiens
tttagttacgtataatgct

SEQ ID NO: 6589909 - DNA, 19 bp, Homo sapiens
tttagttagcatgcgcgct

SEQ ID NO: 6589910 - DNA, 18 bp, Homo sapiens
tttagttataaaaggctt

SEQ ID NO: 6589911 - DNA, 13 bp, Homo sapiens
tttagttatagtt

SEQ ID NO: 6589912 - DNA, 17 bp, Homo sapiens
tttagttatatatatgt

SEQ ID NO: 6589913 - DNA, 17 bp, Homo sapiens
tttagttatttaagaag

SEQ ID NO: 6589914 - DNA, 18 bp, Homo sapiens
tttagttatttaagaaga

SEQ ID NO: 6589915 - DNA, 15 bp, Homo sapiens
tttagttccacaaat

SEQ ID NO: 6589916 - DNA, 12 bp, Homo sapiens
tttagttcctgt

SEQ ID NO: 6589917 - DNA, 17 bp, Homo sapiens
tttagttctgactttga

SEQ ID NO: 6589918 - DNA, 18 bp, Homo sapiens
tttagttctgactttgaa

SEQ ID NO: 6589919 - DNA, 14 bp, Homo sapiens
tttagttctgttga

SEQ ID NO: 6589920 - DNA, 11 bp, Homo sapiens
tttagttcttt

SEQ ID NO: 6589921 - DNA, 17 bp, Homo sapiens
tttagttctttggaaat

SEQ ID NO: 6589922 - DNA, 14 bp, Homo sapiens
tttagttgaaaaat

SEQ ID NO: 6589923 - DNA, 18 bp, Homo sapiens
tttagttgaaaaatctag

SEQ ID NO: 6589924 - DNA, 11 bp, Homo sapiens
tttagttgaat

SEQ ID NO: 6589925 - DNA, 17 bp, Homo sapiens
tttagttgccaacagtt

SEQ ID NO: 6589926 - DNA, 18 bp, Homo sapiens
tttagttgctcaaagagc

SEQ ID NO: 6589927 - DNA, 20 bp, Homo sapiens
tttagttgtatctcttttga

SEQ ID NO: 6589928 - DNA, 17 bp, Homo sapiens
tttagttgttgaaacaa

SEQ ID NO: 6589929 - DNA, 16 bp, Homo sapiens
tttagtttaatagttt

SEQ ID NO: 6589930 - DNA, 19 bp, Homo sapiens
tttagtttaccaatcaaca

SEQ ID NO: 6589931 - DNA, 17 bp, Homo sapiens
tttagtttgtactcagt

SEQ ID NO: 6589932 - DNA, 11 bp, Homo sapiens
tttagtttgtt

SEQ ID NO: 6589933 - DNA, 21 bp, Homo sapiens
tttagtttgttaaagcctgtt

SEQ ID NO: 6589934 - DNA, 18 bp, Homo sapiens
tttagtttgttcttcaga

SEQ ID NO: 6589935 - DNA, 12 bp, Homo sapiens
tttagttttaca

SEQ ID NO: 6589936 - DNA, 15 bp, Homo sapiens
tttagttttacacta

SEQ ID NO: 6589937 - DNA, 18 bp, Homo sapiens
tttagttttacattttaa

SEQ ID NO: 6589938 - DNA, 18 bp, Homo sapiens
tttagttttatactatat

SEQ ID NO: 6589939 - DNA, 13 bp, Homo sapiens
tttagttttatgg

SEQ ID NO: 6589940 - DNA, 15 bp, Homo sapiens
tttagttttgtaact

SEQ ID NO: 6589941 - DNA, 16 bp, Homo sapiens
tttagtttttaacaat

SEQ ID NO: 6589942 - DNA, 12 bp, Homo sapiens
tttagtttttca

SEQ ID NO: 6589943 - DNA, 15 bp, Homo sapiens
tttataaaaaaaagt

SEQ ID NO: 6589944 - DNA, 14 bp, Homo sapiens
tttataaaaagata

SEQ ID NO: 6589945 - DNA, 19 bp, Homo sapiens
tttataaaaataaatagaa

SEQ ID NO: 6589946 - DNA, 23 bp, Homo sapiens
tttataaaaataaatagaaaagt

SEQ ID NO: 6589947 - DNA, 16 bp, Homo sapiens
tttataaaaatataaa

SEQ ID NO: 6589948 - DNA, 22 bp, Homo sapiens
tttataaaacaatgacttttaa

SEQ ID NO: 6589949 - DNA, 14 bp, Homo sapiens
tttataaaacttct

SEQ ID NO: 6589950 - DNA, 15 bp, Homo sapiens
tttataaaatgggaa

SEQ ID NO: 6589951 - DNA, 15 bp, Homo sapiens
aatgaaagtgttaat

SEQ ID NO: 6589952 - DNA, 12 bp, Homo sapiens
aatgaaataatc

SEQ ID NO: 6589953 - DNA, 15 bp, Homo sapiens
aatgaaataatcagt

SEQ ID NO: 6589954 - DNA, 14 bp, Homo sapiens
aatgaaatacacaa

SEQ ID NO: 6589955 - DNA, 23 bp, Homo sapiens
aatgaaataggagggaaaccttt

SEQ ID NO: 6589956 - DNA, 12 bp, Homo sapiens
aatgaaatataa

SEQ ID NO: 6589957 - DNA, 18 bp, Homo sapiens
aatgaaatatagatgtta

SEQ ID NO: 6589958 - DNA, 22 bp, Homo sapiens
aatgaaatatctgtatttaatt

SEQ ID NO: 6589959 - DNA, 23 bp, Homo sapiens
aatgaaatatgttggggtttttt

SEQ ID NO: 6589960 - DNA, 18 bp, Homo sapiens
aatgaaatattgctgtat

SEQ ID NO: 6589961 - DNA, 19 bp, Homo sapiens
aatgaaatattgtttccaa

SEQ ID NO: 6589962 - DNA, 15 bp, Homo sapiens
aatgaaatatttgct

SEQ ID NO: 6589963 - DNA, 19 bp, Homo sapiens
aatgaaatgataaagactt

SEQ ID NO: 6589964 - DNA, 14 bp, Homo sapiens
aatgaaatgcatat

SEQ ID NO: 6589965 - DNA, 14 bp, Homo sapiens
aatgaaatgccaaa

SEQ ID NO: 6589966 - DNA, 17 bp, Homo sapiens
aatgaaatgctctcctt

SEQ ID NO: 6589967 - DNA, 16 bp, Homo sapiens
aatgaaatgtatgtgc

SEQ ID NO: 6589968 - DNA, 12 bp, Homo sapiens
aatgaaatgttt

SEQ ID NO: 6589969 - DNA, 13 bp, Homo sapiens
aatgaaatgtttt

SEQ ID NO: 6589970 - DNA, 14 bp, Homo sapiens
aatgaaatgtttta

SEQ ID NO: 6589971 - DNA, 16 bp, Homo sapiens
aatgaaattcctcctt

SEQ ID NO: 6589972 - DNA, 15 bp, Homo sapiens
aatgaaatttaatta

SEQ ID NO: 6589973 - DNA, 12 bp, Homo sapiens
aatgaaatttta

SEQ ID NO: 6589974 - DNA, 16 bp, Homo sapiens
aatgaaattttgatta

SEQ ID NO: 6589975 - DNA, 16 bp, Homo sapiens
aatgaacaaatatgct

SEQ ID NO: 6589976 - DNA, 13 bp, Homo sapiens
aatgaacaagaga

SEQ ID NO: 6589977 - DNA, 15 bp, Homo sapiens
aatgaacaagcattc

SEQ ID NO: 6589978 - DNA, 17 bp, Homo sapiens
aatgaacacaaattatg

SEQ ID NO: 6589979 - DNA, 20 bp, Homo sapiens
aatgaacacagctctttaac

SEQ ID NO: 6589980 - DNA, 22 bp, Homo sapiens
aatgaacacagctctttaacat

SEQ ID NO: 6589981 - DNA, 17 bp, Homo sapiens
aatgaacacatggcaga

SEQ ID NO: 6589982 - DNA, 18 bp, Homo sapiens
aatgaacactcttttgct

SEQ ID NO: 6589983 - DNA, 12 bp, Homo sapiens
aatgaacagaac

SEQ ID NO: 6589984 - DNA, 14 bp, Homo sapiens
aatgaacagctcct

SEQ ID NO: 6589985 - DNA, 17 bp, Homo sapiens
aatgaacagctcctcct

SEQ ID NO: 6589986 - DNA, 16 bp, Homo sapiens
aatgaacatctcatgt

SEQ ID NO: 6589987 - DNA, 13 bp, Homo sapiens
aatgaacatctct

SEQ ID NO: 6589988 - DNA, 19 bp, Homo sapiens
aatgaacatctcttgaaac

SEQ ID NO: 6589989 - DNA, 14 bp, Homo sapiens
aatgaacattaaca

SEQ ID NO: 6589990 - DNA, 13 bp, Homo sapiens
aatgaacattcca

SEQ ID NO: 6589991 - DNA, 17 bp, Homo sapiens
aatgaaccataaattca

SEQ ID NO: 6589992 - DNA, 19 bp, Homo sapiens
aatgaacccatagggagct

SEQ ID NO: 6589993 - DNA, 19 bp, Homo sapiens
aatgaacccctggctcctt

SEQ ID NO: 6589994 - DNA, 18 bp, Homo sapiens
aatgaaccgtttacagtg

SEQ ID NO: 6589995 - DNA, 17 bp, Homo sapiens
aatgaactaactgccat

SEQ ID NO: 6589996 - DNA, 15 bp, Homo sapiens
aatgaactgaagttt

SEQ ID NO: 6589997 - DNA, 13 bp, Homo sapiens
aatgaactgattt

SEQ ID NO: 6589998 - DNA, 14 bp, Homo sapiens
aatgaactgcccac

SEQ ID NO: 6589999 - DNA, 17 bp, Homo sapiens
aatgaactgcttttcct

SEQ ID NO: 6590000 - DNA, 20 bp, Homo sapiens
aatgaactgtatattattgc

SEQ ID NO: 6590001 - DNA, 21 bp, Homo sapiens
aatgaactgtatattattgct

SEQ ID NO: 6590002 - DNA, 14 bp, Homo sapiens
aatgaactgtatta

SEQ ID NO: 6590003 - DNA, 15 bp, Homo sapiens
aatgaacttccattt

SEQ ID NO: 6590004 - DNA, 13 bp, Homo sapiens
aatgaacttgtta

SEQ ID NO: 6590005 - DNA, 21 bp, Homo sapiens
aatgaacttttacagaatgca

SEQ ID NO: 6590006 - DNA, 22 bp, Homo sapiens
aatgaagaaaaaggctggctga

SEQ ID NO: 6590007 - DNA, 12 bp, Homo sapiens
aatgaagaaagt

SEQ ID NO: 6590008 - DNA, 13 bp, Homo sapiens
aatgaagaaatac

SEQ ID NO: 6590009 - DNA, 14 bp, Homo sapiens
aatgaagaacactg

SEQ ID NO: 6590010 - DNA, 15 bp, Homo sapiens
aatgaagaacactgt

SEQ ID NO: 6590011 - DNA, 20 bp, Homo sapiens
aatgaagaactgttgcctaa

SEQ ID NO: 6590012 - DNA, 21 bp, Homo sapiens
aatgaagaactgttgcctaat

SEQ ID NO: 6590013 - DNA, 13 bp, Homo sapiens
aatgaagaagaca

SEQ ID NO: 6590014 - DNA, 14 bp, Homo sapiens
aatgaagaatggtg

SEQ ID NO: 6590015 - DNA, 23 bp, Homo sapiens
aatgaagaattatgtaatatatt

SEQ ID NO: 6590016 - DNA, 13 bp, Homo sapiens
aatgaagaattta

SEQ ID NO: 6590017 - DNA, 19 bp, Homo sapiens
aatgaagacaaaacataca

SEQ ID NO: 6590018 - DNA, 12 bp, Homo sapiens
aatgaagacaat

SEQ ID NO: 6590019 - DNA, 20 bp, Homo sapiens
aatgaagacatttctgctct

SEQ ID NO: 6590020 - DNA, 14 bp, Homo sapiens
aatgaagacctaaa

SEQ ID NO: 6590021 - DNA, 13 bp, Homo sapiens
aatgaagataaat

SEQ ID NO: 6590022 - DNA, 14 bp, Homo sapiens
aatgaagataaatg

SEQ ID NO: 6590023 - DNA, 19 bp, Homo sapiens
aatgaagatacacattaca

SEQ ID NO: 6590024 - DNA, 21 bp, Homo sapiens
aatgaagataccatcagcaaa

SEQ ID NO: 6590025 - DNA, 20 bp, Homo sapiens
aatgaagatactgaaataaa

SEQ ID NO: 6590026 - DNA, 15 bp, Homo sapiens
aatgaagatctttgt

SEQ ID NO: 6590027 - DNA, 15 bp, Homo sapiens
aatgaagcaaacaca

SEQ ID NO: 6590028 - DNA, 12 bp, Homo sapiens
aatgaagcatgt

SEQ ID NO: 6590029 - DNA, 13 bp, Homo sapiens
aatgaagcatgta

SEQ ID NO: 6590030 - DNA, 22 bp, Homo sapiens
aatgaagccatatgaacagctg

SEQ ID NO: 6590031 - DNA, 16 bp, Homo sapiens
aatgaagcttgtgtat

SEQ ID NO: 6590032 - DNA, 17 bp, Homo sapiens
aatgaagcttgtgtatc

SEQ ID NO: 6590033 - DNA, 19 bp, Homo sapiens
aatgaagcttgtgtatcca

SEQ ID NO: 6590034 - DNA, 15 bp, Homo sapiens
aatgaagctttggtt

SEQ ID NO: 6590035 - DNA, 15 bp, Homo sapiens
aatgaagctttttaa

SEQ ID NO: 6590036 - DNA, 23 bp, Homo sapiens
aatgaaggaaataaaaaagtctc

SEQ ID NO: 6590037 - DNA, 13 bp, Homo sapiens
aatgaaggaatta

SEQ ID NO: 6590038 - DNA, 15 bp, Homo sapiens
aatgaaggatttctt

SEQ ID NO: 6590039 - DNA, 19 bp, Homo sapiens
aatgaaggtcataagtttc

SEQ ID NO: 6590040 - DNA, 22 bp, Homo sapiens
aatgaaggtgtcagaataataa

SEQ ID NO: 6590041 - DNA, 15 bp, Homo sapiens
aatgaaggtttttgt

SEQ ID NO: 6590042 - DNA, 22 bp, Homo sapiens
aatgaaggtttttgtaaagatt

SEQ ID NO: 6590043 - DNA, 18 bp, Homo sapiens
aatgaagtattacatgat

SEQ ID NO: 6590044 - DNA, 16 bp, Homo sapiens
aatgaagtatttcatg

SEQ ID NO: 6590045 - DNA, 19 bp, Homo sapiens
aatgaagttgattcatatt

SEQ ID NO: 6590046 - DNA, 14 bp, Homo sapiens
aatgaagttggggt

SEQ ID NO: 6590047 - DNA, 17 bp, Homo sapiens
aatgaagtttatacagt

SEQ ID NO: 6590048 - DNA, 14 bp, Homo sapiens
aatgaagtttgaat

SEQ ID NO: 6590049 - DNA, 16 bp, Homo sapiens
aatgaagtttgaatgt

SEQ ID NO: 6590050 - DNA, 19 bp, Homo sapiens
aatgaataatgcctttgta

SEQ ID NO: 6590051 - DNA, 14 bp, Homo sapiens
aatgaataatttat

SEQ ID NO: 6590052 - DNA, 16 bp, Homo sapiens
aatgaataatttccca

SEQ ID NO: 6590053 - DNA, 12 bp, Homo sapiens
aatgaatacctt

SEQ ID NO: 6590054 - DNA, 13 bp, Homo sapiens
aatgaatagcttg

SEQ ID NO: 6590055 - DNA, 16 bp, Homo sapiens
aatgaatatcatgcaa

SEQ ID NO: 6590056 - DNA, 19 bp, Homo sapiens
aatgaatatctattaatat

SEQ ID NO: 6590057 - DNA, 20 bp, Homo sapiens
aatgaatatctattaatata

SEQ ID NO: 6590058 - DNA, 14 bp, Homo sapiens
aatgaatatctgct

SEQ ID NO: 6590059 - DNA, 13 bp, Homo sapiens
aatgaatgaaact

SEQ ID NO: 6590060 - DNA, 13 bp, Homo sapiens
aatgaatgaaata

SEQ ID NO: 6590061 - DNA, 23 bp, Homo sapiens
aatgaatgaaatataaactgtga

SEQ ID NO: 6590062 - DNA, 17 bp, Homo sapiens
aatgaatgaatggcttg

SEQ ID NO: 6590063 - DNA, 10 bp, Homo sapiens
aatgaatgag

SEQ ID NO: 6590064 - DNA, 19 bp, Homo sapiens
aatgaatgaggtctgggct

SEQ ID NO: 6590065 - DNA, 13 bp, Homo sapiens
aatgaatgattct

SEQ ID NO: 6590066 - DNA, 14 bp, Homo sapiens
aatgaatgattcta

SEQ ID NO: 6590067 - DNA, 23 bp, Homo sapiens
aatgaatgcaaaattgttttcac

SEQ ID NO: 6590068 - DNA, 16 bp, Homo sapiens
aatgaatgcctttcaa

SEQ ID NO: 6590069 - DNA, 14 bp, Homo sapiens
aatgaatgggatat

SEQ ID NO: 6590070 - DNA, 14 bp, Homo sapiens
aatgaatgtaaaag

SEQ ID NO: 6590071 - DNA, 14 bp, Homo sapiens
aatgaatgtgctga

SEQ ID NO: 6590072 - DNA, 16 bp, Homo sapiens
aatgaattaaatattg

SEQ ID NO: 6590073 - DNA, 17 bp, Homo sapiens
aatgaattaagaaagat

SEQ ID NO: 6590074 - DNA, 22 bp, Homo sapiens
aatgaattataacagttatatt

SEQ ID NO: 6590075 - DNA, 16 bp, Homo sapiens
aatgaattcctagaat

SEQ ID NO: 6590076 - DNA, 18 bp, Homo sapiens
aatgaattcctatatacc

SEQ ID NO: 6590077 - DNA, 21 bp, Homo sapiens
aatgaattctctctaaaaata

SEQ ID NO: 6590078 - DNA, 13 bp, Homo sapiens
aatgaattctgaa

SEQ ID NO: 6590079 - DNA, 14 bp, Homo sapiens
aatgaattcttgat

SEQ ID NO: 6590080 - DNA, 17 bp, Homo sapiens
aatgaattgaaaaacaa

SEQ ID NO: 6590081 - DNA, 14 bp, Homo sapiens
aatgaattgaaatt

SEQ ID NO: 6590082 - DNA, 22 bp, Homo sapiens
aatgaattgaaattttatttat

SEQ ID NO: 6590083 - DNA, 12 bp, Homo sapiens
aatgaattgcct

SEQ ID NO: 6590084 - DNA, 14 bp, Homo sapiens
aatgaattgccttt

SEQ ID NO: 6590085 - DNA, 18 bp, Homo sapiens
aatgaattgtattttttg

SEQ ID NO: 6590086 - DNA, 17 bp, Homo sapiens
aatgaatttaaggcaaa

SEQ ID NO: 6590087 - DNA, 14 bp, Homo sapiens
aatgaatttatcat

SEQ ID NO: 6590088 - DNA, 18 bp, Homo sapiens
aatgaatttatcatttta

SEQ ID NO: 6590089 - DNA, 15 bp, Homo sapiens
aatgaatttatcttt

SEQ ID NO: 6590090 - DNA, 19 bp, Homo sapiens
aatgaatttatctttacca

SEQ ID NO: 6590091 - DNA, 19 bp, Homo sapiens
aatgaatttgctaaataca

SEQ ID NO: 6590092 - DNA, 12 bp, Homo sapiens
aatgaattttaa

SEQ ID NO: 6590093 - DNA, 19 bp, Homo sapiens
aatgaattttaaaagcata

SEQ ID NO: 6590094 - DNA, 21 bp, Homo sapiens
aatgaattttaaaagcatata

SEQ ID NO: 6590095 - DNA, 23 bp, Homo sapiens
aatgaatttttattgagattttc

SEQ ID NO: 6590096 - DNA, 17 bp, Homo sapiens
aatgacaaaagatacaa

SEQ ID NO: 6590097 - DNA, 14 bp, Homo sapiens
aatgacaaagccat

SEQ ID NO: 6590098 - DNA, 12 bp, Homo sapiens
aatgacaacact

SEQ ID NO: 6590099 - DNA, 15 bp, Homo sapiens
aatgacaacacttaa

SEQ ID NO: 6590100 - DNA, 20 bp, Homo sapiens
aatgacaacacttaatagca

SEQ ID NO: 6590101 - DNA, 13 bp, Homo sapiens
aatgacaacagaa

SEQ ID NO: 6590102 - DNA, 14 bp, Homo sapiens
aatgacaacagaaa

SEQ ID NO: 6590103 - DNA, 19 bp, Homo sapiens
aatgacaacagaaaaacaa

SEQ ID NO: 6590104 - DNA, 23 bp, Homo sapiens
aatgacaacagaaaaacaatctt

SEQ ID NO: 6590105 - DNA, 16 bp, Homo sapiens
aatgacaacagaagct

SEQ ID NO: 6590106 - DNA, 15 bp, Homo sapiens
aatgacaagatgttc

SEQ ID NO: 6590107 - DNA, 12 bp, Homo sapiens
aatgacaatatt

SEQ ID NO: 6590108 - DNA, 15 bp, Homo sapiens
aatgacaatcatgtg

SEQ ID NO: 6590109 - DNA, 16 bp, Homo sapiens
aatgacaattgtgaac

SEQ ID NO: 6590110 - DNA, 15 bp, Homo sapiens
aatgacacatttgtt

SEQ ID NO: 6590111 - DNA, 14 bp, Homo sapiens
aatgacacccagac

SEQ ID NO: 6590112 - DNA, 16 bp, Homo sapiens
aatgacacccagacct

SEQ ID NO: 6590113 - DNA, 16 bp, Homo sapiens
aatgacacccatgcca

SEQ ID NO: 6590114 - DNA, 22 bp, Homo sapiens
aatgacacccatgccagagagg

SEQ ID NO: 6590115 - DNA, 19 bp, Homo sapiens
aatgacactcatataatta

SEQ ID NO: 6590116 - DNA, 18 bp, Homo sapiens
aatgacactgtttcctga

SEQ ID NO: 6590117 - DNA, 16 bp, Homo sapiens
aatgacagaatgctgt

SEQ ID NO: 6590118 - DNA, 18 bp, Homo sapiens
aatgacagagagttctgg

SEQ ID NO: 6590119 - DNA, 11 bp, Homo sapiens
aatgacagagc

SEQ ID NO: 6590120 - DNA, 16 bp, Homo sapiens
aatgacagagccagtg

SEQ ID NO: 6590121 - DNA, 13 bp, Homo sapiens
aatgacagatttc

SEQ ID NO: 6590122 - DNA, 14 bp, Homo sapiens
aatgacagatttct

SEQ ID NO: 6590123 - DNA, 18 bp, Homo sapiens
aatgacagatttctgtaa

SEQ ID NO: 6590124 - DNA, 13 bp, Homo sapiens
aatgacaggatat

SEQ ID NO: 6590125 - DNA, 21 bp, Homo sapiens
aatgacatacgcttttaatga

SEQ ID NO: 6590126 - DNA, 13 bp, Homo sapiens
aatgacatctttt

SEQ ID NO: 6590127 - DNA, 16 bp, Homo sapiens
aatgacatctttttaa

SEQ ID NO: 6590128 - DNA, 13 bp, Homo sapiens
aatgacatgaatt

SEQ ID NO: 6590129 - DNA, 12 bp, Homo sapiens
aatgacatgcac

SEQ ID NO: 6590130 - DNA, 15 bp, Homo sapiens
aatgacatgcactga

SEQ ID NO: 6590131 - DNA, 16 bp, Homo sapiens
aatgacatgcactgac

SEQ ID NO: 6590132 - DNA, 22 bp, Homo sapiens
aatgacatgcactgacccttcc

SEQ ID NO: 6590133 - DNA, 14 bp, Homo sapiens
aatgacatgtgtca

SEQ ID NO: 6590134 - DNA, 23 bp, Homo sapiens
aatgacatgtgtcaagctgcttg

SEQ ID NO: 6590135 - DNA, 17 bp, Homo sapiens
tttataaaattaaagaa

SEQ ID NO: 6590136 - DNA, 14 bp, Homo sapiens
tttataaaattaga

SEQ ID NO: 6590137 - DNA, 22 bp, Homo sapiens
tttataaaattagaaagcaact

SEQ ID NO: 6590138 - DNA, 18 bp, Homo sapiens
tttataaacagacaatat

SEQ ID NO: 6590139 - DNA, 21 bp, Homo sapiens
tttataaaccataaaataaat

SEQ ID NO: 6590140 - DNA, 14 bp, Homo sapiens
tttataaactttac

SEQ ID NO: 6590141 - DNA, 18 bp, Homo sapiens
tttataaactttaccttt

SEQ ID NO: 6590142 - DNA, 20 bp, Homo sapiens
tttataaagtgcttgtgtaa

SEQ ID NO: 6590143 - DNA, 13 bp, Homo sapiens
tttataaagttta

SEQ ID NO: 6590144 - DNA, 17 bp, Homo sapiens
tttataaagtttatcag

SEQ ID NO: 6590145 - DNA, 20 bp, Homo sapiens
tttataaatactgcaaatca

SEQ ID NO: 6590146 - DNA, 22 bp, Homo sapiens
tttataaatatgtgattatcat

SEQ ID NO: 6590147 - DNA, 18 bp, Homo sapiens
tttataaatcgcttttga

SEQ ID NO: 6590148 - DNA, 19 bp, Homo sapiens
tttataaatcgcttttgat

SEQ ID NO: 6590149 - DNA, 21 bp, Homo sapiens
tttataaatgaagatgcattt

SEQ ID NO: 6590150 - DNA, 14 bp, Homo sapiens
tttataaatgctat

SEQ ID NO: 6590151 - DNA, 16 bp, Homo sapiens
tttataaatgttttaa

SEQ ID NO: 6590152 - DNA, 13 bp, Homo sapiens
tttataaattaaa

SEQ ID NO: 6590153 - DNA, 17 bp, Homo sapiens
tttataaattaaatata

SEQ ID NO: 6590154 - DNA, 18 bp, Homo sapiens
tttataaatttaagcatt

SEQ ID NO: 6590155 - DNA, 13 bp, Homo sapiens
tttataaatttga

SEQ ID NO: 6590156 - DNA, 15 bp, Homo sapiens
tttataacagttata

SEQ ID NO: 6590157 - DNA, 21 bp, Homo sapiens
tttataacagttataaagaaa

SEQ ID NO: 6590158 - DNA, 17 bp, Homo sapiens
tttataacatctttatt

SEQ ID NO: 6590159 - DNA, 15 bp, Homo sapiens
tttataacattgtaa

SEQ ID NO: 6590160 - DNA, 20 bp, Homo sapiens
tttataaccaccaagtatta

SEQ ID NO: 6590161 - DNA, 18 bp, Homo sapiens
tttataaccatgagaatt

SEQ ID NO: 6590162 - DNA, 22 bp, Homo sapiens
tttataaccatggttttcctga

SEQ ID NO: 6590163 - DNA, 19 bp, Homo sapiens
tttataaccccagcctgac

SEQ ID NO: 6590164 - DNA, 18 bp, Homo sapiens
tttataacctgatgccat

SEQ ID NO: 6590165 - DNA, 22 bp, Homo sapiens
tttataaccttgttctctgctt

SEQ ID NO: 6590166 - DNA, 16 bp, Homo sapiens
tttataactatataaa

SEQ ID NO: 6590167 - DNA, 23 bp, Homo sapiens
tttataactatataaatgacatt

SEQ ID NO: 6590168 - DNA, 20 bp, Homo sapiens
tttataactattcagttgtg

SEQ ID NO: 6590169 - DNA, 20 bp, Homo sapiens
tttataacttaaatattgct

SEQ ID NO: 6590170 - DNA, 16 bp, Homo sapiens
tttataactttttata

SEQ ID NO: 6590171 - DNA, 14 bp, Homo sapiens
tttataagaaaaac

SEQ ID NO: 6590172 - DNA, 18 bp, Homo sapiens
tttataagaaaaactttt

SEQ ID NO: 6590173 - DNA, 21 bp, Homo sapiens
tttataagagggaacaaattt

SEQ ID NO: 6590174 - DNA, 18 bp, Homo sapiens
tttataagcacagacaat

SEQ ID NO: 6590175 - DNA, 12 bp, Homo sapiens
tttataagcatc

SEQ ID NO: 6590176 - DNA, 16 bp, Homo sapiens
tttataagcatcatta

SEQ ID NO: 6590177 - DNA, 18 bp, Homo sapiens
tttataagcatcattatt

SEQ ID NO: 6590178 - DNA, 17 bp, Homo sapiens
tttataagcattgccat

SEQ ID NO: 6590179 - DNA, 17 bp, Homo sapiens
tttataaggacttcctg

SEQ ID NO: 6590180 - DNA, 16 bp, Homo sapiens
tttataagttcacaaa

SEQ ID NO: 6590181 - DNA, 13 bp, Homo sapiens
tttataagttttt

SEQ ID NO: 6590182 - DNA, 19 bp, Homo sapiens
tttataataaaaatatatt

SEQ ID NO: 6590183 - DNA, 16 bp, Homo sapiens
tttataataaactgtt

SEQ ID NO: 6590184 - DNA, 17 bp, Homo sapiens
tttataataaactgttt

SEQ ID NO: 6590185 - DNA, 21 bp, Homo sapiens
tttataatacagaatcttgtt

SEQ ID NO: 6590186 - DNA, 14 bp, Homo sapiens
tttataatactgtt

SEQ ID NO: 6590187 - DNA, 18 bp, Homo sapiens
tttataatagcaactttt

SEQ ID NO: 6590188 - DNA, 20 bp, Homo sapiens
tttataatataaatatatgt

SEQ ID NO: 6590189 - DNA, 16 bp, Homo sapiens
tttataatctgaagat

SEQ ID NO: 6590190 - DNA, 21 bp, Homo sapiens
tttataatgaaaagaaacaag

SEQ ID NO: 6590191 - DNA, 12 bp, Homo sapiens
tttataatgaat

SEQ ID NO: 6590192 - DNA, 14 bp, Homo sapiens
tttataatgaataa

SEQ ID NO: 6590193 - DNA, 12 bp, Homo sapiens
tttataatgact

SEQ ID NO: 6590194 - DNA, 23 bp, Homo sapiens
tttataatgactggtcttcctta

SEQ ID NO: 6590195 - DNA, 13 bp, Homo sapiens
tttataatgattc

SEQ ID NO: 6590196 - DNA, 12 bp, Homo sapiens
tttataatggct

SEQ ID NO: 6590197 - DNA, 19 bp, Homo sapiens
tttataatgtcaaatgaaa

SEQ ID NO: 6590198 - DNA, 20 bp, Homo sapiens
tttataatgtggatttccta

SEQ ID NO: 6590199 - DNA, 19 bp, Homo sapiens
tttataattaaagaaaatt

SEQ ID NO: 6590200 - DNA, 14 bp, Homo sapiens
tttataattcagta

SEQ ID NO: 6590201 - DNA, 15 bp, Homo sapiens
tttataattggctta

SEQ ID NO: 6590202 - DNA, 17 bp, Homo sapiens
tttataattgtacaaaa

SEQ ID NO: 6590203 - DNA, 21 bp, Homo sapiens
tttataattttaagattcctt

SEQ ID NO: 6590204 - DNA, 22 bp, Homo sapiens
tttataattttaagattccttt

SEQ ID NO: 6590205 - DNA, 13 bp, Homo sapiens
tttatacaaaata

SEQ ID NO: 6590206 - DNA, 22 bp, Homo sapiens
tttatacaaaataatttaacta

SEQ ID NO: 6590207 - DNA, 22 bp, Homo sapiens
tttatacaaagacagccacttt

SEQ ID NO: 6590208 - DNA, 15 bp, Homo sapiens
tttatacaaattaga

SEQ ID NO: 6590209 - DNA, 17 bp, Homo sapiens
tttatacaaattagaaa

SEQ ID NO: 6590210 - DNA, 17 bp, Homo sapiens
tttatacaacagtgcta

SEQ ID NO: 6590211 - DNA, 19 bp, Homo sapiens
tttatacaacagtgctaaa

SEQ ID NO: 6590212 - DNA, 16 bp, Homo sapiens
tttatacaatatcatc

SEQ ID NO: 6590213 - DNA, 21 bp, Homo sapiens
tttatacaatggaataaatta

SEQ ID NO: 6590214 - DNA, 23 bp, Homo sapiens
tttatacaatggaataaattatg

SEQ ID NO: 6590215 - DNA, 18 bp, Homo sapiens
tttatacacaactttgca

SEQ ID NO: 6590216 - DNA, 11 bp, Homo sapiens
tttatacacat

SEQ ID NO: 6590217 - DNA, 18 bp, Homo sapiens
tttatacactgtaagctt

SEQ ID NO: 6590218 - DNA, 19 bp, Homo sapiens
tttatacacttctggctca

SEQ ID NO: 6590219 - DNA, 16 bp, Homo sapiens
tttatacagaactcac

SEQ ID NO: 6590220 - DNA, 23 bp, Homo sapiens
tttatacagaactgaattaagtt

SEQ ID NO: 6590221 - DNA, 22 bp, Homo sapiens
tttatacagtagtgagaagaat

SEQ ID NO: 6590222 - DNA, 18 bp, Homo sapiens
tttatacatagtcacaaa

SEQ ID NO: 6590223 - DNA, 12 bp, Homo sapiens
tttatacatatc

SEQ ID NO: 6590224 - DNA, 16 bp, Homo sapiens
tttatacatatcagaa

SEQ ID NO: 6590225 - DNA, 21 bp, Homo sapiens
tttatacatatcagaaaagta

SEQ ID NO: 6590226 - DNA, 12 bp, Homo sapiens
tttataccaaag

SEQ ID NO: 6590227 - DNA, 22 bp, Homo sapiens
tttataccagcttaatagctgt

SEQ ID NO: 6590228 - DNA, 21 bp, Homo sapiens
tttataccattataccagcaa

SEQ ID NO: 6590229 - DNA, 21 bp, Homo sapiens
tttatacctatctgagtgaat

SEQ ID NO: 6590230 - DNA, 18 bp, Homo sapiens
tttatacctgtttaaatt

SEQ ID NO: 6590231 - DNA, 13 bp, Homo sapiens
tttatactatatt

SEQ ID NO: 6590232 - DNA, 19 bp, Homo sapiens
tttatactccagtgtacat

SEQ ID NO: 6590233 - DNA, 19 bp, Homo sapiens
tttatactccatacataac

SEQ ID NO: 6590234 - DNA, 18 bp, Homo sapiens
tttatactctcttccctt

SEQ ID NO: 6590235 - DNA, 16 bp, Homo sapiens
tttatactgaaggaaa

SEQ ID NO: 6590236 - DNA, 18 bp, Homo sapiens
tttatactgaatataaaa

SEQ ID NO: 6590237 - DNA, 15 bp, Homo sapiens
tttatactgcacagt

SEQ ID NO: 6590238 - DNA, 14 bp, Homo sapiens
tttatactgtacat

SEQ ID NO: 6590239 - DNA, 19 bp, Homo sapiens
tttatactgtagcaatata

SEQ ID NO: 6590240 - DNA, 13 bp, Homo sapiens
tttatactgtata

SEQ ID NO: 6590241 - DNA, 19 bp, Homo sapiens
tttatactgtatttctaag

SEQ ID NO: 6590242 - DNA, 15 bp, Homo sapiens
tttatactgtgaaat

SEQ ID NO: 6590243 - DNA, 16 bp, Homo sapiens
tttatactgtttactg

SEQ ID NO: 6590244 - DNA, 22 bp, Homo sapiens
tttatacttaaacagctttttt

SEQ ID NO: 6590245 - DNA, 13 bp, Homo sapiens
tttatactttatt

SEQ ID NO: 6590246 - DNA, 21 bp, Homo sapiens
tttatactttgcaatccaaat

SEQ ID NO: 6590247 - DNA, 17 bp, Homo sapiens
tttatagaaaatgcatt

SEQ ID NO: 6590248 - DNA, 12 bp, Homo sapiens
tttatagaagaa

SEQ ID NO: 6590249 - DNA, 19 bp, Homo sapiens
tttatagaaggaatttgta

SEQ ID NO: 6590250 - DNA, 21 bp, Homo sapiens
tttatagaagtggtgtttttt

SEQ ID NO: 6590251 - DNA, 18 bp, Homo sapiens
tttatagagataagataa

SEQ ID NO: 6590252 - DNA, 21 bp, Homo sapiens
tttatagagttcatagaaata

SEQ ID NO: 6590253 - DNA, 17 bp, Homo sapiens
tttatagatcatttcta

SEQ ID NO: 6590254 - DNA, 18 bp, Homo sapiens
tttatagcaagatattga

SEQ ID NO: 6590255 - DNA, 16 bp, Homo sapiens
tttatagccctgtgaa

SEQ ID NO: 6590256 - DNA, 18 bp, Homo sapiens
tttatagccctgtgaagt

SEQ ID NO: 6590257 - DNA, 16 bp, Homo sapiens
tttatagctcagttta

SEQ ID NO: 6590258 - DNA, 14 bp, Homo sapiens
tttataggaaaaaa

SEQ ID NO: 6590259 - DNA, 23 bp, Homo sapiens
tttataggactgttctttgctgt

SEQ ID NO: 6590260 - DNA, 12 bp, Homo sapiens
tttatagggctt

SEQ ID NO: 6590261 - DNA, 15 bp, Homo sapiens
tttataggttttata

SEQ ID NO: 6590262 - DNA, 13 bp, Homo sapiens
tttatagtaatga

SEQ ID NO: 6590263 - DNA, 16 bp, Homo sapiens
tttatagtatgtgact

SEQ ID NO: 6590264 - DNA, 17 bp, Homo sapiens
tttatagtatgtgactt

SEQ ID NO: 6590265 - DNA, 17 bp, Homo sapiens
tttatagtgaagtgtta

SEQ ID NO: 6590266 - DNA, 15 bp, Homo sapiens
tttatagtgcacaaa

SEQ ID NO: 6590267 - DNA, 15 bp, Homo sapiens
tttatagttaataat

SEQ ID NO: 6590268 - DNA, 17 bp, Homo sapiens
tttatagttaataatct

SEQ ID NO: 6590269 - DNA, 14 bp, Homo sapiens
tttatagttaatct

SEQ ID NO: 6590270 - DNA, 17 bp, Homo sapiens
tttatagttaatctata

SEQ ID NO: 6590271 - DNA, 22 bp, Homo sapiens
tttatagttattaaatgtttca

SEQ ID NO: 6590272 - DNA, 13 bp, Homo sapiens
tttatagttgtat

SEQ ID NO: 6590273 - DNA, 15 bp, Homo sapiens
tttatataaagtatt

SEQ ID NO: 6590274 - DNA, 17 bp, Homo sapiens
tttatataaagtatttt

SEQ ID NO: 6590275 - DNA, 16 bp, Homo sapiens
tttatataactacatt

SEQ ID NO: 6590276 - DNA, 22 bp, Homo sapiens
tttatataagcccttaataata

SEQ ID NO: 6590277 - DNA, 14 bp, Homo sapiens
tttatataaggtca

SEQ ID NO: 6590278 - DNA, 14 bp, Homo sapiens
tttatataagtctg

SEQ ID NO: 6590279 - DNA, 15 bp, Homo sapiens
tttatataagtctgt

SEQ ID NO: 6590280 - DNA, 17 bp, Homo sapiens
tttatataagttaaaga

SEQ ID NO: 6590281 - DNA, 15 bp, Homo sapiens
tttatataataaagt

SEQ ID NO: 6590282 - DNA, 14 bp, Homo sapiens
tttatataatatct

SEQ ID NO: 6590283 - DNA, 17 bp, Homo sapiens
tttatataatatctaaa

SEQ ID NO: 6590284 - DNA, 14 bp, Homo sapiens
tttatataattatg

SEQ ID NO: 6590285 - DNA, 16 bp, Homo sapiens
tttatatacaataatg

SEQ ID NO: 6590286 - DNA, 14 bp, Homo sapiens
tttatatacgttta

SEQ ID NO: 6590287 - DNA, 17 bp, Homo sapiens
tttatatactgctattt

SEQ ID NO: 6590288 - DNA, 23 bp, Homo sapiens
tttatatactgggttcttgtttt

SEQ ID NO: 6590289 - DNA, 11 bp, Homo sapiens
tttatatactt

SEQ ID NO: 6590290 - DNA, 12 bp, Homo sapiens
tttatatacttt

SEQ ID NO: 6590291 - DNA, 18 bp, Homo sapiens
tttatatactttttcatg

SEQ ID NO: 6590292 - DNA, 21 bp, Homo sapiens
tttatatagatgtcagcaatt

SEQ ID NO: 6590293 - DNA, 13 bp, Homo sapiens
tttatatataaaa

SEQ ID NO: 6590294 - DNA, 21 bp, Homo sapiens
tttatatataaaataaatata

SEQ ID NO: 6590295 - DNA, 22 bp, Homo sapiens
tttatatatataaagtcagtga

SEQ ID NO: 6590296 - DNA, 19 bp, Homo sapiens
tttatatatatatataaag

SEQ ID NO: 6590297 - DNA, 20 bp, Homo sapiens
tttatatatatatgtatatg

SEQ ID NO: 6590298 - DNA, 14 bp, Homo sapiens
tttatatatatgca

SEQ ID NO: 6590299 - DNA, 18 bp, Homo sapiens
tttatatatctaagttca

SEQ ID NO: 6590300 - DNA, 19 bp, Homo sapiens
tttatatatctaagttcac

SEQ ID NO: 6590301 - DNA, 17 bp, Homo sapiens
tttatatatgaaaacta

SEQ ID NO: 6590302 - DNA, 22 bp, Homo sapiens
tttatatatgaatattacatgt

SEQ ID NO: 6590303 - DNA, 18 bp, Homo sapiens
tttatatatggacagctt

SEQ ID NO: 6590304 - DNA, 15 bp, Homo sapiens
tttatatatggacat

SEQ ID NO: 6590305 - DNA, 13 bp, Homo sapiens
tttatatatgtac

SEQ ID NO: 6590306 - DNA, 13 bp, Homo sapiens
tttatatatgtat

SEQ ID NO: 6590307 - DNA, 15 bp, Homo sapiens
tttatatattatatg

SEQ ID NO: 6590308 - DNA, 20 bp, Homo sapiens
tttatatattgtctgtaaaa

SEQ ID NO: 6590309 - DNA, 16 bp, Homo sapiens
tttatatatttataac

SEQ ID NO: 6590310 - DNA, 12 bp, Homo sapiens
tttatatatttg

SEQ ID NO: 6590311 - DNA, 15 bp, Homo sapiens
tttatatcacatgtt

SEQ ID NO: 6590312 - DNA, 15 bp, Homo sapiens
tttatatcactgtct

SEQ ID NO: 6590313 - DNA, 17 bp, Homo sapiens
tttatatcagcctgagt

SEQ ID NO: 6590314 - DNA, 18 bp, Homo sapiens
tttatatcaggtgtataa

SEQ ID NO: 6590315 - DNA, 21 bp, Homo sapiens
aatgacattaaatgcaataat

SEQ ID NO: 6590316 - DNA, 23 bp, Homo sapiens
aatgacattaaatgcaataattt

SEQ ID NO: 6590317 - DNA, 17 bp, Homo sapiens
aatgacattattaaagt

SEQ ID NO: 6590318 - DNA, 21 bp, Homo sapiens
aatgacatttcactaaaagtc

SEQ ID NO: 6590319 - DNA, 14 bp, Homo sapiens
aatgacattttact

SEQ ID NO: 6590320 - DNA, 13 bp, Homo sapiens
aatgacatttttg

SEQ ID NO: 6590321 - DNA, 17 bp, Homo sapiens
aatgaccaagaaaaaga

SEQ ID NO: 6590322 - DNA, 19 bp, Homo sapiens
aatgaccaagacaggttca

SEQ ID NO: 6590323 - DNA, 20 bp, Homo sapiens
aatgaccaagctcagttcaa

SEQ ID NO: 6590324 - DNA, 14 bp, Homo sapiens
aatgaccagcagca

SEQ ID NO: 6590325 - DNA, 18 bp, Homo sapiens
aatgaccagtaattgtga

SEQ ID NO: 6590326 - DNA, 13 bp, Homo sapiens
aatgaccagttta

SEQ ID NO: 6590327 - DNA, 15 bp, Homo sapiens
aatgaccattcaatt

SEQ ID NO: 6590328 - DNA, 12 bp, Homo sapiens
aatgacccaaac

SEQ ID NO: 6590329 - DNA, 18 bp, Homo sapiens
aatgacccagacccaact

SEQ ID NO: 6590330 - DNA, 19 bp, Homo sapiens
aatgacccagatatggaaa

SEQ ID NO: 6590331 - DNA, 14 bp, Homo sapiens
aatgaccctgtcaa

SEQ ID NO: 6590332 - DNA, 19 bp, Homo sapiens
aatgacccttttgtgtcta

SEQ ID NO: 6590333 - DNA, 15 bp, Homo sapiens
aatgaccgagccctg

SEQ ID NO: 6590334 - DNA, 16 bp, Homo sapiens
aatgacctcaagatgt

SEQ ID NO: 6590335 - DNA, 15 bp, Homo sapiens
aatgacctcaaggaa

SEQ ID NO: 6590336 - DNA, 21 bp, Homo sapiens
aatgacctccagggaatcaga

SEQ ID NO: 6590337 - DNA, 22 bp, Homo sapiens
aatgaccttcattctgagacca

SEQ ID NO: 6590338 - DNA, 13 bp, Homo sapiens
aatgaccttgtaa

SEQ ID NO: 6590339 - DNA, 14 bp, Homo sapiens
aatgaccttgtaat

SEQ ID NO: 6590340 - DNA, 19 bp, Homo sapiens
aatgaccttgtaatgtaac

SEQ ID NO: 6590341 - DNA, 21 bp, Homo sapiens
aatgaccttgtaatgtaactg

SEQ ID NO: 6590342 - DNA, 22 bp, Homo sapiens
aatgaccttgtaatgtaactgc

SEQ ID NO: 6590343 - DNA, 21 bp, Homo sapiens
aatgacctttcaataggaaaa

SEQ ID NO: 6590344 - DNA, 12 bp, Homo sapiens
aatgacgcctga

SEQ ID NO: 6590345 - DNA, 24 bp, Homo sapiens
aatgacggtaagtgttctcatgaa

SEQ ID NO: 6590346 - DNA, 23 bp, Homo sapiens
aatgacggtgttaattttgctaa

SEQ ID NO: 6590347 - DNA, 19 bp, Homo sapiens
aatgacgtattgtgaaatt

SEQ ID NO: 6590348 - DNA, 23 bp, Homo sapiens
aatgacgtattgtgaaatttgtt

SEQ ID NO: 6590349 - DNA, 16 bp, Homo sapiens
aatgacgtgtgtggct

SEQ ID NO: 6590350 - DNA, 24 bp, Homo sapiens
aatgactaaaaatattataactta

SEQ ID NO: 6590351 - DNA, 22 bp, Homo sapiens
aatgactaaagacctgctgtaa

SEQ ID NO: 6590352 - DNA, 20 bp, Homo sapiens
aatgactaagccaagctgtg

SEQ ID NO: 6590353 - DNA, 23 bp, Homo sapiens
aatgactaattagggtacattta

SEQ ID NO: 6590354 - DNA, 17 bp, Homo sapiens
aatgactaattcttgca

SEQ ID NO: 6590355 - DNA, 23 bp, Homo sapiens
aatgactatataatttatttcca

SEQ ID NO: 6590356 - DNA, 16 bp, Homo sapiens
aatgactatgtccaga

SEQ ID NO: 6590357 - DNA, 19 bp, Homo sapiens
aatgactattgtaatgcca

SEQ ID NO: 6590358 - DNA, 20 bp, Homo sapiens
aatgactcaggacatccccc

SEQ ID NO: 6590359 - DNA, 19 bp, Homo sapiens
aatgactccactgtttttc

SEQ ID NO: 6590360 - DNA, 14 bp, Homo sapiens
aatgactccaggaa

SEQ ID NO: 6590361 - DNA, 17 bp, Homo sapiens
aatgactctctgaccct

SEQ ID NO: 6590362 - DNA, 16 bp, Homo sapiens
aatgactctttctgaa

SEQ ID NO: 6590363 - DNA, 21 bp, Homo sapiens
aatgactctttctgaaggaag

SEQ ID NO: 6590364 - DNA, 13 bp, Homo sapiens
aatgactgaaaga

SEQ ID NO: 6590365 - DNA, 21 bp, Homo sapiens
aatgactgaaagaagaacagc

SEQ ID NO: 6590366 - DNA, 13 bp, Homo sapiens
aatgactgaagac

SEQ ID NO: 6590367 - DNA, 15 bp, Homo sapiens
aatgactggctcctg

SEQ ID NO: 6590368 - DNA, 19 bp, Homo sapiens
aatgactggtcttccttac

SEQ ID NO: 6590369 - DNA, 22 bp, Homo sapiens
aatgactggtcttccttacctg

SEQ ID NO: 6590370 - DNA, 13 bp, Homo sapiens
aatgactgtggtg

SEQ ID NO: 6590371 - DNA, 16 bp, Homo sapiens
aatgacttattgatta

SEQ ID NO: 6590372 - DNA, 23 bp, Homo sapiens
aatgacttattgtggataacaaa

SEQ ID NO: 6590373 - DNA, 24 bp, Homo sapiens
aatgacttattgtggataacaaag

SEQ ID NO: 6590374 - DNA, 15 bp, Homo sapiens
aatgacttcatttct

SEQ ID NO: 6590375 - DNA, 13 bp, Homo sapiens
aatgacttctaat

SEQ ID NO: 6590376 - DNA, 19 bp, Homo sapiens
aatgacttctaatttatat

SEQ ID NO: 6590377 - DNA, 18 bp, Homo sapiens
aatgacttgattgtactt

SEQ ID NO: 6590378 - DNA, 23 bp, Homo sapiens
aatgacttgtacaaacagtattt

SEQ ID NO: 6590379 - DNA, 17 bp, Homo sapiens
aatgactttattattta

SEQ ID NO: 6590380 - DNA, 17 bp, Homo sapiens
aatgactttgaactgaa

SEQ ID NO: 6590381 - DNA, 13 bp, Homo sapiens
aatgacttttaaa

SEQ ID NO: 6590382 - DNA, 21 bp, Homo sapiens
aatgacttttgaattacagag

SEQ ID NO: 6590383 - DNA, 18 bp, Homo sapiens
aatgactttttataatgt

SEQ ID NO: 6590384 - DNA, 14 bp, Homo sapiens
aatgagaaaaataa

SEQ ID NO: 6590385 - DNA, 20 bp, Homo sapiens
aatgagaaaatgtctttatt

SEQ ID NO: 6590386 - DNA, 12 bp, Homo sapiens
aatgagaaagga

SEQ ID NO: 6590387 - DNA, 15 bp, Homo sapiens
aatgagaaatcatgt

SEQ ID NO: 6590388 - DNA, 13 bp, Homo sapiens
aatgagaaatgga

SEQ ID NO: 6590389 - DNA, 22 bp, Homo sapiens
aatgagaaattgtgccaaagat

SEQ ID NO: 6590390 - DNA, 14 bp, Homo sapiens
aatgagaacattta

SEQ ID NO: 6590391 - DNA, 16 bp, Homo sapiens
aatgagaacatttaca

SEQ ID NO: 6590392 - DNA, 15 bp, Homo sapiens
aatgagaacttcaat

SEQ ID NO: 6590393 - DNA, 22 bp, Homo sapiens
aatgagaagaaaatggaaccag

SEQ ID NO: 6590394 - DNA, 22 bp, Homo sapiens
aatgagaaggccaatagtttta

SEQ ID NO: 6590395 - DNA, 14 bp, Homo sapiens
aatgagaatagaaa

SEQ ID NO: 6590396 - DNA, 19 bp, Homo sapiens
aatgagaattttatattct

SEQ ID NO: 6590397 - DNA, 14 bp, Homo sapiens
aatgagacatccag

SEQ ID NO: 6590398 - DNA, 15 bp, Homo sapiens
aatgagacatccagc

SEQ ID NO: 6590399 - DNA, 15 bp, Homo sapiens
aatgagacgaaatgc

SEQ ID NO: 6590400 - DNA, 22 bp, Homo sapiens
aatgagacgaaatgctgatgta

SEQ ID NO: 6590401 - DNA, 18 bp, Homo sapiens
aatgagacttactgggtg

SEQ ID NO: 6590402 - DNA, 17 bp, Homo sapiens
aatgagacttgccttcc

SEQ ID NO: 6590403 - DNA, 16 bp, Homo sapiens
aatgagactttaaaag

SEQ ID NO: 6590404 - DNA, 22 bp, Homo sapiens
aatgagagacacactgaagaag

SEQ ID NO: 6590405 - DNA, 10 bp, Homo sapiens
aatgagagag

SEQ ID NO: 6590406 - DNA, 20 bp, Homo sapiens
aatgagagagagactgtgtg

SEQ ID NO: 6590407 - DNA, 16 bp, Homo sapiens
aatgagagagtgtgga

SEQ ID NO: 6590408 - DNA, 17 bp, Homo sapiens
aatgagagagtgtggaa

SEQ ID NO: 6590409 - DNA, 12 bp, Homo sapiens
aatgagagcata

SEQ ID NO: 6590410 - DNA, 17 bp, Homo sapiens
aatgagagcgacacaga

SEQ ID NO: 6590411 - DNA, 22 bp, Homo sapiens
aatgagagcgacacagacgtta

SEQ ID NO: 6590412 - DNA, 18 bp, Homo sapiens
aatgagaggaaaagaaaa

SEQ ID NO: 6590413 - DNA, 23 bp, Homo sapiens
aatgagagggcagtgtttccttt

SEQ ID NO: 6590414 - DNA, 18 bp, Homo sapiens
aatgagagttccttctca

SEQ ID NO: 6590415 - DNA, 19 bp, Homo sapiens
aatgagagttccttctcac

SEQ ID NO: 6590416 - DNA, 16 bp, Homo sapiens
aatgagatagtagcat

SEQ ID NO: 6590417 - DNA, 22 bp, Homo sapiens
aatgagatatatctttatactt

SEQ ID NO: 6590418 - DNA, 21 bp, Homo sapiens
aatgagatatgcaataaatat

SEQ ID NO: 6590419 - DNA, 15 bp, Homo sapiens
aatgagatatttgta

SEQ ID NO: 6590420 - DNA, 18 bp, Homo sapiens
aatgagatatttgtattt

SEQ ID NO: 6590421 - DNA, 14 bp, Homo sapiens
aatgagatgcatga

SEQ ID NO: 6590422 - DNA, 17 bp, Homo sapiens
aatgagattaattcctt

SEQ ID NO: 6590423 - DNA, 18 bp, Homo sapiens
aatgagattatatgtgga

SEQ ID NO: 6590424 - DNA, 17 bp, Homo sapiens
aatgagatttcttattt

SEQ ID NO: 6590425 - DNA, 23 bp, Homo sapiens
aatgagcacccattccaaagctt

SEQ ID NO: 6590426 - DNA, 18 bp, Homo sapiens
aatgagcagctttagcaa

SEQ ID NO: 6590427 - DNA, 12 bp, Homo sapiens
aatgagcatgtt

SEQ ID NO: 6590428 - DNA, 22 bp, Homo sapiens
aatgagcatgtttagactttaa

SEQ ID NO: 6590429 - DNA, 16 bp, Homo sapiens
aatgagccattttttg

SEQ ID NO: 6590430 - DNA, 19 bp, Homo sapiens
aatgagcccagagaacagc

SEQ ID NO: 6590431 - DNA, 12 bp, Homo sapiens
aatgagccctgg

SEQ ID NO: 6590432 - DNA, 13 bp, Homo sapiens
aatgagcctggca

SEQ ID NO: 6590433 - DNA, 14 bp, Homo sapiens
aatgagcctgtaat

SEQ ID NO: 6590434 - DNA, 16 bp, Homo sapiens
aatgagcgttaacaca

SEQ ID NO: 6590435 - DNA, 20 bp, Homo sapiens
aatgagctacttcttattca

SEQ ID NO: 6590436 - DNA, 18 bp, Homo sapiens
aatgagctattaaaactc

SEQ ID NO: 6590437 - DNA, 21 bp, Homo sapiens
aatgagctcaaattgattttt

SEQ ID NO: 6590438 - DNA, 22 bp, Homo sapiens
aatgagctcgcatttgtcaatg

SEQ ID NO: 6590439 - DNA, 15 bp, Homo sapiens
aatgagcttaatgtc

SEQ ID NO: 6590440 - DNA, 18 bp, Homo sapiens
aatgagcttgattaaatc

SEQ ID NO: 6590441 - DNA, 18 bp, Homo sapiens
aatgagcttgtaaatact

SEQ ID NO: 6590442 - DNA, 13 bp, Homo sapiens
aatgagctttctg

SEQ ID NO: 6590443 - DNA, 14 bp, Homo sapiens
aatgagctttctga

SEQ ID NO: 6590444 - DNA, 15 bp, Homo sapiens
aatgagctttctgaa

SEQ ID NO: 6590445 - DNA, 20 bp, Homo sapiens
aatgagctttctgaacagct

SEQ ID NO: 6590446 - DNA, 23 bp, Homo sapiens
aatgagctttctgaacagctggt

SEQ ID NO: 6590447 - DNA, 17 bp, Homo sapiens
aatgaggaaaattctta

SEQ ID NO: 6590448 - DNA, 18 bp, Homo sapiens
aatgaggaatagttttct

SEQ ID NO: 6590449 - DNA, 16 bp, Homo sapiens
aatgaggacatgtttt

SEQ ID NO: 6590450 - DNA, 16 bp, Homo sapiens
aatgaggagagaaaat

SEQ ID NO: 6590451 - DNA, 18 bp, Homo sapiens
aatgaggagagaaggaca

SEQ ID NO: 6590452 - DNA, 18 bp, Homo sapiens
aatgaggaggaaggagag

SEQ ID NO: 6590453 - DNA, 18 bp, Homo sapiens
aatgaggaggtacattga

SEQ ID NO: 6590454 - DNA, 19 bp, Homo sapiens
aatgaggaggtacattgaa

SEQ ID NO: 6590455 - DNA, 12 bp, Homo sapiens
aatgaggatcca

SEQ ID NO: 6590456 - DNA, 19 bp, Homo sapiens
aatgaggatccagggcagc

SEQ ID NO: 6590457 - DNA, 15 bp, Homo sapiens
aatgaggattattga

SEQ ID NO: 6590458 - DNA, 17 bp, Homo sapiens
aatgaggattattgata

SEQ ID NO: 6590459 - DNA, 16 bp, Homo sapiens
aatgaggccatggact

SEQ ID NO: 6590460 - DNA, 17 bp, Homo sapiens
aatgaggccggacagag

SEQ ID NO: 6590461 - DNA, 13 bp, Homo sapiens
aatgaggcttgct

SEQ ID NO: 6590462 - DNA, 24 bp, Homo sapiens
aatgaggcttggggctggagagga

SEQ ID NO: 6590463 - DNA, 22 bp, Homo sapiens
aatgagggaaacaaaatattta

SEQ ID NO: 6590464 - DNA, 18 bp, Homo sapiens
aatgagggaaatctgtaa

SEQ ID NO: 6590465 - DNA, 21 bp, Homo sapiens
aatgagggactggaaccaggg

SEQ ID NO: 6590466 - DNA, 20 bp, Homo sapiens
aatgagggcgtgaaacacaa

SEQ ID NO: 6590467 - DNA, 23 bp, Homo sapiens
aatgagggcgtgaaacacaatat

SEQ ID NO: 6590468 - DNA, 15 bp, Homo sapiens
aatgagggtttctga

SEQ ID NO: 6590469 - DNA, 23 bp, Homo sapiens
aatgagggtttctgatctgtact

SEQ ID NO: 6590470 - DNA, 18 bp, Homo sapiens
aatgaggtcagagcctgc

SEQ ID NO: 6590471 - DNA, 15 bp, Homo sapiens
aatgaggtcccaggc

SEQ ID NO: 6590472 - DNA, 14 bp, Homo sapiens
aatgaggtctgttt

SEQ ID NO: 6590473 - DNA, 17 bp, Homo sapiens
aatgaggttatgagaaa

SEQ ID NO: 6590474 - DNA, 21 bp, Homo sapiens
aatgaggttatgagaaaaaaa

SEQ ID NO: 6590475 - DNA, 21 bp, Homo sapiens
aatgaggttgggggaaccagc

SEQ ID NO: 6590476 - DNA, 18 bp, Homo sapiens
aatgagtaaaaactagaa

SEQ ID NO: 6590477 - DNA, 23 bp, Homo sapiens
aatgagtaaaaactagaaggctt

SEQ ID NO: 6590478 - DNA, 15 bp, Homo sapiens
aatgagtaaaatcac

SEQ ID NO: 6590479 - DNA, 13 bp, Homo sapiens
aatgagtaaataa

SEQ ID NO: 6590480 - DNA, 21 bp, Homo sapiens
aatgagtaaataaactcttca

SEQ ID NO: 6590481 - DNA, 17 bp, Homo sapiens
aatgagtaacatttgct

SEQ ID NO: 6590482 - DNA, 19 bp, Homo sapiens
aatgagtaacatttgctgt

SEQ ID NO: 6590483 - DNA, 20 bp, Homo sapiens
aatgagtaatgcagacattt

SEQ ID NO: 6590484 - DNA, 21 bp, Homo sapiens
aatgagtaatgcagacattta

SEQ ID NO: 6590485 - DNA, 18 bp, Homo sapiens
aatgagtaggatgtctct

SEQ ID NO: 6590486 - DNA, 21 bp, Homo sapiens
aatgagtatatgtaacagttt

SEQ ID NO: 6590487 - DNA, 21 bp, Homo sapiens
aatgagtcaatcagcctttag

SEQ ID NO: 6590488 - DNA, 16 bp, Homo sapiens
aatgagtcacaaaata

SEQ ID NO: 6590489 - DNA, 18 bp, Homo sapiens
aatgagtcaccattcttc

SEQ ID NO: 6590490 - DNA, 20 bp, Homo sapiens
aatgagtcaggcaattgatt

SEQ ID NO: 6590491 - DNA, 16 bp, Homo sapiens
aatgagtcatttgttt

SEQ ID NO: 6590492 - DNA, 19 bp, Homo sapiens
tttatatcatacagttttc

SEQ ID NO: 6590493 - DNA, 18 bp, Homo sapiens
tttatatcattttaaaat

SEQ ID NO: 6590494 - DNA, 21 bp, Homo sapiens
tttatatcattttaaaatgtc

SEQ ID NO: 6590495 - DNA, 13 bp, Homo sapiens
tttatatccattt

SEQ ID NO: 6590496 - DNA, 17 bp, Homo sapiens
tttatatcccattttta

SEQ ID NO: 6590497 - DNA, 14 bp, Homo sapiens
tttatatctggaat

SEQ ID NO: 6590498 - DNA, 16 bp, Homo sapiens
tttatatctgtaaatt

SEQ ID NO: 6590499 - DNA, 18 bp, Homo sapiens
tttatatctgtaatgata

SEQ ID NO: 6590500 - DNA, 16 bp, Homo sapiens
tttatatctgtatgta

SEQ ID NO: 6590501 - DNA, 13 bp, Homo sapiens
tttatatcttgtt

SEQ ID NO: 6590502 - DNA, 17 bp, Homo sapiens
tttatatcttgtttaca

SEQ ID NO: 6590503 - DNA, 14 bp, Homo sapiens
tttatatgaaaaca

SEQ ID NO: 6590504 - DNA, 20 bp, Homo sapiens
tttatatgaaatgtttcact

SEQ ID NO: 6590505 - DNA, 14 bp, Homo sapiens
tttatatgattaaa

SEQ ID NO: 6590506 - DNA, 15 bp, Homo sapiens
tttatatgattaaat

SEQ ID NO: 6590507 - DNA, 11 bp, Homo sapiens
tttatatgcat

SEQ ID NO: 6590508 - DNA, 19 bp, Homo sapiens
tttatatgcttctgtttta

SEQ ID NO: 6590509 - DNA, 18 bp, Homo sapiens
tttatatggcccagcctt

SEQ ID NO: 6590510 - DNA, 18 bp, Homo sapiens
tttatatgggtttatttt

SEQ ID NO: 6590511 - DNA, 16 bp, Homo sapiens
tttatatgtaaatgtg

SEQ ID NO: 6590512 - DNA, 13 bp, Homo sapiens
tttatatgtacat

SEQ ID NO: 6590513 - DNA, 20 bp, Homo sapiens
tttatatgtacatacatata

SEQ ID NO: 6590514 - DNA, 17 bp, Homo sapiens
tttatatgtatccagta

SEQ ID NO: 6590515 - DNA, 12 bp, Homo sapiens
tttatatgtctt

SEQ ID NO: 6590516 - DNA, 17 bp, Homo sapiens
tttatatgtcttgcaaa

SEQ ID NO: 6590517 - DNA, 16 bp, Homo sapiens
tttatattaatgtact

SEQ ID NO: 6590518 - DNA, 23 bp, Homo sapiens
tttatattaatttgtttttctta

SEQ ID NO: 6590519 - DNA, 16 bp, Homo sapiens
tttatattactctcat

SEQ ID NO: 6590520 - DNA, 20 bp, Homo sapiens
tttatattagataaccatat

SEQ ID NO: 6590521 - DNA, 16 bp, Homo sapiens
tttatattagttgctt

SEQ ID NO: 6590522 - DNA, 23 bp, Homo sapiens
tttatattataactctgtataat

SEQ ID NO: 6590523 - DNA, 22 bp, Homo sapiens
tttatattccgtatttaaagtt

SEQ ID NO: 6590524 - DNA, 21 bp, Homo sapiens
tttatattgcagattgaatat

SEQ ID NO: 6590525 - DNA, 19 bp, Homo sapiens
tttatattgtggaataaat

SEQ ID NO: 6590526 - DNA, 13 bp, Homo sapiens
tttatatttaaat

SEQ ID NO: 6590527 - DNA, 17 bp, Homo sapiens
tttatatttaattatta

SEQ ID NO: 6590528 - DNA, 16 bp, Homo sapiens
tttatatttactaaaa

SEQ ID NO: 6590529 - DNA, 14 bp, Homo sapiens
tttatatttagtga

SEQ ID NO: 6590530 - DNA, 14 bp, Homo sapiens
tttatatttagtta

SEQ ID NO: 6590531 - DNA, 14 bp, Homo sapiens
tttatatttatcca

SEQ ID NO: 6590532 - DNA, 19 bp, Homo sapiens
tttatatttattgttagaa

SEQ ID NO: 6590533 - DNA, 14 bp, Homo sapiens
tttatatttcaagt

SEQ ID NO: 6590534 - DNA, 18 bp, Homo sapiens
tttatatttcaagtacac

SEQ ID NO: 6590535 - DNA, 20 bp, Homo sapiens
tttatatttcaagtacactg

SEQ ID NO: 6590536 - DNA, 15 bp, Homo sapiens
tttatatttccttta

SEQ ID NO: 6590537 - DNA, 18 bp, Homo sapiens
tttatatttcctttatgt

SEQ ID NO: 6590538 - DNA, 20 bp, Homo sapiens
tttatatttcctttatgtga

SEQ ID NO: 6590539 - DNA, 22 bp, Homo sapiens
tttatatttcctttatgtgaat

SEQ ID NO: 6590540 - DNA, 23 bp, Homo sapiens
tttatatttgagttgtgattgaa

SEQ ID NO: 6590541 - DNA, 14 bp, Homo sapiens
tttatatttggaaa

SEQ ID NO: 6590542 - DNA, 19 bp, Homo sapiens
tttatattttatactgcac

SEQ ID NO: 6590543 - DNA, 13 bp, Homo sapiens
tttatattttccc

SEQ ID NO: 6590544 - DNA, 20 bp, Homo sapiens
tttatattttctatatttgt

SEQ ID NO: 6590545 - DNA, 12 bp, Homo sapiens
tttatattttta

SEQ ID NO: 6590546 - DNA, 17 bp, Homo sapiens
tttatatttttgtacat

SEQ ID NO: 6590547 - DNA, 19 bp, Homo sapiens
tttatatttttttaactgt

SEQ ID NO: 6590548 - DNA, 14 bp, Homo sapiens
tttatcaaagcata

SEQ ID NO: 6590549 - DNA, 22 bp, Homo sapiens
tttatcaaagcatagatgtttt

SEQ ID NO: 6590550 - DNA, 16 bp, Homo sapiens
tttatcaactgtcaaa

SEQ ID NO: 6590551 - DNA, 14 bp, Homo sapiens
tttatcaagcattt

SEQ ID NO: 6590552 - DNA, 14 bp, Homo sapiens
tttatcaaggaagt

SEQ ID NO: 6590553 - DNA, 23 bp, Homo sapiens
tttatcaaggaagtcttcaaatt

SEQ ID NO: 6590554 - DNA, 16 bp, Homo sapiens
tttatcaatgtgtctt

SEQ ID NO: 6590555 - DNA, 22 bp, Homo sapiens
tttatcacaaccaccgttacaa

SEQ ID NO: 6590556 - DNA, 15 bp, Homo sapiens
tttatcacacttctg

SEQ ID NO: 6590557 - DNA, 17 bp, Homo sapiens
tttatcacacttctgtg

SEQ ID NO: 6590558 - DNA, 18 bp, Homo sapiens
tttatcacatgtatgttt

SEQ ID NO: 6590559 - DNA, 22 bp, Homo sapiens
tttatcacatgtatgttttggt

SEQ ID NO: 6590560 - DNA, 17 bp, Homo sapiens
tttatcacctcattctg

SEQ ID NO: 6590561 - DNA, 22 bp, Homo sapiens
tttatcactttttgaactaaga

SEQ ID NO: 6590562 - DNA, 17 bp, Homo sapiens
tttatcagaactatgtt

SEQ ID NO: 6590563 - DNA, 15 bp, Homo sapiens
tttatcagaagcaag

SEQ ID NO: 6590564 - DNA, 21 bp, Homo sapiens
tttatcagatacatcactgct

SEQ ID NO: 6590565 - DNA, 21 bp, Homo sapiens
tttatcagatattttcatatt

SEQ ID NO: 6590566 - DNA, 14 bp, Homo sapiens
tttatcagattgct

SEQ ID NO: 6590567 - DNA, 23 bp, Homo sapiens
tttatcagattgcttttgtgcat

SEQ ID NO: 6590568 - DNA, 14 bp, Homo sapiens
tttatcagcaaaaa

SEQ ID NO: 6590569 - DNA, 19 bp, Homo sapiens
tttatcaggggaatttcag

SEQ ID NO: 6590570 - DNA, 19 bp, Homo sapiens
tttatcatcctttcagttt

SEQ ID NO: 6590571 - DNA, 17 bp, Homo sapiens
tttatcatgaatgcttt

SEQ ID NO: 6590572 - DNA, 22 bp, Homo sapiens
tttatcatgaattcccttttaa

SEQ ID NO: 6590573 - DNA, 15 bp, Homo sapiens
tttatcatgacatgt

SEQ ID NO: 6590574 - DNA, 17 bp, Homo sapiens
tttatcatggtcctgaa

SEQ ID NO: 6590575 - DNA, 23 bp, Homo sapiens
tttatcatgtcgtaggtaaacta

SEQ ID NO: 6590576 - DNA, 17 bp, Homo sapiens
tttatcattaattttta

SEQ ID NO: 6590577 - DNA, 19 bp, Homo sapiens
tttatcattgaaacattta

SEQ ID NO: 6590578 - DNA, 18 bp, Homo sapiens
tttatcatttctactgaa

SEQ ID NO: 6590579 - DNA, 12 bp, Homo sapiens
tttatcattttc

SEQ ID NO: 6590580 - DNA, 15 bp, Homo sapiens
tttatccaaatcttg

SEQ ID NO: 6590581 - DNA, 17 bp, Homo sapiens
tttatccaatcctcagg

SEQ ID NO: 6590582 - DNA, 18 bp, Homo sapiens
tttatccaatcctcagga

SEQ ID NO: 6590583 - DNA, 11 bp, Homo sapiens
tttatccacat

SEQ ID NO: 6590584 - DNA, 18 bp, Homo sapiens
tttatccacattgtagcc

SEQ ID NO: 6590585 - DNA, 20 bp, Homo sapiens
tttatccagatgaactgaga

SEQ ID NO: 6590586 - DNA, 13 bp, Homo sapiens
tttatccataatg

SEQ ID NO: 6590587 - DNA, 13 bp, Homo sapiens
tttatccatttct

SEQ ID NO: 6590588 - DNA, 18 bp, Homo sapiens
tttatcccaaagttgttg

SEQ ID NO: 6590589 - DNA, 21 bp, Homo sapiens
tttatcccaaagttgttgtaa

SEQ ID NO: 6590590 - DNA, 17 bp, Homo sapiens
tttatcccacggaaaat

SEQ ID NO: 6590591 - DNA, 15 bp, Homo sapiens
tttatcccatttagt

SEQ ID NO: 6590592 - DNA, 15 bp, Homo sapiens
tttatcccttcctgt

SEQ ID NO: 6590593 - DNA, 17 bp, Homo sapiens
tttatccctttacaatg

SEQ ID NO: 6590594 - DNA, 23 bp, Homo sapiens
tttatccctttacaatgtgaata

SEQ ID NO: 6590595 - DNA, 14 bp, Homo sapiens
tttatccctttcct

SEQ ID NO: 6590596 - DNA, 15 bp, Homo sapiens
tttatccctttcctg

SEQ ID NO: 6590597 - DNA, 17 bp, Homo sapiens
tttatccgtagttttga

SEQ ID NO: 6590598 - DNA, 17 bp, Homo sapiens
tttatcctaaaaatctg

SEQ ID NO: 6590599 - DNA, 23 bp, Homo sapiens
tttatcctagtcattcttcccta

SEQ ID NO: 6590600 - DNA, 21 bp, Homo sapiens
tttatcctagttccattcttg

SEQ ID NO: 6590601 - DNA, 19 bp, Homo sapiens
tttatcctgaaatttcaga

SEQ ID NO: 6590602 - DNA, 20 bp, Homo sapiens
tttatcctggccttgtactt

SEQ ID NO: 6590603 - DNA, 23 bp, Homo sapiens
tttatcctgtattcttgtttgaa

SEQ ID NO: 6590604 - DNA, 15 bp, Homo sapiens
tttatccttaagaat

SEQ ID NO: 6590605 - DNA, 21 bp, Homo sapiens
tttatccttacaatgtgaata

SEQ ID NO: 6590606 - DNA, 23 bp, Homo sapiens
tttatccttacaatgtgaataat

SEQ ID NO: 6590607 - DNA, 14 bp, Homo sapiens
tttatccttaggaa

SEQ ID NO: 6590608 - DNA, 21 bp, Homo sapiens
tttatccttcaccagcaactc

SEQ ID NO: 6590609 - DNA, 14 bp, Homo sapiens
tttatccttccttt

SEQ ID NO: 6590610 - DNA, 20 bp, Homo sapiens
tttatcgccattccaggggc

SEQ ID NO: 6590611 - DNA, 21 bp, Homo sapiens
tttatcgccattccaggggcc

SEQ ID NO: 6590612 - DNA, 16 bp, Homo sapiens
tttatcgctaaatgac

SEQ ID NO: 6590613 - DNA, 15 bp, Homo sapiens
tttatcgctgggaaa

SEQ ID NO: 6590614 - DNA, 15 bp, Homo sapiens
tttatctaaattaaa

SEQ ID NO: 6590615 - DNA, 17 bp, Homo sapiens
tttatctagatgtaaat

SEQ ID NO: 6590616 - DNA, 19 bp, Homo sapiens
tttatctataatttaccta

SEQ ID NO: 6590617 - DNA, 20 bp, Homo sapiens
tttatctatataaaataact

SEQ ID NO: 6590618 - DNA, 13 bp, Homo sapiens
tttatctattgta

SEQ ID NO: 6590619 - DNA, 14 bp, Homo sapiens
tttatctattgtaa

SEQ ID NO: 6590620 - DNA, 12 bp, Homo sapiens
tttatctcctgc

SEQ ID NO: 6590621 - DNA, 20 bp, Homo sapiens
tttatctcctgtctacagtt

SEQ ID NO: 6590622 - DNA, 13 bp, Homo sapiens
tttatctcctgtg

SEQ ID NO: 6590623 - DNA, 19 bp, Homo sapiens
tttatctccttgtggccta

SEQ ID NO: 6590624 - DNA, 13 bp, Homo sapiens
tttatctctattt

SEQ ID NO: 6590625 - DNA, 16 bp, Homo sapiens
tttatctgaattttta

SEQ ID NO: 6590626 - DNA, 19 bp, Homo sapiens
tttatctgcctctcttgta

SEQ ID NO: 6590627 - DNA, 17 bp, Homo sapiens
tttatctgggattatgg

SEQ ID NO: 6590628 - DNA, 18 bp, Homo sapiens
tttatctggtatggtgct

SEQ ID NO: 6590629 - DNA, 16 bp, Homo sapiens
tttatctgtaattgta

SEQ ID NO: 6590630 - DNA, 16 bp, Homo sapiens
tttatctgtagtaaac

SEQ ID NO: 6590631 - DNA, 19 bp, Homo sapiens
tttatctgtagtaaactat

SEQ ID NO: 6590632 - DNA, 11 bp, Homo sapiens
tttatctgtat

SEQ ID NO: 6590633 - DNA, 23 bp, Homo sapiens
tttatctgtataagctgtaatat

SEQ ID NO: 6590634 - DNA, 21 bp, Homo sapiens
tttatctgtattttttacagt

SEQ ID NO: 6590635 - DNA, 15 bp, Homo sapiens
tttatctgtcacaca

SEQ ID NO: 6590636 - DNA, 22 bp, Homo sapiens
tttatctgtgaatcctttgtac

SEQ ID NO: 6590637 - DNA, 17 bp, Homo sapiens
tttatcttaattgcaag

SEQ ID NO: 6590638 - DNA, 12 bp, Homo sapiens
tttatcttctgt

SEQ ID NO: 6590639 - DNA, 15 bp, Homo sapiens
tttatcttctgtttt

SEQ ID NO: 6590640 - DNA, 23 bp, Homo sapiens
tttatcttctgtttttctcaaat

SEQ ID NO: 6590641 - DNA, 17 bp, Homo sapiens
tttatcttgaaggaaaa

SEQ ID NO: 6590642 - DNA, 21 bp, Homo sapiens
tttatcttgaaggaaaaattc

SEQ ID NO: 6590643 - DNA, 21 bp, Homo sapiens
tttatcttggactgacattta

SEQ ID NO: 6590644 - DNA, 15 bp, Homo sapiens
tttatcttgggactg

SEQ ID NO: 6590645 - DNA, 14 bp, Homo sapiens
tttatcttgtctct

SEQ ID NO: 6590646 - DNA, 12 bp, Homo sapiens
tttatctttata

SEQ ID NO: 6590647 - DNA, 18 bp, Homo sapiens
tttatctttatatgaaga

SEQ ID NO: 6590648 - DNA, 19 bp, Homo sapiens
tttatctttgattctcctt

SEQ ID NO: 6590649 - DNA, 15 bp, Homo sapiens
tttatctttgtattc

SEQ ID NO: 6590650 - DNA, 15 bp, Homo sapiens
tttatctttgtgtaa

SEQ ID NO: 6590651 - DNA, 12 bp, Homo sapiens
tttatcttttaa

SEQ ID NO: 6590652 - DNA, 12 bp, Homo sapiens
tttatcttttta

SEQ ID NO: 6590653 - DNA, 17 bp, Homo sapiens
tttatgaaaaaaatata

SEQ ID NO: 6590654 - DNA, 16 bp, Homo sapiens
tttatgaaaataaata

SEQ ID NO: 6590655 - DNA, 17 bp, Homo sapiens
tttatgaaacagaaaag

SEQ ID NO: 6590656 - DNA, 18 bp, Homo sapiens
tttatgaaaggtttacat

SEQ ID NO: 6590657 - DNA, 16 bp, Homo sapiens
tttatgaacagaaata

SEQ ID NO: 6590658 - DNA, 16 bp, Homo sapiens
tttatgaactgcatca

SEQ ID NO: 6590659 - DNA, 22 bp, Homo sapiens
tttatgaagaaaaaatacattt

SEQ ID NO: 6590660 - DNA, 16 bp, Homo sapiens
tttatgaagaaaatac

SEQ ID NO: 6590661 - DNA, 14 bp, Homo sapiens
tttatgaagatagt

SEQ ID NO: 6590662 - DNA, 22 bp, Homo sapiens
tttatgaagtttttattttaaa

SEQ ID NO: 6590663 - DNA, 14 bp, Homo sapiens
tttatgaatataat

SEQ ID NO: 6590664 - DNA, 21 bp, Homo sapiens
tttatgaatgtgcatttcttg

SEQ ID NO: 6590665 - DNA, 16 bp, Homo sapiens
tttatgaattaaagta

SEQ ID NO: 6590666 - DNA, 17 bp, Homo sapiens
tttatgaattgtctaaa

SEQ ID NO: 6590667 - DNA, 22 bp, Homo sapiens
tttatgacacaatgacacattt

SEQ ID NO: 6590668 - DNA, 15 bp, Homo sapiens
tttatgacagtaatt

SEQ ID NO: 6590669 - DNA, 16 bp, Homo sapiens
tttatgacagtaattg

SEQ ID NO: 6590670 - DNA, 19 bp, Homo sapiens
tttatgacagtaattgtgt

SEQ ID NO: 6590671 - DNA, 22 bp, Homo sapiens
aatgagtcatttgtttaaacaa

SEQ ID NO: 6590672 - DNA, 20 bp, Homo sapiens
aatgagtctgtttgaaatgc

SEQ ID NO: 6590673 - DNA, 18 bp, Homo sapiens
aatgagtgataaatttgg

SEQ ID NO: 6590674 - DNA, 14 bp, Homo sapiens
aatgagtggccagc

SEQ ID NO: 6590675 - DNA, 14 bp, Homo sapiens
aatgagtgggaatc

SEQ ID NO: 6590676 - DNA, 14 bp, Homo sapiens
aatgagttcccttg

SEQ ID NO: 6590677 - DNA, 17 bp, Homo sapiens
aatgagttgctggaaaa

SEQ ID NO: 6590678 - DNA, 19 bp, Homo sapiens
aatgagttgctggaaaatc

SEQ ID NO: 6590679 - DNA, 20 bp, Homo sapiens
aatgagtttccagctaagcc

SEQ ID NO: 6590680 - DNA, 22 bp, Homo sapiens
aatgagtttcttagacttttcc

SEQ ID NO: 6590681 - DNA, 17 bp, Homo sapiens
aatgagttttacattac

SEQ ID NO: 6590682 - DNA, 21 bp, Homo sapiens
aatgagtttttatggggctga

SEQ ID NO: 6590683 - DNA, 14 bp, Homo sapiens
aatgataaatgtac

SEQ ID NO: 6590684 - DNA, 17 bp, Homo sapiens
aatgataaatttaaatg

SEQ ID NO: 6590685 - DNA, 14 bp, Homo sapiens
aatgataactggaa

SEQ ID NO: 6590686 - DNA, 20 bp, Homo sapiens
aatgataactggaaacttca

SEQ ID NO: 6590687 - DNA, 23 bp, Homo sapiens
aatgataatgctaattttattat

SEQ ID NO: 6590688 - DNA, 17 bp, Homo sapiens
aatgatacccaacagtt

SEQ ID NO: 6590689 - DNA, 17 bp, Homo sapiens
aatgatactgattatga

SEQ ID NO: 6590690 - DNA, 18 bp, Homo sapiens
aatgatactgattatgaa

SEQ ID NO: 6590691 - DNA, 19 bp, Homo sapiens
aatgatactgattatgaaa

SEQ ID NO: 6590692 - DNA, 20 bp, Homo sapiens
aatgatactgtctaagaata

SEQ ID NO: 6590693 - DNA, 21 bp, Homo sapiens
aatgatactgtctaagaataa

SEQ ID NO: 6590694 - DNA, 15 bp, Homo sapiens
aatgatactgtgtgt

SEQ ID NO: 6590695 - DNA, 22 bp, Homo sapiens
aatgatactgtgtgttttccca

SEQ ID NO: 6590696 - DNA, 15 bp, Homo sapiens
aatgatagaactgta

SEQ ID NO: 6590697 - DNA, 14 bp, Homo sapiens
aatgatagatttga

SEQ ID NO: 6590698 - DNA, 15 bp, Homo sapiens
aatgataggtaattt

SEQ ID NO: 6590699 - DNA, 23 bp, Homo sapiens
aatgatatactgatcttcattac

SEQ ID NO: 6590700 - DNA, 18 bp, Homo sapiens
aatgatatccagtaagca

SEQ ID NO: 6590701 - DNA, 20 bp, Homo sapiens
aatgatatctatattctaaa

SEQ ID NO: 6590702 - DNA, 13 bp, Homo sapiens
aatgatatgcatt

SEQ ID NO: 6590703 - DNA, 17 bp, Homo sapiens
aatgatatgcttgtaac

SEQ ID NO: 6590704 - DNA, 18 bp, Homo sapiens
aatgatatgcttgtaact

SEQ ID NO: 6590705 - DNA, 19 bp, Homo sapiens
aatgatatgcttgtaacta

SEQ ID NO: 6590706 - DNA, 18 bp, Homo sapiens
aatgatatgtctttaaaa

SEQ ID NO: 6590707 - DNA, 21 bp, Homo sapiens
aatgatatgtctttaaaatga

SEQ ID NO: 6590708 - DNA, 17 bp, Homo sapiens
aatgatattcatattca

SEQ ID NO: 6590709 - DNA, 16 bp, Homo sapiens
aatgatattgctgaag

SEQ ID NO: 6590710 - DNA, 22 bp, Homo sapiens
aatgatattgctgaagaatcta

SEQ ID NO: 6590711 - DNA, 19 bp, Homo sapiens
aatgatattgttatataca

SEQ ID NO: 6590712 - DNA, 22 bp, Homo sapiens
aatgatatttaggtttttggct

SEQ ID NO: 6590713 - DNA, 16 bp, Homo sapiens
aatgatatttattaaa

SEQ ID NO: 6590714 - DNA, 14 bp, Homo sapiens
aatgatcaaaacat

SEQ ID NO: 6590715 - DNA, 15 bp, Homo sapiens
aatgatcaaaacatg

SEQ ID NO: 6590716 - DNA, 15 bp, Homo sapiens
aatgatcaaattttg

SEQ ID NO: 6590717 - DNA, 19 bp, Homo sapiens
aatgatcacatctaaagct

SEQ ID NO: 6590718 - DNA, 23 bp, Homo sapiens
aatgatcaccatgttagccttag

SEQ ID NO: 6590719 - DNA, 20 bp, Homo sapiens
aatgatcactctggaaatgc

SEQ ID NO: 6590720 - DNA, 19 bp, Homo sapiens
aatgatcagacttgattta

SEQ ID NO: 6590721 - DNA, 16 bp, Homo sapiens
aatgatcagcatctgt

SEQ ID NO: 6590722 - DNA, 17 bp, Homo sapiens
aatgatcagctatatac

SEQ ID NO: 6590723 - DNA, 20 bp, Homo sapiens
aatgatccccagctgtttat

SEQ ID NO: 6590724 - DNA, 19 bp, Homo sapiens
aatgatccctcagtctgag

SEQ ID NO: 6590725 - DNA, 22 bp, Homo sapiens
aatgatcctcagtgcaaaatgt

SEQ ID NO: 6590726 - DNA, 13 bp, Homo sapiens
aatgatcctgcca

SEQ ID NO: 6590727 - DNA, 23 bp, Homo sapiens
aatgatcctggaaattgcagtaa

SEQ ID NO: 6590728 - DNA, 17 bp, Homo sapiens
aatgatctaggtttaac

SEQ ID NO: 6590729 - DNA, 18 bp, Homo sapiens
aatgatctaggtttaact

SEQ ID NO: 6590730 - DNA, 22 bp, Homo sapiens
aatgatctaggtttaactcaga

SEQ ID NO: 6590731 - DNA, 21 bp, Homo sapiens
aatgatctagttcagaaggaa

SEQ ID NO: 6590732 - DNA, 11 bp, Homo sapiens
aatgatctatt

SEQ ID NO: 6590733 - DNA, 21 bp, Homo sapiens
aatgatctgattgaccgtgtt

SEQ ID NO: 6590734 - DNA, 20 bp, Homo sapiens
aatgatctgcctctaaaagc

SEQ ID NO: 6590735 - DNA, 14 bp, Homo sapiens
aatgatcttccaaa

SEQ ID NO: 6590736 - DNA, 19 bp, Homo sapiens
aatgatcttccaaatatta

SEQ ID NO: 6590737 - DNA, 13 bp, Homo sapiens
aatgatcttgtgt

SEQ ID NO: 6590738 - DNA, 18 bp, Homo sapiens
aatgatgaaatctttctt

SEQ ID NO: 6590739 - DNA, 20 bp, Homo sapiens
aatgatgaaatctttctttc

SEQ ID NO: 6590740 - DNA, 18 bp, Homo sapiens
aatgatgacttgagccct

SEQ ID NO: 6590741 - DNA, 17 bp, Homo sapiens
aatgatgagtaacttaa

SEQ ID NO: 6590742 - DNA, 15 bp, Homo sapiens
aatgatgagtattag

SEQ ID NO: 6590743 - DNA, 15 bp, Homo sapiens
aatgatgataatcat

SEQ ID NO: 6590744 - DNA, 23 bp, Homo sapiens
aatgatgatcaattatagtttct

SEQ ID NO: 6590745 - DNA, 13 bp, Homo sapiens
aatgatgatcttc

SEQ ID NO: 6590746 - DNA, 18 bp, Homo sapiens
aatgatgatgataatgat

SEQ ID NO: 6590747 - DNA, 15 bp, Homo sapiens
aatgatgcagctgtt

SEQ ID NO: 6590748 - DNA, 19 bp, Homo sapiens
aatgatgctatttgcaatt

SEQ ID NO: 6590749 - DNA, 16 bp, Homo sapiens
aatgatggaatttttc

SEQ ID NO: 6590750 - DNA, 18 bp, Homo sapiens
aatgatggcaattttgta

SEQ ID NO: 6590751 - DNA, 14 bp, Homo sapiens
aatgatggcccatt

SEQ ID NO: 6590752 - DNA, 18 bp, Homo sapiens
aatgatggtgttaaagct

SEQ ID NO: 6590753 - DNA, 22 bp, Homo sapiens
aatgatgtagacattttaagca

SEQ ID NO: 6590754 - DNA, 14 bp, Homo sapiens
aatgatgtccagaa

SEQ ID NO: 6590755 - DNA, 18 bp, Homo sapiens
aatgatgtccagaagaat

SEQ ID NO: 6590756 - DNA, 22 bp, Homo sapiens
aatgatgtgaaagataaatgat

SEQ ID NO: 6590757 - DNA, 14 bp, Homo sapiens
aatgatgtgaaagg

SEQ ID NO: 6590758 - DNA, 14 bp, Homo sapiens
aatgatgtgaccct

SEQ ID NO: 6590759 - DNA, 22 bp, Homo sapiens
aatgatgttatcttaacactga

SEQ ID NO: 6590760 - DNA, 23 bp, Homo sapiens
aatgatgttatcttaacactgaa

SEQ ID NO: 6590761 - DNA, 22 bp, Homo sapiens
aatgattaaaatgtttgagcac

SEQ ID NO: 6590762 - DNA, 18 bp, Homo sapiens
aatgattaaagactgtga

SEQ ID NO: 6590763 - DNA, 12 bp, Homo sapiens
aatgattaatca

SEQ ID NO: 6590764 - DNA, 16 bp, Homo sapiens
aatgattaatcaaagg

SEQ ID NO: 6590765 - DNA, 18 bp, Homo sapiens
aatgattaggagagctgt

SEQ ID NO: 6590766 - DNA, 22 bp, Homo sapiens
aatgattataagccctgcataa

SEQ ID NO: 6590767 - DNA, 23 bp, Homo sapiens
aatgattatgaattacatttgta

SEQ ID NO: 6590768 - DNA, 12 bp, Homo sapiens
aatgattatgat

SEQ ID NO: 6590769 - DNA, 23 bp, Homo sapiens
aatgattatgtgtcctttcttga

SEQ ID NO: 6590770 - DNA, 18 bp, Homo sapiens
aatgattattttcattac

SEQ ID NO: 6590771 - DNA, 23 bp, Homo sapiens
aatgattattttcattacaatgg

SEQ ID NO: 6590772 - DNA, 17 bp, Homo sapiens
aatgattcaaaaagtca

SEQ ID NO: 6590773 - DNA, 21 bp, Homo sapiens
aatgattcaaaaagtcacagt

SEQ ID NO: 6590774 - DNA, 18 bp, Homo sapiens
aatgattcaaatgtttta

SEQ ID NO: 6590775 - DNA, 20 bp, Homo sapiens
aatgattcaaattgctgctt

SEQ ID NO: 6590776 - DNA, 21 bp, Homo sapiens
aatgattcaaattgctgcttg

SEQ ID NO: 6590777 - DNA, 22 bp, Homo sapiens
aatgattcaaattgctgcttgg

SEQ ID NO: 6590778 - DNA, 14 bp, Homo sapiens
aatgattcaatgtg

SEQ ID NO: 6590779 - DNA, 16 bp, Homo sapiens
aatgattcaatgtgaa

SEQ ID NO: 6590780 - DNA, 20 bp, Homo sapiens
aatgattcaatgtgaatttt

SEQ ID NO: 6590781 - DNA, 15 bp, Homo sapiens
aatgattcaccaggt

SEQ ID NO: 6590782 - DNA, 22 bp, Homo sapiens
aatgattcaccaggtccaatgt

SEQ ID NO: 6590783 - DNA, 21 bp, Homo sapiens
aatgattcagtgttaaatgtg

SEQ ID NO: 6590784 - DNA, 22 bp, Homo sapiens
aatgattcagtgttaaatgtga

SEQ ID NO: 6590785 - DNA, 23 bp, Homo sapiens
aatgattcagtgttaaatgtgat

SEQ ID NO: 6590786 - DNA, 13 bp, Homo sapiens
aatgattcataac

SEQ ID NO: 6590787 - DNA, 16 bp, Homo sapiens
aatgattcataacaat

SEQ ID NO: 6590788 - DNA, 16 bp, Homo sapiens
aatgattcatctttca

SEQ ID NO: 6590789 - DNA, 20 bp, Homo sapiens
aatgattcatctttcagaaa

SEQ ID NO: 6590790 - DNA, 15 bp, Homo sapiens
aatgattcatgttat

SEQ ID NO: 6590791 - DNA, 16 bp, Homo sapiens
aatgattcatgttata

SEQ ID NO: 6590792 - DNA, 16 bp, Homo sapiens
aatgattcatttttct

SEQ ID NO: 6590793 - DNA, 12 bp, Homo sapiens
aatgattccaaa

SEQ ID NO: 6590794 - DNA, 13 bp, Homo sapiens
aatgattccaaat

SEQ ID NO: 6590795 - DNA, 15 bp, Homo sapiens
aatgattccaaataa

SEQ ID NO: 6590796 - DNA, 19 bp, Homo sapiens
aatgattccagacgacctt

SEQ ID NO: 6590797 - DNA, 17 bp, Homo sapiens
aatgattcttgtgtcat

SEQ ID NO: 6590798 - DNA, 13 bp, Homo sapiens
aatgattgaaaat

SEQ ID NO: 6590799 - DNA, 15 bp, Homo sapiens
aatgattgcttttaa

SEQ ID NO: 6590800 - DNA, 16 bp, Homo sapiens
aatgattgcttttaaa

SEQ ID NO: 6590801 - DNA, 19 bp, Homo sapiens
aatgattgcttttaaaatt

SEQ ID NO: 6590802 - DNA, 20 bp, Homo sapiens
aatgattgcttttaaaattt

SEQ ID NO: 6590803 - DNA, 22 bp, Homo sapiens
aatgattgcttttaaaatttta

SEQ ID NO: 6590804 - DNA, 24 bp, Homo sapiens
aatgattggtaggaaatagaatga

SEQ ID NO: 6590805 - DNA, 21 bp, Homo sapiens
aatgattggttaaaatgtgat

SEQ ID NO: 6590806 - DNA, 14 bp, Homo sapiens
aatgattgtttaaa

SEQ ID NO: 6590807 - DNA, 24 bp, Homo sapiens
aatgatttcagctcactgcaacct

SEQ ID NO: 6590808 - DNA, 14 bp, Homo sapiens
aatgatttcatatt

SEQ ID NO: 6590809 - DNA, 20 bp, Homo sapiens
aatgatttggccaggcctag

SEQ ID NO: 6590810 - DNA, 12 bp, Homo sapiens
aatgatttgtaa

SEQ ID NO: 6590811 - DNA, 18 bp, Homo sapiens
aatgatttgtaaaggact

SEQ ID NO: 6590812 - DNA, 20 bp, Homo sapiens
aatgatttgtgtttctttat

SEQ ID NO: 6590813 - DNA, 19 bp, Homo sapiens
aatgattttatctgtgaat

SEQ ID NO: 6590814 - DNA, 20 bp, Homo sapiens
aatgattttatctgtgaatt

SEQ ID NO: 6590815 - DNA, 16 bp, Homo sapiens
aatgattttgctgact

SEQ ID NO: 6590816 - DNA, 14 bp, Homo sapiens
aatgatttttagat

SEQ ID NO: 6590817 - DNA, 15 bp, Homo sapiens
aatgatttttcttta

SEQ ID NO: 6590818 - DNA, 16 bp, Homo sapiens
aatgatttttgtgtat

SEQ ID NO: 6590819 - DNA, 16 bp, Homo sapiens
aatgcaaaaaaaatta

SEQ ID NO: 6590820 - DNA, 14 bp, Homo sapiens
aatgcaaaaataac

SEQ ID NO: 6590821 - DNA, 14 bp, Homo sapiens
aatgcaaaaatata

SEQ ID NO: 6590822 - DNA, 14 bp, Homo sapiens
aatgcaaaaccttt

SEQ ID NO: 6590823 - DNA, 22 bp, Homo sapiens
aatgcaaaaggctgattactga

SEQ ID NO: 6590824 - DNA, 12 bp, Homo sapiens
aatgcaaaatga

SEQ ID NO: 6590825 - DNA, 13 bp, Homo sapiens
aatgcaaaattag

SEQ ID NO: 6590826 - DNA, 14 bp, Homo sapiens
aatgcaaaattgtt

SEQ ID NO: 6590827 - DNA, 20 bp, Homo sapiens
aatgcaaacacacaaaggta

SEQ ID NO: 6590828 - DNA, 21 bp, Homo sapiens
aatgcaaactgggatgaaact

SEQ ID NO: 6590829 - DNA, 17 bp, Homo sapiens
aatgcaaagaatcccta

SEQ ID NO: 6590830 - DNA, 14 bp, Homo sapiens
aatgcaaagctgaa

SEQ ID NO: 6590831 - DNA, 17 bp, Homo sapiens
aatgcaaagctgaagac

SEQ ID NO: 6590832 - DNA, 20 bp, Homo sapiens
aatgcaaagttctgtgttta

SEQ ID NO: 6590833 - DNA, 17 bp, Homo sapiens
aatgcaaataacaaatg

SEQ ID NO: 6590834 - DNA, 20 bp, Homo sapiens
aatgcaaatattgctattgt

SEQ ID NO: 6590835 - DNA, 23 bp, Homo sapiens
aatgcaaattaaaacatatttca

SEQ ID NO: 6590836 - DNA, 16 bp, Homo sapiens
aatgcaaattaaaggg

SEQ ID NO: 6590837 - DNA, 16 bp, Homo sapiens
aatgcaaattctcagg

SEQ ID NO: 6590838 - DNA, 20 bp, Homo sapiens
aatgcaacaaaatatttaat

SEQ ID NO: 6590839 - DNA, 14 bp, Homo sapiens
aatgcaacaaatga

SEQ ID NO: 6590840 - DNA, 15 bp, Homo sapiens
aatgcaacaatgtgt

SEQ ID NO: 6590841 - DNA, 13 bp, Homo sapiens
aatgcaacagaaa

SEQ ID NO: 6590842 - DNA, 22 bp, Homo sapiens
aatgcaacatacgggaagttta

SEQ ID NO: 6590843 - DNA, 19 bp, Homo sapiens
aatgcaacttttaattact

SEQ ID NO: 6590844 - DNA, 22 bp, Homo sapiens
aatgcaacttttaattactgtt

SEQ ID NO: 6590845 - DNA, 16 bp, Homo sapiens
aatgcaagagaacatt

SEQ ID NO: 6590846 - DNA, 17 bp, Homo sapiens
aatgcaagagaacattt

SEQ ID NO: 6590847 - DNA, 19 bp, Homo sapiens
aatgcaagagaacatttta

SEQ ID NO: 6590848 - DNA, 21 bp, Homo sapiens
tttatgacatgaaaagttatt

SEQ ID NO: 6590849 - DNA, 20 bp, Homo sapiens
tttatgaccagagcaaaaat

SEQ ID NO: 6590850 - DNA, 12 bp, Homo sapiens
tttatgacctaa

SEQ ID NO: 6590851 - DNA, 15 bp, Homo sapiens
tttatgactaatcct

SEQ ID NO: 6590852 - DNA, 20 bp, Homo sapiens
tttatgactaatccttaata

SEQ ID NO: 6590853 - DNA, 20 bp, Homo sapiens
tttatgactgtaaacataga

SEQ ID NO: 6590854 - DNA, 17 bp, Homo sapiens
tttatgactgttgcata

SEQ ID NO: 6590855 - DNA, 20 bp, Homo sapiens
tttatgacttcattaataat

SEQ ID NO: 6590856 - DNA, 13 bp, Homo sapiens
tttatgagaaatg

SEQ ID NO: 6590857 - DNA, 20 bp, Homo sapiens
tttatgagaaatgtaatgcg

SEQ ID NO: 6590858 - DNA, 23 bp, Homo sapiens
tttatgagaactggttcttgcct

SEQ ID NO: 6590859 - DNA, 20 bp, Homo sapiens
tttatgagatgctggttttc

SEQ ID NO: 6590860 - DNA, 14 bp, Homo sapiens
tttatgagatggat

SEQ ID NO: 6590861 - DNA, 16 bp, Homo sapiens
tttatgagatttactg

SEQ ID NO: 6590862 - DNA, 17 bp, Homo sapiens
tttatgagatttactgc

SEQ ID NO: 6590863 - DNA, 17 bp, Homo sapiens
tttatgagccagacaaa

SEQ ID NO: 6590864 - DNA, 19 bp, Homo sapiens
tttatgagccagacaaatg

SEQ ID NO: 6590865 - DNA, 17 bp, Homo sapiens
tttatgagctaaaaata

SEQ ID NO: 6590866 - DNA, 17 bp, Homo sapiens
tttatgagtctttgaga

SEQ ID NO: 6590867 - DNA, 17 bp, Homo sapiens
tttatgagttcttgttt

SEQ ID NO: 6590868 - DNA, 18 bp, Homo sapiens
tttatgataatagattct

SEQ ID NO: 6590869 - DNA, 19 bp, Homo sapiens
tttatgatacttgaatttt

SEQ ID NO: 6590870 - DNA, 14 bp, Homo sapiens
tttatgatcagtgt

SEQ ID NO: 6590871 - DNA, 15 bp, Homo sapiens
tttatgatcagtgtt

SEQ ID NO: 6590872 - DNA, 17 bp, Homo sapiens
tttatgatctatttgta

SEQ ID NO: 6590873 - DNA, 14 bp, Homo sapiens
tttatgatgtatat

SEQ ID NO: 6590874 - DNA, 17 bp, Homo sapiens
tttatgattcttactgt

SEQ ID NO: 6590875 - DNA, 15 bp, Homo sapiens
tttatgatttcaaca

SEQ ID NO: 6590876 - DNA, 19 bp, Homo sapiens
tttatgattttcataactt

SEQ ID NO: 6590877 - DNA, 17 bp, Homo sapiens
tttatgcaaaaacatat

SEQ ID NO: 6590878 - DNA, 16 bp, Homo sapiens
tttatgcaaaaggttt

SEQ ID NO: 6590879 - DNA, 15 bp, Homo sapiens
tttatgcaaatacaa

SEQ ID NO: 6590880 - DNA, 16 bp, Homo sapiens
tttatgcaaatacaat

SEQ ID NO: 6590881 - DNA, 14 bp, Homo sapiens
tttatgcacttttt

SEQ ID NO: 6590882 - DNA, 17 bp, Homo sapiens
tttatgcatatgtagat

SEQ ID NO: 6590883 - DNA, 19 bp, Homo sapiens
tttatgcatgagaactaaa

SEQ ID NO: 6590884 - DNA, 20 bp, Homo sapiens
tttatgcatgagaactaaat

SEQ ID NO: 6590885 - DNA, 16 bp, Homo sapiens
tttatgcatttatgca

SEQ ID NO: 6590886 - DNA, 12 bp, Homo sapiens
tttatgcatttc

SEQ ID NO: 6590887 - DNA, 13 bp, Homo sapiens
tttatgcatttca

SEQ ID NO: 6590888 - DNA, 20 bp, Homo sapiens
tttatgcatttgcatttgct

SEQ ID NO: 6590889 - DNA, 18 bp, Homo sapiens
tttatgccagttgttaaa

SEQ ID NO: 6590890 - DNA, 18 bp, Homo sapiens
tttatgccggatgtgctt

SEQ ID NO: 6590891 - DNA, 19 bp, Homo sapiens
tttatgccttcttattgct

SEQ ID NO: 6590892 - DNA, 17 bp, Homo sapiens
tttatgcctttctctcc

SEQ ID NO: 6590893 - DNA, 20 bp, Homo sapiens
tttatgccttttatttctta

SEQ ID NO: 6590894 - DNA, 20 bp, Homo sapiens
tttatgcgcaaatacaaaat

SEQ ID NO: 6590895 - DNA, 19 bp, Homo sapiens
tttatgctacctagtctcc

SEQ ID NO: 6590896 - DNA, 23 bp, Homo sapiens
tttatgctataaattttttgaaa

SEQ ID NO: 6590897 - DNA, 23 bp, Homo sapiens
tttatgctcttgaaatattcaga

SEQ ID NO: 6590898 - DNA, 20 bp, Homo sapiens
tttatgctgtattttaacac

SEQ ID NO: 6590899 - DNA, 13 bp, Homo sapiens
tttatgcttgcaa

SEQ ID NO: 6590900 - DNA, 15 bp, Homo sapiens
tttatgctttaaaca

SEQ ID NO: 6590901 - DNA, 16 bp, Homo sapiens
tttatgctttaaacat

SEQ ID NO: 6590902 - DNA, 20 bp, Homo sapiens
tttatggaattaaccattta

SEQ ID NO: 6590903 - DNA, 18 bp, Homo sapiens
tttatggaccacttttat

SEQ ID NO: 6590904 - DNA, 24 bp, Homo sapiens
tttatggatcccaattcatttcat

SEQ ID NO: 6590905 - DNA, 17 bp, Homo sapiens
tttatggatgattaaat

SEQ ID NO: 6590906 - DNA, 20 bp, Homo sapiens
tttatggattaaaaactgct

SEQ ID NO: 6590907 - DNA, 20 bp, Homo sapiens
tttatggcacctatttcttt

SEQ ID NO: 6590908 - DNA, 20 bp, Homo sapiens
tttatggcagacattgtgct

SEQ ID NO: 6590909 - DNA, 15 bp, Homo sapiens
tttatggcatgattt

SEQ ID NO: 6590910 - DNA, 19 bp, Homo sapiens
tttatggccgtatcaaatg

SEQ ID NO: 6590911 - DNA, 12 bp, Homo sapiens
tttatggcctca

SEQ ID NO: 6590912 - DNA, 20 bp, Homo sapiens
tttatggcttataaatgtgt

SEQ ID NO: 6590913 - DNA, 14 bp, Homo sapiens
tttatggcttttgt

SEQ ID NO: 6590914 - DNA, 20 bp, Homo sapiens
tttatggcttttgtgcatta

SEQ ID NO: 6590915 - DNA, 18 bp, Homo sapiens
tttatgggcccctggcac

SEQ ID NO: 6590916 - DNA, 13 bp, Homo sapiens
tttatgggccttg

SEQ ID NO: 6590917 - DNA, 18 bp, Homo sapiens
tttatggtaatcatatta

SEQ ID NO: 6590918 - DNA, 18 bp, Homo sapiens
tttatggtcctaaaagca

SEQ ID NO: 6590919 - DNA, 21 bp, Homo sapiens
tttatggtcctaaaagcaaaa

SEQ ID NO: 6590920 - DNA, 24 bp, Homo sapiens
tttatggtgcctagtattgacaaa

SEQ ID NO: 6590921 - DNA, 21 bp, Homo sapiens
tttatggttatgtttttctgt

SEQ ID NO: 6590922 - DNA, 17 bp, Homo sapiens
tttatgtaacttcctgt

SEQ ID NO: 6590923 - DNA, 12 bp, Homo sapiens
tttatgtaatag

SEQ ID NO: 6590924 - DNA, 14 bp, Homo sapiens
tttatgtaatttca

SEQ ID NO: 6590925 - DNA, 14 bp, Homo sapiens
tttatgtacaaaat

SEQ ID NO: 6590926 - DNA, 12 bp, Homo sapiens
tttatgtacaac

SEQ ID NO: 6590927 - DNA, 12 bp, Homo sapiens
tttatgtactgc

SEQ ID NO: 6590928 - DNA, 16 bp, Homo sapiens
tttatgtatgtttaca

SEQ ID NO: 6590929 - DNA, 21 bp, Homo sapiens
tttatgtatgtttacactgtc

SEQ ID NO: 6590930 - DNA, 11 bp, Homo sapiens
tttatgtattg

SEQ ID NO: 6590931 - DNA, 19 bp, Homo sapiens
tttatgtattgtgcaatgt

SEQ ID NO: 6590932 - DNA, 19 bp, Homo sapiens
tttatgtctgtggattttt

SEQ ID NO: 6590933 - DNA, 12 bp, Homo sapiens
tttatgtctttc

SEQ ID NO: 6590934 - DNA, 13 bp, Homo sapiens
tttatgtctttct

SEQ ID NO: 6590935 - DNA, 15 bp, Homo sapiens
tttatgtgaaagagt

SEQ ID NO: 6590936 - DNA, 13 bp, Homo sapiens
tttatgtgaaatg

SEQ ID NO: 6590937 - DNA, 22 bp, Homo sapiens
tttatgtgaaatgctttctgta

SEQ ID NO: 6590938 - DNA, 16 bp, Homo sapiens
tttatgtgagatttcc

SEQ ID NO: 6590939 - DNA, 19 bp, Homo sapiens
tttatgtgatgccaaagat

SEQ ID NO: 6590940 - DNA, 23 bp, Homo sapiens
tttatgtgatgccaaagatgttt

SEQ ID NO: 6590941 - DNA, 17 bp, Homo sapiens
tttatgtgctatgcaaa

SEQ ID NO: 6590942 - DNA, 17 bp, Homo sapiens
tttatgtgctgttagaa

SEQ ID NO: 6590943 - DNA, 20 bp, Homo sapiens
tttatgtgcttgaagattca

SEQ ID NO: 6590944 - DNA, 17 bp, Homo sapiens
tttatgtgggtgatttg

SEQ ID NO: 6590945 - DNA, 13 bp, Homo sapiens
tttatgtgtagaa

SEQ ID NO: 6590946 - DNA, 14 bp, Homo sapiens
tttatgtgtagaat

SEQ ID NO: 6590947 - DNA, 19 bp, Homo sapiens
tttatgtgtatatttgtag

SEQ ID NO: 6590948 - DNA, 20 bp, Homo sapiens
tttatgttactacatgcact

SEQ ID NO: 6590949 - DNA, 19 bp, Homo sapiens
tttatgttccattaaacga

SEQ ID NO: 6590950 - DNA, 14 bp, Homo sapiens
tttatgttccttta

SEQ ID NO: 6590951 - DNA, 13 bp, Homo sapiens
tttatgttctcaa

SEQ ID NO: 6590952 - DNA, 17 bp, Homo sapiens
tttatgttctcagaatc

SEQ ID NO: 6590953 - DNA, 11 bp, Homo sapiens
tttatgttctt

SEQ ID NO: 6590954 - DNA, 14 bp, Homo sapiens
tttatgttgacatt

SEQ ID NO: 6590955 - DNA, 22 bp, Homo sapiens
tttatgttgacatttgtttggt

SEQ ID NO: 6590956 - DNA, 18 bp, Homo sapiens
tttatgttgatctgcata

SEQ ID NO: 6590957 - DNA, 23 bp, Homo sapiens
tttatgttgcaggaaaccctttt

SEQ ID NO: 6590958 - DNA, 16 bp, Homo sapiens
tttatgttgtatgatt

SEQ ID NO: 6590959 - DNA, 12 bp, Homo sapiens
tttatgtttgaa

SEQ ID NO: 6590960 - DNA, 23 bp, Homo sapiens
tttatgtttgcacttgtgattat

SEQ ID NO: 6590961 - DNA, 13 bp, Homo sapiens
tttatgtttgtgg

SEQ ID NO: 6590962 - DNA, 18 bp, Homo sapiens
tttattaaaaactgagtg

SEQ ID NO: 6590963 - DNA, 16 bp, Homo sapiens
tttattaaaaatgttc

SEQ ID NO: 6590964 - DNA, 17 bp, Homo sapiens
tttattaaaaatgttct

SEQ ID NO: 6590965 - DNA, 22 bp, Homo sapiens
tttattaaaaatgttctcaaat

SEQ ID NO: 6590966 - DNA, 13 bp, Homo sapiens
tttattaaaacag

SEQ ID NO: 6590967 - DNA, 15 bp, Homo sapiens
tttattaaacacagg

SEQ ID NO: 6590968 - DNA, 14 bp, Homo sapiens
tttattaaacagat

SEQ ID NO: 6590969 - DNA, 15 bp, Homo sapiens
tttattaaacagata

SEQ ID NO: 6590970 - DNA, 13 bp, Homo sapiens
tttattaaagaaa

SEQ ID NO: 6590971 - DNA, 12 bp, Homo sapiens
tttattaaataa

SEQ ID NO: 6590972 - DNA, 19 bp, Homo sapiens
tttattaaatgtagaaagt

SEQ ID NO: 6590973 - DNA, 13 bp, Homo sapiens
tttattaaatgtt

SEQ ID NO: 6590974 - DNA, 13 bp, Homo sapiens
tttattaaattta

SEQ ID NO: 6590975 - DNA, 20 bp, Homo sapiens
tttattaaatttgttgacaa

SEQ ID NO: 6590976 - DNA, 18 bp, Homo sapiens
tttattaacaaattatgt

SEQ ID NO: 6590977 - DNA, 15 bp, Homo sapiens
tttattaagatggat

SEQ ID NO: 6590978 - DNA, 23 bp, Homo sapiens
tttattaagattattttattatg

SEQ ID NO: 6590979 - DNA, 20 bp, Homo sapiens
tttattaagcagtacaaatg

SEQ ID NO: 6590980 - DNA, 19 bp, Homo sapiens
tttattaagtatatttgta

SEQ ID NO: 6590981 - DNA, 20 bp, Homo sapiens
tttattaataatatttatgt

SEQ ID NO: 6590982 - DNA, 14 bp, Homo sapiens
tttattaatagaat

SEQ ID NO: 6590983 - DNA, 13 bp, Homo sapiens
tttattaatcact

SEQ ID NO: 6590984 - DNA, 12 bp, Homo sapiens
tttattaatgtt

SEQ ID NO: 6590985 - DNA, 17 bp, Homo sapiens
tttattaattgctttga

SEQ ID NO: 6590986 - DNA, 13 bp, Homo sapiens
tttattacaaatc

SEQ ID NO: 6590987 - DNA, 15 bp, Homo sapiens
tttattacaaatgca

SEQ ID NO: 6590988 - DNA, 23 bp, Homo sapiens
tttattacaatgtatctttatta

SEQ ID NO: 6590989 - DNA, 18 bp, Homo sapiens
tttattacagaaatgttt

SEQ ID NO: 6590990 - DNA, 14 bp, Homo sapiens
tttattacataatt

SEQ ID NO: 6590991 - DNA, 23 bp, Homo sapiens
tttattaccccctccttcagaca

SEQ ID NO: 6590992 - DNA, 22 bp, Homo sapiens
tttattaccgataaatgaacat

SEQ ID NO: 6590993 - DNA, 14 bp, Homo sapiens
tttattacctctga

SEQ ID NO: 6590994 - DNA, 20 bp, Homo sapiens
tttattacctctgatacctc

SEQ ID NO: 6590995 - DNA, 17 bp, Homo sapiens
tttattaccttctttct

SEQ ID NO: 6590996 - DNA, 19 bp, Homo sapiens
tttattacgtatgtctggt

SEQ ID NO: 6590997 - DNA, 21 bp, Homo sapiens
tttattactagtgtttaagtc

SEQ ID NO: 6590998 - DNA, 21 bp, Homo sapiens
tttattactgtttattacttc

SEQ ID NO: 6590999 - DNA, 13 bp, Homo sapiens
tttattacttttt

SEQ ID NO: 6591000 - DNA, 11 bp, Homo sapiens
tttattagaaa

SEQ ID NO: 6591001 - DNA, 13 bp, Homo sapiens
tttattagatgaa

SEQ ID NO: 6591002 - DNA, 13 bp, Homo sapiens
tttattagctgta

SEQ ID NO: 6591003 - DNA, 16 bp, Homo sapiens
tttattagctgtaaat

SEQ ID NO: 6591004 - DNA, 19 bp, Homo sapiens
tttattaggaaaagatatt

SEQ ID NO: 6591005 - DNA, 13 bp, Homo sapiens
tttattagtaaca

SEQ ID NO: 6591006 - DNA, 20 bp, Homo sapiens
tttattagtattgttgtcct

SEQ ID NO: 6591007 - DNA, 14 bp, Homo sapiens
tttattataaaatg

SEQ ID NO: 6591008 - DNA, 20 bp, Homo sapiens
tttattatccttcacaattt

SEQ ID NO: 6591009 - DNA, 13 bp, Homo sapiens
tttattatgaaac

SEQ ID NO: 6591010 - DNA, 16 bp, Homo sapiens
tttattatgcattata

SEQ ID NO: 6591011 - DNA, 14 bp, Homo sapiens
tttattattgaaga

SEQ ID NO: 6591012 - DNA, 12 bp, Homo sapiens
tttattatttga

SEQ ID NO: 6591013 - DNA, 16 bp, Homo sapiens
tttattattttcaaag

SEQ ID NO: 6591014 - DNA, 17 bp, Homo sapiens
tttattattttcacctg

SEQ ID NO: 6591015 - DNA, 13 bp, Homo sapiens
tttattattttta

SEQ ID NO: 6591016 - DNA, 12 bp, Homo sapiens
tttattcaaaat

SEQ ID NO: 6591017 - DNA, 14 bp, Homo sapiens
tttattcaaaatat

SEQ ID NO: 6591018 - DNA, 14 bp, Homo sapiens
tttattcaaactac

SEQ ID NO: 6591019 - DNA, 12 bp, Homo sapiens
tttattcaaggt

SEQ ID NO: 6591020 - DNA, 20 bp, Homo sapiens
tttattcaaggtaaaattct

SEQ ID NO: 6591021 - DNA, 17 bp, Homo sapiens
tttattcaattctgtat

SEQ ID NO: 6591022 - DNA, 16 bp, Homo sapiens
tttattcagaacttta

SEQ ID NO: 6591023 - DNA, 15 bp, Homo sapiens
tttattcagcagact

SEQ ID NO: 6591024 - DNA, 19 bp, Homo sapiens
tttattcagcttcatttgt

SEQ ID NO: 6591025 - DNA, 23 bp, Homo sapiens
tttattcagtgacttctggctta

SEQ ID NO: 6591026 - DNA, 14 bp, Homo sapiens
tttattcataatga

SEQ ID NO: 6591027 - DNA, 21 bp, Homo sapiens
tttattcataatgaattataa

SEQ ID NO: 6591028 - DNA, 14 bp, Homo sapiens
tttattcatatgca

SEQ ID NO: 6591029 - DNA, 17 bp, Homo sapiens
tttattcatctgtgaaa

SEQ ID NO: 6591030 - DNA, 16 bp, Homo sapiens
tttattcattagctgt

SEQ ID NO: 6591031 - DNA, 22 bp, Homo sapiens
tttattcattggtctaatttat

SEQ ID NO: 6591032 - DNA, 19 bp, Homo sapiens
tttattccagcgtcttcta

SEQ ID NO: 6591033 - DNA, 18 bp, Homo sapiens
tttattccccagtgactc

SEQ ID NO: 6591034 - DNA, 12 bp, Homo sapiens
tttattcccttt

SEQ ID NO: 6591035 - DNA, 13 bp, Homo sapiens
tttattcctctgt

SEQ ID NO: 6591036 - DNA, 16 bp, Homo sapiens
tttattcctgttagta

SEQ ID NO: 6591037 - DNA, 18 bp, Homo sapiens
tttattccttctgtagtg

SEQ ID NO: 6591038 - DNA, 14 bp, Homo sapiens
tttattccttgtga

SEQ ID NO: 6591039 - DNA, 15 bp, Homo sapiens
tttattctagttaag

SEQ ID NO: 6591040 - DNA, 12 bp, Homo sapiens
tttattctcaga

SEQ ID NO: 6591041 - DNA, 23 bp, Homo sapiens
tttattctcaggtaatcatttta

SEQ ID NO: 6591042 - DNA, 19 bp, Homo sapiens
tttattctgggaaatgttt

SEQ ID NO: 6591043 - DNA, 23 bp, Homo sapiens
tttattctgtggttctataataa

SEQ ID NO: 6591044 - DNA, 18 bp, Homo sapiens
tttattcttctagagttc

SEQ ID NO: 6591045 - DNA, 22 bp, Homo sapiens
tttattcttgaagtgaaatctg

SEQ ID NO: 6591046 - DNA, 17 bp, Homo sapiens
tttattctttaattgtt

SEQ ID NO: 6591047 - DNA, 17 bp, Homo sapiens
tttattgaaatgtataa

SEQ ID NO: 6591048 - DNA, 18 bp, Homo sapiens
tttattgaattagaaaat

SEQ ID NO: 6591049 - DNA, 16 bp, Homo sapiens
tttattgactgggcaa

SEQ ID NO: 6591050 - DNA, 22 bp, Homo sapiens
tttattgactgggcaacactgc

SEQ ID NO: 6591051 - DNA, 16 bp, Homo sapiens
tttattgactgtcttt

SEQ ID NO: 6591052 - DNA, 14 bp, Homo sapiens
tttattgagaaaga

SEQ ID NO: 6591053 - DNA, 16 bp, Homo sapiens
tttattgagaaagagc

SEQ ID NO: 6591054 - DNA, 14 bp, Homo sapiens
tttattgagaattt

SEQ ID NO: 6591055 - DNA, 18 bp, Homo sapiens
tttattgagattttccat

SEQ ID NO: 6591056 - DNA, 14 bp, Homo sapiens
tttattgagcatct

SEQ ID NO: 6591057 - DNA, 15 bp, Homo sapiens
tttattgagtaatat

SEQ ID NO: 6591058 - DNA, 18 bp, Homo sapiens
tttattgagtaatattac

SEQ ID NO: 6591059 - DNA, 21 bp, Homo sapiens
tttattgagtacctactgtgt

SEQ ID NO: 6591060 - DNA, 16 bp, Homo sapiens
tttattgatgtgcaaa

SEQ ID NO: 6591061 - DNA, 19 bp, Homo sapiens
tttattgattaaaaatgtg

SEQ ID NO: 6591062 - DNA, 17 bp, Homo sapiens
tttattgcacaaaatat

SEQ ID NO: 6591063 - DNA, 12 bp, Homo sapiens
tttattgcacta

SEQ ID NO: 6591064 - DNA, 23 bp, Homo sapiens
tttattgcatctgggtagctgta

SEQ ID NO: 6591065 - DNA, 24 bp, Homo sapiens
tttattgcatctgggtagctgtaa

SEQ ID NO: 6591066 - DNA, 12 bp, Homo sapiens
tttattgcatgg

SEQ ID NO: 6591067 - DNA, 18 bp, Homo sapiens
tttattgcatttgctgtt

SEQ ID NO: 6591068 - DNA, 21 bp, Homo sapiens
tttattgcatttgctgttgtt

SEQ ID NO: 6591069 - DNA, 19 bp, Homo sapiens
tttattgctagtatttgaa

SEQ ID NO: 6591070 - DNA, 20 bp, Homo sapiens
tttattgctagtatttgaat

SEQ ID NO: 6591071 - DNA, 23 bp, Homo sapiens
tttattgctagtatttgaattaa

SEQ ID NO: 6591072 - DNA, 22 bp, Homo sapiens
tttattgctcgcccagacacca

SEQ ID NO: 6591073 - DNA, 17 bp, Homo sapiens
tttattgcttgatactt

SEQ ID NO: 6591074 - DNA, 23 bp, Homo sapiens
tttattggatgatacagtgtttt

SEQ ID NO: 6591075 - DNA, 17 bp, Homo sapiens
tttattgggcaataaaa

SEQ ID NO: 6591076 - DNA, 20 bp, Homo sapiens
tttattgtaacagacattgt

SEQ ID NO: 6591077 - DNA, 13 bp, Homo sapiens
tttattgtataaa

SEQ ID NO: 6591078 - DNA, 14 bp, Homo sapiens
tttattgtcaaagt

SEQ ID NO: 6591079 - DNA, 19 bp, Homo sapiens
tttattgtcattactgcct

SEQ ID NO: 6591080 - DNA, 12 bp, Homo sapiens
tttattgtctgt

SEQ ID NO: 6591081 - DNA, 19 bp, Homo sapiens
tttattgtctgtctacatt

SEQ ID NO: 6591082 - DNA, 22 bp, Homo sapiens
tttattgtctgtctacatttct

SEQ ID NO: 6591083 - DNA, 21 bp, Homo sapiens
tttattgtcttggttgccagt

SEQ ID NO: 6591084 - DNA, 22 bp, Homo sapiens
tttattgtgggccatgaaccaa

SEQ ID NO: 6591085 - DNA, 16 bp, Homo sapiens
tttattgtgtttgtca

SEQ ID NO: 6591086 - DNA, 15 bp, Homo sapiens
tttattgttaaatta

SEQ ID NO: 6591087 - DNA, 19 bp, Homo sapiens
tttattgttaaattacatt

SEQ ID NO: 6591088 - DNA, 19 bp, Homo sapiens
tttattgttaatacaaggt

SEQ ID NO: 6591089 - DNA, 21 bp, Homo sapiens
tttattgttatacctttttga

SEQ ID NO: 6591090 - DNA, 17 bp, Homo sapiens
tttattgtttgatgttt

SEQ ID NO: 6591091 - DNA, 22 bp, Homo sapiens
tttattgttttctatttatgcc

SEQ ID NO: 6591092 - DNA, 22 bp, Homo sapiens
tttatttaaaaaactaaaaact

SEQ ID NO: 6591093 - DNA, 14 bp, Homo sapiens
tttatttaaaaaag

SEQ ID NO: 6591094 - DNA, 14 bp, Homo sapiens
tttatttaaaactc

SEQ ID NO: 6591095 - DNA, 17 bp, Homo sapiens
tttatttaaaagattca

SEQ ID NO: 6591096 - DNA, 22 bp, Homo sapiens
tttatttaaaagattcattttt

SEQ ID NO: 6591097 - DNA, 13 bp, Homo sapiens
tttatttaaacaa

SEQ ID NO: 6591098 - DNA, 17 bp, Homo sapiens
tttatttaaatgcatgt

SEQ ID NO: 6591099 - DNA, 14 bp, Homo sapiens
tttatttaaatgct

SEQ ID NO: 6591100 - DNA, 13 bp, Homo sapiens
tttatttaaatgt

SEQ ID NO: 6591101 - DNA, 19 bp, Homo sapiens
tttatttaaattacaattt

SEQ ID NO: 6591102 - DNA, 23 bp, Homo sapiens
tttatttaaggatggatggcacc

SEQ ID NO: 6591103 - DNA, 17 bp, Homo sapiens
tttatttaatgttatgt

SEQ ID NO: 6591104 - DNA, 11 bp, Homo sapiens
tttatttaatt

SEQ ID NO: 6591105 - DNA, 16 bp, Homo sapiens
tttatttacaaatgtt

SEQ ID NO: 6591106 - DNA, 14 bp, Homo sapiens
tttatttacatttt

SEQ ID NO: 6591107 - DNA, 15 bp, Homo sapiens
tttatttacatttta

SEQ ID NO: 6591108 - DNA, 18 bp, Homo sapiens
tttatttacattttatat

SEQ ID NO: 6591109 - DNA, 14 bp, Homo sapiens
tttatttagaaact

SEQ ID NO: 6591110 - DNA, 15 bp, Homo sapiens
tttatttagctattt

SEQ ID NO: 6591111 - DNA, 16 bp, Homo sapiens
tttatttaggaaacac

SEQ ID NO: 6591112 - DNA, 15 bp, Homo sapiens
tttatttatatcttt

SEQ ID NO: 6591113 - DNA, 15 bp, Homo sapiens
tttatttatcagtga

SEQ ID NO: 6591114 - DNA, 21 bp, Homo sapiens
tttatttatccagaaaactgt

SEQ ID NO: 6591115 - DNA, 22 bp, Homo sapiens
tttatttatccagaaaactgtg

SEQ ID NO: 6591116 - DNA, 13 bp, Homo sapiens
tttatttatgaag

SEQ ID NO: 6591117 - DNA, 12 bp, Homo sapiens
tttatttatggc

SEQ ID NO: 6591118 - DNA, 11 bp, Homo sapiens
tttatttatgt

SEQ ID NO: 6591119 - DNA, 15 bp, Homo sapiens
tttatttatgtactt

SEQ ID NO: 6591120 - DNA, 13 bp, Homo sapiens
tttatttatgttc

SEQ ID NO: 6591121 - DNA, 16 bp, Homo sapiens
tttatttattcactgt

SEQ ID NO: 6591122 - DNA, 14 bp, Homo sapiens
tttatttattgctt

SEQ ID NO: 6591123 - DNA, 16 bp, Homo sapiens
tttatttatttattca

SEQ ID NO: 6591124 - DNA, 13 bp, Homo sapiens
tttatttatttct

SEQ ID NO: 6591125 - DNA, 13 bp, Homo sapiens
tttatttcaattg

SEQ ID NO: 6591126 - DNA, 23 bp, Homo sapiens
tttatttcatttacaaaagattt

SEQ ID NO: 6591127 - DNA, 13 bp, Homo sapiens
tttatttccaaaa

SEQ ID NO: 6591128 - DNA, 20 bp, Homo sapiens
tttatttccactaaaaatat

SEQ ID NO: 6591129 - DNA, 15 bp, Homo sapiens
tttatttctctctta

SEQ ID NO: 6591130 - DNA, 22 bp, Homo sapiens
tttatttctgtgaaagaagtat

SEQ ID NO: 6591131 - DNA, 20 bp, Homo sapiens
tttatttcttcgtgaacata

SEQ ID NO: 6591132 - DNA, 19 bp, Homo sapiens
tttatttcttttagaaaag

SEQ ID NO: 6591133 - DNA, 17 bp, Homo sapiens
tttatttgagaattttg

SEQ ID NO: 6591134 - DNA, 15 bp, Homo sapiens
tttatttgattaggt

SEQ ID NO: 6591135 - DNA, 20 bp, Homo sapiens
tttatttgcaatttgagcca

SEQ ID NO: 6591136 - DNA, 15 bp, Homo sapiens
tttatttgcacttgt

SEQ ID NO: 6591137 - DNA, 21 bp, Homo sapiens
tttatttgcacttgtggaata

SEQ ID NO: 6591138 - DNA, 14 bp, Homo sapiens
tttatttgcttctt

SEQ ID NO: 6591139 - DNA, 22 bp, Homo sapiens
tttatttggaaaggaatgcaaa

SEQ ID NO: 6591140 - DNA, 19 bp, Homo sapiens
tttatttgtcgtgttggaa

SEQ ID NO: 6591141 - DNA, 17 bp, Homo sapiens
tttatttgttctttttc

SEQ ID NO: 6591142 - DNA, 13 bp, Homo sapiens
tttattttaaaac

SEQ ID NO: 6591143 - DNA, 21 bp, Homo sapiens
tttattttaaaacagaagaat

SEQ ID NO: 6591144 - DNA, 18 bp, Homo sapiens
tttattttaagaggaaga

SEQ ID NO: 6591145 - DNA, 16 bp, Homo sapiens
tttattttaataatgt

SEQ ID NO: 6591146 - DNA, 14 bp, Homo sapiens
tttattttaatgta

SEQ ID NO: 6591147 - DNA, 16 bp, Homo sapiens
tttattttaatgtatt

SEQ ID NO: 6591148 - DNA, 21 bp, Homo sapiens
tttattttacacagaaacact

SEQ ID NO: 6591149 - DNA, 15 bp, Homo sapiens
tttattttacattta

SEQ ID NO: 6591150 - DNA, 12 bp, Homo sapiens
tttattttacta

SEQ ID NO: 6591151 - DNA, 16 bp, Homo sapiens
tttattttactagaaa

SEQ ID NO: 6591152 - DNA, 17 bp, Homo sapiens
tttattttataaattta

SEQ ID NO: 6591153 - DNA, 11 bp, Homo sapiens
tttattttatg

SEQ ID NO: 6591154 - DNA, 17 bp, Homo sapiens
tttattttcaaatctgg

SEQ ID NO: 6591155 - DNA, 22 bp, Homo sapiens
tttattttcagtcccctctctc

SEQ ID NO: 6591156 - DNA, 23 bp, Homo sapiens
tttattttcagtcccctctctct

SEQ ID NO: 6591157 - DNA, 13 bp, Homo sapiens
tttattttctaaa

SEQ ID NO: 6591158 - DNA, 15 bp, Homo sapiens
tttattttctgtgta

SEQ ID NO: 6591159 - DNA, 16 bp, Homo sapiens
tttattttgaaatttg

SEQ ID NO: 6591160 - DNA, 18 bp, Homo sapiens
tttattttgagatgtaaa

SEQ ID NO: 6591161 - DNA, 17 bp, Homo sapiens
tttattttgctccctct

SEQ ID NO: 6591162 - DNA, 18 bp, Homo sapiens
tttattttgctccctctg

SEQ ID NO: 6591163 - DNA, 19 bp, Homo sapiens
tttattttgctccctctgt

SEQ ID NO: 6591164 - DNA, 23 bp, Homo sapiens
tttattttggaactatgaagact

SEQ ID NO: 6591165 - DNA, 23 bp, Homo sapiens
tttattttggggaggaaaacagt

SEQ ID NO: 6591166 - DNA, 20 bp, Homo sapiens
tttattttgttaaaatctct

SEQ ID NO: 6591167 - DNA, 17 bp, Homo sapiens
tttatttttaagaaaga

SEQ ID NO: 6591168 - DNA, 23 bp, Homo sapiens
tttatttttacaagaagtttatt

SEQ ID NO: 6591169 - DNA, 16 bp, Homo sapiens
tttatttttagaattt

SEQ ID NO: 6591170 - DNA, 23 bp, Homo sapiens
tttatttttagaattttgtgaaa

SEQ ID NO: 6591171 - DNA, 12 bp, Homo sapiens
tttatttttcat

SEQ ID NO: 6591172 - DNA, 14 bp, Homo sapiens
tttatttttcatta

SEQ ID NO: 6591173 - DNA, 17 bp, Homo sapiens
tttatttttcatttagt

SEQ ID NO: 6591174 - DNA, 15 bp, Homo sapiens
tttatttttctaaaa

SEQ ID NO: 6591175 - DNA, 13 bp, Homo sapiens
tttatttttctgt

SEQ ID NO: 6591176 - DNA, 22 bp, Homo sapiens
tttatttttctttaaagccagt

SEQ ID NO: 6591177 - DNA, 22 bp, Homo sapiens
tttatttttcttttcctgggaa

SEQ ID NO: 6591178 - DNA, 23 bp, Homo sapiens
tttatttttgaacccctgtgtcc

SEQ ID NO: 6591179 - DNA, 15 bp, Homo sapiens
tttatttttgcacaa

SEQ ID NO: 6591180 - DNA, 21 bp, Homo sapiens
tttatttttgggtttggccag

SEQ ID NO: 6591181 - DNA, 15 bp, Homo sapiens
tttatttttgtactg

SEQ ID NO: 6591182 - DNA, 16 bp, Homo sapiens
tttatttttgtactgt

SEQ ID NO: 6591183 - DNA, 19 bp, Homo sapiens
tttatttttgtgtaggtgt

SEQ ID NO: 6591184 - DNA, 21 bp, Homo sapiens
tttattttttaaaaagtgttt

SEQ ID NO: 6591185 - DNA, 18 bp, Homo sapiens
tttattttttaaaaatga

SEQ ID NO: 6591186 - DNA, 16 bp, Homo sapiens
tttattttttaagaaa

SEQ ID NO: 6591187 - DNA, 17 bp, Homo sapiens
tttattttttaagttca

SEQ ID NO: 6591188 - DNA, 15 bp, Homo sapiens
tttattttttaatca

SEQ ID NO: 6591189 - DNA, 17 bp, Homo sapiens
tttattttttaatcatt

SEQ ID NO: 6591190 - DNA, 15 bp, Homo sapiens
tttattttttacatt

SEQ ID NO: 6591191 - DNA, 13 bp, Homo sapiens
tttattttttacc

SEQ ID NO: 6591192 - DNA, 14 bp, Homo sapiens
tttattttttagtg

SEQ ID NO: 6591193 - DNA, 17 bp, Homo sapiens
tttattttttcttttgt

SEQ ID NO: 6591194 - DNA, 16 bp, Homo sapiens
tttattttttgggcca

SEQ ID NO: 6591195 - DNA, 13 bp, Homo sapiens
tttattttttggt

SEQ ID NO: 6591196 - DNA, 16 bp, Homo sapiens
tttattttttgtaact

SEQ ID NO: 6591197 - DNA, 14 bp, Homo sapiens
tttatttttttcta

SEQ ID NO: 6591198 - DNA, 21 bp, Homo sapiens
tttattttttttaattgtatt

SEQ ID NO: 6591199 - DNA, 18 bp, Homo sapiens
tttattttttttcaaaat

SEQ ID NO: 6591200 - DNA, 22 bp, Homo sapiens
tttcaaaaaaaaaaaaaaagac

SEQ ID NO: 6591201 - DNA, 14 bp, Homo sapiens
tttcaaaaaaacat

SEQ ID NO: 6591202 - DNA, 17 bp, Homo sapiens
tttcaaaaatataactt

SEQ ID NO: 6591203 - DNA, 18 bp, Homo sapiens
tttcaaaaatataactta

SEQ ID NO: 6591204 - DNA, 21 bp, Homo sapiens
tttcaaaaatataacttaaaa

SEQ ID NO: 6591205 - DNA, 21 bp, Homo sapiens
tttcaaaaattgtgtttagat

SEQ ID NO: 6591206 - DNA, 15 bp, Homo sapiens
tttcaaaaatttgga

SEQ ID NO: 6591207 - DNA, 22 bp, Homo sapiens
tttcaaaaatttggaattctgt

SEQ ID NO: 6591208 - DNA, 20 bp, Homo sapiens
aatgcaagagaacattttac

SEQ ID NO: 6591209 - DNA, 23 bp, Homo sapiens
aatgcaagagaacattttactgt

SEQ ID NO: 6591210 - DNA, 17 bp, Homo sapiens
aatgcaagagaaggaga

SEQ ID NO: 6591211 - DNA, 19 bp, Homo sapiens
aatgcaagagtgattgcag

SEQ ID NO: 6591212 - DNA, 13 bp, Homo sapiens
aatgcaagctctg

SEQ ID NO: 6591213 - DNA, 16 bp, Homo sapiens
aatgcaaggggctgca

SEQ ID NO: 6591214 - DNA, 13 bp, Homo sapiens
aatgcaataactc

SEQ ID NO: 6591215 - DNA, 15 bp, Homo sapiens
aatgcaataactctg

SEQ ID NO: 6591216 - DNA, 23 bp, Homo sapiens
aatgcaataagattgcgcctgag

SEQ ID NO: 6591217 - DNA, 13 bp, Homo sapiens
aatgcaataattt

SEQ ID NO: 6591218 - DNA, 20 bp, Homo sapiens
aatgcaatataaaaatgtga

SEQ ID NO: 6591219 - DNA, 21 bp, Homo sapiens
aatgcaatataaaaatgtgaa

SEQ ID NO: 6591220 - DNA, 20 bp, Homo sapiens
aatgcaatcaatttaaatta

SEQ ID NO: 6591221 - DNA, 24 bp, Homo sapiens
aatgcaatctccccttgatttaaa

SEQ ID NO: 6591222 - DNA, 13 bp, Homo sapiens
aatgcaatgaaaa

SEQ ID NO: 6591223 - DNA, 15 bp, Homo sapiens
aatgcaatgaaaaca

SEQ ID NO: 6591224 - DNA, 16 bp, Homo sapiens
aatgcaatgaaaacaa

SEQ ID NO: 6591225 - DNA, 16 bp, Homo sapiens
aatgcaatgataaata

SEQ ID NO: 6591226 - DNA, 14 bp, Homo sapiens
aatgcaatgcatct

SEQ ID NO: 6591227 - DNA, 17 bp, Homo sapiens
aatgcaatgcatctgaa

SEQ ID NO: 6591228 - DNA, 18 bp, Homo sapiens
aatgcacaaattgaaaac

SEQ ID NO: 6591229 - DNA, 17 bp, Homo sapiens
aatgcacaagctcagaa

SEQ ID NO: 6591230 - DNA, 10 bp, Homo sapiens
aatgcacaat

SEQ ID NO: 6591231 - DNA, 16 bp, Homo sapiens
aatgcacaatttagaa

SEQ ID NO: 6591232 - DNA, 19 bp, Homo sapiens
aatgcacaatttagaaaac

SEQ ID NO: 6591233 - DNA, 15 bp, Homo sapiens
aatgcacacaaaaca

SEQ ID NO: 6591234 - DNA, 17 bp, Homo sapiens
aatgcacacaaaacaac

SEQ ID NO: 6591235 - DNA, 16 bp, Homo sapiens
aatgcacagatatact

SEQ ID NO: 6591236 - DNA, 21 bp, Homo sapiens
aatgcacagttgccacattta

SEQ ID NO: 6591237 - DNA, 18 bp, Homo sapiens
aatgcacatccattccca

SEQ ID NO: 6591238 - DNA, 17 bp, Homo sapiens
aatgcaccaagaaagct

SEQ ID NO: 6591239 - DNA, 14 bp, Homo sapiens
aatgcaccaatcag

SEQ ID NO: 6591240 - DNA, 21 bp, Homo sapiens
aatgcaccacggcagctctcc

SEQ ID NO: 6591241 - DNA, 16 bp, Homo sapiens
aatgcaccatggagac

SEQ ID NO: 6591242 - DNA, 18 bp, Homo sapiens
aatgcacccatcagcact

SEQ ID NO: 6591243 - DNA, 15 bp, Homo sapiens
aatgcacctaaagaa

SEQ ID NO: 6591244 - DNA, 21 bp, Homo sapiens
aatgcacgcgtgcatatgcta

SEQ ID NO: 6591245 - DNA, 18 bp, Homo sapiens
aatgcactaagacaagaa

SEQ ID NO: 6591246 - DNA, 18 bp, Homo sapiens
aatgcactgggaaaaagt

SEQ ID NO: 6591247 - DNA, 13 bp, Homo sapiens
aatgcactgtaat

SEQ ID NO: 6591248 - DNA, 11 bp, Homo sapiens
aatgcactgtg

SEQ ID NO: 6591249 - DNA, 21 bp, Homo sapiens
aatgcactttgttctggctct

SEQ ID NO: 6591250 - DNA, 22 bp, Homo sapiens
aatgcactttgttctggctctt

SEQ ID NO: 6591251 - DNA, 13 bp, Homo sapiens
aatgcagaaatca

SEQ ID NO: 6591252 - DNA, 12 bp, Homo sapiens
aatgcagacaca

SEQ ID NO: 6591253 - DNA, 21 bp, Homo sapiens
aatgcagacatttacatgttc

SEQ ID NO: 6591254 - DNA, 20 bp, Homo sapiens
aatgcagacttttcagactg

SEQ ID NO: 6591255 - DNA, 11 bp, Homo sapiens
aatgcagagat

SEQ ID NO: 6591256 - DNA, 17 bp, Homo sapiens
aatgcagaggaggagaa

SEQ ID NO: 6591257 - DNA, 19 bp, Homo sapiens
aatgcagataaatacattt

SEQ ID NO: 6591258 - DNA, 18 bp, Homo sapiens
aatgcagattacactgat

SEQ ID NO: 6591259 - DNA, 22 bp, Homo sapiens
aatgcagattcataggcagcat

SEQ ID NO: 6591260 - DNA, 16 bp, Homo sapiens
aatgcagattcctggg

SEQ ID NO: 6591261 - DNA, 15 bp, Homo sapiens
aatgcagatttctct

SEQ ID NO: 6591262 - DNA, 23 bp, Homo sapiens
aatgcagcaaggccctgctgccc

SEQ ID NO: 6591263 - DNA, 12 bp, Homo sapiens
aatgcagcactg

SEQ ID NO: 6591264 - DNA, 20 bp, Homo sapiens
aatgcagccacgattggaga

SEQ ID NO: 6591265 - DNA, 23 bp, Homo sapiens
aatgcagccacgattggagaata

SEQ ID NO: 6591266 - DNA, 18 bp, Homo sapiens
aatgcagcccatttctcc

SEQ ID NO: 6591267 - DNA, 23 bp, Homo sapiens
aatgcagcttcaggtgagccaag

SEQ ID NO: 6591268 - DNA, 22 bp, Homo sapiens
aatgcagcttgtgtgcaaaagc

SEQ ID NO: 6591269 - DNA, 11 bp, Homo sapiens
aatgcaggaga

SEQ ID NO: 6591270 - DNA, 18 bp, Homo sapiens
aatgcagggaagagggca

SEQ ID NO: 6591271 - DNA, 13 bp, Homo sapiens
aatgcagtacaga

SEQ ID NO: 6591272 - DNA, 14 bp, Homo sapiens
aatgcagtataaaa

SEQ ID NO: 6591273 - DNA, 15 bp, Homo sapiens
aatgcagtatggtac

SEQ ID NO: 6591274 - DNA, 15 bp, Homo sapiens
aatgcagtccagaat

SEQ ID NO: 6591275 - DNA, 20 bp, Homo sapiens
aatgcagtctgtccaggctc

SEQ ID NO: 6591276 - DNA, 17 bp, Homo sapiens
aatgcagtgaattgtga

SEQ ID NO: 6591277 - DNA, 14 bp, Homo sapiens
aatgcagtgtattt

SEQ ID NO: 6591278 - DNA, 23 bp, Homo sapiens
aatgcagtgtatttaatgtttgt

SEQ ID NO: 6591279 - DNA, 19 bp, Homo sapiens
aatgcagttgtctctgttt

SEQ ID NO: 6591280 - DNA, 17 bp, Homo sapiens
aatgcagttgttgtaca

SEQ ID NO: 6591281 - DNA, 16 bp, Homo sapiens
aatgcagttttaagaa

SEQ ID NO: 6591282 - DNA, 15 bp, Homo sapiens
aatgcagtttttaaa

SEQ ID NO: 6591283 - DNA, 13 bp, Homo sapiens
aatgcataaaatg

SEQ ID NO: 6591284 - DNA, 15 bp, Homo sapiens
aatgcataaataaat

SEQ ID NO: 6591285 - DNA, 19 bp, Homo sapiens
aatgcataatgtctttaaa

SEQ ID NO: 6591286 - DNA, 16 bp, Homo sapiens
aatgcatacaataaaa

SEQ ID NO: 6591287 - DNA, 23 bp, Homo sapiens
aatgcatacaataaaagagcttt

SEQ ID NO: 6591288 - DNA, 22 bp, Homo sapiens
aatgcatactgttgatacaaac

SEQ ID NO: 6591289 - DNA, 14 bp, Homo sapiens
aatgcatagagcaa

SEQ ID NO: 6591290 - DNA, 16 bp, Homo sapiens
aatgcatagagcaatt

SEQ ID NO: 6591291 - DNA, 16 bp, Homo sapiens
aatgcatagagccctg

SEQ ID NO: 6591292 - DNA, 18 bp, Homo sapiens
aatgcatagagccctggc

SEQ ID NO: 6591293 - DNA, 14 bp, Homo sapiens
aatgcatagtttgt

SEQ ID NO: 6591294 - DNA, 19 bp, Homo sapiens
aatgcatatcctgagccat

SEQ ID NO: 6591295 - DNA, 14 bp, Homo sapiens
aatgcatatctgtt

SEQ ID NO: 6591296 - DNA, 14 bp, Homo sapiens
aatgcatattcaac

SEQ ID NO: 6591297 - DNA, 17 bp, Homo sapiens
aatgcatattcaacaca

SEQ ID NO: 6591298 - DNA, 16 bp, Homo sapiens
aatgcatattgtatta

SEQ ID NO: 6591299 - DNA, 15 bp, Homo sapiens
aatgcatatttataa

SEQ ID NO: 6591300 - DNA, 20 bp, Homo sapiens
aatgcatatttataagagaa

SEQ ID NO: 6591301 - DNA, 17 bp, Homo sapiens
aatgcatatttctatgt

SEQ ID NO: 6591302 - DNA, 18 bp, Homo sapiens
aatgcatatttgcaaagt

SEQ ID NO: 6591303 - DNA, 15 bp, Homo sapiens
aatgcatatttttgc

SEQ ID NO: 6591304 - DNA, 18 bp, Homo sapiens
aatgcatcaatatgtatt

SEQ ID NO: 6591305 - DNA, 20 bp, Homo sapiens
aatgcatcaatcctgtgtgg

SEQ ID NO: 6591306 - DNA, 21 bp, Homo sapiens
aatgcatcaatcctgtgtggt

SEQ ID NO: 6591307 - DNA, 23 bp, Homo sapiens
aatgcatccattcctcagggaca

SEQ ID NO: 6591308 - DNA, 22 bp, Homo sapiens
aatgcatccttaacctttatta

SEQ ID NO: 6591309 - DNA, 20 bp, Homo sapiens
aatgcatctgaaagttttga

SEQ ID NO: 6591310 - DNA, 16 bp, Homo sapiens
aatgcatctgtcctca

SEQ ID NO: 6591311 - DNA, 20 bp, Homo sapiens
aatgcatctttgatgtgttg

SEQ ID NO: 6591312 - DNA, 19 bp, Homo sapiens
aatgcatgatattgtatgt

SEQ ID NO: 6591313 - DNA, 23 bp, Homo sapiens
aatgcatgatattgtatgtacct

SEQ ID NO: 6591314 - DNA, 24 bp, Homo sapiens
aatgcatgatgactcttcttatca

SEQ ID NO: 6591315 - DNA, 13 bp, Homo sapiens
aatgcatgatttt

SEQ ID NO: 6591316 - DNA, 14 bp, Homo sapiens
aatgcatgatttta

SEQ ID NO: 6591317 - DNA, 15 bp, Homo sapiens
aatgcatgattttat

SEQ ID NO: 6591318 - DNA, 16 bp, Homo sapiens
aatgcatgattttata

SEQ ID NO: 6591319 - DNA, 17 bp, Homo sapiens
aatgcatgattttatac

SEQ ID NO: 6591320 - DNA, 19 bp, Homo sapiens
aatgcatgattttgtaacc

SEQ ID NO: 6591321 - DNA, 13 bp, Homo sapiens
aatgcatgctttc

SEQ ID NO: 6591322 - DNA, 20 bp, Homo sapiens
aatgcatgctttggaaattt

SEQ ID NO: 6591323 - DNA, 21 bp, Homo sapiens
aatgcatgtaaggtcttcttg

SEQ ID NO: 6591324 - DNA, 12 bp, Homo sapiens
aatgcatgtctt

SEQ ID NO: 6591325 - DNA, 19 bp, Homo sapiens
aatgcatgtcttaaatgct

SEQ ID NO: 6591326 - DNA, 15 bp, Homo sapiens
aatgcatgtgctgtc

SEQ ID NO: 6591327 - DNA, 11 bp, Homo sapiens
aatgcatgtgt

SEQ ID NO: 6591328 - DNA, 14 bp, Homo sapiens
aatgcattattttg

SEQ ID NO: 6591329 - DNA, 15 bp, Homo sapiens
aatgcattattttgt

SEQ ID NO: 6591330 - DNA, 21 bp, Homo sapiens
aatgcattattttgtcataaa

SEQ ID NO: 6591331 - DNA, 13 bp, Homo sapiens
aatgcattcaaaa

SEQ ID NO: 6591332 - DNA, 15 bp, Homo sapiens
aatgcattcaaaata

SEQ ID NO: 6591333 - DNA, 15 bp, Homo sapiens
aatgcattcatgttt

SEQ ID NO: 6591334 - DNA, 18 bp, Homo sapiens
aatgcattccagaacaaa

SEQ ID NO: 6591335 - DNA, 14 bp, Homo sapiens
aatgcattctttct

SEQ ID NO: 6591336 - DNA, 21 bp, Homo sapiens
aatgcattctttcttctcttt

SEQ ID NO: 6591337 - DNA, 14 bp, Homo sapiens
aatgcattgatatt

SEQ ID NO: 6591338 - DNA, 16 bp, Homo sapiens
aatgcattgatattgt

SEQ ID NO: 6591339 - DNA, 20 bp, Homo sapiens
aatgcattgatattgtgaac

SEQ ID NO: 6591340 - DNA, 21 bp, Homo sapiens
aatgcattgtatcgatgttat

SEQ ID NO: 6591341 - DNA, 22 bp, Homo sapiens
aatgcattgtgaattgcctgcc

SEQ ID NO: 6591342 - DNA, 21 bp, Homo sapiens
aatgcattgttgtaaagtatt

SEQ ID NO: 6591343 - DNA, 22 bp, Homo sapiens
aatgcattgttgtaaagtattt

SEQ ID NO: 6591344 - DNA, 17 bp, Homo sapiens
aatgcatttaaaatacc

SEQ ID NO: 6591345 - DNA, 20 bp, Homo sapiens
aatgcatttaagttgtaaac

SEQ ID NO: 6591346 - DNA, 19 bp, Homo sapiens
aatgcatttatagatcatt

SEQ ID NO: 6591347 - DNA, 21 bp, Homo sapiens
aatgcattttctacatgtatt

SEQ ID NO: 6591348 - DNA, 22 bp, Homo sapiens
aatgcattttctgggtgaaaga

SEQ ID NO: 6591349 - DNA, 23 bp, Homo sapiens
aatgcattttgctagacagttaa

SEQ ID NO: 6591350 - DNA, 21 bp, Homo sapiens
aatgcattttgtttggtattg

SEQ ID NO: 6591351 - DNA, 23 bp, Homo sapiens
aatgcattttgtttggtattgta

SEQ ID NO: 6591352 - DNA, 18 bp, Homo sapiens
aatgcatttttaagaatt

SEQ ID NO: 6591353 - DNA, 22 bp, Homo sapiens
aatgccaaaaacaaaatggtaa

SEQ ID NO: 6591354 - DNA, 17 bp, Homo sapiens
aatgccaaaatgtactt

SEQ ID NO: 6591355 - DNA, 16 bp, Homo sapiens
aatgccaagactctat

SEQ ID NO: 6591356 - DNA, 19 bp, Homo sapiens
aatgccaagactctatgct

SEQ ID NO: 6591357 - DNA, 13 bp, Homo sapiens
aatgccaagataa

SEQ ID NO: 6591358 - DNA, 14 bp, Homo sapiens
aatgccaagcactt

SEQ ID NO: 6591359 - DNA, 19 bp, Homo sapiens
aatgccaagggtaaacaag

SEQ ID NO: 6591360 - DNA, 15 bp, Homo sapiens
aatgccaagtgcctg

SEQ ID NO: 6591361 - DNA, 15 bp, Homo sapiens
aatgccaatgaacat

SEQ ID NO: 6591362 - DNA, 16 bp, Homo sapiens
aatgccaattcatctc

SEQ ID NO: 6591363 - DNA, 15 bp, Homo sapiens
aatgccacagccctg

SEQ ID NO: 6591364 - DNA, 23 bp, Homo sapiens
aatgccacagccctgtcagcatg

SEQ ID NO: 6591365 - DNA, 17 bp, Homo sapiens
aatgccaccacacgtgt

SEQ ID NO: 6591366 - DNA, 18 bp, Homo sapiens
aatgccacctagactctc

SEQ ID NO: 6591367 - DNA, 23 bp, Homo sapiens
aatgccacgtgccattgtctttc

SEQ ID NO: 6591368 - DNA, 21 bp, Homo sapiens
aatgccacgtggtcactgtgc

SEQ ID NO: 6591369 - DNA, 12 bp, Homo sapiens
aatgccactccc

SEQ ID NO: 6591370 - DNA, 18 bp, Homo sapiens
aatgccactctgggcagt

SEQ ID NO: 6591371 - DNA, 18 bp, Homo sapiens
aatgccagagccaacctg

SEQ ID NO: 6591372 - DNA, 14 bp, Homo sapiens
aatgccagcccaaa

SEQ ID NO: 6591373 - DNA, 17 bp, Homo sapiens
aatgccagtctcattgt

SEQ ID NO: 6591374 - DNA, 16 bp, Homo sapiens
aatgccataatacaaa

SEQ ID NO: 6591375 - DNA, 15 bp, Homo sapiens
aatgccatcaaatga

SEQ ID NO: 6591376 - DNA, 23 bp, Homo sapiens
aatgccatcaataaaaaattatg

SEQ ID NO: 6591377 - DNA, 17 bp, Homo sapiens
aatgccatcagcccctg

SEQ ID NO: 6591378 - DNA, 20 bp, Homo sapiens
aatgccatcagcccctggga

SEQ ID NO: 6591379 - DNA, 15 bp, Homo sapiens
aatgccatcatctcc

SEQ ID NO: 6591380 - DNA, 22 bp, Homo sapiens
aatgccatcctcaaacactgca

SEQ ID NO: 6591381 - DNA, 16 bp, Homo sapiens
aatgccatgaacaaat

SEQ ID NO: 6591382 - DNA, 21 bp, Homo sapiens
aatgccatggacagaagaagg

SEQ ID NO: 6591383 - DNA, 22 bp, Homo sapiens
aatgccatttagcaataaataa

SEQ ID NO: 6591384 - DNA, 22 bp, Homo sapiens
aatgcccaacttactgtcttct

SEQ ID NO: 6591385 - DNA, 11 bp, Homo sapiens
aatgcccagac

SEQ ID NO: 6591386 - DNA, 21 bp, Homo sapiens
tttcaaaacatacaagcaaca

SEQ ID NO: 6591387 - DNA, 13 bp, Homo sapiens
tttcaaaagacac

SEQ ID NO: 6591388 - DNA, 18 bp, Homo sapiens
tttcaaaagacatgttgt

SEQ ID NO: 6591389 - DNA, 12 bp, Homo sapiens
tttcaaaagcat

SEQ ID NO: 6591390 - DNA, 14 bp, Homo sapiens
tttcaaaaggaagg

SEQ ID NO: 6591391 - DNA, 13 bp, Homo sapiens
tttcaaaagtgat

SEQ ID NO: 6591392 - DNA, 19 bp, Homo sapiens
tttcaaaatagaaaagtta

SEQ ID NO: 6591393 - DNA, 13 bp, Homo sapiens
tttcaaaatatat

SEQ ID NO: 6591394 - DNA, 22 bp, Homo sapiens
tttcaaaatatattttcagtac

SEQ ID NO: 6591395 - DNA, 21 bp, Homo sapiens
tttcaaaatccaaaaagaaat

SEQ ID NO: 6591396 - DNA, 15 bp, Homo sapiens
tttcaaaatgctttt

SEQ ID NO: 6591397 - DNA, 19 bp, Homo sapiens
tttcaaaattaatagcttt

SEQ ID NO: 6591398 - DNA, 23 bp, Homo sapiens
tttcaaaccagtttcacataagt

SEQ ID NO: 6591399 - DNA, 16 bp, Homo sapiens
tttcaaactcctgacc

SEQ ID NO: 6591400 - DNA, 20 bp, Homo sapiens
tttcaaactcctgactttgt

SEQ ID NO: 6591401 - DNA, 17 bp, Homo sapiens
tttcaaactgaatttgt

SEQ ID NO: 6591402 - DNA, 14 bp, Homo sapiens
tttcaaactgtaaa

SEQ ID NO: 6591403 - DNA, 12 bp, Homo sapiens
tttcaaacttta

SEQ ID NO: 6591404 - DNA, 22 bp, Homo sapiens
tttcaaactttactatggccct

SEQ ID NO: 6591405 - DNA, 22 bp, Homo sapiens
tttcaaactttattgacaagtg

SEQ ID NO: 6591406 - DNA, 12 bp, Homo sapiens
tttcaaactttt

SEQ ID NO: 6591407 - DNA, 15 bp, Homo sapiens
tttcaaacttttgaa

SEQ ID NO: 6591408 - DNA, 13 bp, Homo sapiens
tttcaaagaaaga

SEQ ID NO: 6591409 - DNA, 15 bp, Homo sapiens
tttcaaagaaagact

SEQ ID NO: 6591410 - DNA, 18 bp, Homo sapiens
tttcaaagaaagactgta

SEQ ID NO: 6591411 - DNA, 13 bp, Homo sapiens
tttcaaagaactc

SEQ ID NO: 6591412 - DNA, 13 bp, Homo sapiens
tttcaaagacaat

SEQ ID NO: 6591413 - DNA, 16 bp, Homo sapiens
tttcaaagactgccac

SEQ ID NO: 6591414 - DNA, 20 bp, Homo sapiens
tttcaaagacttcatttaac

SEQ ID NO: 6591415 - DNA, 19 bp, Homo sapiens
tttcaaagatgctgtgagt

SEQ ID NO: 6591416 - DNA, 22 bp, Homo sapiens
tttcaaagcaattgaaatgcat

SEQ ID NO: 6591417 - DNA, 12 bp, Homo sapiens
tttcaaagcact

SEQ ID NO: 6591418 - DNA, 14 bp, Homo sapiens
tttcaaagccctgc

SEQ ID NO: 6591419 - DNA, 12 bp, Homo sapiens
tttcaaaggaaa

SEQ ID NO: 6591420 - DNA, 17 bp, Homo sapiens
tttcaaagggagagaga

SEQ ID NO: 6591421 - DNA, 17 bp, Homo sapiens
tttcaaagggattgctt

SEQ ID NO: 6591422 - DNA, 17 bp, Homo sapiens
tttcaaaggtacttgga

SEQ ID NO: 6591423 - DNA, 21 bp, Homo sapiens
tttcaaagtaaaggcctcctc

SEQ ID NO: 6591424 - DNA, 15 bp, Homo sapiens
tttcaaagtacataa

SEQ ID NO: 6591425 - DNA, 19 bp, Homo sapiens
tttcaaagtgcacacacac

SEQ ID NO: 6591426 - DNA, 23 bp, Homo sapiens
tttcaaagtgtctcattctcaga

SEQ ID NO: 6591427 - DNA, 20 bp, Homo sapiens
tttcaaagttttgttgtact

SEQ ID NO: 6591428 - DNA, 20 bp, Homo sapiens
tttcaaataactgcagaaaa

SEQ ID NO: 6591429 - DNA, 20 bp, Homo sapiens
tttcaaataatgcttttcta

SEQ ID NO: 6591430 - DNA, 14 bp, Homo sapiens
tttcaaatattgaa

SEQ ID NO: 6591431 - DNA, 17 bp, Homo sapiens
tttcaaatattgaatgc

SEQ ID NO: 6591432 - DNA, 16 bp, Homo sapiens
tttcaaatcattcctt

SEQ ID NO: 6591433 - DNA, 15 bp, Homo sapiens
tttcaaatcattttt

SEQ ID NO: 6591434 - DNA, 12 bp, Homo sapiens
tttcaaatcctt

SEQ ID NO: 6591435 - DNA, 21 bp, Homo sapiens
tttcaaatctcttccttccct

SEQ ID NO: 6591436 - DNA, 15 bp, Homo sapiens
tttcaaatctgtaat

SEQ ID NO: 6591437 - DNA, 19 bp, Homo sapiens
tttcaaatgagtttaaaaa

SEQ ID NO: 6591438 - DNA, 23 bp, Homo sapiens
tttcaaatgattatgattagtta

SEQ ID NO: 6591439 - DNA, 11 bp, Homo sapiens
tttcaaatgca

SEQ ID NO: 6591440 - DNA, 14 bp, Homo sapiens
tttcaaatgcagaa

SEQ ID NO: 6591441 - DNA, 11 bp, Homo sapiens
tttcaaatgtg

SEQ ID NO: 6591442 - DNA, 13 bp, Homo sapiens
tttcaaatgttag

SEQ ID NO: 6591443 - DNA, 14 bp, Homo sapiens
tttcaaatgttctc

SEQ ID NO: 6591444 - DNA, 18 bp, Homo sapiens
tttcaaattaatctttct

SEQ ID NO: 6591445 - DNA, 20 bp, Homo sapiens
tttcaaattaatctttctat

SEQ ID NO: 6591446 - DNA, 21 bp, Homo sapiens
tttcaaattaatctttctata

SEQ ID NO: 6591447 - DNA, 19 bp, Homo sapiens
tttcaaattaatgttccag

SEQ ID NO: 6591448 - DNA, 12 bp, Homo sapiens
tttcaaattatt

SEQ ID NO: 6591449 - DNA, 14 bp, Homo sapiens
tttcaaattgcctt

SEQ ID NO: 6591450 - DNA, 20 bp, Homo sapiens
tttcaaattggactttcaaa

SEQ ID NO: 6591451 - DNA, 21 bp, Homo sapiens
tttcaacaaatttcattgcac

SEQ ID NO: 6591452 - DNA, 19 bp, Homo sapiens
tttcaacaagcctgaaagt

SEQ ID NO: 6591453 - DNA, 20 bp, Homo sapiens
tttcaacaattggtgtcatt

SEQ ID NO: 6591454 - DNA, 14 bp, Homo sapiens
tttcaacactgaaa

SEQ ID NO: 6591455 - DNA, 20 bp, Homo sapiens
tttcaacactgaaaaaatac

SEQ ID NO: 6591456 - DNA, 22 bp, Homo sapiens
tttcaacagagccctattggct

SEQ ID NO: 6591457 - DNA, 19 bp, Homo sapiens
tttcaacagtgaagacaga

SEQ ID NO: 6591458 - DNA, 16 bp, Homo sapiens
tttcaacatatcattt

SEQ ID NO: 6591459 - DNA, 16 bp, Homo sapiens
tttcaacatgagtgta

SEQ ID NO: 6591460 - DNA, 21 bp, Homo sapiens
tttcaacatttttttttctcc

SEQ ID NO: 6591461 - DNA, 22 bp, Homo sapiens
tttcaacatttttttttctcca

SEQ ID NO: 6591462 - DNA, 19 bp, Homo sapiens
tttcaaccagcattttact

SEQ ID NO: 6591463 - DNA, 20 bp, Homo sapiens
tttcaaccagcattttacta

SEQ ID NO: 6591464 - DNA, 23 bp, Homo sapiens
tttcaaccaggcacctcaaagcg

SEQ ID NO: 6591465 - DNA, 14 bp, Homo sapiens
tttcaaccccaccc

SEQ ID NO: 6591466 - DNA, 18 bp, Homo sapiens
tttcaaccgcttgccata

SEQ ID NO: 6591467 - DNA, 19 bp, Homo sapiens
tttcaacctagaaaccttt

SEQ ID NO: 6591468 - DNA, 22 bp, Homo sapiens
tttcaacctctagaattttaag

SEQ ID NO: 6591469 - DNA, 15 bp, Homo sapiens
tttcaacgcagccct

SEQ ID NO: 6591470 - DNA, 21 bp, Homo sapiens
tttcaacgcagccctgctttg

SEQ ID NO: 6591471 - DNA, 15 bp, Homo sapiens
tttcaacggaaagtg

SEQ ID NO: 6591472 - DNA, 18 bp, Homo sapiens
tttcaacgtatgtgtgtt

SEQ ID NO: 6591473 - DNA, 22 bp, Homo sapiens
tttcaactaatgtgtattatgt

SEQ ID NO: 6591474 - DNA, 20 bp, Homo sapiens
tttcaactagaaaattctaa

SEQ ID NO: 6591475 - DNA, 13 bp, Homo sapiens
tttcaactccaga

SEQ ID NO: 6591476 - DNA, 19 bp, Homo sapiens
tttcaactgggttttcagc

SEQ ID NO: 6591477 - DNA, 18 bp, Homo sapiens
tttcaacttcttctatat

SEQ ID NO: 6591478 - DNA, 16 bp, Homo sapiens
tttcaacttggatcat

SEQ ID NO: 6591479 - DNA, 13 bp, Homo sapiens
tttcaactttctt

SEQ ID NO: 6591480 - DNA, 22 bp, Homo sapiens
tttcaagaaaaaataaatggaa

SEQ ID NO: 6591481 - DNA, 14 bp, Homo sapiens
tttcaagaaaatct

SEQ ID NO: 6591482 - DNA, 13 bp, Homo sapiens
tttcaagaatatg

SEQ ID NO: 6591483 - DNA, 21 bp, Homo sapiens
tttcaagaatgtttcagttat

SEQ ID NO: 6591484 - DNA, 16 bp, Homo sapiens
tttcaagacagatgag

SEQ ID NO: 6591485 - DNA, 21 bp, Homo sapiens
tttcaagacagcctaatgaag

SEQ ID NO: 6591486 - DNA, 20 bp, Homo sapiens
tttcaagacattaaatctat

SEQ ID NO: 6591487 - DNA, 22 bp, Homo sapiens
tttcaagagaagaaaaaattaa

SEQ ID NO: 6591488 - DNA, 24 bp, Homo sapiens
tttcaagagtgcagttgattctga

SEQ ID NO: 6591489 - DNA, 14 bp, Homo sapiens
tttcaagattctaa

SEQ ID NO: 6591490 - DNA, 22 bp, Homo sapiens
tttcaagcagtcgtgcctgtgt

SEQ ID NO: 6591491 - DNA, 13 bp, Homo sapiens
tttcaagcatctc

SEQ ID NO: 6591492 - DNA, 17 bp, Homo sapiens
tttcaagcatctcctga

SEQ ID NO: 6591493 - DNA, 12 bp, Homo sapiens
tttcaagccctc

SEQ ID NO: 6591494 - DNA, 22 bp, Homo sapiens
tttcaagcctgcctaggaattc

SEQ ID NO: 6591495 - DNA, 20 bp, Homo sapiens
tttcaagcgtcactttattt

SEQ ID NO: 6591496 - DNA, 14 bp, Homo sapiens
tttcaagcttattt

SEQ ID NO: 6591497 - DNA, 15 bp, Homo sapiens
tttcaaggaaagtga

SEQ ID NO: 6591498 - DNA, 17 bp, Homo sapiens
tttcaaggaagaaaacg

SEQ ID NO: 6591499 - DNA, 16 bp, Homo sapiens
tttcaaggcacattga

SEQ ID NO: 6591500 - DNA, 20 bp, Homo sapiens
tttcaaggcactctagattc

SEQ ID NO: 6591501 - DNA, 16 bp, Homo sapiens
tttcaaggccttcagt

SEQ ID NO: 6591502 - DNA, 16 bp, Homo sapiens
tttcaaggctggggca

SEQ ID NO: 6591503 - DNA, 15 bp, Homo sapiens
tttcaagtaataaaa

SEQ ID NO: 6591504 - DNA, 11 bp, Homo sapiens
tttcaagtagc

SEQ ID NO: 6591505 - DNA, 16 bp, Homo sapiens
tttcaagtatttaagc

SEQ ID NO: 6591506 - DNA, 23 bp, Homo sapiens
tttcaagtatttaagcctaaaga

SEQ ID NO: 6591507 - DNA, 19 bp, Homo sapiens
tttcaagtctgactctcca

SEQ ID NO: 6591508 - DNA, 19 bp, Homo sapiens
tttcaagtgcctagactgt

SEQ ID NO: 6591509 - DNA, 22 bp, Homo sapiens
tttcaagtgcctagactgttac

SEQ ID NO: 6591510 - DNA, 23 bp, Homo sapiens
tttcaagtgcctagactgttact

SEQ ID NO: 6591511 - DNA, 23 bp, Homo sapiens
tttcaagtgcctttctgcagttt

SEQ ID NO: 6591512 - DNA, 18 bp, Homo sapiens
tttcaagtgtacatgtgt

SEQ ID NO: 6591513 - DNA, 17 bp, Homo sapiens
tttcaagttattcaaat

SEQ ID NO: 6591514 - DNA, 15 bp, Homo sapiens
tttcaagttattcag

SEQ ID NO: 6591515 - DNA, 12 bp, Homo sapiens
tttcaagttgca

SEQ ID NO: 6591516 - DNA, 16 bp, Homo sapiens
tttcaagttgtaaata

SEQ ID NO: 6591517 - DNA, 11 bp, Homo sapiens
tttcaagttta

SEQ ID NO: 6591518 - DNA, 12 bp, Homo sapiens
tttcaagtttac

SEQ ID NO: 6591519 - DNA, 16 bp, Homo sapiens
tttcaagtttacactt

SEQ ID NO: 6591520 - DNA, 17 bp, Homo sapiens
tttcaagttttaaagtt

SEQ ID NO: 6591521 - DNA, 18 bp, Homo sapiens
tttcaagttttaaagttc

SEQ ID NO: 6591522 - DNA, 13 bp, Homo sapiens
tttcaataaaact

SEQ ID NO: 6591523 - DNA, 13 bp, Homo sapiens
tttcaataaagtt

SEQ ID NO: 6591524 - DNA, 15 bp, Homo sapiens
tttcaataaatcttt

SEQ ID NO: 6591525 - DNA, 14 bp, Homo sapiens
tttcaataaatgat

SEQ ID NO: 6591526 - DNA, 18 bp, Homo sapiens
tttcaataaatgtatcat

SEQ ID NO: 6591527 - DNA, 19 bp, Homo sapiens
tttcaataacaaagcacat

SEQ ID NO: 6591528 - DNA, 21 bp, Homo sapiens
tttcaataagtgttgtaccat

SEQ ID NO: 6591529 - DNA, 15 bp, Homo sapiens
tttcaatagcacata

SEQ ID NO: 6591530 - DNA, 13 bp, Homo sapiens
tttcaatagccac

SEQ ID NO: 6591531 - DNA, 12 bp, Homo sapiens
tttcaataggaa

SEQ ID NO: 6591532 - DNA, 14 bp, Homo sapiens
tttcaataggaaaa

SEQ ID NO: 6591533 - DNA, 22 bp, Homo sapiens
tttcaatagtggcataccaaat

SEQ ID NO: 6591534 - DNA, 23 bp, Homo sapiens
tttcaatatattactaataactt

SEQ ID NO: 6591535 - DNA, 14 bp, Homo sapiens
tttcaatatattga

SEQ ID NO: 6591536 - DNA, 19 bp, Homo sapiens
tttcaatatattgaacttt

SEQ ID NO: 6591537 - DNA, 13 bp, Homo sapiens
tttcaatcaactt

SEQ ID NO: 6591538 - DNA, 20 bp, Homo sapiens
tttcaatcaactttactgta

SEQ ID NO: 6591539 - DNA, 13 bp, Homo sapiens
tttcaatcattga

SEQ ID NO: 6591540 - DNA, 18 bp, Homo sapiens
tttcaatcattgaagtat

SEQ ID NO: 6591541 - DNA, 23 bp, Homo sapiens
tttcaatccacagtattgttctt

SEQ ID NO: 6591542 - DNA, 14 bp, Homo sapiens
tttcaatccaggag

SEQ ID NO: 6591543 - DNA, 15 bp, Homo sapiens
tttcaatccattttt

SEQ ID NO: 6591544 - DNA, 23 bp, Homo sapiens
tttcaatctcgtatagaagtctt

SEQ ID NO: 6591545 - DNA, 13 bp, Homo sapiens
tttcaatcttcta

SEQ ID NO: 6591546 - DNA, 13 bp, Homo sapiens
tttcaatctttta

SEQ ID NO: 6591547 - DNA, 16 bp, Homo sapiens
tttcaatcttttaaat

SEQ ID NO: 6591548 - DNA, 20 bp, Homo sapiens
tttcaatcttttaaattgca

SEQ ID NO: 6591549 - DNA, 16 bp, Homo sapiens
tttcaatgaattaaga

SEQ ID NO: 6591550 - DNA, 14 bp, Homo sapiens
tttcaatgacattt

SEQ ID NO: 6591551 - DNA, 13 bp, Homo sapiens
tttcaatgcaatg

SEQ ID NO: 6591552 - DNA, 18 bp, Homo sapiens
tttcaatgcaatgcatct

SEQ ID NO: 6591553 - DNA, 17 bp, Homo sapiens
tttcaatgcttctttta

SEQ ID NO: 6591554 - DNA, 18 bp, Homo sapiens
tttcaatggttgggacaa

SEQ ID NO: 6591555 - DNA, 16 bp, Homo sapiens
tttcaatgtagtctgt

SEQ ID NO: 6591556 - DNA, 10 bp, Homo sapiens
tttcaatgtg

SEQ ID NO: 6591557 - DNA, 15 bp, Homo sapiens
tttcaatgtgaaaca

SEQ ID NO: 6591558 - DNA, 17 bp, Homo sapiens
tttcaatgtgattcttc

SEQ ID NO: 6591559 - DNA, 14 bp, Homo sapiens
tttcaatgtgtata

SEQ ID NO: 6591560 - DNA, 22 bp, Homo sapiens
tttcaatgtgttggaaactgta

SEQ ID NO: 6591561 - DNA, 13 bp, Homo sapiens
tttcaatgtgttt

SEQ ID NO: 6591562 - DNA, 15 bp, Homo sapiens
tttcaatgtttgaaa

SEQ ID NO: 6591563 - DNA, 12 bp, Homo sapiens
tttcaattaaac

SEQ ID NO: 6591564 - DNA, 13 bp, Homo sapiens
tttcaattaaacg

SEQ ID NO: 6591565 - DNA, 16 bp, Homo sapiens
tttcaattaaacggat

SEQ ID NO: 6591566 - DNA, 18 bp, Homo sapiens
tttcaattaaacggatta

SEQ ID NO: 6591567 - DNA, 21 bp, Homo sapiens
tttcaattaaacggattattt

SEQ ID NO: 6591568 - DNA, 16 bp, Homo sapiens
tttcaattcaaaaatg

SEQ ID NO: 6591569 - DNA, 19 bp, Homo sapiens
tttcaattcaaaaatgtac

SEQ ID NO: 6591570 - DNA, 20 bp, Homo sapiens
tttcaattcaaaaatgtaca

SEQ ID NO: 6591571 - DNA, 16 bp, Homo sapiens
tttcaattctgtaggt

SEQ ID NO: 6591572 - DNA, 23 bp, Homo sapiens
tttcaattgagtaattctagaca

SEQ ID NO: 6591573 - DNA, 20 bp, Homo sapiens
tttcaattgcatctcccaga

SEQ ID NO: 6591574 - DNA, 22 bp, Homo sapiens
tttcaattgtattttatatgag

SEQ ID NO: 6591575 - DNA, 14 bp, Homo sapiens
tttcaattgtttat

SEQ ID NO: 6591576 - DNA, 12 bp, Homo sapiens
tttcaatttcaa

SEQ ID NO: 6591577 - DNA, 19 bp, Homo sapiens
tttcaatttccaagagctg

SEQ ID NO: 6591578 - DNA, 15 bp, Homo sapiens
tttcaattttaaaca

SEQ ID NO: 6591579 - DNA, 18 bp, Homo sapiens
tttcaattttaaacatat

SEQ ID NO: 6591580 - DNA, 13 bp, Homo sapiens
tttcacaaatatt

SEQ ID NO: 6591581 - DNA, 17 bp, Homo sapiens
tttcacaaatattaaaa

SEQ ID NO: 6591582 - DNA, 14 bp, Homo sapiens
tttcacaaatttgt

SEQ ID NO: 6591583 - DNA, 19 bp, Homo sapiens
tttcacaacagatttctaa

SEQ ID NO: 6591584 - DNA, 16 bp, Homo sapiens
tttcacaacaggcatt

SEQ ID NO: 6591585 - DNA, 16 bp, Homo sapiens
tttcacaaccttctgt

SEQ ID NO: 6591586 - DNA, 13 bp, Homo sapiens
tttcacaagcaac

SEQ ID NO: 6591587 - DNA, 21 bp, Homo sapiens
tttcacaaggtacaaaatctt

SEQ ID NO: 6591588 - DNA, 17 bp, Homo sapiens
tttcacaaggtctttaa

SEQ ID NO: 6591589 - DNA, 14 bp, Homo sapiens
tttcacaatataaa

SEQ ID NO: 6591590 - DNA, 16 bp, Homo sapiens
tttcacaatgtgaaac

SEQ ID NO: 6591591 - DNA, 17 bp, Homo sapiens
tttcacaattattaaat

SEQ ID NO: 6591592 - DNA, 14 bp, Homo sapiens
tttcacacaactgt

SEQ ID NO: 6591593 - DNA, 16 bp, Homo sapiens
tttcacacaggtcctg

SEQ ID NO: 6591594 - DNA, 23 bp, Homo sapiens
tttcacacatctgggtgccctga

SEQ ID NO: 6591595 - DNA, 19 bp, Homo sapiens
tttcacactggtaaatgtt

SEQ ID NO: 6591596 - DNA, 21 bp, Homo sapiens
tttcacactggtaaatgttac

SEQ ID NO: 6591597 - DNA, 19 bp, Homo sapiens
tttcacactgtcttcccga

SEQ ID NO: 6591598 - DNA, 17 bp, Homo sapiens
tttcacagaaaataagg

SEQ ID NO: 6591599 - DNA, 23 bp, Homo sapiens
tttcacagagcacgcctgccatc

SEQ ID NO: 6591600 - DNA, 18 bp, Homo sapiens
tttcacagataacataaa

SEQ ID NO: 6591601 - DNA, 20 bp, Homo sapiens
tttcacagcacttacaattt

SEQ ID NO: 6591602 - DNA, 23 bp, Homo sapiens
tttcacaggctgtaaattgaact

SEQ ID NO: 6591603 - DNA, 18 bp, Homo sapiens
tttcacaggtagcctatt

SEQ ID NO: 6591604 - DNA, 20 bp, Homo sapiens
tttcacaggtgtggtgtaat

SEQ ID NO: 6591605 - DNA, 16 bp, Homo sapiens
tttcacagtgaagtgc

SEQ ID NO: 6591606 - DNA, 18 bp, Homo sapiens
tttcacagtgaagtgcct

SEQ ID NO: 6591607 - DNA, 23 bp, Homo sapiens
tttcacagtgggcggcttccctg

SEQ ID NO: 6591608 - DNA, 15 bp, Homo sapiens
tttcacagtgtctgt

SEQ ID NO: 6591609 - DNA, 21 bp, Homo sapiens
tttcacatagcccacttacat

SEQ ID NO: 6591610 - DNA, 16 bp, Homo sapiens
tttcacatagctgtct

SEQ ID NO: 6591611 - DNA, 18 bp, Homo sapiens
tttcacatagctgtctag

SEQ ID NO: 6591612 - DNA, 20 bp, Homo sapiens
tttcacatataaatagatga

SEQ ID NO: 6591613 - DNA, 17 bp, Homo sapiens
tttcacatctctgtaga

SEQ ID NO: 6591614 - DNA, 13 bp, Homo sapiens
tttcacatctgta

SEQ ID NO: 6591615 - DNA, 18 bp, Homo sapiens
tttcacattagaagacaa

SEQ ID NO: 6591616 - DNA, 19 bp, Homo sapiens
tttcacattagaagacaat

SEQ ID NO: 6591617 - DNA, 16 bp, Homo sapiens
tttcacattcttataa

SEQ ID NO: 6591618 - DNA, 16 bp, Homo sapiens
tttcacattcttggct

SEQ ID NO: 6591619 - DNA, 14 bp, Homo sapiens
tttcacattttcct

SEQ ID NO: 6591620 - DNA, 17 bp, Homo sapiens
tttcacatttttgtaat

SEQ ID NO: 6591621 - DNA, 22 bp, Homo sapiens
tttcacattttttttctttttc

SEQ ID NO: 6591622 - DNA, 15 bp, Homo sapiens
tttcaccagaagtta

SEQ ID NO: 6591623 - DNA, 13 bp, Homo sapiens
tttcaccagcagc

SEQ ID NO: 6591624 - DNA, 18 bp, Homo sapiens
tttcaccatctttctaat

SEQ ID NO: 6591625 - DNA, 22 bp, Homo sapiens
tttcaccatgttggtcaggctg

SEQ ID NO: 6591626 - DNA, 23 bp, Homo sapiens
tttcaccatttccgggaaacgaa

SEQ ID NO: 6591627 - DNA, 15 bp, Homo sapiens
tttcacccacagaaa

SEQ ID NO: 6591628 - DNA, 18 bp, Homo sapiens
tttcacccatcctaggaa

SEQ ID NO: 6591629 - DNA, 17 bp, Homo sapiens
tttcacccatctctcag

SEQ ID NO: 6591630 - DNA, 22 bp, Homo sapiens
tttcaccccacccttcccctcc

SEQ ID NO: 6591631 - DNA, 22 bp, Homo sapiens
tttcacccctccctttctcccc

SEQ ID NO: 6591632 - DNA, 16 bp, Homo sapiens
tttcaccctcatgaaa

SEQ ID NO: 6591633 - DNA, 17 bp, Homo sapiens
tttcaccctcatgaaaa

SEQ ID NO: 6591634 - DNA, 19 bp, Homo sapiens
tttcaccctgccaccctct

SEQ ID NO: 6591635 - DNA, 22 bp, Homo sapiens
tttcacccttaacccaaggagc

SEQ ID NO: 6591636 - DNA, 20 bp, Homo sapiens
tttcaccgtgttagccagga

SEQ ID NO: 6591637 - DNA, 16 bp, Homo sapiens
tttcacctatctggaa

SEQ ID NO: 6591638 - DNA, 22 bp, Homo sapiens
tttcacctcttcccacaagaaa

SEQ ID NO: 6591639 - DNA, 13 bp, Homo sapiens
tttcacctgtaaa

SEQ ID NO: 6591640 - DNA, 18 bp, Homo sapiens
tttcacctgtaaacctga

SEQ ID NO: 6591641 - DNA, 22 bp, Homo sapiens
tttcacctgtttttaagctgtt

SEQ ID NO: 6591642 - DNA, 14 bp, Homo sapiens
tttcacctttactt

SEQ ID NO: 6591643 - DNA, 16 bp, Homo sapiens
tttcacctttacttta

SEQ ID NO: 6591644 - DNA, 19 bp, Homo sapiens
tttcacctttactttagaa

SEQ ID NO: 6591645 - DNA, 16 bp, Homo sapiens
tttcaccttttcagga

SEQ ID NO: 6591646 - DNA, 18 bp, Homo sapiens
tttcaccttttcaggaaa

SEQ ID NO: 6591647 - DNA, 16 bp, Homo sapiens
tttcacgattcatttt

SEQ ID NO: 6591648 - DNA, 14 bp, Homo sapiens
tttcacggaaactc

SEQ ID NO: 6591649 - DNA, 18 bp, Homo sapiens
tttcacggaaactcccga

SEQ ID NO: 6591650 - DNA, 19 bp, Homo sapiens
tttcacggaagttttcaat

SEQ ID NO: 6591651 - DNA, 22 bp, Homo sapiens
tttcacgggaactctccaaata

SEQ ID NO: 6591652 - DNA, 22 bp, Homo sapiens
tttcacgggcaacactcactgc

SEQ ID NO: 6591653 - DNA, 20 bp, Homo sapiens
tttcacgtaaatattcatat

SEQ ID NO: 6591654 - DNA, 16 bp, Homo sapiens
tttcacgtcttggtgc

SEQ ID NO: 6591655 - DNA, 23 bp, Homo sapiens
tttcacgtcttggtgccttttgt

SEQ ID NO: 6591656 - DNA, 15 bp, Homo sapiens
tttcactaggaaaat

SEQ ID NO: 6591657 - DNA, 19 bp, Homo sapiens
tttcactaggactcagaaa

SEQ ID NO: 6591658 - DNA, 20 bp, Homo sapiens
tttcactataatgtgaaatg

SEQ ID NO: 6591659 - DNA, 20 bp, Homo sapiens
tttcactatacaggctggga

SEQ ID NO: 6591660 - DNA, 15 bp, Homo sapiens
tttcactatttcctt

SEQ ID NO: 6591661 - DNA, 14 bp, Homo sapiens
tttcactccaccat

SEQ ID NO: 6591662 - DNA, 13 bp, Homo sapiens
tttcactccctct

SEQ ID NO: 6591663 - DNA, 16 bp, Homo sapiens
tttcactcctgcttct

SEQ ID NO: 6591664 - DNA, 14 bp, Homo sapiens
tttcactctaagtc

SEQ ID NO: 6591665 - DNA, 15 bp, Homo sapiens
tttcactctaagtca

SEQ ID NO: 6591666 - DNA, 22 bp, Homo sapiens
tttcactctaagtcatgtatgt

SEQ ID NO: 6591667 - DNA, 14 bp, Homo sapiens
tttcactctccttg

SEQ ID NO: 6591668 - DNA, 22 bp, Homo sapiens
tttcactgataccacgaggaaa

SEQ ID NO: 6591669 - DNA, 14 bp, Homo sapiens
tttcactgctgctc

SEQ ID NO: 6591670 - DNA, 14 bp, Homo sapiens
tttcactgctggct

SEQ ID NO: 6591671 - DNA, 17 bp, Homo sapiens
tttcactgctggctgcc

SEQ ID NO: 6591672 - DNA, 24 bp, Homo sapiens
tttcactgctggctgccttagaac

SEQ ID NO: 6591673 - DNA, 23 bp, Homo sapiens
tttcactgctgttatatttcatc

SEQ ID NO: 6591674 - DNA, 16 bp, Homo sapiens
tttcactggaaaggaa

SEQ ID NO: 6591675 - DNA, 18 bp, Homo sapiens
tttcactggagttacatt

SEQ ID NO: 6591676 - DNA, 19 bp, Homo sapiens
tttcactggagttacatta

SEQ ID NO: 6591677 - DNA, 14 bp, Homo sapiens
tttcactggggatc

SEQ ID NO: 6591678 - DNA, 17 bp, Homo sapiens
tttcactgtactgcatg

SEQ ID NO: 6591679 - DNA, 24 bp, Homo sapiens
tttcactgtgttggccaggctggt

SEQ ID NO: 6591680 - DNA, 17 bp, Homo sapiens
tttcacttaaactttgt

SEQ ID NO: 6591681 - DNA, 18 bp, Homo sapiens
tttcacttaagtattgtc

SEQ ID NO: 6591682 - DNA, 22 bp, Homo sapiens
tttcacttaataatttttacct

SEQ ID NO: 6591683 - DNA, 15 bp, Homo sapiens
tttcacttatacctg

SEQ ID NO: 6591684 - DNA, 21 bp, Homo sapiens
tttcacttcctctccacagga

SEQ ID NO: 6591685 - DNA, 20 bp, Homo sapiens
tttcacttcgggctgtgtaa

SEQ ID NO: 6591686 - DNA, 16 bp, Homo sapiens
tttcacttcttaagga

SEQ ID NO: 6591687 - DNA, 17 bp, Homo sapiens
tttcacttcttaaggac

SEQ ID NO: 6591688 - DNA, 14 bp, Homo sapiens
tttcacttcttcct

SEQ ID NO: 6591689 - DNA, 14 bp, Homo sapiens
tttcacttctttcc

SEQ ID NO: 6591690 - DNA, 23 bp, Homo sapiens
tttcacttctttcccttcctcca

SEQ ID NO: 6591691 - DNA, 17 bp, Homo sapiens
tttcacttgggtctctg

SEQ ID NO: 6591692 - DNA, 19 bp, Homo sapiens
tttcacttgtattgacttt

SEQ ID NO: 6591693 - DNA, 21 bp, Homo sapiens
tttcacttgtattgactttat

SEQ ID NO: 6591694 - DNA, 19 bp, Homo sapiens
tttcacttgtctcctttct

SEQ ID NO: 6591695 - DNA, 18 bp, Homo sapiens
tttcacttgtgttttaaa

SEQ ID NO: 6591696 - DNA, 15 bp, Homo sapiens
tttcactttgaaaag

SEQ ID NO: 6591697 - DNA, 16 bp, Homo sapiens
tttcactttgaaaagt

SEQ ID NO: 6591698 - DNA, 13 bp, Homo sapiens
tttcacttttaaa

SEQ ID NO: 6591699 - DNA, 17 bp, Homo sapiens
tttcacttttgttctgc

SEQ ID NO: 6591700 - DNA, 16 bp, Homo sapiens
tttcagaaaaagaaat

SEQ ID NO: 6591701 - DNA, 12 bp, Homo sapiens
tttcagaaaaca

SEQ ID NO: 6591702 - DNA, 16 bp, Homo sapiens
tttcagaaaacagaaa

SEQ ID NO: 6591703 - DNA, 13 bp, Homo sapiens
tttcagaaaacat

SEQ ID NO: 6591704 - DNA, 16 bp, Homo sapiens
tttcagaaaatgaaaa

SEQ ID NO: 6591705 - DNA, 21 bp, Homo sapiens
tttcagaaagaagtggggaca

SEQ ID NO: 6591706 - DNA, 16 bp, Homo sapiens
tttcagaaagatgaag

SEQ ID NO: 6591707 - DNA, 19 bp, Homo sapiens
tttcagaaagggcagcccc

SEQ ID NO: 6591708 - DNA, 20 bp, Homo sapiens
tttcagaaatatgtggtttc

SEQ ID NO: 6591709 - DNA, 11 bp, Homo sapiens
tttcagaaatg

SEQ ID NO: 6591710 - DNA, 18 bp, Homo sapiens
tttcagaaattctcaaaa

SEQ ID NO: 6591711 - DNA, 19 bp, Homo sapiens
tttcagaacctcttcccca

SEQ ID NO: 6591712 - DNA, 23 bp, Homo sapiens
tttcagaacctcttccccagaaa

SEQ ID NO: 6591713 - DNA, 16 bp, Homo sapiens
tttcagaagatggtga

SEQ ID NO: 6591714 - DNA, 18 bp, Homo sapiens
tttcagaagcaagccaga

SEQ ID NO: 6591715 - DNA, 22 bp, Homo sapiens
tttcagaagcaagccagaccta

SEQ ID NO: 6591716 - DNA, 14 bp, Homo sapiens
tttcagaagctgat

SEQ ID NO: 6591717 - DNA, 17 bp, Homo sapiens
tttcagaagctgcagct

SEQ ID NO: 6591718 - DNA, 15 bp, Homo sapiens
tttcagaaggaccaa

SEQ ID NO: 6591719 - DNA, 19 bp, Homo sapiens
tttcagaaggtatcagtta

SEQ ID NO: 6591720 - DNA, 14 bp, Homo sapiens
tttcagaagtactg

SEQ ID NO: 6591721 - DNA, 18 bp, Homo sapiens
tttcagaagtactggcat

SEQ ID NO: 6591722 - DNA, 23 bp, Homo sapiens
tttcagaagtcagcctacataac

SEQ ID NO: 6591723 - DNA, 22 bp, Homo sapiens
tttcagaagtgagctttgctgc

SEQ ID NO: 6591724 - DNA, 14 bp, Homo sapiens
tttcagaagtgatt

SEQ ID NO: 6591725 - DNA, 22 bp, Homo sapiens
tttcagaagtttaaatattaag

SEQ ID NO: 6591726 - DNA, 20 bp, Homo sapiens
tttcagaatattttcaaaat

SEQ ID NO: 6591727 - DNA, 16 bp, Homo sapiens
tttcagaatcttttca

SEQ ID NO: 6591728 - DNA, 14 bp, Homo sapiens
tttcagaatgttgt

SEQ ID NO: 6591729 - DNA, 17 bp, Homo sapiens
tttcagacattttcact

SEQ ID NO: 6591730 - DNA, 21 bp, Homo sapiens
tttcagacattttcactggaa

SEQ ID NO: 6591731 - DNA, 12 bp, Homo sapiens
tttcagaccttt

SEQ ID NO: 6591732 - DNA, 19 bp, Homo sapiens
tttcagacctttgtctgaa

SEQ ID NO: 6591733 - DNA, 18 bp, Homo sapiens
tttcagactccagctgtg

SEQ ID NO: 6591734 - DNA, 15 bp, Homo sapiens
tttcagactgcttta

SEQ ID NO: 6591735 - DNA, 17 bp, Homo sapiens
tttcagagaccattgca

SEQ ID NO: 6591736 - DNA, 19 bp, Homo sapiens
tttcagagaccttaattta

SEQ ID NO: 6591737 - DNA, 20 bp, Homo sapiens
tttcagagactttttttata

SEQ ID NO: 6591738 - DNA, 18 bp, Homo sapiens
tttcagagccagcctggc

SEQ ID NO: 6591739 - DNA, 22 bp, Homo sapiens
tttcagagccagcctggctctg

SEQ ID NO: 6591740 - DNA, 19 bp, Homo sapiens
tttcagagccagtgaagga

SEQ ID NO: 6591741 - DNA, 13 bp, Homo sapiens
tttcagagcctcc

SEQ ID NO: 6591742 - DNA, 19 bp, Homo sapiens
tttcagagggtaagtaaac

SEQ ID NO: 6591743 - DNA, 21 bp, Homo sapiens
tttcagagggtaagtaaacag

SEQ ID NO: 6591744 - DNA, 19 bp, Homo sapiens
aatgcccagccagccaccc

SEQ ID NO: 6591745 - DNA, 15 bp, Homo sapiens
aatgcccagcccctt

SEQ ID NO: 6591746 - DNA, 20 bp, Homo sapiens
aatgcccagccccttctgac

SEQ ID NO: 6591747 - DNA, 17 bp, Homo sapiens
aatgcccagtaaaattt

SEQ ID NO: 6591748 - DNA, 19 bp, Homo sapiens
aatgcccagtaaaatttca

SEQ ID NO: 6591749 - DNA, 13 bp, Homo sapiens
aatgcccagttca

SEQ ID NO: 6591750 - DNA, 17 bp, Homo sapiens
aatgcccccagctggcc

SEQ ID NO: 6591751 - DNA, 16 bp, Homo sapiens
aatgcccccctcccaa

SEQ ID NO: 6591752 - DNA, 17 bp, Homo sapiens
aatgccccctcccctcc

SEQ ID NO: 6591753 - DNA, 19 bp, Homo sapiens
aatgccccctcccctcctt

SEQ ID NO: 6591754 - DNA, 21 bp, Homo sapiens
aatgcccctgaatttaaatag

SEQ ID NO: 6591755 - DNA, 22 bp, Homo sapiens
aatgccctacctgcctgttctc

SEQ ID NO: 6591756 - DNA, 18 bp, Homo sapiens
aatgccctcctaaatgtc

SEQ ID NO: 6591757 - DNA, 14 bp, Homo sapiens
aatgccctctctga

SEQ ID NO: 6591758 - DNA, 20 bp, Homo sapiens
aatgccctgcggctctggaa

SEQ ID NO: 6591759 - DNA, 23 bp, Homo sapiens
aatgccgaatttggtacacatgt

SEQ ID NO: 6591760 - DNA, 17 bp, Homo sapiens
aatgccgatatcttcag

SEQ ID NO: 6591761 - DNA, 18 bp, Homo sapiens
aatgccggttaaattcca

SEQ ID NO: 6591762 - DNA, 19 bp, Homo sapiens
aatgccggttaaattccat

SEQ ID NO: 6591763 - DNA, 15 bp, Homo sapiens
aatgcctaagaagat

SEQ ID NO: 6591764 - DNA, 23 bp, Homo sapiens
aatgcctagagatatttcaagct

SEQ ID NO: 6591765 - DNA, 17 bp, Homo sapiens
aatgcctaggccagctc

SEQ ID NO: 6591766 - DNA, 13 bp, Homo sapiens
aatgcctaggtcc

SEQ ID NO: 6591767 - DNA, 15 bp, Homo sapiens
aatgcctattgtaat

SEQ ID NO: 6591768 - DNA, 17 bp, Homo sapiens
aatgcctattgtaatat

SEQ ID NO: 6591769 - DNA, 20 bp, Homo sapiens
aatgcctcagtgtatttgta

SEQ ID NO: 6591770 - DNA, 12 bp, Homo sapiens
aatgcctcctcc

SEQ ID NO: 6591771 - DNA, 15 bp, Homo sapiens
aatgcctcctccctg

SEQ ID NO: 6591772 - DNA, 17 bp, Homo sapiens
aatgcctcctgtgggga

SEQ ID NO: 6591773 - DNA, 16 bp, Homo sapiens
aatgcctcgctccctt

SEQ ID NO: 6591774 - DNA, 11 bp, Homo sapiens
aatgcctctgc

SEQ ID NO: 6591775 - DNA, 15 bp, Homo sapiens
aatgcctctgccttg

SEQ ID NO: 6591776 - DNA, 23 bp, Homo sapiens
aatgcctctggctctacacatat

SEQ ID NO: 6591777 - DNA, 20 bp, Homo sapiens
aatgcctcttaaattatata

SEQ ID NO: 6591778 - DNA, 16 bp, Homo sapiens
aatgcctcttgtcttc

SEQ ID NO: 6591779 - DNA, 22 bp, Homo sapiens
aatgcctgactagggagccatg

SEQ ID NO: 6591780 - DNA, 19 bp, Homo sapiens
aatgcctgagtgcctggcc

SEQ ID NO: 6591781 - DNA, 12 bp, Homo sapiens
aatgcctggagg

SEQ ID NO: 6591782 - DNA, 22 bp, Homo sapiens
aatgcctgtctctagctgttct

SEQ ID NO: 6591783 - DNA, 12 bp, Homo sapiens
aatgcctgtgcc

SEQ ID NO: 6591784 - DNA, 20 bp, Homo sapiens
aatgccttaaaatggaattg

SEQ ID NO: 6591785 - DNA, 21 bp, Homo sapiens
aatgccttaattaaagaattt

SEQ ID NO: 6591786 - DNA, 19 bp, Homo sapiens
aatgccttactttgtatga

SEQ ID NO: 6591787 - DNA, 17 bp, Homo sapiens
aatgccttatttttgaa

SEQ ID NO: 6591788 - DNA, 22 bp, Homo sapiens
aatgccttctgttttccaaagg

SEQ ID NO: 6591789 - DNA, 14 bp, Homo sapiens
aatgccttgaactg

SEQ ID NO: 6591790 - DNA, 22 bp, Homo sapiens
aatgccttggtttgatttctag

SEQ ID NO: 6591791 - DNA, 12 bp, Homo sapiens
aatgcctttaaa

SEQ ID NO: 6591792 - DNA, 23 bp, Homo sapiens
aatgcctttatatttcacaggct

SEQ ID NO: 6591793 - DNA, 16 bp, Homo sapiens
aatgcctttcaaacat

SEQ ID NO: 6591794 - DNA, 18 bp, Homo sapiens
aatgcctttcaaacattg

SEQ ID NO: 6591795 - DNA, 13 bp, Homo sapiens
aatgcctttcatc

SEQ ID NO: 6591796 - DNA, 14 bp, Homo sapiens
aatgcctttgagac

SEQ ID NO: 6591797 - DNA, 19 bp, Homo sapiens
aatgcctttgagacagttt

SEQ ID NO: 6591798 - DNA, 22 bp, Homo sapiens
aatgcctttgagacagtttctt

SEQ ID NO: 6591799 - DNA, 23 bp, Homo sapiens
aatgcctttgtaaccacaacttt

SEQ ID NO: 6591800 - DNA, 17 bp, Homo sapiens
aatgcctttttgtttac

SEQ ID NO: 6591801 - DNA, 19 bp, Homo sapiens
aatgcgaaattattggttg

SEQ ID NO: 6591802 - DNA, 17 bp, Homo sapiens
aatgcgagactctgatg

SEQ ID NO: 6591803 - DNA, 14 bp, Homo sapiens
aatgcgattttatt

SEQ ID NO: 6591804 - DNA, 16 bp, Homo sapiens
aatgcgattttattac

SEQ ID NO: 6591805 - DNA, 22 bp, Homo sapiens
aatgcgattttattactggcgt

SEQ ID NO: 6591806 - DNA, 15 bp, Homo sapiens
aatgcgcaggctggc

SEQ ID NO: 6591807 - DNA, 20 bp, Homo sapiens
aatgcgctttattgcccatg

SEQ ID NO: 6591808 - DNA, 20 bp, Homo sapiens
aatgcggccgcattccctga

SEQ ID NO: 6591809 - DNA, 17 bp, Homo sapiens
aatgcgggggagcaggc

SEQ ID NO: 6591810 - DNA, 15 bp, Homo sapiens
aatgcggtctggtct

SEQ ID NO: 6591811 - DNA, 18 bp, Homo sapiens
aatgcggttgggaggcag

SEQ ID NO: 6591812 - DNA, 14 bp, Homo sapiens
aatgcgtaattaaa

SEQ ID NO: 6591813 - DNA, 14 bp, Homo sapiens
aatgcgtcttgtga

SEQ ID NO: 6591814 - DNA, 23 bp, Homo sapiens
aatgcgtgttgtacatacagagg

SEQ ID NO: 6591815 - DNA, 12 bp, Homo sapiens
aatgctaaatgc

SEQ ID NO: 6591816 - DNA, 14 bp, Homo sapiens
aatgctaaatgtgt

SEQ ID NO: 6591817 - DNA, 16 bp, Homo sapiens
aatgctaaatgtgtaa

SEQ ID NO: 6591818 - DNA, 20 bp, Homo sapiens
aatgctaaccttgtagcatg

SEQ ID NO: 6591819 - DNA, 14 bp, Homo sapiens
aatgctaattttat

SEQ ID NO: 6591820 - DNA, 16 bp, Homo sapiens
aatgctacaaaaattg

SEQ ID NO: 6591821 - DNA, 20 bp, Homo sapiens
aatgctacaattttaagagg

SEQ ID NO: 6591822 - DNA, 23 bp, Homo sapiens
aatgctaccgccccaaagtaaaa

SEQ ID NO: 6591823 - DNA, 21 bp, Homo sapiens
aatgctacctctgatcaaagc

SEQ ID NO: 6591824 - DNA, 17 bp, Homo sapiens
aatgctacgtgtgattt

SEQ ID NO: 6591825 - DNA, 23 bp, Homo sapiens
aatgctacgtgtgatttttctgg

SEQ ID NO: 6591826 - DNA, 13 bp, Homo sapiens
aatgctactttat

SEQ ID NO: 6591827 - DNA, 22 bp, Homo sapiens
aatgctagcacaatattcctat

SEQ ID NO: 6591828 - DNA, 17 bp, Homo sapiens
aatgctaggtctcggac

SEQ ID NO: 6591829 - DNA, 23 bp, Homo sapiens
aatgctataactatgttgataaa

SEQ ID NO: 6591830 - DNA, 19 bp, Homo sapiens
aatgctatcaaataactaa

SEQ ID NO: 6591831 - DNA, 14 bp, Homo sapiens
aatgctatcactgt

SEQ ID NO: 6591832 - DNA, 14 bp, Homo sapiens
aatgctatggaaat

SEQ ID NO: 6591833 - DNA, 17 bp, Homo sapiens
aatgctatggaaataca

SEQ ID NO: 6591834 - DNA, 19 bp, Homo sapiens
aatgctatggaaatacatt

SEQ ID NO: 6591835 - DNA, 20 bp, Homo sapiens
aatgctatggaaatacattt

SEQ ID NO: 6591836 - DNA, 13 bp, Homo sapiens
aatgctatggact

SEQ ID NO: 6591837 - DNA, 19 bp, Homo sapiens
aatgctatggactgcacaa

SEQ ID NO: 6591838 - DNA, 15 bp, Homo sapiens
aatgctatgtcattt

SEQ ID NO: 6591839 - DNA, 18 bp, Homo sapiens
aatgctatgtcatttcat

SEQ ID NO: 6591840 - DNA, 17 bp, Homo sapiens
aatgctattatactgtt

SEQ ID NO: 6591841 - DNA, 23 bp, Homo sapiens
aatgctattatactgttatccat

SEQ ID NO: 6591842 - DNA, 19 bp, Homo sapiens
aatgctattgaaattactg

SEQ ID NO: 6591843 - DNA, 12 bp, Homo sapiens
aatgctatttta

SEQ ID NO: 6591844 - DNA, 17 bp, Homo sapiens
aatgctattttaaaaaa

SEQ ID NO: 6591845 - DNA, 19 bp, Homo sapiens
aatgctattttaaaattca

SEQ ID NO: 6591846 - DNA, 19 bp, Homo sapiens
aatgctatttttgttttta

SEQ ID NO: 6591847 - DNA, 20 bp, Homo sapiens
aatgctatttttgtttttag

SEQ ID NO: 6591848 - DNA, 23 bp, Homo sapiens
aatgctattttttcccttctctt

SEQ ID NO: 6591849 - DNA, 14 bp, Homo sapiens
aatgctcaaagaaa

SEQ ID NO: 6591850 - DNA, 18 bp, Homo sapiens
aatgctcaatgtgctgtt

SEQ ID NO: 6591851 - DNA, 19 bp, Homo sapiens
aatgctcagcgcttaaaaa

SEQ ID NO: 6591852 - DNA, 23 bp, Homo sapiens
aatgctcagcgcttaaaaaaaca

SEQ ID NO: 6591853 - DNA, 16 bp, Homo sapiens
aatgctcataacggat

SEQ ID NO: 6591854 - DNA, 12 bp, Homo sapiens
aatgctcatctg

SEQ ID NO: 6591855 - DNA, 16 bp, Homo sapiens
aatgctcattttctgg

SEQ ID NO: 6591856 - DNA, 13 bp, Homo sapiens
aatgctccagctg

SEQ ID NO: 6591857 - DNA, 23 bp, Homo sapiens
aatgctccagctgtcgtctgact

SEQ ID NO: 6591858 - DNA, 17 bp, Homo sapiens
aatgctcccacctgaat

SEQ ID NO: 6591859 - DNA, 19 bp, Homo sapiens
aatgctcccagctgtgctg

SEQ ID NO: 6591860 - DNA, 22 bp, Homo sapiens
aatgctcccatctcctgatttc

SEQ ID NO: 6591861 - DNA, 23 bp, Homo sapiens
aatgctcccatctcctgatttct

SEQ ID NO: 6591862 - DNA, 16 bp, Homo sapiens
aatgctcctctctttg

SEQ ID NO: 6591863 - DNA, 19 bp, Homo sapiens
aatgctccttgttcctaga

SEQ ID NO: 6591864 - DNA, 18 bp, Homo sapiens
aatgctcgtgtgatttcc

SEQ ID NO: 6591865 - DNA, 23 bp, Homo sapiens
aatgctcgtgtgatttcctacag

SEQ ID NO: 6591866 - DNA, 16 bp, Homo sapiens
aatgctctatgtttgt

SEQ ID NO: 6591867 - DNA, 19 bp, Homo sapiens
aatgctctatgtttgtatt

SEQ ID NO: 6591868 - DNA, 23 bp, Homo sapiens
aatgctctgaaaggatgtagaaa

SEQ ID NO: 6591869 - DNA, 20 bp, Homo sapiens
aatgctctggggtcttttta

SEQ ID NO: 6591870 - DNA, 16 bp, Homo sapiens
aatgctcttatttcat

SEQ ID NO: 6591871 - DNA, 13 bp, Homo sapiens
aatgctcttgtcc

SEQ ID NO: 6591872 - DNA, 23 bp, Homo sapiens
aatgctctttacttcatggactt

SEQ ID NO: 6591873 - DNA, 18 bp, Homo sapiens
aatgctgaaaaaacacct

SEQ ID NO: 6591874 - DNA, 20 bp, Homo sapiens
aatgctgagccagccatctt

SEQ ID NO: 6591875 - DNA, 21 bp, Homo sapiens
aatgctgagctgaagaaatta

SEQ ID NO: 6591876 - DNA, 18 bp, Homo sapiens
aatgctgatgaatcactg

SEQ ID NO: 6591877 - DNA, 23 bp, Homo sapiens
aatgctgcacaccagttactgtt

SEQ ID NO: 6591878 - DNA, 12 bp, Homo sapiens
aatgctgcactt

SEQ ID NO: 6591879 - DNA, 20 bp, Homo sapiens
aatgctgcagatttgggctg

SEQ ID NO: 6591880 - DNA, 17 bp, Homo sapiens
aatgctgccatgcccac

SEQ ID NO: 6591881 - DNA, 11 bp, Homo sapiens
aatgctgcctc

SEQ ID NO: 6591882 - DNA, 19 bp, Homo sapiens
aatgctgcctcaggaccca

SEQ ID NO: 6591883 - DNA, 20 bp, Homo sapiens
aatgctgcctcaggacccat

SEQ ID NO: 6591884 - DNA, 19 bp, Homo sapiens
aatgctgcgcccttcccca

SEQ ID NO: 6591885 - DNA, 14 bp, Homo sapiens
aatgctgctggcca

SEQ ID NO: 6591886 - DNA, 17 bp, Homo sapiens
aatgctgctggccaaat

SEQ ID NO: 6591887 - DNA, 18 bp, Homo sapiens
aatgctgctgtcagacga

SEQ ID NO: 6591888 - DNA, 22 bp, Homo sapiens
aatgctgcttccactcagggct

SEQ ID NO: 6591889 - DNA, 22 bp, Homo sapiens
aatgctgcttctcctcccagcg

SEQ ID NO: 6591890 - DNA, 12 bp, Homo sapiens
aatgctgctttg

SEQ ID NO: 6591891 - DNA, 21 bp, Homo sapiens
aatgctgctttggttaatctc

SEQ ID NO: 6591892 - DNA, 18 bp, Homo sapiens
aatgctgctttgtccagg

SEQ ID NO: 6591893 - DNA, 12 bp, Homo sapiens
aatgctgctttt

SEQ ID NO: 6591894 - DNA, 17 bp, Homo sapiens
aatgctgcttttaaaac

SEQ ID NO: 6591895 - DNA, 17 bp, Homo sapiens
aatgctggactggaggc

SEQ ID NO: 6591896 - DNA, 20 bp, Homo sapiens
aatgctggctgagctgaaca

SEQ ID NO: 6591897 - DNA, 22 bp, Homo sapiens
aatgctggctgttggctggggg

SEQ ID NO: 6591898 - DNA, 11 bp, Homo sapiens
aatgctgggcc

SEQ ID NO: 6591899 - DNA, 21 bp, Homo sapiens
aatgctgggcccccagcctgg

SEQ ID NO: 6591900 - DNA, 22 bp, Homo sapiens
aatgctgggcccccagcctggc

SEQ ID NO: 6591901 - DNA, 10 bp, Homo sapiens
aatgctgggt

SEQ ID NO: 6591902 - DNA, 20 bp, Homo sapiens
aatgctgggtatgctctgtg

SEQ ID NO: 6591903 - DNA, 21 bp, Homo sapiens
aatgctggttttcctaaatgc

SEQ ID NO: 6591904 - DNA, 18 bp, Homo sapiens
aatgctggtttttcagtt

SEQ ID NO: 6591905 - DNA, 14 bp, Homo sapiens
aatgctgtaaatat

SEQ ID NO: 6591906 - DNA, 15 bp, Homo sapiens
aatgctgtaaatatt

SEQ ID NO: 6591907 - DNA, 13 bp, Homo sapiens
aatgctgtacatc

SEQ ID NO: 6591908 - DNA, 23 bp, Homo sapiens
aatgctgtacatctattttggat

SEQ ID NO: 6591909 - DNA, 20 bp, Homo sapiens
aatgctgtagaatgcttggc

SEQ ID NO: 6591910 - DNA, 21 bp, Homo sapiens
aatgctgtattttaaaagaat

SEQ ID NO: 6591911 - DNA, 20 bp, Homo sapiens
aatgctgtctttgtggactg

SEQ ID NO: 6591912 - DNA, 13 bp, Homo sapiens
aatgctgtgaata

SEQ ID NO: 6591913 - DNA, 21 bp, Homo sapiens
aatgctgttcgttcaaaagtg

SEQ ID NO: 6591914 - DNA, 21 bp, Homo sapiens
aatgctgttctgatttactag

SEQ ID NO: 6591915 - DNA, 20 bp, Homo sapiens
aatgctgttggtaaagcaca

SEQ ID NO: 6591916 - DNA, 20 bp, Homo sapiens
aatgctgtttctaagaaaat

SEQ ID NO: 6591917 - DNA, 15 bp, Homo sapiens
aatgcttaaactaaa

SEQ ID NO: 6591918 - DNA, 20 bp, Homo sapiens
aatgcttaaactaaataatg

SEQ ID NO: 6591919 - DNA, 18 bp, Homo sapiens
aatgcttaacataaactt

SEQ ID NO: 6591920 - DNA, 12 bp, Homo sapiens
aatgcttaagag

SEQ ID NO: 6591921 - DNA, 15 bp, Homo sapiens
tttcagataatcaca

SEQ ID NO: 6591922 - DNA, 13 bp, Homo sapiens
tttcagatactgg

SEQ ID NO: 6591923 - DNA, 16 bp, Homo sapiens
tttcagatataaaaga

SEQ ID NO: 6591924 - DNA, 15 bp, Homo sapiens
tttcagatatatatc

SEQ ID NO: 6591925 - DNA, 12 bp, Homo sapiens
tttcagatgcaa

SEQ ID NO: 6591926 - DNA, 12 bp, Homo sapiens
tttcagatgctt

SEQ ID NO: 6591927 - DNA, 16 bp, Homo sapiens
tttcagatgcttctgg

SEQ ID NO: 6591928 - DNA, 15 bp, Homo sapiens
tttcagatgctttag

SEQ ID NO: 6591929 - DNA, 15 bp, Homo sapiens
tttcagatgtaatgt

SEQ ID NO: 6591930 - DNA, 18 bp, Homo sapiens
tttcagatgtgaaccatt

SEQ ID NO: 6591931 - DNA, 16 bp, Homo sapiens
tttcagattccacaca

SEQ ID NO: 6591932 - DNA, 20 bp, Homo sapiens
tttcagattcccagagcaaa

SEQ ID NO: 6591933 - DNA, 16 bp, Homo sapiens
tttcagattgtggaat

SEQ ID NO: 6591934 - DNA, 16 bp, Homo sapiens
tttcagattttttaaa

SEQ ID NO: 6591935 - DNA, 17 bp, Homo sapiens
tttcagcaacaagactg

SEQ ID NO: 6591936 - DNA, 18 bp, Homo sapiens
tttcagcaagataaacat

SEQ ID NO: 6591937 - DNA, 21 bp, Homo sapiens
tttcagcaatatttaaggaga

SEQ ID NO: 6591938 - DNA, 16 bp, Homo sapiens
tttcagcacccccacc

SEQ ID NO: 6591939 - DNA, 17 bp, Homo sapiens
tttcagcacccccaccc

SEQ ID NO: 6591940 - DNA, 20 bp, Homo sapiens
tttcagcacccccacccacc

SEQ ID NO: 6591941 - DNA, 22 bp, Homo sapiens
tttcagcacccccacccacctc

SEQ ID NO: 6591942 - DNA, 20 bp, Homo sapiens
tttcagcactagccaaacct

SEQ ID NO: 6591943 - DNA, 23 bp, Homo sapiens
tttcagcactagccaaacctcac

SEQ ID NO: 6591944 - DNA, 14 bp, Homo sapiens
tttcagcagactat

SEQ ID NO: 6591945 - DNA, 21 bp, Homo sapiens
tttcagcagactatgaatatt

SEQ ID NO: 6591946 - DNA, 14 bp, Homo sapiens
tttcagcagactga

SEQ ID NO: 6591947 - DNA, 15 bp, Homo sapiens
tttcagcagctgcag

SEQ ID NO: 6591948 - DNA, 13 bp, Homo sapiens
tttcagcaggcag

SEQ ID NO: 6591949 - DNA, 14 bp, Homo sapiens
tttcagcagtctaa

SEQ ID NO: 6591950 - DNA, 22 bp, Homo sapiens
tttcagcagtctaaattttcta

SEQ ID NO: 6591951 - DNA, 14 bp, Homo sapiens
tttcagcataaatg

SEQ ID NO: 6591952 - DNA, 14 bp, Homo sapiens
tttcagcatacata

SEQ ID NO: 6591953 - DNA, 15 bp, Homo sapiens
tttcagcatacataa

SEQ ID NO: 6591954 - DNA, 12 bp, Homo sapiens
tttcagcatcaa

SEQ ID NO: 6591955 - DNA, 15 bp, Homo sapiens
tttcagcattgatat

SEQ ID NO: 6591956 - DNA, 20 bp, Homo sapiens
tttcagcattgatatttgtg

SEQ ID NO: 6591957 - DNA, 21 bp, Homo sapiens
tttcagccaaactgtagatga

SEQ ID NO: 6591958 - DNA, 14 bp, Homo sapiens
tttcagccaatctg

SEQ ID NO: 6591959 - DNA, 19 bp, Homo sapiens
tttcagccaatttgtctcc

SEQ ID NO: 6591960 - DNA, 22 bp, Homo sapiens
tttcagccacatgccccaggct

SEQ ID NO: 6591961 - DNA, 23 bp, Homo sapiens
tttcagccatgcgcgcgctctct

SEQ ID NO: 6591962 - DNA, 17 bp, Homo sapiens
tttcagccattcacaac

SEQ ID NO: 6591963 - DNA, 20 bp, Homo sapiens
tttcagccattcacaacaca

SEQ ID NO: 6591964 - DNA, 18 bp, Homo sapiens
tttcagcctacattgatg

SEQ ID NO: 6591965 - DNA, 17 bp, Homo sapiens
tttcagccttcagattt

SEQ ID NO: 6591966 - DNA, 22 bp, Homo sapiens
tttcagcgcccccaggcctgcc

SEQ ID NO: 6591967 - DNA, 23 bp, Homo sapiens
tttcagcgcccccaggcctgccc

SEQ ID NO: 6591968 - DNA, 22 bp, Homo sapiens
tttcagctaagggaagacattt

SEQ ID NO: 6591969 - DNA, 23 bp, Homo sapiens
tttcagctaagggaagacatttc

SEQ ID NO: 6591970 - DNA, 21 bp, Homo sapiens
tttcagctaggaacaaatctt

SEQ ID NO: 6591971 - DNA, 18 bp, Homo sapiens
tttcagctatacctgcac

SEQ ID NO: 6591972 - DNA, 21 bp, Homo sapiens
tttcagctatttagtgatata

SEQ ID NO: 6591973 - DNA, 12 bp, Homo sapiens
tttcagctcctg

SEQ ID NO: 6591974 - DNA, 21 bp, Homo sapiens
tttcagctctctgtataaaca

SEQ ID NO: 6591975 - DNA, 18 bp, Homo sapiens
tttcagctgacagctgct

SEQ ID NO: 6591976 - DNA, 20 bp, Homo sapiens
tttcagctgagccctgggga

SEQ ID NO: 6591977 - DNA, 22 bp, Homo sapiens
tttcagctgagccctggggact

SEQ ID NO: 6591978 - DNA, 20 bp, Homo sapiens
tttcagctgctcagaattca

SEQ ID NO: 6591979 - DNA, 21 bp, Homo sapiens
tttcagctggaaacttctgta

SEQ ID NO: 6591980 - DNA, 15 bp, Homo sapiens
tttcagctgtctttt

SEQ ID NO: 6591981 - DNA, 21 bp, Homo sapiens
tttcagctgtgaacatggact

SEQ ID NO: 6591982 - DNA, 13 bp, Homo sapiens
tttcagcttaaaa

SEQ ID NO: 6591983 - DNA, 14 bp, Homo sapiens
tttcagcttctgct

SEQ ID NO: 6591984 - DNA, 20 bp, Homo sapiens
tttcagcttctgctgggctg

SEQ ID NO: 6591985 - DNA, 16 bp, Homo sapiens
tttcagcttgtttcta

SEQ ID NO: 6591986 - DNA, 19 bp, Homo sapiens
tttcagcttgtttctatac

SEQ ID NO: 6591987 - DNA, 16 bp, Homo sapiens
tttcagctttcttcag

SEQ ID NO: 6591988 - DNA, 11 bp, Homo sapiens
tttcaggaaaa

SEQ ID NO: 6591989 - DNA, 20 bp, Homo sapiens
tttcaggaaatctacttcct

SEQ ID NO: 6591990 - DNA, 23 bp, Homo sapiens
tttcaggaaatctacttcctaca

SEQ ID NO: 6591991 - DNA, 23 bp, Homo sapiens
tttcaggaagttgctgagaaatg

SEQ ID NO: 6591992 - DNA, 21 bp, Homo sapiens
tttcaggacagctgcttctgt

SEQ ID NO: 6591993 - DNA, 14 bp, Homo sapiens
tttcaggagatggg

SEQ ID NO: 6591994 - DNA, 18 bp, Homo sapiens
tttcaggaggaatactga

SEQ ID NO: 6591995 - DNA, 22 bp, Homo sapiens
tttcaggaggctggaggaaggg

SEQ ID NO: 6591996 - DNA, 23 bp, Homo sapiens
tttcaggagggtccccagctggt

SEQ ID NO: 6591997 - DNA, 13 bp, Homo sapiens
tttcaggatactc

SEQ ID NO: 6591998 - DNA, 19 bp, Homo sapiens
tttcaggatactctgtcag

SEQ ID NO: 6591999 - DNA, 16 bp, Homo sapiens
tttcaggatctatttt

SEQ ID NO: 6592000 - DNA, 17 bp, Homo sapiens
tttcaggcaaggcagct

SEQ ID NO: 6592001 - DNA, 14 bp, Homo sapiens
tttcaggcagcagg

SEQ ID NO: 6592002 - DNA, 22 bp, Homo sapiens
tttcaggcaggcacctagcaat

SEQ ID NO: 6592003 - DNA, 15 bp, Homo sapiens
tttcaggccaaggct

SEQ ID NO: 6592004 - DNA, 15 bp, Homo sapiens
tttcaggccctcagc

SEQ ID NO: 6592005 - DNA, 16 bp, Homo sapiens
tttcaggctacctttt

SEQ ID NO: 6592006 - DNA, 11 bp, Homo sapiens
tttcaggctcg

SEQ ID NO: 6592007 - DNA, 18 bp, Homo sapiens
tttcagggaaaacagaag

SEQ ID NO: 6592008 - DNA, 16 bp, Homo sapiens
tttcagggaaattaat

SEQ ID NO: 6592009 - DNA, 17 bp, Homo sapiens
tttcagggaaattaatc

SEQ ID NO: 6592010 - DNA, 17 bp, Homo sapiens
tttcagggacctcaggg

SEQ ID NO: 6592011 - DNA, 20 bp, Homo sapiens
tttcagggagaaactccaaa

SEQ ID NO: 6592012 - DNA, 22 bp, Homo sapiens
tttcagggagaaactccaaagt

SEQ ID NO: 6592013 - DNA, 19 bp, Homo sapiens
tttcagggaggtggctggg

SEQ ID NO: 6592014 - DNA, 22 bp, Homo sapiens
tttcagggccttgacaagtaca

SEQ ID NO: 6592015 - DNA, 18 bp, Homo sapiens
tttcagggctggctcctg

SEQ ID NO: 6592016 - DNA, 22 bp, Homo sapiens
tttcagggttttctgagggaaa

SEQ ID NO: 6592017 - DNA, 15 bp, Homo sapiens
tttcaggtgacatgt

SEQ ID NO: 6592018 - DNA, 20 bp, Homo sapiens
tttcaggtgacatgtgaaac

SEQ ID NO: 6592019 - DNA, 17 bp, Homo sapiens
tttcaggtgtaaccatt

SEQ ID NO: 6592020 - DNA, 20 bp, Homo sapiens
tttcaggtgtaaccatttgt

SEQ ID NO: 6592021 - DNA, 16 bp, Homo sapiens
tttcaggttgtgcatt

SEQ ID NO: 6592022 - DNA, 18 bp, Homo sapiens
tttcaggttttgtaaaga

SEQ ID NO: 6592023 - DNA, 19 bp, Homo sapiens
tttcaggttttgtaaagat

SEQ ID NO: 6592024 - DNA, 20 bp, Homo sapiens
tttcagtaatagctgaacct

SEQ ID NO: 6592025 - DNA, 19 bp, Homo sapiens
tttcagtacttttttaaat

SEQ ID NO: 6592026 - DNA, 15 bp, Homo sapiens
tttcagtagctcctt

SEQ ID NO: 6592027 - DNA, 14 bp, Homo sapiens
tttcagtatactgt

SEQ ID NO: 6592028 - DNA, 16 bp, Homo sapiens
tttcagtatactgtgt

SEQ ID NO: 6592029 - DNA, 20 bp, Homo sapiens
tttcagtattaaactctcct

SEQ ID NO: 6592030 - DNA, 15 bp, Homo sapiens
tttcagtattttcca

SEQ ID NO: 6592031 - DNA, 16 bp, Homo sapiens
tttcagtcaaaacttt

SEQ ID NO: 6592032 - DNA, 18 bp, Homo sapiens
tttcagtccccacagata

SEQ ID NO: 6592033 - DNA, 13 bp, Homo sapiens
tttcagtcccctc

SEQ ID NO: 6592034 - DNA, 19 bp, Homo sapiens
tttcagtcccctctctctg

SEQ ID NO: 6592035 - DNA, 13 bp, Homo sapiens
tttcagtcctaat

SEQ ID NO: 6592036 - DNA, 17 bp, Homo sapiens
tttcagtcctgtagttt

SEQ ID NO: 6592037 - DNA, 17 bp, Homo sapiens
tttcagtgaaagcatca

SEQ ID NO: 6592038 - DNA, 21 bp, Homo sapiens
tttcagtgaagatgctgtaaa

SEQ ID NO: 6592039 - DNA, 17 bp, Homo sapiens
tttcagtgatcttcact

SEQ ID NO: 6592040 - DNA, 22 bp, Homo sapiens
tttcagtgatcttcactgtata

SEQ ID NO: 6592041 - DNA, 16 bp, Homo sapiens
tttcagtgcctgctgt

SEQ ID NO: 6592042 - DNA, 16 bp, Homo sapiens
tttcagtgctttctca

SEQ ID NO: 6592043 - DNA, 20 bp, Homo sapiens
tttcagtgctttctcaaaat

SEQ ID NO: 6592044 - DNA, 20 bp, Homo sapiens
tttcagtgctttgcccttga

SEQ ID NO: 6592045 - DNA, 16 bp, Homo sapiens
tttcagtggaaaccct

SEQ ID NO: 6592046 - DNA, 22 bp, Homo sapiens
tttcagtggcacgtcatctagt

SEQ ID NO: 6592047 - DNA, 21 bp, Homo sapiens
tttcagtggggcagtcattat

SEQ ID NO: 6592048 - DNA, 13 bp, Homo sapiens
tttcagtgtacat

SEQ ID NO: 6592049 - DNA, 19 bp, Homo sapiens
tttcagtgtagttaattta

SEQ ID NO: 6592050 - DNA, 11 bp, Homo sapiens
tttcagtgtga

SEQ ID NO: 6592051 - DNA, 13 bp, Homo sapiens
tttcagttatttt

SEQ ID NO: 6592052 - DNA, 13 bp, Homo sapiens
tttcagttccaag

SEQ ID NO: 6592053 - DNA, 15 bp, Homo sapiens
tttcagttctaggaa

SEQ ID NO: 6592054 - DNA, 15 bp, Homo sapiens
tttcagttctattta

SEQ ID NO: 6592055 - DNA, 18 bp, Homo sapiens
tttcagttctgtgtacat

SEQ ID NO: 6592056 - DNA, 22 bp, Homo sapiens
tttcagttctttggattctaaa

SEQ ID NO: 6592057 - DNA, 14 bp, Homo sapiens
tttcagtttgttgg

SEQ ID NO: 6592058 - DNA, 15 bp, Homo sapiens
tttcagttttaaaaa

SEQ ID NO: 6592059 - DNA, 19 bp, Homo sapiens
tttcagttttaaaaatgaa

SEQ ID NO: 6592060 - DNA, 15 bp, Homo sapiens
tttcagttttcagga

SEQ ID NO: 6592061 - DNA, 12 bp, Homo sapiens
tttcataaatta

SEQ ID NO: 6592062 - DNA, 19 bp, Homo sapiens
tttcataaattatttgatt

SEQ ID NO: 6592063 - DNA, 14 bp, Homo sapiens
tttcataaatttga

SEQ ID NO: 6592064 - DNA, 20 bp, Homo sapiens
tttcataacaaaccatctgg

SEQ ID NO: 6592065 - DNA, 23 bp, Homo sapiens
tttcataacaaaccatctggtgc

SEQ ID NO: 6592066 - DNA, 18 bp, Homo sapiens
tttcataacttattgctg

SEQ ID NO: 6592067 - DNA, 14 bp, Homo sapiens
tttcataaggcctg

SEQ ID NO: 6592068 - DNA, 22 bp, Homo sapiens
tttcataaggcctgccctccca

SEQ ID NO: 6592069 - DNA, 14 bp, Homo sapiens
tttcataagtattt

SEQ ID NO: 6592070 - DNA, 19 bp, Homo sapiens
tttcataagtatttcaaat

SEQ ID NO: 6592071 - DNA, 21 bp, Homo sapiens
tttcataatgcagaagtattc

SEQ ID NO: 6592072 - DNA, 14 bp, Homo sapiens
tttcataattcaga

SEQ ID NO: 6592073 - DNA, 14 bp, Homo sapiens
tttcataattcatt

SEQ ID NO: 6592074 - DNA, 17 bp, Homo sapiens
tttcataattctgaaac

SEQ ID NO: 6592075 - DNA, 14 bp, Homo sapiens
tttcataattgcct

SEQ ID NO: 6592076 - DNA, 14 bp, Homo sapiens
tttcatacaaattt

SEQ ID NO: 6592077 - DNA, 17 bp, Homo sapiens
tttcatacatatatata

SEQ ID NO: 6592078 - DNA, 21 bp, Homo sapiens
tttcatacattatattcctct

SEQ ID NO: 6592079 - DNA, 16 bp, Homo sapiens
tttcataccacttgaa

SEQ ID NO: 6592080 - DNA, 16 bp, Homo sapiens
tttcatactctagatt

SEQ ID NO: 6592081 - DNA, 17 bp, Homo sapiens
tttcatactctagattt

SEQ ID NO: 6592082 - DNA, 22 bp, Homo sapiens
tttcatactcttaagtgtaaat

SEQ ID NO: 6592083 - DNA, 15 bp, Homo sapiens
tttcatactgtacac

SEQ ID NO: 6592084 - DNA, 17 bp, Homo sapiens
tttcatactgtacacat

SEQ ID NO: 6592085 - DNA, 18 bp, Homo sapiens
tttcatactgtacacatt

SEQ ID NO: 6592086 - DNA, 21 bp, Homo sapiens
tttcatactgtacacatttct

SEQ ID NO: 6592087 - DNA, 20 bp, Homo sapiens
tttcatagattgagaagttt

SEQ ID NO: 6592088 - DNA, 23 bp, Homo sapiens
tttcatagatttgaaaaactttt

SEQ ID NO: 6592089 - DNA, 19 bp, Homo sapiens
tttcatagccaaacaggag

SEQ ID NO: 6592090 - DNA, 20 bp, Homo sapiens
tttcatagctaagaaataaa

SEQ ID NO: 6592091 - DNA, 17 bp, Homo sapiens
tttcataggtctgaaat

SEQ ID NO: 6592092 - DNA, 21 bp, Homo sapiens
tttcatagtgcctttttcctt

SEQ ID NO: 6592093 - DNA, 23 bp, Homo sapiens
tttcatagtgtcaagaaggaaga

SEQ ID NO: 6592094 - DNA, 14 bp, Homo sapiens
tttcatagttcaga

SEQ ID NO: 6592095 - DNA, 21 bp, Homo sapiens
tttcatagttctgttaaatat

SEQ ID NO: 6592096 - DNA, 15 bp, Homo sapiens
tttcatagtttatta

SEQ ID NO: 6592097 - DNA, 23 bp, Homo sapiens
tttcatagtttattattattaaa

SEQ ID NO: 6592098 - DNA, 23 bp, Homo sapiens
tttcatataggaatagaaacatg

SEQ ID NO: 6592099 - DNA, 15 bp, Homo sapiens
tttcatatagttagc

SEQ ID NO: 6592100 - DNA, 23 bp, Homo sapiens
tttcatatgaggggacccagcgc

SEQ ID NO: 6592101 - DNA, 15 bp, Homo sapiens
tttcatatgctgtat

SEQ ID NO: 6592102 - DNA, 19 bp, Homo sapiens
tttcatattaaacaaaaac

SEQ ID NO: 6592103 - DNA, 21 bp, Homo sapiens
tttcatattattttagtgtgt

SEQ ID NO: 6592104 - DNA, 13 bp, Homo sapiens
tttcatattcttt

SEQ ID NO: 6592105 - DNA, 18 bp, Homo sapiens
tttcatattctttcaatt

SEQ ID NO: 6592106 - DNA, 17 bp, Homo sapiens
tttcatatttaaagcca

SEQ ID NO: 6592107 - DNA, 15 bp, Homo sapiens
tttcatattttaaat

SEQ ID NO: 6592108 - DNA, 17 bp, Homo sapiens
tttcatatttttcaaaa

SEQ ID NO: 6592109 - DNA, 16 bp, Homo sapiens
tttcatcaaaaagcct

SEQ ID NO: 6592110 - DNA, 14 bp, Homo sapiens
tttcatcaatttaa

SEQ ID NO: 6592111 - DNA, 24 bp, Homo sapiens
tttcatcattcacttcactgtgct

SEQ ID NO: 6592112 - DNA, 22 bp, Homo sapiens
tttcatcattgttgtgtataat

SEQ ID NO: 6592113 - DNA, 13 bp, Homo sapiens
tttcatcattttt

SEQ ID NO: 6592114 - DNA, 21 bp, Homo sapiens
tttcatccactagtgcaaatc

SEQ ID NO: 6592115 - DNA, 17 bp, Homo sapiens
tttcatccataactgaa

SEQ ID NO: 6592116 - DNA, 19 bp, Homo sapiens
tttcatccccttaccctta

SEQ ID NO: 6592117 - DNA, 23 bp, Homo sapiens
tttcatccctatgggattcagtg

SEQ ID NO: 6592118 - DNA, 15 bp, Homo sapiens
tttcatcctggcctc

SEQ ID NO: 6592119 - DNA, 17 bp, Homo sapiens
tttcatccttctttcct

SEQ ID NO: 6592120 - DNA, 14 bp, Homo sapiens
tttcatctaaatga

SEQ ID NO: 6592121 - DNA, 15 bp, Homo sapiens
tttcatctaaatgaa

SEQ ID NO: 6592122 - DNA, 19 bp, Homo sapiens
tttcatctaccttttctgg

SEQ ID NO: 6592123 - DNA, 12 bp, Homo sapiens
tttcatctattt

SEQ ID NO: 6592124 - DNA, 13 bp, Homo sapiens
tttcatctatttc

SEQ ID NO: 6592125 - DNA, 18 bp, Homo sapiens
tttcatctatttctgaga

SEQ ID NO: 6592126 - DNA, 19 bp, Homo sapiens
tttcatctattttatttta

SEQ ID NO: 6592127 - DNA, 21 bp, Homo sapiens
tttcatctcagagtccactgt

SEQ ID NO: 6592128 - DNA, 16 bp, Homo sapiens
tttcatctcagctttt

SEQ ID NO: 6592129 - DNA, 17 bp, Homo sapiens
tttcatctcctgagtat

SEQ ID NO: 6592130 - DNA, 14 bp, Homo sapiens
tttcatctcttcaa

SEQ ID NO: 6592131 - DNA, 17 bp, Homo sapiens
tttcatctcttcaatca

SEQ ID NO: 6592132 - DNA, 18 bp, Homo sapiens
tttcatctgaaaagcagt

SEQ ID NO: 6592133 - DNA, 15 bp, Homo sapiens
tttcatctgagcttt

SEQ ID NO: 6592134 - DNA, 17 bp, Homo sapiens
tttcatctgagctttta

SEQ ID NO: 6592135 - DNA, 23 bp, Homo sapiens
tttcatctgagcttttaccacta

SEQ ID NO: 6592136 - DNA, 17 bp, Homo sapiens
tttcatctgctctcctt

SEQ ID NO: 6592137 - DNA, 20 bp, Homo sapiens
tttcatctgctctccttcct

SEQ ID NO: 6592138 - DNA, 14 bp, Homo sapiens
tttcatctgggaaa

SEQ ID NO: 6592139 - DNA, 15 bp, Homo sapiens
tttcatctgggaaag

SEQ ID NO: 6592140 - DNA, 16 bp, Homo sapiens
tttcatctgggaaaga

SEQ ID NO: 6592141 - DNA, 14 bp, Homo sapiens
tttcatctggggat

SEQ ID NO: 6592142 - DNA, 17 bp, Homo sapiens
tttcatctggggtgggg

SEQ ID NO: 6592143 - DNA, 18 bp, Homo sapiens
tttcatctggttttatta

SEQ ID NO: 6592144 - DNA, 12 bp, Homo sapiens
tttcatctgttg

SEQ ID NO: 6592145 - DNA, 16 bp, Homo sapiens
tttcatcttcagttgt

SEQ ID NO: 6592146 - DNA, 22 bp, Homo sapiens
tttcatcttcagttgtctctga

SEQ ID NO: 6592147 - DNA, 15 bp, Homo sapiens
tttcatctttccaaa

SEQ ID NO: 6592148 - DNA, 15 bp, Homo sapiens
tttcatcttttgaag

SEQ ID NO: 6592149 - DNA, 12 bp, Homo sapiens
tttcatgaaaaa

SEQ ID NO: 6592150 - DNA, 20 bp, Homo sapiens
tttcatgaaaaagctgcttc

SEQ ID NO: 6592151 - DNA, 14 bp, Homo sapiens
tttcatgaaaactt

SEQ ID NO: 6592152 - DNA, 17 bp, Homo sapiens
tttcatgaaaataccat

SEQ ID NO: 6592153 - DNA, 17 bp, Homo sapiens
tttcatgaaaatggagt

SEQ ID NO: 6592154 - DNA, 16 bp, Homo sapiens
tttcatgaacacagcc

SEQ ID NO: 6592155 - DNA, 12 bp, Homo sapiens
tttcatgaagaa

SEQ ID NO: 6592156 - DNA, 15 bp, Homo sapiens
tttcatgacagaata

SEQ ID NO: 6592157 - DNA, 23 bp, Homo sapiens
tttcatgaccactgggcctgcta

SEQ ID NO: 6592158 - DNA, 19 bp, Homo sapiens
tttcatgataatgaacaga

SEQ ID NO: 6592159 - DNA, 22 bp, Homo sapiens
tttcatgataatgaacagaaca

SEQ ID NO: 6592160 - DNA, 21 bp, Homo sapiens
tttcatgattagacaatgtgg

SEQ ID NO: 6592161 - DNA, 20 bp, Homo sapiens
tttcatgattcatgagctgg

SEQ ID NO: 6592162 - DNA, 18 bp, Homo sapiens
tttcatgcaaactctttg

SEQ ID NO: 6592163 - DNA, 15 bp, Homo sapiens
tttcatgccatttta

SEQ ID NO: 6592164 - DNA, 19 bp, Homo sapiens
tttcatgctatctctgtgt

SEQ ID NO: 6592165 - DNA, 21 bp, Homo sapiens
tttcatgctgttcatgaaaga

SEQ ID NO: 6592166 - DNA, 12 bp, Homo sapiens
tttcatggaagt

SEQ ID NO: 6592167 - DNA, 13 bp, Homo sapiens
tttcatggacact

SEQ ID NO: 6592168 - DNA, 18 bp, Homo sapiens
tttcatggacactttgaa

SEQ ID NO: 6592169 - DNA, 20 bp, Homo sapiens
tttcatggcaatgaaaattt

SEQ ID NO: 6592170 - DNA, 12 bp, Homo sapiens
tttcatgtaagt

SEQ ID NO: 6592171 - DNA, 14 bp, Homo sapiens
tttcatgtaagttt

SEQ ID NO: 6592172 - DNA, 12 bp, Homo sapiens
tttcatgtactg

SEQ ID NO: 6592173 - DNA, 15 bp, Homo sapiens
tttcatgtactgcat

SEQ ID NO: 6592174 - DNA, 21 bp, Homo sapiens
tttcatgtagaactcagcagt

SEQ ID NO: 6592175 - DNA, 17 bp, Homo sapiens
tttcatgtcctgtgtca

SEQ ID NO: 6592176 - DNA, 21 bp, Homo sapiens
tttcatgtcctgtgtcagttt

SEQ ID NO: 6592177 - DNA, 17 bp, Homo sapiens
tttcatgtctttactgg

SEQ ID NO: 6592178 - DNA, 21 bp, Homo sapiens
tttcatgtctttactggacct

SEQ ID NO: 6592179 - DNA, 23 bp, Homo sapiens
tttcatgtgcggggatcatctgc

SEQ ID NO: 6592180 - DNA, 21 bp, Homo sapiens
tttcatgtggtgaatatgcaa

SEQ ID NO: 6592181 - DNA, 23 bp, Homo sapiens
tttcatgttggtttattttcaca

SEQ ID NO: 6592182 - DNA, 18 bp, Homo sapiens
tttcatgttttgtgacta

SEQ ID NO: 6592183 - DNA, 15 bp, Homo sapiens
tttcatgtttttgat

SEQ ID NO: 6592184 - DNA, 21 bp, Homo sapiens
tttcattaaaaggaaaaaaga

SEQ ID NO: 6592185 - DNA, 14 bp, Homo sapiens
tttcattaaacttg

SEQ ID NO: 6592186 - DNA, 21 bp, Homo sapiens
tttcattaaacttgaagcagt

SEQ ID NO: 6592187 - DNA, 23 bp, Homo sapiens
tttcattaaaggcttctctctca

SEQ ID NO: 6592188 - DNA, 18 bp, Homo sapiens
tttcattaaataaatttg

SEQ ID NO: 6592189 - DNA, 22 bp, Homo sapiens
tttcattaaataaatttgactt

SEQ ID NO: 6592190 - DNA, 17 bp, Homo sapiens
tttcattaccctacaga

SEQ ID NO: 6592191 - DNA, 17 bp, Homo sapiens
tttcattacctgtagct

SEQ ID NO: 6592192 - DNA, 16 bp, Homo sapiens
tttcattacttgaatg

SEQ ID NO: 6592193 - DNA, 17 bp, Homo sapiens
tttcattacttgaatgt

SEQ ID NO: 6592194 - DNA, 18 bp, Homo sapiens
tttcattacttgaatgta

SEQ ID NO: 6592195 - DNA, 14 bp, Homo sapiens
tttcattagcaaaa

SEQ ID NO: 6592196 - DNA, 16 bp, Homo sapiens
tttcattagcaaaaaa

SEQ ID NO: 6592197 - DNA, 19 bp, Homo sapiens
tttcattagcaaaaaaagt

SEQ ID NO: 6592198 - DNA, 14 bp, Homo sapiens
tttcattaggcaaa

SEQ ID NO: 6592199 - DNA, 15 bp, Homo sapiens
tttcattatcatcaa

SEQ ID NO: 6592200 - DNA, 19 bp, Homo sapiens
tttcattatctaatgagtt

SEQ ID NO: 6592201 - DNA, 17 bp, Homo sapiens
tttcattatgctttgaa

SEQ ID NO: 6592202 - DNA, 21 bp, Homo sapiens
tttcattatgctttgaacttt

SEQ ID NO: 6592203 - DNA, 18 bp, Homo sapiens
tttcattatgtaaaatgt

SEQ ID NO: 6592204 - DNA, 16 bp, Homo sapiens
tttcattattctcata

SEQ ID NO: 6592205 - DNA, 15 bp, Homo sapiens
tttcattattctcca

SEQ ID NO: 6592206 - DNA, 15 bp, Homo sapiens
tttcattatttggaa

SEQ ID NO: 6592207 - DNA, 13 bp, Homo sapiens
tttcattatttta

SEQ ID NO: 6592208 - DNA, 15 bp, Homo sapiens
tttcattattttatt

SEQ ID NO: 6592209 - DNA, 15 bp, Homo sapiens
tttcattattttccc

SEQ ID NO: 6592210 - DNA, 19 bp, Homo sapiens
tttcattatttttcaatta

SEQ ID NO: 6592211 - DNA, 16 bp, Homo sapiens
tttcattcaaatcagt

SEQ ID NO: 6592212 - DNA, 15 bp, Homo sapiens
tttcattcatcctga

SEQ ID NO: 6592213 - DNA, 12 bp, Homo sapiens
tttcattcatga

SEQ ID NO: 6592214 - DNA, 16 bp, Homo sapiens
tttcattccattgcct

SEQ ID NO: 6592215 - DNA, 12 bp, Homo sapiens
tttcattccctg

SEQ ID NO: 6592216 - DNA, 21 bp, Homo sapiens
tttcattcggtgtgaactttt

SEQ ID NO: 6592217 - DNA, 15 bp, Homo sapiens
tttcattctcagaat

SEQ ID NO: 6592218 - DNA, 14 bp, Homo sapiens
tttcattcttgtat

SEQ ID NO: 6592219 - DNA, 16 bp, Homo sapiens
tttcattgagggaaaa

SEQ ID NO: 6592220 - DNA, 22 bp, Homo sapiens
tttcattgagggaaaacataat

SEQ ID NO: 6592221 - DNA, 23 bp, Homo sapiens
tttcattgagggaaaacataata

SEQ ID NO: 6592222 - DNA, 22 bp, Homo sapiens
tttcattgatatgaaaaatatg

SEQ ID NO: 6592223 - DNA, 11 bp, Homo sapiens
tttcattgcac

SEQ ID NO: 6592224 - DNA, 12 bp, Homo sapiens
tttcattgcact

SEQ ID NO: 6592225 - DNA, 16 bp, Homo sapiens
tttcattgccagtgtc

SEQ ID NO: 6592226 - DNA, 16 bp, Homo sapiens
tttcattgctaagact

SEQ ID NO: 6592227 - DNA, 23 bp, Homo sapiens
tttcattgggaaaggacagcttt

SEQ ID NO: 6592228 - DNA, 13 bp, Homo sapiens
tttcattggtgta

SEQ ID NO: 6592229 - DNA, 17 bp, Homo sapiens
tttcattggttaatttt

SEQ ID NO: 6592230 - DNA, 15 bp, Homo sapiens
tttcattgtatgatg

SEQ ID NO: 6592231 - DNA, 11 bp, Homo sapiens
tttcattgtgt

SEQ ID NO: 6592232 - DNA, 13 bp, Homo sapiens
tttcatttacaaa

SEQ ID NO: 6592233 - DNA, 20 bp, Homo sapiens
tttcatttacaatttcaaaa

SEQ ID NO: 6592234 - DNA, 22 bp, Homo sapiens
tttcatttacaatttcaaaaga

SEQ ID NO: 6592235 - DNA, 18 bp, Homo sapiens
tttcatttaggtgaggaa

SEQ ID NO: 6592236 - DNA, 16 bp, Homo sapiens
tttcatttatactgta

SEQ ID NO: 6592237 - DNA, 17 bp, Homo sapiens
tttcatttatctataat

SEQ ID NO: 6592238 - DNA, 13 bp, Homo sapiens
tttcatttcatat

SEQ ID NO: 6592239 - DNA, 23 bp, Homo sapiens
tttcatttcttctacaactcata

SEQ ID NO: 6592240 - DNA, 22 bp, Homo sapiens
tttcatttcttgtcaattatgt

SEQ ID NO: 6592241 - DNA, 19 bp, Homo sapiens
tttcatttggttcattaat

SEQ ID NO: 6592242 - DNA, 13 bp, Homo sapiens
tttcatttgtaaa

SEQ ID NO: 6592243 - DNA, 18 bp, Homo sapiens
tttcatttgtgtcagcat

SEQ ID NO: 6592244 - DNA, 18 bp, Homo sapiens
tttcattttctctcaggt

SEQ ID NO: 6592245 - DNA, 18 bp, Homo sapiens
tttcattttctctcctcg

SEQ ID NO: 6592246 - DNA, 15 bp, Homo sapiens
tttcattttctgcaa

SEQ ID NO: 6592247 - DNA, 17 bp, Homo sapiens
tttcattttctttcctt

SEQ ID NO: 6592248 - DNA, 16 bp, Homo sapiens
tttcattttgagaaca

SEQ ID NO: 6592249 - DNA, 19 bp, Homo sapiens
tttcattttgcacctgcag

SEQ ID NO: 6592250 - DNA, 22 bp, Homo sapiens
tttcattttgcagaaggaaatg

SEQ ID NO: 6592251 - DNA, 16 bp, Homo sapiens
tttcattttgctttaa

SEQ ID NO: 6592252 - DNA, 20 bp, Homo sapiens
tttcattttgctttaatttt

SEQ ID NO: 6592253 - DNA, 16 bp, Homo sapiens
tttcatttttcatttt

SEQ ID NO: 6592254 - DNA, 20 bp, Homo sapiens
tttcatttttccatgacatt

SEQ ID NO: 6592255 - DNA, 14 bp, Homo sapiens
tttcatttttgcca

SEQ ID NO: 6592256 - DNA, 12 bp, Homo sapiens
tttccaaaaata

SEQ ID NO: 6592257 - DNA, 21 bp, Homo sapiens
tttccaaaacatttctggaca

SEQ ID NO: 6592258 - DNA, 19 bp, Homo sapiens
tttccaaaacctcagttaa

SEQ ID NO: 6592259 - DNA, 18 bp, Homo sapiens
tttccaaaagtggcctct

SEQ ID NO: 6592260 - DNA, 23 bp, Homo sapiens
tttccaaaagtggctagtcctca

SEQ ID NO: 6592261 - DNA, 19 bp, Homo sapiens
tttccaaaataaaacaaag

SEQ ID NO: 6592262 - DNA, 18 bp, Homo sapiens
tttccaaaataaaatgaa

SEQ ID NO: 6592263 - DNA, 14 bp, Homo sapiens
tttccaaaataatt

SEQ ID NO: 6592264 - DNA, 18 bp, Homo sapiens
tttccaaaatttttcaac

SEQ ID NO: 6592265 - DNA, 16 bp, Homo sapiens
tttccaaactgactca

SEQ ID NO: 6592266 - DNA, 13 bp, Homo sapiens
tttccaaagctga

SEQ ID NO: 6592267 - DNA, 13 bp, Homo sapiens
tttccaaaggttg

SEQ ID NO: 6592268 - DNA, 12 bp, Homo sapiens
tttccaaagtac

SEQ ID NO: 6592269 - DNA, 18 bp, Homo sapiens
tttccaaagtgcatgtca

SEQ ID NO: 6592270 - DNA, 17 bp, Homo sapiens
tttccaaataaacattt

SEQ ID NO: 6592271 - DNA, 16 bp, Homo sapiens
tttccaaatattctaa

SEQ ID NO: 6592272 - DNA, 12 bp, Homo sapiens
tttccaaatgct

SEQ ID NO: 6592273 - DNA, 23 bp, Homo sapiens
tttccaaatgtggcctccatgtg

SEQ ID NO: 6592274 - DNA, 13 bp, Homo sapiens
tttccaaattaaa

SEQ ID NO: 6592275 - DNA, 23 bp, Homo sapiens
tttccaaattcacaagttgtgtt

SEQ ID NO: 6592276 - DNA, 13 bp, Homo sapiens
tttccaaattgcc

SEQ ID NO: 6592277 - DNA, 22 bp, Homo sapiens
tttccaacaaacttactgtcag

SEQ ID NO: 6592278 - DNA, 15 bp, Homo sapiens
tttccaacaccacag

SEQ ID NO: 6592279 - DNA, 22 bp, Homo sapiens
aatgcttaataataattgaaga

SEQ ID NO: 6592280 - DNA, 14 bp, Homo sapiens
aatgcttaatcaga

SEQ ID NO: 6592281 - DNA, 22 bp, Homo sapiens
aatgcttaatcagatagatatt

SEQ ID NO: 6592282 - DNA, 16 bp, Homo sapiens
aatgcttaatttctaa

SEQ ID NO: 6592283 - DNA, 22 bp, Homo sapiens
aatgcttacctaatttcatttt

SEQ ID NO: 6592284 - DNA, 21 bp, Homo sapiens
aatgcttataggctgggccag

SEQ ID NO: 6592285 - DNA, 20 bp, Homo sapiens
aatgcttatcatctaaagat

SEQ ID NO: 6592286 - DNA, 19 bp, Homo sapiens
aatgcttatggaaagccag

SEQ ID NO: 6592287 - DNA, 15 bp, Homo sapiens
aatgcttatgtgttg

SEQ ID NO: 6592288 - DNA, 15 bp, Homo sapiens
aatgcttattgatga

SEQ ID NO: 6592289 - DNA, 20 bp, Homo sapiens
aatgcttcaagtgttgctct

SEQ ID NO: 6592290 - DNA, 11 bp, Homo sapiens
aatgcttcaga

SEQ ID NO: 6592291 - DNA, 16 bp, Homo sapiens
aatgcttcagatatta

SEQ ID NO: 6592292 - DNA, 13 bp, Homo sapiens
aatgcttcattca

SEQ ID NO: 6592293 - DNA, 21 bp, Homo sapiens
aatgcttcattcaatattgac

SEQ ID NO: 6592294 - DNA, 15 bp, Homo sapiens
aatgcttcattgaaa

SEQ ID NO: 6592295 - DNA, 21 bp, Homo sapiens
aatgcttcattgaaagcttca

SEQ ID NO: 6592296 - DNA, 23 bp, Homo sapiens
aatgcttccccacgggaacatta

SEQ ID NO: 6592297 - DNA, 14 bp, Homo sapiens
aatgcttctaagta

SEQ ID NO: 6592298 - DNA, 22 bp, Homo sapiens
aatgcttctaagtaaatacaat

SEQ ID NO: 6592299 - DNA, 23 bp, Homo sapiens
aatgcttctaagtaaatacaatt

SEQ ID NO: 6592300 - DNA, 23 bp, Homo sapiens
aatgcttctatcagactcagttt

SEQ ID NO: 6592301 - DNA, 13 bp, Homo sapiens
aatgcttctcttt

SEQ ID NO: 6592302 - DNA, 19 bp, Homo sapiens
aatgcttctgtagcttcta

SEQ ID NO: 6592303 - DNA, 16 bp, Homo sapiens
aatgcttcttaaagtt

SEQ ID NO: 6592304 - DNA, 16 bp, Homo sapiens
aatgcttcttctcagg

SEQ ID NO: 6592305 - DNA, 18 bp, Homo sapiens
aatgcttctttcctctta

SEQ ID NO: 6592306 - DNA, 19 bp, Homo sapiens
aatgcttgaaaaatgtgca

SEQ ID NO: 6592307 - DNA, 22 bp, Homo sapiens
aatgcttgacaaatattttcat

SEQ ID NO: 6592308 - DNA, 21 bp, Homo sapiens
aatgcttgcatggagaatggg

SEQ ID NO: 6592309 - DNA, 20 bp, Homo sapiens
aatgcttgctgctgatttaa

SEQ ID NO: 6592310 - DNA, 22 bp, Homo sapiens
aatgcttgctgctgatttaaac

SEQ ID NO: 6592311 - DNA, 23 bp, Homo sapiens
aatgcttgctgctgatttaaaca

SEQ ID NO: 6592312 - DNA, 19 bp, Homo sapiens
aatgcttggaatatctgct

SEQ ID NO: 6592313 - DNA, 19 bp, Homo sapiens
aatgcttgtacagttgatg

SEQ ID NO: 6592314 - DNA, 19 bp, Homo sapiens
aatgcttgtagaagtagga

SEQ ID NO: 6592315 - DNA, 23 bp, Homo sapiens
aatgctttaaaaactatttaact

SEQ ID NO: 6592316 - DNA, 18 bp, Homo sapiens
aatgctttagaaaggttt

SEQ ID NO: 6592317 - DNA, 19 bp, Homo sapiens
aatgctttagaaaggtttt

SEQ ID NO: 6592318 - DNA, 12 bp, Homo sapiens
aatgctttagca

SEQ ID NO: 6592319 - DNA, 14 bp, Homo sapiens
aatgctttatttgt

SEQ ID NO: 6592320 - DNA, 12 bp, Homo sapiens
aatgctttcctc

SEQ ID NO: 6592321 - DNA, 16 bp, Homo sapiens
aatgctttcctccctg

SEQ ID NO: 6592322 - DNA, 21 bp, Homo sapiens
aatgctttctcatgcatagac

SEQ ID NO: 6592323 - DNA, 17 bp, Homo sapiens
aatgctttctctcctct

SEQ ID NO: 6592324 - DNA, 17 bp, Homo sapiens
aatgctttctgaagctt

SEQ ID NO: 6592325 - DNA, 14 bp, Homo sapiens
aatgctttgattgt

SEQ ID NO: 6592326 - DNA, 18 bp, Homo sapiens
aatgctttggaaaaatgg

SEQ ID NO: 6592327 - DNA, 23 bp, Homo sapiens
aatgctttgtccatgatgtcctt

SEQ ID NO: 6592328 - DNA, 16 bp, Homo sapiens
aatgcttttaatgaat

SEQ ID NO: 6592329 - DNA, 19 bp, Homo sapiens
aatgcttttatatggccca

SEQ ID NO: 6592330 - DNA, 18 bp, Homo sapiens
aatggaaaaaaaaaaaag

SEQ ID NO: 6592331 - DNA, 21 bp, Homo sapiens
aatggaaaaaaaaaaaagagg

SEQ ID NO: 6592332 - DNA, 14 bp, Homo sapiens
aatggaaaaaaaca

SEQ ID NO: 6592333 - DNA, 18 bp, Homo sapiens
aatggaaaaatccttgaa

SEQ ID NO: 6592334 - DNA, 17 bp, Homo sapiens
aatggaaaactgttaag

SEQ ID NO: 6592335 - DNA, 17 bp, Homo sapiens
aatggaaaacttagttt

SEQ ID NO: 6592336 - DNA, 22 bp, Homo sapiens
aatggaaaacttagtttgtgaa

SEQ ID NO: 6592337 - DNA, 20 bp, Homo sapiens
aatggaaaatgtatattttg

SEQ ID NO: 6592338 - DNA, 14 bp, Homo sapiens
aatggaaacctcac

SEQ ID NO: 6592339 - DNA, 15 bp, Homo sapiens
aatggaaactattat

SEQ ID NO: 6592340 - DNA, 17 bp, Homo sapiens
aatggaaactattataa

SEQ ID NO: 6592341 - DNA, 13 bp, Homo sapiens
aatggaaactgaa

SEQ ID NO: 6592342 - DNA, 15 bp, Homo sapiens
aatggaaactttagg

SEQ ID NO: 6592343 - DNA, 19 bp, Homo sapiens
aatggaaagaaaagaatgt

SEQ ID NO: 6592344 - DNA, 12 bp, Homo sapiens
aatggaaagaag

SEQ ID NO: 6592345 - DNA, 14 bp, Homo sapiens
aatggaaagaagga

SEQ ID NO: 6592346 - DNA, 15 bp, Homo sapiens
aatggaaagaaggaa

SEQ ID NO: 6592347 - DNA, 23 bp, Homo sapiens
aatggaaagaaggaaaaaaggag

SEQ ID NO: 6592348 - DNA, 13 bp, Homo sapiens
aatggaaaggaga

SEQ ID NO: 6592349 - DNA, 15 bp, Homo sapiens
aatggaaaggagagg

SEQ ID NO: 6592350 - DNA, 20 bp, Homo sapiens
aatggaaagtttgtagcatt

SEQ ID NO: 6592351 - DNA, 21 bp, Homo sapiens
aatggaaatgggcagagcaga

SEQ ID NO: 6592352 - DNA, 15 bp, Homo sapiens
aatggaaattttgct

SEQ ID NO: 6592353 - DNA, 17 bp, Homo sapiens
aatggaactactgtact

SEQ ID NO: 6592354 - DNA, 14 bp, Homo sapiens
aatggaagacacat

SEQ ID NO: 6592355 - DNA, 13 bp, Homo sapiens
aatggaagacagc

SEQ ID NO: 6592356 - DNA, 16 bp, Homo sapiens
aatggaagacagctct

SEQ ID NO: 6592357 - DNA, 15 bp, Homo sapiens
aatggaagagaaatc

SEQ ID NO: 6592358 - DNA, 16 bp, Homo sapiens
aatggaagagaaatct

SEQ ID NO: 6592359 - DNA, 21 bp, Homo sapiens
aatggaagatttgcccattta

SEQ ID NO: 6592360 - DNA, 16 bp, Homo sapiens
aatggaagcaattgct

SEQ ID NO: 6592361 - DNA, 23 bp, Homo sapiens
aatggaagcaattgctcatgttg

SEQ ID NO: 6592362 - DNA, 18 bp, Homo sapiens
aatggaaggtttgtatat

SEQ ID NO: 6592363 - DNA, 14 bp, Homo sapiens
aatggaagtgtctg

SEQ ID NO: 6592364 - DNA, 16 bp, Homo sapiens
aatggaataactatct

SEQ ID NO: 6592365 - DNA, 14 bp, Homo sapiens
aatggaatactgaa

SEQ ID NO: 6592366 - DNA, 19 bp, Homo sapiens
aatggaatcttctccagta

SEQ ID NO: 6592367 - DNA, 21 bp, Homo sapiens
aatggaatgtgatgttcatgg

SEQ ID NO: 6592368 - DNA, 22 bp, Homo sapiens
aatggaatgtgcccctggccca

SEQ ID NO: 6592369 - DNA, 19 bp, Homo sapiens
aatggaattcgtgttatga

SEQ ID NO: 6592370 - DNA, 21 bp, Homo sapiens
aatggaattgcttctgtgtag

SEQ ID NO: 6592371 - DNA, 17 bp, Homo sapiens
aatggacacaaattttc

SEQ ID NO: 6592372 - DNA, 20 bp, Homo sapiens
aatggacacaaattttcaag

SEQ ID NO: 6592373 - DNA, 21 bp, Homo sapiens
aatggacatatgggtttgaac

SEQ ID NO: 6592374 - DNA, 13 bp, Homo sapiens
aatggacatttct

SEQ ID NO: 6592375 - DNA, 13 bp, Homo sapiens
aatggacattttc

SEQ ID NO: 6592376 - DNA, 18 bp, Homo sapiens
aatggaccacagtgactt

SEQ ID NO: 6592377 - DNA, 22 bp, Homo sapiens
aatggaccactgagagccacag

SEQ ID NO: 6592378 - DNA, 22 bp, Homo sapiens
aatggaccctttttgttatgat

SEQ ID NO: 6592379 - DNA, 20 bp, Homo sapiens
aatggacggtttaggtgaaa

SEQ ID NO: 6592380 - DNA, 21 bp, Homo sapiens
aatggacgtgttatgactcca

SEQ ID NO: 6592381 - DNA, 23 bp, Homo sapiens
aatggacgtgttatgactccaga

SEQ ID NO: 6592382 - DNA, 20 bp, Homo sapiens
aatggactaaaacattttga

SEQ ID NO: 6592383 - DNA, 14 bp, Homo sapiens
aatggactatacat

SEQ ID NO: 6592384 - DNA, 17 bp, Homo sapiens
aatggactcagctctgt

SEQ ID NO: 6592385 - DNA, 23 bp, Homo sapiens
aatggactcagctctgtctgctc

SEQ ID NO: 6592386 - DNA, 13 bp, Homo sapiens
aatggactcatgg

SEQ ID NO: 6592387 - DNA, 18 bp, Homo sapiens
aatggactgaccttaaaa

SEQ ID NO: 6592388 - DNA, 17 bp, Homo sapiens
aatggactggaagggga

SEQ ID NO: 6592389 - DNA, 23 bp, Homo sapiens
aatggactggaaggggaagggac

SEQ ID NO: 6592390 - DNA, 19 bp, Homo sapiens
aatggactggtttgagatt

SEQ ID NO: 6592391 - DNA, 22 bp, Homo sapiens
aatggactgtacaataagttac

SEQ ID NO: 6592392 - DNA, 21 bp, Homo sapiens
aatggactgtgaatttcaaaa

SEQ ID NO: 6592393 - DNA, 21 bp, Homo sapiens
aatggacttatttcttcaaat

SEQ ID NO: 6592394 - DNA, 15 bp, Homo sapiens
aatggacttcaaatt

SEQ ID NO: 6592395 - DNA, 18 bp, Homo sapiens
aatggactttgcacactt

SEQ ID NO: 6592396 - DNA, 19 bp, Homo sapiens
aatggacttttgtacatag

SEQ ID NO: 6592397 - DNA, 13 bp, Homo sapiens
aatggagaaaatg

SEQ ID NO: 6592398 - DNA, 19 bp, Homo sapiens
aatggagaaaatgaatgga

SEQ ID NO: 6592399 - DNA, 16 bp, Homo sapiens
aatggagctttctgta

SEQ ID NO: 6592400 - DNA, 20 bp, Homo sapiens
aatggaggaagaacaacaaa

SEQ ID NO: 6592401 - DNA, 15 bp, Homo sapiens
aatggaggaatatga

SEQ ID NO: 6592402 - DNA, 19 bp, Homo sapiens
aatggaggagccaggcccc

SEQ ID NO: 6592403 - DNA, 19 bp, Homo sapiens
aatggaggatctctaaaga

SEQ ID NO: 6592404 - DNA, 13 bp, Homo sapiens
aatggaggccaag

SEQ ID NO: 6592405 - DNA, 17 bp, Homo sapiens
aatggaggccattgtgt

SEQ ID NO: 6592406 - DNA, 13 bp, Homo sapiens
aatggagggtggg

SEQ ID NO: 6592407 - DNA, 16 bp, Homo sapiens
aatggaggtacaggat

SEQ ID NO: 6592408 - DNA, 17 bp, Homo sapiens
aatggaggtacaggata

SEQ ID NO: 6592409 - DNA, 18 bp, Homo sapiens
aatggaggtcccagccct

SEQ ID NO: 6592410 - DNA, 23 bp, Homo sapiens
aatggagtagacccctggctggt

SEQ ID NO: 6592411 - DNA, 20 bp, Homo sapiens
aatggagtctcccactgcaa

SEQ ID NO: 6592412 - DNA, 21 bp, Homo sapiens
aatggagtctcccactgcaac

SEQ ID NO: 6592413 - DNA, 14 bp, Homo sapiens
aatggagtgggaga

SEQ ID NO: 6592414 - DNA, 13 bp, Homo sapiens
aatggagtgtttg

SEQ ID NO: 6592415 - DNA, 17 bp, Homo sapiens
aatggagtgtttgaaaa

SEQ ID NO: 6592416 - DNA, 19 bp, Homo sapiens
aatggagtgtttgaaaact

SEQ ID NO: 6592417 - DNA, 21 bp, Homo sapiens
aatggagttggagttcattca

SEQ ID NO: 6592418 - DNA, 18 bp, Homo sapiens
aatggataaaatctgata

SEQ ID NO: 6592419 - DNA, 22 bp, Homo sapiens
aatggataagatgatgttaaat

SEQ ID NO: 6592420 - DNA, 22 bp, Homo sapiens
aatggatatagaaaatcttagt

SEQ ID NO: 6592421 - DNA, 17 bp, Homo sapiens
aatggatattattagaa

SEQ ID NO: 6592422 - DNA, 19 bp, Homo sapiens
aatggatattattagaaat

SEQ ID NO: 6592423 - DNA, 11 bp, Homo sapiens
aatggatattg

SEQ ID NO: 6592424 - DNA, 22 bp, Homo sapiens
aatggatatttgtactgtttaa

SEQ ID NO: 6592425 - DNA, 23 bp, Homo sapiens
aatggatattttaaattcattca

SEQ ID NO: 6592426 - DNA, 16 bp, Homo sapiens
aatggatcacaagatg

SEQ ID NO: 6592427 - DNA, 12 bp, Homo sapiens
aatggatgaaat

SEQ ID NO: 6592428 - DNA, 13 bp, Homo sapiens
aatggatgaggtg

SEQ ID NO: 6592429 - DNA, 17 bp, Homo sapiens
aatggatgccttgaata

SEQ ID NO: 6592430 - DNA, 14 bp, Homo sapiens
aatggatgtaatat

SEQ ID NO: 6592431 - DNA, 14 bp, Homo sapiens
aatggattaaatgg

SEQ ID NO: 6592432 - DNA, 14 bp, Homo sapiens
aatggattatacaa

SEQ ID NO: 6592433 - DNA, 14 bp, Homo sapiens
aatggattctattt

SEQ ID NO: 6592434 - DNA, 23 bp, Homo sapiens
aatggattggattatttaataac

SEQ ID NO: 6592435 - DNA, 19 bp, Homo sapiens
aatggatttaatccatttt

SEQ ID NO: 6592436 - DNA, 16 bp, Homo sapiens
aatggatttcctagtg

SEQ ID NO: 6592437 - DNA, 22 bp, Homo sapiens
aatggattttagtcaaatattt

SEQ ID NO: 6592438 - DNA, 19 bp, Homo sapiens
aatggatttttgactttgt

SEQ ID NO: 6592439 - DNA, 20 bp, Homo sapiens
aatggcaaaagatccaggag

SEQ ID NO: 6592440 - DNA, 22 bp, Homo sapiens
aatggcaaagcggttgcttctg

SEQ ID NO: 6592441 - DNA, 21 bp, Homo sapiens
aatggcaaggcagccctgtct

SEQ ID NO: 6592442 - DNA, 20 bp, Homo sapiens
aatggcaatgttttgctttt

SEQ ID NO: 6592443 - DNA, 17 bp, Homo sapiens
aatggcacagcccaaag

SEQ ID NO: 6592444 - DNA, 18 bp, Homo sapiens
aatggcaccttccccctt

SEQ ID NO: 6592445 - DNA, 16 bp, Homo sapiens
aatggcacgatctcag

SEQ ID NO: 6592446 - DNA, 12 bp, Homo sapiens
aatggcactgat

SEQ ID NO: 6592447 - DNA, 15 bp, Homo sapiens
aatggcacttttgat

SEQ ID NO: 6592448 - DNA, 18 bp, Homo sapiens
aatggcagcattcccacc

SEQ ID NO: 6592449 - DNA, 13 bp, Homo sapiens
aatggcagcctga

SEQ ID NO: 6592450 - DNA, 20 bp, Homo sapiens
aatggcagcctgaggaagtt

SEQ ID NO: 6592451 - DNA, 18 bp, Homo sapiens
aatggcagctagactgga

SEQ ID NO: 6592452 - DNA, 13 bp, Homo sapiens
aatggcagctagt

SEQ ID NO: 6592453 - DNA, 16 bp, Homo sapiens
aatggcagctagtgcc

SEQ ID NO: 6592454 - DNA, 15 bp, Homo sapiens
aatggcagtcctgga

SEQ ID NO: 6592455 - DNA, 22 bp, Homo sapiens
aatggcagtgactccccagccc

SEQ ID NO: 6592456 - DNA, 21 bp, Homo sapiens
tttccaacaccacagacacac

SEQ ID NO: 6592457 - DNA, 22 bp, Homo sapiens
tttccaacaccacagacacaca

SEQ ID NO: 6592458 - DNA, 17 bp, Homo sapiens
tttccaacattatcctg

SEQ ID NO: 6592459 - DNA, 19 bp, Homo sapiens
tttccaaccggctttgtgg

SEQ ID NO: 6592460 - DNA, 16 bp, Homo sapiens
tttccaactggcactc

SEQ ID NO: 6592461 - DNA, 14 bp, Homo sapiens
tttccaacttgtct

SEQ ID NO: 6592462 - DNA, 15 bp, Homo sapiens
tttccaagacagagt

SEQ ID NO: 6592463 - DNA, 19 bp, Homo sapiens
tttccaagcaaaatctaaa

SEQ ID NO: 6592464 - DNA, 21 bp, Homo sapiens
tttccaagcaaatgttacata

SEQ ID NO: 6592465 - DNA, 22 bp, Homo sapiens
tttccaagcaaatgttacatag

SEQ ID NO: 6592466 - DNA, 11 bp, Homo sapiens
tttccaagcct

SEQ ID NO: 6592467 - DNA, 19 bp, Homo sapiens
tttccaagcctctctggca

SEQ ID NO: 6592468 - DNA, 17 bp, Homo sapiens
tttccaagcctgggcca

SEQ ID NO: 6592469 - DNA, 13 bp, Homo sapiens
tttccaagctgcg

SEQ ID NO: 6592470 - DNA, 19 bp, Homo sapiens
tttccaaggagctgagaat

SEQ ID NO: 6592471 - DNA, 13 bp, Homo sapiens
tttccaaggtgca

SEQ ID NO: 6592472 - DNA, 21 bp, Homo sapiens
tttccaagtaatataatggaa

SEQ ID NO: 6592473 - DNA, 19 bp, Homo sapiens
tttccaagttcctgcactc

SEQ ID NO: 6592474 - DNA, 23 bp, Homo sapiens
tttccaagttcctgcactccaga

SEQ ID NO: 6592475 - DNA, 13 bp, Homo sapiens
tttccaatagaaa

SEQ ID NO: 6592476 - DNA, 18 bp, Homo sapiens
tttccaatattttaataa

SEQ ID NO: 6592477 - DNA, 18 bp, Homo sapiens
tttccaatcacagtgtta

SEQ ID NO: 6592478 - DNA, 19 bp, Homo sapiens
tttccaatgaaggaaacat

SEQ ID NO: 6592479 - DNA, 15 bp, Homo sapiens
tttccaatgccacag

SEQ ID NO: 6592480 - DNA, 17 bp, Homo sapiens
tttccaattctccttta

SEQ ID NO: 6592481 - DNA, 13 bp, Homo sapiens
tttccacaattct

SEQ ID NO: 6592482 - DNA, 13 bp, Homo sapiens
tttccacacaggc

SEQ ID NO: 6592483 - DNA, 18 bp, Homo sapiens
tttccacacgcattaata

SEQ ID NO: 6592484 - DNA, 15 bp, Homo sapiens
tttccacagaagctc

SEQ ID NO: 6592485 - DNA, 21 bp, Homo sapiens
tttccacagatttttttgtaa

SEQ ID NO: 6592486 - DNA, 17 bp, Homo sapiens
tttccacataaatttta

SEQ ID NO: 6592487 - DNA, 20 bp, Homo sapiens
tttccacataaattttaatt

SEQ ID NO: 6592488 - DNA, 18 bp, Homo sapiens
tttccacatccccaccct

SEQ ID NO: 6592489 - DNA, 19 bp, Homo sapiens
tttccacatggcagatgat

SEQ ID NO: 6592490 - DNA, 21 bp, Homo sapiens
tttccaccaactttttccaag

SEQ ID NO: 6592491 - DNA, 22 bp, Homo sapiens
tttccaccaactttttccaagt

SEQ ID NO: 6592492 - DNA, 19 bp, Homo sapiens
tttccacccagaccctcct

SEQ ID NO: 6592493 - DNA, 21 bp, Homo sapiens
tttccacctgctttctcctgg

SEQ ID NO: 6592494 - DNA, 14 bp, Homo sapiens
tttccaccttttgt

SEQ ID NO: 6592495 - DNA, 14 bp, Homo sapiens
tttccacgcagttc

SEQ ID NO: 6592496 - DNA, 19 bp, Homo sapiens
tttccacggaaacagaact

SEQ ID NO: 6592497 - DNA, 20 bp, Homo sapiens
tttccacggaaacagaactc

SEQ ID NO: 6592498 - DNA, 21 bp, Homo sapiens
tttccactaagaacacctgca

SEQ ID NO: 6592499 - DNA, 15 bp, Homo sapiens
tttccactactgcta

SEQ ID NO: 6592500 - DNA, 20 bp, Homo sapiens
tttccactattatagaaatt

SEQ ID NO: 6592501 - DNA, 16 bp, Homo sapiens
tttccactccattgtc

SEQ ID NO: 6592502 - DNA, 19 bp, Homo sapiens
tttccactcctcctagcca

SEQ ID NO: 6592503 - DNA, 13 bp, Homo sapiens
tttccactgaaca

SEQ ID NO: 6592504 - DNA, 21 bp, Homo sapiens
tttccactgagcatcacaata

SEQ ID NO: 6592505 - DNA, 21 bp, Homo sapiens
tttccactggcttttgcctgt

SEQ ID NO: 6592506 - DNA, 21 bp, Homo sapiens
tttccactgtaattaaaacta

SEQ ID NO: 6592507 - DNA, 20 bp, Homo sapiens
tttccacttgccctgtgttc

SEQ ID NO: 6592508 - DNA, 20 bp, Homo sapiens
tttccacttgccctgttctc

SEQ ID NO: 6592509 - DNA, 23 bp, Homo sapiens
tttccactttcatctggggtggg

SEQ ID NO: 6592510 - DNA, 23 bp, Homo sapiens
tttccactttgttctttaggaga

SEQ ID NO: 6592511 - DNA, 14 bp, Homo sapiens
tttccagaaaatat

SEQ ID NO: 6592512 - DNA, 21 bp, Homo sapiens
tttccagaaccacacttgaaa

SEQ ID NO: 6592513 - DNA, 12 bp, Homo sapiens
tttccagaattg

SEQ ID NO: 6592514 - DNA, 16 bp, Homo sapiens
tttccagaatttgaat

SEQ ID NO: 6592515 - DNA, 19 bp, Homo sapiens
tttccagaatttgaatatt

SEQ ID NO: 6592516 - DNA, 17 bp, Homo sapiens
tttccagaccaataaat

SEQ ID NO: 6592517 - DNA, 14 bp, Homo sapiens
tttccagagaactg

SEQ ID NO: 6592518 - DNA, 18 bp, Homo sapiens
tttccagagaactgcaga

SEQ ID NO: 6592519 - DNA, 13 bp, Homo sapiens
tttccagagcatt

SEQ ID NO: 6592520 - DNA, 19 bp, Homo sapiens
tttccagagcattccagtc

SEQ ID NO: 6592521 - DNA, 20 bp, Homo sapiens
tttccagaggagtttcttaa

SEQ ID NO: 6592522 - DNA, 19 bp, Homo sapiens
tttccagaggctattattt

SEQ ID NO: 6592523 - DNA, 18 bp, Homo sapiens
tttccagagttgttgttt

SEQ ID NO: 6592524 - DNA, 17 bp, Homo sapiens
tttccagcaaaatatat

SEQ ID NO: 6592525 - DNA, 16 bp, Homo sapiens
tttccagcagaagaca

SEQ ID NO: 6592526 - DNA, 17 bp, Homo sapiens
tttccagcattcccagg

SEQ ID NO: 6592527 - DNA, 15 bp, Homo sapiens
tttccagcattttta

SEQ ID NO: 6592528 - DNA, 17 bp, Homo sapiens
tttccagccttatgtgt

SEQ ID NO: 6592529 - DNA, 19 bp, Homo sapiens
tttccagcctttgtcacta

SEQ ID NO: 6592530 - DNA, 21 bp, Homo sapiens
tttccagctgccaagtgctct

SEQ ID NO: 6592531 - DNA, 19 bp, Homo sapiens
tttccagctgtgcagcacg

SEQ ID NO: 6592532 - DNA, 13 bp, Homo sapiens
tttccagcttctc

SEQ ID NO: 6592533 - DNA, 14 bp, Homo sapiens
tttccaggaaaaaa

SEQ ID NO: 6592534 - DNA, 17 bp, Homo sapiens
tttccaggaaaaaataa

SEQ ID NO: 6592535 - DNA, 22 bp, Homo sapiens
tttccaggaaaaaataaaaaga

SEQ ID NO: 6592536 - DNA, 21 bp, Homo sapiens
tttccaggagacatatatagg

SEQ ID NO: 6592537 - DNA, 19 bp, Homo sapiens
tttccaggcccctgaggac

SEQ ID NO: 6592538 - DNA, 15 bp, Homo sapiens
tttccaggctggttc

SEQ ID NO: 6592539 - DNA, 22 bp, Homo sapiens
tttccaggctggttcggatttg

SEQ ID NO: 6592540 - DNA, 18 bp, Homo sapiens
tttccaggcttctgctgg

SEQ ID NO: 6592541 - DNA, 23 bp, Homo sapiens
tttccaggcttctgctggggcct

SEQ ID NO: 6592542 - DNA, 21 bp, Homo sapiens
tttccagtaaggaatgatatt

SEQ ID NO: 6592543 - DNA, 19 bp, Homo sapiens
tttccagtattgaaaactt

SEQ ID NO: 6592544 - DNA, 17 bp, Homo sapiens
tttccagtattttagtg

SEQ ID NO: 6592545 - DNA, 15 bp, Homo sapiens
tttccagtctccacc

SEQ ID NO: 6592546 - DNA, 15 bp, Homo sapiens
tttccagtctgtaca

SEQ ID NO: 6592547 - DNA, 17 bp, Homo sapiens
tttccagtgagtgtaaa

SEQ ID NO: 6592548 - DNA, 18 bp, Homo sapiens
tttccagtgagtgtaaat

SEQ ID NO: 6592549 - DNA, 22 bp, Homo sapiens
tttccagtggcctggctccgct

SEQ ID NO: 6592550 - DNA, 21 bp, Homo sapiens
tttccagtggtcatgctcagc

SEQ ID NO: 6592551 - DNA, 12 bp, Homo sapiens
tttccagtgtgt

SEQ ID NO: 6592552 - DNA, 14 bp, Homo sapiens
tttccagttccctt

SEQ ID NO: 6592553 - DNA, 16 bp, Homo sapiens
tttccagttgttactg

SEQ ID NO: 6592554 - DNA, 19 bp, Homo sapiens
tttccataaagaagatgtt

SEQ ID NO: 6592555 - DNA, 14 bp, Homo sapiens
tttccataagctat

SEQ ID NO: 6592556 - DNA, 15 bp, Homo sapiens
tttccataaggaatg

SEQ ID NO: 6592557 - DNA, 19 bp, Homo sapiens
tttccatagcaacaggaaa

SEQ ID NO: 6592558 - DNA, 19 bp, Homo sapiens
tttccatatttaacctatt

SEQ ID NO: 6592559 - DNA, 17 bp, Homo sapiens
tttccatcaactcccaa

SEQ ID NO: 6592560 - DNA, 14 bp, Homo sapiens
tttccatcagcttt

SEQ ID NO: 6592561 - DNA, 12 bp, Homo sapiens
tttccatcatgt

SEQ ID NO: 6592562 - DNA, 23 bp, Homo sapiens
tttccatcattaaatttttcctt

SEQ ID NO: 6592563 - DNA, 16 bp, Homo sapiens
tttccatcattttaca

SEQ ID NO: 6592564 - DNA, 18 bp, Homo sapiens
tttccatcattttacagt

SEQ ID NO: 6592565 - DNA, 19 bp, Homo sapiens
tttccatccaaacctacct

SEQ ID NO: 6592566 - DNA, 19 bp, Homo sapiens
tttccatccatggccagca

SEQ ID NO: 6592567 - DNA, 18 bp, Homo sapiens
tttccatcttaatgttac

SEQ ID NO: 6592568 - DNA, 17 bp, Homo sapiens
tttccatgacatttttc

SEQ ID NO: 6592569 - DNA, 18 bp, Homo sapiens
tttccatgagtcccctgt

SEQ ID NO: 6592570 - DNA, 23 bp, Homo sapiens
tttccatgcaccctcatacacag

SEQ ID NO: 6592571 - DNA, 21 bp, Homo sapiens
tttccatgcagactcctcaga

SEQ ID NO: 6592572 - DNA, 22 bp, Homo sapiens
tttccatgggaccacaactatt

SEQ ID NO: 6592573 - DNA, 22 bp, Homo sapiens
tttccatgggcccgctgcctct

SEQ ID NO: 6592574 - DNA, 23 bp, Homo sapiens
tttccatgggcccgctgcctctt

SEQ ID NO: 6592575 - DNA, 15 bp, Homo sapiens
tttccatgtatgcat

SEQ ID NO: 6592576 - DNA, 18 bp, Homo sapiens
tttccatgtgttttgctt

SEQ ID NO: 6592577 - DNA, 23 bp, Homo sapiens
tttccatgttatgtttctacaca

SEQ ID NO: 6592578 - DNA, 20 bp, Homo sapiens
tttccattaaatcaatcagg

SEQ ID NO: 6592579 - DNA, 18 bp, Homo sapiens
tttccattacaagtattt

SEQ ID NO: 6592580 - DNA, 15 bp, Homo sapiens
tttccattagaacaa

SEQ ID NO: 6592581 - DNA, 13 bp, Homo sapiens
tttccattattta

SEQ ID NO: 6592582 - DNA, 14 bp, Homo sapiens
tttccattccataa

SEQ ID NO: 6592583 - DNA, 16 bp, Homo sapiens
tttccattcttcttgc

SEQ ID NO: 6592584 - DNA, 18 bp, Homo sapiens
tttccattcttttaaatg

SEQ ID NO: 6592585 - DNA, 21 bp, Homo sapiens
tttccattcttttaaatgggt

SEQ ID NO: 6592586 - DNA, 19 bp, Homo sapiens
tttccattgaccagctctc

SEQ ID NO: 6592587 - DNA, 17 bp, Homo sapiens
tttccattggaaataac

SEQ ID NO: 6592588 - DNA, 14 bp, Homo sapiens
tttccattgtgtgg

SEQ ID NO: 6592589 - DNA, 17 bp, Homo sapiens
tttccatttacttaaga

SEQ ID NO: 6592590 - DNA, 19 bp, Homo sapiens
tttccatttatttatgaaa

SEQ ID NO: 6592591 - DNA, 11 bp, Homo sapiens
tttccatttct

SEQ ID NO: 6592592 - DNA, 19 bp, Homo sapiens
tttccatttcttcagaggg

SEQ ID NO: 6592593 - DNA, 21 bp, Homo sapiens
tttccatttgcatttgtttat

SEQ ID NO: 6592594 - DNA, 16 bp, Homo sapiens
tttccatttggatttt

SEQ ID NO: 6592595 - DNA, 13 bp, Homo sapiens
tttccattttata

SEQ ID NO: 6592596 - DNA, 20 bp, Homo sapiens
tttccatttttttctttact

SEQ ID NO: 6592597 - DNA, 13 bp, Homo sapiens
tttcccaaagcac

SEQ ID NO: 6592598 - DNA, 18 bp, Homo sapiens
tttcccaaagtcctctgc

SEQ ID NO: 6592599 - DNA, 12 bp, Homo sapiens
tttcccaactct

SEQ ID NO: 6592600 - DNA, 21 bp, Homo sapiens
tttcccaagctagactgtgtc

SEQ ID NO: 6592601 - DNA, 23 bp, Homo sapiens
tttcccaagctagactgtgtctg

SEQ ID NO: 6592602 - DNA, 19 bp, Homo sapiens
tttcccaatattgagcagt

SEQ ID NO: 6592603 - DNA, 20 bp, Homo sapiens
tttcccaatggtgtttttct

SEQ ID NO: 6592604 - DNA, 15 bp, Homo sapiens
tttcccacagtctct

SEQ ID NO: 6592605 - DNA, 21 bp, Homo sapiens
tttcccaccaatcctcaccta

SEQ ID NO: 6592606 - DNA, 13 bp, Homo sapiens
tttcccaccacct

SEQ ID NO: 6592607 - DNA, 16 bp, Homo sapiens
tttcccaccagctccc

SEQ ID NO: 6592608 - DNA, 22 bp, Homo sapiens
tttcccacccactagccctctt

SEQ ID NO: 6592609 - DNA, 21 bp, Homo sapiens
tttcccaccccaacctgctct

SEQ ID NO: 6592610 - DNA, 22 bp, Homo sapiens
tttcccaccccaacctgctctc

SEQ ID NO: 6592611 - DNA, 19 bp, Homo sapiens
tttcccaccctcctgcccc

SEQ ID NO: 6592612 - DNA, 21 bp, Homo sapiens
tttcccacgtctaactggaaa

SEQ ID NO: 6592613 - DNA, 12 bp, Homo sapiens
tttcccactcca

SEQ ID NO: 6592614 - DNA, 16 bp, Homo sapiens
tttcccactccaagcc

SEQ ID NO: 6592615 - DNA, 12 bp, Homo sapiens
tttcccactctg

SEQ ID NO: 6592616 - DNA, 15 bp, Homo sapiens
tttcccactctgaag

SEQ ID NO: 6592617 - DNA, 21 bp, Homo sapiens
tttcccactgtttaaggagtt

SEQ ID NO: 6592618 - DNA, 17 bp, Homo sapiens
tttcccactttcttcta

SEQ ID NO: 6592619 - DNA, 17 bp, Homo sapiens
tttcccagccctttcca

SEQ ID NO: 6592620 - DNA, 20 bp, Homo sapiens
tttcccagctacacctttct

SEQ ID NO: 6592621 - DNA, 19 bp, Homo sapiens
tttcccaggacaggaaata

SEQ ID NO: 6592622 - DNA, 14 bp, Homo sapiens
tttcccaggaccct

SEQ ID NO: 6592623 - DNA, 18 bp, Homo sapiens
tttcccaggaccctgaag

SEQ ID NO: 6592624 - DNA, 16 bp, Homo sapiens
tttcccaggttctgtt

SEQ ID NO: 6592625 - DNA, 13 bp, Homo sapiens
tttcccagtgagc

SEQ ID NO: 6592626 - DNA, 15 bp, Homo sapiens
tttcccagttaaaga

SEQ ID NO: 6592627 - DNA, 19 bp, Homo sapiens
tttcccatcaccccttccc

SEQ ID NO: 6592628 - DNA, 21 bp, Homo sapiens
tttcccatcaccccttcccca

SEQ ID NO: 6592629 - DNA, 21 bp, Homo sapiens
tttcccatcatcctttgttct

SEQ ID NO: 6592630 - DNA, 18 bp, Homo sapiens
tttcccatgactcttgga

SEQ ID NO: 6592631 - DNA, 14 bp, Homo sapiens
tttcccatgatttc

SEQ ID NO: 6592632 - DNA, 18 bp, Homo sapiens
tttcccatgatttcatgt

SEQ ID NO: 6592633 - DNA, 13 bp, Homo sapiens
aatggcagtgaga

SEQ ID NO: 6592634 - DNA, 13 bp, Homo sapiens
aatggcatgacaa

SEQ ID NO: 6592635 - DNA, 23 bp, Homo sapiens
aatggcatgagaaatacaaaaat

SEQ ID NO: 6592636 - DNA, 15 bp, Homo sapiens
aatggcatgagatag

SEQ ID NO: 6592637 - DNA, 13 bp, Homo sapiens
aatggcatggaga

SEQ ID NO: 6592638 - DNA, 17 bp, Homo sapiens
aatggcatttagcacag

SEQ ID NO: 6592639 - DNA, 18 bp, Homo sapiens
aatggcatttagcacagt

SEQ ID NO: 6592640 - DNA, 18 bp, Homo sapiens
aatggcatttctctttaa

SEQ ID NO: 6592641 - DNA, 19 bp, Homo sapiens
aatggcatttgctggttat

SEQ ID NO: 6592642 - DNA, 18 bp, Homo sapiens
aatggccaagtgtacatt

SEQ ID NO: 6592643 - DNA, 19 bp, Homo sapiens
aatggccacaaacctgccc

SEQ ID NO: 6592644 - DNA, 13 bp, Homo sapiens
aatggccagccca

SEQ ID NO: 6592645 - DNA, 14 bp, Homo sapiens
aatggccagcccag

SEQ ID NO: 6592646 - DNA, 17 bp, Homo sapiens
aatggccagtgctgctt

SEQ ID NO: 6592647 - DNA, 17 bp, Homo sapiens
aatggccatgcaggagg

SEQ ID NO: 6592648 - DNA, 21 bp, Homo sapiens
aatggccatgcaggaggtgga

SEQ ID NO: 6592649 - DNA, 23 bp, Homo sapiens
aatggccatgcaggaggtggaga

SEQ ID NO: 6592650 - DNA, 19 bp, Homo sapiens
aatggccattgagctgttt

SEQ ID NO: 6592651 - DNA, 20 bp, Homo sapiens
aatggccattgagctgtttc

SEQ ID NO: 6592652 - DNA, 15 bp, Homo sapiens
aatggccattttaaa

SEQ ID NO: 6592653 - DNA, 19 bp, Homo sapiens
aatggcccggcccctcctg

SEQ ID NO: 6592654 - DNA, 16 bp, Homo sapiens
aatggcctctctccac

SEQ ID NO: 6592655 - DNA, 18 bp, Homo sapiens
aatggcctctctccacta

SEQ ID NO: 6592656 - DNA, 16 bp, Homo sapiens
aatggcctcttaaaaa

SEQ ID NO: 6592657 - DNA, 20 bp, Homo sapiens
aatggcctcttaaaaattat

SEQ ID NO: 6592658 - DNA, 14 bp, Homo sapiens
aatggcctgagaca

SEQ ID NO: 6592659 - DNA, 17 bp, Homo sapiens
aatggcctggagcaggc

SEQ ID NO: 6592660 - DNA, 20 bp, Homo sapiens
aatggcctggtaggtctgga

SEQ ID NO: 6592661 - DNA, 18 bp, Homo sapiens
aatggccttaattaattc

SEQ ID NO: 6592662 - DNA, 14 bp, Homo sapiens
aatggccttccttc

SEQ ID NO: 6592663 - DNA, 19 bp, Homo sapiens
aatggcggtttttatccat

SEQ ID NO: 6592664 - DNA, 23 bp, Homo sapiens
aatggcgtccgtgggttgctaac

SEQ ID NO: 6592665 - DNA, 14 bp, Homo sapiens
aatggcgtctgctc

SEQ ID NO: 6592666 - DNA, 19 bp, Homo sapiens
aatggcgtctgctctggtg

SEQ ID NO: 6592667 - DNA, 23 bp, Homo sapiens
aatggcgtctgctctggtggctt

SEQ ID NO: 6592668 - DNA, 18 bp, Homo sapiens
aatggcgtgatctcggct

SEQ ID NO: 6592669 - DNA, 20 bp, Homo sapiens
aatggctaataaactgtatt

SEQ ID NO: 6592670 - DNA, 18 bp, Homo sapiens
aatggctacatctccaaa

SEQ ID NO: 6592671 - DNA, 15 bp, Homo sapiens
aatggctagtactgt

SEQ ID NO: 6592672 - DNA, 18 bp, Homo sapiens
aatggctatcaaaagaaa

SEQ ID NO: 6592673 - DNA, 23 bp, Homo sapiens
aatggctatgaacagaaactaca

SEQ ID NO: 6592674 - DNA, 20 bp, Homo sapiens
aatggctatgtttttaatgt

SEQ ID NO: 6592675 - DNA, 16 bp, Homo sapiens
aatggctatttttgaa

SEQ ID NO: 6592676 - DNA, 16 bp, Homo sapiens
aatggctcaagtagaa

SEQ ID NO: 6592677 - DNA, 18 bp, Homo sapiens
aatggctcaagtagaaaa

SEQ ID NO: 6592678 - DNA, 12 bp, Homo sapiens
aatggctcagat

SEQ ID NO: 6592679 - DNA, 13 bp, Homo sapiens
aatggctccttca

SEQ ID NO: 6592680 - DNA, 22 bp, Homo sapiens
aatggctccttgccctcaagca

SEQ ID NO: 6592681 - DNA, 17 bp, Homo sapiens
aatggctgaagaaacac

SEQ ID NO: 6592682 - DNA, 18 bp, Homo sapiens
aatggctgaagaaacaca

SEQ ID NO: 6592683 - DNA, 22 bp, Homo sapiens
aatggctgaagaaacacagcat

SEQ ID NO: 6592684 - DNA, 14 bp, Homo sapiens
aatggctgaagcca

SEQ ID NO: 6592685 - DNA, 17 bp, Homo sapiens
aatggctgataatttta

SEQ ID NO: 6592686 - DNA, 21 bp, Homo sapiens
aatggctgcacctttttgcat

SEQ ID NO: 6592687 - DNA, 15 bp, Homo sapiens
aatggctgggtttgg

SEQ ID NO: 6592688 - DNA, 18 bp, Homo sapiens
aatggctgtaaactataa

SEQ ID NO: 6592689 - DNA, 17 bp, Homo sapiens
aatggctgtaatcattt

SEQ ID NO: 6592690 - DNA, 13 bp, Homo sapiens
aatggctgtgccc

SEQ ID NO: 6592691 - DNA, 14 bp, Homo sapiens
aatggctgtgcccc

SEQ ID NO: 6592692 - DNA, 19 bp, Homo sapiens
aatggctgtgccccacctg

SEQ ID NO: 6592693 - DNA, 23 bp, Homo sapiens
aatggctgtgccccacctgttgt

SEQ ID NO: 6592694 - DNA, 22 bp, Homo sapiens
aatggcttaagcaataaggaaa

SEQ ID NO: 6592695 - DNA, 14 bp, Homo sapiens
aatggcttctctgt

SEQ ID NO: 6592696 - DNA, 21 bp, Homo sapiens
aatggctttggtctcttgctt

SEQ ID NO: 6592697 - DNA, 18 bp, Homo sapiens
aatggctttgtatagaac

SEQ ID NO: 6592698 - DNA, 15 bp, Homo sapiens
aatggctttgtcttg

SEQ ID NO: 6592699 - DNA, 17 bp, Homo sapiens
aatggctttgtcttgaa

SEQ ID NO: 6592700 - DNA, 22 bp, Homo sapiens
aatggctttgtcttgaaaaaaa

SEQ ID NO: 6592701 - DNA, 15 bp, Homo sapiens
aatgggaaaaaaaca

SEQ ID NO: 6592702 - DNA, 22 bp, Homo sapiens
aatgggaaaacttcactccaaa

SEQ ID NO: 6592703 - DNA, 14 bp, Homo sapiens
aatgggaaagtatt

SEQ ID NO: 6592704 - DNA, 12 bp, Homo sapiens
aatgggaaatag

SEQ ID NO: 6592705 - DNA, 13 bp, Homo sapiens
aatgggaaatggg

SEQ ID NO: 6592706 - DNA, 14 bp, Homo sapiens
aatgggaacattta

SEQ ID NO: 6592707 - DNA, 23 bp, Homo sapiens
aatgggaacatttattttatgag

SEQ ID NO: 6592708 - DNA, 13 bp, Homo sapiens
aatgggaagaaat

SEQ ID NO: 6592709 - DNA, 16 bp, Homo sapiens
aatgggaatattttat

SEQ ID NO: 6592710 - DNA, 17 bp, Homo sapiens
aatgggaatcatggcct

SEQ ID NO: 6592711 - DNA, 15 bp, Homo sapiens
aatgggaatcattcc

SEQ ID NO: 6592712 - DNA, 17 bp, Homo sapiens
aatgggaattctgactt

SEQ ID NO: 6592713 - DNA, 13 bp, Homo sapiens
aatgggacactaa

SEQ ID NO: 6592714 - DNA, 16 bp, Homo sapiens
aatgggaccgtgcccc

SEQ ID NO: 6592715 - DNA, 18 bp, Homo sapiens
aatgggactgatgtcatc

SEQ ID NO: 6592716 - DNA, 13 bp, Homo sapiens
aatgggactggag

SEQ ID NO: 6592717 - DNA, 23 bp, Homo sapiens
aatgggactggagtcagatgagc

SEQ ID NO: 6592718 - DNA, 17 bp, Homo sapiens
aatgggacttcttttca

SEQ ID NO: 6592719 - DNA, 21 bp, Homo sapiens
aatgggacttcttttcacatt

SEQ ID NO: 6592720 - DNA, 14 bp, Homo sapiens
aatgggagacctgt

SEQ ID NO: 6592721 - DNA, 18 bp, Homo sapiens
aatgggagatggtcagtg

SEQ ID NO: 6592722 - DNA, 16 bp, Homo sapiens
aatgggagcaacatat

SEQ ID NO: 6592723 - DNA, 20 bp, Homo sapiens
aatgggagcacatagccctg

SEQ ID NO: 6592724 - DNA, 13 bp, Homo sapiens
aatgggagccagg

SEQ ID NO: 6592725 - DNA, 21 bp, Homo sapiens
aatgggagctgaggccacact

SEQ ID NO: 6592726 - DNA, 21 bp, Homo sapiens
aatgggaggggaaatgggaat

SEQ ID NO: 6592727 - DNA, 17 bp, Homo sapiens
aatgggagtctgaaatg

SEQ ID NO: 6592728 - DNA, 19 bp, Homo sapiens
aatgggatataataccttt

SEQ ID NO: 6592729 - DNA, 14 bp, Homo sapiens
aatgggatctattt

SEQ ID NO: 6592730 - DNA, 22 bp, Homo sapiens
aatgggatggtcggatctcaca

SEQ ID NO: 6592731 - DNA, 16 bp, Homo sapiens
aatgggattagaaaca

SEQ ID NO: 6592732 - DNA, 15 bp, Homo sapiens
aatgggatttgaatc

SEQ ID NO: 6592733 - DNA, 21 bp, Homo sapiens
aatgggattttctagtttcct

SEQ ID NO: 6592734 - DNA, 18 bp, Homo sapiens
aatgggcaaaactgaatt

SEQ ID NO: 6592735 - DNA, 19 bp, Homo sapiens
aatgggcacaatcttggtc

SEQ ID NO: 6592736 - DNA, 17 bp, Homo sapiens
aatgggcagtgcctcct

SEQ ID NO: 6592737 - DNA, 22 bp, Homo sapiens
aatgggcagttacatgcatact

SEQ ID NO: 6592738 - DNA, 22 bp, Homo sapiens
aatgggcagttctcccagggag

SEQ ID NO: 6592739 - DNA, 13 bp, Homo sapiens
aatgggcatttat

SEQ ID NO: 6592740 - DNA, 17 bp, Homo sapiens
aatgggcatttatttta

SEQ ID NO: 6592741 - DNA, 15 bp, Homo sapiens
aatgggcattttaca

SEQ ID NO: 6592742 - DNA, 20 bp, Homo sapiens
aatgggcattttacaagaag

SEQ ID NO: 6592743 - DNA, 18 bp, Homo sapiens
aatgggccaattaaaata

SEQ ID NO: 6592744 - DNA, 20 bp, Homo sapiens
aatgggccactgaaatctgt

SEQ ID NO: 6592745 - DNA, 14 bp, Homo sapiens
aatgggcctcagcc

SEQ ID NO: 6592746 - DNA, 11 bp, Homo sapiens
aatgggcctgc

SEQ ID NO: 6592747 - DNA, 13 bp, Homo sapiens
aatgggcctgccc

SEQ ID NO: 6592748 - DNA, 15 bp, Homo sapiens
aatgggcctgcccaa

SEQ ID NO: 6592749 - DNA, 18 bp, Homo sapiens
aatgggcctgcctgcctc

SEQ ID NO: 6592750 - DNA, 18 bp, Homo sapiens
aatgggcgcccccccctc

SEQ ID NO: 6592751 - DNA, 19 bp, Homo sapiens
aatgggctctccggggcca

SEQ ID NO: 6592752 - DNA, 15 bp, Homo sapiens
aatgggctcttccaa

SEQ ID NO: 6592753 - DNA, 19 bp, Homo sapiens
aatgggctgcaaaatgaag

SEQ ID NO: 6592754 - DNA, 23 bp, Homo sapiens
aatgggctgcaaaatgaagacac

SEQ ID NO: 6592755 - DNA, 13 bp, Homo sapiens
aatgggctgctgt

SEQ ID NO: 6592756 - DNA, 23 bp, Homo sapiens
aatgggctttcccccaactcagg

SEQ ID NO: 6592757 - DNA, 20 bp, Homo sapiens
aatggggaactcccccagag

SEQ ID NO: 6592758 - DNA, 15 bp, Homo sapiens
aatggggacgcagat

SEQ ID NO: 6592759 - DNA, 13 bp, Homo sapiens
aatggggcgctgg

SEQ ID NO: 6592760 - DNA, 17 bp, Homo sapiens
aatggggcgctggacac

SEQ ID NO: 6592761 - DNA, 14 bp, Homo sapiens
aatgggggaggccc

SEQ ID NO: 6592762 - DNA, 20 bp, Homo sapiens
aatgggggctttcggggagg

SEQ ID NO: 6592763 - DNA, 23 bp, Homo sapiens
aatgggggctttcggggagggcg

SEQ ID NO: 6592764 - DNA, 22 bp, Homo sapiens
aatggggggcgggccagggtgg

SEQ ID NO: 6592765 - DNA, 15 bp, Homo sapiens
aatgggggggcggct

SEQ ID NO: 6592766 - DNA, 18 bp, Homo sapiens
aatgggggtagcagctgg

SEQ ID NO: 6592767 - DNA, 15 bp, Homo sapiens
aatgggggtgcattt

SEQ ID NO: 6592768 - DNA, 17 bp, Homo sapiens
aatgggggtgcatttga

SEQ ID NO: 6592769 - DNA, 21 bp, Homo sapiens
aatggggtagaaacattgtaa

SEQ ID NO: 6592770 - DNA, 21 bp, Homo sapiens
aatggggtccacttccccctc

SEQ ID NO: 6592771 - DNA, 13 bp, Homo sapiens
aatggggttcctg

SEQ ID NO: 6592772 - DNA, 15 bp, Homo sapiens
aatgggtcatgacaa

SEQ ID NO: 6592773 - DNA, 23 bp, Homo sapiens
aatgggtcttttataggaaaaaa

SEQ ID NO: 6592774 - DNA, 22 bp, Homo sapiens
aatgggtttactctcaatgcat

SEQ ID NO: 6592775 - DNA, 19 bp, Homo sapiens
aatgggttttaattttcag

SEQ ID NO: 6592776 - DNA, 16 bp, Homo sapiens
aatgggtttttccctg

SEQ ID NO: 6592777 - DNA, 23 bp, Homo sapiens
aatggtaaaataaaatgcctcag

SEQ ID NO: 6592778 - DNA, 13 bp, Homo sapiens
aatggtaaaattg

SEQ ID NO: 6592779 - DNA, 17 bp, Homo sapiens
aatggtaaaattgcatg

SEQ ID NO: 6592780 - DNA, 20 bp, Homo sapiens
aatggtaacatttttcaata

SEQ ID NO: 6592781 - DNA, 14 bp, Homo sapiens
aatggtaacttttg

SEQ ID NO: 6592782 - DNA, 15 bp, Homo sapiens
aatggtaacttttgt

SEQ ID NO: 6592783 - DNA, 21 bp, Homo sapiens
aatggtaacttttgtagtctt

SEQ ID NO: 6592784 - DNA, 13 bp, Homo sapiens
aatggtaatttag

SEQ ID NO: 6592785 - DNA, 19 bp, Homo sapiens
aatggtacatgtcttccat

SEQ ID NO: 6592786 - DNA, 16 bp, Homo sapiens
aatggtaccagataaa

SEQ ID NO: 6592787 - DNA, 17 bp, Homo sapiens
aatggtactcccaaact

SEQ ID NO: 6592788 - DNA, 22 bp, Homo sapiens
aatggtacttaaacatttttgt

SEQ ID NO: 6592789 - DNA, 17 bp, Homo sapiens
aatggtagattcgctgt

SEQ ID NO: 6592790 - DNA, 16 bp, Homo sapiens
aatggtagcctctggg

SEQ ID NO: 6592791 - DNA, 19 bp, Homo sapiens
aatggtagctctgaaggga

SEQ ID NO: 6592792 - DNA, 17 bp, Homo sapiens
aatggtaggcatttcct

SEQ ID NO: 6592793 - DNA, 18 bp, Homo sapiens
aatggtaggcatttccta

SEQ ID NO: 6592794 - DNA, 19 bp, Homo sapiens
aatggtagtctaaccaaat

SEQ ID NO: 6592795 - DNA, 22 bp, Homo sapiens
aatggtagtctaaccaaatgca

SEQ ID NO: 6592796 - DNA, 18 bp, Homo sapiens
aatggtagttagcaacta

SEQ ID NO: 6592797 - DNA, 13 bp, Homo sapiens
aatggtataaaag

SEQ ID NO: 6592798 - DNA, 14 bp, Homo sapiens
aatggtataaaagg

SEQ ID NO: 6592799 - DNA, 23 bp, Homo sapiens
aatggtataaaaggttgccaaat

SEQ ID NO: 6592800 - DNA, 18 bp, Homo sapiens
aatggtatcaaaattaca

SEQ ID NO: 6592801 - DNA, 19 bp, Homo sapiens
aatggtatcctactgagca

SEQ ID NO: 6592802 - DNA, 18 bp, Homo sapiens
aatggtatgagctgaggg

SEQ ID NO: 6592803 - DNA, 13 bp, Homo sapiens
aatggtatgtaga

SEQ ID NO: 6592804 - DNA, 21 bp, Homo sapiens
aatggtattgggcagttggga

SEQ ID NO: 6592805 - DNA, 16 bp, Homo sapiens
aatggtattgtaacta

SEQ ID NO: 6592806 - DNA, 22 bp, Homo sapiens
aatggtatttgaattaaatgtt

SEQ ID NO: 6592807 - DNA, 14 bp, Homo sapiens
aatggtcagcgttg

SEQ ID NO: 6592808 - DNA, 18 bp, Homo sapiens
aatggtcagcgttgcatg

SEQ ID NO: 6592809 - DNA, 20 bp, Homo sapiens
aatggtcagcgttgcatgtc

SEQ ID NO: 6592810 - DNA, 14 bp, Homo sapiens
aatggtccagggtt

SEQ ID NO: 6592811 - DNA, 18 bp, Homo sapiens
tttcccatgctgaattat

SEQ ID NO: 6592812 - DNA, 16 bp, Homo sapiens
tttcccatggggaggg

SEQ ID NO: 6592813 - DNA, 14 bp, Homo sapiens
tttcccattggttc

SEQ ID NO: 6592814 - DNA, 14 bp, Homo sapiens
tttcccatttagaa

SEQ ID NO: 6592815 - DNA, 21 bp, Homo sapiens
tttcccatttgtgccagagga

SEQ ID NO: 6592816 - DNA, 19 bp, Homo sapiens
tttcccatttgttgctgct

SEQ ID NO: 6592817 - DNA, 23 bp, Homo sapiens
tttccccagaccgatccttccca

SEQ ID NO: 6592818 - DNA, 19 bp, Homo sapiens
tttccccagcctctcctcc

SEQ ID NO: 6592819 - DNA, 16 bp, Homo sapiens
tttccccatctctgtc

SEQ ID NO: 6592820 - DNA, 18 bp, Homo sapiens
tttccccatctctgtctg

SEQ ID NO: 6592821 - DNA, 21 bp, Homo sapiens
tttcccccacagttttaataa

SEQ ID NO: 6592822 - DNA, 19 bp, Homo sapiens
tttcccccaccccagagtt

SEQ ID NO: 6592823 - DNA, 15 bp, Homo sapiens
tttcccccaccctcc

SEQ ID NO: 6592824 - DNA, 12 bp, Homo sapiens
tttcccccactc

SEQ ID NO: 6592825 - DNA, 22 bp, Homo sapiens
tttcccccagcaacgcccctcc

SEQ ID NO: 6592826 - DNA, 22 bp, Homo sapiens
tttccccccaacccggaaacag

SEQ ID NO: 6592827 - DNA, 12 bp, Homo sapiens
tttccccccact

SEQ ID NO: 6592828 - DNA, 18 bp, Homo sapiens
tttcccccctccttctgc

SEQ ID NO: 6592829 - DNA, 13 bp, Homo sapiens
tttcccccgagct

SEQ ID NO: 6592830 - DNA, 21 bp, Homo sapiens
tttcccccgagctcttggcct

SEQ ID NO: 6592831 - DNA, 17 bp, Homo sapiens
tttcccccttcatccat

SEQ ID NO: 6592832 - DNA, 13 bp, Homo sapiens
tttcccccttccc

SEQ ID NO: 6592833 - DNA, 14 bp, Homo sapiens
tttcccccttccca

SEQ ID NO: 6592834 - DNA, 21 bp, Homo sapiens
tttcccccttcccgccttcca

SEQ ID NO: 6592835 - DNA, 17 bp, Homo sapiens
tttccccctttcttcct

SEQ ID NO: 6592836 - DNA, 21 bp, Homo sapiens
tttcccccttttctgcatttt

SEQ ID NO: 6592837 - DNA, 23 bp, Homo sapiens
tttccccgcctgcagtcttctgg

SEQ ID NO: 6592838 - DNA, 20 bp, Homo sapiens
tttccccgggggaggaaggg

SEQ ID NO: 6592839 - DNA, 18 bp, Homo sapiens
tttccccggtcccttgag

SEQ ID NO: 6592840 - DNA, 14 bp, Homo sapiens
tttcccctaatttt

SEQ ID NO: 6592841 - DNA, 16 bp, Homo sapiens
tttcccctagcttact

SEQ ID NO: 6592842 - DNA, 21 bp, Homo sapiens
tttcccctcattgcatttatt

SEQ ID NO: 6592843 - DNA, 13 bp, Homo sapiens
tttcccctccctg

SEQ ID NO: 6592844 - DNA, 18 bp, Homo sapiens
tttcccctctctgcccct

SEQ ID NO: 6592845 - DNA, 16 bp, Homo sapiens
tttcccctgaagactt

SEQ ID NO: 6592846 - DNA, 12 bp, Homo sapiens
tttcccctggcc

SEQ ID NO: 6592847 - DNA, 13 bp, Homo sapiens
tttcccctggcct

SEQ ID NO: 6592848 - DNA, 21 bp, Homo sapiens
tttcccctggcctcagttccc

SEQ ID NO: 6592849 - DNA, 22 bp, Homo sapiens
tttcccctgtcagtttcccctc

SEQ ID NO: 6592850 - DNA, 15 bp, Homo sapiens
tttccccttcccctc

SEQ ID NO: 6592851 - DNA, 12 bp, Homo sapiens
tttccccttcct

SEQ ID NO: 6592852 - DNA, 23 bp, Homo sapiens
tttccccttggtcccaagcctga

SEQ ID NO: 6592853 - DNA, 14 bp, Homo sapiens
tttccccttttgca

SEQ ID NO: 6592854 - DNA, 21 bp, Homo sapiens
tttcccgagcaaagtctaaag

SEQ ID NO: 6592855 - DNA, 22 bp, Homo sapiens
tttcccgagcaaagtctaaagt

SEQ ID NO: 6592856 - DNA, 13 bp, Homo sapiens
tttcccgccaagc

SEQ ID NO: 6592857 - DNA, 23 bp, Homo sapiens
tttcccgcccagcctcacttcct

SEQ ID NO: 6592858 - DNA, 21 bp, Homo sapiens
tttcccgtaaggctgtacata

SEQ ID NO: 6592859 - DNA, 21 bp, Homo sapiens
tttcccgtggccccagcctgg

SEQ ID NO: 6592860 - DNA, 19 bp, Homo sapiens
tttccctaaaatacattta

SEQ ID NO: 6592861 - DNA, 11 bp, Homo sapiens
tttccctaagc

SEQ ID NO: 6592862 - DNA, 20 bp, Homo sapiens
tttccctaagccagctgccc

SEQ ID NO: 6592863 - DNA, 22 bp, Homo sapiens
tttccctaagccagctgccccc

SEQ ID NO: 6592864 - DNA, 15 bp, Homo sapiens
tttccctactcccca

SEQ ID NO: 6592865 - DNA, 22 bp, Homo sapiens
tttccctagaaagccatattcc

SEQ ID NO: 6592866 - DNA, 14 bp, Homo sapiens
tttccctattttag

SEQ ID NO: 6592867 - DNA, 23 bp, Homo sapiens
tttccctcaaatgcgcgtgtgca

SEQ ID NO: 6592868 - DNA, 19 bp, Homo sapiens
tttccctcactgttcccca

SEQ ID NO: 6592869 - DNA, 14 bp, Homo sapiens
tttccctcagtgaa

SEQ ID NO: 6592870 - DNA, 13 bp, Homo sapiens
tttccctccaggt

SEQ ID NO: 6592871 - DNA, 14 bp, Homo sapiens
tttccctccaggtg

SEQ ID NO: 6592872 - DNA, 16 bp, Homo sapiens
tttccctcccagtttt

SEQ ID NO: 6592873 - DNA, 13 bp, Homo sapiens
tttccctccccag

SEQ ID NO: 6592874 - DNA, 13 bp, Homo sapiens
tttccctccttgg

SEQ ID NO: 6592875 - DNA, 18 bp, Homo sapiens
tttccctcgtccgtctgt

SEQ ID NO: 6592876 - DNA, 22 bp, Homo sapiens
tttccctcgtccgtctgtctcg

SEQ ID NO: 6592877 - DNA, 16 bp, Homo sapiens
tttccctctccttcca

SEQ ID NO: 6592878 - DNA, 19 bp, Homo sapiens
tttccctcttgtgctcagt

SEQ ID NO: 6592879 - DNA, 12 bp, Homo sapiens
tttccctgaaca

SEQ ID NO: 6592880 - DNA, 21 bp, Homo sapiens
tttccctgaagttatgtgtat

SEQ ID NO: 6592881 - DNA, 14 bp, Homo sapiens
tttccctgactcct

SEQ ID NO: 6592882 - DNA, 12 bp, Homo sapiens
tttccctgagga

SEQ ID NO: 6592883 - DNA, 16 bp, Homo sapiens
tttccctgaggaatga

SEQ ID NO: 6592884 - DNA, 11 bp, Homo sapiens
tttccctgcca

SEQ ID NO: 6592885 - DNA, 13 bp, Homo sapiens
tttccctgcccct

SEQ ID NO: 6592886 - DNA, 11 bp, Homo sapiens
tttccctgctg

SEQ ID NO: 6592887 - DNA, 16 bp, Homo sapiens
tttccctgctgaatgc

SEQ ID NO: 6592888 - DNA, 22 bp, Homo sapiens
tttccctgcttaatgaaaagct

SEQ ID NO: 6592889 - DNA, 18 bp, Homo sapiens
tttccctggaatttaatt

SEQ ID NO: 6592890 - DNA, 12 bp, Homo sapiens
tttccctggagc

SEQ ID NO: 6592891 - DNA, 20 bp, Homo sapiens
tttccctgggggcatcctgc

SEQ ID NO: 6592892 - DNA, 12 bp, Homo sapiens
tttccctgggtg

SEQ ID NO: 6592893 - DNA, 12 bp, Homo sapiens
tttccctggtcc

SEQ ID NO: 6592894 - DNA, 13 bp, Homo sapiens
tttccctgtgctg

SEQ ID NO: 6592895 - DNA, 19 bp, Homo sapiens
tttccctgtgtaccctcca

SEQ ID NO: 6592896 - DNA, 22 bp, Homo sapiens
tttcccttaaatacagataatt

SEQ ID NO: 6592897 - DNA, 18 bp, Homo sapiens
tttcccttaacttttcct

SEQ ID NO: 6592898 - DNA, 15 bp, Homo sapiens
tttcccttattgcct

SEQ ID NO: 6592899 - DNA, 22 bp, Homo sapiens
tttcccttcatttaaactaaat

SEQ ID NO: 6592900 - DNA, 13 bp, Homo sapiens
tttcccttccaaa

SEQ ID NO: 6592901 - DNA, 15 bp, Homo sapiens
tttcccttccaaaga

SEQ ID NO: 6592902 - DNA, 12 bp, Homo sapiens
tttcccttccag

SEQ ID NO: 6592903 - DNA, 14 bp, Homo sapiens
tttcccttccagtt

SEQ ID NO: 6592904 - DNA, 16 bp, Homo sapiens
tttcccttcccttcca

SEQ ID NO: 6592905 - DNA, 13 bp, Homo sapiens
tttcccttcctct

SEQ ID NO: 6592906 - DNA, 15 bp, Homo sapiens
tttcccttcctcttc

SEQ ID NO: 6592907 - DNA, 19 bp, Homo sapiens
tttcccttcctcttcggcc

SEQ ID NO: 6592908 - DNA, 15 bp, Homo sapiens
tttcccttcttctgt

SEQ ID NO: 6592909 - DNA, 16 bp, Homo sapiens
tttcccttcttgcatc

SEQ ID NO: 6592910 - DNA, 17 bp, Homo sapiens
tttcccttgcttcccct

SEQ ID NO: 6592911 - DNA, 19 bp, Homo sapiens
tttcccttgcttttccctc

SEQ ID NO: 6592912 - DNA, 18 bp, Homo sapiens
tttcccttggctgttaag

SEQ ID NO: 6592913 - DNA, 20 bp, Homo sapiens
tttcccttgtagctcctccc

SEQ ID NO: 6592914 - DNA, 18 bp, Homo sapiens
tttcccttgtgtgagggc

SEQ ID NO: 6592915 - DNA, 20 bp, Homo sapiens
tttccctttaccactgtggt

SEQ ID NO: 6592916 - DNA, 22 bp, Homo sapiens
tttccctttagctaagcacaga

SEQ ID NO: 6592917 - DNA, 18 bp, Homo sapiens
tttccctttagctgtgtt

SEQ ID NO: 6592918 - DNA, 21 bp, Homo sapiens
tttccctttatttctcttcta

SEQ ID NO: 6592919 - DNA, 13 bp, Homo sapiens
tttccctttgcca

SEQ ID NO: 6592920 - DNA, 22 bp, Homo sapiens
tttcccttttctttccttttca

SEQ ID NO: 6592921 - DNA, 18 bp, Homo sapiens
tttccgaagaccttctga

SEQ ID NO: 6592922 - DNA, 16 bp, Homo sapiens
tttccgaagtctctga

SEQ ID NO: 6592923 - DNA, 20 bp, Homo sapiens
tttccgcactacctgaacat

SEQ ID NO: 6592924 - DNA, 24 bp, Homo sapiens
tttccgctgtcgccccaggccctc

SEQ ID NO: 6592925 - DNA, 18 bp, Homo sapiens
tttccgctttgcttgctt

SEQ ID NO: 6592926 - DNA, 18 bp, Homo sapiens
tttccggcacactgccaa

SEQ ID NO: 6592927 - DNA, 15 bp, Homo sapiens
tttccgtaaatgtct

SEQ ID NO: 6592928 - DNA, 20 bp, Homo sapiens
tttccgtagcagttttgaaa

SEQ ID NO: 6592929 - DNA, 15 bp, Homo sapiens
tttccgtctccctaa

SEQ ID NO: 6592930 - DNA, 19 bp, Homo sapiens
tttccgtgaactctggtgc

SEQ ID NO: 6592931 - DNA, 18 bp, Homo sapiens
tttccgtgagctcaaact

SEQ ID NO: 6592932 - DNA, 23 bp, Homo sapiens
tttccgtgccgtgtattttttaa

SEQ ID NO: 6592933 - DNA, 15 bp, Homo sapiens
tttccgttaaaatac

SEQ ID NO: 6592934 - DNA, 23 bp, Homo sapiens
tttccgtttttttttttttattg

SEQ ID NO: 6592935 - DNA, 23 bp, Homo sapiens
tttcctaaacataattgtggatt

SEQ ID NO: 6592936 - DNA, 20 bp, Homo sapiens
tttcctaaatatattttaag

SEQ ID NO: 6592937 - DNA, 16 bp, Homo sapiens
tttcctaaatcagcat

SEQ ID NO: 6592938 - DNA, 18 bp, Homo sapiens
tttcctaaatcagcattt

SEQ ID NO: 6592939 - DNA, 19 bp, Homo sapiens
tttcctaaatcagcatttt

SEQ ID NO: 6592940 - DNA, 15 bp, Homo sapiens
tttcctaaatgcagt

SEQ ID NO: 6592941 - DNA, 13 bp, Homo sapiens
tttcctaaatgta

SEQ ID NO: 6592942 - DNA, 23 bp, Homo sapiens
tttcctaacaaaagatgaaagca

SEQ ID NO: 6592943 - DNA, 13 bp, Homo sapiens
tttcctaacattt

SEQ ID NO: 6592944 - DNA, 18 bp, Homo sapiens
tttcctaagaaagacatc

SEQ ID NO: 6592945 - DNA, 14 bp, Homo sapiens
tttcctaagacatt

SEQ ID NO: 6592946 - DNA, 15 bp, Homo sapiens
tttcctaagacattt

SEQ ID NO: 6592947 - DNA, 18 bp, Homo sapiens
tttcctaagacatttttc

SEQ ID NO: 6592948 - DNA, 19 bp, Homo sapiens
tttcctaagacatttttca

SEQ ID NO: 6592949 - DNA, 13 bp, Homo sapiens
tttcctaaggaaa

SEQ ID NO: 6592950 - DNA, 19 bp, Homo sapiens
tttcctaaggaaactgctt

SEQ ID NO: 6592951 - DNA, 17 bp, Homo sapiens
tttcctaaggctgcaag

SEQ ID NO: 6592952 - DNA, 18 bp, Homo sapiens
tttcctaagtttttttca

SEQ ID NO: 6592953 - DNA, 23 bp, Homo sapiens
tttcctaataaagttctgtactc

SEQ ID NO: 6592954 - DNA, 22 bp, Homo sapiens
tttcctaatcagaaatttttat

SEQ ID NO: 6592955 - DNA, 21 bp, Homo sapiens
tttcctacaactaaaaataaa

SEQ ID NO: 6592956 - DNA, 18 bp, Homo sapiens
tttcctacaagttaacca

SEQ ID NO: 6592957 - DNA, 16 bp, Homo sapiens
tttcctacagaaatac

SEQ ID NO: 6592958 - DNA, 17 bp, Homo sapiens
tttcctactgtcctcag

SEQ ID NO: 6592959 - DNA, 18 bp, Homo sapiens
tttcctactgtcctcaga

SEQ ID NO: 6592960 - DNA, 15 bp, Homo sapiens
tttcctactgtcctg

SEQ ID NO: 6592961 - DNA, 14 bp, Homo sapiens
tttcctactttcta

SEQ ID NO: 6592962 - DNA, 16 bp, Homo sapiens
tttcctagaagtggtt

SEQ ID NO: 6592963 - DNA, 22 bp, Homo sapiens
tttcctagactaattaaaatct

SEQ ID NO: 6592964 - DNA, 19 bp, Homo sapiens
tttcctagctgttctaatt

SEQ ID NO: 6592965 - DNA, 20 bp, Homo sapiens
tttcctagctgttctaatta

SEQ ID NO: 6592966 - DNA, 22 bp, Homo sapiens
tttcctaggatgtcatgtctgc

SEQ ID NO: 6592967 - DNA, 23 bp, Homo sapiens
tttcctaggcccaggcctgggtt

SEQ ID NO: 6592968 - DNA, 20 bp, Homo sapiens
tttcctagtatacccactgc

SEQ ID NO: 6592969 - DNA, 18 bp, Homo sapiens
tttcctagttttatgttt

SEQ ID NO: 6592970 - DNA, 17 bp, Homo sapiens
tttcctatagactgtaa

SEQ ID NO: 6592971 - DNA, 17 bp, Homo sapiens
tttcctatcatgttaac

SEQ ID NO: 6592972 - DNA, 23 bp, Homo sapiens
tttcctatctagcatttatttct

SEQ ID NO: 6592973 - DNA, 15 bp, Homo sapiens
tttcctatgctttga

SEQ ID NO: 6592974 - DNA, 15 bp, Homo sapiens
tttcctatgggaaca

SEQ ID NO: 6592975 - DNA, 16 bp, Homo sapiens
tttcctattaatcttc

SEQ ID NO: 6592976 - DNA, 15 bp, Homo sapiens
tttcctatttgcaca

SEQ ID NO: 6592977 - DNA, 19 bp, Homo sapiens
tttcctattttaaaaccat

SEQ ID NO: 6592978 - DNA, 22 bp, Homo sapiens
tttcctattttaaaaccatgca

SEQ ID NO: 6592979 - DNA, 20 bp, Homo sapiens
tttcctcaagcaataattgt

SEQ ID NO: 6592980 - DNA, 21 bp, Homo sapiens
tttcctcaagtatcttctatt

SEQ ID NO: 6592981 - DNA, 19 bp, Homo sapiens
tttcctcacgtgcaggaca

SEQ ID NO: 6592982 - DNA, 19 bp, Homo sapiens
tttcctcagactctaagaa

SEQ ID NO: 6592983 - DNA, 20 bp, Homo sapiens
tttcctcagctgtacaaatc

SEQ ID NO: 6592984 - DNA, 19 bp, Homo sapiens
tttcctcagcttatctctt

SEQ ID NO: 6592985 - DNA, 22 bp, Homo sapiens
tttcctcatctatggttctaaa

SEQ ID NO: 6592986 - DNA, 16 bp, Homo sapiens
tttcctcatctgcaga

SEQ ID NO: 6592987 - DNA, 16 bp, Homo sapiens
tttcctcatctgtcca

SEQ ID NO: 6592988 - DNA, 19 bp, Homo sapiens
tttcctcatctttaaaatg

SEQ ID NO: 6592989 - DNA, 16 bp, Homo sapiens
aatggtccagggttga

SEQ ID NO: 6592990 - DNA, 18 bp, Homo sapiens
aatggtcccaattaagaa

SEQ ID NO: 6592991 - DNA, 19 bp, Homo sapiens
aatggtccgctttcctgga

SEQ ID NO: 6592992 - DNA, 15 bp, Homo sapiens
aatggtcgcccagga

SEQ ID NO: 6592993 - DNA, 18 bp, Homo sapiens
aatggtctaaaaataaac

SEQ ID NO: 6592994 - DNA, 20 bp, Homo sapiens
aatggtctagaaacatttct

SEQ ID NO: 6592995 - DNA, 23 bp, Homo sapiens
aatggtctttgctccagataact

SEQ ID NO: 6592996 - DNA, 15 bp, Homo sapiens
aatggtgaatgttca

SEQ ID NO: 6592997 - DNA, 16 bp, Homo sapiens
aatggtgatcactcca

SEQ ID NO: 6592998 - DNA, 17 bp, Homo sapiens
aatggtgatcctctatt

SEQ ID NO: 6592999 - DNA, 20 bp, Homo sapiens
aatggtgatcctctattttg

SEQ ID NO: 6593000 - DNA, 23 bp, Homo sapiens
aatggtgatcctctattttgtga

SEQ ID NO: 6593001 - DNA, 12 bp, Homo sapiens
aatggtgatttt

SEQ ID NO: 6593002 - DNA, 13 bp, Homo sapiens
aatggtgcaaaaa

SEQ ID NO: 6593003 - DNA, 22 bp, Homo sapiens
aatggtgcaaaggagccgccac

SEQ ID NO: 6593004 - DNA, 13 bp, Homo sapiens
aatggtgcagaaa

SEQ ID NO: 6593005 - DNA, 19 bp, Homo sapiens
aatggtgcattgtatagat

SEQ ID NO: 6593006 - DNA, 16 bp, Homo sapiens
aatggtgccattttcg

SEQ ID NO: 6593007 - DNA, 23 bp, Homo sapiens
aatggtgcgtgaaggctctcaga

SEQ ID NO: 6593008 - DNA, 19 bp, Homo sapiens
aatggtgctataataaata

SEQ ID NO: 6593009 - DNA, 13 bp, Homo sapiens
aatggtgctgttt

SEQ ID NO: 6593010 - DNA, 18 bp, Homo sapiens
aatggtgcttattaagac

SEQ ID NO: 6593011 - DNA, 20 bp, Homo sapiens
aatggtgcttcccccacccc

SEQ ID NO: 6593012 - DNA, 20 bp, Homo sapiens
aatggtggaggattgctgcc

SEQ ID NO: 6593013 - DNA, 16 bp, Homo sapiens
aatggtggcttcagct

SEQ ID NO: 6593014 - DNA, 19 bp, Homo sapiens
aatggtggcttcagctcca

SEQ ID NO: 6593015 - DNA, 22 bp, Homo sapiens
aatggtggcttcttttctttgt

SEQ ID NO: 6593016 - DNA, 16 bp, Homo sapiens
aatggtgggctccaga

SEQ ID NO: 6593017 - DNA, 17 bp, Homo sapiens
aatggtgggctccagag

SEQ ID NO: 6593018 - DNA, 21 bp, Homo sapiens
aatggtggttgtttcttccaa

SEQ ID NO: 6593019 - DNA, 23 bp, Homo sapiens
aatggtggtttgtcatatattca

SEQ ID NO: 6593020 - DNA, 18 bp, Homo sapiens
aatggtgtagctgtcctc

SEQ ID NO: 6593021 - DNA, 20 bp, Homo sapiens
aatggtgtctcttttatgtt

SEQ ID NO: 6593022 - DNA, 15 bp, Homo sapiens
aatggtgttccattg

SEQ ID NO: 6593023 - DNA, 13 bp, Homo sapiens
aatggttaaaaga

SEQ ID NO: 6593024 - DNA, 22 bp, Homo sapiens
aatggttaaattttacatgaca

SEQ ID NO: 6593025 - DNA, 23 bp, Homo sapiens
aatggttaaattttacatgacag

SEQ ID NO: 6593026 - DNA, 22 bp, Homo sapiens
aatggttaagggacttgtccca

SEQ ID NO: 6593027 - DNA, 20 bp, Homo sapiens
aatggttaatccaactgtca

SEQ ID NO: 6593028 - DNA, 15 bp, Homo sapiens
aatggttcagaatta

SEQ ID NO: 6593029 - DNA, 18 bp, Homo sapiens
aatggttgatggaaaata

SEQ ID NO: 6593030 - DNA, 15 bp, Homo sapiens
aatggttgccttaaa

SEQ ID NO: 6593031 - DNA, 14 bp, Homo sapiens
aatggttgggacaa

SEQ ID NO: 6593032 - DNA, 22 bp, Homo sapiens
aatggttgggacaatggcaata

SEQ ID NO: 6593033 - DNA, 21 bp, Homo sapiens
aatggttgggaccaggccaat

SEQ ID NO: 6593034 - DNA, 18 bp, Homo sapiens
aatggttggtttttgtgt

SEQ ID NO: 6593035 - DNA, 14 bp, Homo sapiens
aatggttgtacata

SEQ ID NO: 6593036 - DNA, 19 bp, Homo sapiens
aatggttgtacgttttgca

SEQ ID NO: 6593037 - DNA, 20 bp, Homo sapiens
aatggttgtacgttttgcac

SEQ ID NO: 6593038 - DNA, 18 bp, Homo sapiens
aatggttgtgaaatgtaa

SEQ ID NO: 6593039 - DNA, 21 bp, Homo sapiens
aatggtttatagccctgtgaa

SEQ ID NO: 6593040 - DNA, 21 bp, Homo sapiens
aatggtttctgaaaatgttta

SEQ ID NO: 6593041 - DNA, 14 bp, Homo sapiens
aatggtttgaatat

SEQ ID NO: 6593042 - DNA, 21 bp, Homo sapiens
aatggtttggtgctttttata

SEQ ID NO: 6593043 - DNA, 16 bp, Homo sapiens
aatggtttttaaattt

SEQ ID NO: 6593044 - DNA, 17 bp, Homo sapiens
aatggtttttaaatttt

SEQ ID NO: 6593045 - DNA, 19 bp, Homo sapiens
aatgtaaaaaagaaaaaac

SEQ ID NO: 6593046 - DNA, 17 bp, Homo sapiens
aatgtaaaaatgaagga

SEQ ID NO: 6593047 - DNA, 23 bp, Homo sapiens
aatgtaaaaatttaatttctgaa

SEQ ID NO: 6593048 - DNA, 15 bp, Homo sapiens
aatgtaaaacacata

SEQ ID NO: 6593049 - DNA, 18 bp, Homo sapiens
aatgtaaaagaaaatttt

SEQ ID NO: 6593050 - DNA, 23 bp, Homo sapiens
aatgtaaaataaaggctctgtgc

SEQ ID NO: 6593051 - DNA, 16 bp, Homo sapiens
aatgtaaaatatttga

SEQ ID NO: 6593052 - DNA, 14 bp, Homo sapiens
aatgtaaaattatg

SEQ ID NO: 6593053 - DNA, 15 bp, Homo sapiens
aatgtaaaattcata

SEQ ID NO: 6593054 - DNA, 17 bp, Homo sapiens
aatgtaaaattcatagc

SEQ ID NO: 6593055 - DNA, 15 bp, Homo sapiens
aatgtaaaattgaaa

SEQ ID NO: 6593056 - DNA, 21 bp, Homo sapiens
aatgtaaaattgaaaatatgt

SEQ ID NO: 6593057 - DNA, 13 bp, Homo sapiens
aatgtaaacattt

SEQ ID NO: 6593058 - DNA, 14 bp, Homo sapiens
aatgtaaacatttt

SEQ ID NO: 6593059 - DNA, 18 bp, Homo sapiens
aatgtaaaccagaaaaaa

SEQ ID NO: 6593060 - DNA, 22 bp, Homo sapiens
aatgtaaaccagaaaaaataaa

SEQ ID NO: 6593061 - DNA, 23 bp, Homo sapiens
aatgtaaaccagaaaaaataaat

SEQ ID NO: 6593062 - DNA, 23 bp, Homo sapiens
aatgtaaactaggattggagtat

SEQ ID NO: 6593063 - DNA, 15 bp, Homo sapiens
aatgtaaactgccat

SEQ ID NO: 6593064 - DNA, 17 bp, Homo sapiens
aatgtaaactgtttctt

SEQ ID NO: 6593065 - DNA, 22 bp, Homo sapiens
aatgtaaactttgtcatggttt

SEQ ID NO: 6593066 - DNA, 14 bp, Homo sapiens
aatgtaaagaactt

SEQ ID NO: 6593067 - DNA, 21 bp, Homo sapiens
aatgtaaagaacttaaattat

SEQ ID NO: 6593068 - DNA, 15 bp, Homo sapiens
aatgtaaagacaaaa

SEQ ID NO: 6593069 - DNA, 23 bp, Homo sapiens
aatgtaaaggagtcaaaactaca

SEQ ID NO: 6593070 - DNA, 12 bp, Homo sapiens
aatgtaaaggtt

SEQ ID NO: 6593071 - DNA, 16 bp, Homo sapiens
aatgtaaagtctagaa

SEQ ID NO: 6593072 - DNA, 19 bp, Homo sapiens
aatgtaaagtctagaaaat

SEQ ID NO: 6593073 - DNA, 21 bp, Homo sapiens
aatgtaaagttgtcttttaaa

SEQ ID NO: 6593074 - DNA, 15 bp, Homo sapiens
aatgtaaataaacta

SEQ ID NO: 6593075 - DNA, 19 bp, Homo sapiens
aatgtaaataaactattta

SEQ ID NO: 6593076 - DNA, 13 bp, Homo sapiens
aatgtaaatacat

SEQ ID NO: 6593077 - DNA, 16 bp, Homo sapiens
aatgtaaatattttaa

SEQ ID NO: 6593078 - DNA, 17 bp, Homo sapiens
aatgtaaatattttaaa

SEQ ID NO: 6593079 - DNA, 19 bp, Homo sapiens
aatgtaaatattttaaaga

SEQ ID NO: 6593080 - DNA, 18 bp, Homo sapiens
aatgtaaatgtctcactg

SEQ ID NO: 6593081 - DNA, 17 bp, Homo sapiens
aatgtaaattagtttga

SEQ ID NO: 6593082 - DNA, 22 bp, Homo sapiens
aatgtaaattagtttgacactg

SEQ ID NO: 6593083 - DNA, 14 bp, Homo sapiens
aatgtaaatttgta

SEQ ID NO: 6593084 - DNA, 16 bp, Homo sapiens
aatgtaaatttgtact

SEQ ID NO: 6593085 - DNA, 18 bp, Homo sapiens
aatgtaaatttgtactat

SEQ ID NO: 6593086 - DNA, 14 bp, Homo sapiens
aatgtaaattttaa

SEQ ID NO: 6593087 - DNA, 15 bp, Homo sapiens
aatgtaaattttaat

SEQ ID NO: 6593088 - DNA, 17 bp, Homo sapiens
aatgtaacagtctgatc

SEQ ID NO: 6593089 - DNA, 18 bp, Homo sapiens
aatgtaacatcataatta

SEQ ID NO: 6593090 - DNA, 17 bp, Homo sapiens
aatgtaacatgaagcaa

SEQ ID NO: 6593091 - DNA, 16 bp, Homo sapiens
aatgtaacatgatttc

SEQ ID NO: 6593092 - DNA, 19 bp, Homo sapiens
aatgtaactgaagcataaa

SEQ ID NO: 6593093 - DNA, 20 bp, Homo sapiens
aatgtaactgtccgtagtat

SEQ ID NO: 6593094 - DNA, 13 bp, Homo sapiens
aatgtaactgtta

SEQ ID NO: 6593095 - DNA, 13 bp, Homo sapiens
aatgtaacttact

SEQ ID NO: 6593096 - DNA, 13 bp, Homo sapiens
aatgtaacttatt

SEQ ID NO: 6593097 - DNA, 15 bp, Homo sapiens
aatgtaacttttgta

SEQ ID NO: 6593098 - DNA, 22 bp, Homo sapiens
aatgtaacttttgtaagacaaa

SEQ ID NO: 6593099 - DNA, 17 bp, Homo sapiens
aatgtaagaatcattgt

SEQ ID NO: 6593100 - DNA, 13 bp, Homo sapiens
aatgtaagacaaa

SEQ ID NO: 6593101 - DNA, 21 bp, Homo sapiens
aatgtaagattatagattcta

SEQ ID NO: 6593102 - DNA, 22 bp, Homo sapiens
aatgtaagattatagattctaa

SEQ ID NO: 6593103 - DNA, 18 bp, Homo sapiens
aatgtaaggctgtgtaag

SEQ ID NO: 6593104 - DNA, 20 bp, Homo sapiens
aatgtaagggaaactgccag

SEQ ID NO: 6593105 - DNA, 17 bp, Homo sapiens
aatgtaaggtatatcat

SEQ ID NO: 6593106 - DNA, 17 bp, Homo sapiens
aatgtaagtaaatgtct

SEQ ID NO: 6593107 - DNA, 15 bp, Homo sapiens
aatgtaataaagtga

SEQ ID NO: 6593108 - DNA, 20 bp, Homo sapiens
aatgtaatactggaataatt

SEQ ID NO: 6593109 - DNA, 14 bp, Homo sapiens
aatgtaatactgta

SEQ ID NO: 6593110 - DNA, 20 bp, Homo sapiens
aatgtaatactgtagaaata

SEQ ID NO: 6593111 - DNA, 16 bp, Homo sapiens
aatgtaatgatgctga

SEQ ID NO: 6593112 - DNA, 17 bp, Homo sapiens
aatgtaatgtcagactt

SEQ ID NO: 6593113 - DNA, 21 bp, Homo sapiens
aatgtaatgtttttatttcaa

SEQ ID NO: 6593114 - DNA, 19 bp, Homo sapiens
aatgtaattaaactgttaa

SEQ ID NO: 6593115 - DNA, 20 bp, Homo sapiens
aatgtaattaactgtaaact

SEQ ID NO: 6593116 - DNA, 16 bp, Homo sapiens
aatgtaattcaggact

SEQ ID NO: 6593117 - DNA, 17 bp, Homo sapiens
aatgtaattcaggactc

SEQ ID NO: 6593118 - DNA, 16 bp, Homo sapiens
aatgtaatttaaatga

SEQ ID NO: 6593119 - DNA, 17 bp, Homo sapiens
aatgtaatttaaatgaa

SEQ ID NO: 6593120 - DNA, 17 bp, Homo sapiens
aatgtaatttgtgtaat

SEQ ID NO: 6593121 - DNA, 20 bp, Homo sapiens
aatgtacaagttttgtataa

SEQ ID NO: 6593122 - DNA, 14 bp, Homo sapiens
aatgtacacttttt

SEQ ID NO: 6593123 - DNA, 16 bp, Homo sapiens
aatgtacagacatatt

SEQ ID NO: 6593124 - DNA, 16 bp, Homo sapiens
aatgtacagagtggcc

SEQ ID NO: 6593125 - DNA, 23 bp, Homo sapiens
aatgtacatctcccctttgctaa

SEQ ID NO: 6593126 - DNA, 14 bp, Homo sapiens
aatgtacatgtatt

SEQ ID NO: 6593127 - DNA, 16 bp, Homo sapiens
aatgtacatgtattaa

SEQ ID NO: 6593128 - DNA, 22 bp, Homo sapiens
aatgtacatgttcctttgtaat

SEQ ID NO: 6593129 - DNA, 21 bp, Homo sapiens
aatgtacatttccaaatgaac

SEQ ID NO: 6593130 - DNA, 22 bp, Homo sapiens
aatgtacatttccaaatgaact

SEQ ID NO: 6593131 - DNA, 18 bp, Homo sapiens
aatgtacctatgtgagtt

SEQ ID NO: 6593132 - DNA, 19 bp, Homo sapiens
aatgtacctctattagttt

SEQ ID NO: 6593133 - DNA, 17 bp, Homo sapiens
aatgtaccttatttaaa

SEQ ID NO: 6593134 - DNA, 21 bp, Homo sapiens
aatgtaccttatttaaaagat

SEQ ID NO: 6593135 - DNA, 23 bp, Homo sapiens
aatgtaccttatttaaaagattt

SEQ ID NO: 6593136 - DNA, 21 bp, Homo sapiens
aatgtaccttctttcactctg

SEQ ID NO: 6593137 - DNA, 22 bp, Homo sapiens
aatgtacgaaactgtatgatta

SEQ ID NO: 6593138 - DNA, 16 bp, Homo sapiens
aatgtacgctgctgca

SEQ ID NO: 6593139 - DNA, 19 bp, Homo sapiens
aatgtactcacatataaca

SEQ ID NO: 6593140 - DNA, 18 bp, Homo sapiens
aatgtactgaattcttta

SEQ ID NO: 6593141 - DNA, 12 bp, Homo sapiens
aatgtactgaga

SEQ ID NO: 6593142 - DNA, 17 bp, Homo sapiens
aatgtactgatttcagt

SEQ ID NO: 6593143 - DNA, 18 bp, Homo sapiens
aatgtactgcatatgaaa

SEQ ID NO: 6593144 - DNA, 18 bp, Homo sapiens
aatgtactggtaattgta

SEQ ID NO: 6593145 - DNA, 15 bp, Homo sapiens
aatgtactgtacata

SEQ ID NO: 6593146 - DNA, 16 bp, Homo sapiens
aatgtacttaaagggt

SEQ ID NO: 6593147 - DNA, 14 bp, Homo sapiens
aatgtacttaaatg

SEQ ID NO: 6593148 - DNA, 15 bp, Homo sapiens
aatgtacttatatta

SEQ ID NO: 6593149 - DNA, 23 bp, Homo sapiens
aatgtacttatattaagaaaaat

SEQ ID NO: 6593150 - DNA, 13 bp, Homo sapiens
aatgtacttgttt

SEQ ID NO: 6593151 - DNA, 16 bp, Homo sapiens
aatgtacttgtttgaa

SEQ ID NO: 6593152 - DNA, 17 bp, Homo sapiens
aatgtacttgtttgaat

SEQ ID NO: 6593153 - DNA, 18 bp, Homo sapiens
aatgtacttgtttgaata

SEQ ID NO: 6593154 - DNA, 15 bp, Homo sapiens
aatgtactttcattc

SEQ ID NO: 6593155 - DNA, 18 bp, Homo sapiens
aatgtactttttattgca

SEQ ID NO: 6593156 - DNA, 19 bp, Homo sapiens
aatgtactttttattgcat

SEQ ID NO: 6593157 - DNA, 20 bp, Homo sapiens
aatgtactttttattgcatg

SEQ ID NO: 6593158 - DNA, 22 bp, Homo sapiens
aatgtagaaatgtttcatacag

SEQ ID NO: 6593159 - DNA, 15 bp, Homo sapiens
aatgtagaaattcta

SEQ ID NO: 6593160 - DNA, 16 bp, Homo sapiens
aatgtagaaattcttc

SEQ ID NO: 6593161 - DNA, 18 bp, Homo sapiens
aatgtagaacctcaaaca

SEQ ID NO: 6593162 - DNA, 12 bp, Homo sapiens
aatgtagaagaa

SEQ ID NO: 6593163 - DNA, 16 bp, Homo sapiens
aatgtagaagaaagca

SEQ ID NO: 6593164 - DNA, 18 bp, Homo sapiens
aatgtagaagaaagcaaa

SEQ ID NO: 6593165 - DNA, 22 bp, Homo sapiens
aatgtagaagaaagcaaaaaat

SEQ ID NO: 6593166 - DNA, 15 bp, Homo sapiens
tttcctcatgtaaca

SEQ ID NO: 6593167 - DNA, 12 bp, Homo sapiens
tttcctccccac

SEQ ID NO: 6593168 - DNA, 21 bp, Homo sapiens
tttcctccccatacacacaca

SEQ ID NO: 6593169 - DNA, 23 bp, Homo sapiens
tttcctccccattcctacaattt

SEQ ID NO: 6593170 - DNA, 15 bp, Homo sapiens
tttcctccccctgca

SEQ ID NO: 6593171 - DNA, 20 bp, Homo sapiens
tttcctccctctgcccctcc

SEQ ID NO: 6593172 - DNA, 11 bp, Homo sapiens
tttcctccctt

SEQ ID NO: 6593173 - DNA, 14 bp, Homo sapiens
tttcctcccttctg

SEQ ID NO: 6593174 - DNA, 18 bp, Homo sapiens
tttcctcctcaggcacac

SEQ ID NO: 6593175 - DNA, 14 bp, Homo sapiens
tttcctcctgggca

SEQ ID NO: 6593176 - DNA, 17 bp, Homo sapiens
tttcctcctttatcaca

SEQ ID NO: 6593177 - DNA, 18 bp, Homo sapiens
tttcctcgcctaggcctg

SEQ ID NO: 6593178 - DNA, 14 bp, Homo sapiens
tttcctcggtctcc

SEQ ID NO: 6593179 - DNA, 15 bp, Homo sapiens
tttcctctaaagaaa

SEQ ID NO: 6593180 - DNA, 17 bp, Homo sapiens
tttcctctaaagaaact

SEQ ID NO: 6593181 - DNA, 18 bp, Homo sapiens
tttcctctaatatgccta

SEQ ID NO: 6593182 - DNA, 19 bp, Homo sapiens
tttcctctccactgctgga

SEQ ID NO: 6593183 - DNA, 16 bp, Homo sapiens
tttcctctccctcagg

SEQ ID NO: 6593184 - DNA, 17 bp, Homo sapiens
tttcctctctatatttc

SEQ ID NO: 6593185 - DNA, 14 bp, Homo sapiens
tttcctctctctct

SEQ ID NO: 6593186 - DNA, 23 bp, Homo sapiens
tttcctctctctctctctctctg

SEQ ID NO: 6593187 - DNA, 16 bp, Homo sapiens
tttcctctctgtctgt

SEQ ID NO: 6593188 - DNA, 23 bp, Homo sapiens
tttcctctctttgttctcagctc

SEQ ID NO: 6593189 - DNA, 18 bp, Homo sapiens
tttcctctgagattctaa

SEQ ID NO: 6593190 - DNA, 16 bp, Homo sapiens
tttcctctgagcccag

SEQ ID NO: 6593191 - DNA, 20 bp, Homo sapiens
tttcctctgagctgttatct

SEQ ID NO: 6593192 - DNA, 12 bp, Homo sapiens
tttcctctgcac

SEQ ID NO: 6593193 - DNA, 19 bp, Homo sapiens
tttcctctgttaaaaacct

SEQ ID NO: 6593194 - DNA, 16 bp, Homo sapiens
tttcctcttccttctc

SEQ ID NO: 6593195 - DNA, 12 bp, Homo sapiens
tttcctcttgtg

SEQ ID NO: 6593196 - DNA, 21 bp, Homo sapiens
tttcctgaaacaacttggaaa

SEQ ID NO: 6593197 - DNA, 11 bp, Homo sapiens
tttcctgaaat

SEQ ID NO: 6593198 - DNA, 12 bp, Homo sapiens
tttcctgaaata

SEQ ID NO: 6593199 - DNA, 18 bp, Homo sapiens
tttcctgaaccatgtgga

SEQ ID NO: 6593200 - DNA, 18 bp, Homo sapiens
tttcctgagctgtcgctg

SEQ ID NO: 6593201 - DNA, 13 bp, Homo sapiens
tttcctgagcttg

SEQ ID NO: 6593202 - DNA, 18 bp, Homo sapiens
tttcctgagcttggccag

SEQ ID NO: 6593203 - DNA, 23 bp, Homo sapiens
tttcctgaggtcatctgtaaaat

SEQ ID NO: 6593204 - DNA, 20 bp, Homo sapiens
tttcctgatagcatatgaca

SEQ ID NO: 6593205 - DNA, 13 bp, Homo sapiens
tttcctgatctag

SEQ ID NO: 6593206 - DNA, 18 bp, Homo sapiens
tttcctgatgatgctggc

SEQ ID NO: 6593207 - DNA, 16 bp, Homo sapiens
tttcctgatgttgata

SEQ ID NO: 6593208 - DNA, 13 bp, Homo sapiens
tttcctgcccagc

SEQ ID NO: 6593209 - DNA, 21 bp, Homo sapiens
tttcctgcccagcctggggca

SEQ ID NO: 6593210 - DNA, 22 bp, Homo sapiens
tttcctgccccaaccacaaact

SEQ ID NO: 6593211 - DNA, 20 bp, Homo sapiens
tttcctgccgtccctcctgt

SEQ ID NO: 6593212 - DNA, 16 bp, Homo sapiens
tttcctgccttcttct

SEQ ID NO: 6593213 - DNA, 22 bp, Homo sapiens
tttcctgccttttagttcctgt

SEQ ID NO: 6593214 - DNA, 23 bp, Homo sapiens
tttcctgccttttagttcctgtg

SEQ ID NO: 6593215 - DNA, 18 bp, Homo sapiens
tttcctgctacaagtgtt

SEQ ID NO: 6593216 - DNA, 16 bp, Homo sapiens
tttcctgctgtcttct

SEQ ID NO: 6593217 - DNA, 17 bp, Homo sapiens
tttcctgcttagaatta

SEQ ID NO: 6593218 - DNA, 16 bp, Homo sapiens
tttcctgcttccctgt

SEQ ID NO: 6593219 - DNA, 11 bp, Homo sapiens
tttcctggaaa

SEQ ID NO: 6593220 - DNA, 16 bp, Homo sapiens
tttcctggaaagactg

SEQ ID NO: 6593221 - DNA, 12 bp, Homo sapiens
tttcctggaagc

SEQ ID NO: 6593222 - DNA, 18 bp, Homo sapiens
tttcctggaagcagagca

SEQ ID NO: 6593223 - DNA, 19 bp, Homo sapiens
tttcctggaattgccagct

SEQ ID NO: 6593224 - DNA, 20 bp, Homo sapiens
tttcctggacactcagacct

SEQ ID NO: 6593225 - DNA, 19 bp, Homo sapiens
tttcctggacttaaagaaa

SEQ ID NO: 6593226 - DNA, 20 bp, Homo sapiens
tttcctggacttaaagaaaa

SEQ ID NO: 6593227 - DNA, 11 bp, Homo sapiens
tttcctggagc

SEQ ID NO: 6593228 - DNA, 17 bp, Homo sapiens
tttcctggagtgccctg

SEQ ID NO: 6593229 - DNA, 20 bp, Homo sapiens
tttcctggagtgccctgcag

SEQ ID NO: 6593230 - DNA, 13 bp, Homo sapiens
tttcctgggcctt

SEQ ID NO: 6593231 - DNA, 17 bp, Homo sapiens
tttcctgggccttctca

SEQ ID NO: 6593232 - DNA, 18 bp, Homo sapiens
tttcctgggccttctcag

SEQ ID NO: 6593233 - DNA, 18 bp, Homo sapiens
tttcctgggcctttgcaa

SEQ ID NO: 6593234 - DNA, 20 bp, Homo sapiens
tttcctggttccactgctac

SEQ ID NO: 6593235 - DNA, 12 bp, Homo sapiens
tttcctgtaata

SEQ ID NO: 6593236 - DNA, 21 bp, Homo sapiens
tttcctgtaatatatttatat

SEQ ID NO: 6593237 - DNA, 23 bp, Homo sapiens
tttcctgtatttgttcccaagag

SEQ ID NO: 6593238 - DNA, 22 bp, Homo sapiens
tttcctgtctgtatataactta

SEQ ID NO: 6593239 - DNA, 12 bp, Homo sapiens
tttcctgtgaca

SEQ ID NO: 6593240 - DNA, 22 bp, Homo sapiens
tttcctgtgcccatcatctctg

SEQ ID NO: 6593241 - DNA, 19 bp, Homo sapiens
tttcctgtggaaatatgca

SEQ ID NO: 6593242 - DNA, 12 bp, Homo sapiens
tttcctgtgtct

SEQ ID NO: 6593243 - DNA, 18 bp, Homo sapiens
tttcctgtgtgtgttgcc

SEQ ID NO: 6593244 - DNA, 16 bp, Homo sapiens
tttcctgttcagcatt

SEQ ID NO: 6593245 - DNA, 16 bp, Homo sapiens
tttcctgtttactgat

SEQ ID NO: 6593246 - DNA, 20 bp, Homo sapiens
tttcctgtttctgaaaagaa

SEQ ID NO: 6593247 - DNA, 13 bp, Homo sapiens
tttcctgtttgaa

SEQ ID NO: 6593248 - DNA, 15 bp, Homo sapiens
tttcctgtttgggaa

SEQ ID NO: 6593249 - DNA, 16 bp, Homo sapiens
tttccttacataaaca

SEQ ID NO: 6593250 - DNA, 22 bp, Homo sapiens
tttccttaccataccactttga

SEQ ID NO: 6593251 - DNA, 18 bp, Homo sapiens
tttccttacctatttcct

SEQ ID NO: 6593252 - DNA, 15 bp, Homo sapiens
tttccttacttttaa

SEQ ID NO: 6593253 - DNA, 23 bp, Homo sapiens
tttccttacttttaaaataaaat

SEQ ID NO: 6593254 - DNA, 16 bp, Homo sapiens
tttccttattgaaaaa

SEQ ID NO: 6593255 - DNA, 16 bp, Homo sapiens
tttccttatttgcctt

SEQ ID NO: 6593256 - DNA, 13 bp, Homo sapiens
tttccttattttc

SEQ ID NO: 6593257 - DNA, 18 bp, Homo sapiens
tttccttcaaagtttaat

SEQ ID NO: 6593258 - DNA, 13 bp, Homo sapiens
tttccttcagagt

SEQ ID NO: 6593259 - DNA, 13 bp, Homo sapiens
tttccttcagtgc

SEQ ID NO: 6593260 - DNA, 14 bp, Homo sapiens
tttccttcataatt

SEQ ID NO: 6593261 - DNA, 21 bp, Homo sapiens
tttccttcattcaacccacct

SEQ ID NO: 6593262 - DNA, 16 bp, Homo sapiens
tttccttcattcatag

SEQ ID NO: 6593263 - DNA, 12 bp, Homo sapiens
tttccttccaat

SEQ ID NO: 6593264 - DNA, 17 bp, Homo sapiens
tttccttccagcctttt

SEQ ID NO: 6593265 - DNA, 14 bp, Homo sapiens
tttccttccatccc

SEQ ID NO: 6593266 - DNA, 15 bp, Homo sapiens
tttccttccatccct

SEQ ID NO: 6593267 - DNA, 21 bp, Homo sapiens
tttccttccatgctcccaact

SEQ ID NO: 6593268 - DNA, 10 bp, Homo sapiens
tttccttccc

SEQ ID NO: 6593269 - DNA, 16 bp, Homo sapiens
tttccttccctctcct

SEQ ID NO: 6593270 - DNA, 16 bp, Homo sapiens
tttccttccttccctg

SEQ ID NO: 6593271 - DNA, 18 bp, Homo sapiens
tttccttccttccctggc

SEQ ID NO: 6593272 - DNA, 13 bp, Homo sapiens
tttccttctcgtc

SEQ ID NO: 6593273 - DNA, 20 bp, Homo sapiens
tttccttctcgtcttcctct

SEQ ID NO: 6593274 - DNA, 21 bp, Homo sapiens
tttccttctgaagtctgagcc

SEQ ID NO: 6593275 - DNA, 13 bp, Homo sapiens
tttccttctgccc

SEQ ID NO: 6593276 - DNA, 14 bp, Homo sapiens
tttccttctgccct

SEQ ID NO: 6593277 - DNA, 13 bp, Homo sapiens
tttccttctgtta

SEQ ID NO: 6593278 - DNA, 14 bp, Homo sapiens
tttccttctgttaa

SEQ ID NO: 6593279 - DNA, 15 bp, Homo sapiens
tttccttctgttaag

SEQ ID NO: 6593280 - DNA, 21 bp, Homo sapiens
tttccttctgttaagaaagga

SEQ ID NO: 6593281 - DNA, 23 bp, Homo sapiens
tttccttctgttaagaaaggata

SEQ ID NO: 6593282 - DNA, 14 bp, Homo sapiens
tttccttcttccca

SEQ ID NO: 6593283 - DNA, 15 bp, Homo sapiens
tttccttgaaaaaaa

SEQ ID NO: 6593284 - DNA, 14 bp, Homo sapiens
tttccttgaagccg

SEQ ID NO: 6593285 - DNA, 19 bp, Homo sapiens
tttccttggggcaggcagt

SEQ ID NO: 6593286 - DNA, 14 bp, Homo sapiens
tttccttgtctctc

SEQ ID NO: 6593287 - DNA, 15 bp, Homo sapiens
tttccttgtgcaaaa

SEQ ID NO: 6593288 - DNA, 19 bp, Homo sapiens
tttccttgtgctcctgcca

SEQ ID NO: 6593289 - DNA, 18 bp, Homo sapiens
tttccttgtggcagagga

SEQ ID NO: 6593290 - DNA, 13 bp, Homo sapiens
tttcctttaaatt

SEQ ID NO: 6593291 - DNA, 15 bp, Homo sapiens
tttcctttactcctg

SEQ ID NO: 6593292 - DNA, 20 bp, Homo sapiens
tttcctttagatcaaggcaa

SEQ ID NO: 6593293 - DNA, 14 bp, Homo sapiens
tttcctttatgtga

SEQ ID NO: 6593294 - DNA, 20 bp, Homo sapiens
tttcctttcattttctttcc

SEQ ID NO: 6593295 - DNA, 16 bp, Homo sapiens
tttcctttccccagcc

SEQ ID NO: 6593296 - DNA, 17 bp, Homo sapiens
tttcctttccccagccc

SEQ ID NO: 6593297 - DNA, 20 bp, Homo sapiens
tttcctttccccagcccagg

SEQ ID NO: 6593298 - DNA, 16 bp, Homo sapiens
tttcctttcctttctt

SEQ ID NO: 6593299 - DNA, 18 bp, Homo sapiens
tttcctttgaacgtgctt

SEQ ID NO: 6593300 - DNA, 21 bp, Homo sapiens
tttcctttgaacgtgcttctt

SEQ ID NO: 6593301 - DNA, 14 bp, Homo sapiens
tttcctttgtcctt

SEQ ID NO: 6593302 - DNA, 21 bp, Homo sapiens
tttcctttgtggttttatgga

SEQ ID NO: 6593303 - DNA, 16 bp, Homo sapiens
tttccttttcaggaga

SEQ ID NO: 6593304 - DNA, 18 bp, Homo sapiens
tttccttttctctgccct

SEQ ID NO: 6593305 - DNA, 18 bp, Homo sapiens
tttccttttcttccttct

SEQ ID NO: 6593306 - DNA, 23 bp, Homo sapiens
tttccttttcttgtctctgaggc

SEQ ID NO: 6593307 - DNA, 13 bp, Homo sapiens
tttccttttgcac

SEQ ID NO: 6593308 - DNA, 18 bp, Homo sapiens
tttccttttgctgtgtga

SEQ ID NO: 6593309 - DNA, 13 bp, Homo sapiens
tttcctttttaat

SEQ ID NO: 6593310 - DNA, 22 bp, Homo sapiens
tttcctttttaatatgcttaaa

SEQ ID NO: 6593311 - DNA, 16 bp, Homo sapiens
tttcctttttctgatt

SEQ ID NO: 6593312 - DNA, 16 bp, Homo sapiens
tttcctttttctttcc

SEQ ID NO: 6593313 - DNA, 16 bp, Homo sapiens
tttcctttttgacact

SEQ ID NO: 6593314 - DNA, 19 bp, Homo sapiens
tttcctttttgacactgaa

SEQ ID NO: 6593315 - DNA, 15 bp, Homo sapiens
tttcctttttgagat

SEQ ID NO: 6593316 - DNA, 17 bp, Homo sapiens
tttcctttttggggagt

SEQ ID NO: 6593317 - DNA, 21 bp, Homo sapiens
tttccttttttaaaaatgcaa

SEQ ID NO: 6593318 - DNA, 20 bp, Homo sapiens
tttccttttttgtctatgaa

SEQ ID NO: 6593319 - DNA, 16 bp, Homo sapiens
tttccttttttgttat

SEQ ID NO: 6593320 - DNA, 17 bp, Homo sapiens
tttccttttttgttatt

SEQ ID NO: 6593321 - DNA, 15 bp, Homo sapiens
tttcgaaactgccaa

SEQ ID NO: 6593322 - DNA, 16 bp, Homo sapiens
tttcgaagtcattaaa

SEQ ID NO: 6593323 - DNA, 20 bp, Homo sapiens
tttcgaagtcattaaactgg

SEQ ID NO: 6593324 - DNA, 15 bp, Homo sapiens
tttcgaccctggggc

SEQ ID NO: 6593325 - DNA, 20 bp, Homo sapiens
tttcgacgcttaacctttcc

SEQ ID NO: 6593326 - DNA, 17 bp, Homo sapiens
tttcgactggtccagct

SEQ ID NO: 6593327 - DNA, 19 bp, Homo sapiens
tttcgagtaaacttgaaaa

SEQ ID NO: 6593328 - DNA, 19 bp, Homo sapiens
tttcgatatttattgatgt

SEQ ID NO: 6593329 - DNA, 13 bp, Homo sapiens
tttcgatgatgat

SEQ ID NO: 6593330 - DNA, 15 bp, Homo sapiens
tttcgatgtttttga

SEQ ID NO: 6593331 - DNA, 22 bp, Homo sapiens
tttcgattcgttaagagagcaa

SEQ ID NO: 6593332 - DNA, 18 bp, Homo sapiens
tttcgcaggattcttcct

SEQ ID NO: 6593333 - DNA, 18 bp, Homo sapiens
tttcgcctcctccagctc

SEQ ID NO: 6593334 - DNA, 13 bp, Homo sapiens
tttcgctatggga

SEQ ID NO: 6593335 - DNA, 12 bp, Homo sapiens
tttcgcttgctt

SEQ ID NO: 6593336 - DNA, 15 bp, Homo sapiens
tttcgcttgcttctg

SEQ ID NO: 6593337 - DNA, 15 bp, Homo sapiens
tttcgctttcctctg

SEQ ID NO: 6593338 - DNA, 21 bp, Homo sapiens
tttcggaaaaaaaaaaagaaa

SEQ ID NO: 6593339 - DNA, 20 bp, Homo sapiens
tttcggaccgaaggtgacag

SEQ ID NO: 6593340 - DNA, 17 bp, Homo sapiens
tttcggattttttccaa

SEQ ID NO: 6593341 - DNA, 14 bp, Homo sapiens
tttcggtgggacag

SEQ ID NO: 6593342 - DNA, 17 bp, Homo sapiens
tttcgtaatagctcaga

SEQ ID NO: 6593343 - DNA, 14 bp, Homo sapiens
tttcgtaccttccc

SEQ ID NO: 6593344 - DNA, 14 bp, Homo sapiens
tttcgtatgaaaat

SEQ ID NO: 6593345 - DNA, 15 bp, Homo sapiens
tttcgtatgcactcc

SEQ ID NO: 6593346 - DNA, 18 bp, Homo sapiens
tttcgtatgcactccctt

SEQ ID NO: 6593347 - DNA, 20 bp, Homo sapiens
tttcgtcatcttccctgccc

SEQ ID NO: 6593348 - DNA, 21 bp, Homo sapiens
tttcgtccatgtttctcacat

SEQ ID NO: 6593349 - DNA, 21 bp, Homo sapiens
tttcgtctgtttataaacatt

SEQ ID NO: 6593350 - DNA, 19 bp, Homo sapiens
tttcgtgatcttattgctt

SEQ ID NO: 6593351 - DNA, 15 bp, Homo sapiens
tttcgtgcatttgtg

SEQ ID NO: 6593352 - DNA, 21 bp, Homo sapiens
tttcgtgggtctgttttcctt

SEQ ID NO: 6593353 - DNA, 14 bp, Homo sapiens
tttcgttaagcagt

SEQ ID NO: 6593354 - DNA, 22 bp, Homo sapiens
tttcgttggttgtttctctgag

SEQ ID NO: 6593355 - DNA, 20 bp, Homo sapiens
tttcgtttagaatcagaata

SEQ ID NO: 6593356 - DNA, 20 bp, Homo sapiens
tttcgttttttacacgagat

SEQ ID NO: 6593357 - DNA, 18 bp, Homo sapiens
tttctaaaaaaaaaaact

SEQ ID NO: 6593358 - DNA, 22 bp, Homo sapiens
tttctaaaaagtcaattcatct

SEQ ID NO: 6593359 - DNA, 17 bp, Homo sapiens
tttctaaaaataaagct

SEQ ID NO: 6593360 - DNA, 12 bp, Homo sapiens
tttctaaaacta

SEQ ID NO: 6593361 - DNA, 15 bp, Homo sapiens
tttctaaaactaaat

SEQ ID NO: 6593362 - DNA, 19 bp, Homo sapiens
tttctaaaactaaatagca

SEQ ID NO: 6593363 - DNA, 13 bp, Homo sapiens
tttctaaaagact

SEQ ID NO: 6593364 - DNA, 22 bp, Homo sapiens
tttctaaaagccataatccagt

SEQ ID NO: 6593365 - DNA, 15 bp, Homo sapiens
tttctaaaatctaaa

SEQ ID NO: 6593366 - DNA, 20 bp, Homo sapiens
tttctaaaatgttaaaacat

SEQ ID NO: 6593367 - DNA, 17 bp, Homo sapiens
tttctaaacaagatttt

SEQ ID NO: 6593368 - DNA, 14 bp, Homo sapiens
tttctaaactggag

SEQ ID NO: 6593369 - DNA, 16 bp, Homo sapiens
tttctaaactggagac

SEQ ID NO: 6593370 - DNA, 19 bp, Homo sapiens
tttctaaactggagactgt

SEQ ID NO: 6593371 - DNA, 15 bp, Homo sapiens
tttctaaactgtttt

SEQ ID NO: 6593372 - DNA, 12 bp, Homo sapiens
tttctaaagact

SEQ ID NO: 6593373 - DNA, 20 bp, Homo sapiens
tttctaaaggctacctttgt

SEQ ID NO: 6593374 - DNA, 13 bp, Homo sapiens
tttctaaagtaaa

SEQ ID NO: 6593375 - DNA, 13 bp, Homo sapiens
tttctaaagtgtt

SEQ ID NO: 6593376 - DNA, 21 bp, Homo sapiens
tttctaaataaggaatttcct

SEQ ID NO: 6593377 - DNA, 16 bp, Homo sapiens
tttctaaatgtttctt

SEQ ID NO: 6593378 - DNA, 13 bp, Homo sapiens
tttctaaatttat

SEQ ID NO: 6593379 - DNA, 17 bp, Homo sapiens
tttctaaatttgataat

SEQ ID NO: 6593380 - DNA, 19 bp, Homo sapiens
tttctaacaattttcagac

SEQ ID NO: 6593381 - DNA, 23 bp, Homo sapiens
tttctaacactagcttatttcca

SEQ ID NO: 6593382 - DNA, 13 bp, Homo sapiens
tttctaaccttga

SEQ ID NO: 6593383 - DNA, 19 bp, Homo sapiens
tttctaaccttgaatgctg

SEQ ID NO: 6593384 - DNA, 18 bp, Homo sapiens
tttctaactacaaaggtt

SEQ ID NO: 6593385 - DNA, 20 bp, Homo sapiens
tttctaactacaaaggttta

SEQ ID NO: 6593386 - DNA, 15 bp, Homo sapiens
tttctaactatataa

SEQ ID NO: 6593387 - DNA, 21 bp, Homo sapiens
tttctaactctgatgtaaatg

SEQ ID NO: 6593388 - DNA, 16 bp, Homo sapiens
tttctaactgtaaatc

SEQ ID NO: 6593389 - DNA, 22 bp, Homo sapiens
tttctaactgtaaatcacttgt

SEQ ID NO: 6593390 - DNA, 23 bp, Homo sapiens
tttctaactgtaaatcacttgta

SEQ ID NO: 6593391 - DNA, 11 bp, Homo sapiens
tttctaacttt

SEQ ID NO: 6593392 - DNA, 14 bp, Homo sapiens
tttctaagaaaatg

SEQ ID NO: 6593393 - DNA, 15 bp, Homo sapiens
tttctaagaaataga

SEQ ID NO: 6593394 - DNA, 17 bp, Homo sapiens
tttctaagaaatagagc

SEQ ID NO: 6593395 - DNA, 16 bp, Homo sapiens
tttctaagaatttaga

SEQ ID NO: 6593396 - DNA, 12 bp, Homo sapiens
tttctaagacta

SEQ ID NO: 6593397 - DNA, 16 bp, Homo sapiens
tttctaagagaagcaa

SEQ ID NO: 6593398 - DNA, 13 bp, Homo sapiens
tttctaagattct

SEQ ID NO: 6593399 - DNA, 15 bp, Homo sapiens
tttctaagattctaa

SEQ ID NO: 6593400 - DNA, 17 bp, Homo sapiens
tttctaagattctaaag

SEQ ID NO: 6593401 - DNA, 14 bp, Homo sapiens
tttctaagcagata

SEQ ID NO: 6593402 - DNA, 21 bp, Homo sapiens
tttctaaggatagcctttgta

SEQ ID NO: 6593403 - DNA, 13 bp, Homo sapiens
tttctaagtattt

SEQ ID NO: 6593404 - DNA, 20 bp, Homo sapiens
tttctaagtgtaacctcagt

SEQ ID NO: 6593405 - DNA, 21 bp, Homo sapiens
tttctaagttaaatcattttc

SEQ ID NO: 6593406 - DNA, 23 bp, Homo sapiens
tttctaagttaaatcattttcat

SEQ ID NO: 6593407 - DNA, 13 bp, Homo sapiens
tttctaataaact

SEQ ID NO: 6593408 - DNA, 21 bp, Homo sapiens
tttctaataaacttggattct

SEQ ID NO: 6593409 - DNA, 18 bp, Homo sapiens
tttctaatacaagcatat

SEQ ID NO: 6593410 - DNA, 15 bp, Homo sapiens
tttctaatacgagcc

SEQ ID NO: 6593411 - DNA, 15 bp, Homo sapiens
tttctaatagagaga

SEQ ID NO: 6593412 - DNA, 13 bp, Homo sapiens
tttctaatcaaaa

SEQ ID NO: 6593413 - DNA, 17 bp, Homo sapiens
tttctaatccttttcct

SEQ ID NO: 6593414 - DNA, 20 bp, Homo sapiens
tttctaatccttttccttat

SEQ ID NO: 6593415 - DNA, 15 bp, Homo sapiens
tttctaatcttgtta

SEQ ID NO: 6593416 - DNA, 23 bp, Homo sapiens
tttctaatgaggagagaaaatat

SEQ ID NO: 6593417 - DNA, 21 bp, Homo sapiens
tttctaatgatataaatttca

SEQ ID NO: 6593418 - DNA, 21 bp, Homo sapiens
tttctaatgttattttccttc

SEQ ID NO: 6593419 - DNA, 16 bp, Homo sapiens
tttctaatgtttacta

SEQ ID NO: 6593420 - DNA, 17 bp, Homo sapiens
tttctaatgtttactat

SEQ ID NO: 6593421 - DNA, 15 bp, Homo sapiens
tttctaattaacctt

SEQ ID NO: 6593422 - DNA, 19 bp, Homo sapiens
tttctaattatgtagctct

SEQ ID NO: 6593423 - DNA, 13 bp, Homo sapiens
tttctaattgctt

SEQ ID NO: 6593424 - DNA, 16 bp, Homo sapiens
tttctaattgcttatt

SEQ ID NO: 6593425 - DNA, 19 bp, Homo sapiens
tttctaattggctttacta

SEQ ID NO: 6593426 - DNA, 12 bp, Homo sapiens
tttctaattgta

SEQ ID NO: 6593427 - DNA, 13 bp, Homo sapiens
tttctaattgtaa

SEQ ID NO: 6593428 - DNA, 14 bp, Homo sapiens
tttctaatttcaag

SEQ ID NO: 6593429 - DNA, 14 bp, Homo sapiens
tttctacaactgat

SEQ ID NO: 6593430 - DNA, 17 bp, Homo sapiens
tttctacaatgtgaact

SEQ ID NO: 6593431 - DNA, 21 bp, Homo sapiens
tttctacaattaatagtttgt

SEQ ID NO: 6593432 - DNA, 19 bp, Homo sapiens
tttctacacagtaaaaact

SEQ ID NO: 6593433 - DNA, 22 bp, Homo sapiens
tttctacacagtaaaaacttgt

SEQ ID NO: 6593434 - DNA, 19 bp, Homo sapiens
tttctacacattgctacct

SEQ ID NO: 6593435 - DNA, 12 bp, Homo sapiens
tttctacagaga

SEQ ID NO: 6593436 - DNA, 17 bp, Homo sapiens
tttctacataattgtga

SEQ ID NO: 6593437 - DNA, 21 bp, Homo sapiens
tttctacatagttattctatc

SEQ ID NO: 6593438 - DNA, 21 bp, Homo sapiens
tttctacattcagattatatg

SEQ ID NO: 6593439 - DNA, 20 bp, Homo sapiens
tttctaccaccgcatcctca

SEQ ID NO: 6593440 - DNA, 21 bp, Homo sapiens
tttctaccattaaaatcttga

SEQ ID NO: 6593441 - DNA, 20 bp, Homo sapiens
tttctaccctagccattcct

SEQ ID NO: 6593442 - DNA, 23 bp, Homo sapiens
tttctacccttggaaagaaatgt

SEQ ID NO: 6593443 - DNA, 12 bp, Homo sapiens
tttctacctcag

SEQ ID NO: 6593444 - DNA, 14 bp, Homo sapiens
tttctacctcagca

SEQ ID NO: 6593445 - DNA, 14 bp, Homo sapiens
tttctacctctttt

SEQ ID NO: 6593446 - DNA, 18 bp, Homo sapiens
tttctacctcttttttct

SEQ ID NO: 6593447 - DNA, 23 bp, Homo sapiens
tttctacgtcatgtattttatga

SEQ ID NO: 6593448 - DNA, 16 bp, Homo sapiens
tttctactatatacat

SEQ ID NO: 6593449 - DNA, 16 bp, Homo sapiens
tttctactctagatgg

SEQ ID NO: 6593450 - DNA, 10 bp, Homo sapiens
tttctactga

SEQ ID NO: 6593451 - DNA, 18 bp, Homo sapiens
tttctactgtataaacaa

SEQ ID NO: 6593452 - DNA, 17 bp, Homo sapiens
tttctacttcccctggg

SEQ ID NO: 6593453 - DNA, 14 bp, Homo sapiens
tttctactttaaat

SEQ ID NO: 6593454 - DNA, 17 bp, Homo sapiens
tttctagaaaagcttcc

SEQ ID NO: 6593455 - DNA, 21 bp, Homo sapiens
tttctagaaaagcttcctagc

SEQ ID NO: 6593456 - DNA, 19 bp, Homo sapiens
tttctagaagcacatgtgt

SEQ ID NO: 6593457 - DNA, 14 bp, Homo sapiens
tttctagaatacta

SEQ ID NO: 6593458 - DNA, 21 bp, Homo sapiens
tttctagaattatttttcact

SEQ ID NO: 6593459 - DNA, 22 bp, Homo sapiens
tttctagacagtattgccacct

SEQ ID NO: 6593460 - DNA, 23 bp, Homo sapiens
tttctagacatcattgtcagcct

SEQ ID NO: 6593461 - DNA, 15 bp, Homo sapiens
tttctagactttctg

SEQ ID NO: 6593462 - DNA, 21 bp, Homo sapiens
tttctagaggtgctacatagt

SEQ ID NO: 6593463 - DNA, 16 bp, Homo sapiens
tttctagatacaataa

SEQ ID NO: 6593464 - DNA, 18 bp, Homo sapiens
tttctagatacaataaat

SEQ ID NO: 6593465 - DNA, 20 bp, Homo sapiens
tttctagatacaataaattg

SEQ ID NO: 6593466 - DNA, 16 bp, Homo sapiens
tttctagattaagata

SEQ ID NO: 6593467 - DNA, 19 bp, Homo sapiens
tttctagcccgaatacaaa

SEQ ID NO: 6593468 - DNA, 13 bp, Homo sapiens
tttctagccttag

SEQ ID NO: 6593469 - DNA, 14 bp, Homo sapiens
tttctagccttaga

SEQ ID NO: 6593470 - DNA, 18 bp, Homo sapiens
tttctagctaatggaaaa

SEQ ID NO: 6593471 - DNA, 22 bp, Homo sapiens
tttctagctagaaatatgattt

SEQ ID NO: 6593472 - DNA, 18 bp, Homo sapiens
tttctagctataacaact

SEQ ID NO: 6593473 - DNA, 18 bp, Homo sapiens
tttctagctttttaatta

SEQ ID NO: 6593474 - DNA, 22 bp, Homo sapiens
tttctaggaagcacgggggagt

SEQ ID NO: 6593475 - DNA, 22 bp, Homo sapiens
tttctaggcaggtggagagagt

SEQ ID NO: 6593476 - DNA, 20 bp, Homo sapiens
tttctaggccaaaaatggtg

SEQ ID NO: 6593477 - DNA, 17 bp, Homo sapiens
tttctagggacatgaaa

SEQ ID NO: 6593478 - DNA, 15 bp, Homo sapiens
tttctagtaacagta

SEQ ID NO: 6593479 - DNA, 14 bp, Homo sapiens
tttctagtggtctt

SEQ ID NO: 6593480 - DNA, 20 bp, Homo sapiens
tttctagtggtctttgtaag

SEQ ID NO: 6593481 - DNA, 19 bp, Homo sapiens
tttctagtgtatactctgt

SEQ ID NO: 6593482 - DNA, 16 bp, Homo sapiens
tttctagtgtatcaaa

SEQ ID NO: 6593483 - DNA, 19 bp, Homo sapiens
tttctagtgtatcaaaatg

SEQ ID NO: 6593484 - DNA, 21 bp, Homo sapiens
tttctagtgtatcaaaatgct

SEQ ID NO: 6593485 - DNA, 14 bp, Homo sapiens
tttctagtgtcact

SEQ ID NO: 6593486 - DNA, 16 bp, Homo sapiens
tttctagttctttcct

SEQ ID NO: 6593487 - DNA, 16 bp, Homo sapiens
tttctagttgaggagt

SEQ ID NO: 6593488 - DNA, 14 bp, Homo sapiens
tttctagtttcagt

SEQ ID NO: 6593489 - DNA, 21 bp, Homo sapiens
tttctagtttcagtaaataat

SEQ ID NO: 6593490 - DNA, 14 bp, Homo sapiens
tttctagtttcctg

SEQ ID NO: 6593491 - DNA, 18 bp, Homo sapiens
tttctagtttgtttagtt

SEQ ID NO: 6593492 - DNA, 18 bp, Homo sapiens
tttctagtttttaatttt

SEQ ID NO: 6593493 - DNA, 14 bp, Homo sapiens
tttctataaatgac

SEQ ID NO: 6593494 - DNA, 15 bp, Homo sapiens
tttctataacagata

SEQ ID NO: 6593495 - DNA, 11 bp, Homo sapiens
tttctataagt

SEQ ID NO: 6593496 - DNA, 14 bp, Homo sapiens
tttctatacaaata

SEQ ID NO: 6593497 - DNA, 17 bp, Homo sapiens
tttctatacagtagctt

SEQ ID NO: 6593498 - DNA, 18 bp, Homo sapiens
tttctatagccaaaaata

SEQ ID NO: 6593499 - DNA, 22 bp, Homo sapiens
tttctatatagttccttgcctt

SEQ ID NO: 6593500 - DNA, 22 bp, Homo sapiens
tttctatatgtaacttcagatg

SEQ ID NO: 6593501 - DNA, 22 bp, Homo sapiens
tttctatattcctccagctggg

SEQ ID NO: 6593502 - DNA, 14 bp, Homo sapiens
tttctatatttgga

SEQ ID NO: 6593503 - DNA, 15 bp, Homo sapiens
tttctatatttgtaa

SEQ ID NO: 6593504 - DNA, 18 bp, Homo sapiens
tttctatattttcattct

SEQ ID NO: 6593505 - DNA, 17 bp, Homo sapiens
tttctatcaaaactcta

SEQ ID NO: 6593506 - DNA, 18 bp, Homo sapiens
tttctatcagaagttgta

SEQ ID NO: 6593507 - DNA, 21 bp, Homo sapiens
tttctatcagacgtgctccct

SEQ ID NO: 6593508 - DNA, 20 bp, Homo sapiens
tttctatcccccttaaagaa

SEQ ID NO: 6593509 - DNA, 15 bp, Homo sapiens
tttctatcctgttta

SEQ ID NO: 6593510 - DNA, 14 bp, Homo sapiens
tttctatgaaatat

SEQ ID NO: 6593511 - DNA, 20 bp, Homo sapiens
tttctatgaaatattatgtt

SEQ ID NO: 6593512 - DNA, 14 bp, Homo sapiens
tttctatgacaaat

SEQ ID NO: 6593513 - DNA, 20 bp, Homo sapiens
tttctatggattcacttcta

SEQ ID NO: 6593514 - DNA, 21 bp, Homo sapiens
tttctatgtaaattattgtaa

SEQ ID NO: 6593515 - DNA, 22 bp, Homo sapiens
tttctatgtaaattattgtaaa

SEQ ID NO: 6593516 - DNA, 13 bp, Homo sapiens
tttctatgtacta

SEQ ID NO: 6593517 - DNA, 18 bp, Homo sapiens
tttctatgtactagtact

SEQ ID NO: 6593518 - DNA, 17 bp, Homo sapiens
tttctatgtagaactgt

SEQ ID NO: 6593519 - DNA, 21 bp, Homo sapiens
tttctatgtagaactgttcat

SEQ ID NO: 6593520 - DNA, 21 bp, Homo sapiens
tttctatgtgttgtgtttgta

SEQ ID NO: 6593521 - DNA, 15 bp, Homo sapiens
tttctattaaaagac

SEQ ID NO: 6593522 - DNA, 20 bp, Homo sapiens
tttctattaaatagttatat

SEQ ID NO: 6593523 - DNA, 21 bp, Homo sapiens
tttctattaatatcaactctg

SEQ ID NO: 6593524 - DNA, 20 bp, Homo sapiens
tttctattatggaaaactgt

SEQ ID NO: 6593525 - DNA, 19 bp, Homo sapiens
aatgtagaatattcagaca

SEQ ID NO: 6593526 - DNA, 13 bp, Homo sapiens
aatgtagacagat

SEQ ID NO: 6593527 - DNA, 18 bp, Homo sapiens
aatgtagataagtgttct

SEQ ID NO: 6593528 - DNA, 12 bp, Homo sapiens
aatgtagatttt

SEQ ID NO: 6593529 - DNA, 12 bp, Homo sapiens
aatgtagcactt

SEQ ID NO: 6593530 - DNA, 22 bp, Homo sapiens
aatgtagccctctccaaatcaa

SEQ ID NO: 6593531 - DNA, 13 bp, Homo sapiens
aatgtagcttcca

SEQ ID NO: 6593532 - DNA, 14 bp, Homo sapiens
aatgtagcttccac

SEQ ID NO: 6593533 - DNA, 21 bp, Homo sapiens
aatgtaggccaaatttgtagt

SEQ ID NO: 6593534 - DNA, 18 bp, Homo sapiens
aatgtaggccttaactat

SEQ ID NO: 6593535 - DNA, 15 bp, Homo sapiens
aatgtagggcagaat

SEQ ID NO: 6593536 - DNA, 17 bp, Homo sapiens
aatgtagggcagaatag

SEQ ID NO: 6593537 - DNA, 20 bp, Homo sapiens
aatgtaggggaaagtttcat

SEQ ID NO: 6593538 - DNA, 20 bp, Homo sapiens
aatgtaggtatgaataagtt

SEQ ID NO: 6593539 - DNA, 18 bp, Homo sapiens
aatgtaggtcctcagaaa

SEQ ID NO: 6593540 - DNA, 23 bp, Homo sapiens
aatgtaggtttagatatataact

SEQ ID NO: 6593541 - DNA, 22 bp, Homo sapiens
aatgtagtgaagggatgtatca

SEQ ID NO: 6593542 - DNA, 14 bp, Homo sapiens
aatgtagtggagag

SEQ ID NO: 6593543 - DNA, 23 bp, Homo sapiens
aatgtagtggagagatcatagct

SEQ ID NO: 6593544 - DNA, 15 bp, Homo sapiens
aatgtagttgatgta

SEQ ID NO: 6593545 - DNA, 16 bp, Homo sapiens
aatgtagttgatgtat

SEQ ID NO: 6593546 - DNA, 18 bp, Homo sapiens
aatgtagttgatgtatcc

SEQ ID NO: 6593547 - DNA, 15 bp, Homo sapiens
aatgtagttgtcaca

SEQ ID NO: 6593548 - DNA, 18 bp, Homo sapiens
aatgtagtttgaggaaat

SEQ ID NO: 6593549 - DNA, 20 bp, Homo sapiens
aatgtagtttgaggaaattt

SEQ ID NO: 6593550 - DNA, 18 bp, Homo sapiens
aatgtagttttaaataaa

SEQ ID NO: 6593551 - DNA, 19 bp, Homo sapiens
aatgtataaaaattatcaa

SEQ ID NO: 6593552 - DNA, 22 bp, Homo sapiens
aatgtataaaaattatcaaaaa

SEQ ID NO: 6593553 - DNA, 21 bp, Homo sapiens
aatgtataaactttagagtag

SEQ ID NO: 6593554 - DNA, 14 bp, Homo sapiens
aatgtataaagatt

SEQ ID NO: 6593555 - DNA, 20 bp, Homo sapiens
aatgtataaagattgtactt

SEQ ID NO: 6593556 - DNA, 13 bp, Homo sapiens
aatgtataaatat

SEQ ID NO: 6593557 - DNA, 20 bp, Homo sapiens
aatgtataattaacttaact

SEQ ID NO: 6593558 - DNA, 18 bp, Homo sapiens
aatgtatacaatgcactt

SEQ ID NO: 6593559 - DNA, 21 bp, Homo sapiens
aatgtatacaatgcactttta

SEQ ID NO: 6593560 - DNA, 19 bp, Homo sapiens
aatgtatacaccaagtggt

SEQ ID NO: 6593561 - DNA, 13 bp, Homo sapiens
aatgtatacctgt

SEQ ID NO: 6593562 - DNA, 17 bp, Homo sapiens
aatgtatacctgtaact

SEQ ID NO: 6593563 - DNA, 19 bp, Homo sapiens
aatgtatactatagtacca

SEQ ID NO: 6593564 - DNA, 13 bp, Homo sapiens
aatgtatacttga

SEQ ID NO: 6593565 - DNA, 21 bp, Homo sapiens
aatgtatagtatttgaaaaca

SEQ ID NO: 6593566 - DNA, 22 bp, Homo sapiens
aatgtatagtatttgaaaacag

SEQ ID NO: 6593567 - DNA, 14 bp, Homo sapiens
aatgtatataaaaa

SEQ ID NO: 6593568 - DNA, 14 bp, Homo sapiens
aatgtatatacaca

SEQ ID NO: 6593569 - DNA, 12 bp, Homo sapiens
aatgtatatatt

SEQ ID NO: 6593570 - DNA, 20 bp, Homo sapiens
aatgtatatatttagtgctg

SEQ ID NO: 6593571 - DNA, 14 bp, Homo sapiens
aatgtatatgcact

SEQ ID NO: 6593572 - DNA, 21 bp, Homo sapiens
aatgtatatgttttgtgggaa

SEQ ID NO: 6593573 - DNA, 16 bp, Homo sapiens
aatgtatatttaactt

SEQ ID NO: 6593574 - DNA, 16 bp, Homo sapiens
aatgtatcaaactgta

SEQ ID NO: 6593575 - DNA, 18 bp, Homo sapiens
aatgtatcatagaaatgt

SEQ ID NO: 6593576 - DNA, 19 bp, Homo sapiens
aatgtatcatagaaatgta

SEQ ID NO: 6593577 - DNA, 21 bp, Homo sapiens
aatgtatcatttttgtgcaca

SEQ ID NO: 6593578 - DNA, 16 bp, Homo sapiens
aatgtatccagaggaa

SEQ ID NO: 6593579 - DNA, 19 bp, Homo sapiens
aatgtatccagaggaattg

SEQ ID NO: 6593580 - DNA, 22 bp, Homo sapiens
aatgtatcccttctcacagcac

SEQ ID NO: 6593581 - DNA, 21 bp, Homo sapiens
aatgtatctagtggtctgatt

SEQ ID NO: 6593582 - DNA, 19 bp, Homo sapiens
aatgtatctatttgtacaa

SEQ ID NO: 6593583 - DNA, 20 bp, Homo sapiens
aatgtatctatttgtacaat

SEQ ID NO: 6593584 - DNA, 15 bp, Homo sapiens
aatgtatctgcatat

SEQ ID NO: 6593585 - DNA, 13 bp, Homo sapiens
aatgtatctgtga

SEQ ID NO: 6593586 - DNA, 14 bp, Homo sapiens
aatgtatctgtgaa

SEQ ID NO: 6593587 - DNA, 10 bp, Homo sapiens
aatgtatctt

SEQ ID NO: 6593588 - DNA, 16 bp, Homo sapiens
aatgtatcttattcac

SEQ ID NO: 6593589 - DNA, 20 bp, Homo sapiens
aatgtatcttatttatatat

SEQ ID NO: 6593590 - DNA, 20 bp, Homo sapiens
aatgtatctttattaaaaca

SEQ ID NO: 6593591 - DNA, 16 bp, Homo sapiens
aatgtatgaattttgt

SEQ ID NO: 6593592 - DNA, 20 bp, Homo sapiens
aatgtatgaattttgtaagt

SEQ ID NO: 6593593 - DNA, 19 bp, Homo sapiens
aatgtatgcatgttgtcta

SEQ ID NO: 6593594 - DNA, 21 bp, Homo sapiens
aatgtatgctatcctcttatt

SEQ ID NO: 6593595 - DNA, 22 bp, Homo sapiens
aatgtatgctatcctcttattc

SEQ ID NO: 6593596 - DNA, 16 bp, Homo sapiens
aatgtatgcttcatac

SEQ ID NO: 6593597 - DNA, 17 bp, Homo sapiens
aatgtatgcttcataca

SEQ ID NO: 6593598 - DNA, 18 bp, Homo sapiens
aatgtatgcttcatacag

SEQ ID NO: 6593599 - DNA, 15 bp, Homo sapiens
aatgtatgtaaatag

SEQ ID NO: 6593600 - DNA, 15 bp, Homo sapiens
aatgtatgtacaata

SEQ ID NO: 6593601 - DNA, 13 bp, Homo sapiens
aatgtatgtatca

SEQ ID NO: 6593602 - DNA, 19 bp, Homo sapiens
aatgtatgtatcatcagtt

SEQ ID NO: 6593603 - DNA, 19 bp, Homo sapiens
aatgtatgtgaaagtgtaa

SEQ ID NO: 6593604 - DNA, 20 bp, Homo sapiens
aatgtatgtgaaagtgtaaa

SEQ ID NO: 6593605 - DNA, 19 bp, Homo sapiens
aatgtatgtgtgtctattt

SEQ ID NO: 6593606 - DNA, 23 bp, Homo sapiens
aatgtattaagcccacagtatat

SEQ ID NO: 6593607 - DNA, 20 bp, Homo sapiens
aatgtattaatatctccata

SEQ ID NO: 6593608 - DNA, 17 bp, Homo sapiens
aatgtattaatctgttt

SEQ ID NO: 6593609 - DNA, 22 bp, Homo sapiens
aatgtattacagtggggaatga

SEQ ID NO: 6593610 - DNA, 15 bp, Homo sapiens
aatgtattatcctgt

SEQ ID NO: 6593611 - DNA, 19 bp, Homo sapiens
aatgtattatcctgtgtgt

SEQ ID NO: 6593612 - DNA, 16 bp, Homo sapiens
aatgtattatgagcca

SEQ ID NO: 6593613 - DNA, 22 bp, Homo sapiens
aatgtattatgtcctgtgagat

SEQ ID NO: 6593614 - DNA, 14 bp, Homo sapiens
aatgtattattctg

SEQ ID NO: 6593615 - DNA, 16 bp, Homo sapiens
aatgtattattctgca

SEQ ID NO: 6593616 - DNA, 14 bp, Homo sapiens
aatgtattcaagca

SEQ ID NO: 6593617 - DNA, 21 bp, Homo sapiens
aatgtattcctgaaaagctgc

SEQ ID NO: 6593618 - DNA, 16 bp, Homo sapiens
aatgtattcctttaaa

SEQ ID NO: 6593619 - DNA, 20 bp, Homo sapiens
aatgtattgttctcatgtaa

SEQ ID NO: 6593620 - DNA, 17 bp, Homo sapiens
aatgtatttaactcaga

SEQ ID NO: 6593621 - DNA, 14 bp, Homo sapiens
aatgtatttagcta

SEQ ID NO: 6593622 - DNA, 21 bp, Homo sapiens
aatgtatttatatgttaattt

SEQ ID NO: 6593623 - DNA, 17 bp, Homo sapiens
aatgtatttatgtgtat

SEQ ID NO: 6593624 - DNA, 21 bp, Homo sapiens
aatgtatttatgtgtatattt

SEQ ID NO: 6593625 - DNA, 19 bp, Homo sapiens
aatgtatttgatttataag

SEQ ID NO: 6593626 - DNA, 23 bp, Homo sapiens
aatgtatttgtgcacatgtacat

SEQ ID NO: 6593627 - DNA, 13 bp, Homo sapiens
aatgtatttgttc

SEQ ID NO: 6593628 - DNA, 17 bp, Homo sapiens
aatgtatttgttcatgt

SEQ ID NO: 6593629 - DNA, 22 bp, Homo sapiens
aatgtattttaactatttttgt

SEQ ID NO: 6593630 - DNA, 13 bp, Homo sapiens
aatgtattttatg

SEQ ID NO: 6593631 - DNA, 15 bp, Homo sapiens
aatgtattttatgtt

SEQ ID NO: 6593632 - DNA, 13 bp, Homo sapiens
aatgtattttgaa

SEQ ID NO: 6593633 - DNA, 17 bp, Homo sapiens
aatgtattttgaaaaca

SEQ ID NO: 6593634 - DNA, 22 bp, Homo sapiens
aatgtattttgaagaatattta

SEQ ID NO: 6593635 - DNA, 16 bp, Homo sapiens
aatgtatttttcaaaa

SEQ ID NO: 6593636 - DNA, 13 bp, Homo sapiens
aatgtcaaaatca

SEQ ID NO: 6593637 - DNA, 16 bp, Homo sapiens
aatgtcaaacagtgcc

SEQ ID NO: 6593638 - DNA, 18 bp, Homo sapiens
aatgtcaaatcaaggcaa

SEQ ID NO: 6593639 - DNA, 13 bp, Homo sapiens
aatgtcaaatgaa

SEQ ID NO: 6593640 - DNA, 15 bp, Homo sapiens
aatgtcaaatgtgaa

SEQ ID NO: 6593641 - DNA, 14 bp, Homo sapiens
aatgtcaacctttg

SEQ ID NO: 6593642 - DNA, 14 bp, Homo sapiens
aatgtcaagaaatt

SEQ ID NO: 6593643 - DNA, 15 bp, Homo sapiens
aatgtcaagagtatt

SEQ ID NO: 6593644 - DNA, 13 bp, Homo sapiens
aatgtcaataaat

SEQ ID NO: 6593645 - DNA, 24 bp, Homo sapiens
aatgtcaatagcaaatgaaggatg

SEQ ID NO: 6593646 - DNA, 18 bp, Homo sapiens
aatgtcacaacctctctg

SEQ ID NO: 6593647 - DNA, 21 bp, Homo sapiens
aatgtcacacttgtttcttgt

SEQ ID NO: 6593648 - DNA, 13 bp, Homo sapiens
aatgtcacaggca

SEQ ID NO: 6593649 - DNA, 19 bp, Homo sapiens
aatgtcacaggcaggtcca

SEQ ID NO: 6593650 - DNA, 19 bp, Homo sapiens
aatgtcacagtaatgcaag

SEQ ID NO: 6593651 - DNA, 17 bp, Homo sapiens
aatgtcacattctattt

SEQ ID NO: 6593652 - DNA, 18 bp, Homo sapiens
aatgtcacatttgaattc

SEQ ID NO: 6593653 - DNA, 16 bp, Homo sapiens
aatgtcaccaccttcc

SEQ ID NO: 6593654 - DNA, 20 bp, Homo sapiens
aatgtcacggctactctata

SEQ ID NO: 6593655 - DNA, 20 bp, Homo sapiens
aatgtcacgtactgtctgat

SEQ ID NO: 6593656 - DNA, 10 bp, Homo sapiens
aatgtcactg

SEQ ID NO: 6593657 - DNA, 17 bp, Homo sapiens
aatgtcactgaagtgat

SEQ ID NO: 6593658 - DNA, 12 bp, Homo sapiens
aatgtcactgcc

SEQ ID NO: 6593659 - DNA, 17 bp, Homo sapiens
aatgtcactgtagtttt

SEQ ID NO: 6593660 - DNA, 19 bp, Homo sapiens
aatgtcactgtagttttga

SEQ ID NO: 6593661 - DNA, 15 bp, Homo sapiens
aatgtcactgttata

SEQ ID NO: 6593662 - DNA, 19 bp, Homo sapiens
aatgtcactgttataaatt

SEQ ID NO: 6593663 - DNA, 21 bp, Homo sapiens
aatgtcactgttataaatttt

SEQ ID NO: 6593664 - DNA, 22 bp, Homo sapiens
aatgtcactgttataaattttg

SEQ ID NO: 6593665 - DNA, 17 bp, Homo sapiens
aatgtcacttaaaggct

SEQ ID NO: 6593666 - DNA, 19 bp, Homo sapiens
aatgtcactttttgaggca

SEQ ID NO: 6593667 - DNA, 23 bp, Homo sapiens
aatgtcagaaactcgatgaatgt

SEQ ID NO: 6593668 - DNA, 12 bp, Homo sapiens
aatgtcagaaca

SEQ ID NO: 6593669 - DNA, 21 bp, Homo sapiens
aatgtcagactttgctgcatt

SEQ ID NO: 6593670 - DNA, 20 bp, Homo sapiens
aatgtcagagctatgttccc

SEQ ID NO: 6593671 - DNA, 23 bp, Homo sapiens
aatgtcagagctatgttccctcc

SEQ ID NO: 6593672 - DNA, 16 bp, Homo sapiens
aatgtcagatacaatg

SEQ ID NO: 6593673 - DNA, 19 bp, Homo sapiens
aatgtcagatgcgtgccca

SEQ ID NO: 6593674 - DNA, 14 bp, Homo sapiens
aatgtcagatttct

SEQ ID NO: 6593675 - DNA, 17 bp, Homo sapiens
aatgtcagatttctggt

SEQ ID NO: 6593676 - DNA, 13 bp, Homo sapiens
aatgtcagccttt

SEQ ID NO: 6593677 - DNA, 22 bp, Homo sapiens
aatgtcagcctttgttaacctt

SEQ ID NO: 6593678 - DNA, 19 bp, Homo sapiens
aatgtcaggaatttaagaa

SEQ ID NO: 6593679 - DNA, 14 bp, Homo sapiens
aatgtcagtagtgc

SEQ ID NO: 6593680 - DNA, 13 bp, Homo sapiens
aatgtcagtattt

SEQ ID NO: 6593681 - DNA, 16 bp, Homo sapiens
aatgtcagtatttcag

SEQ ID NO: 6593682 - DNA, 16 bp, Homo sapiens
aatgtcagtgtgactg

SEQ ID NO: 6593683 - DNA, 23 bp, Homo sapiens
aatgtcagttctgatatggaagc

SEQ ID NO: 6593684 - DNA, 15 bp, Homo sapiens
aatgtcatatactgc

SEQ ID NO: 6593685 - DNA, 16 bp, Homo sapiens
aatgtcatgctgcctt

SEQ ID NO: 6593686 - DNA, 19 bp, Homo sapiens
aatgtcatggccttgaaac

SEQ ID NO: 6593687 - DNA, 19 bp, Homo sapiens
aatgtcattaaaataaata

SEQ ID NO: 6593688 - DNA, 22 bp, Homo sapiens
aatgtcattacatagaacactt

SEQ ID NO: 6593689 - DNA, 20 bp, Homo sapiens
aatgtcattgctaaaaaata

SEQ ID NO: 6593690 - DNA, 15 bp, Homo sapiens
aatgtcattgtctac

SEQ ID NO: 6593691 - DNA, 23 bp, Homo sapiens
aatgtcatttcatacaaattttc

SEQ ID NO: 6593692 - DNA, 17 bp, Homo sapiens
aatgtcatttgctaatg

SEQ ID NO: 6593693 - DNA, 21 bp, Homo sapiens
aatgtccaagcatcagcaaga

SEQ ID NO: 6593694 - DNA, 18 bp, Homo sapiens
aatgtccacttaaaatac

SEQ ID NO: 6593695 - DNA, 17 bp, Homo sapiens
aatgtccaggtcacagg

SEQ ID NO: 6593696 - DNA, 15 bp, Homo sapiens
aatgtccatatgcta

SEQ ID NO: 6593697 - DNA, 22 bp, Homo sapiens
aatgtcccaaataaatttataa

SEQ ID NO: 6593698 - DNA, 13 bp, Homo sapiens
aatgtcccagagg

SEQ ID NO: 6593699 - DNA, 17 bp, Homo sapiens
aatgtccccattctata

SEQ ID NO: 6593700 - DNA, 23 bp, Homo sapiens
aatgtccccattctataaattca

SEQ ID NO: 6593701 - DNA, 23 bp, Homo sapiens
aatgtcccccatcatgtggccca

SEQ ID NO: 6593702 - DNA, 22 bp, Homo sapiens
aatgtcccctcaaactcattgc

SEQ ID NO: 6593703 - DNA, 20 bp, Homo sapiens
tttctattcagcaaaagtta

SEQ ID NO: 6593704 - DNA, 13 bp, Homo sapiens
tttctattcctta

SEQ ID NO: 6593705 - DNA, 18 bp, Homo sapiens
tttctattccttctggcc

SEQ ID NO: 6593706 - DNA, 19 bp, Homo sapiens
tttctattccttctggcct

SEQ ID NO: 6593707 - DNA, 13 bp, Homo sapiens
tttctattgtaca

SEQ ID NO: 6593708 - DNA, 22 bp, Homo sapiens
tttctattgttaaacaaatgat

SEQ ID NO: 6593709 - DNA, 13 bp, Homo sapiens
tttctattgttac

SEQ ID NO: 6593710 - DNA, 15 bp, Homo sapiens
tttctatttacctcc

SEQ ID NO: 6593711 - DNA, 16 bp, Homo sapiens
tttctatttagacact

SEQ ID NO: 6593712 - DNA, 17 bp, Homo sapiens
tttctatttagacacta

SEQ ID NO: 6593713 - DNA, 18 bp, Homo sapiens
tttctatttagttattta

SEQ ID NO: 6593714 - DNA, 16 bp, Homo sapiens
tttctatttcactgga

SEQ ID NO: 6593715 - DNA, 19 bp, Homo sapiens
tttctatttcactggagca

SEQ ID NO: 6593716 - DNA, 20 bp, Homo sapiens
tttctatttcttttttaagt

SEQ ID NO: 6593717 - DNA, 12 bp, Homo sapiens
tttctattttac

SEQ ID NO: 6593718 - DNA, 15 bp, Homo sapiens
tttctattttcacaa

SEQ ID NO: 6593719 - DNA, 13 bp, Homo sapiens
tttctattttgca

SEQ ID NO: 6593720 - DNA, 13 bp, Homo sapiens
tttctatttttat

SEQ ID NO: 6593721 - DNA, 22 bp, Homo sapiens
tttctcaaaagaggttacttta

SEQ ID NO: 6593722 - DNA, 13 bp, Homo sapiens
tttctcaaaagca

SEQ ID NO: 6593723 - DNA, 14 bp, Homo sapiens
tttctcaaaagcat

SEQ ID NO: 6593724 - DNA, 14 bp, Homo sapiens
tttctcaaagaaat

SEQ ID NO: 6593725 - DNA, 16 bp, Homo sapiens
tttctcaaagttttga

SEQ ID NO: 6593726 - DNA, 12 bp, Homo sapiens
tttctcaaataa

SEQ ID NO: 6593727 - DNA, 22 bp, Homo sapiens
tttctcaacaaagcacagtgtt

SEQ ID NO: 6593728 - DNA, 21 bp, Homo sapiens
tttctcaactgggtccagaag

SEQ ID NO: 6593729 - DNA, 23 bp, Homo sapiens
tttctcaatagttcttaaaatta

SEQ ID NO: 6593730 - DNA, 14 bp, Homo sapiens
tttctcaatctttt

SEQ ID NO: 6593731 - DNA, 22 bp, Homo sapiens
tttctcacaaaaaggcaaatat

SEQ ID NO: 6593732 - DNA, 23 bp, Homo sapiens
tttctcaccgcagtcgtcgcaca

SEQ ID NO: 6593733 - DNA, 21 bp, Homo sapiens
tttctcactatatatatttct

SEQ ID NO: 6593734 - DNA, 24 bp, Homo sapiens
tttctcactccctttgtggacttt

SEQ ID NO: 6593735 - DNA, 16 bp, Homo sapiens
tttctcagaagtactt

SEQ ID NO: 6593736 - DNA, 19 bp, Homo sapiens
tttctcagaatccaaagat

SEQ ID NO: 6593737 - DNA, 17 bp, Homo sapiens
tttctcagatccttgtt

SEQ ID NO: 6593738 - DNA, 20 bp, Homo sapiens
tttctcagatccttgtttca

SEQ ID NO: 6593739 - DNA, 23 bp, Homo sapiens
tttctcagatccttgtttcaaac

SEQ ID NO: 6593740 - DNA, 22 bp, Homo sapiens
tttctcagcgggagtctcctca

SEQ ID NO: 6593741 - DNA, 15 bp, Homo sapiens
tttctcagctcccat

SEQ ID NO: 6593742 - DNA, 20 bp, Homo sapiens
tttctcaggagcttcaatga

SEQ ID NO: 6593743 - DNA, 20 bp, Homo sapiens
tttctcaggctaggccagca

SEQ ID NO: 6593744 - DNA, 17 bp, Homo sapiens
tttctcaggcttctcat

SEQ ID NO: 6593745 - DNA, 18 bp, Homo sapiens
tttctcagtcctaatttg

SEQ ID NO: 6593746 - DNA, 16 bp, Homo sapiens
tttctcagtggcttct

SEQ ID NO: 6593747 - DNA, 20 bp, Homo sapiens
tttctcagtgttggtatatt

SEQ ID NO: 6593748 - DNA, 15 bp, Homo sapiens
tttctcatatttgag

SEQ ID NO: 6593749 - DNA, 14 bp, Homo sapiens
tttctcatgaagct

SEQ ID NO: 6593750 - DNA, 15 bp, Homo sapiens
tttctcatgcataga

SEQ ID NO: 6593751 - DNA, 17 bp, Homo sapiens
tttctcatgcttcttct

SEQ ID NO: 6593752 - DNA, 10 bp, Homo sapiens
tttctcatgt

SEQ ID NO: 6593753 - DNA, 21 bp, Homo sapiens
tttctcatgtagaacaagaaa

SEQ ID NO: 6593754 - DNA, 15 bp, Homo sapiens
tttctcatgtatctt

SEQ ID NO: 6593755 - DNA, 12 bp, Homo sapiens
tttctcatgtgc

SEQ ID NO: 6593756 - DNA, 17 bp, Homo sapiens
tttctcatgtgctttgt

SEQ ID NO: 6593757 - DNA, 13 bp, Homo sapiens
tttctcatgttga

SEQ ID NO: 6593758 - DNA, 22 bp, Homo sapiens
tttctcatgttgaagctttaag

SEQ ID NO: 6593759 - DNA, 23 bp, Homo sapiens
tttctcatgttgaagctttaaga

SEQ ID NO: 6593760 - DNA, 13 bp, Homo sapiens
tttctcattaaac

SEQ ID NO: 6593761 - DNA, 16 bp, Homo sapiens
tttctcatttgaaatg

SEQ ID NO: 6593762 - DNA, 19 bp, Homo sapiens
tttctcatttgaaatgttt

SEQ ID NO: 6593763 - DNA, 20 bp, Homo sapiens
tttctccaacttggtctttc

SEQ ID NO: 6593764 - DNA, 19 bp, Homo sapiens
tttctccacaacactgtgt

SEQ ID NO: 6593765 - DNA, 11 bp, Homo sapiens
tttctccacct

SEQ ID NO: 6593766 - DNA, 19 bp, Homo sapiens
tttctccacttcattttta

SEQ ID NO: 6593767 - DNA, 18 bp, Homo sapiens
tttctccagccagcaatg

SEQ ID NO: 6593768 - DNA, 19 bp, Homo sapiens
tttctccagcccatgctgg

SEQ ID NO: 6593769 - DNA, 13 bp, Homo sapiens
tttctccagccct

SEQ ID NO: 6593770 - DNA, 12 bp, Homo sapiens
tttctccagctg

SEQ ID NO: 6593771 - DNA, 11 bp, Homo sapiens
tttctccaggc

SEQ ID NO: 6593772 - DNA, 11 bp, Homo sapiens
tttctccagtc

SEQ ID NO: 6593773 - DNA, 13 bp, Homo sapiens
tttctccatatca

SEQ ID NO: 6593774 - DNA, 19 bp, Homo sapiens
tttctccatcccctccctg

SEQ ID NO: 6593775 - DNA, 22 bp, Homo sapiens
tttctccatcccctccctgcct

SEQ ID NO: 6593776 - DNA, 23 bp, Homo sapiens
tttctccatctttatagaaggaa

SEQ ID NO: 6593777 - DNA, 10 bp, Homo sapiens
tttctccatg

SEQ ID NO: 6593778 - DNA, 17 bp, Homo sapiens
tttctccatgtctgtag

SEQ ID NO: 6593779 - DNA, 19 bp, Homo sapiens
tttctccatttatttaaaa

SEQ ID NO: 6593780 - DNA, 19 bp, Homo sapiens
tttctccatttgtcatcgt

SEQ ID NO: 6593781 - DNA, 16 bp, Homo sapiens
tttctcccaagaaacc

SEQ ID NO: 6593782 - DNA, 17 bp, Homo sapiens
tttctcccagaaggctg

SEQ ID NO: 6593783 - DNA, 17 bp, Homo sapiens
tttctcccagtatgttt

SEQ ID NO: 6593784 - DNA, 18 bp, Homo sapiens
tttctcccagtcatttaa

SEQ ID NO: 6593785 - DNA, 23 bp, Homo sapiens
tttctccccaatgagacttgcct

SEQ ID NO: 6593786 - DNA, 23 bp, Homo sapiens
tttctccccacgatgatatctat

SEQ ID NO: 6593787 - DNA, 20 bp, Homo sapiens
tttctccccatccccttcct

SEQ ID NO: 6593788 - DNA, 23 bp, Homo sapiens
tttctccccatccccttcctaaa

SEQ ID NO: 6593789 - DNA, 21 bp, Homo sapiens
tttctccccatggtagtttaa

SEQ ID NO: 6593790 - DNA, 21 bp, Homo sapiens
tttctcccccgacactgctgc

SEQ ID NO: 6593791 - DNA, 13 bp, Homo sapiens
tttctcccctgcc

SEQ ID NO: 6593792 - DNA, 16 bp, Homo sapiens
tttctcccctgccccc

SEQ ID NO: 6593793 - DNA, 23 bp, Homo sapiens
tttctcccctgcccccaggactg

SEQ ID NO: 6593794 - DNA, 17 bp, Homo sapiens
tttctccctaaactgta

SEQ ID NO: 6593795 - DNA, 17 bp, Homo sapiens
tttctccctagaaacaa

SEQ ID NO: 6593796 - DNA, 17 bp, Homo sapiens
tttctccctccttcctt

SEQ ID NO: 6593797 - DNA, 20 bp, Homo sapiens
tttctccctctcactgtctg

SEQ ID NO: 6593798 - DNA, 21 bp, Homo sapiens
tttctccctctcactgtctga

SEQ ID NO: 6593799 - DNA, 23 bp, Homo sapiens
tttctccctctcatgtccctcca

SEQ ID NO: 6593800 - DNA, 20 bp, Homo sapiens
tttctccctggatttttacc

SEQ ID NO: 6593801 - DNA, 22 bp, Homo sapiens
tttctccctggatttttaccag

SEQ ID NO: 6593802 - DNA, 20 bp, Homo sapiens
tttctccctttatgtatctc

SEQ ID NO: 6593803 - DNA, 19 bp, Homo sapiens
tttctcctactttacactc

SEQ ID NO: 6593804 - DNA, 13 bp, Homo sapiens
tttctcctatctt

SEQ ID NO: 6593805 - DNA, 14 bp, Homo sapiens
tttctcctcagaag

SEQ ID NO: 6593806 - DNA, 15 bp, Homo sapiens
tttctcctcagaagt

SEQ ID NO: 6593807 - DNA, 16 bp, Homo sapiens
tttctcctcagaagtg

SEQ ID NO: 6593808 - DNA, 15 bp, Homo sapiens
tttctcctcatttaa

SEQ ID NO: 6593809 - DNA, 13 bp, Homo sapiens
tttctcctcccca

SEQ ID NO: 6593810 - DNA, 17 bp, Homo sapiens
tttctcctccccacctg

SEQ ID NO: 6593811 - DNA, 15 bp, Homo sapiens
tttctcctcccttcc

SEQ ID NO: 6593812 - DNA, 13 bp, Homo sapiens
tttctcctctccc

SEQ ID NO: 6593813 - DNA, 12 bp, Homo sapiens
tttctcctcttt

SEQ ID NO: 6593814 - DNA, 12 bp, Homo sapiens
tttctcctgcag

SEQ ID NO: 6593815 - DNA, 11 bp, Homo sapiens
tttctcctgcc

SEQ ID NO: 6593816 - DNA, 23 bp, Homo sapiens
tttctcctggaaaacctcagcat

SEQ ID NO: 6593817 - DNA, 11 bp, Homo sapiens
tttctcctggc

SEQ ID NO: 6593818 - DNA, 23 bp, Homo sapiens
tttctcctgggcccgctttgcct

SEQ ID NO: 6593819 - DNA, 11 bp, Homo sapiens
tttctcctggt

SEQ ID NO: 6593820 - DNA, 14 bp, Homo sapiens
tttctcctggtgtt

SEQ ID NO: 6593821 - DNA, 21 bp, Homo sapiens
tttctcctggtgtttttctct

SEQ ID NO: 6593822 - DNA, 23 bp, Homo sapiens
tttctcctggtgtttttctctct

SEQ ID NO: 6593823 - DNA, 15 bp, Homo sapiens
tttctcctgtgggaa

SEQ ID NO: 6593824 - DNA, 20 bp, Homo sapiens
tttctccttagtcttctcat

SEQ ID NO: 6593825 - DNA, 16 bp, Homo sapiens
tttctccttcacagct

SEQ ID NO: 6593826 - DNA, 11 bp, Homo sapiens
tttctccttcc

SEQ ID NO: 6593827 - DNA, 16 bp, Homo sapiens
tttctccttggtttgc

SEQ ID NO: 6593828 - DNA, 15 bp, Homo sapiens
tttctcctttcacca

SEQ ID NO: 6593829 - DNA, 23 bp, Homo sapiens
tttctcctttcaccaccccctcc

SEQ ID NO: 6593830 - DNA, 15 bp, Homo sapiens
tttctcctttgcaat

SEQ ID NO: 6593831 - DNA, 15 bp, Homo sapiens
tttctccttttccta

SEQ ID NO: 6593832 - DNA, 16 bp, Homo sapiens
tttctcgacagatgat

SEQ ID NO: 6593833 - DNA, 17 bp, Homo sapiens
tttctcgattttatctt

SEQ ID NO: 6593834 - DNA, 16 bp, Homo sapiens
tttctcgtccccctcc

SEQ ID NO: 6593835 - DNA, 18 bp, Homo sapiens
tttctctaaccctatcct

SEQ ID NO: 6593836 - DNA, 14 bp, Homo sapiens
tttctctacactaa

SEQ ID NO: 6593837 - DNA, 16 bp, Homo sapiens
tttctctagaggctgg

SEQ ID NO: 6593838 - DNA, 17 bp, Homo sapiens
tttctctatgaaaagca

SEQ ID NO: 6593839 - DNA, 20 bp, Homo sapiens
tttctctatgaaaagcaact

SEQ ID NO: 6593840 - DNA, 16 bp, Homo sapiens
tttctctattatgtta

SEQ ID NO: 6593841 - DNA, 19 bp, Homo sapiens
tttctctcagccttacatt

SEQ ID NO: 6593842 - DNA, 21 bp, Homo sapiens
tttctctcagccttacatttg

SEQ ID NO: 6593843 - DNA, 13 bp, Homo sapiens
tttctctcccata

SEQ ID NO: 6593844 - DNA, 19 bp, Homo sapiens
tttctctccttcttccctg

SEQ ID NO: 6593845 - DNA, 20 bp, Homo sapiens
tttctctccttcttccctgt

SEQ ID NO: 6593846 - DNA, 19 bp, Homo sapiens
tttctctctatttccccct

SEQ ID NO: 6593847 - DNA, 19 bp, Homo sapiens
tttctctctcactctcttc

SEQ ID NO: 6593848 - DNA, 12 bp, Homo sapiens
tttctctctcct

SEQ ID NO: 6593849 - DNA, 14 bp, Homo sapiens
tttctctctcctct

SEQ ID NO: 6593850 - DNA, 10 bp, Homo sapiens
tttctctctg

SEQ ID NO: 6593851 - DNA, 12 bp, Homo sapiens
tttctctctgga

SEQ ID NO: 6593852 - DNA, 18 bp, Homo sapiens
tttctctctggcttctct

SEQ ID NO: 6593853 - DNA, 20 bp, Homo sapiens
tttctctctggcttctctct

SEQ ID NO: 6593854 - DNA, 12 bp, Homo sapiens
tttctctctgtt

SEQ ID NO: 6593855 - DNA, 16 bp, Homo sapiens
tttctctcttccctca

SEQ ID NO: 6593856 - DNA, 20 bp, Homo sapiens
tttctctctttatacagctg

SEQ ID NO: 6593857 - DNA, 13 bp, Homo sapiens
tttctctctttct

SEQ ID NO: 6593858 - DNA, 14 bp, Homo sapiens
tttctctctttctt

SEQ ID NO: 6593859 - DNA, 18 bp, Homo sapiens
tttctctgaaaagcaaag

SEQ ID NO: 6593860 - DNA, 17 bp, Homo sapiens
tttctctgagaaccaaa

SEQ ID NO: 6593861 - DNA, 20 bp, Homo sapiens
tttctctgatttgcaaaaaa

SEQ ID NO: 6593862 - DNA, 21 bp, Homo sapiens
tttctctgcagaaactactga

SEQ ID NO: 6593863 - DNA, 22 bp, Homo sapiens
tttctctgcatttaaaaaaatc

SEQ ID NO: 6593864 - DNA, 14 bp, Homo sapiens
tttctctgcctctg

SEQ ID NO: 6593865 - DNA, 20 bp, Homo sapiens
tttctctgcctctgggcagc

SEQ ID NO: 6593866 - DNA, 14 bp, Homo sapiens
tttctctgcctggc

SEQ ID NO: 6593867 - DNA, 22 bp, Homo sapiens
tttctctgcctggcaacatctt

SEQ ID NO: 6593868 - DNA, 17 bp, Homo sapiens
tttctctgcttaccctt

SEQ ID NO: 6593869 - DNA, 14 bp, Homo sapiens
tttctctgcttcca

SEQ ID NO: 6593870 - DNA, 17 bp, Homo sapiens
tttctctgcttccagtt

SEQ ID NO: 6593871 - DNA, 16 bp, Homo sapiens
tttctctggcaaactt

SEQ ID NO: 6593872 - DNA, 20 bp, Homo sapiens
tttctctggtggtcttcctt

SEQ ID NO: 6593873 - DNA, 15 bp, Homo sapiens
tttctctgtactttt

SEQ ID NO: 6593874 - DNA, 11 bp, Homo sapiens
tttctctgtat

SEQ ID NO: 6593875 - DNA, 17 bp, Homo sapiens
tttctctgtgtttgttc

SEQ ID NO: 6593876 - DNA, 14 bp, Homo sapiens
tttctctgttgtaa

SEQ ID NO: 6593877 - DNA, 17 bp, Homo sapiens
tttctcttaacttaatt

SEQ ID NO: 6593878 - DNA, 13 bp, Homo sapiens
tttctcttaagct

SEQ ID NO: 6593879 - DNA, 18 bp, Homo sapiens
tttctcttaagctgccca

SEQ ID NO: 6593880 - DNA, 12 bp, Homo sapiens
tttctcttcata

SEQ ID NO: 6593881 - DNA, 20 bp, Homo sapiens
tttctcttccccttagaaac

SEQ ID NO: 6593882 - DNA, 20 bp, Homo sapiens
tttctcttccctccttccct

SEQ ID NO: 6593883 - DNA, 13 bp, Homo sapiens
tttctcttctccc

SEQ ID NO: 6593884 - DNA, 15 bp, Homo sapiens
tttctcttgagctgg

SEQ ID NO: 6593885 - DNA, 16 bp, Homo sapiens
tttctcttgagctggc

SEQ ID NO: 6593886 - DNA, 18 bp, Homo sapiens
tttctcttgagctggcct

SEQ ID NO: 6593887 - DNA, 14 bp, Homo sapiens
tttctcttgtcctt

SEQ ID NO: 6593888 - DNA, 13 bp, Homo sapiens
tttctcttgtctt

SEQ ID NO: 6593889 - DNA, 14 bp, Homo sapiens
tttctcttgtttaa

SEQ ID NO: 6593890 - DNA, 13 bp, Homo sapiens
tttctctttcagt

SEQ ID NO: 6593891 - DNA, 22 bp, Homo sapiens
tttctctttcctctaactcatt

SEQ ID NO: 6593892 - DNA, 15 bp, Homo sapiens
tttctctttgtctgc

SEQ ID NO: 6593893 - DNA, 15 bp, Homo sapiens
tttctctttgttctt

SEQ ID NO: 6593894 - DNA, 22 bp, Homo sapiens
tttctcttttcccctttcctgt

SEQ ID NO: 6593895 - DNA, 14 bp, Homo sapiens
tttctcttttcctt

SEQ ID NO: 6593896 - DNA, 13 bp, Homo sapiens
tttctcttttctt

SEQ ID NO: 6593897 - DNA, 13 bp, Homo sapiens
tttctcttttgct

SEQ ID NO: 6593898 - DNA, 18 bp, Homo sapiens
tttctcttttggtttctg

SEQ ID NO: 6593899 - DNA, 15 bp, Homo sapiens
tttctctttttagtt

SEQ ID NO: 6593900 - DNA, 16 bp, Homo sapiens
tttctctttttgatct

SEQ ID NO: 6593901 - DNA, 18 bp, Homo sapiens
tttctcttttttaaaaac

SEQ ID NO: 6593902 - DNA, 19 bp, Homo sapiens
tttctgaaaattaacactg

SEQ ID NO: 6593903 - DNA, 22 bp, Homo sapiens
tttctgaaaattccagaaagga

SEQ ID NO: 6593904 - DNA, 13 bp, Homo sapiens
tttctgaaaattt

SEQ ID NO: 6593905 - DNA, 13 bp, Homo sapiens
tttctgaaacaca

SEQ ID NO: 6593906 - DNA, 21 bp, Homo sapiens
tttctgaaactcccttgtgtt

SEQ ID NO: 6593907 - DNA, 18 bp, Homo sapiens
tttctgaaagtaaaacaa

SEQ ID NO: 6593908 - DNA, 20 bp, Homo sapiens
tttctgaaagttacccactg

SEQ ID NO: 6593909 - DNA, 14 bp, Homo sapiens
tttctgaaataaca

SEQ ID NO: 6593910 - DNA, 15 bp, Homo sapiens
tttctgaaatagtca

SEQ ID NO: 6593911 - DNA, 20 bp, Homo sapiens
tttctgaaatcgccgtgtta

SEQ ID NO: 6593912 - DNA, 17 bp, Homo sapiens
tttctgaaattcacaga

SEQ ID NO: 6593913 - DNA, 13 bp, Homo sapiens
tttctgaacaaaa

SEQ ID NO: 6593914 - DNA, 15 bp, Homo sapiens
tttctgaacagctgg

SEQ ID NO: 6593915 - DNA, 17 bp, Homo sapiens
tttctgaacagctggtg

SEQ ID NO: 6593916 - DNA, 14 bp, Homo sapiens
tttctgaactgtta

SEQ ID NO: 6593917 - DNA, 22 bp, Homo sapiens
tttctgaagaagttaattctta

SEQ ID NO: 6593918 - DNA, 14 bp, Homo sapiens
tttctgaagcctct

SEQ ID NO: 6593919 - DNA, 21 bp, Homo sapiens
tttctgaaggaagagaagaca

SEQ ID NO: 6593920 - DNA, 14 bp, Homo sapiens
tttctgaaggcttt

SEQ ID NO: 6593921 - DNA, 18 bp, Homo sapiens
tttctgaataaaaaagat

SEQ ID NO: 6593922 - DNA, 20 bp, Homo sapiens
tttctgaataaaaaagattc

SEQ ID NO: 6593923 - DNA, 21 bp, Homo sapiens
tttctgaataaaaaagattct

SEQ ID NO: 6593924 - DNA, 22 bp, Homo sapiens
tttctgaataaaaaagattcta

SEQ ID NO: 6593925 - DNA, 19 bp, Homo sapiens
tttctgacatcaaaacttg

SEQ ID NO: 6593926 - DNA, 20 bp, Homo sapiens
tttctgacatcagcacttta

SEQ ID NO: 6593927 - DNA, 24 bp, Homo sapiens
tttctgacatcagcactttaccag

SEQ ID NO: 6593928 - DNA, 20 bp, Homo sapiens
tttctgaccaatcactgagt

SEQ ID NO: 6593929 - DNA, 17 bp, Homo sapiens
tttctgacgaaggtcct

SEQ ID NO: 6593930 - DNA, 14 bp, Homo sapiens
tttctgactctaaa

SEQ ID NO: 6593931 - DNA, 14 bp, Homo sapiens
tttctgactcttat

SEQ ID NO: 6593932 - DNA, 19 bp, Homo sapiens
tttctgactgtccctgcca

SEQ ID NO: 6593933 - DNA, 21 bp, Homo sapiens
tttctgacttctagctgtctg

SEQ ID NO: 6593934 - DNA, 18 bp, Homo sapiens
tttctgagatttttgata

SEQ ID NO: 6593935 - DNA, 19 bp, Homo sapiens
tttctgagcttttcatgga

SEQ ID NO: 6593936 - DNA, 11 bp, Homo sapiens
tttctgaggag

SEQ ID NO: 6593937 - DNA, 16 bp, Homo sapiens
tttctgaggagaaaca

SEQ ID NO: 6593938 - DNA, 21 bp, Homo sapiens
tttctgagtagcatatataat

SEQ ID NO: 6593939 - DNA, 18 bp, Homo sapiens
tttctgagttttaccaaa

SEQ ID NO: 6593940 - DNA, 16 bp, Homo sapiens
tttctgataagacatg

SEQ ID NO: 6593941 - DNA, 17 bp, Homo sapiens
tttctgatcgtctcggc

SEQ ID NO: 6593942 - DNA, 23 bp, Homo sapiens
tttctgatctgattttttattca

SEQ ID NO: 6593943 - DNA, 17 bp, Homo sapiens
tttctgatgacataata

SEQ ID NO: 6593944 - DNA, 22 bp, Homo sapiens
tttctgatgacataataaagac

SEQ ID NO: 6593945 - DNA, 22 bp, Homo sapiens
tttctgatgggaggaaagtagc

SEQ ID NO: 6593946 - DNA, 18 bp, Homo sapiens
tttctgatggtataaaca

SEQ ID NO: 6593947 - DNA, 19 bp, Homo sapiens
tttctgatggtataaacag

SEQ ID NO: 6593948 - DNA, 18 bp, Homo sapiens
tttctgatgtattacatg

SEQ ID NO: 6593949 - DNA, 13 bp, Homo sapiens
tttctgattaata

SEQ ID NO: 6593950 - DNA, 18 bp, Homo sapiens
tttctgattagctttgtg

SEQ ID NO: 6593951 - DNA, 20 bp, Homo sapiens
tttctgattagctttgtgtt

SEQ ID NO: 6593952 - DNA, 20 bp, Homo sapiens
tttctgattataagacaatg

SEQ ID NO: 6593953 - DNA, 19 bp, Homo sapiens
tttctgattccatcctgtg

SEQ ID NO: 6593954 - DNA, 11 bp, Homo sapiens
tttctgattgt

SEQ ID NO: 6593955 - DNA, 15 bp, Homo sapiens
tttctgatttcataa

SEQ ID NO: 6593956 - DNA, 14 bp, Homo sapiens
tttctgcaaacaaa

SEQ ID NO: 6593957 - DNA, 20 bp, Homo sapiens
tttctgcaaacaaacacctt

SEQ ID NO: 6593958 - DNA, 18 bp, Homo sapiens
tttctgcacaataataag

SEQ ID NO: 6593959 - DNA, 12 bp, Homo sapiens
tttctgcacagc

SEQ ID NO: 6593960 - DNA, 13 bp, Homo sapiens
tttctgcacagct

SEQ ID NO: 6593961 - DNA, 21 bp, Homo sapiens
tttctgcacaggtctctgttt

SEQ ID NO: 6593962 - DNA, 17 bp, Homo sapiens
tttctgcactatatgca

SEQ ID NO: 6593963 - DNA, 14 bp, Homo sapiens
tttctgcagaaaca

SEQ ID NO: 6593964 - DNA, 13 bp, Homo sapiens
tttctgcagaaat

SEQ ID NO: 6593965 - DNA, 17 bp, Homo sapiens
tttctgcagaggcagca

SEQ ID NO: 6593966 - DNA, 13 bp, Homo sapiens
tttctgcagccct

SEQ ID NO: 6593967 - DNA, 15 bp, Homo sapiens
tttctgcagctgttt

SEQ ID NO: 6593968 - DNA, 17 bp, Homo sapiens
tttctgcatatgttgaa

SEQ ID NO: 6593969 - DNA, 20 bp, Homo sapiens
tttctgcatcagttcactgc

SEQ ID NO: 6593970 - DNA, 16 bp, Homo sapiens
tttctgcatctccact

SEQ ID NO: 6593971 - DNA, 22 bp, Homo sapiens
tttctgcatgaatatcatacaa

SEQ ID NO: 6593972 - DNA, 24 bp, Homo sapiens
tttctgcatgaccaaagtgataaa

SEQ ID NO: 6593973 - DNA, 20 bp, Homo sapiens
tttctgccatgatgtttaca

SEQ ID NO: 6593974 - DNA, 19 bp, Homo sapiens
tttctgcccaactttcatt

SEQ ID NO: 6593975 - DNA, 13 bp, Homo sapiens
tttctgccctggc

SEQ ID NO: 6593976 - DNA, 15 bp, Homo sapiens
tttctgccctggctg

SEQ ID NO: 6593977 - DNA, 16 bp, Homo sapiens
tttctgccgcagccct

SEQ ID NO: 6593978 - DNA, 16 bp, Homo sapiens
tttctgcctataaatt

SEQ ID NO: 6593979 - DNA, 16 bp, Homo sapiens
tttctgcctgagattc

SEQ ID NO: 6593980 - DNA, 14 bp, Homo sapiens
tttctgcctggagt

SEQ ID NO: 6593981 - DNA, 15 bp, Homo sapiens
tttctgcctttcccc

SEQ ID NO: 6593982 - DNA, 18 bp, Homo sapiens
tttctgctcagcttctcc

SEQ ID NO: 6593983 - DNA, 15 bp, Homo sapiens
tttctgctctgccat

SEQ ID NO: 6593984 - DNA, 21 bp, Homo sapiens
tttctgctgaattttcacatg

SEQ ID NO: 6593985 - DNA, 20 bp, Homo sapiens
tttctgctgtggtctataaa

SEQ ID NO: 6593986 - DNA, 22 bp, Homo sapiens
tttctgctgtttacaacatcac

SEQ ID NO: 6593987 - DNA, 10 bp, Homo sapiens
tttctgctta

SEQ ID NO: 6593988 - DNA, 16 bp, Homo sapiens
tttctgctttaaatta

SEQ ID NO: 6593989 - DNA, 16 bp, Homo sapiens
tttctggaaaatgctt

SEQ ID NO: 6593990 - DNA, 19 bp, Homo sapiens
tttctggaaaggaaacatt

SEQ ID NO: 6593991 - DNA, 11 bp, Homo sapiens
tttctggaaat

SEQ ID NO: 6593992 - DNA, 16 bp, Homo sapiens
tttctggaaatgttct

SEQ ID NO: 6593993 - DNA, 14 bp, Homo sapiens
tttctggaaatttt

SEQ ID NO: 6593994 - DNA, 20 bp, Homo sapiens
tttctggaaattttgtccat

SEQ ID NO: 6593995 - DNA, 11 bp, Homo sapiens
tttctggaaga

SEQ ID NO: 6593996 - DNA, 21 bp, Homo sapiens
tttctggaatacatgaaatat

SEQ ID NO: 6593997 - DNA, 15 bp, Homo sapiens
tttctggacattctc

SEQ ID NO: 6593998 - DNA, 11 bp, Homo sapiens
tttctggactg

SEQ ID NO: 6593999 - DNA, 11 bp, Homo sapiens
tttctggagtc

SEQ ID NO: 6594000 - DNA, 21 bp, Homo sapiens
tttctggcaaatattttgtca

SEQ ID NO: 6594001 - DNA, 17 bp, Homo sapiens
tttctggccaaaagcag

SEQ ID NO: 6594002 - DNA, 18 bp, Homo sapiens
tttctggctatgcatttg

SEQ ID NO: 6594003 - DNA, 13 bp, Homo sapiens
tttctggctcctg

SEQ ID NO: 6594004 - DNA, 14 bp, Homo sapiens
tttctggctcctgt

SEQ ID NO: 6594005 - DNA, 14 bp, Homo sapiens
tttctggctgggga

SEQ ID NO: 6594006 - DNA, 15 bp, Homo sapiens
tttctggctggggat

SEQ ID NO: 6594007 - DNA, 16 bp, Homo sapiens
tttctggctggggatg

SEQ ID NO: 6594008 - DNA, 15 bp, Homo sapiens
tttctggcttttaag

SEQ ID NO: 6594009 - DNA, 14 bp, Homo sapiens
tttctgggatgtgg

SEQ ID NO: 6594010 - DNA, 14 bp, Homo sapiens
tttctgggctctgg

SEQ ID NO: 6594011 - DNA, 15 bp, Homo sapiens
tttctgggctctgga

SEQ ID NO: 6594012 - DNA, 17 bp, Homo sapiens
tttctgggctctggact

SEQ ID NO: 6594013 - DNA, 20 bp, Homo sapiens
tttctgggctctggactcca

SEQ ID NO: 6594014 - DNA, 21 bp, Homo sapiens
tttctgggctgtctattctag

SEQ ID NO: 6594015 - DNA, 13 bp, Homo sapiens
tttctgggctttc

SEQ ID NO: 6594016 - DNA, 16 bp, Homo sapiens
tttctgggcttttcct

SEQ ID NO: 6594017 - DNA, 23 bp, Homo sapiens
tttctggggaaaaaaaagagact

SEQ ID NO: 6594018 - DNA, 21 bp, Homo sapiens
tttctggggaaagacactgcc

SEQ ID NO: 6594019 - DNA, 21 bp, Homo sapiens
tttctggggaattactttcct

SEQ ID NO: 6594020 - DNA, 22 bp, Homo sapiens
tttctggggcctaataaaactg

SEQ ID NO: 6594021 - DNA, 16 bp, Homo sapiens
tttctgggggaaaaag

SEQ ID NO: 6594022 - DNA, 11 bp, Homo sapiens
tttctgggggc

SEQ ID NO: 6594023 - DNA, 18 bp, Homo sapiens
tttctgggtccctgctcc

SEQ ID NO: 6594024 - DNA, 21 bp, Homo sapiens
tttctgggtccctgctcccct

SEQ ID NO: 6594025 - DNA, 23 bp, Homo sapiens
tttctgggtctcccactttctgt

SEQ ID NO: 6594026 - DNA, 17 bp, Homo sapiens
tttctggtagatagaaa

SEQ ID NO: 6594027 - DNA, 20 bp, Homo sapiens
tttctggtatcgttcgcttg

SEQ ID NO: 6594028 - DNA, 10 bp, Homo sapiens
tttctggtgc

SEQ ID NO: 6594029 - DNA, 21 bp, Homo sapiens
tttctggtgctaagtctgatg

SEQ ID NO: 6594030 - DNA, 16 bp, Homo sapiens
tttctggtggggctgt

SEQ ID NO: 6594031 - DNA, 22 bp, Homo sapiens
tttctggtggggctgtcctgct

SEQ ID NO: 6594032 - DNA, 15 bp, Homo sapiens
tttctggtggtctgt

SEQ ID NO: 6594033 - DNA, 13 bp, Homo sapiens
tttctggttccaa

SEQ ID NO: 6594034 - DNA, 15 bp, Homo sapiens
tttctggttccaaac

SEQ ID NO: 6594035 - DNA, 15 bp, Homo sapiens
tttctggttctaaca

SEQ ID NO: 6594036 - DNA, 14 bp, Homo sapiens
tttctgtaaaagtt

SEQ ID NO: 6594037 - DNA, 21 bp, Homo sapiens
tttctgtaaaagttactaata

SEQ ID NO: 6594038 - DNA, 16 bp, Homo sapiens
tttctgtaaataacct

SEQ ID NO: 6594039 - DNA, 15 bp, Homo sapiens
tttctgtaaatgaag

SEQ ID NO: 6594040 - DNA, 14 bp, Homo sapiens
tttctgtaaggtct

SEQ ID NO: 6594041 - DNA, 16 bp, Homo sapiens
tttctgtaatgtaaat

SEQ ID NO: 6594042 - DNA, 19 bp, Homo sapiens
tttctgtaattcttctcct

SEQ ID NO: 6594043 - DNA, 14 bp, Homo sapiens
tttctgtaccagtt

SEQ ID NO: 6594044 - DNA, 11 bp, Homo sapiens
tttctgtactt

SEQ ID NO: 6594045 - DNA, 19 bp, Homo sapiens
tttctgtactttttggcat

SEQ ID NO: 6594046 - DNA, 13 bp, Homo sapiens
tttctgtagaaaa

SEQ ID NO: 6594047 - DNA, 18 bp, Homo sapiens
tttctgtagcctaaaacg

SEQ ID NO: 6594048 - DNA, 19 bp, Homo sapiens
tttctgtagtcatttacta

SEQ ID NO: 6594049 - DNA, 24 bp, Homo sapiens
tttctgtagtcatttactaaacat

SEQ ID NO: 6594050 - DNA, 16 bp, Homo sapiens
tttctgtagttcaatt

SEQ ID NO: 6594051 - DNA, 17 bp, Homo sapiens
tttctgtataaatgtct

SEQ ID NO: 6594052 - DNA, 12 bp, Homo sapiens
tttctgtatact

SEQ ID NO: 6594053 - DNA, 17 bp, Homo sapiens
tttctgtatatactttt

SEQ ID NO: 6594054 - DNA, 15 bp, Homo sapiens
tttctgtcaagaaga

SEQ ID NO: 6594055 - DNA, 17 bp, Homo sapiens
tttctgtcagatgagaa

SEQ ID NO: 6594056 - DNA, 19 bp, Homo sapiens
tttctgtcagatgagaaca

SEQ ID NO: 6594057 - DNA, 23 bp, Homo sapiens
tttctgtcagatgagaacaaagc

SEQ ID NO: 6594058 - DNA, 19 bp, Homo sapiens
tttctgtcagtaaaactct

SEQ ID NO: 6594059 - DNA, 13 bp, Homo sapiens
tttctgtcattca

SEQ ID NO: 6594060 - DNA, 19 bp, Homo sapiens
tttctgtcattgttaaata

SEQ ID NO: 6594061 - DNA, 12 bp, Homo sapiens
tttctgtcccac

SEQ ID NO: 6594062 - DNA, 14 bp, Homo sapiens
tttctgtcctgggc

SEQ ID NO: 6594063 - DNA, 23 bp, Homo sapiens
tttctgtctctctctctttttct

SEQ ID NO: 6594064 - DNA, 22 bp, Homo sapiens
aatgtcctaacagagaaataga

SEQ ID NO: 6594065 - DNA, 23 bp, Homo sapiens
aatgtcctccagaagcctctggc

SEQ ID NO: 6594066 - DNA, 16 bp, Homo sapiens
aatgtcctgcctttta

SEQ ID NO: 6594067 - DNA, 18 bp, Homo sapiens
aatgtccttattcttgtg

SEQ ID NO: 6594068 - DNA, 16 bp, Homo sapiens
aatgtcctttccctgg

SEQ ID NO: 6594069 - DNA, 23 bp, Homo sapiens
aatgtcgctgtaaattttatggc

SEQ ID NO: 6594070 - DNA, 15 bp, Homo sapiens
aatgtcggggttggg

SEQ ID NO: 6594071 - DNA, 16 bp, Homo sapiens
aatgtcggggttgggg

SEQ ID NO: 6594072 - DNA, 20 bp, Homo sapiens
aatgtcggggttggggtggg

SEQ ID NO: 6594073 - DNA, 23 bp, Homo sapiens
aatgtcggggttggggtgggagg

SEQ ID NO: 6594074 - DNA, 17 bp, Homo sapiens
aatgtctaaatgctgaa

SEQ ID NO: 6594075 - DNA, 20 bp, Homo sapiens
aatgtctaatgtattttatt

SEQ ID NO: 6594076 - DNA, 14 bp, Homo sapiens
aatgtctagatttt

SEQ ID NO: 6594077 - DNA, 17 bp, Homo sapiens
aatgtctagattttgaa

SEQ ID NO: 6594078 - DNA, 14 bp, Homo sapiens
aatgtctattaagg

SEQ ID NO: 6594079 - DNA, 18 bp, Homo sapiens
aatgtctattattatgaa

SEQ ID NO: 6594080 - DNA, 20 bp, Homo sapiens
aatgtctcaaggcagttaat

SEQ ID NO: 6594081 - DNA, 14 bp, Homo sapiens
aatgtctcactgtt

SEQ ID NO: 6594082 - DNA, 13 bp, Homo sapiens
aatgtctccattg

SEQ ID NO: 6594083 - DNA, 15 bp, Homo sapiens
aatgtctcccacacc

SEQ ID NO: 6594084 - DNA, 16 bp, Homo sapiens
aatgtctcccacaccc

SEQ ID NO: 6594085 - DNA, 15 bp, Homo sapiens
aatgtctcctttgct

SEQ ID NO: 6594086 - DNA, 16 bp, Homo sapiens
aatgtctcctttgctc

SEQ ID NO: 6594087 - DNA, 23 bp, Homo sapiens
aatgtctcctttgctcttgccaa

SEQ ID NO: 6594088 - DNA, 14 bp, Homo sapiens
aatgtctcttcctc

SEQ ID NO: 6594089 - DNA, 23 bp, Homo sapiens
aatgtctcttctaacatcttaga

SEQ ID NO: 6594090 - DNA, 15 bp, Homo sapiens
aatgtctgaaatgga

SEQ ID NO: 6594091 - DNA, 16 bp, Homo sapiens
aatgtctgaagtacaa

SEQ ID NO: 6594092 - DNA, 17 bp, Homo sapiens
aatgtctgaagtacaaa

SEQ ID NO: 6594093 - DNA, 21 bp, Homo sapiens
aatgtctgaagtacaaacatg

SEQ ID NO: 6594094 - DNA, 17 bp, Homo sapiens
aatgtctgagtgaacct

SEQ ID NO: 6594095 - DNA, 15 bp, Homo sapiens
aatgtctgctgagga

SEQ ID NO: 6594096 - DNA, 20 bp, Homo sapiens
aatgtctgctggtatttcta

SEQ ID NO: 6594097 - DNA, 14 bp, Homo sapiens
aatgtctggggaca

SEQ ID NO: 6594098 - DNA, 15 bp, Homo sapiens
aatgtctggtgtttg

SEQ ID NO: 6594099 - DNA, 18 bp, Homo sapiens
aatgtctggtgtttgtca

SEQ ID NO: 6594100 - DNA, 21 bp, Homo sapiens
aatgtctggtgtttgtcatgg

SEQ ID NO: 6594101 - DNA, 19 bp, Homo sapiens
aatgtctgtataaataatg

SEQ ID NO: 6594102 - DNA, 14 bp, Homo sapiens
aatgtctgtcagaa

SEQ ID NO: 6594103 - DNA, 22 bp, Homo sapiens
aatgtctgtcagaagacactaa

SEQ ID NO: 6594104 - DNA, 20 bp, Homo sapiens
aatgtctgtccctaaacata

SEQ ID NO: 6594105 - DNA, 23 bp, Homo sapiens
aatgtctgtccctaaacatagtg

SEQ ID NO: 6594106 - DNA, 12 bp, Homo sapiens
aatgtctgtttt

SEQ ID NO: 6594107 - DNA, 14 bp, Homo sapiens
aatgtcttcatgtt

SEQ ID NO: 6594108 - DNA, 21 bp, Homo sapiens
aatgtcttcatttcattgtat

SEQ ID NO: 6594109 - DNA, 12 bp, Homo sapiens
aatgtcttcctt

SEQ ID NO: 6594110 - DNA, 13 bp, Homo sapiens
aatgtcttgagct

SEQ ID NO: 6594111 - DNA, 15 bp, Homo sapiens
aatgtcttgagctct

SEQ ID NO: 6594112 - DNA, 20 bp, Homo sapiens
aatgtcttggtcttctactg

SEQ ID NO: 6594113 - DNA, 22 bp, Homo sapiens
aatgtcttggtcttctactgcc

SEQ ID NO: 6594114 - DNA, 23 bp, Homo sapiens
aatgtcttggtcttctactgcct

SEQ ID NO: 6594115 - DNA, 14 bp, Homo sapiens
aatgtcttgtgtat

SEQ ID NO: 6594116 - DNA, 16 bp, Homo sapiens
aatgtcttgttaatat

SEQ ID NO: 6594117 - DNA, 13 bp, Homo sapiens
aatgtctttgtaa

SEQ ID NO: 6594118 - DNA, 15 bp, Homo sapiens
aatgtctttgtaagt

SEQ ID NO: 6594119 - DNA, 22 bp, Homo sapiens
aatgtctttgtaagtcagtgtt

SEQ ID NO: 6594120 - DNA, 15 bp, Homo sapiens
aatgtgaaaaaaatt

SEQ ID NO: 6594121 - DNA, 16 bp, Homo sapiens
aatgtgaaaaaaatta

SEQ ID NO: 6594122 - DNA, 14 bp, Homo sapiens
aatgtgaaaaacta

SEQ ID NO: 6594123 - DNA, 18 bp, Homo sapiens
aatgtgaaaaatctgctg

SEQ ID NO: 6594124 - DNA, 15 bp, Homo sapiens
aatgtgaaaagaaaa

SEQ ID NO: 6594125 - DNA, 19 bp, Homo sapiens
aatgtgaaaagaaaaatga

SEQ ID NO: 6594126 - DNA, 20 bp, Homo sapiens
aatgtgaaaagtatcactct

SEQ ID NO: 6594127 - DNA, 14 bp, Homo sapiens
aatgtgaaactgga

SEQ ID NO: 6594128 - DNA, 16 bp, Homo sapiens
aatgtgaaatgctttt

SEQ ID NO: 6594129 - DNA, 11 bp, Homo sapiens
aatgtgaaatt

SEQ ID NO: 6594130 - DNA, 17 bp, Homo sapiens
aatgtgaaatttttcca

SEQ ID NO: 6594131 - DNA, 19 bp, Homo sapiens
aatgtgaacagcggctgga

SEQ ID NO: 6594132 - DNA, 17 bp, Homo sapiens
aatgtgaacgtccttcc

SEQ ID NO: 6594133 - DNA, 17 bp, Homo sapiens
aatgtgaacttgtagct

SEQ ID NO: 6594134 - DNA, 15 bp, Homo sapiens
aatgtgaactttatt

SEQ ID NO: 6594135 - DNA, 12 bp, Homo sapiens
aatgtgaagaca

SEQ ID NO: 6594136 - DNA, 15 bp, Homo sapiens
aatgtgaagacattt

SEQ ID NO: 6594137 - DNA, 23 bp, Homo sapiens
aatgtgaagaggtctgattggct

SEQ ID NO: 6594138 - DNA, 15 bp, Homo sapiens
aatgtgaagatgcat

SEQ ID NO: 6594139 - DNA, 22 bp, Homo sapiens
aatgtgaagatgcattgtagtt

SEQ ID NO: 6594140 - DNA, 14 bp, Homo sapiens
aatgtgaagccttc

SEQ ID NO: 6594141 - DNA, 15 bp, Homo sapiens
aatgtgaagccttcc

SEQ ID NO: 6594142 - DNA, 15 bp, Homo sapiens
aatgtgaagtctact

SEQ ID NO: 6594143 - DNA, 16 bp, Homo sapiens
aatgtgaataaaatta

SEQ ID NO: 6594144 - DNA, 17 bp, Homo sapiens
aatgtgaataaaattat

SEQ ID NO: 6594145 - DNA, 15 bp, Homo sapiens
aatgtgaataatggc

SEQ ID NO: 6594146 - DNA, 19 bp, Homo sapiens
aatgtgaatatgccagtga

SEQ ID NO: 6594147 - DNA, 17 bp, Homo sapiens
aatgtgaatgggaaaag

SEQ ID NO: 6594148 - DNA, 17 bp, Homo sapiens
aatgtgaattactaact

SEQ ID NO: 6594149 - DNA, 23 bp, Homo sapiens
aatgtgaattttaaaatgcaaat

SEQ ID NO: 6594150 - DNA, 18 bp, Homo sapiens
aatgtgaatttttgccta

SEQ ID NO: 6594151 - DNA, 21 bp, Homo sapiens
aatgtgaccaaaaaaaagcat

SEQ ID NO: 6594152 - DNA, 15 bp, Homo sapiens
aatgtgaccaggggt

SEQ ID NO: 6594153 - DNA, 18 bp, Homo sapiens
aatgtgaccatgtgaatc

SEQ ID NO: 6594154 - DNA, 16 bp, Homo sapiens
aatgtgacctttaaga

SEQ ID NO: 6594155 - DNA, 21 bp, Homo sapiens
aatgtgactaccgtgccagca

SEQ ID NO: 6594156 - DNA, 23 bp, Homo sapiens
aatgtgacttggattcaatttta

SEQ ID NO: 6594157 - DNA, 19 bp, Homo sapiens
aatgtgagatggttcccaa

SEQ ID NO: 6594158 - DNA, 21 bp, Homo sapiens
aatgtgagctaagcattttct

SEQ ID NO: 6594159 - DNA, 18 bp, Homo sapiens
aatgtgaggaactcacat

SEQ ID NO: 6594160 - DNA, 22 bp, Homo sapiens
aatgtgagtggttgaatatgat

SEQ ID NO: 6594161 - DNA, 12 bp, Homo sapiens
aatgtgagtgtg

SEQ ID NO: 6594162 - DNA, 23 bp, Homo sapiens
aatgtgagtttggtctggactga

SEQ ID NO: 6594163 - DNA, 23 bp, Homo sapiens
aatgtgataatatattgctaaaa

SEQ ID NO: 6594164 - DNA, 16 bp, Homo sapiens
aatgtgatcatatgag

SEQ ID NO: 6594165 - DNA, 15 bp, Homo sapiens
aatgtgatcatcttt

SEQ ID NO: 6594166 - DNA, 18 bp, Homo sapiens
aatgtgatcatctttgct

SEQ ID NO: 6594167 - DNA, 22 bp, Homo sapiens
aatgtgatcgcttggttatcca

SEQ ID NO: 6594168 - DNA, 14 bp, Homo sapiens
aatgtgatctatgt

SEQ ID NO: 6594169 - DNA, 22 bp, Homo sapiens
aatgtgatctatgtttcatctt

SEQ ID NO: 6594170 - DNA, 12 bp, Homo sapiens
aatgtgatgaat

SEQ ID NO: 6594171 - DNA, 17 bp, Homo sapiens
aatgtgatgatgtaatt

SEQ ID NO: 6594172 - DNA, 23 bp, Homo sapiens
aatgtgatgcttataataaagaa

SEQ ID NO: 6594173 - DNA, 21 bp, Homo sapiens
aatgtgatgcttgatataata

SEQ ID NO: 6594174 - DNA, 20 bp, Homo sapiens
aatgtgatggatggcacaat

SEQ ID NO: 6594175 - DNA, 23 bp, Homo sapiens
aatgtgatggatggcacaatgaa

SEQ ID NO: 6594176 - DNA, 13 bp, Homo sapiens
aatgtgatgttct

SEQ ID NO: 6594177 - DNA, 14 bp, Homo sapiens
aatgtgatgttcta

SEQ ID NO: 6594178 - DNA, 15 bp, Homo sapiens
aatgtgatgttctaa

SEQ ID NO: 6594179 - DNA, 22 bp, Homo sapiens
aatgtgattcctttgaagagga

SEQ ID NO: 6594180 - DNA, 14 bp, Homo sapiens
aatgtgattctaat

SEQ ID NO: 6594181 - DNA, 19 bp, Homo sapiens
aatgtgattctaatgtctt

SEQ ID NO: 6594182 - DNA, 22 bp, Homo sapiens
aatgtgattctaatgtcttcat

SEQ ID NO: 6594183 - DNA, 14 bp, Homo sapiens
aatgtgattcttct

SEQ ID NO: 6594184 - DNA, 18 bp, Homo sapiens
aatgtgattcttctaaag

SEQ ID NO: 6594185 - DNA, 20 bp, Homo sapiens
aatgtgatttacgctcattg

SEQ ID NO: 6594186 - DNA, 18 bp, Homo sapiens
aatgtgatttgtcttccc

SEQ ID NO: 6594187 - DNA, 21 bp, Homo sapiens
aatgtgatttgtcttcccttc

SEQ ID NO: 6594188 - DNA, 12 bp, Homo sapiens
aatgtgattttt

SEQ ID NO: 6594189 - DNA, 16 bp, Homo sapiens
aatgtgatttttctga

SEQ ID NO: 6594190 - DNA, 16 bp, Homo sapiens
aatgtgatttttgtaa

SEQ ID NO: 6594191 - DNA, 18 bp, Homo sapiens
aatgtgcaaattttgcat

SEQ ID NO: 6594192 - DNA, 15 bp, Homo sapiens
aatgtgcaatagaag

SEQ ID NO: 6594193 - DNA, 15 bp, Homo sapiens
aatgtgcagaaaata

SEQ ID NO: 6594194 - DNA, 16 bp, Homo sapiens
aatgtgcagaaaatat

SEQ ID NO: 6594195 - DNA, 19 bp, Homo sapiens
aatgtgcagaaaatattta

SEQ ID NO: 6594196 - DNA, 14 bp, Homo sapiens
aatgtgcagcaaaa

SEQ ID NO: 6594197 - DNA, 17 bp, Homo sapiens
aatgtgcataatgataa

SEQ ID NO: 6594198 - DNA, 14 bp, Homo sapiens
aatgtgcatttctt

SEQ ID NO: 6594199 - DNA, 15 bp, Homo sapiens
aatgtgcatttcttg

SEQ ID NO: 6594200 - DNA, 17 bp, Homo sapiens
aatgtgccaaaatgtca

SEQ ID NO: 6594201 - DNA, 18 bp, Homo sapiens
aatgtgccaaaatgtcaa

SEQ ID NO: 6594202 - DNA, 16 bp, Homo sapiens
aatgtgccacagaggc

SEQ ID NO: 6594203 - DNA, 15 bp, Homo sapiens
aatgtgccatgtata

SEQ ID NO: 6594204 - DNA, 16 bp, Homo sapiens
aatgtgcccagtcatg

SEQ ID NO: 6594205 - DNA, 20 bp, Homo sapiens
aatgtgcccagtcatgacat

SEQ ID NO: 6594206 - DNA, 13 bp, Homo sapiens
aatgtgcccccag

SEQ ID NO: 6594207 - DNA, 12 bp, Homo sapiens
aatgtgcccctg

SEQ ID NO: 6594208 - DNA, 18 bp, Homo sapiens
aatgtgcccctggcccat

SEQ ID NO: 6594209 - DNA, 12 bp, Homo sapiens
aatgtgcctatt

SEQ ID NO: 6594210 - DNA, 20 bp, Homo sapiens
aatgtgctagagttaaaagt

SEQ ID NO: 6594211 - DNA, 22 bp, Homo sapiens
aatgtgctcaaattactaatga

SEQ ID NO: 6594212 - DNA, 21 bp, Homo sapiens
aatgtgctgaatggttttcaa

SEQ ID NO: 6594213 - DNA, 13 bp, Homo sapiens
aatgtgctgccta

SEQ ID NO: 6594214 - DNA, 13 bp, Homo sapiens
aatgtgctgtgta

SEQ ID NO: 6594215 - DNA, 15 bp, Homo sapiens
aatgtgctgtgtaaa

SEQ ID NO: 6594216 - DNA, 18 bp, Homo sapiens
aatgtgctgtgtaaagtt

SEQ ID NO: 6594217 - DNA, 22 bp, Homo sapiens
aatgtgctgttgattctttcaa

SEQ ID NO: 6594218 - DNA, 23 bp, Homo sapiens
aatgtgcttccgagattcagact

SEQ ID NO: 6594219 - DNA, 11 bp, Homo sapiens
aatgtgcttta

SEQ ID NO: 6594220 - DNA, 19 bp, Homo sapiens
aatgtgctttatttgcaaa

SEQ ID NO: 6594221 - DNA, 20 bp, Homo sapiens
aatgtgctttatttgcaaat

SEQ ID NO: 6594222 - DNA, 15 bp, Homo sapiens
aatgtgcttttccat

SEQ ID NO: 6594223 - DNA, 22 bp, Homo sapiens
aatgtgcttttccatctaaaat

SEQ ID NO: 6594224 - DNA, 16 bp, Homo sapiens
aatgtggaaaaagtaa

SEQ ID NO: 6594225 - DNA, 15 bp, Homo sapiens
aatgtggaattacat

SEQ ID NO: 6594226 - DNA, 21 bp, Homo sapiens
aatgtggaattacataacagg

SEQ ID NO: 6594227 - DNA, 20 bp, Homo sapiens
aatgtggacgtgcactgaca

SEQ ID NO: 6594228 - DNA, 19 bp, Homo sapiens
aatgtggagtctccctctg

SEQ ID NO: 6594229 - DNA, 21 bp, Homo sapiens
aatgtggataaaactgtgtaa

SEQ ID NO: 6594230 - DNA, 15 bp, Homo sapiens
aatgtggatgctctt

SEQ ID NO: 6594231 - DNA, 22 bp, Homo sapiens
aatgtggatttcctattttaaa

SEQ ID NO: 6594232 - DNA, 22 bp, Homo sapiens
aatgtggcaaggaaaaacaggt

SEQ ID NO: 6594233 - DNA, 17 bp, Homo sapiens
aatgtggcagctgtctc

SEQ ID NO: 6594234 - DNA, 14 bp, Homo sapiens
aatgtggcagttta

SEQ ID NO: 6594235 - DNA, 18 bp, Homo sapiens
aatgtggccaagcctatc

SEQ ID NO: 6594236 - DNA, 18 bp, Homo sapiens
aatgtggccacttatttc

SEQ ID NO: 6594237 - DNA, 20 bp, Homo sapiens
aatgtggccacttatttcac

SEQ ID NO: 6594238 - DNA, 21 bp, Homo sapiens
aatgtggcccctgaacaagaa

SEQ ID NO: 6594239 - DNA, 17 bp, Homo sapiens
aatgtggccgaggactt

SEQ ID NO: 6594240 - DNA, 14 bp, Homo sapiens
aatgtggctcctgg

SEQ ID NO: 6594241 - DNA, 18 bp, Homo sapiens
aatgtggctgtaaaactt

SEQ ID NO: 6594242 - DNA, 17 bp, Homo sapiens
tttctgtctctcttgct

SEQ ID NO: 6594243 - DNA, 19 bp, Homo sapiens
tttctgtgaaattctcaga

SEQ ID NO: 6594244 - DNA, 16 bp, Homo sapiens
tttctgtgacatttat

SEQ ID NO: 6594245 - DNA, 21 bp, Homo sapiens
tttctgtgataactctgcaaa

SEQ ID NO: 6594246 - DNA, 11 bp, Homo sapiens
tttctgtgcca

SEQ ID NO: 6594247 - DNA, 18 bp, Homo sapiens
tttctgtgccctactcat

SEQ ID NO: 6594248 - DNA, 10 bp, Homo sapiens
tttctgtgga

SEQ ID NO: 6594249 - DNA, 23 bp, Homo sapiens
tttctgtggatacagtgcccacc

SEQ ID NO: 6594250 - DNA, 17 bp, Homo sapiens
tttctgtggctggctct

SEQ ID NO: 6594251 - DNA, 23 bp, Homo sapiens
tttctgtggttgcagcctgacca

SEQ ID NO: 6594252 - DNA, 17 bp, Homo sapiens
tttctgtgtaaaatgag

SEQ ID NO: 6594253 - DNA, 11 bp, Homo sapiens
tttctgtgtgc

SEQ ID NO: 6594254 - DNA, 22 bp, Homo sapiens
tttctgtgtgcaccttaccaac

SEQ ID NO: 6594255 - DNA, 15 bp, Homo sapiens
tttctgtgtgtccgt

SEQ ID NO: 6594256 - DNA, 15 bp, Homo sapiens
tttctgtgtgttcct

SEQ ID NO: 6594257 - DNA, 17 bp, Homo sapiens
tttctgtgtgttcctgg

SEQ ID NO: 6594258 - DNA, 19 bp, Homo sapiens
tttctgtgtttagctattt

SEQ ID NO: 6594259 - DNA, 14 bp, Homo sapiens
tttctgttaaaatg

SEQ ID NO: 6594260 - DNA, 15 bp, Homo sapiens
tttctgttaacctct

SEQ ID NO: 6594261 - DNA, 21 bp, Homo sapiens
tttctgttatttttaagcttt

SEQ ID NO: 6594262 - DNA, 9 bp, Homo sapiens
tttctgttc

SEQ ID NO: 6594263 - DNA, 20 bp, Homo sapiens
tttctgttcagcttttcagt

SEQ ID NO: 6594264 - DNA, 22 bp, Homo sapiens
tttctgttccaaattcagtttc

SEQ ID NO: 6594265 - DNA, 22 bp, Homo sapiens
tttctgttcgaagttcattttt

SEQ ID NO: 6594266 - DNA, 14 bp, Homo sapiens
tttctgttctgccc

SEQ ID NO: 6594267 - DNA, 20 bp, Homo sapiens
tttctgttctgccccctcag

SEQ ID NO: 6594268 - DNA, 15 bp, Homo sapiens
tttctgttctgttga

SEQ ID NO: 6594269 - DNA, 12 bp, Homo sapiens
tttctgttgaag

SEQ ID NO: 6594270 - DNA, 14 bp, Homo sapiens
tttctgttggtctt

SEQ ID NO: 6594271 - DNA, 23 bp, Homo sapiens
tttctgttggtcttaactaatgt

SEQ ID NO: 6594272 - DNA, 15 bp, Homo sapiens
tttctgttggtgtat

SEQ ID NO: 6594273 - DNA, 15 bp, Homo sapiens
tttctgttgtaactt

SEQ ID NO: 6594274 - DNA, 16 bp, Homo sapiens
tttctgttgtaactta

SEQ ID NO: 6594275 - DNA, 13 bp, Homo sapiens
tttctgttgtcat

SEQ ID NO: 6594276 - DNA, 17 bp, Homo sapiens
tttctgttgtcattgct

SEQ ID NO: 6594277 - DNA, 18 bp, Homo sapiens
tttctgttgtcattgctg

SEQ ID NO: 6594278 - DNA, 23 bp, Homo sapiens
tttctgttgtcattgctgttgtc

SEQ ID NO: 6594279 - DNA, 21 bp, Homo sapiens
tttctgtttataattgtttat

SEQ ID NO: 6594280 - DNA, 17 bp, Homo sapiens
tttctgtttcttgctct

SEQ ID NO: 6594281 - DNA, 16 bp, Homo sapiens
tttctgtttgattctt

SEQ ID NO: 6594282 - DNA, 14 bp, Homo sapiens
tttctgtttgttta

SEQ ID NO: 6594283 - DNA, 23 bp, Homo sapiens
tttctgtttgtttaagctgagcc

SEQ ID NO: 6594284 - DNA, 12 bp, Homo sapiens
tttctgttttgt

SEQ ID NO: 6594285 - DNA, 18 bp, Homo sapiens
tttctgtttttatgtttt

SEQ ID NO: 6594286 - DNA, 18 bp, Homo sapiens
tttcttaaaacacatgat

SEQ ID NO: 6594287 - DNA, 22 bp, Homo sapiens
tttcttaaaacacatgatacca

SEQ ID NO: 6594288 - DNA, 13 bp, Homo sapiens
tttcttaaaactt

SEQ ID NO: 6594289 - DNA, 21 bp, Homo sapiens
tttcttaaaactttattaaaa

SEQ ID NO: 6594290 - DNA, 15 bp, Homo sapiens
tttcttaaaagtact

SEQ ID NO: 6594291 - DNA, 22 bp, Homo sapiens
tttcttaaaagtactttaaaaa

SEQ ID NO: 6594292 - DNA, 16 bp, Homo sapiens
tttcttaaaccttcag

SEQ ID NO: 6594293 - DNA, 17 bp, Homo sapiens
tttcttaaagcaaagtc

SEQ ID NO: 6594294 - DNA, 17 bp, Homo sapiens
tttcttaaagtgccagt

SEQ ID NO: 6594295 - DNA, 21 bp, Homo sapiens
tttcttaaataagaaactttt

SEQ ID NO: 6594296 - DNA, 21 bp, Homo sapiens
tttcttaaataatgcttcaga

SEQ ID NO: 6594297 - DNA, 22 bp, Homo sapiens
tttcttaaataatgcttcagat

SEQ ID NO: 6594298 - DNA, 24 bp, Homo sapiens
tttcttaaatatgtatatgacatt

SEQ ID NO: 6594299 - DNA, 13 bp, Homo sapiens
tttcttaaatctt

SEQ ID NO: 6594300 - DNA, 18 bp, Homo sapiens
tttcttaaatgttttcat

SEQ ID NO: 6594301 - DNA, 15 bp, Homo sapiens
tttcttaaattattt

SEQ ID NO: 6594302 - DNA, 15 bp, Homo sapiens
tttcttaaccatctt

SEQ ID NO: 6594303 - DNA, 13 bp, Homo sapiens
tttcttaacttct

SEQ ID NO: 6594304 - DNA, 16 bp, Homo sapiens
tttcttaacttctgaa

SEQ ID NO: 6594305 - DNA, 14 bp, Homo sapiens
tttcttaagaaatg

SEQ ID NO: 6594306 - DNA, 18 bp, Homo sapiens
tttcttaagaattcaaat

SEQ ID NO: 6594307 - DNA, 23 bp, Homo sapiens
tttcttaagcaacaatggatatt

SEQ ID NO: 6594308 - DNA, 18 bp, Homo sapiens
tttcttaaggaattttgt

SEQ ID NO: 6594309 - DNA, 21 bp, Homo sapiens
tttcttaaggtcattaaaaca

SEQ ID NO: 6594310 - DNA, 12 bp, Homo sapiens
tttcttaaggtt

SEQ ID NO: 6594311 - DNA, 23 bp, Homo sapiens
tttcttaatagaaagtcagatga

SEQ ID NO: 6594312 - DNA, 20 bp, Homo sapiens
tttcttaatatatagcattt

SEQ ID NO: 6594313 - DNA, 15 bp, Homo sapiens
tttcttaatgtctgt

SEQ ID NO: 6594314 - DNA, 21 bp, Homo sapiens
tttcttaattattataaaaat

SEQ ID NO: 6594315 - DNA, 23 bp, Homo sapiens
tttcttaattattataaaaatat

SEQ ID NO: 6594316 - DNA, 15 bp, Homo sapiens
tttcttaatttggaa

SEQ ID NO: 6594317 - DNA, 17 bp, Homo sapiens
tttcttacacaagagct

SEQ ID NO: 6594318 - DNA, 13 bp, Homo sapiens
tttcttacacact

SEQ ID NO: 6594319 - DNA, 15 bp, Homo sapiens
tttcttacagcacat

SEQ ID NO: 6594320 - DNA, 13 bp, Homo sapiens
tttcttactcaaa

SEQ ID NO: 6594321 - DNA, 15 bp, Homo sapiens
tttcttactcctcct

SEQ ID NO: 6594322 - DNA, 17 bp, Homo sapiens
tttcttactcctcctct

SEQ ID NO: 6594323 - DNA, 16 bp, Homo sapiens
tttcttacttatcaaa

SEQ ID NO: 6594324 - DNA, 20 bp, Homo sapiens
tttcttagatggagaagttg

SEQ ID NO: 6594325 - DNA, 12 bp, Homo sapiens
tttcttagcttt

SEQ ID NO: 6594326 - DNA, 23 bp, Homo sapiens
tttcttaggagcaagaagaaaat

SEQ ID NO: 6594327 - DNA, 18 bp, Homo sapiens
tttcttagggaaggatac

SEQ ID NO: 6594328 - DNA, 23 bp, Homo sapiens
tttcttagggaaggatacaaaag

SEQ ID NO: 6594329 - DNA, 21 bp, Homo sapiens
tttcttagtccctaatcatgt

SEQ ID NO: 6594330 - DNA, 23 bp, Homo sapiens
tttcttagtgcttcagagtttgt

SEQ ID NO: 6594331 - DNA, 21 bp, Homo sapiens
tttcttagtgttgtggacact

SEQ ID NO: 6594332 - DNA, 14 bp, Homo sapiens
tttcttataaattt

SEQ ID NO: 6594333 - DNA, 19 bp, Homo sapiens
tttcttataatactctgtt

SEQ ID NO: 6594334 - DNA, 21 bp, Homo sapiens
tttcttataatactctgttgt

SEQ ID NO: 6594335 - DNA, 23 bp, Homo sapiens
tttcttatcacaaaaaagaaaat

SEQ ID NO: 6594336 - DNA, 22 bp, Homo sapiens
tttcttatcacataagagagat

SEQ ID NO: 6594337 - DNA, 15 bp, Homo sapiens
tttcttatgtgacat

SEQ ID NO: 6594338 - DNA, 22 bp, Homo sapiens
tttcttatgtgggtcttatgct

SEQ ID NO: 6594339 - DNA, 23 bp, Homo sapiens
tttcttatgtgggtcttatgctt

SEQ ID NO: 6594340 - DNA, 22 bp, Homo sapiens
tttcttattaggcctcagaaag

SEQ ID NO: 6594341 - DNA, 15 bp, Homo sapiens
tttcttattctctgt

SEQ ID NO: 6594342 - DNA, 13 bp, Homo sapiens
tttcttattgcgc

SEQ ID NO: 6594343 - DNA, 14 bp, Homo sapiens
tttcttattgcgct

SEQ ID NO: 6594344 - DNA, 19 bp, Homo sapiens
tttcttatttaattagaat

SEQ ID NO: 6594345 - DNA, 19 bp, Homo sapiens
tttcttatttatgtaacaa

SEQ ID NO: 6594346 - DNA, 20 bp, Homo sapiens
tttcttatttatgtaacaaa

SEQ ID NO: 6594347 - DNA, 17 bp, Homo sapiens
tttcttatttcatttct

SEQ ID NO: 6594348 - DNA, 23 bp, Homo sapiens
tttcttattttgtaataaactct

SEQ ID NO: 6594349 - DNA, 15 bp, Homo sapiens
tttcttatttttgtc

SEQ ID NO: 6594350 - DNA, 22 bp, Homo sapiens
tttcttcaaaatataaaatgcc

SEQ ID NO: 6594351 - DNA, 16 bp, Homo sapiens
tttcttcaaaatgtat

SEQ ID NO: 6594352 - DNA, 18 bp, Homo sapiens
tttcttcaacatgctcca

SEQ ID NO: 6594353 - DNA, 19 bp, Homo sapiens
tttcttcaagtgagtggca

SEQ ID NO: 6594354 - DNA, 23 bp, Homo sapiens
tttcttcaagtgagtggcatgtg

SEQ ID NO: 6594355 - DNA, 16 bp, Homo sapiens
tttcttcaatggttct

SEQ ID NO: 6594356 - DNA, 18 bp, Homo sapiens
tttcttcaccaaatcttg

SEQ ID NO: 6594357 - DNA, 23 bp, Homo sapiens
tttcttcacctctgctactcaag

SEQ ID NO: 6594358 - DNA, 21 bp, Homo sapiens
tttcttcactgttgaaaatta

SEQ ID NO: 6594359 - DNA, 20 bp, Homo sapiens
tttcttcacttacaagaaag

SEQ ID NO: 6594360 - DNA, 13 bp, Homo sapiens
tttcttcagaatt

SEQ ID NO: 6594361 - DNA, 11 bp, Homo sapiens
tttcttcagca

SEQ ID NO: 6594362 - DNA, 16 bp, Homo sapiens
tttcttcagggctgct

SEQ ID NO: 6594363 - DNA, 13 bp, Homo sapiens
tttcttcatccaa

SEQ ID NO: 6594364 - DNA, 16 bp, Homo sapiens
tttcttcatgcaatga

SEQ ID NO: 6594365 - DNA, 18 bp, Homo sapiens
tttcttcatgcaatgaca

SEQ ID NO: 6594366 - DNA, 19 bp, Homo sapiens
tttcttcatgcaatgacat

SEQ ID NO: 6594367 - DNA, 14 bp, Homo sapiens
tttcttcccatcac

SEQ ID NO: 6594368 - DNA, 15 bp, Homo sapiens
tttcttcccatttgt

SEQ ID NO: 6594369 - DNA, 22 bp, Homo sapiens
tttcttcccatttgtaatgtat

SEQ ID NO: 6594370 - DNA, 16 bp, Homo sapiens
tttcttccccaccctg

SEQ ID NO: 6594371 - DNA, 16 bp, Homo sapiens
tttcttcccctcctgt

SEQ ID NO: 6594372 - DNA, 23 bp, Homo sapiens
tttcttccctcatgttctcatgt

SEQ ID NO: 6594373 - DNA, 20 bp, Homo sapiens
tttcttccctgctttgcatc

SEQ ID NO: 6594374 - DNA, 22 bp, Homo sapiens
tttcttcctaccaagtcaaact

SEQ ID NO: 6594375 - DNA, 16 bp, Homo sapiens
tttcttcctatttctg

SEQ ID NO: 6594376 - DNA, 15 bp, Homo sapiens
tttcttcctcagctg

SEQ ID NO: 6594377 - DNA, 12 bp, Homo sapiens
tttcttccttcc

SEQ ID NO: 6594378 - DNA, 14 bp, Homo sapiens
tttcttccttcctt

SEQ ID NO: 6594379 - DNA, 12 bp, Homo sapiens
tttcttccttct

SEQ ID NO: 6594380 - DNA, 23 bp, Homo sapiens
tttcttccttggccaagagaagg

SEQ ID NO: 6594381 - DNA, 23 bp, Homo sapiens
tttcttccttgttgtttgctttg

SEQ ID NO: 6594382 - DNA, 20 bp, Homo sapiens
tttcttcctttgaagcttta

SEQ ID NO: 6594383 - DNA, 13 bp, Homo sapiens
tttcttcgctgct

SEQ ID NO: 6594384 - DNA, 14 bp, Homo sapiens
tttcttcgctggac

SEQ ID NO: 6594385 - DNA, 15 bp, Homo sapiens
tttcttctagaagat

SEQ ID NO: 6594386 - DNA, 14 bp, Homo sapiens
tttcttctagcttt

SEQ ID NO: 6594387 - DNA, 12 bp, Homo sapiens
tttcttctcatt

SEQ ID NO: 6594388 - DNA, 12 bp, Homo sapiens
tttcttctccct

SEQ ID NO: 6594389 - DNA, 13 bp, Homo sapiens
tttcttctccctc

SEQ ID NO: 6594390 - DNA, 20 bp, Homo sapiens
tttcttctcgcctaggattt

SEQ ID NO: 6594391 - DNA, 13 bp, Homo sapiens
tttcttctctctg

SEQ ID NO: 6594392 - DNA, 14 bp, Homo sapiens
tttcttctctctgt

SEQ ID NO: 6594393 - DNA, 12 bp, Homo sapiens
tttcttctctgc

SEQ ID NO: 6594394 - DNA, 13 bp, Homo sapiens
tttcttctctgga

SEQ ID NO: 6594395 - DNA, 17 bp, Homo sapiens
tttcttctctgtgaagt

SEQ ID NO: 6594396 - DNA, 14 bp, Homo sapiens
tttcttctgccctt

SEQ ID NO: 6594397 - DNA, 17 bp, Homo sapiens
tttcttctggtagcata

SEQ ID NO: 6594398 - DNA, 23 bp, Homo sapiens
tttcttctgtatttttttttcta

SEQ ID NO: 6594399 - DNA, 23 bp, Homo sapiens
tttcttcttcaaacctttgtgtg

SEQ ID NO: 6594400 - DNA, 13 bp, Homo sapiens
tttcttcttccct

SEQ ID NO: 6594401 - DNA, 17 bp, Homo sapiens
tttcttcttctaagaag

SEQ ID NO: 6594402 - DNA, 18 bp, Homo sapiens
tttcttcttctaagaaga

SEQ ID NO: 6594403 - DNA, 21 bp, Homo sapiens
tttcttctttaatttttctgt

SEQ ID NO: 6594404 - DNA, 14 bp, Homo sapiens
tttcttctttctag

SEQ ID NO: 6594405 - DNA, 13 bp, Homo sapiens
tttcttctttctt

SEQ ID NO: 6594406 - DNA, 11 bp, Homo sapiens
tttcttctttg

SEQ ID NO: 6594407 - DNA, 18 bp, Homo sapiens
tttcttctttgtggtctt

SEQ ID NO: 6594408 - DNA, 15 bp, Homo sapiens
tttcttcttttcctt

SEQ ID NO: 6594409 - DNA, 17 bp, Homo sapiens
tttcttcttttccttta

SEQ ID NO: 6594410 - DNA, 21 bp, Homo sapiens
tttcttcttttttaagttgtc

SEQ ID NO: 6594411 - DNA, 13 bp, Homo sapiens
tttcttgaaattg

SEQ ID NO: 6594412 - DNA, 13 bp, Homo sapiens
tttcttgaatttt

SEQ ID NO: 6594413 - DNA, 14 bp, Homo sapiens
tttcttgacaagct

SEQ ID NO: 6594414 - DNA, 22 bp, Homo sapiens
tttcttgagatctgctgacaga

SEQ ID NO: 6594415 - DNA, 23 bp, Homo sapiens
tttcttgagctagaccaaggtca

SEQ ID NO: 6594416 - DNA, 22 bp, Homo sapiens
tttcttgaggtactctgcacat

SEQ ID NO: 6594417 - DNA, 14 bp, Homo sapiens
tttcttgataattt

SEQ ID NO: 6594418 - DNA, 21 bp, Homo sapiens
tttcttgataattttccttta

SEQ ID NO: 6594419 - DNA, 18 bp, Homo sapiens
tttcttgatcttaaagat

SEQ ID NO: 6594420 - DNA, 17 bp, Homo sapiens
tttcttgcaaaacaaac

SEQ ID NO: 6594421 - DNA, 21 bp, Homo sapiens
aatgtgggaagaaacaaaccc

SEQ ID NO: 6594422 - DNA, 14 bp, Homo sapiens
aatgtgggattatg

SEQ ID NO: 6594423 - DNA, 19 bp, Homo sapiens
aatgtgggtagtcattctt

SEQ ID NO: 6594424 - DNA, 16 bp, Homo sapiens
aatgtggtagcctcac

SEQ ID NO: 6594425 - DNA, 21 bp, Homo sapiens
aatgtggtgacacctccccct

SEQ ID NO: 6594426 - DNA, 14 bp, Homo sapiens
aatgtgtaaaattg

SEQ ID NO: 6594427 - DNA, 13 bp, Homo sapiens
aatgtgtaaatgt

SEQ ID NO: 6594428 - DNA, 13 bp, Homo sapiens
aatgtgtaagaac

SEQ ID NO: 6594429 - DNA, 18 bp, Homo sapiens
aatgtgtaattgttttgg

SEQ ID NO: 6594430 - DNA, 19 bp, Homo sapiens
aatgtgtaattgttttgga

SEQ ID NO: 6594431 - DNA, 16 bp, Homo sapiens
aatgtgtaattttgtt

SEQ ID NO: 6594432 - DNA, 19 bp, Homo sapiens
aatgtgtaattttgttcta

SEQ ID NO: 6594433 - DNA, 16 bp, Homo sapiens
aatgtgtacaacttaa

SEQ ID NO: 6594434 - DNA, 16 bp, Homo sapiens
aatgtgtacagtgaat

SEQ ID NO: 6594435 - DNA, 23 bp, Homo sapiens
aatgtgtataaactgctgtcaat

SEQ ID NO: 6594436 - DNA, 14 bp, Homo sapiens
aatgtgtatgtctg

SEQ ID NO: 6594437 - DNA, 22 bp, Homo sapiens
aatgtgtattacaaatattttg

SEQ ID NO: 6594438 - DNA, 21 bp, Homo sapiens
aatgtgtatttactgtactaa

SEQ ID NO: 6594439 - DNA, 18 bp, Homo sapiens
aatgtgtattttatatga

SEQ ID NO: 6594440 - DNA, 20 bp, Homo sapiens
aatgtgtcaaagagatgagg

SEQ ID NO: 6594441 - DNA, 15 bp, Homo sapiens
aatgtgtcaaataca

SEQ ID NO: 6594442 - DNA, 19 bp, Homo sapiens
aatgtgtcaaattataaga

SEQ ID NO: 6594443 - DNA, 20 bp, Homo sapiens
aatgtgtcaatgtaaagcca

SEQ ID NO: 6594444 - DNA, 21 bp, Homo sapiens
aatgtgtcagaataggaaaac

SEQ ID NO: 6594445 - DNA, 12 bp, Homo sapiens
aatgtgtcattg

SEQ ID NO: 6594446 - DNA, 17 bp, Homo sapiens
aatgtgtctatttctga

SEQ ID NO: 6594447 - DNA, 16 bp, Homo sapiens
aatgtgtctctgcttt

SEQ ID NO: 6594448 - DNA, 21 bp, Homo sapiens
aatgtgtctgcaacatggatt

SEQ ID NO: 6594449 - DNA, 12 bp, Homo sapiens
aatgtgtcttta

SEQ ID NO: 6594450 - DNA, 14 bp, Homo sapiens
aatgtgtctttaga

SEQ ID NO: 6594451 - DNA, 15 bp, Homo sapiens
aatgtgtctttctaa

SEQ ID NO: 6594452 - DNA, 19 bp, Homo sapiens
aatgtgtgaattcaataca

SEQ ID NO: 6594453 - DNA, 12 bp, Homo sapiens
aatgtgtgagaa

SEQ ID NO: 6594454 - DNA, 18 bp, Homo sapiens
aatgtgtgagaaaaacta

SEQ ID NO: 6594455 - DNA, 20 bp, Homo sapiens
aatgtgtgagtgcatgtact

SEQ ID NO: 6594456 - DNA, 16 bp, Homo sapiens
aatgtgtggcctgcac

SEQ ID NO: 6594457 - DNA, 17 bp, Homo sapiens
aatgtgtgggcccaagg

SEQ ID NO: 6594458 - DNA, 17 bp, Homo sapiens
aatgtgtggtgctaact

SEQ ID NO: 6594459 - DNA, 18 bp, Homo sapiens
aatgtgtgtctgaagact

SEQ ID NO: 6594460 - DNA, 21 bp, Homo sapiens
aatgtgtgtctgaagactatc

SEQ ID NO: 6594461 - DNA, 16 bp, Homo sapiens
aatgtgtgtgatgtga

SEQ ID NO: 6594462 - DNA, 14 bp, Homo sapiens
aatgtgtgtgcaga

SEQ ID NO: 6594463 - DNA, 19 bp, Homo sapiens
aatgtgtgtgtgtggcagg

SEQ ID NO: 6594464 - DNA, 17 bp, Homo sapiens
aatgtgttatgagaaat

SEQ ID NO: 6594465 - DNA, 19 bp, Homo sapiens
aatgtgttctcggagtgtg

SEQ ID NO: 6594466 - DNA, 17 bp, Homo sapiens
aatgtgttgatttgaga

SEQ ID NO: 6594467 - DNA, 16 bp, Homo sapiens
aatgtgtttaattttg

SEQ ID NO: 6594468 - DNA, 18 bp, Homo sapiens
aatgtgtttcaaactgta

SEQ ID NO: 6594469 - DNA, 19 bp, Homo sapiens
aatgtgtttcataacaaac

SEQ ID NO: 6594470 - DNA, 15 bp, Homo sapiens
aatgtgttttggtcc

SEQ ID NO: 6594471 - DNA, 17 bp, Homo sapiens
aatgtgttttgtacatg

SEQ ID NO: 6594472 - DNA, 13 bp, Homo sapiens
aatgtgtttttca

SEQ ID NO: 6594473 - DNA, 15 bp, Homo sapiens
aatgtgtttttcagt

SEQ ID NO: 6594474 - DNA, 14 bp, Homo sapiens
aatgtgtttttccc

SEQ ID NO: 6594475 - DNA, 16 bp, Homo sapiens
aatgtgtttttctata

SEQ ID NO: 6594476 - DNA, 16 bp, Homo sapiens
aatgtgtttttctcca

SEQ ID NO: 6594477 - DNA, 13 bp, Homo sapiens
aatgttaaaacat

SEQ ID NO: 6594478 - DNA, 18 bp, Homo sapiens
aatgttaaaacataaaca

SEQ ID NO: 6594479 - DNA, 12 bp, Homo sapiens
aatgttaaaatg

SEQ ID NO: 6594480 - DNA, 17 bp, Homo sapiens
aatgttaaacaccattt

SEQ ID NO: 6594481 - DNA, 14 bp, Homo sapiens
aatgttaaagatgt

SEQ ID NO: 6594482 - DNA, 19 bp, Homo sapiens
aatgttaaagatgtagcaa

SEQ ID NO: 6594483 - DNA, 15 bp, Homo sapiens
aatgttaaagtcagt

SEQ ID NO: 6594484 - DNA, 13 bp, Homo sapiens
aatgttaaataaa

SEQ ID NO: 6594485 - DNA, 18 bp, Homo sapiens
aatgttaaataaattgta

SEQ ID NO: 6594486 - DNA, 20 bp, Homo sapiens
aatgttaaataaattgtata

SEQ ID NO: 6594487 - DNA, 21 bp, Homo sapiens
aatgttaaataaattgtatat

SEQ ID NO: 6594488 - DNA, 13 bp, Homo sapiens
aatgttaaatcta

SEQ ID NO: 6594489 - DNA, 12 bp, Homo sapiens
aatgttaaattt

SEQ ID NO: 6594490 - DNA, 16 bp, Homo sapiens
aatgttaaatttgtaa

SEQ ID NO: 6594491 - DNA, 21 bp, Homo sapiens
aatgttaaatttgtaagtttc

SEQ ID NO: 6594492 - DNA, 22 bp, Homo sapiens
aatgttaaatttgtaagtttca

SEQ ID NO: 6594493 - DNA, 11 bp, Homo sapiens
aatgttaacat

SEQ ID NO: 6594494 - DNA, 17 bp, Homo sapiens
aatgttaactttcaaat

SEQ ID NO: 6594495 - DNA, 15 bp, Homo sapiens
aatgttaagaataac

SEQ ID NO: 6594496 - DNA, 15 bp, Homo sapiens
aatgttaagaattga

SEQ ID NO: 6594497 - DNA, 19 bp, Homo sapiens
aatgttaagacttgacagt

SEQ ID NO: 6594498 - DNA, 13 bp, Homo sapiens
aatgttaagcaga

SEQ ID NO: 6594499 - DNA, 15 bp, Homo sapiens
aatgttaagctttat

SEQ ID NO: 6594500 - DNA, 12 bp, Homo sapiens
aatgttaataaa

SEQ ID NO: 6594501 - DNA, 19 bp, Homo sapiens
aatgttaatttattttgct

SEQ ID NO: 6594502 - DNA, 13 bp, Homo sapiens
aatgttaattttt

SEQ ID NO: 6594503 - DNA, 15 bp, Homo sapiens
aatgttacaaaaaaa

SEQ ID NO: 6594504 - DNA, 21 bp, Homo sapiens
aatgttacatagtaaatggta

SEQ ID NO: 6594505 - DNA, 16 bp, Homo sapiens
aatgttacatagtgta

SEQ ID NO: 6594506 - DNA, 20 bp, Homo sapiens
aatgttacatagtgtaggct

SEQ ID NO: 6594507 - DNA, 15 bp, Homo sapiens
aatgttaccagactt

SEQ ID NO: 6594508 - DNA, 18 bp, Homo sapiens
aatgttaccagacttcaa

SEQ ID NO: 6594509 - DNA, 12 bp, Homo sapiens
aatgttacctaa

SEQ ID NO: 6594510 - DNA, 14 bp, Homo sapiens
aatgttacctaatt

SEQ ID NO: 6594511 - DNA, 20 bp, Homo sapiens
aatgttacggcatcacactt

SEQ ID NO: 6594512 - DNA, 23 bp, Homo sapiens
aatgttacggcatcacacttata

SEQ ID NO: 6594513 - DNA, 23 bp, Homo sapiens
aatgttactaaattttctaatta

SEQ ID NO: 6594514 - DNA, 21 bp, Homo sapiens
aatgttactgatcatgcattg

SEQ ID NO: 6594515 - DNA, 13 bp, Homo sapiens
aatgttactgcct

SEQ ID NO: 6594516 - DNA, 15 bp, Homo sapiens
aatgttactgcctta

SEQ ID NO: 6594517 - DNA, 16 bp, Homo sapiens
aatgttacttctgata

SEQ ID NO: 6594518 - DNA, 20 bp, Homo sapiens
aatgttacttctgatacttt

SEQ ID NO: 6594519 - DNA, 22 bp, Homo sapiens
aatgttagaagaggcctttgga

SEQ ID NO: 6594520 - DNA, 13 bp, Homo sapiens
aatgttagaattg

SEQ ID NO: 6594521 - DNA, 16 bp, Homo sapiens
aatgttagacttgtgt

SEQ ID NO: 6594522 - DNA, 19 bp, Homo sapiens
aatgttagacttgtgtgca

SEQ ID NO: 6594523 - DNA, 20 bp, Homo sapiens
aatgttagacttgtgtgcat

SEQ ID NO: 6594524 - DNA, 13 bp, Homo sapiens
aatgttagagcac

SEQ ID NO: 6594525 - DNA, 14 bp, Homo sapiens
aatgttagatattg

SEQ ID NO: 6594526 - DNA, 17 bp, Homo sapiens
aatgttagatattgcta

SEQ ID NO: 6594527 - DNA, 15 bp, Homo sapiens
aatgttagatgctta

SEQ ID NO: 6594528 - DNA, 22 bp, Homo sapiens
aatgttagatgcttagtgtgaa

SEQ ID NO: 6594529 - DNA, 18 bp, Homo sapiens
aatgttagtattttaatc

SEQ ID NO: 6594530 - DNA, 21 bp, Homo sapiens
aatgttataacttatgaagta

SEQ ID NO: 6594531 - DNA, 16 bp, Homo sapiens
aatgttatatcatcaa

SEQ ID NO: 6594532 - DNA, 21 bp, Homo sapiens
aatgttatcttatactgtaca

SEQ ID NO: 6594533 - DNA, 22 bp, Homo sapiens
aatgttatgggatgtaaacaat

SEQ ID NO: 6594534 - DNA, 14 bp, Homo sapiens
aatgttatgtatat

SEQ ID NO: 6594535 - DNA, 21 bp, Homo sapiens
aatgttattacttgtaaataa

SEQ ID NO: 6594536 - DNA, 14 bp, Homo sapiens
aatgttattgtgta

SEQ ID NO: 6594537 - DNA, 14 bp, Homo sapiens
aatgttatttaaca

SEQ ID NO: 6594538 - DNA, 14 bp, Homo sapiens
aatgttatttccct

SEQ ID NO: 6594539 - DNA, 21 bp, Homo sapiens
aatgttatttgttattttcag

SEQ ID NO: 6594540 - DNA, 13 bp, Homo sapiens
aatgttattttcc

SEQ ID NO: 6594541 - DNA, 14 bp, Homo sapiens
aatgttattttcct

SEQ ID NO: 6594542 - DNA, 18 bp, Homo sapiens
aatgttattttccttctg

SEQ ID NO: 6594543 - DNA, 20 bp, Homo sapiens
aatgttattttcttctaagt

SEQ ID NO: 6594544 - DNA, 19 bp, Homo sapiens
aatgttattttttaattat

SEQ ID NO: 6594545 - DNA, 21 bp, Homo sapiens
aatgttattttttaattatta

SEQ ID NO: 6594546 - DNA, 14 bp, Homo sapiens
aatgttcaatgcca

SEQ ID NO: 6594547 - DNA, 18 bp, Homo sapiens
aatgttcacaatatattt

SEQ ID NO: 6594548 - DNA, 19 bp, Homo sapiens
aatgttcacatagtgaaat

SEQ ID NO: 6594549 - DNA, 22 bp, Homo sapiens
aatgttcactggtactctgcca

SEQ ID NO: 6594550 - DNA, 16 bp, Homo sapiens
aatgttcacttcgaaa

SEQ ID NO: 6594551 - DNA, 19 bp, Homo sapiens
aatgttcatatagccaggg

SEQ ID NO: 6594552 - DNA, 23 bp, Homo sapiens
aatgttcatatttattgattaaa

SEQ ID NO: 6594553 - DNA, 12 bp, Homo sapiens
aatgttcatcat

SEQ ID NO: 6594554 - DNA, 16 bp, Homo sapiens
aatgttcatgatttca

SEQ ID NO: 6594555 - DNA, 23 bp, Homo sapiens
aatgttcatgatttcaagatgtt

SEQ ID NO: 6594556 - DNA, 10 bp, Homo sapiens
aatgttcatt

SEQ ID NO: 6594557 - DNA, 20 bp, Homo sapiens
aatgttcattctatgacaat

SEQ ID NO: 6594558 - DNA, 13 bp, Homo sapiens
aatgttcattgta

SEQ ID NO: 6594559 - DNA, 22 bp, Homo sapiens
aatgttcattgtagattttgtt

SEQ ID NO: 6594560 - DNA, 14 bp, Homo sapiens
aatgttcattttct

SEQ ID NO: 6594561 - DNA, 15 bp, Homo sapiens
aatgttcattttgaa

SEQ ID NO: 6594562 - DNA, 18 bp, Homo sapiens
aatgttcattttgaaaat

SEQ ID NO: 6594563 - DNA, 20 bp, Homo sapiens
aatgttcattttgaaaatat

SEQ ID NO: 6594564 - DNA, 12 bp, Homo sapiens
aatgttccagac

SEQ ID NO: 6594565 - DNA, 15 bp, Homo sapiens
aatgttccattcagt

SEQ ID NO: 6594566 - DNA, 22 bp, Homo sapiens
aatgttccattcagtctgcagc

SEQ ID NO: 6594567 - DNA, 21 bp, Homo sapiens
aatgttcctcaaagcttggat

SEQ ID NO: 6594568 - DNA, 22 bp, Homo sapiens
aatgttcctcaaagcttggatt

SEQ ID NO: 6594569 - DNA, 18 bp, Homo sapiens
aatgttccttttttgtat

SEQ ID NO: 6594570 - DNA, 21 bp, Homo sapiens
aatgttccttttttgtatatt

SEQ ID NO: 6594571 - DNA, 20 bp, Homo sapiens
aatgttcgtattctattcaa

SEQ ID NO: 6594572 - DNA, 17 bp, Homo sapiens
aatgttctaagtttcta

SEQ ID NO: 6594573 - DNA, 21 bp, Homo sapiens
aatgttctatggttatgaaag

SEQ ID NO: 6594574 - DNA, 14 bp, Homo sapiens
aatgttctcaaata

SEQ ID NO: 6594575 - DNA, 17 bp, Homo sapiens
aatgttctcagatttct

SEQ ID NO: 6594576 - DNA, 12 bp, Homo sapiens
aatgttctgaca

SEQ ID NO: 6594577 - DNA, 14 bp, Homo sapiens
aatgttctgacatt

SEQ ID NO: 6594578 - DNA, 15 bp, Homo sapiens
aatgttctgacatta

SEQ ID NO: 6594579 - DNA, 22 bp, Homo sapiens
aatgttcttatgcaaaatggaa

SEQ ID NO: 6594580 - DNA, 19 bp, Homo sapiens
aatgttcttgaattatatc

SEQ ID NO: 6594581 - DNA, 12 bp, Homo sapiens
aatgttctttat

SEQ ID NO: 6594582 - DNA, 20 bp, Homo sapiens
aatgttctttggaaagtaca

SEQ ID NO: 6594583 - DNA, 22 bp, Homo sapiens
aatgttctttggaaagtacact

SEQ ID NO: 6594584 - DNA, 15 bp, Homo sapiens
aatgttgaaaaagaa

SEQ ID NO: 6594585 - DNA, 18 bp, Homo sapiens
aatgttgaaaaagaaaac

SEQ ID NO: 6594586 - DNA, 17 bp, Homo sapiens
aatgttgaaaagtaatt

SEQ ID NO: 6594587 - DNA, 15 bp, Homo sapiens
aatgttgaaatatga

SEQ ID NO: 6594588 - DNA, 22 bp, Homo sapiens
aatgttgaaatatgatgttaaa

SEQ ID NO: 6594589 - DNA, 13 bp, Homo sapiens
aatgttgaaatct

SEQ ID NO: 6594590 - DNA, 17 bp, Homo sapiens
aatgttgaaatcttaaa

SEQ ID NO: 6594591 - DNA, 22 bp, Homo sapiens
aatgttgaacaaaataaattgg

SEQ ID NO: 6594592 - DNA, 19 bp, Homo sapiens
aatgttgaaccaaacctcc

SEQ ID NO: 6594593 - DNA, 18 bp, Homo sapiens
aatgttgaatgtttgaat

SEQ ID NO: 6594594 - DNA, 13 bp, Homo sapiens
aatgttgaccttt

SEQ ID NO: 6594595 - DNA, 18 bp, Homo sapiens
aatgttgagaatcccaaa

SEQ ID NO: 6594596 - DNA, 13 bp, Homo sapiens
aatgttgatcagc

SEQ ID NO: 6594597 - DNA, 16 bp, Homo sapiens
aatgttgatcagcaaa

SEQ ID NO: 6594598 - DNA, 21 bp, Homo sapiens
aatgttgatcagcaaatttaa

SEQ ID NO: 6594599 - DNA, 13 bp, Homo sapiens
aatgttgatttct

SEQ ID NO: 6594600 - DNA, 14 bp, Homo sapiens
aatgttgatttcta

SEQ ID NO: 6594601 - DNA, 13 bp, Homo sapiens
tttcttgcaagct

SEQ ID NO: 6594602 - DNA, 16 bp, Homo sapiens
tttcttgcaagctcca

SEQ ID NO: 6594603 - DNA, 14 bp, Homo sapiens
tttcttgcaatttg

SEQ ID NO: 6594604 - DNA, 15 bp, Homo sapiens
tttcttgcaatttga

SEQ ID NO: 6594605 - DNA, 18 bp, Homo sapiens
tttcttgccaccctctgg

SEQ ID NO: 6594606 - DNA, 16 bp, Homo sapiens
tttcttgccagctcag

SEQ ID NO: 6594607 - DNA, 12 bp, Homo sapiens
tttcttgcctct

SEQ ID NO: 6594608 - DNA, 16 bp, Homo sapiens
tttcttgctcccttca

SEQ ID NO: 6594609 - DNA, 12 bp, Homo sapiens
tttcttgctgct

SEQ ID NO: 6594610 - DNA, 11 bp, Homo sapiens
tttcttgctgg

SEQ ID NO: 6594611 - DNA, 21 bp, Homo sapiens
tttcttgctgtattataagag

SEQ ID NO: 6594612 - DNA, 14 bp, Homo sapiens
tttcttgcttgtac

SEQ ID NO: 6594613 - DNA, 22 bp, Homo sapiens
tttcttgcttgtacctctggct

SEQ ID NO: 6594614 - DNA, 12 bp, Homo sapiens
tttcttgctttg

SEQ ID NO: 6594615 - DNA, 23 bp, Homo sapiens
tttcttgctttgaatgcatgtgt

SEQ ID NO: 6594616 - DNA, 21 bp, Homo sapiens
tttcttggatctttttgcaga

SEQ ID NO: 6594617 - DNA, 21 bp, Homo sapiens
tttcttggcgttcctgccagg

SEQ ID NO: 6594618 - DNA, 18 bp, Homo sapiens
tttcttgggaataaatta

SEQ ID NO: 6594619 - DNA, 21 bp, Homo sapiens
tttcttgggatgcttattaga

SEQ ID NO: 6594620 - DNA, 21 bp, Homo sapiens
tttcttggtctcagcttcatt

SEQ ID NO: 6594621 - DNA, 17 bp, Homo sapiens
tttcttggttcataaat

SEQ ID NO: 6594622 - DNA, 18 bp, Homo sapiens
tttcttggttcataaatg

SEQ ID NO: 6594623 - DNA, 23 bp, Homo sapiens
tttcttggttcataaatgaattt

SEQ ID NO: 6594624 - DNA, 19 bp, Homo sapiens
tttcttgtaaacctggagg

SEQ ID NO: 6594625 - DNA, 14 bp, Homo sapiens
tttcttgtaaatgt

SEQ ID NO: 6594626 - DNA, 20 bp, Homo sapiens
tttcttgtcattaacacatt

SEQ ID NO: 6594627 - DNA, 14 bp, Homo sapiens
tttcttgtctctga

SEQ ID NO: 6594628 - DNA, 20 bp, Homo sapiens
tttcttgtgcactggcacca

SEQ ID NO: 6594629 - DNA, 16 bp, Homo sapiens
tttcttgttgctttgt

SEQ ID NO: 6594630 - DNA, 20 bp, Homo sapiens
tttcttgtttctgcatcttt

SEQ ID NO: 6594631 - DNA, 12 bp, Homo sapiens
tttcttgtttgt

SEQ ID NO: 6594632 - DNA, 14 bp, Homo sapiens
tttcttgtttgtca

SEQ ID NO: 6594633 - DNA, 15 bp, Homo sapiens
tttctttaaaaaaca

SEQ ID NO: 6594634 - DNA, 14 bp, Homo sapiens
tttctttaaagatg

SEQ ID NO: 6594635 - DNA, 20 bp, Homo sapiens
tttctttaagataatagttt

SEQ ID NO: 6594636 - DNA, 21 bp, Homo sapiens
tttctttagagcattgccatt

SEQ ID NO: 6594637 - DNA, 19 bp, Homo sapiens
tttctttaggacataaaga

SEQ ID NO: 6594638 - DNA, 21 bp, Homo sapiens
tttctttagtttttgtgaagt

SEQ ID NO: 6594639 - DNA, 20 bp, Homo sapiens
tttctttatatttatccact

SEQ ID NO: 6594640 - DNA, 22 bp, Homo sapiens
tttctttatcctaaagattatt

SEQ ID NO: 6594641 - DNA, 17 bp, Homo sapiens
tttctttatttctgtct

SEQ ID NO: 6594642 - DNA, 15 bp, Homo sapiens
tttctttcacaaaaa

SEQ ID NO: 6594643 - DNA, 14 bp, Homo sapiens
tttctttcatacat

SEQ ID NO: 6594644 - DNA, 14 bp, Homo sapiens
tttctttccaaaac

SEQ ID NO: 6594645 - DNA, 14 bp, Homo sapiens
tttctttcccatgt

SEQ ID NO: 6594646 - DNA, 15 bp, Homo sapiens
tttctttcccttact

SEQ ID NO: 6594647 - DNA, 13 bp, Homo sapiens
tttctttccgaca

SEQ ID NO: 6594648 - DNA, 12 bp, Homo sapiens
tttctttccttt

SEQ ID NO: 6594649 - DNA, 14 bp, Homo sapiens
tttctttctatgta

SEQ ID NO: 6594650 - DNA, 13 bp, Homo sapiens
tttctttcttcca

SEQ ID NO: 6594651 - DNA, 13 bp, Homo sapiens
tttctttctttct

SEQ ID NO: 6594652 - DNA, 13 bp, Homo sapiens
tttctttgaaatg

SEQ ID NO: 6594653 - DNA, 16 bp, Homo sapiens
tttctttgaatgcttt

SEQ ID NO: 6594654 - DNA, 17 bp, Homo sapiens
tttctttgaattttcat

SEQ ID NO: 6594655 - DNA, 14 bp, Homo sapiens
tttctttgaccaga

SEQ ID NO: 6594656 - DNA, 16 bp, Homo sapiens
tttctttgatttaact

SEQ ID NO: 6594657 - DNA, 15 bp, Homo sapiens
tttctttgcattcca

SEQ ID NO: 6594658 - DNA, 22 bp, Homo sapiens
tttctttgccatctctgctcca

SEQ ID NO: 6594659 - DNA, 12 bp, Homo sapiens
tttctttgcctc

SEQ ID NO: 6594660 - DNA, 14 bp, Homo sapiens
tttctttgcctctg

SEQ ID NO: 6594661 - DNA, 14 bp, Homo sapiens
tttctttgctgctg

SEQ ID NO: 6594662 - DNA, 16 bp, Homo sapiens
tttctttgggaccctg

SEQ ID NO: 6594663 - DNA, 19 bp, Homo sapiens
tttctttggtgcctttcct

SEQ ID NO: 6594664 - DNA, 20 bp, Homo sapiens
tttctttgtattataaaatt

SEQ ID NO: 6594665 - DNA, 16 bp, Homo sapiens
tttctttgtcattcag

SEQ ID NO: 6594666 - DNA, 16 bp, Homo sapiens
tttctttgtgtagtat

SEQ ID NO: 6594667 - DNA, 17 bp, Homo sapiens
tttctttgtgtttgctt

SEQ ID NO: 6594668 - DNA, 20 bp, Homo sapiens
tttcttttaaagaagtaaat

SEQ ID NO: 6594669 - DNA, 22 bp, Homo sapiens
tttcttttaagcatttgtatat

SEQ ID NO: 6594670 - DNA, 13 bp, Homo sapiens
tttcttttactct

SEQ ID NO: 6594671 - DNA, 15 bp, Homo sapiens
tttcttttagaaaag

SEQ ID NO: 6594672 - DNA, 14 bp, Homo sapiens
tttcttttatatct

SEQ ID NO: 6594673 - DNA, 16 bp, Homo sapiens
tttcttttatatctgt

SEQ ID NO: 6594674 - DNA, 20 bp, Homo sapiens
tttcttttatggcaaaagta

SEQ ID NO: 6594675 - DNA, 14 bp, Homo sapiens
tttcttttattatc

SEQ ID NO: 6594676 - DNA, 9 bp, Homo sapiens
tttcttttc

SEQ ID NO: 6594677 - DNA, 21 bp, Homo sapiens
tttcttttcccccattaatca

SEQ ID NO: 6594678 - DNA, 22 bp, Homo sapiens
tttcttttccttcattcatagg

SEQ ID NO: 6594679 - DNA, 21 bp, Homo sapiens
tttcttttctaccctagccat

SEQ ID NO: 6594680 - DNA, 15 bp, Homo sapiens
tttcttttgcaggag

SEQ ID NO: 6594681 - DNA, 12 bp, Homo sapiens
tttcttttggaa

SEQ ID NO: 6594682 - DNA, 14 bp, Homo sapiens
tttcttttggaaat

SEQ ID NO: 6594683 - DNA, 17 bp, Homo sapiens
tttcttttggtccaggg

SEQ ID NO: 6594684 - DNA, 16 bp, Homo sapiens
tttcttttgtaattgt

SEQ ID NO: 6594685 - DNA, 14 bp, Homo sapiens
tttcttttgttact

SEQ ID NO: 6594686 - DNA, 24 bp, Homo sapiens
tttcttttgttactgttcttgctg

SEQ ID NO: 6594687 - DNA, 15 bp, Homo sapiens
tttctttttaaagtt

SEQ ID NO: 6594688 - DNA, 16 bp, Homo sapiens
tttctttttaaatgtg

SEQ ID NO: 6594689 - DNA, 22 bp, Homo sapiens
tttctttttattttaaatctga

SEQ ID NO: 6594690 - DNA, 14 bp, Homo sapiens
tttctttttccagt

SEQ ID NO: 6594691 - DNA, 21 bp, Homo sapiens
tttctttttctggaaattttg

SEQ ID NO: 6594692 - DNA, 13 bp, Homo sapiens
tttctttttctgt

SEQ ID NO: 6594693 - DNA, 13 bp, Homo sapiens
tttctttttggta

SEQ ID NO: 6594694 - DNA, 14 bp, Homo sapiens
tttcttttttaaat

SEQ ID NO: 6594695 - DNA, 13 bp, Homo sapiens
tttcttttttaat

SEQ ID NO: 6594696 - DNA, 17 bp, Homo sapiens
tttcttttttaattgaa

SEQ ID NO: 6594697 - DNA, 18 bp, Homo sapiens
tttcttttttaattgaaa

SEQ ID NO: 6594698 - DNA, 15 bp, Homo sapiens
tttcttttttatctt

SEQ ID NO: 6594699 - DNA, 23 bp, Homo sapiens
tttcttttttcctctgagttctg

SEQ ID NO: 6594700 - DNA, 20 bp, Homo sapiens
tttcttttttgagtgtgcaa

SEQ ID NO: 6594701 - DNA, 19 bp, Homo sapiens
tttctttttttaactggtg

SEQ ID NO: 6594702 - DNA, 19 bp, Homo sapiens
tttctttttttggtaaatt

SEQ ID NO: 6594703 - DNA, 19 bp, Homo sapiens
tttcttttttttaataagg

SEQ ID NO: 6594704 - DNA, 16 bp, Homo sapiens
tttgaaaaaaaataaa

SEQ ID NO: 6594705 - DNA, 16 bp, Homo sapiens
tttgaaaaaaacttca

SEQ ID NO: 6594706 - DNA, 14 bp, Homo sapiens
tttgaaaaaagctc

SEQ ID NO: 6594707 - DNA, 15 bp, Homo sapiens
tttgaaaaaagctca

SEQ ID NO: 6594708 - DNA, 20 bp, Homo sapiens
tttgaaaaaattaaaatctt

SEQ ID NO: 6594709 - DNA, 24 bp, Homo sapiens
tttgaaaaacttttaggttgttac

SEQ ID NO: 6594710 - DNA, 20 bp, Homo sapiens
tttgaaaaagaaaacactta

SEQ ID NO: 6594711 - DNA, 15 bp, Homo sapiens
tttgaaaaagcgaaa

SEQ ID NO: 6594712 - DNA, 20 bp, Homo sapiens
tttgaaaaagcgaaaaaatc

SEQ ID NO: 6594713 - DNA, 17 bp, Homo sapiens
tttgaaaaagttccata

SEQ ID NO: 6594714 - DNA, 21 bp, Homo sapiens
tttgaaaaatataaaattatg

SEQ ID NO: 6594715 - DNA, 16 bp, Homo sapiens
tttgaaaaatattgct

SEQ ID NO: 6594716 - DNA, 18 bp, Homo sapiens
tttgaaaaatattgctaa

SEQ ID NO: 6594717 - DNA, 19 bp, Homo sapiens
tttgaaaaattacagcttc

SEQ ID NO: 6594718 - DNA, 14 bp, Homo sapiens
tttgaaaacaaaaa

SEQ ID NO: 6594719 - DNA, 17 bp, Homo sapiens
tttgaaaacaattcagt

SEQ ID NO: 6594720 - DNA, 20 bp, Homo sapiens
tttgaaaacaattcagtggt

SEQ ID NO: 6594721 - DNA, 14 bp, Homo sapiens
tttgaaaacactta

SEQ ID NO: 6594722 - DNA, 19 bp, Homo sapiens
tttgaaaacacttatttta

SEQ ID NO: 6594723 - DNA, 17 bp, Homo sapiens
tttgaaaacatgtttat

SEQ ID NO: 6594724 - DNA, 19 bp, Homo sapiens
tttgaaaaccatattttat

SEQ ID NO: 6594725 - DNA, 18 bp, Homo sapiens
tttgaaaactacatttta

SEQ ID NO: 6594726 - DNA, 19 bp, Homo sapiens
tttgaaaactgacatcaga

SEQ ID NO: 6594727 - DNA, 15 bp, Homo sapiens
tttgaaaagaaaaat

SEQ ID NO: 6594728 - DNA, 15 bp, Homo sapiens
tttgaaaagaacaga

SEQ ID NO: 6594729 - DNA, 14 bp, Homo sapiens
tttgaaaagaattt

SEQ ID NO: 6594730 - DNA, 16 bp, Homo sapiens
tttgaaaagaatttgt

SEQ ID NO: 6594731 - DNA, 15 bp, Homo sapiens
tttgaaaagagaagc

SEQ ID NO: 6594732 - DNA, 22 bp, Homo sapiens
tttgaaaagctgctaactacat

SEQ ID NO: 6594733 - DNA, 13 bp, Homo sapiens
tttgaaaagcttc

SEQ ID NO: 6594734 - DNA, 16 bp, Homo sapiens
tttgaaaagcttctta

SEQ ID NO: 6594735 - DNA, 17 bp, Homo sapiens
tttgaaaagcttcttaa

SEQ ID NO: 6594736 - DNA, 23 bp, Homo sapiens
tttgaaaagcttcttaattaatt

SEQ ID NO: 6594737 - DNA, 14 bp, Homo sapiens
tttgaaaagtaata

SEQ ID NO: 6594738 - DNA, 17 bp, Homo sapiens
tttgaaaagtaatattt

SEQ ID NO: 6594739 - DNA, 14 bp, Homo sapiens
tttgaaaagttgga

SEQ ID NO: 6594740 - DNA, 22 bp, Homo sapiens
tttgaaaagtttcctaggatgt

SEQ ID NO: 6594741 - DNA, 22 bp, Homo sapiens
tttgaaaatagagcaatacttt

SEQ ID NO: 6594742 - DNA, 19 bp, Homo sapiens
tttgaaaatatgtactgta

SEQ ID NO: 6594743 - DNA, 17 bp, Homo sapiens
tttgaaaatatttctat

SEQ ID NO: 6594744 - DNA, 18 bp, Homo sapiens
tttgaaaatatttctatg

SEQ ID NO: 6594745 - DNA, 14 bp, Homo sapiens
tttgaaaatgtaca

SEQ ID NO: 6594746 - DNA, 15 bp, Homo sapiens
tttgaaaatgtacat

SEQ ID NO: 6594747 - DNA, 15 bp, Homo sapiens
tttgaaaatgtcctt

SEQ ID NO: 6594748 - DNA, 13 bp, Homo sapiens
tttgaaaattaca

SEQ ID NO: 6594749 - DNA, 22 bp, Homo sapiens
tttgaaaattacctttaatgca

SEQ ID NO: 6594750 - DNA, 15 bp, Homo sapiens
tttgaaaattatgca

SEQ ID NO: 6594751 - DNA, 17 bp, Homo sapiens
tttgaaaattttacttc

SEQ ID NO: 6594752 - DNA, 16 bp, Homo sapiens
tttgaaacaatactca

SEQ ID NO: 6594753 - DNA, 21 bp, Homo sapiens
tttgaaacatgcttgtgtttc

SEQ ID NO: 6594754 - DNA, 15 bp, Homo sapiens
tttgaaacattgctt

SEQ ID NO: 6594755 - DNA, 15 bp, Homo sapiens
tttgaaacccacagt

SEQ ID NO: 6594756 - DNA, 15 bp, Homo sapiens
tttgaaacctgctct

SEQ ID NO: 6594757 - DNA, 17 bp, Homo sapiens
tttgaaactaaaataaa

SEQ ID NO: 6594758 - DNA, 15 bp, Homo sapiens
tttgaaactagaaat

SEQ ID NO: 6594759 - DNA, 23 bp, Homo sapiens
tttgaaactgtaaatatgtttgt

SEQ ID NO: 6594760 - DNA, 14 bp, Homo sapiens
tttgaaagaaaaat

SEQ ID NO: 6594761 - DNA, 15 bp, Homo sapiens
tttgaaagaaatgta

SEQ ID NO: 6594762 - DNA, 21 bp, Homo sapiens
tttgaaagaatagaacacagt

SEQ ID NO: 6594763 - DNA, 23 bp, Homo sapiens
tttgaaagaattctattttgctg

SEQ ID NO: 6594764 - DNA, 16 bp, Homo sapiens
tttgaaagatggtaat

SEQ ID NO: 6594765 - DNA, 23 bp, Homo sapiens
tttgaaagatggtaatcttttct

SEQ ID NO: 6594766 - DNA, 13 bp, Homo sapiens
tttgaaagatgta

SEQ ID NO: 6594767 - DNA, 19 bp, Homo sapiens
tttgaaagtgaataaactt

SEQ ID NO: 6594768 - DNA, 18 bp, Homo sapiens
tttgaaagtttaacaaat

SEQ ID NO: 6594769 - DNA, 17 bp, Homo sapiens
tttgaaagtttccttat

SEQ ID NO: 6594770 - DNA, 19 bp, Homo sapiens
tttgaaagtttccttattt

SEQ ID NO: 6594771 - DNA, 22 bp, Homo sapiens
tttgaaataaaaaaagattttt

SEQ ID NO: 6594772 - DNA, 16 bp, Homo sapiens
tttgaaataaaaatgg

SEQ ID NO: 6594773 - DNA, 23 bp, Homo sapiens
tttgaaataaagaaccagtccct

SEQ ID NO: 6594774 - DNA, 12 bp, Homo sapiens
tttgaaataagc

SEQ ID NO: 6594775 - DNA, 13 bp, Homo sapiens
tttgaaatacctt

SEQ ID NO: 6594776 - DNA, 22 bp, Homo sapiens
tttgaaatacctttgtagttac

SEQ ID NO: 6594777 - DNA, 14 bp, Homo sapiens
tttgaaatactaaa

SEQ ID NO: 6594778 - DNA, 15 bp, Homo sapiens
tttgaaatactaaaa

SEQ ID NO: 6594779 - DNA, 21 bp, Homo sapiens
tttgaaatatatggtctaatg

SEQ ID NO: 6594780 - DNA, 19 bp, Homo sapiens
tttgaaatatgcatgtact

SEQ ID NO: 6594781 - DNA, 16 bp, Homo sapiens
tttgaaatatggtctt

SEQ ID NO: 6594782 - DNA, 15 bp, Homo sapiens
aatgttgatttctag

SEQ ID NO: 6594783 - DNA, 21 bp, Homo sapiens
aatgttgcacatcattcattc

SEQ ID NO: 6594784 - DNA, 22 bp, Homo sapiens
aatgttgcacatcattcattca

SEQ ID NO: 6594785 - DNA, 21 bp, Homo sapiens
aatgttgccttggaaacattt

SEQ ID NO: 6594786 - DNA, 18 bp, Homo sapiens
aatgttggaaaacatatg

SEQ ID NO: 6594787 - DNA, 20 bp, Homo sapiens
aatgttggaactctgtgcag

SEQ ID NO: 6594788 - DNA, 21 bp, Homo sapiens
aatgttggacacctttaggtt

SEQ ID NO: 6594789 - DNA, 19 bp, Homo sapiens
aatgttggagcagcaggcc

SEQ ID NO: 6594790 - DNA, 21 bp, Homo sapiens
aatgttggagcagcaggcctc

SEQ ID NO: 6594791 - DNA, 21 bp, Homo sapiens
aatgttggcctgtcagagctt

SEQ ID NO: 6594792 - DNA, 13 bp, Homo sapiens
aatgttgggactg

SEQ ID NO: 6594793 - DNA, 21 bp, Homo sapiens
aatgttgggactgctaaataa

SEQ ID NO: 6594794 - DNA, 17 bp, Homo sapiens
aatgttgggatttatat

SEQ ID NO: 6594795 - DNA, 18 bp, Homo sapiens
aatgttgggatttatatc

SEQ ID NO: 6594796 - DNA, 19 bp, Homo sapiens
aatgttgggatttatatct

SEQ ID NO: 6594797 - DNA, 24 bp, Homo sapiens
aatgttgggatttatatctatagt

SEQ ID NO: 6594798 - DNA, 15 bp, Homo sapiens
aatgttggtgcaatt

SEQ ID NO: 6594799 - DNA, 16 bp, Homo sapiens
aatgttggtgcaatta

SEQ ID NO: 6594800 - DNA, 12 bp, Homo sapiens
aatgttgtacag

SEQ ID NO: 6594801 - DNA, 15 bp, Homo sapiens
aatgttgtacagaga

SEQ ID NO: 6594802 - DNA, 16 bp, Homo sapiens
aatgttgtacttgaaa

SEQ ID NO: 6594803 - DNA, 19 bp, Homo sapiens
aatgttgtatcatactctt

SEQ ID NO: 6594804 - DNA, 21 bp, Homo sapiens
aatgttgtccaacaataaaca

SEQ ID NO: 6594805 - DNA, 17 bp, Homo sapiens
aatgttgtcctgtgtca

SEQ ID NO: 6594806 - DNA, 13 bp, Homo sapiens
aatgttgtgaata

SEQ ID NO: 6594807 - DNA, 17 bp, Homo sapiens
aatgttgtggtttgttg

SEQ ID NO: 6594808 - DNA, 22 bp, Homo sapiens
aatgttgtgtgggttcaaattc

SEQ ID NO: 6594809 - DNA, 12 bp, Homo sapiens
aatgttgtgtgt

SEQ ID NO: 6594810 - DNA, 15 bp, Homo sapiens
aatgttgtgtgttgc

SEQ ID NO: 6594811 - DNA, 18 bp, Homo sapiens
aatgttgttatgctatta

SEQ ID NO: 6594812 - DNA, 21 bp, Homo sapiens
aatgttgttcaccagtgcttg

SEQ ID NO: 6594813 - DNA, 21 bp, Homo sapiens
aatgttgttcattattggagg

SEQ ID NO: 6594814 - DNA, 23 bp, Homo sapiens
aatgttgtttcctaatatcaaat

SEQ ID NO: 6594815 - DNA, 17 bp, Homo sapiens
aatgtttaaaaaagttt

SEQ ID NO: 6594816 - DNA, 13 bp, Homo sapiens
aatgtttaaaaca

SEQ ID NO: 6594817 - DNA, 20 bp, Homo sapiens
aatgtttaaatcatgtatgt

SEQ ID NO: 6594818 - DNA, 21 bp, Homo sapiens
aatgtttaaatcatgtatgtt

SEQ ID NO: 6594819 - DNA, 21 bp, Homo sapiens
aatgtttaagcagaattggaa

SEQ ID NO: 6594820 - DNA, 16 bp, Homo sapiens
aatgtttaataaagct

SEQ ID NO: 6594821 - DNA, 13 bp, Homo sapiens
aatgtttaatcat

SEQ ID NO: 6594822 - DNA, 17 bp, Homo sapiens
aatgtttaatcatataa

SEQ ID NO: 6594823 - DNA, 14 bp, Homo sapiens
aatgtttaattcat

SEQ ID NO: 6594824 - DNA, 22 bp, Homo sapiens
aatgtttaattcattaatctgt

SEQ ID NO: 6594825 - DNA, 12 bp, Homo sapiens
aatgtttacaaa

SEQ ID NO: 6594826 - DNA, 18 bp, Homo sapiens
aatgtttacaagtaaata

SEQ ID NO: 6594827 - DNA, 20 bp, Homo sapiens
aatgtttacactctttgtaa

SEQ ID NO: 6594828 - DNA, 13 bp, Homo sapiens
aatgtttacattt

SEQ ID NO: 6594829 - DNA, 15 bp, Homo sapiens
aatgtttacattttg

SEQ ID NO: 6594830 - DNA, 20 bp, Homo sapiens
aatgtttactaagtggactg

SEQ ID NO: 6594831 - DNA, 21 bp, Homo sapiens
aatgtttactatagaccaaaa

SEQ ID NO: 6594832 - DNA, 14 bp, Homo sapiens
aatgtttactgtaa

SEQ ID NO: 6594833 - DNA, 16 bp, Homo sapiens
aatgtttactgtaaat

SEQ ID NO: 6594834 - DNA, 20 bp, Homo sapiens
aatgtttagcaaatacatat

SEQ ID NO: 6594835 - DNA, 16 bp, Homo sapiens
aatgtttaggaaattt

SEQ ID NO: 6594836 - DNA, 17 bp, Homo sapiens
aatgtttagtgtgctgc

SEQ ID NO: 6594837 - DNA, 13 bp, Homo sapiens
aatgtttataact

SEQ ID NO: 6594838 - DNA, 17 bp, Homo sapiens
aatgtttatacagagta

SEQ ID NO: 6594839 - DNA, 22 bp, Homo sapiens
aatgtttatactgtatttctaa

SEQ ID NO: 6594840 - DNA, 20 bp, Homo sapiens
aatgtttatattagataacc

SEQ ID NO: 6594841 - DNA, 22 bp, Homo sapiens
aatgtttatgcaaggaaggaaa

SEQ ID NO: 6594842 - DNA, 23 bp, Homo sapiens
aatgtttatgcaaggaaggaaag

SEQ ID NO: 6594843 - DNA, 19 bp, Homo sapiens
aatgtttatggaaatatta

SEQ ID NO: 6594844 - DNA, 17 bp, Homo sapiens
aatgtttattatttaca

SEQ ID NO: 6594845 - DNA, 20 bp, Homo sapiens
aatgtttattccttctgtag

SEQ ID NO: 6594846 - DNA, 16 bp, Homo sapiens
aatgtttattccttga

SEQ ID NO: 6594847 - DNA, 19 bp, Homo sapiens
aatgtttatttagctctga

SEQ ID NO: 6594848 - DNA, 16 bp, Homo sapiens
aatgtttcatgaagaa

SEQ ID NO: 6594849 - DNA, 19 bp, Homo sapiens
aatgtttcatgaagaaaaa

SEQ ID NO: 6594850 - DNA, 20 bp, Homo sapiens
aatgtttccaacctggagta

SEQ ID NO: 6594851 - DNA, 14 bp, Homo sapiens
aatgtttccaggca

SEQ ID NO: 6594852 - DNA, 15 bp, Homo sapiens
aatgtttcccccact

SEQ ID NO: 6594853 - DNA, 17 bp, Homo sapiens
aatgtttcctgtggaaa

SEQ ID NO: 6594854 - DNA, 21 bp, Homo sapiens
aatgtttcctgtggaaatatg

SEQ ID NO: 6594855 - DNA, 13 bp, Homo sapiens
aatgtttccttaa

SEQ ID NO: 6594856 - DNA, 19 bp, Homo sapiens
aatgtttccttaaacatga

SEQ ID NO: 6594857 - DNA, 12 bp, Homo sapiens
aatgtttctctc

SEQ ID NO: 6594858 - DNA, 15 bp, Homo sapiens
aatgtttctggacat

SEQ ID NO: 6594859 - DNA, 16 bp, Homo sapiens
aatgtttctggatttc

SEQ ID NO: 6594860 - DNA, 13 bp, Homo sapiens
aatgtttctgtgt

SEQ ID NO: 6594861 - DNA, 15 bp, Homo sapiens
aatgtttctgtgtca

SEQ ID NO: 6594862 - DNA, 21 bp, Homo sapiens
aatgtttcttttgtttggtaa

SEQ ID NO: 6594863 - DNA, 22 bp, Homo sapiens
aatgtttgaactgccaagaaaa

SEQ ID NO: 6594864 - DNA, 14 bp, Homo sapiens
aatgtttgatttag

SEQ ID NO: 6594865 - DNA, 16 bp, Homo sapiens
aatgtttgatttagta

SEQ ID NO: 6594866 - DNA, 14 bp, Homo sapiens
aatgtttgcatata

SEQ ID NO: 6594867 - DNA, 18 bp, Homo sapiens
aatgtttgcctctgcctc

SEQ ID NO: 6594868 - DNA, 21 bp, Homo sapiens
aatgtttgcttttcactggca

SEQ ID NO: 6594869 - DNA, 14 bp, Homo sapiens
aatgtttggaattt

SEQ ID NO: 6594870 - DNA, 17 bp, Homo sapiens
aatgtttggaatttaag

SEQ ID NO: 6594871 - DNA, 15 bp, Homo sapiens
aatgtttggatggtt

SEQ ID NO: 6594872 - DNA, 16 bp, Homo sapiens
aatgtttgggatatta

SEQ ID NO: 6594873 - DNA, 22 bp, Homo sapiens
aatgtttgggatattaaaacac

SEQ ID NO: 6594874 - DNA, 15 bp, Homo sapiens
aatgtttgtaagcaa

SEQ ID NO: 6594875 - DNA, 23 bp, Homo sapiens
aatgtttgtaagcaattctaagt

SEQ ID NO: 6594876 - DNA, 22 bp, Homo sapiens
aatgtttgtcagtaaatactcc

SEQ ID NO: 6594877 - DNA, 15 bp, Homo sapiens
aatgtttgtgagaag

SEQ ID NO: 6594878 - DNA, 13 bp, Homo sapiens
aatgtttgtgggt

SEQ ID NO: 6594879 - DNA, 12 bp, Homo sapiens
aatgtttgttga

SEQ ID NO: 6594880 - DNA, 23 bp, Homo sapiens
aatgttttaaagtttaatgccta

SEQ ID NO: 6594881 - DNA, 17 bp, Homo sapiens
aatgttttaaatgtaca

SEQ ID NO: 6594882 - DNA, 13 bp, Homo sapiens
aatgttttacaac

SEQ ID NO: 6594883 - DNA, 14 bp, Homo sapiens
aatgttttacaact

SEQ ID NO: 6594884 - DNA, 23 bp, Homo sapiens
aatgttttacaagaattgtccat

SEQ ID NO: 6594885 - DNA, 14 bp, Homo sapiens
aatgttttatgaca

SEQ ID NO: 6594886 - DNA, 21 bp, Homo sapiens
aatgttttatgacatttttct

SEQ ID NO: 6594887 - DNA, 17 bp, Homo sapiens
aatgttttatttatcaa

SEQ ID NO: 6594888 - DNA, 13 bp, Homo sapiens
aatgttttcatta

SEQ ID NO: 6594889 - DNA, 15 bp, Homo sapiens
aatgttttcattatg

SEQ ID NO: 6594890 - DNA, 22 bp, Homo sapiens
aatgttttcatttacaggaaat

SEQ ID NO: 6594891 - DNA, 16 bp, Homo sapiens
aatgttttccaatatt

SEQ ID NO: 6594892 - DNA, 13 bp, Homo sapiens
aatgttttctgca

SEQ ID NO: 6594893 - DNA, 19 bp, Homo sapiens
aatgttttctgcagaaaaa

SEQ ID NO: 6594894 - DNA, 17 bp, Homo sapiens
aatgttttctttgcaaa

SEQ ID NO: 6594895 - DNA, 12 bp, Homo sapiens
aatgttttgaca

SEQ ID NO: 6594896 - DNA, 18 bp, Homo sapiens
aatgttttggaattcaat

SEQ ID NO: 6594897 - DNA, 20 bp, Homo sapiens
aatgttttgtaaacatttat

SEQ ID NO: 6594898 - DNA, 17 bp, Homo sapiens
aatgttttgtaaacttt

SEQ ID NO: 6594899 - DNA, 20 bp, Homo sapiens
aatgttttgtaaactttgaa

SEQ ID NO: 6594900 - DNA, 22 bp, Homo sapiens
aatgttttgtaaactttgaaat

SEQ ID NO: 6594901 - DNA, 18 bp, Homo sapiens
aatgttttgtacaattac

SEQ ID NO: 6594902 - DNA, 15 bp, Homo sapiens
aatgttttgtatata

SEQ ID NO: 6594903 - DNA, 23 bp, Homo sapiens
aatgttttgtgtgtaaggagtat

SEQ ID NO: 6594904 - DNA, 17 bp, Homo sapiens
aatgtttttaaatatat

SEQ ID NO: 6594905 - DNA, 17 bp, Homo sapiens
aatgtttttaatgtatt

SEQ ID NO: 6594906 - DNA, 19 bp, Homo sapiens
aatgtttttatttcaattg

SEQ ID NO: 6594907 - DNA, 20 bp, Homo sapiens
aatgtttttatttcaattgt

SEQ ID NO: 6594908 - DNA, 22 bp, Homo sapiens
aatgtttttatttcaattgttt

SEQ ID NO: 6594909 - DNA, 18 bp, Homo sapiens
aatgtttttccctcccca

SEQ ID NO: 6594910 - DNA, 14 bp, Homo sapiens
aatgtttttctaaa

SEQ ID NO: 6594911 - DNA, 22 bp, Homo sapiens
aatgtttttctcaaaaagctgc

SEQ ID NO: 6594912 - DNA, 22 bp, Homo sapiens
aatgtttttggcaacaggagag

SEQ ID NO: 6594913 - DNA, 23 bp, Homo sapiens
aatgttttttaaaatggttatgt

SEQ ID NO: 6594914 - DNA, 15 bp, Homo sapiens
aatgttttttagaac

SEQ ID NO: 6594915 - DNA, 20 bp, Homo sapiens
aatgttttttgaagttctgg

SEQ ID NO: 6594916 - DNA, 13 bp, Homo sapiens
aatgttttttgcc

SEQ ID NO: 6594917 - DNA, 23 bp, Homo sapiens
aatgttttttgccacagcttttg

SEQ ID NO: 6594918 - DNA, 21 bp, Homo sapiens
aatgttttttggaaattcaga

SEQ ID NO: 6594919 - DNA, 15 bp, Homo sapiens
aatgttttttttcag

SEQ ID NO: 6594920 - DNA, 15 bp, Homo sapiens
aatgtttttttttaa

SEQ ID NO: 6594921 - DNA, 20 bp, Homo sapiens
aatgtttttttttaaagact

SEQ ID NO: 6594922 - DNA, 22 bp, Homo sapiens
aatgtttttttttaaagacttt

SEQ ID NO: 6594923 - DNA, 18 bp, Homo sapiens
aattaaaaaaataataac

SEQ ID NO: 6594924 - DNA, 22 bp, Homo sapiens
aattaaaaaaatatatattgta

SEQ ID NO: 6594925 - DNA, 19 bp, Homo sapiens
aattaaaaaagataaacac

SEQ ID NO: 6594926 - DNA, 17 bp, Homo sapiens
aattaaaaaatttccag

SEQ ID NO: 6594927 - DNA, 17 bp, Homo sapiens
aattaaaaacagaaaat

SEQ ID NO: 6594928 - DNA, 17 bp, Homo sapiens
aattaaaaactagtagt

SEQ ID NO: 6594929 - DNA, 21 bp, Homo sapiens
aattaaaaactagtagttctc

SEQ ID NO: 6594930 - DNA, 12 bp, Homo sapiens
aattaaaaagat

SEQ ID NO: 6594931 - DNA, 16 bp, Homo sapiens
aattaaaaagattctt

SEQ ID NO: 6594932 - DNA, 17 bp, Homo sapiens
aattaaaaatgaaaatt

SEQ ID NO: 6594933 - DNA, 13 bp, Homo sapiens
aattaaaacaaaa

SEQ ID NO: 6594934 - DNA, 14 bp, Homo sapiens
aattaaaacaaaac

SEQ ID NO: 6594935 - DNA, 13 bp, Homo sapiens
aattaaaacaaat

SEQ ID NO: 6594936 - DNA, 13 bp, Homo sapiens
aattaaaactatg

SEQ ID NO: 6594937 - DNA, 13 bp, Homo sapiens
aattaaaactgaa

SEQ ID NO: 6594938 - DNA, 15 bp, Homo sapiens
aattaaaactgagtc

SEQ ID NO: 6594939 - DNA, 21 bp, Homo sapiens
aattaaaagcaaatcatttgt

SEQ ID NO: 6594940 - DNA, 20 bp, Homo sapiens
aattaaaaggatagtatttt

SEQ ID NO: 6594941 - DNA, 22 bp, Homo sapiens
aattaaaaggatagtattttta

SEQ ID NO: 6594942 - DNA, 16 bp, Homo sapiens
aattaaaagtcttttt

SEQ ID NO: 6594943 - DNA, 17 bp, Homo sapiens
aattaaaataaaacaca

SEQ ID NO: 6594944 - DNA, 21 bp, Homo sapiens
aattaaaataggcatattact

SEQ ID NO: 6594945 - DNA, 20 bp, Homo sapiens
aattaaaatatatataaata

SEQ ID NO: 6594946 - DNA, 18 bp, Homo sapiens
aattaaaatccagcatcc

SEQ ID NO: 6594947 - DNA, 13 bp, Homo sapiens
aattaaaatctca

SEQ ID NO: 6594948 - DNA, 10 bp, Homo sapiens
aattaaaatg

SEQ ID NO: 6594949 - DNA, 13 bp, Homo sapiens
aattaaaatggtt

SEQ ID NO: 6594950 - DNA, 18 bp, Homo sapiens
aattaaaatggtttttgt

SEQ ID NO: 6594951 - DNA, 14 bp, Homo sapiens
aattaaaatgtcta

SEQ ID NO: 6594952 - DNA, 16 bp, Homo sapiens
aattaaaattacaaaa

SEQ ID NO: 6594953 - DNA, 19 bp, Homo sapiens
aattaaaattcatactgta

SEQ ID NO: 6594954 - DNA, 12 bp, Homo sapiens
aattaaaattgt

SEQ ID NO: 6594955 - DNA, 11 bp, Homo sapiens
aattaaaattt

SEQ ID NO: 6594956 - DNA, 14 bp, Homo sapiens
aattaaaatttaac

SEQ ID NO: 6594957 - DNA, 18 bp, Homo sapiens
aattaaaatttatcttaa

SEQ ID NO: 6594958 - DNA, 14 bp, Homo sapiens
aattaaaattttat

SEQ ID NO: 6594959 - DNA, 17 bp, Homo sapiens
aattaaaattttatgac

SEQ ID NO: 6594960 - DNA, 14 bp, Homo sapiens
aattaaacatgaaa

SEQ ID NO: 6594961 - DNA, 15 bp, Homo sapiens
tttgaaatattgact

SEQ ID NO: 6594962 - DNA, 20 bp, Homo sapiens
tttgaaatcagtaaacactg

SEQ ID NO: 6594963 - DNA, 11 bp, Homo sapiens
tttgaaatccc

SEQ ID NO: 6594964 - DNA, 18 bp, Homo sapiens
tttgaaatcgttggaaaa

SEQ ID NO: 6594965 - DNA, 16 bp, Homo sapiens
tttgaaatgaaattta

SEQ ID NO: 6594966 - DNA, 14 bp, Homo sapiens
tttgaaatgaactt

SEQ ID NO: 6594967 - DNA, 15 bp, Homo sapiens
tttgaaatgctaaac

SEQ ID NO: 6594968 - DNA, 18 bp, Homo sapiens
tttgaaatgctaaacttg

SEQ ID NO: 6594969 - DNA, 14 bp, Homo sapiens
tttgaaatgggcat

SEQ ID NO: 6594970 - DNA, 22 bp, Homo sapiens
tttgaaatgtcgatcaagagaa

SEQ ID NO: 6594971 - DNA, 14 bp, Homo sapiens
tttgaaatgtttaa

SEQ ID NO: 6594972 - DNA, 14 bp, Homo sapiens
tttgaaatgttttt

SEQ ID NO: 6594973 - DNA, 16 bp, Homo sapiens
tttgaaattatgtaaa

SEQ ID NO: 6594974 - DNA, 21 bp, Homo sapiens
tttgaaattatgtaaattatg

SEQ ID NO: 6594975 - DNA, 17 bp, Homo sapiens
tttgaaattatgtgaca

SEQ ID NO: 6594976 - DNA, 13 bp, Homo sapiens
tttgaaattctga

SEQ ID NO: 6594977 - DNA, 14 bp, Homo sapiens
tttgaaattctgaa

SEQ ID NO: 6594978 - DNA, 20 bp, Homo sapiens
tttgaaattctgaatttgca

SEQ ID NO: 6594979 - DNA, 21 bp, Homo sapiens
tttgaaattctgaatttgcaa

SEQ ID NO: 6594980 - DNA, 15 bp, Homo sapiens
tttgaacaaatgtat

SEQ ID NO: 6594981 - DNA, 14 bp, Homo sapiens
tttgaacacattct

SEQ ID NO: 6594982 - DNA, 21 bp, Homo sapiens
tttgaacacgaaagaaatgta

SEQ ID NO: 6594983 - DNA, 12 bp, Homo sapiens
tttgaacaggtc

SEQ ID NO: 6594984 - DNA, 22 bp, Homo sapiens
tttgaacatgtgccttttctga

SEQ ID NO: 6594985 - DNA, 20 bp, Homo sapiens
tttgaacatgtttaatgggt

SEQ ID NO: 6594986 - DNA, 20 bp, Homo sapiens
tttgaacattaatgttgaaa

SEQ ID NO: 6594987 - DNA, 16 bp, Homo sapiens
tttgaaccaaaacatt

SEQ ID NO: 6594988 - DNA, 22 bp, Homo sapiens
tttgaacccccgccatccttca

SEQ ID NO: 6594989 - DNA, 15 bp, Homo sapiens
tttgaacccctgtgt

SEQ ID NO: 6594990 - DNA, 18 bp, Homo sapiens
tttgaacctgatgaaaat

SEQ ID NO: 6594991 - DNA, 20 bp, Homo sapiens
tttgaacctgatgaaaataa

SEQ ID NO: 6594992 - DNA, 18 bp, Homo sapiens
tttgaacgtgccagcagc

SEQ ID NO: 6594993 - DNA, 22 bp, Homo sapiens
tttgaacgtgccagcagccctt

SEQ ID NO: 6594994 - DNA, 21 bp, Homo sapiens
tttgaactaagaaacttttgt

SEQ ID NO: 6594995 - DNA, 15 bp, Homo sapiens
tttgaactaataaaa

SEQ ID NO: 6594996 - DNA, 18 bp, Homo sapiens
tttgaactgaaacttttc

SEQ ID NO: 6594997 - DNA, 22 bp, Homo sapiens
tttgaactgaaacttttctaaa

SEQ ID NO: 6594998 - DNA, 15 bp, Homo sapiens
tttgaactgataaag

SEQ ID NO: 6594999 - DNA, 19 bp, Homo sapiens
tttgaactgttagatgctg

SEQ ID NO: 6595000 - DNA, 11 bp, Homo sapiens
tttgaactttg

SEQ ID NO: 6595001 - DNA, 19 bp, Homo sapiens
tttgaagaacaaaaggctt

SEQ ID NO: 6595002 - DNA, 17 bp, Homo sapiens
tttgaagaacatgtgag

SEQ ID NO: 6595003 - DNA, 18 bp, Homo sapiens
tttgaagaacatgtgaga

SEQ ID NO: 6595004 - DNA, 18 bp, Homo sapiens
tttgaagaaggcaaggct

SEQ ID NO: 6595005 - DNA, 17 bp, Homo sapiens
tttgaagaatatttaag

SEQ ID NO: 6595006 - DNA, 18 bp, Homo sapiens
tttgaagaatatttaaga

SEQ ID NO: 6595007 - DNA, 15 bp, Homo sapiens
tttgaagaattaatg

SEQ ID NO: 6595008 - DNA, 18 bp, Homo sapiens
tttgaagaattaatgaca

SEQ ID NO: 6595009 - DNA, 12 bp, Homo sapiens
tttgaagaattg

SEQ ID NO: 6595010 - DNA, 21 bp, Homo sapiens
tttgaagacgtggactcctct

SEQ ID NO: 6595011 - DNA, 23 bp, Homo sapiens
tttgaagacttcaaaatattgag

SEQ ID NO: 6595012 - DNA, 22 bp, Homo sapiens
tttgaagagattgctgacgccc

SEQ ID NO: 6595013 - DNA, 16 bp, Homo sapiens
tttgaagattctatgt

SEQ ID NO: 6595014 - DNA, 20 bp, Homo sapiens
tttgaagcaaatacaattca

SEQ ID NO: 6595015 - DNA, 21 bp, Homo sapiens
tttgaagcaactgtgaattca

SEQ ID NO: 6595016 - DNA, 18 bp, Homo sapiens
tttgaagcagctctgcct

SEQ ID NO: 6595017 - DNA, 20 bp, Homo sapiens
tttgaagcagtcttgctctg

SEQ ID NO: 6595018 - DNA, 22 bp, Homo sapiens
tttgaagcctgcccttgtctga

SEQ ID NO: 6595019 - DNA, 21 bp, Homo sapiens
tttgaagcctgtgcctcccag

SEQ ID NO: 6595020 - DNA, 16 bp, Homo sapiens
tttgaagctaattatt

SEQ ID NO: 6595021 - DNA, 18 bp, Homo sapiens
tttgaagctactgtgtgt

SEQ ID NO: 6595022 - DNA, 23 bp, Homo sapiens
tttgaaggaaatgagtggccagc

SEQ ID NO: 6595023 - DNA, 14 bp, Homo sapiens
tttgaaggagaatg

SEQ ID NO: 6595024 - DNA, 18 bp, Homo sapiens
tttgaagggagaagacac

SEQ ID NO: 6595025 - DNA, 22 bp, Homo sapiens
tttgaagggagaagacactgca

SEQ ID NO: 6595026 - DNA, 17 bp, Homo sapiens
tttgaagggcaagaaat

SEQ ID NO: 6595027 - DNA, 23 bp, Homo sapiens
tttgaagtaggtggcttgagcta

SEQ ID NO: 6595028 - DNA, 14 bp, Homo sapiens
tttgaagtcagaga

SEQ ID NO: 6595029 - DNA, 16 bp, Homo sapiens
tttgaagtctgacaat

SEQ ID NO: 6595030 - DNA, 19 bp, Homo sapiens
tttgaagtcttccctcaga

SEQ ID NO: 6595031 - DNA, 13 bp, Homo sapiens
tttgaagtcttgt

SEQ ID NO: 6595032 - DNA, 23 bp, Homo sapiens
tttgaagtgcctctgattctatg

SEQ ID NO: 6595033 - DNA, 10 bp, Homo sapiens
tttgaagtgt

SEQ ID NO: 6595034 - DNA, 11 bp, Homo sapiens
tttgaagtgta

SEQ ID NO: 6595035 - DNA, 18 bp, Homo sapiens
tttgaagtgtaggcagac

SEQ ID NO: 6595036 - DNA, 21 bp, Homo sapiens
tttgaagtgtaggcagacaca

SEQ ID NO: 6595037 - DNA, 16 bp, Homo sapiens
tttgaagttagcttta

SEQ ID NO: 6595038 - DNA, 17 bp, Homo sapiens
tttgaataaaaaacatt

SEQ ID NO: 6595039 - DNA, 21 bp, Homo sapiens
tttgaataaaaaacatttgta

SEQ ID NO: 6595040 - DNA, 16 bp, Homo sapiens
tttgaataaaaagtga

SEQ ID NO: 6595041 - DNA, 12 bp, Homo sapiens
tttgaataaaag

SEQ ID NO: 6595042 - DNA, 23 bp, Homo sapiens
tttgaataaactctcccctttct

SEQ ID NO: 6595043 - DNA, 14 bp, Homo sapiens
tttgaataaagaat

SEQ ID NO: 6595044 - DNA, 16 bp, Homo sapiens
tttgaataaagaatac

SEQ ID NO: 6595045 - DNA, 21 bp, Homo sapiens
tttgaataaagaatacttgaa

SEQ ID NO: 6595046 - DNA, 18 bp, Homo sapiens
tttgaataacaaggaaaa

SEQ ID NO: 6595047 - DNA, 12 bp, Homo sapiens
tttgaataagca

SEQ ID NO: 6595048 - DNA, 17 bp, Homo sapiens
tttgaatacatttgtat

SEQ ID NO: 6595049 - DNA, 22 bp, Homo sapiens
tttgaataccattaaaactgct

SEQ ID NO: 6595050 - DNA, 21 bp, Homo sapiens
tttgaatacccccagagacct

SEQ ID NO: 6595051 - DNA, 19 bp, Homo sapiens
tttgaatataaacactata

SEQ ID NO: 6595052 - DNA, 14 bp, Homo sapiens
tttgaatatgcctt

SEQ ID NO: 6595053 - DNA, 14 bp, Homo sapiens
tttgaatatggaca

SEQ ID NO: 6595054 - DNA, 19 bp, Homo sapiens
tttgaatatgtagtatcta

SEQ ID NO: 6595055 - DNA, 17 bp, Homo sapiens
tttgaatatttgtttta

SEQ ID NO: 6595056 - DNA, 16 bp, Homo sapiens
tttgaatattttttga

SEQ ID NO: 6595057 - DNA, 14 bp, Homo sapiens
tttgaatcaatctg

SEQ ID NO: 6595058 - DNA, 17 bp, Homo sapiens
tttgaatccatgcttgg

SEQ ID NO: 6595059 - DNA, 19 bp, Homo sapiens
tttgaatcctctctctgtg

SEQ ID NO: 6595060 - DNA, 20 bp, Homo sapiens
tttgaatctatttatcttca

SEQ ID NO: 6595061 - DNA, 16 bp, Homo sapiens
tttgaatctcataatt

SEQ ID NO: 6595062 - DNA, 16 bp, Homo sapiens
tttgaatcttgtctca

SEQ ID NO: 6595063 - DNA, 13 bp, Homo sapiens
tttgaatctttaa

SEQ ID NO: 6595064 - DNA, 15 bp, Homo sapiens
tttgaatctttaatt

SEQ ID NO: 6595065 - DNA, 22 bp, Homo sapiens
tttgaatgaaaaatttaagcat

SEQ ID NO: 6595066 - DNA, 23 bp, Homo sapiens
tttgaatgaaaaatttaagcatt

SEQ ID NO: 6595067 - DNA, 24 bp, Homo sapiens
tttgaatgaaaaatttaagcattg

SEQ ID NO: 6595068 - DNA, 13 bp, Homo sapiens
tttgaatgaaaac

SEQ ID NO: 6595069 - DNA, 17 bp, Homo sapiens
tttgaatgatttttctt

SEQ ID NO: 6595070 - DNA, 15 bp, Homo sapiens
tttgaatgcaaaaga

SEQ ID NO: 6595071 - DNA, 14 bp, Homo sapiens
tttgaatgcatttt

SEQ ID NO: 6595072 - DNA, 23 bp, Homo sapiens
tttgaatgcctcataaattaatg

SEQ ID NO: 6595073 - DNA, 12 bp, Homo sapiens
tttgaatgctta

SEQ ID NO: 6595074 - DNA, 16 bp, Homo sapiens
tttgaatgcttcctga

SEQ ID NO: 6595075 - DNA, 12 bp, Homo sapiens
tttgaatggatt

SEQ ID NO: 6595076 - DNA, 21 bp, Homo sapiens
tttgaatggattaaatggcac

SEQ ID NO: 6595077 - DNA, 13 bp, Homo sapiens
tttgaatgtaacc

SEQ ID NO: 6595078 - DNA, 16 bp, Homo sapiens
tttgaatgtatttgat

SEQ ID NO: 6595079 - DNA, 15 bp, Homo sapiens
tttgaatgtcataaa

SEQ ID NO: 6595080 - DNA, 22 bp, Homo sapiens
tttgaatgtgattttaaagagt

SEQ ID NO: 6595081 - DNA, 11 bp, Homo sapiens
tttgaatgtgg

SEQ ID NO: 6595082 - DNA, 21 bp, Homo sapiens
tttgaatgtgtgaattcaata

SEQ ID NO: 6595083 - DNA, 15 bp, Homo sapiens
tttgaatgtgtttca

SEQ ID NO: 6595084 - DNA, 12 bp, Homo sapiens
tttgaatgttaa

SEQ ID NO: 6595085 - DNA, 13 bp, Homo sapiens
tttgaatgttaaa

SEQ ID NO: 6595086 - DNA, 16 bp, Homo sapiens
tttgaatgttaaataa

SEQ ID NO: 6595087 - DNA, 13 bp, Homo sapiens
tttgaatgttaat

SEQ ID NO: 6595088 - DNA, 16 bp, Homo sapiens
tttgaatgttagatgc

SEQ ID NO: 6595089 - DNA, 18 bp, Homo sapiens
tttgaattaatctagaaa

SEQ ID NO: 6595090 - DNA, 14 bp, Homo sapiens
tttgaattagaaga

SEQ ID NO: 6595091 - DNA, 18 bp, Homo sapiens
tttgaattatttctttat

SEQ ID NO: 6595092 - DNA, 19 bp, Homo sapiens
tttgaattcatttgctgac

SEQ ID NO: 6595093 - DNA, 20 bp, Homo sapiens
tttgaattcctcctctattt

SEQ ID NO: 6595094 - DNA, 18 bp, Homo sapiens
tttgaattctttagattt

SEQ ID NO: 6595095 - DNA, 19 bp, Homo sapiens
tttgaattctttagatttt

SEQ ID NO: 6595096 - DNA, 14 bp, Homo sapiens
tttgaattggcctg

SEQ ID NO: 6595097 - DNA, 16 bp, Homo sapiens
tttgaattggcctgaa

SEQ ID NO: 6595098 - DNA, 23 bp, Homo sapiens
tttgaattggcctgaacagatgt

SEQ ID NO: 6595099 - DNA, 18 bp, Homo sapiens
tttgaattgtgtcttaat

SEQ ID NO: 6595100 - DNA, 13 bp, Homo sapiens
tttgaattgtgtg

SEQ ID NO: 6595101 - DNA, 20 bp, Homo sapiens
tttgaattgtgtggagaagt

SEQ ID NO: 6595102 - DNA, 16 bp, Homo sapiens
tttgaattgttttctt

SEQ ID NO: 6595103 - DNA, 16 bp, Homo sapiens
tttgaatttaaataaa

SEQ ID NO: 6595104 - DNA, 14 bp, Homo sapiens
tttgaatttactgg

SEQ ID NO: 6595105 - DNA, 20 bp, Homo sapiens
tttgaatttatataaagtat

SEQ ID NO: 6595106 - DNA, 17 bp, Homo sapiens
tttgaattttaaatcta

SEQ ID NO: 6595107 - DNA, 13 bp, Homo sapiens
tttgaattttcaa

SEQ ID NO: 6595108 - DNA, 23 bp, Homo sapiens
tttgaattttcattttacagtta

SEQ ID NO: 6595109 - DNA, 14 bp, Homo sapiens
tttgaattttgtgt

SEQ ID NO: 6595110 - DNA, 17 bp, Homo sapiens
tttgaattttgttttta

SEQ ID NO: 6595111 - DNA, 19 bp, Homo sapiens
tttgaatttttacatttgt

SEQ ID NO: 6595112 - DNA, 12 bp, Homo sapiens
tttgacaaaaat

SEQ ID NO: 6595113 - DNA, 16 bp, Homo sapiens
tttgacaaaagtaaat

SEQ ID NO: 6595114 - DNA, 15 bp, Homo sapiens
tttgacaaacacaat

SEQ ID NO: 6595115 - DNA, 23 bp, Homo sapiens
tttgacaagctggcttacactgg

SEQ ID NO: 6595116 - DNA, 22 bp, Homo sapiens
tttgacaatcaaagaaaagact

SEQ ID NO: 6595117 - DNA, 17 bp, Homo sapiens
tttgacacaacatctga

SEQ ID NO: 6595118 - DNA, 13 bp, Homo sapiens
tttgacacactca

SEQ ID NO: 6595119 - DNA, 15 bp, Homo sapiens
tttgacactatatct

SEQ ID NO: 6595120 - DNA, 12 bp, Homo sapiens
tttgacactgaa

SEQ ID NO: 6595121 - DNA, 13 bp, Homo sapiens
tttgacactgaaa

SEQ ID NO: 6595122 - DNA, 19 bp, Homo sapiens
tttgacactgaaagttttg

SEQ ID NO: 6595123 - DNA, 22 bp, Homo sapiens
tttgacactgaaagttttgtaa

SEQ ID NO: 6595124 - DNA, 21 bp, Homo sapiens
tttgacacttatagattgaaa

SEQ ID NO: 6595125 - DNA, 19 bp, Homo sapiens
tttgacacttttaaaaaac

SEQ ID NO: 6595126 - DNA, 22 bp, Homo sapiens
tttgacacttttaaaaaacaaa

SEQ ID NO: 6595127 - DNA, 22 bp, Homo sapiens
tttgacagaatatgtttcaaac

SEQ ID NO: 6595128 - DNA, 18 bp, Homo sapiens
tttgacagcgcacagctg

SEQ ID NO: 6595129 - DNA, 13 bp, Homo sapiens
tttgacagtgtgg

SEQ ID NO: 6595130 - DNA, 16 bp, Homo sapiens
tttgacatgaaaagat

SEQ ID NO: 6595131 - DNA, 17 bp, Homo sapiens
tttgacatgaacagaaa

SEQ ID NO: 6595132 - DNA, 15 bp, Homo sapiens
tttgacatgtgaagc

SEQ ID NO: 6595133 - DNA, 17 bp, Homo sapiens
tttgacattgtatgtat

SEQ ID NO: 6595134 - DNA, 22 bp, Homo sapiens
tttgacattgtatgtatctatt

SEQ ID NO: 6595135 - DNA, 13 bp, Homo sapiens
tttgacatttcat

SEQ ID NO: 6595136 - DNA, 12 bp, Homo sapiens
tttgaccaattt

SEQ ID NO: 6595137 - DNA, 14 bp, Homo sapiens
tttgaccaatttgc

SEQ ID NO: 6595138 - DNA, 13 bp, Homo sapiens
tttgaccagaaaa

SEQ ID NO: 6595139 - DNA, 19 bp, Homo sapiens
tttgaccagatctttctct

SEQ ID NO: 6595140 - DNA, 14 bp, Homo sapiens
tttgaccaggaaag

SEQ ID NO: 6595141 - DNA, 18 bp, Homo sapiens
tttgaccatggaaagaaa

SEQ ID NO: 6595142 - DNA, 15 bp, Homo sapiens
tttgaccccttcctg

SEQ ID NO: 6595143 - DNA, 16 bp, Homo sapiens
tttgaccccttcctgt

SEQ ID NO: 6595144 - DNA, 20 bp, Homo sapiens
tttgaccccttcctgtctgg

SEQ ID NO: 6595145 - DNA, 21 bp, Homo sapiens
tttgacctctgcagcaataaa

SEQ ID NO: 6595146 - DNA, 22 bp, Homo sapiens
tttgacctgacgatcttccccc

SEQ ID NO: 6595147 - DNA, 19 bp, Homo sapiens
tttgacgaagaaacaaaaa

SEQ ID NO: 6595148 - DNA, 14 bp, Homo sapiens
tttgacgccatccc

SEQ ID NO: 6595149 - DNA, 20 bp, Homo sapiens
tttgacgccatcccagcccc

SEQ ID NO: 6595150 - DNA, 19 bp, Homo sapiens
tttgacgggaggcctcagt

SEQ ID NO: 6595151 - DNA, 21 bp, Homo sapiens
tttgacgtcactgatattttt

SEQ ID NO: 6595152 - DNA, 16 bp, Homo sapiens
tttgactaagaatttt

SEQ ID NO: 6595153 - DNA, 22 bp, Homo sapiens
tttgactagccatctcaagcaa

SEQ ID NO: 6595154 - DNA, 16 bp, Homo sapiens
tttgactattctgtat

SEQ ID NO: 6595155 - DNA, 15 bp, Homo sapiens
tttgactcagaggct

SEQ ID NO: 6595156 - DNA, 20 bp, Homo sapiens
tttgactctggggtgcagct

SEQ ID NO: 6595157 - DNA, 14 bp, Homo sapiens
tttgactctttcaa

SEQ ID NO: 6595158 - DNA, 13 bp, Homo sapiens
tttgactgaaaaa

SEQ ID NO: 6595159 - DNA, 15 bp, Homo sapiens
tttgactgaaaaaaa

SEQ ID NO: 6595160 - DNA, 15 bp, Homo sapiens
tttgactgattgttt

SEQ ID NO: 6595161 - DNA, 22 bp, Homo sapiens
tttgactgcttcacggactctt

SEQ ID NO: 6595162 - DNA, 12 bp, Homo sapiens
tttgactgtaat

SEQ ID NO: 6595163 - DNA, 15 bp, Homo sapiens
tttgactgtcagcaa

SEQ ID NO: 6595164 - DNA, 18 bp, Homo sapiens
tttgactgtctcactttt

SEQ ID NO: 6595165 - DNA, 18 bp, Homo sapiens
tttgacttaagaaagcaa

SEQ ID NO: 6595166 - DNA, 14 bp, Homo sapiens
tttgacttcagctg

SEQ ID NO: 6595167 - DNA, 19 bp, Homo sapiens
tttgacttcagctgcctga

SEQ ID NO: 6595168 - DNA, 14 bp, Homo sapiens
tttgacttcttgct

SEQ ID NO: 6595169 - DNA, 14 bp, Homo sapiens
tttgactttaattt

SEQ ID NO: 6595170 - DNA, 13 bp, Homo sapiens
tttgactttctgt

SEQ ID NO: 6595171 - DNA, 18 bp, Homo sapiens
tttgactttcttctgaat

SEQ ID NO: 6595172 - DNA, 14 bp, Homo sapiens
tttgacttttctgt

SEQ ID NO: 6595173 - DNA, 16 bp, Homo sapiens
tttgacttttctgtaa

SEQ ID NO: 6595174 - DNA, 17 bp, Homo sapiens
tttgagaaaaaggaaaa

SEQ ID NO: 6595175 - DNA, 14 bp, Homo sapiens
tttgagaaagaaat

SEQ ID NO: 6595176 - DNA, 20 bp, Homo sapiens
tttgagaaagaaataattgt

SEQ ID NO: 6595177 - DNA, 23 bp, Homo sapiens
tttgagaaatttttttttccagt

SEQ ID NO: 6595178 - DNA, 14 bp, Homo sapiens
tttgagaagaaaac

SEQ ID NO: 6595179 - DNA, 16 bp, Homo sapiens
tttgagaatacaagat

SEQ ID NO: 6595180 - DNA, 14 bp, Homo sapiens
tttgagaatgtgat

SEQ ID NO: 6595181 - DNA, 19 bp, Homo sapiens
tttgagacagtttcttagc

SEQ ID NO: 6595182 - DNA, 18 bp, Homo sapiens
tttgagaccagaagaaaa

SEQ ID NO: 6595183 - DNA, 20 bp, Homo sapiens
tttgagaccagaagaaaaga

SEQ ID NO: 6595184 - DNA, 23 bp, Homo sapiens
tttgagaccagaagaaaagactt

SEQ ID NO: 6595185 - DNA, 14 bp, Homo sapiens
tttgagaccagcct

SEQ ID NO: 6595186 - DNA, 23 bp, Homo sapiens
tttgagacctgaatagctcccag

SEQ ID NO: 6595187 - DNA, 10 bp, Homo sapiens
tttgagacgg

SEQ ID NO: 6595188 - DNA, 13 bp, Homo sapiens
tttgagactgaaa

SEQ ID NO: 6595189 - DNA, 19 bp, Homo sapiens
tttgagagagagaaccttt

SEQ ID NO: 6595190 - DNA, 14 bp, Homo sapiens
tttgagagttctaa

SEQ ID NO: 6595191 - DNA, 18 bp, Homo sapiens
tttgagatattaaagatt

SEQ ID NO: 6595192 - DNA, 16 bp, Homo sapiens
tttgagatcagcctgg

SEQ ID NO: 6595193 - DNA, 17 bp, Homo sapiens
tttgagatcagcctggg

SEQ ID NO: 6595194 - DNA, 17 bp, Homo sapiens
tttgagatctaaaaata

SEQ ID NO: 6595195 - DNA, 18 bp, Homo sapiens
tttgagatgtacatcttt

SEQ ID NO: 6595196 - DNA, 20 bp, Homo sapiens
tttgagatgtgttcctcctg

SEQ ID NO: 6595197 - DNA, 22 bp, Homo sapiens
tttgagattcctgtaaatgtga

SEQ ID NO: 6595198 - DNA, 14 bp, Homo sapiens
tttgagcaattcat

SEQ ID NO: 6595199 - DNA, 13 bp, Homo sapiens
tttgagcacaatc

SEQ ID NO: 6595200 - DNA, 20 bp, Homo sapiens
tttgagcatcacttaggaga

SEQ ID NO: 6595201 - DNA, 14 bp, Homo sapiens
tttgagcattagaa

SEQ ID NO: 6595202 - DNA, 14 bp, Homo sapiens
tttgagccatttaa

SEQ ID NO: 6595203 - DNA, 19 bp, Homo sapiens
tttgagcccattcttctgg

SEQ ID NO: 6595204 - DNA, 15 bp, Homo sapiens
tttgagcccttgttt

SEQ ID NO: 6595205 - DNA, 16 bp, Homo sapiens
tttgagcctgggaaat

SEQ ID NO: 6595206 - DNA, 21 bp, Homo sapiens
tttgagccttagttttttcat

SEQ ID NO: 6595207 - DNA, 19 bp, Homo sapiens
tttgagcctttattggtaa

SEQ ID NO: 6595208 - DNA, 19 bp, Homo sapiens
tttgagctagttacataaa

SEQ ID NO: 6595209 - DNA, 19 bp, Homo sapiens
tttgagctattcacctcag

SEQ ID NO: 6595210 - DNA, 14 bp, Homo sapiens
tttgagctcagccc

SEQ ID NO: 6595211 - DNA, 15 bp, Homo sapiens
tttgagcttaatctt

SEQ ID NO: 6595212 - DNA, 15 bp, Homo sapiens
tttgagcttctcctc

SEQ ID NO: 6595213 - DNA, 17 bp, Homo sapiens
tttgagcttctcctctg

SEQ ID NO: 6595214 - DNA, 13 bp, Homo sapiens
tttgagctttcat

SEQ ID NO: 6595215 - DNA, 17 bp, Homo sapiens
tttgaggaaatttgcag

SEQ ID NO: 6595216 - DNA, 20 bp, Homo sapiens
tttgaggacttgttaaagag

SEQ ID NO: 6595217 - DNA, 22 bp, Homo sapiens
tttgaggagaagggggtctctg

SEQ ID NO: 6595218 - DNA, 15 bp, Homo sapiens
tttgaggagagtgaa

SEQ ID NO: 6595219 - DNA, 17 bp, Homo sapiens
tttgaggagcatgtttt

SEQ ID NO: 6595220 - DNA, 19 bp, Homo sapiens
tttgaggagctggaggggt

SEQ ID NO: 6595221 - DNA, 11 bp, Homo sapiens
tttgaggataa

SEQ ID NO: 6595222 - DNA, 22 bp, Homo sapiens
tttgaggatatattttcacttt

SEQ ID NO: 6595223 - DNA, 17 bp, Homo sapiens
tttgaggattagtttag

SEQ ID NO: 6595224 - DNA, 14 bp, Homo sapiens
tttgaggattcctg

SEQ ID NO: 6595225 - DNA, 15 bp, Homo sapiens
tttgaggcaaaagaa

SEQ ID NO: 6595226 - DNA, 17 bp, Homo sapiens
tttgaggcaaattaact

SEQ ID NO: 6595227 - DNA, 19 bp, Homo sapiens
tttgaggcagcgcattgtt

SEQ ID NO: 6595228 - DNA, 20 bp, Homo sapiens
tttgaggctcaccagaatta

SEQ ID NO: 6595229 - DNA, 23 bp, Homo sapiens
tttgagggacaaatttaaaacaa

SEQ ID NO: 6595230 - DNA, 21 bp, Homo sapiens
tttgagggactgcctctgcca

SEQ ID NO: 6595231 - DNA, 17 bp, Homo sapiens
tttgagggcatgaagct

SEQ ID NO: 6595232 - DNA, 16 bp, Homo sapiens
tttgaggggaaaacac

SEQ ID NO: 6595233 - DNA, 17 bp, Homo sapiens
tttgaggtagaggaaaa

SEQ ID NO: 6595234 - DNA, 19 bp, Homo sapiens
tttgaggtagaggaaaatc

SEQ ID NO: 6595235 - DNA, 18 bp, Homo sapiens
tttgaggtatcactgcag

SEQ ID NO: 6595236 - DNA, 14 bp, Homo sapiens
tttgaggtcagtgt

SEQ ID NO: 6595237 - DNA, 15 bp, Homo sapiens
tttgaggtctacatt

SEQ ID NO: 6595238 - DNA, 17 bp, Homo sapiens
tttgaggtctgttcttt

SEQ ID NO: 6595239 - DNA, 12 bp, Homo sapiens
tttgaggtcttt

SEQ ID NO: 6595240 - DNA, 23 bp, Homo sapiens
tttgaggttggaaaatatctttg

SEQ ID NO: 6595241 - DNA, 20 bp, Homo sapiens
tttgaggtttttaagcctta

SEQ ID NO: 6595242 - DNA, 19 bp, Homo sapiens
tttgagtaaaaagacattt

SEQ ID NO: 6595243 - DNA, 23 bp, Homo sapiens
tttgagtaattcaagcctctaaa

SEQ ID NO: 6595244 - DNA, 15 bp, Homo sapiens
tttgagtaattttct

SEQ ID NO: 6595245 - DNA, 19 bp, Homo sapiens
tttgagtcaaagacttaaa

SEQ ID NO: 6595246 - DNA, 15 bp, Homo sapiens
tttgagtccagtgtg

SEQ ID NO: 6595247 - DNA, 16 bp, Homo sapiens
tttgagtccctccaaa

SEQ ID NO: 6595248 - DNA, 16 bp, Homo sapiens
tttgagtgagggtttc

SEQ ID NO: 6595249 - DNA, 16 bp, Homo sapiens
tttgagtgattatttg

SEQ ID NO: 6595250 - DNA, 21 bp, Homo sapiens
tttgagtgccttacacaatgg

SEQ ID NO: 6595251 - DNA, 13 bp, Homo sapiens
tttgagtgctctg

SEQ ID NO: 6595252 - DNA, 22 bp, Homo sapiens
tttgagtggagttactgaacag

SEQ ID NO: 6595253 - DNA, 20 bp, Homo sapiens
tttgagtggatgatgtttcg

SEQ ID NO: 6595254 - DNA, 21 bp, Homo sapiens
tttgagtggatgatgtttcgt

SEQ ID NO: 6595255 - DNA, 15 bp, Homo sapiens
tttgagtgtactgtg

SEQ ID NO: 6595256 - DNA, 15 bp, Homo sapiens
tttgagtgtcaggct

SEQ ID NO: 6595257 - DNA, 13 bp, Homo sapiens
tttgagtgtgcaa

SEQ ID NO: 6595258 - DNA, 15 bp, Homo sapiens
tttgagtgtgcaata

SEQ ID NO: 6595259 - DNA, 18 bp, Homo sapiens
tttgagtgtgtgtgtgca

SEQ ID NO: 6595260 - DNA, 14 bp, Homo sapiens
tttgagttatagtt

SEQ ID NO: 6595261 - DNA, 12 bp, Homo sapiens
tttgagttctac

SEQ ID NO: 6595262 - DNA, 15 bp, Homo sapiens
tttgagttgcaccct

SEQ ID NO: 6595263 - DNA, 16 bp, Homo sapiens
tttgagtttcagctgg

SEQ ID NO: 6595264 - DNA, 21 bp, Homo sapiens
tttgagtttctggctgaaaat

SEQ ID NO: 6595265 - DNA, 16 bp, Homo sapiens
tttgagtttttcctcc

SEQ ID NO: 6595266 - DNA, 13 bp, Homo sapiens
tttgataaactga

SEQ ID NO: 6595267 - DNA, 20 bp, Homo sapiens
tttgataaagatctccagtt

SEQ ID NO: 6595268 - DNA, 20 bp, Homo sapiens
tttgataaagtaattcatac

SEQ ID NO: 6595269 - DNA, 21 bp, Homo sapiens
tttgataaagtagtaaaaatt

SEQ ID NO: 6595270 - DNA, 13 bp, Homo sapiens
tttgataaattta

SEQ ID NO: 6595271 - DNA, 14 bp, Homo sapiens
tttgataacaaaaa

SEQ ID NO: 6595272 - DNA, 23 bp, Homo sapiens
tttgataacagggattgatttta

SEQ ID NO: 6595273 - DNA, 15 bp, Homo sapiens
tttgataagaaaacc

SEQ ID NO: 6595274 - DNA, 23 bp, Homo sapiens
tttgataatagataactgctctt

SEQ ID NO: 6595275 - DNA, 20 bp, Homo sapiens
tttgataatcaactgggctg

SEQ ID NO: 6595276 - DNA, 13 bp, Homo sapiens
tttgataatgaca

SEQ ID NO: 6595277 - DNA, 18 bp, Homo sapiens
tttgataatgacactgtt

SEQ ID NO: 6595278 - DNA, 23 bp, Homo sapiens
tttgataatgacactgtttcctg

SEQ ID NO: 6595279 - DNA, 15 bp, Homo sapiens
tttgataatgttaaa

SEQ ID NO: 6595280 - DNA, 17 bp, Homo sapiens
tttgatacaaatgggaa

SEQ ID NO: 6595281 - DNA, 21 bp, Homo sapiens
tttgatacagttttcagaaaa

SEQ ID NO: 6595282 - DNA, 22 bp, Homo sapiens
tttgatacagttttcagaaaaa

SEQ ID NO: 6595283 - DNA, 13 bp, Homo sapiens
tttgatacataat

SEQ ID NO: 6595284 - DNA, 18 bp, Homo sapiens
tttgatacatttatcttc

SEQ ID NO: 6595285 - DNA, 22 bp, Homo sapiens
tttgatacatttatcttctgtt

SEQ ID NO: 6595286 - DNA, 17 bp, Homo sapiens
tttgatacccctgggga

SEQ ID NO: 6595287 - DNA, 16 bp, Homo sapiens
tttgatactaagcatt

SEQ ID NO: 6595288 - DNA, 12 bp, Homo sapiens
tttgatacttat

SEQ ID NO: 6595289 - DNA, 16 bp, Homo sapiens
tttgatacttgtaact

SEQ ID NO: 6595290 - DNA, 18 bp, Homo sapiens
tttgatagaaaggaacac

SEQ ID NO: 6595291 - DNA, 19 bp, Homo sapiens
tttgatagggaactgggga

SEQ ID NO: 6595292 - DNA, 18 bp, Homo sapiens
tttgatagtatttataat

SEQ ID NO: 6595293 - DNA, 16 bp, Homo sapiens
tttgatagtgcttctt

SEQ ID NO: 6595294 - DNA, 13 bp, Homo sapiens
tttgatataattg

SEQ ID NO: 6595295 - DNA, 16 bp, Homo sapiens
tttgatataccaaatt

SEQ ID NO: 6595296 - DNA, 23 bp, Homo sapiens
tttgatatagaagtataaagaat

SEQ ID NO: 6595297 - DNA, 17 bp, Homo sapiens
tttgatatatgtatctt

SEQ ID NO: 6595298 - DNA, 17 bp, Homo sapiens
tttgatatcacagtcta

SEQ ID NO: 6595299 - DNA, 17 bp, Homo sapiens
tttgatatccaaagctg

SEQ ID NO: 6595300 - DNA, 15 bp, Homo sapiens
tttgatatgagtata

SEQ ID NO: 6595301 - DNA, 18 bp, Homo sapiens
tttgatatgagtatacaa

SEQ ID NO: 6595302 - DNA, 20 bp, Homo sapiens
tttgatatgcatatttgttt

SEQ ID NO: 6595303 - DNA, 13 bp, Homo sapiens
tttgatatgccac

SEQ ID NO: 6595304 - DNA, 22 bp, Homo sapiens
tttgatatgggctttctctttg

SEQ ID NO: 6595305 - DNA, 23 bp, Homo sapiens
tttgatatgggctttctctttgg

SEQ ID NO: 6595306 - DNA, 17 bp, Homo sapiens
tttgatatgtgaacagt

SEQ ID NO: 6595307 - DNA, 22 bp, Homo sapiens
tttgatattgagacattaattt

SEQ ID NO: 6595308 - DNA, 17 bp, Homo sapiens
tttgatatttatttcct

SEQ ID NO: 6595309 - DNA, 18 bp, Homo sapiens
tttgatatttatttcctg

SEQ ID NO: 6595310 - DNA, 13 bp, Homo sapiens
tttgatatttgca

SEQ ID NO: 6595311 - DNA, 16 bp, Homo sapiens
tttgatatttgtgtaa

SEQ ID NO: 6595312 - DNA, 17 bp, Homo sapiens
tttgatatttgtgtaaa

SEQ ID NO: 6595313 - DNA, 13 bp, Homo sapiens
tttgatcaaatct

SEQ ID NO: 6595314 - DNA, 18 bp, Homo sapiens
tttgatcaggtggggagt

SEQ ID NO: 6595315 - DNA, 13 bp, Homo sapiens
tttgatcatgaat

SEQ ID NO: 6595316 - DNA, 13 bp, Homo sapiens
tttgatcatttct

SEQ ID NO: 6595317 - DNA, 21 bp, Homo sapiens
tttgatcatttctgccatgat

SEQ ID NO: 6595318 - DNA, 14 bp, Homo sapiens
tttgatccaagctg

SEQ ID NO: 6595319 - DNA, 17 bp, Homo sapiens
tttgatccttggaaacc

SEQ ID NO: 6595320 - DNA, 20 bp, Homo sapiens
tttgatcgcctctttgacat

SEQ ID NO: 6595321 - DNA, 23 bp, Homo sapiens
aattaaaccagactctgttgcaa

SEQ ID NO: 6595322 - DNA, 23 bp, Homo sapiens
aattaaaccctgccccacttctc

SEQ ID NO: 6595323 - DNA, 16 bp, Homo sapiens
aattaaaccgcatgtg

SEQ ID NO: 6595324 - DNA, 12 bp, Homo sapiens
aattaaacggat

SEQ ID NO: 6595325 - DNA, 14 bp, Homo sapiens
aattaaacggatta

SEQ ID NO: 6595326 - DNA, 23 bp, Homo sapiens
aattaaacggattattttttcag

SEQ ID NO: 6595327 - DNA, 17 bp, Homo sapiens
aattaaacgtaaatgtt

SEQ ID NO: 6595328 - DNA, 13 bp, Homo sapiens
aattaaactccta

SEQ ID NO: 6595329 - DNA, 19 bp, Homo sapiens
aattaaactgaagaaggat

SEQ ID NO: 6595330 - DNA, 22 bp, Homo sapiens
aattaaacttccaaagaaagtt

SEQ ID NO: 6595331 - DNA, 15 bp, Homo sapiens
aattaaactttgtat

SEQ ID NO: 6595332 - DNA, 14 bp, Homo sapiens
aattaaacttttaa

SEQ ID NO: 6595333 - DNA, 23 bp, Homo sapiens
aattaaagaaaattgccaaaata

SEQ ID NO: 6595334 - DNA, 13 bp, Homo sapiens
aattaaagaaatg

SEQ ID NO: 6595335 - DNA, 14 bp, Homo sapiens
aattaaagacattt

SEQ ID NO: 6595336 - DNA, 20 bp, Homo sapiens
aattaaagatgccatagcat

SEQ ID NO: 6595337 - DNA, 20 bp, Homo sapiens
aattaaagatggtttatgca

SEQ ID NO: 6595338 - DNA, 15 bp, Homo sapiens
aattaaagctgttat

SEQ ID NO: 6595339 - DNA, 15 bp, Homo sapiens
aattaaagggcagat

SEQ ID NO: 6595340 - DNA, 18 bp, Homo sapiens
aattaaaggtcctgccct

SEQ ID NO: 6595341 - DNA, 14 bp, Homo sapiens
aattaaagtacttt

SEQ ID NO: 6595342 - DNA, 11 bp, Homo sapiens
aattaaagtct

SEQ ID NO: 6595343 - DNA, 18 bp, Homo sapiens
aattaaagtctacactgc

SEQ ID NO: 6595344 - DNA, 23 bp, Homo sapiens
aattaaagtctacactgcctttg

SEQ ID NO: 6595345 - DNA, 18 bp, Homo sapiens
aattaaagtgctgtttag

SEQ ID NO: 6595346 - DNA, 13 bp, Homo sapiens
aattaaagtgtcc

SEQ ID NO: 6595347 - DNA, 21 bp, Homo sapiens
aattaaagtgtccattgacat

SEQ ID NO: 6595348 - DNA, 14 bp, Homo sapiens
aattaaataaaata

SEQ ID NO: 6595349 - DNA, 14 bp, Homo sapiens
aattaaataaaatt

SEQ ID NO: 6595350 - DNA, 15 bp, Homo sapiens
aattaaataaactgt

SEQ ID NO: 6595351 - DNA, 13 bp, Homo sapiens
aattaaataattt

SEQ ID NO: 6595352 - DNA, 14 bp, Homo sapiens
aattaaatagtgtg

SEQ ID NO: 6595353 - DNA, 16 bp, Homo sapiens
aattaaatagtgtgat

SEQ ID NO: 6595354 - DNA, 14 bp, Homo sapiens
aattaaatatatgt

SEQ ID NO: 6595355 - DNA, 16 bp, Homo sapiens
aattaaatatatgtat

SEQ ID NO: 6595356 - DNA, 23 bp, Homo sapiens
aattaaatatatgtatgtaaaaa

SEQ ID NO: 6595357 - DNA, 17 bp, Homo sapiens
aattaaatatttcttaa

SEQ ID NO: 6595358 - DNA, 14 bp, Homo sapiens
aattaaatccaact

SEQ ID NO: 6595359 - DNA, 21 bp, Homo sapiens
aattaaatccaactttcacag

SEQ ID NO: 6595360 - DNA, 12 bp, Homo sapiens
aattaaatctgt

SEQ ID NO: 6595361 - DNA, 14 bp, Homo sapiens
aattaaatgaaata

SEQ ID NO: 6595362 - DNA, 15 bp, Homo sapiens
aattaaatgaaatac

SEQ ID NO: 6595363 - DNA, 19 bp, Homo sapiens
aattaaatgccttgtataa

SEQ ID NO: 6595364 - DNA, 17 bp, Homo sapiens
aattaaatgtatttaat

SEQ ID NO: 6595365 - DNA, 11 bp, Homo sapiens
aattaaatgtg

SEQ ID NO: 6595366 - DNA, 14 bp, Homo sapiens
aattaaattgggct

SEQ ID NO: 6595367 - DNA, 23 bp, Homo sapiens
aattaaattgggcttcaatcact

SEQ ID NO: 6595368 - DNA, 12 bp, Homo sapiens
aattaaatttaa

SEQ ID NO: 6595369 - DNA, 22 bp, Homo sapiens
aattaaattttgagttctacat

SEQ ID NO: 6595370 - DNA, 14 bp, Homo sapiens
aattaacaaagtgt

SEQ ID NO: 6595371 - DNA, 21 bp, Homo sapiens
aattaacaaatttctttgttt

SEQ ID NO: 6595372 - DNA, 15 bp, Homo sapiens
aattaacaagaactc

SEQ ID NO: 6595373 - DNA, 16 bp, Homo sapiens
aattaacacagtgttt

SEQ ID NO: 6595374 - DNA, 17 bp, Homo sapiens
aattaacacttaaggtt

SEQ ID NO: 6595375 - DNA, 14 bp, Homo sapiens
aattaacatataat

SEQ ID NO: 6595376 - DNA, 17 bp, Homo sapiens
aattaacatataatata

SEQ ID NO: 6595377 - DNA, 20 bp, Homo sapiens
aattaacatataatatatgt

SEQ ID NO: 6595378 - DNA, 13 bp, Homo sapiens
aattaacatgtta

SEQ ID NO: 6595379 - DNA, 14 bp, Homo sapiens
aattaacatgttaa

SEQ ID NO: 6595380 - DNA, 18 bp, Homo sapiens
aattaacatgttaaacca

SEQ ID NO: 6595381 - DNA, 14 bp, Homo sapiens
aattaacattatat

SEQ ID NO: 6595382 - DNA, 20 bp, Homo sapiens
aattaacattgggaaatctt

SEQ ID NO: 6595383 - DNA, 17 bp, Homo sapiens
aattaaccaaaaaagtt

SEQ ID NO: 6595384 - DNA, 16 bp, Homo sapiens
aattaaccgagacact

SEQ ID NO: 6595385 - DNA, 12 bp, Homo sapiens
aattaacctggt

SEQ ID NO: 6595386 - DNA, 13 bp, Homo sapiens
aattaacctggtg

SEQ ID NO: 6595387 - DNA, 16 bp, Homo sapiens
aattaacctggtgctg

SEQ ID NO: 6595388 - DNA, 18 bp, Homo sapiens
aattaactaaggaaatat

SEQ ID NO: 6595389 - DNA, 22 bp, Homo sapiens
aattaactaggttgctacttta

SEQ ID NO: 6595390 - DNA, 16 bp, Homo sapiens
aattaactatgtgatg

SEQ ID NO: 6595391 - DNA, 13 bp, Homo sapiens
aattaactcacca

SEQ ID NO: 6595392 - DNA, 21 bp, Homo sapiens
aattaactctccagttatcag

SEQ ID NO: 6595393 - DNA, 16 bp, Homo sapiens
aattaacttaactgaa

SEQ ID NO: 6595394 - DNA, 18 bp, Homo sapiens
aattaacttctattttca

SEQ ID NO: 6595395 - DNA, 11 bp, Homo sapiens
aattaacttga

SEQ ID NO: 6595396 - DNA, 15 bp, Homo sapiens
aattaacttttataa

SEQ ID NO: 6595397 - DNA, 14 bp, Homo sapiens
aattaagaaagatt

SEQ ID NO: 6595398 - DNA, 12 bp, Homo sapiens
aattaagaagaa

SEQ ID NO: 6595399 - DNA, 12 bp, Homo sapiens
aattaagacaag

SEQ ID NO: 6595400 - DNA, 14 bp, Homo sapiens
aattaagacagcat

SEQ ID NO: 6595401 - DNA, 15 bp, Homo sapiens
aattaagactgaaaa

SEQ ID NO: 6595402 - DNA, 21 bp, Homo sapiens
aattaagaggatgctgggctc

SEQ ID NO: 6595403 - DNA, 19 bp, Homo sapiens
aattaagatcctaaactct

SEQ ID NO: 6595404 - DNA, 19 bp, Homo sapiens
aattaagattctctgccca

SEQ ID NO: 6595405 - DNA, 23 bp, Homo sapiens
aattaagattgaagctaaaacac

SEQ ID NO: 6595406 - DNA, 13 bp, Homo sapiens
aattaagcaaatg

SEQ ID NO: 6595407 - DNA, 22 bp, Homo sapiens
aattaagcaaatgttaaaagtt

SEQ ID NO: 6595408 - DNA, 23 bp, Homo sapiens
aattaagcaaatgttaaaagttt

SEQ ID NO: 6595409 - DNA, 16 bp, Homo sapiens
aattaagcagaaacag

SEQ ID NO: 6595410 - DNA, 17 bp, Homo sapiens
aattaaggcagctgaaa

SEQ ID NO: 6595411 - DNA, 21 bp, Homo sapiens
aattaaggccagaggcccatt

SEQ ID NO: 6595412 - DNA, 15 bp, Homo sapiens
aattaagggacatgt

SEQ ID NO: 6595413 - DNA, 16 bp, Homo sapiens
aattaaggtacatcat

SEQ ID NO: 6595414 - DNA, 18 bp, Homo sapiens
aattaagtaaaccaaaaa

SEQ ID NO: 6595415 - DNA, 14 bp, Homo sapiens
aattaagtgcaatt

SEQ ID NO: 6595416 - DNA, 20 bp, Homo sapiens
aattaagtggtcccaatgct

SEQ ID NO: 6595417 - DNA, 20 bp, Homo sapiens
aattaagtgtgtgtatactg

SEQ ID NO: 6595418 - DNA, 13 bp, Homo sapiens
aattaagtgttga

SEQ ID NO: 6595419 - DNA, 22 bp, Homo sapiens
aattaagttacaattacatctc

SEQ ID NO: 6595420 - DNA, 23 bp, Homo sapiens
aattaataaaaaatggaaagaat

SEQ ID NO: 6595421 - DNA, 20 bp, Homo sapiens
aattaataaacgaagataaa

SEQ ID NO: 6595422 - DNA, 17 bp, Homo sapiens
aattaataaagaaaaag

SEQ ID NO: 6595423 - DNA, 15 bp, Homo sapiens
aattaataatcttat

SEQ ID NO: 6595424 - DNA, 12 bp, Homo sapiens
aattaatacaga

SEQ ID NO: 6595425 - DNA, 17 bp, Homo sapiens
aattaatatattaaaat

SEQ ID NO: 6595426 - DNA, 19 bp, Homo sapiens
aattaatatccctacatgt

SEQ ID NO: 6595427 - DNA, 21 bp, Homo sapiens
aattaatatccctacatgtat

SEQ ID NO: 6595428 - DNA, 16 bp, Homo sapiens
aattaatatgattatt

SEQ ID NO: 6595429 - DNA, 14 bp, Homo sapiens
aattaatctagaaa

SEQ ID NO: 6595430 - DNA, 13 bp, Homo sapiens
aattaatctttct

SEQ ID NO: 6595431 - DNA, 16 bp, Homo sapiens
aattaatctttctata

SEQ ID NO: 6595432 - DNA, 12 bp, Homo sapiens
aattaatctttt

SEQ ID NO: 6595433 - DNA, 20 bp, Homo sapiens
aattaatcttttaaaaatga

SEQ ID NO: 6595434 - DNA, 17 bp, Homo sapiens
aattaatgaaatatctg

SEQ ID NO: 6595435 - DNA, 22 bp, Homo sapiens
aattaatgaaatgataaagact

SEQ ID NO: 6595436 - DNA, 20 bp, Homo sapiens
aattaatgacttactttaat

SEQ ID NO: 6595437 - DNA, 22 bp, Homo sapiens
aattaatgagttttatccaaga

SEQ ID NO: 6595438 - DNA, 13 bp, Homo sapiens
aattaatgattct

SEQ ID NO: 6595439 - DNA, 16 bp, Homo sapiens
aattaatgattctgaa

SEQ ID NO: 6595440 - DNA, 12 bp, Homo sapiens
aattaatggaaa

SEQ ID NO: 6595441 - DNA, 13 bp, Homo sapiens
aattaatggaaaa

SEQ ID NO: 6595442 - DNA, 17 bp, Homo sapiens
aattaatggaaaactgt

SEQ ID NO: 6595443 - DNA, 19 bp, Homo sapiens
aattaatgtaataaagtga

SEQ ID NO: 6595444 - DNA, 20 bp, Homo sapiens
aattaatgtaataaagtgaa

SEQ ID NO: 6595445 - DNA, 21 bp, Homo sapiens
aattaatgtcagtatttcaac

SEQ ID NO: 6595446 - DNA, 12 bp, Homo sapiens
aattaatgtcat

SEQ ID NO: 6595447 - DNA, 21 bp, Homo sapiens
aattaatgtgtgtctgaagac

SEQ ID NO: 6595448 - DNA, 22 bp, Homo sapiens
aattaatgttctgacagttgtg

SEQ ID NO: 6595449 - DNA, 24 bp, Homo sapiens
aattaatgttctgacagttgtgat

SEQ ID NO: 6595450 - DNA, 15 bp, Homo sapiens
aattaatgtttgtgg

SEQ ID NO: 6595451 - DNA, 13 bp, Homo sapiens
aattaattaaaag

SEQ ID NO: 6595452 - DNA, 14 bp, Homo sapiens
aattaattaacatc

SEQ ID NO: 6595453 - DNA, 14 bp, Homo sapiens
aattaattctttat

SEQ ID NO: 6595454 - DNA, 18 bp, Homo sapiens
aattaattggcagcagat

SEQ ID NO: 6595455 - DNA, 12 bp, Homo sapiens
aattaattgtaa

SEQ ID NO: 6595456 - DNA, 15 bp, Homo sapiens
aattaattgtcatta

SEQ ID NO: 6595457 - DNA, 13 bp, Homo sapiens
aattaattgtgtg

SEQ ID NO: 6595458 - DNA, 13 bp, Homo sapiens
aattaatttcagt

SEQ ID NO: 6595459 - DNA, 13 bp, Homo sapiens
aattaatttgtga

SEQ ID NO: 6595460 - DNA, 21 bp, Homo sapiens
aattaatttgtgaatttgcaa

SEQ ID NO: 6595461 - DNA, 16 bp, Homo sapiens
aattaatttgttaatt

SEQ ID NO: 6595462 - DNA, 20 bp, Homo sapiens
aattaattttctctttagga

SEQ ID NO: 6595463 - DNA, 17 bp, Homo sapiens
aattaatttttcaattt

SEQ ID NO: 6595464 - DNA, 20 bp, Homo sapiens
aattacaaacaataagaaca

SEQ ID NO: 6595465 - DNA, 23 bp, Homo sapiens
aattacaagtattcagttccaat

SEQ ID NO: 6595466 - DNA, 14 bp, Homo sapiens
aattacaattgtca

SEQ ID NO: 6595467 - DNA, 14 bp, Homo sapiens
aattacaattttat

SEQ ID NO: 6595468 - DNA, 18 bp, Homo sapiens
aattacacaataaagcag

SEQ ID NO: 6595469 - DNA, 20 bp, Homo sapiens
aattacacaataaagcagtc

SEQ ID NO: 6595470 - DNA, 16 bp, Homo sapiens
aattacaccacaagta

SEQ ID NO: 6595471 - DNA, 19 bp, Homo sapiens
aattacaccacaagtatct

SEQ ID NO: 6595472 - DNA, 14 bp, Homo sapiens
aattacacccaaag

SEQ ID NO: 6595473 - DNA, 20 bp, Homo sapiens
aattacactcttcctccatt

SEQ ID NO: 6595474 - DNA, 17 bp, Homo sapiens
aattacactgtgccttt

SEQ ID NO: 6595475 - DNA, 17 bp, Homo sapiens
aattacagaaatttaat

SEQ ID NO: 6595476 - DNA, 22 bp, Homo sapiens
aattacagaaatttaattcaga

SEQ ID NO: 6595477 - DNA, 16 bp, Homo sapiens
aattacagactctgat

SEQ ID NO: 6595478 - DNA, 16 bp, Homo sapiens
aattacagagatataa

SEQ ID NO: 6595479 - DNA, 22 bp, Homo sapiens
aattacagagatataaatgaag

SEQ ID NO: 6595480 - DNA, 14 bp, Homo sapiens
aattacagatgtga

SEQ ID NO: 6595481 - DNA, 16 bp, Homo sapiens
aattacagatgtgaaa

SEQ ID NO: 6595482 - DNA, 23 bp, Homo sapiens
aattacagcagttgactcagagt

SEQ ID NO: 6595483 - DNA, 17 bp, Homo sapiens
aattacaggaaatgcaa

SEQ ID NO: 6595484 - DNA, 17 bp, Homo sapiens
aattacaggaagtactg

SEQ ID NO: 6595485 - DNA, 20 bp, Homo sapiens
aattacaggaagtactggag

SEQ ID NO: 6595486 - DNA, 20 bp, Homo sapiens
aattacaggagggaacattt

SEQ ID NO: 6595487 - DNA, 18 bp, Homo sapiens
aattacagggaagaaatc

SEQ ID NO: 6595488 - DNA, 16 bp, Homo sapiens
aattacagggtgactc

SEQ ID NO: 6595489 - DNA, 19 bp, Homo sapiens
aattacagtccaaaatact

SEQ ID NO: 6595490 - DNA, 19 bp, Homo sapiens
aattacataacaggcattg

SEQ ID NO: 6595491 - DNA, 12 bp, Homo sapiens
aattacatattt

SEQ ID NO: 6595492 - DNA, 22 bp, Homo sapiens
aattacatatttgactctttca

SEQ ID NO: 6595493 - DNA, 19 bp, Homo sapiens
aattacatgaagatttggt

SEQ ID NO: 6595494 - DNA, 17 bp, Homo sapiens
aattacatgtaaaacat

SEQ ID NO: 6595495 - DNA, 20 bp, Homo sapiens
aattacatgtaaacaaatat

SEQ ID NO: 6595496 - DNA, 22 bp, Homo sapiens
aattacatgtaaacaaatattt

SEQ ID NO: 6595497 - DNA, 12 bp, Homo sapiens
aattacatgttt

SEQ ID NO: 6595498 - DNA, 19 bp, Homo sapiens
aattacattactgaaaact

SEQ ID NO: 6595499 - DNA, 22 bp, Homo sapiens
aattacattactgaaaacttca

SEQ ID NO: 6595500 - DNA, 13 bp, Homo sapiens
aattacattccta

SEQ ID NO: 6595501 - DNA, 14 bp, Homo sapiens
aattacattcctaa

SEQ ID NO: 6595502 - DNA, 18 bp, Homo sapiens
tttgatcgcttttaataa

SEQ ID NO: 6595503 - DNA, 21 bp, Homo sapiens
tttgatctggacagaacattt

SEQ ID NO: 6595504 - DNA, 15 bp, Homo sapiens
tttgatcttcaacaa

SEQ ID NO: 6595505 - DNA, 18 bp, Homo sapiens
tttgatcttcaacaaatt

SEQ ID NO: 6595506 - DNA, 19 bp, Homo sapiens
tttgatcttcctctgctaa

SEQ ID NO: 6595507 - DNA, 20 bp, Homo sapiens
tttgatcttcctctgctaaa

SEQ ID NO: 6595508 - DNA, 16 bp, Homo sapiens
tttgatgaaataaaat

SEQ ID NO: 6595509 - DNA, 22 bp, Homo sapiens
tttgatgaattcttcctctcct

SEQ ID NO: 6595510 - DNA, 21 bp, Homo sapiens
tttgatgaggtattttttcct

SEQ ID NO: 6595511 - DNA, 15 bp, Homo sapiens
tttgatgagttgtga

SEQ ID NO: 6595512 - DNA, 23 bp, Homo sapiens
tttgatgataaaaggagaataag

SEQ ID NO: 6595513 - DNA, 23 bp, Homo sapiens
tttgatgatgtctacagaaaatg

SEQ ID NO: 6595514 - DNA, 22 bp, Homo sapiens
tttgatgattttcatttcatga

SEQ ID NO: 6595515 - DNA, 16 bp, Homo sapiens
tttgatgcagcatttg

SEQ ID NO: 6595516 - DNA, 17 bp, Homo sapiens
tttgatgcatgtctttt

SEQ ID NO: 6595517 - DNA, 17 bp, Homo sapiens
tttgatgccaaagcaga

SEQ ID NO: 6595518 - DNA, 20 bp, Homo sapiens
tttgatgcccaatatattct

SEQ ID NO: 6595519 - DNA, 15 bp, Homo sapiens
tttgatgctgagtca

SEQ ID NO: 6595520 - DNA, 18 bp, Homo sapiens
tttgatgctggagaggtt

SEQ ID NO: 6595521 - DNA, 16 bp, Homo sapiens
tttgatgcttttctct

SEQ ID NO: 6595522 - DNA, 20 bp, Homo sapiens
tttgatggagggtggaaata

SEQ ID NO: 6595523 - DNA, 18 bp, Homo sapiens
tttgatggctgggtcctt

SEQ ID NO: 6595524 - DNA, 17 bp, Homo sapiens
tttgatggggagaaagg

SEQ ID NO: 6595525 - DNA, 21 bp, Homo sapiens
tttgatggtaagactgtaatt

SEQ ID NO: 6595526 - DNA, 21 bp, Homo sapiens
tttgatggtgaatattacatt

SEQ ID NO: 6595527 - DNA, 14 bp, Homo sapiens
tttgatggtggtat

SEQ ID NO: 6595528 - DNA, 18 bp, Homo sapiens
tttgatgtacattacaga

SEQ ID NO: 6595529 - DNA, 16 bp, Homo sapiens
tttgatgtatgtgtga

SEQ ID NO: 6595530 - DNA, 17 bp, Homo sapiens
tttgatgtcagcagttg

SEQ ID NO: 6595531 - DNA, 21 bp, Homo sapiens
tttgatgtcagcagttgctgg

SEQ ID NO: 6595532 - DNA, 15 bp, Homo sapiens
tttgatgtcagcctt

SEQ ID NO: 6595533 - DNA, 16 bp, Homo sapiens
tttgatgtcagccttg

SEQ ID NO: 6595534 - DNA, 19 bp, Homo sapiens
tttgatgtgacaataatat

SEQ ID NO: 6595535 - DNA, 21 bp, Homo sapiens
tttgatgtgtatgtgtttata

SEQ ID NO: 6595536 - DNA, 11 bp, Homo sapiens
tttgatgttaa

SEQ ID NO: 6595537 - DNA, 15 bp, Homo sapiens
tttgatgttccttcc

SEQ ID NO: 6595538 - DNA, 17 bp, Homo sapiens
tttgatgttccttccag

SEQ ID NO: 6595539 - DNA, 19 bp, Homo sapiens
tttgatgtttgtggcctca

SEQ ID NO: 6595540 - DNA, 18 bp, Homo sapiens
tttgattaaattcttgca

SEQ ID NO: 6595541 - DNA, 20 bp, Homo sapiens
tttgattaaccttttcaaat

SEQ ID NO: 6595542 - DNA, 12 bp, Homo sapiens
tttgattaataa

SEQ ID NO: 6595543 - DNA, 17 bp, Homo sapiens
tttgattaataaaatat

SEQ ID NO: 6595544 - DNA, 20 bp, Homo sapiens
tttgattaatgaagaaagta

SEQ ID NO: 6595545 - DNA, 19 bp, Homo sapiens
tttgattaggtatgtttgt

SEQ ID NO: 6595546 - DNA, 23 bp, Homo sapiens
tttgattagtataatatttctta

SEQ ID NO: 6595547 - DNA, 22 bp, Homo sapiens
tttgattagttttcttgttgct

SEQ ID NO: 6595548 - DNA, 19 bp, Homo sapiens
tttgattatgtatggatat

SEQ ID NO: 6595549 - DNA, 16 bp, Homo sapiens
tttgattattgagaaa

SEQ ID NO: 6595550 - DNA, 17 bp, Homo sapiens
tttgattatttaagact

SEQ ID NO: 6595551 - DNA, 15 bp, Homo sapiens
tttgattatttgcat

SEQ ID NO: 6595552 - DNA, 20 bp, Homo sapiens
tttgattatttgcatgttat

SEQ ID NO: 6595553 - DNA, 22 bp, Homo sapiens
tttgattatttgcatgttatgt

SEQ ID NO: 6595554 - DNA, 16 bp, Homo sapiens
tttgattcaaggctca

SEQ ID NO: 6595555 - DNA, 13 bp, Homo sapiens
tttgattcacatg

SEQ ID NO: 6595556 - DNA, 20 bp, Homo sapiens
tttgattcacatgttttcaa

SEQ ID NO: 6595557 - DNA, 22 bp, Homo sapiens
tttgattcacatgttttcaaat

SEQ ID NO: 6595558 - DNA, 21 bp, Homo sapiens
tttgattcagacagctgcctg

SEQ ID NO: 6595559 - DNA, 22 bp, Homo sapiens
tttgattcagacagctgcctgg

SEQ ID NO: 6595560 - DNA, 20 bp, Homo sapiens
tttgattcatagtaacttct

SEQ ID NO: 6595561 - DNA, 20 bp, Homo sapiens
tttgattcattttcctgttc

SEQ ID NO: 6595562 - DNA, 13 bp, Homo sapiens
tttgattccattt

SEQ ID NO: 6595563 - DNA, 15 bp, Homo sapiens
tttgattctgtgtgt

SEQ ID NO: 6595564 - DNA, 21 bp, Homo sapiens
tttgattgaataatgccacca

SEQ ID NO: 6595565 - DNA, 22 bp, Homo sapiens
tttgattgagagtaacttaagt

SEQ ID NO: 6595566 - DNA, 12 bp, Homo sapiens
tttgattggctt

SEQ ID NO: 6595567 - DNA, 21 bp, Homo sapiens
tttgattgttatgtaaaactc

SEQ ID NO: 6595568 - DNA, 14 bp, Homo sapiens
tttgattgtttaca

SEQ ID NO: 6595569 - DNA, 14 bp, Homo sapiens
tttgatttaatgtt

SEQ ID NO: 6595570 - DNA, 15 bp, Homo sapiens
tttgatttacagcaa

SEQ ID NO: 6595571 - DNA, 17 bp, Homo sapiens
tttgatttacagcaagt

SEQ ID NO: 6595572 - DNA, 17 bp, Homo sapiens
tttgatttataaaactt

SEQ ID NO: 6595573 - DNA, 12 bp, Homo sapiens
tttgatttatgc

SEQ ID NO: 6595574 - DNA, 21 bp, Homo sapiens
tttgatttattaacttaataa

SEQ ID NO: 6595575 - DNA, 14 bp, Homo sapiens
tttgatttcaacat

SEQ ID NO: 6595576 - DNA, 20 bp, Homo sapiens
tttgatttccaagtaatata

SEQ ID NO: 6595577 - DNA, 13 bp, Homo sapiens
tttgatttctaag

SEQ ID NO: 6595578 - DNA, 14 bp, Homo sapiens
tttgatttctaatt

SEQ ID NO: 6595579 - DNA, 12 bp, Homo sapiens
tttgatttgcaa

SEQ ID NO: 6595580 - DNA, 16 bp, Homo sapiens
tttgatttgcaacact

SEQ ID NO: 6595581 - DNA, 19 bp, Homo sapiens
tttgatttgtttagttttg

SEQ ID NO: 6595582 - DNA, 22 bp, Homo sapiens
tttgatttttttaaagtagttc

SEQ ID NO: 6595583 - DNA, 16 bp, Homo sapiens
tttgcaaaactgtgct

SEQ ID NO: 6595584 - DNA, 13 bp, Homo sapiens
tttgcaaaataag

SEQ ID NO: 6595585 - DNA, 15 bp, Homo sapiens
tttgcaaaatcactt

SEQ ID NO: 6595586 - DNA, 15 bp, Homo sapiens
tttgcaaacaaaatg

SEQ ID NO: 6595587 - DNA, 17 bp, Homo sapiens
tttgcaaacaaaatgat

SEQ ID NO: 6595588 - DNA, 22 bp, Homo sapiens
tttgcaaacaattttaatgatg

SEQ ID NO: 6595589 - DNA, 19 bp, Homo sapiens
tttgcaaacccgaaaataa

SEQ ID NO: 6595590 - DNA, 23 bp, Homo sapiens
tttgcaaaccctttgtattataa

SEQ ID NO: 6595591 - DNA, 19 bp, Homo sapiens
tttgcaaagaaagaaaaaa

SEQ ID NO: 6595592 - DNA, 18 bp, Homo sapiens
tttgcaaagaccacctcc

SEQ ID NO: 6595593 - DNA, 19 bp, Homo sapiens
tttgcaaagaccacctcca

SEQ ID NO: 6595594 - DNA, 21 bp, Homo sapiens
tttgcaaaggagacttaattt

SEQ ID NO: 6595595 - DNA, 11 bp, Homo sapiens
tttgcaaagta

SEQ ID NO: 6595596 - DNA, 14 bp, Homo sapiens
tttgcaaagtactg

SEQ ID NO: 6595597 - DNA, 22 bp, Homo sapiens
tttgcaaataaaggctctggaa

SEQ ID NO: 6595598 - DNA, 15 bp, Homo sapiens
tttgcaaataactta

SEQ ID NO: 6595599 - DNA, 14 bp, Homo sapiens
tttgcaaataggca

SEQ ID NO: 6595600 - DNA, 14 bp, Homo sapiens
tttgcaaattattt

SEQ ID NO: 6595601 - DNA, 22 bp, Homo sapiens
tttgcaacaagacaaagcaaag

SEQ ID NO: 6595602 - DNA, 23 bp, Homo sapiens
tttgcaacactgccaaacatcag

SEQ ID NO: 6595603 - DNA, 19 bp, Homo sapiens
tttgcaacagcaaattaat

SEQ ID NO: 6595604 - DNA, 20 bp, Homo sapiens
tttgcaacagcaaattaatg

SEQ ID NO: 6595605 - DNA, 17 bp, Homo sapiens
tttgcaacagcagtgtt

SEQ ID NO: 6595606 - DNA, 20 bp, Homo sapiens
tttgcaacaggggaggaaaa

SEQ ID NO: 6595607 - DNA, 19 bp, Homo sapiens
tttgcaacagtaatcagag

SEQ ID NO: 6595608 - DNA, 15 bp, Homo sapiens
tttgcaaccaggaac

SEQ ID NO: 6595609 - DNA, 13 bp, Homo sapiens
tttgcaaccttta

SEQ ID NO: 6595610 - DNA, 17 bp, Homo sapiens
tttgcaactttagtttg

SEQ ID NO: 6595611 - DNA, 22 bp, Homo sapiens
tttgcaagagtgatgggaaaga

SEQ ID NO: 6595612 - DNA, 21 bp, Homo sapiens
tttgcaaggaagccacagctg

SEQ ID NO: 6595613 - DNA, 24 bp, Homo sapiens
tttgcaaggtgcatttttactatt

SEQ ID NO: 6595614 - DNA, 13 bp, Homo sapiens
tttgcaagtgaag

SEQ ID NO: 6595615 - DNA, 15 bp, Homo sapiens
tttgcaagtgaaggt

SEQ ID NO: 6595616 - DNA, 20 bp, Homo sapiens
tttgcaagtgagatagcttc

SEQ ID NO: 6595617 - DNA, 18 bp, Homo sapiens
tttgcaataaaaggtatt

SEQ ID NO: 6595618 - DNA, 16 bp, Homo sapiens
tttgcaataacagctg

SEQ ID NO: 6595619 - DNA, 17 bp, Homo sapiens
tttgcaataacagctgc

SEQ ID NO: 6595620 - DNA, 20 bp, Homo sapiens
tttgcaataaggatttattc

SEQ ID NO: 6595621 - DNA, 16 bp, Homo sapiens
tttgcaataatgcagt

SEQ ID NO: 6595622 - DNA, 17 bp, Homo sapiens
tttgcaataatgcagta

SEQ ID NO: 6595623 - DNA, 19 bp, Homo sapiens
tttgcaatcttatgttgat

SEQ ID NO: 6595624 - DNA, 19 bp, Homo sapiens
tttgcaatggctatatggc

SEQ ID NO: 6595625 - DNA, 14 bp, Homo sapiens
tttgcaattcatgt

SEQ ID NO: 6595626 - DNA, 19 bp, Homo sapiens
tttgcaattgctcttctcc

SEQ ID NO: 6595627 - DNA, 15 bp, Homo sapiens
tttgcaatttgagcc

SEQ ID NO: 6595628 - DNA, 16 bp, Homo sapiens
tttgcaatttgagcca

SEQ ID NO: 6595629 - DNA, 17 bp, Homo sapiens
tttgcaatttgagccat

SEQ ID NO: 6595630 - DNA, 19 bp, Homo sapiens
tttgcacaaggaaataaag

SEQ ID NO: 6595631 - DNA, 18 bp, Homo sapiens
tttgcacaagttccctgg

SEQ ID NO: 6595632 - DNA, 18 bp, Homo sapiens
tttgcacaatatttcttt

SEQ ID NO: 6595633 - DNA, 22 bp, Homo sapiens
tttgcacactttggcccagggt

SEQ ID NO: 6595634 - DNA, 20 bp, Homo sapiens
tttgcacaggaaagagtcac

SEQ ID NO: 6595635 - DNA, 12 bp, Homo sapiens
tttgcacataaa

SEQ ID NO: 6595636 - DNA, 21 bp, Homo sapiens
tttgcacatatattttttaca

SEQ ID NO: 6595637 - DNA, 13 bp, Homo sapiens
tttgcacatgtga

SEQ ID NO: 6595638 - DNA, 16 bp, Homo sapiens
tttgcacattccaaaa

SEQ ID NO: 6595639 - DNA, 13 bp, Homo sapiens
tttgcaccaaaga

SEQ ID NO: 6595640 - DNA, 15 bp, Homo sapiens
tttgcaccaaagaca

SEQ ID NO: 6595641 - DNA, 20 bp, Homo sapiens
tttgcacccactgaaaggaa

SEQ ID NO: 6595642 - DNA, 20 bp, Homo sapiens
tttgcaccccatgctgttga

SEQ ID NO: 6595643 - DNA, 13 bp, Homo sapiens
tttgcacccctcc

SEQ ID NO: 6595644 - DNA, 16 bp, Homo sapiens
tttgcacccctcccat

SEQ ID NO: 6595645 - DNA, 21 bp, Homo sapiens
tttgcacccctttcctcccca

SEQ ID NO: 6595646 - DNA, 13 bp, Homo sapiens
tttgcacctctgt

SEQ ID NO: 6595647 - DNA, 20 bp, Homo sapiens
tttgcacctttctagttgaa

SEQ ID NO: 6595648 - DNA, 17 bp, Homo sapiens
tttgcacgacgccctct

SEQ ID NO: 6595649 - DNA, 19 bp, Homo sapiens
tttgcacgacgccctctcc

SEQ ID NO: 6595650 - DNA, 20 bp, Homo sapiens
tttgcacggtttggataatc

SEQ ID NO: 6595651 - DNA, 18 bp, Homo sapiens
tttgcacgtttggtttgc

SEQ ID NO: 6595652 - DNA, 21 bp, Homo sapiens
tttgcacgtttggtttgcgca

SEQ ID NO: 6595653 - DNA, 14 bp, Homo sapiens
tttgcactaaatca

SEQ ID NO: 6595654 - DNA, 20 bp, Homo sapiens
tttgcactaagatatttcca

SEQ ID NO: 6595655 - DNA, 16 bp, Homo sapiens
tttgcactaatgtgtt

SEQ ID NO: 6595656 - DNA, 21 bp, Homo sapiens
tttgcactcaaatcttaagaa

SEQ ID NO: 6595657 - DNA, 20 bp, Homo sapiens
tttgcactctgtaattgcac

SEQ ID NO: 6595658 - DNA, 14 bp, Homo sapiens
tttgcactgagggc

SEQ ID NO: 6595659 - DNA, 18 bp, Homo sapiens
tttgcactgatatatcat

SEQ ID NO: 6595660 - DNA, 20 bp, Homo sapiens
tttgcactgctttattttag

SEQ ID NO: 6595661 - DNA, 14 bp, Homo sapiens
tttgcactgtgtgc

SEQ ID NO: 6595662 - DNA, 14 bp, Homo sapiens
tttgcactgttact

SEQ ID NO: 6595663 - DNA, 14 bp, Homo sapiens
tttgcactgtttaa

SEQ ID NO: 6595664 - DNA, 12 bp, Homo sapiens
tttgcacttatg

SEQ ID NO: 6595665 - DNA, 21 bp, Homo sapiens
tttgcacttgtgattatttat

SEQ ID NO: 6595666 - DNA, 17 bp, Homo sapiens
tttgcactttgccatct

SEQ ID NO: 6595667 - DNA, 13 bp, Homo sapiens
tttgcacttttct

SEQ ID NO: 6595668 - DNA, 22 bp, Homo sapiens
tttgcactttttcttaatcatt

SEQ ID NO: 6595669 - DNA, 19 bp, Homo sapiens
tttgcagaaaagcacctgc

SEQ ID NO: 6595670 - DNA, 19 bp, Homo sapiens
tttgcagaaggaaatgatg

SEQ ID NO: 6595671 - DNA, 20 bp, Homo sapiens
tttgcagaatgatgcaggtt

SEQ ID NO: 6595672 - DNA, 12 bp, Homo sapiens
tttgcagagcct

SEQ ID NO: 6595673 - DNA, 15 bp, Homo sapiens
tttgcagatgacaaa

SEQ ID NO: 6595674 - DNA, 22 bp, Homo sapiens
tttgcagatgtaattagttaag

SEQ ID NO: 6595675 - DNA, 19 bp, Homo sapiens
tttgcagattattttagtc

SEQ ID NO: 6595676 - DNA, 20 bp, Homo sapiens
tttgcagatttatttagtga

SEQ ID NO: 6595677 - DNA, 21 bp, Homo sapiens
tttgcagctgagagaaaataa

SEQ ID NO: 6595678 - DNA, 14 bp, Homo sapiens
tttgcagctgctgg

SEQ ID NO: 6595679 - DNA, 15 bp, Homo sapiens
tttgcagctgctggt

SEQ ID NO: 6595680 - DNA, 19 bp, Homo sapiens
tttgcagcttccttccaag

SEQ ID NO: 6595681 - DNA, 19 bp, Homo sapiens
tttgcaggagtttgtggta

SEQ ID NO: 6595682 - DNA, 20 bp, Homo sapiens
tttgcaggatctgtctgtgc

SEQ ID NO: 6595683 - DNA, 16 bp, Homo sapiens
tttgcaggattccctt

SEQ ID NO: 6595684 - DNA, 21 bp, Homo sapiens
tttgcaggattcccttctggg

SEQ ID NO: 6595685 - DNA, 16 bp, Homo sapiens
tttgcaggcatgcatg

SEQ ID NO: 6595686 - DNA, 16 bp, Homo sapiens
tttgcaggctctgggc

SEQ ID NO: 6595687 - DNA, 17 bp, Homo sapiens
tttgcaggctctgggct

SEQ ID NO: 6595688 - DNA, 20 bp, Homo sapiens
tttgcaggggactgggccat

SEQ ID NO: 6595689 - DNA, 16 bp, Homo sapiens
tttgcaggtctttaaa

SEQ ID NO: 6595690 - DNA, 22 bp, Homo sapiens
tttgcagtacatgggtgactat

SEQ ID NO: 6595691 - DNA, 18 bp, Homo sapiens
tttgcagtatatttctga

SEQ ID NO: 6595692 - DNA, 17 bp, Homo sapiens
tttgcagtcttttgctg

SEQ ID NO: 6595693 - DNA, 18 bp, Homo sapiens
tttgcagtcttttgctgt

SEQ ID NO: 6595694 - DNA, 17 bp, Homo sapiens
tttgcagtgttaagata

SEQ ID NO: 6595695 - DNA, 13 bp, Homo sapiens
tttgcagttgatg

SEQ ID NO: 6595696 - DNA, 19 bp, Homo sapiens
tttgcagttgatgtgtctt

SEQ ID NO: 6595697 - DNA, 21 bp, Homo sapiens
tttgcagttgatgtgtctttt

SEQ ID NO: 6595698 - DNA, 20 bp, Homo sapiens
tttgcagttggactctcagg

SEQ ID NO: 6595699 - DNA, 18 bp, Homo sapiens
tttgcataacaattcctc

SEQ ID NO: 6595700 - DNA, 19 bp, Homo sapiens
tttgcataataaatgcttc

SEQ ID NO: 6595701 - DNA, 17 bp, Homo sapiens
tttgcataatatgcata

SEQ ID NO: 6595702 - DNA, 19 bp, Homo sapiens
tttgcatacatgaataaaa

SEQ ID NO: 6595703 - DNA, 21 bp, Homo sapiens
tttgcatacatgaataaaaat

SEQ ID NO: 6595704 - DNA, 20 bp, Homo sapiens
tttgcatactgaaaatccaa

SEQ ID NO: 6595705 - DNA, 22 bp, Homo sapiens
tttgcatacttacctagtgaaa

SEQ ID NO: 6595706 - DNA, 21 bp, Homo sapiens
tttgcatacttcctggatttt

SEQ ID NO: 6595707 - DNA, 21 bp, Homo sapiens
tttgcatagcagctgctacta

SEQ ID NO: 6595708 - DNA, 14 bp, Homo sapiens
tttgcatagctctc

SEQ ID NO: 6595709 - DNA, 15 bp, Homo sapiens
tttgcatagctttca

SEQ ID NO: 6595710 - DNA, 23 bp, Homo sapiens
tttgcatagtaccaatcatttta

SEQ ID NO: 6595711 - DNA, 16 bp, Homo sapiens
tttgcatatcagtcat

SEQ ID NO: 6595712 - DNA, 17 bp, Homo sapiens
tttgcatattctattgt

SEQ ID NO: 6595713 - DNA, 24 bp, Homo sapiens
tttgcatattttgagaaactgctg

SEQ ID NO: 6595714 - DNA, 21 bp, Homo sapiens
tttgcatccacttcaggagcc

SEQ ID NO: 6595715 - DNA, 13 bp, Homo sapiens
tttgcatccagca

SEQ ID NO: 6595716 - DNA, 23 bp, Homo sapiens
tttgcatcccccaaacttcttgt

SEQ ID NO: 6595717 - DNA, 20 bp, Homo sapiens
tttgcatcgtcccctccccc

SEQ ID NO: 6595718 - DNA, 14 bp, Homo sapiens
tttgcatctcagta

SEQ ID NO: 6595719 - DNA, 14 bp, Homo sapiens
tttgcatctgaaat

SEQ ID NO: 6595720 - DNA, 22 bp, Homo sapiens
tttgcatctgaaataggaaaca

SEQ ID NO: 6595721 - DNA, 22 bp, Homo sapiens
tttgcatctgaccccggggggc

SEQ ID NO: 6595722 - DNA, 13 bp, Homo sapiens
tttgcatctttgt

SEQ ID NO: 6595723 - DNA, 18 bp, Homo sapiens
tttgcatgatatcttcaa

SEQ ID NO: 6595724 - DNA, 12 bp, Homo sapiens
tttgcatgcagg

SEQ ID NO: 6595725 - DNA, 19 bp, Homo sapiens
tttgcatgcaggctgtgtt

SEQ ID NO: 6595726 - DNA, 21 bp, Homo sapiens
tttgcatggaatttgtaagtt

SEQ ID NO: 6595727 - DNA, 17 bp, Homo sapiens
tttgcatggcagggcct

SEQ ID NO: 6595728 - DNA, 19 bp, Homo sapiens
tttgcatgtcgcacaatgt

SEQ ID NO: 6595729 - DNA, 17 bp, Homo sapiens
tttgcatgtctaattca

SEQ ID NO: 6595730 - DNA, 14 bp, Homo sapiens
tttgcatgtctgca

SEQ ID NO: 6595731 - DNA, 15 bp, Homo sapiens
tttgcatgtctgcat

SEQ ID NO: 6595732 - DNA, 21 bp, Homo sapiens
tttgcatgtgaaaatcaaata

SEQ ID NO: 6595733 - DNA, 12 bp, Homo sapiens
tttgcatgttct

SEQ ID NO: 6595734 - DNA, 21 bp, Homo sapiens
tttgcatgttttacttttatc

SEQ ID NO: 6595735 - DNA, 16 bp, Homo sapiens
tttgcattaaattaca

SEQ ID NO: 6595736 - DNA, 19 bp, Homo sapiens
tttgcattaaattacagaa

SEQ ID NO: 6595737 - DNA, 21 bp, Homo sapiens
tttgcattaaattcacaaact

SEQ ID NO: 6595738 - DNA, 12 bp, Homo sapiens
tttgcattcaaa

SEQ ID NO: 6595739 - DNA, 13 bp, Homo sapiens
tttgcattccaga

SEQ ID NO: 6595740 - DNA, 14 bp, Homo sapiens
tttgcattccatga

SEQ ID NO: 6595741 - DNA, 14 bp, Homo sapiens
tttgcattcctaca

SEQ ID NO: 6595742 - DNA, 19 bp, Homo sapiens
tttgcattgaggaaatatt

SEQ ID NO: 6595743 - DNA, 13 bp, Homo sapiens
tttgcattgtcta

SEQ ID NO: 6595744 - DNA, 12 bp, Homo sapiens
tttgcattgtgt

SEQ ID NO: 6595745 - DNA, 18 bp, Homo sapiens
tttgcattgtgtcagaaa

SEQ ID NO: 6595746 - DNA, 14 bp, Homo sapiens
tttgcattgtgtga

SEQ ID NO: 6595747 - DNA, 17 bp, Homo sapiens
tttgcatttaaaacaga

SEQ ID NO: 6595748 - DNA, 23 bp, Homo sapiens
tttgcatttaaaacagacactgg

SEQ ID NO: 6595749 - DNA, 21 bp, Homo sapiens
tttgcatttaagaattgccag

SEQ ID NO: 6595750 - DNA, 20 bp, Homo sapiens
tttgcatttctcttcctaaa

SEQ ID NO: 6595751 - DNA, 12 bp, Homo sapiens
tttgcatttgtt

SEQ ID NO: 6595752 - DNA, 20 bp, Homo sapiens
tttgcatttgtttatgtaat

SEQ ID NO: 6595753 - DNA, 21 bp, Homo sapiens
tttgcatttgtttatgtaatt

SEQ ID NO: 6595754 - DNA, 19 bp, Homo sapiens
tttgcatttttgtattttg

SEQ ID NO: 6595755 - DNA, 22 bp, Homo sapiens
tttgcatttttgttttgaaagt

SEQ ID NO: 6595756 - DNA, 12 bp, Homo sapiens
tttgccaaaaaa

SEQ ID NO: 6595757 - DNA, 21 bp, Homo sapiens
tttgccaaaagaagaagaatt

SEQ ID NO: 6595758 - DNA, 21 bp, Homo sapiens
tttgccaaaataccagagcct

SEQ ID NO: 6595759 - DNA, 23 bp, Homo sapiens
tttgccaaaattcatttctaatt

SEQ ID NO: 6595760 - DNA, 13 bp, Homo sapiens
tttgccaactgaa

SEQ ID NO: 6595761 - DNA, 23 bp, Homo sapiens
tttgccaagaccatttcacagaa

SEQ ID NO: 6595762 - DNA, 16 bp, Homo sapiens
tttgccaagctaatct

SEQ ID NO: 6595763 - DNA, 14 bp, Homo sapiens
tttgccaagctgaa

SEQ ID NO: 6595764 - DNA, 18 bp, Homo sapiens
tttgccaaggctctcccc

SEQ ID NO: 6595765 - DNA, 16 bp, Homo sapiens
tttgccaagtctccca

SEQ ID NO: 6595766 - DNA, 13 bp, Homo sapiens
tttgccaataaag

SEQ ID NO: 6595767 - DNA, 17 bp, Homo sapiens
tttgccaataaagcttt

SEQ ID NO: 6595768 - DNA, 21 bp, Homo sapiens
tttgccaatgaactctttccc

SEQ ID NO: 6595769 - DNA, 16 bp, Homo sapiens
tttgccacagcttttg

SEQ ID NO: 6595770 - DNA, 18 bp, Homo sapiens
tttgccaccctcatgctg

SEQ ID NO: 6595771 - DNA, 19 bp, Homo sapiens
tttgccactgatattcaga

SEQ ID NO: 6595772 - DNA, 19 bp, Homo sapiens
tttgccagactctaggtta

SEQ ID NO: 6595773 - DNA, 16 bp, Homo sapiens
tttgccagacttaaat

SEQ ID NO: 6595774 - DNA, 13 bp, Homo sapiens
tttgccagagcag

SEQ ID NO: 6595775 - DNA, 20 bp, Homo sapiens
tttgccagaggaccaatgct

SEQ ID NO: 6595776 - DNA, 16 bp, Homo sapiens
tttgccagcagagcca

SEQ ID NO: 6595777 - DNA, 13 bp, Homo sapiens
tttgccagctgct

SEQ ID NO: 6595778 - DNA, 17 bp, Homo sapiens
tttgccaggacatgcaa

SEQ ID NO: 6595779 - DNA, 18 bp, Homo sapiens
tttgccagttttccctgg

SEQ ID NO: 6595780 - DNA, 22 bp, Homo sapiens
tttgccatatggaggactgtga

SEQ ID NO: 6595781 - DNA, 22 bp, Homo sapiens
tttgccatgacaacttctaatt

SEQ ID NO: 6595782 - DNA, 16 bp, Homo sapiens
tttgccatgctgctat

SEQ ID NO: 6595783 - DNA, 14 bp, Homo sapiens
tttgccatgtgctt

SEQ ID NO: 6595784 - DNA, 15 bp, Homo sapiens
tttgccattcctgga

SEQ ID NO: 6595785 - DNA, 14 bp, Homo sapiens
tttgccattgtgaa

SEQ ID NO: 6595786 - DNA, 13 bp, Homo sapiens
tttgccatttctt

SEQ ID NO: 6595787 - DNA, 18 bp, Homo sapiens
tttgccatttttctataa

SEQ ID NO: 6595788 - DNA, 14 bp, Homo sapiens
tttgcccaacacca

SEQ ID NO: 6595789 - DNA, 22 bp, Homo sapiens
tttgcccacacacactccttcc

SEQ ID NO: 6595790 - DNA, 18 bp, Homo sapiens
tttgcccagaaagaagat

SEQ ID NO: 6595791 - DNA, 12 bp, Homo sapiens
tttgccccactg

SEQ ID NO: 6595792 - DNA, 13 bp, Homo sapiens
tttgccctcctgc

SEQ ID NO: 6595793 - DNA, 15 bp, Homo sapiens
tttgccctcctgccc

SEQ ID NO: 6595794 - DNA, 14 bp, Homo sapiens
tttgccctgaggct

SEQ ID NO: 6595795 - DNA, 20 bp, Homo sapiens
tttgccctggagcctcagca

SEQ ID NO: 6595796 - DNA, 14 bp, Homo sapiens
tttgcccttcctcc

SEQ ID NO: 6595797 - DNA, 22 bp, Homo sapiens
tttgcccttcctcctgcctttc

SEQ ID NO: 6595798 - DNA, 16 bp, Homo sapiens
tttgccgctgagatat

SEQ ID NO: 6595799 - DNA, 17 bp, Homo sapiens
tttgccgtgagcatgca

SEQ ID NO: 6595800 - DNA, 22 bp, Homo sapiens
tttgcctaaatccaaagaaaaa

SEQ ID NO: 6595801 - DNA, 17 bp, Homo sapiens
tttgcctaccatttcac

SEQ ID NO: 6595802 - DNA, 20 bp, Homo sapiens
tttgcctacgtgacaacaca

SEQ ID NO: 6595803 - DNA, 20 bp, Homo sapiens
tttgcctaggaggccttctc

SEQ ID NO: 6595804 - DNA, 17 bp, Homo sapiens
tttgcctcatgaacact

SEQ ID NO: 6595805 - DNA, 22 bp, Homo sapiens
tttgcctcatgaacactggctg

SEQ ID NO: 6595806 - DNA, 15 bp, Homo sapiens
tttgcctctgctact

SEQ ID NO: 6595807 - DNA, 11 bp, Homo sapiens
tttgcctctgt

SEQ ID NO: 6595808 - DNA, 12 bp, Homo sapiens
tttgcctctgtc

SEQ ID NO: 6595809 - DNA, 22 bp, Homo sapiens
tttgcctctgtcctcccatccc

SEQ ID NO: 6595810 - DNA, 17 bp, Homo sapiens
tttgcctcttccagtct

SEQ ID NO: 6595811 - DNA, 15 bp, Homo sapiens
tttgcctcttctttg

SEQ ID NO: 6595812 - DNA, 20 bp, Homo sapiens
tttgcctcttttctctgtgc

SEQ ID NO: 6595813 - DNA, 20 bp, Homo sapiens
tttgcctgagtgtattttac

SEQ ID NO: 6595814 - DNA, 13 bp, Homo sapiens
tttgcctgcaaga

SEQ ID NO: 6595815 - DNA, 23 bp, Homo sapiens
tttgcctgcagtttcttgtgtag

SEQ ID NO: 6595816 - DNA, 14 bp, Homo sapiens
tttgcctgcctggg

SEQ ID NO: 6595817 - DNA, 22 bp, Homo sapiens
tttgcctgcctgggcctcccaa

SEQ ID NO: 6595818 - DNA, 22 bp, Homo sapiens
tttgcctggctgtggaggcctg

SEQ ID NO: 6595819 - DNA, 13 bp, Homo sapiens
tttgcctgtaaca

SEQ ID NO: 6595820 - DNA, 13 bp, Homo sapiens
tttgcctgtaaga

SEQ ID NO: 6595821 - DNA, 12 bp, Homo sapiens
tttgcctgtgcc

SEQ ID NO: 6595822 - DNA, 19 bp, Homo sapiens
tttgcctgtgtgagcatct

SEQ ID NO: 6595823 - DNA, 20 bp, Homo sapiens
tttgcctgttcagttacaga

SEQ ID NO: 6595824 - DNA, 16 bp, Homo sapiens
tttgccttaggaagtg

SEQ ID NO: 6595825 - DNA, 16 bp, Homo sapiens
tttgccttgcagaact

SEQ ID NO: 6595826 - DNA, 17 bp, Homo sapiens
tttgccttgcagaactg

SEQ ID NO: 6595827 - DNA, 22 bp, Homo sapiens
tttgccttgcagaactgccatt

SEQ ID NO: 6595828 - DNA, 20 bp, Homo sapiens
tttgccttgcagccacatgg

SEQ ID NO: 6595829 - DNA, 19 bp, Homo sapiens
tttgcctttcttctgccct

SEQ ID NO: 6595830 - DNA, 12 bp, Homo sapiens
tttgcctttggt

SEQ ID NO: 6595831 - DNA, 17 bp, Homo sapiens
tttgcgctggtggacca

SEQ ID NO: 6595832 - DNA, 13 bp, Homo sapiens
tttgcggcagtgt

SEQ ID NO: 6595833 - DNA, 16 bp, Homo sapiens
tttgcggggcctgtct

SEQ ID NO: 6595834 - DNA, 15 bp, Homo sapiens
tttgcgtacacagag

SEQ ID NO: 6595835 - DNA, 20 bp, Homo sapiens
tttgcgtgtgtcataaagtt

SEQ ID NO: 6595836 - DNA, 13 bp, Homo sapiens
tttgctaaaagaa

SEQ ID NO: 6595837 - DNA, 14 bp, Homo sapiens
tttgctaaaagaag

SEQ ID NO: 6595838 - DNA, 19 bp, Homo sapiens
tttgctaaaagaagagagg

SEQ ID NO: 6595839 - DNA, 15 bp, Homo sapiens
tttgctaaagacatg

SEQ ID NO: 6595840 - DNA, 12 bp, Homo sapiens
tttgctaactgg

SEQ ID NO: 6595841 - DNA, 13 bp, Homo sapiens
tttgctaactggg

SEQ ID NO: 6595842 - DNA, 16 bp, Homo sapiens
tttgctaactgggtta

SEQ ID NO: 6595843 - DNA, 17 bp, Homo sapiens
tttgctaactgggttaa

SEQ ID NO: 6595844 - DNA, 21 bp, Homo sapiens
tttgctaactgggttaaatat

SEQ ID NO: 6595845 - DNA, 14 bp, Homo sapiens
tttgctaactggtt

SEQ ID NO: 6595846 - DNA, 16 bp, Homo sapiens
tttgctaactggttaa

SEQ ID NO: 6595847 - DNA, 13 bp, Homo sapiens
tttgctaatgcac

SEQ ID NO: 6595848 - DNA, 19 bp, Homo sapiens
tttgctaattaaaaagtta

SEQ ID NO: 6595849 - DNA, 20 bp, Homo sapiens
tttgctaattaactgaaaca

SEQ ID NO: 6595850 - DNA, 21 bp, Homo sapiens
tttgctacaaatttatgcatt

SEQ ID NO: 6595851 - DNA, 22 bp, Homo sapiens
tttgctacaaatttatgcattt

SEQ ID NO: 6595852 - DNA, 22 bp, Homo sapiens
tttgctacaataaatgctgaat

SEQ ID NO: 6595853 - DNA, 20 bp, Homo sapiens
tttgctaccaaagaatgcat

SEQ ID NO: 6595854 - DNA, 22 bp, Homo sapiens
tttgctacccatttacaaataa

SEQ ID NO: 6595855 - DNA, 17 bp, Homo sapiens
tttgctacgattccact

SEQ ID NO: 6595856 - DNA, 24 bp, Homo sapiens
tttgctactgtacataaacaatga

SEQ ID NO: 6595857 - DNA, 19 bp, Homo sapiens
aattacattcctaactaga

SEQ ID NO: 6595858 - DNA, 14 bp, Homo sapiens
aattacatttgtat

SEQ ID NO: 6595859 - DNA, 13 bp, Homo sapiens
aattaccagtttt

SEQ ID NO: 6595860 - DNA, 21 bp, Homo sapiens
aattaccatgcttcacaatgt

SEQ ID NO: 6595861 - DNA, 13 bp, Homo sapiens
aattaccattaat

SEQ ID NO: 6595862 - DNA, 18 bp, Homo sapiens
aattacccataaacagca

SEQ ID NO: 6595863 - DNA, 15 bp, Homo sapiens
aattacccttcctca

SEQ ID NO: 6595864 - DNA, 17 bp, Homo sapiens
aattacccttttgcagg

SEQ ID NO: 6595865 - DNA, 19 bp, Homo sapiens
aattacctaagagccacaa

SEQ ID NO: 6595866 - DNA, 21 bp, Homo sapiens
aattaccttgagccagtaatt

SEQ ID NO: 6595867 - DNA, 15 bp, Homo sapiens
aattacctttaatgc

SEQ ID NO: 6595868 - DNA, 20 bp, Homo sapiens
aattacctttaattttaatg

SEQ ID NO: 6595869 - DNA, 17 bp, Homo sapiens
aattacctttacatata

SEQ ID NO: 6595870 - DNA, 18 bp, Homo sapiens
aattacctttatgtgaac

SEQ ID NO: 6595871 - DNA, 19 bp, Homo sapiens
aattaccttttttgttgtt

SEQ ID NO: 6595872 - DNA, 15 bp, Homo sapiens
aattacgataaggaa

SEQ ID NO: 6595873 - DNA, 18 bp, Homo sapiens
aattacgataaggaagaa

SEQ ID NO: 6595874 - DNA, 22 bp, Homo sapiens
aattacgattatagtaccactg

SEQ ID NO: 6595875 - DNA, 22 bp, Homo sapiens
aattacgtatgcaagtctgtga

SEQ ID NO: 6595876 - DNA, 14 bp, Homo sapiens
aattacgtgctctg

SEQ ID NO: 6595877 - DNA, 18 bp, Homo sapiens
aattacgtttaaagtgca

SEQ ID NO: 6595878 - DNA, 16 bp, Homo sapiens
aattactaaattgtat

SEQ ID NO: 6595879 - DNA, 14 bp, Homo sapiens
aattactaacttct

SEQ ID NO: 6595880 - DNA, 15 bp, Homo sapiens
aattactaataaatt

SEQ ID NO: 6595881 - DNA, 22 bp, Homo sapiens
aattactaataaattgacataa

SEQ ID NO: 6595882 - DNA, 17 bp, Homo sapiens
aattactactaggtaat

SEQ ID NO: 6595883 - DNA, 18 bp, Homo sapiens
aattactatctgttgaaa

SEQ ID NO: 6595884 - DNA, 18 bp, Homo sapiens
aattactatttactttat

SEQ ID NO: 6595885 - DNA, 19 bp, Homo sapiens
aattactcaggaagaacac

SEQ ID NO: 6595886 - DNA, 16 bp, Homo sapiens
aattactgccttgaaa

SEQ ID NO: 6595887 - DNA, 22 bp, Homo sapiens
aattactggagccatgtctaca

SEQ ID NO: 6595888 - DNA, 14 bp, Homo sapiens
aattactggtccaa

SEQ ID NO: 6595889 - DNA, 21 bp, Homo sapiens
aattactgtacacattaaggt

SEQ ID NO: 6595890 - DNA, 14 bp, Homo sapiens
aattactgtatata

SEQ ID NO: 6595891 - DNA, 18 bp, Homo sapiens
aattactgtatataaact

SEQ ID NO: 6595892 - DNA, 20 bp, Homo sapiens
aattactgtatataaactcc

SEQ ID NO: 6595893 - DNA, 15 bp, Homo sapiens
aattactgtgagaac

SEQ ID NO: 6595894 - DNA, 18 bp, Homo sapiens
aattactgtgagaactgt

SEQ ID NO: 6595895 - DNA, 13 bp, Homo sapiens
aattactgtgtgt

SEQ ID NO: 6595896 - DNA, 23 bp, Homo sapiens
aattactgtttattaaagtacaa

SEQ ID NO: 6595897 - DNA, 12 bp, Homo sapiens
aattactgtttt

SEQ ID NO: 6595898 - DNA, 15 bp, Homo sapiens
aattacttaaaaaaa

SEQ ID NO: 6595899 - DNA, 15 bp, Homo sapiens
aattacttaatgtga

SEQ ID NO: 6595900 - DNA, 13 bp, Homo sapiens
aattacttatatt

SEQ ID NO: 6595901 - DNA, 21 bp, Homo sapiens
aattacttatccctgcccatt

SEQ ID NO: 6595902 - DNA, 20 bp, Homo sapiens
aattacttattggatattca

SEQ ID NO: 6595903 - DNA, 15 bp, Homo sapiens
aattactttaacatt

SEQ ID NO: 6595904 - DNA, 16 bp, Homo sapiens
aattactttaacattt

SEQ ID NO: 6595905 - DNA, 18 bp, Homo sapiens
aattactttaacattttg

SEQ ID NO: 6595906 - DNA, 17 bp, Homo sapiens
aattactttattataaa

SEQ ID NO: 6595907 - DNA, 13 bp, Homo sapiens
aattactttcaga

SEQ ID NO: 6595908 - DNA, 22 bp, Homo sapiens
aattactttcagaatattttca

SEQ ID NO: 6595909 - DNA, 19 bp, Homo sapiens
aattactttcagaatgttg

SEQ ID NO: 6595910 - DNA, 14 bp, Homo sapiens
aattactttggtag

SEQ ID NO: 6595911 - DNA, 21 bp, Homo sapiens
aattacttttgaaccatgtat

SEQ ID NO: 6595912 - DNA, 23 bp, Homo sapiens
aattacttttttccaattttaga

SEQ ID NO: 6595913 - DNA, 16 bp, Homo sapiens
aattagaaaaaaacaa

SEQ ID NO: 6595914 - DNA, 18 bp, Homo sapiens
aattagaaaatattctct

SEQ ID NO: 6595915 - DNA, 15 bp, Homo sapiens
aattagaaaattagt

SEQ ID NO: 6595916 - DNA, 17 bp, Homo sapiens
aattagaaaattagtga

SEQ ID NO: 6595917 - DNA, 19 bp, Homo sapiens
aattagaaacaccattcat

SEQ ID NO: 6595918 - DNA, 13 bp, Homo sapiens
aattagaacaata

SEQ ID NO: 6595919 - DNA, 13 bp, Homo sapiens
aattagaagacat

SEQ ID NO: 6595920 - DNA, 12 bp, Homo sapiens
aattagaagcaa

SEQ ID NO: 6595921 - DNA, 16 bp, Homo sapiens
aattagaagccatcct

SEQ ID NO: 6595922 - DNA, 15 bp, Homo sapiens
aattagaatagtgtt

SEQ ID NO: 6595923 - DNA, 17 bp, Homo sapiens
aattagacactttggaa

SEQ ID NO: 6595924 - DNA, 18 bp, Homo sapiens
aattagacatcttcagat

SEQ ID NO: 6595925 - DNA, 17 bp, Homo sapiens
aattagagaagctgaaa

SEQ ID NO: 6595926 - DNA, 21 bp, Homo sapiens
aattagagagcatctgcaaca

SEQ ID NO: 6595927 - DNA, 12 bp, Homo sapiens
aattagagcaga

SEQ ID NO: 6595928 - DNA, 17 bp, Homo sapiens
aattagagttgtgatac

SEQ ID NO: 6595929 - DNA, 22 bp, Homo sapiens
aattagagttgtgatacagagt

SEQ ID NO: 6595930 - DNA, 17 bp, Homo sapiens
aattagataaattgtag

SEQ ID NO: 6595931 - DNA, 19 bp, Homo sapiens
aattagatgattatatatt

SEQ ID NO: 6595932 - DNA, 23 bp, Homo sapiens
aattagatgattatatattgttg

SEQ ID NO: 6595933 - DNA, 14 bp, Homo sapiens
aattagatgcatgt

SEQ ID NO: 6595934 - DNA, 21 bp, Homo sapiens
aattagatgcatgttgaccat

SEQ ID NO: 6595935 - DNA, 13 bp, Homo sapiens
aattagatggctt

SEQ ID NO: 6595936 - DNA, 18 bp, Homo sapiens
aattagattagaaagact

SEQ ID NO: 6595937 - DNA, 19 bp, Homo sapiens
aattagattatttctgtat

SEQ ID NO: 6595938 - DNA, 21 bp, Homo sapiens
aattagatttgtgcaaacatg

SEQ ID NO: 6595939 - DNA, 16 bp, Homo sapiens
aattagcaatcatttt

SEQ ID NO: 6595940 - DNA, 22 bp, Homo sapiens
aattagcagaatggagaaagta

SEQ ID NO: 6595941 - DNA, 13 bp, Homo sapiens
aattagcatgcaa

SEQ ID NO: 6595942 - DNA, 17 bp, Homo sapiens
aattagcatgcaagctt

SEQ ID NO: 6595943 - DNA, 23 bp, Homo sapiens
aattagcatgctgctttttgtac

SEQ ID NO: 6595944 - DNA, 12 bp, Homo sapiens
aattagccaaaa

SEQ ID NO: 6595945 - DNA, 16 bp, Homo sapiens
aattagccacatgtac

SEQ ID NO: 6595946 - DNA, 12 bp, Homo sapiens
aattagccagta

SEQ ID NO: 6595947 - DNA, 19 bp, Homo sapiens
aattagccagtaatcctgt

SEQ ID NO: 6595948 - DNA, 20 bp, Homo sapiens
aattagccagtaatcctgta

SEQ ID NO: 6595949 - DNA, 20 bp, Homo sapiens
aattagccagtcatggtggc

SEQ ID NO: 6595950 - DNA, 14 bp, Homo sapiens
aattagccgggcgt

SEQ ID NO: 6595951 - DNA, 19 bp, Homo sapiens
aattagcctaagatatact

SEQ ID NO: 6595952 - DNA, 22 bp, Homo sapiens
aattagcctaagatatacttgt

SEQ ID NO: 6595953 - DNA, 14 bp, Homo sapiens
aattagctgcttct

SEQ ID NO: 6595954 - DNA, 22 bp, Homo sapiens
aattagcttatgttaactgaca

SEQ ID NO: 6595955 - DNA, 17 bp, Homo sapiens
aattaggaaaaaaacta

SEQ ID NO: 6595956 - DNA, 17 bp, Homo sapiens
aattaggaagtgattat

SEQ ID NO: 6595957 - DNA, 20 bp, Homo sapiens
aattaggaataaataaaaat

SEQ ID NO: 6595958 - DNA, 19 bp, Homo sapiens
aattaggaggctcaacaat

SEQ ID NO: 6595959 - DNA, 21 bp, Homo sapiens
aattaggaggctcaacaataa

SEQ ID NO: 6595960 - DNA, 18 bp, Homo sapiens
aattaggataactaaaat

SEQ ID NO: 6595961 - DNA, 19 bp, Homo sapiens
aattaggatctatgcaatt

SEQ ID NO: 6595962 - DNA, 16 bp, Homo sapiens
aattaggccttatgta

SEQ ID NO: 6595963 - DNA, 19 bp, Homo sapiens
aattaggctgtaactactt

SEQ ID NO: 6595964 - DNA, 19 bp, Homo sapiens
aattagggatgctcaaacg

SEQ ID NO: 6595965 - DNA, 20 bp, Homo sapiens
aattagggctctaatttcct

SEQ ID NO: 6595966 - DNA, 17 bp, Homo sapiens
aattagggtacatttat

SEQ ID NO: 6595967 - DNA, 16 bp, Homo sapiens
aattaggtaatggata

SEQ ID NO: 6595968 - DNA, 20 bp, Homo sapiens
aattaggtccacttcaatgt

SEQ ID NO: 6595969 - DNA, 16 bp, Homo sapiens
aattaggtctgcattt

SEQ ID NO: 6595970 - DNA, 15 bp, Homo sapiens
aattaggttaacatt

SEQ ID NO: 6595971 - DNA, 22 bp, Homo sapiens
aattaggttaactatgtacaat

SEQ ID NO: 6595972 - DNA, 17 bp, Homo sapiens
aattaggtttttcctta

SEQ ID NO: 6595973 - DNA, 13 bp, Homo sapiens
aattagtaacatt

SEQ ID NO: 6595974 - DNA, 14 bp, Homo sapiens
aattagtaataaaa

SEQ ID NO: 6595975 - DNA, 16 bp, Homo sapiens
aattagtacagtagct

SEQ ID NO: 6595976 - DNA, 22 bp, Homo sapiens
aattagtacagtagcttaaata

SEQ ID NO: 6595977 - DNA, 17 bp, Homo sapiens
aattagtatgtctgttt

SEQ ID NO: 6595978 - DNA, 23 bp, Homo sapiens
aattagtatgtctgtttttgtat

SEQ ID NO: 6595979 - DNA, 13 bp, Homo sapiens
aattagtatttca

SEQ ID NO: 6595980 - DNA, 18 bp, Homo sapiens
aattagtcttttgtaata

SEQ ID NO: 6595981 - DNA, 13 bp, Homo sapiens
aattagtcttttt

SEQ ID NO: 6595982 - DNA, 19 bp, Homo sapiens
aattagtgaccattattca

SEQ ID NO: 6595983 - DNA, 21 bp, Homo sapiens
aattagtgaccattattcaca

SEQ ID NO: 6595984 - DNA, 21 bp, Homo sapiens
aattagtgagattaaaaatct

SEQ ID NO: 6595985 - DNA, 14 bp, Homo sapiens
aattagtggatttt

SEQ ID NO: 6595986 - DNA, 19 bp, Homo sapiens
aattagtggatttttttgt

SEQ ID NO: 6595987 - DNA, 18 bp, Homo sapiens
aattagtggcacttgctt

SEQ ID NO: 6595988 - DNA, 21 bp, Homo sapiens
aattagtggtcataaaataga

SEQ ID NO: 6595989 - DNA, 23 bp, Homo sapiens
aattagtgtgacagtttccaaat

SEQ ID NO: 6595990 - DNA, 14 bp, Homo sapiens
aattagtgttttca

SEQ ID NO: 6595991 - DNA, 20 bp, Homo sapiens
aattagtgttttcattctgg

SEQ ID NO: 6595992 - DNA, 14 bp, Homo sapiens
aattagttatatat

SEQ ID NO: 6595993 - DNA, 16 bp, Homo sapiens
aattagttcagccatt

SEQ ID NO: 6595994 - DNA, 14 bp, Homo sapiens
aattagtttaaaat

SEQ ID NO: 6595995 - DNA, 23 bp, Homo sapiens
aattagtttacctcatccatgca

SEQ ID NO: 6595996 - DNA, 12 bp, Homo sapiens
aattagtttcct

SEQ ID NO: 6595997 - DNA, 20 bp, Homo sapiens
aattagtttgggttctctac

SEQ ID NO: 6595998 - DNA, 22 bp, Homo sapiens
aattagttttaaaatactatat

SEQ ID NO: 6595999 - DNA, 20 bp, Homo sapiens
aattagttttatatgcttct

SEQ ID NO: 6596000 - DNA, 14 bp, Homo sapiens
aattataaaatgca

SEQ ID NO: 6596001 - DNA, 14 bp, Homo sapiens
aattataaaattga

SEQ ID NO: 6596002 - DNA, 18 bp, Homo sapiens
aattataaaattgaaaac

SEQ ID NO: 6596003 - DNA, 13 bp, Homo sapiens
aattataaacagc

SEQ ID NO: 6596004 - DNA, 16 bp, Homo sapiens
aattataaacagcagg

SEQ ID NO: 6596005 - DNA, 12 bp, Homo sapiens
aattataaatgt

SEQ ID NO: 6596006 - DNA, 13 bp, Homo sapiens
aattataaatgtg

SEQ ID NO: 6596007 - DNA, 22 bp, Homo sapiens
aattataaatgtgtttatagct

SEQ ID NO: 6596008 - DNA, 17 bp, Homo sapiens
aattataacagttatat

SEQ ID NO: 6596009 - DNA, 16 bp, Homo sapiens
aattataactattaca

SEQ ID NO: 6596010 - DNA, 21 bp, Homo sapiens
aattataactattacagtgtt

SEQ ID NO: 6596011 - DNA, 17 bp, Homo sapiens
aattataacttaaaata

SEQ ID NO: 6596012 - DNA, 13 bp, Homo sapiens
aattataagaaga

SEQ ID NO: 6596013 - DNA, 20 bp, Homo sapiens
aattataagaatttctaaca

SEQ ID NO: 6596014 - DNA, 20 bp, Homo sapiens
aattataagctatgtcacta

SEQ ID NO: 6596015 - DNA, 15 bp, Homo sapiens
aattataaggactgc

SEQ ID NO: 6596016 - DNA, 15 bp, Homo sapiens
aattataatgcatct

SEQ ID NO: 6596017 - DNA, 13 bp, Homo sapiens
aattataatgtat

SEQ ID NO: 6596018 - DNA, 14 bp, Homo sapiens
aattataatgtatt

SEQ ID NO: 6596019 - DNA, 17 bp, Homo sapiens
aattataattttagttt

SEQ ID NO: 6596020 - DNA, 13 bp, Homo sapiens
aattatacaaatt

SEQ ID NO: 6596021 - DNA, 22 bp, Homo sapiens
aattatacagacctaatatcat

SEQ ID NO: 6596022 - DNA, 19 bp, Homo sapiens
aattatacgtacatacaca

SEQ ID NO: 6596023 - DNA, 20 bp, Homo sapiens
aattatactggagaagtctt

SEQ ID NO: 6596024 - DNA, 16 bp, Homo sapiens
aattatactgtgtgtg

SEQ ID NO: 6596025 - DNA, 19 bp, Homo sapiens
aattatagatgggaatgaa

SEQ ID NO: 6596026 - DNA, 18 bp, Homo sapiens
aattatagctctaatgtt

SEQ ID NO: 6596027 - DNA, 16 bp, Homo sapiens
aattataggaagttct

SEQ ID NO: 6596028 - DNA, 19 bp, Homo sapiens
aattatagtgtagaaaaga

SEQ ID NO: 6596029 - DNA, 21 bp, Homo sapiens
aattatagtgtcatgcagagt

SEQ ID NO: 6596030 - DNA, 14 bp, Homo sapiens
aattatagtttctg

SEQ ID NO: 6596031 - DNA, 15 bp, Homo sapiens
aattatagtttctga

SEQ ID NO: 6596032 - DNA, 17 bp, Homo sapiens
aattatagtttctgagg

SEQ ID NO: 6596033 - DNA, 17 bp, Homo sapiens
aattatataactgtatt

SEQ ID NO: 6596034 - DNA, 14 bp, Homo sapiens
aattatataaggca

SEQ ID NO: 6596035 - DNA, 15 bp, Homo sapiens
aattatataagtatt

SEQ ID NO: 6596036 - DNA, 21 bp, Homo sapiens
tttgctagagctaacagacat

SEQ ID NO: 6596037 - DNA, 16 bp, Homo sapiens
tttgctagtgcatttc

SEQ ID NO: 6596038 - DNA, 21 bp, Homo sapiens
tttgctagttctgctgccctc

SEQ ID NO: 6596039 - DNA, 23 bp, Homo sapiens
tttgctagttggagtgcttgttt

SEQ ID NO: 6596040 - DNA, 16 bp, Homo sapiens
tttgctataatcatta

SEQ ID NO: 6596041 - DNA, 16 bp, Homo sapiens
tttgctatctgggctg

SEQ ID NO: 6596042 - DNA, 18 bp, Homo sapiens
tttgctatcttaattttg

SEQ ID NO: 6596043 - DNA, 17 bp, Homo sapiens
tttgctatgactacatt

SEQ ID NO: 6596044 - DNA, 19 bp, Homo sapiens
tttgctatgagctggggat

SEQ ID NO: 6596045 - DNA, 23 bp, Homo sapiens
tttgctattgacaagtcatttta

SEQ ID NO: 6596046 - DNA, 16 bp, Homo sapiens
tttgctattgtaaata

SEQ ID NO: 6596047 - DNA, 20 bp, Homo sapiens
tttgctcaaaattgcttcta

SEQ ID NO: 6596048 - DNA, 17 bp, Homo sapiens
tttgctcaatatgatct

SEQ ID NO: 6596049 - DNA, 23 bp, Homo sapiens
tttgctcagtgtctggctgcaga

SEQ ID NO: 6596050 - DNA, 21 bp, Homo sapiens
tttgctcataagtaaatgtct

SEQ ID NO: 6596051 - DNA, 22 bp, Homo sapiens
tttgctcataagtaaatgtctt

SEQ ID NO: 6596052 - DNA, 12 bp, Homo sapiens
tttgctccaccc

SEQ ID NO: 6596053 - DNA, 20 bp, Homo sapiens
tttgctccaccttcatattg

SEQ ID NO: 6596054 - DNA, 12 bp, Homo sapiens
tttgctccaggc

SEQ ID NO: 6596055 - DNA, 21 bp, Homo sapiens
tttgctccccttccccttcct

SEQ ID NO: 6596056 - DNA, 11 bp, Homo sapiens
tttgctccctc

SEQ ID NO: 6596057 - DNA, 23 bp, Homo sapiens
tttgctccctccccgctgccctt

SEQ ID NO: 6596058 - DNA, 15 bp, Homo sapiens
tttgctccctctgtt

SEQ ID NO: 6596059 - DNA, 16 bp, Homo sapiens
tttgctccctctgtta

SEQ ID NO: 6596060 - DNA, 14 bp, Homo sapiens
tttgctccgaagct

SEQ ID NO: 6596061 - DNA, 17 bp, Homo sapiens
tttgctccgctcccacc

SEQ ID NO: 6596062 - DNA, 16 bp, Homo sapiens
tttgctcctagaactg

SEQ ID NO: 6596063 - DNA, 16 bp, Homo sapiens
tttgctccttcagttc

SEQ ID NO: 6596064 - DNA, 21 bp, Homo sapiens
tttgctccttcagttctgctt

SEQ ID NO: 6596065 - DNA, 15 bp, Homo sapiens
tttgctctatgggaa

SEQ ID NO: 6596066 - DNA, 23 bp, Homo sapiens
tttgctctattaagattggaaat

SEQ ID NO: 6596067 - DNA, 19 bp, Homo sapiens
tttgctctgatttccttcc

SEQ ID NO: 6596068 - DNA, 12 bp, Homo sapiens
tttgctctgcca

SEQ ID NO: 6596069 - DNA, 20 bp, Homo sapiens
tttgctctgtggtaagagat

SEQ ID NO: 6596070 - DNA, 13 bp, Homo sapiens
tttgctcttcaga

SEQ ID NO: 6596071 - DNA, 21 bp, Homo sapiens
tttgctcttcagatgccactt

SEQ ID NO: 6596072 - DNA, 19 bp, Homo sapiens
tttgctcttctgtatgtga

SEQ ID NO: 6596073 - DNA, 14 bp, Homo sapiens
tttgctcttggaat

SEQ ID NO: 6596074 - DNA, 17 bp, Homo sapiens
tttgctcttgtcccacg

SEQ ID NO: 6596075 - DNA, 13 bp, Homo sapiens
tttgctctttctt

SEQ ID NO: 6596076 - DNA, 17 bp, Homo sapiens
tttgctcttttaagcag

SEQ ID NO: 6596077 - DNA, 19 bp, Homo sapiens
tttgctcttttaagcagtc

SEQ ID NO: 6596078 - DNA, 18 bp, Homo sapiens
tttgctgaacattggaga

SEQ ID NO: 6596079 - DNA, 17 bp, Homo sapiens
tttgctgaagtctcccc

SEQ ID NO: 6596080 - DNA, 17 bp, Homo sapiens
tttgctgaattccttta

SEQ ID NO: 6596081 - DNA, 19 bp, Homo sapiens
tttgctgaattcctttaca

SEQ ID NO: 6596082 - DNA, 23 bp, Homo sapiens
tttgctgacaaccattaaagtca

SEQ ID NO: 6596083 - DNA, 22 bp, Homo sapiens
tttgctgaccggaatggtcaaa

SEQ ID NO: 6596084 - DNA, 19 bp, Homo sapiens
tttgctgagttgttctaac

SEQ ID NO: 6596085 - DNA, 15 bp, Homo sapiens
tttgctgattgtctg

SEQ ID NO: 6596086 - DNA, 19 bp, Homo sapiens
tttgctgcacagcaggacc

SEQ ID NO: 6596087 - DNA, 18 bp, Homo sapiens
tttgctgcattttacaca

SEQ ID NO: 6596088 - DNA, 19 bp, Homo sapiens
tttgctgccaaatgcgtat

SEQ ID NO: 6596089 - DNA, 13 bp, Homo sapiens
tttgctgcccctg

SEQ ID NO: 6596090 - DNA, 11 bp, Homo sapiens
tttgctgccct

SEQ ID NO: 6596091 - DNA, 18 bp, Homo sapiens
tttgctgcgcaccaatgc

SEQ ID NO: 6596092 - DNA, 22 bp, Homo sapiens
tttgctgctatgaaaatgagca

SEQ ID NO: 6596093 - DNA, 23 bp, Homo sapiens
tttgctgctatgaaaatgagcat

SEQ ID NO: 6596094 - DNA, 13 bp, Homo sapiens
tttgctgctcttc

SEQ ID NO: 6596095 - DNA, 23 bp, Homo sapiens
tttgctgctgatgggcatcattg

SEQ ID NO: 6596096 - DNA, 22 bp, Homo sapiens
tttgctgctgcccatgtttcaa

SEQ ID NO: 6596097 - DNA, 17 bp, Homo sapiens
tttgctgctgctctcag

SEQ ID NO: 6596098 - DNA, 21 bp, Homo sapiens
tttgctgctgtggaaaggatt

SEQ ID NO: 6596099 - DNA, 13 bp, Homo sapiens
tttgctgcttctg

SEQ ID NO: 6596100 - DNA, 12 bp, Homo sapiens
tttgctgctttg

SEQ ID NO: 6596101 - DNA, 15 bp, Homo sapiens
tttgctggaaaatct

SEQ ID NO: 6596102 - DNA, 15 bp, Homo sapiens
tttgctggaataagt

SEQ ID NO: 6596103 - DNA, 16 bp, Homo sapiens
tttgctggagtcctgt

SEQ ID NO: 6596104 - DNA, 14 bp, Homo sapiens
tttgctgtactctt

SEQ ID NO: 6596105 - DNA, 21 bp, Homo sapiens
tttgctgtactcttgctgatg

SEQ ID NO: 6596106 - DNA, 24 bp, Homo sapiens
tttgctgtaggttttttatagcta

SEQ ID NO: 6596107 - DNA, 18 bp, Homo sapiens
tttgctgtatacaaacag

SEQ ID NO: 6596108 - DNA, 23 bp, Homo sapiens
tttgctgtcccatagtccctgcc

SEQ ID NO: 6596109 - DNA, 15 bp, Homo sapiens
tttgctgtgaacaat

SEQ ID NO: 6596110 - DNA, 21 bp, Homo sapiens
tttgctgtgaggctgtcctgt

SEQ ID NO: 6596111 - DNA, 18 bp, Homo sapiens
tttgctgtgctttggaac

SEQ ID NO: 6596112 - DNA, 13 bp, Homo sapiens
tttgctgttactg

SEQ ID NO: 6596113 - DNA, 16 bp, Homo sapiens
tttgctgttgaagaaa

SEQ ID NO: 6596114 - DNA, 15 bp, Homo sapiens
tttgctgttgggttt

SEQ ID NO: 6596115 - DNA, 17 bp, Homo sapiens
tttgctgttgtttctat

SEQ ID NO: 6596116 - DNA, 10 bp, Homo sapiens
tttgctgttt

SEQ ID NO: 6596117 - DNA, 21 bp, Homo sapiens
tttgctgttttaaacattaat

SEQ ID NO: 6596118 - DNA, 18 bp, Homo sapiens
tttgcttaaaatatgtga

SEQ ID NO: 6596119 - DNA, 17 bp, Homo sapiens
tttgcttaccaaaagct

SEQ ID NO: 6596120 - DNA, 19 bp, Homo sapiens
tttgcttaccaaaagctca

SEQ ID NO: 6596121 - DNA, 12 bp, Homo sapiens
tttgcttagaaa

SEQ ID NO: 6596122 - DNA, 16 bp, Homo sapiens
tttgcttattgttcca

SEQ ID NO: 6596123 - DNA, 17 bp, Homo sapiens
tttgcttattgttccaa

SEQ ID NO: 6596124 - DNA, 19 bp, Homo sapiens
tttgcttattgttccaaga

SEQ ID NO: 6596125 - DNA, 18 bp, Homo sapiens
tttgcttatttttataat

SEQ ID NO: 6596126 - DNA, 20 bp, Homo sapiens
tttgcttatttttataatta

SEQ ID NO: 6596127 - DNA, 22 bp, Homo sapiens
tttgcttatttttataattaaa

SEQ ID NO: 6596128 - DNA, 22 bp, Homo sapiens
tttgcttcaacaactttgtgct

SEQ ID NO: 6596129 - DNA, 20 bp, Homo sapiens
tttgcttcatagtattggag

SEQ ID NO: 6596130 - DNA, 12 bp, Homo sapiens
tttgcttcctca

SEQ ID NO: 6596131 - DNA, 13 bp, Homo sapiens
tttgcttctctcc

SEQ ID NO: 6596132 - DNA, 15 bp, Homo sapiens
tttgcttctttttct

SEQ ID NO: 6596133 - DNA, 16 bp, Homo sapiens
tttgcttgaaagaaaa

SEQ ID NO: 6596134 - DNA, 16 bp, Homo sapiens
tttgcttgaacacagt

SEQ ID NO: 6596135 - DNA, 22 bp, Homo sapiens
tttgcttgcaatctaatctgaa

SEQ ID NO: 6596136 - DNA, 17 bp, Homo sapiens
tttgcttgcagtagatt

SEQ ID NO: 6596137 - DNA, 18 bp, Homo sapiens
tttgcttgcgtgctggga

SEQ ID NO: 6596138 - DNA, 21 bp, Homo sapiens
tttgcttgctcatatgcatgt

SEQ ID NO: 6596139 - DNA, 15 bp, Homo sapiens
tttgcttggcagaga

SEQ ID NO: 6596140 - DNA, 17 bp, Homo sapiens
tttgcttggtgctggtt

SEQ ID NO: 6596141 - DNA, 14 bp, Homo sapiens
tttgcttgtcttct

SEQ ID NO: 6596142 - DNA, 23 bp, Homo sapiens
tttgcttgtggctccacacacac

SEQ ID NO: 6596143 - DNA, 9 bp, Homo sapiens
tttgctttc

SEQ ID NO: 6596144 - DNA, 21 bp, Homo sapiens
tttgctttcggtactgtaata

SEQ ID NO: 6596145 - DNA, 19 bp, Homo sapiens
tttgctttcggttccagtt

SEQ ID NO: 6596146 - DNA, 15 bp, Homo sapiens
tttgctttctgaatt

SEQ ID NO: 6596147 - DNA, 15 bp, Homo sapiens
tttgctttgtgattt

SEQ ID NO: 6596148 - DNA, 12 bp, Homo sapiens
tttgctttttct

SEQ ID NO: 6596149 - DNA, 20 bp, Homo sapiens
tttgctttttgcgtacacag

SEQ ID NO: 6596150 - DNA, 15 bp, Homo sapiens
tttggaaaaaactct

SEQ ID NO: 6596151 - DNA, 15 bp, Homo sapiens
tttggaaaaaccttg

SEQ ID NO: 6596152 - DNA, 17 bp, Homo sapiens
tttggaaaaatgtcact

SEQ ID NO: 6596153 - DNA, 15 bp, Homo sapiens
tttggaaaaatgttt

SEQ ID NO: 6596154 - DNA, 24 bp, Homo sapiens
tttggaaaacataaaaatcactca

SEQ ID NO: 6596155 - DNA, 14 bp, Homo sapiens
tttggaaaactaac

SEQ ID NO: 6596156 - DNA, 19 bp, Homo sapiens
tttggaaaagagctgggat

SEQ ID NO: 6596157 - DNA, 20 bp, Homo sapiens
tttggaaaagtggcgtggga

SEQ ID NO: 6596158 - DNA, 23 bp, Homo sapiens
tttggaaaatgacattttactat

SEQ ID NO: 6596159 - DNA, 13 bp, Homo sapiens
tttggaaaattca

SEQ ID NO: 6596160 - DNA, 13 bp, Homo sapiens
tttggaaactaat

SEQ ID NO: 6596161 - DNA, 21 bp, Homo sapiens
tttggaaactaataaaatatt

SEQ ID NO: 6596162 - DNA, 17 bp, Homo sapiens
tttggaaactcaaggaa

SEQ ID NO: 6596163 - DNA, 14 bp, Homo sapiens
tttggaaagaaatt

SEQ ID NO: 6596164 - DNA, 14 bp, Homo sapiens
tttggaaagagacc

SEQ ID NO: 6596165 - DNA, 16 bp, Homo sapiens
tttggaaaggaatgca

SEQ ID NO: 6596166 - DNA, 18 bp, Homo sapiens
tttggaaaggaatgcaaa

SEQ ID NO: 6596167 - DNA, 19 bp, Homo sapiens
tttggaaaggaatgcaaag

SEQ ID NO: 6596168 - DNA, 20 bp, Homo sapiens
tttggaaagtacactctgct

SEQ ID NO: 6596169 - DNA, 21 bp, Homo sapiens
tttggaaagtacactctgctg

SEQ ID NO: 6596170 - DNA, 15 bp, Homo sapiens
tttggaaatctcttt

SEQ ID NO: 6596171 - DNA, 15 bp, Homo sapiens
tttggaaatctttaa

SEQ ID NO: 6596172 - DNA, 16 bp, Homo sapiens
tttggaaatctttaaa

SEQ ID NO: 6596173 - DNA, 19 bp, Homo sapiens
tttggaaatggggagctgg

SEQ ID NO: 6596174 - DNA, 23 bp, Homo sapiens
tttggaacaagatggttctagca

SEQ ID NO: 6596175 - DNA, 18 bp, Homo sapiens
tttggaaccctaaataat

SEQ ID NO: 6596176 - DNA, 12 bp, Homo sapiens
tttggaactatg

SEQ ID NO: 6596177 - DNA, 12 bp, Homo sapiens
tttggaagaagg

SEQ ID NO: 6596178 - DNA, 21 bp, Homo sapiens
tttggaagaagttttttactt

SEQ ID NO: 6596179 - DNA, 17 bp, Homo sapiens
tttggaagaattcatga

SEQ ID NO: 6596180 - DNA, 14 bp, Homo sapiens
tttggaagcagcaa

SEQ ID NO: 6596181 - DNA, 22 bp, Homo sapiens
tttggaagcagccccctgtggc

SEQ ID NO: 6596182 - DNA, 14 bp, Homo sapiens
tttggaagtgatgt

SEQ ID NO: 6596183 - DNA, 13 bp, Homo sapiens
tttggaagttatt

SEQ ID NO: 6596184 - DNA, 19 bp, Homo sapiens
tttggaagtttagctctga

SEQ ID NO: 6596185 - DNA, 14 bp, Homo sapiens
tttggaagttttca

SEQ ID NO: 6596186 - DNA, 13 bp, Homo sapiens
tttggaataaagt

SEQ ID NO: 6596187 - DNA, 20 bp, Homo sapiens
tttggaataataattttcct

SEQ ID NO: 6596188 - DNA, 17 bp, Homo sapiens
tttggaataatttctat

SEQ ID NO: 6596189 - DNA, 15 bp, Homo sapiens
tttggaatacttttt

SEQ ID NO: 6596190 - DNA, 21 bp, Homo sapiens
tttggaatctagaagaaatga

SEQ ID NO: 6596191 - DNA, 23 bp, Homo sapiens
tttggaatctagaagaaatgaaa

SEQ ID NO: 6596192 - DNA, 22 bp, Homo sapiens
tttggaatcttctctttgacaa

SEQ ID NO: 6596193 - DNA, 13 bp, Homo sapiens
tttggaattagaa

SEQ ID NO: 6596194 - DNA, 19 bp, Homo sapiens
tttggaattgaactctctg

SEQ ID NO: 6596195 - DNA, 16 bp, Homo sapiens
tttggaattggtgtat

SEQ ID NO: 6596196 - DNA, 22 bp, Homo sapiens
tttggaattttcctcctttctc

SEQ ID NO: 6596197 - DNA, 13 bp, Homo sapiens
tttggacaaaatg

SEQ ID NO: 6596198 - DNA, 13 bp, Homo sapiens
tttggacaaggaa

SEQ ID NO: 6596199 - DNA, 17 bp, Homo sapiens
tttggacacacacagct

SEQ ID NO: 6596200 - DNA, 16 bp, Homo sapiens
tttggacagtggcctc

SEQ ID NO: 6596201 - DNA, 15 bp, Homo sapiens
tttggaccctgaggc

SEQ ID NO: 6596202 - DNA, 16 bp, Homo sapiens
tttggacgtgtgagga

SEQ ID NO: 6596203 - DNA, 14 bp, Homo sapiens
tttggactctctgt

SEQ ID NO: 6596204 - DNA, 16 bp, Homo sapiens
tttggactctctgtgg

SEQ ID NO: 6596205 - DNA, 18 bp, Homo sapiens
tttggactgttttcaata

SEQ ID NO: 6596206 - DNA, 16 bp, Homo sapiens
tttggacttctggggt

SEQ ID NO: 6596207 - DNA, 12 bp, Homo sapiens
tttggagaaaaa

SEQ ID NO: 6596208 - DNA, 19 bp, Homo sapiens
tttggagaaaaattacaga

SEQ ID NO: 6596209 - DNA, 22 bp, Homo sapiens
tttggagaaattatttaataaa

SEQ ID NO: 6596210 - DNA, 22 bp, Homo sapiens
tttggagaacgccagtctccca

SEQ ID NO: 6596211 - DNA, 18 bp, Homo sapiens
tttggagaactcatttca

SEQ ID NO: 6596212 - DNA, 19 bp, Homo sapiens
tttggagaactcatttcaa

SEQ ID NO: 6596213 - DNA, 14 bp, Homo sapiens
tttggagagaaata

SEQ ID NO: 6596214 - DNA, 19 bp, Homo sapiens
tttggagagaaatatttta

SEQ ID NO: 6596215 - DNA, 17 bp, Homo sapiens
aattatataagtattct

SEQ ID NO: 6596216 - DNA, 20 bp, Homo sapiens
aattatatagcaaagatata

SEQ ID NO: 6596217 - DNA, 21 bp, Homo sapiens
aattatatagcaaagatatat

SEQ ID NO: 6596218 - DNA, 13 bp, Homo sapiens
aattatatatact

SEQ ID NO: 6596219 - DNA, 12 bp, Homo sapiens
aattatatattt

SEQ ID NO: 6596220 - DNA, 14 bp, Homo sapiens
aattatatattttg

SEQ ID NO: 6596221 - DNA, 18 bp, Homo sapiens
aattatatattttgttgt

SEQ ID NO: 6596222 - DNA, 19 bp, Homo sapiens
aattatatctaatttatac

SEQ ID NO: 6596223 - DNA, 22 bp, Homo sapiens
aattatatctaatttatacaaa

SEQ ID NO: 6596224 - DNA, 17 bp, Homo sapiens
aattatatctattatgt

SEQ ID NO: 6596225 - DNA, 22 bp, Homo sapiens
aattatatctgaggaattctgt

SEQ ID NO: 6596226 - DNA, 20 bp, Homo sapiens
aattatatgatatgcatgta

SEQ ID NO: 6596227 - DNA, 13 bp, Homo sapiens
aattatatgctaa

SEQ ID NO: 6596228 - DNA, 14 bp, Homo sapiens
aattatatgttgta

SEQ ID NO: 6596229 - DNA, 19 bp, Homo sapiens
aattatattatgaataaaa

SEQ ID NO: 6596230 - DNA, 18 bp, Homo sapiens
aattatattcaatgcatt

SEQ ID NO: 6596231 - DNA, 16 bp, Homo sapiens
aattatatttaccttt

SEQ ID NO: 6596232 - DNA, 20 bp, Homo sapiens
aattatatttctacagagaa

SEQ ID NO: 6596233 - DNA, 14 bp, Homo sapiens
aattatatttgaaa

SEQ ID NO: 6596234 - DNA, 13 bp, Homo sapiens
aattatatttgtg

SEQ ID NO: 6596235 - DNA, 22 bp, Homo sapiens
aattatatttgtgctatagtat

SEQ ID NO: 6596236 - DNA, 13 bp, Homo sapiens
aattatattttga

SEQ ID NO: 6596237 - DNA, 15 bp, Homo sapiens
aattatatttttgta

SEQ ID NO: 6596238 - DNA, 19 bp, Homo sapiens
aattatatttttgtaaata

SEQ ID NO: 6596239 - DNA, 21 bp, Homo sapiens
aattatcaaaaaacagaaaaa

SEQ ID NO: 6596240 - DNA, 13 bp, Homo sapiens
aattatcagcaaa

SEQ ID NO: 6596241 - DNA, 19 bp, Homo sapiens
aattatcagcaaagaaaaa

SEQ ID NO: 6596242 - DNA, 21 bp, Homo sapiens
aattatcagcaaagaaaaaaa

SEQ ID NO: 6596243 - DNA, 22 bp, Homo sapiens
aattatcaggcaaatttgcatt

SEQ ID NO: 6596244 - DNA, 19 bp, Homo sapiens
aattatcatcccaacagcc

SEQ ID NO: 6596245 - DNA, 13 bp, Homo sapiens
aattatcattgtt

SEQ ID NO: 6596246 - DNA, 21 bp, Homo sapiens
aattatcattgtttgtccttt

SEQ ID NO: 6596247 - DNA, 13 bp, Homo sapiens
aattatccaggaa

SEQ ID NO: 6596248 - DNA, 18 bp, Homo sapiens
aattatccaggatgtgtg

SEQ ID NO: 6596249 - DNA, 16 bp, Homo sapiens
aattatcccttttctt

SEQ ID NO: 6596250 - DNA, 18 bp, Homo sapiens
aattatcctcaagttgtg

SEQ ID NO: 6596251 - DNA, 17 bp, Homo sapiens
aattatcctctttgtaa

SEQ ID NO: 6596252 - DNA, 19 bp, Homo sapiens
aattatctaatttataaaa

SEQ ID NO: 6596253 - DNA, 14 bp, Homo sapiens
aattatctatacat

SEQ ID NO: 6596254 - DNA, 16 bp, Homo sapiens
aattatctatacatat

SEQ ID NO: 6596255 - DNA, 22 bp, Homo sapiens
aattatctatacatatctttat

SEQ ID NO: 6596256 - DNA, 19 bp, Homo sapiens
aattatctatttgtatata

SEQ ID NO: 6596257 - DNA, 15 bp, Homo sapiens
aattatctcaagtaa

SEQ ID NO: 6596258 - DNA, 21 bp, Homo sapiens
aattatctcaagtaaaacaaa

SEQ ID NO: 6596259 - DNA, 20 bp, Homo sapiens
aattatctcctaattgtatg

SEQ ID NO: 6596260 - DNA, 22 bp, Homo sapiens
aattatctctcatttgttgttg

SEQ ID NO: 6596261 - DNA, 16 bp, Homo sapiens
aattatctgaatatta

SEQ ID NO: 6596262 - DNA, 18 bp, Homo sapiens
aattatctgccttataca

SEQ ID NO: 6596263 - DNA, 14 bp, Homo sapiens
aattatcttattta

SEQ ID NO: 6596264 - DNA, 18 bp, Homo sapiens
aattatcttgatacattc

SEQ ID NO: 6596265 - DNA, 20 bp, Homo sapiens
aattatcttgatacattcaa

SEQ ID NO: 6596266 - DNA, 12 bp, Homo sapiens
aattatctttaa

SEQ ID NO: 6596267 - DNA, 18 bp, Homo sapiens
aattatctttagttgaat

SEQ ID NO: 6596268 - DNA, 18 bp, Homo sapiens
aattatgaaaaaatgttc

SEQ ID NO: 6596269 - DNA, 19 bp, Homo sapiens
aattatgaaaaaatgttca

SEQ ID NO: 6596270 - DNA, 16 bp, Homo sapiens
aattatgaaaagaaat

SEQ ID NO: 6596271 - DNA, 18 bp, Homo sapiens
aattatgaaaatgtaagt

SEQ ID NO: 6596272 - DNA, 18 bp, Homo sapiens
aattatgaaacttttgga

SEQ ID NO: 6596273 - DNA, 15 bp, Homo sapiens
aattatgaagattta

SEQ ID NO: 6596274 - DNA, 20 bp, Homo sapiens
aattatgaagccctaagtaa

SEQ ID NO: 6596275 - DNA, 17 bp, Homo sapiens
aattatgaatctgattt

SEQ ID NO: 6596276 - DNA, 21 bp, Homo sapiens
aattatgaatctgatttttat

SEQ ID NO: 6596277 - DNA, 17 bp, Homo sapiens
aattatgacgtgcacaa

SEQ ID NO: 6596278 - DNA, 20 bp, Homo sapiens
aattatgagaggctgtcata

SEQ ID NO: 6596279 - DNA, 13 bp, Homo sapiens
aattatgagatga

SEQ ID NO: 6596280 - DNA, 23 bp, Homo sapiens
aattatgagattggttttcctgt

SEQ ID NO: 6596281 - DNA, 21 bp, Homo sapiens
aattatgaggtgaaacaatta

SEQ ID NO: 6596282 - DNA, 19 bp, Homo sapiens
aattatgagttatttttat

SEQ ID NO: 6596283 - DNA, 17 bp, Homo sapiens
aattatgatggaagaca

SEQ ID NO: 6596284 - DNA, 15 bp, Homo sapiens
aattatgatttgggt

SEQ ID NO: 6596285 - DNA, 19 bp, Homo sapiens
aattatgcaattcagtgtt

SEQ ID NO: 6596286 - DNA, 18 bp, Homo sapiens
aattatgcactggccacc

SEQ ID NO: 6596287 - DNA, 22 bp, Homo sapiens
aattatgcagcttgcacaccca

SEQ ID NO: 6596288 - DNA, 15 bp, Homo sapiens
aattatgcatctgct

SEQ ID NO: 6596289 - DNA, 17 bp, Homo sapiens
aattatgccttttttga

SEQ ID NO: 6596290 - DNA, 18 bp, Homo sapiens
aattatgctaagaatttt

SEQ ID NO: 6596291 - DNA, 22 bp, Homo sapiens
aattatgctaagaattttttat

SEQ ID NO: 6596292 - DNA, 21 bp, Homo sapiens
aattatgctgtgaattttaca

SEQ ID NO: 6596293 - DNA, 12 bp, Homo sapiens
aattatggaaat

SEQ ID NO: 6596294 - DNA, 23 bp, Homo sapiens
aattatggaatatcatctgtcat

SEQ ID NO: 6596295 - DNA, 22 bp, Homo sapiens
aattatgggaacaagtgtacag

SEQ ID NO: 6596296 - DNA, 23 bp, Homo sapiens
aattatgggaacaagtgtacaga

SEQ ID NO: 6596297 - DNA, 12 bp, Homo sapiens
aattatggtgaa

SEQ ID NO: 6596298 - DNA, 12 bp, Homo sapiens
aattatgtaaat

SEQ ID NO: 6596299 - DNA, 19 bp, Homo sapiens
aattatgtaaatacaattt

SEQ ID NO: 6596300 - DNA, 19 bp, Homo sapiens
aattatgtaatatattgta

SEQ ID NO: 6596301 - DNA, 18 bp, Homo sapiens
aattatgtaatgcaaaat

SEQ ID NO: 6596302 - DNA, 18 bp, Homo sapiens
aattatgtacaacattta

SEQ ID NO: 6596303 - DNA, 12 bp, Homo sapiens
aattatgtagct

SEQ ID NO: 6596304 - DNA, 13 bp, Homo sapiens
aattatgtagctc

SEQ ID NO: 6596305 - DNA, 18 bp, Homo sapiens
aattatgtatgtttacat

SEQ ID NO: 6596306 - DNA, 21 bp, Homo sapiens
aattatgtatgtttacatatc

SEQ ID NO: 6596307 - DNA, 14 bp, Homo sapiens
aattatgtcaaatg

SEQ ID NO: 6596308 - DNA, 18 bp, Homo sapiens
aattatgtcaaatggatg

SEQ ID NO: 6596309 - DNA, 14 bp, Homo sapiens
aattatgtctcttg

SEQ ID NO: 6596310 - DNA, 20 bp, Homo sapiens
aattatgtgacaacctttgt

SEQ ID NO: 6596311 - DNA, 14 bp, Homo sapiens
aattatgttaaact

SEQ ID NO: 6596312 - DNA, 23 bp, Homo sapiens
aattatgttaaactagcatatct

SEQ ID NO: 6596313 - DNA, 16 bp, Homo sapiens
aattatgttactgtat

SEQ ID NO: 6596314 - DNA, 18 bp, Homo sapiens
aattatgttactgtattt

SEQ ID NO: 6596315 - DNA, 17 bp, Homo sapiens
aattatgtttatataaa

SEQ ID NO: 6596316 - DNA, 17 bp, Homo sapiens
aattatgttttgacaca

SEQ ID NO: 6596317 - DNA, 16 bp, Homo sapiens
aattattaactacatt

SEQ ID NO: 6596318 - DNA, 19 bp, Homo sapiens
aattattaactacatttat

SEQ ID NO: 6596319 - DNA, 20 bp, Homo sapiens
aattattaactacatttatg

SEQ ID NO: 6596320 - DNA, 23 bp, Homo sapiens
aattattaactacatttatgagt

SEQ ID NO: 6596321 - DNA, 13 bp, Homo sapiens
aattattaatgaa

SEQ ID NO: 6596322 - DNA, 17 bp, Homo sapiens
aattattaatgaaaata

SEQ ID NO: 6596323 - DNA, 22 bp, Homo sapiens
aattattaattgtcctgtgtct

SEQ ID NO: 6596324 - DNA, 18 bp, Homo sapiens
aattattacagtccttca

SEQ ID NO: 6596325 - DNA, 18 bp, Homo sapiens
aattattacagtgtttat

SEQ ID NO: 6596326 - DNA, 18 bp, Homo sapiens
aattattacatttataca

SEQ ID NO: 6596327 - DNA, 19 bp, Homo sapiens
aattattaccagttatttg

SEQ ID NO: 6596328 - DNA, 23 bp, Homo sapiens
aattattactttaaattatatga

SEQ ID NO: 6596329 - DNA, 17 bp, Homo sapiens
aattattagcaccagct

SEQ ID NO: 6596330 - DNA, 19 bp, Homo sapiens
aattattaggagtaattct

SEQ ID NO: 6596331 - DNA, 18 bp, Homo sapiens
aattattataagcattga

SEQ ID NO: 6596332 - DNA, 18 bp, Homo sapiens
aattattatttaactctt

SEQ ID NO: 6596333 - DNA, 19 bp, Homo sapiens
aattattatttaactctta

SEQ ID NO: 6596334 - DNA, 20 bp, Homo sapiens
aattattatttatttttgcc

SEQ ID NO: 6596335 - DNA, 15 bp, Homo sapiens
aattattatttgtgt

SEQ ID NO: 6596336 - DNA, 16 bp, Homo sapiens
aattattatttgtgtt

SEQ ID NO: 6596337 - DNA, 21 bp, Homo sapiens
aattattattttaaaatatat

SEQ ID NO: 6596338 - DNA, 22 bp, Homo sapiens
aattattattttaaaatatatg

SEQ ID NO: 6596339 - DNA, 17 bp, Homo sapiens
aattattcatagctgta

SEQ ID NO: 6596340 - DNA, 16 bp, Homo sapiens
aattattccctgaatt

SEQ ID NO: 6596341 - DNA, 22 bp, Homo sapiens
aattattccctgaattgtttga

SEQ ID NO: 6596342 - DNA, 21 bp, Homo sapiens
aattattctaattttatatat

SEQ ID NO: 6596343 - DNA, 13 bp, Homo sapiens
aattattctagtc

SEQ ID NO: 6596344 - DNA, 23 bp, Homo sapiens
aattattctataatttccattta

SEQ ID NO: 6596345 - DNA, 17 bp, Homo sapiens
aattattctgattcttt

SEQ ID NO: 6596346 - DNA, 17 bp, Homo sapiens
aattattgatatatatt

SEQ ID NO: 6596347 - DNA, 20 bp, Homo sapiens
aattattgatatatattata

SEQ ID NO: 6596348 - DNA, 17 bp, Homo sapiens
aattattgatgttttca

SEQ ID NO: 6596349 - DNA, 17 bp, Homo sapiens
aattattgattgctttt

SEQ ID NO: 6596350 - DNA, 13 bp, Homo sapiens
aattattgcttaa

SEQ ID NO: 6596351 - DNA, 20 bp, Homo sapiens
aattattgggcttaatataa

SEQ ID NO: 6596352 - DNA, 16 bp, Homo sapiens
aattattgtaaacttt

SEQ ID NO: 6596353 - DNA, 19 bp, Homo sapiens
aattattgtaaactttttc

SEQ ID NO: 6596354 - DNA, 21 bp, Homo sapiens
aattattgtaaactttttcaa

SEQ ID NO: 6596355 - DNA, 12 bp, Homo sapiens
aattattgtaca

SEQ ID NO: 6596356 - DNA, 18 bp, Homo sapiens
aattattgtacactaaca

SEQ ID NO: 6596357 - DNA, 14 bp, Homo sapiens
aattattgtagaca

SEQ ID NO: 6596358 - DNA, 15 bp, Homo sapiens
aattattgtagacat

SEQ ID NO: 6596359 - DNA, 19 bp, Homo sapiens
aattattgtttatattttc

SEQ ID NO: 6596360 - DNA, 16 bp, Homo sapiens
aattattgtttttctt

SEQ ID NO: 6596361 - DNA, 15 bp, Homo sapiens
aattatttaaatgta

SEQ ID NO: 6596362 - DNA, 17 bp, Homo sapiens
aattatttaactaatta

SEQ ID NO: 6596363 - DNA, 13 bp, Homo sapiens
aattatttaagat

SEQ ID NO: 6596364 - DNA, 15 bp, Homo sapiens
aattatttaagattt

SEQ ID NO: 6596365 - DNA, 19 bp, Homo sapiens
aattatttaagatttcttt

SEQ ID NO: 6596366 - DNA, 17 bp, Homo sapiens
aattatttaatatgcat

SEQ ID NO: 6596367 - DNA, 21 bp, Homo sapiens
aattatttatattactgaatt

SEQ ID NO: 6596368 - DNA, 19 bp, Homo sapiens
aattatttatttaataaca

SEQ ID NO: 6596369 - DNA, 12 bp, Homo sapiens
aattatttcaga

SEQ ID NO: 6596370 - DNA, 11 bp, Homo sapiens
aattatttctg

SEQ ID NO: 6596371 - DNA, 12 bp, Homo sapiens
aattatttgaat

SEQ ID NO: 6596372 - DNA, 21 bp, Homo sapiens
aattatttgactttaatttat

SEQ ID NO: 6596373 - DNA, 18 bp, Homo sapiens
aattatttgccttttaaa

SEQ ID NO: 6596374 - DNA, 14 bp, Homo sapiens
aattatttgctaag

SEQ ID NO: 6596375 - DNA, 18 bp, Homo sapiens
aattatttgtgtaataga

SEQ ID NO: 6596376 - DNA, 21 bp, Homo sapiens
aattatttgtgtaatagaaaa

SEQ ID NO: 6596377 - DNA, 21 bp, Homo sapiens
aattatttgtgttgggggaaa

SEQ ID NO: 6596378 - DNA, 11 bp, Homo sapiens
aattattttaa

SEQ ID NO: 6596379 - DNA, 15 bp, Homo sapiens
aattattttaaaaga

SEQ ID NO: 6596380 - DNA, 18 bp, Homo sapiens
aattattttaaaatattt

SEQ ID NO: 6596381 - DNA, 15 bp, Homo sapiens
aattattttaaatta

SEQ ID NO: 6596382 - DNA, 20 bp, Homo sapiens
aattattttaaattataagg

SEQ ID NO: 6596383 - DNA, 21 bp, Homo sapiens
aattattttaaattataagga

SEQ ID NO: 6596384 - DNA, 22 bp, Homo sapiens
aattattttaaattataaggac

SEQ ID NO: 6596385 - DNA, 22 bp, Homo sapiens
aattattttatatcatacagtt

SEQ ID NO: 6596386 - DNA, 23 bp, Homo sapiens
aattattttatatcatacagttt

SEQ ID NO: 6596387 - DNA, 14 bp, Homo sapiens
aattattttattgt

SEQ ID NO: 6596388 - DNA, 22 bp, Homo sapiens
aattattttctgagacttggat

SEQ ID NO: 6596389 - DNA, 22 bp, Homo sapiens
aattattttgaatgtcacaaat

SEQ ID NO: 6596390 - DNA, 23 bp, Homo sapiens
aattattttgagtggcaaaataa

SEQ ID NO: 6596391 - DNA, 16 bp, Homo sapiens
aattattttgataaat

SEQ ID NO: 6596392 - DNA, 22 bp, Homo sapiens
tttggagagaaatattttaatt

SEQ ID NO: 6596393 - DNA, 19 bp, Homo sapiens
tttggagagggaaaatctt

SEQ ID NO: 6596394 - DNA, 18 bp, Homo sapiens
tttggagagtttcctgaa

SEQ ID NO: 6596395 - DNA, 20 bp, Homo sapiens
tttggagatgtctctgtgtg

SEQ ID NO: 6596396 - DNA, 20 bp, Homo sapiens
tttggagccgggaaagctgt

SEQ ID NO: 6596397 - DNA, 22 bp, Homo sapiens
tttggagctatcagtgctttgt

SEQ ID NO: 6596398 - DNA, 21 bp, Homo sapiens
tttggaggctgagttctggtt

SEQ ID NO: 6596399 - DNA, 18 bp, Homo sapiens
tttggagggaagctcttg

SEQ ID NO: 6596400 - DNA, 18 bp, Homo sapiens
tttggaggtgcttgatct

SEQ ID NO: 6596401 - DNA, 19 bp, Homo sapiens
tttggagtgttatgtattt

SEQ ID NO: 6596402 - DNA, 15 bp, Homo sapiens
tttggataatatcca

SEQ ID NO: 6596403 - DNA, 16 bp, Homo sapiens
tttggataatcttaaa

SEQ ID NO: 6596404 - DNA, 15 bp, Homo sapiens
tttggatacagctgc

SEQ ID NO: 6596405 - DNA, 22 bp, Homo sapiens
tttggatacagctgctttgagc

SEQ ID NO: 6596406 - DNA, 20 bp, Homo sapiens
tttggatataggtcagtgag

SEQ ID NO: 6596407 - DNA, 13 bp, Homo sapiens
tttggatatatta

SEQ ID NO: 6596408 - DNA, 14 bp, Homo sapiens
tttggatatattat

SEQ ID NO: 6596409 - DNA, 21 bp, Homo sapiens
tttggatcatttttaactgat

SEQ ID NO: 6596410 - DNA, 22 bp, Homo sapiens
tttggatgaatgcagtataaaa

SEQ ID NO: 6596411 - DNA, 21 bp, Homo sapiens
tttggatgggccttttagaaa

SEQ ID NO: 6596412 - DNA, 15 bp, Homo sapiens
tttggatgtaattta

SEQ ID NO: 6596413 - DNA, 12 bp, Homo sapiens
tttggatgtggg

SEQ ID NO: 6596414 - DNA, 12 bp, Homo sapiens
tttggatgttgc

SEQ ID NO: 6596415 - DNA, 14 bp, Homo sapiens
tttggatgttgcta

SEQ ID NO: 6596416 - DNA, 14 bp, Homo sapiens
tttggattaaatta

SEQ ID NO: 6596417 - DNA, 15 bp, Homo sapiens
tttggattagaaatt

SEQ ID NO: 6596418 - DNA, 15 bp, Homo sapiens
tttggattctaaata

SEQ ID NO: 6596419 - DNA, 18 bp, Homo sapiens
tttggattctaaatacat

SEQ ID NO: 6596420 - DNA, 19 bp, Homo sapiens
tttggattctctaagatga

SEQ ID NO: 6596421 - DNA, 11 bp, Homo sapiens
tttggattctt

SEQ ID NO: 6596422 - DNA, 23 bp, Homo sapiens
tttggattgacagtaacttggtt

SEQ ID NO: 6596423 - DNA, 18 bp, Homo sapiens
tttggattgactctgcat

SEQ ID NO: 6596424 - DNA, 22 bp, Homo sapiens
tttggattggacaaaatgactt

SEQ ID NO: 6596425 - DNA, 22 bp, Homo sapiens
tttggattggatgaattccaaa

SEQ ID NO: 6596426 - DNA, 16 bp, Homo sapiens
tttggattttaaacaa

SEQ ID NO: 6596427 - DNA, 18 bp, Homo sapiens
tttggatttttaattaaa

SEQ ID NO: 6596428 - DNA, 18 bp, Homo sapiens
tttggcaaactctccacc

SEQ ID NO: 6596429 - DNA, 16 bp, Homo sapiens
tttggcaacagaaaac

SEQ ID NO: 6596430 - DNA, 13 bp, Homo sapiens
tttggcaataaat

SEQ ID NO: 6596431 - DNA, 18 bp, Homo sapiens
tttggcaataaataaagc

SEQ ID NO: 6596432 - DNA, 20 bp, Homo sapiens
tttggcaatttcctggccct

SEQ ID NO: 6596433 - DNA, 14 bp, Homo sapiens
tttggcactctgac

SEQ ID NO: 6596434 - DNA, 16 bp, Homo sapiens
tttggcactgatgcaa

SEQ ID NO: 6596435 - DNA, 17 bp, Homo sapiens
tttggcactggggcact

SEQ ID NO: 6596436 - DNA, 17 bp, Homo sapiens
tttggcagaactgctgg

SEQ ID NO: 6596437 - DNA, 20 bp, Homo sapiens
tttggcagaactgctggggc

SEQ ID NO: 6596438 - DNA, 21 bp, Homo sapiens
tttggcagaactgctggggct

SEQ ID NO: 6596439 - DNA, 13 bp, Homo sapiens
tttggcagagttc

SEQ ID NO: 6596440 - DNA, 21 bp, Homo sapiens
tttggcaggaagatgtatgct

SEQ ID NO: 6596441 - DNA, 23 bp, Homo sapiens
tttggcaggagaatcaataaaaa

SEQ ID NO: 6596442 - DNA, 11 bp, Homo sapiens
tttggcaggca

SEQ ID NO: 6596443 - DNA, 14 bp, Homo sapiens
tttggcatctcctg

SEQ ID NO: 6596444 - DNA, 16 bp, Homo sapiens
tttggcatctgcaaag

SEQ ID NO: 6596445 - DNA, 23 bp, Homo sapiens
tttggcatctgcaaaggaatcac

SEQ ID NO: 6596446 - DNA, 19 bp, Homo sapiens
tttggcatgcttaaatatt

SEQ ID NO: 6596447 - DNA, 23 bp, Homo sapiens
tttggcatgtaaatgtaaactca

SEQ ID NO: 6596448 - DNA, 14 bp, Homo sapiens
tttggcatgtttaa

SEQ ID NO: 6596449 - DNA, 15 bp, Homo sapiens
tttggcattcctcta

SEQ ID NO: 6596450 - DNA, 21 bp, Homo sapiens
tttggccactgtatttgttaa

SEQ ID NO: 6596451 - DNA, 12 bp, Homo sapiens
tttggccagaag

SEQ ID NO: 6596452 - DNA, 14 bp, Homo sapiens
tttggccagaagtc

SEQ ID NO: 6596453 - DNA, 23 bp, Homo sapiens
tttggccatctctggatgcctga

SEQ ID NO: 6596454 - DNA, 17 bp, Homo sapiens
tttggccatctgctcct

SEQ ID NO: 6596455 - DNA, 13 bp, Homo sapiens
tttggcccaagac

SEQ ID NO: 6596456 - DNA, 16 bp, Homo sapiens
tttggccccactttga

SEQ ID NO: 6596457 - DNA, 20 bp, Homo sapiens
tttggcccccgagctggggg

SEQ ID NO: 6596458 - DNA, 14 bp, Homo sapiens
tttggccctggagc

SEQ ID NO: 6596459 - DNA, 19 bp, Homo sapiens
tttggccctggagccaggg

SEQ ID NO: 6596460 - DNA, 19 bp, Homo sapiens
tttggcctacattctttat

SEQ ID NO: 6596461 - DNA, 18 bp, Homo sapiens
tttggcctcattacttta

SEQ ID NO: 6596462 - DNA, 22 bp, Homo sapiens
tttggcctccatcctcatctct

SEQ ID NO: 6596463 - DNA, 14 bp, Homo sapiens
tttggcctcttgta

SEQ ID NO: 6596464 - DNA, 22 bp, Homo sapiens
tttggcctggggtgcatctcct

SEQ ID NO: 6596465 - DNA, 15 bp, Homo sapiens
tttggcctttccttg

SEQ ID NO: 6596466 - DNA, 14 bp, Homo sapiens
tttggcgggccaag

SEQ ID NO: 6596467 - DNA, 24 bp, Homo sapiens
tttggctatgccttcactacaaca

SEQ ID NO: 6596468 - DNA, 15 bp, Homo sapiens
tttggctcctgccca

SEQ ID NO: 6596469 - DNA, 16 bp, Homo sapiens
tttggctctattggat

SEQ ID NO: 6596470 - DNA, 13 bp, Homo sapiens
tttggctctccca

SEQ ID NO: 6596471 - DNA, 23 bp, Homo sapiens
tttggctctcctcagaagaaaga

SEQ ID NO: 6596472 - DNA, 15 bp, Homo sapiens
tttggctgaaattat

SEQ ID NO: 6596473 - DNA, 21 bp, Homo sapiens
tttggctgaaattctcctgga

SEQ ID NO: 6596474 - DNA, 22 bp, Homo sapiens
tttggctgaaattctcctggag

SEQ ID NO: 6596475 - DNA, 20 bp, Homo sapiens
tttggctgaggggcttggga

SEQ ID NO: 6596476 - DNA, 17 bp, Homo sapiens
tttggctgagtactgga

SEQ ID NO: 6596477 - DNA, 12 bp, Homo sapiens
tttggctgctct

SEQ ID NO: 6596478 - DNA, 18 bp, Homo sapiens
tttggctgctctccatct

SEQ ID NO: 6596479 - DNA, 13 bp, Homo sapiens
tttggctgctgaa

SEQ ID NO: 6596480 - DNA, 15 bp, Homo sapiens
tttggctgtaattta

SEQ ID NO: 6596481 - DNA, 18 bp, Homo sapiens
tttggctgtaatttaatt

SEQ ID NO: 6596482 - DNA, 13 bp, Homo sapiens
tttggctgtgtct

SEQ ID NO: 6596483 - DNA, 15 bp, Homo sapiens
tttggcttataaaca

SEQ ID NO: 6596484 - DNA, 18 bp, Homo sapiens
tttggcttataaacacat

SEQ ID NO: 6596485 - DNA, 16 bp, Homo sapiens
tttggcttcatttcaa

SEQ ID NO: 6596486 - DNA, 13 bp, Homo sapiens
tttggcttcctct

SEQ ID NO: 6596487 - DNA, 15 bp, Homo sapiens
tttggcttcctctgc

SEQ ID NO: 6596488 - DNA, 18 bp, Homo sapiens
tttggcttctcctgtgac

SEQ ID NO: 6596489 - DNA, 14 bp, Homo sapiens
tttggcttgctgtt

SEQ ID NO: 6596490 - DNA, 23 bp, Homo sapiens
tttggcttttcttatttaaaatt

SEQ ID NO: 6596491 - DNA, 19 bp, Homo sapiens
tttgggaaaagaagctgtc

SEQ ID NO: 6596492 - DNA, 24 bp, Homo sapiens
tttgggaaagatggataaactgag

SEQ ID NO: 6596493 - DNA, 15 bp, Homo sapiens
tttgggaaagcccag

SEQ ID NO: 6596494 - DNA, 14 bp, Homo sapiens
tttgggaaagctgc

SEQ ID NO: 6596495 - DNA, 21 bp, Homo sapiens
tttgggaagaaaacctgtatt

SEQ ID NO: 6596496 - DNA, 12 bp, Homo sapiens
tttgggaagaat

SEQ ID NO: 6596497 - DNA, 23 bp, Homo sapiens
tttgggaaggtgtttaaagagtt

SEQ ID NO: 6596498 - DNA, 21 bp, Homo sapiens
tttgggaagttaaagggaaga

SEQ ID NO: 6596499 - DNA, 23 bp, Homo sapiens
tttgggaccctgctttagagcta

SEQ ID NO: 6596500 - DNA, 16 bp, Homo sapiens
tttgggacttgggagc

SEQ ID NO: 6596501 - DNA, 18 bp, Homo sapiens
tttgggagacatgtgaca

SEQ ID NO: 6596502 - DNA, 14 bp, Homo sapiens
tttgggagagactt

SEQ ID NO: 6596503 - DNA, 20 bp, Homo sapiens
tttgggaggaggaaaagaaa

SEQ ID NO: 6596504 - DNA, 14 bp, Homo sapiens
tttgggaggccaag

SEQ ID NO: 6596505 - DNA, 22 bp, Homo sapiens
tttgggaggccaaggtgggagg

SEQ ID NO: 6596506 - DNA, 23 bp, Homo sapiens
tttgggagtttttatgagaaact

SEQ ID NO: 6596507 - DNA, 23 bp, Homo sapiens
tttgggatattaaaacacaaagt

SEQ ID NO: 6596508 - DNA, 23 bp, Homo sapiens
tttgggcacatgtatgtccattc

SEQ ID NO: 6596509 - DNA, 11 bp, Homo sapiens
tttgggcagag

SEQ ID NO: 6596510 - DNA, 17 bp, Homo sapiens
tttgggcagagaggctg

SEQ ID NO: 6596511 - DNA, 23 bp, Homo sapiens
tttgggcagatttgcaacagcaa

SEQ ID NO: 6596512 - DNA, 23 bp, Homo sapiens
tttgggcaggagtcaccatgcaa

SEQ ID NO: 6596513 - DNA, 13 bp, Homo sapiens
tttgggccattac

SEQ ID NO: 6596514 - DNA, 14 bp, Homo sapiens
tttgggccattacc

SEQ ID NO: 6596515 - DNA, 22 bp, Homo sapiens
tttgggccgaatcccccaggga

SEQ ID NO: 6596516 - DNA, 16 bp, Homo sapiens
tttgggcctgttcctt

SEQ ID NO: 6596517 - DNA, 22 bp, Homo sapiens
tttgggctctgaaataaaaatt

SEQ ID NO: 6596518 - DNA, 14 bp, Homo sapiens
tttgggctgaatgt

SEQ ID NO: 6596519 - DNA, 14 bp, Homo sapiens
tttgggctgccctg

SEQ ID NO: 6596520 - DNA, 14 bp, Homo sapiens
tttgggctggagct

SEQ ID NO: 6596521 - DNA, 21 bp, Homo sapiens
tttgggcttagtatttctcag

SEQ ID NO: 6596522 - DNA, 14 bp, Homo sapiens
tttggggaaaaaag

SEQ ID NO: 6596523 - DNA, 22 bp, Homo sapiens
tttggggaaaaaagcacataca

SEQ ID NO: 6596524 - DNA, 17 bp, Homo sapiens
tttggggaaaaattctt

SEQ ID NO: 6596525 - DNA, 18 bp, Homo sapiens
tttggggaaacctagaga

SEQ ID NO: 6596526 - DNA, 23 bp, Homo sapiens
tttggggaagggtttgaattgtt

SEQ ID NO: 6596527 - DNA, 18 bp, Homo sapiens
tttggggaagtttatttg

SEQ ID NO: 6596528 - DNA, 22 bp, Homo sapiens
tttggggacagattcagtcttg

SEQ ID NO: 6596529 - DNA, 15 bp, Homo sapiens
tttggggagggaggg

SEQ ID NO: 6596530 - DNA, 23 bp, Homo sapiens
tttggggagggaggggaaatgta

SEQ ID NO: 6596531 - DNA, 19 bp, Homo sapiens
tttggggaggtgttcactg

SEQ ID NO: 6596532 - DNA, 18 bp, Homo sapiens
tttggggatagtctggaa

SEQ ID NO: 6596533 - DNA, 19 bp, Homo sapiens
tttggggattcagatttct

SEQ ID NO: 6596534 - DNA, 21 bp, Homo sapiens
tttggggcatttgtaaaaagt

SEQ ID NO: 6596535 - DNA, 13 bp, Homo sapiens
tttggggccctct

SEQ ID NO: 6596536 - DNA, 18 bp, Homo sapiens
tttggggcgaggcagagg

SEQ ID NO: 6596537 - DNA, 16 bp, Homo sapiens
tttggggcttctgtga

SEQ ID NO: 6596538 - DNA, 18 bp, Homo sapiens
tttggggcttctgtgaaa

SEQ ID NO: 6596539 - DNA, 18 bp, Homo sapiens
tttgggggacgcccagcc

SEQ ID NO: 6596540 - DNA, 18 bp, Homo sapiens
tttgggggacgtttctca

SEQ ID NO: 6596541 - DNA, 15 bp, Homo sapiens
tttgggggcttccct

SEQ ID NO: 6596542 - DNA, 22 bp, Homo sapiens
tttgggggtaaagtttgctcta

SEQ ID NO: 6596543 - DNA, 19 bp, Homo sapiens
tttgggggtcagcatccag

SEQ ID NO: 6596544 - DNA, 17 bp, Homo sapiens
tttgggggttggatggg

SEQ ID NO: 6596545 - DNA, 20 bp, Homo sapiens
tttggggtagctagaggaac

SEQ ID NO: 6596546 - DNA, 21 bp, Homo sapiens
tttggggtataggtctcatct

SEQ ID NO: 6596547 - DNA, 11 bp, Homo sapiens
tttggggtgcc

SEQ ID NO: 6596548 - DNA, 18 bp, Homo sapiens
tttggggtgcccctctcc

SEQ ID NO: 6596549 - DNA, 21 bp, Homo sapiens
tttggggttcggcctgtgtcc

SEQ ID NO: 6596550 - DNA, 21 bp, Homo sapiens
tttggggttgcatcagaaatg

SEQ ID NO: 6596551 - DNA, 23 bp, Homo sapiens
tttggggttgcccagcctggagc

SEQ ID NO: 6596552 - DNA, 13 bp, Homo sapiens
tttgggtaaatca

SEQ ID NO: 6596553 - DNA, 22 bp, Homo sapiens
tttgggtatgttaacctaggca

SEQ ID NO: 6596554 - DNA, 17 bp, Homo sapiens
tttgggtcataaatcag

SEQ ID NO: 6596555 - DNA, 13 bp, Homo sapiens
tttgggtccagga

SEQ ID NO: 6596556 - DNA, 15 bp, Homo sapiens
tttgggtccaggagg

SEQ ID NO: 6596557 - DNA, 13 bp, Homo sapiens
tttgggtgggggc

SEQ ID NO: 6596558 - DNA, 20 bp, Homo sapiens
tttgggtgtttttcatgttt

SEQ ID NO: 6596559 - DNA, 15 bp, Homo sapiens
tttgggttaaaaaaa

SEQ ID NO: 6596560 - DNA, 15 bp, Homo sapiens
tttgggttacagtat

SEQ ID NO: 6596561 - DNA, 14 bp, Homo sapiens
tttgggttctgcct

SEQ ID NO: 6596562 - DNA, 16 bp, Homo sapiens
tttgggttctttctgg

SEQ ID NO: 6596563 - DNA, 17 bp, Homo sapiens
tttgggttgtgacccag

SEQ ID NO: 6596564 - DNA, 16 bp, Homo sapiens
tttgggtttggccagg

SEQ ID NO: 6596565 - DNA, 19 bp, Homo sapiens
tttgggtttttttttttga

SEQ ID NO: 6596566 - DNA, 16 bp, Homo sapiens
tttggtaaaaatgctg

SEQ ID NO: 6596567 - DNA, 21 bp, Homo sapiens
tttggtaaatttttgaaaaat

SEQ ID NO: 6596568 - DNA, 16 bp, Homo sapiens
tttggtaatatatata

SEQ ID NO: 6596569 - DNA, 15 bp, Homo sapiens
tttggtacacatgtg

SEQ ID NO: 6596570 - DNA, 11 bp, Homo sapiens
aattattttgg

SEQ ID NO: 6596571 - DNA, 19 bp, Homo sapiens
aattattttgttactgtct

SEQ ID NO: 6596572 - DNA, 20 bp, Homo sapiens
aattattttgttcatacata

SEQ ID NO: 6596573 - DNA, 15 bp, Homo sapiens
aattatttttaagtg

SEQ ID NO: 6596574 - DNA, 17 bp, Homo sapiens
aattatttttaatttaa

SEQ ID NO: 6596575 - DNA, 20 bp, Homo sapiens
aattatttttaatttaaaaa

SEQ ID NO: 6596576 - DNA, 12 bp, Homo sapiens
aattatttttgt

SEQ ID NO: 6596577 - DNA, 19 bp, Homo sapiens
aattatttttgtgtttcta

SEQ ID NO: 6596578 - DNA, 19 bp, Homo sapiens
aattatttttttaaacttc

SEQ ID NO: 6596579 - DNA, 22 bp, Homo sapiens
aattatttttttttttgttctt

SEQ ID NO: 6596580 - DNA, 24 bp, Homo sapiens
aattatttttttttttgttcttga

SEQ ID NO: 6596581 - DNA, 15 bp, Homo sapiens
aattcaaaaagtgtt

SEQ ID NO: 6596582 - DNA, 14 bp, Homo sapiens
aattcaaaaataaa

SEQ ID NO: 6596583 - DNA, 23 bp, Homo sapiens
aattcaaaagagagagagagatc

SEQ ID NO: 6596584 - DNA, 19 bp, Homo sapiens
aattcaaaagtgattatct

SEQ ID NO: 6596585 - DNA, 16 bp, Homo sapiens
aattcaaaagttccaa

SEQ ID NO: 6596586 - DNA, 21 bp, Homo sapiens
aattcaaacaattcaatcaaa

SEQ ID NO: 6596587 - DNA, 17 bp, Homo sapiens
aattcaaaccatttaat

SEQ ID NO: 6596588 - DNA, 21 bp, Homo sapiens
aattcaaaccatttaattcat

SEQ ID NO: 6596589 - DNA, 20 bp, Homo sapiens
aattcaaactggggcctcca

SEQ ID NO: 6596590 - DNA, 14 bp, Homo sapiens
aattcaaagaatca

SEQ ID NO: 6596591 - DNA, 13 bp, Homo sapiens
aattcaaagcatg

SEQ ID NO: 6596592 - DNA, 18 bp, Homo sapiens
aattcaaagctctattaa

SEQ ID NO: 6596593 - DNA, 14 bp, Homo sapiens
aattcaaagcttgt

SEQ ID NO: 6596594 - DNA, 18 bp, Homo sapiens
aattcaaagcttgtgaaa

SEQ ID NO: 6596595 - DNA, 22 bp, Homo sapiens
aattcaaatttgtaataaaact

SEQ ID NO: 6596596 - DNA, 23 bp, Homo sapiens
aattcaaatttgtaataaaacta

SEQ ID NO: 6596597 - DNA, 22 bp, Homo sapiens
aattcaaattttatctgcctct

SEQ ID NO: 6596598 - DNA, 16 bp, Homo sapiens
aattcaacaaatgatg

SEQ ID NO: 6596599 - DNA, 13 bp, Homo sapiens
aattcaacaagat

SEQ ID NO: 6596600 - DNA, 13 bp, Homo sapiens
aattcaacacatt

SEQ ID NO: 6596601 - DNA, 19 bp, Homo sapiens
aattcaacacattacttgc

SEQ ID NO: 6596602 - DNA, 17 bp, Homo sapiens
aattcaacacttatttt

SEQ ID NO: 6596603 - DNA, 13 bp, Homo sapiens
aattcaacatcaa

SEQ ID NO: 6596604 - DNA, 22 bp, Homo sapiens
aattcaacatcaaaacttaaga

SEQ ID NO: 6596605 - DNA, 14 bp, Homo sapiens
aattcaaccctttg

SEQ ID NO: 6596606 - DNA, 18 bp, Homo sapiens
aattcaaccctttgcccc

SEQ ID NO: 6596607 - DNA, 18 bp, Homo sapiens
aattcaacctgtgtctta

SEQ ID NO: 6596608 - DNA, 21 bp, Homo sapiens
aattcaacgttaataattctg

SEQ ID NO: 6596609 - DNA, 22 bp, Homo sapiens
aattcaactctgtgtcccagca

SEQ ID NO: 6596610 - DNA, 13 bp, Homo sapiens
aattcaactggaa

SEQ ID NO: 6596611 - DNA, 14 bp, Homo sapiens
aattcaactttgta

SEQ ID NO: 6596612 - DNA, 16 bp, Homo sapiens
aattcaactttgtaaa

SEQ ID NO: 6596613 - DNA, 20 bp, Homo sapiens
aattcaagaaaacaacttca

SEQ ID NO: 6596614 - DNA, 20 bp, Homo sapiens
aattcaagcctctaaacaga

SEQ ID NO: 6596615 - DNA, 16 bp, Homo sapiens
aattcaaggaatttct

SEQ ID NO: 6596616 - DNA, 15 bp, Homo sapiens
aattcaatagtaata

SEQ ID NO: 6596617 - DNA, 16 bp, Homo sapiens
aattcaatagtaatat

SEQ ID NO: 6596618 - DNA, 17 bp, Homo sapiens
aattcaatcaaagctac

SEQ ID NO: 6596619 - DNA, 21 bp, Homo sapiens
aattcaatgaatccccgaccc

SEQ ID NO: 6596620 - DNA, 21 bp, Homo sapiens
aattcaatgcaatgaaaacaa

SEQ ID NO: 6596621 - DNA, 21 bp, Homo sapiens
aattcaatgccgcaacatata

SEQ ID NO: 6596622 - DNA, 14 bp, Homo sapiens
aattcaattaaaac

SEQ ID NO: 6596623 - DNA, 14 bp, Homo sapiens
aattcaattgtaaa

SEQ ID NO: 6596624 - DNA, 23 bp, Homo sapiens
aattcaattgtaaattgaatcag

SEQ ID NO: 6596625 - DNA, 12 bp, Homo sapiens
aattcaatttct

SEQ ID NO: 6596626 - DNA, 14 bp, Homo sapiens
aattcacaaacaaa

SEQ ID NO: 6596627 - DNA, 17 bp, Homo sapiens
aattcacaaagtaattt

SEQ ID NO: 6596628 - DNA, 15 bp, Homo sapiens
aattcacaaagttaa

SEQ ID NO: 6596629 - DNA, 16 bp, Homo sapiens
aattcacaagctgcct

SEQ ID NO: 6596630 - DNA, 23 bp, Homo sapiens
aattcacagatatttaaagaatg

SEQ ID NO: 6596631 - DNA, 16 bp, Homo sapiens
aattcacagcacagta

SEQ ID NO: 6596632 - DNA, 20 bp, Homo sapiens
aattcacagcacagtacaca

SEQ ID NO: 6596633 - DNA, 14 bp, Homo sapiens
aattcacataataa

SEQ ID NO: 6596634 - DNA, 18 bp, Homo sapiens
aattcacatccccaaagg

SEQ ID NO: 6596635 - DNA, 21 bp, Homo sapiens
aattcacatctaacctcatct

SEQ ID NO: 6596636 - DNA, 22 bp, Homo sapiens
aattcacatctaacctcatctt

SEQ ID NO: 6596637 - DNA, 14 bp, Homo sapiens
aattcaccaaagta

SEQ ID NO: 6596638 - DNA, 18 bp, Homo sapiens
aattcaccacagacttta

SEQ ID NO: 6596639 - DNA, 15 bp, Homo sapiens
aattcaccagtgttc

SEQ ID NO: 6596640 - DNA, 21 bp, Homo sapiens
aattcaccccctttcctggac

SEQ ID NO: 6596641 - DNA, 12 bp, Homo sapiens
aattcacccctc

SEQ ID NO: 6596642 - DNA, 14 bp, Homo sapiens
aattcacctatgtt

SEQ ID NO: 6596643 - DNA, 19 bp, Homo sapiens
aattcacctcagcctggag

SEQ ID NO: 6596644 - DNA, 15 bp, Homo sapiens
aattcaccttcccct

SEQ ID NO: 6596645 - DNA, 10 bp, Homo sapiens
aattcactcc

SEQ ID NO: 6596646 - DNA, 19 bp, Homo sapiens
aattcactccagtcaacag

SEQ ID NO: 6596647 - DNA, 20 bp, Homo sapiens
aattcactccagtcaacaga

SEQ ID NO: 6596648 - DNA, 13 bp, Homo sapiens
aattcactcccac

SEQ ID NO: 6596649 - DNA, 19 bp, Homo sapiens
aattcacttcattgaccaa

SEQ ID NO: 6596650 - DNA, 20 bp, Homo sapiens
aattcagaaaacataatata

SEQ ID NO: 6596651 - DNA, 15 bp, Homo sapiens
aattcagaaactaca

SEQ ID NO: 6596652 - DNA, 18 bp, Homo sapiens
aattcagaaatccttgta

SEQ ID NO: 6596653 - DNA, 21 bp, Homo sapiens
aattcagaactaaatttttca

SEQ ID NO: 6596654 - DNA, 23 bp, Homo sapiens
aattcagaactaaatttttcata

SEQ ID NO: 6596655 - DNA, 21 bp, Homo sapiens
aattcagaaggatcttcatct

SEQ ID NO: 6596656 - DNA, 11 bp, Homo sapiens
aattcagacaa

SEQ ID NO: 6596657 - DNA, 18 bp, Homo sapiens
aattcagataatggtaat

SEQ ID NO: 6596658 - DNA, 23 bp, Homo sapiens
aattcagataatggtaatttagt

SEQ ID NO: 6596659 - DNA, 20 bp, Homo sapiens
aattcagatatatttttcac

SEQ ID NO: 6596660 - DNA, 18 bp, Homo sapiens
aattcagattgtcttgca

SEQ ID NO: 6596661 - DNA, 16 bp, Homo sapiens
aattcagcaaaccatt

SEQ ID NO: 6596662 - DNA, 14 bp, Homo sapiens
aattcagcaccctg

SEQ ID NO: 6596663 - DNA, 16 bp, Homo sapiens
aattcagcagttttat

SEQ ID NO: 6596664 - DNA, 18 bp, Homo sapiens
aattcagccatgtacaga

SEQ ID NO: 6596665 - DNA, 13 bp, Homo sapiens
aattcagctcagc

SEQ ID NO: 6596666 - DNA, 12 bp, Homo sapiens
aattcagctctg

SEQ ID NO: 6596667 - DNA, 13 bp, Homo sapiens
aattcagctctga

SEQ ID NO: 6596668 - DNA, 17 bp, Homo sapiens
aattcagctttagaaat

SEQ ID NO: 6596669 - DNA, 15 bp, Homo sapiens
aattcaggcaaacgt

SEQ ID NO: 6596670 - DNA, 14 bp, Homo sapiens
aattcagggcttta

SEQ ID NO: 6596671 - DNA, 15 bp, Homo sapiens
aattcaggtttttcc

SEQ ID NO: 6596672 - DNA, 13 bp, Homo sapiens
aattcagtacaac

SEQ ID NO: 6596673 - DNA, 18 bp, Homo sapiens
aattcagtacaacccata

SEQ ID NO: 6596674 - DNA, 17 bp, Homo sapiens
aattcagtactgattat

SEQ ID NO: 6596675 - DNA, 13 bp, Homo sapiens
aattcagtatttt

SEQ ID NO: 6596676 - DNA, 18 bp, Homo sapiens
aattcagtgtatttcagt

SEQ ID NO: 6596677 - DNA, 17 bp, Homo sapiens
aattcagttataaagtc

SEQ ID NO: 6596678 - DNA, 15 bp, Homo sapiens
aattcagtttcataa

SEQ ID NO: 6596679 - DNA, 19 bp, Homo sapiens
aattcagttttagtttcaa

SEQ ID NO: 6596680 - DNA, 22 bp, Homo sapiens
aattcagttttagtttcaaaat

SEQ ID NO: 6596681 - DNA, 20 bp, Homo sapiens
aattcagtttttgtatcttg

SEQ ID NO: 6596682 - DNA, 16 bp, Homo sapiens
aattcataaccaaaga

SEQ ID NO: 6596683 - DNA, 15 bp, Homo sapiens
aattcataataaatt

SEQ ID NO: 6596684 - DNA, 16 bp, Homo sapiens
aattcataattagaac

SEQ ID NO: 6596685 - DNA, 17 bp, Homo sapiens
aattcataattagaaca

SEQ ID NO: 6596686 - DNA, 18 bp, Homo sapiens
aattcataattagaacaa

SEQ ID NO: 6596687 - DNA, 19 bp, Homo sapiens
aattcataattagaacaat

SEQ ID NO: 6596688 - DNA, 24 bp, Homo sapiens
aattcatacaaagtactgtcctca

SEQ ID NO: 6596689 - DNA, 16 bp, Homo sapiens
aattcatacctccctc

SEQ ID NO: 6596690 - DNA, 15 bp, Homo sapiens
aattcatactctgtt

SEQ ID NO: 6596691 - DNA, 22 bp, Homo sapiens
aattcatactctgttgcctcct

SEQ ID NO: 6596692 - DNA, 19 bp, Homo sapiens
aattcatagcatcctgatt

SEQ ID NO: 6596693 - DNA, 19 bp, Homo sapiens
aattcatatcatttggccg

SEQ ID NO: 6596694 - DNA, 16 bp, Homo sapiens
aattcatatctaaata

SEQ ID NO: 6596695 - DNA, 13 bp, Homo sapiens
aattcatattctt

SEQ ID NO: 6596696 - DNA, 18 bp, Homo sapiens
aattcatatttttcctta

SEQ ID NO: 6596697 - DNA, 20 bp, Homo sapiens
aattcatatttttccttata

SEQ ID NO: 6596698 - DNA, 22 bp, Homo sapiens
aattcatcatatgaatgttctt

SEQ ID NO: 6596699 - DNA, 17 bp, Homo sapiens
aattcatctatttcgag

SEQ ID NO: 6596700 - DNA, 16 bp, Homo sapiens
aattcatctgtgaatc

SEQ ID NO: 6596701 - DNA, 13 bp, Homo sapiens
aattcatctttta

SEQ ID NO: 6596702 - DNA, 23 bp, Homo sapiens
aattcatcttttaatcatgagcc

SEQ ID NO: 6596703 - DNA, 11 bp, Homo sapiens
aattcatgaac

SEQ ID NO: 6596704 - DNA, 23 bp, Homo sapiens
aattcatgaacttcgcatcaaaa

SEQ ID NO: 6596705 - DNA, 22 bp, Homo sapiens
aattcatgacattatgtggaat

SEQ ID NO: 6596706 - DNA, 13 bp, Homo sapiens
aattcatgatgct

SEQ ID NO: 6596707 - DNA, 19 bp, Homo sapiens
aattcatgatgctagttct

SEQ ID NO: 6596708 - DNA, 21 bp, Homo sapiens
aattcatgatgctagttctta

SEQ ID NO: 6596709 - DNA, 19 bp, Homo sapiens
aattcatgcctttcatagt

SEQ ID NO: 6596710 - DNA, 22 bp, Homo sapiens
aattcatggcatgcttaaattt

SEQ ID NO: 6596711 - DNA, 15 bp, Homo sapiens
aattcatggcttttt

SEQ ID NO: 6596712 - DNA, 24 bp, Homo sapiens
aattcatggttcaagtattaagca

SEQ ID NO: 6596713 - DNA, 14 bp, Homo sapiens
aattcatgtaacag

SEQ ID NO: 6596714 - DNA, 18 bp, Homo sapiens
aattcatgtaacagttgt

SEQ ID NO: 6596715 - DNA, 12 bp, Homo sapiens
aattcattaaag

SEQ ID NO: 6596716 - DNA, 14 bp, Homo sapiens
aattcattaaattt

SEQ ID NO: 6596717 - DNA, 15 bp, Homo sapiens
aattcattaataaaa

SEQ ID NO: 6596718 - DNA, 13 bp, Homo sapiens
aattcattccatt

SEQ ID NO: 6596719 - DNA, 22 bp, Homo sapiens
aattcattgagcagttagctca

SEQ ID NO: 6596720 - DNA, 15 bp, Homo sapiens
aattcattggctcct

SEQ ID NO: 6596721 - DNA, 13 bp, Homo sapiens
aattcattgtctc

SEQ ID NO: 6596722 - DNA, 16 bp, Homo sapiens
aattcattgtgtatga

SEQ ID NO: 6596723 - DNA, 13 bp, Homo sapiens
aattcattgttaa

SEQ ID NO: 6596724 - DNA, 19 bp, Homo sapiens
aattcattgttaaaaaaca

SEQ ID NO: 6596725 - DNA, 20 bp, Homo sapiens
aattcattgttaaaaaacaa

SEQ ID NO: 6596726 - DNA, 21 bp, Homo sapiens
aattcattgttaaaaaacaac

SEQ ID NO: 6596727 - DNA, 19 bp, Homo sapiens
aattcattgttttgcaaaa

SEQ ID NO: 6596728 - DNA, 12 bp, Homo sapiens
aattcatttaag

SEQ ID NO: 6596729 - DNA, 16 bp, Homo sapiens
aattcatttattaagt

SEQ ID NO: 6596730 - DNA, 15 bp, Homo sapiens
aattcatttcactgt

SEQ ID NO: 6596731 - DNA, 17 bp, Homo sapiens
aattcatttcactttaa

SEQ ID NO: 6596732 - DNA, 19 bp, Homo sapiens
aattcatttcactttaaag

SEQ ID NO: 6596733 - DNA, 20 bp, Homo sapiens
aattcatttcactttaaagt

SEQ ID NO: 6596734 - DNA, 20 bp, Homo sapiens
aattcatttcatctactaca

SEQ ID NO: 6596735 - DNA, 15 bp, Homo sapiens
aattcatttctagac

SEQ ID NO: 6596736 - DNA, 19 bp, Homo sapiens
aattcatttgtattgctta

SEQ ID NO: 6596737 - DNA, 17 bp, Homo sapiens
aattcattttcatcact

SEQ ID NO: 6596738 - DNA, 15 bp, Homo sapiens
aattcatttttttca

SEQ ID NO: 6596739 - DNA, 12 bp, Homo sapiens
aattccaaagat

SEQ ID NO: 6596740 - DNA, 12 bp, Homo sapiens
aattccaaagtc

SEQ ID NO: 6596741 - DNA, 16 bp, Homo sapiens
aattccaactcctgat

SEQ ID NO: 6596742 - DNA, 15 bp, Homo sapiens
aattccaacttgaag

SEQ ID NO: 6596743 - DNA, 23 bp, Homo sapiens
aattccaagtgtattttaaaata

SEQ ID NO: 6596744 - DNA, 17 bp, Homo sapiens
aattccaagtgtttctg

SEQ ID NO: 6596745 - DNA, 16 bp, Homo sapiens
aattccaatatttata

SEQ ID NO: 6596746 - DNA, 20 bp, Homo sapiens
aattccaatatttataatta

SEQ ID NO: 6596747 - DNA, 20 bp, Homo sapiens
aattccaattaaatttattt

SEQ ID NO: 6596748 - DNA, 15 bp, Homo sapiens
aattccaatttcaaa

SEQ ID NO: 6596749 - DNA, 23 bp, Homo sapiens
tttggtacagttcataattcacc

SEQ ID NO: 6596750 - DNA, 18 bp, Homo sapiens
tttggtacttattactgc

SEQ ID NO: 6596751 - DNA, 15 bp, Homo sapiens
tttggtagatgacaa

SEQ ID NO: 6596752 - DNA, 20 bp, Homo sapiens
tttggtagatgacaaatatt

SEQ ID NO: 6596753 - DNA, 19 bp, Homo sapiens
tttggtaggaagcctgagg

SEQ ID NO: 6596754 - DNA, 14 bp, Homo sapiens
tttggtataatgtt

SEQ ID NO: 6596755 - DNA, 20 bp, Homo sapiens
tttggtatgaaacaaatata

SEQ ID NO: 6596756 - DNA, 22 bp, Homo sapiens
tttggtatgaaacaaatatact

SEQ ID NO: 6596757 - DNA, 21 bp, Homo sapiens
tttggtattctgcttccacat

SEQ ID NO: 6596758 - DNA, 13 bp, Homo sapiens
tttggtattgtat

SEQ ID NO: 6596759 - DNA, 23 bp, Homo sapiens
tttggtatttgtttgtagctttc

SEQ ID NO: 6596760 - DNA, 11 bp, Homo sapiens
tttggtcaaat

SEQ ID NO: 6596761 - DNA, 12 bp, Homo sapiens
tttggtcaaatt

SEQ ID NO: 6596762 - DNA, 15 bp, Homo sapiens
tttggtcaacactaa

SEQ ID NO: 6596763 - DNA, 14 bp, Homo sapiens
tttggtcatttggc

SEQ ID NO: 6596764 - DNA, 18 bp, Homo sapiens
tttggtccacttttccag

SEQ ID NO: 6596765 - DNA, 16 bp, Homo sapiens
tttggtcccctccctc

SEQ ID NO: 6596766 - DNA, 23 bp, Homo sapiens
tttggtcccgtgcagcttctgtc

SEQ ID NO: 6596767 - DNA, 17 bp, Homo sapiens
tttggtccgtcataacc

SEQ ID NO: 6596768 - DNA, 16 bp, Homo sapiens
tttggtcgaggagtaa

SEQ ID NO: 6596769 - DNA, 19 bp, Homo sapiens
tttggtcgaggagtaacaa

SEQ ID NO: 6596770 - DNA, 23 bp, Homo sapiens
tttggtctcatccttctctgact

SEQ ID NO: 6596771 - DNA, 22 bp, Homo sapiens
tttggtctccatttttcccagg

SEQ ID NO: 6596772 - DNA, 15 bp, Homo sapiens
tttggtctgccagaa

SEQ ID NO: 6596773 - DNA, 16 bp, Homo sapiens
tttggtcttagcttta

SEQ ID NO: 6596774 - DNA, 18 bp, Homo sapiens
tttggtcttagctttaca

SEQ ID NO: 6596775 - DNA, 20 bp, Homo sapiens
tttggtcttcagcctccctc

SEQ ID NO: 6596776 - DNA, 20 bp, Homo sapiens
tttggtctttaatgaaaagc

SEQ ID NO: 6596777 - DNA, 22 bp, Homo sapiens
tttggtgaacattgcaatagaa

SEQ ID NO: 6596778 - DNA, 14 bp, Homo sapiens
tttggtgaattcct

SEQ ID NO: 6596779 - DNA, 21 bp, Homo sapiens
tttggtgaattccttctaaga

SEQ ID NO: 6596780 - DNA, 23 bp, Homo sapiens
tttggtgaccccatacatttgtg

SEQ ID NO: 6596781 - DNA, 19 bp, Homo sapiens
tttggtgagagtcaaagct

SEQ ID NO: 6596782 - DNA, 16 bp, Homo sapiens
tttggtgagatctcta

SEQ ID NO: 6596783 - DNA, 16 bp, Homo sapiens
tttggtgatgtaaaac

SEQ ID NO: 6596784 - DNA, 15 bp, Homo sapiens
tttggtgcaaagtat

SEQ ID NO: 6596785 - DNA, 17 bp, Homo sapiens
tttggtgcctatttgaa

SEQ ID NO: 6596786 - DNA, 13 bp, Homo sapiens
tttggtgcctggc

SEQ ID NO: 6596787 - DNA, 18 bp, Homo sapiens
tttggtgcctttcctgtt

SEQ ID NO: 6596788 - DNA, 19 bp, Homo sapiens
tttggtggcctaatttaca

SEQ ID NO: 6596789 - DNA, 19 bp, Homo sapiens
tttggtggtttcagaaatg

SEQ ID NO: 6596790 - DNA, 15 bp, Homo sapiens
tttggtgtacagact

SEQ ID NO: 6596791 - DNA, 13 bp, Homo sapiens
tttggtgtgcatc

SEQ ID NO: 6596792 - DNA, 18 bp, Homo sapiens
tttggtgtggctgtattc

SEQ ID NO: 6596793 - DNA, 14 bp, Homo sapiens
tttggtgtgttccc

SEQ ID NO: 6596794 - DNA, 19 bp, Homo sapiens
tttggtgttcctggaagca

SEQ ID NO: 6596795 - DNA, 13 bp, Homo sapiens
tttggttaaagta

SEQ ID NO: 6596796 - DNA, 20 bp, Homo sapiens
tttggttaagtctgttttat

SEQ ID NO: 6596797 - DNA, 19 bp, Homo sapiens
tttggttaatatgtctttt

SEQ ID NO: 6596798 - DNA, 17 bp, Homo sapiens
tttggttaatcagtgtt

SEQ ID NO: 6596799 - DNA, 21 bp, Homo sapiens
tttggttagaagtaaggatta

SEQ ID NO: 6596800 - DNA, 17 bp, Homo sapiens
tttggttagctcacagg

SEQ ID NO: 6596801 - DNA, 18 bp, Homo sapiens
tttggttatagtgcaata

SEQ ID NO: 6596802 - DNA, 20 bp, Homo sapiens
tttggttcattaattctata

SEQ ID NO: 6596803 - DNA, 19 bp, Homo sapiens
tttggttcctcatggctgt

SEQ ID NO: 6596804 - DNA, 14 bp, Homo sapiens
tttggttcctgtga

SEQ ID NO: 6596805 - DNA, 12 bp, Homo sapiens
tttggttctgtg

SEQ ID NO: 6596806 - DNA, 21 bp, Homo sapiens
tttggttcttagttctcactg

SEQ ID NO: 6596807 - DNA, 20 bp, Homo sapiens
tttggttcttctcaaaagaa

SEQ ID NO: 6596808 - DNA, 24 bp, Homo sapiens
tttggttcttctgacacttgtggt

SEQ ID NO: 6596809 - DNA, 15 bp, Homo sapiens
tttggttggttttat

SEQ ID NO: 6596810 - DNA, 20 bp, Homo sapiens
tttggttgtaaatgctcgtg

SEQ ID NO: 6596811 - DNA, 14 bp, Homo sapiens
tttggtttacattt

SEQ ID NO: 6596812 - DNA, 15 bp, Homo sapiens
tttggtttactttca

SEQ ID NO: 6596813 - DNA, 23 bp, Homo sapiens
tttggtttactttcaaaagagta

SEQ ID NO: 6596814 - DNA, 21 bp, Homo sapiens
tttggtttatgcggtgctgtc

SEQ ID NO: 6596815 - DNA, 18 bp, Homo sapiens
tttggtttcaccttccct

SEQ ID NO: 6596816 - DNA, 19 bp, Homo sapiens
tttggtttgacttgtttgt

SEQ ID NO: 6596817 - DNA, 23 bp, Homo sapiens
tttggtttgccttttatgtaaat

SEQ ID NO: 6596818 - DNA, 20 bp, Homo sapiens
tttggtttggcctccatcct

SEQ ID NO: 6596819 - DNA, 19 bp, Homo sapiens
tttggttttcacattggaa

SEQ ID NO: 6596820 - DNA, 12 bp, Homo sapiens
tttggttttgtt

SEQ ID NO: 6596821 - DNA, 15 bp, Homo sapiens
tttggttttgttccc

SEQ ID NO: 6596822 - DNA, 21 bp, Homo sapiens
tttggttttgttcccctcctc

SEQ ID NO: 6596823 - DNA, 15 bp, Homo sapiens
tttggtttttatatt

SEQ ID NO: 6596824 - DNA, 14 bp, Homo sapiens
tttggtttttcctc

SEQ ID NO: 6596825 - DNA, 18 bp, Homo sapiens
tttggtttttctcatttg

SEQ ID NO: 6596826 - DNA, 23 bp, Homo sapiens
tttggtttttctcatttgaaatg

SEQ ID NO: 6596827 - DNA, 15 bp, Homo sapiens
tttggtttttgtctt

SEQ ID NO: 6596828 - DNA, 21 bp, Homo sapiens
tttgtaaaaactgaagaattt

SEQ ID NO: 6596829 - DNA, 14 bp, Homo sapiens
tttgtaaaaacttt

SEQ ID NO: 6596830 - DNA, 17 bp, Homo sapiens
tttgtaaaaatactgtt

SEQ ID NO: 6596831 - DNA, 23 bp, Homo sapiens
tttgtaaaaatcttttgaagcat

SEQ ID NO: 6596832 - DNA, 12 bp, Homo sapiens
tttgtaaaacaa

SEQ ID NO: 6596833 - DNA, 18 bp, Homo sapiens
tttgtaaaacaatgccat

SEQ ID NO: 6596834 - DNA, 14 bp, Homo sapiens
tttgtaaaactgtt

SEQ ID NO: 6596835 - DNA, 14 bp, Homo sapiens
tttgtaaaacttct

SEQ ID NO: 6596836 - DNA, 17 bp, Homo sapiens
tttgtaaaagagctgtt

SEQ ID NO: 6596837 - DNA, 20 bp, Homo sapiens
tttgtaaaagagctgttctt

SEQ ID NO: 6596838 - DNA, 23 bp, Homo sapiens
tttgtaaaatgacaatcatgtgt

SEQ ID NO: 6596839 - DNA, 17 bp, Homo sapiens
tttgtaaactaaggatt

SEQ ID NO: 6596840 - DNA, 17 bp, Homo sapiens
tttgtaaactgatgttt

SEQ ID NO: 6596841 - DNA, 18 bp, Homo sapiens
tttgtaaagaaaaatatt

SEQ ID NO: 6596842 - DNA, 13 bp, Homo sapiens
tttgtaaagaaat

SEQ ID NO: 6596843 - DNA, 21 bp, Homo sapiens
tttgtaaagagaccatcttct

SEQ ID NO: 6596844 - DNA, 16 bp, Homo sapiens
tttgtaaagcccttgc

SEQ ID NO: 6596845 - DNA, 14 bp, Homo sapiens
tttgtaaaggaaat

SEQ ID NO: 6596846 - DNA, 14 bp, Homo sapiens
tttgtaaagtaaaa

SEQ ID NO: 6596847 - DNA, 17 bp, Homo sapiens
tttgtaaagtccccaga

SEQ ID NO: 6596848 - DNA, 12 bp, Homo sapiens
tttgtaaagtgt

SEQ ID NO: 6596849 - DNA, 17 bp, Homo sapiens
tttgtaaagtgtggtcc

SEQ ID NO: 6596850 - DNA, 22 bp, Homo sapiens
tttgtaaagttaattcattaaa

SEQ ID NO: 6596851 - DNA, 22 bp, Homo sapiens
tttgtaaagttggttggataag

SEQ ID NO: 6596852 - DNA, 17 bp, Homo sapiens
tttgtaaataagagatt

SEQ ID NO: 6596853 - DNA, 15 bp, Homo sapiens
tttgtaaatactgct

SEQ ID NO: 6596854 - DNA, 17 bp, Homo sapiens
tttgtaaatactgcttg

SEQ ID NO: 6596855 - DNA, 14 bp, Homo sapiens
tttgtaaataggat

SEQ ID NO: 6596856 - DNA, 16 bp, Homo sapiens
tttgtaaatagtttaa

SEQ ID NO: 6596857 - DNA, 20 bp, Homo sapiens
tttgtaaatatgacagaatt

SEQ ID NO: 6596858 - DNA, 12 bp, Homo sapiens
tttgtaaatatt

SEQ ID NO: 6596859 - DNA, 17 bp, Homo sapiens
tttgtaaatgaaactta

SEQ ID NO: 6596860 - DNA, 22 bp, Homo sapiens
tttgtaaatgactttcataata

SEQ ID NO: 6596861 - DNA, 21 bp, Homo sapiens
tttgtaaatgctgtaaatatt

SEQ ID NO: 6596862 - DNA, 12 bp, Homo sapiens
tttgtaaatgtt

SEQ ID NO: 6596863 - DNA, 16 bp, Homo sapiens
tttgtaaattaacttt

SEQ ID NO: 6596864 - DNA, 22 bp, Homo sapiens
tttgtaaattaacttttataaa

SEQ ID NO: 6596865 - DNA, 17 bp, Homo sapiens
tttgtaaattaatactt

SEQ ID NO: 6596866 - DNA, 13 bp, Homo sapiens
tttgtaaattatt

SEQ ID NO: 6596867 - DNA, 17 bp, Homo sapiens
tttgtaaattattgatg

SEQ ID NO: 6596868 - DNA, 18 bp, Homo sapiens
tttgtaaattatttatgt

SEQ ID NO: 6596869 - DNA, 18 bp, Homo sapiens
tttgtaaattattttatg

SEQ ID NO: 6596870 - DNA, 21 bp, Homo sapiens
tttgtaaattattttatgtca

SEQ ID NO: 6596871 - DNA, 12 bp, Homo sapiens
tttgtaaattct

SEQ ID NO: 6596872 - DNA, 15 bp, Homo sapiens
tttgtaaattctgat

SEQ ID NO: 6596873 - DNA, 16 bp, Homo sapiens
tttgtaaattctgatt

SEQ ID NO: 6596874 - DNA, 20 bp, Homo sapiens
tttgtaaattctgatttctt

SEQ ID NO: 6596875 - DNA, 17 bp, Homo sapiens
tttgtaaattgaataag

SEQ ID NO: 6596876 - DNA, 23 bp, Homo sapiens
tttgtaacaaaaagaccttcata

SEQ ID NO: 6596877 - DNA, 22 bp, Homo sapiens
tttgtaacattagttttaaaaa

SEQ ID NO: 6596878 - DNA, 20 bp, Homo sapiens
tttgtaaccacaactttcac

SEQ ID NO: 6596879 - DNA, 19 bp, Homo sapiens
tttgtaacccactgagagg

SEQ ID NO: 6596880 - DNA, 21 bp, Homo sapiens
tttgtaacccagattttgctg

SEQ ID NO: 6596881 - DNA, 16 bp, Homo sapiens
tttgtaacctcagctc

SEQ ID NO: 6596882 - DNA, 10 bp, Homo sapiens
tttgtaacta

SEQ ID NO: 6596883 - DNA, 12 bp, Homo sapiens
tttgtaactacc

SEQ ID NO: 6596884 - DNA, 18 bp, Homo sapiens
tttgtaactattcttcag

SEQ ID NO: 6596885 - DNA, 16 bp, Homo sapiens
tttgtaacttagcttt

SEQ ID NO: 6596886 - DNA, 11 bp, Homo sapiens
tttgtaacttc

SEQ ID NO: 6596887 - DNA, 15 bp, Homo sapiens
tttgtaactttgcat

SEQ ID NO: 6596888 - DNA, 16 bp, Homo sapiens
tttgtaactttttaca

SEQ ID NO: 6596889 - DNA, 20 bp, Homo sapiens
tttgtaactttttacattac

SEQ ID NO: 6596890 - DNA, 12 bp, Homo sapiens
tttgtaagaaaa

SEQ ID NO: 6596891 - DNA, 22 bp, Homo sapiens
tttgtaagaaaaccaaaataaa

SEQ ID NO: 6596892 - DNA, 13 bp, Homo sapiens
tttgtaagaaacc

SEQ ID NO: 6596893 - DNA, 19 bp, Homo sapiens
tttgtaagacacacagcct

SEQ ID NO: 6596894 - DNA, 16 bp, Homo sapiens
tttgtaagacatttgt

SEQ ID NO: 6596895 - DNA, 18 bp, Homo sapiens
tttgtaagagtgtagaag

SEQ ID NO: 6596896 - DNA, 22 bp, Homo sapiens
tttgtaagagtgtagaagcatt

SEQ ID NO: 6596897 - DNA, 19 bp, Homo sapiens
tttgtaagcaacttgcttc

SEQ ID NO: 6596898 - DNA, 21 bp, Homo sapiens
tttgtaagctataacatattt

SEQ ID NO: 6596899 - DNA, 17 bp, Homo sapiens
tttgtaaggcttgttcc

SEQ ID NO: 6596900 - DNA, 18 bp, Homo sapiens
tttgtaaggtttttgtag

SEQ ID NO: 6596901 - DNA, 21 bp, Homo sapiens
tttgtaagtaacaatatgtaa

SEQ ID NO: 6596902 - DNA, 22 bp, Homo sapiens
tttgtaagtaacaatatgtaat

SEQ ID NO: 6596903 - DNA, 14 bp, Homo sapiens
tttgtaagtaagta

SEQ ID NO: 6596904 - DNA, 20 bp, Homo sapiens
tttgtaagtaagtaagaaag

SEQ ID NO: 6596905 - DNA, 22 bp, Homo sapiens
tttgtaagttaggtaactgtat

SEQ ID NO: 6596906 - DNA, 13 bp, Homo sapiens
tttgtaagtttat

SEQ ID NO: 6596907 - DNA, 21 bp, Homo sapiens
tttgtaagtttatgtctaaag

SEQ ID NO: 6596908 - DNA, 21 bp, Homo sapiens
tttgtaagtttcaggtgacat

SEQ ID NO: 6596909 - DNA, 20 bp, Homo sapiens
tttgtaataaaaggtatgaa

SEQ ID NO: 6596910 - DNA, 14 bp, Homo sapiens
tttgtaataaactc

SEQ ID NO: 6596911 - DNA, 21 bp, Homo sapiens
tttgtaataaaggtctttgca

SEQ ID NO: 6596912 - DNA, 17 bp, Homo sapiens
tttgtaataacatttaa

SEQ ID NO: 6596913 - DNA, 17 bp, Homo sapiens
tttgtaatataagacaa

SEQ ID NO: 6596914 - DNA, 19 bp, Homo sapiens
tttgtaatataagacaagt

SEQ ID NO: 6596915 - DNA, 15 bp, Homo sapiens
tttgtaatatgagaa

SEQ ID NO: 6596916 - DNA, 17 bp, Homo sapiens
tttgtaatatgagaatg

SEQ ID NO: 6596917 - DNA, 21 bp, Homo sapiens
tttgtaatatgagaatgtatt

SEQ ID NO: 6596918 - DNA, 17 bp, Homo sapiens
tttgtaatattctgttt

SEQ ID NO: 6596919 - DNA, 19 bp, Homo sapiens
tttgtaatatttgaatttt

SEQ ID NO: 6596920 - DNA, 14 bp, Homo sapiens
tttgtaatcctgta

SEQ ID NO: 6596921 - DNA, 19 bp, Homo sapiens
tttgtaatgcactgttttt

SEQ ID NO: 6596922 - DNA, 14 bp, Homo sapiens
tttgtaatggtgct

SEQ ID NO: 6596923 - DNA, 16 bp, Homo sapiens
tttgtaatggtgctta

SEQ ID NO: 6596924 - DNA, 17 bp, Homo sapiens
tttgtaatggtgcttat

SEQ ID NO: 6596925 - DNA, 21 bp, Homo sapiens
tttgtaatgtatcttatttat

SEQ ID NO: 6596926 - DNA, 23 bp, Homo sapiens
tttgtaatgtcaccaccttccca

SEQ ID NO: 6596927 - DNA, 23 bp, Homo sapiens
tttgtaatgtcttgagctctatt

SEQ ID NO: 6596928 - DNA, 13 bp, Homo sapiens
tttgtaatgtgaa

SEQ ID NO: 6596929 - DNA, 23 bp, Homo sapiens
tttgtaattacaggagggaacat

SEQ ID NO: 6596930 - DNA, 14 bp, Homo sapiens
tttgtaattattgt

SEQ ID NO: 6596931 - DNA, 13 bp, Homo sapiens
tttgtaattgaca

SEQ ID NO: 6596932 - DNA, 21 bp, Homo sapiens
tttgtaattttaaaagtctat

SEQ ID NO: 6596933 - DNA, 14 bp, Homo sapiens
tttgtaatttttgc

SEQ ID NO: 6596934 - DNA, 20 bp, Homo sapiens
tttgtacaaactatttcaga

SEQ ID NO: 6596935 - DNA, 13 bp, Homo sapiens
tttgtacaaagtt

SEQ ID NO: 6596936 - DNA, 15 bp, Homo sapiens
tttgtacaaataaac

SEQ ID NO: 6596937 - DNA, 17 bp, Homo sapiens
tttgtacaaataaacct

SEQ ID NO: 6596938 - DNA, 14 bp, Homo sapiens
tttgtacaaatact

SEQ ID NO: 6596939 - DNA, 23 bp, Homo sapiens
tttgtacaaggggccatttggca

SEQ ID NO: 6596940 - DNA, 20 bp, Homo sapiens
tttgtacaaggtaattgttt

SEQ ID NO: 6596941 - DNA, 21 bp, Homo sapiens
tttgtacaatatgaaaaggat

SEQ ID NO: 6596942 - DNA, 21 bp, Homo sapiens
tttgtacaattgaacttaaat

SEQ ID NO: 6596943 - DNA, 21 bp, Homo sapiens
tttgtacacccatgaaagaaa

SEQ ID NO: 6596944 - DNA, 15 bp, Homo sapiens
tttgtacactgctgt

SEQ ID NO: 6596945 - DNA, 21 bp, Homo sapiens
tttgtacagaatttttaatga

SEQ ID NO: 6596946 - DNA, 18 bp, Homo sapiens
tttgtacaggactgtaaa

SEQ ID NO: 6596947 - DNA, 21 bp, Homo sapiens
tttgtacatagccaactgtag

SEQ ID NO: 6596948 - DNA, 17 bp, Homo sapiens
tttgtacatatcaaata

SEQ ID NO: 6596949 - DNA, 19 bp, Homo sapiens
tttgtacatatcaaataga

SEQ ID NO: 6596950 - DNA, 17 bp, Homo sapiens
tttgtacatattatcat

SEQ ID NO: 6596951 - DNA, 14 bp, Homo sapiens
tttgtacatattgt

SEQ ID NO: 6596952 - DNA, 12 bp, Homo sapiens
tttgtacatctg

SEQ ID NO: 6596953 - DNA, 20 bp, Homo sapiens
tttgtacattacactaaatt

SEQ ID NO: 6596954 - DNA, 23 bp, Homo sapiens
tttgtacattacactaaattatt

SEQ ID NO: 6596955 - DNA, 12 bp, Homo sapiens
tttgtacattat

SEQ ID NO: 6596956 - DNA, 15 bp, Homo sapiens
tttgtacattatgtt

SEQ ID NO: 6596957 - DNA, 18 bp, Homo sapiens
tttgtacattatgttatt

SEQ ID NO: 6596958 - DNA, 13 bp, Homo sapiens
tttgtacattcct

SEQ ID NO: 6596959 - DNA, 19 bp, Homo sapiens
tttgtaccagtgaattttt

SEQ ID NO: 6596960 - DNA, 17 bp, Homo sapiens
tttgtaccatggtgtga

SEQ ID NO: 6596961 - DNA, 19 bp, Homo sapiens
tttgtaccattccttcaaa

SEQ ID NO: 6596962 - DNA, 20 bp, Homo sapiens
tttgtaccattccttcaaat

SEQ ID NO: 6596963 - DNA, 18 bp, Homo sapiens
tttgtaccttattgatct

SEQ ID NO: 6596964 - DNA, 18 bp, Homo sapiens
tttgtacgttatatattg

SEQ ID NO: 6596965 - DNA, 15 bp, Homo sapiens
tttgtactgaaaaat

SEQ ID NO: 6596966 - DNA, 15 bp, Homo sapiens
tttgtactgtgctga

SEQ ID NO: 6596967 - DNA, 13 bp, Homo sapiens
tttgtactgttta

SEQ ID NO: 6596968 - DNA, 20 bp, Homo sapiens
tttgtacttccacctccacc

SEQ ID NO: 6596969 - DNA, 15 bp, Homo sapiens
tttgtacttcttatt

SEQ ID NO: 6596970 - DNA, 12 bp, Homo sapiens
tttgtactttct

SEQ ID NO: 6596971 - DNA, 15 bp, Homo sapiens
tttgtactttctgtt

SEQ ID NO: 6596972 - DNA, 23 bp, Homo sapiens
tttgtacttttctggttccaaac

SEQ ID NO: 6596973 - DNA, 17 bp, Homo sapiens
tttgtacttttgtgtta

SEQ ID NO: 6596974 - DNA, 17 bp, Homo sapiens
tttgtactttttaatgt

SEQ ID NO: 6596975 - DNA, 16 bp, Homo sapiens
tttgtagaataaatgg

SEQ ID NO: 6596976 - DNA, 18 bp, Homo sapiens
tttgtagaataaatggtt

SEQ ID NO: 6596977 - DNA, 22 bp, Homo sapiens
tttgtagacagggtctccctat

SEQ ID NO: 6596978 - DNA, 19 bp, Homo sapiens
tttgtagacattttgaaat

SEQ ID NO: 6596979 - DNA, 22 bp, Homo sapiens
tttgtagacattttgaaataaa

SEQ ID NO: 6596980 - DNA, 13 bp, Homo sapiens
tttgtagagccag

SEQ ID NO: 6596981 - DNA, 19 bp, Homo sapiens
tttgtagatggagtttcac

SEQ ID NO: 6596982 - DNA, 12 bp, Homo sapiens
tttgtagatgtt

SEQ ID NO: 6596983 - DNA, 18 bp, Homo sapiens
tttgtagcataactgtag

SEQ ID NO: 6596984 - DNA, 23 bp, Homo sapiens
tttgtagcataactgtagctcaa

SEQ ID NO: 6596985 - DNA, 21 bp, Homo sapiens
tttgtagcatttttctaatag

SEQ ID NO: 6596986 - DNA, 16 bp, Homo sapiens
tttgtagccaaagaaa

SEQ ID NO: 6596987 - DNA, 22 bp, Homo sapiens
tttgtagctagtttaaaattat

SEQ ID NO: 6596988 - DNA, 20 bp, Homo sapiens
tttgtagcttaaaaaaagga

SEQ ID NO: 6596989 - DNA, 16 bp, Homo sapiens
tttgtagctttcctgg

SEQ ID NO: 6596990 - DNA, 22 bp, Homo sapiens
tttgtaggaaggtctcattctt

SEQ ID NO: 6596991 - DNA, 23 bp, Homo sapiens
tttgtaggaaggtctcattcttc

SEQ ID NO: 6596992 - DNA, 12 bp, Homo sapiens
tttgtaggccag

SEQ ID NO: 6596993 - DNA, 19 bp, Homo sapiens
tttgtaggggtcaaagaaa

SEQ ID NO: 6596994 - DNA, 21 bp, Homo sapiens
tttgtaggggtcaaagaaatg

SEQ ID NO: 6596995 - DNA, 23 bp, Homo sapiens
tttgtaggggtcaaagaaatgct

SEQ ID NO: 6596996 - DNA, 17 bp, Homo sapiens
tttgtagggttctgctt

SEQ ID NO: 6596997 - DNA, 15 bp, Homo sapiens
tttgtaggtaaaatg

SEQ ID NO: 6596998 - DNA, 14 bp, Homo sapiens
tttgtagtaaatat

SEQ ID NO: 6596999 - DNA, 17 bp, Homo sapiens
tttgtagtagcgttttt

SEQ ID NO: 6597000 - DNA, 15 bp, Homo sapiens
tttgtagtcttatga

SEQ ID NO: 6597001 - DNA, 19 bp, Homo sapiens
tttgtagtcttatgaatag

SEQ ID NO: 6597002 - DNA, 23 bp, Homo sapiens
tttgtagtgagcgagtggatgct

SEQ ID NO: 6597003 - DNA, 22 bp, Homo sapiens
tttgtagtgatttttatgccac

SEQ ID NO: 6597004 - DNA, 19 bp, Homo sapiens
tttgtagtgttggagaaga

SEQ ID NO: 6597005 - DNA, 19 bp, Homo sapiens
tttgtagttactcaagcag

SEQ ID NO: 6597006 - DNA, 13 bp, Homo sapiens
tttgtagttgttg

SEQ ID NO: 6597007 - DNA, 17 bp, Homo sapiens
tttgtagttttatttgt

SEQ ID NO: 6597008 - DNA, 12 bp, Homo sapiens
tttgtataaaaa

SEQ ID NO: 6597009 - DNA, 15 bp, Homo sapiens
tttgtataaaaagga

SEQ ID NO: 6597010 - DNA, 14 bp, Homo sapiens
tttgtataaaagtg

SEQ ID NO: 6597011 - DNA, 20 bp, Homo sapiens
tttgtataaaagtgtgaaat

SEQ ID NO: 6597012 - DNA, 12 bp, Homo sapiens
tttgtataaaat

SEQ ID NO: 6597013 - DNA, 14 bp, Homo sapiens
tttgtataaaataa

SEQ ID NO: 6597014 - DNA, 17 bp, Homo sapiens
tttgtataaaataattt

SEQ ID NO: 6597015 - DNA, 19 bp, Homo sapiens
tttgtataaaataattttt

SEQ ID NO: 6597016 - DNA, 13 bp, Homo sapiens
tttgtataaaatc

SEQ ID NO: 6597017 - DNA, 23 bp, Homo sapiens
tttgtataaaatccatagattta

SEQ ID NO: 6597018 - DNA, 14 bp, Homo sapiens
tttgtataaataat

SEQ ID NO: 6597019 - DNA, 20 bp, Homo sapiens
tttgtataaatgacaaagtg

SEQ ID NO: 6597020 - DNA, 22 bp, Homo sapiens
tttgtataagtccatgaatgtt

SEQ ID NO: 6597021 - DNA, 13 bp, Homo sapiens
tttgtataattgt

SEQ ID NO: 6597022 - DNA, 17 bp, Homo sapiens
tttgtataattgtatcg

SEQ ID NO: 6597023 - DNA, 20 bp, Homo sapiens
tttgtataattgtatcgtat

SEQ ID NO: 6597024 - DNA, 17 bp, Homo sapiens
tttgtatacatcctggg

SEQ ID NO: 6597025 - DNA, 20 bp, Homo sapiens
tttgtatacatcctgggtaa

SEQ ID NO: 6597026 - DNA, 18 bp, Homo sapiens
tttgtataccctgaagaa

SEQ ID NO: 6597027 - DNA, 20 bp, Homo sapiens
tttgtatactttaaataatt

SEQ ID NO: 6597028 - DNA, 21 bp, Homo sapiens
tttgtatagttatgtaaataa

SEQ ID NO: 6597029 - DNA, 15 bp, Homo sapiens
tttgtatagttgctt

SEQ ID NO: 6597030 - DNA, 16 bp, Homo sapiens
tttgtatataaatggt

SEQ ID NO: 6597031 - DNA, 19 bp, Homo sapiens
tttgtatataggcttctca

SEQ ID NO: 6597032 - DNA, 13 bp, Homo sapiens
tttgtatatccta

SEQ ID NO: 6597033 - DNA, 23 bp, Homo sapiens
tttgtatatctcaacagaattaa

SEQ ID NO: 6597034 - DNA, 20 bp, Homo sapiens
tttgtatattacaacattta

SEQ ID NO: 6597035 - DNA, 14 bp, Homo sapiens
tttgtatattacac

SEQ ID NO: 6597036 - DNA, 19 bp, Homo sapiens
tttgtatattacacatttg

SEQ ID NO: 6597037 - DNA, 21 bp, Homo sapiens
tttgtatattacacatttgta

SEQ ID NO: 6597038 - DNA, 18 bp, Homo sapiens
tttgtatattgtatttat

SEQ ID NO: 6597039 - DNA, 14 bp, Homo sapiens
tttgtatatttgca

SEQ ID NO: 6597040 - DNA, 22 bp, Homo sapiens
tttgtatcctccattgtatctt

SEQ ID NO: 6597041 - DNA, 20 bp, Homo sapiens
tttgtatctttaaagacttg

SEQ ID NO: 6597042 - DNA, 13 bp, Homo sapiens
tttgtatctttat

SEQ ID NO: 6597043 - DNA, 16 bp, Homo sapiens
tttgtatctttatgct

SEQ ID NO: 6597044 - DNA, 14 bp, Homo sapiens
tttgtatctttctt

SEQ ID NO: 6597045 - DNA, 21 bp, Homo sapiens
tttgtatgaaattataatctg

SEQ ID NO: 6597046 - DNA, 11 bp, Homo sapiens
tttgtatgaga

SEQ ID NO: 6597047 - DNA, 15 bp, Homo sapiens
tttgtatgagatggt

SEQ ID NO: 6597048 - DNA, 17 bp, Homo sapiens
tttgtatgagatggtta

SEQ ID NO: 6597049 - DNA, 18 bp, Homo sapiens
tttgtatgagatggttaa

SEQ ID NO: 6597050 - DNA, 16 bp, Homo sapiens
tttgtatgctaaatga

SEQ ID NO: 6597051 - DNA, 14 bp, Homo sapiens
tttgtatggagtta

SEQ ID NO: 6597052 - DNA, 12 bp, Homo sapiens
tttgtatgtaaa

SEQ ID NO: 6597053 - DNA, 17 bp, Homo sapiens
tttgtatgtaaatacca

SEQ ID NO: 6597054 - DNA, 17 bp, Homo sapiens
tttgtatgtaaatgtgc

SEQ ID NO: 6597055 - DNA, 14 bp, Homo sapiens
tttgtatgtataat

SEQ ID NO: 6597056 - DNA, 22 bp, Homo sapiens
tttgtatgtatgtgtagtgtgt

SEQ ID NO: 6597057 - DNA, 13 bp, Homo sapiens
tttgtatgtctgt

SEQ ID NO: 6597058 - DNA, 15 bp, Homo sapiens
tttgtatgtgaacaa

SEQ ID NO: 6597059 - DNA, 23 bp, Homo sapiens
tttgtatgtgaacaaatcaaatt

SEQ ID NO: 6597060 - DNA, 10 bp, Homo sapiens
tttgtatgtt

SEQ ID NO: 6597061 - DNA, 16 bp, Homo sapiens
tttgtatgttaaagag

SEQ ID NO: 6597062 - DNA, 18 bp, Homo sapiens
tttgtatgttatgaacat

SEQ ID NO: 6597063 - DNA, 21 bp, Homo sapiens
tttgtatgtttagtagaaacg

SEQ ID NO: 6597064 - DNA, 12 bp, Homo sapiens
tttgtatgtttt

SEQ ID NO: 6597065 - DNA, 17 bp, Homo sapiens
tttgtatgtttttctgt

SEQ ID NO: 6597066 - DNA, 22 bp, Homo sapiens
tttgtattaaaaaaaaatactc

SEQ ID NO: 6597067 - DNA, 11 bp, Homo sapiens
tttgtattaat

SEQ ID NO: 6597068 - DNA, 12 bp, Homo sapiens
tttgtattaata

SEQ ID NO: 6597069 - DNA, 18 bp, Homo sapiens
tttgtattaataaagcat

SEQ ID NO: 6597070 - DNA, 17 bp, Homo sapiens
tttgtattacttaggtt

SEQ ID NO: 6597071 - DNA, 19 bp, Homo sapiens
tttgtattactttctctgt

SEQ ID NO: 6597072 - DNA, 16 bp, Homo sapiens
tttgtattagtaataa

SEQ ID NO: 6597073 - DNA, 15 bp, Homo sapiens
tttgtattataaaag

SEQ ID NO: 6597074 - DNA, 16 bp, Homo sapiens
tttgtattataaaagc

SEQ ID NO: 6597075 - DNA, 17 bp, Homo sapiens
tttgtattattacaaat

SEQ ID NO: 6597076 - DNA, 14 bp, Homo sapiens
tttgtattattgct

SEQ ID NO: 6597077 - DNA, 22 bp, Homo sapiens
tttgtattcaattaaagaaata

SEQ ID NO: 6597078 - DNA, 17 bp, Homo sapiens
tttgtattctgtcttca

SEQ ID NO: 6597079 - DNA, 12 bp, Homo sapiens
tttgtattgcca

SEQ ID NO: 6597080 - DNA, 14 bp, Homo sapiens
tttgtattgtatat

SEQ ID NO: 6597081 - DNA, 15 bp, Homo sapiens
tttgtattgtcctat

SEQ ID NO: 6597082 - DNA, 18 bp, Homo sapiens
tttgtattgttaatatct

SEQ ID NO: 6597083 - DNA, 21 bp, Homo sapiens
tttgtattgtttcaattgcat

SEQ ID NO: 6597084 - DNA, 10 bp, Homo sapiens
tttgtattta

SEQ ID NO: 6597085 - DNA, 12 bp, Homo sapiens
tttgtatttagt

SEQ ID NO: 6597086 - DNA, 19 bp, Homo sapiens
tttgtatttattaatttga

SEQ ID NO: 6597087 - DNA, 13 bp, Homo sapiens
tttgtatttattc

SEQ ID NO: 6597088 - DNA, 16 bp, Homo sapiens
tttgtatttattcttt

SEQ ID NO: 6597089 - DNA, 15 bp, Homo sapiens
tttgtatttctttta

SEQ ID NO: 6597090 - DNA, 20 bp, Homo sapiens
tttgtatttcttttatatat

SEQ ID NO: 6597091 - DNA, 22 bp, Homo sapiens
tttgtatttcttttatatataa

SEQ ID NO: 6597092 - DNA, 13 bp, Homo sapiens
tttgtattttcaa

SEQ ID NO: 6597093 - DNA, 13 bp, Homo sapiens
tttgtattttcat

SEQ ID NO: 6597094 - DNA, 13 bp, Homo sapiens
tttgtattttgct

SEQ ID NO: 6597095 - DNA, 20 bp, Homo sapiens
tttgtatttttcatctttaa

SEQ ID NO: 6597096 - DNA, 16 bp, Homo sapiens
tttgtatttttgaata

SEQ ID NO: 6597097 - DNA, 19 bp, Homo sapiens
tttgtattttttatttaca

SEQ ID NO: 6597098 - DNA, 14 bp, Homo sapiens
tttgtcaaactgta

SEQ ID NO: 6597099 - DNA, 23 bp, Homo sapiens
tttgtcaaactgtagaaatgatg

SEQ ID NO: 6597100 - DNA, 13 bp, Homo sapiens
tttgtcaacaaaa

SEQ ID NO: 6597101 - DNA, 20 bp, Homo sapiens
tttgtcaacacaaagacatg

SEQ ID NO: 6597102 - DNA, 16 bp, Homo sapiens
tttgtcaacattgtga

SEQ ID NO: 6597103 - DNA, 21 bp, Homo sapiens
tttgtcaagagccaagacaca

SEQ ID NO: 6597104 - DNA, 20 bp, Homo sapiens
tttgtcaaggctgactactc

SEQ ID NO: 6597105 - DNA, 23 bp, Homo sapiens
tttgtcacaagctgtagataaca

SEQ ID NO: 6597106 - DNA, 16 bp, Homo sapiens
aattccacacctttta

SEQ ID NO: 6597107 - DNA, 18 bp, Homo sapiens
aattccacagattatcaa

SEQ ID NO: 6597108 - DNA, 18 bp, Homo sapiens
aattccacccctcctcga

SEQ ID NO: 6597109 - DNA, 20 bp, Homo sapiens
aattccacctggaaagccag

SEQ ID NO: 6597110 - DNA, 17 bp, Homo sapiens
aattccactgaaaattt

SEQ ID NO: 6597111 - DNA, 21 bp, Homo sapiens
aattccactgaaaatttaaca

SEQ ID NO: 6597112 - DNA, 14 bp, Homo sapiens
aattccactggact

SEQ ID NO: 6597113 - DNA, 22 bp, Homo sapiens
aattccactgtcaagaaagagc

SEQ ID NO: 6597114 - DNA, 22 bp, Homo sapiens
aattccagactttctattaata

SEQ ID NO: 6597115 - DNA, 22 bp, Homo sapiens
aattccagaggactctgcttaa

SEQ ID NO: 6597116 - DNA, 15 bp, Homo sapiens
aattccagatttgtt

SEQ ID NO: 6597117 - DNA, 18 bp, Homo sapiens
aattccagcaataagaaa

SEQ ID NO: 6597118 - DNA, 17 bp, Homo sapiens
aattccaggtgtgcaca

SEQ ID NO: 6597119 - DNA, 13 bp, Homo sapiens
aattccagtaaat

SEQ ID NO: 6597120 - DNA, 18 bp, Homo sapiens
aattccagtaaatcctca

SEQ ID NO: 6597121 - DNA, 15 bp, Homo sapiens
aattccagttgcaat

SEQ ID NO: 6597122 - DNA, 17 bp, Homo sapiens
aattccatacttctctc

SEQ ID NO: 6597123 - DNA, 19 bp, Homo sapiens
aattccatatatccttttc

SEQ ID NO: 6597124 - DNA, 19 bp, Homo sapiens
aattccatatgctccagga

SEQ ID NO: 6597125 - DNA, 23 bp, Homo sapiens
aattccatattgatgaagatgtt

SEQ ID NO: 6597126 - DNA, 24 bp, Homo sapiens
aattccatcaagccaagcctcctg

SEQ ID NO: 6597127 - DNA, 15 bp, Homo sapiens
aattccatgcactct

SEQ ID NO: 6597128 - DNA, 23 bp, Homo sapiens
aattccatgtcagataagtgtaa

SEQ ID NO: 6597129 - DNA, 15 bp, Homo sapiens
aattccattatctta

SEQ ID NO: 6597130 - DNA, 20 bp, Homo sapiens
aattccatttacttgatcat

SEQ ID NO: 6597131 - DNA, 15 bp, Homo sapiens
aattcccaacatttc

SEQ ID NO: 6597132 - DNA, 23 bp, Homo sapiens
aattcccagatagtcccagcagc

SEQ ID NO: 6597133 - DNA, 21 bp, Homo sapiens
aattcccagctgtctgtgtca

SEQ ID NO: 6597134 - DNA, 22 bp, Homo sapiens
aattcccatctgctttattgcc

SEQ ID NO: 6597135 - DNA, 14 bp, Homo sapiens
aattcccccacttg

SEQ ID NO: 6597136 - DNA, 14 bp, Homo sapiens
aattcccccatcct

SEQ ID NO: 6597137 - DNA, 14 bp, Homo sapiens
aattcccccttaaa

SEQ ID NO: 6597138 - DNA, 18 bp, Homo sapiens
aattcccccttaaacttc

SEQ ID NO: 6597139 - DNA, 22 bp, Homo sapiens
aattcccccttaaacttccaaa

SEQ ID NO: 6597140 - DNA, 12 bp, Homo sapiens
aattccccttcc

SEQ ID NO: 6597141 - DNA, 19 bp, Homo sapiens
aattccccttcccttattt

SEQ ID NO: 6597142 - DNA, 10 bp, Homo sapiens
aattccctat

SEQ ID NO: 6597143 - DNA, 22 bp, Homo sapiens
aattccctatcttttagtttta

SEQ ID NO: 6597144 - DNA, 23 bp, Homo sapiens
aattccctctctcagcacagcct

SEQ ID NO: 6597145 - DNA, 16 bp, Homo sapiens
aattccctctctctga

SEQ ID NO: 6597146 - DNA, 17 bp, Homo sapiens
aattccctctctctgac

SEQ ID NO: 6597147 - DNA, 14 bp, Homo sapiens
aattccctctggag

SEQ ID NO: 6597148 - DNA, 17 bp, Homo sapiens
aattccctgaaaaacta

SEQ ID NO: 6597149 - DNA, 22 bp, Homo sapiens
aattccctgaaaaactagtaat

SEQ ID NO: 6597150 - DNA, 13 bp, Homo sapiens
aattccctggacc

SEQ ID NO: 6597151 - DNA, 19 bp, Homo sapiens
aattccctggcctttcata

SEQ ID NO: 6597152 - DNA, 15 bp, Homo sapiens
aattcctaaaattat

SEQ ID NO: 6597153 - DNA, 16 bp, Homo sapiens
aattcctaattctatg

SEQ ID NO: 6597154 - DNA, 18 bp, Homo sapiens
aattcctacaacttaatg

SEQ ID NO: 6597155 - DNA, 14 bp, Homo sapiens
aattcctacagcac

SEQ ID NO: 6597156 - DNA, 18 bp, Homo sapiens
aattcctacagcactact

SEQ ID NO: 6597157 - DNA, 20 bp, Homo sapiens
aattcctactccctcttcca

SEQ ID NO: 6597158 - DNA, 14 bp, Homo sapiens
aattcctagaatta

SEQ ID NO: 6597159 - DNA, 21 bp, Homo sapiens
aattcctagctgtaaatataa

SEQ ID NO: 6597160 - DNA, 22 bp, Homo sapiens
aattcctatacgcagcgtgctt

SEQ ID NO: 6597161 - DNA, 12 bp, Homo sapiens
aattcctattgt

SEQ ID NO: 6597162 - DNA, 16 bp, Homo sapiens
aattcctattgtgatt

SEQ ID NO: 6597163 - DNA, 15 bp, Homo sapiens
aattcctcatttgtt

SEQ ID NO: 6597164 - DNA, 17 bp, Homo sapiens
aattcctccagagacac

SEQ ID NO: 6597165 - DNA, 18 bp, Homo sapiens
aattcctcctgtctcctc

SEQ ID NO: 6597166 - DNA, 11 bp, Homo sapiens
aattcctcctt

SEQ ID NO: 6597167 - DNA, 23 bp, Homo sapiens
aattcctccttccccccatctct

SEQ ID NO: 6597168 - DNA, 14 bp, Homo sapiens
aattcctctgataa

SEQ ID NO: 6597169 - DNA, 12 bp, Homo sapiens
aattcctcttta

SEQ ID NO: 6597170 - DNA, 13 bp, Homo sapiens
aattcctctttaa

SEQ ID NO: 6597171 - DNA, 19 bp, Homo sapiens
aattcctgcaaaattacct

SEQ ID NO: 6597172 - DNA, 21 bp, Homo sapiens
aattcctgctatgacagctgg

SEQ ID NO: 6597173 - DNA, 11 bp, Homo sapiens
aattcctggaa

SEQ ID NO: 6597174 - DNA, 17 bp, Homo sapiens
aattcctggaaaactgg

SEQ ID NO: 6597175 - DNA, 13 bp, Homo sapiens
aattcctggaacc

SEQ ID NO: 6597176 - DNA, 18 bp, Homo sapiens
aattcctggcaaacacca

SEQ ID NO: 6597177 - DNA, 17 bp, Homo sapiens
aattcctgtagcatctt

SEQ ID NO: 6597178 - DNA, 21 bp, Homo sapiens
aattcctgtttttattattaa

SEQ ID NO: 6597179 - DNA, 14 bp, Homo sapiens
aattccttaaaatt

SEQ ID NO: 6597180 - DNA, 15 bp, Homo sapiens
aattccttaaaattt

SEQ ID NO: 6597181 - DNA, 17 bp, Homo sapiens
aattccttaaatgaact

SEQ ID NO: 6597182 - DNA, 23 bp, Homo sapiens
aattccttcagggtgatgccagg

SEQ ID NO: 6597183 - DNA, 12 bp, Homo sapiens
aattccttccca

SEQ ID NO: 6597184 - DNA, 15 bp, Homo sapiens
aattccttcccactc

SEQ ID NO: 6597185 - DNA, 22 bp, Homo sapiens
aattccttcgaaaggccttcag

SEQ ID NO: 6597186 - DNA, 23 bp, Homo sapiens
aattccttcgaaaggccttcaga

SEQ ID NO: 6597187 - DNA, 16 bp, Homo sapiens
aattccttgccccaca

SEQ ID NO: 6597188 - DNA, 14 bp, Homo sapiens
aattcgacctgatt

SEQ ID NO: 6597189 - DNA, 12 bp, Homo sapiens
aattcgagcaaa

SEQ ID NO: 6597190 - DNA, 15 bp, Homo sapiens
aattcgcatgtttaa

SEQ ID NO: 6597191 - DNA, 20 bp, Homo sapiens
aattcgcatgtttaatgtga

SEQ ID NO: 6597192 - DNA, 23 bp, Homo sapiens
aattcgcccgagctgtttatgtt

SEQ ID NO: 6597193 - DNA, 17 bp, Homo sapiens
aattcggtgtgctgcca

SEQ ID NO: 6597194 - DNA, 20 bp, Homo sapiens
aattcggtgtgctgccaact

SEQ ID NO: 6597195 - DNA, 12 bp, Homo sapiens
aattctaaaatg

SEQ ID NO: 6597196 - DNA, 14 bp, Homo sapiens
aattctaaaatgat

SEQ ID NO: 6597197 - DNA, 18 bp, Homo sapiens
aattctaaataaaatata

SEQ ID NO: 6597198 - DNA, 20 bp, Homo sapiens
aattctaaataaaatataat

SEQ ID NO: 6597199 - DNA, 22 bp, Homo sapiens
aattctaaataaaatataattg

SEQ ID NO: 6597200 - DNA, 14 bp, Homo sapiens
aattctaacccaag

SEQ ID NO: 6597201 - DNA, 23 bp, Homo sapiens
aattctaacgcaaaaatagctct

SEQ ID NO: 6597202 - DNA, 17 bp, Homo sapiens
aattctaacttaatgta

SEQ ID NO: 6597203 - DNA, 18 bp, Homo sapiens
aattctaagattgtacat

SEQ ID NO: 6597204 - DNA, 21 bp, Homo sapiens
aattctaagattgtacatatg

SEQ ID NO: 6597205 - DNA, 15 bp, Homo sapiens
aattctaatctaaca

SEQ ID NO: 6597206 - DNA, 12 bp, Homo sapiens
aattctaattgt

SEQ ID NO: 6597207 - DNA, 19 bp, Homo sapiens
aattctaattgttttgtgt

SEQ ID NO: 6597208 - DNA, 22 bp, Homo sapiens
aattctacacctcctttaagat

SEQ ID NO: 6597209 - DNA, 14 bp, Homo sapiens
aattctacaggatg

SEQ ID NO: 6597210 - DNA, 16 bp, Homo sapiens
aattctacaggatggg

SEQ ID NO: 6597211 - DNA, 14 bp, Homo sapiens
aattctactaagtt

SEQ ID NO: 6597212 - DNA, 13 bp, Homo sapiens
aattctagaaaat

SEQ ID NO: 6597213 - DNA, 18 bp, Homo sapiens
aattctagacataactgg

SEQ ID NO: 6597214 - DNA, 18 bp, Homo sapiens
aattctaggatgaacaat

SEQ ID NO: 6597215 - DNA, 15 bp, Homo sapiens
aattctagtctctga

SEQ ID NO: 6597216 - DNA, 18 bp, Homo sapiens
aattctagtctgtttcat

SEQ ID NO: 6597217 - DNA, 20 bp, Homo sapiens
aattctagtctgtttcatta

SEQ ID NO: 6597218 - DNA, 23 bp, Homo sapiens
aattctagtgtccataaataaag

SEQ ID NO: 6597219 - DNA, 13 bp, Homo sapiens
aattctataaaaa

SEQ ID NO: 6597220 - DNA, 16 bp, Homo sapiens
aattctataaggccat

SEQ ID NO: 6597221 - DNA, 13 bp, Homo sapiens
aattctatactgt

SEQ ID NO: 6597222 - DNA, 14 bp, Homo sapiens
aattctatttgctg

SEQ ID NO: 6597223 - DNA, 15 bp, Homo sapiens
aattctcaaagtttt

SEQ ID NO: 6597224 - DNA, 22 bp, Homo sapiens
aattctcaacctaccacccctt

SEQ ID NO: 6597225 - DNA, 13 bp, Homo sapiens
aattctcacagaa

SEQ ID NO: 6597226 - DNA, 17 bp, Homo sapiens
aattctcagaagtgaaa

SEQ ID NO: 6597227 - DNA, 20 bp, Homo sapiens
aattctcagaattacaggaa

SEQ ID NO: 6597228 - DNA, 20 bp, Homo sapiens
aattctcagtcatgcactca

SEQ ID NO: 6597229 - DNA, 20 bp, Homo sapiens
aattctcatgtgatcctttt

SEQ ID NO: 6597230 - DNA, 17 bp, Homo sapiens
aattctcattatgaaga

SEQ ID NO: 6597231 - DNA, 21 bp, Homo sapiens
aattctcatttgtcacacact

SEQ ID NO: 6597232 - DNA, 14 bp, Homo sapiens
aattctcatttgtt

SEQ ID NO: 6597233 - DNA, 14 bp, Homo sapiens
aattctccactgtg

SEQ ID NO: 6597234 - DNA, 22 bp, Homo sapiens
aattctccaggattttaatttc

SEQ ID NO: 6597235 - DNA, 23 bp, Homo sapiens
aattctccaggattttaatttca

SEQ ID NO: 6597236 - DNA, 17 bp, Homo sapiens
aattctcccctccctcc

SEQ ID NO: 6597237 - DNA, 18 bp, Homo sapiens
aattctccctatcttgtg

SEQ ID NO: 6597238 - DNA, 14 bp, Homo sapiens
aattctcctgcctc

SEQ ID NO: 6597239 - DNA, 16 bp, Homo sapiens
aattctcctgcctttg

SEQ ID NO: 6597240 - DNA, 16 bp, Homo sapiens
aattctcgattctttg

SEQ ID NO: 6597241 - DNA, 15 bp, Homo sapiens
aattctctaggaaag

SEQ ID NO: 6597242 - DNA, 15 bp, Homo sapiens
aattctctagtttga

SEQ ID NO: 6597243 - DNA, 17 bp, Homo sapiens
aattctctatgtacaga

SEQ ID NO: 6597244 - DNA, 22 bp, Homo sapiens
aattctctcctaatgatgactt

SEQ ID NO: 6597245 - DNA, 13 bp, Homo sapiens
aattctctgttcc

SEQ ID NO: 6597246 - DNA, 15 bp, Homo sapiens
aattctcttatccaa

SEQ ID NO: 6597247 - DNA, 12 bp, Homo sapiens
aattctctttct

SEQ ID NO: 6597248 - DNA, 23 bp, Homo sapiens
aattctcttttcaaacacacaca

SEQ ID NO: 6597249 - DNA, 10 bp, Homo sapiens
aattctgaat

SEQ ID NO: 6597250 - DNA, 15 bp, Homo sapiens
aattctgaatttgca

SEQ ID NO: 6597251 - DNA, 16 bp, Homo sapiens
aattctgaatttgcaa

SEQ ID NO: 6597252 - DNA, 20 bp, Homo sapiens
aattctgaatttgcaaagta

SEQ ID NO: 6597253 - DNA, 15 bp, Homo sapiens
aattctgactgtcca

SEQ ID NO: 6597254 - DNA, 17 bp, Homo sapiens
aattctgacttctccca

SEQ ID NO: 6597255 - DNA, 19 bp, Homo sapiens
aattctgacttctcccatc

SEQ ID NO: 6597256 - DNA, 13 bp, Homo sapiens
aattctgagatcc

SEQ ID NO: 6597257 - DNA, 20 bp, Homo sapiens
aattctgagatccagcacaa

SEQ ID NO: 6597258 - DNA, 22 bp, Homo sapiens
aattctgagctggccctttcca

SEQ ID NO: 6597259 - DNA, 21 bp, Homo sapiens
aattctgaggtaagtgtatga

SEQ ID NO: 6597260 - DNA, 17 bp, Homo sapiens
aattctgagttttgtgt

SEQ ID NO: 6597261 - DNA, 19 bp, Homo sapiens
aattctgataaacctgtct

SEQ ID NO: 6597262 - DNA, 17 bp, Homo sapiens
aattctgatgtttctgt

SEQ ID NO: 6597263 - DNA, 19 bp, Homo sapiens
aattctgatgtttctgtga

SEQ ID NO: 6597264 - DNA, 20 bp, Homo sapiens
aattctgatgtttctgtgaa

SEQ ID NO: 6597265 - DNA, 23 bp, Homo sapiens
aattctgattctggctttaagcc

SEQ ID NO: 6597266 - DNA, 11 bp, Homo sapiens
aattctgattt

SEQ ID NO: 6597267 - DNA, 17 bp, Homo sapiens
aattctgccccacaccc

SEQ ID NO: 6597268 - DNA, 22 bp, Homo sapiens
aattctgcctgcctcctccctc

SEQ ID NO: 6597269 - DNA, 14 bp, Homo sapiens
aattctgccttggt

SEQ ID NO: 6597270 - DNA, 15 bp, Homo sapiens
aattctgctacctca

SEQ ID NO: 6597271 - DNA, 16 bp, Homo sapiens
aattctgctcagatag

SEQ ID NO: 6597272 - DNA, 22 bp, Homo sapiens
aattctgctctaaataaagacg

SEQ ID NO: 6597273 - DNA, 11 bp, Homo sapiens
aattctgctgc

SEQ ID NO: 6597274 - DNA, 12 bp, Homo sapiens
aattctggaaac

SEQ ID NO: 6597275 - DNA, 16 bp, Homo sapiens
aattctggacagacag

SEQ ID NO: 6597276 - DNA, 17 bp, Homo sapiens
aattctggaggaagaag

SEQ ID NO: 6597277 - DNA, 21 bp, Homo sapiens
aattctgggttcatttgtgat

SEQ ID NO: 6597278 - DNA, 13 bp, Homo sapiens
aattctggtatac

SEQ ID NO: 6597279 - DNA, 12 bp, Homo sapiens
aattctgtaaat

SEQ ID NO: 6597280 - DNA, 17 bp, Homo sapiens
aattctgtacatagcct

SEQ ID NO: 6597281 - DNA, 22 bp, Homo sapiens
aattctgtactgatttttgtaa

SEQ ID NO: 6597282 - DNA, 12 bp, Homo sapiens
aattctgtatag

SEQ ID NO: 6597283 - DNA, 13 bp, Homo sapiens
aattctgtataga

SEQ ID NO: 6597284 - DNA, 20 bp, Homo sapiens
aattctgtatagattagaga

SEQ ID NO: 6597285 - DNA, 14 bp, Homo sapiens
aattctgtcattaa

SEQ ID NO: 6597286 - DNA, 20 bp, Homo sapiens
tttgtcacattatttattaa

SEQ ID NO: 6597287 - DNA, 17 bp, Homo sapiens
tttgtcaccagaacaca

SEQ ID NO: 6597288 - DNA, 13 bp, Homo sapiens
tttgtcactgaat

SEQ ID NO: 6597289 - DNA, 20 bp, Homo sapiens
tttgtcactggaacctccct

SEQ ID NO: 6597290 - DNA, 13 bp, Homo sapiens
tttgtcacttatt

SEQ ID NO: 6597291 - DNA, 13 bp, Homo sapiens
tttgtcacttctg

SEQ ID NO: 6597292 - DNA, 19 bp, Homo sapiens
tttgtcacttgccacatgg

SEQ ID NO: 6597293 - DNA, 14 bp, Homo sapiens
tttgtcactttttc

SEQ ID NO: 6597294 - DNA, 15 bp, Homo sapiens
tttgtcactttttct

SEQ ID NO: 6597295 - DNA, 19 bp, Homo sapiens
tttgtcagagaagaaaaac

SEQ ID NO: 6597296 - DNA, 14 bp, Homo sapiens
tttgtcagcatctg

SEQ ID NO: 6597297 - DNA, 16 bp, Homo sapiens
tttgtcagtaaatact

SEQ ID NO: 6597298 - DNA, 23 bp, Homo sapiens
tttgtcagtgtagatcaactcat

SEQ ID NO: 6597299 - DNA, 12 bp, Homo sapiens
tttgtcagtgtt

SEQ ID NO: 6597300 - DNA, 18 bp, Homo sapiens
tttgtcataaaatgctat

SEQ ID NO: 6597301 - DNA, 19 bp, Homo sapiens
tttgtcatatattcatgta

SEQ ID NO: 6597302 - DNA, 17 bp, Homo sapiens
tttgtcatcagccacca

SEQ ID NO: 6597303 - DNA, 21 bp, Homo sapiens
tttgtcatgaattcttatgct

SEQ ID NO: 6597304 - DNA, 22 bp, Homo sapiens
tttgtcatgctgggatttccaa

SEQ ID NO: 6597305 - DNA, 12 bp, Homo sapiens
tttgtcatggtg

SEQ ID NO: 6597306 - DNA, 13 bp, Homo sapiens
tttgtcatggtga

SEQ ID NO: 6597307 - DNA, 14 bp, Homo sapiens
tttgtcatggtgaa

SEQ ID NO: 6597308 - DNA, 16 bp, Homo sapiens
tttgtcatggtgaaat

SEQ ID NO: 6597309 - DNA, 17 bp, Homo sapiens
tttgtcatggtgaaatt

SEQ ID NO: 6597310 - DNA, 16 bp, Homo sapiens
tttgtcatgttatgca

SEQ ID NO: 6597311 - DNA, 17 bp, Homo sapiens
tttgtcattaaaattgt

SEQ ID NO: 6597312 - DNA, 20 bp, Homo sapiens
tttgtcattagcctgagtag

SEQ ID NO: 6597313 - DNA, 12 bp, Homo sapiens
tttgtcattcag

SEQ ID NO: 6597314 - DNA, 14 bp, Homo sapiens
tttgtcattcagtt

SEQ ID NO: 6597315 - DNA, 17 bp, Homo sapiens
tttgtcattcagttcta

SEQ ID NO: 6597316 - DNA, 21 bp, Homo sapiens
tttgtcattttcattagcaaa

SEQ ID NO: 6597317 - DNA, 14 bp, Homo sapiens
tttgtcattttgaa

SEQ ID NO: 6597318 - DNA, 19 bp, Homo sapiens
tttgtcattttgaagctaa

SEQ ID NO: 6597319 - DNA, 20 bp, Homo sapiens
tttgtcattttgaagctaat

SEQ ID NO: 6597320 - DNA, 15 bp, Homo sapiens
tttgtccaaacaggt

SEQ ID NO: 6597321 - DNA, 18 bp, Homo sapiens
tttgtccaacaactgtca

SEQ ID NO: 6597322 - DNA, 22 bp, Homo sapiens
tttgtccaatggctgtaaacta

SEQ ID NO: 6597323 - DNA, 18 bp, Homo sapiens
tttgtccaattgtgtaga

SEQ ID NO: 6597324 - DNA, 20 bp, Homo sapiens
tttgtccaattgtgtagacg

SEQ ID NO: 6597325 - DNA, 16 bp, Homo sapiens
tttgtccaccattcct

SEQ ID NO: 6597326 - DNA, 13 bp, Homo sapiens
tttgtccacttca

SEQ ID NO: 6597327 - DNA, 12 bp, Homo sapiens
tttgtccatctt

SEQ ID NO: 6597328 - DNA, 16 bp, Homo sapiens
tttgtcccacagcttg

SEQ ID NO: 6597329 - DNA, 10 bp, Homo sapiens
tttgtcccag

SEQ ID NO: 6597330 - DNA, 13 bp, Homo sapiens
tttgtcccagcct

SEQ ID NO: 6597331 - DNA, 14 bp, Homo sapiens
tttgtcccagcctg

SEQ ID NO: 6597332 - DNA, 19 bp, Homo sapiens
tttgtcccagtcagaaata

SEQ ID NO: 6597333 - DNA, 20 bp, Homo sapiens
tttgtcccatttccttggag

SEQ ID NO: 6597334 - DNA, 14 bp, Homo sapiens
tttgtcccccaact

SEQ ID NO: 6597335 - DNA, 18 bp, Homo sapiens
tttgtcccccaacttgag

SEQ ID NO: 6597336 - DNA, 21 bp, Homo sapiens
tttgtcccccaacttgagatg

SEQ ID NO: 6597337 - DNA, 16 bp, Homo sapiens
tttgtccctgctcctc

SEQ ID NO: 6597338 - DNA, 13 bp, Homo sapiens
tttgtcccttcta

SEQ ID NO: 6597339 - DNA, 22 bp, Homo sapiens
tttgtccgattaatttgaaatc

SEQ ID NO: 6597340 - DNA, 22 bp, Homo sapiens
tttgtcctaagagatttatctt

SEQ ID NO: 6597341 - DNA, 13 bp, Homo sapiens
tttgtcctgcctc

SEQ ID NO: 6597342 - DNA, 22 bp, Homo sapiens
tttgtcctgcgttttctccggg

SEQ ID NO: 6597343 - DNA, 22 bp, Homo sapiens
tttgtccttggggacatctcat

SEQ ID NO: 6597344 - DNA, 19 bp, Homo sapiens
tttgtcctttgagaaagaa

SEQ ID NO: 6597345 - DNA, 21 bp, Homo sapiens
tttgtcctttgagaaagaaat

SEQ ID NO: 6597346 - DNA, 20 bp, Homo sapiens
tttgtcgaatttttattatt

SEQ ID NO: 6597347 - DNA, 22 bp, Homo sapiens
tttgtcgatatttccatcatta

SEQ ID NO: 6597348 - DNA, 18 bp, Homo sapiens
tttgtcgtggttcttaaa

SEQ ID NO: 6597349 - DNA, 19 bp, Homo sapiens
tttgtctaaaacaataaaa

SEQ ID NO: 6597350 - DNA, 16 bp, Homo sapiens
tttgtctaagaaacat

SEQ ID NO: 6597351 - DNA, 20 bp, Homo sapiens
tttgtctaagaaacattgga

SEQ ID NO: 6597352 - DNA, 21 bp, Homo sapiens
tttgtctacgtttagtttccg

SEQ ID NO: 6597353 - DNA, 14 bp, Homo sapiens
tttgtctatgaagt

SEQ ID NO: 6597354 - DNA, 17 bp, Homo sapiens
tttgtctatgaagttgc

SEQ ID NO: 6597355 - DNA, 16 bp, Homo sapiens
tttgtctcacttttca

SEQ ID NO: 6597356 - DNA, 12 bp, Homo sapiens
tttgtctcagat

SEQ ID NO: 6597357 - DNA, 14 bp, Homo sapiens
tttgtctcatccca

SEQ ID NO: 6597358 - DNA, 20 bp, Homo sapiens
tttgtctcattttgtatgta

SEQ ID NO: 6597359 - DNA, 23 bp, Homo sapiens
tttgtctcattttgtatgtatgt

SEQ ID NO: 6597360 - DNA, 12 bp, Homo sapiens
tttgtctcccag

SEQ ID NO: 6597361 - DNA, 20 bp, Homo sapiens
tttgtctcctactctgtgta

SEQ ID NO: 6597362 - DNA, 16 bp, Homo sapiens
tttgtctctccttttc

SEQ ID NO: 6597363 - DNA, 17 bp, Homo sapiens
tttgtctctccttttct

SEQ ID NO: 6597364 - DNA, 22 bp, Homo sapiens
tttgtctctccttttcttttgt

SEQ ID NO: 6597365 - DNA, 14 bp, Homo sapiens
tttgtctgaaaaat

SEQ ID NO: 6597366 - DNA, 12 bp, Homo sapiens
tttgtctgaaca

SEQ ID NO: 6597367 - DNA, 14 bp, Homo sapiens
tttgtctgaacaaa

SEQ ID NO: 6597368 - DNA, 15 bp, Homo sapiens
tttgtctgaaggatt

SEQ ID NO: 6597369 - DNA, 20 bp, Homo sapiens
tttgtctggactagaaaatc

SEQ ID NO: 6597370 - DNA, 22 bp, Homo sapiens
tttgtctggctgtggcccctcc

SEQ ID NO: 6597371 - DNA, 13 bp, Homo sapiens
tttgtctgtacat

SEQ ID NO: 6597372 - DNA, 14 bp, Homo sapiens
tttgtctgtacata

SEQ ID NO: 6597373 - DNA, 12 bp, Homo sapiens
tttgtctgtcca

SEQ ID NO: 6597374 - DNA, 13 bp, Homo sapiens
tttgtctgtgttg

SEQ ID NO: 6597375 - DNA, 18 bp, Homo sapiens
tttgtctgtgttgctgtt

SEQ ID NO: 6597376 - DNA, 21 bp, Homo sapiens
tttgtctgtttgtttcaagaa

SEQ ID NO: 6597377 - DNA, 12 bp, Homo sapiens
tttgtcttaaaa

SEQ ID NO: 6597378 - DNA, 14 bp, Homo sapiens
tttgtcttaagtgt

SEQ ID NO: 6597379 - DNA, 17 bp, Homo sapiens
tttgtcttaagtgtttc

SEQ ID NO: 6597380 - DNA, 18 bp, Homo sapiens
tttgtcttacattggctt

SEQ ID NO: 6597381 - DNA, 17 bp, Homo sapiens
tttgtcttagagagaga

SEQ ID NO: 6597382 - DNA, 14 bp, Homo sapiens
tttgtcttatatat

SEQ ID NO: 6597383 - DNA, 23 bp, Homo sapiens
tttgtcttatcccccccagcctg

SEQ ID NO: 6597384 - DNA, 16 bp, Homo sapiens
tttgtcttattcttaa

SEQ ID NO: 6597385 - DNA, 16 bp, Homo sapiens
tttgtcttattgaaaa

SEQ ID NO: 6597386 - DNA, 13 bp, Homo sapiens
tttgtcttcaact

SEQ ID NO: 6597387 - DNA, 13 bp, Homo sapiens
tttgtcttctata

SEQ ID NO: 6597388 - DNA, 15 bp, Homo sapiens
tttgtcttctcccca

SEQ ID NO: 6597389 - DNA, 13 bp, Homo sapiens
tttgtcttgaaaa

SEQ ID NO: 6597390 - DNA, 16 bp, Homo sapiens
tttgtcttgaatgtct

SEQ ID NO: 6597391 - DNA, 12 bp, Homo sapiens
tttgtcttgtac

SEQ ID NO: 6597392 - DNA, 13 bp, Homo sapiens
tttgtcttgtact

SEQ ID NO: 6597393 - DNA, 14 bp, Homo sapiens
tttgtcttgtactt

SEQ ID NO: 6597394 - DNA, 15 bp, Homo sapiens
tttgtctttaaacag

SEQ ID NO: 6597395 - DNA, 12 bp, Homo sapiens
tttgtctttcaa

SEQ ID NO: 6597396 - DNA, 17 bp, Homo sapiens
tttgtctttcaaattta

SEQ ID NO: 6597397 - DNA, 20 bp, Homo sapiens
tttgtctttctctcccttct

SEQ ID NO: 6597398 - DNA, 17 bp, Homo sapiens
tttgtcttttaatgctt

SEQ ID NO: 6597399 - DNA, 14 bp, Homo sapiens
tttgtctttttcct

SEQ ID NO: 6597400 - DNA, 13 bp, Homo sapiens
tttgtctttttgt

SEQ ID NO: 6597401 - DNA, 14 bp, Homo sapiens
tttgtgaaatttca

SEQ ID NO: 6597402 - DNA, 17 bp, Homo sapiens
tttgtgaaatttcatga

SEQ ID NO: 6597403 - DNA, 18 bp, Homo sapiens
tttgtgaactatatcagt

SEQ ID NO: 6597404 - DNA, 20 bp, Homo sapiens
tttgtgaactcagccaagca

SEQ ID NO: 6597405 - DNA, 12 bp, Homo sapiens
tttgtgaagaat

SEQ ID NO: 6597406 - DNA, 24 bp, Homo sapiens
tttgtgaaggcctcgcaggaagac

SEQ ID NO: 6597407 - DNA, 18 bp, Homo sapiens
tttgtgaagtattcacaa

SEQ ID NO: 6597408 - DNA, 23 bp, Homo sapiens
tttgtgaagtgaaggatttgtgt

SEQ ID NO: 6597409 - DNA, 19 bp, Homo sapiens
tttgtgaatggattggatt

SEQ ID NO: 6597410 - DNA, 12 bp, Homo sapiens
tttgtgaatttg

SEQ ID NO: 6597411 - DNA, 18 bp, Homo sapiens
tttgtgaccagaaagctt

SEQ ID NO: 6597412 - DNA, 14 bp, Homo sapiens
tttgtgactatata

SEQ ID NO: 6597413 - DNA, 23 bp, Homo sapiens
tttgtgactatatagagatgttt

SEQ ID NO: 6597414 - DNA, 20 bp, Homo sapiens
tttgtgagagcccagtcatt

SEQ ID NO: 6597415 - DNA, 12 bp, Homo sapiens
tttgtgagagcg

SEQ ID NO: 6597416 - DNA, 18 bp, Homo sapiens
tttgtgagccaaagagaa

SEQ ID NO: 6597417 - DNA, 20 bp, Homo sapiens
tttgtgagccttgctgccaa

SEQ ID NO: 6597418 - DNA, 22 bp, Homo sapiens
tttgtgagctttttgttccctc

SEQ ID NO: 6597419 - DNA, 18 bp, Homo sapiens
tttgtgaggaagccgctg

SEQ ID NO: 6597420 - DNA, 19 bp, Homo sapiens
tttgtgaggaagccgctgg

SEQ ID NO: 6597421 - DNA, 16 bp, Homo sapiens
tttgtgaggacctttg

SEQ ID NO: 6597422 - DNA, 18 bp, Homo sapiens
tttgtgaggtgaatgtct

SEQ ID NO: 6597423 - DNA, 13 bp, Homo sapiens
tttgtgagtatgt

SEQ ID NO: 6597424 - DNA, 16 bp, Homo sapiens
tttgtgagttagcatg

SEQ ID NO: 6597425 - DNA, 13 bp, Homo sapiens
tttgtgataattt

SEQ ID NO: 6597426 - DNA, 15 bp, Homo sapiens
tttgtgatacaatgc

SEQ ID NO: 6597427 - DNA, 22 bp, Homo sapiens
tttgtgatacaatgctgtgccc

SEQ ID NO: 6597428 - DNA, 20 bp, Homo sapiens
tttgtgatatgcacaatgta

SEQ ID NO: 6597429 - DNA, 22 bp, Homo sapiens
tttgtgatcagcattgtgactt

SEQ ID NO: 6597430 - DNA, 21 bp, Homo sapiens
tttgtgatgaatctacatttg

SEQ ID NO: 6597431 - DNA, 22 bp, Homo sapiens
tttgtgatgaatctacatttgt

SEQ ID NO: 6597432 - DNA, 15 bp, Homo sapiens
tttgtgatgcatttt

SEQ ID NO: 6597433 - DNA, 16 bp, Homo sapiens
tttgtgatgcatttta

SEQ ID NO: 6597434 - DNA, 12 bp, Homo sapiens
tttgtgattcca

SEQ ID NO: 6597435 - DNA, 21 bp, Homo sapiens
tttgtgcaaaagcttcaaatt

SEQ ID NO: 6597436 - DNA, 11 bp, Homo sapiens
tttgtgcacag

SEQ ID NO: 6597437 - DNA, 14 bp, Homo sapiens
tttgtgcagaatct

SEQ ID NO: 6597438 - DNA, 19 bp, Homo sapiens
tttgtgcattatctagata

SEQ ID NO: 6597439 - DNA, 13 bp, Homo sapiens
tttgtgcattctt

SEQ ID NO: 6597440 - DNA, 17 bp, Homo sapiens
tttgtgcattctttggt

SEQ ID NO: 6597441 - DNA, 13 bp, Homo sapiens
tttgtgcattttc

SEQ ID NO: 6597442 - DNA, 13 bp, Homo sapiens
tttgtgccagagg

SEQ ID NO: 6597443 - DNA, 20 bp, Homo sapiens
tttgtgccattatatttgca

SEQ ID NO: 6597444 - DNA, 12 bp, Homo sapiens
tttgtgccctat

SEQ ID NO: 6597445 - DNA, 16 bp, Homo sapiens
tttgtgcctttggcct

SEQ ID NO: 6597446 - DNA, 21 bp, Homo sapiens
tttgtgctccattttttcttc

SEQ ID NO: 6597447 - DNA, 22 bp, Homo sapiens
tttgtgctctttgttcatcatt

SEQ ID NO: 6597448 - DNA, 12 bp, Homo sapiens
tttgtgctgctg

SEQ ID NO: 6597449 - DNA, 14 bp, Homo sapiens
tttgtgcttcaaat

SEQ ID NO: 6597450 - DNA, 14 bp, Homo sapiens
tttgtgcttctaat

SEQ ID NO: 6597451 - DNA, 20 bp, Homo sapiens
tttgtgctttgaaaaaaagt

SEQ ID NO: 6597452 - DNA, 12 bp, Homo sapiens
tttgtgcttttt

SEQ ID NO: 6597453 - DNA, 17 bp, Homo sapiens
tttgtgctttttgtcat

SEQ ID NO: 6597454 - DNA, 21 bp, Homo sapiens
tttgtgctttttgtcatgtta

SEQ ID NO: 6597455 - DNA, 12 bp, Homo sapiens
tttgtggaataa

SEQ ID NO: 6597456 - DNA, 12 bp, Homo sapiens
tttgtggacttt

SEQ ID NO: 6597457 - DNA, 17 bp, Homo sapiens
tttgtggagtttgtatt

SEQ ID NO: 6597458 - DNA, 14 bp, Homo sapiens
tttgtggatgtctt

SEQ ID NO: 6597459 - DNA, 22 bp, Homo sapiens
tttgtggcagaagtgtttcatg

SEQ ID NO: 6597460 - DNA, 15 bp, Homo sapiens
tttgtggcctcagaa

SEQ ID NO: 6597461 - DNA, 12 bp, Homo sapiens
tttgtggcttct

SEQ ID NO: 6597462 - DNA, 14 bp, Homo sapiens
tttgtgggaattta

SEQ ID NO: 6597463 - DNA, 17 bp, Homo sapiens
tttgtgggaatttaaga

SEQ ID NO: 6597464 - DNA, 21 bp, Homo sapiens
tttgtggggacctcagcctgc

SEQ ID NO: 6597465 - DNA, 20 bp, Homo sapiens
tttgtggggcttggcgtgga

SEQ ID NO: 6597466 - DNA, 20 bp, Homo sapiens
tttgtgggggactgtaagtt

SEQ ID NO: 6597467 - DNA, 19 bp, Homo sapiens
tttgtgggtttctctgtgc

SEQ ID NO: 6597468 - DNA, 19 bp, Homo sapiens
tttgtggtaacttctttga

SEQ ID NO: 6597469 - DNA, 22 bp, Homo sapiens
tttgtggtaacttctttgaagt

SEQ ID NO: 6597470 - DNA, 22 bp, Homo sapiens
tttgtggtacgacctttagatt

SEQ ID NO: 6597471 - DNA, 16 bp, Homo sapiens
tttgtggtgatataga

SEQ ID NO: 6597472 - DNA, 13 bp, Homo sapiens
tttgtggtgtctt

SEQ ID NO: 6597473 - DNA, 14 bp, Homo sapiens
tttgtggttgcatg

SEQ ID NO: 6597474 - DNA, 16 bp, Homo sapiens
tttgtggttttatgga

SEQ ID NO: 6597475 - DNA, 16 bp, Homo sapiens
tttgtggttttgagaa

SEQ ID NO: 6597476 - DNA, 21 bp, Homo sapiens
tttgtgtaactcccagtgatg

SEQ ID NO: 6597477 - DNA, 12 bp, Homo sapiens
tttgtgtaataa

SEQ ID NO: 6597478 - DNA, 17 bp, Homo sapiens
tttgtgtaataaagtgt

SEQ ID NO: 6597479 - DNA, 23 bp, Homo sapiens
tttgtgtaatattactttaacat

SEQ ID NO: 6597480 - DNA, 16 bp, Homo sapiens
tttgtgtacagtatgt

SEQ ID NO: 6597481 - DNA, 17 bp, Homo sapiens
tttgtgtacagtatgtg

SEQ ID NO: 6597482 - DNA, 17 bp, Homo sapiens
tttgtgtacttttaaga

SEQ ID NO: 6597483 - DNA, 19 bp, Homo sapiens
tttgtgtatctcatttaat

SEQ ID NO: 6597484 - DNA, 13 bp, Homo sapiens
tttgtgtatgtac

SEQ ID NO: 6597485 - DNA, 12 bp, Homo sapiens
tttgtgtatgtt

SEQ ID NO: 6597486 - DNA, 15 bp, Homo sapiens
tttgtgtattaaatg

SEQ ID NO: 6597487 - DNA, 22 bp, Homo sapiens
tttgtgtattctgtggattcta

SEQ ID NO: 6597488 - DNA, 23 bp, Homo sapiens
tttgtgtattctgtggattctat

SEQ ID NO: 6597489 - DNA, 23 bp, Homo sapiens
tttgtgtcactgtacagttttgt

SEQ ID NO: 6597490 - DNA, 15 bp, Homo sapiens
tttgtgtcctttaaa

SEQ ID NO: 6597491 - DNA, 16 bp, Homo sapiens
tttgtgtcgtcttgaa

SEQ ID NO: 6597492 - DNA, 20 bp, Homo sapiens
tttgtgtctcttatggatgt

SEQ ID NO: 6597493 - DNA, 14 bp, Homo sapiens
tttgtgtctgactc

SEQ ID NO: 6597494 - DNA, 15 bp, Homo sapiens
tttgtgtctgcctgc

SEQ ID NO: 6597495 - DNA, 18 bp, Homo sapiens
tttgtgtctggtgcagaa

SEQ ID NO: 6597496 - DNA, 21 bp, Homo sapiens
tttgtgtgagacttaaaacat

SEQ ID NO: 6597497 - DNA, 22 bp, Homo sapiens
tttgtgtgagacttaaaacatg

SEQ ID NO: 6597498 - DNA, 16 bp, Homo sapiens
tttgtgtgatgcatgt

SEQ ID NO: 6597499 - DNA, 18 bp, Homo sapiens
tttgtgtgcttcacacaa

SEQ ID NO: 6597500 - DNA, 20 bp, Homo sapiens
tttgtgtggagtcatttctg

SEQ ID NO: 6597501 - DNA, 17 bp, Homo sapiens
tttgtgtggatatttat

SEQ ID NO: 6597502 - DNA, 14 bp, Homo sapiens
tttgtgtggctcct

SEQ ID NO: 6597503 - DNA, 14 bp, Homo sapiens
tttgtgtgtatata

SEQ ID NO: 6597504 - DNA, 15 bp, Homo sapiens
tttgtgtgtgtgtca

SEQ ID NO: 6597505 - DNA, 14 bp, Homo sapiens
tttgtgtgttatac

SEQ ID NO: 6597506 - DNA, 14 bp, Homo sapiens
tttgtgtgttatat

SEQ ID NO: 6597507 - DNA, 18 bp, Homo sapiens
tttgtgtgttgtcttgaa

SEQ ID NO: 6597508 - DNA, 19 bp, Homo sapiens
tttgtgtgttgtcttgaaa

SEQ ID NO: 6597509 - DNA, 14 bp, Homo sapiens
tttgtgtgtttcaa

SEQ ID NO: 6597510 - DNA, 14 bp, Homo sapiens
tttgtgttcctatg

SEQ ID NO: 6597511 - DNA, 17 bp, Homo sapiens
tttgtgttctgttttgt

SEQ ID NO: 6597512 - DNA, 20 bp, Homo sapiens
tttgtgttgttggaaaaagt

SEQ ID NO: 6597513 - DNA, 21 bp, Homo sapiens
tttgtgttgttggaaaaagtc

SEQ ID NO: 6597514 - DNA, 16 bp, Homo sapiens
tttgtgtttattcttg

SEQ ID NO: 6597515 - DNA, 22 bp, Homo sapiens
tttgtgtttcagccatgtattt

SEQ ID NO: 6597516 - DNA, 23 bp, Homo sapiens
tttgtgttttaaaaaaactgaag

SEQ ID NO: 6597517 - DNA, 22 bp, Homo sapiens
tttgtgtttttccaaaacttga

SEQ ID NO: 6597518 - DNA, 20 bp, Homo sapiens
tttgttaaaaatattttctg

SEQ ID NO: 6597519 - DNA, 22 bp, Homo sapiens
tttgttaaaattatcaatatct

SEQ ID NO: 6597520 - DNA, 22 bp, Homo sapiens
tttgttaaatatttacatatga

SEQ ID NO: 6597521 - DNA, 18 bp, Homo sapiens
tttgttaacagtatttct

SEQ ID NO: 6597522 - DNA, 15 bp, Homo sapiens
tttgttaaccttaaa

SEQ ID NO: 6597523 - DNA, 14 bp, Homo sapiens
tttgttaagaattt

SEQ ID NO: 6597524 - DNA, 17 bp, Homo sapiens
tttgttaagctcaggat

SEQ ID NO: 6597525 - DNA, 17 bp, Homo sapiens
tttgttaataaaatact

SEQ ID NO: 6597526 - DNA, 17 bp, Homo sapiens
tttgttaataaagtgca

SEQ ID NO: 6597527 - DNA, 23 bp, Homo sapiens
tttgttaatataccccaaattgt

SEQ ID NO: 6597528 - DNA, 16 bp, Homo sapiens
tttgttaatatttctt

SEQ ID NO: 6597529 - DNA, 16 bp, Homo sapiens
tttgttaatgaaaatg

SEQ ID NO: 6597530 - DNA, 13 bp, Homo sapiens
tttgttaatgatt

SEQ ID NO: 6597531 - DNA, 16 bp, Homo sapiens
tttgttaatgcattgt

SEQ ID NO: 6597532 - DNA, 16 bp, Homo sapiens
tttgttaattcttatt

SEQ ID NO: 6597533 - DNA, 23 bp, Homo sapiens
tttgttaatttagaaaactttaa

SEQ ID NO: 6597534 - DNA, 19 bp, Homo sapiens
tttgttacaataaaactaa

SEQ ID NO: 6597535 - DNA, 21 bp, Homo sapiens
tttgttacaataaaactaaat

SEQ ID NO: 6597536 - DNA, 21 bp, Homo sapiens
tttgttaccatactgtctctg

SEQ ID NO: 6597537 - DNA, 16 bp, Homo sapiens
tttgttaccttttaca

SEQ ID NO: 6597538 - DNA, 14 bp, Homo sapiens
tttgttactatgta

SEQ ID NO: 6597539 - DNA, 10 bp, Homo sapiens
tttgttactg

SEQ ID NO: 6597540 - DNA, 15 bp, Homo sapiens
tttgttactgtctgt

SEQ ID NO: 6597541 - DNA, 15 bp, Homo sapiens
tttgttactgttctt

SEQ ID NO: 6597542 - DNA, 16 bp, Homo sapiens
tttgttactgttcttg

SEQ ID NO: 6597543 - DNA, 19 bp, Homo sapiens
tttgttactgttcttgctg

SEQ ID NO: 6597544 - DNA, 17 bp, Homo sapiens
tttgttactttaaaaat

SEQ ID NO: 6597545 - DNA, 22 bp, Homo sapiens
tttgttactttacttttgctgt

SEQ ID NO: 6597546 - DNA, 17 bp, Homo sapiens
tttgttaggattttcac

SEQ ID NO: 6597547 - DNA, 16 bp, Homo sapiens
tttgttagtttacaat

SEQ ID NO: 6597548 - DNA, 13 bp, Homo sapiens
tttgttatacatt

SEQ ID NO: 6597549 - DNA, 20 bp, Homo sapiens
tttgttatagattgtcttaa

SEQ ID NO: 6597550 - DNA, 18 bp, Homo sapiens
tttgttatataatttaga

SEQ ID NO: 6597551 - DNA, 15 bp, Homo sapiens
tttgttatattttat

SEQ ID NO: 6597552 - DNA, 21 bp, Homo sapiens
tttgttatgtatatagatgtg

SEQ ID NO: 6597553 - DNA, 19 bp, Homo sapiens
tttgttatgtgtctggaag

SEQ ID NO: 6597554 - DNA, 16 bp, Homo sapiens
tttgttattcttaaga

SEQ ID NO: 6597555 - DNA, 20 bp, Homo sapiens
tttgttattttcagtatttt

SEQ ID NO: 6597556 - DNA, 15 bp, Homo sapiens
tttgttattttgcaa

SEQ ID NO: 6597557 - DNA, 22 bp, Homo sapiens
tttgttcaaagtctatttttat

SEQ ID NO: 6597558 - DNA, 21 bp, Homo sapiens
tttgttcaatgttccattctt

SEQ ID NO: 6597559 - DNA, 14 bp, Homo sapiens
tttgttcacactcc

SEQ ID NO: 6597560 - DNA, 15 bp, Homo sapiens
tttgttcaccttctg

SEQ ID NO: 6597561 - DNA, 17 bp, Homo sapiens
tttgttcaccttctgtg

SEQ ID NO: 6597562 - DNA, 19 bp, Homo sapiens
tttgttcaccttctgtgca

SEQ ID NO: 6597563 - DNA, 20 bp, Homo sapiens
tttgttcaccttctgtgcat

SEQ ID NO: 6597564 - DNA, 17 bp, Homo sapiens
tttgttcactgaaggtg

SEQ ID NO: 6597565 - DNA, 16 bp, Homo sapiens
tttgttcagctccccc

SEQ ID NO: 6597566 - DNA, 13 bp, Homo sapiens
tttgttcatacat

SEQ ID NO: 6597567 - DNA, 16 bp, Homo sapiens
tttgttcatacatatt

SEQ ID NO: 6597568 - DNA, 14 bp, Homo sapiens
tttgttcatattaa

SEQ ID NO: 6597569 - DNA, 15 bp, Homo sapiens
tttgttcatattaag

SEQ ID NO: 6597570 - DNA, 19 bp, Homo sapiens
tttgttcatcctattgttg

SEQ ID NO: 6597571 - DNA, 12 bp, Homo sapiens
tttgttcatctg

SEQ ID NO: 6597572 - DNA, 15 bp, Homo sapiens
tttgttcatgtttgg

SEQ ID NO: 6597573 - DNA, 10 bp, Homo sapiens
tttgttcatt

SEQ ID NO: 6597574 - DNA, 20 bp, Homo sapiens
tttgttccaacagttaaact

SEQ ID NO: 6597575 - DNA, 14 bp, Homo sapiens
tttgttcccatcct

SEQ ID NO: 6597576 - DNA, 17 bp, Homo sapiens
tttgttccccactggag

SEQ ID NO: 6597577 - DNA, 12 bp, Homo sapiens
tttgttcccctc

SEQ ID NO: 6597578 - DNA, 16 bp, Homo sapiens
tttgttcccctcctcc

SEQ ID NO: 6597579 - DNA, 13 bp, Homo sapiens
tttgttcccggct

SEQ ID NO: 6597580 - DNA, 22 bp, Homo sapiens
tttgttccctcattctgcatta

SEQ ID NO: 6597581 - DNA, 10 bp, Homo sapiens
tttgttcctg

SEQ ID NO: 6597582 - DNA, 12 bp, Homo sapiens
tttgttcctgtg

SEQ ID NO: 6597583 - DNA, 13 bp, Homo sapiens
tttgttcctgttt

SEQ ID NO: 6597584 - DNA, 15 bp, Homo sapiens
tttgttcctgtttat

SEQ ID NO: 6597585 - DNA, 14 bp, Homo sapiens
tttgttctacatga

SEQ ID NO: 6597586 - DNA, 12 bp, Homo sapiens
tttgttctccta

SEQ ID NO: 6597587 - DNA, 23 bp, Homo sapiens
tttgttctcctaatgctctgaaa

SEQ ID NO: 6597588 - DNA, 22 bp, Homo sapiens
tttgttctgctacccactgcca

SEQ ID NO: 6597589 - DNA, 12 bp, Homo sapiens
tttgttctgtat

SEQ ID NO: 6597590 - DNA, 13 bp, Homo sapiens
tttgttctgtttt

SEQ ID NO: 6597591 - DNA, 23 bp, Homo sapiens
tttgttcttaaaaaaataaaata

SEQ ID NO: 6597592 - DNA, 18 bp, Homo sapiens
tttgttcttaaaaatgca

SEQ ID NO: 6597593 - DNA, 12 bp, Homo sapiens
tttgttcttaca

SEQ ID NO: 6597594 - DNA, 13 bp, Homo sapiens
tttgttcttatga

SEQ ID NO: 6597595 - DNA, 13 bp, Homo sapiens
tttgttcttcaga

SEQ ID NO: 6597596 - DNA, 24 bp, Homo sapiens
tttgttcttgtattttaataaact

SEQ ID NO: 6597597 - DNA, 19 bp, Homo sapiens
tttgttctttatgtagaat

SEQ ID NO: 6597598 - DNA, 15 bp, Homo sapiens
tttgttctttatttg

SEQ ID NO: 6597599 - DNA, 20 bp, Homo sapiens
tttgttgacagcaaaatgtt

SEQ ID NO: 6597600 - DNA, 15 bp, Homo sapiens
tttgttgacattctg

SEQ ID NO: 6597601 - DNA, 16 bp, Homo sapiens
tttgttgacattctga

SEQ ID NO: 6597602 - DNA, 20 bp, Homo sapiens
tttgttgaccattttgttaa

SEQ ID NO: 6597603 - DNA, 21 bp, Homo sapiens
tttgttgcactgaagtttgat

SEQ ID NO: 6597604 - DNA, 15 bp, Homo sapiens
tttgttgcccaggct

SEQ ID NO: 6597605 - DNA, 21 bp, Homo sapiens
tttgttgcctacctagctgca

SEQ ID NO: 6597606 - DNA, 16 bp, Homo sapiens
tttgttgctgctgctg

SEQ ID NO: 6597607 - DNA, 17 bp, Homo sapiens
tttgttgctgttgttca

SEQ ID NO: 6597608 - DNA, 18 bp, Homo sapiens
tttgttgctttcttacct

SEQ ID NO: 6597609 - DNA, 19 bp, Homo sapiens
tttgttgcttttttagatt

SEQ ID NO: 6597610 - DNA, 12 bp, Homo sapiens
tttgttgtaaaa

SEQ ID NO: 6597611 - DNA, 15 bp, Homo sapiens
tttgttgtaaaaaga

SEQ ID NO: 6597612 - DNA, 17 bp, Homo sapiens
tttgttgtaaagagttg

SEQ ID NO: 6597613 - DNA, 22 bp, Homo sapiens
tttgttgtactttttattcaat

SEQ ID NO: 6597614 - DNA, 12 bp, Homo sapiens
tttgttgtagat

SEQ ID NO: 6597615 - DNA, 15 bp, Homo sapiens
tttgttgtagatgct

SEQ ID NO: 6597616 - DNA, 15 bp, Homo sapiens
tttgttgtctacatt

SEQ ID NO: 6597617 - DNA, 22 bp, Homo sapiens
tttgttgtctacattaaatcac

SEQ ID NO: 6597618 - DNA, 13 bp, Homo sapiens
tttgttgtgactg

SEQ ID NO: 6597619 - DNA, 22 bp, Homo sapiens
tttgttgtgattttgtacagaa

SEQ ID NO: 6597620 - DNA, 22 bp, Homo sapiens
tttgttgtggccaatgtcgaaa

SEQ ID NO: 6597621 - DNA, 13 bp, Homo sapiens
tttgttgtgtgcc

SEQ ID NO: 6597622 - DNA, 23 bp, Homo sapiens
tttgttgtgtgcctctagctgaa

SEQ ID NO: 6597623 - DNA, 18 bp, Homo sapiens
tttgttgtgttctgttga

SEQ ID NO: 6597624 - DNA, 10 bp, Homo sapiens
tttgttgtta

SEQ ID NO: 6597625 - DNA, 15 bp, Homo sapiens
tttgttgttaatatg

SEQ ID NO: 6597626 - DNA, 13 bp, Homo sapiens
tttgttgttgttg

SEQ ID NO: 6597627 - DNA, 22 bp, Homo sapiens
tttgttgtttcttaatttggaa

SEQ ID NO: 6597628 - DNA, 12 bp, Homo sapiens
tttgttgtttgg

SEQ ID NO: 6597629 - DNA, 14 bp, Homo sapiens
tttgtttaaaagga

SEQ ID NO: 6597630 - DNA, 14 bp, Homo sapiens
tttgtttaaaattc

SEQ ID NO: 6597631 - DNA, 22 bp, Homo sapiens
tttgtttaaatgccaaaatgta

SEQ ID NO: 6597632 - DNA, 20 bp, Homo sapiens
tttgtttaagctgagccacg

SEQ ID NO: 6597633 - DNA, 17 bp, Homo sapiens
tttgtttaatgtgaact

SEQ ID NO: 6597634 - DNA, 15 bp, Homo sapiens
tttgtttataatgtt

SEQ ID NO: 6597635 - DNA, 19 bp, Homo sapiens
tttgtttatatcactgtct

SEQ ID NO: 6597636 - DNA, 18 bp, Homo sapiens
tttgtttattagatgaat

SEQ ID NO: 6597637 - DNA, 21 bp, Homo sapiens
tttgtttcaagaacctggaaa

SEQ ID NO: 6597638 - DNA, 22 bp, Homo sapiens
tttgtttcaatgaggtgtccaa

SEQ ID NO: 6597639 - DNA, 13 bp, Homo sapiens
tttgtttcactgg

SEQ ID NO: 6597640 - DNA, 12 bp, Homo sapiens
tttgtttcccta

SEQ ID NO: 6597641 - DNA, 14 bp, Homo sapiens
tttgtttcctttgt

SEQ ID NO: 6597642 - DNA, 12 bp, Homo sapiens
tttgtttctcat

SEQ ID NO: 6597643 - DNA, 21 bp, Homo sapiens
tttgtttctgttgttcacttg

SEQ ID NO: 6597644 - DNA, 12 bp, Homo sapiens
tttgtttcttct

SEQ ID NO: 6597645 - DNA, 14 bp, Homo sapiens
tttgtttcttcttt

SEQ ID NO: 6597646 - DNA, 12 bp, Homo sapiens
tttgtttcttga

SEQ ID NO: 6597647 - DNA, 18 bp, Homo sapiens
tttgtttgaactgataaa

SEQ ID NO: 6597648 - DNA, 13 bp, Homo sapiens
tttgtttgctatc

SEQ ID NO: 6597649 - DNA, 12 bp, Homo sapiens
aattctgtccct

SEQ ID NO: 6597650 - DNA, 18 bp, Homo sapiens
aattctgtccctgtccct

SEQ ID NO: 6597651 - DNA, 22 bp, Homo sapiens
aattctgtccctgtccctgccc

SEQ ID NO: 6597652 - DNA, 13 bp, Homo sapiens
aattctgtgaaga

SEQ ID NO: 6597653 - DNA, 15 bp, Homo sapiens
aattctgtgaagaat

SEQ ID NO: 6597654 - DNA, 20 bp, Homo sapiens
aattctgtgaagaatgaagt

SEQ ID NO: 6597655 - DNA, 16 bp, Homo sapiens
aattctgttacacaat

SEQ ID NO: 6597656 - DNA, 18 bp, Homo sapiens
aattctgttactttgcta

SEQ ID NO: 6597657 - DNA, 20 bp, Homo sapiens
aattctgttagctgctcact

SEQ ID NO: 6597658 - DNA, 16 bp, Homo sapiens
aattctgttcatttgt

SEQ ID NO: 6597659 - DNA, 17 bp, Homo sapiens
aattctgttcatttgtt

SEQ ID NO: 6597660 - DNA, 18 bp, Homo sapiens
aattctgttcatttgtta

SEQ ID NO: 6597661 - DNA, 18 bp, Homo sapiens
aattctgttgtaatttaa

SEQ ID NO: 6597662 - DNA, 22 bp, Homo sapiens
aattctgttgttccattttatg

SEQ ID NO: 6597663 - DNA, 15 bp, Homo sapiens
aattctgtttaattt

SEQ ID NO: 6597664 - DNA, 17 bp, Homo sapiens
aattctgtttttaaaaa

SEQ ID NO: 6597665 - DNA, 20 bp, Homo sapiens
aattctgtttttaaaaatta

SEQ ID NO: 6597666 - DNA, 19 bp, Homo sapiens
aattctgtttttaatgcta

SEQ ID NO: 6597667 - DNA, 22 bp, Homo sapiens
aattctgtttttaatgctattt

SEQ ID NO: 6597668 - DNA, 20 bp, Homo sapiens
aattcttaaaaaattgaaaa

SEQ ID NO: 6597669 - DNA, 17 bp, Homo sapiens
aattcttaaaactataa

SEQ ID NO: 6597670 - DNA, 23 bp, Homo sapiens
aattcttaaaaggcccatagcag

SEQ ID NO: 6597671 - DNA, 13 bp, Homo sapiens
aattcttaaatat

SEQ ID NO: 6597672 - DNA, 15 bp, Homo sapiens
aattcttaaatttct

SEQ ID NO: 6597673 - DNA, 16 bp, Homo sapiens
aattcttaagtatgtt

SEQ ID NO: 6597674 - DNA, 22 bp, Homo sapiens
aattcttaatttggatctattt

SEQ ID NO: 6597675 - DNA, 23 bp, Homo sapiens
aattcttacactgcctgtatact

SEQ ID NO: 6597676 - DNA, 13 bp, Homo sapiens
aattcttacatgt

SEQ ID NO: 6597677 - DNA, 19 bp, Homo sapiens
aattcttaccgaaatgaaa

SEQ ID NO: 6597678 - DNA, 14 bp, Homo sapiens
aattcttacctcat

SEQ ID NO: 6597679 - DNA, 23 bp, Homo sapiens
aattcttacctcatttgcatcct

SEQ ID NO: 6597680 - DNA, 13 bp, Homo sapiens
aattcttactctg

SEQ ID NO: 6597681 - DNA, 18 bp, Homo sapiens
aattcttactgttctgaa

SEQ ID NO: 6597682 - DNA, 21 bp, Homo sapiens
aattcttactgttctgaaatt

SEQ ID NO: 6597683 - DNA, 22 bp, Homo sapiens
aattcttatgactaaattttct

SEQ ID NO: 6597684 - DNA, 14 bp, Homo sapiens
aattcttatgctta

SEQ ID NO: 6597685 - DNA, 15 bp, Homo sapiens
aattcttatgcttat

SEQ ID NO: 6597686 - DNA, 22 bp, Homo sapiens
aattcttattggccaaatgcct

SEQ ID NO: 6597687 - DNA, 15 bp, Homo sapiens
aattcttatttcccc

SEQ ID NO: 6597688 - DNA, 20 bp, Homo sapiens
aattcttatttcccctttcc

SEQ ID NO: 6597689 - DNA, 13 bp, Homo sapiens
aattcttattttg

SEQ ID NO: 6597690 - DNA, 19 bp, Homo sapiens
aattcttcaacagggaaaa

SEQ ID NO: 6597691 - DNA, 22 bp, Homo sapiens
aattcttcaacagggaaaacag

SEQ ID NO: 6597692 - DNA, 19 bp, Homo sapiens
aattcttcagcgtaaaatg

SEQ ID NO: 6597693 - DNA, 18 bp, Homo sapiens
aattcttcattatagtaa

SEQ ID NO: 6597694 - DNA, 21 bp, Homo sapiens
aattcttccagtgcaacaaaa

SEQ ID NO: 6597695 - DNA, 19 bp, Homo sapiens
aattcttcctctccttccc

SEQ ID NO: 6597696 - DNA, 23 bp, Homo sapiens
aattcttccttccctccttttaa

SEQ ID NO: 6597697 - DNA, 18 bp, Homo sapiens
aattcttctgaactcaaa

SEQ ID NO: 6597698 - DNA, 23 bp, Homo sapiens
aattcttctgttctctggtttca

SEQ ID NO: 6597699 - DNA, 16 bp, Homo sapiens
aattcttgaaggaaaa

SEQ ID NO: 6597700 - DNA, 12 bp, Homo sapiens
aattcttgagaa

SEQ ID NO: 6597701 - DNA, 18 bp, Homo sapiens
aattcttgagaagtaact

SEQ ID NO: 6597702 - DNA, 13 bp, Homo sapiens
aattcttgataaa

SEQ ID NO: 6597703 - DNA, 22 bp, Homo sapiens
aattcttgcactgtatccaagt

SEQ ID NO: 6597704 - DNA, 16 bp, Homo sapiens
aattcttgtatattat

SEQ ID NO: 6597705 - DNA, 20 bp, Homo sapiens
aattcttgtatattatggaa

SEQ ID NO: 6597706 - DNA, 17 bp, Homo sapiens
aattctttacaataaac

SEQ ID NO: 6597707 - DNA, 20 bp, Homo sapiens
aattctttatacaacagtgc

SEQ ID NO: 6597708 - DNA, 19 bp, Homo sapiens
aattctttatcacatgttg

SEQ ID NO: 6597709 - DNA, 20 bp, Homo sapiens
aattctttcaatacagatat

SEQ ID NO: 6597710 - DNA, 19 bp, Homo sapiens
aattctttcaattcttcat

SEQ ID NO: 6597711 - DNA, 13 bp, Homo sapiens
aattctttcatga

SEQ ID NO: 6597712 - DNA, 14 bp, Homo sapiens
aattctttcatttt

SEQ ID NO: 6597713 - DNA, 17 bp, Homo sapiens
aattctttctattttca

SEQ ID NO: 6597714 - DNA, 11 bp, Homo sapiens
aattctttctg

SEQ ID NO: 6597715 - DNA, 17 bp, Homo sapiens
aattctttctgtctccc

SEQ ID NO: 6597716 - DNA, 22 bp, Homo sapiens
aattctttgacctgttgggagt

SEQ ID NO: 6597717 - DNA, 17 bp, Homo sapiens
aattctttgcaaaaatc

SEQ ID NO: 6597718 - DNA, 14 bp, Homo sapiens
aattctttgttctg

SEQ ID NO: 6597719 - DNA, 17 bp, Homo sapiens
aattctttgttctgttt

SEQ ID NO: 6597720 - DNA, 23 bp, Homo sapiens
aattctttgttgcttaatctaga

SEQ ID NO: 6597721 - DNA, 15 bp, Homo sapiens
aattcttttcaaaat

SEQ ID NO: 6597722 - DNA, 19 bp, Homo sapiens
aattcttttcaaaattgtt

SEQ ID NO: 6597723 - DNA, 15 bp, Homo sapiens
aattcttttcccaga

SEQ ID NO: 6597724 - DNA, 12 bp, Homo sapiens
aattctttttgg

SEQ ID NO: 6597725 - DNA, 18 bp, Homo sapiens
aattcttttttaaatttt

SEQ ID NO: 6597726 - DNA, 17 bp, Homo sapiens
aattcttttttattaat

SEQ ID NO: 6597727 - DNA, 21 bp, Homo sapiens
aattcttttttattaatcact

SEQ ID NO: 6597728 - DNA, 18 bp, Homo sapiens
aattctttttttattatt

SEQ ID NO: 6597729 - DNA, 20 bp, Homo sapiens
aattctttttttattattat

SEQ ID NO: 6597730 - DNA, 13 bp, Homo sapiens
aattgaaaaacaa

SEQ ID NO: 6597731 - DNA, 20 bp, Homo sapiens
aattgaaaaataaaaaccat

SEQ ID NO: 6597732 - DNA, 12 bp, Homo sapiens
aattgaaaacac

SEQ ID NO: 6597733 - DNA, 15 bp, Homo sapiens
aattgaaaagaagta

SEQ ID NO: 6597734 - DNA, 16 bp, Homo sapiens
aattgaaaagaagtag

SEQ ID NO: 6597735 - DNA, 20 bp, Homo sapiens
aattgaaaagtgttctgtgc

SEQ ID NO: 6597736 - DNA, 14 bp, Homo sapiens
aattgaaaagttat

SEQ ID NO: 6597737 - DNA, 14 bp, Homo sapiens
aattgaaaatgcat

SEQ ID NO: 6597738 - DNA, 21 bp, Homo sapiens
aattgaaaatgcattagggaa

SEQ ID NO: 6597739 - DNA, 18 bp, Homo sapiens
aattgaaacaacattatt

SEQ ID NO: 6597740 - DNA, 13 bp, Homo sapiens
aattgaaacactt

SEQ ID NO: 6597741 - DNA, 15 bp, Homo sapiens
aattgaaacactttt

SEQ ID NO: 6597742 - DNA, 14 bp, Homo sapiens
aattgaaagaactt

SEQ ID NO: 6597743 - DNA, 16 bp, Homo sapiens
aattgaaagaacttaa

SEQ ID NO: 6597744 - DNA, 21 bp, Homo sapiens
aattgaaagaacttaagtctc

SEQ ID NO: 6597745 - DNA, 16 bp, Homo sapiens
aattgaaagagaattt

SEQ ID NO: 6597746 - DNA, 23 bp, Homo sapiens
aattgaaagcactatgaatttgt

SEQ ID NO: 6597747 - DNA, 22 bp, Homo sapiens
aattgaaaggcattctctgaag

SEQ ID NO: 6597748 - DNA, 15 bp, Homo sapiens
aattgaaagggacaa

SEQ ID NO: 6597749 - DNA, 21 bp, Homo sapiens
aattgaaagggacaagtatca

SEQ ID NO: 6597750 - DNA, 13 bp, Homo sapiens
aattgaaagtatt

SEQ ID NO: 6597751 - DNA, 15 bp, Homo sapiens
aattgaaagtattca

SEQ ID NO: 6597752 - DNA, 18 bp, Homo sapiens
aattgaaagtattcagaa

SEQ ID NO: 6597753 - DNA, 19 bp, Homo sapiens
aattgaaagtattcagaaa

SEQ ID NO: 6597754 - DNA, 12 bp, Homo sapiens
aattgaaatata

SEQ ID NO: 6597755 - DNA, 12 bp, Homo sapiens
aattgaaatgta

SEQ ID NO: 6597756 - DNA, 15 bp, Homo sapiens
aattgaaatgtaagg

SEQ ID NO: 6597757 - DNA, 24 bp, Homo sapiens
aattgaaatgtaaggctgtgtaag

SEQ ID NO: 6597758 - DNA, 12 bp, Homo sapiens
aattgaaatttt

SEQ ID NO: 6597759 - DNA, 14 bp, Homo sapiens
aattgaaattttat

SEQ ID NO: 6597760 - DNA, 17 bp, Homo sapiens
aattgaaattttattta

SEQ ID NO: 6597761 - DNA, 13 bp, Homo sapiens
aattgaacctttg

SEQ ID NO: 6597762 - DNA, 21 bp, Homo sapiens
aattgaacgactgtatattgc

SEQ ID NO: 6597763 - DNA, 23 bp, Homo sapiens
aattgaacgactgtatattgcta

SEQ ID NO: 6597764 - DNA, 23 bp, Homo sapiens
aattgaactctctgcctgtaaat

SEQ ID NO: 6597765 - DNA, 22 bp, Homo sapiens
aattgaacttaaataaatgtca

SEQ ID NO: 6597766 - DNA, 14 bp, Homo sapiens
aattgaacttccca

SEQ ID NO: 6597767 - DNA, 18 bp, Homo sapiens
aattgaagaactgcactt

SEQ ID NO: 6597768 - DNA, 11 bp, Homo sapiens
aattgaagaat

SEQ ID NO: 6597769 - DNA, 14 bp, Homo sapiens
aattgaagatgtaa

SEQ ID NO: 6597770 - DNA, 17 bp, Homo sapiens
aattgaagcatgaacgt

SEQ ID NO: 6597771 - DNA, 18 bp, Homo sapiens
aattgaagctttttaaaa

SEQ ID NO: 6597772 - DNA, 20 bp, Homo sapiens
aattgaaggagaaaatgcat

SEQ ID NO: 6597773 - DNA, 16 bp, Homo sapiens
aattgaaggtttttga

SEQ ID NO: 6597774 - DNA, 19 bp, Homo sapiens
aattgaagtcccaatttaa

SEQ ID NO: 6597775 - DNA, 16 bp, Homo sapiens
aattgaagtgtcttct

SEQ ID NO: 6597776 - DNA, 16 bp, Homo sapiens
aattgaatactttgaa

SEQ ID NO: 6597777 - DNA, 18 bp, Homo sapiens
aattgaatactttgaatg

SEQ ID NO: 6597778 - DNA, 20 bp, Homo sapiens
aattgaatagtttatttctg

SEQ ID NO: 6597779 - DNA, 23 bp, Homo sapiens
aattgaatagtttatttctgtga

SEQ ID NO: 6597780 - DNA, 22 bp, Homo sapiens
aattgaatcactgctcacactg

SEQ ID NO: 6597781 - DNA, 19 bp, Homo sapiens
aattgaatggtcagcgttg

SEQ ID NO: 6597782 - DNA, 21 bp, Homo sapiens
aattgaatgtaccttatttaa

SEQ ID NO: 6597783 - DNA, 21 bp, Homo sapiens
aattgaatgtcaatatgagat

SEQ ID NO: 6597784 - DNA, 17 bp, Homo sapiens
aattgaattggaaagac

SEQ ID NO: 6597785 - DNA, 23 bp, Homo sapiens
aattgaattggaaagacttctca

SEQ ID NO: 6597786 - DNA, 15 bp, Homo sapiens
aattgaatttaacaa

SEQ ID NO: 6597787 - DNA, 16 bp, Homo sapiens
aattgaatttaacaat

SEQ ID NO: 6597788 - DNA, 21 bp, Homo sapiens
aattgaatttaacaatgcgaa

SEQ ID NO: 6597789 - DNA, 20 bp, Homo sapiens
aattgaattttcaagcatct

SEQ ID NO: 6597790 - DNA, 21 bp, Homo sapiens
aattgaattttcaagcatctc

SEQ ID NO: 6597791 - DNA, 15 bp, Homo sapiens
aattgacaaatgatg

SEQ ID NO: 6597792 - DNA, 17 bp, Homo sapiens
aattgacaacccaaact

SEQ ID NO: 6597793 - DNA, 21 bp, Homo sapiens
aattgacagatcaagctgtga

SEQ ID NO: 6597794 - DNA, 21 bp, Homo sapiens
aattgacataggcaataataa

SEQ ID NO: 6597795 - DNA, 15 bp, Homo sapiens
aattgacattccttt

SEQ ID NO: 6597796 - DNA, 16 bp, Homo sapiens
aattgacattctctat

SEQ ID NO: 6597797 - DNA, 19 bp, Homo sapiens
aattgaccatctgctttta

SEQ ID NO: 6597798 - DNA, 22 bp, Homo sapiens
aattgacccacaagaaatgaaa

SEQ ID NO: 6597799 - DNA, 21 bp, Homo sapiens
aattgacctcaaaagaaaatg

SEQ ID NO: 6597800 - DNA, 19 bp, Homo sapiens
aattgacctgatttccatt

SEQ ID NO: 6597801 - DNA, 11 bp, Homo sapiens
aattgactacc

SEQ ID NO: 6597802 - DNA, 12 bp, Homo sapiens
aattgactgaaa

SEQ ID NO: 6597803 - DNA, 20 bp, Homo sapiens
aattgactgaaattacttta

SEQ ID NO: 6597804 - DNA, 22 bp, Homo sapiens
aattgactgaaattactttaac

SEQ ID NO: 6597805 - DNA, 17 bp, Homo sapiens
aattgacttagatatta

SEQ ID NO: 6597806 - DNA, 14 bp, Homo sapiens
aattgacttattta

SEQ ID NO: 6597807 - DNA, 15 bp, Homo sapiens
aattgacttcagcag

SEQ ID NO: 6597808 - DNA, 23 bp, Homo sapiens
aattgacttcagcaggggtggga

SEQ ID NO: 6597809 - DNA, 22 bp, Homo sapiens
aattgacttcttgcttgtacat

SEQ ID NO: 6597810 - DNA, 21 bp, Homo sapiens
aattgagaactacagctttta

SEQ ID NO: 6597811 - DNA, 16 bp, Homo sapiens
aattgagactgaaaga

SEQ ID NO: 6597812 - DNA, 23 bp, Homo sapiens
aattgagagctttattgctgcat

SEQ ID NO: 6597813 - DNA, 20 bp, Homo sapiens
aattgagataatatctgtga

SEQ ID NO: 6597814 - DNA, 19 bp, Homo sapiens
aattgagataatgatactt

SEQ ID NO: 6597815 - DNA, 19 bp, Homo sapiens
aattgagcctgtgcctggc

SEQ ID NO: 6597816 - DNA, 14 bp, Homo sapiens
aattgagctagaaa

SEQ ID NO: 6597817 - DNA, 18 bp, Homo sapiens
aattgagctgcagaaacg

SEQ ID NO: 6597818 - DNA, 22 bp, Homo sapiens
aattgagctgctttttttgaaa

SEQ ID NO: 6597819 - DNA, 23 bp, Homo sapiens
aattgagctgctttttttgaaac

SEQ ID NO: 6597820 - DNA, 18 bp, Homo sapiens
aattgaggacactgatat

SEQ ID NO: 6597821 - DNA, 14 bp, Homo sapiens
aattgaggtctgct

SEQ ID NO: 6597822 - DNA, 19 bp, Homo sapiens
aattgaggtctgctcggcc

SEQ ID NO: 6597823 - DNA, 20 bp, Homo sapiens
aattgaggttgttcaaagtt

SEQ ID NO: 6597824 - DNA, 16 bp, Homo sapiens
aattgagtaatggtgt

SEQ ID NO: 6597825 - DNA, 21 bp, Homo sapiens
aattgagtaatggtgtagaac

SEQ ID NO: 6597826 - DNA, 13 bp, Homo sapiens
tttgtttgctgct

SEQ ID NO: 6597827 - DNA, 21 bp, Homo sapiens
tttgtttggatgtaatttagg

SEQ ID NO: 6597828 - DNA, 14 bp, Homo sapiens
tttgtttggcactg

SEQ ID NO: 6597829 - DNA, 20 bp, Homo sapiens
tttgtttggttttacatttt

SEQ ID NO: 6597830 - DNA, 13 bp, Homo sapiens
tttgtttgtaatc

SEQ ID NO: 6597831 - DNA, 12 bp, Homo sapiens
tttgtttgtctg

SEQ ID NO: 6597832 - DNA, 14 bp, Homo sapiens
tttgtttgtgttta

SEQ ID NO: 6597833 - DNA, 15 bp, Homo sapiens
tttgtttgtgtttat

SEQ ID NO: 6597834 - DNA, 11 bp, Homo sapiens
tttgtttgttt

SEQ ID NO: 6597835 - DNA, 15 bp, Homo sapiens
tttgtttgttttcct

SEQ ID NO: 6597836 - DNA, 23 bp, Homo sapiens
tttgttttaaaacgtgtaaatga

SEQ ID NO: 6597837 - DNA, 20 bp, Homo sapiens
tttgttttaaccaataacta

SEQ ID NO: 6597838 - DNA, 20 bp, Homo sapiens
tttgttttaaggaaaaaaga

SEQ ID NO: 6597839 - DNA, 12 bp, Homo sapiens
tttgttttactt

SEQ ID NO: 6597840 - DNA, 15 bp, Homo sapiens
tttgttttagaacca

SEQ ID NO: 6597841 - DNA, 13 bp, Homo sapiens
tttgttttagcat

SEQ ID NO: 6597842 - DNA, 24 bp, Homo sapiens
tttgttttatttttttaccaattc

SEQ ID NO: 6597843 - DNA, 14 bp, Homo sapiens
tttgttttcatggt

SEQ ID NO: 6597844 - DNA, 17 bp, Homo sapiens
tttgttttcattaaaga

SEQ ID NO: 6597845 - DNA, 19 bp, Homo sapiens
tttgttttcccacacatat

SEQ ID NO: 6597846 - DNA, 15 bp, Homo sapiens
tttgttttcgatgag

SEQ ID NO: 6597847 - DNA, 13 bp, Homo sapiens
tttgttttcttca

SEQ ID NO: 6597848 - DNA, 14 bp, Homo sapiens
tttgttttgaaagt

SEQ ID NO: 6597849 - DNA, 13 bp, Homo sapiens
tttgttttgtgtc

SEQ ID NO: 6597850 - DNA, 16 bp, Homo sapiens
tttgttttgttgctca

SEQ ID NO: 6597851 - DNA, 15 bp, Homo sapiens
tttgttttgtttaca

SEQ ID NO: 6597852 - DNA, 17 bp, Homo sapiens
tttgttttgtttttaca

SEQ ID NO: 6597853 - DNA, 16 bp, Homo sapiens
tttgtttttaaactgt

SEQ ID NO: 6597854 - DNA, 19 bp, Homo sapiens
tttgtttttaaactgtaca

SEQ ID NO: 6597855 - DNA, 20 bp, Homo sapiens
tttgtttttaaactgtacag

SEQ ID NO: 6597856 - DNA, 21 bp, Homo sapiens
tttgtttttaaactgtacagt

SEQ ID NO: 6597857 - DNA, 12 bp, Homo sapiens
tttgtttttact

SEQ ID NO: 6597858 - DNA, 14 bp, Homo sapiens
tttgtttttattct

SEQ ID NO: 6597859 - DNA, 21 bp, Homo sapiens
tttgtttttcaagaaatgatt

SEQ ID NO: 6597860 - DNA, 14 bp, Homo sapiens
tttgtttttcattc

SEQ ID NO: 6597861 - DNA, 14 bp, Homo sapiens
tttgtttttctcac

SEQ ID NO: 6597862 - DNA, 19 bp, Homo sapiens
tttgtttttcttatccaag

SEQ ID NO: 6597863 - DNA, 17 bp, Homo sapiens
tttgtttttgcattttt

SEQ ID NO: 6597864 - DNA, 13 bp, Homo sapiens
tttgtttttgctt

SEQ ID NO: 6597865 - DNA, 14 bp, Homo sapiens
tttgtttttgtaaa

SEQ ID NO: 6597866 - DNA, 18 bp, Homo sapiens
tttgttttttcaatgttt

SEQ ID NO: 6597867 - DNA, 18 bp, Homo sapiens
tttgttttttgacttctg

SEQ ID NO: 6597868 - DNA, 19 bp, Homo sapiens
tttgttttttgagtctttt

SEQ ID NO: 6597869 - DNA, 20 bp, Homo sapiens
tttgttttttgtaactacaa

SEQ ID NO: 6597870 - DNA, 21 bp, Homo sapiens
tttgttttttgtaactacaaa

SEQ ID NO: 6597871 - DNA, 18 bp, Homo sapiens
tttgttttttgtttttct

SEQ ID NO: 6597872 - DNA, 14 bp, Homo sapiens
tttgtttttttcct

SEQ ID NO: 6597873 - DNA, 15 bp, Homo sapiens
tttgtttttttgaga

SEQ ID NO: 6597874 - DNA, 15 bp, Homo sapiens
tttgtttttttgcca

SEQ ID NO: 6597875 - DNA, 19 bp, Homo sapiens
ttttaaaaaaaaaaacaaa

SEQ ID NO: 6597876 - DNA, 15 bp, Homo sapiens
ttttaaaaaaaatgt

SEQ ID NO: 6597877 - DNA, 16 bp, Homo sapiens
ttttaaaaaaaatgtg

SEQ ID NO: 6597878 - DNA, 19 bp, Homo sapiens
ttttaaaaaaaatttgtgt

SEQ ID NO: 6597879 - DNA, 14 bp, Homo sapiens
ttttaaaaaaactg

SEQ ID NO: 6597880 - DNA, 22 bp, Homo sapiens
ttttaaaaaaactggatatttc

SEQ ID NO: 6597881 - DNA, 15 bp, Homo sapiens
ttttaaaaaaagaaa

SEQ ID NO: 6597882 - DNA, 18 bp, Homo sapiens
ttttaaaaaaagaaaatg

SEQ ID NO: 6597883 - DNA, 19 bp, Homo sapiens
ttttaaaaaaataaaacag

SEQ ID NO: 6597884 - DNA, 20 bp, Homo sapiens
ttttaaaaaaataaaacagt

SEQ ID NO: 6597885 - DNA, 19 bp, Homo sapiens
ttttaaaaaaataaaacat

SEQ ID NO: 6597886 - DNA, 22 bp, Homo sapiens
ttttaaaaaaataaaacatttt

SEQ ID NO: 6597887 - DNA, 15 bp, Homo sapiens
ttttaaaaaaatttg

SEQ ID NO: 6597888 - DNA, 15 bp, Homo sapiens
ttttaaaaaacactg

SEQ ID NO: 6597889 - DNA, 18 bp, Homo sapiens
ttttaaaaaactgctgac

SEQ ID NO: 6597890 - DNA, 21 bp, Homo sapiens
ttttaaaaaactgctgactgt

SEQ ID NO: 6597891 - DNA, 17 bp, Homo sapiens
ttttaaaaaagcttaaa

SEQ ID NO: 6597892 - DNA, 20 bp, Homo sapiens
ttttaaaaaagcttaaaact

SEQ ID NO: 6597893 - DNA, 21 bp, Homo sapiens
ttttaaaaaagcttaaaactt

SEQ ID NO: 6597894 - DNA, 22 bp, Homo sapiens
ttttaaaaaagcttaaaacttt

SEQ ID NO: 6597895 - DNA, 23 bp, Homo sapiens
ttttaaaaaagcttaaaactttg

SEQ ID NO: 6597896 - DNA, 23 bp, Homo sapiens
ttttaaaaaataacatattcttg

SEQ ID NO: 6597897 - DNA, 22 bp, Homo sapiens
ttttaaaaaataccattgaaat

SEQ ID NO: 6597898 - DNA, 23 bp, Homo sapiens
ttttaaaaaatactctgctattt

SEQ ID NO: 6597899 - DNA, 19 bp, Homo sapiens
ttttaaaaaatcaatcaat

SEQ ID NO: 6597900 - DNA, 21 bp, Homo sapiens
ttttaaaaaatcaatcaatgg

SEQ ID NO: 6597901 - DNA, 22 bp, Homo sapiens
ttttaaaaaatctgttgttcca

SEQ ID NO: 6597902 - DNA, 13 bp, Homo sapiens
ttttaaaaaatga

SEQ ID NO: 6597903 - DNA, 13 bp, Homo sapiens
ttttaaaaaattt

SEQ ID NO: 6597904 - DNA, 20 bp, Homo sapiens
ttttaaaaacataacataaa

SEQ ID NO: 6597905 - DNA, 13 bp, Homo sapiens
ttttaaaaaccta

SEQ ID NO: 6597906 - DNA, 22 bp, Homo sapiens
ttttaaaaagaaacaagatgct

SEQ ID NO: 6597907 - DNA, 14 bp, Homo sapiens
ttttaaaaagcaaa

SEQ ID NO: 6597908 - DNA, 15 bp, Homo sapiens
ttttaaaaagcaaat

SEQ ID NO: 6597909 - DNA, 17 bp, Homo sapiens
ttttaaaaagcaaatct

SEQ ID NO: 6597910 - DNA, 15 bp, Homo sapiens
ttttaaaaaggcagt

SEQ ID NO: 6597911 - DNA, 17 bp, Homo sapiens
ttttaaaaaggcctttg

SEQ ID NO: 6597912 - DNA, 18 bp, Homo sapiens
ttttaaaaaggcctttgg

SEQ ID NO: 6597913 - DNA, 19 bp, Homo sapiens
ttttaaaaaggcctttggg

SEQ ID NO: 6597914 - DNA, 20 bp, Homo sapiens
ttttaaaaaggcctttggga

SEQ ID NO: 6597915 - DNA, 14 bp, Homo sapiens
ttttaaaaagggta

SEQ ID NO: 6597916 - DNA, 18 bp, Homo sapiens
ttttaaaaagtattgcca

SEQ ID NO: 6597917 - DNA, 17 bp, Homo sapiens
ttttaaaaagttgcaca

SEQ ID NO: 6597918 - DNA, 19 bp, Homo sapiens
ttttaaaaagttgcacatt

SEQ ID NO: 6597919 - DNA, 22 bp, Homo sapiens
ttttaaaaataaaggaaaacaa

SEQ ID NO: 6597920 - DNA, 15 bp, Homo sapiens
ttttaaaaataaatg

SEQ ID NO: 6597921 - DNA, 14 bp, Homo sapiens
ttttaaaaataact

SEQ ID NO: 6597922 - DNA, 15 bp, Homo sapiens
ttttaaaaataactg

SEQ ID NO: 6597923 - DNA, 23 bp, Homo sapiens
ttttaaaaataagttttatacat

SEQ ID NO: 6597924 - DNA, 14 bp, Homo sapiens
ttttaaaaatacat

SEQ ID NO: 6597925 - DNA, 22 bp, Homo sapiens
ttttaaaaatcataaactgtgt

SEQ ID NO: 6597926 - DNA, 15 bp, Homo sapiens
ttttaaaaatgaatc

SEQ ID NO: 6597927 - DNA, 12 bp, Homo sapiens
ttttaaaaatgg

SEQ ID NO: 6597928 - DNA, 17 bp, Homo sapiens
ttttaaaaatgtagaaa

SEQ ID NO: 6597929 - DNA, 19 bp, Homo sapiens
ttttaaaaatgtagaaatt

SEQ ID NO: 6597930 - DNA, 20 bp, Homo sapiens
ttttaaaaattgttaatttt

SEQ ID NO: 6597931 - DNA, 22 bp, Homo sapiens
ttttaaaacaagaaagtttccc

SEQ ID NO: 6597932 - DNA, 15 bp, Homo sapiens
ttttaaaacactaaa

SEQ ID NO: 6597933 - DNA, 13 bp, Homo sapiens
ttttaaaacatgg

SEQ ID NO: 6597934 - DNA, 12 bp, Homo sapiens
ttttaaaacatt

SEQ ID NO: 6597935 - DNA, 16 bp, Homo sapiens
ttttaaaaccataaaa

SEQ ID NO: 6597936 - DNA, 16 bp, Homo sapiens
ttttaaaaccatgcag

SEQ ID NO: 6597937 - DNA, 17 bp, Homo sapiens
ttttaaaaccatgcagc

SEQ ID NO: 6597938 - DNA, 13 bp, Homo sapiens
ttttaaaacccag

SEQ ID NO: 6597939 - DNA, 15 bp, Homo sapiens
ttttaaaactactta

SEQ ID NO: 6597940 - DNA, 14 bp, Homo sapiens
ttttaaaactagca

SEQ ID NO: 6597941 - DNA, 15 bp, Homo sapiens
ttttaaaactggacc

SEQ ID NO: 6597942 - DNA, 13 bp, Homo sapiens
ttttaaaagactt

SEQ ID NO: 6597943 - DNA, 14 bp, Homo sapiens
ttttaaaagacttt

SEQ ID NO: 6597944 - DNA, 22 bp, Homo sapiens
ttttaaaagagacaaactgtaa

SEQ ID NO: 6597945 - DNA, 14 bp, Homo sapiens
ttttaaaagaggaa

SEQ ID NO: 6597946 - DNA, 17 bp, Homo sapiens
ttttaaaagataaacag

SEQ ID NO: 6597947 - DNA, 20 bp, Homo sapiens
ttttaaaagatgcaatgtag

SEQ ID NO: 6597948 - DNA, 21 bp, Homo sapiens
ttttaaaagcaattatattgt

SEQ ID NO: 6597949 - DNA, 21 bp, Homo sapiens
ttttaaaaggatgtataaatt

SEQ ID NO: 6597950 - DNA, 24 bp, Homo sapiens
ttttaaaaggtagagtcttacaat

SEQ ID NO: 6597951 - DNA, 21 bp, Homo sapiens
ttttaaaaggtattttgaata

SEQ ID NO: 6597952 - DNA, 15 bp, Homo sapiens
ttttaaaagtttcaa

SEQ ID NO: 6597953 - DNA, 10 bp, Homo sapiens
ttttaaaata

SEQ ID NO: 6597954 - DNA, 16 bp, Homo sapiens
ttttaaaataaactgt

SEQ ID NO: 6597955 - DNA, 21 bp, Homo sapiens
ttttaaaataaactgtaaact

SEQ ID NO: 6597956 - DNA, 22 bp, Homo sapiens
ttttaaaataagtctgatttaa

SEQ ID NO: 6597957 - DNA, 21 bp, Homo sapiens
ttttaaaataagttaaaggca

SEQ ID NO: 6597958 - DNA, 16 bp, Homo sapiens
ttttaaaataatatgt

SEQ ID NO: 6597959 - DNA, 16 bp, Homo sapiens
ttttaaaatagaaatt

SEQ ID NO: 6597960 - DNA, 18 bp, Homo sapiens
ttttaaaatagaaatttt

SEQ ID NO: 6597961 - DNA, 18 bp, Homo sapiens
ttttaaaatagacactat

SEQ ID NO: 6597962 - DNA, 20 bp, Homo sapiens
ttttaaaatatcttttgacc

SEQ ID NO: 6597963 - DNA, 15 bp, Homo sapiens
ttttaaaatatttag

SEQ ID NO: 6597964 - DNA, 14 bp, Homo sapiens
ttttaaaatcagct

SEQ ID NO: 6597965 - DNA, 14 bp, Homo sapiens
ttttaaaatccact

SEQ ID NO: 6597966 - DNA, 18 bp, Homo sapiens
ttttaaaatccagacttt

SEQ ID NO: 6597967 - DNA, 21 bp, Homo sapiens
ttttaaaatctgagggaaatg

SEQ ID NO: 6597968 - DNA, 22 bp, Homo sapiens
ttttaaaatctgatttaatgtt

SEQ ID NO: 6597969 - DNA, 12 bp, Homo sapiens
ttttaaaatctt

SEQ ID NO: 6597970 - DNA, 18 bp, Homo sapiens
ttttaaaatcttttctat

SEQ ID NO: 6597971 - DNA, 21 bp, Homo sapiens
ttttaaaatgaaatgcatttt

SEQ ID NO: 6597972 - DNA, 19 bp, Homo sapiens
ttttaaaatgagagtcact

SEQ ID NO: 6597973 - DNA, 14 bp, Homo sapiens
ttttaaaatgtaca

SEQ ID NO: 6597974 - DNA, 22 bp, Homo sapiens
ttttaaaatgtcttggtcttct

SEQ ID NO: 6597975 - DNA, 20 bp, Homo sapiens
ttttaaaatgtgaggcaata

SEQ ID NO: 6597976 - DNA, 19 bp, Homo sapiens
ttttaaaattatatagcaa

SEQ ID NO: 6597977 - DNA, 22 bp, Homo sapiens
ttttaaaattatatagcaaaga

SEQ ID NO: 6597978 - DNA, 17 bp, Homo sapiens
ttttaaaattcaaaagt

SEQ ID NO: 6597979 - DNA, 18 bp, Homo sapiens
ttttaaaattctgagtga

SEQ ID NO: 6597980 - DNA, 11 bp, Homo sapiens
ttttaaaattt

SEQ ID NO: 6597981 - DNA, 19 bp, Homo sapiens
ttttaaaatttatttgcaa

SEQ ID NO: 6597982 - DNA, 15 bp, Homo sapiens
ttttaaaatttcata

SEQ ID NO: 6597983 - DNA, 17 bp, Homo sapiens
ttttaaaatttgtctta

SEQ ID NO: 6597984 - DNA, 15 bp, Homo sapiens
ttttaaaatttgttc

SEQ ID NO: 6597985 - DNA, 16 bp, Homo sapiens
ttttaaacaaaataga

SEQ ID NO: 6597986 - DNA, 14 bp, Homo sapiens
ttttaaacaaaatg

SEQ ID NO: 6597987 - DNA, 17 bp, Homo sapiens
ttttaaacaaaatttca

SEQ ID NO: 6597988 - DNA, 19 bp, Homo sapiens
ttttaaacaaaatttcaca

SEQ ID NO: 6597989 - DNA, 20 bp, Homo sapiens
ttttaaacaaaatttcacag

SEQ ID NO: 6597990 - DNA, 18 bp, Homo sapiens
ttttaaacacattaggaa

SEQ ID NO: 6597991 - DNA, 19 bp, Homo sapiens
ttttaaacagtgtttatga

SEQ ID NO: 6597992 - DNA, 17 bp, Homo sapiens
ttttaaacataaagaat

SEQ ID NO: 6597993 - DNA, 15 bp, Homo sapiens
ttttaaacatgtaaa

SEQ ID NO: 6597994 - DNA, 23 bp, Homo sapiens
ttttaaacattaatagcagcctt

SEQ ID NO: 6597995 - DNA, 21 bp, Homo sapiens
ttttaaaccaaaacaccccaa

SEQ ID NO: 6597996 - DNA, 17 bp, Homo sapiens
ttttaaacccaaaatat

SEQ ID NO: 6597997 - DNA, 22 bp, Homo sapiens
ttttaaacccaaaatatataca

SEQ ID NO: 6597998 - DNA, 22 bp, Homo sapiens
ttttaaacctttaatgagaaaa

SEQ ID NO: 6597999 - DNA, 13 bp, Homo sapiens
ttttaaactagat

SEQ ID NO: 6598000 - DNA, 14 bp, Homo sapiens
ttttaaactctttt

SEQ ID NO: 6598001 - DNA, 17 bp, Homo sapiens
ttttaaactgatgtata

SEQ ID NO: 6598002 - DNA, 13 bp, Homo sapiens
ttttaaactgtac

SEQ ID NO: 6598003 - DNA, 16 bp, Homo sapiens
ttttaaactgtacagt

SEQ ID NO: 6598004 - DNA, 17 bp, Homo sapiens
ttttaaactgtacagtg

SEQ ID NO: 6598005 - DNA, 20 bp, Homo sapiens
aattgagtaattctagacat

SEQ ID NO: 6598006 - DNA, 21 bp, Homo sapiens
aattgagtctcttttttattc

SEQ ID NO: 6598007 - DNA, 21 bp, Homo sapiens
aattgagtgcactaaacaaat

SEQ ID NO: 6598008 - DNA, 18 bp, Homo sapiens
aattgagttgcacttatt

SEQ ID NO: 6598009 - DNA, 15 bp, Homo sapiens
aattgagtttcagaa

SEQ ID NO: 6598010 - DNA, 13 bp, Homo sapiens
aattgataataaa

SEQ ID NO: 6598011 - DNA, 15 bp, Homo sapiens
aattgatagcagata

SEQ ID NO: 6598012 - DNA, 21 bp, Homo sapiens
aattgatagcaggtgtaataa

SEQ ID NO: 6598013 - DNA, 17 bp, Homo sapiens
aattgatatttctgtgt

SEQ ID NO: 6598014 - DNA, 15 bp, Homo sapiens
aattgatcagatgct

SEQ ID NO: 6598015 - DNA, 21 bp, Homo sapiens
aattgatcataggtatttcaa

SEQ ID NO: 6598016 - DNA, 22 bp, Homo sapiens
aattgatcataggtatttcaaa

SEQ ID NO: 6598017 - DNA, 22 bp, Homo sapiens
aattgatcattttccccccact

SEQ ID NO: 6598018 - DNA, 23 bp, Homo sapiens
aattgatgatgttgtaaaatgaa

SEQ ID NO: 6598019 - DNA, 21 bp, Homo sapiens
aattgatgggtgggctagtaa

SEQ ID NO: 6598020 - DNA, 15 bp, Homo sapiens
aattgatgtatatgt

SEQ ID NO: 6598021 - DNA, 23 bp, Homo sapiens
aattgatgtatatgtttatatac

SEQ ID NO: 6598022 - DNA, 13 bp, Homo sapiens
aattgatgtgttt

SEQ ID NO: 6598023 - DNA, 14 bp, Homo sapiens
aattgatgtgttta

SEQ ID NO: 6598024 - DNA, 15 bp, Homo sapiens
aattgatgttgatgc

SEQ ID NO: 6598025 - DNA, 16 bp, Homo sapiens
aattgatgttgatgca

SEQ ID NO: 6598026 - DNA, 15 bp, Homo sapiens
aattgattaaaatct

SEQ ID NO: 6598027 - DNA, 18 bp, Homo sapiens
aattgattaaaatctctt

SEQ ID NO: 6598028 - DNA, 13 bp, Homo sapiens
aattgattaaact

SEQ ID NO: 6598029 - DNA, 14 bp, Homo sapiens
aattgattaaactg

SEQ ID NO: 6598030 - DNA, 16 bp, Homo sapiens
aattgattaaactgta

SEQ ID NO: 6598031 - DNA, 17 bp, Homo sapiens
aattgattaaactgtat

SEQ ID NO: 6598032 - DNA, 16 bp, Homo sapiens
aattgattaacttata

SEQ ID NO: 6598033 - DNA, 20 bp, Homo sapiens
aattgattaacttatactgt

SEQ ID NO: 6598034 - DNA, 21 bp, Homo sapiens
aattgattaacttatactgta

SEQ ID NO: 6598035 - DNA, 22 bp, Homo sapiens
aattgattcctcgcgacatctt

SEQ ID NO: 6598036 - DNA, 19 bp, Homo sapiens
aattgattgggcacatcat

SEQ ID NO: 6598037 - DNA, 20 bp, Homo sapiens
aattgattgggcacatcatt

SEQ ID NO: 6598038 - DNA, 11 bp, Homo sapiens
aattgattgtc

SEQ ID NO: 6598039 - DNA, 19 bp, Homo sapiens
aattgatttataaataaca

SEQ ID NO: 6598040 - DNA, 19 bp, Homo sapiens
aattgatttcccttcttct

SEQ ID NO: 6598041 - DNA, 13 bp, Homo sapiens
aattgatttgcat

SEQ ID NO: 6598042 - DNA, 22 bp, Homo sapiens
aattgatttgcattgaacacaa

SEQ ID NO: 6598043 - DNA, 20 bp, Homo sapiens
aattgatttttataaatact

SEQ ID NO: 6598044 - DNA, 23 bp, Homo sapiens
aattgatttttctcttcattttt

SEQ ID NO: 6598045 - DNA, 23 bp, Homo sapiens
aattgcaaaatgcgtatttgcat

SEQ ID NO: 6598046 - DNA, 14 bp, Homo sapiens
aattgcaaatcttg

SEQ ID NO: 6598047 - DNA, 16 bp, Homo sapiens
aattgcaacatgaagt

SEQ ID NO: 6598048 - DNA, 12 bp, Homo sapiens
aattgcaagtct

SEQ ID NO: 6598049 - DNA, 16 bp, Homo sapiens
aattgcaatttcttag

SEQ ID NO: 6598050 - DNA, 21 bp, Homo sapiens
aattgcaattttaacacacat

SEQ ID NO: 6598051 - DNA, 10 bp, Homo sapiens
aattgcacaa

SEQ ID NO: 6598052 - DNA, 12 bp, Homo sapiens
aattgcacaatt

SEQ ID NO: 6598053 - DNA, 19 bp, Homo sapiens
aattgcacagaagtcctgt

SEQ ID NO: 6598054 - DNA, 22 bp, Homo sapiens
aattgcacagaagtcctgtatg

SEQ ID NO: 6598055 - DNA, 22 bp, Homo sapiens
aattgcacgtttggtgaaagtt

SEQ ID NO: 6598056 - DNA, 15 bp, Homo sapiens
aattgcactaaatga

SEQ ID NO: 6598057 - DNA, 15 bp, Homo sapiens
aattgcactgaagtt

SEQ ID NO: 6598058 - DNA, 22 bp, Homo sapiens
aattgcactgaagtttttgaaa

SEQ ID NO: 6598059 - DNA, 18 bp, Homo sapiens
aattgcacttttaaacct

SEQ ID NO: 6598060 - DNA, 20 bp, Homo sapiens
aattgcagaagaaactcctg

SEQ ID NO: 6598061 - DNA, 23 bp, Homo sapiens
aattgcagcagacccagcagcag

SEQ ID NO: 6598062 - DNA, 17 bp, Homo sapiens
aattgcagcagttgcta

SEQ ID NO: 6598063 - DNA, 13 bp, Homo sapiens
aattgcagtttac

SEQ ID NO: 6598064 - DNA, 14 bp, Homo sapiens
aattgcagtttcat

SEQ ID NO: 6598065 - DNA, 13 bp, Homo sapiens
aattgcatgaaaa

SEQ ID NO: 6598066 - DNA, 16 bp, Homo sapiens
aattgcatgctgcttt

SEQ ID NO: 6598067 - DNA, 17 bp, Homo sapiens
aattgcatgctgcttta

SEQ ID NO: 6598068 - DNA, 22 bp, Homo sapiens
aattgcatgggttttgtaggta

SEQ ID NO: 6598069 - DNA, 17 bp, Homo sapiens
aattgcattattttata

SEQ ID NO: 6598070 - DNA, 18 bp, Homo sapiens
aattgcatttttaccttt

SEQ ID NO: 6598071 - DNA, 14 bp, Homo sapiens
aattgccaaagctg

SEQ ID NO: 6598072 - DNA, 11 bp, Homo sapiens
aattgccaagt

SEQ ID NO: 6598073 - DNA, 13 bp, Homo sapiens
aattgccaatctt

SEQ ID NO: 6598074 - DNA, 15 bp, Homo sapiens
aattgccagcaaata

SEQ ID NO: 6598075 - DNA, 17 bp, Homo sapiens
aattgccagcaaataaa

SEQ ID NO: 6598076 - DNA, 22 bp, Homo sapiens
aattgccataatatgatgcaaa

SEQ ID NO: 6598077 - DNA, 15 bp, Homo sapiens
aattgccatattgca

SEQ ID NO: 6598078 - DNA, 16 bp, Homo sapiens
aattgccatattgcac

SEQ ID NO: 6598079 - DNA, 23 bp, Homo sapiens
aattgccatattgcacatgtctt

SEQ ID NO: 6598080 - DNA, 19 bp, Homo sapiens
aattgcctacaataaaaag

SEQ ID NO: 6598081 - DNA, 20 bp, Homo sapiens
aattgcctacaataaaaaga

SEQ ID NO: 6598082 - DNA, 17 bp, Homo sapiens
aattgcctataatactt

SEQ ID NO: 6598083 - DNA, 18 bp, Homo sapiens
aattgcctcccttcctcc

SEQ ID NO: 6598084 - DNA, 20 bp, Homo sapiens
aattgcctttgataattctt

SEQ ID NO: 6598085 - DNA, 20 bp, Homo sapiens
aattgccttttttctgtata

SEQ ID NO: 6598086 - DNA, 16 bp, Homo sapiens
aattgcgttggtctct

SEQ ID NO: 6598087 - DNA, 20 bp, Homo sapiens
aattgcgttggtctctgcat

SEQ ID NO: 6598088 - DNA, 22 bp, Homo sapiens
aattgcgttggtctctgcattt

SEQ ID NO: 6598089 - DNA, 14 bp, Homo sapiens
aattgctaacaatt

SEQ ID NO: 6598090 - DNA, 20 bp, Homo sapiens
aattgctaatacccagttac

SEQ ID NO: 6598091 - DNA, 15 bp, Homo sapiens
aattgctaatgttgc

SEQ ID NO: 6598092 - DNA, 16 bp, Homo sapiens
aattgctaatgttgct

SEQ ID NO: 6598093 - DNA, 16 bp, Homo sapiens
aattgctataaatcga

SEQ ID NO: 6598094 - DNA, 20 bp, Homo sapiens
aattgctatgttactatttt

SEQ ID NO: 6598095 - DNA, 23 bp, Homo sapiens
aattgctatgttttgacattttt

SEQ ID NO: 6598096 - DNA, 20 bp, Homo sapiens
aattgctattttatttgtat

SEQ ID NO: 6598097 - DNA, 14 bp, Homo sapiens
aattgctcaaaaaa

SEQ ID NO: 6598098 - DNA, 14 bp, Homo sapiens
aattgctcaagttc

SEQ ID NO: 6598099 - DNA, 22 bp, Homo sapiens
aattgctcacagttattacata

SEQ ID NO: 6598100 - DNA, 11 bp, Homo sapiens
aattgctccta

SEQ ID NO: 6598101 - DNA, 21 bp, Homo sapiens
aattgctcctaactccaccgc

SEQ ID NO: 6598102 - DNA, 20 bp, Homo sapiens
aattgctcctaagcttcaaa

SEQ ID NO: 6598103 - DNA, 12 bp, Homo sapiens
aattgctccttg

SEQ ID NO: 6598104 - DNA, 22 bp, Homo sapiens
aattgctctgtgtatatctctt

SEQ ID NO: 6598105 - DNA, 13 bp, Homo sapiens
aattgctgagatg

SEQ ID NO: 6598106 - DNA, 23 bp, Homo sapiens
aattgctgataccatatgaatga

SEQ ID NO: 6598107 - DNA, 14 bp, Homo sapiens
aattgctgcatatt

SEQ ID NO: 6598108 - DNA, 13 bp, Homo sapiens
aattgctgctact

SEQ ID NO: 6598109 - DNA, 19 bp, Homo sapiens
aattgctgtctagccttag

SEQ ID NO: 6598110 - DNA, 12 bp, Homo sapiens
aattgctgtgcc

SEQ ID NO: 6598111 - DNA, 13 bp, Homo sapiens
aattgctgtgtat

SEQ ID NO: 6598112 - DNA, 18 bp, Homo sapiens
aattgctgtgtatctgat

SEQ ID NO: 6598113 - DNA, 15 bp, Homo sapiens
aattgcttacatttt

SEQ ID NO: 6598114 - DNA, 20 bp, Homo sapiens
aattgcttacatttttacaa

SEQ ID NO: 6598115 - DNA, 15 bp, Homo sapiens
aattgcttattctag

SEQ ID NO: 6598116 - DNA, 22 bp, Homo sapiens
aattgcttatttattgtattct

SEQ ID NO: 6598117 - DNA, 14 bp, Homo sapiens
aattgcttctctaa

SEQ ID NO: 6598118 - DNA, 20 bp, Homo sapiens
aattgcttctctaaaacagc

SEQ ID NO: 6598119 - DNA, 18 bp, Homo sapiens
aattgctttgccaaaata

SEQ ID NO: 6598120 - DNA, 17 bp, Homo sapiens
aattgcttttgttgtga

SEQ ID NO: 6598121 - DNA, 19 bp, Homo sapiens
aattggaaaagactaagat

SEQ ID NO: 6598122 - DNA, 14 bp, Homo sapiens
aattggaaaggact

SEQ ID NO: 6598123 - DNA, 20 bp, Homo sapiens
aattggaacagaatgtttta

SEQ ID NO: 6598124 - DNA, 13 bp, Homo sapiens
aattggaactgca

SEQ ID NO: 6598125 - DNA, 12 bp, Homo sapiens
aattggaatcaa

SEQ ID NO: 6598126 - DNA, 13 bp, Homo sapiens
aattggaatcttc

SEQ ID NO: 6598127 - DNA, 23 bp, Homo sapiens
aattggaatcttcacctcagagt

SEQ ID NO: 6598128 - DNA, 18 bp, Homo sapiens
aattggaatgcactcaga

SEQ ID NO: 6598129 - DNA, 23 bp, Homo sapiens
aattggacagattgcctgtttct

SEQ ID NO: 6598130 - DNA, 20 bp, Homo sapiens
aattggacagttttgataca

SEQ ID NO: 6598131 - DNA, 17 bp, Homo sapiens
aattggagaaaagcact

SEQ ID NO: 6598132 - DNA, 15 bp, Homo sapiens
aattggagctcgtgg

SEQ ID NO: 6598133 - DNA, 22 bp, Homo sapiens
aattggagttggagtagaatgt

SEQ ID NO: 6598134 - DNA, 16 bp, Homo sapiens
aattggattattttct

SEQ ID NO: 6598135 - DNA, 15 bp, Homo sapiens
aattggatttcctaa

SEQ ID NO: 6598136 - DNA, 17 bp, Homo sapiens
aattggcagtgactttg

SEQ ID NO: 6598137 - DNA, 20 bp, Homo sapiens
aattggcagtgactttgtat

SEQ ID NO: 6598138 - DNA, 16 bp, Homo sapiens
aattggcataatttgt

SEQ ID NO: 6598139 - DNA, 18 bp, Homo sapiens
aattggcataatttgtct

SEQ ID NO: 6598140 - DNA, 18 bp, Homo sapiens
aattggcatgtgtatgtt

SEQ ID NO: 6598141 - DNA, 13 bp, Homo sapiens
aattggcattaaa

SEQ ID NO: 6598142 - DNA, 16 bp, Homo sapiens
aattggcattaaaact

SEQ ID NO: 6598143 - DNA, 17 bp, Homo sapiens
aattggcattaaaactt

SEQ ID NO: 6598144 - DNA, 16 bp, Homo sapiens
aattggcctgaacaga

SEQ ID NO: 6598145 - DNA, 17 bp, Homo sapiens
aattggcctgaacagat

SEQ ID NO: 6598146 - DNA, 20 bp, Homo sapiens
aattggcctgaacagatgta

SEQ ID NO: 6598147 - DNA, 23 bp, Homo sapiens
aattggcctgaacagatgtaaat

SEQ ID NO: 6598148 - DNA, 18 bp, Homo sapiens
aattggctcctttcccac

SEQ ID NO: 6598149 - DNA, 20 bp, Homo sapiens
aattggctcctttcccacag

SEQ ID NO: 6598150 - DNA, 23 bp, Homo sapiens
aattggcttgtttaaggttcttg

SEQ ID NO: 6598151 - DNA, 19 bp, Homo sapiens
aattggctttgcagatatt

SEQ ID NO: 6598152 - DNA, 23 bp, Homo sapiens
aattggcttttgaatcaaagaat

SEQ ID NO: 6598153 - DNA, 18 bp, Homo sapiens
aattgggagtccaggcac

SEQ ID NO: 6598154 - DNA, 19 bp, Homo sapiens
aattgggagtccaggcaca

SEQ ID NO: 6598155 - DNA, 21 bp, Homo sapiens
aattgggagtccaggcacagg

SEQ ID NO: 6598156 - DNA, 22 bp, Homo sapiens
aattgggattttaaaaacatga

SEQ ID NO: 6598157 - DNA, 15 bp, Homo sapiens
aattgggcactattt

SEQ ID NO: 6598158 - DNA, 18 bp, Homo sapiens
aattgggcactatttatt

SEQ ID NO: 6598159 - DNA, 22 bp, Homo sapiens
aattgggcccttagaatgtgaa

SEQ ID NO: 6598160 - DNA, 19 bp, Homo sapiens
aattgggctggattgtgct

SEQ ID NO: 6598161 - DNA, 19 bp, Homo sapiens
aattgggcttcaatcactg

SEQ ID NO: 6598162 - DNA, 22 bp, Homo sapiens
aattgggcttcaatcactgtaa

SEQ ID NO: 6598163 - DNA, 16 bp, Homo sapiens
aattggggaggagggg

SEQ ID NO: 6598164 - DNA, 22 bp, Homo sapiens
aattggggattgagttgtaaag

SEQ ID NO: 6598165 - DNA, 15 bp, Homo sapiens
aattggggcggagcc

SEQ ID NO: 6598166 - DNA, 23 bp, Homo sapiens
aattggggctgtcgggggctgtg

SEQ ID NO: 6598167 - DNA, 18 bp, Homo sapiens
aattgggtcatagaaatt

SEQ ID NO: 6598168 - DNA, 22 bp, Homo sapiens
aattgggtgtgccctggctccc

SEQ ID NO: 6598169 - DNA, 23 bp, Homo sapiens
aattgggtttagtcaatcactgc

SEQ ID NO: 6598170 - DNA, 12 bp, Homo sapiens
aattggtaatat

SEQ ID NO: 6598171 - DNA, 16 bp, Homo sapiens
aattggtaattacctg

SEQ ID NO: 6598172 - DNA, 13 bp, Homo sapiens
aattggtcattcc

SEQ ID NO: 6598173 - DNA, 13 bp, Homo sapiens
aattggtgaataa

SEQ ID NO: 6598174 - DNA, 19 bp, Homo sapiens
aattggtgataagtggaaa

SEQ ID NO: 6598175 - DNA, 20 bp, Homo sapiens
aattggtgataagtggaaaa

SEQ ID NO: 6598176 - DNA, 18 bp, Homo sapiens
aattggtgctatttgaag

SEQ ID NO: 6598177 - DNA, 13 bp, Homo sapiens
aattggtgcttca

SEQ ID NO: 6598178 - DNA, 15 bp, Homo sapiens
aattggtgcttcagc

SEQ ID NO: 6598179 - DNA, 18 bp, Homo sapiens
aattggtgcttcagccct

SEQ ID NO: 6598180 - DNA, 14 bp, Homo sapiens
aattggtgggaagc

SEQ ID NO: 6598181 - DNA, 20 bp, Homo sapiens
aattggtgtatatcatgaag

SEQ ID NO: 6598182 - DNA, 10 bp, Homo sapiens
ttttaaagaa

SEQ ID NO: 6598183 - DNA, 11 bp, Homo sapiens
ttttaaagaaa

SEQ ID NO: 6598184 - DNA, 18 bp, Homo sapiens
ttttaaagaaaagatgaa

SEQ ID NO: 6598185 - DNA, 14 bp, Homo sapiens
ttttaaagaaaagt

SEQ ID NO: 6598186 - DNA, 20 bp, Homo sapiens
ttttaaagaaaatgtgtctg

SEQ ID NO: 6598187 - DNA, 15 bp, Homo sapiens
ttttaaagaagcttt

SEQ ID NO: 6598188 - DNA, 17 bp, Homo sapiens
ttttaaagaagctttat

SEQ ID NO: 6598189 - DNA, 13 bp, Homo sapiens
ttttaaagaagga

SEQ ID NO: 6598190 - DNA, 15 bp, Homo sapiens
ttttaaagaatccaa

SEQ ID NO: 6598191 - DNA, 17 bp, Homo sapiens
ttttaaagaatccaaga

SEQ ID NO: 6598192 - DNA, 23 bp, Homo sapiens
ttttaaagaatccaagacaaact

SEQ ID NO: 6598193 - DNA, 18 bp, Homo sapiens
ttttaaagacttttatga

SEQ ID NO: 6598194 - DNA, 20 bp, Homo sapiens
ttttaaagagtgaaaaatga

SEQ ID NO: 6598195 - DNA, 20 bp, Homo sapiens
ttttaaagagtgtgttataa

SEQ ID NO: 6598196 - DNA, 19 bp, Homo sapiens
ttttaaagatctcggtgct

SEQ ID NO: 6598197 - DNA, 15 bp, Homo sapiens
ttttaaagcaagtca

SEQ ID NO: 6598198 - DNA, 18 bp, Homo sapiens
ttttaaagcaagtcacct

SEQ ID NO: 6598199 - DNA, 17 bp, Homo sapiens
ttttaaagcctggcttc

SEQ ID NO: 6598200 - DNA, 12 bp, Homo sapiens
ttttaaagctaa

SEQ ID NO: 6598201 - DNA, 19 bp, Homo sapiens
ttttaaaggacaaacagtg

SEQ ID NO: 6598202 - DNA, 22 bp, Homo sapiens
ttttaaaggacaaacagtgaat

SEQ ID NO: 6598203 - DNA, 19 bp, Homo sapiens
ttttaaaggccgttggctg

SEQ ID NO: 6598204 - DNA, 22 bp, Homo sapiens
ttttaaagggagccatgctctt

SEQ ID NO: 6598205 - DNA, 16 bp, Homo sapiens
ttttaaaggtggattt

SEQ ID NO: 6598206 - DNA, 20 bp, Homo sapiens
ttttaaaggttggaatcttt

SEQ ID NO: 6598207 - DNA, 9 bp, Homo sapiens
ttttaaagt

SEQ ID NO: 6598208 - DNA, 17 bp, Homo sapiens
ttttaaagtaaatctct

SEQ ID NO: 6598209 - DNA, 17 bp, Homo sapiens
ttttaaagtaaattatt

SEQ ID NO: 6598210 - DNA, 21 bp, Homo sapiens
ttttaaagtaaccctacaaaa

SEQ ID NO: 6598211 - DNA, 22 bp, Homo sapiens
ttttaaagtatgttattgcata

SEQ ID NO: 6598212 - DNA, 13 bp, Homo sapiens
ttttaaagtattt

SEQ ID NO: 6598213 - DNA, 13 bp, Homo sapiens
ttttaaagtgcaa

SEQ ID NO: 6598214 - DNA, 14 bp, Homo sapiens
ttttaaagttaaaa

SEQ ID NO: 6598215 - DNA, 21 bp, Homo sapiens
ttttaaataaaaattactgtg

SEQ ID NO: 6598216 - DNA, 15 bp, Homo sapiens
ttttaaataaaagca

SEQ ID NO: 6598217 - DNA, 16 bp, Homo sapiens
ttttaaataaaagcac

SEQ ID NO: 6598218 - DNA, 17 bp, Homo sapiens
ttttaaataaaagcagc

SEQ ID NO: 6598219 - DNA, 14 bp, Homo sapiens
ttttaaataaactt

SEQ ID NO: 6598220 - DNA, 15 bp, Homo sapiens
ttttaaataaacttt

SEQ ID NO: 6598221 - DNA, 16 bp, Homo sapiens
ttttaaataaactttt

SEQ ID NO: 6598222 - DNA, 21 bp, Homo sapiens
ttttaaataaactttttttca

SEQ ID NO: 6598223 - DNA, 17 bp, Homo sapiens
ttttaaataacctctgg

SEQ ID NO: 6598224 - DNA, 12 bp, Homo sapiens
ttttaaataatg

SEQ ID NO: 6598225 - DNA, 19 bp, Homo sapiens
ttttaaatatgaacaaaga

SEQ ID NO: 6598226 - DNA, 14 bp, Homo sapiens
ttttaaatctaaat

SEQ ID NO: 6598227 - DNA, 17 bp, Homo sapiens
ttttaaatctgaaggtt

SEQ ID NO: 6598228 - DNA, 22 bp, Homo sapiens
ttttaaatctgcagcacattga

SEQ ID NO: 6598229 - DNA, 12 bp, Homo sapiens
ttttaaatgacc

SEQ ID NO: 6598230 - DNA, 17 bp, Homo sapiens
ttttaaatgagctttca

SEQ ID NO: 6598231 - DNA, 18 bp, Homo sapiens
ttttaaatgattccaaat

SEQ ID NO: 6598232 - DNA, 19 bp, Homo sapiens
ttttaaatgattccaaata

SEQ ID NO: 6598233 - DNA, 14 bp, Homo sapiens
ttttaaatgcagtt

SEQ ID NO: 6598234 - DNA, 19 bp, Homo sapiens
ttttaaatgcataaatgca

SEQ ID NO: 6598235 - DNA, 13 bp, Homo sapiens
ttttaaatggcat

SEQ ID NO: 6598236 - DNA, 19 bp, Homo sapiens
ttttaaatgggtagagaaa

SEQ ID NO: 6598237 - DNA, 10 bp, Homo sapiens
ttttaaatgt

SEQ ID NO: 6598238 - DNA, 22 bp, Homo sapiens
ttttaaatgtacagacatattt

SEQ ID NO: 6598239 - DNA, 12 bp, Homo sapiens
ttttaaatgtat

SEQ ID NO: 6598240 - DNA, 16 bp, Homo sapiens
ttttaaatgtatacta

SEQ ID NO: 6598241 - DNA, 12 bp, Homo sapiens
ttttaaatgtgg

SEQ ID NO: 6598242 - DNA, 12 bp, Homo sapiens
ttttaaatgttt

SEQ ID NO: 6598243 - DNA, 23 bp, Homo sapiens
ttttaaattaagacaaaaagcct

SEQ ID NO: 6598244 - DNA, 17 bp, Homo sapiens
ttttaaattataagatg

SEQ ID NO: 6598245 - DNA, 20 bp, Homo sapiens
ttttaaattatactgtagct

SEQ ID NO: 6598246 - DNA, 20 bp, Homo sapiens
ttttaaattctgagacatgt

SEQ ID NO: 6598247 - DNA, 15 bp, Homo sapiens
ttttaaattcttact

SEQ ID NO: 6598248 - DNA, 12 bp, Homo sapiens
ttttaaattgtt

SEQ ID NO: 6598249 - DNA, 22 bp, Homo sapiens
ttttaaattgtttcatatctgg

SEQ ID NO: 6598250 - DNA, 13 bp, Homo sapiens
ttttaaatttcag

SEQ ID NO: 6598251 - DNA, 12 bp, Homo sapiens
ttttaaatttgc

SEQ ID NO: 6598252 - DNA, 17 bp, Homo sapiens
ttttaaattttctccag

SEQ ID NO: 6598253 - DNA, 18 bp, Homo sapiens
ttttaaattttcttcagt

SEQ ID NO: 6598254 - DNA, 15 bp, Homo sapiens
ttttaaattttgtaa

SEQ ID NO: 6598255 - DNA, 18 bp, Homo sapiens
ttttaaattttgtaatga

SEQ ID NO: 6598256 - DNA, 21 bp, Homo sapiens
ttttaacaaaaaacagattct

SEQ ID NO: 6598257 - DNA, 16 bp, Homo sapiens
ttttaacaaaagcaag

SEQ ID NO: 6598258 - DNA, 21 bp, Homo sapiens
ttttaacaagaagatgaatgg

SEQ ID NO: 6598259 - DNA, 14 bp, Homo sapiens
ttttaacactttgt

SEQ ID NO: 6598260 - DNA, 17 bp, Homo sapiens
ttttaacagacatgtat

SEQ ID NO: 6598261 - DNA, 20 bp, Homo sapiens
ttttaacagttttacttctg

SEQ ID NO: 6598262 - DNA, 22 bp, Homo sapiens
ttttaacatagcagctggttaa

SEQ ID NO: 6598263 - DNA, 21 bp, Homo sapiens
ttttaacatcagaactgaaat

SEQ ID NO: 6598264 - DNA, 13 bp, Homo sapiens
ttttaacatgtga

SEQ ID NO: 6598265 - DNA, 19 bp, Homo sapiens
ttttaacatttatctaaaa

SEQ ID NO: 6598266 - DNA, 22 bp, Homo sapiens
ttttaacatttatctaaaagaa

SEQ ID NO: 6598267 - DNA, 12 bp, Homo sapiens
ttttaacatttt

SEQ ID NO: 6598268 - DNA, 14 bp, Homo sapiens
ttttaacattttgt

SEQ ID NO: 6598269 - DNA, 14 bp, Homo sapiens
ttttaaccaaaggt

SEQ ID NO: 6598270 - DNA, 15 bp, Homo sapiens
ttttaaccaaaggtg

SEQ ID NO: 6598271 - DNA, 16 bp, Homo sapiens
ttttaaccaataacta

SEQ ID NO: 6598272 - DNA, 16 bp, Homo sapiens
ttttaaccatccttaa

SEQ ID NO: 6598273 - DNA, 18 bp, Homo sapiens
ttttaaccccgtcaacaa

SEQ ID NO: 6598274 - DNA, 18 bp, Homo sapiens
ttttaacctcaaaatggt

SEQ ID NO: 6598275 - DNA, 13 bp, Homo sapiens
ttttaacctcaga

SEQ ID NO: 6598276 - DNA, 14 bp, Homo sapiens
ttttaacctgtttt

SEQ ID NO: 6598277 - DNA, 22 bp, Homo sapiens
ttttaacgtatgtatttcattg

SEQ ID NO: 6598278 - DNA, 15 bp, Homo sapiens
ttttaacgtggcttg

SEQ ID NO: 6598279 - DNA, 17 bp, Homo sapiens
ttttaactgaaaatgta

SEQ ID NO: 6598280 - DNA, 20 bp, Homo sapiens
ttttaactgaaaatgtaaat

SEQ ID NO: 6598281 - DNA, 21 bp, Homo sapiens
ttttaactgaaaatgtaaatt

SEQ ID NO: 6598282 - DNA, 19 bp, Homo sapiens
ttttaactgccaatcctta

SEQ ID NO: 6598283 - DNA, 11 bp, Homo sapiens
ttttaactgta

SEQ ID NO: 6598284 - DNA, 14 bp, Homo sapiens
ttttaactgtgcaa

SEQ ID NO: 6598285 - DNA, 14 bp, Homo sapiens
ttttaactgtggat

SEQ ID NO: 6598286 - DNA, 12 bp, Homo sapiens
ttttaactgttt

SEQ ID NO: 6598287 - DNA, 17 bp, Homo sapiens
ttttaacttaaatttta

SEQ ID NO: 6598288 - DNA, 18 bp, Homo sapiens
ttttaacttatgtatgtg

SEQ ID NO: 6598289 - DNA, 22 bp, Homo sapiens
ttttaacttgaaaagattgcaa

SEQ ID NO: 6598290 - DNA, 13 bp, Homo sapiens
ttttaactttaat

SEQ ID NO: 6598291 - DNA, 12 bp, Homo sapiens
ttttaactttgt

SEQ ID NO: 6598292 - DNA, 13 bp, Homo sapiens
ttttaactttgtt

SEQ ID NO: 6598293 - DNA, 18 bp, Homo sapiens
ttttaacttttggaatca

SEQ ID NO: 6598294 - DNA, 19 bp, Homo sapiens
ttttaacttttggaatcat

SEQ ID NO: 6598295 - DNA, 20 bp, Homo sapiens
ttttaagaaaaaataaaagg

SEQ ID NO: 6598296 - DNA, 17 bp, Homo sapiens
ttttaagaaaaacatgt

SEQ ID NO: 6598297 - DNA, 14 bp, Homo sapiens
ttttaagaaagaga

SEQ ID NO: 6598298 - DNA, 23 bp, Homo sapiens
ttttaagaaagagaatgaactgt

SEQ ID NO: 6598299 - DNA, 18 bp, Homo sapiens
ttttaagaaagtaattta

SEQ ID NO: 6598300 - DNA, 23 bp, Homo sapiens
ttttaagaaagtaatttaatttg

SEQ ID NO: 6598301 - DNA, 16 bp, Homo sapiens
ttttaagaaatgtagt

SEQ ID NO: 6598302 - DNA, 18 bp, Homo sapiens
ttttaagaacttcatttt

SEQ ID NO: 6598303 - DNA, 16 bp, Homo sapiens
ttttaagaagacatga

SEQ ID NO: 6598304 - DNA, 19 bp, Homo sapiens
ttttaagaaggcattggca

SEQ ID NO: 6598305 - DNA, 13 bp, Homo sapiens
ttttaagaatatc

SEQ ID NO: 6598306 - DNA, 17 bp, Homo sapiens
ttttaagaatggtctca

SEQ ID NO: 6598307 - DNA, 19 bp, Homo sapiens
ttttaagaattgagtaatg

SEQ ID NO: 6598308 - DNA, 16 bp, Homo sapiens
ttttaagaattgttta

SEQ ID NO: 6598309 - DNA, 17 bp, Homo sapiens
ttttaagacagagtttc

SEQ ID NO: 6598310 - DNA, 19 bp, Homo sapiens
ttttaagacgtgtttgtgt

SEQ ID NO: 6598311 - DNA, 20 bp, Homo sapiens
ttttaagagaattagacaaa

SEQ ID NO: 6598312 - DNA, 23 bp, Homo sapiens
ttttaagaggaatttataacaaa

SEQ ID NO: 6598313 - DNA, 15 bp, Homo sapiens
ttttaagaggcaggg

SEQ ID NO: 6598314 - DNA, 22 bp, Homo sapiens
ttttaagataaattataagtta

SEQ ID NO: 6598315 - DNA, 15 bp, Homo sapiens
ttttaagatttgtgt

SEQ ID NO: 6598316 - DNA, 21 bp, Homo sapiens
ttttaagatttttctcaaagt

SEQ ID NO: 6598317 - DNA, 15 bp, Homo sapiens
ttttaagcaaaatat

SEQ ID NO: 6598318 - DNA, 21 bp, Homo sapiens
ttttaagcaaatgcattctat

SEQ ID NO: 6598319 - DNA, 16 bp, Homo sapiens
ttttaagcaacacttg

SEQ ID NO: 6598320 - DNA, 21 bp, Homo sapiens
ttttaagcactcttaaagcaa

SEQ ID NO: 6598321 - DNA, 18 bp, Homo sapiens
ttttaagcagactcagct

SEQ ID NO: 6598322 - DNA, 22 bp, Homo sapiens
ttttaagcagactcagctgcta

SEQ ID NO: 6598323 - DNA, 15 bp, Homo sapiens
ttttaagcagctcta

SEQ ID NO: 6598324 - DNA, 22 bp, Homo sapiens
ttttaagcagctctaaaacata

SEQ ID NO: 6598325 - DNA, 18 bp, Homo sapiens
ttttaagcattgtgagta

SEQ ID NO: 6598326 - DNA, 18 bp, Homo sapiens
ttttaagcctttgaagtg

SEQ ID NO: 6598327 - DNA, 20 bp, Homo sapiens
ttttaagcctttgttgaact

SEQ ID NO: 6598328 - DNA, 16 bp, Homo sapiens
ttttaagctaaaatgt

SEQ ID NO: 6598329 - DNA, 21 bp, Homo sapiens
ttttaagctccatgtgcatat

SEQ ID NO: 6598330 - DNA, 22 bp, Homo sapiens
ttttaagctgtaaaaagagaga

SEQ ID NO: 6598331 - DNA, 22 bp, Homo sapiens
ttttaaggaaactttttaattg

SEQ ID NO: 6598332 - DNA, 22 bp, Homo sapiens
ttttaaggactgactgaggcag

SEQ ID NO: 6598333 - DNA, 19 bp, Homo sapiens
ttttaaggatggcacagta

SEQ ID NO: 6598334 - DNA, 17 bp, Homo sapiens
ttttaaggattctgcag

SEQ ID NO: 6598335 - DNA, 16 bp, Homo sapiens
ttttaaggctgtgtga

SEQ ID NO: 6598336 - DNA, 18 bp, Homo sapiens
ttttaagggatgttgcaa

SEQ ID NO: 6598337 - DNA, 22 bp, Homo sapiens
ttttaagggccctttttcaata

SEQ ID NO: 6598338 - DNA, 20 bp, Homo sapiens
ttttaagggtttgtggaaaa

SEQ ID NO: 6598339 - DNA, 23 bp, Homo sapiens
ttttaagggtttgtggaaaatga

SEQ ID NO: 6598340 - DNA, 18 bp, Homo sapiens
ttttaaggtctttcagta

SEQ ID NO: 6598341 - DNA, 23 bp, Homo sapiens
ttttaaggtttcaacaaatttca

SEQ ID NO: 6598342 - DNA, 14 bp, Homo sapiens
ttttaagtaatgtg

SEQ ID NO: 6598343 - DNA, 15 bp, Homo sapiens
ttttaagtaatgtgg

SEQ ID NO: 6598344 - DNA, 14 bp, Homo sapiens
ttttaagtatacaa

SEQ ID NO: 6598345 - DNA, 17 bp, Homo sapiens
ttttaagtatttatata

SEQ ID NO: 6598346 - DNA, 19 bp, Homo sapiens
ttttaagtcaaatgcattt

SEQ ID NO: 6598347 - DNA, 14 bp, Homo sapiens
ttttaagtgaaatt

SEQ ID NO: 6598348 - DNA, 21 bp, Homo sapiens
ttttaagtgcaacatttctgt

SEQ ID NO: 6598349 - DNA, 23 bp, Homo sapiens
ttttaagtgccttggatgagaag

SEQ ID NO: 6598350 - DNA, 17 bp, Homo sapiens
ttttaagtgctttgtaa

SEQ ID NO: 6598351 - DNA, 15 bp, Homo sapiens
ttttaagtgtcagac

SEQ ID NO: 6598352 - DNA, 15 bp, Homo sapiens
ttttaagttaataga

SEQ ID NO: 6598353 - DNA, 23 bp, Homo sapiens
ttttaagttaatagattttttca

SEQ ID NO: 6598354 - DNA, 22 bp, Homo sapiens
ttttaagttacacatttttcag

SEQ ID NO: 6598355 - DNA, 19 bp, Homo sapiens
ttttaagtttctctgcaga

SEQ ID NO: 6598356 - DNA, 20 bp, Homo sapiens
ttttaagtttctctgcagaa

SEQ ID NO: 6598357 - DNA, 15 bp, Homo sapiens
ttttaataaaagatt

SEQ ID NO: 6598358 - DNA, 13 bp, Homo sapiens
ttttaataaaatt

SEQ ID NO: 6598359 - DNA, 15 bp, Homo sapiens
ttttaataaactact

SEQ ID NO: 6598360 - DNA, 19 bp, Homo sapiens
ttttaataaactactcttt

SEQ ID NO: 6598361 - DNA, 22 bp, Homo sapiens
aattggttagaacctcctattt

SEQ ID NO: 6598362 - DNA, 17 bp, Homo sapiens
aattggttgtatataaa

SEQ ID NO: 6598363 - DNA, 16 bp, Homo sapiens
aattggtttaaacttt

SEQ ID NO: 6598364 - DNA, 17 bp, Homo sapiens
aattggtttaaactttt

SEQ ID NO: 6598365 - DNA, 19 bp, Homo sapiens
aattggtttttactgaaac

SEQ ID NO: 6598366 - DNA, 18 bp, Homo sapiens
aattgtaaaattgtatag

SEQ ID NO: 6598367 - DNA, 17 bp, Homo sapiens
aattgtaaatattttga

SEQ ID NO: 6598368 - DNA, 18 bp, Homo sapiens
aattgtaaatcctgtgtt

SEQ ID NO: 6598369 - DNA, 24 bp, Homo sapiens
aattgtaaattgaatcagtataaa

SEQ ID NO: 6598370 - DNA, 14 bp, Homo sapiens
aattgtaactgttc

SEQ ID NO: 6598371 - DNA, 22 bp, Homo sapiens
aattgtaaggaatgattaatta

SEQ ID NO: 6598372 - DNA, 15 bp, Homo sapiens
aattgtaagtgaaat

SEQ ID NO: 6598373 - DNA, 18 bp, Homo sapiens
aattgtaagtgaaattaa

SEQ ID NO: 6598374 - DNA, 20 bp, Homo sapiens
aattgtaattccaaaatcca

SEQ ID NO: 6598375 - DNA, 17 bp, Homo sapiens
aattgtaatttgggaac

SEQ ID NO: 6598376 - DNA, 12 bp, Homo sapiens
aattgtacaaaa

SEQ ID NO: 6598377 - DNA, 19 bp, Homo sapiens
aattgtacaaaaaagttat

SEQ ID NO: 6598378 - DNA, 13 bp, Homo sapiens
aattgtacaataa

SEQ ID NO: 6598379 - DNA, 14 bp, Homo sapiens
aattgtacaataaa

SEQ ID NO: 6598380 - DNA, 15 bp, Homo sapiens
aattgtacaataaat

SEQ ID NO: 6598381 - DNA, 14 bp, Homo sapiens
aattgtacagccgg

SEQ ID NO: 6598382 - DNA, 14 bp, Homo sapiens
aattgtacatattt

SEQ ID NO: 6598383 - DNA, 21 bp, Homo sapiens
aattgtacatatttgtggaat

SEQ ID NO: 6598384 - DNA, 18 bp, Homo sapiens
aattgtaccatcatttta

SEQ ID NO: 6598385 - DNA, 17 bp, Homo sapiens
aattgtactaaagccaa

SEQ ID NO: 6598386 - DNA, 14 bp, Homo sapiens
aattgtactcaatg

SEQ ID NO: 6598387 - DNA, 13 bp, Homo sapiens
aattgtactgtgt

SEQ ID NO: 6598388 - DNA, 14 bp, Homo sapiens
aattgtactttgaa

SEQ ID NO: 6598389 - DNA, 17 bp, Homo sapiens
aattgtagaacatagat

SEQ ID NO: 6598390 - DNA, 16 bp, Homo sapiens
aattgtagacagcctt

SEQ ID NO: 6598391 - DNA, 22 bp, Homo sapiens
aattgtagagtgcccatggggt

SEQ ID NO: 6598392 - DNA, 18 bp, Homo sapiens
aattgtagataatactgt

SEQ ID NO: 6598393 - DNA, 14 bp, Homo sapiens
aattgtagggcttt

SEQ ID NO: 6598394 - DNA, 17 bp, Homo sapiens
aattgtagttctgtgta

SEQ ID NO: 6598395 - DNA, 16 bp, Homo sapiens
aattgtagttcttagt

SEQ ID NO: 6598396 - DNA, 12 bp, Homo sapiens
aattgtataaaa

SEQ ID NO: 6598397 - DNA, 18 bp, Homo sapiens
aattgtataaaacagtgt

SEQ ID NO: 6598398 - DNA, 14 bp, Homo sapiens
aattgtataacagg

SEQ ID NO: 6598399 - DNA, 17 bp, Homo sapiens
aattgtataacaggtta

SEQ ID NO: 6598400 - DNA, 19 bp, Homo sapiens
aattgtataacaggttatt

SEQ ID NO: 6598401 - DNA, 11 bp, Homo sapiens
aattgtataag

SEQ ID NO: 6598402 - DNA, 21 bp, Homo sapiens
aattgtataagtcaagcacat

SEQ ID NO: 6598403 - DNA, 13 bp, Homo sapiens
aattgtatacatt

SEQ ID NO: 6598404 - DNA, 21 bp, Homo sapiens
aattgtatacattttgttata

SEQ ID NO: 6598405 - DNA, 21 bp, Homo sapiens
aattgtataccaatgtgtttt

SEQ ID NO: 6598406 - DNA, 23 bp, Homo sapiens
aattgtatagagatatgcagaag

SEQ ID NO: 6598407 - DNA, 14 bp, Homo sapiens
aattgtatatatat

SEQ ID NO: 6598408 - DNA, 18 bp, Homo sapiens
aattgtatatatatgtga

SEQ ID NO: 6598409 - DNA, 18 bp, Homo sapiens
aattgtatcaatttgttt

SEQ ID NO: 6598410 - DNA, 20 bp, Homo sapiens
aattgtatcgtatagctgta

SEQ ID NO: 6598411 - DNA, 19 bp, Homo sapiens
aattgtatcttattataaa

SEQ ID NO: 6598412 - DNA, 22 bp, Homo sapiens
aattgtatgttagaataatttt

SEQ ID NO: 6598413 - DNA, 16 bp, Homo sapiens
aattgtattctcataa

SEQ ID NO: 6598414 - DNA, 19 bp, Homo sapiens
aattgtattgaaaacactt

SEQ ID NO: 6598415 - DNA, 19 bp, Homo sapiens
aattgtcaaatgtcattat

SEQ ID NO: 6598416 - DNA, 16 bp, Homo sapiens
aattgtcacctctgtt

SEQ ID NO: 6598417 - DNA, 19 bp, Homo sapiens
aattgtcactttttatgct

SEQ ID NO: 6598418 - DNA, 19 bp, Homo sapiens
aattgtcattatttttgtt

SEQ ID NO: 6598419 - DNA, 19 bp, Homo sapiens
aattgtccacagcaaaggg

SEQ ID NO: 6598420 - DNA, 13 bp, Homo sapiens
aattgtccccagt

SEQ ID NO: 6598421 - DNA, 18 bp, Homo sapiens
aattgtccctctgtggct

SEQ ID NO: 6598422 - DNA, 19 bp, Homo sapiens
aattgtccttgaagcttgt

SEQ ID NO: 6598423 - DNA, 15 bp, Homo sapiens
aattgtcgtttttat

SEQ ID NO: 6598424 - DNA, 19 bp, Homo sapiens
aattgtcgtttttattcct

SEQ ID NO: 6598425 - DNA, 22 bp, Homo sapiens
aattgtctaaagttactactga

SEQ ID NO: 6598426 - DNA, 18 bp, Homo sapiens
aattgtctatttatcttt

SEQ ID NO: 6598427 - DNA, 12 bp, Homo sapiens
aattgtctgaaa

SEQ ID NO: 6598428 - DNA, 19 bp, Homo sapiens
aattgtcttaaaaccagag

SEQ ID NO: 6598429 - DNA, 14 bp, Homo sapiens
aattgtctttcctt

SEQ ID NO: 6598430 - DNA, 17 bp, Homo sapiens
aattgtcttttagacaa

SEQ ID NO: 6598431 - DNA, 16 bp, Homo sapiens
aattgtgaacatgata

SEQ ID NO: 6598432 - DNA, 15 bp, Homo sapiens
aattgtgaactcatt

SEQ ID NO: 6598433 - DNA, 21 bp, Homo sapiens
aattgtgaattgataataaac

SEQ ID NO: 6598434 - DNA, 12 bp, Homo sapiens
aattgtgacagc

SEQ ID NO: 6598435 - DNA, 22 bp, Homo sapiens
aattgtgaccaatacatttgta

SEQ ID NO: 6598436 - DNA, 18 bp, Homo sapiens
aattgtgagaattactgt

SEQ ID NO: 6598437 - DNA, 14 bp, Homo sapiens
aattgtgatgtgtc

SEQ ID NO: 6598438 - DNA, 15 bp, Homo sapiens
aattgtgatgtgtcc

SEQ ID NO: 6598439 - DNA, 16 bp, Homo sapiens
aattgtgatgttttgt

SEQ ID NO: 6598440 - DNA, 21 bp, Homo sapiens
aattgtgatgttttgttcaaa

SEQ ID NO: 6598441 - DNA, 20 bp, Homo sapiens
aattgtgattagacagaaca

SEQ ID NO: 6598442 - DNA, 14 bp, Homo sapiens
aattgtgattgttt

SEQ ID NO: 6598443 - DNA, 16 bp, Homo sapiens
aattgtgcaaaatatt

SEQ ID NO: 6598444 - DNA, 21 bp, Homo sapiens
aattgtgcagtactttgtgca

SEQ ID NO: 6598445 - DNA, 12 bp, Homo sapiens
aattgtgccaaa

SEQ ID NO: 6598446 - DNA, 15 bp, Homo sapiens
aattgtgccaaagat

SEQ ID NO: 6598447 - DNA, 17 bp, Homo sapiens
aattgtgctccaaatgt

SEQ ID NO: 6598448 - DNA, 13 bp, Homo sapiens
aattgtgctgcca

SEQ ID NO: 6598449 - DNA, 13 bp, Homo sapiens
aattgtgctttgt

SEQ ID NO: 6598450 - DNA, 16 bp, Homo sapiens
aattgtggagaggaga

SEQ ID NO: 6598451 - DNA, 17 bp, Homo sapiens
aattgtggattataaaa

SEQ ID NO: 6598452 - DNA, 18 bp, Homo sapiens
aattgtggctatcctgat

SEQ ID NO: 6598453 - DNA, 23 bp, Homo sapiens
aattgtgggcaaaagagaaaaag

SEQ ID NO: 6598454 - DNA, 20 bp, Homo sapiens
aattgtgggcataaactgtt

SEQ ID NO: 6598455 - DNA, 21 bp, Homo sapiens
aattgtggggatgatgaaata

SEQ ID NO: 6598456 - DNA, 16 bp, Homo sapiens
aattgtgggtctattt

SEQ ID NO: 6598457 - DNA, 16 bp, Homo sapiens
aattgtggtttatata

SEQ ID NO: 6598458 - DNA, 15 bp, Homo sapiens
aattgtgtaactgtt

SEQ ID NO: 6598459 - DNA, 17 bp, Homo sapiens
aattgtgtaactgttct

SEQ ID NO: 6598460 - DNA, 22 bp, Homo sapiens
aattgtgtacactttcattact

SEQ ID NO: 6598461 - DNA, 13 bp, Homo sapiens
aattgtgtacctt

SEQ ID NO: 6598462 - DNA, 17 bp, Homo sapiens
aattgtgtagccttttt

SEQ ID NO: 6598463 - DNA, 23 bp, Homo sapiens
aattgtgtatatatcttataact

SEQ ID NO: 6598464 - DNA, 22 bp, Homo sapiens
aattgtgtattgatgcaatata

SEQ ID NO: 6598465 - DNA, 23 bp, Homo sapiens
aattgtgtattgatgcaatataa

SEQ ID NO: 6598466 - DNA, 23 bp, Homo sapiens
aattgtgtcatgattaatgtgta

SEQ ID NO: 6598467 - DNA, 14 bp, Homo sapiens
aattgtgtctgcag

SEQ ID NO: 6598468 - DNA, 22 bp, Homo sapiens
aattgtgtcttaatctctccat

SEQ ID NO: 6598469 - DNA, 15 bp, Homo sapiens
aattgtgtgaacttg

SEQ ID NO: 6598470 - DNA, 22 bp, Homo sapiens
aattgtgtgatatttcagaaat

SEQ ID NO: 6598471 - DNA, 19 bp, Homo sapiens
aattgtgtggattctttaa

SEQ ID NO: 6598472 - DNA, 21 bp, Homo sapiens
aattgtgtggtcagtggctct

SEQ ID NO: 6598473 - DNA, 17 bp, Homo sapiens
aattgtgtgtcttctat

SEQ ID NO: 6598474 - DNA, 14 bp, Homo sapiens
aattgtgtgtgcaa

SEQ ID NO: 6598475 - DNA, 19 bp, Homo sapiens
aattgtgttgtcttcagca

SEQ ID NO: 6598476 - DNA, 15 bp, Homo sapiens
aattgttaagatatg

SEQ ID NO: 6598477 - DNA, 16 bp, Homo sapiens
aattgttaatgtgatg

SEQ ID NO: 6598478 - DNA, 23 bp, Homo sapiens
aattgttacaagtgttcttaggt

SEQ ID NO: 6598479 - DNA, 17 bp, Homo sapiens
aattgttacaatagaat

SEQ ID NO: 6598480 - DNA, 16 bp, Homo sapiens
aattgttacaattttc

SEQ ID NO: 6598481 - DNA, 14 bp, Homo sapiens
aattgttatgaaaa

SEQ ID NO: 6598482 - DNA, 15 bp, Homo sapiens
aattgttatgaaaat

SEQ ID NO: 6598483 - DNA, 17 bp, Homo sapiens
aattgttatttcaatag

SEQ ID NO: 6598484 - DNA, 14 bp, Homo sapiens
aattgttcctcttt

SEQ ID NO: 6598485 - DNA, 17 bp, Homo sapiens
aattgttcctgatgtgc

SEQ ID NO: 6598486 - DNA, 21 bp, Homo sapiens
aattgttccttgcttttatag

SEQ ID NO: 6598487 - DNA, 22 bp, Homo sapiens
aattgttccttgcttttatagt

SEQ ID NO: 6598488 - DNA, 20 bp, Homo sapiens
aattgttctcttaaatattc

SEQ ID NO: 6598489 - DNA, 18 bp, Homo sapiens
aattgttctgggtgattt

SEQ ID NO: 6598490 - DNA, 19 bp, Homo sapiens
aattgttcttaaaaccaat

SEQ ID NO: 6598491 - DNA, 21 bp, Homo sapiens
aattgttgaaactaaagcact

SEQ ID NO: 6598492 - DNA, 16 bp, Homo sapiens
aattgttgaaattttg

SEQ ID NO: 6598493 - DNA, 22 bp, Homo sapiens
aattgttgaacaggtgtttttc

SEQ ID NO: 6598494 - DNA, 14 bp, Homo sapiens
aattgttgatattt

SEQ ID NO: 6598495 - DNA, 23 bp, Homo sapiens
aattgttgcatcccccttagaat

SEQ ID NO: 6598496 - DNA, 23 bp, Homo sapiens
aattgttgctaatcttcttatgc

SEQ ID NO: 6598497 - DNA, 19 bp, Homo sapiens
aattgttgtggtttaaata

SEQ ID NO: 6598498 - DNA, 12 bp, Homo sapiens
aattgttgttct

SEQ ID NO: 6598499 - DNA, 14 bp, Homo sapiens
aattgttgttctgt

SEQ ID NO: 6598500 - DNA, 15 bp, Homo sapiens
aattgttgttctgtt

SEQ ID NO: 6598501 - DNA, 17 bp, Homo sapiens
aattgttgttctgttaa

SEQ ID NO: 6598502 - DNA, 15 bp, Homo sapiens
aattgttgtttcttt

SEQ ID NO: 6598503 - DNA, 17 bp, Homo sapiens
aattgttgtttctttct

SEQ ID NO: 6598504 - DNA, 18 bp, Homo sapiens
aattgttgtttctttcta

SEQ ID NO: 6598505 - DNA, 19 bp, Homo sapiens
aattgttgtttctttctag

SEQ ID NO: 6598506 - DNA, 21 bp, Homo sapiens
aattgttgtttgtatgtataa

SEQ ID NO: 6598507 - DNA, 14 bp, Homo sapiens
aattgtttaaaagc

SEQ ID NO: 6598508 - DNA, 15 bp, Homo sapiens
aattgtttaaaagca

SEQ ID NO: 6598509 - DNA, 14 bp, Homo sapiens
aattgtttaagaat

SEQ ID NO: 6598510 - DNA, 17 bp, Homo sapiens
aattgtttaagaatcat

SEQ ID NO: 6598511 - DNA, 19 bp, Homo sapiens
aattgtttaagaatcatgg

SEQ ID NO: 6598512 - DNA, 20 bp, Homo sapiens
aattgtttaagtgttgtaaa

SEQ ID NO: 6598513 - DNA, 20 bp, Homo sapiens
aattgtttaatgttggaaaa

SEQ ID NO: 6598514 - DNA, 16 bp, Homo sapiens
aattgtttatacacaa

SEQ ID NO: 6598515 - DNA, 23 bp, Homo sapiens
aattgtttatgtgttatgaacat

SEQ ID NO: 6598516 - DNA, 12 bp, Homo sapiens
aattgtttcaca

SEQ ID NO: 6598517 - DNA, 15 bp, Homo sapiens
aattgtttcatatct

SEQ ID NO: 6598518 - DNA, 13 bp, Homo sapiens
aattgtttccaaa

SEQ ID NO: 6598519 - DNA, 21 bp, Homo sapiens
aattgtttgacggcaaggttt

SEQ ID NO: 6598520 - DNA, 22 bp, Homo sapiens
aattgttttacctgttctgaaa

SEQ ID NO: 6598521 - DNA, 14 bp, Homo sapiens
aattgttttcactt

SEQ ID NO: 6598522 - DNA, 17 bp, Homo sapiens
aattgttttgcactttt

SEQ ID NO: 6598523 - DNA, 18 bp, Homo sapiens
aattgtttttataaaaac

SEQ ID NO: 6598524 - DNA, 20 bp, Homo sapiens
aattgtttttattgttttct

SEQ ID NO: 6598525 - DNA, 17 bp, Homo sapiens
aattgtttttgaattta

SEQ ID NO: 6598526 - DNA, 21 bp, Homo sapiens
aattgtttttgaatttaaata

SEQ ID NO: 6598527 - DNA, 17 bp, Homo sapiens
aattgttttttaaagca

SEQ ID NO: 6598528 - DNA, 18 bp, Homo sapiens
aatttaaaaaactcctgt

SEQ ID NO: 6598529 - DNA, 18 bp, Homo sapiens
aatttaaaaacttaaata

SEQ ID NO: 6598530 - DNA, 15 bp, Homo sapiens
aatttaaaaagcaaa

SEQ ID NO: 6598531 - DNA, 17 bp, Homo sapiens
aatttaaaaagcccaac

SEQ ID NO: 6598532 - DNA, 16 bp, Homo sapiens
aatttaaaaataaagc

SEQ ID NO: 6598533 - DNA, 14 bp, Homo sapiens
aatttaaaaatata

SEQ ID NO: 6598534 - DNA, 22 bp, Homo sapiens
aatttaaaaatctttcagaata

SEQ ID NO: 6598535 - DNA, 14 bp, Homo sapiens
aatttaaaaattaa

SEQ ID NO: 6598536 - DNA, 22 bp, Homo sapiens
aatttaaaaattaaagcagcaa

SEQ ID NO: 6598537 - DNA, 16 bp, Homo sapiens
aatttaaaacacagta

SEQ ID NO: 6598538 - DNA, 13 bp, Homo sapiens
aatttaaaactgt

SEQ ID NO: 6598539 - DNA, 22 bp, Homo sapiens
aatttaaaagcagagcattttt

SEQ ID NO: 6598540 - DNA, 14 bp, Homo sapiens
ttttaataaattga

SEQ ID NO: 6598541 - DNA, 18 bp, Homo sapiens
ttttaataagaacagatc

SEQ ID NO: 6598542 - DNA, 14 bp, Homo sapiens
ttttaataatgttt

SEQ ID NO: 6598543 - DNA, 21 bp, Homo sapiens
ttttaatacagattgaaagga

SEQ ID NO: 6598544 - DNA, 12 bp, Homo sapiens
ttttaatacagg

SEQ ID NO: 6598545 - DNA, 23 bp, Homo sapiens
ttttaatacaggacttttaaatg

SEQ ID NO: 6598546 - DNA, 12 bp, Homo sapiens
ttttaatagcac

SEQ ID NO: 6598547 - DNA, 18 bp, Homo sapiens
ttttaatagtgctttttt

SEQ ID NO: 6598548 - DNA, 17 bp, Homo sapiens
ttttaatatataattta

SEQ ID NO: 6598549 - DNA, 12 bp, Homo sapiens
ttttaatatcct

SEQ ID NO: 6598550 - DNA, 13 bp, Homo sapiens
ttttaatatgtaa

SEQ ID NO: 6598551 - DNA, 15 bp, Homo sapiens
ttttaatattactgt

SEQ ID NO: 6598552 - DNA, 18 bp, Homo sapiens
ttttaatattcttttgtt

SEQ ID NO: 6598553 - DNA, 15 bp, Homo sapiens
ttttaatattgatgt

SEQ ID NO: 6598554 - DNA, 20 bp, Homo sapiens
ttttaatcaattaggggcaa

SEQ ID NO: 6598555 - DNA, 18 bp, Homo sapiens
ttttaatcatgagcctgt

SEQ ID NO: 6598556 - DNA, 21 bp, Homo sapiens
ttttaatcgtacattttcata

SEQ ID NO: 6598557 - DNA, 13 bp, Homo sapiens
ttttaatctcttg

SEQ ID NO: 6598558 - DNA, 11 bp, Homo sapiens
ttttaatctgc

SEQ ID NO: 6598559 - DNA, 22 bp, Homo sapiens
ttttaatgaaaaggaatcacgt

SEQ ID NO: 6598560 - DNA, 21 bp, Homo sapiens
ttttaatgaatattgatgtta

SEQ ID NO: 6598561 - DNA, 16 bp, Homo sapiens
ttttaatgacttttta

SEQ ID NO: 6598562 - DNA, 19 bp, Homo sapiens
ttttaatgatggtgttaaa

SEQ ID NO: 6598563 - DNA, 22 bp, Homo sapiens
ttttaatgatggtgttaaagct

SEQ ID NO: 6598564 - DNA, 16 bp, Homo sapiens
ttttaatgcagttgct

SEQ ID NO: 6598565 - DNA, 20 bp, Homo sapiens
ttttaatgctatttgaacaa

SEQ ID NO: 6598566 - DNA, 17 bp, Homo sapiens
ttttaatgctccaaatg

SEQ ID NO: 6598567 - DNA, 23 bp, Homo sapiens
ttttaatggaaagttgtatccat

SEQ ID NO: 6598568 - DNA, 17 bp, Homo sapiens
ttttaatggcagcagaa

SEQ ID NO: 6598569 - DNA, 21 bp, Homo sapiens
ttttaatggcagcagaaaact

SEQ ID NO: 6598570 - DNA, 20 bp, Homo sapiens
ttttaatgggggtagcagct

SEQ ID NO: 6598571 - DNA, 22 bp, Homo sapiens
ttttaatgggggtagcagctgg

SEQ ID NO: 6598572 - DNA, 13 bp, Homo sapiens
ttttaatggttaa

SEQ ID NO: 6598573 - DNA, 12 bp, Homo sapiens
ttttaatgtaaa

SEQ ID NO: 6598574 - DNA, 20 bp, Homo sapiens
ttttaatgtacttgaaaaat

SEQ ID NO: 6598575 - DNA, 14 bp, Homo sapiens
ttttaatgtatcta

SEQ ID NO: 6598576 - DNA, 21 bp, Homo sapiens
ttttaatgtatctatttgtac

SEQ ID NO: 6598577 - DNA, 16 bp, Homo sapiens
ttttaatgtatcttaa

SEQ ID NO: 6598578 - DNA, 22 bp, Homo sapiens
ttttaatgtctgtttattaact

SEQ ID NO: 6598579 - DNA, 11 bp, Homo sapiens
ttttaatgtga

SEQ ID NO: 6598580 - DNA, 18 bp, Homo sapiens
ttttaatgtgatgatgta

SEQ ID NO: 6598581 - DNA, 18 bp, Homo sapiens
ttttaatgtgctgtgtaa

SEQ ID NO: 6598582 - DNA, 19 bp, Homo sapiens
ttttaatgtgctgtgtaaa

SEQ ID NO: 6598583 - DNA, 21 bp, Homo sapiens
ttttaatgtgctgtgtaaagt

SEQ ID NO: 6598584 - DNA, 12 bp, Homo sapiens
ttttaattaaaa

SEQ ID NO: 6598585 - DNA, 15 bp, Homo sapiens
ttttaattaaaaact

SEQ ID NO: 6598586 - DNA, 19 bp, Homo sapiens
ttttaattaaaaactttaa

SEQ ID NO: 6598587 - DNA, 23 bp, Homo sapiens
ttttaattaaaattggtaaaaat

SEQ ID NO: 6598588 - DNA, 13 bp, Homo sapiens
ttttaattaaatg

SEQ ID NO: 6598589 - DNA, 13 bp, Homo sapiens
ttttaattacaga

SEQ ID NO: 6598590 - DNA, 15 bp, Homo sapiens
ttttaattactgttt

SEQ ID NO: 6598591 - DNA, 13 bp, Homo sapiens
ttttaattattgt

SEQ ID NO: 6598592 - DNA, 18 bp, Homo sapiens
ttttaattattttaaaat

SEQ ID NO: 6598593 - DNA, 20 bp, Homo sapiens
ttttaattattttctgagac

SEQ ID NO: 6598594 - DNA, 20 bp, Homo sapiens
ttttaattcaccaaagtatt

SEQ ID NO: 6598595 - DNA, 19 bp, Homo sapiens
ttttaattcacgtgctttg

SEQ ID NO: 6598596 - DNA, 21 bp, Homo sapiens
ttttaattcacgtgctttgtg

SEQ ID NO: 6598597 - DNA, 16 bp, Homo sapiens
ttttaattcagtacaa

SEQ ID NO: 6598598 - DNA, 12 bp, Homo sapiens
ttttaattcatt

SEQ ID NO: 6598599 - DNA, 18 bp, Homo sapiens
ttttaattccaatatgat

SEQ ID NO: 6598600 - DNA, 22 bp, Homo sapiens
ttttaattccaatatgatgact

SEQ ID NO: 6598601 - DNA, 15 bp, Homo sapiens
ttttaattccatgaa

SEQ ID NO: 6598602 - DNA, 18 bp, Homo sapiens
ttttaattccatgaatcg

SEQ ID NO: 6598603 - DNA, 21 bp, Homo sapiens
ttttaattccatgaatcgctt

SEQ ID NO: 6598604 - DNA, 12 bp, Homo sapiens
ttttaattgaaa

SEQ ID NO: 6598605 - DNA, 18 bp, Homo sapiens
ttttaattgaaattaact

SEQ ID NO: 6598606 - DNA, 14 bp, Homo sapiens
ttttaattgcaaca

SEQ ID NO: 6598607 - DNA, 21 bp, Homo sapiens
ttttaattgcaacaatgcaaa

SEQ ID NO: 6598608 - DNA, 13 bp, Homo sapiens
ttttaattgtatt

SEQ ID NO: 6598609 - DNA, 13 bp, Homo sapiens
ttttaattgtcat

SEQ ID NO: 6598610 - DNA, 15 bp, Homo sapiens
ttttaattgtcatgg

SEQ ID NO: 6598611 - DNA, 23 bp, Homo sapiens
ttttaattgtcatggttacaaac

SEQ ID NO: 6598612 - DNA, 14 bp, Homo sapiens
ttttaatttaaaaa

SEQ ID NO: 6598613 - DNA, 15 bp, Homo sapiens
ttttaatttaaagct

SEQ ID NO: 6598614 - DNA, 14 bp, Homo sapiens
ttttaatttaaagt

SEQ ID NO: 6598615 - DNA, 15 bp, Homo sapiens
ttttaatttaaagtt

SEQ ID NO: 6598616 - DNA, 18 bp, Homo sapiens
ttttaatttaacaaacta

SEQ ID NO: 6598617 - DNA, 17 bp, Homo sapiens
ttttaatttacaaaaat

SEQ ID NO: 6598618 - DNA, 18 bp, Homo sapiens
ttttaatttacttgtttt

SEQ ID NO: 6598619 - DNA, 14 bp, Homo sapiens
ttttaatttagtaa

SEQ ID NO: 6598620 - DNA, 20 bp, Homo sapiens
ttttaatttagtaaatgtta

SEQ ID NO: 6598621 - DNA, 21 bp, Homo sapiens
ttttaatttatttatactatt

SEQ ID NO: 6598622 - DNA, 22 bp, Homo sapiens
ttttaatttatttattaagatg

SEQ ID NO: 6598623 - DNA, 21 bp, Homo sapiens
ttttaatttatttcatccagt

SEQ ID NO: 6598624 - DNA, 11 bp, Homo sapiens
ttttaatttca

SEQ ID NO: 6598625 - DNA, 19 bp, Homo sapiens
ttttaatttcaagcttatt

SEQ ID NO: 6598626 - DNA, 13 bp, Homo sapiens
ttttaatttcagg

SEQ ID NO: 6598627 - DNA, 12 bp, Homo sapiens
ttttaatttcta

SEQ ID NO: 6598628 - DNA, 23 bp, Homo sapiens
ttttaatttctgcaaatgtaatt

SEQ ID NO: 6598629 - DNA, 11 bp, Homo sapiens
ttttaatttga

SEQ ID NO: 6598630 - DNA, 17 bp, Homo sapiens
ttttaatttgaatcaga

SEQ ID NO: 6598631 - DNA, 15 bp, Homo sapiens
ttttaatttgatgaa

SEQ ID NO: 6598632 - DNA, 21 bp, Homo sapiens
ttttaatttgatgaaagctga

SEQ ID NO: 6598633 - DNA, 14 bp, Homo sapiens
ttttaatttgtttt

SEQ ID NO: 6598634 - DNA, 16 bp, Homo sapiens
ttttaattttcacaaa

SEQ ID NO: 6598635 - DNA, 19 bp, Homo sapiens
ttttaattttcaggtcaag

SEQ ID NO: 6598636 - DNA, 13 bp, Homo sapiens
ttttaattttgat

SEQ ID NO: 6598637 - DNA, 13 bp, Homo sapiens
ttttaattttgta

SEQ ID NO: 6598638 - DNA, 13 bp, Homo sapiens
ttttaattttgtc

SEQ ID NO: 6598639 - DNA, 17 bp, Homo sapiens
ttttaattttgtgttgc

SEQ ID NO: 6598640 - DNA, 19 bp, Homo sapiens
ttttaattttgtgttgcta

SEQ ID NO: 6598641 - DNA, 12 bp, Homo sapiens
ttttacaaaact

SEQ ID NO: 6598642 - DNA, 18 bp, Homo sapiens
ttttacaaacagatgaaa

SEQ ID NO: 6598643 - DNA, 15 bp, Homo sapiens
ttttacaaagaaaca

SEQ ID NO: 6598644 - DNA, 12 bp, Homo sapiens
ttttacaaagcc

SEQ ID NO: 6598645 - DNA, 13 bp, Homo sapiens
ttttacaaatatt

SEQ ID NO: 6598646 - DNA, 20 bp, Homo sapiens
ttttacaaatattaagaaaa

SEQ ID NO: 6598647 - DNA, 21 bp, Homo sapiens
ttttacaaatattaagaaaat

SEQ ID NO: 6598648 - DNA, 12 bp, Homo sapiens
ttttacaaatgt

SEQ ID NO: 6598649 - DNA, 22 bp, Homo sapiens
ttttacaaatgttaaaatgtgt

SEQ ID NO: 6598650 - DNA, 20 bp, Homo sapiens
ttttacaaattaatatttgt

SEQ ID NO: 6598651 - DNA, 23 bp, Homo sapiens
ttttacaaattcctttcagagtt

SEQ ID NO: 6598652 - DNA, 16 bp, Homo sapiens
ttttacaagatccatt

SEQ ID NO: 6598653 - DNA, 12 bp, Homo sapiens
ttttacaagtaa

SEQ ID NO: 6598654 - DNA, 18 bp, Homo sapiens
ttttacaagtataacagt

SEQ ID NO: 6598655 - DNA, 20 bp, Homo sapiens
ttttacaagtataacagttt

SEQ ID NO: 6598656 - DNA, 21 bp, Homo sapiens
ttttacaagtggttaaaacat

SEQ ID NO: 6598657 - DNA, 20 bp, Homo sapiens
ttttacaatctgtatctttg

SEQ ID NO: 6598658 - DNA, 17 bp, Homo sapiens
ttttacaatgatttgta

SEQ ID NO: 6598659 - DNA, 14 bp, Homo sapiens
ttttacaattgaaa

SEQ ID NO: 6598660 - DNA, 14 bp, Homo sapiens
ttttacacagcacc

SEQ ID NO: 6598661 - DNA, 18 bp, Homo sapiens
ttttacacgagatttctt

SEQ ID NO: 6598662 - DNA, 14 bp, Homo sapiens
ttttacacgtctat

SEQ ID NO: 6598663 - DNA, 21 bp, Homo sapiens
ttttacactggatgtttctca

SEQ ID NO: 6598664 - DNA, 11 bp, Homo sapiens
ttttacacttg

SEQ ID NO: 6598665 - DNA, 18 bp, Homo sapiens
ttttacactttatggtaa

SEQ ID NO: 6598666 - DNA, 22 bp, Homo sapiens
ttttacagaatgcattaaaaaa

SEQ ID NO: 6598667 - DNA, 15 bp, Homo sapiens
ttttacagcagcaat

SEQ ID NO: 6598668 - DNA, 17 bp, Homo sapiens
ttttacagctactttaa

SEQ ID NO: 6598669 - DNA, 13 bp, Homo sapiens
ttttacagtaaat

SEQ ID NO: 6598670 - DNA, 18 bp, Homo sapiens
ttttacagtatcttcaaa

SEQ ID NO: 6598671 - DNA, 22 bp, Homo sapiens
ttttacagtatcttcaaaaata

SEQ ID NO: 6598672 - DNA, 20 bp, Homo sapiens
ttttacagtgaatttctgat

SEQ ID NO: 6598673 - DNA, 19 bp, Homo sapiens
ttttacagtgaccttttct

SEQ ID NO: 6598674 - DNA, 18 bp, Homo sapiens
ttttacataactgccttg

SEQ ID NO: 6598675 - DNA, 17 bp, Homo sapiens
ttttacataattgccaa

SEQ ID NO: 6598676 - DNA, 15 bp, Homo sapiens
ttttacatactgctg

SEQ ID NO: 6598677 - DNA, 16 bp, Homo sapiens
ttttacatctaaacta

SEQ ID NO: 6598678 - DNA, 21 bp, Homo sapiens
ttttacatgaagctgtataat

SEQ ID NO: 6598679 - DNA, 14 bp, Homo sapiens
ttttacatgaagta

SEQ ID NO: 6598680 - DNA, 17 bp, Homo sapiens
ttttacatgacagatat

SEQ ID NO: 6598681 - DNA, 15 bp, Homo sapiens
ttttacatggagaaa

SEQ ID NO: 6598682 - DNA, 23 bp, Homo sapiens
ttttacattacagaatatgaatg

SEQ ID NO: 6598683 - DNA, 15 bp, Homo sapiens
ttttacattatgcaa

SEQ ID NO: 6598684 - DNA, 18 bp, Homo sapiens
ttttacattccatttcat

SEQ ID NO: 6598685 - DNA, 13 bp, Homo sapiens
ttttacattctgt

SEQ ID NO: 6598686 - DNA, 13 bp, Homo sapiens
ttttacatttcta

SEQ ID NO: 6598687 - DNA, 16 bp, Homo sapiens
ttttacatttgttgta

SEQ ID NO: 6598688 - DNA, 15 bp, Homo sapiens
ttttaccaaagcatc

SEQ ID NO: 6598689 - DNA, 16 bp, Homo sapiens
ttttaccaaagcatca

SEQ ID NO: 6598690 - DNA, 12 bp, Homo sapiens
ttttaccaactt

SEQ ID NO: 6598691 - DNA, 17 bp, Homo sapiens
ttttaccaagttatata

SEQ ID NO: 6598692 - DNA, 21 bp, Homo sapiens
ttttaccaagttatataaaga

SEQ ID NO: 6598693 - DNA, 23 bp, Homo sapiens
ttttaccatcacacatgttcaga

SEQ ID NO: 6598694 - DNA, 22 bp, Homo sapiens
ttttaccatgcccctgagcaat

SEQ ID NO: 6598695 - DNA, 16 bp, Homo sapiens
ttttacccaaatatgt

SEQ ID NO: 6598696 - DNA, 22 bp, Homo sapiens
ttttaccctaatgtcttcataa

SEQ ID NO: 6598697 - DNA, 14 bp, Homo sapiens
ttttaccctgtgtc

SEQ ID NO: 6598698 - DNA, 18 bp, Homo sapiens
ttttaccctgtgtcagag

SEQ ID NO: 6598699 - DNA, 20 bp, Homo sapiens
ttttacctaccacagtgtct

SEQ ID NO: 6598700 - DNA, 21 bp, Homo sapiens
ttttacctaccacagtgtctg

SEQ ID NO: 6598701 - DNA, 21 bp, Homo sapiens
ttttacctgtcacattgcatt

SEQ ID NO: 6598702 - DNA, 23 bp, Homo sapiens
ttttacctgtcacattgcattct

SEQ ID NO: 6598703 - DNA, 16 bp, Homo sapiens
ttttaccttaaatctg

SEQ ID NO: 6598704 - DNA, 15 bp, Homo sapiens
ttttaccttcaaaat

SEQ ID NO: 6598705 - DNA, 14 bp, Homo sapiens
ttttaccttcactg

SEQ ID NO: 6598706 - DNA, 21 bp, Homo sapiens
ttttaccttcagtaaacacca

SEQ ID NO: 6598707 - DNA, 16 bp, Homo sapiens
ttttacggaattccaa

SEQ ID NO: 6598708 - DNA, 19 bp, Homo sapiens
ttttacggtgatattgtgc

SEQ ID NO: 6598709 - DNA, 23 bp, Homo sapiens
ttttacgtagctatttttataca

SEQ ID NO: 6598710 - DNA, 21 bp, Homo sapiens
ttttacgtgcaaacaacctga

SEQ ID NO: 6598711 - DNA, 14 bp, Homo sapiens
ttttactaaagcag

SEQ ID NO: 6598712 - DNA, 15 bp, Homo sapiens
ttttactaaagcagt

SEQ ID NO: 6598713 - DNA, 16 bp, Homo sapiens
ttttactaaagcagtg

SEQ ID NO: 6598714 - DNA, 17 bp, Homo sapiens
ttttactaaagcagtgt

SEQ ID NO: 6598715 - DNA, 13 bp, Homo sapiens
ttttactaagaca

SEQ ID NO: 6598716 - DNA, 19 bp, Homo sapiens
ttttactaagttttcaaat

SEQ ID NO: 6598717 - DNA, 22 bp, Homo sapiens
ttttactaccaatgccaagata

SEQ ID NO: 6598718 - DNA, 18 bp, Homo sapiens
ttttactagaaatgggaa

SEQ ID NO: 6598719 - DNA, 18 bp, Homo sapiens
ttttactattaacatgat

SEQ ID NO: 6598720 - DNA, 22 bp, Homo sapiens
ttttactcaggctttctattgg

SEQ ID NO: 6598721 - DNA, 16 bp, Homo sapiens
ttttactcattgaaat

SEQ ID NO: 6598722 - DNA, 20 bp, Homo sapiens
ttttactcattgaaatgtca

SEQ ID NO: 6598723 - DNA, 15 bp, Homo sapiens
ttttactccttttta

SEQ ID NO: 6598724 - DNA, 13 bp, Homo sapiens
ttttactctgcct

SEQ ID NO: 6598725 - DNA, 14 bp, Homo sapiens
ttttactctgccta

SEQ ID NO: 6598726 - DNA, 16 bp, Homo sapiens
ttttactctgcctaca

SEQ ID NO: 6598727 - DNA, 23 bp, Homo sapiens
ttttactctgtgtaaagacttga

SEQ ID NO: 6598728 - DNA, 15 bp, Homo sapiens
ttttactgaatgatc

SEQ ID NO: 6598729 - DNA, 14 bp, Homo sapiens
ttttactgacagaa

SEQ ID NO: 6598730 - DNA, 12 bp, Homo sapiens
ttttactgcatt

SEQ ID NO: 6598731 - DNA, 20 bp, Homo sapiens
ttttactgcattttcacaac

SEQ ID NO: 6598732 - DNA, 14 bp, Homo sapiens
ttttactgccactc

SEQ ID NO: 6598733 - DNA, 17 bp, Homo sapiens
ttttactgccactcttt

SEQ ID NO: 6598734 - DNA, 13 bp, Homo sapiens
ttttactgccctt

SEQ ID NO: 6598735 - DNA, 13 bp, Homo sapiens
ttttactggctgt

SEQ ID NO: 6598736 - DNA, 18 bp, Homo sapiens
ttttactggttgcatgga

SEQ ID NO: 6598737 - DNA, 21 bp, Homo sapiens
ttttactggttgcatggaaat

SEQ ID NO: 6598738 - DNA, 14 bp, Homo sapiens
ttttactgtacaga

SEQ ID NO: 6598739 - DNA, 17 bp, Homo sapiens
ttttactgtcagattaa

SEQ ID NO: 6598740 - DNA, 11 bp, Homo sapiens
ttttactgttg

SEQ ID NO: 6598741 - DNA, 15 bp, Homo sapiens
ttttacttacaaaaa

SEQ ID NO: 6598742 - DNA, 21 bp, Homo sapiens
ttttacttagctggagaacta

SEQ ID NO: 6598743 - DNA, 12 bp, Homo sapiens
ttttacttgaag

SEQ ID NO: 6598744 - DNA, 16 bp, Homo sapiens
ttttacttgaatcaga

SEQ ID NO: 6598745 - DNA, 18 bp, Homo sapiens
ttttacttgaatcagatg

SEQ ID NO: 6598746 - DNA, 15 bp, Homo sapiens
ttttacttgagcaaa

SEQ ID NO: 6598747 - DNA, 12 bp, Homo sapiens
ttttacttgtat

SEQ ID NO: 6598748 - DNA, 22 bp, Homo sapiens
ttttacttgttcatttctgtct

SEQ ID NO: 6598749 - DNA, 12 bp, Homo sapiens
ttttactttggt

SEQ ID NO: 6598750 - DNA, 19 bp, Homo sapiens
ttttactttgtacttgtgt

SEQ ID NO: 6598751 - DNA, 12 bp, Homo sapiens
ttttactttgtt

SEQ ID NO: 6598752 - DNA, 18 bp, Homo sapiens
ttttacttttaaactgtg

SEQ ID NO: 6598753 - DNA, 21 bp, Homo sapiens
ttttacttttcacactgtctt

SEQ ID NO: 6598754 - DNA, 12 bp, Homo sapiens
ttttacttttgt

SEQ ID NO: 6598755 - DNA, 16 bp, Homo sapiens
ttttactttttttagt

SEQ ID NO: 6598756 - DNA, 17 bp, Homo sapiens
ttttactttttttagta

SEQ ID NO: 6598757 - DNA, 17 bp, Homo sapiens
ttttagaaaaacattta

SEQ ID NO: 6598758 - DNA, 14 bp, Homo sapiens
ttttagaaaacagc

SEQ ID NO: 6598759 - DNA, 21 bp, Homo sapiens
ttttagaaaaccccacagaaa

SEQ ID NO: 6598760 - DNA, 16 bp, Homo sapiens
ttttagaaacctcatt

SEQ ID NO: 6598761 - DNA, 15 bp, Homo sapiens
ttttagaaagaaaat

SEQ ID NO: 6598762 - DNA, 16 bp, Homo sapiens
ttttagaaagcatttg

SEQ ID NO: 6598763 - DNA, 18 bp, Homo sapiens
ttttagaaagcatttgaa

SEQ ID NO: 6598764 - DNA, 15 bp, Homo sapiens
ttttagaaagctaaa

SEQ ID NO: 6598765 - DNA, 17 bp, Homo sapiens
ttttagaaattctataa

SEQ ID NO: 6598766 - DNA, 13 bp, Homo sapiens
ttttagaaattgg

SEQ ID NO: 6598767 - DNA, 11 bp, Homo sapiens
ttttagaacag

SEQ ID NO: 6598768 - DNA, 17 bp, Homo sapiens
ttttagaacagaaaaca

SEQ ID NO: 6598769 - DNA, 21 bp, Homo sapiens
ttttagaagattctatgttaa

SEQ ID NO: 6598770 - DNA, 22 bp, Homo sapiens
ttttagaagattctatgttaat

SEQ ID NO: 6598771 - DNA, 17 bp, Homo sapiens
ttttagaataagaattt

SEQ ID NO: 6598772 - DNA, 22 bp, Homo sapiens
ttttagaataagaatttgcata

SEQ ID NO: 6598773 - DNA, 21 bp, Homo sapiens
ttttagacaaatactcatgtg

SEQ ID NO: 6598774 - DNA, 22 bp, Homo sapiens
ttttagacaaatctaagggaaa

SEQ ID NO: 6598775 - DNA, 16 bp, Homo sapiens
ttttagagacagggtc

SEQ ID NO: 6598776 - DNA, 14 bp, Homo sapiens
ttttagagcattaa

SEQ ID NO: 6598777 - DNA, 19 bp, Homo sapiens
ttttagagcttccaaatgt

SEQ ID NO: 6598778 - DNA, 23 bp, Homo sapiens
ttttagaggactattacatattt

SEQ ID NO: 6598779 - DNA, 23 bp, Homo sapiens
ttttagaggcagggctgcattgg

SEQ ID NO: 6598780 - DNA, 18 bp, Homo sapiens
ttttagaggtgagtttta

SEQ ID NO: 6598781 - DNA, 19 bp, Homo sapiens
ttttagatcaaatacttta

SEQ ID NO: 6598782 - DNA, 18 bp, Homo sapiens
ttttagatccaaatgtaa

SEQ ID NO: 6598783 - DNA, 13 bp, Homo sapiens
ttttagatttctt

SEQ ID NO: 6598784 - DNA, 21 bp, Homo sapiens
ttttagcaatttatacaatat

SEQ ID NO: 6598785 - DNA, 11 bp, Homo sapiens
ttttagcatgt

SEQ ID NO: 6598786 - DNA, 19 bp, Homo sapiens
ttttagccataattttgca

SEQ ID NO: 6598787 - DNA, 20 bp, Homo sapiens
ttttagcctcttccctctga

SEQ ID NO: 6598788 - DNA, 13 bp, Homo sapiens
ttttagcctggct

SEQ ID NO: 6598789 - DNA, 16 bp, Homo sapiens
ttttagccttctctgt

SEQ ID NO: 6598790 - DNA, 17 bp, Homo sapiens
ttttagcggtttgcaaa

SEQ ID NO: 6598791 - DNA, 16 bp, Homo sapiens
ttttagctctgttctt

SEQ ID NO: 6598792 - DNA, 20 bp, Homo sapiens
ttttagctgatgaacttatt

SEQ ID NO: 6598793 - DNA, 17 bp, Homo sapiens
ttttagcttcatatcta

SEQ ID NO: 6598794 - DNA, 17 bp, Homo sapiens
ttttaggaaaagcatct

SEQ ID NO: 6598795 - DNA, 11 bp, Homo sapiens
ttttaggaaat

SEQ ID NO: 6598796 - DNA, 15 bp, Homo sapiens
ttttaggaaatgaat

SEQ ID NO: 6598797 - DNA, 13 bp, Homo sapiens
ttttaggaactca

SEQ ID NO: 6598798 - DNA, 19 bp, Homo sapiens
ttttaggaactcactcttt

SEQ ID NO: 6598799 - DNA, 18 bp, Homo sapiens
ttttaggaagcaagctta

SEQ ID NO: 6598800 - DNA, 18 bp, Homo sapiens
ttttaggaataataaatt

SEQ ID NO: 6598801 - DNA, 15 bp, Homo sapiens
ttttaggagacagtc

SEQ ID NO: 6598802 - DNA, 14 bp, Homo sapiens
ttttaggatactta

SEQ ID NO: 6598803 - DNA, 19 bp, Homo sapiens
ttttaggatacttaacaaa

SEQ ID NO: 6598804 - DNA, 20 bp, Homo sapiens
ttttaggatacttaacaaat

SEQ ID NO: 6598805 - DNA, 16 bp, Homo sapiens
ttttaggatctcgcct

SEQ ID NO: 6598806 - DNA, 13 bp, Homo sapiens
ttttaggcaaaga

SEQ ID NO: 6598807 - DNA, 21 bp, Homo sapiens
ttttaggcaaagataatttat

SEQ ID NO: 6598808 - DNA, 19 bp, Homo sapiens
ttttaggcagggatttgag

SEQ ID NO: 6598809 - DNA, 16 bp, Homo sapiens
ttttaggcataagatg

SEQ ID NO: 6598810 - DNA, 14 bp, Homo sapiens
ttttaggctattat

SEQ ID NO: 6598811 - DNA, 18 bp, Homo sapiens
ttttaggctattataata

SEQ ID NO: 6598812 - DNA, 23 bp, Homo sapiens
ttttagggagaagggcttttctt

SEQ ID NO: 6598813 - DNA, 22 bp, Homo sapiens
ttttagggtcaatgagagccat

SEQ ID NO: 6598814 - DNA, 19 bp, Homo sapiens
ttttagggttctaaatgca

SEQ ID NO: 6598815 - DNA, 18 bp, Homo sapiens
ttttaggtctcttcccct

SEQ ID NO: 6598816 - DNA, 20 bp, Homo sapiens
ttttaggtgctgttatgttt

SEQ ID NO: 6598817 - DNA, 23 bp, Homo sapiens
ttttaggtggctgggagttttga

SEQ ID NO: 6598818 - DNA, 22 bp, Homo sapiens
ttttaggtgttgattttctgtt

SEQ ID NO: 6598819 - DNA, 12 bp, Homo sapiens
ttttaggttcta

SEQ ID NO: 6598820 - DNA, 18 bp, Homo sapiens
ttttaggttctaaagttc

SEQ ID NO: 6598821 - DNA, 16 bp, Homo sapiens
ttttaggttgttacca

SEQ ID NO: 6598822 - DNA, 17 bp, Homo sapiens
ttttaggtttatctttt

SEQ ID NO: 6598823 - DNA, 17 bp, Homo sapiens
ttttagtaacctttaaa

SEQ ID NO: 6598824 - DNA, 14 bp, Homo sapiens
ttttagtaatctgt

SEQ ID NO: 6598825 - DNA, 15 bp, Homo sapiens
ttttagtaatctgta

SEQ ID NO: 6598826 - DNA, 15 bp, Homo sapiens
ttttagtattcattc

SEQ ID NO: 6598827 - DNA, 20 bp, Homo sapiens
ttttagtatttatttatgta

SEQ ID NO: 6598828 - DNA, 23 bp, Homo sapiens
ttttagtatttatttatgtactt

SEQ ID NO: 6598829 - DNA, 17 bp, Homo sapiens
ttttagtcactaagact

SEQ ID NO: 6598830 - DNA, 13 bp, Homo sapiens
ttttagtcacttt

SEQ ID NO: 6598831 - DNA, 15 bp, Homo sapiens
ttttagtcagaaatg

SEQ ID NO: 6598832 - DNA, 18 bp, Homo sapiens
ttttagtcagaaatgatt

SEQ ID NO: 6598833 - DNA, 18 bp, Homo sapiens
ttttagtgattttaataa

SEQ ID NO: 6598834 - DNA, 23 bp, Homo sapiens
ttttagtggaccctgaaatgtgt

SEQ ID NO: 6598835 - DNA, 16 bp, Homo sapiens
ttttagtgtaaaattg

SEQ ID NO: 6598836 - DNA, 15 bp, Homo sapiens
ttttagtgtctgacc

SEQ ID NO: 6598837 - DNA, 17 bp, Homo sapiens
ttttagtgtctgaccta

SEQ ID NO: 6598838 - DNA, 14 bp, Homo sapiens
ttttagtgtgtaaa

SEQ ID NO: 6598839 - DNA, 23 bp, Homo sapiens
ttttagttactgaagccttacaa

SEQ ID NO: 6598840 - DNA, 22 bp, Homo sapiens
ttttagttatagtgtttaactg

SEQ ID NO: 6598841 - DNA, 15 bp, Homo sapiens
ttttagttatatata

SEQ ID NO: 6598842 - DNA, 14 bp, Homo sapiens
ttttagttcagact

SEQ ID NO: 6598843 - DNA, 20 bp, Homo sapiens
ttttagttcctgtgcacagc

SEQ ID NO: 6598844 - DNA, 16 bp, Homo sapiens
ttttagttctgacttt

SEQ ID NO: 6598845 - DNA, 18 bp, Homo sapiens
ttttagttctgactttga

SEQ ID NO: 6598846 - DNA, 16 bp, Homo sapiens
ttttagttctttggaa

SEQ ID NO: 6598847 - DNA, 19 bp, Homo sapiens
ttttagttgcaactttgta

SEQ ID NO: 6598848 - DNA, 20 bp, Homo sapiens
ttttagtttaaaatcttgca

SEQ ID NO: 6598849 - DNA, 18 bp, Homo sapiens
ttttagtttctgttctgt

SEQ ID NO: 6598850 - DNA, 22 bp, Homo sapiens
ttttagtttgctaagagttttc

SEQ ID NO: 6598851 - DNA, 13 bp, Homo sapiens
ttttagttttgct

SEQ ID NO: 6598852 - DNA, 16 bp, Homo sapiens
ttttagtttttctgtc

SEQ ID NO: 6598853 - DNA, 16 bp, Homo sapiens
ttttataaaaaatggt

SEQ ID NO: 6598854 - DNA, 22 bp, Homo sapiens
ttttataaaatggctgtaatca

SEQ ID NO: 6598855 - DNA, 14 bp, Homo sapiens
ttttataaacttta

SEQ ID NO: 6598856 - DNA, 13 bp, Homo sapiens
ttttataaagtct

SEQ ID NO: 6598857 - DNA, 13 bp, Homo sapiens
ttttataaagtgc

SEQ ID NO: 6598858 - DNA, 13 bp, Homo sapiens
ttttataaagttt

SEQ ID NO: 6598859 - DNA, 14 bp, Homo sapiens
ttttataaatatgt

SEQ ID NO: 6598860 - DNA, 12 bp, Homo sapiens
ttttataaatgt

SEQ ID NO: 6598861 - DNA, 12 bp, Homo sapiens
ttttataaatta

SEQ ID NO: 6598862 - DNA, 14 bp, Homo sapiens
ttttataaattaaa

SEQ ID NO: 6598863 - DNA, 16 bp, Homo sapiens
ttttataaattaaata

SEQ ID NO: 6598864 - DNA, 17 bp, Homo sapiens
ttttataaattataatg

SEQ ID NO: 6598865 - DNA, 20 bp, Homo sapiens
ttttataactagtcctttac

SEQ ID NO: 6598866 - DNA, 19 bp, Homo sapiens
ttttataactatataaatg

SEQ ID NO: 6598867 - DNA, 14 bp, Homo sapiens
ttttataagaaaaa

SEQ ID NO: 6598868 - DNA, 16 bp, Homo sapiens
ttttataagaaaaact

SEQ ID NO: 6598869 - DNA, 15 bp, Homo sapiens
ttttataagaaaacc

SEQ ID NO: 6598870 - DNA, 21 bp, Homo sapiens
ttttataagacaaaatttaat

SEQ ID NO: 6598871 - DNA, 20 bp, Homo sapiens
ttttataaggctgactctta

SEQ ID NO: 6598872 - DNA, 23 bp, Homo sapiens
ttttataataaaaggaaaagcaa

SEQ ID NO: 6598873 - DNA, 18 bp, Homo sapiens
ttttataatattcataca

SEQ ID NO: 6598874 - DNA, 18 bp, Homo sapiens
ttttataatgttattcat

SEQ ID NO: 6598875 - DNA, 21 bp, Homo sapiens
ttttataatgttattcatttg

SEQ ID NO: 6598876 - DNA, 16 bp, Homo sapiens
ttttataatgttgtat

SEQ ID NO: 6598877 - DNA, 16 bp, Homo sapiens
ttttataattaaagat

SEQ ID NO: 6598878 - DNA, 17 bp, Homo sapiens
ttttataattttatctg

SEQ ID NO: 6598879 - DNA, 23 bp, Homo sapiens
ttttataattttgtgaagcaaaa

SEQ ID NO: 6598880 - DNA, 14 bp, Homo sapiens
ttttatacaaacct

SEQ ID NO: 6598881 - DNA, 13 bp, Homo sapiens
ttttatacaagaa

SEQ ID NO: 6598882 - DNA, 13 bp, Homo sapiens
ttttatacacata

SEQ ID NO: 6598883 - DNA, 15 bp, Homo sapiens
ttttatacacataat

SEQ ID NO: 6598884 - DNA, 12 bp, Homo sapiens
ttttatacatag

SEQ ID NO: 6598885 - DNA, 16 bp, Homo sapiens
ttttatacatatcaga

SEQ ID NO: 6598886 - DNA, 18 bp, Homo sapiens
ttttatacatatcagaaa

SEQ ID NO: 6598887 - DNA, 20 bp, Homo sapiens
ttttatacatatcagaaaag

SEQ ID NO: 6598888 - DNA, 23 bp, Homo sapiens
ttttatacatatcagaaaagtag

SEQ ID NO: 6598889 - DNA, 20 bp, Homo sapiens
ttttatacctgtacacacac

SEQ ID NO: 6598890 - DNA, 17 bp, Homo sapiens
ttttatacctgtttaaa

SEQ ID NO: 6598891 - DNA, 21 bp, Homo sapiens
ttttatacggaaaaaattgta

SEQ ID NO: 6598892 - DNA, 13 bp, Homo sapiens
ttttatactcaga

SEQ ID NO: 6598893 - DNA, 20 bp, Homo sapiens
ttttatactccatacataac

SEQ ID NO: 6598894 - DNA, 15 bp, Homo sapiens
ttttatactgaatat

SEQ ID NO: 6598895 - DNA, 15 bp, Homo sapiens
ttttatactgcactt

SEQ ID NO: 6598896 - DNA, 18 bp, Homo sapiens
ttttatacttcaaatgtc

SEQ ID NO: 6598897 - DNA, 20 bp, Homo sapiens
ttttatacttcaaatgtcat

SEQ ID NO: 6598898 - DNA, 19 bp, Homo sapiens
ttttatagaaaaacaaatc

SEQ ID NO: 6598899 - DNA, 14 bp, Homo sapiens
ttttatagaaaacc

SEQ ID NO: 6598900 - DNA, 20 bp, Homo sapiens
ttttatagaaaacctgactt

SEQ ID NO: 6598901 - DNA, 17 bp, Homo sapiens
aatttaaaatatttccc

SEQ ID NO: 6598902 - DNA, 23 bp, Homo sapiens
aatttaaaatccattttaggtga

SEQ ID NO: 6598903 - DNA, 13 bp, Homo sapiens
aatttaaaatgta

SEQ ID NO: 6598904 - DNA, 14 bp, Homo sapiens
aatttaaaatgtag

SEQ ID NO: 6598905 - DNA, 14 bp, Homo sapiens
aatttaaaatgtgt

SEQ ID NO: 6598906 - DNA, 16 bp, Homo sapiens
aatttaaaatgtgtgc

SEQ ID NO: 6598907 - DNA, 12 bp, Homo sapiens
aatttaaaatta

SEQ ID NO: 6598908 - DNA, 16 bp, Homo sapiens
aatttaaaattaagta

SEQ ID NO: 6598909 - DNA, 15 bp, Homo sapiens
aatttaaacacctcc

SEQ ID NO: 6598910 - DNA, 19 bp, Homo sapiens
aatttaaacacctcctcat

SEQ ID NO: 6598911 - DNA, 13 bp, Homo sapiens
aatttaaacatta

SEQ ID NO: 6598912 - DNA, 20 bp, Homo sapiens
aatttaaacatttgttcctg

SEQ ID NO: 6598913 - DNA, 14 bp, Homo sapiens
aatttaaaccagca

SEQ ID NO: 6598914 - DNA, 17 bp, Homo sapiens
aatttaaaccagcagaa

SEQ ID NO: 6598915 - DNA, 18 bp, Homo sapiens
aatttaaaccagcagaaa

SEQ ID NO: 6598916 - DNA, 19 bp, Homo sapiens
aatttaaaccagcagaaaa

SEQ ID NO: 6598917 - DNA, 18 bp, Homo sapiens
aatttaaacccattttag

SEQ ID NO: 6598918 - DNA, 19 bp, Homo sapiens
aatttaaacccattttagt

SEQ ID NO: 6598919 - DNA, 22 bp, Homo sapiens
aatttaaagcaggttcttgttg

SEQ ID NO: 6598920 - DNA, 14 bp, Homo sapiens
aatttaaagctgtt

SEQ ID NO: 6598921 - DNA, 21 bp, Homo sapiens
aatttaaagggtgtacttata

SEQ ID NO: 6598922 - DNA, 22 bp, Homo sapiens
aatttaaagggtgtacttatat

SEQ ID NO: 6598923 - DNA, 11 bp, Homo sapiens
aatttaaagtt

SEQ ID NO: 6598924 - DNA, 14 bp, Homo sapiens
aatttaaataaagt

SEQ ID NO: 6598925 - DNA, 15 bp, Homo sapiens
aatttaaataaagtt

SEQ ID NO: 6598926 - DNA, 21 bp, Homo sapiens
aatttaaatagcattatctta

SEQ ID NO: 6598927 - DNA, 22 bp, Homo sapiens
aatttaaatagcattatcttat

SEQ ID NO: 6598928 - DNA, 24 bp, Homo sapiens
aatttaaatagcattatcttatca

SEQ ID NO: 6598929 - DNA, 15 bp, Homo sapiens
aatttaaatagcttt

SEQ ID NO: 6598930 - DNA, 20 bp, Homo sapiens
aatttaaatataattctgta

SEQ ID NO: 6598931 - DNA, 23 bp, Homo sapiens
aatttaaatctgattaatccatt

SEQ ID NO: 6598932 - DNA, 18 bp, Homo sapiens
aatttaaatgaaagaaaa

SEQ ID NO: 6598933 - DNA, 14 bp, Homo sapiens
aatttaaatgacat

SEQ ID NO: 6598934 - DNA, 14 bp, Homo sapiens
aatttaaatgatat

SEQ ID NO: 6598935 - DNA, 18 bp, Homo sapiens
aatttaaatgatttaaat

SEQ ID NO: 6598936 - DNA, 11 bp, Homo sapiens
aatttaaatgc

SEQ ID NO: 6598937 - DNA, 11 bp, Homo sapiens
aatttaaatgt

SEQ ID NO: 6598938 - DNA, 12 bp, Homo sapiens
aatttaaatgtt

SEQ ID NO: 6598939 - DNA, 13 bp, Homo sapiens
aatttaaattgtt

SEQ ID NO: 6598940 - DNA, 15 bp, Homo sapiens
aatttaaatttaaag

SEQ ID NO: 6598941 - DNA, 18 bp, Homo sapiens
aatttaaatttaaagata

SEQ ID NO: 6598942 - DNA, 21 bp, Homo sapiens
aatttaacagaagttgtgaaa

SEQ ID NO: 6598943 - DNA, 15 bp, Homo sapiens
aatttaacatcacta

SEQ ID NO: 6598944 - DNA, 21 bp, Homo sapiens
aatttaacatcactacaaaaa

SEQ ID NO: 6598945 - DNA, 16 bp, Homo sapiens
aatttaactaatttaa

SEQ ID NO: 6598946 - DNA, 17 bp, Homo sapiens
aatttaactaatttaaa

SEQ ID NO: 6598947 - DNA, 19 bp, Homo sapiens
aatttaactaatttaaacc

SEQ ID NO: 6598948 - DNA, 20 bp, Homo sapiens
aatttaactaatttaaacca

SEQ ID NO: 6598949 - DNA, 16 bp, Homo sapiens
aatttaactttccagt

SEQ ID NO: 6598950 - DNA, 19 bp, Homo sapiens
aatttaacttttaaagaat

SEQ ID NO: 6598951 - DNA, 15 bp, Homo sapiens
aatttaagaaaacaa

SEQ ID NO: 6598952 - DNA, 21 bp, Homo sapiens
aatttaagaaaacaagtatat

SEQ ID NO: 6598953 - DNA, 16 bp, Homo sapiens
aatttaagaatttgtt

SEQ ID NO: 6598954 - DNA, 17 bp, Homo sapiens
aatttaagatacaaata

SEQ ID NO: 6598955 - DNA, 16 bp, Homo sapiens
aatttaagcaaacgtc

SEQ ID NO: 6598956 - DNA, 14 bp, Homo sapiens
aatttaagcacaaa

SEQ ID NO: 6598957 - DNA, 11 bp, Homo sapiens
aatttaagcat

SEQ ID NO: 6598958 - DNA, 15 bp, Homo sapiens
aatttaagcattgtt

SEQ ID NO: 6598959 - DNA, 21 bp, Homo sapiens
aatttaagcattgtttgctta

SEQ ID NO: 6598960 - DNA, 23 bp, Homo sapiens
aatttaagcattgtttgcttatt

SEQ ID NO: 6598961 - DNA, 18 bp, Homo sapiens
aatttaagctgtaaatta

SEQ ID NO: 6598962 - DNA, 12 bp, Homo sapiens
aatttaaggcaa

SEQ ID NO: 6598963 - DNA, 14 bp, Homo sapiens
aatttaaggcaaaa

SEQ ID NO: 6598964 - DNA, 14 bp, Homo sapiens
aatttaagtatctt

SEQ ID NO: 6598965 - DNA, 21 bp, Homo sapiens
aatttaagtcattttcatgtg

SEQ ID NO: 6598966 - DNA, 15 bp, Homo sapiens
aatttaagtgacaca

SEQ ID NO: 6598967 - DNA, 18 bp, Homo sapiens
aatttaagtgttggaaaa

SEQ ID NO: 6598968 - DNA, 17 bp, Homo sapiens
aatttaagttttgacaa

SEQ ID NO: 6598969 - DNA, 14 bp, Homo sapiens
aatttaatactttt

SEQ ID NO: 6598970 - DNA, 15 bp, Homo sapiens
aatttaatacttttc

SEQ ID NO: 6598971 - DNA, 21 bp, Homo sapiens
aatttaatagataaagtgcct

SEQ ID NO: 6598972 - DNA, 15 bp, Homo sapiens
aatttaatatatata

SEQ ID NO: 6598973 - DNA, 19 bp, Homo sapiens
aatttaatccttctttgta

SEQ ID NO: 6598974 - DNA, 20 bp, Homo sapiens
aatttaatccttctttgtaa

SEQ ID NO: 6598975 - DNA, 19 bp, Homo sapiens
aatttaatggactgtgaat

SEQ ID NO: 6598976 - DNA, 14 bp, Homo sapiens
aatttaatgtaaat

SEQ ID NO: 6598977 - DNA, 15 bp, Homo sapiens
aatttaatgtaaata

SEQ ID NO: 6598978 - DNA, 15 bp, Homo sapiens
aatttaattaatcga

SEQ ID NO: 6598979 - DNA, 21 bp, Homo sapiens
aatttaattaggggttgctaa

SEQ ID NO: 6598980 - DNA, 14 bp, Homo sapiens
aatttaattatttg

SEQ ID NO: 6598981 - DNA, 18 bp, Homo sapiens
aatttaattcatgtttct

SEQ ID NO: 6598982 - DNA, 23 bp, Homo sapiens
aatttaattcatgtttcttaaat

SEQ ID NO: 6598983 - DNA, 20 bp, Homo sapiens
aatttaattcctctttttag

SEQ ID NO: 6598984 - DNA, 13 bp, Homo sapiens
aatttaattgctt

SEQ ID NO: 6598985 - DNA, 14 bp, Homo sapiens
aatttaatttatag

SEQ ID NO: 6598986 - DNA, 14 bp, Homo sapiens
aatttaatttatgt

SEQ ID NO: 6598987 - DNA, 19 bp, Homo sapiens
aatttaatttcttttttcc

SEQ ID NO: 6598988 - DNA, 19 bp, Homo sapiens
aatttaatttgtaaaactt

SEQ ID NO: 6598989 - DNA, 24 bp, Homo sapiens
aatttaatttgtaaaacttctgct

SEQ ID NO: 6598990 - DNA, 13 bp, Homo sapiens
aatttacaaagtg

SEQ ID NO: 6598991 - DNA, 18 bp, Homo sapiens
aatttacaaagtgtgtat

SEQ ID NO: 6598992 - DNA, 22 bp, Homo sapiens
aatttacacagtgagactgtac

SEQ ID NO: 6598993 - DNA, 15 bp, Homo sapiens
aatttacactgccat

SEQ ID NO: 6598994 - DNA, 18 bp, Homo sapiens
aatttacagtcaatctat

SEQ ID NO: 6598995 - DNA, 13 bp, Homo sapiens
aatttacagtgat

SEQ ID NO: 6598996 - DNA, 17 bp, Homo sapiens
aatttacatcagaagtt

SEQ ID NO: 6598997 - DNA, 13 bp, Homo sapiens
aatttacatttat

SEQ ID NO: 6598998 - DNA, 19 bp, Homo sapiens
aatttaccaaggatgaatt

SEQ ID NO: 6598999 - DNA, 22 bp, Homo sapiens
aatttaccaaggatgaattctt

SEQ ID NO: 6599000 - DNA, 16 bp, Homo sapiens
aatttaccacaaaagc

SEQ ID NO: 6599001 - DNA, 21 bp, Homo sapiens
aatttaccacaggatgcatat

SEQ ID NO: 6599002 - DNA, 19 bp, Homo sapiens
aatttaccctcttgaatat

SEQ ID NO: 6599003 - DNA, 13 bp, Homo sapiens
aatttacctaaga

SEQ ID NO: 6599004 - DNA, 17 bp, Homo sapiens
aatttacctgaagtctt

SEQ ID NO: 6599005 - DNA, 13 bp, Homo sapiens
aatttacgtatat

SEQ ID NO: 6599006 - DNA, 17 bp, Homo sapiens
aatttacgtatatttca

SEQ ID NO: 6599007 - DNA, 21 bp, Homo sapiens
aatttactacaatatgtacat

SEQ ID NO: 6599008 - DNA, 12 bp, Homo sapiens
aatttactatat

SEQ ID NO: 6599009 - DNA, 16 bp, Homo sapiens
aatttactatatatat

SEQ ID NO: 6599010 - DNA, 21 bp, Homo sapiens
aatttactcacagcacttgtt

SEQ ID NO: 6599011 - DNA, 21 bp, Homo sapiens
aatttactgatgagagaatgt

SEQ ID NO: 6599012 - DNA, 19 bp, Homo sapiens
aatttactggacaaagaat

SEQ ID NO: 6599013 - DNA, 14 bp, Homo sapiens
aatttactgtgact

SEQ ID NO: 6599014 - DNA, 14 bp, Homo sapiens
aatttacttgccat

SEQ ID NO: 6599015 - DNA, 18 bp, Homo sapiens
aatttactttaaaaagaa

SEQ ID NO: 6599016 - DNA, 17 bp, Homo sapiens
aatttagaaaaagaaca

SEQ ID NO: 6599017 - DNA, 22 bp, Homo sapiens
aatttagaaaaagaacatgcag

SEQ ID NO: 6599018 - DNA, 16 bp, Homo sapiens
aatttagaaaaagtca

SEQ ID NO: 6599019 - DNA, 14 bp, Homo sapiens
aatttagaaaacat

SEQ ID NO: 6599020 - DNA, 21 bp, Homo sapiens
aatttagaaaacattcatcca

SEQ ID NO: 6599021 - DNA, 16 bp, Homo sapiens
aatttagaaaacttta

SEQ ID NO: 6599022 - DNA, 18 bp, Homo sapiens
aatttagaaactaattga

SEQ ID NO: 6599023 - DNA, 19 bp, Homo sapiens
aatttagaaactaattgac

SEQ ID NO: 6599024 - DNA, 21 bp, Homo sapiens
aatttagaaactaattgactt

SEQ ID NO: 6599025 - DNA, 22 bp, Homo sapiens
aatttagaaactaattgacttt

SEQ ID NO: 6599026 - DNA, 13 bp, Homo sapiens
aatttagaaactg

SEQ ID NO: 6599027 - DNA, 14 bp, Homo sapiens
aatttagaaactga

SEQ ID NO: 6599028 - DNA, 16 bp, Homo sapiens
aatttagaaagcttaa

SEQ ID NO: 6599029 - DNA, 17 bp, Homo sapiens
aatttagaaatcatttt

SEQ ID NO: 6599030 - DNA, 20 bp, Homo sapiens
aatttagacttggattcttt

SEQ ID NO: 6599031 - DNA, 18 bp, Homo sapiens
aatttagatattttccat

SEQ ID NO: 6599032 - DNA, 16 bp, Homo sapiens
aatttagattgtaaac

SEQ ID NO: 6599033 - DNA, 19 bp, Homo sapiens
aatttagcaaactgatgct

SEQ ID NO: 6599034 - DNA, 18 bp, Homo sapiens
aatttagcagtccaaaga

SEQ ID NO: 6599035 - DNA, 16 bp, Homo sapiens
aatttagcattgtagt

SEQ ID NO: 6599036 - DNA, 18 bp, Homo sapiens
aatttagccaataaagaa

SEQ ID NO: 6599037 - DNA, 18 bp, Homo sapiens
aatttagccagaatgttt

SEQ ID NO: 6599038 - DNA, 22 bp, Homo sapiens
aatttagccctggtttgaaatt

SEQ ID NO: 6599039 - DNA, 19 bp, Homo sapiens
aatttagccctttaaaacg

SEQ ID NO: 6599040 - DNA, 19 bp, Homo sapiens
aatttaggaatgctcaatg

SEQ ID NO: 6599041 - DNA, 19 bp, Homo sapiens
aatttaggtaaataaagct

SEQ ID NO: 6599042 - DNA, 20 bp, Homo sapiens
aatttagtaaatgttatctt

SEQ ID NO: 6599043 - DNA, 19 bp, Homo sapiens
aatttagtaagtgaccacc

SEQ ID NO: 6599044 - DNA, 13 bp, Homo sapiens
aatttagtatttt

SEQ ID NO: 6599045 - DNA, 13 bp, Homo sapiens
aatttagtcatta

SEQ ID NO: 6599046 - DNA, 22 bp, Homo sapiens
aatttagtcccttaaaaattaa

SEQ ID NO: 6599047 - DNA, 18 bp, Homo sapiens
aatttagtctaacacagt

SEQ ID NO: 6599048 - DNA, 16 bp, Homo sapiens
aatttagttgttgtag

SEQ ID NO: 6599049 - DNA, 20 bp, Homo sapiens
aatttagtttgtactcagtg

SEQ ID NO: 6599050 - DNA, 16 bp, Homo sapiens
aatttagtttgttaaa

SEQ ID NO: 6599051 - DNA, 16 bp, Homo sapiens
aatttagtttttgttc

SEQ ID NO: 6599052 - DNA, 17 bp, Homo sapiens
aatttagtttttgttct

SEQ ID NO: 6599053 - DNA, 18 bp, Homo sapiens
aatttagtttttgttctt

SEQ ID NO: 6599054 - DNA, 20 bp, Homo sapiens
aatttagtttttgttcttaa

SEQ ID NO: 6599055 - DNA, 16 bp, Homo sapiens
aatttataaaattaga

SEQ ID NO: 6599056 - DNA, 22 bp, Homo sapiens
aatttataaactaattttgtac

SEQ ID NO: 6599057 - DNA, 10 bp, Homo sapiens
aatttataac

SEQ ID NO: 6599058 - DNA, 15 bp, Homo sapiens
aatttataacaaata

SEQ ID NO: 6599059 - DNA, 16 bp, Homo sapiens
aatttataatgtattt

SEQ ID NO: 6599060 - DNA, 17 bp, Homo sapiens
aatttataatgtatttg

SEQ ID NO: 6599061 - DNA, 20 bp, Homo sapiens
aatttataatgtatttgaaa

SEQ ID NO: 6599062 - DNA, 17 bp, Homo sapiens
aatttataattcagtat

SEQ ID NO: 6599063 - DNA, 13 bp, Homo sapiens
aatttataatttt

SEQ ID NO: 6599064 - DNA, 14 bp, Homo sapiens
aatttatacaaaat

SEQ ID NO: 6599065 - DNA, 16 bp, Homo sapiens
aatttatacaaaataa

SEQ ID NO: 6599066 - DNA, 15 bp, Homo sapiens
aatttatacaaagaa

SEQ ID NO: 6599067 - DNA, 18 bp, Homo sapiens
aatttatacaaagaaact

SEQ ID NO: 6599068 - DNA, 19 bp, Homo sapiens
aatttatacaaagaaactt

SEQ ID NO: 6599069 - DNA, 20 bp, Homo sapiens
aatttatacctcaattttca

SEQ ID NO: 6599070 - DNA, 21 bp, Homo sapiens
aatttatacctcaattttcac

SEQ ID NO: 6599071 - DNA, 19 bp, Homo sapiens
aatttatagaataatttct

SEQ ID NO: 6599072 - DNA, 20 bp, Homo sapiens
aatttataggcagatcttta

SEQ ID NO: 6599073 - DNA, 15 bp, Homo sapiens
aatttatataaagta

SEQ ID NO: 6599074 - DNA, 18 bp, Homo sapiens
aatttatataaagtattt

SEQ ID NO: 6599075 - DNA, 15 bp, Homo sapiens
aatttatataactgt

SEQ ID NO: 6599076 - DNA, 20 bp, Homo sapiens
aatttatatacaacctgctt

SEQ ID NO: 6599077 - DNA, 15 bp, Homo sapiens
aatttatatctttat

SEQ ID NO: 6599078 - DNA, 16 bp, Homo sapiens
aatttatatgtatcca

SEQ ID NO: 6599079 - DNA, 22 bp, Homo sapiens
aatttatattccatttacataa

SEQ ID NO: 6599080 - DNA, 17 bp, Homo sapiens
aatttatatttgaaatt

SEQ ID NO: 6599081 - DNA, 13 bp, Homo sapiens
ttttatagaaaag

SEQ ID NO: 6599082 - DNA, 16 bp, Homo sapiens
ttttatagactgattt

SEQ ID NO: 6599083 - DNA, 23 bp, Homo sapiens
ttttatagtagatttttaacaaa

SEQ ID NO: 6599084 - DNA, 21 bp, Homo sapiens
ttttatagtctcaaatcaaat

SEQ ID NO: 6599085 - DNA, 15 bp, Homo sapiens
ttttatagttgtatt

SEQ ID NO: 6599086 - DNA, 14 bp, Homo sapiens
ttttatataaagaa

SEQ ID NO: 6599087 - DNA, 22 bp, Homo sapiens
ttttatataataaaagtgcctt

SEQ ID NO: 6599088 - DNA, 22 bp, Homo sapiens
ttttatatagaccccaagcatt

SEQ ID NO: 6599089 - DNA, 13 bp, Homo sapiens
ttttatatagcaa

SEQ ID NO: 6599090 - DNA, 19 bp, Homo sapiens
ttttatatagcttgaaaca

SEQ ID NO: 6599091 - DNA, 13 bp, Homo sapiens
ttttatatataaa

SEQ ID NO: 6599092 - DNA, 20 bp, Homo sapiens
ttttatatataaaataaata

SEQ ID NO: 6599093 - DNA, 21 bp, Homo sapiens
ttttatatataaaataaatat

SEQ ID NO: 6599094 - DNA, 23 bp, Homo sapiens
ttttatatataaaataaatatac

SEQ ID NO: 6599095 - DNA, 15 bp, Homo sapiens
ttttatatatacagt

SEQ ID NO: 6599096 - DNA, 18 bp, Homo sapiens
ttttatatatattgttaa

SEQ ID NO: 6599097 - DNA, 15 bp, Homo sapiens
ttttatatatgaata

SEQ ID NO: 6599098 - DNA, 19 bp, Homo sapiens
ttttatatattatgtgaag

SEQ ID NO: 6599099 - DNA, 22 bp, Homo sapiens
ttttatatattatgtgaagaat

SEQ ID NO: 6599100 - DNA, 21 bp, Homo sapiens
ttttatatctggaatgagcct

SEQ ID NO: 6599101 - DNA, 14 bp, Homo sapiens
ttttatatctgtaa

SEQ ID NO: 6599102 - DNA, 15 bp, Homo sapiens
ttttatatctgtaaa

SEQ ID NO: 6599103 - DNA, 14 bp, Homo sapiens
ttttatatctgtat

SEQ ID NO: 6599104 - DNA, 14 bp, Homo sapiens
ttttatatgattaa

SEQ ID NO: 6599105 - DNA, 19 bp, Homo sapiens
ttttatatgtgagcgagca

SEQ ID NO: 6599106 - DNA, 17 bp, Homo sapiens
ttttatatgttcatatt

SEQ ID NO: 6599107 - DNA, 19 bp, Homo sapiens
ttttatattactgacattt

SEQ ID NO: 6599108 - DNA, 18 bp, Homo sapiens
ttttatattacttttgta

SEQ ID NO: 6599109 - DNA, 11 bp, Homo sapiens
ttttatattct

SEQ ID NO: 6599110 - DNA, 14 bp, Homo sapiens
ttttatattgaaaa

SEQ ID NO: 6599111 - DNA, 10 bp, Homo sapiens
ttttatattt

SEQ ID NO: 6599112 - DNA, 13 bp, Homo sapiens
ttttatatttaaa

SEQ ID NO: 6599113 - DNA, 11 bp, Homo sapiens
ttttatatttc

SEQ ID NO: 6599114 - DNA, 22 bp, Homo sapiens
ttttatatttcctttatgtgaa

SEQ ID NO: 6599115 - DNA, 13 bp, Homo sapiens
ttttatatttgaa

SEQ ID NO: 6599116 - DNA, 13 bp, Homo sapiens
ttttatatttgta

SEQ ID NO: 6599117 - DNA, 20 bp, Homo sapiens
ttttatcaaaagacttttat

SEQ ID NO: 6599118 - DNA, 17 bp, Homo sapiens
ttttatcacatgtatgt

SEQ ID NO: 6599119 - DNA, 14 bp, Homo sapiens
ttttatcatgaatt

SEQ ID NO: 6599120 - DNA, 13 bp, Homo sapiens
ttttatcattaat

SEQ ID NO: 6599121 - DNA, 18 bp, Homo sapiens
ttttatcattgaaacatt

SEQ ID NO: 6599122 - DNA, 15 bp, Homo sapiens
ttttatcccaaagtt

SEQ ID NO: 6599123 - DNA, 23 bp, Homo sapiens
ttttatcccatttagtgtgaata

SEQ ID NO: 6599124 - DNA, 16 bp, Homo sapiens
ttttatctagaacatt

SEQ ID NO: 6599125 - DNA, 13 bp, Homo sapiens
ttttatctcagat

SEQ ID NO: 6599126 - DNA, 12 bp, Homo sapiens
ttttatctcctt

SEQ ID NO: 6599127 - DNA, 19 bp, Homo sapiens
ttttatctgaaatcaatta

SEQ ID NO: 6599128 - DNA, 20 bp, Homo sapiens
ttttatctgagttacagaaa

SEQ ID NO: 6599129 - DNA, 22 bp, Homo sapiens
ttttatctggtatggtgctaat

SEQ ID NO: 6599130 - DNA, 16 bp, Homo sapiens
ttttatctggttctat

SEQ ID NO: 6599131 - DNA, 21 bp, Homo sapiens
ttttatctggttctatatgaa

SEQ ID NO: 6599132 - DNA, 15 bp, Homo sapiens
ttttatctgtttcct

SEQ ID NO: 6599133 - DNA, 16 bp, Homo sapiens
ttttatcttaaactgt

SEQ ID NO: 6599134 - DNA, 13 bp, Homo sapiens
ttttatgaaacca

SEQ ID NO: 6599135 - DNA, 20 bp, Homo sapiens
ttttatgacttcattaataa

SEQ ID NO: 6599136 - DNA, 12 bp, Homo sapiens
ttttatgagaaa

SEQ ID NO: 6599137 - DNA, 14 bp, Homo sapiens
ttttatgagaaatg

SEQ ID NO: 6599138 - DNA, 15 bp, Homo sapiens
ttttatgagaaatgt

SEQ ID NO: 6599139 - DNA, 18 bp, Homo sapiens
ttttatgagacttcctat

SEQ ID NO: 6599140 - DNA, 18 bp, Homo sapiens
ttttatgagttcttgttt

SEQ ID NO: 6599141 - DNA, 16 bp, Homo sapiens
ttttatgatacttgaa

SEQ ID NO: 6599142 - DNA, 20 bp, Homo sapiens
ttttatgatacttgaaaatt

SEQ ID NO: 6599143 - DNA, 11 bp, Homo sapiens
ttttatgatat

SEQ ID NO: 6599144 - DNA, 15 bp, Homo sapiens
ttttatgatatccct

SEQ ID NO: 6599145 - DNA, 15 bp, Homo sapiens
ttttatgatgatgaa

SEQ ID NO: 6599146 - DNA, 15 bp, Homo sapiens
ttttatgatgctatt

SEQ ID NO: 6599147 - DNA, 16 bp, Homo sapiens
ttttatgcaaaagtca

SEQ ID NO: 6599148 - DNA, 20 bp, Homo sapiens
ttttatgccatgttaatatt

SEQ ID NO: 6599149 - DNA, 22 bp, Homo sapiens
ttttatgctcttttttactcat

SEQ ID NO: 6599150 - DNA, 19 bp, Homo sapiens
ttttatggagacctctcct

SEQ ID NO: 6599151 - DNA, 17 bp, Homo sapiens
ttttatggatgattaaa

SEQ ID NO: 6599152 - DNA, 19 bp, Homo sapiens
ttttatggcacctatttct

SEQ ID NO: 6599153 - DNA, 19 bp, Homo sapiens
ttttatggcactagtattt

SEQ ID NO: 6599154 - DNA, 22 bp, Homo sapiens
ttttatggcactagtatttcta

SEQ ID NO: 6599155 - DNA, 15 bp, Homo sapiens
ttttatggcatgatt

SEQ ID NO: 6599156 - DNA, 17 bp, Homo sapiens
ttttatggcatgattta

SEQ ID NO: 6599157 - DNA, 21 bp, Homo sapiens
ttttatggtactaatgaaatt

SEQ ID NO: 6599158 - DNA, 20 bp, Homo sapiens
ttttatggttccaatgaaat

SEQ ID NO: 6599159 - DNA, 12 bp, Homo sapiens
ttttatgtaaat

SEQ ID NO: 6599160 - DNA, 17 bp, Homo sapiens
ttttatgtaattatata

SEQ ID NO: 6599161 - DNA, 13 bp, Homo sapiens
ttttatgtacttt

SEQ ID NO: 6599162 - DNA, 21 bp, Homo sapiens
ttttatgtattctttctgcct

SEQ ID NO: 6599163 - DNA, 16 bp, Homo sapiens
ttttatgtcatactct

SEQ ID NO: 6599164 - DNA, 21 bp, Homo sapiens
ttttatgtcatactctgtgta

SEQ ID NO: 6599165 - DNA, 19 bp, Homo sapiens
ttttatgtcatagtttaat

SEQ ID NO: 6599166 - DNA, 14 bp, Homo sapiens
ttttatgtgactat

SEQ ID NO: 6599167 - DNA, 12 bp, Homo sapiens
ttttatgtgaga

SEQ ID NO: 6599168 - DNA, 18 bp, Homo sapiens
ttttatgtgagagaaagt

SEQ ID NO: 6599169 - DNA, 13 bp, Homo sapiens
ttttatgtgttct

SEQ ID NO: 6599170 - DNA, 13 bp, Homo sapiens
ttttatgttattt

SEQ ID NO: 6599171 - DNA, 13 bp, Homo sapiens
ttttatgttgaca

SEQ ID NO: 6599172 - DNA, 22 bp, Homo sapiens
ttttatgttgcatagaataaaa

SEQ ID NO: 6599173 - DNA, 21 bp, Homo sapiens
ttttatgtttaaaatggcatt

SEQ ID NO: 6599174 - DNA, 17 bp, Homo sapiens
ttttatgttttctttct

SEQ ID NO: 6599175 - DNA, 19 bp, Homo sapiens
ttttattaaaatatttcag

SEQ ID NO: 6599176 - DNA, 19 bp, Homo sapiens
ttttattaaacaattttgt

SEQ ID NO: 6599177 - DNA, 18 bp, Homo sapiens
ttttattaaacattttca

SEQ ID NO: 6599178 - DNA, 20 bp, Homo sapiens
ttttattaaacttaaaactt

SEQ ID NO: 6599179 - DNA, 12 bp, Homo sapiens
ttttattaaatt

SEQ ID NO: 6599180 - DNA, 22 bp, Homo sapiens
ttttattaagctttttggaatc

SEQ ID NO: 6599181 - DNA, 13 bp, Homo sapiens
ttttattaataat

SEQ ID NO: 6599182 - DNA, 16 bp, Homo sapiens
ttttattaataatatt

SEQ ID NO: 6599183 - DNA, 12 bp, Homo sapiens
ttttattaatca

SEQ ID NO: 6599184 - DNA, 13 bp, Homo sapiens
ttttattaatcac

SEQ ID NO: 6599185 - DNA, 14 bp, Homo sapiens
ttttattaatcact

SEQ ID NO: 6599186 - DNA, 15 bp, Homo sapiens
ttttattaatcactg

SEQ ID NO: 6599187 - DNA, 18 bp, Homo sapiens
ttttattaatctactgta

SEQ ID NO: 6599188 - DNA, 22 bp, Homo sapiens
ttttattaatctactgtatcaa

SEQ ID NO: 6599189 - DNA, 11 bp, Homo sapiens
ttttattaatg

SEQ ID NO: 6599190 - DNA, 22 bp, Homo sapiens
ttttattaatggcatgtaatat

SEQ ID NO: 6599191 - DNA, 15 bp, Homo sapiens
ttttattaattataa

SEQ ID NO: 6599192 - DNA, 17 bp, Homo sapiens
ttttattacaaatgcaa

SEQ ID NO: 6599193 - DNA, 19 bp, Homo sapiens
ttttattacagaaatgttt

SEQ ID NO: 6599194 - DNA, 18 bp, Homo sapiens
ttttattactagtgttta

SEQ ID NO: 6599195 - DNA, 22 bp, Homo sapiens
ttttattactctcacccataaa

SEQ ID NO: 6599196 - DNA, 20 bp, Homo sapiens
ttttattagcattttcaaga

SEQ ID NO: 6599197 - DNA, 20 bp, Homo sapiens
ttttattaggttaagtctca

SEQ ID NO: 6599198 - DNA, 22 bp, Homo sapiens
ttttattaggttaagtctcaat

SEQ ID NO: 6599199 - DNA, 13 bp, Homo sapiens
ttttattataaag

SEQ ID NO: 6599200 - DNA, 15 bp, Homo sapiens
ttttattatcagtta

SEQ ID NO: 6599201 - DNA, 23 bp, Homo sapiens
ttttattatcagttaaaatcaca

SEQ ID NO: 6599202 - DNA, 22 bp, Homo sapiens
ttttattatgaaacttgtgtaa

SEQ ID NO: 6599203 - DNA, 14 bp, Homo sapiens
ttttattatgagct

SEQ ID NO: 6599204 - DNA, 13 bp, Homo sapiens
ttttattatgcat

SEQ ID NO: 6599205 - DNA, 23 bp, Homo sapiens
ttttattatgcataactgacaaa

SEQ ID NO: 6599206 - DNA, 12 bp, Homo sapiens
ttttattatgct

SEQ ID NO: 6599207 - DNA, 15 bp, Homo sapiens
ttttattatgggtat

SEQ ID NO: 6599208 - DNA, 14 bp, Homo sapiens
ttttattatgtaaa

SEQ ID NO: 6599209 - DNA, 16 bp, Homo sapiens
ttttattattactgtt

SEQ ID NO: 6599210 - DNA, 18 bp, Homo sapiens
ttttattattcagaatta

SEQ ID NO: 6599211 - DNA, 14 bp, Homo sapiens
ttttattattgtgg

SEQ ID NO: 6599212 - DNA, 17 bp, Homo sapiens
ttttattatttctatta

SEQ ID NO: 6599213 - DNA, 14 bp, Homo sapiens
ttttattcaaggta

SEQ ID NO: 6599214 - DNA, 13 bp, Homo sapiens
ttttattcagcag

SEQ ID NO: 6599215 - DNA, 20 bp, Homo sapiens
ttttattcataagccaattt

SEQ ID NO: 6599216 - DNA, 21 bp, Homo sapiens
ttttattcgtcctttgacaaa

SEQ ID NO: 6599217 - DNA, 13 bp, Homo sapiens
ttttattctccag

SEQ ID NO: 6599218 - DNA, 20 bp, Homo sapiens
ttttattctgttaatgcatt

SEQ ID NO: 6599219 - DNA, 12 bp, Homo sapiens
ttttattcttgt

SEQ ID NO: 6599220 - DNA, 13 bp, Homo sapiens
ttttattcttgtg

SEQ ID NO: 6599221 - DNA, 16 bp, Homo sapiens
ttttattgaaaatgtg

SEQ ID NO: 6599222 - DNA, 13 bp, Homo sapiens
ttttattgaaatg

SEQ ID NO: 6599223 - DNA, 19 bp, Homo sapiens
ttttattgaaatgtataat

SEQ ID NO: 6599224 - DNA, 16 bp, Homo sapiens
ttttattgacacagaa

SEQ ID NO: 6599225 - DNA, 16 bp, Homo sapiens
ttttattgccttctca

SEQ ID NO: 6599226 - DNA, 14 bp, Homo sapiens
ttttattgctacaa

SEQ ID NO: 6599227 - DNA, 17 bp, Homo sapiens
ttttattgctagtattt

SEQ ID NO: 6599228 - DNA, 23 bp, Homo sapiens
ttttattgctagtatttgaatta

SEQ ID NO: 6599229 - DNA, 21 bp, Homo sapiens
ttttattggggaattaaatag

SEQ ID NO: 6599230 - DNA, 19 bp, Homo sapiens
ttttattgtaacagacatt

SEQ ID NO: 6599231 - DNA, 20 bp, Homo sapiens
ttttattgtaacagacattg

SEQ ID NO: 6599232 - DNA, 22 bp, Homo sapiens
ttttattgtaacagacattgtt

SEQ ID NO: 6599233 - DNA, 20 bp, Homo sapiens
ttttattgtataaactatca

SEQ ID NO: 6599234 - DNA, 10 bp, Homo sapiens
ttttattgtt

SEQ ID NO: 6599235 - DNA, 19 bp, Homo sapiens
ttttattgttgttgtttga

SEQ ID NO: 6599236 - DNA, 20 bp, Homo sapiens
ttttattgtttaaagcaact

SEQ ID NO: 6599237 - DNA, 15 bp, Homo sapiens
ttttattgttttcta

SEQ ID NO: 6599238 - DNA, 23 bp, Homo sapiens
ttttatttaactgtgcagtgact

SEQ ID NO: 6599239 - DNA, 23 bp, Homo sapiens
ttttatttagggccttttctgtg

SEQ ID NO: 6599240 - DNA, 12 bp, Homo sapiens
ttttatttatca

SEQ ID NO: 6599241 - DNA, 18 bp, Homo sapiens
ttttatttatgaagtttt

SEQ ID NO: 6599242 - DNA, 12 bp, Homo sapiens
ttttatttccaa

SEQ ID NO: 6599243 - DNA, 17 bp, Homo sapiens
ttttatttccacataaa

SEQ ID NO: 6599244 - DNA, 20 bp, Homo sapiens
ttttatttccacataaaggt

SEQ ID NO: 6599245 - DNA, 16 bp, Homo sapiens
ttttatttcctatgat

SEQ ID NO: 6599246 - DNA, 18 bp, Homo sapiens
ttttatttcctatgatgt

SEQ ID NO: 6599247 - DNA, 19 bp, Homo sapiens
ttttatttctaagtattta

SEQ ID NO: 6599248 - DNA, 21 bp, Homo sapiens
ttttatttctactgtcaaatg

SEQ ID NO: 6599249 - DNA, 21 bp, Homo sapiens
ttttatttctcgggtgcattt

SEQ ID NO: 6599250 - DNA, 12 bp, Homo sapiens
ttttatttctga

SEQ ID NO: 6599251 - DNA, 13 bp, Homo sapiens
ttttatttctgac

SEQ ID NO: 6599252 - DNA, 20 bp, Homo sapiens
ttttatttctgactcttatt

SEQ ID NO: 6599253 - DNA, 20 bp, Homo sapiens
ttttatttctgatttcataa

SEQ ID NO: 6599254 - DNA, 19 bp, Homo sapiens
ttttatttgagaattttgt

SEQ ID NO: 6599255 - DNA, 12 bp, Homo sapiens
ttttatttgtaa

SEQ ID NO: 6599256 - DNA, 13 bp, Homo sapiens
ttttatttgtcag

SEQ ID NO: 6599257 - DNA, 11 bp, Homo sapiens
ttttattttat

SEQ ID NO: 6599258 - DNA, 15 bp, Homo sapiens
ttttattttattgaa

SEQ ID NO: 6599259 - DNA, 16 bp, Homo sapiens
ttttattttcaaatct

SEQ ID NO: 6599260 - DNA, 14 bp, Homo sapiens
ttttattttcctgt

SEQ ID NO: 6599261 - DNA, 12 bp, Homo sapiens
ttttattttgaa

SEQ ID NO: 6599262 - DNA, 15 bp, Homo sapiens
ttttattttgctgag

SEQ ID NO: 6599263 - DNA, 16 bp, Homo sapiens
ttttattttgtctctg

SEQ ID NO: 6599264 - DNA, 18 bp, Homo sapiens
ttttatttttagacagag

SEQ ID NO: 6599265 - DNA, 18 bp, Homo sapiens
ttttatttttctaaaaaa

SEQ ID NO: 6599266 - DNA, 14 bp, Homo sapiens
ttttattttttaag

SEQ ID NO: 6599267 - DNA, 16 bp, Homo sapiens
ttttattttttaagtt

SEQ ID NO: 6599268 - DNA, 14 bp, Homo sapiens
ttttattttttagt

SEQ ID NO: 6599269 - DNA, 16 bp, Homo sapiens
ttttattttttataca

SEQ ID NO: 6599270 - DNA, 18 bp, Homo sapiens
ttttattttttcttttgt

SEQ ID NO: 6599271 - DNA, 17 bp, Homo sapiens
ttttcaaaactagttct

SEQ ID NO: 6599272 - DNA, 14 bp, Homo sapiens
ttttcaaaagaaag

SEQ ID NO: 6599273 - DNA, 15 bp, Homo sapiens
ttttcaaaagataat

SEQ ID NO: 6599274 - DNA, 18 bp, Homo sapiens
ttttcaaaagataatatt

SEQ ID NO: 6599275 - DNA, 10 bp, Homo sapiens
ttttcaaaat

SEQ ID NO: 6599276 - DNA, 12 bp, Homo sapiens
ttttcaaaatga

SEQ ID NO: 6599277 - DNA, 14 bp, Homo sapiens
ttttcaaaatggag

SEQ ID NO: 6599278 - DNA, 23 bp, Homo sapiens
ttttcaaaattcaaaatactttt

SEQ ID NO: 6599279 - DNA, 16 bp, Homo sapiens
ttttcaaacaaagatg

SEQ ID NO: 6599280 - DNA, 13 bp, Homo sapiens
ttttcaaacaagt

SEQ ID NO: 6599281 - DNA, 15 bp, Homo sapiens
ttttcaaacaagtat

SEQ ID NO: 6599282 - DNA, 21 bp, Homo sapiens
ttttcaaaccagtatacaaga

SEQ ID NO: 6599283 - DNA, 14 bp, Homo sapiens
ttttcaaagagatg

SEQ ID NO: 6599284 - DNA, 23 bp, Homo sapiens
ttttcaaaggaaaacacctttat

SEQ ID NO: 6599285 - DNA, 17 bp, Homo sapiens
ttttcaaataatgcttt

SEQ ID NO: 6599286 - DNA, 12 bp, Homo sapiens
ttttcaaatatg

SEQ ID NO: 6599287 - DNA, 13 bp, Homo sapiens
ttttcaaatatgt

SEQ ID NO: 6599288 - DNA, 16 bp, Homo sapiens
ttttcaaatatgtaaa

SEQ ID NO: 6599289 - DNA, 19 bp, Homo sapiens
ttttcaaatattgaatgcc

SEQ ID NO: 6599290 - DNA, 14 bp, Homo sapiens
ttttcaaatctggt

SEQ ID NO: 6599291 - DNA, 18 bp, Homo sapiens
ttttcaaatggagttgga

SEQ ID NO: 6599292 - DNA, 22 bp, Homo sapiens
ttttcaaatgtgcaatttgtaa

SEQ ID NO: 6599293 - DNA, 12 bp, Homo sapiens
ttttcaaattaa

SEQ ID NO: 6599294 - DNA, 13 bp, Homo sapiens
ttttcaaattaat

SEQ ID NO: 6599295 - DNA, 22 bp, Homo sapiens
ttttcaaattaatgttccagtt

SEQ ID NO: 6599296 - DNA, 13 bp, Homo sapiens
ttttcaaattatt

SEQ ID NO: 6599297 - DNA, 14 bp, Homo sapiens
ttttcaaattgtat

SEQ ID NO: 6599298 - DNA, 22 bp, Homo sapiens
ttttcaacaaatatcttgtgtt

SEQ ID NO: 6599299 - DNA, 14 bp, Homo sapiens
ttttcaaccagcat

SEQ ID NO: 6599300 - DNA, 22 bp, Homo sapiens
ttttcaaccagcattttactac

SEQ ID NO: 6599301 - DNA, 22 bp, Homo sapiens
ttttcaaccataaaagaagttt

SEQ ID NO: 6599302 - DNA, 19 bp, Homo sapiens
ttttcaaccccaccctgtt

SEQ ID NO: 6599303 - DNA, 15 bp, Homo sapiens
ttttcaactgctttg

SEQ ID NO: 6599304 - DNA, 14 bp, Homo sapiens
ttttcaagaaatga

SEQ ID NO: 6599305 - DNA, 16 bp, Homo sapiens
ttttcaagaataatca

SEQ ID NO: 6599306 - DNA, 20 bp, Homo sapiens
ttttcaagagaagaaaaaat

SEQ ID NO: 6599307 - DNA, 22 bp, Homo sapiens
ttttcaagagaagaaaaaatta

SEQ ID NO: 6599308 - DNA, 14 bp, Homo sapiens
ttttcaagattcta

SEQ ID NO: 6599309 - DNA, 17 bp, Homo sapiens
ttttcaagcaaaacagt

SEQ ID NO: 6599310 - DNA, 15 bp, Homo sapiens
ttttcaagcaaatat

SEQ ID NO: 6599311 - DNA, 22 bp, Homo sapiens
ttttcaagcagcatcttctggt

SEQ ID NO: 6599312 - DNA, 18 bp, Homo sapiens
ttttcaaggaagaaaacg

SEQ ID NO: 6599313 - DNA, 19 bp, Homo sapiens
ttttcaagtaattttcata

SEQ ID NO: 6599314 - DNA, 19 bp, Homo sapiens
ttttcaagttattcagaaa

SEQ ID NO: 6599315 - DNA, 22 bp, Homo sapiens
ttttcaagttgcagtcagaaga

SEQ ID NO: 6599316 - DNA, 17 bp, Homo sapiens
ttttcaagtttttcata

SEQ ID NO: 6599317 - DNA, 20 bp, Homo sapiens
ttttcaataaatttctgctt

SEQ ID NO: 6599318 - DNA, 16 bp, Homo sapiens
ttttcaatagccacta

SEQ ID NO: 6599319 - DNA, 21 bp, Homo sapiens
ttttcaatatattgaactttt

SEQ ID NO: 6599320 - DNA, 23 bp, Homo sapiens
ttttcaatatattgaacttttgt

SEQ ID NO: 6599321 - DNA, 20 bp, Homo sapiens
ttttcaatctcgtatagaag

SEQ ID NO: 6599322 - DNA, 24 bp, Homo sapiens
ttttcaatctcgtatagaagtctt

SEQ ID NO: 6599323 - DNA, 18 bp, Homo sapiens
ttttcaatgaattttata

SEQ ID NO: 6599324 - DNA, 12 bp, Homo sapiens
ttttcaatgcaa

SEQ ID NO: 6599325 - DNA, 17 bp, Homo sapiens
ttttcaatgcaatgcat

SEQ ID NO: 6599326 - DNA, 21 bp, Homo sapiens
ttttcaatgcaatgcatctga

SEQ ID NO: 6599327 - DNA, 18 bp, Homo sapiens
ttttcaatgtactgtatt

SEQ ID NO: 6599328 - DNA, 17 bp, Homo sapiens
ttttcaatgtgaaacac

SEQ ID NO: 6599329 - DNA, 13 bp, Homo sapiens
ttttcaattaaac

SEQ ID NO: 6599330 - DNA, 18 bp, Homo sapiens
ttttcaattaaacggatt

SEQ ID NO: 6599331 - DNA, 22 bp, Homo sapiens
ttttcaattaaacggattattt

SEQ ID NO: 6599332 - DNA, 14 bp, Homo sapiens
ttttcaattatact

SEQ ID NO: 6599333 - DNA, 21 bp, Homo sapiens
ttttcaattatgtttgaaaat

SEQ ID NO: 6599334 - DNA, 18 bp, Homo sapiens
ttttcaattcaaaaatgt

SEQ ID NO: 6599335 - DNA, 19 bp, Homo sapiens
ttttcaatttgtcatgtta

SEQ ID NO: 6599336 - DNA, 14 bp, Homo sapiens
ttttcaattttgca

SEQ ID NO: 6599337 - DNA, 14 bp, Homo sapiens
ttttcacaaacatt

SEQ ID NO: 6599338 - DNA, 16 bp, Homo sapiens
ttttcacaacatatca

SEQ ID NO: 6599339 - DNA, 15 bp, Homo sapiens
ttttcacaatgtgaa

SEQ ID NO: 6599340 - DNA, 18 bp, Homo sapiens
ttttcacactgtcttccc

SEQ ID NO: 6599341 - DNA, 22 bp, Homo sapiens
ttttcacatataaatagatgat

SEQ ID NO: 6599342 - DNA, 15 bp, Homo sapiens
ttttcacatccttga

SEQ ID NO: 6599343 - DNA, 23 bp, Homo sapiens
ttttcacattcttataaatatga

SEQ ID NO: 6599344 - DNA, 13 bp, Homo sapiens
ttttcaccccacc

SEQ ID NO: 6599345 - DNA, 12 bp, Homo sapiens
ttttcacctcat

SEQ ID NO: 6599346 - DNA, 17 bp, Homo sapiens
ttttcacctccatgtca

SEQ ID NO: 6599347 - DNA, 20 bp, Homo sapiens
ttttcacctccatgtcatcc

SEQ ID NO: 6599348 - DNA, 12 bp, Homo sapiens
ttttcacctctt

SEQ ID NO: 6599349 - DNA, 18 bp, Homo sapiens
ttttcacctgaaacactt

SEQ ID NO: 6599350 - DNA, 23 bp, Homo sapiens
ttttcacctgtttttaagctgtt

SEQ ID NO: 6599351 - DNA, 18 bp, Homo sapiens
ttttcacggaagttttca

SEQ ID NO: 6599352 - DNA, 19 bp, Homo sapiens
ttttcacggaagttttcaa

SEQ ID NO: 6599353 - DNA, 20 bp, Homo sapiens
ttttcacggaagttttcaat

SEQ ID NO: 6599354 - DNA, 19 bp, Homo sapiens
ttttcactgctggctgcct

SEQ ID NO: 6599355 - DNA, 22 bp, Homo sapiens
ttttcactggaagatttatgaa

SEQ ID NO: 6599356 - DNA, 14 bp, Homo sapiens
ttttcacttatgaa

SEQ ID NO: 6599357 - DNA, 18 bp, Homo sapiens
ttttcacttcttaaggac

SEQ ID NO: 6599358 - DNA, 18 bp, Homo sapiens
ttttcacttgcttaaaaa

SEQ ID NO: 6599359 - DNA, 14 bp, Homo sapiens
ttttcacttgtatt

SEQ ID NO: 6599360 - DNA, 17 bp, Homo sapiens
ttttcactttagcaaag

SEQ ID NO: 6599361 - DNA, 20 bp, Homo sapiens
ttttcactttgtgtattaaa

SEQ ID NO: 6599362 - DNA, 12 bp, Homo sapiens
ttttcagaaaga

SEQ ID NO: 6599363 - DNA, 16 bp, Homo sapiens
ttttcagaaagatgaa

SEQ ID NO: 6599364 - DNA, 16 bp, Homo sapiens
ttttcagaaagtttga

SEQ ID NO: 6599365 - DNA, 15 bp, Homo sapiens
ttttcagaaatatgt

SEQ ID NO: 6599366 - DNA, 12 bp, Homo sapiens
ttttcagaactg

SEQ ID NO: 6599367 - DNA, 17 bp, Homo sapiens
ttttcagaactgttaaa

SEQ ID NO: 6599368 - DNA, 22 bp, Homo sapiens
ttttcagaagatggtgaagaca

SEQ ID NO: 6599369 - DNA, 12 bp, Homo sapiens
ttttcagaagca

SEQ ID NO: 6599370 - DNA, 21 bp, Homo sapiens
ttttcagaaggttattttctt

SEQ ID NO: 6599371 - DNA, 13 bp, Homo sapiens
ttttcagaatctg

SEQ ID NO: 6599372 - DNA, 20 bp, Homo sapiens
ttttcagaatctgaatgtaa

SEQ ID NO: 6599373 - DNA, 22 bp, Homo sapiens
ttttcagaatctgaatgtaatt

SEQ ID NO: 6599374 - DNA, 23 bp, Homo sapiens
ttttcagaatctgaatgtaattt

SEQ ID NO: 6599375 - DNA, 19 bp, Homo sapiens
ttttcagaattaatgcatt

SEQ ID NO: 6599376 - DNA, 16 bp, Homo sapiens
ttttcagacaaattac

SEQ ID NO: 6599377 - DNA, 22 bp, Homo sapiens
ttttcagacatttttggaaatt

SEQ ID NO: 6599378 - DNA, 11 bp, Homo sapiens
ttttcagaccg

SEQ ID NO: 6599379 - DNA, 13 bp, Homo sapiens
ttttcagaccgaa

SEQ ID NO: 6599380 - DNA, 18 bp, Homo sapiens
ttttcagactgctttaaa

SEQ ID NO: 6599381 - DNA, 22 bp, Homo sapiens
ttttcagagatttatataaatg

SEQ ID NO: 6599382 - DNA, 17 bp, Homo sapiens
ttttcagagcaggaggc

SEQ ID NO: 6599383 - DNA, 19 bp, Homo sapiens
ttttcagaggtgaattaat

SEQ ID NO: 6599384 - DNA, 12 bp, Homo sapiens
ttttcagatata

SEQ ID NO: 6599385 - DNA, 21 bp, Homo sapiens
ttttcagatataaaagactga

SEQ ID NO: 6599386 - DNA, 11 bp, Homo sapiens
ttttcagatgt

SEQ ID NO: 6599387 - DNA, 17 bp, Homo sapiens
ttttcagatgtgaacca

SEQ ID NO: 6599388 - DNA, 18 bp, Homo sapiens
ttttcagatgtgaaccat

SEQ ID NO: 6599389 - DNA, 14 bp, Homo sapiens
ttttcagattcagg

SEQ ID NO: 6599390 - DNA, 21 bp, Homo sapiens
ttttcagattccacacaaaat

SEQ ID NO: 6599391 - DNA, 23 bp, Homo sapiens
ttttcagattccacacaaaatgt

SEQ ID NO: 6599392 - DNA, 12 bp, Homo sapiens
ttttcagattgt

SEQ ID NO: 6599393 - DNA, 18 bp, Homo sapiens
ttttcagcaaactctttt

SEQ ID NO: 6599394 - DNA, 19 bp, Homo sapiens
ttttcagcaaactcttttc

SEQ ID NO: 6599395 - DNA, 16 bp, Homo sapiens
ttttcagcaactcaga

SEQ ID NO: 6599396 - DNA, 20 bp, Homo sapiens
ttttcagccaatttgtctcc

SEQ ID NO: 6599397 - DNA, 20 bp, Homo sapiens
ttttcagccttgtaaatggg

SEQ ID NO: 6599398 - DNA, 18 bp, Homo sapiens
ttttcagcgatgtatgca

SEQ ID NO: 6599399 - DNA, 22 bp, Homo sapiens
ttttcagctaggaacaaatctt

SEQ ID NO: 6599400 - DNA, 20 bp, Homo sapiens
ttttcagctattagcaactg

SEQ ID NO: 6599401 - DNA, 17 bp, Homo sapiens
ttttcagctctctgtat

SEQ ID NO: 6599402 - DNA, 20 bp, Homo sapiens
ttttcagctgctcagaattc

SEQ ID NO: 6599403 - DNA, 12 bp, Homo sapiens
ttttcagcttct

SEQ ID NO: 6599404 - DNA, 20 bp, Homo sapiens
ttttcagcttctgctgggct

SEQ ID NO: 6599405 - DNA, 20 bp, Homo sapiens
ttttcagcttgtttctatac

SEQ ID NO: 6599406 - DNA, 22 bp, Homo sapiens
ttttcaggagcgcaagatagat

SEQ ID NO: 6599407 - DNA, 18 bp, Homo sapiens
ttttcaggctcgccaagg

SEQ ID NO: 6599408 - DNA, 21 bp, Homo sapiens
ttttcaggctcgccaaggcct

SEQ ID NO: 6599409 - DNA, 18 bp, Homo sapiens
ttttcaggtgctcaaaat

SEQ ID NO: 6599410 - DNA, 18 bp, Homo sapiens
ttttcaggttaaattatt

SEQ ID NO: 6599411 - DNA, 20 bp, Homo sapiens
ttttcaggttaaattattga

SEQ ID NO: 6599412 - DNA, 16 bp, Homo sapiens
ttttcagtaccaaaga

SEQ ID NO: 6599413 - DNA, 16 bp, Homo sapiens
ttttcagtattttgga

SEQ ID NO: 6599414 - DNA, 23 bp, Homo sapiens
ttttcagtattttggagaaatta

SEQ ID NO: 6599415 - DNA, 22 bp, Homo sapiens
ttttcagtgatcttcactgtat

SEQ ID NO: 6599416 - DNA, 21 bp, Homo sapiens
ttttcagtgctttgcccttga

SEQ ID NO: 6599417 - DNA, 21 bp, Homo sapiens
ttttcagttccctcctgccca

SEQ ID NO: 6599418 - DNA, 14 bp, Homo sapiens
ttttcataaactga

SEQ ID NO: 6599419 - DNA, 18 bp, Homo sapiens
ttttcataaactgagcct

SEQ ID NO: 6599420 - DNA, 21 bp, Homo sapiens
ttttcataacttattgctgat

SEQ ID NO: 6599421 - DNA, 15 bp, Homo sapiens
ttttcataattcatt

SEQ ID NO: 6599422 - DNA, 15 bp, Homo sapiens
ttttcatactgtaca

SEQ ID NO: 6599423 - DNA, 17 bp, Homo sapiens
ttttcatactgtacaca

SEQ ID NO: 6599424 - DNA, 18 bp, Homo sapiens
ttttcatactgtacacat

SEQ ID NO: 6599425 - DNA, 20 bp, Homo sapiens
ttttcatactgtacacattt

SEQ ID NO: 6599426 - DNA, 23 bp, Homo sapiens
ttttcatactgtacacatttctt

SEQ ID NO: 6599427 - DNA, 21 bp, Homo sapiens
ttttcatagattgagaagttt

SEQ ID NO: 6599428 - DNA, 14 bp, Homo sapiens
ttttcatagatttg

SEQ ID NO: 6599429 - DNA, 16 bp, Homo sapiens
ttttcataggaagaca

SEQ ID NO: 6599430 - DNA, 23 bp, Homo sapiens
ttttcatagtaagtgcgaagact

SEQ ID NO: 6599431 - DNA, 14 bp, Homo sapiens
ttttcatattgtgc

SEQ ID NO: 6599432 - DNA, 19 bp, Homo sapiens
ttttcatattgtgccaata

SEQ ID NO: 6599433 - DNA, 13 bp, Homo sapiens
ttttcatcaaaac

SEQ ID NO: 6599434 - DNA, 14 bp, Homo sapiens
ttttcatcacaact

SEQ ID NO: 6599435 - DNA, 13 bp, Homo sapiens
ttttcatcattgt

SEQ ID NO: 6599436 - DNA, 16 bp, Homo sapiens
ttttcatcatttcagc

SEQ ID NO: 6599437 - DNA, 18 bp, Homo sapiens
ttttcatccataactgaa

SEQ ID NO: 6599438 - DNA, 17 bp, Homo sapiens
ttttcatccattaaaat

SEQ ID NO: 6599439 - DNA, 11 bp, Homo sapiens
ttttcatcctg

SEQ ID NO: 6599440 - DNA, 14 bp, Homo sapiens
ttttcatcctggcc

SEQ ID NO: 6599441 - DNA, 18 bp, Homo sapiens
aatttatatttgaaattt

SEQ ID NO: 6599442 - DNA, 16 bp, Homo sapiens
aatttatatttgtctc

SEQ ID NO: 6599443 - DNA, 15 bp, Homo sapiens
aatttatattttaga

SEQ ID NO: 6599444 - DNA, 15 bp, Homo sapiens
aatttatcaaagcat

SEQ ID NO: 6599445 - DNA, 22 bp, Homo sapiens
aatttatcaaagcatagatgtt

SEQ ID NO: 6599446 - DNA, 16 bp, Homo sapiens
aatttatcaactgtca

SEQ ID NO: 6599447 - DNA, 19 bp, Homo sapiens
aatttatcaactgtcaaat

SEQ ID NO: 6599448 - DNA, 16 bp, Homo sapiens
aatttatcacattgaa

SEQ ID NO: 6599449 - DNA, 18 bp, Homo sapiens
aatttatcacattgaata

SEQ ID NO: 6599450 - DNA, 17 bp, Homo sapiens
aatttatcagtacctaa

SEQ ID NO: 6599451 - DNA, 22 bp, Homo sapiens
aatttatcatgttttataattt

SEQ ID NO: 6599452 - DNA, 22 bp, Homo sapiens
aatttatcattttagtatagtt

SEQ ID NO: 6599453 - DNA, 15 bp, Homo sapiens
aatttatctgtgaat

SEQ ID NO: 6599454 - DNA, 12 bp, Homo sapiens
aatttatctgtt

SEQ ID NO: 6599455 - DNA, 20 bp, Homo sapiens
aatttatcttgtctctgggc

SEQ ID NO: 6599456 - DNA, 12 bp, Homo sapiens
aatttatcttta

SEQ ID NO: 6599457 - DNA, 15 bp, Homo sapiens
aatttatctttacca

SEQ ID NO: 6599458 - DNA, 15 bp, Homo sapiens
aatttatctttgata

SEQ ID NO: 6599459 - DNA, 16 bp, Homo sapiens
aatttatctttgataa

SEQ ID NO: 6599460 - DNA, 20 bp, Homo sapiens
aatttatgagtttttgatag

SEQ ID NO: 6599461 - DNA, 16 bp, Homo sapiens
aatttatgatataata

SEQ ID NO: 6599462 - DNA, 15 bp, Homo sapiens
aatttatgcatttca

SEQ ID NO: 6599463 - DNA, 16 bp, Homo sapiens
aatttatggtattgta

SEQ ID NO: 6599464 - DNA, 12 bp, Homo sapiens
aatttatggttt

SEQ ID NO: 6599465 - DNA, 22 bp, Homo sapiens
aatttatgtgaaatgctttctg

SEQ ID NO: 6599466 - DNA, 14 bp, Homo sapiens
aatttatgtgatgg

SEQ ID NO: 6599467 - DNA, 15 bp, Homo sapiens
aatttatgttaacag

SEQ ID NO: 6599468 - DNA, 16 bp, Homo sapiens
aatttattaaatttat

SEQ ID NO: 6599469 - DNA, 19 bp, Homo sapiens
aatttattaattgctttga

SEQ ID NO: 6599470 - DNA, 17 bp, Homo sapiens
aatttattagttaatat

SEQ ID NO: 6599471 - DNA, 18 bp, Homo sapiens
aatttattagttaatata

SEQ ID NO: 6599472 - DNA, 19 bp, Homo sapiens
aatttattagttaatatat

SEQ ID NO: 6599473 - DNA, 18 bp, Homo sapiens
aatttattatgtggctaa

SEQ ID NO: 6599474 - DNA, 14 bp, Homo sapiens
aatttattattaaa

SEQ ID NO: 6599475 - DNA, 17 bp, Homo sapiens
aatttattattgaaatt

SEQ ID NO: 6599476 - DNA, 16 bp, Homo sapiens
aatttattattgttct

SEQ ID NO: 6599477 - DNA, 22 bp, Homo sapiens
aatttattctacttttaaataa

SEQ ID NO: 6599478 - DNA, 19 bp, Homo sapiens
aatttattgaggaaaaata

SEQ ID NO: 6599479 - DNA, 16 bp, Homo sapiens
aatttattgcacaaaa

SEQ ID NO: 6599480 - DNA, 19 bp, Homo sapiens
aatttattgcacattgttc

SEQ ID NO: 6599481 - DNA, 16 bp, Homo sapiens
aatttattgcttgata

SEQ ID NO: 6599482 - DNA, 19 bp, Homo sapiens
aatttattggcttttctga

SEQ ID NO: 6599483 - DNA, 17 bp, Homo sapiens
aatttattgtaccaaag

SEQ ID NO: 6599484 - DNA, 17 bp, Homo sapiens
aatttattgtctgtcta

SEQ ID NO: 6599485 - DNA, 20 bp, Homo sapiens
aatttattgtctgtctacat

SEQ ID NO: 6599486 - DNA, 17 bp, Homo sapiens
aatttatttatattccg

SEQ ID NO: 6599487 - DNA, 20 bp, Homo sapiens
aatttatttatgggatcctg

SEQ ID NO: 6599488 - DNA, 19 bp, Homo sapiens
aatttatttatgttctcaa

SEQ ID NO: 6599489 - DNA, 16 bp, Homo sapiens
aatttatttattaaga

SEQ ID NO: 6599490 - DNA, 15 bp, Homo sapiens
aatttatttccccag

SEQ ID NO: 6599491 - DNA, 16 bp, Homo sapiens
aatttatttcctagtt

SEQ ID NO: 6599492 - DNA, 23 bp, Homo sapiens
aatttatttgaatgatttttctt

SEQ ID NO: 6599493 - DNA, 12 bp, Homo sapiens
aatttatttgca

SEQ ID NO: 6599494 - DNA, 14 bp, Homo sapiens
aatttatttgcaaa

SEQ ID NO: 6599495 - DNA, 16 bp, Homo sapiens
aatttatttgtttccc

SEQ ID NO: 6599496 - DNA, 17 bp, Homo sapiens
aatttattttataagaa

SEQ ID NO: 6599497 - DNA, 23 bp, Homo sapiens
aatttattttataagaaaaactt

SEQ ID NO: 6599498 - DNA, 20 bp, Homo sapiens
aatttattttattttagcag

SEQ ID NO: 6599499 - DNA, 22 bp, Homo sapiens
aatttattttattttagcagtt

SEQ ID NO: 6599500 - DNA, 12 bp, Homo sapiens
aatttattttgc

SEQ ID NO: 6599501 - DNA, 19 bp, Homo sapiens
aatttattttgctccctct

SEQ ID NO: 6599502 - DNA, 20 bp, Homo sapiens
aatttattttgctccctctg

SEQ ID NO: 6599503 - DNA, 12 bp, Homo sapiens
aatttattttgt

SEQ ID NO: 6599504 - DNA, 21 bp, Homo sapiens
aatttattttgtcgaattttt

SEQ ID NO: 6599505 - DNA, 23 bp, Homo sapiens
aatttatttttaccttcactgtg

SEQ ID NO: 6599506 - DNA, 20 bp, Homo sapiens
aatttcaaaagacatgttgt

SEQ ID NO: 6599507 - DNA, 19 bp, Homo sapiens
aatttcaaaagtgatctgt

SEQ ID NO: 6599508 - DNA, 11 bp, Homo sapiens
aatttcaaaat

SEQ ID NO: 6599509 - DNA, 21 bp, Homo sapiens
aatttcaaaatacatttgtaa

SEQ ID NO: 6599510 - DNA, 23 bp, Homo sapiens
aatttcaaaatacatttgtaagt

SEQ ID NO: 6599511 - DNA, 13 bp, Homo sapiens
aatttcaaaatgc

SEQ ID NO: 6599512 - DNA, 17 bp, Homo sapiens
aatttcaaaatgcatgt

SEQ ID NO: 6599513 - DNA, 14 bp, Homo sapiens
aatttcaaaatgtc

SEQ ID NO: 6599514 - DNA, 15 bp, Homo sapiens
aatttcaaaatttaa

SEQ ID NO: 6599515 - DNA, 12 bp, Homo sapiens
aatttcaaagaa

SEQ ID NO: 6599516 - DNA, 15 bp, Homo sapiens
aatttcaaatctgta

SEQ ID NO: 6599517 - DNA, 17 bp, Homo sapiens
aatttcaaatctgtaat

SEQ ID NO: 6599518 - DNA, 17 bp, Homo sapiens
aatttcaacgtatgtgt

SEQ ID NO: 6599519 - DNA, 15 bp, Homo sapiens
aatttcaagaatgtt

SEQ ID NO: 6599520 - DNA, 22 bp, Homo sapiens
aatttcaagaatgtttcagtta

SEQ ID NO: 6599521 - DNA, 20 bp, Homo sapiens
aatttcaagcttattttgga

SEQ ID NO: 6599522 - DNA, 14 bp, Homo sapiens
aatttcaaggaact

SEQ ID NO: 6599523 - DNA, 16 bp, Homo sapiens
aatttcaaggttctaa

SEQ ID NO: 6599524 - DNA, 16 bp, Homo sapiens
aatttcaatcaaccaa

SEQ ID NO: 6599525 - DNA, 14 bp, Homo sapiens
aatttcaatgcttc

SEQ ID NO: 6599526 - DNA, 17 bp, Homo sapiens
aatttcaatgcttcttt

SEQ ID NO: 6599527 - DNA, 19 bp, Homo sapiens
aatttcaatgcttctttta

SEQ ID NO: 6599528 - DNA, 14 bp, Homo sapiens
aatttcaatttgtt

SEQ ID NO: 6599529 - DNA, 20 bp, Homo sapiens
aatttcacagttctgtaatg

SEQ ID NO: 6599530 - DNA, 21 bp, Homo sapiens
aatttcaccaccaaatgccaa

SEQ ID NO: 6599531 - DNA, 16 bp, Homo sapiens
aatttcacctgtaaac

SEQ ID NO: 6599532 - DNA, 19 bp, Homo sapiens
aatttcacctgtaaacctg

SEQ ID NO: 6599533 - DNA, 22 bp, Homo sapiens
aatttcactactagattgacta

SEQ ID NO: 6599534 - DNA, 13 bp, Homo sapiens
aatttcactgtct

SEQ ID NO: 6599535 - DNA, 23 bp, Homo sapiens
aatttcactgtctttaattctgt

SEQ ID NO: 6599536 - DNA, 16 bp, Homo sapiens
aatttcacttatacct

SEQ ID NO: 6599537 - DNA, 18 bp, Homo sapiens
aatttcacttgaaattaa

SEQ ID NO: 6599538 - DNA, 20 bp, Homo sapiens
aatttcagagagaatcaaga

SEQ ID NO: 6599539 - DNA, 22 bp, Homo sapiens
aatttcagctggagatactgat

SEQ ID NO: 6599540 - DNA, 18 bp, Homo sapiens
aatttcagctttggctct

SEQ ID NO: 6599541 - DNA, 19 bp, Homo sapiens
aatttcaggaatcagaaat

SEQ ID NO: 6599542 - DNA, 17 bp, Homo sapiens
aatttcaggaatttaat

SEQ ID NO: 6599543 - DNA, 21 bp, Homo sapiens
aatttcaggaatttaatttat

SEQ ID NO: 6599544 - DNA, 17 bp, Homo sapiens
aatttcaggcattttgt

SEQ ID NO: 6599545 - DNA, 23 bp, Homo sapiens
aatttcagtaggctttatgctgt

SEQ ID NO: 6599546 - DNA, 15 bp, Homo sapiens
aatttcagtcaattc

SEQ ID NO: 6599547 - DNA, 22 bp, Homo sapiens
aatttcagtcaattctgatgtt

SEQ ID NO: 6599548 - DNA, 19 bp, Homo sapiens
aatttcagtgggaaatatg

SEQ ID NO: 6599549 - DNA, 12 bp, Homo sapiens
aatttcataaat

SEQ ID NO: 6599550 - DNA, 14 bp, Homo sapiens
aatttcataaattg

SEQ ID NO: 6599551 - DNA, 17 bp, Homo sapiens
aatttcataattctgaa

SEQ ID NO: 6599552 - DNA, 19 bp, Homo sapiens
aatttcataattctgaaac

SEQ ID NO: 6599553 - DNA, 17 bp, Homo sapiens
aatttcatctttccaaa

SEQ ID NO: 6599554 - DNA, 14 bp, Homo sapiens
aatttcatgaaaac

SEQ ID NO: 6599555 - DNA, 16 bp, Homo sapiens
aatttcatgtaaaaca

SEQ ID NO: 6599556 - DNA, 18 bp, Homo sapiens
aatttcatgtaaaacaga

SEQ ID NO: 6599557 - DNA, 14 bp, Homo sapiens
aatttcatgtatat

SEQ ID NO: 6599558 - DNA, 12 bp, Homo sapiens
aatttcattatc

SEQ ID NO: 6599559 - DNA, 12 bp, Homo sapiens
aatttcattcaa

SEQ ID NO: 6599560 - DNA, 15 bp, Homo sapiens
aatttcattgtctct

SEQ ID NO: 6599561 - DNA, 18 bp, Homo sapiens
aatttcatttaaatatct

SEQ ID NO: 6599562 - DNA, 11 bp, Homo sapiens
aatttcatttc

SEQ ID NO: 6599563 - DNA, 19 bp, Homo sapiens
aatttcatttcacattttt

SEQ ID NO: 6599564 - DNA, 20 bp, Homo sapiens
aatttcatttccagcatttt

SEQ ID NO: 6599565 - DNA, 21 bp, Homo sapiens
aatttccacaaaatctgtcca

SEQ ID NO: 6599566 - DNA, 21 bp, Homo sapiens
aatttccactcaggtctgttt

SEQ ID NO: 6599567 - DNA, 19 bp, Homo sapiens
aatttccaggaaaaaataa

SEQ ID NO: 6599568 - DNA, 16 bp, Homo sapiens
aatttccatatagtct

SEQ ID NO: 6599569 - DNA, 13 bp, Homo sapiens
aatttccatatcc

SEQ ID NO: 6599570 - DNA, 17 bp, Homo sapiens
aatttcccaaagcagtg

SEQ ID NO: 6599571 - DNA, 21 bp, Homo sapiens
aatttcccacaccccagcgcc

SEQ ID NO: 6599572 - DNA, 13 bp, Homo sapiens
aatttcccacccc

SEQ ID NO: 6599573 - DNA, 13 bp, Homo sapiens
aatttcccagaag

SEQ ID NO: 6599574 - DNA, 12 bp, Homo sapiens
aatttcccagga

SEQ ID NO: 6599575 - DNA, 17 bp, Homo sapiens
aatttcccaggaccctg

SEQ ID NO: 6599576 - DNA, 22 bp, Homo sapiens
aatttcccaggaccctgaaggg

SEQ ID NO: 6599577 - DNA, 14 bp, Homo sapiens
aatttccccaacag

SEQ ID NO: 6599578 - DNA, 18 bp, Homo sapiens
aatttccccaacagtgtg

SEQ ID NO: 6599579 - DNA, 20 bp, Homo sapiens
aatttccccaacagtgtgaa

SEQ ID NO: 6599580 - DNA, 14 bp, Homo sapiens
aatttcccccacct

SEQ ID NO: 6599581 - DNA, 21 bp, Homo sapiens
aatttcccggagccatcaccc

SEQ ID NO: 6599582 - DNA, 17 bp, Homo sapiens
aatttccctcaggttct

SEQ ID NO: 6599583 - DNA, 15 bp, Homo sapiens
aatttccggaagtaa

SEQ ID NO: 6599584 - DNA, 14 bp, Homo sapiens
aatttcctatctgt

SEQ ID NO: 6599585 - DNA, 16 bp, Homo sapiens
aatttcctatctgtat

SEQ ID NO: 6599586 - DNA, 15 bp, Homo sapiens
aatttcctcactgcc

SEQ ID NO: 6599587 - DNA, 14 bp, Homo sapiens
aatttcctctccac

SEQ ID NO: 6599588 - DNA, 17 bp, Homo sapiens
aatttcctctccactgc

SEQ ID NO: 6599589 - DNA, 12 bp, Homo sapiens
aatttcctgctc

SEQ ID NO: 6599590 - DNA, 12 bp, Homo sapiens
aatttcctggga

SEQ ID NO: 6599591 - DNA, 15 bp, Homo sapiens
aatttcctgggagct

SEQ ID NO: 6599592 - DNA, 13 bp, Homo sapiens
aatttcctgtaat

SEQ ID NO: 6599593 - DNA, 14 bp, Homo sapiens
aatttcctgtaata

SEQ ID NO: 6599594 - DNA, 15 bp, Homo sapiens
aatttcctgtgagga

SEQ ID NO: 6599595 - DNA, 16 bp, Homo sapiens
aatttcctgtttgaaa

SEQ ID NO: 6599596 - DNA, 16 bp, Homo sapiens
aatttccttcaggcag

SEQ ID NO: 6599597 - DNA, 17 bp, Homo sapiens
aatttccttcaggcagc

SEQ ID NO: 6599598 - DNA, 15 bp, Homo sapiens
aatttccttctgtta

SEQ ID NO: 6599599 - DNA, 20 bp, Homo sapiens
aatttcctttattattctgt

SEQ ID NO: 6599600 - DNA, 17 bp, Homo sapiens
aatttcctttttgacac

SEQ ID NO: 6599601 - DNA, 20 bp, Homo sapiens
aatttcctttttgacactga

SEQ ID NO: 6599602 - DNA, 14 bp, Homo sapiens
aatttcgagatttg

SEQ ID NO: 6599603 - DNA, 14 bp, Homo sapiens
aatttcgccttaaa

SEQ ID NO: 6599604 - DNA, 17 bp, Homo sapiens
aatttcggattttttcc

SEQ ID NO: 6599605 - DNA, 18 bp, Homo sapiens
aatttcggattttttcca

SEQ ID NO: 6599606 - DNA, 21 bp, Homo sapiens
aatttcgggagccttgtcagt

SEQ ID NO: 6599607 - DNA, 18 bp, Homo sapiens
aatttctaaagtaaaatt

SEQ ID NO: 6599608 - DNA, 23 bp, Homo sapiens
aatttctaaagtaaaattgaagc

SEQ ID NO: 6599609 - DNA, 21 bp, Homo sapiens
aatttctaaatctccaaaata

SEQ ID NO: 6599610 - DNA, 16 bp, Homo sapiens
aatttctaatggcctt

SEQ ID NO: 6599611 - DNA, 18 bp, Homo sapiens
aatttctacaaaataaca

SEQ ID NO: 6599612 - DNA, 23 bp, Homo sapiens
aatttctacccatgttgggaaaa

SEQ ID NO: 6599613 - DNA, 16 bp, Homo sapiens
aatttctactttgaag

SEQ ID NO: 6599614 - DNA, 21 bp, Homo sapiens
aatttctagacagtattgcca

SEQ ID NO: 6599615 - DNA, 22 bp, Homo sapiens
aatttctagacagtattgccac

SEQ ID NO: 6599616 - DNA, 20 bp, Homo sapiens
aatttctagatatgagaaat

SEQ ID NO: 6599617 - DNA, 18 bp, Homo sapiens
aatttctaggactgaatt

SEQ ID NO: 6599618 - DNA, 21 bp, Homo sapiens
aatttctataaatttaagaaa

SEQ ID NO: 6599619 - DNA, 14 bp, Homo sapiens
aatttctatgaagg

SEQ ID NO: 6599620 - DNA, 13 bp, Homo sapiens
aatttctattaaa

SEQ ID NO: 6599621 - DNA, 18 bp, Homo sapiens
ttttcatctaacgtgcat

SEQ ID NO: 6599622 - DNA, 15 bp, Homo sapiens
ttttcatctcattaa

SEQ ID NO: 6599623 - DNA, 16 bp, Homo sapiens
ttttcatctcttcaat

SEQ ID NO: 6599624 - DNA, 20 bp, Homo sapiens
ttttcatctcttcaatcact

SEQ ID NO: 6599625 - DNA, 21 bp, Homo sapiens
ttttcatctgaaaagcagttc

SEQ ID NO: 6599626 - DNA, 14 bp, Homo sapiens
ttttcatctgggaa

SEQ ID NO: 6599627 - DNA, 21 bp, Homo sapiens
ttttcatcttctctggcgaca

SEQ ID NO: 6599628 - DNA, 22 bp, Homo sapiens
ttttcatctttaagaatgctta

SEQ ID NO: 6599629 - DNA, 14 bp, Homo sapiens
ttttcatgaatgtg

SEQ ID NO: 6599630 - DNA, 18 bp, Homo sapiens
ttttcatgaatgtgctgg

SEQ ID NO: 6599631 - DNA, 21 bp, Homo sapiens
ttttcatgaatgtgctggtga

SEQ ID NO: 6599632 - DNA, 15 bp, Homo sapiens
ttttcatgacagaat

SEQ ID NO: 6599633 - DNA, 17 bp, Homo sapiens
ttttcatgacagaatat

SEQ ID NO: 6599634 - DNA, 21 bp, Homo sapiens
ttttcatgattttgaaatcat

SEQ ID NO: 6599635 - DNA, 14 bp, Homo sapiens
ttttcatgcttcca

SEQ ID NO: 6599636 - DNA, 19 bp, Homo sapiens
ttttcatggaagtggcagt

SEQ ID NO: 6599637 - DNA, 12 bp, Homo sapiens
ttttcatgtttt

SEQ ID NO: 6599638 - DNA, 20 bp, Homo sapiens
ttttcatgttttaacaaaaa

SEQ ID NO: 6599639 - DNA, 22 bp, Homo sapiens
ttttcattaaagagccattctg

SEQ ID NO: 6599640 - DNA, 20 bp, Homo sapiens
ttttcattaaataaatttga

SEQ ID NO: 6599641 - DNA, 19 bp, Homo sapiens
ttttcattacaatggaaac

SEQ ID NO: 6599642 - DNA, 20 bp, Homo sapiens
ttttcattacctgtagcttt

SEQ ID NO: 6599643 - DNA, 21 bp, Homo sapiens
ttttcattagcaaaaaaagtt

SEQ ID NO: 6599644 - DNA, 22 bp, Homo sapiens
ttttcattagcagttgctcaca

SEQ ID NO: 6599645 - DNA, 12 bp, Homo sapiens
ttttcattatgt

SEQ ID NO: 6599646 - DNA, 20 bp, Homo sapiens
ttttcattatgttcatgtaa

SEQ ID NO: 6599647 - DNA, 13 bp, Homo sapiens
ttttcattattgt

SEQ ID NO: 6599648 - DNA, 21 bp, Homo sapiens
ttttcattattttattatgaa

SEQ ID NO: 6599649 - DNA, 20 bp, Homo sapiens
ttttcattccatgtgcccag

SEQ ID NO: 6599650 - DNA, 17 bp, Homo sapiens
ttttcattcctaaagaa

SEQ ID NO: 6599651 - DNA, 14 bp, Homo sapiens
ttttcattctcatt

SEQ ID NO: 6599652 - DNA, 15 bp, Homo sapiens
ttttcattctgccaa

SEQ ID NO: 6599653 - DNA, 18 bp, Homo sapiens
ttttcattgaacagcaaa

SEQ ID NO: 6599654 - DNA, 15 bp, Homo sapiens
ttttcattgcaaagt

SEQ ID NO: 6599655 - DNA, 14 bp, Homo sapiens
ttttcattgctgtg

SEQ ID NO: 6599656 - DNA, 13 bp, Homo sapiens
ttttcattgtaaa

SEQ ID NO: 6599657 - DNA, 14 bp, Homo sapiens
ttttcattgtgttt

SEQ ID NO: 6599658 - DNA, 13 bp, Homo sapiens
ttttcatttaact

SEQ ID NO: 6599659 - DNA, 18 bp, Homo sapiens
ttttcatttaactacaaa

SEQ ID NO: 6599660 - DNA, 19 bp, Homo sapiens
ttttcatttacaggaaatt

SEQ ID NO: 6599661 - DNA, 18 bp, Homo sapiens
ttttcatttcagatttta

SEQ ID NO: 6599662 - DNA, 11 bp, Homo sapiens
ttttcatttgt

SEQ ID NO: 6599663 - DNA, 18 bp, Homo sapiens
ttttcatttgtaaaaatg

SEQ ID NO: 6599664 - DNA, 16 bp, Homo sapiens
ttttcatttgttttgc

SEQ ID NO: 6599665 - DNA, 14 bp, Homo sapiens
ttttcattttaact

SEQ ID NO: 6599666 - DNA, 13 bp, Homo sapiens
ttttcattttaat

SEQ ID NO: 6599667 - DNA, 16 bp, Homo sapiens
ttttcattttaatata

SEQ ID NO: 6599668 - DNA, 13 bp, Homo sapiens
ttttcattttaca

SEQ ID NO: 6599669 - DNA, 17 bp, Homo sapiens
ttttcattttagacatt

SEQ ID NO: 6599670 - DNA, 13 bp, Homo sapiens
ttttcattttcat

SEQ ID NO: 6599671 - DNA, 13 bp, Homo sapiens
ttttcattttcca

SEQ ID NO: 6599672 - DNA, 18 bp, Homo sapiens
ttttcattttctgcaagc

SEQ ID NO: 6599673 - DNA, 13 bp, Homo sapiens
ttttcatttttgt

SEQ ID NO: 6599674 - DNA, 17 bp, Homo sapiens
ttttccaaaaacaaagt

SEQ ID NO: 6599675 - DNA, 20 bp, Homo sapiens
ttttccaaaagtggcctctt

SEQ ID NO: 6599676 - DNA, 13 bp, Homo sapiens
ttttccaaactga

SEQ ID NO: 6599677 - DNA, 18 bp, Homo sapiens
ttttccaaagaaaagtat

SEQ ID NO: 6599678 - DNA, 20 bp, Homo sapiens
ttttccaaagagccatgtgt

SEQ ID NO: 6599679 - DNA, 18 bp, Homo sapiens
ttttccaaataaacattt

SEQ ID NO: 6599680 - DNA, 18 bp, Homo sapiens
ttttccaaatgcccaagg

SEQ ID NO: 6599681 - DNA, 15 bp, Homo sapiens
ttttccaaatgcttc

SEQ ID NO: 6599682 - DNA, 17 bp, Homo sapiens
ttttccaaatgcttcta

SEQ ID NO: 6599683 - DNA, 22 bp, Homo sapiens
ttttccaaatgtaataaacttt

SEQ ID NO: 6599684 - DNA, 20 bp, Homo sapiens
ttttccaagtgtataatgtt

SEQ ID NO: 6599685 - DNA, 12 bp, Homo sapiens
ttttccaataaa

SEQ ID NO: 6599686 - DNA, 17 bp, Homo sapiens
ttttccaatattttaat

SEQ ID NO: 6599687 - DNA, 19 bp, Homo sapiens
ttttccaatattttaataa

SEQ ID NO: 6599688 - DNA, 14 bp, Homo sapiens
ttttccaatgtctg

SEQ ID NO: 6599689 - DNA, 18 bp, Homo sapiens
ttttccacataaatttta

SEQ ID NO: 6599690 - DNA, 19 bp, Homo sapiens
ttttccacataaattttaa

SEQ ID NO: 6599691 - DNA, 13 bp, Homo sapiens
ttttccacattcc

SEQ ID NO: 6599692 - DNA, 20 bp, Homo sapiens
ttttccacattccagtgatg

SEQ ID NO: 6599693 - DNA, 17 bp, Homo sapiens
ttttccacgcagttctt

SEQ ID NO: 6599694 - DNA, 18 bp, Homo sapiens
ttttccacggaaacagaa

SEQ ID NO: 6599695 - DNA, 14 bp, Homo sapiens
ttttccacttttgt

SEQ ID NO: 6599696 - DNA, 22 bp, Homo sapiens
ttttccagaaatacctgtctag

SEQ ID NO: 6599697 - DNA, 13 bp, Homo sapiens
ttttccagaattt

SEQ ID NO: 6599698 - DNA, 11 bp, Homo sapiens
ttttccagagg

SEQ ID NO: 6599699 - DNA, 18 bp, Homo sapiens
ttttccagcaaaatggaa

SEQ ID NO: 6599700 - DNA, 12 bp, Homo sapiens
ttttccagcaag

SEQ ID NO: 6599701 - DNA, 13 bp, Homo sapiens
ttttccagcaagt

SEQ ID NO: 6599702 - DNA, 19 bp, Homo sapiens
ttttccagccttatgtgtt

SEQ ID NO: 6599703 - DNA, 20 bp, Homo sapiens
ttttccagctggatgagaat

SEQ ID NO: 6599704 - DNA, 17 bp, Homo sapiens
ttttccaggcttctgct

SEQ ID NO: 6599705 - DNA, 20 bp, Homo sapiens
ttttccagggcaatcaatgt

SEQ ID NO: 6599706 - DNA, 13 bp, Homo sapiens
ttttccagtattg

SEQ ID NO: 6599707 - DNA, 17 bp, Homo sapiens
ttttccagtattttagt

SEQ ID NO: 6599708 - DNA, 14 bp, Homo sapiens
ttttccataaagaa

SEQ ID NO: 6599709 - DNA, 16 bp, Homo sapiens
ttttccataagctatt

SEQ ID NO: 6599710 - DNA, 14 bp, Homo sapiens
ttttccatatattg

SEQ ID NO: 6599711 - DNA, 23 bp, Homo sapiens
ttttccatatccctcttgacatt

SEQ ID NO: 6599712 - DNA, 18 bp, Homo sapiens
ttttccatatttttacaa

SEQ ID NO: 6599713 - DNA, 20 bp, Homo sapiens
ttttccatcattttacagtg

SEQ ID NO: 6599714 - DNA, 13 bp, Homo sapiens
ttttccatcctga

SEQ ID NO: 6599715 - DNA, 22 bp, Homo sapiens
ttttccatcctgaggtgcctcc

SEQ ID NO: 6599716 - DNA, 24 bp, Homo sapiens
ttttccatcctgaggtgcctccca

SEQ ID NO: 6599717 - DNA, 14 bp, Homo sapiens
ttttccatctaaaa

SEQ ID NO: 6599718 - DNA, 15 bp, Homo sapiens
ttttccatctaaaat

SEQ ID NO: 6599719 - DNA, 16 bp, Homo sapiens
ttttccatctaaaata

SEQ ID NO: 6599720 - DNA, 17 bp, Homo sapiens
ttttccatctgtgtgca

SEQ ID NO: 6599721 - DNA, 11 bp, Homo sapiens
ttttccatgaa

SEQ ID NO: 6599722 - DNA, 14 bp, Homo sapiens
ttttccatgacatt

SEQ ID NO: 6599723 - DNA, 18 bp, Homo sapiens
ttttccatgagtcccctg

SEQ ID NO: 6599724 - DNA, 19 bp, Homo sapiens
ttttccatgagtcccctgt

SEQ ID NO: 6599725 - DNA, 14 bp, Homo sapiens
ttttccatgtatct

SEQ ID NO: 6599726 - DNA, 18 bp, Homo sapiens
ttttccattacatgatct

SEQ ID NO: 6599727 - DNA, 18 bp, Homo sapiens
ttttccattgaccagctc

SEQ ID NO: 6599728 - DNA, 20 bp, Homo sapiens
ttttccattgaccagctctc

SEQ ID NO: 6599729 - DNA, 20 bp, Homo sapiens
ttttccatttggcactatgg

SEQ ID NO: 6599730 - DNA, 16 bp, Homo sapiens
ttttccatttgggcac

SEQ ID NO: 6599731 - DNA, 14 bp, Homo sapiens
ttttccattttata

SEQ ID NO: 6599732 - DNA, 18 bp, Homo sapiens
ttttcccaaagcactttt

SEQ ID NO: 6599733 - DNA, 23 bp, Homo sapiens
ttttcccacaattcttttgaaag

SEQ ID NO: 6599734 - DNA, 20 bp, Homo sapiens
ttttcccactgcaccccctc

SEQ ID NO: 6599735 - DNA, 15 bp, Homo sapiens
ttttcccaggaaaga

SEQ ID NO: 6599736 - DNA, 19 bp, Homo sapiens
ttttcccaggacaggaaat

SEQ ID NO: 6599737 - DNA, 11 bp, Homo sapiens
ttttcccagtg

SEQ ID NO: 6599738 - DNA, 19 bp, Homo sapiens
ttttcccagtgaataaata

SEQ ID NO: 6599739 - DNA, 19 bp, Homo sapiens
ttttccccaaccacagaga

SEQ ID NO: 6599740 - DNA, 19 bp, Homo sapiens
ttttccccaattatcctcc

SEQ ID NO: 6599741 - DNA, 21 bp, Homo sapiens
ttttccccacattctatagcc

SEQ ID NO: 6599742 - DNA, 22 bp, Homo sapiens
ttttccccattgaccctcacct

SEQ ID NO: 6599743 - DNA, 13 bp, Homo sapiens
ttttcccccagca

SEQ ID NO: 6599744 - DNA, 20 bp, Homo sapiens
ttttccccccaccccccagc

SEQ ID NO: 6599745 - DNA, 18 bp, Homo sapiens
ttttccccctaattctta

SEQ ID NO: 6599746 - DNA, 12 bp, Homo sapiens
ttttcccccttc

SEQ ID NO: 6599747 - DNA, 23 bp, Homo sapiens
ttttccccgcctgcagtcttctg

SEQ ID NO: 6599748 - DNA, 23 bp, Homo sapiens
ttttccccggtcccttgagacct

SEQ ID NO: 6599749 - DNA, 20 bp, Homo sapiens
ttttcccctaccaatattag

SEQ ID NO: 6599750 - DNA, 16 bp, Homo sapiens
ttttcccctgtcctga

SEQ ID NO: 6599751 - DNA, 15 bp, Homo sapiens
ttttcccctttcctg

SEQ ID NO: 6599752 - DNA, 15 bp, Homo sapiens
ttttcccctttctgt

SEQ ID NO: 6599753 - DNA, 22 bp, Homo sapiens
ttttcccgtatgctttcttcat

SEQ ID NO: 6599754 - DNA, 15 bp, Homo sapiens
ttttccctacctaag

SEQ ID NO: 6599755 - DNA, 14 bp, Homo sapiens
ttttccctccccag

SEQ ID NO: 6599756 - DNA, 19 bp, Homo sapiens
ttttccctctcttgccttt

SEQ ID NO: 6599757 - DNA, 14 bp, Homo sapiens
ttttccctctgctg

SEQ ID NO: 6599758 - DNA, 16 bp, Homo sapiens
ttttccctctgctgct

SEQ ID NO: 6599759 - DNA, 15 bp, Homo sapiens
ttttccctgtacagt

SEQ ID NO: 6599760 - DNA, 15 bp, Homo sapiens
ttttccctgtttgcc

SEQ ID NO: 6599761 - DNA, 19 bp, Homo sapiens
ttttcccttagtattaaca

SEQ ID NO: 6599762 - DNA, 17 bp, Homo sapiens
ttttcccttcatgtttt

SEQ ID NO: 6599763 - DNA, 16 bp, Homo sapiens
ttttcccttttctttc

SEQ ID NO: 6599764 - DNA, 18 bp, Homo sapiens
ttttccgcattctttgta

SEQ ID NO: 6599765 - DNA, 15 bp, Homo sapiens
ttttccgtaaatgtc

SEQ ID NO: 6599766 - DNA, 20 bp, Homo sapiens
ttttccgtcacttaaatttg

SEQ ID NO: 6599767 - DNA, 14 bp, Homo sapiens
ttttcctaaaaata

SEQ ID NO: 6599768 - DNA, 16 bp, Homo sapiens
ttttcctaaggaaact

SEQ ID NO: 6599769 - DNA, 20 bp, Homo sapiens
ttttcctaagtgattgtatg

SEQ ID NO: 6599770 - DNA, 17 bp, Homo sapiens
ttttcctacaggcagtc

SEQ ID NO: 6599771 - DNA, 17 bp, Homo sapiens
ttttcctactgtcctca

SEQ ID NO: 6599772 - DNA, 11 bp, Homo sapiens
ttttcctatat

SEQ ID NO: 6599773 - DNA, 15 bp, Homo sapiens
ttttcctatgctatt

SEQ ID NO: 6599774 - DNA, 19 bp, Homo sapiens
ttttcctatgctattgaca

SEQ ID NO: 6599775 - DNA, 20 bp, Homo sapiens
ttttcctatgctattgacaa

SEQ ID NO: 6599776 - DNA, 14 bp, Homo sapiens
ttttcctattctgt

SEQ ID NO: 6599777 - DNA, 13 bp, Homo sapiens
ttttcctatttgt

SEQ ID NO: 6599778 - DNA, 22 bp, Homo sapiens
ttttcctcacacccacctgctg

SEQ ID NO: 6599779 - DNA, 20 bp, Homo sapiens
ttttcctcatgtaacattgg

SEQ ID NO: 6599780 - DNA, 15 bp, Homo sapiens
ttttcctcattttga

SEQ ID NO: 6599781 - DNA, 15 bp, Homo sapiens
ttttcctccaaagta

SEQ ID NO: 6599782 - DNA, 12 bp, Homo sapiens
ttttcctcccag

SEQ ID NO: 6599783 - DNA, 24 bp, Homo sapiens
ttttcctcccagttctacaagcat

SEQ ID NO: 6599784 - DNA, 18 bp, Homo sapiens
ttttcctccccgaagaca

SEQ ID NO: 6599785 - DNA, 20 bp, Homo sapiens
ttttcctccctgcttaaaaa

SEQ ID NO: 6599786 - DNA, 21 bp, Homo sapiens
ttttcctcccttgggttctga

SEQ ID NO: 6599787 - DNA, 17 bp, Homo sapiens
ttttcctcgcttctttc

SEQ ID NO: 6599788 - DNA, 18 bp, Homo sapiens
ttttcctcgcttctttca

SEQ ID NO: 6599789 - DNA, 19 bp, Homo sapiens
ttttcctctcaataaaatt

SEQ ID NO: 6599790 - DNA, 19 bp, Homo sapiens
ttttcctctcattgtcttg

SEQ ID NO: 6599791 - DNA, 21 bp, Homo sapiens
ttttcctctgagcccagctgc

SEQ ID NO: 6599792 - DNA, 16 bp, Homo sapiens
ttttcctctgttcaca

SEQ ID NO: 6599793 - DNA, 12 bp, Homo sapiens
ttttcctcttct

SEQ ID NO: 6599794 - DNA, 14 bp, Homo sapiens
ttttcctcttgtga

SEQ ID NO: 6599795 - DNA, 13 bp, Homo sapiens
ttttcctgcatgt

SEQ ID NO: 6599796 - DNA, 10 bp, Homo sapiens
ttttcctgcc

SEQ ID NO: 6599797 - DNA, 20 bp, Homo sapiens
ttttcctggcagctgctgtg

SEQ ID NO: 6599798 - DNA, 12 bp, Homo sapiens
ttttcctgtcaa

SEQ ID NO: 6599799 - DNA, 20 bp, Homo sapiens
ttttcctgtcctctttcagc

SEQ ID NO: 6599800 - DNA, 12 bp, Homo sapiens
ttttcctgtctt

SEQ ID NO: 6599801 - DNA, 14 bp, Homo sapiens
ttttcctgtcttct

SEQ ID NO: 6599802 - DNA, 21 bp, Homo sapiens
aatttctcacctgaaaatgtg

SEQ ID NO: 6599803 - DNA, 11 bp, Homo sapiens
aatttctcagc

SEQ ID NO: 6599804 - DNA, 23 bp, Homo sapiens
aatttctcagcgggagtctcctc

SEQ ID NO: 6599805 - DNA, 14 bp, Homo sapiens
aatttctcatgttc

SEQ ID NO: 6599806 - DNA, 22 bp, Homo sapiens
aatttctcatgttccttttgaa

SEQ ID NO: 6599807 - DNA, 15 bp, Homo sapiens
aatttctccaaagct

SEQ ID NO: 6599808 - DNA, 20 bp, Homo sapiens
aatttctcccagtcatttaa

SEQ ID NO: 6599809 - DNA, 18 bp, Homo sapiens
aatttctcctcatttaat

SEQ ID NO: 6599810 - DNA, 12 bp, Homo sapiens
aatttctcctcc

SEQ ID NO: 6599811 - DNA, 14 bp, Homo sapiens
aatttctcctccct

SEQ ID NO: 6599812 - DNA, 21 bp, Homo sapiens
aatttctcctttcctacagtt

SEQ ID NO: 6599813 - DNA, 14 bp, Homo sapiens
aatttctctacaga

SEQ ID NO: 6599814 - DNA, 16 bp, Homo sapiens
aatttctctactgtct

SEQ ID NO: 6599815 - DNA, 16 bp, Homo sapiens
aatttctctcaatttg

SEQ ID NO: 6599816 - DNA, 16 bp, Homo sapiens
aatttctctctttctt

SEQ ID NO: 6599817 - DNA, 23 bp, Homo sapiens
aatttctcttaagtactgaaata

SEQ ID NO: 6599818 - DNA, 19 bp, Homo sapiens
aatttctgaaagatgagta

SEQ ID NO: 6599819 - DNA, 22 bp, Homo sapiens
aatttctgataaagttccttaa

SEQ ID NO: 6599820 - DNA, 23 bp, Homo sapiens
aatttctgcacaggtctctgttt

SEQ ID NO: 6599821 - DNA, 19 bp, Homo sapiens
aatttctgccaataaattc

SEQ ID NO: 6599822 - DNA, 14 bp, Homo sapiens
aatttctgccattt

SEQ ID NO: 6599823 - DNA, 20 bp, Homo sapiens
aatttctgccatttcatgtc

SEQ ID NO: 6599824 - DNA, 12 bp, Homo sapiens
aatttctgccct

SEQ ID NO: 6599825 - DNA, 18 bp, Homo sapiens
aatttctgctaaatatca

SEQ ID NO: 6599826 - DNA, 22 bp, Homo sapiens
aatttctgctgtggtctataaa

SEQ ID NO: 6599827 - DNA, 16 bp, Homo sapiens
aatttctggaagaaag

SEQ ID NO: 6599828 - DNA, 14 bp, Homo sapiens
aatttctggaagat

SEQ ID NO: 6599829 - DNA, 13 bp, Homo sapiens
aatttctggcaaa

SEQ ID NO: 6599830 - DNA, 23 bp, Homo sapiens
aatttctggcaaatattttgtca

SEQ ID NO: 6599831 - DNA, 12 bp, Homo sapiens
aatttctgtata

SEQ ID NO: 6599832 - DNA, 14 bp, Homo sapiens
aatttctgtccaga

SEQ ID NO: 6599833 - DNA, 13 bp, Homo sapiens
aatttctgtcttt

SEQ ID NO: 6599834 - DNA, 14 bp, Homo sapiens
aatttctgtgaaac

SEQ ID NO: 6599835 - DNA, 12 bp, Homo sapiens
aatttctgtgcc

SEQ ID NO: 6599836 - DNA, 19 bp, Homo sapiens
aatttctgtgccctcctga

SEQ ID NO: 6599837 - DNA, 21 bp, Homo sapiens
aatttctgtgttgccaagctc

SEQ ID NO: 6599838 - DNA, 21 bp, Homo sapiens
aatttcttactaaacattttg

SEQ ID NO: 6599839 - DNA, 21 bp, Homo sapiens
aatttcttactagtactattt

SEQ ID NO: 6599840 - DNA, 14 bp, Homo sapiens
aatttcttatgtga

SEQ ID NO: 6599841 - DNA, 16 bp, Homo sapiens
aatttcttatgtgaca

SEQ ID NO: 6599842 - DNA, 20 bp, Homo sapiens
aatttcttatgtgacattaa

SEQ ID NO: 6599843 - DNA, 21 bp, Homo sapiens
aatttcttcactgttgaaaat

SEQ ID NO: 6599844 - DNA, 12 bp, Homo sapiens
aatttcttcctt

SEQ ID NO: 6599845 - DNA, 16 bp, Homo sapiens
aatttcttctttagat

SEQ ID NO: 6599846 - DNA, 19 bp, Homo sapiens
aatttcttgcaatttgaag

SEQ ID NO: 6599847 - DNA, 17 bp, Homo sapiens
aatttcttggtaagaag

SEQ ID NO: 6599848 - DNA, 11 bp, Homo sapiens
aatttcttgtt

SEQ ID NO: 6599849 - DNA, 14 bp, Homo sapiens
aatttctttaaaaa

SEQ ID NO: 6599850 - DNA, 16 bp, Homo sapiens
aatttctttaaaaaag

SEQ ID NO: 6599851 - DNA, 22 bp, Homo sapiens
aatttctttataaaatttactg

SEQ ID NO: 6599852 - DNA, 22 bp, Homo sapiens
aatttctttatgtaatctatgt

SEQ ID NO: 6599853 - DNA, 21 bp, Homo sapiens
aatttctttctaaaacacatt

SEQ ID NO: 6599854 - DNA, 20 bp, Homo sapiens
aatttctttgtttaacaaaa

SEQ ID NO: 6599855 - DNA, 19 bp, Homo sapiens
aatttcttttattaatact

SEQ ID NO: 6599856 - DNA, 20 bp, Homo sapiens
aatttcttttattaatactt

SEQ ID NO: 6599857 - DNA, 20 bp, Homo sapiens
aatttcttttccttcattca

SEQ ID NO: 6599858 - DNA, 15 bp, Homo sapiens
aatttcttttgctga

SEQ ID NO: 6599859 - DNA, 18 bp, Homo sapiens
aatttctttttggtaaat

SEQ ID NO: 6599860 - DNA, 19 bp, Homo sapiens
aatttctttttttaaattg

SEQ ID NO: 6599861 - DNA, 17 bp, Homo sapiens
aatttgaaaaaactttc

SEQ ID NO: 6599862 - DNA, 15 bp, Homo sapiens
aatttgaaacattgc

SEQ ID NO: 6599863 - DNA, 13 bp, Homo sapiens
aatttgaaccaaa

SEQ ID NO: 6599864 - DNA, 17 bp, Homo sapiens
aatttgaaccaaaacat

SEQ ID NO: 6599865 - DNA, 23 bp, Homo sapiens
aatttgaaccaaaacattccgtt

SEQ ID NO: 6599866 - DNA, 18 bp, Homo sapiens
aatttgaagacttcaaaa

SEQ ID NO: 6599867 - DNA, 18 bp, Homo sapiens
aatttgaagctcagaaag

SEQ ID NO: 6599868 - DNA, 23 bp, Homo sapiens
aatttgaagtaacttatttgact

SEQ ID NO: 6599869 - DNA, 23 bp, Homo sapiens
aatttgaagtccctgtttgggaa

SEQ ID NO: 6599870 - DNA, 13 bp, Homo sapiens
aatttgaatcaga

SEQ ID NO: 6599871 - DNA, 21 bp, Homo sapiens
aatttgaatcagagaaaactg

SEQ ID NO: 6599872 - DNA, 16 bp, Homo sapiens
aatttgaatgaaaaat

SEQ ID NO: 6599873 - DNA, 22 bp, Homo sapiens
aatttgaattatcagcaaagaa

SEQ ID NO: 6599874 - DNA, 21 bp, Homo sapiens
aatttgacattgtcagaatgt

SEQ ID NO: 6599875 - DNA, 16 bp, Homo sapiens
aatttgaccagaaaat

SEQ ID NO: 6599876 - DNA, 16 bp, Homo sapiens
aatttgactaatttta

SEQ ID NO: 6599877 - DNA, 22 bp, Homo sapiens
aatttgactgtcctcgcagaga

SEQ ID NO: 6599878 - DNA, 14 bp, Homo sapiens
aatttgacttttgt

SEQ ID NO: 6599879 - DNA, 21 bp, Homo sapiens
aatttgagaatacataaacaa

SEQ ID NO: 6599880 - DNA, 21 bp, Homo sapiens
aatttgagactgaaatttagt

SEQ ID NO: 6599881 - DNA, 16 bp, Homo sapiens
aatttgagcaattcat

SEQ ID NO: 6599882 - DNA, 13 bp, Homo sapiens
aatttgagtgctc

SEQ ID NO: 6599883 - DNA, 20 bp, Homo sapiens
aatttgagtgtatatatatt

SEQ ID NO: 6599884 - DNA, 19 bp, Homo sapiens
aatttgataaaaacccaaa

SEQ ID NO: 6599885 - DNA, 20 bp, Homo sapiens
aatttgataatcagtttcca

SEQ ID NO: 6599886 - DNA, 23 bp, Homo sapiens
aatttgataatcagtttccacta

SEQ ID NO: 6599887 - DNA, 13 bp, Homo sapiens
aatttgatacata

SEQ ID NO: 6599888 - DNA, 21 bp, Homo sapiens
aatttgatacatatgtgaata

SEQ ID NO: 6599889 - DNA, 15 bp, Homo sapiens
aatttgatacttata

SEQ ID NO: 6599890 - DNA, 16 bp, Homo sapiens
aatttgatacttatat

SEQ ID NO: 6599891 - DNA, 18 bp, Homo sapiens
aatttgatagatgtttga

SEQ ID NO: 6599892 - DNA, 20 bp, Homo sapiens
aatttgatagatgtttgact

SEQ ID NO: 6599893 - DNA, 23 bp, Homo sapiens
aatttgatagatgtttgacttta

SEQ ID NO: 6599894 - DNA, 16 bp, Homo sapiens
aatttgatatcacagt

SEQ ID NO: 6599895 - DNA, 18 bp, Homo sapiens
aatttgatatcacagtct

SEQ ID NO: 6599896 - DNA, 17 bp, Homo sapiens
aatttgattaacaaata

SEQ ID NO: 6599897 - DNA, 12 bp, Homo sapiens
aatttgattgat

SEQ ID NO: 6599898 - DNA, 15 bp, Homo sapiens
aatttgattgatttg

SEQ ID NO: 6599899 - DNA, 14 bp, Homo sapiens
aatttgattgcttt

SEQ ID NO: 6599900 - DNA, 16 bp, Homo sapiens
aatttgattgctttgc

SEQ ID NO: 6599901 - DNA, 15 bp, Homo sapiens
aatttgatttctatt

SEQ ID NO: 6599902 - DNA, 19 bp, Homo sapiens
aatttgcaaagtactgtaa

SEQ ID NO: 6599903 - DNA, 15 bp, Homo sapiens
aatttgcacaatatt

SEQ ID NO: 6599904 - DNA, 16 bp, Homo sapiens
aatttgcacacaaaac

SEQ ID NO: 6599905 - DNA, 17 bp, Homo sapiens
aatttgcacagtgatat

SEQ ID NO: 6599906 - DNA, 17 bp, Homo sapiens
aatttgcaccagtttta

SEQ ID NO: 6599907 - DNA, 20 bp, Homo sapiens
aatttgcactaaatcagaga

SEQ ID NO: 6599908 - DNA, 21 bp, Homo sapiens
aatttgcactgttacttttta

SEQ ID NO: 6599909 - DNA, 17 bp, Homo sapiens
aatttgcataaagggcc

SEQ ID NO: 6599910 - DNA, 19 bp, Homo sapiens
aatttgcatattctattgt

SEQ ID NO: 6599911 - DNA, 20 bp, Homo sapiens
aatttgcattaaattacaga

SEQ ID NO: 6599912 - DNA, 17 bp, Homo sapiens
aatttgcattaaattca

SEQ ID NO: 6599913 - DNA, 15 bp, Homo sapiens
aatttgcattactct

SEQ ID NO: 6599914 - DNA, 18 bp, Homo sapiens
aatttgcattactctggt

SEQ ID NO: 6599915 - DNA, 20 bp, Homo sapiens
aatttgcattgtgtcagaaa

SEQ ID NO: 6599916 - DNA, 16 bp, Homo sapiens
aatttgccaaaataat

SEQ ID NO: 6599917 - DNA, 18 bp, Homo sapiens
aatttgccaaaataatgt

SEQ ID NO: 6599918 - DNA, 16 bp, Homo sapiens
aatttgccagacagag

SEQ ID NO: 6599919 - DNA, 18 bp, Homo sapiens
aatttgccagacagagat

SEQ ID NO: 6599920 - DNA, 21 bp, Homo sapiens
aatttgccatagcagtgctag

SEQ ID NO: 6599921 - DNA, 23 bp, Homo sapiens
aatttgccatgacatttcatctg

SEQ ID NO: 6599922 - DNA, 12 bp, Homo sapiens
aatttgccattg

SEQ ID NO: 6599923 - DNA, 13 bp, Homo sapiens
aatttgcctgctg

SEQ ID NO: 6599924 - DNA, 16 bp, Homo sapiens
aatttgcctgtaacaa

SEQ ID NO: 6599925 - DNA, 14 bp, Homo sapiens
aatttgcgcctcgg

SEQ ID NO: 6599926 - DNA, 16 bp, Homo sapiens
aatttgctatataatt

SEQ ID NO: 6599927 - DNA, 18 bp, Homo sapiens
aatttggaaactaataaa

SEQ ID NO: 6599928 - DNA, 14 bp, Homo sapiens
aatttggaaatcct

SEQ ID NO: 6599929 - DNA, 11 bp, Homo sapiens
aatttggaatt

SEQ ID NO: 6599930 - DNA, 22 bp, Homo sapiens
aatttggaggctggagtaatca

SEQ ID NO: 6599931 - DNA, 16 bp, Homo sapiens
aatttggatctattta

SEQ ID NO: 6599932 - DNA, 23 bp, Homo sapiens
aatttggatctcttcttaatgta

SEQ ID NO: 6599933 - DNA, 23 bp, Homo sapiens
aatttggatttaaaagcctgctc

SEQ ID NO: 6599934 - DNA, 20 bp, Homo sapiens
aatttggatttacgactgaa

SEQ ID NO: 6599935 - DNA, 23 bp, Homo sapiens
aatttggatttacgactgaagaa

SEQ ID NO: 6599936 - DNA, 19 bp, Homo sapiens
aatttggcaaaacaaaatg

SEQ ID NO: 6599937 - DNA, 15 bp, Homo sapiens
aatttggcaattttg

SEQ ID NO: 6599938 - DNA, 17 bp, Homo sapiens
aatttggcccagagagg

SEQ ID NO: 6599939 - DNA, 14 bp, Homo sapiens
aatttggccttaag

SEQ ID NO: 6599940 - DNA, 18 bp, Homo sapiens
aatttggccttaagaact

SEQ ID NO: 6599941 - DNA, 14 bp, Homo sapiens
aatttggctgcttc

SEQ ID NO: 6599942 - DNA, 12 bp, Homo sapiens
aatttggcttct

SEQ ID NO: 6599943 - DNA, 19 bp, Homo sapiens
aatttgggaaaataaatac

SEQ ID NO: 6599944 - DNA, 16 bp, Homo sapiens
aatttgggaattgtgt

SEQ ID NO: 6599945 - DNA, 21 bp, Homo sapiens
aatttgggaccctgctttaga

SEQ ID NO: 6599946 - DNA, 22 bp, Homo sapiens
aatttgggacctgcttcattca

SEQ ID NO: 6599947 - DNA, 16 bp, Homo sapiens
aatttgggagatatat

SEQ ID NO: 6599948 - DNA, 12 bp, Homo sapiens
aatttgggcctc

SEQ ID NO: 6599949 - DNA, 20 bp, Homo sapiens
aatttgggcttcctgtttgt

SEQ ID NO: 6599950 - DNA, 20 bp, Homo sapiens
aatttggggacagattcagt

SEQ ID NO: 6599951 - DNA, 19 bp, Homo sapiens
aatttgggttgcaaagcta

SEQ ID NO: 6599952 - DNA, 23 bp, Homo sapiens
aatttgggtttgttggtcacatg

SEQ ID NO: 6599953 - DNA, 14 bp, Homo sapiens
aatttggtacacat

SEQ ID NO: 6599954 - DNA, 22 bp, Homo sapiens
aatttggtagatgacaaatatt

SEQ ID NO: 6599955 - DNA, 16 bp, Homo sapiens
aatttggtctgcctct

SEQ ID NO: 6599956 - DNA, 22 bp, Homo sapiens
aatttggtgccgatgttgaact

SEQ ID NO: 6599957 - DNA, 22 bp, Homo sapiens
aatttggtgctcacgtgtcctt

SEQ ID NO: 6599958 - DNA, 23 bp, Homo sapiens
aatttggtgtggctgtattcaga

SEQ ID NO: 6599959 - DNA, 13 bp, Homo sapiens
aatttggttttca

SEQ ID NO: 6599960 - DNA, 15 bp, Homo sapiens
aatttggttttcaca

SEQ ID NO: 6599961 - DNA, 17 bp, Homo sapiens
aatttgtaaaaaagatt

SEQ ID NO: 6599962 - DNA, 24 bp, Homo sapiens
aatttgtaaaaacagcattgcttt

SEQ ID NO: 6599963 - DNA, 15 bp, Homo sapiens
aatttgtaaaacttc

SEQ ID NO: 6599964 - DNA, 14 bp, Homo sapiens
aatttgtaaacttc

SEQ ID NO: 6599965 - DNA, 17 bp, Homo sapiens
aatttgtaaattgaata

SEQ ID NO: 6599966 - DNA, 15 bp, Homo sapiens
aatttgtaacctcag

SEQ ID NO: 6599967 - DNA, 22 bp, Homo sapiens
aatttgtaagtaacacagtatt

SEQ ID NO: 6599968 - DNA, 14 bp, Homo sapiens
aatttgtaagttta

SEQ ID NO: 6599969 - DNA, 15 bp, Homo sapiens
aatttgtaagtttat

SEQ ID NO: 6599970 - DNA, 18 bp, Homo sapiens
aatttgtaagtttcaggt

SEQ ID NO: 6599971 - DNA, 19 bp, Homo sapiens
aatttgtaagtttcaggtg

SEQ ID NO: 6599972 - DNA, 19 bp, Homo sapiens
aatttgtaatatatcctgt

SEQ ID NO: 6599973 - DNA, 14 bp, Homo sapiens
aatttgtaatgatt

SEQ ID NO: 6599974 - DNA, 15 bp, Homo sapiens
aatttgtaattgctt

SEQ ID NO: 6599975 - DNA, 18 bp, Homo sapiens
aatttgtacaatggttta

SEQ ID NO: 6599976 - DNA, 21 bp, Homo sapiens
aatttgtacaatggtttattc

SEQ ID NO: 6599977 - DNA, 12 bp, Homo sapiens
aatttgtacagg

SEQ ID NO: 6599978 - DNA, 22 bp, Homo sapiens
aatttgtacaggactgtaaaga

SEQ ID NO: 6599979 - DNA, 17 bp, Homo sapiens
aatttgtaccatttcag

SEQ ID NO: 6599980 - DNA, 13 bp, Homo sapiens
ttttcctgtgaca

SEQ ID NO: 6599981 - DNA, 13 bp, Homo sapiens
ttttcctgtgact

SEQ ID NO: 6599982 - DNA, 13 bp, Homo sapiens
ttttcctgttcta

SEQ ID NO: 6599983 - DNA, 22 bp, Homo sapiens
ttttcctgttgttttcttaact

SEQ ID NO: 6599984 - DNA, 18 bp, Homo sapiens
ttttcctgtttctgaaaa

SEQ ID NO: 6599985 - DNA, 12 bp, Homo sapiens
ttttccttaaaa

SEQ ID NO: 6599986 - DNA, 12 bp, Homo sapiens
ttttccttacat

SEQ ID NO: 6599987 - DNA, 14 bp, Homo sapiens
ttttccttacataa

SEQ ID NO: 6599988 - DNA, 15 bp, Homo sapiens
ttttccttacataaa

SEQ ID NO: 6599989 - DNA, 15 bp, Homo sapiens
ttttccttatttcaa

SEQ ID NO: 6599990 - DNA, 13 bp, Homo sapiens
ttttccttcaaga

SEQ ID NO: 6599991 - DNA, 15 bp, Homo sapiens
ttttccttcagtgcc

SEQ ID NO: 6599992 - DNA, 23 bp, Homo sapiens
ttttccttccatgctcccaactc

SEQ ID NO: 6599993 - DNA, 14 bp, Homo sapiens
ttttccttcctgag

SEQ ID NO: 6599994 - DNA, 19 bp, Homo sapiens
ttttccttcctttttattc

SEQ ID NO: 6599995 - DNA, 16 bp, Homo sapiens
ttttccttctggttct

SEQ ID NO: 6599996 - DNA, 12 bp, Homo sapiens
ttttccttctgt

SEQ ID NO: 6599997 - DNA, 15 bp, Homo sapiens
ttttccttcttcagc

SEQ ID NO: 6599998 - DNA, 16 bp, Homo sapiens
ttttccttgactatta

SEQ ID NO: 6599999 - DNA, 14 bp, Homo sapiens
ttttccttgcatac

SEQ ID NO: 6600000 - DNA, 19 bp, Homo sapiens
ttttccttgtatgttcttg

SEQ ID NO: 6600001 - DNA, 16 bp, Homo sapiens
ttttccttgtccccac

SEQ ID NO: 6600002 - DNA, 13 bp, Homo sapiens
ttttcctttataa

SEQ ID NO: 6600003 - DNA, 13 bp, Homo sapiens
ttttcctttctgt

SEQ ID NO: 6600004 - DNA, 20 bp, Homo sapiens
ttttcctttcttctagtatt

SEQ ID NO: 6600005 - DNA, 17 bp, Homo sapiens
ttttcctttgaatcctc

SEQ ID NO: 6600006 - DNA, 16 bp, Homo sapiens
ttttcctttgtcatca

SEQ ID NO: 6600007 - DNA, 14 bp, Homo sapiens
ttttccttttcatc

SEQ ID NO: 6600008 - DNA, 17 bp, Homo sapiens
ttttccttttcatctgt

SEQ ID NO: 6600009 - DNA, 16 bp, Homo sapiens
ttttcctttttcatgt

SEQ ID NO: 6600010 - DNA, 21 bp, Homo sapiens
ttttcgaactgtgctcccacg

SEQ ID NO: 6600011 - DNA, 19 bp, Homo sapiens
ttttcgaagctcagcccac

SEQ ID NO: 6600012 - DNA, 22 bp, Homo sapiens
ttttcggaaacactgacttagg

SEQ ID NO: 6600013 - DNA, 15 bp, Homo sapiens
ttttcggaacacatt

SEQ ID NO: 6600014 - DNA, 14 bp, Homo sapiens
ttttcggctaaaaa

SEQ ID NO: 6600015 - DNA, 17 bp, Homo sapiens
ttttcgtcatcttccct

SEQ ID NO: 6600016 - DNA, 14 bp, Homo sapiens
ttttcgtcttccct

SEQ ID NO: 6600017 - DNA, 15 bp, Homo sapiens
ttttctaaaacaagt

SEQ ID NO: 6600018 - DNA, 16 bp, Homo sapiens
ttttctaaaagccata

SEQ ID NO: 6600019 - DNA, 17 bp, Homo sapiens
ttttctaaactcaataa

SEQ ID NO: 6600020 - DNA, 14 bp, Homo sapiens
ttttctaaagactt

SEQ ID NO: 6600021 - DNA, 17 bp, Homo sapiens
ttttctaaataaaaata

SEQ ID NO: 6600022 - DNA, 14 bp, Homo sapiens
ttttctaaatcctt

SEQ ID NO: 6600023 - DNA, 13 bp, Homo sapiens
ttttctaaatgtt

SEQ ID NO: 6600024 - DNA, 14 bp, Homo sapiens
ttttctaaattctt

SEQ ID NO: 6600025 - DNA, 15 bp, Homo sapiens
ttttctaaatttatc

SEQ ID NO: 6600026 - DNA, 12 bp, Homo sapiens
ttttctaactgt

SEQ ID NO: 6600027 - DNA, 15 bp, Homo sapiens
ttttctaactgtaaa

SEQ ID NO: 6600028 - DNA, 18 bp, Homo sapiens
ttttctaactgtaaatca

SEQ ID NO: 6600029 - DNA, 22 bp, Homo sapiens
ttttctaactgtaaatcacttg

SEQ ID NO: 6600030 - DNA, 13 bp, Homo sapiens
ttttctaactttt

SEQ ID NO: 6600031 - DNA, 18 bp, Homo sapiens
ttttctaagaaacattta

SEQ ID NO: 6600032 - DNA, 15 bp, Homo sapiens
ttttctaagtgtaac

SEQ ID NO: 6600033 - DNA, 22 bp, Homo sapiens
ttttctaagtgtaacctcagta

SEQ ID NO: 6600034 - DNA, 21 bp, Homo sapiens
ttttctaatgaggagagaaaa

SEQ ID NO: 6600035 - DNA, 15 bp, Homo sapiens
ttttctaatgtggtt

SEQ ID NO: 6600036 - DNA, 21 bp, Homo sapiens
ttttctaatgtggttatttct

SEQ ID NO: 6600037 - DNA, 20 bp, Homo sapiens
ttttctacacagtaaaaact

SEQ ID NO: 6600038 - DNA, 14 bp, Homo sapiens
ttttctacagtggt

SEQ ID NO: 6600039 - DNA, 13 bp, Homo sapiens
ttttctacagtta

SEQ ID NO: 6600040 - DNA, 17 bp, Homo sapiens
ttttctacataattgtg

SEQ ID NO: 6600041 - DNA, 23 bp, Homo sapiens
ttttctacatcttttatacattt

SEQ ID NO: 6600042 - DNA, 16 bp, Homo sapiens
ttttctacattattgc

SEQ ID NO: 6600043 - DNA, 16 bp, Homo sapiens
ttttctaccatttctg

SEQ ID NO: 6600044 - DNA, 17 bp, Homo sapiens
ttttctaccctagccat

SEQ ID NO: 6600045 - DNA, 23 bp, Homo sapiens
ttttctacctttttttctctcct

SEQ ID NO: 6600046 - DNA, 12 bp, Homo sapiens
ttttctacttta

SEQ ID NO: 6600047 - DNA, 12 bp, Homo sapiens
ttttctagaaga

SEQ ID NO: 6600048 - DNA, 20 bp, Homo sapiens
ttttctagaattatttttca

SEQ ID NO: 6600049 - DNA, 14 bp, Homo sapiens
ttttctagactttc

SEQ ID NO: 6600050 - DNA, 18 bp, Homo sapiens
ttttctagactttctgtt

SEQ ID NO: 6600051 - DNA, 15 bp, Homo sapiens
ttttctagatacaat

SEQ ID NO: 6600052 - DNA, 18 bp, Homo sapiens
ttttctagatacaataaa

SEQ ID NO: 6600053 - DNA, 24 bp, Homo sapiens
ttttctagcaactgttggataata

SEQ ID NO: 6600054 - DNA, 22 bp, Homo sapiens
ttttctagcaattttctttgtt

SEQ ID NO: 6600055 - DNA, 22 bp, Homo sapiens
ttttctagcattttcagaaact

SEQ ID NO: 6600056 - DNA, 16 bp, Homo sapiens
ttttctagtcagtaaa

SEQ ID NO: 6600057 - DNA, 15 bp, Homo sapiens
ttttctataatcact

SEQ ID NO: 6600058 - DNA, 15 bp, Homo sapiens
ttttctatatagttc

SEQ ID NO: 6600059 - DNA, 18 bp, Homo sapiens
ttttctatatagttcctt

SEQ ID NO: 6600060 - DNA, 18 bp, Homo sapiens
ttttctatattgcagtgt

SEQ ID NO: 6600061 - DNA, 16 bp, Homo sapiens
ttttctatatttgtaa

SEQ ID NO: 6600062 - DNA, 16 bp, Homo sapiens
ttttctatgaaagcta

SEQ ID NO: 6600063 - DNA, 21 bp, Homo sapiens
ttttctatgaaataatgtgaa

SEQ ID NO: 6600064 - DNA, 13 bp, Homo sapiens
ttttctatgaatc

SEQ ID NO: 6600065 - DNA, 13 bp, Homo sapiens
ttttctatgaatt

SEQ ID NO: 6600066 - DNA, 13 bp, Homo sapiens
ttttctatgttgc

SEQ ID NO: 6600067 - DNA, 15 bp, Homo sapiens
ttttctattaaaaga

SEQ ID NO: 6600068 - DNA, 19 bp, Homo sapiens
ttttctattatggaaaact

SEQ ID NO: 6600069 - DNA, 17 bp, Homo sapiens
ttttctatttatgcctt

SEQ ID NO: 6600070 - DNA, 17 bp, Homo sapiens
ttttctatttctctgtg

SEQ ID NO: 6600071 - DNA, 11 bp, Homo sapiens
ttttctatttt

SEQ ID NO: 6600072 - DNA, 13 bp, Homo sapiens
ttttctattttgt

SEQ ID NO: 6600073 - DNA, 20 bp, Homo sapiens
ttttctatttttcttctaaa

SEQ ID NO: 6600074 - DNA, 13 bp, Homo sapiens
ttttctcaaaaag

SEQ ID NO: 6600075 - DNA, 19 bp, Homo sapiens
ttttctcaaagttttgaaa

SEQ ID NO: 6600076 - DNA, 17 bp, Homo sapiens
ttttctcactccttttg

SEQ ID NO: 6600077 - DNA, 18 bp, Homo sapiens
ttttctcagaacagctga

SEQ ID NO: 6600078 - DNA, 12 bp, Homo sapiens
ttttctcagctg

SEQ ID NO: 6600079 - DNA, 15 bp, Homo sapiens
ttttctcagtcctaa

SEQ ID NO: 6600080 - DNA, 13 bp, Homo sapiens
ttttctcatttga

SEQ ID NO: 6600081 - DNA, 12 bp, Homo sapiens
ttttctccagct

SEQ ID NO: 6600082 - DNA, 22 bp, Homo sapiens
ttttctcccaagctgattttat

SEQ ID NO: 6600083 - DNA, 12 bp, Homo sapiens
ttttctcccaga

SEQ ID NO: 6600084 - DNA, 20 bp, Homo sapiens
ttttctcccatttcttgcta

SEQ ID NO: 6600085 - DNA, 13 bp, Homo sapiens
ttttctccccgct

SEQ ID NO: 6600086 - DNA, 21 bp, Homo sapiens
ttttctccctttatgtatctc

SEQ ID NO: 6600087 - DNA, 21 bp, Homo sapiens
ttttctcctcactgtatccag

SEQ ID NO: 6600088 - DNA, 11 bp, Homo sapiens
ttttctcctga

SEQ ID NO: 6600089 - DNA, 16 bp, Homo sapiens
ttttctcctgcaaatt

SEQ ID NO: 6600090 - DNA, 19 bp, Homo sapiens
ttttctcctgcatgtgtat

SEQ ID NO: 6600091 - DNA, 17 bp, Homo sapiens
ttttctctaactcagaa

SEQ ID NO: 6600092 - DNA, 20 bp, Homo sapiens
ttttctctaatgcttgattt

SEQ ID NO: 6600093 - DNA, 16 bp, Homo sapiens
ttttctctactccatg

SEQ ID NO: 6600094 - DNA, 14 bp, Homo sapiens
ttttctctaggaaa

SEQ ID NO: 6600095 - DNA, 21 bp, Homo sapiens
ttttctctatgaaaagcaact

SEQ ID NO: 6600096 - DNA, 14 bp, Homo sapiens
ttttctctcccata

SEQ ID NO: 6600097 - DNA, 21 bp, Homo sapiens
ttttctctcgttaattttcct

SEQ ID NO: 6600098 - DNA, 12 bp, Homo sapiens
ttttctctctta

SEQ ID NO: 6600099 - DNA, 13 bp, Homo sapiens
ttttctctgatca

SEQ ID NO: 6600100 - DNA, 17 bp, Homo sapiens
ttttctctgcttccagt

SEQ ID NO: 6600101 - DNA, 14 bp, Homo sapiens
ttttctctggtaat

SEQ ID NO: 6600102 - DNA, 21 bp, Homo sapiens
ttttctctggtaatattgact

SEQ ID NO: 6600103 - DNA, 18 bp, Homo sapiens
ttttctctgtacttttca

SEQ ID NO: 6600104 - DNA, 21 bp, Homo sapiens
ttttctctgtagttacattta

SEQ ID NO: 6600105 - DNA, 13 bp, Homo sapiens
ttttctcttcata

SEQ ID NO: 6600106 - DNA, 22 bp, Homo sapiens
ttttctcttgggctgagactgg

SEQ ID NO: 6600107 - DNA, 17 bp, Homo sapiens
ttttctctttaaaagaa

SEQ ID NO: 6600108 - DNA, 21 bp, Homo sapiens
ttttctctttaattttaactg

SEQ ID NO: 6600109 - DNA, 14 bp, Homo sapiens
ttttctctttctcc

SEQ ID NO: 6600110 - DNA, 22 bp, Homo sapiens
ttttctctttctccttagtctt

SEQ ID NO: 6600111 - DNA, 22 bp, Homo sapiens
ttttctcttttaaaatatcctg

SEQ ID NO: 6600112 - DNA, 19 bp, Homo sapiens
ttttctcttttcacagcaa

SEQ ID NO: 6600113 - DNA, 12 bp, Homo sapiens
ttttctgaaaca

SEQ ID NO: 6600114 - DNA, 21 bp, Homo sapiens
ttttctgaagcctctaacaaa

SEQ ID NO: 6600115 - DNA, 19 bp, Homo sapiens
ttttctgaataaaaaagat

SEQ ID NO: 6600116 - DNA, 21 bp, Homo sapiens
ttttctgaataaaaaagattc

SEQ ID NO: 6600117 - DNA, 14 bp, Homo sapiens
ttttctgaattatg

SEQ ID NO: 6600118 - DNA, 14 bp, Homo sapiens
ttttctgactagtt

SEQ ID NO: 6600119 - DNA, 14 bp, Homo sapiens
ttttctgactttta

SEQ ID NO: 6600120 - DNA, 18 bp, Homo sapiens
ttttctgagaaagactat

SEQ ID NO: 6600121 - DNA, 22 bp, Homo sapiens
ttttctgagatgctcactttat

SEQ ID NO: 6600122 - DNA, 20 bp, Homo sapiens
ttttctgagatttttgatat

SEQ ID NO: 6600123 - DNA, 16 bp, Homo sapiens
ttttctgagcccgggc

SEQ ID NO: 6600124 - DNA, 19 bp, Homo sapiens
ttttctgatccagttttgt

SEQ ID NO: 6600125 - DNA, 11 bp, Homo sapiens
ttttctgatgg

SEQ ID NO: 6600126 - DNA, 11 bp, Homo sapiens
ttttctgattc

SEQ ID NO: 6600127 - DNA, 16 bp, Homo sapiens
ttttctgatttgtcct

SEQ ID NO: 6600128 - DNA, 16 bp, Homo sapiens
ttttctgcacagcttt

SEQ ID NO: 6600129 - DNA, 21 bp, Homo sapiens
ttttctgcacagcttttccaa

SEQ ID NO: 6600130 - DNA, 23 bp, Homo sapiens
ttttctgcacagcttttccaaaa

SEQ ID NO: 6600131 - DNA, 13 bp, Homo sapiens
ttttctgcagctg

SEQ ID NO: 6600132 - DNA, 20 bp, Homo sapiens
ttttctgccaggctcaacaa

SEQ ID NO: 6600133 - DNA, 22 bp, Homo sapiens
ttttctgcccaactttcattgg

SEQ ID NO: 6600134 - DNA, 11 bp, Homo sapiens
ttttctgccct

SEQ ID NO: 6600135 - DNA, 11 bp, Homo sapiens
ttttctgctgt

SEQ ID NO: 6600136 - DNA, 22 bp, Homo sapiens
ttttctgctttagacttgaaaa

SEQ ID NO: 6600137 - DNA, 11 bp, Homo sapiens
ttttctggaaa

SEQ ID NO: 6600138 - DNA, 17 bp, Homo sapiens
ttttctggaatacatga

SEQ ID NO: 6600139 - DNA, 21 bp, Homo sapiens
ttttctggaatacatgaaata

SEQ ID NO: 6600140 - DNA, 17 bp, Homo sapiens
ttttctggctcctgtgt

SEQ ID NO: 6600141 - DNA, 21 bp, Homo sapiens
ttttctggctgtgatcttaaa

SEQ ID NO: 6600142 - DNA, 23 bp, Homo sapiens
ttttctgggcttttccttttgca

SEQ ID NO: 6600143 - DNA, 22 bp, Homo sapiens
ttttctggggaattactttcct

SEQ ID NO: 6600144 - DNA, 22 bp, Homo sapiens
ttttctgggttttgttggcttt

SEQ ID NO: 6600145 - DNA, 15 bp, Homo sapiens
ttttctggttccaaa

SEQ ID NO: 6600146 - DNA, 14 bp, Homo sapiens
ttttctggttctaa

SEQ ID NO: 6600147 - DNA, 16 bp, Homo sapiens
ttttctggtttggcat

SEQ ID NO: 6600148 - DNA, 17 bp, Homo sapiens
ttttctgtaaattcata

SEQ ID NO: 6600149 - DNA, 14 bp, Homo sapiens
ttttctgtaattca

SEQ ID NO: 6600150 - DNA, 19 bp, Homo sapiens
ttttctgtaattcttctcc

SEQ ID NO: 6600151 - DNA, 13 bp, Homo sapiens
ttttctgtacaca

SEQ ID NO: 6600152 - DNA, 14 bp, Homo sapiens
ttttctgtaccagt

SEQ ID NO: 6600153 - DNA, 14 bp, Homo sapiens
ttttctgtagtcat

SEQ ID NO: 6600154 - DNA, 18 bp, Homo sapiens
ttttctgtagtcatttac

SEQ ID NO: 6600155 - DNA, 22 bp, Homo sapiens
ttttctgtatatgatatatatt

SEQ ID NO: 6600156 - DNA, 20 bp, Homo sapiens
ttttctgtcagatgagaaca

SEQ ID NO: 6600157 - DNA, 22 bp, Homo sapiens
ttttctgtcattgttaaataca

SEQ ID NO: 6600158 - DNA, 12 bp, Homo sapiens
ttttctgtcttg

SEQ ID NO: 6600159 - DNA, 14 bp, Homo sapiens
ttttctgtgacatt

SEQ ID NO: 6600160 - DNA, 10 bp, Homo sapiens
ttttctgtgt

SEQ ID NO: 6600161 - DNA, 19 bp, Homo sapiens
ttttctgtgtaaaatgagt

SEQ ID NO: 6600162 - DNA, 13 bp, Homo sapiens
aatttgtacttct

SEQ ID NO: 6600163 - DNA, 13 bp, Homo sapiens
aatttgtagaatt

SEQ ID NO: 6600164 - DNA, 17 bp, Homo sapiens
aatttgtagggtttcta

SEQ ID NO: 6600165 - DNA, 14 bp, Homo sapiens
aatttgtataaaat

SEQ ID NO: 6600166 - DNA, 16 bp, Homo sapiens
aatttgtataacccat

SEQ ID NO: 6600167 - DNA, 21 bp, Homo sapiens
aatttgtataacccatatctg

SEQ ID NO: 6600168 - DNA, 15 bp, Homo sapiens
aatttgtatctgaag

SEQ ID NO: 6600169 - DNA, 17 bp, Homo sapiens
aatttgtatctgaagga

SEQ ID NO: 6600170 - DNA, 12 bp, Homo sapiens
aatttgtatgtt

SEQ ID NO: 6600171 - DNA, 15 bp, Homo sapiens
aatttgtatgtttcc

SEQ ID NO: 6600172 - DNA, 17 bp, Homo sapiens
aatttgtatgtttccat

SEQ ID NO: 6600173 - DNA, 21 bp, Homo sapiens
aatttgtattactttctctgt

SEQ ID NO: 6600174 - DNA, 18 bp, Homo sapiens
aatttgtcattttgaagc

SEQ ID NO: 6600175 - DNA, 16 bp, Homo sapiens
aatttgtccattgtaa

SEQ ID NO: 6600176 - DNA, 20 bp, Homo sapiens
aatttgtctgaaacatttca

SEQ ID NO: 6600177 - DNA, 22 bp, Homo sapiens
aatttgtctgaaacatttcata

SEQ ID NO: 6600178 - DNA, 16 bp, Homo sapiens
aatttgtctttcaagt

SEQ ID NO: 6600179 - DNA, 15 bp, Homo sapiens
aatttgtgaactgtc

SEQ ID NO: 6600180 - DNA, 17 bp, Homo sapiens
aatttgtgatacaatgc

SEQ ID NO: 6600181 - DNA, 15 bp, Homo sapiens
aatttgtgctgggtt

SEQ ID NO: 6600182 - DNA, 19 bp, Homo sapiens
aatttgtgtaaattattga

SEQ ID NO: 6600183 - DNA, 13 bp, Homo sapiens
aatttgtgtaata

SEQ ID NO: 6600184 - DNA, 22 bp, Homo sapiens
aatttgtgtaataaagtgtttt

SEQ ID NO: 6600185 - DNA, 16 bp, Homo sapiens
aatttgtgtgcttctg

SEQ ID NO: 6600186 - DNA, 17 bp, Homo sapiens
aatttgtgtgtttttag

SEQ ID NO: 6600187 - DNA, 21 bp, Homo sapiens
aatttgtgttcccattttaaa

SEQ ID NO: 6600188 - DNA, 18 bp, Homo sapiens
aatttgttaattaaatat

SEQ ID NO: 6600189 - DNA, 18 bp, Homo sapiens
aatttgttattttgcaac

SEQ ID NO: 6600190 - DNA, 12 bp, Homo sapiens
aatttgttctgt

SEQ ID NO: 6600191 - DNA, 19 bp, Homo sapiens
aatttgttcttgtatttta

SEQ ID NO: 6600192 - DNA, 15 bp, Homo sapiens
aatttgttgtacttt

SEQ ID NO: 6600193 - DNA, 19 bp, Homo sapiens
aatttgttgtcatgtgtat

SEQ ID NO: 6600194 - DNA, 15 bp, Homo sapiens
aatttgttgttaata

SEQ ID NO: 6600195 - DNA, 14 bp, Homo sapiens
aatttgtttaaaga

SEQ ID NO: 6600196 - DNA, 15 bp, Homo sapiens
aatttgtttaaagaa

SEQ ID NO: 6600197 - DNA, 18 bp, Homo sapiens
aatttgtttaaagaataa

SEQ ID NO: 6600198 - DNA, 15 bp, Homo sapiens
aatttgtttaaatta

SEQ ID NO: 6600199 - DNA, 16 bp, Homo sapiens
aatttgtttaaggtta

SEQ ID NO: 6600200 - DNA, 22 bp, Homo sapiens
aatttgtttcatctattttatt

SEQ ID NO: 6600201 - DNA, 16 bp, Homo sapiens
aatttgtttcttctgt

SEQ ID NO: 6600202 - DNA, 13 bp, Homo sapiens
aatttgtttgtgc

SEQ ID NO: 6600203 - DNA, 14 bp, Homo sapiens
aatttgtttgtgct

SEQ ID NO: 6600204 - DNA, 17 bp, Homo sapiens
aatttgtttgtgcttct

SEQ ID NO: 6600205 - DNA, 18 bp, Homo sapiens
aatttgtttgtgcttcta

SEQ ID NO: 6600206 - DNA, 14 bp, Homo sapiens
aatttgtttttgca

SEQ ID NO: 6600207 - DNA, 15 bp, Homo sapiens
aattttaaaaatcta

SEQ ID NO: 6600208 - DNA, 22 bp, Homo sapiens
aattttaaaaatctacgtcttt

SEQ ID NO: 6600209 - DNA, 15 bp, Homo sapiens
aattttaaaacattt

SEQ ID NO: 6600210 - DNA, 15 bp, Homo sapiens
aattttaaaagcata

SEQ ID NO: 6600211 - DNA, 23 bp, Homo sapiens
aattttaaaagcatatataaaac

SEQ ID NO: 6600212 - DNA, 19 bp, Homo sapiens
aattttaaaagtctatttt

SEQ ID NO: 6600213 - DNA, 23 bp, Homo sapiens
aattttaaaatgaaatgcatttt

SEQ ID NO: 6600214 - DNA, 16 bp, Homo sapiens
aattttaaaatgttta

SEQ ID NO: 6600215 - DNA, 14 bp, Homo sapiens
aattttaaacaaag

SEQ ID NO: 6600216 - DNA, 13 bp, Homo sapiens
aattttaaacata

SEQ ID NO: 6600217 - DNA, 13 bp, Homo sapiens
aattttaaagcct

SEQ ID NO: 6600218 - DNA, 11 bp, Homo sapiens
aattttaaagt

SEQ ID NO: 6600219 - DNA, 12 bp, Homo sapiens
aattttaaagtc

SEQ ID NO: 6600220 - DNA, 13 bp, Homo sapiens
aattttaaagtca

SEQ ID NO: 6600221 - DNA, 14 bp, Homo sapiens
aattttaaagttct

SEQ ID NO: 6600222 - DNA, 14 bp, Homo sapiens
aattttaaataaga

SEQ ID NO: 6600223 - DNA, 12 bp, Homo sapiens
aattttaaattg

SEQ ID NO: 6600224 - DNA, 13 bp, Homo sapiens
aattttaacacta

SEQ ID NO: 6600225 - DNA, 19 bp, Homo sapiens
aattttaacctatgatatt

SEQ ID NO: 6600226 - DNA, 14 bp, Homo sapiens
aattttaactgatt

SEQ ID NO: 6600227 - DNA, 17 bp, Homo sapiens
aattttaacttaaattt

SEQ ID NO: 6600228 - DNA, 11 bp, Homo sapiens
aattttaagaa

SEQ ID NO: 6600229 - DNA, 18 bp, Homo sapiens
aattttaagctaggaaaa

SEQ ID NO: 6600230 - DNA, 22 bp, Homo sapiens
aattttaagtgctttgtaatgg

SEQ ID NO: 6600231 - DNA, 22 bp, Homo sapiens
aattttaatattccagaagaac

SEQ ID NO: 6600232 - DNA, 19 bp, Homo sapiens
aattttaatattcttttgt

SEQ ID NO: 6600233 - DNA, 16 bp, Homo sapiens
aattttaatgataaaa

SEQ ID NO: 6600234 - DNA, 13 bp, Homo sapiens
aattttaatgcta

SEQ ID NO: 6600235 - DNA, 16 bp, Homo sapiens
aattttaatgctgttt

SEQ ID NO: 6600236 - DNA, 22 bp, Homo sapiens
aattttaatgctgtttctaaga

SEQ ID NO: 6600237 - DNA, 13 bp, Homo sapiens
aattttaatgtaa

SEQ ID NO: 6600238 - DNA, 15 bp, Homo sapiens
aattttaattaaaaa

SEQ ID NO: 6600239 - DNA, 14 bp, Homo sapiens
aattttaatttagt

SEQ ID NO: 6600240 - DNA, 13 bp, Homo sapiens
aattttaatttct

SEQ ID NO: 6600241 - DNA, 13 bp, Homo sapiens
aattttacaaaaa

SEQ ID NO: 6600242 - DNA, 20 bp, Homo sapiens
aattttacatgtttataaat

SEQ ID NO: 6600243 - DNA, 17 bp, Homo sapiens
aattttaccctttagac

SEQ ID NO: 6600244 - DNA, 15 bp, Homo sapiens
aattttaccttgttt

SEQ ID NO: 6600245 - DNA, 14 bp, Homo sapiens
aattttactgtgaa

SEQ ID NO: 6600246 - DNA, 18 bp, Homo sapiens
aattttactgtgaaaaaa

SEQ ID NO: 6600247 - DNA, 11 bp, Homo sapiens
aattttacttc

SEQ ID NO: 6600248 - DNA, 18 bp, Homo sapiens
aattttacttgcacctta

SEQ ID NO: 6600249 - DNA, 13 bp, Homo sapiens
aattttacttttt

SEQ ID NO: 6600250 - DNA, 16 bp, Homo sapiens
aattttagaaagaaaa

SEQ ID NO: 6600251 - DNA, 15 bp, Homo sapiens
aattttagaaatatt

SEQ ID NO: 6600252 - DNA, 17 bp, Homo sapiens
aattttagaaatattca

SEQ ID NO: 6600253 - DNA, 19 bp, Homo sapiens
aattttagacgatcacaga

SEQ ID NO: 6600254 - DNA, 13 bp, Homo sapiens
aattttagatgta

SEQ ID NO: 6600255 - DNA, 17 bp, Homo sapiens
aattttaggaaagttgt

SEQ ID NO: 6600256 - DNA, 15 bp, Homo sapiens
aattttagtacattt

SEQ ID NO: 6600257 - DNA, 13 bp, Homo sapiens
aattttagtattc

SEQ ID NO: 6600258 - DNA, 18 bp, Homo sapiens
aattttagtcactaagac

SEQ ID NO: 6600259 - DNA, 20 bp, Homo sapiens
aattttagtcactaagactt

SEQ ID NO: 6600260 - DNA, 16 bp, Homo sapiens
aattttagtcttgctg

SEQ ID NO: 6600261 - DNA, 12 bp, Homo sapiens
aattttagtgta

SEQ ID NO: 6600262 - DNA, 22 bp, Homo sapiens
aattttagtttatattaatttc

SEQ ID NO: 6600263 - DNA, 14 bp, Homo sapiens
aattttagtttttc

SEQ ID NO: 6600264 - DNA, 15 bp, Homo sapiens
aattttagtttttca

SEQ ID NO: 6600265 - DNA, 16 bp, Homo sapiens
aattttatagtagtgg

SEQ ID NO: 6600266 - DNA, 15 bp, Homo sapiens
aattttatatcttgt

SEQ ID NO: 6600267 - DNA, 20 bp, Homo sapiens
aattttatatgtaaatgtgt

SEQ ID NO: 6600268 - DNA, 20 bp, Homo sapiens
aattttatccctcacctgta

SEQ ID NO: 6600269 - DNA, 23 bp, Homo sapiens
aattttatctacccagtcatgta

SEQ ID NO: 6600270 - DNA, 13 bp, Homo sapiens
aattttatctgcc

SEQ ID NO: 6600271 - DNA, 14 bp, Homo sapiens
aattttatctgtat

SEQ ID NO: 6600272 - DNA, 12 bp, Homo sapiens
aattttatgaat

SEQ ID NO: 6600273 - DNA, 19 bp, Homo sapiens
aattttatgagggccacgg

SEQ ID NO: 6600274 - DNA, 21 bp, Homo sapiens
aattttatgtgactatgaaac

SEQ ID NO: 6600275 - DNA, 16 bp, Homo sapiens
aattttatgtgttata

SEQ ID NO: 6600276 - DNA, 19 bp, Homo sapiens
aattttatgtgttatagta

SEQ ID NO: 6600277 - DNA, 15 bp, Homo sapiens
aattttattaaatgc

SEQ ID NO: 6600278 - DNA, 12 bp, Homo sapiens
aattttatttat

SEQ ID NO: 6600279 - DNA, 15 bp, Homo sapiens
aattttattttgctg

SEQ ID NO: 6600280 - DNA, 16 bp, Homo sapiens
aattttattttgctga

SEQ ID NO: 6600281 - DNA, 13 bp, Homo sapiens
aattttattttgt

SEQ ID NO: 6600282 - DNA, 17 bp, Homo sapiens
aattttcaaaagaaaac

SEQ ID NO: 6600283 - DNA, 17 bp, Homo sapiens
aattttcaaataaggaa

SEQ ID NO: 6600284 - DNA, 13 bp, Homo sapiens
aattttcaaatcc

SEQ ID NO: 6600285 - DNA, 22 bp, Homo sapiens
aattttcaactgtcttcctcaa

SEQ ID NO: 6600286 - DNA, 15 bp, Homo sapiens
aattttcaagtttac

SEQ ID NO: 6600287 - DNA, 21 bp, Homo sapiens
aattttcaagtttacacttca

SEQ ID NO: 6600288 - DNA, 13 bp, Homo sapiens
aattttcacaaaa

SEQ ID NO: 6600289 - DNA, 19 bp, Homo sapiens
aattttcacacacgtgaga

SEQ ID NO: 6600290 - DNA, 20 bp, Homo sapiens
aattttcacttgcttaaaaa

SEQ ID NO: 6600291 - DNA, 23 bp, Homo sapiens
aattttcagaattaatgcattca

SEQ ID NO: 6600292 - DNA, 17 bp, Homo sapiens
aattttcagaccccagc

SEQ ID NO: 6600293 - DNA, 13 bp, Homo sapiens
aattttcagattt

SEQ ID NO: 6600294 - DNA, 19 bp, Homo sapiens
aattttcaggtttcttaaa

SEQ ID NO: 6600295 - DNA, 20 bp, Homo sapiens
aattttcagtataatttaac

SEQ ID NO: 6600296 - DNA, 18 bp, Homo sapiens
aattttcattaaacttga

SEQ ID NO: 6600297 - DNA, 21 bp, Homo sapiens
aattttcattaaacttgaagc

SEQ ID NO: 6600298 - DNA, 12 bp, Homo sapiens
aattttcatttt

SEQ ID NO: 6600299 - DNA, 19 bp, Homo sapiens
aattttccataagctattt

SEQ ID NO: 6600300 - DNA, 19 bp, Homo sapiens
aattttccattaatttcaa

SEQ ID NO: 6600301 - DNA, 16 bp, Homo sapiens
aattttccattacatg

SEQ ID NO: 6600302 - DNA, 19 bp, Homo sapiens
aattttcctcaatcacact

SEQ ID NO: 6600303 - DNA, 13 bp, Homo sapiens
aattttcctccta

SEQ ID NO: 6600304 - DNA, 12 bp, Homo sapiens
aattttccttta

SEQ ID NO: 6600305 - DNA, 23 bp, Homo sapiens
aattttcctttaatatgaaattt

SEQ ID NO: 6600306 - DNA, 20 bp, Homo sapiens
aattttcctttatgattctt

SEQ ID NO: 6600307 - DNA, 18 bp, Homo sapiens
aattttcctttttcatgt

SEQ ID NO: 6600308 - DNA, 12 bp, Homo sapiens
aattttctaaaa

SEQ ID NO: 6600309 - DNA, 16 bp, Homo sapiens
aattttctaagacagt

SEQ ID NO: 6600310 - DNA, 20 bp, Homo sapiens
aattttctacaaataatttt

SEQ ID NO: 6600311 - DNA, 23 bp, Homo sapiens
aattttctaccactggtgtaaaa

SEQ ID NO: 6600312 - DNA, 15 bp, Homo sapiens
aattttctagacttt

SEQ ID NO: 6600313 - DNA, 15 bp, Homo sapiens
aattttctatgtgtt

SEQ ID NO: 6600314 - DNA, 17 bp, Homo sapiens
aattttctcattttctt

SEQ ID NO: 6600315 - DNA, 13 bp, Homo sapiens
aattttctccagt

SEQ ID NO: 6600316 - DNA, 18 bp, Homo sapiens
aattttctccagtccctg

SEQ ID NO: 6600317 - DNA, 18 bp, Homo sapiens
aattttctcccaggaagc

SEQ ID NO: 6600318 - DNA, 19 bp, Homo sapiens
aattttctccctttatgta

SEQ ID NO: 6600319 - DNA, 23 bp, Homo sapiens
aattttctccctttatgtatctc

SEQ ID NO: 6600320 - DNA, 16 bp, Homo sapiens
aattttctgcagctgt

SEQ ID NO: 6600321 - DNA, 11 bp, Homo sapiens
aattttctgta

SEQ ID NO: 6600322 - DNA, 19 bp, Homo sapiens
aattttctgtggatcattt

SEQ ID NO: 6600323 - DNA, 17 bp, Homo sapiens
aattttcttcagttggt

SEQ ID NO: 6600324 - DNA, 19 bp, Homo sapiens
aattttcttcatgcaatga

SEQ ID NO: 6600325 - DNA, 15 bp, Homo sapiens
aattttcttctcatt

SEQ ID NO: 6600326 - DNA, 16 bp, Homo sapiens
aattttcttctcattc

SEQ ID NO: 6600327 - DNA, 19 bp, Homo sapiens
aattttcttctcattcttc

SEQ ID NO: 6600328 - DNA, 12 bp, Homo sapiens
aattttcttgat

SEQ ID NO: 6600329 - DNA, 13 bp, Homo sapiens
aattttcttgatg

SEQ ID NO: 6600330 - DNA, 19 bp, Homo sapiens
aattttcttgatgactgga

SEQ ID NO: 6600331 - DNA, 16 bp, Homo sapiens
aattttcttgtttgtt

SEQ ID NO: 6600332 - DNA, 23 bp, Homo sapiens
aattttctttaaccagtctgaag

SEQ ID NO: 6600333 - DNA, 13 bp, Homo sapiens
aattttctttatg

SEQ ID NO: 6600334 - DNA, 14 bp, Homo sapiens
aattttctttgttt

SEQ ID NO: 6600335 - DNA, 17 bp, Homo sapiens
aattttctttgtttctt

SEQ ID NO: 6600336 - DNA, 16 bp, Homo sapiens
aattttcttttaagca

SEQ ID NO: 6600337 - DNA, 21 bp, Homo sapiens
aattttctttttaataaaaag

SEQ ID NO: 6600338 - DNA, 18 bp, Homo sapiens
aattttctttttctgaag

SEQ ID NO: 6600339 - DNA, 23 bp, Homo sapiens
aattttctttttctgaagcctct

SEQ ID NO: 6600340 - DNA, 22 bp, Homo sapiens
aattttctttttgtttcactgg

SEQ ID NO: 6600341 - DNA, 13 bp, Homo sapiens
aattttgaaaaac

SEQ ID NO: 6600342 - DNA, 13 bp, Homo sapiens
aattttgaaaagt

SEQ ID NO: 6600343 - DNA, 21 bp, Homo sapiens
aattttgaaaagtaatattta

SEQ ID NO: 6600344 - DNA, 12 bp, Homo sapiens
ttttctgtgtgt

SEQ ID NO: 6600345 - DNA, 19 bp, Homo sapiens
ttttctgtgtgttcctggc

SEQ ID NO: 6600346 - DNA, 14 bp, Homo sapiens
ttttctgtgttact

SEQ ID NO: 6600347 - DNA, 13 bp, Homo sapiens
ttttctgtgttta

SEQ ID NO: 6600348 - DNA, 12 bp, Homo sapiens
ttttctgttata

SEQ ID NO: 6600349 - DNA, 17 bp, Homo sapiens
ttttctgttcatagata

SEQ ID NO: 6600350 - DNA, 23 bp, Homo sapiens
ttttctgttgaagtttacaatca

SEQ ID NO: 6600351 - DNA, 22 bp, Homo sapiens
ttttctgtttgtaaattatttg

SEQ ID NO: 6600352 - DNA, 14 bp, Homo sapiens
ttttcttaaaaagt

SEQ ID NO: 6600353 - DNA, 16 bp, Homo sapiens
ttttcttaaagtgcca

SEQ ID NO: 6600354 - DNA, 18 bp, Homo sapiens
ttttcttaaagtgccagt

SEQ ID NO: 6600355 - DNA, 14 bp, Homo sapiens
ttttcttaagaaat

SEQ ID NO: 6600356 - DNA, 16 bp, Homo sapiens
ttttcttaccctctct

SEQ ID NO: 6600357 - DNA, 21 bp, Homo sapiens
ttttcttaccctctctttcaa

SEQ ID NO: 6600358 - DNA, 23 bp, Homo sapiens
ttttcttaggagcaagaagaaaa

SEQ ID NO: 6600359 - DNA, 18 bp, Homo sapiens
ttttcttatccacaaagt

SEQ ID NO: 6600360 - DNA, 13 bp, Homo sapiens
ttttcttatttaa

SEQ ID NO: 6600361 - DNA, 16 bp, Homo sapiens
ttttcttcaaatgttt

SEQ ID NO: 6600362 - DNA, 22 bp, Homo sapiens
ttttcttcaacatcaatgttca

SEQ ID NO: 6600363 - DNA, 15 bp, Homo sapiens
ttttcttcacaatct

SEQ ID NO: 6600364 - DNA, 20 bp, Homo sapiens
ttttcttcacctcacttgtg

SEQ ID NO: 6600365 - DNA, 16 bp, Homo sapiens
ttttcttcatgcaatg

SEQ ID NO: 6600366 - DNA, 21 bp, Homo sapiens
ttttcttccttctttctcttc

SEQ ID NO: 6600367 - DNA, 13 bp, Homo sapiens
ttttcttctaaaa

SEQ ID NO: 6600368 - DNA, 19 bp, Homo sapiens
ttttcttctaaaatgcttt

SEQ ID NO: 6600369 - DNA, 13 bp, Homo sapiens
ttttcttctcatt

SEQ ID NO: 6600370 - DNA, 14 bp, Homo sapiens
ttttcttctccctc

SEQ ID NO: 6600371 - DNA, 11 bp, Homo sapiens
ttttcttctga

SEQ ID NO: 6600372 - DNA, 16 bp, Homo sapiens
ttttcttcttgggata

SEQ ID NO: 6600373 - DNA, 15 bp, Homo sapiens
ttttcttctttgtgg

SEQ ID NO: 6600374 - DNA, 17 bp, Homo sapiens
ttttcttcttttaaaaa

SEQ ID NO: 6600375 - DNA, 16 bp, Homo sapiens
ttttcttgaggaaaat

SEQ ID NO: 6600376 - DNA, 19 bp, Homo sapiens
ttttcttgatatctttcct

SEQ ID NO: 6600377 - DNA, 16 bp, Homo sapiens
ttttcttgatgtcact

SEQ ID NO: 6600378 - DNA, 16 bp, Homo sapiens
ttttcttgcatggttt

SEQ ID NO: 6600379 - DNA, 13 bp, Homo sapiens
ttttcttgctgtt

SEQ ID NO: 6600380 - DNA, 19 bp, Homo sapiens
ttttcttggcaaaagcctt

SEQ ID NO: 6600381 - DNA, 19 bp, Homo sapiens
ttttcttggtagcacaaat

SEQ ID NO: 6600382 - DNA, 11 bp, Homo sapiens
ttttcttggtg

SEQ ID NO: 6600383 - DNA, 18 bp, Homo sapiens
ttttcttggtggcagaat

SEQ ID NO: 6600384 - DNA, 16 bp, Homo sapiens
ttttcttggtttctgg

SEQ ID NO: 6600385 - DNA, 19 bp, Homo sapiens
ttttcttgtaaatgtttct

SEQ ID NO: 6600386 - DNA, 13 bp, Homo sapiens
ttttcttgtaatt

SEQ ID NO: 6600387 - DNA, 11 bp, Homo sapiens
ttttcttgtat

SEQ ID NO: 6600388 - DNA, 13 bp, Homo sapiens
ttttcttgtctat

SEQ ID NO: 6600389 - DNA, 22 bp, Homo sapiens
ttttcttgtgtgtttattgtca

SEQ ID NO: 6600390 - DNA, 22 bp, Homo sapiens
ttttcttgtgttgttttctctg

SEQ ID NO: 6600391 - DNA, 14 bp, Homo sapiens
ttttcttgttaact

SEQ ID NO: 6600392 - DNA, 17 bp, Homo sapiens
ttttcttgtttaacata

SEQ ID NO: 6600393 - DNA, 15 bp, Homo sapiens
ttttcttgtttatca

SEQ ID NO: 6600394 - DNA, 18 bp, Homo sapiens
ttttctttaactgccgta

SEQ ID NO: 6600395 - DNA, 15 bp, Homo sapiens
ttttctttaatatga

SEQ ID NO: 6600396 - DNA, 12 bp, Homo sapiens
ttttctttactt

SEQ ID NO: 6600397 - DNA, 15 bp, Homo sapiens
ttttctttagagaac

SEQ ID NO: 6600398 - DNA, 19 bp, Homo sapiens
ttttctttagagaactgaa

SEQ ID NO: 6600399 - DNA, 15 bp, Homo sapiens
ttttctttagtatag

SEQ ID NO: 6600400 - DNA, 13 bp, Homo sapiens
ttttctttataag

SEQ ID NO: 6600401 - DNA, 19 bp, Homo sapiens
ttttctttataagaaagcc

SEQ ID NO: 6600402 - DNA, 20 bp, Homo sapiens
ttttctttatttttgttaat

SEQ ID NO: 6600403 - DNA, 17 bp, Homo sapiens
ttttctttcaagaacta

SEQ ID NO: 6600404 - DNA, 10 bp, Homo sapiens
ttttctttcc

SEQ ID NO: 6600405 - DNA, 19 bp, Homo sapiens
ttttctttcccatgtattt

SEQ ID NO: 6600406 - DNA, 15 bp, Homo sapiens
ttttctttccttaaa

SEQ ID NO: 6600407 - DNA, 15 bp, Homo sapiens
ttttctttcctttcc

SEQ ID NO: 6600408 - DNA, 17 bp, Homo sapiens
ttttctttctagtttgt

SEQ ID NO: 6600409 - DNA, 14 bp, Homo sapiens
ttttctttgaaatt

SEQ ID NO: 6600410 - DNA, 15 bp, Homo sapiens
ttttctttgaataaa

SEQ ID NO: 6600411 - DNA, 13 bp, Homo sapiens
ttttctttgattt

SEQ ID NO: 6600412 - DNA, 15 bp, Homo sapiens
ttttctttgattttc

SEQ ID NO: 6600413 - DNA, 12 bp, Homo sapiens
ttttctttgcaa

SEQ ID NO: 6600414 - DNA, 20 bp, Homo sapiens
ttttctttgccatctctgct

SEQ ID NO: 6600415 - DNA, 16 bp, Homo sapiens
ttttctttgtaaaggt

SEQ ID NO: 6600416 - DNA, 19 bp, Homo sapiens
ttttctttgtgtagctttg

SEQ ID NO: 6600417 - DNA, 13 bp, Homo sapiens
ttttcttttaaga

SEQ ID NO: 6600418 - DNA, 15 bp, Homo sapiens
ttttcttttaagaat

SEQ ID NO: 6600419 - DNA, 21 bp, Homo sapiens
ttttcttttagttacatgaat

SEQ ID NO: 6600420 - DNA, 17 bp, Homo sapiens
ttttcttttattatcag

SEQ ID NO: 6600421 - DNA, 22 bp, Homo sapiens
ttttcttttattatcagttaaa

SEQ ID NO: 6600422 - DNA, 21 bp, Homo sapiens
ttttcttttcctccatgatgt

SEQ ID NO: 6600423 - DNA, 11 bp, Homo sapiens
ttttcttttct

SEQ ID NO: 6600424 - DNA, 15 bp, Homo sapiens
ttttcttttctatgg

SEQ ID NO: 6600425 - DNA, 14 bp, Homo sapiens
ttttcttttgttac

SEQ ID NO: 6600426 - DNA, 16 bp, Homo sapiens
ttttcttttgttactg

SEQ ID NO: 6600427 - DNA, 20 bp, Homo sapiens
ttttctttttaaagtttgtt

SEQ ID NO: 6600428 - DNA, 23 bp, Homo sapiens
ttttctttttacataactgcctt

SEQ ID NO: 6600429 - DNA, 16 bp, Homo sapiens
ttttctttttgaaaca

SEQ ID NO: 6600430 - DNA, 20 bp, Homo sapiens
ttttctttttgtttcactgg

SEQ ID NO: 6600431 - DNA, 17 bp, Homo sapiens
ttttcttttttaaatgt

SEQ ID NO: 6600432 - DNA, 21 bp, Homo sapiens
ttttcttttttaaatgtttct

SEQ ID NO: 6600433 - DNA, 23 bp, Homo sapiens
ttttcttttttaaattaatatct

SEQ ID NO: 6600434 - DNA, 19 bp, Homo sapiens
ttttcttttttaattgaaa

SEQ ID NO: 6600435 - DNA, 19 bp, Homo sapiens
ttttctttttttgcatatt

SEQ ID NO: 6600436 - DNA, 18 bp, Homo sapiens
ttttctttttttggtaaa

SEQ ID NO: 6600437 - DNA, 22 bp, Homo sapiens
ttttgaaaaaggatcatggttt

SEQ ID NO: 6600438 - DNA, 21 bp, Homo sapiens
ttttgaaaaagtgtacatgaa

SEQ ID NO: 6600439 - DNA, 22 bp, Homo sapiens
ttttgaaaaagtgtacatgaag

SEQ ID NO: 6600440 - DNA, 23 bp, Homo sapiens
ttttgaaaaagtgtacatgaaga

SEQ ID NO: 6600441 - DNA, 12 bp, Homo sapiens
ttttgaaaaata

SEQ ID NO: 6600442 - DNA, 20 bp, Homo sapiens
ttttgaaaaatattgctaaa

SEQ ID NO: 6600443 - DNA, 22 bp, Homo sapiens
ttttgaaaaattacctgtataa

SEQ ID NO: 6600444 - DNA, 12 bp, Homo sapiens
ttttgaaaacac

SEQ ID NO: 6600445 - DNA, 14 bp, Homo sapiens
ttttgaaaactcat

SEQ ID NO: 6600446 - DNA, 14 bp, Homo sapiens
ttttgaaaagctaa

SEQ ID NO: 6600447 - DNA, 15 bp, Homo sapiens
ttttgaaaagctatt

SEQ ID NO: 6600448 - DNA, 23 bp, Homo sapiens
ttttgaaaagctattagccagga

SEQ ID NO: 6600449 - DNA, 12 bp, Homo sapiens
ttttgaaaaggc

SEQ ID NO: 6600450 - DNA, 20 bp, Homo sapiens
ttttgaaaagtaatatttat

SEQ ID NO: 6600451 - DNA, 13 bp, Homo sapiens
ttttgaaaagttg

SEQ ID NO: 6600452 - DNA, 23 bp, Homo sapiens
ttttgaaaagttgaaatgtgtaa

SEQ ID NO: 6600453 - DNA, 21 bp, Homo sapiens
ttttgaaaatatgtactgtat

SEQ ID NO: 6600454 - DNA, 18 bp, Homo sapiens
ttttgaaaattatgcaaa

SEQ ID NO: 6600455 - DNA, 13 bp, Homo sapiens
ttttgaaacaaac

SEQ ID NO: 6600456 - DNA, 19 bp, Homo sapiens
ttttgaaacaaacatggat

SEQ ID NO: 6600457 - DNA, 15 bp, Homo sapiens
ttttgaaacaaagta

SEQ ID NO: 6600458 - DNA, 19 bp, Homo sapiens
ttttgaaacacaataccta

SEQ ID NO: 6600459 - DNA, 14 bp, Homo sapiens
ttttgaaacagcag

SEQ ID NO: 6600460 - DNA, 22 bp, Homo sapiens
ttttgaaacccacagttttagt

SEQ ID NO: 6600461 - DNA, 15 bp, Homo sapiens
ttttgaaactgcatt

SEQ ID NO: 6600462 - DNA, 12 bp, Homo sapiens
ttttgaaagaat

SEQ ID NO: 6600463 - DNA, 19 bp, Homo sapiens
ttttgaaagacaaaattta

SEQ ID NO: 6600464 - DNA, 23 bp, Homo sapiens
ttttgaaagtcagctgaaggatg

SEQ ID NO: 6600465 - DNA, 17 bp, Homo sapiens
ttttgaaataaaaatgg

SEQ ID NO: 6600466 - DNA, 14 bp, Homo sapiens
ttttgaaatacctt

SEQ ID NO: 6600467 - DNA, 18 bp, Homo sapiens
ttttgaaatatttgtgtg

SEQ ID NO: 6600468 - DNA, 20 bp, Homo sapiens
ttttgaaatctgtatctgta

SEQ ID NO: 6600469 - DNA, 12 bp, Homo sapiens
ttttgaaatgaa

SEQ ID NO: 6600470 - DNA, 16 bp, Homo sapiens
ttttgaaatgaaattt

SEQ ID NO: 6600471 - DNA, 13 bp, Homo sapiens
ttttgaaatgatt

SEQ ID NO: 6600472 - DNA, 18 bp, Homo sapiens
ttttgaaatgattcatct

SEQ ID NO: 6600473 - DNA, 17 bp, Homo sapiens
ttttgaaattaacctct

SEQ ID NO: 6600474 - DNA, 12 bp, Homo sapiens
ttttgaaattgt

SEQ ID NO: 6600475 - DNA, 23 bp, Homo sapiens
ttttgaactaagaaacttttgta

SEQ ID NO: 6600476 - DNA, 21 bp, Homo sapiens
ttttgaactaataaaagcata

SEQ ID NO: 6600477 - DNA, 13 bp, Homo sapiens
ttttgaactgcct

SEQ ID NO: 6600478 - DNA, 16 bp, Homo sapiens
ttttgaacttgtcacg

SEQ ID NO: 6600479 - DNA, 12 bp, Homo sapiens
ttttgaactttt

SEQ ID NO: 6600480 - DNA, 20 bp, Homo sapiens
ttttgaagaagggaaattca

SEQ ID NO: 6600481 - DNA, 21 bp, Homo sapiens
ttttgaagaagttcttaaata

SEQ ID NO: 6600482 - DNA, 13 bp, Homo sapiens
ttttgaagcatag

SEQ ID NO: 6600483 - DNA, 13 bp, Homo sapiens
ttttgaagggagg

SEQ ID NO: 6600484 - DNA, 15 bp, Homo sapiens
ttttgaagtcatctt

SEQ ID NO: 6600485 - DNA, 15 bp, Homo sapiens
ttttgaagtcttgta

SEQ ID NO: 6600486 - DNA, 16 bp, Homo sapiens
ttttgaagtcttgtat

SEQ ID NO: 6600487 - DNA, 20 bp, Homo sapiens
ttttgaagtctttaatattt

SEQ ID NO: 6600488 - DNA, 10 bp, Homo sapiens
ttttgaagtg

SEQ ID NO: 6600489 - DNA, 18 bp, Homo sapiens
ttttgaagtgagaaaatg

SEQ ID NO: 6600490 - DNA, 15 bp, Homo sapiens
ttttgaagtttacat

SEQ ID NO: 6600491 - DNA, 16 bp, Homo sapiens
ttttgaagtttacatt

SEQ ID NO: 6600492 - DNA, 18 bp, Homo sapiens
ttttgaagtttacatttt

SEQ ID NO: 6600493 - DNA, 15 bp, Homo sapiens
ttttgaataaaaagt

SEQ ID NO: 6600494 - DNA, 16 bp, Homo sapiens
ttttgaataaaaagtg

SEQ ID NO: 6600495 - DNA, 21 bp, Homo sapiens
ttttgaataaaaagtgaactt

SEQ ID NO: 6600496 - DNA, 16 bp, Homo sapiens
ttttgaatatgcctta

SEQ ID NO: 6600497 - DNA, 22 bp, Homo sapiens
ttttgaatcatccctattctgt

SEQ ID NO: 6600498 - DNA, 15 bp, Homo sapiens
ttttgaatctataaa

SEQ ID NO: 6600499 - DNA, 20 bp, Homo sapiens
ttttgaatctcataatttat

SEQ ID NO: 6600500 - DNA, 18 bp, Homo sapiens
ttttgaatgcttcctgac

SEQ ID NO: 6600501 - DNA, 14 bp, Homo sapiens
ttttgaatgtacct

SEQ ID NO: 6600502 - DNA, 14 bp, Homo sapiens
ttttgaatgtcaca

SEQ ID NO: 6600503 - DNA, 20 bp, Homo sapiens
ttttgaatgtcataaagaag

SEQ ID NO: 6600504 - DNA, 15 bp, Homo sapiens
ttttgaattgttaca

SEQ ID NO: 6600505 - DNA, 15 bp, Homo sapiens
ttttgaatttaaata

SEQ ID NO: 6600506 - DNA, 18 bp, Homo sapiens
ttttgaatttaaataaag

SEQ ID NO: 6600507 - DNA, 20 bp, Homo sapiens
ttttgaatttaaataaagtt

SEQ ID NO: 6600508 - DNA, 14 bp, Homo sapiens
ttttgacaaaaatg

SEQ ID NO: 6600509 - DNA, 16 bp, Homo sapiens
ttttgacaaagtgcct

SEQ ID NO: 6600510 - DNA, 21 bp, Homo sapiens
ttttgacaacatggcttctcc

SEQ ID NO: 6600511 - DNA, 20 bp, Homo sapiens
ttttgacaaggggcagtggt

SEQ ID NO: 6600512 - DNA, 19 bp, Homo sapiens
ttttgacactatatctgta

SEQ ID NO: 6600513 - DNA, 12 bp, Homo sapiens
ttttgacactga

SEQ ID NO: 6600514 - DNA, 23 bp, Homo sapiens
ttttgacagaatatgtttcaaac

SEQ ID NO: 6600515 - DNA, 23 bp, Homo sapiens
ttttgacagagttggtgttcata

SEQ ID NO: 6600516 - DNA, 16 bp, Homo sapiens
ttttgaccagtttctt

SEQ ID NO: 6600517 - DNA, 17 bp, Homo sapiens
ttttgaccatatagatt

SEQ ID NO: 6600518 - DNA, 15 bp, Homo sapiens
ttttgacctgtttca

SEQ ID NO: 6600519 - DNA, 21 bp, Homo sapiens
ttttgaccttcatttcatgta

SEQ ID NO: 6600520 - DNA, 15 bp, Homo sapiens
ttttgaccttgtatt

SEQ ID NO: 6600521 - DNA, 15 bp, Homo sapiens
ttttgacctttgata

SEQ ID NO: 6600522 - DNA, 15 bp, Homo sapiens
ttttgacggatgatt

SEQ ID NO: 6600523 - DNA, 20 bp, Homo sapiens
ttttgactaaagctatgtta

SEQ ID NO: 6600524 - DNA, 23 bp, Homo sapiens
ttttgactaagaattttgtttta

SEQ ID NO: 6600525 - DNA, 22 bp, Homo sapiens
ttttgactaagtttttatacca

SEQ ID NO: 6600526 - DNA, 11 bp, Homo sapiens
ttttgactctt

SEQ ID NO: 6600527 - DNA, 15 bp, Homo sapiens
ttttgactcttccgt

SEQ ID NO: 6600528 - DNA, 12 bp, Homo sapiens
ttttgactggct

SEQ ID NO: 6600529 - DNA, 14 bp, Homo sapiens
ttttgactggcttg

SEQ ID NO: 6600530 - DNA, 15 bp, Homo sapiens
ttttgacttaatgtg

SEQ ID NO: 6600531 - DNA, 17 bp, Homo sapiens
ttttgacttaatgtgat

SEQ ID NO: 6600532 - DNA, 23 bp, Homo sapiens
ttttgagaaacagctacagcttt

SEQ ID NO: 6600533 - DNA, 17 bp, Homo sapiens
ttttgagaacgtaaaga

SEQ ID NO: 6600534 - DNA, 17 bp, Homo sapiens
ttttgagacagaatctc

SEQ ID NO: 6600535 - DNA, 15 bp, Homo sapiens
ttttgagacatggga

SEQ ID NO: 6600536 - DNA, 16 bp, Homo sapiens
ttttgagagtaatttg

SEQ ID NO: 6600537 - DNA, 21 bp, Homo sapiens
ttttgagataaatgagtgatt

SEQ ID NO: 6600538 - DNA, 21 bp, Homo sapiens
ttttgagatggagtctcactc

SEQ ID NO: 6600539 - DNA, 21 bp, Homo sapiens
ttttgagatggggtctcgctc

SEQ ID NO: 6600540 - DNA, 14 bp, Homo sapiens
ttttgagatgtaaa

SEQ ID NO: 6600541 - DNA, 17 bp, Homo sapiens
ttttgagcaactttctt

SEQ ID NO: 6600542 - DNA, 15 bp, Homo sapiens
ttttgagcaggagca

SEQ ID NO: 6600543 - DNA, 11 bp, Homo sapiens
ttttgagccaa

SEQ ID NO: 6600544 - DNA, 19 bp, Homo sapiens
ttttgagcgacatctctga

SEQ ID NO: 6600545 - DNA, 16 bp, Homo sapiens
ttttgagctatttcct

SEQ ID NO: 6600546 - DNA, 18 bp, Homo sapiens
ttttgaggcttctccttc

SEQ ID NO: 6600547 - DNA, 14 bp, Homo sapiens
ttttgaggctttca

SEQ ID NO: 6600548 - DNA, 18 bp, Homo sapiens
ttttgagggcatgaagct

SEQ ID NO: 6600549 - DNA, 17 bp, Homo sapiens
ttttgaggggttcttct

SEQ ID NO: 6600550 - DNA, 18 bp, Homo sapiens
ttttgagtagatattact

SEQ ID NO: 6600551 - DNA, 23 bp, Homo sapiens
ttttgagtcttttttttttaagt

SEQ ID NO: 6600552 - DNA, 19 bp, Homo sapiens
ttttgagtgtactgtgcct

SEQ ID NO: 6600553 - DNA, 22 bp, Homo sapiens
ttttgagtgtttatagatcact

SEQ ID NO: 6600554 - DNA, 17 bp, Homo sapiens
ttttgagttttcttata

SEQ ID NO: 6600555 - DNA, 12 bp, Homo sapiens
ttttgataaaat

SEQ ID NO: 6600556 - DNA, 22 bp, Homo sapiens
ttttgataaagtagtaaaaatt

SEQ ID NO: 6600557 - DNA, 23 bp, Homo sapiens
ttttgataaagtagtaaaaatta

SEQ ID NO: 6600558 - DNA, 19 bp, Homo sapiens
ttttgataaagtttctcag

SEQ ID NO: 6600559 - DNA, 21 bp, Homo sapiens
ttttgataaagtttctcagat

SEQ ID NO: 6600560 - DNA, 13 bp, Homo sapiens
ttttgataacaat

SEQ ID NO: 6600561 - DNA, 13 bp, Homo sapiens
ttttgataactgt

SEQ ID NO: 6600562 - DNA, 18 bp, Homo sapiens
ttttgataataaattgaa

SEQ ID NO: 6600563 - DNA, 13 bp, Homo sapiens
ttttgatacattt

SEQ ID NO: 6600564 - DNA, 15 bp, Homo sapiens
ttttgatagttgtgt

SEQ ID NO: 6600565 - DNA, 10 bp, Homo sapiens
ttttgatata

SEQ ID NO: 6600566 - DNA, 20 bp, Homo sapiens
ttttgatataattgtactgt

SEQ ID NO: 6600567 - DNA, 15 bp, Homo sapiens
ttttgatatatgaaa

SEQ ID NO: 6600568 - DNA, 16 bp, Homo sapiens
ttttgatatgagtata

SEQ ID NO: 6600569 - DNA, 18 bp, Homo sapiens
ttttgatcatccctttct

SEQ ID NO: 6600570 - DNA, 21 bp, Homo sapiens
ttttgatcctctactgtgcat

SEQ ID NO: 6600571 - DNA, 20 bp, Homo sapiens
ttttgatctattaagggatt

SEQ ID NO: 6600572 - DNA, 14 bp, Homo sapiens
ttttgatctcacat

SEQ ID NO: 6600573 - DNA, 18 bp, Homo sapiens
ttttgatcttcaacaaat

SEQ ID NO: 6600574 - DNA, 20 bp, Homo sapiens
ttttgatcttgtgctatgaa

SEQ ID NO: 6600575 - DNA, 19 bp, Homo sapiens
ttttgatctttgagtgtat

SEQ ID NO: 6600576 - DNA, 23 bp, Homo sapiens
ttttgatgaacaaaatttcctaa

SEQ ID NO: 6600577 - DNA, 24 bp, Homo sapiens
ttttgatgagatattaaattctca

SEQ ID NO: 6600578 - DNA, 15 bp, Homo sapiens
ttttgatgcagcatt

SEQ ID NO: 6600579 - DNA, 20 bp, Homo sapiens
ttttgatgccatttgtcttt

SEQ ID NO: 6600580 - DNA, 16 bp, Homo sapiens
ttttgatgtataaaac

SEQ ID NO: 6600581 - DNA, 17 bp, Homo sapiens
ttttgatgtatatatct

SEQ ID NO: 6600582 - DNA, 19 bp, Homo sapiens
ttttgatgtattattatat

SEQ ID NO: 6600583 - DNA, 13 bp, Homo sapiens
ttttgatgtgctt

SEQ ID NO: 6600584 - DNA, 17 bp, Homo sapiens
ttttgattaacaatgta

SEQ ID NO: 6600585 - DNA, 22 bp, Homo sapiens
ttttgattaagtggttactttg

SEQ ID NO: 6600586 - DNA, 21 bp, Homo sapiens
ttttgattaatgaagaaagta

SEQ ID NO: 6600587 - DNA, 17 bp, Homo sapiens
ttttgattagtataata

SEQ ID NO: 6600588 - DNA, 14 bp, Homo sapiens
ttttgattgcatat

SEQ ID NO: 6600589 - DNA, 19 bp, Homo sapiens
ttttgattgcatattttgt

SEQ ID NO: 6600590 - DNA, 22 bp, Homo sapiens
ttttgattgcatattttgttat

SEQ ID NO: 6600591 - DNA, 18 bp, Homo sapiens
ttttgattgttatgtaaa

SEQ ID NO: 6600592 - DNA, 15 bp, Homo sapiens
ttttgattttgctga

SEQ ID NO: 6600593 - DNA, 13 bp, Homo sapiens
ttttgcaaaattt

SEQ ID NO: 6600594 - DNA, 13 bp, Homo sapiens
ttttgcaaagaaa

SEQ ID NO: 6600595 - DNA, 19 bp, Homo sapiens
ttttgcaaatataaacatc

SEQ ID NO: 6600596 - DNA, 19 bp, Homo sapiens
ttttgcaaatctaaagttg

SEQ ID NO: 6600597 - DNA, 16 bp, Homo sapiens
ttttgcaacaattaag

SEQ ID NO: 6600598 - DNA, 17 bp, Homo sapiens
ttttgcaacctcgctgg

SEQ ID NO: 6600599 - DNA, 17 bp, Homo sapiens
ttttgcaaggtaaaatt

SEQ ID NO: 6600600 - DNA, 21 bp, Homo sapiens
ttttgcaaggtaaaattttag

SEQ ID NO: 6600601 - DNA, 17 bp, Homo sapiens
ttttgcaataacttcta

SEQ ID NO: 6600602 - DNA, 22 bp, Homo sapiens
ttttgcaataaggatttattct

SEQ ID NO: 6600603 - DNA, 18 bp, Homo sapiens
ttttgcaataatgcagta

SEQ ID NO: 6600604 - DNA, 18 bp, Homo sapiens
ttttgcaatcccttaata

SEQ ID NO: 6600605 - DNA, 17 bp, Homo sapiens
ttttgcaatggctatat

SEQ ID NO: 6600606 - DNA, 14 bp, Homo sapiens
ttttgcacagtgga

SEQ ID NO: 6600607 - DNA, 23 bp, Homo sapiens
ttttgcacagttagttgtgaaag

SEQ ID NO: 6600608 - DNA, 14 bp, Homo sapiens
ttttgcacatatat

SEQ ID NO: 6600609 - DNA, 18 bp, Homo sapiens
ttttgcaccccatgctgt

SEQ ID NO: 6600610 - DNA, 13 bp, Homo sapiens
ttttgcacccctc

SEQ ID NO: 6600611 - DNA, 16 bp, Homo sapiens
ttttgcacgtcttgct

SEQ ID NO: 6600612 - DNA, 12 bp, Homo sapiens
ttttgcactgta

SEQ ID NO: 6600613 - DNA, 14 bp, Homo sapiens
ttttgcacttatct

SEQ ID NO: 6600614 - DNA, 18 bp, Homo sapiens
ttttgcagaaaaaacaaa

SEQ ID NO: 6600615 - DNA, 20 bp, Homo sapiens
ttttgcagaaggaaatgatg

SEQ ID NO: 6600616 - DNA, 13 bp, Homo sapiens
ttttgcagcagag

SEQ ID NO: 6600617 - DNA, 14 bp, Homo sapiens
ttttgcagcagagg

SEQ ID NO: 6600618 - DNA, 20 bp, Homo sapiens
ttttgcaggggactgggcca

SEQ ID NO: 6600619 - DNA, 15 bp, Homo sapiens
ttttgcataatttca

SEQ ID NO: 6600620 - DNA, 17 bp, Homo sapiens
ttttgcatactgaaaat

SEQ ID NO: 6600621 - DNA, 20 bp, Homo sapiens
ttttgcatattaaagataag

SEQ ID NO: 6600622 - DNA, 15 bp, Homo sapiens
ttttgcatattgcat

SEQ ID NO: 6600623 - DNA, 19 bp, Homo sapiens
ttttgcatgcatgcaaatg

SEQ ID NO: 6600624 - DNA, 21 bp, Homo sapiens
ttttgcatgcatgcaaatgag

SEQ ID NO: 6600625 - DNA, 19 bp, Homo sapiens
ttttgcatggcacttgcat

SEQ ID NO: 6600626 - DNA, 18 bp, Homo sapiens
ttttgcatgtcgcacaat

SEQ ID NO: 6600627 - DNA, 13 bp, Homo sapiens
ttttgcattcaaa

SEQ ID NO: 6600628 - DNA, 15 bp, Homo sapiens
ttttgcattccagaa

SEQ ID NO: 6600629 - DNA, 20 bp, Homo sapiens
ttttgcatttctcttcctaa

SEQ ID NO: 6600630 - DNA, 20 bp, Homo sapiens
ttttgccacagcttttgcaa

SEQ ID NO: 6600631 - DNA, 21 bp, Homo sapiens
ttttgccacagggtactaaaa

SEQ ID NO: 6600632 - DNA, 22 bp, Homo sapiens
ttttgccactgcaaacaataaa

SEQ ID NO: 6600633 - DNA, 22 bp, Homo sapiens
ttttgccactttggcttctcct

SEQ ID NO: 6600634 - DNA, 16 bp, Homo sapiens
ttttgccagactctag

SEQ ID NO: 6600635 - DNA, 18 bp, Homo sapiens
ttttgcccatataaaatg

SEQ ID NO: 6600636 - DNA, 20 bp, Homo sapiens
ttttgcccatataaaatgct

SEQ ID NO: 6600637 - DNA, 21 bp, Homo sapiens
ttttgcccccgtggggctccc

SEQ ID NO: 6600638 - DNA, 17 bp, Homo sapiens
ttttgccctatatacct

SEQ ID NO: 6600639 - DNA, 19 bp, Homo sapiens
ttttgccctccctctctgc

SEQ ID NO: 6600640 - DNA, 14 bp, Homo sapiens
ttttgccctcctgc

SEQ ID NO: 6600641 - DNA, 13 bp, Homo sapiens
ttttgccctttga

SEQ ID NO: 6600642 - DNA, 16 bp, Homo sapiens
ttttgcctaaaatata

SEQ ID NO: 6600643 - DNA, 22 bp, Homo sapiens
ttttgcctatctttaaacattt

SEQ ID NO: 6600644 - DNA, 18 bp, Homo sapiens
ttttgcctcatgaacact

SEQ ID NO: 6600645 - DNA, 14 bp, Homo sapiens
ttttgcctctttaa

SEQ ID NO: 6600646 - DNA, 13 bp, Homo sapiens
ttttgcctttggt

SEQ ID NO: 6600647 - DNA, 22 bp, Homo sapiens
ttttgcctttgtggcccatgaa

SEQ ID NO: 6600648 - DNA, 21 bp, Homo sapiens
ttttgcgatgtgttttattca

SEQ ID NO: 6600649 - DNA, 21 bp, Homo sapiens
ttttgcggttcaggaaaattg

SEQ ID NO: 6600650 - DNA, 13 bp, Homo sapiens
ttttgctagatgg

SEQ ID NO: 6600651 - DNA, 17 bp, Homo sapiens
ttttgctattgtaaata

SEQ ID NO: 6600652 - DNA, 13 bp, Homo sapiens
ttttgctctaaaa

SEQ ID NO: 6600653 - DNA, 15 bp, Homo sapiens
ttttgctctaaaata

SEQ ID NO: 6600654 - DNA, 22 bp, Homo sapiens
ttttgctctaaaatatttatga

SEQ ID NO: 6600655 - DNA, 16 bp, Homo sapiens
ttttgctcttctgtat

SEQ ID NO: 6600656 - DNA, 14 bp, Homo sapiens
ttttgctgaattca

SEQ ID NO: 6600657 - DNA, 20 bp, Homo sapiens
ttttgctgaattcctttaca

SEQ ID NO: 6600658 - DNA, 13 bp, Homo sapiens
ttttgctgagact

SEQ ID NO: 6600659 - DNA, 15 bp, Homo sapiens
ttttgctgagagcat

SEQ ID NO: 6600660 - DNA, 23 bp, Homo sapiens
ttttgctggaattcctaactttt

SEQ ID NO: 6600661 - DNA, 21 bp, Homo sapiens
ttttgctggagactatttaag

SEQ ID NO: 6600662 - DNA, 21 bp, Homo sapiens
ttttgctggcttgcactttct

SEQ ID NO: 6600663 - DNA, 14 bp, Homo sapiens
ttttgctgtagaag

SEQ ID NO: 6600664 - DNA, 13 bp, Homo sapiens
ttttgctgtatat

SEQ ID NO: 6600665 - DNA, 16 bp, Homo sapiens
ttttgcttaacagttt

SEQ ID NO: 6600666 - DNA, 12 bp, Homo sapiens
ttttgcttattt

SEQ ID NO: 6600667 - DNA, 13 bp, Homo sapiens
ttttgcttcccct

SEQ ID NO: 6600668 - DNA, 15 bp, Homo sapiens
ttttgcttgcaatgt

SEQ ID NO: 6600669 - DNA, 17 bp, Homo sapiens
ttttgctttaaaacaaa

SEQ ID NO: 6600670 - DNA, 17 bp, Homo sapiens
ttttgctttctgaaatt

SEQ ID NO: 6600671 - DNA, 12 bp, Homo sapiens
ttttgctttggt

SEQ ID NO: 6600672 - DNA, 21 bp, Homo sapiens
ttttgctttgttgaataatac

SEQ ID NO: 6600673 - DNA, 21 bp, Homo sapiens
ttttgcttttccctagtgctg

SEQ ID NO: 6600674 - DNA, 13 bp, Homo sapiens
ttttgcttttcct

SEQ ID NO: 6600675 - DNA, 11 bp, Homo sapiens
ttttgcttttg

SEQ ID NO: 6600676 - DNA, 21 bp, Homo sapiens
ttttgcttttggcaaaactct

SEQ ID NO: 6600677 - DNA, 13 bp, Homo sapiens
ttttgcttttgtt

SEQ ID NO: 6600678 - DNA, 9 bp, Homo sapiens
ttttggaaa

SEQ ID NO: 6600679 - DNA, 23 bp, Homo sapiens
ttttggaaactgctaaattctat

SEQ ID NO: 6600680 - DNA, 15 bp, Homo sapiens
ttttggaaactgttg

SEQ ID NO: 6600681 - DNA, 22 bp, Homo sapiens
ttttggaagaagttttttactt

SEQ ID NO: 6600682 - DNA, 16 bp, Homo sapiens
ttttggaatctaagct

SEQ ID NO: 6600683 - DNA, 17 bp, Homo sapiens
ttttggaatctagaaga

SEQ ID NO: 6600684 - DNA, 18 bp, Homo sapiens
ttttggaattggtgtata

SEQ ID NO: 6600685 - DNA, 13 bp, Homo sapiens
ttttggaatttgc

SEQ ID NO: 6600686 - DNA, 15 bp, Homo sapiens
ttttggacttctggg

SEQ ID NO: 6600687 - DNA, 15 bp, Homo sapiens
ttttggactttgtta

SEQ ID NO: 6600688 - DNA, 20 bp, Homo sapiens
ttttggagaaatgtcataaa

SEQ ID NO: 6600689 - DNA, 16 bp, Homo sapiens
ttttggaggcctgact

SEQ ID NO: 6600690 - DNA, 20 bp, Homo sapiens
ttttggaggtgcttgatcta

SEQ ID NO: 6600691 - DNA, 23 bp, Homo sapiens
ttttggagtgcttaaaaatgcca

SEQ ID NO: 6600692 - DNA, 14 bp, Homo sapiens
ttttggatgttgct

SEQ ID NO: 6600693 - DNA, 17 bp, Homo sapiens
ttttggatgttgctata

SEQ ID NO: 6600694 - DNA, 18 bp, Homo sapiens
ttttggatttctttatat

SEQ ID NO: 6600695 - DNA, 19 bp, Homo sapiens
ttttggcaaacgctaaaga

SEQ ID NO: 6600696 - DNA, 19 bp, Homo sapiens
ttttggcactgagatattt

SEQ ID NO: 6600697 - DNA, 13 bp, Homo sapiens
ttttggcagctga

SEQ ID NO: 6600698 - DNA, 17 bp, Homo sapiens
ttttggcatctgcaaag

SEQ ID NO: 6600699 - DNA, 19 bp, Homo sapiens
ttttggcatctgcaaagga

SEQ ID NO: 6600700 - DNA, 16 bp, Homo sapiens
ttttggccaaagtgtt

SEQ ID NO: 6600701 - DNA, 19 bp, Homo sapiens
ttttggcccccgagctggg

SEQ ID NO: 6600702 - DNA, 13 bp, Homo sapiens
ttttggcctgcct

SEQ ID NO: 6600703 - DNA, 15 bp, Homo sapiens
ttttggcctggagtt

SEQ ID NO: 6600704 - DNA, 11 bp, Homo sapiens
ttttggcctgt

SEQ ID NO: 6600705 - DNA, 15 bp, Homo sapiens
aattttgaaatgatt

SEQ ID NO: 6600706 - DNA, 14 bp, Homo sapiens
aattttgaagtgct

SEQ ID NO: 6600707 - DNA, 12 bp, Homo sapiens
aattttgacact

SEQ ID NO: 6600708 - DNA, 22 bp, Homo sapiens
aattttgagtacagaattcaac

SEQ ID NO: 6600709 - DNA, 17 bp, Homo sapiens
aattttgagtattccat

SEQ ID NO: 6600710 - DNA, 14 bp, Homo sapiens
aattttgagtgaat

SEQ ID NO: 6600711 - DNA, 16 bp, Homo sapiens
aattttgatatacatt

SEQ ID NO: 6600712 - DNA, 20 bp, Homo sapiens
aattttgatatacattgtgt

SEQ ID NO: 6600713 - DNA, 21 bp, Homo sapiens
aattttgatatacattgtgtg

SEQ ID NO: 6600714 - DNA, 14 bp, Homo sapiens
aattttgatgaaca

SEQ ID NO: 6600715 - DNA, 16 bp, Homo sapiens
aattttgatgaacaaa

SEQ ID NO: 6600716 - DNA, 21 bp, Homo sapiens
aattttgattaaccttttcaa

SEQ ID NO: 6600717 - DNA, 13 bp, Homo sapiens
aattttgatttct

SEQ ID NO: 6600718 - DNA, 11 bp, Homo sapiens
aattttgcaaa

SEQ ID NO: 6600719 - DNA, 21 bp, Homo sapiens
aattttgcaaatataaacatc

SEQ ID NO: 6600720 - DNA, 15 bp, Homo sapiens
aattttgcaatgtat

SEQ ID NO: 6600721 - DNA, 22 bp, Homo sapiens
aattttgcagaagctatgtttt

SEQ ID NO: 6600722 - DNA, 20 bp, Homo sapiens
aattttgcagattattttag

SEQ ID NO: 6600723 - DNA, 18 bp, Homo sapiens
aattttgcatattctcta

SEQ ID NO: 6600724 - DNA, 21 bp, Homo sapiens
aattttgccaaaatcctgaac

SEQ ID NO: 6600725 - DNA, 18 bp, Homo sapiens
aattttgcctaatacatt

SEQ ID NO: 6600726 - DNA, 17 bp, Homo sapiens
aattttgcctttaacag

SEQ ID NO: 6600727 - DNA, 15 bp, Homo sapiens
aattttgctaactgg

SEQ ID NO: 6600728 - DNA, 19 bp, Homo sapiens
aattttgctaactgggtta

SEQ ID NO: 6600729 - DNA, 23 bp, Homo sapiens
aattttgctaactgggttaaata

SEQ ID NO: 6600730 - DNA, 20 bp, Homo sapiens
aattttgctggaattcctaa

SEQ ID NO: 6600731 - DNA, 16 bp, Homo sapiens
aattttgcttttaatt

SEQ ID NO: 6600732 - DNA, 14 bp, Homo sapiens
aattttggaagaat

SEQ ID NO: 6600733 - DNA, 17 bp, Homo sapiens
aattttggaagaattca

SEQ ID NO: 6600734 - DNA, 13 bp, Homo sapiens
aattttggatgag

SEQ ID NO: 6600735 - DNA, 17 bp, Homo sapiens
aattttggccaaagtgt

SEQ ID NO: 6600736 - DNA, 18 bp, Homo sapiens
aattttggggattttcaa

SEQ ID NO: 6600737 - DNA, 22 bp, Homo sapiens
aattttggggattttcaaaaga

SEQ ID NO: 6600738 - DNA, 23 bp, Homo sapiens
aattttggtgatgtaaaacagaa

SEQ ID NO: 6600739 - DNA, 19 bp, Homo sapiens
aattttggttgtattcttt

SEQ ID NO: 6600740 - DNA, 22 bp, Homo sapiens
aattttggttgtattctttgat

SEQ ID NO: 6600741 - DNA, 17 bp, Homo sapiens
aattttggtttttctca

SEQ ID NO: 6600742 - DNA, 15 bp, Homo sapiens
aattttgtaaaacaa

SEQ ID NO: 6600743 - DNA, 13 bp, Homo sapiens
aattttgtaattt

SEQ ID NO: 6600744 - DNA, 14 bp, Homo sapiens
aattttgtacaaat

SEQ ID NO: 6600745 - DNA, 12 bp, Homo sapiens
aattttgtacat

SEQ ID NO: 6600746 - DNA, 15 bp, Homo sapiens
aattttgtataactt

SEQ ID NO: 6600747 - DNA, 21 bp, Homo sapiens
aattttgtatattgtaggaat

SEQ ID NO: 6600748 - DNA, 19 bp, Homo sapiens
aattttgtatccatttaaa

SEQ ID NO: 6600749 - DNA, 16 bp, Homo sapiens
aattttgtatgaaaaa

SEQ ID NO: 6600750 - DNA, 16 bp, Homo sapiens
aattttgtatgtcaat

SEQ ID NO: 6600751 - DNA, 20 bp, Homo sapiens
aattttgtatgttaaagaga

SEQ ID NO: 6600752 - DNA, 17 bp, Homo sapiens
aattttgtatttaatga

SEQ ID NO: 6600753 - DNA, 13 bp, Homo sapiens
aattttgtatttt

SEQ ID NO: 6600754 - DNA, 15 bp, Homo sapiens
aattttgtattttcc

SEQ ID NO: 6600755 - DNA, 16 bp, Homo sapiens
aattttgtattttcca

SEQ ID NO: 6600756 - DNA, 14 bp, Homo sapiens
aattttgtctctag

SEQ ID NO: 6600757 - DNA, 21 bp, Homo sapiens
aattttgtcttaagtgtttct

SEQ ID NO: 6600758 - DNA, 18 bp, Homo sapiens
aattttgtgaagcaaaat

SEQ ID NO: 6600759 - DNA, 13 bp, Homo sapiens
aattttgtgatga

SEQ ID NO: 6600760 - DNA, 20 bp, Homo sapiens
aattttgtgatgaataaaat

SEQ ID NO: 6600761 - DNA, 21 bp, Homo sapiens
aattttgtgatgaataaaata

SEQ ID NO: 6600762 - DNA, 16 bp, Homo sapiens
aattttgtgcattctt

SEQ ID NO: 6600763 - DNA, 18 bp, Homo sapiens
aattttgtgcattctttg

SEQ ID NO: 6600764 - DNA, 21 bp, Homo sapiens
aattttgtgcttttagtaaaa

SEQ ID NO: 6600765 - DNA, 14 bp, Homo sapiens
aattttgtgtaaga

SEQ ID NO: 6600766 - DNA, 18 bp, Homo sapiens
aattttgtgtaagaaata

SEQ ID NO: 6600767 - DNA, 12 bp, Homo sapiens
aattttgtgttg

SEQ ID NO: 6600768 - DNA, 13 bp, Homo sapiens
aattttgtgttgc

SEQ ID NO: 6600769 - DNA, 14 bp, Homo sapiens
aattttgttatcac

SEQ ID NO: 6600770 - DNA, 18 bp, Homo sapiens
aattttgttcctgtttat

SEQ ID NO: 6600771 - DNA, 19 bp, Homo sapiens
aattttgttctagttttca

SEQ ID NO: 6600772 - DNA, 20 bp, Homo sapiens
aattttgttctagttttcag

SEQ ID NO: 6600773 - DNA, 16 bp, Homo sapiens
aattttgttctctggg

SEQ ID NO: 6600774 - DNA, 18 bp, Homo sapiens
aattttgttctctgggag

SEQ ID NO: 6600775 - DNA, 19 bp, Homo sapiens
aattttgttctctgggaga

SEQ ID NO: 6600776 - DNA, 24 bp, Homo sapiens
aattttgttctctgggagaaaatc

SEQ ID NO: 6600777 - DNA, 12 bp, Homo sapiens
aattttgtttca

SEQ ID NO: 6600778 - DNA, 14 bp, Homo sapiens
aattttgtttgtaa

SEQ ID NO: 6600779 - DNA, 12 bp, Homo sapiens
aattttgtttta

SEQ ID NO: 6600780 - DNA, 19 bp, Homo sapiens
aattttgttttctttttct

SEQ ID NO: 6600781 - DNA, 17 bp, Homo sapiens
aatttttaaaagacttt

SEQ ID NO: 6600782 - DNA, 15 bp, Homo sapiens
aatttttaaaatctg

SEQ ID NO: 6600783 - DNA, 13 bp, Homo sapiens
aatttttaaacaa

SEQ ID NO: 6600784 - DNA, 13 bp, Homo sapiens
aatttttaaacta

SEQ ID NO: 6600785 - DNA, 13 bp, Homo sapiens
aatttttaactgt

SEQ ID NO: 6600786 - DNA, 18 bp, Homo sapiens
aatttttaactgtactga

SEQ ID NO: 6600787 - DNA, 14 bp, Homo sapiens
aatttttaactttt

SEQ ID NO: 6600788 - DNA, 21 bp, Homo sapiens
aatttttaacttttggaatca

SEQ ID NO: 6600789 - DNA, 13 bp, Homo sapiens
aatttttaagcaa

SEQ ID NO: 6600790 - DNA, 22 bp, Homo sapiens
aatttttaatctttaattttac

SEQ ID NO: 6600791 - DNA, 11 bp, Homo sapiens
aatttttaatg

SEQ ID NO: 6600792 - DNA, 14 bp, Homo sapiens
aatttttaatgatg

SEQ ID NO: 6600793 - DNA, 13 bp, Homo sapiens
aatttttaatgtt

SEQ ID NO: 6600794 - DNA, 14 bp, Homo sapiens
aatttttaatgttt

SEQ ID NO: 6600795 - DNA, 15 bp, Homo sapiens
aatttttacatttgt

SEQ ID NO: 6600796 - DNA, 22 bp, Homo sapiens
aatttttaggaagttttctgta

SEQ ID NO: 6600797 - DNA, 12 bp, Homo sapiens
aatttttataca

SEQ ID NO: 6600798 - DNA, 14 bp, Homo sapiens
aatttttatacata

SEQ ID NO: 6600799 - DNA, 15 bp, Homo sapiens
aatttttatacatat

SEQ ID NO: 6600800 - DNA, 19 bp, Homo sapiens
aatttttatatttgaaata

SEQ ID NO: 6600801 - DNA, 17 bp, Homo sapiens
aatttttattaaattat

SEQ ID NO: 6600802 - DNA, 18 bp, Homo sapiens
aatttttattaaattatg

SEQ ID NO: 6600803 - DNA, 16 bp, Homo sapiens
aatttttattatgcat

SEQ ID NO: 6600804 - DNA, 16 bp, Homo sapiens
aatttttattcataag

SEQ ID NO: 6600805 - DNA, 12 bp, Homo sapiens
aatttttattgt

SEQ ID NO: 6600806 - DNA, 13 bp, Homo sapiens
aatttttattgtt

SEQ ID NO: 6600807 - DNA, 15 bp, Homo sapiens
aatttttatttcttc

SEQ ID NO: 6600808 - DNA, 15 bp, Homo sapiens
aatttttatttcttt

SEQ ID NO: 6600809 - DNA, 15 bp, Homo sapiens
aatttttcaatttct

SEQ ID NO: 6600810 - DNA, 19 bp, Homo sapiens
aatttttcagatgcttctg

SEQ ID NO: 6600811 - DNA, 20 bp, Homo sapiens
aatttttcagctctctgtat

SEQ ID NO: 6600812 - DNA, 23 bp, Homo sapiens
aatttttcagctctctgtataaa

SEQ ID NO: 6600813 - DNA, 13 bp, Homo sapiens
aatttttcatatt

SEQ ID NO: 6600814 - DNA, 19 bp, Homo sapiens
aatttttcatctcttcaat

SEQ ID NO: 6600815 - DNA, 23 bp, Homo sapiens
aatttttcattgatatgaaaaat

SEQ ID NO: 6600816 - DNA, 22 bp, Homo sapiens
aatttttccacactatgtgtgt

SEQ ID NO: 6600817 - DNA, 17 bp, Homo sapiens
aatttttcccagtattt

SEQ ID NO: 6600818 - DNA, 14 bp, Homo sapiens
aatttttcctgcat

SEQ ID NO: 6600819 - DNA, 22 bp, Homo sapiens
aatttttctctaactcagaaac

SEQ ID NO: 6600820 - DNA, 16 bp, Homo sapiens
aatttttctgcactga

SEQ ID NO: 6600821 - DNA, 16 bp, Homo sapiens
aatttttctgtacttc

SEQ ID NO: 6600822 - DNA, 13 bp, Homo sapiens
aatttttctgtat

SEQ ID NO: 6600823 - DNA, 21 bp, Homo sapiens
aatttttctgtatagacagga

SEQ ID NO: 6600824 - DNA, 18 bp, Homo sapiens
aatttttcttaagacaga

SEQ ID NO: 6600825 - DNA, 13 bp, Homo sapiens
aatttttcttctt

SEQ ID NO: 6600826 - DNA, 14 bp, Homo sapiens
aatttttcttcttg

SEQ ID NO: 6600827 - DNA, 16 bp, Homo sapiens
aatttttcttcttgag

SEQ ID NO: 6600828 - DNA, 11 bp, Homo sapiens
aatttttgaaa

SEQ ID NO: 6600829 - DNA, 23 bp, Homo sapiens
aatttttgaaaaatattgctaaa

SEQ ID NO: 6600830 - DNA, 13 bp, Homo sapiens
aatttttgaaaag

SEQ ID NO: 6600831 - DNA, 14 bp, Homo sapiens
aatttttgacactt

SEQ ID NO: 6600832 - DNA, 14 bp, Homo sapiens
aatttttgcaataa

SEQ ID NO: 6600833 - DNA, 15 bp, Homo sapiens
aatttttgcaataat

SEQ ID NO: 6600834 - DNA, 14 bp, Homo sapiens
aatttttgcatgtt

SEQ ID NO: 6600835 - DNA, 15 bp, Homo sapiens
aatttttgcatgttt

SEQ ID NO: 6600836 - DNA, 18 bp, Homo sapiens
aatttttgcctatcttta

SEQ ID NO: 6600837 - DNA, 16 bp, Homo sapiens
aatttttgccttcatt

SEQ ID NO: 6600838 - DNA, 13 bp, Homo sapiens
aatttttgctgaa

SEQ ID NO: 6600839 - DNA, 15 bp, Homo sapiens
aatttttggagaaat

SEQ ID NO: 6600840 - DNA, 21 bp, Homo sapiens
aatttttggattgacagtaac

SEQ ID NO: 6600841 - DNA, 20 bp, Homo sapiens
aatttttggggaaaaaagca

SEQ ID NO: 6600842 - DNA, 23 bp, Homo sapiens
aatttttggggaaaaaagcacat

SEQ ID NO: 6600843 - DNA, 16 bp, Homo sapiens
aatttttggttgaata

SEQ ID NO: 6600844 - DNA, 20 bp, Homo sapiens
aatttttggtttatgacttt

SEQ ID NO: 6600845 - DNA, 16 bp, Homo sapiens
aatttttgtacattac

SEQ ID NO: 6600846 - DNA, 19 bp, Homo sapiens
aatttttgtacattacact

SEQ ID NO: 6600847 - DNA, 23 bp, Homo sapiens
aatttttgtacttttagtagaga

SEQ ID NO: 6600848 - DNA, 12 bp, Homo sapiens
aatttttgtatt

SEQ ID NO: 6600849 - DNA, 17 bp, Homo sapiens
aatttttgtattatttt

SEQ ID NO: 6600850 - DNA, 13 bp, Homo sapiens
aatttttgtattt

SEQ ID NO: 6600851 - DNA, 15 bp, Homo sapiens
aatttttgtctcaga

SEQ ID NO: 6600852 - DNA, 16 bp, Homo sapiens
aatttttgtttggact

SEQ ID NO: 6600853 - DNA, 19 bp, Homo sapiens
aatttttgtttttgagtac

SEQ ID NO: 6600854 - DNA, 15 bp, Homo sapiens
aattttttaaaaagc

SEQ ID NO: 6600855 - DNA, 15 bp, Homo sapiens
aattttttaaagaat

SEQ ID NO: 6600856 - DNA, 18 bp, Homo sapiens
aattttttaaagaatcca

SEQ ID NO: 6600857 - DNA, 22 bp, Homo sapiens
aattttttaagcaactggaaaa

SEQ ID NO: 6600858 - DNA, 18 bp, Homo sapiens
aattttttagttaaaatc

SEQ ID NO: 6600859 - DNA, 20 bp, Homo sapiens
aattttttatcatgcatgtc

SEQ ID NO: 6600860 - DNA, 17 bp, Homo sapiens
aattttttctcattctg

SEQ ID NO: 6600861 - DNA, 13 bp, Homo sapiens
aattttttgaaac

SEQ ID NO: 6600862 - DNA, 22 bp, Homo sapiens
aattttttgaaacacaatacct

SEQ ID NO: 6600863 - DNA, 17 bp, Homo sapiens
aattttttgaaatgggc

SEQ ID NO: 6600864 - DNA, 18 bp, Homo sapiens
aattttttgaatatgcct

SEQ ID NO: 6600865 - DNA, 21 bp, Homo sapiens
aattttttgatgtcagccttg

SEQ ID NO: 6600866 - DNA, 16 bp, Homo sapiens
aattttttggtacaaa

SEQ ID NO: 6600867 - DNA, 19 bp, Homo sapiens
aattttttgttcttcagag

SEQ ID NO: 6600868 - DNA, 16 bp, Homo sapiens
aatttttttaatgttt

SEQ ID NO: 6600869 - DNA, 17 bp, Homo sapiens
aatttttttaattttgt

SEQ ID NO: 6600870 - DNA, 19 bp, Homo sapiens
aatttttttatactaccaa

SEQ ID NO: 6600871 - DNA, 18 bp, Homo sapiens
aatttttttatgttttgt

SEQ ID NO: 6600872 - DNA, 15 bp, Homo sapiens
aatttttttattact

SEQ ID NO: 6600873 - DNA, 17 bp, Homo sapiens
aatttttttattactga

SEQ ID NO: 6600874 - DNA, 18 bp, Homo sapiens
aatttttttattgtttaa

SEQ ID NO: 6600875 - DNA, 13 bp, Homo sapiens
aatttttttcacc

SEQ ID NO: 6600876 - DNA, 14 bp, Homo sapiens
aatttttttctagt

SEQ ID NO: 6600877 - DNA, 13 bp, Homo sapiens
aatttttttctgc

SEQ ID NO: 6600878 - DNA, 14 bp, Homo sapiens
aatttttttctgca

SEQ ID NO: 6600879 - DNA, 15 bp, Homo sapiens
aatttttttctgcac

SEQ ID NO: 6600880 - DNA, 17 bp, Homo sapiens
aatttttttctgcacag

SEQ ID NO: 6600881 - DNA, 18 bp, Homo sapiens
aatttttttctgcacagc

SEQ ID NO: 6600882 - DNA, 22 bp, Homo sapiens
aatttttttgaaaaaagttcaa

SEQ ID NO: 6600883 - DNA, 17 bp, Homo sapiens
aatttttttgtatgaaa

SEQ ID NO: 6600884 - DNA, 19 bp, Homo sapiens
aatttttttgtatgaaaac

SEQ ID NO: 6600885 - DNA, 17 bp, Homo sapiens
aattttttttaaaaatc

SEQ ID NO: 6600886 - DNA, 18 bp, Homo sapiens
ttttggcctgtgatgttt

SEQ ID NO: 6600887 - DNA, 14 bp, Homo sapiens
ttttggcctgtttg

SEQ ID NO: 6600888 - DNA, 15 bp, Homo sapiens
ttttggcctgtttga

SEQ ID NO: 6600889 - DNA, 15 bp, Homo sapiens
ttttggcctttgtaa

SEQ ID NO: 6600890 - DNA, 19 bp, Homo sapiens
ttttggctcaaataaaatt

SEQ ID NO: 6600891 - DNA, 18 bp, Homo sapiens
ttttggctctttcagaga

SEQ ID NO: 6600892 - DNA, 14 bp, Homo sapiens
ttttggctgacttc

SEQ ID NO: 6600893 - DNA, 20 bp, Homo sapiens
ttttggctgtgacctcttca

SEQ ID NO: 6600894 - DNA, 11 bp, Homo sapiens
ttttgggactt

SEQ ID NO: 6600895 - DNA, 18 bp, Homo sapiens
ttttgggatctaactgtt

SEQ ID NO: 6600896 - DNA, 16 bp, Homo sapiens
ttttggggaaaaaagc

SEQ ID NO: 6600897 - DNA, 17 bp, Homo sapiens
ttttggggaaaaaagca

SEQ ID NO: 6600898 - DNA, 18 bp, Homo sapiens
ttttggggaaaaaagcac

SEQ ID NO: 6600899 - DNA, 18 bp, Homo sapiens
ttttggggaagtgaggaa

SEQ ID NO: 6600900 - DNA, 16 bp, Homo sapiens
ttttggggagccagaa

SEQ ID NO: 6600901 - DNA, 17 bp, Homo sapiens
ttttggggaggaaaaca

SEQ ID NO: 6600902 - DNA, 18 bp, Homo sapiens
ttttggggatatgcttag

SEQ ID NO: 6600903 - DNA, 23 bp, Homo sapiens
ttttggggattttcaaaagataa

SEQ ID NO: 6600904 - DNA, 20 bp, Homo sapiens
ttttgggggtaaagtttgct

SEQ ID NO: 6600905 - DNA, 13 bp, Homo sapiens
ttttggggtgggc

SEQ ID NO: 6600906 - DNA, 23 bp, Homo sapiens
ttttggggttttttttttctgaa

SEQ ID NO: 6600907 - DNA, 13 bp, Homo sapiens
ttttgggtagctg

SEQ ID NO: 6600908 - DNA, 14 bp, Homo sapiens
ttttgggtagctgc

SEQ ID NO: 6600909 - DNA, 18 bp, Homo sapiens
ttttgggtgtttttcatg

SEQ ID NO: 6600910 - DNA, 19 bp, Homo sapiens
ttttggtaaagactggctt

SEQ ID NO: 6600911 - DNA, 16 bp, Homo sapiens
ttttggtacaaaaata

SEQ ID NO: 6600912 - DNA, 19 bp, Homo sapiens
ttttggtacttattactgc

SEQ ID NO: 6600913 - DNA, 19 bp, Homo sapiens
ttttggtataatgtttaaa

SEQ ID NO: 6600914 - DNA, 17 bp, Homo sapiens
ttttggtattacactgt

SEQ ID NO: 6600915 - DNA, 19 bp, Homo sapiens
ttttggtgatgtaaaacag

SEQ ID NO: 6600916 - DNA, 19 bp, Homo sapiens
ttttggtgtgccctgtgtg

SEQ ID NO: 6600917 - DNA, 22 bp, Homo sapiens
ttttggttaagctttgacactg

SEQ ID NO: 6600918 - DNA, 14 bp, Homo sapiens
ttttggttaagttg

SEQ ID NO: 6600919 - DNA, 15 bp, Homo sapiens
ttttggttgaataaa

SEQ ID NO: 6600920 - DNA, 12 bp, Homo sapiens
ttttggttgtat

SEQ ID NO: 6600921 - DNA, 20 bp, Homo sapiens
ttttggttgtattctttgat

SEQ ID NO: 6600922 - DNA, 13 bp, Homo sapiens
ttttggtttctta

SEQ ID NO: 6600923 - DNA, 21 bp, Homo sapiens
ttttggtttcttattcaaaga

SEQ ID NO: 6600924 - DNA, 22 bp, Homo sapiens
ttttggtttgccttttatgtaa

SEQ ID NO: 6600925 - DNA, 23 bp, Homo sapiens
ttttggtttgccttttatgtaaa

SEQ ID NO: 6600926 - DNA, 22 bp, Homo sapiens
ttttggtttttcaacactgaaa

SEQ ID NO: 6600927 - DNA, 22 bp, Homo sapiens
ttttgtaaaaactgaagaattt

SEQ ID NO: 6600928 - DNA, 12 bp, Homo sapiens
ttttgtaaaaag

SEQ ID NO: 6600929 - DNA, 17 bp, Homo sapiens
ttttgtaaaaagaaatt

SEQ ID NO: 6600930 - DNA, 15 bp, Homo sapiens
ttttgtaaaacaatg

SEQ ID NO: 6600931 - DNA, 14 bp, Homo sapiens
ttttgtaaacattt

SEQ ID NO: 6600932 - DNA, 16 bp, Homo sapiens
ttttgtaaacatttat

SEQ ID NO: 6600933 - DNA, 22 bp, Homo sapiens
ttttgtaaaccaaacagacaag

SEQ ID NO: 6600934 - DNA, 14 bp, Homo sapiens
ttttgtaaactttg

SEQ ID NO: 6600935 - DNA, 19 bp, Homo sapiens
ttttgtaaactttgaaata

SEQ ID NO: 6600936 - DNA, 12 bp, Homo sapiens
ttttgtaaagag

SEQ ID NO: 6600937 - DNA, 16 bp, Homo sapiens
ttttgtaaagatttct

SEQ ID NO: 6600938 - DNA, 16 bp, Homo sapiens
ttttgtaaagtaaaat

SEQ ID NO: 6600939 - DNA, 19 bp, Homo sapiens
ttttgtaaatactgcttga

SEQ ID NO: 6600940 - DNA, 19 bp, Homo sapiens
ttttgtaaatctgtacttt

SEQ ID NO: 6600941 - DNA, 21 bp, Homo sapiens
ttttgtaaatgaaacttaaga

SEQ ID NO: 6600942 - DNA, 16 bp, Homo sapiens
ttttgtaaatgagaca

SEQ ID NO: 6600943 - DNA, 17 bp, Homo sapiens
ttttgtaaatgctgtaa

SEQ ID NO: 6600944 - DNA, 20 bp, Homo sapiens
ttttgtaaatgctgtaaata

SEQ ID NO: 6600945 - DNA, 19 bp, Homo sapiens
ttttgtaaatgtactggta

SEQ ID NO: 6600946 - DNA, 23 bp, Homo sapiens
ttttgtaaccatatgattgaaaa

SEQ ID NO: 6600947 - DNA, 11 bp, Homo sapiens
ttttgtaacta

SEQ ID NO: 6600948 - DNA, 19 bp, Homo sapiens
ttttgtaactacaaagctt

SEQ ID NO: 6600949 - DNA, 17 bp, Homo sapiens
ttttgtaagacatttcc

SEQ ID NO: 6600950 - DNA, 22 bp, Homo sapiens
ttttgtaagagtgagctctggt

SEQ ID NO: 6600951 - DNA, 13 bp, Homo sapiens
ttttgtaagataa

SEQ ID NO: 6600952 - DNA, 23 bp, Homo sapiens
ttttgtaagtataagaaatttta

SEQ ID NO: 6600953 - DNA, 17 bp, Homo sapiens
ttttgtaatgcactgtt

SEQ ID NO: 6600954 - DNA, 19 bp, Homo sapiens
ttttgtaatgcactgtttt

SEQ ID NO: 6600955 - DNA, 21 bp, Homo sapiens
ttttgtaatgcactgttttta

SEQ ID NO: 6600956 - DNA, 17 bp, Homo sapiens
ttttgtaatgctgtaca

SEQ ID NO: 6600957 - DNA, 19 bp, Homo sapiens
ttttgtaatgtgaaaagta

SEQ ID NO: 6600958 - DNA, 16 bp, Homo sapiens
ttttgtaattcctcta

SEQ ID NO: 6600959 - DNA, 15 bp, Homo sapiens
ttttgtaattgtgta

SEQ ID NO: 6600960 - DNA, 17 bp, Homo sapiens
ttttgtaattttcttga

SEQ ID NO: 6600961 - DNA, 20 bp, Homo sapiens
ttttgtacaaagtaaaaata

SEQ ID NO: 6600962 - DNA, 19 bp, Homo sapiens
ttttgtacaaagttttcct

SEQ ID NO: 6600963 - DNA, 14 bp, Homo sapiens
ttttgtacagaatt

SEQ ID NO: 6600964 - DNA, 20 bp, Homo sapiens
ttttgtacagaatttttaat

SEQ ID NO: 6600965 - DNA, 19 bp, Homo sapiens
ttttgtacatactgtattt

SEQ ID NO: 6600966 - DNA, 15 bp, Homo sapiens
ttttgtacattatgt

SEQ ID NO: 6600967 - DNA, 23 bp, Homo sapiens
ttttgtaccatattgctcttaaa

SEQ ID NO: 6600968 - DNA, 15 bp, Homo sapiens
ttttgtactgaattt

SEQ ID NO: 6600969 - DNA, 12 bp, Homo sapiens
ttttgtactgta

SEQ ID NO: 6600970 - DNA, 13 bp, Homo sapiens
ttttgtactgtaa

SEQ ID NO: 6600971 - DNA, 14 bp, Homo sapiens
ttttgtagatgaaa

SEQ ID NO: 6600972 - DNA, 14 bp, Homo sapiens
ttttgtagatgcta

SEQ ID NO: 6600973 - DNA, 17 bp, Homo sapiens
ttttgtagcaaccattt

SEQ ID NO: 6600974 - DNA, 19 bp, Homo sapiens
ttttgtagcactgacagat

SEQ ID NO: 6600975 - DNA, 18 bp, Homo sapiens
ttttgtagctgctatata

SEQ ID NO: 6600976 - DNA, 21 bp, Homo sapiens
ttttgtagctggggctttgat

SEQ ID NO: 6600977 - DNA, 22 bp, Homo sapiens
ttttgtaggggtcaaagaaatg

SEQ ID NO: 6600978 - DNA, 23 bp, Homo sapiens
ttttgtaggggtcaaagaaatgc

SEQ ID NO: 6600979 - DNA, 16 bp, Homo sapiens
ttttgtaggtactttt

SEQ ID NO: 6600980 - DNA, 21 bp, Homo sapiens
ttttgtagtagttgatgacca

SEQ ID NO: 6600981 - DNA, 18 bp, Homo sapiens
ttttgtagttttatttgt

SEQ ID NO: 6600982 - DNA, 20 bp, Homo sapiens
ttttgtagttttatttgtat

SEQ ID NO: 6600983 - DNA, 14 bp, Homo sapiens
ttttgtataaaaag

SEQ ID NO: 6600984 - DNA, 16 bp, Homo sapiens
ttttgtataaaaagga

SEQ ID NO: 6600985 - DNA, 17 bp, Homo sapiens
ttttgtataaaatctga

SEQ ID NO: 6600986 - DNA, 16 bp, Homo sapiens
ttttgtataattggat

SEQ ID NO: 6600987 - DNA, 16 bp, Homo sapiens
ttttgtataattgtat

SEQ ID NO: 6600988 - DNA, 19 bp, Homo sapiens
ttttgtatacaaatatatt

SEQ ID NO: 6600989 - DNA, 19 bp, Homo sapiens
ttttgtatacatcctgggt

SEQ ID NO: 6600990 - DNA, 16 bp, Homo sapiens
ttttgtatattgtatt

SEQ ID NO: 6600991 - DNA, 14 bp, Homo sapiens
ttttgtatctacat

SEQ ID NO: 6600992 - DNA, 19 bp, Homo sapiens
ttttgtatctacatctttt

SEQ ID NO: 6600993 - DNA, 14 bp, Homo sapiens
ttttgtatcttcct

SEQ ID NO: 6600994 - DNA, 22 bp, Homo sapiens
ttttgtatctttaaagacttga

SEQ ID NO: 6600995 - DNA, 21 bp, Homo sapiens
ttttgtatgaagtacttttaa

SEQ ID NO: 6600996 - DNA, 21 bp, Homo sapiens
ttttgtatgaggtcctcaggt

SEQ ID NO: 6600997 - DNA, 14 bp, Homo sapiens
ttttgtatgtaaat

SEQ ID NO: 6600998 - DNA, 20 bp, Homo sapiens
ttttgtatgtaaatgtgcat

SEQ ID NO: 6600999 - DNA, 17 bp, Homo sapiens
ttttgtattaacaaagt

SEQ ID NO: 6601000 - DNA, 10 bp, Homo sapiens
ttttgtattt

SEQ ID NO: 6601001 - DNA, 14 bp, Homo sapiens
ttttgtatttcttt

SEQ ID NO: 6601002 - DNA, 18 bp, Homo sapiens
ttttgtatttttaatggg

SEQ ID NO: 6601003 - DNA, 14 bp, Homo sapiens
ttttgtatttttga

SEQ ID NO: 6601004 - DNA, 18 bp, Homo sapiens
ttttgtattttttaaaac

SEQ ID NO: 6601005 - DNA, 15 bp, Homo sapiens
ttttgtcaacattgt

SEQ ID NO: 6601006 - DNA, 14 bp, Homo sapiens
ttttgtcacggaaa

SEQ ID NO: 6601007 - DNA, 17 bp, Homo sapiens
ttttgtcagacttccaa

SEQ ID NO: 6601008 - DNA, 14 bp, Homo sapiens
ttttgtctaattat

SEQ ID NO: 6601009 - DNA, 20 bp, Homo sapiens
ttttgtctaggagatgcttt

SEQ ID NO: 6601010 - DNA, 15 bp, Homo sapiens
ttttgtctcgaaata

SEQ ID NO: 6601011 - DNA, 11 bp, Homo sapiens
ttttgtctctg

SEQ ID NO: 6601012 - DNA, 16 bp, Homo sapiens
ttttgtcttaagtgtt

SEQ ID NO: 6601013 - DNA, 13 bp, Homo sapiens
ttttgtcttgaat

SEQ ID NO: 6601014 - DNA, 15 bp, Homo sapiens
ttttgtcttgcattt

SEQ ID NO: 6601015 - DNA, 17 bp, Homo sapiens
ttttgtctttaaataga

SEQ ID NO: 6601016 - DNA, 17 bp, Homo sapiens
ttttgtcttttaatcca

SEQ ID NO: 6601017 - DNA, 13 bp, Homo sapiens
ttttgtgaaatca

SEQ ID NO: 6601018 - DNA, 13 bp, Homo sapiens
ttttgtgaaattt

SEQ ID NO: 6601019 - DNA, 23 bp, Homo sapiens
ttttgtgaaatttcatgaaaact

SEQ ID NO: 6601020 - DNA, 17 bp, Homo sapiens
ttttgtgaaatttttca

SEQ ID NO: 6601021 - DNA, 22 bp, Homo sapiens
ttttgtgaacacttttgaaaat

SEQ ID NO: 6601022 - DNA, 14 bp, Homo sapiens
ttttgtgaagcaaa

SEQ ID NO: 6601023 - DNA, 14 bp, Homo sapiens
ttttgtgaattagg

SEQ ID NO: 6601024 - DNA, 19 bp, Homo sapiens
ttttgtgacccctttcact

SEQ ID NO: 6601025 - DNA, 21 bp, Homo sapiens
ttttgtgacccctttcactta

SEQ ID NO: 6601026 - DNA, 17 bp, Homo sapiens
ttttgtgagcctctttg

SEQ ID NO: 6601027 - DNA, 12 bp, Homo sapiens
ttttgtgatgaa

SEQ ID NO: 6601028 - DNA, 18 bp, Homo sapiens
ttttgtgatgaataaaat

SEQ ID NO: 6601029 - DNA, 23 bp, Homo sapiens
ttttgtgatgaatctacatttgt

SEQ ID NO: 6601030 - DNA, 19 bp, Homo sapiens
ttttgtgatgatgctgtga

SEQ ID NO: 6601031 - DNA, 21 bp, Homo sapiens
ttttgtgcaaaagcttcaaat

SEQ ID NO: 6601032 - DNA, 12 bp, Homo sapiens
ttttgtgcattc

SEQ ID NO: 6601033 - DNA, 13 bp, Homo sapiens
ttttgtgcatttg

SEQ ID NO: 6601034 - DNA, 22 bp, Homo sapiens
ttttgtgcatttgtaaatgctg

SEQ ID NO: 6601035 - DNA, 23 bp, Homo sapiens
ttttgtgccatgttcaaaagaag

SEQ ID NO: 6601036 - DNA, 22 bp, Homo sapiens
ttttgtgccattatatttgcat

SEQ ID NO: 6601037 - DNA, 22 bp, Homo sapiens
ttttgtgctcaaaataaaaagc

SEQ ID NO: 6601038 - DNA, 15 bp, Homo sapiens
ttttgtgctgcttct

SEQ ID NO: 6601039 - DNA, 23 bp, Homo sapiens
ttttgtggacatgcataaaaatt

SEQ ID NO: 6601040 - DNA, 16 bp, Homo sapiens
ttttgtggaggcagtg

SEQ ID NO: 6601041 - DNA, 18 bp, Homo sapiens
ttttgtggattaaacctt

SEQ ID NO: 6601042 - DNA, 18 bp, Homo sapiens
ttttgtggattgacagta

SEQ ID NO: 6601043 - DNA, 18 bp, Homo sapiens
ttttgtgggcttaattga

SEQ ID NO: 6601044 - DNA, 21 bp, Homo sapiens
ttttgtgggggactgtaagtt

SEQ ID NO: 6601045 - DNA, 16 bp, Homo sapiens
ttttgtggtttggaat

SEQ ID NO: 6601046 - DNA, 18 bp, Homo sapiens
ttttgtgtacagtatgtg

SEQ ID NO: 6601047 - DNA, 10 bp, Homo sapiens
ttttgtgtag

SEQ ID NO: 6601048 - DNA, 13 bp, Homo sapiens
ttttgtgtagaaa

SEQ ID NO: 6601049 - DNA, 22 bp, Homo sapiens
ttttgtgtatattggtgtatat

SEQ ID NO: 6601050 - DNA, 23 bp, Homo sapiens
ttttgtgtatattggtgtatatt

SEQ ID NO: 6601051 - DNA, 11 bp, Homo sapiens
ttttgtgtatg

SEQ ID NO: 6601052 - DNA, 15 bp, Homo sapiens
ttttgtgtatgtact

SEQ ID NO: 6601053 - DNA, 17 bp, Homo sapiens
ttttgtgtatgtactta

SEQ ID NO: 6601054 - DNA, 20 bp, Homo sapiens
ttttgtgtcctccaggagct

SEQ ID NO: 6601055 - DNA, 21 bp, Homo sapiens
ttttgtgtctcttatggatgt

SEQ ID NO: 6601056 - DNA, 17 bp, Homo sapiens
ttttgtgtctggtgcag

SEQ ID NO: 6601057 - DNA, 15 bp, Homo sapiens
ttttgtgtgaaattg

SEQ ID NO: 6601058 - DNA, 20 bp, Homo sapiens
ttttgtgtgaccaactgtgt

SEQ ID NO: 6601059 - DNA, 22 bp, Homo sapiens
ttttgtgtgcctggtagaaact

SEQ ID NO: 6601060 - DNA, 14 bp, Homo sapiens
ttttgtgtgtatat

SEQ ID NO: 6601061 - DNA, 21 bp, Homo sapiens
ttttgtgttcctatggaaaca

SEQ ID NO: 6601062 - DNA, 16 bp, Homo sapiens
ttttgtgttgaagagc

SEQ ID NO: 6601063 - DNA, 16 bp, Homo sapiens
ttttgtgtttgttgta

SEQ ID NO: 6601064 - DNA, 13 bp, Homo sapiens
ttttgttaaagct

SEQ ID NO: 6601065 - DNA, 22 bp, Homo sapiens
ttttgttaaagctggaacattt

SEQ ID NO: 6601066 - DNA, 17 bp, Homo sapiens
ttttgttaacagtattt

SEQ ID NO: 6601067 - DNA, 19 bp, Homo sapiens
ttttgttaagttcaccgta

SEQ ID NO: 6601068 - DNA, 18 bp, Homo sapiens
ttttgttaataataagat

SEQ ID NO: 6601069 - DNA, 12 bp, Homo sapiens
ttttgttaatca

SEQ ID NO: 6601070 - DNA, 17 bp, Homo sapiens
ttttgttaatcatcttc

SEQ ID NO: 6601071 - DNA, 16 bp, Homo sapiens
ttttgttacctttatg

SEQ ID NO: 6601072 - DNA, 10 bp, Homo sapiens
ttttgttact

SEQ ID NO: 6601073 - DNA, 16 bp, Homo sapiens
ttttgttactcttggg

SEQ ID NO: 6601074 - DNA, 11 bp, Homo sapiens
ttttgttactg

SEQ ID NO: 6601075 - DNA, 15 bp, Homo sapiens
ttttgttagcaaaga

SEQ ID NO: 6601076 - DNA, 21 bp, Homo sapiens
ttttgttattaaaaaaacaca

SEQ ID NO: 6601077 - DNA, 15 bp, Homo sapiens
ttttgttattaaaca

SEQ ID NO: 6601078 - DNA, 14 bp, Homo sapiens
ttttgttattccat

SEQ ID NO: 6601079 - DNA, 18 bp, Homo sapiens
ttttgttcaatgttccat

SEQ ID NO: 6601080 - DNA, 17 bp, Homo sapiens
ttttgttcaccttctgt

SEQ ID NO: 6601081 - DNA, 24 bp, Homo sapiens
ttttgttcatttcatcctttcact

SEQ ID NO: 6601082 - DNA, 15 bp, Homo sapiens
ttttgttccaacagt

SEQ ID NO: 6601083 - DNA, 15 bp, Homo sapiens
ttttgttccacttgt

SEQ ID NO: 6601084 - DNA, 14 bp, Homo sapiens
ttttgttcccctcc

SEQ ID NO: 6601085 - DNA, 22 bp, Homo sapiens
ttttgttccctcattctgcatt

SEQ ID NO: 6601086 - DNA, 14 bp, Homo sapiens
ttttgttctctggg

SEQ ID NO: 6601087 - DNA, 15 bp, Homo sapiens
ttttgttctcttctg

SEQ ID NO: 6601088 - DNA, 18 bp, Homo sapiens
ttttgttcttaaaaatgc

SEQ ID NO: 6601089 - DNA, 12 bp, Homo sapiens
ttttgttcttca

SEQ ID NO: 6601090 - DNA, 14 bp, Homo sapiens
ttttgttcttcaga

SEQ ID NO: 6601091 - DNA, 23 bp, Homo sapiens
ttttgttgaaatagctttactgt

SEQ ID NO: 6601092 - DNA, 12 bp, Homo sapiens
ttttgttgacat

SEQ ID NO: 6601093 - DNA, 19 bp, Homo sapiens
ttttgttgacattctgaat

SEQ ID NO: 6601094 - DNA, 14 bp, Homo sapiens
ttttgttgattaaa

SEQ ID NO: 6601095 - DNA, 11 bp, Homo sapiens
ttttgttgcac

SEQ ID NO: 6601096 - DNA, 12 bp, Homo sapiens
ttttgttgcact

SEQ ID NO: 6601097 - DNA, 21 bp, Homo sapiens
ttttgttgcactgaagtttga

SEQ ID NO: 6601098 - DNA, 21 bp, Homo sapiens
ttttgttggcatagctctggg

SEQ ID NO: 6601099 - DNA, 19 bp, Homo sapiens
ttttgttgtaaaaagaaaa

SEQ ID NO: 6601100 - DNA, 13 bp, Homo sapiens
ttttgttgtgtgt

SEQ ID NO: 6601101 - DNA, 15 bp, Homo sapiens
ttttgttgttcctct

SEQ ID NO: 6601102 - DNA, 13 bp, Homo sapiens
ttttgttgtttat

SEQ ID NO: 6601103 - DNA, 16 bp, Homo sapiens
ttttgttgtttcagtg

SEQ ID NO: 6601104 - DNA, 21 bp, Homo sapiens
ttttgttgtttcttaaataag

SEQ ID NO: 6601105 - DNA, 14 bp, Homo sapiens
ttttgtttaatttg

SEQ ID NO: 6601106 - DNA, 18 bp, Homo sapiens
ttttgtttacaacacagt

SEQ ID NO: 6601107 - DNA, 22 bp, Homo sapiens
ttttgtttacaacacagtagtg

SEQ ID NO: 6601108 - DNA, 16 bp, Homo sapiens
ttttgtttaccagaga

SEQ ID NO: 6601109 - DNA, 12 bp, Homo sapiens
ttttgtttcaga

SEQ ID NO: 6601110 - DNA, 16 bp, Homo sapiens
ttttgtttcatcctgt

SEQ ID NO: 6601111 - DNA, 13 bp, Homo sapiens
ttttgtttcatta

SEQ ID NO: 6601112 - DNA, 13 bp, Homo sapiens
ttttgtttccaaa

SEQ ID NO: 6601113 - DNA, 14 bp, Homo sapiens
ttttgtttccatgg

SEQ ID NO: 6601114 - DNA, 13 bp, Homo sapiens
ttttgtttccttt

SEQ ID NO: 6601115 - DNA, 22 bp, Homo sapiens
ttttgtttccttttttcccata

SEQ ID NO: 6601116 - DNA, 15 bp, Homo sapiens
ttttgtttcttccaa

SEQ ID NO: 6601117 - DNA, 15 bp, Homo sapiens
ttttgtttgaatgtt

SEQ ID NO: 6601118 - DNA, 13 bp, Homo sapiens
ttttgtttgctat

SEQ ID NO: 6601119 - DNA, 23 bp, Homo sapiens
ttttgtttggaccaaaaaccagt

SEQ ID NO: 6601120 - DNA, 18 bp, Homo sapiens
ttttgtttggagacgttt

SEQ ID NO: 6601121 - DNA, 21 bp, Homo sapiens
ttttgtttggttatatcgaaa

SEQ ID NO: 6601122 - DNA, 21 bp, Homo sapiens
ttttgtttgtattgtaaaaaa

SEQ ID NO: 6601123 - DNA, 14 bp, Homo sapiens
ttttgtttgtctct

SEQ ID NO: 6601124 - DNA, 20 bp, Homo sapiens
ttttgtttgtctctcctttt

SEQ ID NO: 6601125 - DNA, 16 bp, Homo sapiens
ttttgttttaaggaaa

SEQ ID NO: 6601126 - DNA, 14 bp, Homo sapiens
ttttgttttcatta

SEQ ID NO: 6601127 - DNA, 15 bp, Homo sapiens
ttttgttttcctttt

SEQ ID NO: 6601128 - DNA, 11 bp, Homo sapiens
ttttgttttct

SEQ ID NO: 6601129 - DNA, 14 bp, Homo sapiens
ttttgttttcttca

SEQ ID NO: 6601130 - DNA, 12 bp, Homo sapiens
ttttgttttgca

SEQ ID NO: 6601131 - DNA, 13 bp, Homo sapiens
ttttgttttgctt

SEQ ID NO: 6601132 - DNA, 15 bp, Homo sapiens
ttttgttttggctga

SEQ ID NO: 6601133 - DNA, 14 bp, Homo sapiens
ttttgttttgttct

SEQ ID NO: 6601134 - DNA, 16 bp, Homo sapiens
ttttgtttttgtctta

SEQ ID NO: 6601135 - DNA, 14 bp, Homo sapiens
ttttgttttttaac

SEQ ID NO: 6601136 - DNA, 17 bp, Homo sapiens
ttttgttttttgtaact

SEQ ID NO: 6601137 - DNA, 23 bp, Homo sapiens
ttttgttttttttttaaaaaaga

SEQ ID NO: 6601138 - DNA, 21 bp, Homo sapiens
tttttaaaaaaaactatttaa

SEQ ID NO: 6601139 - DNA, 21 bp, Homo sapiens
tttttaaaaaaagctaaatta

SEQ ID NO: 6601140 - DNA, 21 bp, Homo sapiens
tttttaaaaaaataaaacagt

SEQ ID NO: 6601141 - DNA, 14 bp, Homo sapiens
tttttaaaaaactt

SEQ ID NO: 6601142 - DNA, 18 bp, Homo sapiens
tttttaaaaaagacattt

SEQ ID NO: 6601143 - DNA, 22 bp, Homo sapiens
tttttaaaaaagcttaaaactt

SEQ ID NO: 6601144 - DNA, 15 bp, Homo sapiens
tttttaaaaaggcct

SEQ ID NO: 6601145 - DNA, 17 bp, Homo sapiens
tttttaaaaaggccttt

SEQ ID NO: 6601146 - DNA, 18 bp, Homo sapiens
tttttaaaaagtactctt

SEQ ID NO: 6601147 - DNA, 23 bp, Homo sapiens
tttttaaaagaaaaaaaccaaag

SEQ ID NO: 6601148 - DNA, 21 bp, Homo sapiens
tttttaaaagccttccagttt

SEQ ID NO: 6601149 - DNA, 12 bp, Homo sapiens
tttttaaaaggt

SEQ ID NO: 6601150 - DNA, 11 bp, Homo sapiens
tttttaaaagt

SEQ ID NO: 6601151 - DNA, 19 bp, Homo sapiens
tttttaaaagtttcaatgt

SEQ ID NO: 6601152 - DNA, 18 bp, Homo sapiens
tttttaaaataaaaatat

SEQ ID NO: 6601153 - DNA, 16 bp, Homo sapiens
tttttaaaataaaata

SEQ ID NO: 6601154 - DNA, 22 bp, Homo sapiens
tttttaaaataaactgtaaact

SEQ ID NO: 6601155 - DNA, 14 bp, Homo sapiens
tttttaaaatactt

SEQ ID NO: 6601156 - DNA, 23 bp, Homo sapiens
tttttaaaatagaaattttgtaa

SEQ ID NO: 6601157 - DNA, 15 bp, Homo sapiens
tttttaaaatagaca

SEQ ID NO: 6601158 - DNA, 18 bp, Homo sapiens
tttttaaaatatatgtat

SEQ ID NO: 6601159 - DNA, 19 bp, Homo sapiens
tttttaaaatatttaactt

SEQ ID NO: 6601160 - DNA, 14 bp, Homo sapiens
tttttaaaatggtg

SEQ ID NO: 6601161 - DNA, 19 bp, Homo sapiens
tttttaaaatgtcaagaca

SEQ ID NO: 6601162 - DNA, 15 bp, Homo sapiens
tttttaaacagggtc

SEQ ID NO: 6601163 - DNA, 17 bp, Homo sapiens
tttttaaactgtacagt

SEQ ID NO: 6601164 - DNA, 19 bp, Homo sapiens
tttttaaactgtacagtgt

SEQ ID NO: 6601165 - DNA, 23 bp, Homo sapiens
tttttaaacttcagttttactgc

SEQ ID NO: 6601166 - DNA, 18 bp, Homo sapiens
tttttaaacttgaaatat

SEQ ID NO: 6601167 - DNA, 22 bp, Homo sapiens
tttttaaagaaaagttcttaaa

SEQ ID NO: 6601168 - DNA, 20 bp, Homo sapiens
tttttaaagaaaagttttgt

SEQ ID NO: 6601169 - DNA, 17 bp, Homo sapiens
tttttaaagacagagtc

SEQ ID NO: 6601170 - DNA, 12 bp, Homo sapiens
tttttaaagact

SEQ ID NO: 6601171 - DNA, 13 bp, Homo sapiens
tttttaaagacta

SEQ ID NO: 6601172 - DNA, 13 bp, Homo sapiens
tttttaaagactt

SEQ ID NO: 6601173 - DNA, 14 bp, Homo sapiens
tttttaaagcaaat

SEQ ID NO: 6601174 - DNA, 14 bp, Homo sapiens
tttttaaagcaagt

SEQ ID NO: 6601175 - DNA, 16 bp, Homo sapiens
tttttaaagcaagtca

SEQ ID NO: 6601176 - DNA, 15 bp, Homo sapiens
tttttaaagctacaa

SEQ ID NO: 6601177 - DNA, 21 bp, Homo sapiens
tttttaaaggggtctgttctg

SEQ ID NO: 6601178 - DNA, 20 bp, Homo sapiens
tttttaaaggtagagatgtg

SEQ ID NO: 6601179 - DNA, 14 bp, Homo sapiens
tttttaaagtactt

SEQ ID NO: 6601180 - DNA, 12 bp, Homo sapiens
tttttaaagtct

SEQ ID NO: 6601181 - DNA, 18 bp, Homo sapiens
tttttaaagttactttgt

SEQ ID NO: 6601182 - DNA, 12 bp, Homo sapiens
tttttaaagttt

SEQ ID NO: 6601183 - DNA, 14 bp, Homo sapiens
tttttaaagtttaa

SEQ ID NO: 6601184 - DNA, 13 bp, Homo sapiens
tttttaaagtttt

SEQ ID NO: 6601185 - DNA, 18 bp, Homo sapiens
tttttaaataaaatagag

SEQ ID NO: 6601186 - DNA, 13 bp, Homo sapiens
tttttaaatagag

SEQ ID NO: 6601187 - DNA, 17 bp, Homo sapiens
tttttaaatattatgct

SEQ ID NO: 6601188 - DNA, 17 bp, Homo sapiens
tttttaaatgaaaatgt

SEQ ID NO: 6601189 - DNA, 18 bp, Homo sapiens
tttttaaatgatcatgaa

SEQ ID NO: 6601190 - DNA, 16 bp, Homo sapiens
tttttaaatgattcca

SEQ ID NO: 6601191 - DNA, 19 bp, Homo sapiens
tttttaaatgattccaaat

SEQ ID NO: 6601192 - DNA, 17 bp, Homo sapiens
tttttaaatgtgcttca

SEQ ID NO: 6601193 - DNA, 14 bp, Homo sapiens
tttttaaattaaat

SEQ ID NO: 6601194 - DNA, 12 bp, Homo sapiens
tttttaaattac

SEQ ID NO: 6601195 - DNA, 12 bp, Homo sapiens
tttttaaattat

SEQ ID NO: 6601196 - DNA, 13 bp, Homo sapiens
tttttaaattgtt

SEQ ID NO: 6601197 - DNA, 14 bp, Homo sapiens
tttttaaattgttt

SEQ ID NO: 6601198 - DNA, 12 bp, Homo sapiens
tttttaaatttg

SEQ ID NO: 6601199 - DNA, 12 bp, Homo sapiens
tttttaaatttt

SEQ ID NO: 6601200 - DNA, 19 bp, Homo sapiens
tttttaacaaaaaacagat

SEQ ID NO: 6601201 - DNA, 22 bp, Homo sapiens
tttttaacaaaaaacagattct

SEQ ID NO: 6601202 - DNA, 22 bp, Homo sapiens
tttttaacaagtcatttcaaaa

SEQ ID NO: 6601203 - DNA, 20 bp, Homo sapiens
tttttaacactagaaaacat

SEQ ID NO: 6601204 - DNA, 16 bp, Homo sapiens
tttttaacacttaaat

SEQ ID NO: 6601205 - DNA, 15 bp, Homo sapiens
tttttaacagcatgt

SEQ ID NO: 6601206 - DNA, 21 bp, Homo sapiens
tttttaacatagtaacgtgtt

SEQ ID NO: 6601207 - DNA, 18 bp, Homo sapiens
tttttaacatgtgttaaa

SEQ ID NO: 6601208 - DNA, 20 bp, Homo sapiens
tttttaaccaaataagaata

SEQ ID NO: 6601209 - DNA, 19 bp, Homo sapiens
tttttaaccccgtcaacaa

SEQ ID NO: 6601210 - DNA, 21 bp, Homo sapiens
tttttaacctatgttacacca

SEQ ID NO: 6601211 - DNA, 23 bp, Homo sapiens
tttttaaccttccaagactgaag

SEQ ID NO: 6601212 - DNA, 17 bp, Homo sapiens
tttttaacgtggcttgt

SEQ ID NO: 6601213 - DNA, 16 bp, Homo sapiens
tttttaactactgtat

SEQ ID NO: 6601214 - DNA, 17 bp, Homo sapiens
tttttaactactgtatt

SEQ ID NO: 6601215 - DNA, 22 bp, Homo sapiens
tttttaactcaatattttccat

SEQ ID NO: 6601216 - DNA, 22 bp, Homo sapiens
tttttaactctactgtgtaata

SEQ ID NO: 6601217 - DNA, 14 bp, Homo sapiens
tttttaactggtga

SEQ ID NO: 6601218 - DNA, 19 bp, Homo sapiens
tttttaacttatctccagc

SEQ ID NO: 6601219 - DNA, 21 bp, Homo sapiens
tttttaactttaccatgctca

SEQ ID NO: 6601220 - DNA, 22 bp, Homo sapiens
tttttaactttgtggtaacttc

SEQ ID NO: 6601221 - DNA, 13 bp, Homo sapiens
tttttaagaaaaa

SEQ ID NO: 6601222 - DNA, 20 bp, Homo sapiens
tttttaagaaaaattcacaa

SEQ ID NO: 6601223 - DNA, 13 bp, Homo sapiens
tttttaagaaagt

SEQ ID NO: 6601224 - DNA, 20 bp, Homo sapiens
tttttaagaacttcattttt

SEQ ID NO: 6601225 - DNA, 11 bp, Homo sapiens
tttttaagact

SEQ ID NO: 6601226 - DNA, 13 bp, Homo sapiens
tttttaagacttt

SEQ ID NO: 6601227 - DNA, 15 bp, Homo sapiens
tttttaagatagtgt

SEQ ID NO: 6601228 - DNA, 13 bp, Homo sapiens
tttttaagatttt

SEQ ID NO: 6601229 - DNA, 15 bp, Homo sapiens
tttttaagcctttga

SEQ ID NO: 6601230 - DNA, 20 bp, Homo sapiens
tttttaagctgcaaatctga

SEQ ID NO: 6601231 - DNA, 14 bp, Homo sapiens
tttttaagctgtaa

SEQ ID NO: 6601232 - DNA, 16 bp, Homo sapiens
tttttaagcttcagtt

SEQ ID NO: 6601233 - DNA, 23 bp, Homo sapiens
tttttaagggttatcttagatgt

SEQ ID NO: 6601234 - DNA, 20 bp, Homo sapiens
tttttaaggtgagttctcac

SEQ ID NO: 6601235 - DNA, 21 bp, Homo sapiens
tttttaaggtgagttctcact

SEQ ID NO: 6601236 - DNA, 21 bp, Homo sapiens
tttttaagtaatgtggaagaa

SEQ ID NO: 6601237 - DNA, 14 bp, Homo sapiens
tttttaagtctttt

SEQ ID NO: 6601238 - DNA, 13 bp, Homo sapiens
tttttaagtgcaa

SEQ ID NO: 6601239 - DNA, 18 bp, Homo sapiens
tttttaagtgcaacattt

SEQ ID NO: 6601240 - DNA, 19 bp, Homo sapiens
tttttaagtgctatgcata

SEQ ID NO: 6601241 - DNA, 20 bp, Homo sapiens
tttttaagtgctatgcatat

SEQ ID NO: 6601242 - DNA, 21 bp, Homo sapiens
tttttaagtgctatgcatatt

SEQ ID NO: 6601243 - DNA, 18 bp, Homo sapiens
tttttaagtgctgcattt

SEQ ID NO: 6601244 - DNA, 19 bp, Homo sapiens
tttttaagtgctgcattta

SEQ ID NO: 6601245 - DNA, 22 bp, Homo sapiens
tttttaagtgctgcatttaaaa

SEQ ID NO: 6601246 - DNA, 18 bp, Homo sapiens
aattttttttaacattcc

SEQ ID NO: 6601247 - DNA, 19 bp, Homo sapiens
aattttttttaacattcct

SEQ ID NO: 6601248 - DNA, 20 bp, Homo sapiens
aattttttttagtatttatt

SEQ ID NO: 6601249 - DNA, 20 bp, Homo sapiens
aattttttttattagtattg

SEQ ID NO: 6601250 - DNA, 13 bp, Homo sapiens
aattttttttcat

SEQ ID NO: 6601251 - DNA, 16 bp, Homo sapiens
aattttttttccgtaa

SEQ ID NO: 6601252 - DNA, 19 bp, Homo sapiens
aattttttttctgaatttt

SEQ ID NO: 6601253 - DNA, 23 bp, Homo sapiens
aattttttttgttgtttcagtga

SEQ ID NO: 6601254 - DNA, 19 bp, Homo sapiens
aatttttttttaaatttta

SEQ ID NO: 6601255 - DNA, 16 bp, Homo sapiens
aatttttttttctctt

SEQ ID NO: 6601256 - DNA, 15 bp, Homo sapiens
aatttttttttgtaa

SEQ ID NO: 6601257 - DNA, 23 bp, Homo sapiens
aattttttttttcctcttcagaa

SEQ ID NO: 6601258 - DNA, 20 bp, Homo sapiens
aattttttttttttaacttt

SEQ ID NO: 6601259 - DNA, 22 bp, Homo sapiens
acaaaaaaaaaatagagagaga

SEQ ID NO: 6601260 - DNA, 17 bp, Homo sapiens
acaaaaaaaaagtttta

SEQ ID NO: 6601261 - DNA, 21 bp, Homo sapiens
acaaaaaaaaagttttatttt

SEQ ID NO: 6601262 - DNA, 22 bp, Homo sapiens
acaaaaaaaaagttttattttt

SEQ ID NO: 6601263 - DNA, 14 bp, Homo sapiens
acaaaaaaaacaac

SEQ ID NO: 6601264 - DNA, 15 bp, Homo sapiens
acaaaaaaaatttta

SEQ ID NO: 6601265 - DNA, 12 bp, Homo sapiens
acaaaaaaacta

SEQ ID NO: 6601266 - DNA, 23 bp, Homo sapiens
acaaaaaaactataaaaaagaaa

SEQ ID NO: 6601267 - DNA, 12 bp, Homo sapiens
acaaaaaaagac

SEQ ID NO: 6601268 - DNA, 17 bp, Homo sapiens
acaaaaaaataataaaa

SEQ ID NO: 6601269 - DNA, 13 bp, Homo sapiens
acaaaaaaatata

SEQ ID NO: 6601270 - DNA, 20 bp, Homo sapiens
acaaaaaaatatatttaatg

SEQ ID NO: 6601271 - DNA, 16 bp, Homo sapiens
acaaaaaaatctgcag

SEQ ID NO: 6601272 - DNA, 14 bp, Homo sapiens
acaaaaaaatcttc

SEQ ID NO: 6601273 - DNA, 19 bp, Homo sapiens
acaaaaaaatcttccaatt

SEQ ID NO: 6601274 - DNA, 14 bp, Homo sapiens
acaaaaaaccacaa

SEQ ID NO: 6601275 - DNA, 17 bp, Homo sapiens
acaaaaaacgaatgaaa

SEQ ID NO: 6601276 - DNA, 15 bp, Homo sapiens
acaaaaaagttataa

SEQ ID NO: 6601277 - DNA, 20 bp, Homo sapiens
acaaaaaagttataagaaaa

SEQ ID NO: 6601278 - DNA, 21 bp, Homo sapiens
acaaaaaagttataagaaaac

SEQ ID NO: 6601279 - DNA, 13 bp, Homo sapiens
acaaaaaagttta

SEQ ID NO: 6601280 - DNA, 16 bp, Homo sapiens
acaaaaaataaagaat

SEQ ID NO: 6601281 - DNA, 21 bp, Homo sapiens
acaaaaaatattcatctgttg

SEQ ID NO: 6601282 - DNA, 14 bp, Homo sapiens
acaaaaaatgtaat

SEQ ID NO: 6601283 - DNA, 14 bp, Homo sapiens
acaaaaacaaaaca

SEQ ID NO: 6601284 - DNA, 15 bp, Homo sapiens
acaaaaacaaaacaa

SEQ ID NO: 6601285 - DNA, 16 bp, Homo sapiens
acaaaaacaaaacaaa

SEQ ID NO: 6601286 - DNA, 16 bp, Homo sapiens
acaaaaacaaaaccag

SEQ ID NO: 6601287 - DNA, 15 bp, Homo sapiens
acaaaaacacagcaa

SEQ ID NO: 6601288 - DNA, 18 bp, Homo sapiens
acaaaaacagaatttgag

SEQ ID NO: 6601289 - DNA, 13 bp, Homo sapiens
acaaaaacatggc

SEQ ID NO: 6601290 - DNA, 19 bp, Homo sapiens
acaaaaactttccatgaca

SEQ ID NO: 6601291 - DNA, 13 bp, Homo sapiens
acaaaaagaagag

SEQ ID NO: 6601292 - DNA, 15 bp, Homo sapiens
acaaaaagacaaaca

SEQ ID NO: 6601293 - DNA, 12 bp, Homo sapiens
acaaaaagacac

SEQ ID NO: 6601294 - DNA, 16 bp, Homo sapiens
acaaaaagacacttga

SEQ ID NO: 6601295 - DNA, 16 bp, Homo sapiens
acaaaaagatgtctca

SEQ ID NO: 6601296 - DNA, 12 bp, Homo sapiens
acaaaaagcaca

SEQ ID NO: 6601297 - DNA, 14 bp, Homo sapiens
acaaaaagcacaag

SEQ ID NO: 6601298 - DNA, 16 bp, Homo sapiens
acaaaaagcataaaaa

SEQ ID NO: 6601299 - DNA, 19 bp, Homo sapiens
acaaaaagctaataccagt

SEQ ID NO: 6601300 - DNA, 16 bp, Homo sapiens
acaaaaagctacttat

SEQ ID NO: 6601301 - DNA, 20 bp, Homo sapiens
acaaaaaggcaaatattgaa

SEQ ID NO: 6601302 - DNA, 22 bp, Homo sapiens
acaaaaaggtaaaactttttat

SEQ ID NO: 6601303 - DNA, 13 bp, Homo sapiens
acaaaaaggtgct

SEQ ID NO: 6601304 - DNA, 20 bp, Homo sapiens
acaaaaaggttctcaggtgt

SEQ ID NO: 6601305 - DNA, 15 bp, Homo sapiens
acaaaaagtaaaaat

SEQ ID NO: 6601306 - DNA, 22 bp, Homo sapiens
acaaaaagtaaagtaatgcatt

SEQ ID NO: 6601307 - DNA, 12 bp, Homo sapiens
acaaaaataaat

SEQ ID NO: 6601308 - DNA, 12 bp, Homo sapiens
acaaaaataaca

SEQ ID NO: 6601309 - DNA, 19 bp, Homo sapiens
acaaaaataacactgttgg

SEQ ID NO: 6601310 - DNA, 12 bp, Homo sapiens
acaaaaataata

SEQ ID NO: 6601311 - DNA, 13 bp, Homo sapiens
acaaaaatacaat

SEQ ID NO: 6601312 - DNA, 16 bp, Homo sapiens
acaaaaatactcagat

SEQ ID NO: 6601313 - DNA, 14 bp, Homo sapiens
acaaaaatagaata

SEQ ID NO: 6601314 - DNA, 17 bp, Homo sapiens
acaaaaatagaatatat

SEQ ID NO: 6601315 - DNA, 18 bp, Homo sapiens
acaaaaatcagccagaca

SEQ ID NO: 6601316 - DNA, 23 bp, Homo sapiens
acaaaaatgaactgaagtttcac

SEQ ID NO: 6601317 - DNA, 17 bp, Homo sapiens
acaaaaatgtttccact

SEQ ID NO: 6601318 - DNA, 14 bp, Homo sapiens
acaaaaattatgca

SEQ ID NO: 6601319 - DNA, 19 bp, Homo sapiens
acaaaaattctcagttctc

SEQ ID NO: 6601320 - DNA, 14 bp, Homo sapiens
acaaaaattgaata

SEQ ID NO: 6601321 - DNA, 15 bp, Homo sapiens
acaaaaattgactca

SEQ ID NO: 6601322 - DNA, 14 bp, Homo sapiens
acaaaaattgtctt

SEQ ID NO: 6601323 - DNA, 12 bp, Homo sapiens
acaaaacaaaaa

SEQ ID NO: 6601324 - DNA, 12 bp, Homo sapiens
acaaaacaaaac

SEQ ID NO: 6601325 - DNA, 15 bp, Homo sapiens
acaaaacaaaacaaa

SEQ ID NO: 6601326 - DNA, 15 bp, Homo sapiens
acaaaacaaacaaac

SEQ ID NO: 6601327 - DNA, 23 bp, Homo sapiens
acaaaacaaacaacctgccacaa

SEQ ID NO: 6601328 - DNA, 17 bp, Homo sapiens
acaaaacaaacacacac

SEQ ID NO: 6601329 - DNA, 13 bp, Homo sapiens
acaaaacaaactt

SEQ ID NO: 6601330 - DNA, 15 bp, Homo sapiens
acaaaacaacaaaaa

SEQ ID NO: 6601331 - DNA, 13 bp, Homo sapiens
acaaaacaacaac

SEQ ID NO: 6601332 - DNA, 16 bp, Homo sapiens
acaaaacaacaacaat

SEQ ID NO: 6601333 - DNA, 12 bp, Homo sapiens
acaaaacaacag

SEQ ID NO: 6601334 - DNA, 18 bp, Homo sapiens
acaaaacaacagcaacaa

SEQ ID NO: 6601335 - DNA, 21 bp, Homo sapiens
acaaaacaacagcaacaacaa

SEQ ID NO: 6601336 - DNA, 23 bp, Homo sapiens
acaaaacactcggcatttcaaat

SEQ ID NO: 6601337 - DNA, 18 bp, Homo sapiens
acaaaacatattttacat

SEQ ID NO: 6601338 - DNA, 18 bp, Homo sapiens
acaaaaccaattcatgaa

SEQ ID NO: 6601339 - DNA, 19 bp, Homo sapiens
acaaaaccccccagatatc

SEQ ID NO: 6601340 - DNA, 20 bp, Homo sapiens
acaaaaccccccagatatca

SEQ ID NO: 6601341 - DNA, 19 bp, Homo sapiens
acaaaaccctcagcactgt

SEQ ID NO: 6601342 - DNA, 21 bp, Homo sapiens
acaaaacctaacttgcgcaga

SEQ ID NO: 6601343 - DNA, 20 bp, Homo sapiens
acaaaacctatttttccttt

SEQ ID NO: 6601344 - DNA, 18 bp, Homo sapiens
acaaaacgagtctttcat

SEQ ID NO: 6601345 - DNA, 23 bp, Homo sapiens
acaaaactacatgagaacaaaca

SEQ ID NO: 6601346 - DNA, 20 bp, Homo sapiens
acaaaactacttttctaaaa

SEQ ID NO: 6601347 - DNA, 16 bp, Homo sapiens
acaaaactagagactc

SEQ ID NO: 6601348 - DNA, 17 bp, Homo sapiens
acaaaactatacttgaa

SEQ ID NO: 6601349 - DNA, 21 bp, Homo sapiens
acaaaactatcctatgccttc

SEQ ID NO: 6601350 - DNA, 22 bp, Homo sapiens
acaaaactggaactgttgttga

SEQ ID NO: 6601351 - DNA, 14 bp, Homo sapiens
acaaaactgtgaat

SEQ ID NO: 6601352 - DNA, 20 bp, Homo sapiens
acaaaactgttcttttgcat

SEQ ID NO: 6601353 - DNA, 20 bp, Homo sapiens
acaaaacttaaaagtattca

SEQ ID NO: 6601354 - DNA, 23 bp, Homo sapiens
acaaaacttaaaagtattcatac

SEQ ID NO: 6601355 - DNA, 21 bp, Homo sapiens
acaaaacttagcatctaattt

SEQ ID NO: 6601356 - DNA, 12 bp, Homo sapiens
acaaaacttctt

SEQ ID NO: 6601357 - DNA, 19 bp, Homo sapiens
acaaaacttcttgtcagac

SEQ ID NO: 6601358 - DNA, 20 bp, Homo sapiens
acaaaacttcttgtcagaca

SEQ ID NO: 6601359 - DNA, 13 bp, Homo sapiens
acaaaagaaaaaa

SEQ ID NO: 6601360 - DNA, 15 bp, Homo sapiens
acaaaagaaaagact

SEQ ID NO: 6601361 - DNA, 20 bp, Homo sapiens
acaaaagaaaagacttgtaa

SEQ ID NO: 6601362 - DNA, 18 bp, Homo sapiens
acaaaagaaataccttga

SEQ ID NO: 6601363 - DNA, 10 bp, Homo sapiens
acaaaagaag

SEQ ID NO: 6601364 - DNA, 20 bp, Homo sapiens
acaaaagaagaaataaataa

SEQ ID NO: 6601365 - DNA, 23 bp, Homo sapiens
acaaaagaagcccggctcctggt

SEQ ID NO: 6601366 - DNA, 21 bp, Homo sapiens
acaaaagagcagcatttttaa

SEQ ID NO: 6601367 - DNA, 22 bp, Homo sapiens
acaaaagagcatggatgcattt

SEQ ID NO: 6601368 - DNA, 24 bp, Homo sapiens
acaaaagagcatggatgcatttca

SEQ ID NO: 6601369 - DNA, 13 bp, Homo sapiens
acaaaagatgaaa

SEQ ID NO: 6601370 - DNA, 15 bp, Homo sapiens
acaaaagattatgta

SEQ ID NO: 6601371 - DNA, 23 bp, Homo sapiens
acaaaagcaaaatttttaaaact

SEQ ID NO: 6601372 - DNA, 17 bp, Homo sapiens
acaaaagcaaagtgaag

SEQ ID NO: 6601373 - DNA, 12 bp, Homo sapiens
acaaaagcagat

SEQ ID NO: 6601374 - DNA, 13 bp, Homo sapiens
acaaaagcagata

SEQ ID NO: 6601375 - DNA, 22 bp, Homo sapiens
acaaaagcttgtgtatcttgat

SEQ ID NO: 6601376 - DNA, 15 bp, Homo sapiens
acaaaagctttgaat

SEQ ID NO: 6601377 - DNA, 17 bp, Homo sapiens
acaaaagctttttaaaa

SEQ ID NO: 6601378 - DNA, 19 bp, Homo sapiens
acaaaaggaagactggaga

SEQ ID NO: 6601379 - DNA, 18 bp, Homo sapiens
acaaaaggataatgaata

SEQ ID NO: 6601380 - DNA, 17 bp, Homo sapiens
acaaaaggcagcccttt

SEQ ID NO: 6601381 - DNA, 12 bp, Homo sapiens
acaaaaggctgg

SEQ ID NO: 6601382 - DNA, 16 bp, Homo sapiens
acaaaagggagaacat

SEQ ID NO: 6601383 - DNA, 15 bp, Homo sapiens
acaaaagggccaggt

SEQ ID NO: 6601384 - DNA, 15 bp, Homo sapiens
acaaaagggtgtata

SEQ ID NO: 6601385 - DNA, 16 bp, Homo sapiens
acaaaagggtgtatag

SEQ ID NO: 6601386 - DNA, 21 bp, Homo sapiens
acaaaagggtttaaactgatt

SEQ ID NO: 6601387 - DNA, 14 bp, Homo sapiens
acaaaagtaaatgg

SEQ ID NO: 6601388 - DNA, 14 bp, Homo sapiens
acaaaagtacattg

SEQ ID NO: 6601389 - DNA, 16 bp, Homo sapiens
acaaaagtacattgct

SEQ ID NO: 6601390 - DNA, 18 bp, Homo sapiens
acaaaagtacattgctta

SEQ ID NO: 6601391 - DNA, 15 bp, Homo sapiens
acaaaagtctgtctt

SEQ ID NO: 6601392 - DNA, 19 bp, Homo sapiens
acaaaagtgacagatgtta

SEQ ID NO: 6601393 - DNA, 17 bp, Homo sapiens
acaaaagttaatgaata

SEQ ID NO: 6601394 - DNA, 18 bp, Homo sapiens
acaaaagttttaattaaa

SEQ ID NO: 6601395 - DNA, 15 bp, Homo sapiens
acaaaataaaactgt

SEQ ID NO: 6601396 - DNA, 12 bp, Homo sapiens
acaaaataaaca

SEQ ID NO: 6601397 - DNA, 15 bp, Homo sapiens
acaaaataaagctgt

SEQ ID NO: 6601398 - DNA, 15 bp, Homo sapiens
acaaaataacatttg

SEQ ID NO: 6601399 - DNA, 13 bp, Homo sapiens
acaaaataattta

SEQ ID NO: 6601400 - DNA, 19 bp, Homo sapiens
acaaaatacaatcctgttt

SEQ ID NO: 6601401 - DNA, 14 bp, Homo sapiens
acaaaatataaatc

SEQ ID NO: 6601402 - DNA, 15 bp, Homo sapiens
acaaaatataaatca

SEQ ID NO: 6601403 - DNA, 18 bp, Homo sapiens
acaaaatatataatggtt

SEQ ID NO: 6601404 - DNA, 16 bp, Homo sapiens
acaaaatattgaaagg

SEQ ID NO: 6601405 - DNA, 22 bp, Homo sapiens
acaaaatatttaagtgaaggag

SEQ ID NO: 6601406 - DNA, 19 bp, Homo sapiens
acaaaatatttctaagctt

SEQ ID NO: 6601407 - DNA, 15 bp, Homo sapiens
acaaaatcacaagca

SEQ ID NO: 6601408 - DNA, 20 bp, Homo sapiens
acaaaatccagctatgaata

SEQ ID NO: 6601409 - DNA, 23 bp, Homo sapiens
acaaaatccatgtgaccattctg

SEQ ID NO: 6601410 - DNA, 19 bp, Homo sapiens
acaaaatccattccaggta

SEQ ID NO: 6601411 - DNA, 19 bp, Homo sapiens
acaaaatcgattggcttta

SEQ ID NO: 6601412 - DNA, 16 bp, Homo sapiens
acaaaatctaaaacaa

SEQ ID NO: 6601413 - DNA, 22 bp, Homo sapiens
acaaaatctaaaacaaaatctg

SEQ ID NO: 6601414 - DNA, 13 bp, Homo sapiens
acaaaatgaagtt

SEQ ID NO: 6601415 - DNA, 12 bp, Homo sapiens
acaaaatgaatt

SEQ ID NO: 6601416 - DNA, 21 bp, Homo sapiens
acaaaatgacattttgccaaa

SEQ ID NO: 6601417 - DNA, 18 bp, Homo sapiens
acaaaatgactggctcct

SEQ ID NO: 6601418 - DNA, 11 bp, Homo sapiens
acaaaatgcaa

SEQ ID NO: 6601419 - DNA, 16 bp, Homo sapiens
acaaaatgcaaacttt

SEQ ID NO: 6601420 - DNA, 15 bp, Homo sapiens
acaaaatggaattca

SEQ ID NO: 6601421 - DNA, 22 bp, Homo sapiens
acaaaatggaattcattctggt

SEQ ID NO: 6601422 - DNA, 21 bp, Homo sapiens
acaaaatgggcccttgcctct

SEQ ID NO: 6601423 - DNA, 16 bp, Homo sapiens
acaaaatggtcctatt

SEQ ID NO: 6601424 - DNA, 12 bp, Homo sapiens
acaaaatgtaac

SEQ ID NO: 6601425 - DNA, 13 bp, Homo sapiens
acaaaatgtaact

SEQ ID NO: 6601426 - DNA, 16 bp, Homo sapiens
acaaaatgtagaatat

SEQ ID NO: 6601427 - DNA, 17 bp, Homo sapiens
tttttaagtgggctcct

SEQ ID NO: 6601428 - DNA, 21 bp, Homo sapiens
tttttaagtgggctcctgaca

SEQ ID NO: 6601429 - DNA, 18 bp, Homo sapiens
tttttaagttaatagatt

SEQ ID NO: 6601430 - DNA, 16 bp, Homo sapiens
tttttaagttcaattg

SEQ ID NO: 6601431 - DNA, 13 bp, Homo sapiens
tttttaatagaac

SEQ ID NO: 6601432 - DNA, 14 bp, Homo sapiens
tttttaataggatt

SEQ ID NO: 6601433 - DNA, 23 bp, Homo sapiens
tttttaatagtcattccaaatat

SEQ ID NO: 6601434 - DNA, 13 bp, Homo sapiens
tttttaatcatga

SEQ ID NO: 6601435 - DNA, 15 bp, Homo sapiens
tttttaatcatgaaa

SEQ ID NO: 6601436 - DNA, 17 bp, Homo sapiens
tttttaatcatgaatat

SEQ ID NO: 6601437 - DNA, 19 bp, Homo sapiens
tttttaatccgccaatatt

SEQ ID NO: 6601438 - DNA, 22 bp, Homo sapiens
tttttaatctactgcatttagg

SEQ ID NO: 6601439 - DNA, 13 bp, Homo sapiens
tttttaatctcca

SEQ ID NO: 6601440 - DNA, 13 bp, Homo sapiens
tttttaatctcct

SEQ ID NO: 6601441 - DNA, 13 bp, Homo sapiens
tttttaatcttta

SEQ ID NO: 6601442 - DNA, 19 bp, Homo sapiens
tttttaatgactttttata

SEQ ID NO: 6601443 - DNA, 24 bp, Homo sapiens
tttttaatggcaataatgactaaa

SEQ ID NO: 6601444 - DNA, 19 bp, Homo sapiens
tttttaatggcagcagaaa

SEQ ID NO: 6601445 - DNA, 22 bp, Homo sapiens
tttttaatggcagcagaaaact

SEQ ID NO: 6601446 - DNA, 14 bp, Homo sapiens
tttttaatgtatct

SEQ ID NO: 6601447 - DNA, 14 bp, Homo sapiens
tttttaatgtattc

SEQ ID NO: 6601448 - DNA, 17 bp, Homo sapiens
tttttaatgtattccct

SEQ ID NO: 6601449 - DNA, 17 bp, Homo sapiens
tttttaatgtgctgtgt

SEQ ID NO: 6601450 - DNA, 19 bp, Homo sapiens
tttttaatgtgctgtgtaa

SEQ ID NO: 6601451 - DNA, 21 bp, Homo sapiens
tttttaatgtgctgtgtaaag

SEQ ID NO: 6601452 - DNA, 14 bp, Homo sapiens
tttttaattcatat

SEQ ID NO: 6601453 - DNA, 14 bp, Homo sapiens
tttttaattctctg

SEQ ID NO: 6601454 - DNA, 18 bp, Homo sapiens
tttttaattgttgtttct

SEQ ID NO: 6601455 - DNA, 20 bp, Homo sapiens
tttttaattgttgtttcttt

SEQ ID NO: 6601456 - DNA, 16 bp, Homo sapiens
tttttaatttacttgt

SEQ ID NO: 6601457 - DNA, 14 bp, Homo sapiens
tttttaatttatga

SEQ ID NO: 6601458 - DNA, 16 bp, Homo sapiens
tttttaatttcctgtg

SEQ ID NO: 6601459 - DNA, 19 bp, Homo sapiens
tttttaatttcctgtgagg

SEQ ID NO: 6601460 - DNA, 16 bp, Homo sapiens
tttttaatttctaaga

SEQ ID NO: 6601461 - DNA, 16 bp, Homo sapiens
tttttaattttaacat

SEQ ID NO: 6601462 - DNA, 19 bp, Homo sapiens
tttttaattttgatataca

SEQ ID NO: 6601463 - DNA, 19 bp, Homo sapiens
tttttaattttgtgttgct

SEQ ID NO: 6601464 - DNA, 18 bp, Homo sapiens
tttttacaaataaagatg

SEQ ID NO: 6601465 - DNA, 18 bp, Homo sapiens
tttttacaagttttaaat

SEQ ID NO: 6601466 - DNA, 17 bp, Homo sapiens
tttttacaatgtaatta

SEQ ID NO: 6601467 - DNA, 19 bp, Homo sapiens
tttttacactttatggtaa

SEQ ID NO: 6601468 - DNA, 12 bp, Homo sapiens
tttttacagaaa

SEQ ID NO: 6601469 - DNA, 22 bp, Homo sapiens
tttttacagcattgtctttgct

SEQ ID NO: 6601470 - DNA, 21 bp, Homo sapiens
tttttacatagttgagattgt

SEQ ID NO: 6601471 - DNA, 16 bp, Homo sapiens
tttttacatggagaaa

SEQ ID NO: 6601472 - DNA, 18 bp, Homo sapiens
tttttacattatgcaaat

SEQ ID NO: 6601473 - DNA, 18 bp, Homo sapiens
tttttacattttcctgtg

SEQ ID NO: 6601474 - DNA, 17 bp, Homo sapiens
tttttaccaattccaat

SEQ ID NO: 6601475 - DNA, 20 bp, Homo sapiens
tttttacccatttgttcata

SEQ ID NO: 6601476 - DNA, 19 bp, Homo sapiens
tttttaccgttcacttccc

SEQ ID NO: 6601477 - DNA, 17 bp, Homo sapiens
tttttacctgtcacatt

SEQ ID NO: 6601478 - DNA, 14 bp, Homo sapiens
tttttacggaattc

SEQ ID NO: 6601479 - DNA, 21 bp, Homo sapiens
tttttacgtaaacctgaaata

SEQ ID NO: 6601480 - DNA, 22 bp, Homo sapiens
tttttacgtttgaagacattgc

SEQ ID NO: 6601481 - DNA, 19 bp, Homo sapiens
tttttactaagttttcaaa

SEQ ID NO: 6601482 - DNA, 20 bp, Homo sapiens
tttttactaagttttcaaat

SEQ ID NO: 6601483 - DNA, 16 bp, Homo sapiens
tttttactacagttgt

SEQ ID NO: 6601484 - DNA, 21 bp, Homo sapiens
tttttactcagtgactgttgt

SEQ ID NO: 6601485 - DNA, 15 bp, Homo sapiens
tttttactgctctga

SEQ ID NO: 6601486 - DNA, 15 bp, Homo sapiens
tttttactgtatgtt

SEQ ID NO: 6601487 - DNA, 11 bp, Homo sapiens
tttttactgtg

SEQ ID NO: 6601488 - DNA, 14 bp, Homo sapiens
tttttacttatata

SEQ ID NO: 6601489 - DNA, 14 bp, Homo sapiens
tttttacttatgcc

SEQ ID NO: 6601490 - DNA, 15 bp, Homo sapiens
tttttacttgaatca

SEQ ID NO: 6601491 - DNA, 12 bp, Homo sapiens
tttttagaaagc

SEQ ID NO: 6601492 - DNA, 20 bp, Homo sapiens
tttttagaaagcatttgaat

SEQ ID NO: 6601493 - DNA, 18 bp, Homo sapiens
tttttagaataagaattt

SEQ ID NO: 6601494 - DNA, 23 bp, Homo sapiens
tttttagaataagaatttgcata

SEQ ID NO: 6601495 - DNA, 22 bp, Homo sapiens
tttttagacagagtctcactgt

SEQ ID NO: 6601496 - DNA, 16 bp, Homo sapiens
tttttagactatttct

SEQ ID NO: 6601497 - DNA, 16 bp, Homo sapiens
tttttagagcattaaa

SEQ ID NO: 6601498 - DNA, 18 bp, Homo sapiens
tttttagagcttccaaat

SEQ ID NO: 6601499 - DNA, 21 bp, Homo sapiens
tttttagatcaaatactttaa

SEQ ID NO: 6601500 - DNA, 20 bp, Homo sapiens
tttttagatgaccaaaactt

SEQ ID NO: 6601501 - DNA, 20 bp, Homo sapiens
tttttagatggttacactgt

SEQ ID NO: 6601502 - DNA, 14 bp, Homo sapiens
tttttagattccta

SEQ ID NO: 6601503 - DNA, 21 bp, Homo sapiens
tttttagctttgtgtttactt

SEQ ID NO: 6601504 - DNA, 16 bp, Homo sapiens
tttttaggaaaagcat

SEQ ID NO: 6601505 - DNA, 13 bp, Homo sapiens
tttttaggaaatg

SEQ ID NO: 6601506 - DNA, 15 bp, Homo sapiens
tttttaggacatctt

SEQ ID NO: 6601507 - DNA, 13 bp, Homo sapiens
tttttagtaatct

SEQ ID NO: 6601508 - DNA, 23 bp, Homo sapiens
tttttagtatttatttatgtact

SEQ ID NO: 6601509 - DNA, 13 bp, Homo sapiens
tttttagtctttt

SEQ ID NO: 6601510 - DNA, 17 bp, Homo sapiens
tttttagtcttttactc

SEQ ID NO: 6601511 - DNA, 21 bp, Homo sapiens
tttttagtgcatccagttaac

SEQ ID NO: 6601512 - DNA, 21 bp, Homo sapiens
tttttagtggaagcttctaaa

SEQ ID NO: 6601513 - DNA, 18 bp, Homo sapiens
tttttagttcaatacagt

SEQ ID NO: 6601514 - DNA, 12 bp, Homo sapiens
tttttagttgaa

SEQ ID NO: 6601515 - DNA, 13 bp, Homo sapiens
tttttataaaact

SEQ ID NO: 6601516 - DNA, 21 bp, Homo sapiens
tttttataaagtctaagcaag

SEQ ID NO: 6601517 - DNA, 13 bp, Homo sapiens
tttttataactaa

SEQ ID NO: 6601518 - DNA, 13 bp, Homo sapiens
tttttataatatt

SEQ ID NO: 6601519 - DNA, 22 bp, Homo sapiens
tttttataatgtggatttccta

SEQ ID NO: 6601520 - DNA, 18 bp, Homo sapiens
tttttataatgttattca

SEQ ID NO: 6601521 - DNA, 12 bp, Homo sapiens
tttttataatta

SEQ ID NO: 6601522 - DNA, 18 bp, Homo sapiens
tttttataattgtacaaa

SEQ ID NO: 6601523 - DNA, 23 bp, Homo sapiens
tttttataattgtacaaaattaa

SEQ ID NO: 6601524 - DNA, 18 bp, Homo sapiens
tttttataattttatctg

SEQ ID NO: 6601525 - DNA, 13 bp, Homo sapiens
tttttatacacaa

SEQ ID NO: 6601526 - DNA, 17 bp, Homo sapiens
tttttatacactgtaag

SEQ ID NO: 6601527 - DNA, 17 bp, Homo sapiens
tttttatacaggggaat

SEQ ID NO: 6601528 - DNA, 14 bp, Homo sapiens
tttttatacagtga

SEQ ID NO: 6601529 - DNA, 12 bp, Homo sapiens
tttttatacata

SEQ ID NO: 6601530 - DNA, 23 bp, Homo sapiens
tttttatacataaacaagaccac

SEQ ID NO: 6601531 - DNA, 20 bp, Homo sapiens
tttttatacatatcagaaaa

SEQ ID NO: 6601532 - DNA, 23 bp, Homo sapiens
tttttatacctgtacacacacag

SEQ ID NO: 6601533 - DNA, 21 bp, Homo sapiens
tttttatacctgtttaaattg

SEQ ID NO: 6601534 - DNA, 23 bp, Homo sapiens
tttttatacggaaaaaattgtat

SEQ ID NO: 6601535 - DNA, 21 bp, Homo sapiens
tttttatactccatacataac

SEQ ID NO: 6601536 - DNA, 23 bp, Homo sapiens
tttttatactgcacagtggcaca

SEQ ID NO: 6601537 - DNA, 15 bp, Homo sapiens
tttttatactttatt

SEQ ID NO: 6601538 - DNA, 13 bp, Homo sapiens
tttttataggttt

SEQ ID NO: 6601539 - DNA, 16 bp, Homo sapiens
tttttatagttattaa

SEQ ID NO: 6601540 - DNA, 21 bp, Homo sapiens
tttttatataagttaaagaga

SEQ ID NO: 6601541 - DNA, 18 bp, Homo sapiens
tttttatatagcttgaaa

SEQ ID NO: 6601542 - DNA, 14 bp, Homo sapiens
tttttatatataca

SEQ ID NO: 6601543 - DNA, 17 bp, Homo sapiens
tttttatatatatgcat

SEQ ID NO: 6601544 - DNA, 14 bp, Homo sapiens
tttttatatatgaa

SEQ ID NO: 6601545 - DNA, 15 bp, Homo sapiens
tttttatatatgtgt

SEQ ID NO: 6601546 - DNA, 14 bp, Homo sapiens
tttttatatcttgg

SEQ ID NO: 6601547 - DNA, 16 bp, Homo sapiens
tttttatatgaaataa

SEQ ID NO: 6601548 - DNA, 20 bp, Homo sapiens
tttttatattacttttgtaa

SEQ ID NO: 6601549 - DNA, 17 bp, Homo sapiens
tttttatattagttgct

SEQ ID NO: 6601550 - DNA, 21 bp, Homo sapiens
tttttatattctcagcagagt

SEQ ID NO: 6601551 - DNA, 14 bp, Homo sapiens
tttttatattgcct

SEQ ID NO: 6601552 - DNA, 19 bp, Homo sapiens
tttttatatttgaaatatt

SEQ ID NO: 6601553 - DNA, 18 bp, Homo sapiens
tttttatattttatactg

SEQ ID NO: 6601554 - DNA, 12 bp, Homo sapiens
tttttatcatgt

SEQ ID NO: 6601555 - DNA, 22 bp, Homo sapiens
tttttatctatataaaataact

SEQ ID NO: 6601556 - DNA, 22 bp, Homo sapiens
tttttatctggttctatatgaa

SEQ ID NO: 6601557 - DNA, 14 bp, Homo sapiens
tttttatcttgagt

SEQ ID NO: 6601558 - DNA, 17 bp, Homo sapiens
tttttatcttgggactg

SEQ ID NO: 6601559 - DNA, 14 bp, Homo sapiens
tttttatctttata

SEQ ID NO: 6601560 - DNA, 13 bp, Homo sapiens
tttttatcttttc

SEQ ID NO: 6601561 - DNA, 17 bp, Homo sapiens
tttttatcttttctaca

SEQ ID NO: 6601562 - DNA, 21 bp, Homo sapiens
tttttatcttttctacagcaa

SEQ ID NO: 6601563 - DNA, 14 bp, Homo sapiens
tttttatcttttta

SEQ ID NO: 6601564 - DNA, 14 bp, Homo sapiens
tttttatgaactgc

SEQ ID NO: 6601565 - DNA, 19 bp, Homo sapiens
tttttatgaagaaaaagta

SEQ ID NO: 6601566 - DNA, 13 bp, Homo sapiens
tttttatgaggca

SEQ ID NO: 6601567 - DNA, 13 bp, Homo sapiens
tttttatgcaaaa

SEQ ID NO: 6601568 - DNA, 15 bp, Homo sapiens
tttttatgcagacag

SEQ ID NO: 6601569 - DNA, 16 bp, Homo sapiens
tttttatgctatttct

SEQ ID NO: 6601570 - DNA, 22 bp, Homo sapiens
tttttatggcttttgtgcatta

SEQ ID NO: 6601571 - DNA, 23 bp, Homo sapiens
tttttatgggtgaaaataagaca

SEQ ID NO: 6601572 - DNA, 13 bp, Homo sapiens
tttttatgtacaa

SEQ ID NO: 6601573 - DNA, 16 bp, Homo sapiens
tttttatgtattgttt

SEQ ID NO: 6601574 - DNA, 17 bp, Homo sapiens
tttttatgtctcttaga

SEQ ID NO: 6601575 - DNA, 14 bp, Homo sapiens
tttttatgtgctat

SEQ ID NO: 6601576 - DNA, 14 bp, Homo sapiens
tttttattaattta

SEQ ID NO: 6601577 - DNA, 23 bp, Homo sapiens
tttttattaattttagtttttca

SEQ ID NO: 6601578 - DNA, 14 bp, Homo sapiens
tttttattactttt

SEQ ID NO: 6601579 - DNA, 18 bp, Homo sapiens
tttttattagtattgttg

SEQ ID NO: 6601580 - DNA, 15 bp, Homo sapiens
tttttattatgcata

SEQ ID NO: 6601581 - DNA, 15 bp, Homo sapiens
tttttattatgcatt

SEQ ID NO: 6601582 - DNA, 11 bp, Homo sapiens
tttttattatt

SEQ ID NO: 6601583 - DNA, 22 bp, Homo sapiens
tttttattattatttatttgat

SEQ ID NO: 6601584 - DNA, 14 bp, Homo sapiens
tttttattatttgt

SEQ ID NO: 6601585 - DNA, 17 bp, Homo sapiens
tttttattcatgtgaag

SEQ ID NO: 6601586 - DNA, 17 bp, Homo sapiens
tttttattccctgccca

SEQ ID NO: 6601587 - DNA, 12 bp, Homo sapiens
tttttattgatg

SEQ ID NO: 6601588 - DNA, 13 bp, Homo sapiens
tttttattgatgt

SEQ ID NO: 6601589 - DNA, 14 bp, Homo sapiens
tttttattgcattt

SEQ ID NO: 6601590 - DNA, 12 bp, Homo sapiens
tttttattgcta

SEQ ID NO: 6601591 - DNA, 18 bp, Homo sapiens
tttttattgctagtattt

SEQ ID NO: 6601592 - DNA, 22 bp, Homo sapiens
tttttattgctagtatttgaat

SEQ ID NO: 6601593 - DNA, 13 bp, Homo sapiens
tttttattgtaaa

SEQ ID NO: 6601594 - DNA, 12 bp, Homo sapiens
tttttattgttg

SEQ ID NO: 6601595 - DNA, 13 bp, Homo sapiens
tttttatttaatt

SEQ ID NO: 6601596 - DNA, 12 bp, Homo sapiens
tttttatttcct

SEQ ID NO: 6601597 - DNA, 15 bp, Homo sapiens
tttttatttctactg

SEQ ID NO: 6601598 - DNA, 14 bp, Homo sapiens
tttttatttctcct

SEQ ID NO: 6601599 - DNA, 21 bp, Homo sapiens
tttttatttcttttgtgcaga

SEQ ID NO: 6601600 - DNA, 19 bp, Homo sapiens
tttttattttcttatgtaa

SEQ ID NO: 6601601 - DNA, 19 bp, Homo sapiens
tttttcaaaaattacacta

SEQ ID NO: 6601602 - DNA, 13 bp, Homo sapiens
tttttcaaaagaa

SEQ ID NO: 6601603 - DNA, 20 bp, Homo sapiens
tttttcaaaatagaaaagtt

SEQ ID NO: 6601604 - DNA, 21 bp, Homo sapiens
tttttcaaaatcaaagttatg

SEQ ID NO: 6601605 - DNA, 21 bp, Homo sapiens
tttttcaaaatccaaaaagaa

SEQ ID NO: 6601606 - DNA, 21 bp, Homo sapiens
tttttcaaatattgaatgcct

SEQ ID NO: 6601607 - DNA, 22 bp, Homo sapiens
acaaaatgtagggttataataa

SEQ ID NO: 6601608 - DNA, 16 bp, Homo sapiens
acaaaatgtctcagtt

SEQ ID NO: 6601609 - DNA, 12 bp, Homo sapiens
acaaaatgtgac

SEQ ID NO: 6601610 - DNA, 23 bp, Homo sapiens
acaaaatgtgtgcttggaaaatg

SEQ ID NO: 6601611 - DNA, 18 bp, Homo sapiens
acaaaattaatacattct

SEQ ID NO: 6601612 - DNA, 18 bp, Homo sapiens
acaaaattagaaaggaca

SEQ ID NO: 6601613 - DNA, 16 bp, Homo sapiens
acaaaattatgctgca

SEQ ID NO: 6601614 - DNA, 21 bp, Homo sapiens
acaaaattatgctgcatttgg

SEQ ID NO: 6601615 - DNA, 16 bp, Homo sapiens
acaaaattctttctgg

SEQ ID NO: 6601616 - DNA, 15 bp, Homo sapiens
acaaaattgacagct

SEQ ID NO: 6601617 - DNA, 19 bp, Homo sapiens
acaaaattgtaagccagag

SEQ ID NO: 6601618 - DNA, 23 bp, Homo sapiens
acaaaattgtaagccagagtcaa

SEQ ID NO: 6601619 - DNA, 21 bp, Homo sapiens
acaaaatttaattgtgtaact

SEQ ID NO: 6601620 - DNA, 12 bp, Homo sapiens
acaaaatttatg

SEQ ID NO: 6601621 - DNA, 22 bp, Homo sapiens
acaaaatttatgtcattttcag

SEQ ID NO: 6601622 - DNA, 18 bp, Homo sapiens
acaaaatttcacagttct

SEQ ID NO: 6601623 - DNA, 19 bp, Homo sapiens
acaaaatttcacagttctg

SEQ ID NO: 6601624 - DNA, 14 bp, Homo sapiens
acaaaatttctatt

SEQ ID NO: 6601625 - DNA, 12 bp, Homo sapiens
acaaaatttgag

SEQ ID NO: 6601626 - DNA, 13 bp, Homo sapiens
acaaaatttgaga

SEQ ID NO: 6601627 - DNA, 15 bp, Homo sapiens
acaaacaaaaaaaag

SEQ ID NO: 6601628 - DNA, 23 bp, Homo sapiens
acaaacaaaaaatacaataaata

SEQ ID NO: 6601629 - DNA, 13 bp, Homo sapiens
acaaacaaaactt

SEQ ID NO: 6601630 - DNA, 11 bp, Homo sapiens
acaaacaaaag

SEQ ID NO: 6601631 - DNA, 13 bp, Homo sapiens
acaaacaaaagca

SEQ ID NO: 6601632 - DNA, 14 bp, Homo sapiens
acaaacaaacaaaa

SEQ ID NO: 6601633 - DNA, 15 bp, Homo sapiens
acaaacaaacaaaaa

SEQ ID NO: 6601634 - DNA, 15 bp, Homo sapiens
acaaacaaacaaact

SEQ ID NO: 6601635 - DNA, 13 bp, Homo sapiens
acaaacaaacaag

SEQ ID NO: 6601636 - DNA, 14 bp, Homo sapiens
acaaacaaacaagc

SEQ ID NO: 6601637 - DNA, 12 bp, Homo sapiens
acaaacaaattt

SEQ ID NO: 6601638 - DNA, 21 bp, Homo sapiens
acaaacaaccccccatcacaa

SEQ ID NO: 6601639 - DNA, 21 bp, Homo sapiens
acaaacaagtggatgttttta

SEQ ID NO: 6601640 - DNA, 14 bp, Homo sapiens
acaaacaataagaa

SEQ ID NO: 6601641 - DNA, 14 bp, Homo sapiens
acaaacaatacctg

SEQ ID NO: 6601642 - DNA, 20 bp, Homo sapiens
acaaacaatatgatttgctg

SEQ ID NO: 6601643 - DNA, 14 bp, Homo sapiens
acaaacaatctctt

SEQ ID NO: 6601644 - DNA, 12 bp, Homo sapiens
acaaacacacac

SEQ ID NO: 6601645 - DNA, 16 bp, Homo sapiens
acaaacacacacacta

SEQ ID NO: 6601646 - DNA, 14 bp, Homo sapiens
acaaacacacctct

SEQ ID NO: 6601647 - DNA, 20 bp, Homo sapiens
acaaacacatgggggagaga

SEQ ID NO: 6601648 - DNA, 19 bp, Homo sapiens
acaaacacattgttatttt

SEQ ID NO: 6601649 - DNA, 17 bp, Homo sapiens
acaaacaccatcttcag

SEQ ID NO: 6601650 - DNA, 23 bp, Homo sapiens
acaaacactacagacaataaata

SEQ ID NO: 6601651 - DNA, 14 bp, Homo sapiens
acaaacactgaatc

SEQ ID NO: 6601652 - DNA, 12 bp, Homo sapiens
acaaacactgcc

SEQ ID NO: 6601653 - DNA, 14 bp, Homo sapiens
acaaacactgccat

SEQ ID NO: 6601654 - DNA, 22 bp, Homo sapiens
acaaacactgccatattgtgta

SEQ ID NO: 6601655 - DNA, 16 bp, Homo sapiens
acaaacagcccttcct

SEQ ID NO: 6601656 - DNA, 21 bp, Homo sapiens
acaaacaggaatgtctggagt

SEQ ID NO: 6601657 - DNA, 12 bp, Homo sapiens
acaaacagtgaa

SEQ ID NO: 6601658 - DNA, 14 bp, Homo sapiens
acaaacatagacag

SEQ ID NO: 6601659 - DNA, 15 bp, Homo sapiens
acaaacatagacaga

SEQ ID NO: 6601660 - DNA, 21 bp, Homo sapiens
acaaacatagacagatgtgga

SEQ ID NO: 6601661 - DNA, 23 bp, Homo sapiens
acaaacatagacagatgtggaca

SEQ ID NO: 6601662 - DNA, 22 bp, Homo sapiens
acaaacatatttgttaaatatt

SEQ ID NO: 6601663 - DNA, 22 bp, Homo sapiens
acaaacatctaataagtatata

SEQ ID NO: 6601664 - DNA, 12 bp, Homo sapiens
acaaacatgaaa

SEQ ID NO: 6601665 - DNA, 14 bp, Homo sapiens
acaaacatgaaaaa

SEQ ID NO: 6601666 - DNA, 22 bp, Homo sapiens
acaaacatggatacttcctggg

SEQ ID NO: 6601667 - DNA, 17 bp, Homo sapiens
acaaacattgctgcctt

SEQ ID NO: 6601668 - DNA, 18 bp, Homo sapiens
acaaacattgctgccttt

SEQ ID NO: 6601669 - DNA, 12 bp, Homo sapiens
acaaacattgtg

SEQ ID NO: 6601670 - DNA, 16 bp, Homo sapiens
acaaacattgtgttga

SEQ ID NO: 6601671 - DNA, 19 bp, Homo sapiens
acaaacattgtgttgacat

SEQ ID NO: 6601672 - DNA, 21 bp, Homo sapiens
acaaacatttcacttctccaa

SEQ ID NO: 6601673 - DNA, 22 bp, Homo sapiens
acaaacatttgaagacccttgt

SEQ ID NO: 6601674 - DNA, 14 bp, Homo sapiens
acaaacatttttca

SEQ ID NO: 6601675 - DNA, 15 bp, Homo sapiens
acaaacatttttcaa

SEQ ID NO: 6601676 - DNA, 12 bp, Homo sapiens
acaaaccaagtc

SEQ ID NO: 6601677 - DNA, 19 bp, Homo sapiens
acaaaccacaactgacaca

SEQ ID NO: 6601678 - DNA, 17 bp, Homo sapiens
acaaaccaccaggactg

SEQ ID NO: 6601679 - DNA, 21 bp, Homo sapiens
acaaaccaccctaaaatgaca

SEQ ID NO: 6601680 - DNA, 17 bp, Homo sapiens
acaaaccactgtacata

SEQ ID NO: 6601681 - DNA, 12 bp, Homo sapiens
acaaaccagcct

SEQ ID NO: 6601682 - DNA, 13 bp, Homo sapiens
acaaaccaggtca

SEQ ID NO: 6601683 - DNA, 13 bp, Homo sapiens
acaaaccatctgg

SEQ ID NO: 6601684 - DNA, 16 bp, Homo sapiens
acaaaccatctggtgc

SEQ ID NO: 6601685 - DNA, 16 bp, Homo sapiens
acaaaccatttccaac

SEQ ID NO: 6601686 - DNA, 23 bp, Homo sapiens
acaaaccctgctgaacacagtgt

SEQ ID NO: 6601687 - DNA, 15 bp, Homo sapiens
acaaaccctggggac

SEQ ID NO: 6601688 - DNA, 18 bp, Homo sapiens
acaaaccctttaaatggg

SEQ ID NO: 6601689 - DNA, 13 bp, Homo sapiens
acaaacctagctt

SEQ ID NO: 6601690 - DNA, 17 bp, Homo sapiens
acaaacctctatatgtt

SEQ ID NO: 6601691 - DNA, 23 bp, Homo sapiens
acaaaccttcttttcaatgcaat

SEQ ID NO: 6601692 - DNA, 17 bp, Homo sapiens
acaaacgcattaagagg

SEQ ID NO: 6601693 - DNA, 14 bp, Homo sapiens
acaaacggagcccc

SEQ ID NO: 6601694 - DNA, 15 bp, Homo sapiens
acaaacgggctcagc

SEQ ID NO: 6601695 - DNA, 19 bp, Homo sapiens
acaaacgtatggaatgctt

SEQ ID NO: 6601696 - DNA, 21 bp, Homo sapiens
acaaacgtatgtaaatgtata

SEQ ID NO: 6601697 - DNA, 18 bp, Homo sapiens
acaaacgtgttttttaaa

SEQ ID NO: 6601698 - DNA, 12 bp, Homo sapiens
acaaactaaaaa

SEQ ID NO: 6601699 - DNA, 15 bp, Homo sapiens
acaaactaaacttta

SEQ ID NO: 6601700 - DNA, 16 bp, Homo sapiens
acaaactaaatgtagt

SEQ ID NO: 6601701 - DNA, 14 bp, Homo sapiens
acaaactagaaaag

SEQ ID NO: 6601702 - DNA, 15 bp, Homo sapiens
acaaactatttcaga

SEQ ID NO: 6601703 - DNA, 21 bp, Homo sapiens
acaaactatttcagaatattt

SEQ ID NO: 6601704 - DNA, 20 bp, Homo sapiens
acaaactcaccatctgtgca

SEQ ID NO: 6601705 - DNA, 19 bp, Homo sapiens
acaaactcatcctctttta

SEQ ID NO: 6601706 - DNA, 15 bp, Homo sapiens
acaaactccaggctg

SEQ ID NO: 6601707 - DNA, 21 bp, Homo sapiens
acaaactcgttttttacaaag

SEQ ID NO: 6601708 - DNA, 20 bp, Homo sapiens
acaaactctactaattttta

SEQ ID NO: 6601709 - DNA, 17 bp, Homo sapiens
acaaactgaaaaatcta

SEQ ID NO: 6601710 - DNA, 16 bp, Homo sapiens
acaaactgaagataat

SEQ ID NO: 6601711 - DNA, 10 bp, Homo sapiens
acaaactgca

SEQ ID NO: 6601712 - DNA, 11 bp, Homo sapiens
acaaactgcaa

SEQ ID NO: 6601713 - DNA, 23 bp, Homo sapiens
acaaactgcacatgatttcacaa

SEQ ID NO: 6601714 - DNA, 13 bp, Homo sapiens
acaaactgcagct

SEQ ID NO: 6601715 - DNA, 16 bp, Homo sapiens
acaaactgcagctgtg

SEQ ID NO: 6601716 - DNA, 19 bp, Homo sapiens
acaaactgcggtatacatt

SEQ ID NO: 6601717 - DNA, 14 bp, Homo sapiens
acaaactggagtct

SEQ ID NO: 6601718 - DNA, 17 bp, Homo sapiens
acaaactgtaatacaat

SEQ ID NO: 6601719 - DNA, 19 bp, Homo sapiens
acaaactgtaatacaatga

SEQ ID NO: 6601720 - DNA, 15 bp, Homo sapiens
acaaactgtgtaact

SEQ ID NO: 6601721 - DNA, 16 bp, Homo sapiens
acaaactgtgtacata

SEQ ID NO: 6601722 - DNA, 10 bp, Homo sapiens
acaaacttcc

SEQ ID NO: 6601723 - DNA, 20 bp, Homo sapiens
acaaacttctcgcaactgaa

SEQ ID NO: 6601724 - DNA, 12 bp, Homo sapiens
acaaactttgtt

SEQ ID NO: 6601725 - DNA, 21 bp, Homo sapiens
acaaacttttaagatttctct

SEQ ID NO: 6601726 - DNA, 15 bp, Homo sapiens
acaaacttttataaa

SEQ ID NO: 6601727 - DNA, 16 bp, Homo sapiens
acaaacttttataaat

SEQ ID NO: 6601728 - DNA, 10 bp, Homo sapiens
acaaagaaaa

SEQ ID NO: 6601729 - DNA, 11 bp, Homo sapiens
acaaagaaaaa

SEQ ID NO: 6601730 - DNA, 18 bp, Homo sapiens
acaaagaaaaaaatatat

SEQ ID NO: 6601731 - DNA, 14 bp, Homo sapiens
acaaagaaaaatta

SEQ ID NO: 6601732 - DNA, 11 bp, Homo sapiens
acaaagaaaat

SEQ ID NO: 6601733 - DNA, 19 bp, Homo sapiens
acaaagaaaatgagaatct

SEQ ID NO: 6601734 - DNA, 23 bp, Homo sapiens
acaaagaaactttttaataaagt

SEQ ID NO: 6601735 - DNA, 12 bp, Homo sapiens
acaaagaaatat

SEQ ID NO: 6601736 - DNA, 12 bp, Homo sapiens
acaaagaaatta

SEQ ID NO: 6601737 - DNA, 14 bp, Homo sapiens
acaaagaaattatg

SEQ ID NO: 6601738 - DNA, 19 bp, Homo sapiens
acaaagaaccatgcaggaa

SEQ ID NO: 6601739 - DNA, 21 bp, Homo sapiens
acaaagaacggcatgtgaatt

SEQ ID NO: 6601740 - DNA, 20 bp, Homo sapiens
acaaagaacttgctgctgcc

SEQ ID NO: 6601741 - DNA, 16 bp, Homo sapiens
acaaagaagacatgtt

SEQ ID NO: 6601742 - DNA, 19 bp, Homo sapiens
acaaagaagacatgtttta

SEQ ID NO: 6601743 - DNA, 21 bp, Homo sapiens
acaaagaagaccacaaatagt

SEQ ID NO: 6601744 - DNA, 22 bp, Homo sapiens
acaaagaagattcttaccaaga

SEQ ID NO: 6601745 - DNA, 12 bp, Homo sapiens
acaaagaaggaa

SEQ ID NO: 6601746 - DNA, 14 bp, Homo sapiens
acaaagaaggaaaa

SEQ ID NO: 6601747 - DNA, 15 bp, Homo sapiens
acaaagaaggaaaag

SEQ ID NO: 6601748 - DNA, 16 bp, Homo sapiens
acaaagaaggaaaaga

SEQ ID NO: 6601749 - DNA, 17 bp, Homo sapiens
acaaagacacaggaaga

SEQ ID NO: 6601750 - DNA, 12 bp, Homo sapiens
acaaagacagcc

SEQ ID NO: 6601751 - DNA, 12 bp, Homo sapiens
acaaagacaggg

SEQ ID NO: 6601752 - DNA, 13 bp, Homo sapiens
acaaagacatgga

SEQ ID NO: 6601753 - DNA, 19 bp, Homo sapiens
acaaagaccaatgtgaaga

SEQ ID NO: 6601754 - DNA, 13 bp, Homo sapiens
acaaagactcctc

SEQ ID NO: 6601755 - DNA, 13 bp, Homo sapiens
acaaagactgagt

SEQ ID NO: 6601756 - DNA, 16 bp, Homo sapiens
acaaagagaataaaga

SEQ ID NO: 6601757 - DNA, 23 bp, Homo sapiens
acaaagagaataaagacttcatg

SEQ ID NO: 6601758 - DNA, 12 bp, Homo sapiens
acaaagagctga

SEQ ID NO: 6601759 - DNA, 23 bp, Homo sapiens
acaaagagttctggaaaagaact

SEQ ID NO: 6601760 - DNA, 16 bp, Homo sapiens
acaaagataacgcagg

SEQ ID NO: 6601761 - DNA, 19 bp, Homo sapiens
acaaagataacgcaggaga

SEQ ID NO: 6601762 - DNA, 23 bp, Homo sapiens
acaaagataagacttgtttcttt

SEQ ID NO: 6601763 - DNA, 19 bp, Homo sapiens
acaaagatacttgatgcac

SEQ ID NO: 6601764 - DNA, 14 bp, Homo sapiens
acaaagatatcttt

SEQ ID NO: 6601765 - DNA, 21 bp, Homo sapiens
acaaagatatcttttctttag

SEQ ID NO: 6601766 - DNA, 14 bp, Homo sapiens
acaaagatattatt

SEQ ID NO: 6601767 - DNA, 21 bp, Homo sapiens
acaaagatgggtgaaggctgg

SEQ ID NO: 6601768 - DNA, 22 bp, Homo sapiens
acaaagatgggtgaaggctggc

SEQ ID NO: 6601769 - DNA, 18 bp, Homo sapiens
acaaagattgagaagcca

SEQ ID NO: 6601770 - DNA, 13 bp, Homo sapiens
acaaagattttct

SEQ ID NO: 6601771 - DNA, 17 bp, Homo sapiens
acaaagattttctaagg

SEQ ID NO: 6601772 - DNA, 11 bp, Homo sapiens
acaaagcaaat

SEQ ID NO: 6601773 - DNA, 14 bp, Homo sapiens
acaaagcacagtgt

SEQ ID NO: 6601774 - DNA, 17 bp, Homo sapiens
acaaagcactagagaat

SEQ ID NO: 6601775 - DNA, 23 bp, Homo sapiens
acaaagcactagagaatgcacag

SEQ ID NO: 6601776 - DNA, 15 bp, Homo sapiens
acaaagcagaaacat

SEQ ID NO: 6601777 - DNA, 21 bp, Homo sapiens
acaaagcagaatagtattttt

SEQ ID NO: 6601778 - DNA, 12 bp, Homo sapiens
acaaagcagcca

SEQ ID NO: 6601779 - DNA, 13 bp, Homo sapiens
acaaagcaggagt

SEQ ID NO: 6601780 - DNA, 22 bp, Homo sapiens
acaaagcatcattgtaaattat

SEQ ID NO: 6601781 - DNA, 17 bp, Homo sapiens
acaaagccaaacaaaac

SEQ ID NO: 6601782 - DNA, 18 bp, Homo sapiens
acaaagccaaacaaaact

SEQ ID NO: 6601783 - DNA, 20 bp, Homo sapiens
acaaagccaccctaccatga

SEQ ID NO: 6601784 - DNA, 16 bp, Homo sapiens
acaaagccagaggaga

SEQ ID NO: 6601785 - DNA, 20 bp, Homo sapiens
acaaagccattcttttaaat

SEQ ID NO: 6601786 - DNA, 20 bp, Homo sapiens
acaaagcccaagggatctgg

SEQ ID NO: 6601787 - DNA, 21 bp, Homo sapiens
acaaagccccccagctcccac

SEQ ID NO: 6601788 - DNA, 18 bp, Homo sapiens
acaaagccttatcaagtg

SEQ ID NO: 6601789 - DNA, 22 bp, Homo sapiens
tttttcaaccagcattttacta

SEQ ID NO: 6601790 - DNA, 23 bp, Homo sapiens
tttttcaaccccaccctgtttgg

SEQ ID NO: 6601791 - DNA, 14 bp, Homo sapiens
tttttcaagagaaa

SEQ ID NO: 6601792 - DNA, 15 bp, Homo sapiens
tttttcaataaagta

SEQ ID NO: 6601793 - DNA, 16 bp, Homo sapiens
tttttcaatatattga

SEQ ID NO: 6601794 - DNA, 19 bp, Homo sapiens
tttttcaatatattgaact

SEQ ID NO: 6601795 - DNA, 13 bp, Homo sapiens
tttttcaatggtt

SEQ ID NO: 6601796 - DNA, 14 bp, Homo sapiens
tttttcaattaaac

SEQ ID NO: 6601797 - DNA, 20 bp, Homo sapiens
tttttcaattaaacggatta

SEQ ID NO: 6601798 - DNA, 22 bp, Homo sapiens
tttttcaattatgtttgaaaat

SEQ ID NO: 6601799 - DNA, 20 bp, Homo sapiens
tttttcacaatgtgaaactg

SEQ ID NO: 6601800 - DNA, 16 bp, Homo sapiens
tttttcaccctatttt

SEQ ID NO: 6601801 - DNA, 22 bp, Homo sapiens
tttttcacctgggaaggaaaca

SEQ ID NO: 6601802 - DNA, 20 bp, Homo sapiens
tttttcactctaaaaatctt

SEQ ID NO: 6601803 - DNA, 13 bp, Homo sapiens
tttttcactttgg

SEQ ID NO: 6601804 - DNA, 10 bp, Homo sapiens
tttttcagac

SEQ ID NO: 6601805 - DNA, 11 bp, Homo sapiens
tttttcagacc

SEQ ID NO: 6601806 - DNA, 21 bp, Homo sapiens
tttttcagcacttaactactt

SEQ ID NO: 6601807 - DNA, 21 bp, Homo sapiens
tttttcagcagactatgaata

SEQ ID NO: 6601808 - DNA, 13 bp, Homo sapiens
tttttcagccatt

SEQ ID NO: 6601809 - DNA, 15 bp, Homo sapiens
tttttcagtgatctt

SEQ ID NO: 6601810 - DNA, 17 bp, Homo sapiens
tttttcagtgttaaggt

SEQ ID NO: 6601811 - DNA, 14 bp, Homo sapiens
tttttcagttccaa

SEQ ID NO: 6601812 - DNA, 20 bp, Homo sapiens
tttttcagttgttcttttta

SEQ ID NO: 6601813 - DNA, 12 bp, Homo sapiens
tttttcagtttt

SEQ ID NO: 6601814 - DNA, 15 bp, Homo sapiens
tttttcagttttcag

SEQ ID NO: 6601815 - DNA, 16 bp, Homo sapiens
tttttcatactcttaa

SEQ ID NO: 6601816 - DNA, 13 bp, Homo sapiens
tttttcatactgt

SEQ ID NO: 6601817 - DNA, 23 bp, Homo sapiens
tttttcatactgtacacatttct

SEQ ID NO: 6601818 - DNA, 11 bp, Homo sapiens
tttttcataga

SEQ ID NO: 6601819 - DNA, 16 bp, Homo sapiens
tttttcatagtgcctt

SEQ ID NO: 6601820 - DNA, 10 bp, Homo sapiens
tttttcatcc

SEQ ID NO: 6601821 - DNA, 21 bp, Homo sapiens
tttttcatccattaccctcct

SEQ ID NO: 6601822 - DNA, 16 bp, Homo sapiens
tttttcatgataatga

SEQ ID NO: 6601823 - DNA, 15 bp, Homo sapiens
tttttcatgttttag

SEQ ID NO: 6601824 - DNA, 22 bp, Homo sapiens
tttttcattagaagttaccaaa

SEQ ID NO: 6601825 - DNA, 22 bp, Homo sapiens
tttttcattattttattatgaa

SEQ ID NO: 6601826 - DNA, 21 bp, Homo sapiens
tttttcattgatatgaaaaat

SEQ ID NO: 6601827 - DNA, 19 bp, Homo sapiens
tttttcattgccaaaaact

SEQ ID NO: 6601828 - DNA, 15 bp, Homo sapiens
tttttcatttaactt

SEQ ID NO: 6601829 - DNA, 13 bp, Homo sapiens
tttttcatttctt

SEQ ID NO: 6601830 - DNA, 16 bp, Homo sapiens
tttttcatttgtaaaa

SEQ ID NO: 6601831 - DNA, 17 bp, Homo sapiens
tttttcattttccaata

SEQ ID NO: 6601832 - DNA, 20 bp, Homo sapiens
tttttcatttttgccagtct

SEQ ID NO: 6601833 - DNA, 20 bp, Homo sapiens
tttttcatttttttctctct

SEQ ID NO: 6601834 - DNA, 17 bp, Homo sapiens
tttttccaaaaacaaag

SEQ ID NO: 6601835 - DNA, 21 bp, Homo sapiens
tttttccaaattattaattgt

SEQ ID NO: 6601836 - DNA, 21 bp, Homo sapiens
tttttccaagtgtataatgtt

SEQ ID NO: 6601837 - DNA, 20 bp, Homo sapiens
tttttccaatcacagtgtta

SEQ ID NO: 6601838 - DNA, 15 bp, Homo sapiens
tttttccaatgtttt

SEQ ID NO: 6601839 - DNA, 20 bp, Homo sapiens
tttttccaattttagaaaat

SEQ ID NO: 6601840 - DNA, 21 bp, Homo sapiens
tttttccacaaggaataaatg

SEQ ID NO: 6601841 - DNA, 20 bp, Homo sapiens
tttttccactttgttcttta

SEQ ID NO: 6601842 - DNA, 14 bp, Homo sapiens
tttttccagaattt

SEQ ID NO: 6601843 - DNA, 13 bp, Homo sapiens
tttttccagattc

SEQ ID NO: 6601844 - DNA, 10 bp, Homo sapiens
tttttccagt

SEQ ID NO: 6601845 - DNA, 11 bp, Homo sapiens
tttttccatca

SEQ ID NO: 6601846 - DNA, 12 bp, Homo sapiens
tttttccatcat

SEQ ID NO: 6601847 - DNA, 21 bp, Homo sapiens
tttttccatcataattctaat

SEQ ID NO: 6601848 - DNA, 14 bp, Homo sapiens
tttttccatcattt

SEQ ID NO: 6601849 - DNA, 19 bp, Homo sapiens
tttttcccagctacacctt

SEQ ID NO: 6601850 - DNA, 18 bp, Homo sapiens
tttttcccataagacaat

SEQ ID NO: 6601851 - DNA, 21 bp, Homo sapiens
tttttccccccaattgctgcc

SEQ ID NO: 6601852 - DNA, 12 bp, Homo sapiens
tttttcccctgc

SEQ ID NO: 6601853 - DNA, 17 bp, Homo sapiens
tttttccctcctgacaa

SEQ ID NO: 6601854 - DNA, 17 bp, Homo sapiens
tttttccgtaaatgtct

SEQ ID NO: 6601855 - DNA, 16 bp, Homo sapiens
tttttcctaagacatt

SEQ ID NO: 6601856 - DNA, 15 bp, Homo sapiens
tttttcctaaggaaa

SEQ ID NO: 6601857 - DNA, 13 bp, Homo sapiens
tttttcctaagtt

SEQ ID NO: 6601858 - DNA, 24 bp, Homo sapiens
tttttcctactccgttcctggcat

SEQ ID NO: 6601859 - DNA, 19 bp, Homo sapiens
tttttcctagcctgtttct

SEQ ID NO: 6601860 - DNA, 13 bp, Homo sapiens
tttttcctctcca

SEQ ID NO: 6601861 - DNA, 19 bp, Homo sapiens
tttttcctctgagcccagc

SEQ ID NO: 6601862 - DNA, 14 bp, Homo sapiens
tttttcctgtcaat

SEQ ID NO: 6601863 - DNA, 15 bp, Homo sapiens
tttttccttaatcca

SEQ ID NO: 6601864 - DNA, 19 bp, Homo sapiens
tttttccttcagtgcctta

SEQ ID NO: 6601865 - DNA, 20 bp, Homo sapiens
tttttccttcctctgtaaga

SEQ ID NO: 6601866 - DNA, 14 bp, Homo sapiens
tttttccttcctga

SEQ ID NO: 6601867 - DNA, 15 bp, Homo sapiens
tttttccttgcctgt

SEQ ID NO: 6601868 - DNA, 11 bp, Homo sapiens
tttttcctttt

SEQ ID NO: 6601869 - DNA, 17 bp, Homo sapiens
tttttcggtttcaaagt

SEQ ID NO: 6601870 - DNA, 22 bp, Homo sapiens
tttttcgtgtggatcttgccac

SEQ ID NO: 6601871 - DNA, 17 bp, Homo sapiens
tttttcgtttgtttgtt

SEQ ID NO: 6601872 - DNA, 11 bp, Homo sapiens
tttttctaaaa

SEQ ID NO: 6601873 - DNA, 21 bp, Homo sapiens
tttttctaaaacattcccctc

SEQ ID NO: 6601874 - DNA, 16 bp, Homo sapiens
tttttctaagagaagt

SEQ ID NO: 6601875 - DNA, 18 bp, Homo sapiens
tttttctaccataagtga

SEQ ID NO: 6601876 - DNA, 16 bp, Homo sapiens
tttttctataaatcag

SEQ ID NO: 6601877 - DNA, 11 bp, Homo sapiens
tttttctatat

SEQ ID NO: 6601878 - DNA, 13 bp, Homo sapiens
tttttctattaaa

SEQ ID NO: 6601879 - DNA, 21 bp, Homo sapiens
tttttctattaaaagactcat

SEQ ID NO: 6601880 - DNA, 13 bp, Homo sapiens
tttttctcaaata

SEQ ID NO: 6601881 - DNA, 19 bp, Homo sapiens
tttttctctaggaaatatt

SEQ ID NO: 6601882 - DNA, 16 bp, Homo sapiens
tttttctctcaacacc

SEQ ID NO: 6601883 - DNA, 12 bp, Homo sapiens
tttttctctcct

SEQ ID NO: 6601884 - DNA, 15 bp, Homo sapiens
tttttctctctggac

SEQ ID NO: 6601885 - DNA, 23 bp, Homo sapiens
tttttctctgatacagaaaagtt

SEQ ID NO: 6601886 - DNA, 14 bp, Homo sapiens
tttttctcttctgt

SEQ ID NO: 6601887 - DNA, 18 bp, Homo sapiens
tttttctcttctgtccat

SEQ ID NO: 6601888 - DNA, 22 bp, Homo sapiens
tttttctcttctgtccatcagt

SEQ ID NO: 6601889 - DNA, 12 bp, Homo sapiens
tttttctgaata

SEQ ID NO: 6601890 - DNA, 13 bp, Homo sapiens
tttttctgaataa

SEQ ID NO: 6601891 - DNA, 14 bp, Homo sapiens
tttttctgaataaa

SEQ ID NO: 6601892 - DNA, 13 bp, Homo sapiens
tttttctgagatt

SEQ ID NO: 6601893 - DNA, 17 bp, Homo sapiens
tttttctgataaaagat

SEQ ID NO: 6601894 - DNA, 22 bp, Homo sapiens
tttttctgcactgagcagagtc

SEQ ID NO: 6601895 - DNA, 12 bp, Homo sapiens
tttttctgcgct

SEQ ID NO: 6601896 - DNA, 17 bp, Homo sapiens
tttttctgcttttgaaa

SEQ ID NO: 6601897 - DNA, 13 bp, Homo sapiens
tttttctgtaaaa

SEQ ID NO: 6601898 - DNA, 18 bp, Homo sapiens
tttttctgtaaaagttac

SEQ ID NO: 6601899 - DNA, 14 bp, Homo sapiens
tttttctgtaccag

SEQ ID NO: 6601900 - DNA, 23 bp, Homo sapiens
tttttctgtgataactctgcaaa

SEQ ID NO: 6601901 - DNA, 19 bp, Homo sapiens
tttttctgttccctgctgg

SEQ ID NO: 6601902 - DNA, 18 bp, Homo sapiens
tttttctgttgtaactta

SEQ ID NO: 6601903 - DNA, 11 bp, Homo sapiens
tttttcttaaa

SEQ ID NO: 6601904 - DNA, 16 bp, Homo sapiens
tttttcttaaaagtac

SEQ ID NO: 6601905 - DNA, 23 bp, Homo sapiens
tttttcttaaataataaagatca

SEQ ID NO: 6601906 - DNA, 13 bp, Homo sapiens
tttttcttaaggc

SEQ ID NO: 6601907 - DNA, 22 bp, Homo sapiens
tttttcttaaggcatactagta

SEQ ID NO: 6601908 - DNA, 13 bp, Homo sapiens
tttttcttcaaat

SEQ ID NO: 6601909 - DNA, 15 bp, Homo sapiens
tttttcttcattgta

SEQ ID NO: 6601910 - DNA, 16 bp, Homo sapiens
tttttcttgctgttca

SEQ ID NO: 6601911 - DNA, 21 bp, Homo sapiens
tttttcttgctgttcagtgct

SEQ ID NO: 6601912 - DNA, 14 bp, Homo sapiens
tttttctttaagat

SEQ ID NO: 6601913 - DNA, 12 bp, Homo sapiens
tttttctttact

SEQ ID NO: 6601914 - DNA, 21 bp, Homo sapiens
tttttctttactttctcccag

SEQ ID NO: 6601915 - DNA, 13 bp, Homo sapiens
tttttctttataa

SEQ ID NO: 6601916 - DNA, 17 bp, Homo sapiens
tttttctttataaactt

SEQ ID NO: 6601917 - DNA, 19 bp, Homo sapiens
tttttctttataagaaagc

SEQ ID NO: 6601918 - DNA, 12 bp, Homo sapiens
tttttctttatc

SEQ ID NO: 6601919 - DNA, 15 bp, Homo sapiens
tttttctttatcaag

SEQ ID NO: 6601920 - DNA, 14 bp, Homo sapiens
tttttctttccaag

SEQ ID NO: 6601921 - DNA, 23 bp, Homo sapiens
tttttctttgaaatgctaaactt

SEQ ID NO: 6601922 - DNA, 21 bp, Homo sapiens
tttttcttttcggaaatctta

SEQ ID NO: 6601923 - DNA, 10 bp, Homo sapiens
tttttgaaaa

SEQ ID NO: 6601924 - DNA, 17 bp, Homo sapiens
tttttgaaaaaagctca

SEQ ID NO: 6601925 - DNA, 17 bp, Homo sapiens
tttttgaaaaagcgaaa

SEQ ID NO: 6601926 - DNA, 21 bp, Homo sapiens
tttttgaaaaatattgctaaa

SEQ ID NO: 6601927 - DNA, 13 bp, Homo sapiens
tttttgaaaacat

SEQ ID NO: 6601928 - DNA, 12 bp, Homo sapiens
tttttgaaaacc

SEQ ID NO: 6601929 - DNA, 15 bp, Homo sapiens
tttttgaaaagctaa

SEQ ID NO: 6601930 - DNA, 12 bp, Homo sapiens
tttttgaaacag

SEQ ID NO: 6601931 - DNA, 23 bp, Homo sapiens
tttttgaaagctacgcagacaag

SEQ ID NO: 6601932 - DNA, 12 bp, Homo sapiens
tttttgaaatca

SEQ ID NO: 6601933 - DNA, 11 bp, Homo sapiens
tttttgaaatg

SEQ ID NO: 6601934 - DNA, 15 bp, Homo sapiens
tttttgaaatgaaat

SEQ ID NO: 6601935 - DNA, 16 bp, Homo sapiens
tttttgaaatgaaatt

SEQ ID NO: 6601936 - DNA, 17 bp, Homo sapiens
tttttgaaatgctgaaa

SEQ ID NO: 6601937 - DNA, 21 bp, Homo sapiens
tttttgaaccatccacttaca

SEQ ID NO: 6601938 - DNA, 12 bp, Homo sapiens
tttttgaacctc

SEQ ID NO: 6601939 - DNA, 19 bp, Homo sapiens
tttttgaactaagaaactt

SEQ ID NO: 6601940 - DNA, 19 bp, Homo sapiens
tttttgaactcttctcatt

SEQ ID NO: 6601941 - DNA, 20 bp, Homo sapiens
tttttgaagtctccttttgt

SEQ ID NO: 6601942 - DNA, 23 bp, Homo sapiens
tttttgaataaaaaacatttgta

SEQ ID NO: 6601943 - DNA, 22 bp, Homo sapiens
tttttgaatgtcataaagaaga

SEQ ID NO: 6601944 - DNA, 22 bp, Homo sapiens
tttttgaattaatctagaaaat

SEQ ID NO: 6601945 - DNA, 13 bp, Homo sapiens
tttttgaattgtg

SEQ ID NO: 6601946 - DNA, 12 bp, Homo sapiens
tttttgacactg

SEQ ID NO: 6601947 - DNA, 18 bp, Homo sapiens
tttttgacactgaaagtt

SEQ ID NO: 6601948 - DNA, 12 bp, Homo sapiens
tttttgacagaa

SEQ ID NO: 6601949 - DNA, 16 bp, Homo sapiens
tttttgaccagtttct

SEQ ID NO: 6601950 - DNA, 20 bp, Homo sapiens
tttttgactttttttgtatg

SEQ ID NO: 6601951 - DNA, 20 bp, Homo sapiens
tttttgaggctatgaatata

SEQ ID NO: 6601952 - DNA, 18 bp, Homo sapiens
tttttgagtaattttctg

SEQ ID NO: 6601953 - DNA, 15 bp, Homo sapiens
tttttgagtcattga

SEQ ID NO: 6601954 - DNA, 14 bp, Homo sapiens
tttttgataattta

SEQ ID NO: 6601955 - DNA, 15 bp, Homo sapiens
tttttgatactaagc

SEQ ID NO: 6601956 - DNA, 14 bp, Homo sapiens
tttttgatagcatt

SEQ ID NO: 6601957 - DNA, 14 bp, Homo sapiens
tttttgatagcttt

SEQ ID NO: 6601958 - DNA, 14 bp, Homo sapiens
tttttgatggaatt

SEQ ID NO: 6601959 - DNA, 18 bp, Homo sapiens
tttttgatggtaagactg

SEQ ID NO: 6601960 - DNA, 15 bp, Homo sapiens
tttttgatgtataaa

SEQ ID NO: 6601961 - DNA, 11 bp, Homo sapiens
tttttgattaa

SEQ ID NO: 6601962 - DNA, 17 bp, Homo sapiens
tttttgatttatcaata

SEQ ID NO: 6601963 - DNA, 20 bp, Homo sapiens
tttttgcaccccatgctgtt

SEQ ID NO: 6601964 - DNA, 23 bp, Homo sapiens
tttttgcaccccatgctgttgat

SEQ ID NO: 6601965 - DNA, 21 bp, Homo sapiens
tttttgcatgatatcttcaag

SEQ ID NO: 6601966 - DNA, 21 bp, Homo sapiens
tttttgcatggcacttgcatc

SEQ ID NO: 6601967 - DNA, 15 bp, Homo sapiens
tttttgccacaaaga

SEQ ID NO: 6601968 - DNA, 21 bp, Homo sapiens
tttttgccactgatttagcca

SEQ ID NO: 6601969 - DNA, 22 bp, Homo sapiens
tttttgccactgatttagccat

SEQ ID NO: 6601970 - DNA, 18 bp, Homo sapiens
tttttgccagttttccct

SEQ ID NO: 6601971 - DNA, 19 bp, Homo sapiens
acaaagccttatcaagtgt

SEQ ID NO: 6601972 - DNA, 20 bp, Homo sapiens
acaaagcgtttctttacttc

SEQ ID NO: 6601973 - DNA, 15 bp, Homo sapiens
acaaagctgatttcc

SEQ ID NO: 6601974 - DNA, 20 bp, Homo sapiens
acaaagctgtcactcacaaa

SEQ ID NO: 6601975 - DNA, 14 bp, Homo sapiens
acaaagctgtgaaa

SEQ ID NO: 6601976 - DNA, 13 bp, Homo sapiens
acaaagctgttaa

SEQ ID NO: 6601977 - DNA, 18 bp, Homo sapiens
acaaagctgttaaactgt

SEQ ID NO: 6601978 - DNA, 21 bp, Homo sapiens
acaaagcttagcaggagagga

SEQ ID NO: 6601979 - DNA, 21 bp, Homo sapiens
acaaagcttctatcccaggag

SEQ ID NO: 6601980 - DNA, 22 bp, Homo sapiens
acaaagcttctatcccaggagg

SEQ ID NO: 6601981 - DNA, 20 bp, Homo sapiens
acaaagctttgctacaaatt

SEQ ID NO: 6601982 - DNA, 13 bp, Homo sapiens
acaaaggaactaa

SEQ ID NO: 6601983 - DNA, 19 bp, Homo sapiens
acaaaggaagtgccccctc

SEQ ID NO: 6601984 - DNA, 13 bp, Homo sapiens
acaaaggagcctg

SEQ ID NO: 6601985 - DNA, 23 bp, Homo sapiens
acaaaggaggacaagaccctctc

SEQ ID NO: 6601986 - DNA, 21 bp, Homo sapiens
acaaaggatacttatttaaat

SEQ ID NO: 6601987 - DNA, 23 bp, Homo sapiens
acaaaggatacttatttaaatag

SEQ ID NO: 6601988 - DNA, 24 bp, Homo sapiens
acaaaggatacttatttaaataga

SEQ ID NO: 6601989 - DNA, 11 bp, Homo sapiens
acaaaggatga

SEQ ID NO: 6601990 - DNA, 22 bp, Homo sapiens
acaaaggatgaagaacacagca

SEQ ID NO: 6601991 - DNA, 22 bp, Homo sapiens
acaaaggatgcccaaagatgca

SEQ ID NO: 6601992 - DNA, 18 bp, Homo sapiens
acaaaggatttgatgctt

SEQ ID NO: 6601993 - DNA, 23 bp, Homo sapiens
acaaaggatttgatgcttttctc

SEQ ID NO: 6601994 - DNA, 21 bp, Homo sapiens
acaaaggcagctgtgtctgag

SEQ ID NO: 6601995 - DNA, 14 bp, Homo sapiens
acaaaggcatgctg

SEQ ID NO: 6601996 - DNA, 15 bp, Homo sapiens
acaaaggcatgctgg

SEQ ID NO: 6601997 - DNA, 19 bp, Homo sapiens
acaaaggctgtattcagca

SEQ ID NO: 6601998 - DNA, 21 bp, Homo sapiens
acaaagggaaagcctctggcc

SEQ ID NO: 6601999 - DNA, 22 bp, Homo sapiens
acaaagggagggagcaagccct

SEQ ID NO: 6602000 - DNA, 20 bp, Homo sapiens
acaaagggcacagcatctgt

SEQ ID NO: 6602001 - DNA, 16 bp, Homo sapiens
acaaagggcagccctc

SEQ ID NO: 6602002 - DNA, 14 bp, Homo sapiens
acaaagggcccaga

SEQ ID NO: 6602003 - DNA, 17 bp, Homo sapiens
acaaaggggaaagaaca

SEQ ID NO: 6602004 - DNA, 18 bp, Homo sapiens
acaaaggggaaagaacat

SEQ ID NO: 6602005 - DNA, 24 bp, Homo sapiens
acaaaggggagaagggccagccct

SEQ ID NO: 6602006 - DNA, 20 bp, Homo sapiens
acaaaggggatgcccagtgg

SEQ ID NO: 6602007 - DNA, 17 bp, Homo sapiens
acaaaggggcttaatta

SEQ ID NO: 6602008 - DNA, 11 bp, Homo sapiens
acaaaggtggt

SEQ ID NO: 6602009 - DNA, 15 bp, Homo sapiens
acaaaggtggtaaat

SEQ ID NO: 6602010 - DNA, 17 bp, Homo sapiens
acaaaggtggtaaattc

SEQ ID NO: 6602011 - DNA, 20 bp, Homo sapiens
acaaaggtggtaaattcaga

SEQ ID NO: 6602012 - DNA, 24 bp, Homo sapiens
acaaaggttgagatgtaaaaggta

SEQ ID NO: 6602013 - DNA, 15 bp, Homo sapiens
acaaaggtttaaatg

SEQ ID NO: 6602014 - DNA, 16 bp, Homo sapiens
acaaaggtttaaatga

SEQ ID NO: 6602015 - DNA, 20 bp, Homo sapiens
acaaaggtttaaatgaacaa

SEQ ID NO: 6602016 - DNA, 20 bp, Homo sapiens
acaaagtaaaagtagtgttg

SEQ ID NO: 6602017 - DNA, 19 bp, Homo sapiens
acaaagtaaatacaagact

SEQ ID NO: 6602018 - DNA, 14 bp, Homo sapiens
acaaagtaattcct

SEQ ID NO: 6602019 - DNA, 16 bp, Homo sapiens
acaaagtaatttggaa

SEQ ID NO: 6602020 - DNA, 23 bp, Homo sapiens
acaaagtactcctcacttttcaa

SEQ ID NO: 6602021 - DNA, 18 bp, Homo sapiens
acaaagtactctttaaca

SEQ ID NO: 6602022 - DNA, 22 bp, Homo sapiens
acaaagtactgtcctcaaataa

SEQ ID NO: 6602023 - DNA, 14 bp, Homo sapiens
acaaagtagagaag

SEQ ID NO: 6602024 - DNA, 13 bp, Homo sapiens
acaaagtattaag

SEQ ID NO: 6602025 - DNA, 18 bp, Homo sapiens
acaaagtattaagcatat

SEQ ID NO: 6602026 - DNA, 22 bp, Homo sapiens
acaaagtcatcccctctcagga

SEQ ID NO: 6602027 - DNA, 14 bp, Homo sapiens
acaaagtctccagc

SEQ ID NO: 6602028 - DNA, 16 bp, Homo sapiens
acaaagtctttggggt

SEQ ID NO: 6602029 - DNA, 18 bp, Homo sapiens
acaaagtgagacagtcca

SEQ ID NO: 6602030 - DNA, 13 bp, Homo sapiens
acaaagtgcaaag

SEQ ID NO: 6602031 - DNA, 14 bp, Homo sapiens
acaaagtgccaaag

SEQ ID NO: 6602032 - DNA, 15 bp, Homo sapiens
acaaagtgccaaaga

SEQ ID NO: 6602033 - DNA, 17 bp, Homo sapiens
acaaagtgccaaagaaa

SEQ ID NO: 6602034 - DNA, 17 bp, Homo sapiens
acaaagtgccgtgataa

SEQ ID NO: 6602035 - DNA, 15 bp, Homo sapiens
acaaagtgcttcctt

SEQ ID NO: 6602036 - DNA, 21 bp, Homo sapiens
acaaagtgcttccttttcagc

SEQ ID NO: 6602037 - DNA, 18 bp, Homo sapiens
acaaagtggaaggaaaga

SEQ ID NO: 6602038 - DNA, 23 bp, Homo sapiens
acaaagtggaaggaaagatgctc

SEQ ID NO: 6602039 - DNA, 23 bp, Homo sapiens
acaaagtgggtactttctgaaaa

SEQ ID NO: 6602040 - DNA, 14 bp, Homo sapiens
acaaagtgggtgtg

SEQ ID NO: 6602041 - DNA, 17 bp, Homo sapiens
acaaagtgggtgtgtgg

SEQ ID NO: 6602042 - DNA, 12 bp, Homo sapiens
acaaagtgtgta

SEQ ID NO: 6602043 - DNA, 21 bp, Homo sapiens
acaaagtgtgtaattatgtaa

SEQ ID NO: 6602044 - DNA, 22 bp, Homo sapiens
acaaagtgtgtaattatgtaaa

SEQ ID NO: 6602045 - DNA, 17 bp, Homo sapiens
acaaagtgtgtattaaa

SEQ ID NO: 6602046 - DNA, 18 bp, Homo sapiens
acaaagtgtgtattaaaa

SEQ ID NO: 6602047 - DNA, 19 bp, Homo sapiens
acaaagtgtgtattaaaaa

SEQ ID NO: 6602048 - DNA, 21 bp, Homo sapiens
acaaagttactaggtaacttc

SEQ ID NO: 6602049 - DNA, 19 bp, Homo sapiens
acaaagttactggctcttt

SEQ ID NO: 6602050 - DNA, 14 bp, Homo sapiens
acaaagttcagtgt

SEQ ID NO: 6602051 - DNA, 15 bp, Homo sapiens
acaaagttctcagag

SEQ ID NO: 6602052 - DNA, 16 bp, Homo sapiens
acaaagttctcagagc

SEQ ID NO: 6602053 - DNA, 16 bp, Homo sapiens
acaaagttggtgccaa

SEQ ID NO: 6602054 - DNA, 15 bp, Homo sapiens
acaaagttgtatgtg

SEQ ID NO: 6602055 - DNA, 16 bp, Homo sapiens
acaaagtttacattgt

SEQ ID NO: 6602056 - DNA, 18 bp, Homo sapiens
acaaagttttaaacgaaa

SEQ ID NO: 6602057 - DNA, 13 bp, Homo sapiens
acaaataaacagt

SEQ ID NO: 6602058 - DNA, 14 bp, Homo sapiens
acaaataaacagtt

SEQ ID NO: 6602059 - DNA, 13 bp, Homo sapiens
acaaataaacctg

SEQ ID NO: 6602060 - DNA, 14 bp, Homo sapiens
acaaataaactagt

SEQ ID NO: 6602061 - DNA, 19 bp, Homo sapiens
acaaataaagcaatgaata

SEQ ID NO: 6602062 - DNA, 13 bp, Homo sapiens
acaaataaatatg

SEQ ID NO: 6602063 - DNA, 15 bp, Homo sapiens
acaaataaatgatta

SEQ ID NO: 6602064 - DNA, 16 bp, Homo sapiens
acaaataacaatgtgc

SEQ ID NO: 6602065 - DNA, 19 bp, Homo sapiens
acaaataacagctttctta

SEQ ID NO: 6602066 - DNA, 22 bp, Homo sapiens
acaaataactactgcaaaaagt

SEQ ID NO: 6602067 - DNA, 11 bp, Homo sapiens
acaaataagaa

SEQ ID NO: 6602068 - DNA, 17 bp, Homo sapiens
acaaataagaaatgaaa

SEQ ID NO: 6602069 - DNA, 19 bp, Homo sapiens
acaaataagtaatatcttt

SEQ ID NO: 6602070 - DNA, 23 bp, Homo sapiens
acaaataagttcccatttccttg

SEQ ID NO: 6602071 - DNA, 17 bp, Homo sapiens
acaaataatattgcctt

SEQ ID NO: 6602072 - DNA, 18 bp, Homo sapiens
acaaataatattgccttg

SEQ ID NO: 6602073 - DNA, 15 bp, Homo sapiens
acaaataatttaagt

SEQ ID NO: 6602074 - DNA, 16 bp, Homo sapiens
acaaataatttaagtt

SEQ ID NO: 6602075 - DNA, 22 bp, Homo sapiens
acaaataatttaagttggctag

SEQ ID NO: 6602076 - DNA, 13 bp, Homo sapiens
acaaataatttag

SEQ ID NO: 6602077 - DNA, 18 bp, Homo sapiens
acaaataatttagaaata

SEQ ID NO: 6602078 - DNA, 19 bp, Homo sapiens
acaaataatttagaaataa

SEQ ID NO: 6602079 - DNA, 17 bp, Homo sapiens
acaaataatttgaactt

SEQ ID NO: 6602080 - DNA, 23 bp, Homo sapiens
acaaataattttttgcagtcttt

SEQ ID NO: 6602081 - DNA, 11 bp, Homo sapiens
acaaatacaca

SEQ ID NO: 6602082 - DNA, 20 bp, Homo sapiens
acaaatacacatacatatat

SEQ ID NO: 6602083 - DNA, 15 bp, Homo sapiens
acaaatacactttat

SEQ ID NO: 6602084 - DNA, 16 bp, Homo sapiens
acaaatacactttatt

SEQ ID NO: 6602085 - DNA, 19 bp, Homo sapiens
acaaatacatgtgtatatt

SEQ ID NO: 6602086 - DNA, 13 bp, Homo sapiens
acaaatactcatg

SEQ ID NO: 6602087 - DNA, 15 bp, Homo sapiens
acaaatactcatgtg

SEQ ID NO: 6602088 - DNA, 18 bp, Homo sapiens
acaaatactcatgtgtat

SEQ ID NO: 6602089 - DNA, 17 bp, Homo sapiens
acaaatacttattcatt

SEQ ID NO: 6602090 - DNA, 21 bp, Homo sapiens
acaaatacttattcattgtgg

SEQ ID NO: 6602091 - DNA, 15 bp, Homo sapiens
acaaatagaaaatgg

SEQ ID NO: 6602092 - DNA, 13 bp, Homo sapiens
acaaatagatgat

SEQ ID NO: 6602093 - DNA, 14 bp, Homo sapiens
acaaatagattttt

SEQ ID NO: 6602094 - DNA, 22 bp, Homo sapiens
acaaatagcatacaccaaacat

SEQ ID NO: 6602095 - DNA, 23 bp, Homo sapiens
acaaataggagtgagtgtatgtg

SEQ ID NO: 6602096 - DNA, 14 bp, Homo sapiens
acaaataggtatgt

SEQ ID NO: 6602097 - DNA, 17 bp, Homo sapiens
acaaatagtaggcaaga

SEQ ID NO: 6602098 - DNA, 22 bp, Homo sapiens
acaaatagtaggcaagatggca

SEQ ID NO: 6602099 - DNA, 23 bp, Homo sapiens
acaaatagtaggctaaaaacatt

SEQ ID NO: 6602100 - DNA, 21 bp, Homo sapiens
acaaatagtcggattagaaat

SEQ ID NO: 6602101 - DNA, 14 bp, Homo sapiens
acaaatatactcat

SEQ ID NO: 6602102 - DNA, 20 bp, Homo sapiens
acaaatatactcatttggat

SEQ ID NO: 6602103 - DNA, 21 bp, Homo sapiens
acaaatatactcatttggata

SEQ ID NO: 6602104 - DNA, 16 bp, Homo sapiens
acaaatatagttgaac

SEQ ID NO: 6602105 - DNA, 22 bp, Homo sapiens
acaaatatagttgaacaagatt

SEQ ID NO: 6602106 - DNA, 20 bp, Homo sapiens
acaaatatatttaattgtgt

SEQ ID NO: 6602107 - DNA, 22 bp, Homo sapiens
acaaatatcttgtgttgtcctt

SEQ ID NO: 6602108 - DNA, 13 bp, Homo sapiens
acaaatatgaaaa

SEQ ID NO: 6602109 - DNA, 19 bp, Homo sapiens
acaaatatgaaaaatgtaa

SEQ ID NO: 6602110 - DNA, 11 bp, Homo sapiens
acaaatatgca

SEQ ID NO: 6602111 - DNA, 19 bp, Homo sapiens
acaaatatgcaaaaggttc

SEQ ID NO: 6602112 - DNA, 13 bp, Homo sapiens
acaaatatgcttt

SEQ ID NO: 6602113 - DNA, 15 bp, Homo sapiens
acaaatattaagaaa

SEQ ID NO: 6602114 - DNA, 21 bp, Homo sapiens
acaaatattggtgttgtcagt

SEQ ID NO: 6602115 - DNA, 12 bp, Homo sapiens
acaaatatttat

SEQ ID NO: 6602116 - DNA, 22 bp, Homo sapiens
acaaatatttattttctttctg

SEQ ID NO: 6602117 - DNA, 20 bp, Homo sapiens
acaaatatttcacttaaact

SEQ ID NO: 6602118 - DNA, 19 bp, Homo sapiens
acaaatattttagaagcta

SEQ ID NO: 6602119 - DNA, 16 bp, Homo sapiens
acaaatcaaacacaac

SEQ ID NO: 6602120 - DNA, 21 bp, Homo sapiens
acaaatcaacagaagcatttg

SEQ ID NO: 6602121 - DNA, 22 bp, Homo sapiens
acaaatcaagcttcagtttcct

SEQ ID NO: 6602122 - DNA, 15 bp, Homo sapiens
acaaatcaagtttcc

SEQ ID NO: 6602123 - DNA, 19 bp, Homo sapiens
acaaatcaagtttccaagc

SEQ ID NO: 6602124 - DNA, 14 bp, Homo sapiens
acaaatcagaagtc

SEQ ID NO: 6602125 - DNA, 17 bp, Homo sapiens
acaaatcagttagtttt

SEQ ID NO: 6602126 - DNA, 14 bp, Homo sapiens
acaaatcattttga

SEQ ID NO: 6602127 - DNA, 15 bp, Homo sapiens
acaaatcattttgat

SEQ ID NO: 6602128 - DNA, 21 bp, Homo sapiens
acaaatcattttgatgtatta

SEQ ID NO: 6602129 - DNA, 19 bp, Homo sapiens
acaaatctaaaatgcaaag

SEQ ID NO: 6602130 - DNA, 18 bp, Homo sapiens
acaaatctaggaaaatat

SEQ ID NO: 6602131 - DNA, 22 bp, Homo sapiens
acaaatctaggaaaatattttg

SEQ ID NO: 6602132 - DNA, 16 bp, Homo sapiens
acaaatctataaatat

SEQ ID NO: 6602133 - DNA, 14 bp, Homo sapiens
acaaatctatgcca

SEQ ID NO: 6602134 - DNA, 17 bp, Homo sapiens
acaaatctcactgtatt

SEQ ID NO: 6602135 - DNA, 19 bp, Homo sapiens
acaaatctcactgtattaa

SEQ ID NO: 6602136 - DNA, 22 bp, Homo sapiens
acaaatctgtataaatgtctat

SEQ ID NO: 6602137 - DNA, 16 bp, Homo sapiens
acaaatcttcaaggtg

SEQ ID NO: 6602138 - DNA, 14 bp, Homo sapiens
acaaatctttaaga

SEQ ID NO: 6602139 - DNA, 19 bp, Homo sapiens
acaaatgaaagagaaaata

SEQ ID NO: 6602140 - DNA, 12 bp, Homo sapiens
acaaatgaaata

SEQ ID NO: 6602141 - DNA, 13 bp, Homo sapiens
acaaatgaaattt

SEQ ID NO: 6602142 - DNA, 12 bp, Homo sapiens
acaaatgaagta

SEQ ID NO: 6602143 - DNA, 23 bp, Homo sapiens
acaaatgaattgtattttttgtt

SEQ ID NO: 6602144 - DNA, 15 bp, Homo sapiens
acaaatgacactgca

SEQ ID NO: 6602145 - DNA, 23 bp, Homo sapiens
acaaatgactgtatctaggcatt

SEQ ID NO: 6602146 - DNA, 13 bp, Homo sapiens
acaaatgacttta

SEQ ID NO: 6602147 - DNA, 21 bp, Homo sapiens
acaaatgactttattatttat

SEQ ID NO: 6602148 - DNA, 16 bp, Homo sapiens
acaaatgattgctttt

SEQ ID NO: 6602149 - DNA, 14 bp, Homo sapiens
tttttgccttcatt

SEQ ID NO: 6602150 - DNA, 18 bp, Homo sapiens
tttttgctataatcatta

SEQ ID NO: 6602151 - DNA, 12 bp, Homo sapiens
tttttgctattt

SEQ ID NO: 6602152 - DNA, 17 bp, Homo sapiens
tttttgctatttctagt

SEQ ID NO: 6602153 - DNA, 13 bp, Homo sapiens
tttttgctgaatt

SEQ ID NO: 6602154 - DNA, 19 bp, Homo sapiens
tttttgctgaattcatcta

SEQ ID NO: 6602155 - DNA, 23 bp, Homo sapiens
tttttgctgctacttctgtggaa

SEQ ID NO: 6602156 - DNA, 18 bp, Homo sapiens
tttttgctttctgaaatt

SEQ ID NO: 6602157 - DNA, 12 bp, Homo sapiens
tttttgcttttg

SEQ ID NO: 6602158 - DNA, 15 bp, Homo sapiens
tttttggacacattt

SEQ ID NO: 6602159 - DNA, 13 bp, Homo sapiens
tttttggacattt

SEQ ID NO: 6602160 - DNA, 22 bp, Homo sapiens
tttttggaccaccgttcagtca

SEQ ID NO: 6602161 - DNA, 18 bp, Homo sapiens
tttttggacttcaaagca

SEQ ID NO: 6602162 - DNA, 17 bp, Homo sapiens
tttttggagacagggtc

SEQ ID NO: 6602163 - DNA, 20 bp, Homo sapiens
tttttggaggtgcttaagca

SEQ ID NO: 6602164 - DNA, 14 bp, Homo sapiens
tttttggagtgtta

SEQ ID NO: 6602165 - DNA, 20 bp, Homo sapiens
tttttggagtgttatgtatt

SEQ ID NO: 6602166 - DNA, 16 bp, Homo sapiens
tttttggcattcctct

SEQ ID NO: 6602167 - DNA, 16 bp, Homo sapiens
tttttggcctgtttga

SEQ ID NO: 6602168 - DNA, 20 bp, Homo sapiens
tttttggcctgtttgatgta

SEQ ID NO: 6602169 - DNA, 18 bp, Homo sapiens
tttttggctgagtactgg

SEQ ID NO: 6602170 - DNA, 20 bp, Homo sapiens
tttttggctttagacactgg

SEQ ID NO: 6602171 - DNA, 15 bp, Homo sapiens
tttttgggatgtctt

SEQ ID NO: 6602172 - DNA, 21 bp, Homo sapiens
tttttgggcagcaatttaaat

SEQ ID NO: 6602173 - DNA, 19 bp, Homo sapiens
tttttggggaaaaaagcac

SEQ ID NO: 6602174 - DNA, 19 bp, Homo sapiens
tttttgggttaaaagatgg

SEQ ID NO: 6602175 - DNA, 14 bp, Homo sapiens
tttttggtaaattt

SEQ ID NO: 6602176 - DNA, 15 bp, Homo sapiens
tttttggtaataaca

SEQ ID NO: 6602177 - DNA, 13 bp, Homo sapiens
tttttggtacaaa

SEQ ID NO: 6602178 - DNA, 14 bp, Homo sapiens
tttttggtacaaaa

SEQ ID NO: 6602179 - DNA, 19 bp, Homo sapiens
tttttggtataatgtttaa

SEQ ID NO: 6602180 - DNA, 15 bp, Homo sapiens
tttttggtatttgaa

SEQ ID NO: 6602181 - DNA, 22 bp, Homo sapiens
tttttggtcgaggagtaacaat

SEQ ID NO: 6602182 - DNA, 18 bp, Homo sapiens
tttttggtggtggttaaa

SEQ ID NO: 6602183 - DNA, 18 bp, Homo sapiens
tttttggttgtcaatatt

SEQ ID NO: 6602184 - DNA, 19 bp, Homo sapiens
tttttggttgtttgctgtt

SEQ ID NO: 6602185 - DNA, 14 bp, Homo sapiens
tttttggtttctta

SEQ ID NO: 6602186 - DNA, 10 bp, Homo sapiens
tttttgtaaa

SEQ ID NO: 6602187 - DNA, 13 bp, Homo sapiens
tttttgtaaaaac

SEQ ID NO: 6602188 - DNA, 15 bp, Homo sapiens
tttttgtaaactgga

SEQ ID NO: 6602189 - DNA, 14 bp, Homo sapiens
tttttgtaaactgt

SEQ ID NO: 6602190 - DNA, 22 bp, Homo sapiens
tttttgtaaactgtatcaaatc

SEQ ID NO: 6602191 - DNA, 14 bp, Homo sapiens
tttttgtaactaca

SEQ ID NO: 6602192 - DNA, 15 bp, Homo sapiens
tttttgtaactcttt

SEQ ID NO: 6602193 - DNA, 14 bp, Homo sapiens
tttttgtaacttca

SEQ ID NO: 6602194 - DNA, 13 bp, Homo sapiens
tttttgtaagata

SEQ ID NO: 6602195 - DNA, 16 bp, Homo sapiens
tttttgtaatgcactg

SEQ ID NO: 6602196 - DNA, 16 bp, Homo sapiens
tttttgtaattcctct

SEQ ID NO: 6602197 - DNA, 17 bp, Homo sapiens
tttttgtacattacact

SEQ ID NO: 6602198 - DNA, 14 bp, Homo sapiens
tttttgtactgtaa

SEQ ID NO: 6602199 - DNA, 17 bp, Homo sapiens
tttttgtagacagggtc

SEQ ID NO: 6602200 - DNA, 20 bp, Homo sapiens
tttttgtagagccagggtct

SEQ ID NO: 6602201 - DNA, 9 bp, Homo sapiens
tttttgtat

SEQ ID NO: 6602202 - DNA, 19 bp, Homo sapiens
tttttgtatagacaggggc

SEQ ID NO: 6602203 - DNA, 18 bp, Homo sapiens
tttttgtatagttaacac

SEQ ID NO: 6602204 - DNA, 21 bp, Homo sapiens
tttttgtatagttaacacact

SEQ ID NO: 6602205 - DNA, 22 bp, Homo sapiens
tttttgtatattggttttatga

SEQ ID NO: 6602206 - DNA, 16 bp, Homo sapiens
tttttgtatcagaatc

SEQ ID NO: 6602207 - DNA, 12 bp, Homo sapiens
tttttgtatgtg

SEQ ID NO: 6602208 - DNA, 16 bp, Homo sapiens
tttttgtattaacaaa

SEQ ID NO: 6602209 - DNA, 17 bp, Homo sapiens
tttttgtatttctttta

SEQ ID NO: 6602210 - DNA, 12 bp, Homo sapiens
tttttgtatttt

SEQ ID NO: 6602211 - DNA, 18 bp, Homo sapiens
tttttgtattttacatgg

SEQ ID NO: 6602212 - DNA, 12 bp, Homo sapiens
tttttgtcatca

SEQ ID NO: 6602213 - DNA, 11 bp, Homo sapiens
tttttgtcatg

SEQ ID NO: 6602214 - DNA, 18 bp, Homo sapiens
tttttgtcattttatgaa

SEQ ID NO: 6602215 - DNA, 21 bp, Homo sapiens
tttttgtcccccaacttgaga

SEQ ID NO: 6602216 - DNA, 16 bp, Homo sapiens
tttttgtccctgctcc

SEQ ID NO: 6602217 - DNA, 13 bp, Homo sapiens
tttttgtctcaat

SEQ ID NO: 6602218 - DNA, 13 bp, Homo sapiens
tttttgtctcgaa

SEQ ID NO: 6602219 - DNA, 13 bp, Homo sapiens
tttttgtcttttc

SEQ ID NO: 6602220 - DNA, 19 bp, Homo sapiens
tttttgtgaaaagctccat

SEQ ID NO: 6602221 - DNA, 12 bp, Homo sapiens
tttttgtgaaga

SEQ ID NO: 6602222 - DNA, 11 bp, Homo sapiens
tttttgtgaat

SEQ ID NO: 6602223 - DNA, 20 bp, Homo sapiens
tttttgtgagcctctttgta

SEQ ID NO: 6602224 - DNA, 12 bp, Homo sapiens
tttttgtgtatg

SEQ ID NO: 6602225 - DNA, 17 bp, Homo sapiens
tttttgtgtatgtactt

SEQ ID NO: 6602226 - DNA, 14 bp, Homo sapiens
tttttgttaacttt

SEQ ID NO: 6602227 - DNA, 14 bp, Homo sapiens
tttttgttaggttt

SEQ ID NO: 6602228 - DNA, 16 bp, Homo sapiens
tttttgttattaaaca

SEQ ID NO: 6602229 - DNA, 16 bp, Homo sapiens
tttttgttcctgtgta

SEQ ID NO: 6602230 - DNA, 20 bp, Homo sapiens
tttttgttctggtccttttt

SEQ ID NO: 6602231 - DNA, 20 bp, Homo sapiens
tttttgttcttgatggagat

SEQ ID NO: 6602232 - DNA, 19 bp, Homo sapiens
tttttgttgagtctctgaa

SEQ ID NO: 6602233 - DNA, 16 bp, Homo sapiens
tttttgttgcagtgta

SEQ ID NO: 6602234 - DNA, 17 bp, Homo sapiens
tttttgttgtgttctgt

SEQ ID NO: 6602235 - DNA, 12 bp, Homo sapiens
tttttgtttgca

SEQ ID NO: 6602236 - DNA, 11 bp, Homo sapiens
tttttgtttgt

SEQ ID NO: 6602237 - DNA, 16 bp, Homo sapiens
tttttgtttgtattgt

SEQ ID NO: 6602238 - DNA, 15 bp, Homo sapiens
tttttgtttgtttct

SEQ ID NO: 6602239 - DNA, 16 bp, Homo sapiens
tttttgtttgttttgt

SEQ ID NO: 6602240 - DNA, 18 bp, Homo sapiens
tttttgttttgttgcact

SEQ ID NO: 6602241 - DNA, 17 bp, Homo sapiens
tttttgttttgttttgt

SEQ ID NO: 6602242 - DNA, 13 bp, Homo sapiens
tttttgtttttta

SEQ ID NO: 6602243 - DNA, 12 bp, Homo sapiens
ttttttaaaaaa

SEQ ID NO: 6602244 - DNA, 18 bp, Homo sapiens
ttttttaaaaaaagaaaa

SEQ ID NO: 6602245 - DNA, 22 bp, Homo sapiens
ttttttaaaaaaagctaaatta

SEQ ID NO: 6602246 - DNA, 17 bp, Homo sapiens
ttttttaaaaaatttgc

SEQ ID NO: 6602247 - DNA, 14 bp, Homo sapiens
ttttttaaaaatta

SEQ ID NO: 6602248 - DNA, 13 bp, Homo sapiens
ttttttaaaattg

SEQ ID NO: 6602249 - DNA, 13 bp, Homo sapiens
ttttttaaaccag

SEQ ID NO: 6602250 - DNA, 12 bp, Homo sapiens
ttttttaaagaa

SEQ ID NO: 6602251 - DNA, 13 bp, Homo sapiens
ttttttaaagaaa

SEQ ID NO: 6602252 - DNA, 14 bp, Homo sapiens
ttttttaaagaaaa

SEQ ID NO: 6602253 - DNA, 13 bp, Homo sapiens
ttttttaaagaca

SEQ ID NO: 6602254 - DNA, 12 bp, Homo sapiens
ttttttaaagta

SEQ ID NO: 6602255 - DNA, 23 bp, Homo sapiens
ttttttaaatgattccaaataaa

SEQ ID NO: 6602256 - DNA, 17 bp, Homo sapiens
ttttttaacacataact

SEQ ID NO: 6602257 - DNA, 21 bp, Homo sapiens
ttttttaacactagaaaacat

SEQ ID NO: 6602258 - DNA, 12 bp, Homo sapiens
ttttttaacatc

SEQ ID NO: 6602259 - DNA, 15 bp, Homo sapiens
ttttttaacatcttt

SEQ ID NO: 6602260 - DNA, 12 bp, Homo sapiens
ttttttaacatt

SEQ ID NO: 6602261 - DNA, 11 bp, Homo sapiens
ttttttaactg

SEQ ID NO: 6602262 - DNA, 19 bp, Homo sapiens
ttttttaacttatgtatgt

SEQ ID NO: 6602263 - DNA, 10 bp, Homo sapiens
ttttttaaga

SEQ ID NO: 6602264 - DNA, 17 bp, Homo sapiens
ttttttaagaatatctg

SEQ ID NO: 6602265 - DNA, 11 bp, Homo sapiens
ttttttaagat

SEQ ID NO: 6602266 - DNA, 20 bp, Homo sapiens
ttttttaagctatcagcaat

SEQ ID NO: 6602267 - DNA, 12 bp, Homo sapiens
ttttttaagctt

SEQ ID NO: 6602268 - DNA, 22 bp, Homo sapiens
ttttttaagtgggtttttatga

SEQ ID NO: 6602269 - DNA, 17 bp, Homo sapiens
ttttttaagtgttctgt

SEQ ID NO: 6602270 - DNA, 18 bp, Homo sapiens
ttttttaagttcttatga

SEQ ID NO: 6602271 - DNA, 12 bp, Homo sapiens
ttttttaatgta

SEQ ID NO: 6602272 - DNA, 15 bp, Homo sapiens
ttttttaatgtgctg

SEQ ID NO: 6602273 - DNA, 17 bp, Homo sapiens
ttttttaattgcaacaa

SEQ ID NO: 6602274 - DNA, 12 bp, Homo sapiens
ttttttaattta

SEQ ID NO: 6602275 - DNA, 22 bp, Homo sapiens
ttttttacggaattccaatatt

SEQ ID NO: 6602276 - DNA, 18 bp, Homo sapiens
ttttttacttgaatcaga

SEQ ID NO: 6602277 - DNA, 14 bp, Homo sapiens
ttttttacttttgt

SEQ ID NO: 6602278 - DNA, 15 bp, Homo sapiens
ttttttagatcaaat

SEQ ID NO: 6602279 - DNA, 17 bp, Homo sapiens
ttttttaggacatctta

SEQ ID NO: 6602280 - DNA, 12 bp, Homo sapiens
ttttttataaag

SEQ ID NO: 6602281 - DNA, 16 bp, Homo sapiens
ttttttataagtatgt

SEQ ID NO: 6602282 - DNA, 13 bp, Homo sapiens
ttttttatactgc

SEQ ID NO: 6602283 - DNA, 12 bp, Homo sapiens
ttttttatgaag

SEQ ID NO: 6602284 - DNA, 17 bp, Homo sapiens
ttttttatgtacaaccc

SEQ ID NO: 6602285 - DNA, 14 bp, Homo sapiens
ttttttatgttcct

SEQ ID NO: 6602286 - DNA, 12 bp, Homo sapiens
ttttttatttaa

SEQ ID NO: 6602287 - DNA, 12 bp, Homo sapiens
ttttttatttct

SEQ ID NO: 6602288 - DNA, 18 bp, Homo sapiens
ttttttcaaaatagaaaa

SEQ ID NO: 6602289 - DNA, 12 bp, Homo sapiens
ttttttcaatat

SEQ ID NO: 6602290 - DNA, 13 bp, Homo sapiens
ttttttcaatgtg

SEQ ID NO: 6602291 - DNA, 19 bp, Homo sapiens
ttttttcacctgaaacact

SEQ ID NO: 6602292 - DNA, 12 bp, Homo sapiens
ttttttcacttc

SEQ ID NO: 6602293 - DNA, 11 bp, Homo sapiens
ttttttcagac

SEQ ID NO: 6602294 - DNA, 14 bp, Homo sapiens
ttttttcagaccga

SEQ ID NO: 6602295 - DNA, 12 bp, Homo sapiens
ttttttcatctt

SEQ ID NO: 6602296 - DNA, 13 bp, Homo sapiens
ttttttccaaaac

SEQ ID NO: 6602297 - DNA, 14 bp, Homo sapiens
ttttttccaaaatc

SEQ ID NO: 6602298 - DNA, 12 bp, Homo sapiens
ttttttccaaag

SEQ ID NO: 6602299 - DNA, 22 bp, Homo sapiens
ttttttccatctttacaaaact

SEQ ID NO: 6602300 - DNA, 13 bp, Homo sapiens
ttttttcccatga

SEQ ID NO: 6602301 - DNA, 12 bp, Homo sapiens
ttttttcctgtt

SEQ ID NO: 6602302 - DNA, 15 bp, Homo sapiens
ttttttcctgtttct

SEQ ID NO: 6602303 - DNA, 19 bp, Homo sapiens
ttttttcctgtttctgaaa

SEQ ID NO: 6602304 - DNA, 14 bp, Homo sapiens
ttttttccttacat

SEQ ID NO: 6602305 - DNA, 17 bp, Homo sapiens
ttttttccttcagtgcc

SEQ ID NO: 6602306 - DNA, 13 bp, Homo sapiens
ttttttcgtttgt

SEQ ID NO: 6602307 - DNA, 15 bp, Homo sapiens
ttttttctacctata

SEQ ID NO: 6602308 - DNA, 10 bp, Homo sapiens
ttttttctct

SEQ ID NO: 6602309 - DNA, 12 bp, Homo sapiens
ttttttctcttc

SEQ ID NO: 6602310 - DNA, 12 bp, Homo sapiens
ttttttctgaaa

SEQ ID NO: 6602311 - DNA, 11 bp, Homo sapiens
ttttttctgag

SEQ ID NO: 6602312 - DNA, 12 bp, Homo sapiens
ttttttctgcac

SEQ ID NO: 6602313 - DNA, 14 bp, Homo sapiens
ttttttctggtaag

SEQ ID NO: 6602314 - DNA, 17 bp, Homo sapiens
ttttttctgtaatgtaa

SEQ ID NO: 6602315 - DNA, 12 bp, Homo sapiens
ttttttcttcta

SEQ ID NO: 6602316 - DNA, 20 bp, Homo sapiens
ttttttctttcccatgtatt

SEQ ID NO: 6602317 - DNA, 12 bp, Homo sapiens
ttttttgaaaac

SEQ ID NO: 6602318 - DNA, 13 bp, Homo sapiens
ttttttgaaacac

SEQ ID NO: 6602319 - DNA, 10 bp, Homo sapiens
ttttttgaag

SEQ ID NO: 6602320 - DNA, 10 bp, Homo sapiens
ttttttgaga

SEQ ID NO: 6602321 - DNA, 15 bp, Homo sapiens
ttttttgagacatgg

SEQ ID NO: 6602322 - DNA, 13 bp, Homo sapiens
ttttttgagtcat

SEQ ID NO: 6602323 - DNA, 12 bp, Homo sapiens
ttttttgagttt

SEQ ID NO: 6602324 - DNA, 9 bp, Homo sapiens
ttttttgca

SEQ ID NO: 6602325 - DNA, 22 bp, Homo sapiens
ttttttgcaaatttgtaaactt

SEQ ID NO: 6602326 - DNA, 13 bp, Homo sapiens
ttttttgcaagtt

SEQ ID NO: 6602327 - DNA, 12 bp, Homo sapiens
ttttttgcaata

SEQ ID NO: 6602328 - DNA, 10 bp, Homo sapiens
ttttttgcag

SEQ ID NO: 6602329 - DNA, 18 bp, Homo sapiens
ttttttgccacaaagaag

SEQ ID NO: 6602330 - DNA, 20 bp, Homo sapiens
ttttttggaaagcacaaact

SEQ ID NO: 6602331 - DNA, 21 bp, Homo sapiens
ttttttggccatctgctcctg

SEQ ID NO: 6602332 - DNA, 16 bp, Homo sapiens
ttttttgggccattac

SEQ ID NO: 6602333 - DNA, 23 bp, Homo sapiens
ttttttggggatatgcttagtaa

SEQ ID NO: 6602334 - DNA, 13 bp, Homo sapiens
ttttttggtaaat

SEQ ID NO: 6602335 - DNA, 21 bp, Homo sapiens
ttttttggtataatgtttaaa

SEQ ID NO: 6602336 - DNA, 20 bp, Homo sapiens
ttttttggtggtgaaattga

SEQ ID NO: 6602337 - DNA, 18 bp, Homo sapiens
acaaatgattgcttttaa

SEQ ID NO: 6602338 - DNA, 23 bp, Homo sapiens
acaaatgatttcgtgactgtagt

SEQ ID NO: 6602339 - DNA, 15 bp, Homo sapiens
acaaatgcagacaca

SEQ ID NO: 6602340 - DNA, 17 bp, Homo sapiens
acaaatgcagacacaca

SEQ ID NO: 6602341 - DNA, 19 bp, Homo sapiens
acaaatgcagacacacaac

SEQ ID NO: 6602342 - DNA, 15 bp, Homo sapiens
acaaatgcagtgtat

SEQ ID NO: 6602343 - DNA, 20 bp, Homo sapiens
acaaatgcatctttgatgtg

SEQ ID NO: 6602344 - DNA, 19 bp, Homo sapiens
acaaatgccttaaaatgga

SEQ ID NO: 6602345 - DNA, 13 bp, Homo sapiens
acaaatgccttga

SEQ ID NO: 6602346 - DNA, 20 bp, Homo sapiens
acaaatgctcccacctgaat

SEQ ID NO: 6602347 - DNA, 20 bp, Homo sapiens
acaaatgcttttccaaccca

SEQ ID NO: 6602348 - DNA, 22 bp, Homo sapiens
acaaatggaactccccagggcc

SEQ ID NO: 6602349 - DNA, 22 bp, Homo sapiens
acaaatggcttgttcagtcact

SEQ ID NO: 6602350 - DNA, 21 bp, Homo sapiens
acaaatgggcgcccccccctc

SEQ ID NO: 6602351 - DNA, 22 bp, Homo sapiens
acaaatgggcgcccccccctcc

SEQ ID NO: 6602352 - DNA, 19 bp, Homo sapiens
acaaatgggggcggctgga

SEQ ID NO: 6602353 - DNA, 22 bp, Homo sapiens
acaaatgggggcggctggaaag

SEQ ID NO: 6602354 - DNA, 13 bp, Homo sapiens
acaaatgtatgat

SEQ ID NO: 6602355 - DNA, 21 bp, Homo sapiens
acaaatgtattttgaagaata

SEQ ID NO: 6602356 - DNA, 22 bp, Homo sapiens
acaaatgtattttgaagaatat

SEQ ID NO: 6602357 - DNA, 15 bp, Homo sapiens
acaaatgtcattgtc

SEQ ID NO: 6602358 - DNA, 22 bp, Homo sapiens
acaaatgtgaaacggaagctca

SEQ ID NO: 6602359 - DNA, 13 bp, Homo sapiens
acaaatgtgaaga

SEQ ID NO: 6602360 - DNA, 23 bp, Homo sapiens
acaaatgtgaagatgcattgtag

SEQ ID NO: 6602361 - DNA, 23 bp, Homo sapiens
acaaatgtggagtgtctgcgtcc

SEQ ID NO: 6602362 - DNA, 13 bp, Homo sapiens
acaaatgtgtaat

SEQ ID NO: 6602363 - DNA, 14 bp, Homo sapiens
acaaatgtgtaatt

SEQ ID NO: 6602364 - DNA, 11 bp, Homo sapiens
acaaatgtgtg

SEQ ID NO: 6602365 - DNA, 12 bp, Homo sapiens
acaaatgtgtga

SEQ ID NO: 6602366 - DNA, 13 bp, Homo sapiens
acaaatgtgtgac

SEQ ID NO: 6602367 - DNA, 18 bp, Homo sapiens
acaaatgttaaaatgtgt

SEQ ID NO: 6602368 - DNA, 19 bp, Homo sapiens
acaaatgttagacttgtgt

SEQ ID NO: 6602369 - DNA, 21 bp, Homo sapiens
acaaatgttcatatttattga

SEQ ID NO: 6602370 - DNA, 19 bp, Homo sapiens
acaaatgtttataactcta

SEQ ID NO: 6602371 - DNA, 13 bp, Homo sapiens
acaaatgtttcta

SEQ ID NO: 6602372 - DNA, 17 bp, Homo sapiens
acaaattaaataaatta

SEQ ID NO: 6602373 - DNA, 23 bp, Homo sapiens
acaaattaactagatacagaata

SEQ ID NO: 6602374 - DNA, 14 bp, Homo sapiens
acaaattaatattt

SEQ ID NO: 6602375 - DNA, 18 bp, Homo sapiens
acaaattaatgaagcttt

SEQ ID NO: 6602376 - DNA, 20 bp, Homo sapiens
acaaattaggttttgtacaa

SEQ ID NO: 6602377 - DNA, 15 bp, Homo sapiens
acaaattataatgta

SEQ ID NO: 6602378 - DNA, 22 bp, Homo sapiens
acaaattatacataataaagtg

SEQ ID NO: 6602379 - DNA, 18 bp, Homo sapiens
acaaattatgctaagaat

SEQ ID NO: 6602380 - DNA, 14 bp, Homo sapiens
acaaattatttttg

SEQ ID NO: 6602381 - DNA, 14 bp, Homo sapiens
acaaattcagtgga

SEQ ID NO: 6602382 - DNA, 18 bp, Homo sapiens
acaaattcagtggacatt

SEQ ID NO: 6602383 - DNA, 17 bp, Homo sapiens
acaaattcatattctgt

SEQ ID NO: 6602384 - DNA, 18 bp, Homo sapiens
acaaattctactttaata

SEQ ID NO: 6602385 - DNA, 12 bp, Homo sapiens
acaaattctgtt

SEQ ID NO: 6602386 - DNA, 15 bp, Homo sapiens
acaaattctgtttct

SEQ ID NO: 6602387 - DNA, 18 bp, Homo sapiens
acaaattctttagtactc

SEQ ID NO: 6602388 - DNA, 19 bp, Homo sapiens
acaaattctttagtactca

SEQ ID NO: 6602389 - DNA, 19 bp, Homo sapiens
acaaattgactcttattta

SEQ ID NO: 6602390 - DNA, 14 bp, Homo sapiens
acaaattgcacaga

SEQ ID NO: 6602391 - DNA, 14 bp, Homo sapiens
acaaattgcatttg

SEQ ID NO: 6602392 - DNA, 16 bp, Homo sapiens
acaaattgttcatgtt

SEQ ID NO: 6602393 - DNA, 18 bp, Homo sapiens
acaaattgtttttactgt

SEQ ID NO: 6602394 - DNA, 19 bp, Homo sapiens
acaaatttaattttgcaga

SEQ ID NO: 6602395 - DNA, 16 bp, Homo sapiens
acaaatttatgcattt

SEQ ID NO: 6602396 - DNA, 14 bp, Homo sapiens
acaaatttcattgc

SEQ ID NO: 6602397 - DNA, 15 bp, Homo sapiens
acaaatttcattgca

SEQ ID NO: 6602398 - DNA, 17 bp, Homo sapiens
acaaatttcattgcact

SEQ ID NO: 6602399 - DNA, 19 bp, Homo sapiens
acaaatttcattgcacttt

SEQ ID NO: 6602400 - DNA, 22 bp, Homo sapiens
acaaatttcattgcactttcct

SEQ ID NO: 6602401 - DNA, 20 bp, Homo sapiens
acaaatttcccctctaatta

SEQ ID NO: 6602402 - DNA, 20 bp, Homo sapiens
acaaatttctctgttccata

SEQ ID NO: 6602403 - DNA, 17 bp, Homo sapiens
acaaatttttactcagg

SEQ ID NO: 6602404 - DNA, 20 bp, Homo sapiens
acaaatttttactcaggctt

SEQ ID NO: 6602405 - DNA, 19 bp, Homo sapiens
acaaatttttacttgaagt

SEQ ID NO: 6602406 - DNA, 16 bp, Homo sapiens
acaaatttttatttct

SEQ ID NO: 6602407 - DNA, 21 bp, Homo sapiens
acaaatttttatttctaaaat

SEQ ID NO: 6602408 - DNA, 23 bp, Homo sapiens
acaaatttttcaaatcattcctt

SEQ ID NO: 6602409 - DNA, 12 bp, Homo sapiens
acaacaaaaaaa

SEQ ID NO: 6602410 - DNA, 11 bp, Homo sapiens
acaacaaaaac

SEQ ID NO: 6602411 - DNA, 15 bp, Homo sapiens
acaacaaaaatttga

SEQ ID NO: 6602412 - DNA, 13 bp, Homo sapiens
acaacaaaagaaa

SEQ ID NO: 6602413 - DNA, 13 bp, Homo sapiens
acaacaaaccaaa

SEQ ID NO: 6602414 - DNA, 14 bp, Homo sapiens
acaacaaaccaaaa

SEQ ID NO: 6602415 - DNA, 15 bp, Homo sapiens
acaacaaactgaatt

SEQ ID NO: 6602416 - DNA, 12 bp, Homo sapiens
acaacaaacttg

SEQ ID NO: 6602417 - DNA, 12 bp, Homo sapiens
acaacaaagaca

SEQ ID NO: 6602418 - DNA, 14 bp, Homo sapiens
acaacaaaggaagt

SEQ ID NO: 6602419 - DNA, 23 bp, Homo sapiens
acaacaaaggcaagttaagagaa

SEQ ID NO: 6602420 - DNA, 18 bp, Homo sapiens
acaacaaagtgcttcctt

SEQ ID NO: 6602421 - DNA, 15 bp, Homo sapiens
acaacaaataattta

SEQ ID NO: 6602422 - DNA, 23 bp, Homo sapiens
acaacaaatatgttctctgaatg

SEQ ID NO: 6602423 - DNA, 13 bp, Homo sapiens
acaacaacaacaa

SEQ ID NO: 6602424 - DNA, 13 bp, Homo sapiens
acaacaacaataa

SEQ ID NO: 6602425 - DNA, 17 bp, Homo sapiens
acaacaacaataacaac

SEQ ID NO: 6602426 - DNA, 13 bp, Homo sapiens
acaacaagaaact

SEQ ID NO: 6602427 - DNA, 14 bp, Homo sapiens
acaacaaggaccct

SEQ ID NO: 6602428 - DNA, 19 bp, Homo sapiens
acaacaataataaagatgt

SEQ ID NO: 6602429 - DNA, 23 bp, Homo sapiens
acaacaataataaagatgtgaaa

SEQ ID NO: 6602430 - DNA, 15 bp, Homo sapiens
acaacaatcccagca

SEQ ID NO: 6602431 - DNA, 14 bp, Homo sapiens
acaacaatgctttg

SEQ ID NO: 6602432 - DNA, 14 bp, Homo sapiens
acaacacaagaaaa

SEQ ID NO: 6602433 - DNA, 18 bp, Homo sapiens
acaacacaagcaccccag

SEQ ID NO: 6602434 - DNA, 16 bp, Homo sapiens
acaacacaatcaaaag

SEQ ID NO: 6602435 - DNA, 14 bp, Homo sapiens
acaacacacacact

SEQ ID NO: 6602436 - DNA, 18 bp, Homo sapiens
acaacacagtagtgttct

SEQ ID NO: 6602437 - DNA, 16 bp, Homo sapiens
acaacacattgaaact

SEQ ID NO: 6602438 - DNA, 12 bp, Homo sapiens
acaacaccagga

SEQ ID NO: 6602439 - DNA, 13 bp, Homo sapiens
acaacaccaggac

SEQ ID NO: 6602440 - DNA, 13 bp, Homo sapiens
acaacacccattt

SEQ ID NO: 6602441 - DNA, 14 bp, Homo sapiens
acaacacctcctcc

SEQ ID NO: 6602442 - DNA, 15 bp, Homo sapiens
acaacacctcctcct

SEQ ID NO: 6602443 - DNA, 16 bp, Homo sapiens
acaacacctcctcctg

SEQ ID NO: 6602444 - DNA, 19 bp, Homo sapiens
acaacacctcctcctgctg

SEQ ID NO: 6602445 - DNA, 10 bp, Homo sapiens
acaacactga

SEQ ID NO: 6602446 - DNA, 16 bp, Homo sapiens
acaacactgattcctg

SEQ ID NO: 6602447 - DNA, 23 bp, Homo sapiens
acaacactgtagtaaataatgct

SEQ ID NO: 6602448 - DNA, 18 bp, Homo sapiens
acaacactttccctctct

SEQ ID NO: 6602449 - DNA, 13 bp, Homo sapiens
acaacagaaaaac

SEQ ID NO: 6602450 - DNA, 21 bp, Homo sapiens
acaacagaaaaacaatcttat

SEQ ID NO: 6602451 - DNA, 17 bp, Homo sapiens
acaacagaaacttctca

SEQ ID NO: 6602452 - DNA, 13 bp, Homo sapiens
acaacagaagctt

SEQ ID NO: 6602453 - DNA, 19 bp, Homo sapiens
acaacagaagcttcagaag

SEQ ID NO: 6602454 - DNA, 14 bp, Homo sapiens
acaacagaataaag

SEQ ID NO: 6602455 - DNA, 15 bp, Homo sapiens
acaacagaataaagc

SEQ ID NO: 6602456 - DNA, 16 bp, Homo sapiens
acaacagaataaagca

SEQ ID NO: 6602457 - DNA, 20 bp, Homo sapiens
acaacagaataaagcagcct

SEQ ID NO: 6602458 - DNA, 22 bp, Homo sapiens
acaacagagtgaaaaatcttaa

SEQ ID NO: 6602459 - DNA, 20 bp, Homo sapiens
acaacagattggattttatg

SEQ ID NO: 6602460 - DNA, 22 bp, Homo sapiens
acaacagattggattttatgtt

SEQ ID NO: 6602461 - DNA, 23 bp, Homo sapiens
acaacagattggattttatgttg

SEQ ID NO: 6602462 - DNA, 13 bp, Homo sapiens
acaacagatttgt

SEQ ID NO: 6602463 - DNA, 14 bp, Homo sapiens
acaacagatttgtg

SEQ ID NO: 6602464 - DNA, 15 bp, Homo sapiens
acaacagatttgtga

SEQ ID NO: 6602465 - DNA, 17 bp, Homo sapiens
acaacagatttgtgaac

SEQ ID NO: 6602466 - DNA, 18 bp, Homo sapiens
acaacagatttgtgaact

SEQ ID NO: 6602467 - DNA, 19 bp, Homo sapiens
acaacagcacgtgcagcca

SEQ ID NO: 6602468 - DNA, 13 bp, Homo sapiens
acaacagcagtct

SEQ ID NO: 6602469 - DNA, 14 bp, Homo sapiens
acaacagcagtctc

SEQ ID NO: 6602470 - DNA, 13 bp, Homo sapiens
acaacagcctggg

SEQ ID NO: 6602471 - DNA, 18 bp, Homo sapiens
acaacagctcgatccaaa

SEQ ID NO: 6602472 - DNA, 22 bp, Homo sapiens
acaacagctcgatccaaattgt

SEQ ID NO: 6602473 - DNA, 12 bp, Homo sapiens
acaacaggagag

SEQ ID NO: 6602474 - DNA, 16 bp, Homo sapiens
acaacaggagagagat

SEQ ID NO: 6602475 - DNA, 14 bp, Homo sapiens
acaacaggctgtgt

SEQ ID NO: 6602476 - DNA, 16 bp, Homo sapiens
acaacaggtaaaacag

SEQ ID NO: 6602477 - DNA, 18 bp, Homo sapiens
acaacaggttttcaccat

SEQ ID NO: 6602478 - DNA, 14 bp, Homo sapiens
acaacagtcttgtg

SEQ ID NO: 6602479 - DNA, 20 bp, Homo sapiens
acaacagtgctttgtaaatt

SEQ ID NO: 6602480 - DNA, 23 bp, Homo sapiens
acaacagttacataattcactct

SEQ ID NO: 6602481 - DNA, 14 bp, Homo sapiens
acaacataaaactc

SEQ ID NO: 6602482 - DNA, 14 bp, Homo sapiens
acaacataaaatta

SEQ ID NO: 6602483 - DNA, 22 bp, Homo sapiens
acaacatagcagatctgttttg

SEQ ID NO: 6602484 - DNA, 18 bp, Homo sapiens
acaacatcaccagtgcca

SEQ ID NO: 6602485 - DNA, 22 bp, Homo sapiens
acaacatcaccagtgccacgtc

SEQ ID NO: 6602486 - DNA, 16 bp, Homo sapiens
acaacatccaagtggc

SEQ ID NO: 6602487 - DNA, 14 bp, Homo sapiens
acaacatccactgt

SEQ ID NO: 6602488 - DNA, 19 bp, Homo sapiens
acaacatccatgtcctatg

SEQ ID NO: 6602489 - DNA, 19 bp, Homo sapiens
acaacatcccacagtggca

SEQ ID NO: 6602490 - DNA, 13 bp, Homo sapiens
acaacatgtatgt

SEQ ID NO: 6602491 - DNA, 21 bp, Homo sapiens
acaacatgtttccagcattcc

SEQ ID NO: 6602492 - DNA, 18 bp, Homo sapiens
acaacattatgatctaat

SEQ ID NO: 6602493 - DNA, 18 bp, Homo sapiens
acaacatttatatattgt

SEQ ID NO: 6602494 - DNA, 21 bp, Homo sapiens
acaacatttatatattgtctg

SEQ ID NO: 6602495 - DNA, 23 bp, Homo sapiens
acaacatttatatattgtctgta

SEQ ID NO: 6602496 - DNA, 17 bp, Homo sapiens
acaacatttatatgtag

SEQ ID NO: 6602497 - DNA, 13 bp, Homo sapiens
acaacatttattt

SEQ ID NO: 6602498 - DNA, 14 bp, Homo sapiens
acaacatttctata

SEQ ID NO: 6602499 - DNA, 13 bp, Homo sapiens
acaacattttatt

SEQ ID NO: 6602500 - DNA, 15 bp, Homo sapiens
acaacattttgagaa

SEQ ID NO: 6602501 - DNA, 18 bp, Homo sapiens
acaacattttgagaacaa

SEQ ID NO: 6602502 - DNA, 18 bp, Homo sapiens
acaacatttttgtacatt

SEQ ID NO: 6602503 - DNA, 21 bp, Homo sapiens
acaacatttttgtacattatg

SEQ ID NO: 6602504 - DNA, 15 bp, Homo sapiens
acaaccaaagaaaat

SEQ ID NO: 6602505 - DNA, 18 bp, Homo sapiens
acaaccaagctctctgca

SEQ ID NO: 6602506 - DNA, 21 bp, Homo sapiens
acaaccaatttacactgccat

SEQ ID NO: 6602507 - DNA, 21 bp, Homo sapiens
acaaccacatttctggccatt

SEQ ID NO: 6602508 - DNA, 19 bp, Homo sapiens
acaaccaccgctccccagc

SEQ ID NO: 6602509 - DNA, 21 bp, Homo sapiens
acaaccacctaatcaggctga

SEQ ID NO: 6602510 - DNA, 20 bp, Homo sapiens
acaaccacggtcacacctca

SEQ ID NO: 6602511 - DNA, 15 bp, Homo sapiens
acaaccactggtctg

SEQ ID NO: 6602512 - DNA, 12 bp, Homo sapiens
acaaccagagcc

SEQ ID NO: 6602513 - DNA, 17 bp, Homo sapiens
acaaccagagcccccca

SEQ ID NO: 6602514 - DNA, 17 bp, Homo sapiens
acaaccagccacacaga

SEQ ID NO: 6602515 - DNA, 19 bp, Homo sapiens
acaaccagccacacagagc

SEQ ID NO: 6602516 - DNA, 14 bp, Homo sapiens
acaaccatagaact

SEQ ID NO: 6602517 - DNA, 12 bp, Homo sapiens
ttttttggttaa

SEQ ID NO: 6602518 - DNA, 12 bp, Homo sapiens
ttttttgtaact

SEQ ID NO: 6602519 - DNA, 13 bp, Homo sapiens
ttttttgtaactc

SEQ ID NO: 6602520 - DNA, 13 bp, Homo sapiens
ttttttgtaactt

SEQ ID NO: 6602521 - DNA, 13 bp, Homo sapiens
ttttttgtacgca

SEQ ID NO: 6602522 - DNA, 13 bp, Homo sapiens
ttttttgtatgaa

SEQ ID NO: 6602523 - DNA, 14 bp, Homo sapiens
ttttttgtatgaaa

SEQ ID NO: 6602524 - DNA, 13 bp, Homo sapiens
ttttttgtctgtg

SEQ ID NO: 6602525 - DNA, 14 bp, Homo sapiens
ttttttgtgtatgt

SEQ ID NO: 6602526 - DNA, 13 bp, Homo sapiens
ttttttgtttcat

SEQ ID NO: 6602527 - DNA, 12 bp, Homo sapiens
ttttttgtttgt

SEQ ID NO: 6602528 - DNA, 19 bp, Homo sapiens
tttttttaaatgattccaa

SEQ ID NO: 6602529 - DNA, 12 bp, Homo sapiens
tttttttaacat

SEQ ID NO: 6602530 - DNA, 21 bp, Homo sapiens
tttttttaatagtcattccaa

SEQ ID NO: 6602531 - DNA, 12 bp, Homo sapiens
tttttttacatt

SEQ ID NO: 6602532 - DNA, 13 bp, Homo sapiens
tttttttacgtaa

SEQ ID NO: 6602533 - DNA, 11 bp, Homo sapiens
tttttttacta

SEQ ID NO: 6602534 - DNA, 13 bp, Homo sapiens
tttttttatataa

SEQ ID NO: 6602535 - DNA, 11 bp, Homo sapiens
tttttttcaaa

SEQ ID NO: 6602536 - DNA, 12 bp, Homo sapiens
tttttttcaaaa

SEQ ID NO: 6602537 - DNA, 15 bp, Homo sapiens
tttttttcaagtgct

SEQ ID NO: 6602538 - DNA, 13 bp, Homo sapiens
tttttttcaggtt

SEQ ID NO: 6602539 - DNA, 12 bp, Homo sapiens
tttttttcagta

SEQ ID NO: 6602540 - DNA, 13 bp, Homo sapiens
tttttttccaaat

SEQ ID NO: 6602541 - DNA, 13 bp, Homo sapiens
tttttttccagca

SEQ ID NO: 6602542 - DNA, 12 bp, Homo sapiens
tttttttccatt

SEQ ID NO: 6602543 - DNA, 12 bp, Homo sapiens
tttttttccgtg

SEQ ID NO: 6602544 - DNA, 12 bp, Homo sapiens
tttttttcctaa

SEQ ID NO: 6602545 - DNA, 12 bp, Homo sapiens
tttttttcctgt

SEQ ID NO: 6602546 - DNA, 11 bp, Homo sapiens
tttttttcctt

SEQ ID NO: 6602547 - DNA, 13 bp, Homo sapiens
tttttttctaaaa

SEQ ID NO: 6602548 - DNA, 12 bp, Homo sapiens
tttttttctacc

SEQ ID NO: 6602549 - DNA, 12 bp, Homo sapiens
tttttttctatt

SEQ ID NO: 6602550 - DNA, 14 bp, Homo sapiens
tttttttgaaactt

SEQ ID NO: 6602551 - DNA, 10 bp, Homo sapiens
tttttttgca

SEQ ID NO: 6602552 - DNA, 9 bp, Homo sapiens
tttttttgg

SEQ ID NO: 6602553 - DNA, 13 bp, Homo sapiens
tttttttgtaaac

SEQ ID NO: 6602554 - DNA, 14 bp, Homo sapiens
tttttttgtaactt

SEQ ID NO: 6602555 - DNA, 14 bp, Homo sapiens
tttttttgttatta

SEQ ID NO: 6602556 - DNA, 13 bp, Homo sapiens
tttttttgttctt

SEQ ID NO: 6602557 - DNA, 14 bp, Homo sapiens
tttttttgttttgt

SEQ ID NO: 6602558 - DNA, 12 bp, Homo sapiens
ttttttttaaaa

SEQ ID NO: 6602559 - DNA, 11 bp, Homo sapiens
ttttttttcat

SEQ ID NO: 6602560 - DNA, 11 bp, Homo sapiens
ttttttttcca

SEQ ID NO: 6602561 - DNA, 13 bp, Homo sapiens
ttttttttctgaa

SEQ ID NO: 6602562 - DNA, 13 bp, Homo sapiens
ttttttttgacaa

SEQ ID NO: 6602563 - DNA, 13 bp, Homo sapiens
tttttttttcatt

SEQ ID NO: 6602564 - DNA, 13 bp, Homo sapiens
ttttttttttcag

SEQ ID NO: 6602565 - DNA, 13 bp, Homo sapiens
ttttttttttggt

SEQ ID NO: 6602566 - DNA, 15 bp, Homo sapiens
acaaccatagaactg

SEQ ID NO: 6602567 - DNA, 17 bp, Homo sapiens
acaaccatctcatccta

SEQ ID NO: 6602568 - DNA, 15 bp, Homo sapiens
acaaccatgttcttg

SEQ ID NO: 6602569 - DNA, 13 bp, Homo sapiens
acaaccattaaag

SEQ ID NO: 6602570 - DNA, 13 bp, Homo sapiens
acaacccaaggca

SEQ ID NO: 6602571 - DNA, 11 bp, Homo sapiens
acaacccagaa

SEQ ID NO: 6602572 - DNA, 24 bp, Homo sapiens
acaaccccatcatatgacatgcca

SEQ ID NO: 6602573 - DNA, 13 bp, Homo sapiens
acaacccccagct

SEQ ID NO: 6602574 - DNA, 20 bp, Homo sapiens
acaaccccctccacaaagag

SEQ ID NO: 6602575 - DNA, 23 bp, Homo sapiens
acaaccctgaagcagaggccttt

SEQ ID NO: 6602576 - DNA, 19 bp, Homo sapiens
acaaccctgaccgtgaccg

SEQ ID NO: 6602577 - DNA, 19 bp, Homo sapiens
acaaccctgcaaaggactg

SEQ ID NO: 6602578 - DNA, 14 bp, Homo sapiens
acaaccctggcctc

SEQ ID NO: 6602579 - DNA, 17 bp, Homo sapiens
acaaccctgttttatac

SEQ ID NO: 6602580 - DNA, 18 bp, Homo sapiens
acaaccctgttttatact

SEQ ID NO: 6602581 - DNA, 19 bp, Homo sapiens
acaaccgtcctgctgtccc

SEQ ID NO: 6602582 - DNA, 20 bp, Homo sapiens
acaaccgtcctgctgtccct

SEQ ID NO: 6602583 - DNA, 15 bp, Homo sapiens
acaacctcaccaaac

SEQ ID NO: 6602584 - DNA, 13 bp, Homo sapiens
acaacctccacct

SEQ ID NO: 6602585 - DNA, 16 bp, Homo sapiens
acaacctccctcttgt

SEQ ID NO: 6602586 - DNA, 20 bp, Homo sapiens
acaacctccctcttgttttg

SEQ ID NO: 6602587 - DNA, 21 bp, Homo sapiens
acaacctccctcttgttttgt

SEQ ID NO: 6602588 - DNA, 13 bp, Homo sapiens
acaacctgaacct

SEQ ID NO: 6602589 - DNA, 16 bp, Homo sapiens
acaacctgaaggaata

SEQ ID NO: 6602590 - DNA, 14 bp, Homo sapiens
acaacctgccacaa

SEQ ID NO: 6602591 - DNA, 18 bp, Homo sapiens
acaacctgccacaatgtg

SEQ ID NO: 6602592 - DNA, 21 bp, Homo sapiens
acaacctgccacaatgtgata

SEQ ID NO: 6602593 - DNA, 17 bp, Homo sapiens
acaaccttcagctttat

SEQ ID NO: 6602594 - DNA, 18 bp, Homo sapiens
acaaccttcagctttatt

SEQ ID NO: 6602595 - DNA, 23 bp, Homo sapiens
acaaccttcagctttatttttct

SEQ ID NO: 6602596 - DNA, 18 bp, Homo sapiens
acaaccttctgtggctca

SEQ ID NO: 6602597 - DNA, 12 bp, Homo sapiens
acaacctttctg

SEQ ID NO: 6602598 - DNA, 14 bp, Homo sapiens
acaacctttgtgta

SEQ ID NO: 6602599 - DNA, 14 bp, Homo sapiens
acaaccttttcctc

SEQ ID NO: 6602600 - DNA, 18 bp, Homo sapiens
acaacgaacatggcatgt

SEQ ID NO: 6602601 - DNA, 14 bp, Homo sapiens
acaacgaatgaatg

SEQ ID NO: 6602602 - DNA, 14 bp, Homo sapiens
acaacgattatagt

SEQ ID NO: 6602603 - DNA, 14 bp, Homo sapiens
acaacgatttctcc

SEQ ID NO: 6602604 - DNA, 15 bp, Homo sapiens
acaacgatttctcca

SEQ ID NO: 6602605 - DNA, 20 bp, Homo sapiens
acaacgcataggaaaagaat

SEQ ID NO: 6602606 - DNA, 14 bp, Homo sapiens
acaacggagtcaaa

SEQ ID NO: 6602607 - DNA, 20 bp, Homo sapiens
acaacgggcagaaatcgaga

SEQ ID NO: 6602608 - DNA, 18 bp, Homo sapiens
acaacgtaatcaaatatg

SEQ ID NO: 6602609 - DNA, 14 bp, Homo sapiens
acaacgtctttttg

SEQ ID NO: 6602610 - DNA, 22 bp, Homo sapiens
acaacgtgcaactgacactccc

SEQ ID NO: 6602611 - DNA, 13 bp, Homo sapiens
acaacgtgcattg

SEQ ID NO: 6602612 - DNA, 19 bp, Homo sapiens
acaacgtgtatagtgccta

SEQ ID NO: 6602613 - DNA, 15 bp, Homo sapiens
acaactaaaattagg

SEQ ID NO: 6602614 - DNA, 23 bp, Homo sapiens
acaactaatcaagagtgagtgaa

SEQ ID NO: 6602615 - DNA, 15 bp, Homo sapiens
acaactacagaaaaa

SEQ ID NO: 6602616 - DNA, 20 bp, Homo sapiens
acaactactagtgtgactcc

SEQ ID NO: 6602617 - DNA, 21 bp, Homo sapiens
acaactactagtgtgactcct

SEQ ID NO: 6602618 - DNA, 23 bp, Homo sapiens
acaactagatcaaggagcccaga

SEQ ID NO: 6602619 - DNA, 18 bp, Homo sapiens
acaactagatttgtcctt

SEQ ID NO: 6602620 - DNA, 14 bp, Homo sapiens
acaactaggacctc

SEQ ID NO: 6602621 - DNA, 15 bp, Homo sapiens
acaactaggacctca

SEQ ID NO: 6602622 - DNA, 18 bp, Homo sapiens
acaactatcaattcttga

SEQ ID NO: 6602623 - DNA, 18 bp, Homo sapiens
acaactatcctgacttct

SEQ ID NO: 6602624 - DNA, 17 bp, Homo sapiens
acaactatggatcagaa

SEQ ID NO: 6602625 - DNA, 16 bp, Homo sapiens
acaactatttttccaa

SEQ ID NO: 6602626 - DNA, 15 bp, Homo sapiens
acaactattttttaa

SEQ ID NO: 6602627 - DNA, 16 bp, Homo sapiens
acaactcactcctttt

SEQ ID NO: 6602628 - DNA, 21 bp, Homo sapiens
acaactcactccttttaaaga

SEQ ID NO: 6602629 - DNA, 13 bp, Homo sapiens
acaactcagtctg

SEQ ID NO: 6602630 - DNA, 14 bp, Homo sapiens
acaactcagtctgt

SEQ ID NO: 6602631 - DNA, 14 bp, Homo sapiens
acaactcatacact

SEQ ID NO: 6602632 - DNA, 14 bp, Homo sapiens
acaactccactgtc

SEQ ID NO: 6602633 - DNA, 15 bp, Homo sapiens
acaactccaggaaaa

SEQ ID NO: 6602634 - DNA, 21 bp, Homo sapiens
acaactccaggaaaactgttt

SEQ ID NO: 6602635 - DNA, 14 bp, Homo sapiens
acaactcccccacc

SEQ ID NO: 6602636 - DNA, 23 bp, Homo sapiens
acaactcccccaccgcccactct

SEQ ID NO: 6602637 - DNA, 20 bp, Homo sapiens
acaactcctagggccactga

SEQ ID NO: 6602638 - DNA, 19 bp, Homo sapiens
acaactccttccatccttg

SEQ ID NO: 6602639 - DNA, 20 bp, Homo sapiens
acaactccttccatccttga

SEQ ID NO: 6602640 - DNA, 14 bp, Homo sapiens
acaactctattttt

SEQ ID NO: 6602641 - DNA, 16 bp, Homo sapiens
acaactctgcctttat

SEQ ID NO: 6602642 - DNA, 12 bp, Homo sapiens
acaactgagtcc

SEQ ID NO: 6602643 - DNA, 13 bp, Homo sapiens
acaactgagtcct

SEQ ID NO: 6602644 - DNA, 14 bp, Homo sapiens
acaactgagtcctt

SEQ ID NO: 6602645 - DNA, 23 bp, Homo sapiens
acaactgatcatttgcagctgct

SEQ ID NO: 6602646 - DNA, 18 bp, Homo sapiens
acaactgcaataacttct

SEQ ID NO: 6602647 - DNA, 19 bp, Homo sapiens
acaactgcataacctttac

SEQ ID NO: 6602648 - DNA, 16 bp, Homo sapiens
acaactgccaaataaa

SEQ ID NO: 6602649 - DNA, 21 bp, Homo sapiens
acaactgccaaataaaatgtt

SEQ ID NO: 6602650 - DNA, 21 bp, Homo sapiens
acaactgcctcgaaacacaga

SEQ ID NO: 6602651 - DNA, 13 bp, Homo sapiens
acaactgcctggg

SEQ ID NO: 6602652 - DNA, 21 bp, Homo sapiens
acaactgctcttacttttcca

SEQ ID NO: 6602653 - DNA, 16 bp, Homo sapiens
acaactggacaagatt

SEQ ID NO: 6602654 - DNA, 17 bp, Homo sapiens
acaactggagttttttt

SEQ ID NO: 6602655 - DNA, 20 bp, Homo sapiens
acaactggatgcatcaagaa

SEQ ID NO: 6602656 - DNA, 19 bp, Homo sapiens
acaactggcaggcaggctc

SEQ ID NO: 6602657 - DNA, 17 bp, Homo sapiens
acaactgtctaacttta

SEQ ID NO: 6602658 - DNA, 20 bp, Homo sapiens
acaactgtctaatgacacgg

SEQ ID NO: 6602659 - DNA, 13 bp, Homo sapiens
acaactgtgaata

SEQ ID NO: 6602660 - DNA, 15 bp, Homo sapiens
acaactgtgaatatg

SEQ ID NO: 6602661 - DNA, 11 bp, Homo sapiens
acaactgtgac

SEQ ID NO: 6602662 - DNA, 17 bp, Homo sapiens
acaactgtttttgaaga

SEQ ID NO: 6602663 - DNA, 14 bp, Homo sapiens
acaacttaaaaagt

SEQ ID NO: 6602664 - DNA, 13 bp, Homo sapiens
acaacttaagttg

SEQ ID NO: 6602665 - DNA, 17 bp, Homo sapiens
acaacttagaaaccaaa

SEQ ID NO: 6602666 - DNA, 19 bp, Homo sapiens
acaacttagaaaccaaatt

SEQ ID NO: 6602667 - DNA, 21 bp, Homo sapiens
acaacttagctcaggtgcctt

SEQ ID NO: 6602668 - DNA, 13 bp, Homo sapiens
acaacttagtgta

SEQ ID NO: 6602669 - DNA, 18 bp, Homo sapiens
acaacttatttaaaaata

SEQ ID NO: 6602670 - DNA, 23 bp, Homo sapiens
acaacttatttaaaaatatttca

SEQ ID NO: 6602671 - DNA, 17 bp, Homo sapiens
acaacttccagatttga

SEQ ID NO: 6602672 - DNA, 21 bp, Homo sapiens
acaacttctgtttcttctctt

SEQ ID NO: 6602673 - DNA, 15 bp, Homo sapiens
acaacttgatttttt

SEQ ID NO: 6602674 - DNA, 18 bp, Homo sapiens
acaacttgattttttcaa

SEQ ID NO: 6602675 - DNA, 20 bp, Homo sapiens
acaacttgctacttatcatt

SEQ ID NO: 6602676 - DNA, 21 bp, Homo sapiens
acaacttgctacttatcattt

SEQ ID NO: 6602677 - DNA, 18 bp, Homo sapiens
acaacttgctcctttcca

SEQ ID NO: 6602678 - DNA, 15 bp, Homo sapiens
acaacttggcatttc

SEQ ID NO: 6602679 - DNA, 17 bp, Homo sapiens
acaacttggcatttcta

SEQ ID NO: 6602680 - DNA, 18 bp, Homo sapiens
acaacttgtacttgtttc

SEQ ID NO: 6602681 - DNA, 22 bp, Homo sapiens
acaactttaccataaagccttt

SEQ ID NO: 6602682 - DNA, 19 bp, Homo sapiens
acaactttatgtagagaaa

SEQ ID NO: 6602683 - DNA, 22 bp, Homo sapiens
acaactttcactataatgtgaa

SEQ ID NO: 6602684 - DNA, 15 bp, Homo sapiens
acaactttcacttct

SEQ ID NO: 6602685 - DNA, 19 bp, Homo sapiens
acaactttcacttcttcct

SEQ ID NO: 6602686 - DNA, 20 bp, Homo sapiens
acaactttcactttgcaaag

SEQ ID NO: 6602687 - DNA, 13 bp, Homo sapiens
acaactttctgga

SEQ ID NO: 6602688 - DNA, 13 bp, Homo sapiens
acaactttgccag

SEQ ID NO: 6602689 - DNA, 17 bp, Homo sapiens
acaacttttccctcact

SEQ ID NO: 6602690 - DNA, 23 bp, Homo sapiens
acaacttttgagagtatagcatg

SEQ ID NO: 6602691 - DNA, 16 bp, Homo sapiens
acaacttttgttttct

SEQ ID NO: 6602692 - DNA, 15 bp, Homo sapiens
acaagaaaaagtaga

SEQ ID NO: 6602693 - DNA, 18 bp, Homo sapiens
acaagaaaaataaagaaa

SEQ ID NO: 6602694 - DNA, 19 bp, Homo sapiens
acaagaaaacaatggggct

SEQ ID NO: 6602695 - DNA, 10 bp, Homo sapiens
acaagaaaat

SEQ ID NO: 6602696 - DNA, 20 bp, Homo sapiens
acaagaaaccaagtgggctg

SEQ ID NO: 6602697 - DNA, 15 bp, Homo sapiens
acaagaaagaaatgg

SEQ ID NO: 6602698 - DNA, 12 bp, Homo sapiens
acaagaaaggag

SEQ ID NO: 6602699 - DNA, 16 bp, Homo sapiens
acaagaaaggcagaca

SEQ ID NO: 6602700 - DNA, 17 bp, Homo sapiens
acaagaaataatagaaa

SEQ ID NO: 6602701 - DNA, 15 bp, Homo sapiens
acaagaaatccctgt

SEQ ID NO: 6602702 - DNA, 12 bp, Homo sapiens
acaagaaatctg

SEQ ID NO: 6602703 - DNA, 13 bp, Homo sapiens
acaagaaatgaaa

SEQ ID NO: 6602704 - DNA, 10 bp, Homo sapiens
acaagaaatt

SEQ ID NO: 6602705 - DNA, 14 bp, Homo sapiens
acaagaactccctt

SEQ ID NO: 6602706 - DNA, 17 bp, Homo sapiens
acaagaagaaatatgaa

SEQ ID NO: 6602707 - DNA, 19 bp, Homo sapiens
acaagaagaatttgaagac

SEQ ID NO: 6602708 - DNA, 13 bp, Homo sapiens
acaagaagaccag

SEQ ID NO: 6602709 - DNA, 16 bp, Homo sapiens
acaagaagagtaaaca

SEQ ID NO: 6602710 - DNA, 12 bp, Homo sapiens
acaagaagatga

SEQ ID NO: 6602711 - DNA, 17 bp, Homo sapiens
acaagaagcattttgta

SEQ ID NO: 6602712 - DNA, 13 bp, Homo sapiens
acaagaagctgct

SEQ ID NO: 6602713 - DNA, 14 bp, Homo sapiens
acaagaagctgcta

SEQ ID NO: 6602714 - DNA, 15 bp, Homo sapiens
acaagaaggaacaat

SEQ ID NO: 6602715 - DNA, 13 bp, Homo sapiens
acaagaaggccag

SEQ ID NO: 6602716 - DNA, 14 bp, Homo sapiens
acaagaaggccagc

SEQ ID NO: 6602717 - DNA, 22 bp, Homo sapiens
acaagaagtgggagtgggagag

SEQ ID NO: 6602718 - DNA, 21 bp, Homo sapiens
acaagaagtttattctcattt

SEQ ID NO: 6602719 - DNA, 19 bp, Homo sapiens
acaagaataagcagcaaat

SEQ ID NO: 6602720 - DNA, 17 bp, Homo sapiens
acaagaataattttgga

SEQ ID NO: 6602721 - DNA, 14 bp, Homo sapiens
acaagaatggatca

SEQ ID NO: 6602722 - DNA, 17 bp, Homo sapiens
acaagaatggtgtgtgc

SEQ ID NO: 6602723 - DNA, 13 bp, Homo sapiens
acaagaatgtccc

SEQ ID NO: 6602724 - DNA, 20 bp, Homo sapiens
acaagaattacactaatagt

SEQ ID NO: 6602725 - DNA, 21 bp, Homo sapiens
acaagaattgagtatcacttt

SEQ ID NO: 6602726 - DNA, 15 bp, Homo sapiens
acaagacaacattgt

SEQ ID NO: 6602727 - DNA, 17 bp, Homo sapiens
acaagacaacattgtaa

SEQ ID NO: 6602728 - DNA, 16 bp, Homo sapiens
acaagacaagctcctc

SEQ ID NO: 6602729 - DNA, 15 bp, Homo sapiens
acaagacagaagctg

SEQ ID NO: 6602730 - DNA, 16 bp, Homo sapiens
acaagacagaggggag

SEQ ID NO: 6602731 - DNA, 19 bp, Homo sapiens
acaagacagaggggagcag

SEQ ID NO: 6602732 - DNA, 20 bp, Homo sapiens
acaagacagaggggagcagt

SEQ ID NO: 6602733 - DNA, 20 bp, Homo sapiens
acaagacagcagagccatct

SEQ ID NO: 6602734 - DNA, 21 bp, Homo sapiens
acaagacataatttaaaataa

SEQ ID NO: 6602735 - DNA, 14 bp, Homo sapiens
acaagacatttctt

SEQ ID NO: 6602736 - DNA, 19 bp, Homo sapiens
acaagacatttctttctgt

SEQ ID NO: 6602737 - DNA, 16 bp, Homo sapiens
acaagaccacgtttct

SEQ ID NO: 6602738 - DNA, 17 bp, Homo sapiens
acaagaccacgtttcta

SEQ ID NO: 6602739 - DNA, 18 bp, Homo sapiens
acaagacccaagtagctg

SEQ ID NO: 6602740 - DNA, 15 bp, Homo sapiens
acaagacccctgctc

SEQ ID NO: 6602741 - DNA, 13 bp, Homo sapiens
acaagaccctctc

SEQ ID NO: 6602742 - DNA, 16 bp, Homo sapiens
acaagaccctctcagg

SEQ ID NO: 6602743 - DNA, 19 bp, Homo sapiens
acaagaccctgtctcaaaa

SEQ ID NO: 6602744 - DNA, 17 bp, Homo sapiens
acaagaccgccccaggg

SEQ ID NO: 6602745 - DNA, 14 bp, Homo sapiens
acaagacctctggc

SEQ ID NO: 6602746 - DNA, 14 bp, Homo sapiens
acaagactgcacat

SEQ ID NO: 6602747 - DNA, 16 bp, Homo sapiens
acaagactgccaggtg

SEQ ID NO: 6602748 - DNA, 13 bp, Homo sapiens
acaagactgcctc

SEQ ID NO: 6602749 - DNA, 14 bp, Homo sapiens
acaagactggccca

SEQ ID NO: 6602750 - DNA, 16 bp, Homo sapiens
acaagactgtaaattc

SEQ ID NO: 6602751 - DNA, 19 bp, Homo sapiens
acaagactgtaaattccaa

SEQ ID NO: 6602752 - DNA, 22 bp, Homo sapiens
acaagactgtaaattccaaaga

SEQ ID NO: 6602753 - DNA, 23 bp, Homo sapiens
acaagactgtaaattccaaagat

SEQ ID NO: 6602754 - DNA, 18 bp, Homo sapiens
acaagactgttgtgatct

SEQ ID NO: 6602755 - DNA, 14 bp, Homo sapiens
acaagacttcagta

SEQ ID NO: 6602756 - DNA, 16 bp, Homo sapiens
acaagacttcagtatg

SEQ ID NO: 6602757 - DNA, 17 bp, Homo sapiens
acaagagaccaactttt

SEQ ID NO: 6602758 - DNA, 17 bp, Homo sapiens
acaagagaccacttcct

SEQ ID NO: 6602759 - DNA, 21 bp, Homo sapiens
acaagagacccctgtctggca

SEQ ID NO: 6602760 - DNA, 21 bp, Homo sapiens
acaagagacttaaaggacagg

SEQ ID NO: 6602761 - DNA, 19 bp, Homo sapiens
acaagagatcagcagtggc

SEQ ID NO: 6602762 - DNA, 17 bp, Homo sapiens
acaagagatctacacat

SEQ ID NO: 6602763 - DNA, 18 bp, Homo sapiens
acaagagatctacacatg

SEQ ID NO: 6602764 - DNA, 19 bp, Homo sapiens
acaagagccatgtaccagt

SEQ ID NO: 6602765 - DNA, 18 bp, Homo sapiens
acaagagcccaggcctcc

SEQ ID NO: 6602766 - DNA, 22 bp, Homo sapiens
acaagagcctgatctcttcctg

SEQ ID NO: 6602767 - DNA, 17 bp, Homo sapiens
acaagagcctgattttt

SEQ ID NO: 6602768 - DNA, 15 bp, Homo sapiens
acaagagctgctgtc

SEQ ID NO: 6602769 - DNA, 22 bp, Homo sapiens
acaagagctgttatgctgtttc

SEQ ID NO: 6602770 - DNA, 16 bp, Homo sapiens
acaagaggaagagaga

SEQ ID NO: 6602771 - DNA, 18 bp, Homo sapiens
acaagaggattgtaaaat

SEQ ID NO: 6602772 - DNA, 20 bp, Homo sapiens
acaagagggactgtatttct

SEQ ID NO: 6602773 - DNA, 16 bp, Homo sapiens
acaagagggcaaagct

SEQ ID NO: 6602774 - DNA, 18 bp, Homo sapiens
acaagagggcaagcctct

SEQ ID NO: 6602775 - DNA, 19 bp, Homo sapiens
acaagaggtacagggtttt

SEQ ID NO: 6602776 - DNA, 23 bp, Homo sapiens
acaagaggttaaggtgggtccag

SEQ ID NO: 6602777 - DNA, 22 bp, Homo sapiens
acaagaggttagaaatactttt

SEQ ID NO: 6602778 - DNA, 17 bp, Homo sapiens
acaagagtccctttgaa

SEQ ID NO: 6602779 - DNA, 21 bp, Homo sapiens
acaagagtgagactccacctc

SEQ ID NO: 6602780 - DNA, 22 bp, Homo sapiens
acaagagtgattcttgctgcta

SEQ ID NO: 6602781 - DNA, 19 bp, Homo sapiens
acaagagtggtatatacaa

SEQ ID NO: 6602782 - DNA, 23 bp, Homo sapiens
acaagagtgtctatggagcagcc

SEQ ID NO: 6602783 - DNA, 19 bp, Homo sapiens
acaagatattatgtataaa

SEQ ID NO: 6602784 - DNA, 22 bp, Homo sapiens
acaagatattgtacataaaaga

SEQ ID NO: 6602785 - DNA, 20 bp, Homo sapiens
acaagatatttatatgttat

SEQ ID NO: 6602786 - DNA, 15 bp, Homo sapiens
acaagatccaggcag

SEQ ID NO: 6602787 - DNA, 15 bp, Homo sapiens
acaagatccatttgc

SEQ ID NO: 6602788 - DNA, 20 bp, Homo sapiens
acaagatccatttgcctttc

SEQ ID NO: 6602789 - DNA, 14 bp, Homo sapiens
acaagatctttcag

SEQ ID NO: 6602790 - DNA, 18 bp, Homo sapiens
acaagatgccccagggat

SEQ ID NO: 6602791 - DNA, 13 bp, Homo sapiens
acaagatgggaca

SEQ ID NO: 6602792 - DNA, 20 bp, Homo sapiens
acaagatgggacagcaacaa

SEQ ID NO: 6602793 - DNA, 20 bp, Homo sapiens
acaagatgtagcaccttttc

SEQ ID NO: 6602794 - DNA, 17 bp, Homo sapiens
acaagatgtttcatttt

SEQ ID NO: 6602795 - DNA, 18 bp, Homo sapiens
acaagattataatatttt

SEQ ID NO: 6602796 - DNA, 17 bp, Homo sapiens
acaagattattttatca

SEQ ID NO: 6602797 - DNA, 15 bp, Homo sapiens
acaagattcccagag

SEQ ID NO: 6602798 - DNA, 17 bp, Homo sapiens
acaagattggtgttttt

SEQ ID NO: 6602799 - DNA, 18 bp, Homo sapiens
acaagattggtgtttttt

SEQ ID NO: 6602800 - DNA, 22 bp, Homo sapiens
acaagattggtgtttttttcta

SEQ ID NO: 6602801 - DNA, 14 bp, Homo sapiens
acaagatttcctta

SEQ ID NO: 6602802 - DNA, 15 bp, Homo sapiens
acaagattttttaat

SEQ ID NO: 6602803 - DNA, 17 bp, Homo sapiens
acaagcaaactgaaatt

SEQ ID NO: 6602804 - DNA, 22 bp, Homo sapiens
acaagcaacataaaacaatgaa

SEQ ID NO: 6602805 - DNA, 22 bp, Homo sapiens
acaagcaaggatatcagagctg

SEQ ID NO: 6602806 - DNA, 19 bp, Homo sapiens
acaagcaagggtctccttc

SEQ ID NO: 6602807 - DNA, 16 bp, Homo sapiens
acaagcaagttctgag

SEQ ID NO: 6602808 - DNA, 13 bp, Homo sapiens
acaagcaataatt

SEQ ID NO: 6602809 - DNA, 15 bp, Homo sapiens
acaagcaataattag

SEQ ID NO: 6602810 - DNA, 21 bp, Homo sapiens
acaagcaatgatgacccacta

SEQ ID NO: 6602811 - DNA, 14 bp, Homo sapiens
acaagcaatgcaag

SEQ ID NO: 6602812 - DNA, 12 bp, Homo sapiens
acaagcacaaag

SEQ ID NO: 6602813 - DNA, 20 bp, Homo sapiens
acaagcactattttatattt

SEQ ID NO: 6602814 - DNA, 18 bp, Homo sapiens
acaagcagacacacacat

SEQ ID NO: 6602815 - DNA, 20 bp, Homo sapiens
acaagcagacacacacatat

SEQ ID NO: 6602816 - DNA, 22 bp, Homo sapiens
acaagcagacacacacatatat

SEQ ID NO: 6602817 - DNA, 20 bp, Homo sapiens
acaagcagagtgcacagctg

SEQ ID NO: 6602818 - DNA, 22 bp, Homo sapiens
acaagcagagtgcacagctgtc

SEQ ID NO: 6602819 - DNA, 16 bp, Homo sapiens
acaagcaggatggctg

SEQ ID NO: 6602820 - DNA, 15 bp, Homo sapiens
acaagcagtgtctgt

SEQ ID NO: 6602821 - DNA, 19 bp, Homo sapiens
acaagcatataaaatggca

SEQ ID NO: 6602822 - DNA, 14 bp, Homo sapiens
acaagcatatttga

SEQ ID NO: 6602823 - DNA, 15 bp, Homo sapiens
acaagcatgcataaa

SEQ ID NO: 6602824 - DNA, 17 bp, Homo sapiens
acaagcatgcataaatc

SEQ ID NO: 6602825 - DNA, 23 bp, Homo sapiens
acaagcatggtcccacatccctg

SEQ ID NO: 6602826 - DNA, 21 bp, Homo sapiens
acaagcattccttagcagctc

SEQ ID NO: 6602827 - DNA, 22 bp, Homo sapiens
acaagccaaaagtccctccctg

SEQ ID NO: 6602828 - DNA, 17 bp, Homo sapiens
acaagccaaaatgggag

SEQ ID NO: 6602829 - DNA, 21 bp, Homo sapiens
acaagccaacttgtaaataca

SEQ ID NO: 6602830 - DNA, 12 bp, Homo sapiens
acaagccaagaa

SEQ ID NO: 6602831 - DNA, 12 bp, Homo sapiens
acaagccacccc

SEQ ID NO: 6602832 - DNA, 14 bp, Homo sapiens
acaagccagaactt

SEQ ID NO: 6602833 - DNA, 13 bp, Homo sapiens
acaagccagctgg

SEQ ID NO: 6602834 - DNA, 23 bp, Homo sapiens
acaagccaggccctctctgcagt

SEQ ID NO: 6602835 - DNA, 13 bp, Homo sapiens
acaagcccaggac

SEQ ID NO: 6602836 - DNA, 16 bp, Homo sapiens
acaagcccaggctgga

SEQ ID NO: 6602837 - DNA, 15 bp, Homo sapiens
acaagccccaggcag

SEQ ID NO: 6602838 - DNA, 17 bp, Homo sapiens
acaagccccaggcaggc

SEQ ID NO: 6602839 - DNA, 15 bp, Homo sapiens
acaagccccctgccc

SEQ ID NO: 6602840 - DNA, 18 bp, Homo sapiens
acaagccctaacttctgt

SEQ ID NO: 6602841 - DNA, 15 bp, Homo sapiens
acaagccctgcttgc

SEQ ID NO: 6602842 - DNA, 19 bp, Homo sapiens
acaagccctgcttttgcat

SEQ ID NO: 6602843 - DNA, 13 bp, Homo sapiens
acaagccctggca

SEQ ID NO: 6602844 - DNA, 15 bp, Homo sapiens
acaagccgtgtttta

SEQ ID NO: 6602845 - DNA, 17 bp, Homo sapiens
acaagcctcctgtacct

SEQ ID NO: 6602846 - DNA, 20 bp, Homo sapiens
acaagcctggtaggaaaggg

SEQ ID NO: 6602847 - DNA, 14 bp, Homo sapiens
acaagccttaatct

SEQ ID NO: 6602848 - DNA, 17 bp, Homo sapiens
acaagccttactcacct

SEQ ID NO: 6602849 - DNA, 21 bp, Homo sapiens
acaagccttactcacctctct

SEQ ID NO: 6602850 - DNA, 18 bp, Homo sapiens
acaagccttcagccacag

SEQ ID NO: 6602851 - DNA, 16 bp, Homo sapiens
acaagcgctcccagcc

SEQ ID NO: 6602852 - DNA, 17 bp, Homo sapiens
acaagcgctcccagcct

SEQ ID NO: 6602853 - DNA, 18 bp, Homo sapiens
acaagcgctcccagcctg

SEQ ID NO: 6602854 - DNA, 19 bp, Homo sapiens
acaagcgctcccagcctgc

SEQ ID NO: 6602855 - DNA, 23 bp, Homo sapiens
acaagcgtcacttctcctgctgc

SEQ ID NO: 6602856 - DNA, 16 bp, Homo sapiens
acaagctaacttccac

SEQ ID NO: 6602857 - DNA, 14 bp, Homo sapiens
acaagctaagagtt

SEQ ID NO: 6602858 - DNA, 14 bp, Homo sapiens
acaagctacatatg

SEQ ID NO: 6602859 - DNA, 12 bp, Homo sapiens
acaagctactta

SEQ ID NO: 6602860 - DNA, 17 bp, Homo sapiens
acaagctaggtgctaat

SEQ ID NO: 6602861 - DNA, 22 bp, Homo sapiens
acaagctaggtgctaattaata

SEQ ID NO: 6602862 - DNA, 22 bp, Homo sapiens
acaagctcacagacctttgaac

SEQ ID NO: 6602863 - DNA, 16 bp, Homo sapiens
acaagctccaagctcc

SEQ ID NO: 6602864 - DNA, 15 bp, Homo sapiens
acaagctcctccctt

SEQ ID NO: 6602865 - DNA, 17 bp, Homo sapiens
acaagctcttgtttctg

SEQ ID NO: 6602866 - DNA, 22 bp, Homo sapiens
acaagctcttgtttctgtttag

SEQ ID NO: 6602867 - DNA, 15 bp, Homo sapiens
acaagctgatagtgt

SEQ ID NO: 6602868 - DNA, 16 bp, Homo sapiens
acaagctgcactgtga

SEQ ID NO: 6602869 - DNA, 13 bp, Homo sapiens
acaagctgcctcc

SEQ ID NO: 6602870 - DNA, 24 bp, Homo sapiens
acaagctgcctctgacagcagcct

SEQ ID NO: 6602871 - DNA, 18 bp, Homo sapiens
acaagctggaagcacatg

SEQ ID NO: 6602872 - DNA, 20 bp, Homo sapiens
acaagctggccaaagtcact

SEQ ID NO: 6602873 - DNA, 23 bp, Homo sapiens
acaagctggccaaagtcacttcc

SEQ ID NO: 6602874 - DNA, 15 bp, Homo sapiens
acaagctggcttctg

SEQ ID NO: 6602875 - DNA, 16 bp, Homo sapiens
acaagctggcttctgt

SEQ ID NO: 6602876 - DNA, 16 bp, Homo sapiens
acaagctgggaacttc

SEQ ID NO: 6602877 - DNA, 19 bp, Homo sapiens
acaagctgtataaacagaa

SEQ ID NO: 6602878 - DNA, 17 bp, Homo sapiens
acaagctgtccctgcag

SEQ ID NO: 6602879 - DNA, 13 bp, Homo sapiens
acaagctgtgcag

SEQ ID NO: 6602880 - DNA, 18 bp, Homo sapiens
acaagcttcaaagccata

SEQ ID NO: 6602881 - DNA, 19 bp, Homo sapiens
acaagcttcaaagccatat

SEQ ID NO: 6602882 - DNA, 21 bp, Homo sapiens
acaagcttcaaagccatatgg

SEQ ID NO: 6602883 - DNA, 17 bp, Homo sapiens
acaagcttctgtcctgc

SEQ ID NO: 6602884 - DNA, 12 bp, Homo sapiens
acaagcttgtat

SEQ ID NO: 6602885 - DNA, 18 bp, Homo sapiens
acaagcttgtatatacat

SEQ ID NO: 6602886 - DNA, 23 bp, Homo sapiens
acaagcttttagtatccacagga

SEQ ID NO: 6602887 - DNA, 20 bp, Homo sapiens
acaagcttttttacacaaat

SEQ ID NO: 6602888 - DNA, 13 bp, Homo sapiens
acaaggaaaagga

SEQ ID NO: 6602889 - DNA, 15 bp, Homo sapiens
acaaggaaccctcag

SEQ ID NO: 6602890 - DNA, 19 bp, Homo sapiens
acaaggaaccctcaggcca

SEQ ID NO: 6602891 - DNA, 23 bp, Homo sapiens
acaaggaagtgggggccgctggc

SEQ ID NO: 6602892 - DNA, 13 bp, Homo sapiens
acaaggaataaat

SEQ ID NO: 6602893 - DNA, 21 bp, Homo sapiens
acaaggaatagtcgcgcaagc

SEQ ID NO: 6602894 - DNA, 11 bp, Homo sapiens
acaaggaatgc

SEQ ID NO: 6602895 - DNA, 20 bp, Homo sapiens
acaaggaatgcctgtgccaa

SEQ ID NO: 6602896 - DNA, 19 bp, Homo sapiens
acaaggaatttccctgtgt

SEQ ID NO: 6602897 - DNA, 17 bp, Homo sapiens
acaaggacattcactgc

SEQ ID NO: 6602898 - DNA, 14 bp, Homo sapiens
acaaggaccctgtt

SEQ ID NO: 6602899 - DNA, 21 bp, Homo sapiens
acaaggaccctgttttccaca

SEQ ID NO: 6602900 - DNA, 15 bp, Homo sapiens
acaaggacgctggct

SEQ ID NO: 6602901 - DNA, 10 bp, Homo sapiens
acaaggactc

SEQ ID NO: 6602902 - DNA, 15 bp, Homo sapiens
acaaggactcagatg

SEQ ID NO: 6602903 - DNA, 18 bp, Homo sapiens
acaaggagataagaaagc

SEQ ID NO: 6602904 - DNA, 19 bp, Homo sapiens
acaaggagataagaaagca

SEQ ID NO: 6602905 - DNA, 19 bp, Homo sapiens
acaaggagctcaccctgcc

SEQ ID NO: 6602906 - DNA, 21 bp, Homo sapiens
acaaggagctttcttgtttct

SEQ ID NO: 6602907 - DNA, 23 bp, Homo sapiens
acaaggagctttcttgtttctta

SEQ ID NO: 6602908 - DNA, 21 bp, Homo sapiens
acaaggatagatgctggccca

SEQ ID NO: 6602909 - DNA, 13 bp, Homo sapiens
acaaggattgaaa

SEQ ID NO: 6602910 - DNA, 17 bp, Homo sapiens
acaaggattgaaaattc

SEQ ID NO: 6602911 - DNA, 17 bp, Homo sapiens
acaaggcaaaaacaaag

SEQ ID NO: 6602912 - DNA, 12 bp, Homo sapiens
acaaggcaaggc

SEQ ID NO: 6602913 - DNA, 16 bp, Homo sapiens
acaaggcaaggctgtc

SEQ ID NO: 6602914 - DNA, 19 bp, Homo sapiens
acaaggcaaggctgtcaat

SEQ ID NO: 6602915 - DNA, 15 bp, Homo sapiens
acaaggcagcaaggc

SEQ ID NO: 6602916 - DNA, 21 bp, Homo sapiens
acaaggcaggcctttcctaca

SEQ ID NO: 6602917 - DNA, 17 bp, Homo sapiens
acaaggccagaaaaaga

SEQ ID NO: 6602918 - DNA, 18 bp, Homo sapiens
acaaggccagaaaaagaa

SEQ ID NO: 6602919 - DNA, 22 bp, Homo sapiens
acaaggccagaaaaagaagaag

SEQ ID NO: 6602920 - DNA, 13 bp, Homo sapiens
acaaggcccagga

SEQ ID NO: 6602921 - DNA, 18 bp, Homo sapiens
acaaggccccagagactc

SEQ ID NO: 6602922 - DNA, 15 bp, Homo sapiens
acaaggcctgcttga

SEQ ID NO: 6602923 - DNA, 16 bp, Homo sapiens
acaaggctgaaaagtg

SEQ ID NO: 6602924 - DNA, 20 bp, Homo sapiens
acaaggctgaaaagtgcttt

SEQ ID NO: 6602925 - DNA, 18 bp, Homo sapiens
acaaggctgaccaagaga

SEQ ID NO: 6602926 - DNA, 20 bp, Homo sapiens
acaaggctgaccaagagaga

SEQ ID NO: 6602927 - DNA, 12 bp, Homo sapiens
acaaggctgtgc

SEQ ID NO: 6602928 - DNA, 17 bp, Homo sapiens
acaaggctgtgccaggc

SEQ ID NO: 6602929 - DNA, 19 bp, Homo sapiens
acaaggctgtgccaggctg

SEQ ID NO: 6602930 - DNA, 23 bp, Homo sapiens
acaagggaaaaatttttatgtaa

SEQ ID NO: 6602931 - DNA, 19 bp, Homo sapiens
acaagggagagacctcatc

SEQ ID NO: 6602932 - DNA, 15 bp, Homo sapiens
acaagggaggcagtg

SEQ ID NO: 6602933 - DNA, 15 bp, Homo sapiens
acaagggatataaaa

SEQ ID NO: 6602934 - DNA, 19 bp, Homo sapiens
acaagggatataaaatgaa

SEQ ID NO: 6602935 - DNA, 17 bp, Homo sapiens
acaagggattctgggaa

SEQ ID NO: 6602936 - DNA, 21 bp, Homo sapiens
acaagggcagtggaggtgctg

SEQ ID NO: 6602937 - DNA, 18 bp, Homo sapiens
acaagggctacctctgag

SEQ ID NO: 6602938 - DNA, 21 bp, Homo sapiens
acaagggctctcaaagtataa

SEQ ID NO: 6602939 - DNA, 19 bp, Homo sapiens
acaaggggcattgttgctt

SEQ ID NO: 6602940 - DNA, 13 bp, Homo sapiens
acaaggggccctt

SEQ ID NO: 6602941 - DNA, 21 bp, Homo sapiens
acaaggggtggaagggcagga

SEQ ID NO: 6602942 - DNA, 22 bp, Homo sapiens
acaaggggtggaagggcaggag

SEQ ID NO: 6602943 - DNA, 22 bp, Homo sapiens
acaagggtccgtggaccaggag

SEQ ID NO: 6602944 - DNA, 15 bp, Homo sapiens
acaaggtagacatgg

SEQ ID NO: 6602945 - DNA, 22 bp, Homo sapiens
acaaggtaggctgcaaaattaa

SEQ ID NO: 6602946 - DNA, 18 bp, Homo sapiens
acaaggtatttacacata

SEQ ID NO: 6602947 - DNA, 15 bp, Homo sapiens
acaaggtcatggcca

SEQ ID NO: 6602948 - DNA, 20 bp, Homo sapiens
acaaggtcatggccacactg

SEQ ID NO: 6602949 - DNA, 17 bp, Homo sapiens
acaaggtccaagatacc

SEQ ID NO: 6602950 - DNA, 11 bp, Homo sapiens
acaaggtcccc

SEQ ID NO: 6602951 - DNA, 23 bp, Homo sapiens
acaaggtgagtgtgacttccctt

SEQ ID NO: 6602952 - DNA, 16 bp, Homo sapiens
acaaggtggcagcaag

SEQ ID NO: 6602953 - DNA, 15 bp, Homo sapiens
acaaggtgtgtgtgt

SEQ ID NO: 6602954 - DNA, 19 bp, Homo sapiens
acaaggttatatgaatata

SEQ ID NO: 6602955 - DNA, 13 bp, Homo sapiens
acaaggttcttcc

SEQ ID NO: 6602956 - DNA, 18 bp, Homo sapiens
acaaggttcttctaaaat

SEQ ID NO: 6602957 - DNA, 22 bp, Homo sapiens
acaaggttgctggcatttgctg

SEQ ID NO: 6602958 - DNA, 19 bp, Homo sapiens
acaaggttggcaccccagc

SEQ ID NO: 6602959 - DNA, 19 bp, Homo sapiens
acaagtaaaggcattgtcc

SEQ ID NO: 6602960 - DNA, 14 bp, Homo sapiens
acaagtaatgaatt

SEQ ID NO: 6602961 - DNA, 15 bp, Homo sapiens
acaagtaattttgca

SEQ ID NO: 6602962 - DNA, 22 bp, Homo sapiens
acaagtactggctctttattca

SEQ ID NO: 6602963 - DNA, 21 bp, Homo sapiens
acaagtagagatgaagttaaa

SEQ ID NO: 6602964 - DNA, 20 bp, Homo sapiens
acaagtagatgcctgaactt

SEQ ID NO: 6602965 - DNA, 17 bp, Homo sapiens
acaagtagattgatcta

SEQ ID NO: 6602966 - DNA, 14 bp, Homo sapiens
acaagtaggagaca

SEQ ID NO: 6602967 - DNA, 11 bp, Homo sapiens
acaagtagttc

SEQ ID NO: 6602968 - DNA, 16 bp, Homo sapiens
acaagtagttctgtat

SEQ ID NO: 6602969 - DNA, 23 bp, Homo sapiens
acaagtagttctgtatttgaaag

SEQ ID NO: 6602970 - DNA, 17 bp, Homo sapiens
acaagtatataatttac

SEQ ID NO: 6602971 - DNA, 22 bp, Homo sapiens
acaagtatatacttttaaatta

SEQ ID NO: 6602972 - DNA, 23 bp, Homo sapiens
acaagtatcatctaaatattatg

SEQ ID NO: 6602973 - DNA, 21 bp, Homo sapiens
acaagtatgaataaagacacc

SEQ ID NO: 6602974 - DNA, 14 bp, Homo sapiens
acaagtatgaatct

SEQ ID NO: 6602975 - DNA, 13 bp, Homo sapiens
acaagtattcagt

SEQ ID NO: 6602976 - DNA, 19 bp, Homo sapiens
acaagtattcagttccaat

SEQ ID NO: 6602977 - DNA, 14 bp, Homo sapiens
acaagtatttgtta

SEQ ID NO: 6602978 - DNA, 20 bp, Homo sapiens
acaagtatttgttaatttag

SEQ ID NO: 6602979 - DNA, 15 bp, Homo sapiens
acaagtattttatat

SEQ ID NO: 6602980 - DNA, 12 bp, Homo sapiens
acaagtattttt

SEQ ID NO: 6602981 - DNA, 14 bp, Homo sapiens
acaagtcacagctg

SEQ ID NO: 6602982 - DNA, 18 bp, Homo sapiens
acaagtcatggacattca

SEQ ID NO: 6602983 - DNA, 17 bp, Homo sapiens
acaagtcatggtcacag

SEQ ID NO: 6602984 - DNA, 21 bp, Homo sapiens
acaagtcatttcaaaatatgt

SEQ ID NO: 6602985 - DNA, 14 bp, Homo sapiens
acaagtcatttttg

SEQ ID NO: 6602986 - DNA, 16 bp, Homo sapiens
acaagtccctgtaatt

SEQ ID NO: 6602987 - DNA, 17 bp, Homo sapiens
acaagtccctgtaattg

SEQ ID NO: 6602988 - DNA, 15 bp, Homo sapiens
acaagtctaaacaat

SEQ ID NO: 6602989 - DNA, 20 bp, Homo sapiens
acaagtctaaacaatgaatt

SEQ ID NO: 6602990 - DNA, 15 bp, Homo sapiens
acaagtctataatgt

SEQ ID NO: 6602991 - DNA, 17 bp, Homo sapiens
acaagtcttgctgtgct

SEQ ID NO: 6602992 - DNA, 16 bp, Homo sapiens
acaagtctttccagag

SEQ ID NO: 6602993 - DNA, 16 bp, Homo sapiens
acaagtgaaaactgat

SEQ ID NO: 6602994 - DNA, 22 bp, Homo sapiens
acaagtgaagaacactactgct

SEQ ID NO: 6602995 - DNA, 24 bp, Homo sapiens
acaagtgaatctttctcctggtga

SEQ ID NO: 6602996 - DNA, 15 bp, Homo sapiens
acaagtgaccccagg

SEQ ID NO: 6602997 - DNA, 17 bp, Homo sapiens
acaagtgaccccagggc

SEQ ID NO: 6602998 - DNA, 19 bp, Homo sapiens
acaagtgactgtatctgtg

SEQ ID NO: 6602999 - DNA, 17 bp, Homo sapiens
acaagtgagacaaaaag

SEQ ID NO: 6603000 - DNA, 19 bp, Homo sapiens
acaagtgagacaaaaagca

SEQ ID NO: 6603001 - DNA, 14 bp, Homo sapiens
acaagtgataatac

SEQ ID NO: 6603002 - DNA, 14 bp, Homo sapiens
acaagtgcctcctg

SEQ ID NO: 6603003 - DNA, 14 bp, Homo sapiens
acaagtgctcagtt

SEQ ID NO: 6603004 - DNA, 17 bp, Homo sapiens
acaagtgctcagttcca

SEQ ID NO: 6603005 - DNA, 15 bp, Homo sapiens
acaagtgctcctgaa

SEQ ID NO: 6603006 - DNA, 15 bp, Homo sapiens
acaagtggactcagg

SEQ ID NO: 6603007 - DNA, 15 bp, Homo sapiens
acaagtggagggggt

SEQ ID NO: 6603008 - DNA, 17 bp, Homo sapiens
acaagtggatgttttta

SEQ ID NO: 6603009 - DNA, 16 bp, Homo sapiens
acaagtggctccccac

SEQ ID NO: 6603010 - DNA, 20 bp, Homo sapiens
acaagtggctccccacctgg

SEQ ID NO: 6603011 - DNA, 17 bp, Homo sapiens
acaagtgggcagcataa

SEQ ID NO: 6603012 - DNA, 22 bp, Homo sapiens
acaagtggtaatttttgtacat

SEQ ID NO: 6603013 - DNA, 13 bp, Homo sapiens
acaagtggtggta

SEQ ID NO: 6603014 - DNA, 20 bp, Homo sapiens
acaagtgtaatgaatacctt

SEQ ID NO: 6603015 - DNA, 17 bp, Homo sapiens
acaagtgtacagaagaa

SEQ ID NO: 6603016 - DNA, 18 bp, Homo sapiens
acaagtgtacagaagaat

SEQ ID NO: 6603017 - DNA, 19 bp, Homo sapiens
acaagtgtatatcagaaaa

SEQ ID NO: 6603018 - DNA, 20 bp, Homo sapiens
acaagtgtatatcagaaaag

SEQ ID NO: 6603019 - DNA, 12 bp, Homo sapiens
acaagtgtcttt

SEQ ID NO: 6603020 - DNA, 13 bp, Homo sapiens
acaagtgtctttt

SEQ ID NO: 6603021 - DNA, 13 bp, Homo sapiens
acaagtgttctta

SEQ ID NO: 6603022 - DNA, 16 bp, Homo sapiens
acaagtgttcttaggt

SEQ ID NO: 6603023 - DNA, 18 bp, Homo sapiens
acaagtgttcttaggttt

SEQ ID NO: 6603024 - DNA, 22 bp, Homo sapiens
acaagtgttcttaggtttactg

SEQ ID NO: 6603025 - DNA, 18 bp, Homo sapiens
acaagtgttttagatgtt

SEQ ID NO: 6603026 - DNA, 15 bp, Homo sapiens
acaagttaaataaat

SEQ ID NO: 6603027 - DNA, 20 bp, Homo sapiens
acaagttacatacatttaaa

SEQ ID NO: 6603028 - DNA, 19 bp, Homo sapiens
acaagttacccctgaaatc

SEQ ID NO: 6603029 - DNA, 21 bp, Homo sapiens
acaagttacccctgaaatctg

SEQ ID NO: 6603030 - DNA, 22 bp, Homo sapiens
acaagttatttaaatctgtttt

SEQ ID NO: 6603031 - DNA, 21 bp, Homo sapiens
acaagttcatctcatttgtat

SEQ ID NO: 6603032 - DNA, 13 bp, Homo sapiens
acaagttccctgg

SEQ ID NO: 6603033 - DNA, 16 bp, Homo sapiens
acaagttccctggaga

SEQ ID NO: 6603034 - DNA, 22 bp, Homo sapiens
acaagttcgagtcaaagttgaa

SEQ ID NO: 6603035 - DNA, 20 bp, Homo sapiens
acaagttctttcccagcctc

SEQ ID NO: 6603036 - DNA, 22 bp, Homo sapiens
acaagttgcgacggagagaaaa

SEQ ID NO: 6603037 - DNA, 17 bp, Homo sapiens
acaagttgctttgttac

SEQ ID NO: 6603038 - DNA, 21 bp, Homo sapiens
acaagttggaaaaacaacagc

SEQ ID NO: 6603039 - DNA, 18 bp, Homo sapiens
acaagttggagtcactct

SEQ ID NO: 6603040 - DNA, 21 bp, Homo sapiens
acaagttgttaaaacatttaa

SEQ ID NO: 6603041 - DNA, 17 bp, Homo sapiens
acaagtttcagacaggg

SEQ ID NO: 6603042 - DNA, 15 bp, Homo sapiens
acaagtttcagtaat

SEQ ID NO: 6603043 - DNA, 15 bp, Homo sapiens
acaagtttgaacagg

SEQ ID NO: 6603044 - DNA, 16 bp, Homo sapiens
acaagtttgaacaggc

SEQ ID NO: 6603045 - DNA, 12 bp, Homo sapiens
acaagtttgcta

SEQ ID NO: 6603046 - DNA, 18 bp, Homo sapiens
acaagtttgctaaaagaa

SEQ ID NO: 6603047 - DNA, 12 bp, Homo sapiens
acaagttttaga

SEQ ID NO: 6603048 - DNA, 23 bp, Homo sapiens
acaagttttagttaaaactcatc

SEQ ID NO: 6603049 - DNA, 15 bp, Homo sapiens
acaagttttggcagc

SEQ ID NO: 6603050 - DNA, 18 bp, Homo sapiens
acaagttttggcagccat

SEQ ID NO: 6603051 - DNA, 20 bp, Homo sapiens
acaagttttggcagccatga

SEQ ID NO: 6603052 - DNA, 12 bp, Homo sapiens
acaagttttgta

SEQ ID NO: 6603053 - DNA, 13 bp, Homo sapiens
acaagttttgtat

SEQ ID NO: 6603054 - DNA, 13 bp, Homo sapiens
acaagttttgttt

SEQ ID NO: 6603055 - DNA, 18 bp, Homo sapiens
acaagttttgtttcctca

SEQ ID NO: 6603056 - DNA, 15 bp, Homo sapiens
acaagtttttctgtc

SEQ ID NO: 6603057 - DNA, 19 bp, Homo sapiens
acaagtttttttgttcata

SEQ ID NO: 6603058 - DNA, 14 bp, Homo sapiens
acaataaaaatgtt

SEQ ID NO: 6603059 - DNA, 14 bp, Homo sapiens
acaataaaacaaat

SEQ ID NO: 6603060 - DNA, 12 bp, Homo sapiens
acaataaaacat

SEQ ID NO: 6603061 - DNA, 19 bp, Homo sapiens
acaataaaaccaagcctct

SEQ ID NO: 6603062 - DNA, 20 bp, Homo sapiens
acaataaaaccaagcctctg

SEQ ID NO: 6603063 - DNA, 21 bp, Homo sapiens
acaataaaactaaatgtgtac

SEQ ID NO: 6603064 - DNA, 14 bp, Homo sapiens
acaataaaagacat

SEQ ID NO: 6603065 - DNA, 12 bp, Homo sapiens
acaataaaagag

SEQ ID NO: 6603066 - DNA, 13 bp, Homo sapiens
acaataaacagga

SEQ ID NO: 6603067 - DNA, 15 bp, Homo sapiens
acaataaacataaca

SEQ ID NO: 6603068 - DNA, 17 bp, Homo sapiens
acaataaaccaaaccca

SEQ ID NO: 6603069 - DNA, 21 bp, Homo sapiens
acaataaaccaaacccagcca

SEQ ID NO: 6603070 - DNA, 24 bp, Homo sapiens
acaataaaccaaacccagccactg

SEQ ID NO: 6603071 - DNA, 15 bp, Homo sapiens
acaataaaccctcag

SEQ ID NO: 6603072 - DNA, 13 bp, Homo sapiens
acaataaactggt

SEQ ID NO: 6603073 - DNA, 22 bp, Homo sapiens
acaataaagaaagaaatattaa

SEQ ID NO: 6603074 - DNA, 13 bp, Homo sapiens
acaataaagactg

SEQ ID NO: 6603075 - DNA, 12 bp, Homo sapiens
acaataaagaga

SEQ ID NO: 6603076 - DNA, 14 bp, Homo sapiens
acaataaagagctc

SEQ ID NO: 6603077 - DNA, 12 bp, Homo sapiens
acaataaagata

SEQ ID NO: 6603078 - DNA, 14 bp, Homo sapiens
acaataaagtgtat

SEQ ID NO: 6603079 - DNA, 13 bp, Homo sapiens
acaataaataata

SEQ ID NO: 6603080 - DNA, 12 bp, Homo sapiens
acaataaatata

SEQ ID NO: 6603081 - DNA, 17 bp, Homo sapiens
acaataaatatgtatta

SEQ ID NO: 6603082 - DNA, 18 bp, Homo sapiens
acaataaatattctgcat

SEQ ID NO: 6603083 - DNA, 14 bp, Homo sapiens
acaataaatgaaga

SEQ ID NO: 6603084 - DNA, 21 bp, Homo sapiens
acaataaatgctgaatgaatc

SEQ ID NO: 6603085 - DNA, 19 bp, Homo sapiens
acaataaatgtattcaaat

SEQ ID NO: 6603086 - DNA, 14 bp, Homo sapiens
acaataaatgtgca

SEQ ID NO: 6603087 - DNA, 14 bp, Homo sapiens
acaataaattttat

SEQ ID NO: 6603088 - DNA, 14 bp, Homo sapiens
acaataaatttttt

SEQ ID NO: 6603089 - DNA, 21 bp, Homo sapiens
acaataaattttttttggtca

SEQ ID NO: 6603090 - DNA, 22 bp, Homo sapiens
acaataaattttttttggtcaa

SEQ ID NO: 6603091 - DNA, 13 bp, Homo sapiens
acaataacaacaa

SEQ ID NO: 6603092 - DNA, 20 bp, Homo sapiens
acaataacccagttactttt

SEQ ID NO: 6603093 - DNA, 16 bp, Homo sapiens
acaataaccttattct

SEQ ID NO: 6603094 - DNA, 19 bp, Homo sapiens
acaataactactgtgttcc

SEQ ID NO: 6603095 - DNA, 20 bp, Homo sapiens
acaataactactgtgttcct

SEQ ID NO: 6603096 - DNA, 16 bp, Homo sapiens
acaataactcctccca

SEQ ID NO: 6603097 - DNA, 17 bp, Homo sapiens
acaataagaaacagttt

SEQ ID NO: 6603098 - DNA, 22 bp, Homo sapiens
acaataagaaacagtttaacag

SEQ ID NO: 6603099 - DNA, 12 bp, Homo sapiens
acaataagaaca

SEQ ID NO: 6603100 - DNA, 21 bp, Homo sapiens
acaataagacatgcttacttt

SEQ ID NO: 6603101 - DNA, 23 bp, Homo sapiens
acaataagagtctccttctcttc

SEQ ID NO: 6603102 - DNA, 17 bp, Homo sapiens
acaataagtaaatccac

SEQ ID NO: 6603103 - DNA, 20 bp, Homo sapiens
acaataagttacttgaaata

SEQ ID NO: 6603104 - DNA, 16 bp, Homo sapiens
acaataataaagatgt

SEQ ID NO: 6603105 - DNA, 22 bp, Homo sapiens
acaataataagtccatctgtca

SEQ ID NO: 6603106 - DNA, 14 bp, Homo sapiens
acaataataattaa

SEQ ID NO: 6603107 - DNA, 13 bp, Homo sapiens
acaataatgagag

SEQ ID NO: 6603108 - DNA, 16 bp, Homo sapiens
acaataatgagagcaa

SEQ ID NO: 6603109 - DNA, 18 bp, Homo sapiens
acaataatgcaattagaa

SEQ ID NO: 6603110 - DNA, 13 bp, Homo sapiens
acaataatggaaa

SEQ ID NO: 6603111 - DNA, 17 bp, Homo sapiens
acaataatgtaatttag

SEQ ID NO: 6603112 - DNA, 18 bp, Homo sapiens
acaataatgtaatttagt

SEQ ID NO: 6603113 - DNA, 19 bp, Homo sapiens
acaataattaatgtgtgtc

SEQ ID NO: 6603114 - DNA, 23 bp, Homo sapiens
acaataattcatcaagtaatcat

SEQ ID NO: 6603115 - DNA, 18 bp, Homo sapiens
acaataatttgttttcat

SEQ ID NO: 6603116 - DNA, 23 bp, Homo sapiens
acaataatttgttttcatttgta

SEQ ID NO: 6603117 - DNA, 18 bp, Homo sapiens
acaatacaaaggttccat

SEQ ID NO: 6603118 - DNA, 13 bp, Homo sapiens
acaatacaaatgg

SEQ ID NO: 6603119 - DNA, 15 bp, Homo sapiens
acaatacaaatggat

SEQ ID NO: 6603120 - DNA, 15 bp, Homo sapiens
acaatacaacaagaa

SEQ ID NO: 6603121 - DNA, 19 bp, Homo sapiens
acaatacaatgtacaatta

SEQ ID NO: 6603122 - DNA, 17 bp, Homo sapiens
acaatacagataacatt

SEQ ID NO: 6603123 - DNA, 12 bp, Homo sapiens
acaatacagtat

SEQ ID NO: 6603124 - DNA, 15 bp, Homo sapiens
acaatacagtattat

SEQ ID NO: 6603125 - DNA, 16 bp, Homo sapiens
acaatacagtattata

SEQ ID NO: 6603126 - DNA, 22 bp, Homo sapiens
acaatacagtattatagacaaa

SEQ ID NO: 6603127 - DNA, 16 bp, Homo sapiens
acaatacatgctgcta

SEQ ID NO: 6603128 - DNA, 16 bp, Homo sapiens
acaataccactggtta

SEQ ID NO: 6603129 - DNA, 20 bp, Homo sapiens
acaataccactggttaaaat

SEQ ID NO: 6603130 - DNA, 18 bp, Homo sapiens
acaataccagatcactca

SEQ ID NO: 6603131 - DNA, 22 bp, Homo sapiens
acaatacctacaataaactggt

SEQ ID NO: 6603132 - DNA, 10 bp, Homo sapiens
acaatacctg

SEQ ID NO: 6603133 - DNA, 19 bp, Homo sapiens
acaatactcataatgtgaa

SEQ ID NO: 6603134 - DNA, 14 bp, Homo sapiens
acaatagacagaaa

SEQ ID NO: 6603135 - DNA, 21 bp, Homo sapiens
acaatagcattgattcacctt

SEQ ID NO: 6603136 - DNA, 15 bp, Homo sapiens
acaatagctattgca

SEQ ID NO: 6603137 - DNA, 22 bp, Homo sapiens
acaataggagtggtgatttgaa

SEQ ID NO: 6603138 - DNA, 16 bp, Homo sapiens
acaataggtaaagcta

SEQ ID NO: 6603139 - DNA, 15 bp, Homo sapiens
acaatagtatagaag

SEQ ID NO: 6603140 - DNA, 19 bp, Homo sapiens
acaatagtatagaagtctg

SEQ ID NO: 6603141 - DNA, 13 bp, Homo sapiens
acaatagtatttc

SEQ ID NO: 6603142 - DNA, 15 bp, Homo sapiens
acaatagtatttctc

SEQ ID NO: 6603143 - DNA, 17 bp, Homo sapiens
acaatagtatttctcct

SEQ ID NO: 6603144 - DNA, 14 bp, Homo sapiens
acaatagtcagaaa

SEQ ID NO: 6603145 - DNA, 15 bp, Homo sapiens
acaatagtcagaaaa

SEQ ID NO: 6603146 - DNA, 22 bp, Homo sapiens
acaatagttcttagctttgaaa

SEQ ID NO: 6603147 - DNA, 18 bp, Homo sapiens
acaatataaaactgtact

SEQ ID NO: 6603148 - DNA, 21 bp, Homo sapiens
acaatataaccacaaagcaca

SEQ ID NO: 6603149 - DNA, 14 bp, Homo sapiens
acaatatacaagct

SEQ ID NO: 6603150 - DNA, 14 bp, Homo sapiens
acaatatagtattc

SEQ ID NO: 6603151 - DNA, 16 bp, Homo sapiens
acaatatagttttttc

SEQ ID NO: 6603152 - DNA, 11 bp, Homo sapiens
acaatatatat

SEQ ID NO: 6603153 - DNA, 15 bp, Homo sapiens
acaatatcaatatgg

SEQ ID NO: 6603154 - DNA, 16 bp, Homo sapiens
acaatatcaatatggt

SEQ ID NO: 6603155 - DNA, 12 bp, Homo sapiens
acaatatcatat

SEQ ID NO: 6603156 - DNA, 14 bp, Homo sapiens
acaatatcatcccc

SEQ ID NO: 6603157 - DNA, 14 bp, Homo sapiens
acaatatctgcagc

SEQ ID NO: 6603158 - DNA, 21 bp, Homo sapiens
acaatatgaatacagggcatg

SEQ ID NO: 6603159 - DNA, 17 bp, Homo sapiens
acaatatgattgcacta

SEQ ID NO: 6603160 - DNA, 14 bp, Homo sapiens
acaatatgcaatgt

SEQ ID NO: 6603161 - DNA, 18 bp, Homo sapiens
acaatatgccctttctgg

SEQ ID NO: 6603162 - DNA, 13 bp, Homo sapiens
acaatatgtatgc

SEQ ID NO: 6603163 - DNA, 14 bp, Homo sapiens
acaatatgtgccaa

SEQ ID NO: 6603164 - DNA, 20 bp, Homo sapiens
acaatatgtgccaatcaata

SEQ ID NO: 6603165 - DNA, 16 bp, Homo sapiens
acaatatgtttctaaa

SEQ ID NO: 6603166 - DNA, 17 bp, Homo sapiens
acaatattaagtgttgt

SEQ ID NO: 6603167 - DNA, 18 bp, Homo sapiens
acaatattaagtgttgta

SEQ ID NO: 6603168 - DNA, 23 bp, Homo sapiens
acaatattaagtgttgtacaatt

SEQ ID NO: 6603169 - DNA, 23 bp, Homo sapiens
acaatattaattataataaaggt

SEQ ID NO: 6603170 - DNA, 19 bp, Homo sapiens
acaatattaattcaggttt

SEQ ID NO: 6603171 - DNA, 22 bp, Homo sapiens
acaatattactttgtcttttca

SEQ ID NO: 6603172 - DNA, 19 bp, Homo sapiens
acaatattatgaaatttca

SEQ ID NO: 6603173 - DNA, 13 bp, Homo sapiens
acaatattcctat

SEQ ID NO: 6603174 - DNA, 14 bp, Homo sapiens
acaatattgaactt

SEQ ID NO: 6603175 - DNA, 15 bp, Homo sapiens
acaatattgactttg

SEQ ID NO: 6603176 - DNA, 15 bp, Homo sapiens
acaatattgtgcatg

SEQ ID NO: 6603177 - DNA, 14 bp, Homo sapiens
acaatattgtttct

SEQ ID NO: 6603178 - DNA, 10 bp, Homo sapiens
acaatattta

SEQ ID NO: 6603179 - DNA, 14 bp, Homo sapiens
acaatatttaaaat

SEQ ID NO: 6603180 - DNA, 15 bp, Homo sapiens
acaatatttattgta

SEQ ID NO: 6603181 - DNA, 16 bp, Homo sapiens
acaatatttattgtat

SEQ ID NO: 6603182 - DNA, 20 bp, Homo sapiens
acaatatttcttttgttgta

SEQ ID NO: 6603183 - DNA, 14 bp, Homo sapiens
acaatatttgtgtg

SEQ ID NO: 6603184 - DNA, 15 bp, Homo sapiens
acaatattttaagca

SEQ ID NO: 6603185 - DNA, 15 bp, Homo sapiens
acaatattttatggt

SEQ ID NO: 6603186 - DNA, 18 bp, Homo sapiens
acaatattttattctagg

SEQ ID NO: 6603187 - DNA, 20 bp, Homo sapiens
acaatcaaaacacactacta

SEQ ID NO: 6603188 - DNA, 17 bp, Homo sapiens
acaatcaaatctcctgc

SEQ ID NO: 6603189 - DNA, 16 bp, Homo sapiens
acaatcacattaacat

SEQ ID NO: 6603190 - DNA, 16 bp, Homo sapiens
acaatcactaaacttt

SEQ ID NO: 6603191 - DNA, 13 bp, Homo sapiens
acaatcactattc

SEQ ID NO: 6603192 - DNA, 15 bp, Homo sapiens
acaatcactattctt

SEQ ID NO: 6603193 - DNA, 16 bp, Homo sapiens
acaatcactattctta

SEQ ID NO: 6603194 - DNA, 12 bp, Homo sapiens
acaatcaggtaa

SEQ ID NO: 6603195 - DNA, 17 bp, Homo sapiens
acaatcaggtaagatca

SEQ ID NO: 6603196 - DNA, 15 bp, Homo sapiens
acaatcagtcccctc

SEQ ID NO: 6603197 - DNA, 16 bp, Homo sapiens
acaatcagtcccctcc

SEQ ID NO: 6603198 - DNA, 19 bp, Homo sapiens
acaatcagtcccctcccat

SEQ ID NO: 6603199 - DNA, 16 bp, Homo sapiens
acaatcagtgtgaatg

SEQ ID NO: 6603200 - DNA, 17 bp, Homo sapiens
acaatcagttatacagt

SEQ ID NO: 6603201 - DNA, 19 bp, Homo sapiens
acaatcatgaaatatgcat

SEQ ID NO: 6603202 - DNA, 21 bp, Homo sapiens
acaatcatggcggaaggtgaa

SEQ ID NO: 6603203 - DNA, 13 bp, Homo sapiens
acaatcatgtaca

SEQ ID NO: 6603204 - DNA, 14 bp, Homo sapiens
acaatcatgtgtgt

SEQ ID NO: 6603205 - DNA, 21 bp, Homo sapiens
acaatcattgctgaaaatggt

SEQ ID NO: 6603206 - DNA, 17 bp, Homo sapiens
acaatcattgttttgaa

SEQ ID NO: 6603207 - DNA, 21 bp, Homo sapiens
acaatcattgttttgaatatt

SEQ ID NO: 6603208 - DNA, 18 bp, Homo sapiens
acaatcatttgctttttg

SEQ ID NO: 6603209 - DNA, 19 bp, Homo sapiens
acaatccacgcttctccgg

SEQ ID NO: 6603210 - DNA, 18 bp, Homo sapiens
acaatccatgtgattaat

SEQ ID NO: 6603211 - DNA, 23 bp, Homo sapiens
acaatccatgtgattaatgtttt

SEQ ID NO: 6603212 - DNA, 20 bp, Homo sapiens
acaatcccagcatctgattg

SEQ ID NO: 6603213 - DNA, 21 bp, Homo sapiens
acaatccctggggctgtgcat

SEQ ID NO: 6603214 - DNA, 22 bp, Homo sapiens
acaatcctagtgctttcctttt

SEQ ID NO: 6603215 - DNA, 19 bp, Homo sapiens
acaatcctataaatgtgat

SEQ ID NO: 6603216 - DNA, 14 bp, Homo sapiens
acaatcctccccac

SEQ ID NO: 6603217 - DNA, 16 bp, Homo sapiens
acaatcctccccacca

SEQ ID NO: 6603218 - DNA, 14 bp, Homo sapiens
acaatcctgaagaa

SEQ ID NO: 6603219 - DNA, 22 bp, Homo sapiens
acaatcctttaaggtcaacatt

SEQ ID NO: 6603220 - DNA, 22 bp, Homo sapiens
acaatcctttgagttatagttt

SEQ ID NO: 6603221 - DNA, 14 bp, Homo sapiens
acaatccttttgat

SEQ ID NO: 6603222 - DNA, 19 bp, Homo sapiens
acaatcgtcttaagttttt

SEQ ID NO: 6603223 - DNA, 22 bp, Homo sapiens
acaatctaacaataatatttca

SEQ ID NO: 6603224 - DNA, 17 bp, Homo sapiens
acaatctatggcttatt

SEQ ID NO: 6603225 - DNA, 13 bp, Homo sapiens
acaatctatttaa

SEQ ID NO: 6603226 - DNA, 18 bp, Homo sapiens
acaatctatttaaaaaac

SEQ ID NO: 6603227 - DNA, 12 bp, Homo sapiens
acaatctcaaat

SEQ ID NO: 6603228 - DNA, 19 bp, Homo sapiens
acaatctcacacagctggg

SEQ ID NO: 6603229 - DNA, 23 bp, Homo sapiens
acaatctcatcccaacaaacttt

SEQ ID NO: 6603230 - DNA, 17 bp, Homo sapiens
acaatctcccctcaacc

SEQ ID NO: 6603231 - DNA, 20 bp, Homo sapiens
acaatctctaggtttggcta

SEQ ID NO: 6603232 - DNA, 14 bp, Homo sapiens
acaatctgagcacg

SEQ ID NO: 6603233 - DNA, 18 bp, Homo sapiens
acaatctggaagaaaaaa

SEQ ID NO: 6603234 - DNA, 13 bp, Homo sapiens
acaatctggctca

SEQ ID NO: 6603235 - DNA, 22 bp, Homo sapiens
acaatctggctcactgcagcct

SEQ ID NO: 6603236 - DNA, 15 bp, Homo sapiens
acaatctgtaaattt

SEQ ID NO: 6603237 - DNA, 13 bp, Homo sapiens
acaatctgtaatt

SEQ ID NO: 6603238 - DNA, 13 bp, Homo sapiens
acaatctgttcta

SEQ ID NO: 6603239 - DNA, 15 bp, Homo sapiens
acaatctgttctact

SEQ ID NO: 6603240 - DNA, 17 bp, Homo sapiens
acaatctgttctactct

SEQ ID NO: 6603241 - DNA, 18 bp, Homo sapiens
acaatcttaaggggcagc

SEQ ID NO: 6603242 - DNA, 21 bp, Homo sapiens
acaatcttattccgagcattc

SEQ ID NO: 6603243 - DNA, 19 bp, Homo sapiens
acaatcttggagctgcttg

SEQ ID NO: 6603244 - DNA, 13 bp, Homo sapiens
acaatctttcatg

SEQ ID NO: 6603245 - DNA, 14 bp, Homo sapiens
acaatgaaaacaaa

SEQ ID NO: 6603246 - DNA, 18 bp, Homo sapiens
acaatgaactgcttttcc

SEQ ID NO: 6603247 - DNA, 21 bp, Homo sapiens
acaatgaactgcttttcctca

SEQ ID NO: 6603248 - DNA, 17 bp, Homo sapiens
acaatgaagaagtttct

SEQ ID NO: 6603249 - DNA, 19 bp, Homo sapiens
acaatgaagtgaaaaagtt

SEQ ID NO: 6603250 - DNA, 20 bp, Homo sapiens
acaatgaagtgaaaaagttt

SEQ ID NO: 6603251 - DNA, 17 bp, Homo sapiens
acaatgaagtgttttac

SEQ ID NO: 6603252 - DNA, 21 bp, Homo sapiens
acaatgaatgtatattttgtg

SEQ ID NO: 6603253 - DNA, 17 bp, Homo sapiens
acaatgaattcttcaac

SEQ ID NO: 6603254 - DNA, 16 bp, Homo sapiens
acaatgacaaagcaga

SEQ ID NO: 6603255 - DNA, 18 bp, Homo sapiens
acaatgaccagcaggagg

SEQ ID NO: 6603256 - DNA, 12 bp, Homo sapiens
acaatgacttac

SEQ ID NO: 6603257 - DNA, 18 bp, Homo sapiens
acaatgacttactgtaca

SEQ ID NO: 6603258 - DNA, 19 bp, Homo sapiens
acaatgacttactgtacat

SEQ ID NO: 6603259 - DNA, 18 bp, Homo sapiens
acaatgacttttaaagat

SEQ ID NO: 6603260 - DNA, 17 bp, Homo sapiens
acaatgagtttgggcat

SEQ ID NO: 6603261 - DNA, 19 bp, Homo sapiens
acaatgatattgacactgt

SEQ ID NO: 6603262 - DNA, 22 bp, Homo sapiens
acaatgatcctgtattcagaca

SEQ ID NO: 6603263 - DNA, 19 bp, Homo sapiens
acaatgattaatcagctgt

SEQ ID NO: 6603264 - DNA, 16 bp, Homo sapiens
acaatgatttgtaaag

SEQ ID NO: 6603265 - DNA, 17 bp, Homo sapiens
acaatgatttgtaaagg

SEQ ID NO: 6603266 - DNA, 14 bp, Homo sapiens
acaatgattttctt

SEQ ID NO: 6603267 - DNA, 19 bp, Homo sapiens
acaatgcaaaccatcattg

SEQ ID NO: 6603268 - DNA, 18 bp, Homo sapiens
acaatgcaatgaaacaga

SEQ ID NO: 6603269 - DNA, 14 bp, Homo sapiens
acaatgcagaattt

SEQ ID NO: 6603270 - DNA, 13 bp, Homo sapiens
acaatgcagcaag

SEQ ID NO: 6603271 - DNA, 22 bp, Homo sapiens
acaatgcagcaaggccctgctg

SEQ ID NO: 6603272 - DNA, 22 bp, Homo sapiens
acaatgcagttctgagcaccgt

SEQ ID NO: 6603273 - DNA, 19 bp, Homo sapiens
acaatgcataatgtcttta

SEQ ID NO: 6603274 - DNA, 13 bp, Homo sapiens
acaatgcatgtgc

SEQ ID NO: 6603275 - DNA, 15 bp, Homo sapiens
acaatgccagggccc

SEQ ID NO: 6603276 - DNA, 23 bp, Homo sapiens
acaatgccatgaacaaattcttt

SEQ ID NO: 6603277 - DNA, 14 bp, Homo sapiens
acaatgccctgctg

SEQ ID NO: 6603278 - DNA, 19 bp, Homo sapiens
acaatgccgcctgtcaata

SEQ ID NO: 6603279 - DNA, 15 bp, Homo sapiens
acaatgcctctccca

SEQ ID NO: 6603280 - DNA, 18 bp, Homo sapiens
acaatgcctctcccacga

SEQ ID NO: 6603281 - DNA, 19 bp, Homo sapiens
acaatgcgaatggtagtct

SEQ ID NO: 6603282 - DNA, 22 bp, Homo sapiens
acaatgctcatgtccctgtccc

SEQ ID NO: 6603283 - DNA, 17 bp, Homo sapiens
acaatgctgatttggtg

SEQ ID NO: 6603284 - DNA, 17 bp, Homo sapiens
acaatgctgtattttaa

SEQ ID NO: 6603285 - DNA, 18 bp, Homo sapiens
acaatgctgtattttaaa

SEQ ID NO: 6603286 - DNA, 21 bp, Homo sapiens
acaatgctgtgccctaaagtg

SEQ ID NO: 6603287 - DNA, 20 bp, Homo sapiens
acaatgcttctttcctgtat

SEQ ID NO: 6603288 - DNA, 19 bp, Homo sapiens
acaatgctttgataaaata

SEQ ID NO: 6603289 - DNA, 19 bp, Homo sapiens
acaatggaaactgaatgct

SEQ ID NO: 6603290 - DNA, 15 bp, Homo sapiens
acaatggaaacttta

SEQ ID NO: 6603291 - DNA, 16 bp, Homo sapiens
acaatggaaactttag

SEQ ID NO: 6603292 - DNA, 13 bp, Homo sapiens
acaatggaataaa

SEQ ID NO: 6603293 - DNA, 15 bp, Homo sapiens
acaatggagtattct

SEQ ID NO: 6603294 - DNA, 16 bp, Homo sapiens
acaatggcacctctgc

SEQ ID NO: 6603295 - DNA, 20 bp, Homo sapiens
acaatggcacctctgccctt

SEQ ID NO: 6603296 - DNA, 23 bp, Homo sapiens
acaatggcacctctgcccttccc

SEQ ID NO: 6603297 - DNA, 13 bp, Homo sapiens
acaatggcagatg

SEQ ID NO: 6603298 - DNA, 18 bp, Homo sapiens
acaatggcaggttttaca

SEQ ID NO: 6603299 - DNA, 14 bp, Homo sapiens
acaatggccagccc

SEQ ID NO: 6603300 - DNA, 20 bp, Homo sapiens
acaatggcccgacatttctt

SEQ ID NO: 6603301 - DNA, 14 bp, Homo sapiens
acaatggctatatt

SEQ ID NO: 6603302 - DNA, 12 bp, Homo sapiens
acaatggctggg

SEQ ID NO: 6603303 - DNA, 19 bp, Homo sapiens
acaatgggaggctgtgatt

SEQ ID NO: 6603304 - DNA, 16 bp, Homo sapiens
acaatggtagctctga

SEQ ID NO: 6603305 - DNA, 23 bp, Homo sapiens
acaatggtgtggtgaatgtgtga

SEQ ID NO: 6603306 - DNA, 22 bp, Homo sapiens
acaatggtgttatttgaaactt

SEQ ID NO: 6603307 - DNA, 14 bp, Homo sapiens
acaatggttgaatg

SEQ ID NO: 6603308 - DNA, 15 bp, Homo sapiens
acaatggttgaatga

SEQ ID NO: 6603309 - DNA, 19 bp, Homo sapiens
acaatggttgaatgaataa

SEQ ID NO: 6603310 - DNA, 17 bp, Homo sapiens
acaatggtttacatgaa

SEQ ID NO: 6603311 - DNA, 19 bp, Homo sapiens
acaatggtttattcccaag

SEQ ID NO: 6603312 - DNA, 15 bp, Homo sapiens
acaatggttttcttg

SEQ ID NO: 6603313 - DNA, 22 bp, Homo sapiens
acaatgtaaaccacatgaacta

SEQ ID NO: 6603314 - DNA, 19 bp, Homo sapiens
acaatgtaataaaaagcct

SEQ ID NO: 6603315 - DNA, 12 bp, Homo sapiens
acaatgtaatta

SEQ ID NO: 6603316 - DNA, 20 bp, Homo sapiens
acaatgtaattacattaaaa

SEQ ID NO: 6603317 - DNA, 15 bp, Homo sapiens
acaatgtaattattt

SEQ ID NO: 6603318 - DNA, 18 bp, Homo sapiens
acaatgtaattatttatg

SEQ ID NO: 6603319 - DNA, 22 bp, Homo sapiens
acaatgtacaaggtatgtacag

SEQ ID NO: 6603320 - DNA, 17 bp, Homo sapiens
acaatgtacaattatgt

SEQ ID NO: 6603321 - DNA, 15 bp, Homo sapiens
acaatgtataaagat

SEQ ID NO: 6603322 - DNA, 11 bp, Homo sapiens
acaatgtatac

SEQ ID NO: 6603323 - DNA, 19 bp, Homo sapiens
acaatgtatacaatgcact

SEQ ID NO: 6603324 - DNA, 20 bp, Homo sapiens
acaatgtatacttcagtgct

SEQ ID NO: 6603325 - DNA, 22 bp, Homo sapiens
acaatgtatctttattaaaaca

SEQ ID NO: 6603326 - DNA, 14 bp, Homo sapiens
acaatgtatgtaca

SEQ ID NO: 6603327 - DNA, 23 bp, Homo sapiens
acaatgtatttatttaaaagatt

SEQ ID NO: 6603328 - DNA, 13 bp, Homo sapiens
acaatgtatttta

SEQ ID NO: 6603329 - DNA, 16 bp, Homo sapiens
acaatgtattttggaa

SEQ ID NO: 6603330 - DNA, 13 bp, Homo sapiens
acaatgtcctctt

SEQ ID NO: 6603331 - DNA, 20 bp, Homo sapiens
acaatgtcgagtatattatt

SEQ ID NO: 6603332 - DNA, 16 bp, Homo sapiens
acaatgtctgcagccc

SEQ ID NO: 6603333 - DNA, 17 bp, Homo sapiens
acaatgtcttcttgaaa

SEQ ID NO: 6603334 - DNA, 15 bp, Homo sapiens
acaatgtgaaactga

SEQ ID NO: 6603335 - DNA, 22 bp, Homo sapiens
acaatgtgaataatggcactga

SEQ ID NO: 6603336 - DNA, 11 bp, Homo sapiens
acaatgtgata

SEQ ID NO: 6603337 - DNA, 18 bp, Homo sapiens
acaatgtgattttatggt

SEQ ID NO: 6603338 - DNA, 14 bp, Homo sapiens
acaatgtgcactga

SEQ ID NO: 6603339 - DNA, 20 bp, Homo sapiens
acaatgtggaattacataac

SEQ ID NO: 6603340 - DNA, 12 bp, Homo sapiens
acaatgtggagt

SEQ ID NO: 6603341 - DNA, 19 bp, Homo sapiens
acaatgtgggcgtttgtaa

SEQ ID NO: 6603342 - DNA, 21 bp, Homo sapiens
acaatgtgggcgtttgtaaat

SEQ ID NO: 6603343 - DNA, 19 bp, Homo sapiens
acaatgtgtctatttctga

SEQ ID NO: 6603344 - DNA, 22 bp, Homo sapiens
acaatgtgtctttctttttgga

SEQ ID NO: 6603345 - DNA, 23 bp, Homo sapiens
acaatgtgtgggataatgtcatt

SEQ ID NO: 6603346 - DNA, 15 bp, Homo sapiens
acaatgtgtttttct

SEQ ID NO: 6603347 - DNA, 19 bp, Homo sapiens
acaatgtgtttttctccag

SEQ ID NO: 6603348 - DNA, 17 bp, Homo sapiens
acaatgttaacattttt

SEQ ID NO: 6603349 - DNA, 20 bp, Homo sapiens
acaatgttaaggaaactctt

SEQ ID NO: 6603350 - DNA, 21 bp, Homo sapiens
acaatgttaaggaaactctta

SEQ ID NO: 6603351 - DNA, 17 bp, Homo sapiens
acaatgttatcaaccaa

SEQ ID NO: 6603352 - DNA, 14 bp, Homo sapiens
acaatgttctttat

SEQ ID NO: 6603353 - DNA, 13 bp, Homo sapiens
acaatgttgagaa

SEQ ID NO: 6603354 - DNA, 18 bp, Homo sapiens
acaatgttgctagttttt

SEQ ID NO: 6603355 - DNA, 16 bp, Homo sapiens
acaatgttggagcagc

SEQ ID NO: 6603356 - DNA, 18 bp, Homo sapiens
acaatgttggagcagcag

SEQ ID NO: 6603357 - DNA, 18 bp, Homo sapiens
acaatgttggcctgtcag

SEQ ID NO: 6603358 - DNA, 20 bp, Homo sapiens
acaatgttgtccaacaataa

SEQ ID NO: 6603359 - DNA, 21 bp, Homo sapiens
acaatgttgtcctcctgttca

SEQ ID NO: 6603360 - DNA, 13 bp, Homo sapiens
acaatgtttacaa

SEQ ID NO: 6603361 - DNA, 22 bp, Homo sapiens
acaatgtttcttcatttctctg

SEQ ID NO: 6603362 - DNA, 23 bp, Homo sapiens
acaatgtttcttcatttctctgc

SEQ ID NO: 6603363 - DNA, 17 bp, Homo sapiens
acaatgtttgatgtccc

SEQ ID NO: 6603364 - DNA, 16 bp, Homo sapiens
acaatgttttaacaag

SEQ ID NO: 6603365 - DNA, 20 bp, Homo sapiens
acaattaaacagccaaataa

SEQ ID NO: 6603366 - DNA, 16 bp, Homo sapiens
acaattaaagctgtta

SEQ ID NO: 6603367 - DNA, 21 bp, Homo sapiens
acaattacatctctaattttg

SEQ ID NO: 6603368 - DNA, 16 bp, Homo sapiens
acaattacatgtaaac

SEQ ID NO: 6603369 - DNA, 21 bp, Homo sapiens
acaattacatgtaaacaaata

SEQ ID NO: 6603370 - DNA, 16 bp, Homo sapiens
acaattactcaggttt

SEQ ID NO: 6603371 - DNA, 18 bp, Homo sapiens
acaattatatcagtcctc

SEQ ID NO: 6603372 - DNA, 17 bp, Homo sapiens
acaattatgaaaaaatg

SEQ ID NO: 6603373 - DNA, 18 bp, Homo sapiens
acaattatgaaaaaatgt

SEQ ID NO: 6603374 - DNA, 12 bp, Homo sapiens
acaattattaaa

SEQ ID NO: 6603375 - DNA, 20 bp, Homo sapiens
acaattattccaaaccaaat

SEQ ID NO: 6603376 - DNA, 13 bp, Homo sapiens
acaattattggca

SEQ ID NO: 6603377 - DNA, 18 bp, Homo sapiens
acaattattggcaaagtt

SEQ ID NO: 6603378 - DNA, 21 bp, Homo sapiens
acaattattgtacactaacat

SEQ ID NO: 6603379 - DNA, 18 bp, Homo sapiens
acaattattgtatattga

SEQ ID NO: 6603380 - DNA, 16 bp, Homo sapiens
acaattatttatttca

SEQ ID NO: 6603381 - DNA, 21 bp, Homo sapiens
acaattatttatttcatgtct

SEQ ID NO: 6603382 - DNA, 18 bp, Homo sapiens
acaattcaatcaaagcta

SEQ ID NO: 6603383 - DNA, 15 bp, Homo sapiens
acaattcacagtatg

SEQ ID NO: 6603384 - DNA, 14 bp, Homo sapiens
acaattcagtttta

SEQ ID NO: 6603385 - DNA, 23 bp, Homo sapiens
acaattcagttttagtttcaaaa

SEQ ID NO: 6603386 - DNA, 16 bp, Homo sapiens
acaattcattggctcc

SEQ ID NO: 6603387 - DNA, 21 bp, Homo sapiens
acaattcattgttttgcaaaa

SEQ ID NO: 6603388 - DNA, 15 bp, Homo sapiens
acaattccctgctgt

SEQ ID NO: 6603389 - DNA, 20 bp, Homo sapiens
acaattcccttctttttcat

SEQ ID NO: 6603390 - DNA, 22 bp, Homo sapiens
acaattcctagataaaaagatg

SEQ ID NO: 6603391 - DNA, 13 bp, Homo sapiens
acaattcctgtgc

SEQ ID NO: 6603392 - DNA, 14 bp, Homo sapiens
acaattctaaaatg

SEQ ID NO: 6603393 - DNA, 23 bp, Homo sapiens
acaattctaaaatgattgtagta

SEQ ID NO: 6603394 - DNA, 24 bp, Homo sapiens
acaattctaaaatgattgtagtaa

SEQ ID NO: 6603395 - DNA, 14 bp, Homo sapiens
acaattctaatggt

SEQ ID NO: 6603396 - DNA, 22 bp, Homo sapiens
acaattctaatggtaacttttg

SEQ ID NO: 6603397 - DNA, 23 bp, Homo sapiens
acaattctaatggtaacttttgt

SEQ ID NO: 6603398 - DNA, 19 bp, Homo sapiens
acaattctaggatgaacaa

SEQ ID NO: 6603399 - DNA, 21 bp, Homo sapiens
acaattctgtttttaatgcta

SEQ ID NO: 6603400 - DNA, 16 bp, Homo sapiens
acaattctttatacaa

SEQ ID NO: 6603401 - DNA, 18 bp, Homo sapiens
acaattctttatacaaca

SEQ ID NO: 6603402 - DNA, 19 bp, Homo sapiens
acaattctttatacaacag

SEQ ID NO: 6603403 - DNA, 21 bp, Homo sapiens
acaattctttatacaacagtg

SEQ ID NO: 6603404 - DNA, 16 bp, Homo sapiens
acaattctttcaactg

SEQ ID NO: 6603405 - DNA, 14 bp, Homo sapiens
acaattcttttgaa

SEQ ID NO: 6603406 - DNA, 15 bp, Homo sapiens
acaattcttttgaaa

SEQ ID NO: 6603407 - DNA, 18 bp, Homo sapiens
acaattcttttgaaagat

SEQ ID NO: 6603408 - DNA, 16 bp, Homo sapiens
acaattgaacttccag

SEQ ID NO: 6603409 - DNA, 13 bp, Homo sapiens
acaattgaagtaa

SEQ ID NO: 6603410 - DNA, 16 bp, Homo sapiens
acaattgaagtaaact

SEQ ID NO: 6603411 - DNA, 17 bp, Homo sapiens
acaattgaagtcaatta

SEQ ID NO: 6603412 - DNA, 16 bp, Homo sapiens
acaattgatacttcag

SEQ ID NO: 6603413 - DNA, 20 bp, Homo sapiens
acaattgatacttcaggtgc

SEQ ID NO: 6603414 - DNA, 21 bp, Homo sapiens
acaattgatacttcaggtgct

SEQ ID NO: 6603415 - DNA, 19 bp, Homo sapiens
acaattgatctctttttat

SEQ ID NO: 6603416 - DNA, 15 bp, Homo sapiens
acaattggttgtata

SEQ ID NO: 6603417 - DNA, 16 bp, Homo sapiens
acaattggttgtatat

SEQ ID NO: 6603418 - DNA, 17 bp, Homo sapiens
acaattggttgtatata

SEQ ID NO: 6603419 - DNA, 21 bp, Homo sapiens
acaattggttgtatataaagt

SEQ ID NO: 6603420 - DNA, 12 bp, Homo sapiens
acaattgtaata

SEQ ID NO: 6603421 - DNA, 18 bp, Homo sapiens
acaattgtgtagcctttt

SEQ ID NO: 6603422 - DNA, 23 bp, Homo sapiens
acaattgtgtagcctttttgtat

SEQ ID NO: 6603423 - DNA, 21 bp, Homo sapiens
acaattgtttggggttgaaaa

SEQ ID NO: 6603424 - DNA, 12 bp, Homo sapiens
acaattgtttgt

SEQ ID NO: 6603425 - DNA, 18 bp, Homo sapiens
acaattgttttaatctga

SEQ ID NO: 6603426 - DNA, 12 bp, Homo sapiens
acaatttaaaat

SEQ ID NO: 6603427 - DNA, 13 bp, Homo sapiens
acaatttaaagca

SEQ ID NO: 6603428 - DNA, 14 bp, Homo sapiens
acaatttaaattgt

SEQ ID NO: 6603429 - DNA, 15 bp, Homo sapiens
acaatttaaattgtt

SEQ ID NO: 6603430 - DNA, 13 bp, Homo sapiens
acaatttacaaag

SEQ ID NO: 6603431 - DNA, 17 bp, Homo sapiens
acaatttacaaagtgtg

SEQ ID NO: 6603432 - DNA, 19 bp, Homo sapiens
acaatttacaaagtgtgta

SEQ ID NO: 6603433 - DNA, 23 bp, Homo sapiens
acaatttacaaagtgtgtattaa

SEQ ID NO: 6603434 - DNA, 23 bp, Homo sapiens
acaatttaccacaggatgcatat

SEQ ID NO: 6603435 - DNA, 16 bp, Homo sapiens
acaatttacttttaat

SEQ ID NO: 6603436 - DNA, 17 bp, Homo sapiens
acaatttacttttaata

SEQ ID NO: 6603437 - DNA, 18 bp, Homo sapiens
acaatttacttttaataa

SEQ ID NO: 6603438 - DNA, 13 bp, Homo sapiens
acaatttagaaaa

SEQ ID NO: 6603439 - DNA, 14 bp, Homo sapiens
acaatttagaaaac

SEQ ID NO: 6603440 - DNA, 20 bp, Homo sapiens
acaatttagccagaatgttt

SEQ ID NO: 6603441 - DNA, 16 bp, Homo sapiens
acaatttataattaca

SEQ ID NO: 6603442 - DNA, 15 bp, Homo sapiens
acaatttatatgctt

SEQ ID NO: 6603443 - DNA, 15 bp, Homo sapiens
acaatttattatggc

SEQ ID NO: 6603444 - DNA, 16 bp, Homo sapiens
acaatttattatggca

SEQ ID NO: 6603445 - DNA, 14 bp, Homo sapiens
acaatttattctga

SEQ ID NO: 6603446 - DNA, 20 bp, Homo sapiens
acaatttattttattttagc

SEQ ID NO: 6603447 - DNA, 19 bp, Homo sapiens
acaatttcaaaaaaataaa

SEQ ID NO: 6603448 - DNA, 13 bp, Homo sapiens
acaatttcaaaat

SEQ ID NO: 6603449 - DNA, 15 bp, Homo sapiens
acaatttcaaaatgc

SEQ ID NO: 6603450 - DNA, 20 bp, Homo sapiens
acaatttcaaaatgcatgtg

SEQ ID NO: 6603451 - DNA, 11 bp, Homo sapiens
acaatttcaat

SEQ ID NO: 6603452 - DNA, 13 bp, Homo sapiens
acaatttcaatgc

SEQ ID NO: 6603453 - DNA, 16 bp, Homo sapiens
acaatttcatttccag

SEQ ID NO: 6603454 - DNA, 17 bp, Homo sapiens
acaatttcatttccagc

SEQ ID NO: 6603455 - DNA, 16 bp, Homo sapiens
acaatttctctgggtg

SEQ ID NO: 6603456 - DNA, 13 bp, Homo sapiens
acaatttctgtgt

SEQ ID NO: 6603457 - DNA, 15 bp, Homo sapiens
acaatttctttaaaa

SEQ ID NO: 6603458 - DNA, 17 bp, Homo sapiens
acaatttgagactgaaa

SEQ ID NO: 6603459 - DNA, 16 bp, Homo sapiens
acaatttgatacataa

SEQ ID NO: 6603460 - DNA, 17 bp, Homo sapiens
acaatttgatacataat

SEQ ID NO: 6603461 - DNA, 21 bp, Homo sapiens
acaatttgcaaatttaggacc

SEQ ID NO: 6603462 - DNA, 20 bp, Homo sapiens
acaatttgcactaaatcaga

SEQ ID NO: 6603463 - DNA, 15 bp, Homo sapiens
acaatttgcactgtt

SEQ ID NO: 6603464 - DNA, 18 bp, Homo sapiens
acaatttggcaattttgt

SEQ ID NO: 6603465 - DNA, 19 bp, Homo sapiens
acaatttggtcttagcttt

SEQ ID NO: 6603466 - DNA, 12 bp, Homo sapiens
acaatttgtact

SEQ ID NO: 6603467 - DNA, 13 bp, Homo sapiens
acaatttgtatta

SEQ ID NO: 6603468 - DNA, 17 bp, Homo sapiens
acaatttgtattacttt

SEQ ID NO: 6603469 - DNA, 20 bp, Homo sapiens
acaatttgtgatatctaata

SEQ ID NO: 6603470 - DNA, 13 bp, Homo sapiens
acaatttgttaat

SEQ ID NO: 6603471 - DNA, 19 bp, Homo sapiens
acaatttgtttttgcattt

SEQ ID NO: 6603472 - DNA, 21 bp, Homo sapiens
acaatttgtttttgcattttt

SEQ ID NO: 6603473 - DNA, 13 bp, Homo sapiens
acaattttaaagt

SEQ ID NO: 6603474 - DNA, 14 bp, Homo sapiens
acaattttaaagtt

SEQ ID NO: 6603475 - DNA, 12 bp, Homo sapiens
acaattttaatg

SEQ ID NO: 6603476 - DNA, 15 bp, Homo sapiens
acaattttaatgatg

SEQ ID NO: 6603477 - DNA, 21 bp, Homo sapiens
acaattttacctattctgaaa

SEQ ID NO: 6603478 - DNA, 21 bp, Homo sapiens
acaattttagtcactaagact

SEQ ID NO: 6603479 - DNA, 13 bp, Homo sapiens
acaattttatagg

SEQ ID NO: 6603480 - DNA, 19 bp, Homo sapiens
acaattttcactttttctg

SEQ ID NO: 6603481 - DNA, 20 bp, Homo sapiens
acaattttcagatttgcaca

SEQ ID NO: 6603482 - DNA, 21 bp, Homo sapiens
acaattttcagatttgcacaa

SEQ ID NO: 6603483 - DNA, 15 bp, Homo sapiens
acaattttcctgtgg

SEQ ID NO: 6603484 - DNA, 14 bp, Homo sapiens
acaattttctacca

SEQ ID NO: 6603485 - DNA, 13 bp, Homo sapiens
acaattttctgta

SEQ ID NO: 6603486 - DNA, 20 bp, Homo sapiens
acaattttgcttcactttgc

SEQ ID NO: 6603487 - DNA, 17 bp, Homo sapiens
acaattttgtcttaagt

SEQ ID NO: 6603488 - DNA, 17 bp, Homo sapiens
acaattttgtttctgta

SEQ ID NO: 6603489 - DNA, 20 bp, Homo sapiens
acaattttgtttctgtactt

SEQ ID NO: 6603490 - DNA, 10 bp, Homo sapiens
acaattttta

SEQ ID NO: 6603491 - DNA, 16 bp, Homo sapiens
acaatttttaataaat

SEQ ID NO: 6603492 - DNA, 21 bp, Homo sapiens
acaatttttatttcttttact

SEQ ID NO: 6603493 - DNA, 20 bp, Homo sapiens
acaatttttgatcaatgtat

SEQ ID NO: 6603494 - DNA, 16 bp, Homo sapiens
acaatttttgctgttt

SEQ ID NO: 6603495 - DNA, 14 bp, Homo sapiens
acaatttttttaat

SEQ ID NO: 6603496 - DNA, 17 bp, Homo sapiens
acaatttttttaatttt

SEQ ID NO: 6603497 - DNA, 19 bp, Homo sapiens
acaatttttttaattttgt

SEQ ID NO: 6603498 - DNA, 21 bp, Homo sapiens
acaatttttttaattttgtat

SEQ ID NO: 6603499 - DNA, 19 bp, Homo sapiens
acaattttttttcaaatgt

SEQ ID NO: 6603500 - DNA, 10 bp, Homo sapiens
acacaaaaaa

SEQ ID NO: 6603501 - DNA, 13 bp, Homo sapiens
acacaaaaaaaga

SEQ ID NO: 6603502 - DNA, 21 bp, Homo sapiens
acacaaaaagaaagctgtgaa

SEQ ID NO: 6603503 - DNA, 20 bp, Homo sapiens
acacaaaacattcatgtaac

SEQ ID NO: 6603504 - DNA, 19 bp, Homo sapiens
acacaaaactccgccccca

SEQ ID NO: 6603505 - DNA, 13 bp, Homo sapiens
acacaaaagaaga

SEQ ID NO: 6603506 - DNA, 17 bp, Homo sapiens
acacaaaagaagaaata

SEQ ID NO: 6603507 - DNA, 20 bp, Homo sapiens
acacaaaagaagaaataaat

SEQ ID NO: 6603508 - DNA, 23 bp, Homo sapiens
acacaaaagaagaaataaataat

SEQ ID NO: 6603509 - DNA, 13 bp, Homo sapiens
acacaaaagccaa

SEQ ID NO: 6603510 - DNA, 19 bp, Homo sapiens
acacaaaatccattccagg

SEQ ID NO: 6603511 - DNA, 15 bp, Homo sapiens
acacaaaatgaataa

SEQ ID NO: 6603512 - DNA, 19 bp, Homo sapiens
acacaaaccacaactgaca

SEQ ID NO: 6603513 - DNA, 18 bp, Homo sapiens
acacaaacctactgccca

SEQ ID NO: 6603514 - DNA, 18 bp, Homo sapiens
acacaaacgggctcagca

SEQ ID NO: 6603515 - DNA, 13 bp, Homo sapiens
acacaaactatgg

SEQ ID NO: 6603516 - DNA, 14 bp, Homo sapiens
acacaaactatggg

SEQ ID NO: 6603517 - DNA, 13 bp, Homo sapiens
acacaaactttca

SEQ ID NO: 6603518 - DNA, 23 bp, Homo sapiens
acacaaagaagtttttctttgtg

SEQ ID NO: 6603519 - DNA, 20 bp, Homo sapiens
acacaaagacacaggaagaa

SEQ ID NO: 6603520 - DNA, 15 bp, Homo sapiens
acacaaagatcaaat

SEQ ID NO: 6603521 - DNA, 17 bp, Homo sapiens
acacaaagcctgtgtta

SEQ ID NO: 6603522 - DNA, 22 bp, Homo sapiens
acacaaagcctgtgttactgat

SEQ ID NO: 6603523 - DNA, 20 bp, Homo sapiens
acacaaagcttttgcatatt

SEQ ID NO: 6603524 - DNA, 20 bp, Homo sapiens
acacaaaggaagtgccccct

SEQ ID NO: 6603525 - DNA, 21 bp, Homo sapiens
acacaaaggaagtgccccctc

SEQ ID NO: 6603526 - DNA, 15 bp, Homo sapiens
acacaaaggcatgct

SEQ ID NO: 6603527 - DNA, 13 bp, Homo sapiens
acacaaaggggat

SEQ ID NO: 6603528 - DNA, 23 bp, Homo sapiens
acacaaaggggatcataaagtta

SEQ ID NO: 6603529 - DNA, 16 bp, Homo sapiens
acacaaatattgcttg

SEQ ID NO: 6603530 - DNA, 11 bp, Homo sapiens
acacaaatgca

SEQ ID NO: 6603531 - DNA, 22 bp, Homo sapiens
acacaaatgctcaaagaaatct

SEQ ID NO: 6603532 - DNA, 22 bp, Homo sapiens
acacaaatgtctagtttctagt

SEQ ID NO: 6603533 - DNA, 21 bp, Homo sapiens
acacaaatgtgatttttgtaa

SEQ ID NO: 6603534 - DNA, 20 bp, Homo sapiens
acacaaatgtgtatttttgt

SEQ ID NO: 6603535 - DNA, 16 bp, Homo sapiens
acacaaattatgctaa

SEQ ID NO: 6603536 - DNA, 21 bp, Homo sapiens
acacaaattatgctaagaatt

SEQ ID NO: 6603537 - DNA, 13 bp, Homo sapiens
acacaaattcagt

SEQ ID NO: 6603538 - DNA, 18 bp, Homo sapiens
acacaaattcagtctctg

SEQ ID NO: 6603539 - DNA, 18 bp, Homo sapiens
acacaaatttgggagggt

SEQ ID NO: 6603540 - DNA, 12 bp, Homo sapiens
acacaacaaaaa

SEQ ID NO: 6603541 - DNA, 11 bp, Homo sapiens
acacaacacaa

SEQ ID NO: 6603542 - DNA, 12 bp, Homo sapiens
acacaacacaag

SEQ ID NO: 6603543 - DNA, 16 bp, Homo sapiens
acacaacacaagaaaa

SEQ ID NO: 6603544 - DNA, 14 bp, Homo sapiens
acacaacacagata

SEQ ID NO: 6603545 - DNA, 19 bp, Homo sapiens
acacaacagccaacagcta

SEQ ID NO: 6603546 - DNA, 20 bp, Homo sapiens
acacaacagcgtggcttaga

SEQ ID NO: 6603547 - DNA, 14 bp, Homo sapiens
acacaacaggctgt

SEQ ID NO: 6603548 - DNA, 16 bp, Homo sapiens
acacaacaggctgtgt

SEQ ID NO: 6603549 - DNA, 13 bp, Homo sapiens
acacaacatcaag

SEQ ID NO: 6603550 - DNA, 13 bp, Homo sapiens
acacaacatgtat

SEQ ID NO: 6603551 - DNA, 12 bp, Homo sapiens
acacaacattta

SEQ ID NO: 6603552 - DNA, 15 bp, Homo sapiens
acacaacatttgtgt

SEQ ID NO: 6603553 - DNA, 22 bp, Homo sapiens
acacaaccagaggtggcaggag

SEQ ID NO: 6603554 - DNA, 17 bp, Homo sapiens
acacaactatattgttt

SEQ ID NO: 6603555 - DNA, 14 bp, Homo sapiens
acacaactcatcca

SEQ ID NO: 6603556 - DNA, 17 bp, Homo sapiens
acacaactcatccagaa

SEQ ID NO: 6603557 - DNA, 22 bp, Homo sapiens
acacaactgtggataaattttg

SEQ ID NO: 6603558 - DNA, 20 bp, Homo sapiens
acacaacttagaaaccaaat

SEQ ID NO: 6603559 - DNA, 19 bp, Homo sapiens
acacaactttgcaaattat

SEQ ID NO: 6603560 - DNA, 15 bp, Homo sapiens
acacaagacagcaga

SEQ ID NO: 6603561 - DNA, 14 bp, Homo sapiens
acacaagagctgga

SEQ ID NO: 6603562 - DNA, 21 bp, Homo sapiens
acacaagagggactgtatttc

SEQ ID NO: 6603563 - DNA, 13 bp, Homo sapiens
acacaagagtata

SEQ ID NO: 6603564 - DNA, 19 bp, Homo sapiens
acacaagcaaaccttctca

SEQ ID NO: 6603565 - DNA, 17 bp, Homo sapiens
acacaagcaacaaacct

SEQ ID NO: 6603566 - DNA, 16 bp, Homo sapiens
acacaagccacagaag

SEQ ID NO: 6603567 - DNA, 17 bp, Homo sapiens
acacaagcccacagcac

SEQ ID NO: 6603568 - DNA, 12 bp, Homo sapiens
acacaagcggcc

SEQ ID NO: 6603569 - DNA, 14 bp, Homo sapiens
acacaagcggccct

SEQ ID NO: 6603570 - DNA, 14 bp, Homo sapiens
acacaagctcctta

SEQ ID NO: 6603571 - DNA, 14 bp, Homo sapiens
acacaaggacagaa

SEQ ID NO: 6603572 - DNA, 21 bp, Homo sapiens
acacaaggacccttcaggtgt

SEQ ID NO: 6603573 - DNA, 19 bp, Homo sapiens
acacaaggatagatgctgg

SEQ ID NO: 6603574 - DNA, 23 bp, Homo sapiens
acacaaggatagatgctggccca

SEQ ID NO: 6603575 - DNA, 18 bp, Homo sapiens
acacaaggccagaaaaag

SEQ ID NO: 6603576 - DNA, 22 bp, Homo sapiens
acacaaggccagaaaaagaaga

SEQ ID NO: 6603577 - DNA, 13 bp, Homo sapiens
acacaaggctggg

SEQ ID NO: 6603578 - DNA, 16 bp, Homo sapiens
acacaaggctgggcac

SEQ ID NO: 6603579 - DNA, 18 bp, Homo sapiens
acacaagggatataaaat

SEQ ID NO: 6603580 - DNA, 21 bp, Homo sapiens
acacaaggtcatggccacact

SEQ ID NO: 6603581 - DNA, 14 bp, Homo sapiens
acacaaggtgctca

SEQ ID NO: 6603582 - DNA, 16 bp, Homo sapiens
acacaagtaagagact

SEQ ID NO: 6603583 - DNA, 16 bp, Homo sapiens
acacaagtcctgtgaa

SEQ ID NO: 6603584 - DNA, 22 bp, Homo sapiens
acacaagtgagggctttttaac

SEQ ID NO: 6603585 - DNA, 21 bp, Homo sapiens
acacaagtgtattatttctgg

SEQ ID NO: 6603586 - DNA, 20 bp, Homo sapiens
acacaagtttacttgtcttt

SEQ ID NO: 6603587 - DNA, 21 bp, Homo sapiens
acacaagtttgtgctatctat

SEQ ID NO: 6603588 - DNA, 15 bp, Homo sapiens
acacaataaagaacc

SEQ ID NO: 6603589 - DNA, 14 bp, Homo sapiens
acacaatacaataa

SEQ ID NO: 6603590 - DNA, 20 bp, Homo sapiens
acacaataggatcccccttc

SEQ ID NO: 6603591 - DNA, 21 bp, Homo sapiens
acacaatatacgaaaagccag

SEQ ID NO: 6603592 - DNA, 14 bp, Homo sapiens
acacaatatgaata

SEQ ID NO: 6603593 - DNA, 15 bp, Homo sapiens
acacaatcagaccaa

SEQ ID NO: 6603594 - DNA, 20 bp, Homo sapiens
acacaatcagaccaaggaac

SEQ ID NO: 6603595 - DNA, 15 bp, Homo sapiens
acacaatccctgggg

SEQ ID NO: 6603596 - DNA, 14 bp, Homo sapiens
acacaatctttcct

SEQ ID NO: 6603597 - DNA, 19 bp, Homo sapiens
acacaatctttccttgtct

SEQ ID NO: 6603598 - DNA, 22 bp, Homo sapiens
acacaatctttccttgtctctc

SEQ ID NO: 6603599 - DNA, 13 bp, Homo sapiens
acacaatggcacc

SEQ ID NO: 6603600 - DNA, 14 bp, Homo sapiens
acacaatggcacct

SEQ ID NO: 6603601 - DNA, 23 bp, Homo sapiens
acacaatgggtatctaataaata

SEQ ID NO: 6603602 - DNA, 16 bp, Homo sapiens
acacaatggtttttaa

SEQ ID NO: 6603603 - DNA, 22 bp, Homo sapiens
acacaatggtttttaaattttg

SEQ ID NO: 6603604 - DNA, 13 bp, Homo sapiens
acacaatgttatt

SEQ ID NO: 6603605 - DNA, 22 bp, Homo sapiens
acacaatgttgcactgaaaacc

SEQ ID NO: 6603606 - DNA, 13 bp, Homo sapiens
acacaattagaga

SEQ ID NO: 6603607 - DNA, 21 bp, Homo sapiens
acacaatttaattcctctttt

SEQ ID NO: 6603608 - DNA, 16 bp, Homo sapiens
acacaatttatactgc

SEQ ID NO: 6603609 - DNA, 18 bp, Homo sapiens
acacaatttcatttccag

SEQ ID NO: 6603610 - DNA, 21 bp, Homo sapiens
acacaattttattttttttct

SEQ ID NO: 6603611 - DNA, 19 bp, Homo sapiens
acacacaaaaaatgcacaa

SEQ ID NO: 6603612 - DNA, 21 bp, Homo sapiens
acacacaaaaaccttggcata

SEQ ID NO: 6603613 - DNA, 12 bp, Homo sapiens
acacacaaaaag

SEQ ID NO: 6603614 - DNA, 19 bp, Homo sapiens
acacacaaaagattatgta

SEQ ID NO: 6603615 - DNA, 22 bp, Homo sapiens
acacacaaattatcttaaaact

SEQ ID NO: 6603616 - DNA, 15 bp, Homo sapiens
acacacaacaaaaat

SEQ ID NO: 6603617 - DNA, 20 bp, Homo sapiens
acacacaagcagacacacac

SEQ ID NO: 6603618 - DNA, 18 bp, Homo sapiens
acacacaaggtgctcaga

SEQ ID NO: 6603619 - DNA, 16 bp, Homo sapiens
acacacaataaagaac

SEQ ID NO: 6603620 - DNA, 15 bp, Homo sapiens
acacacaatggcaag

SEQ ID NO: 6603621 - DNA, 13 bp, Homo sapiens
acacacacaaacc

SEQ ID NO: 6603622 - DNA, 14 bp, Homo sapiens
acacacacaaatgc

SEQ ID NO: 6603623 - DNA, 12 bp, Homo sapiens
acacacacacaa

SEQ ID NO: 6603624 - DNA, 16 bp, Homo sapiens
acacacacacaaatgc

SEQ ID NO: 6603625 - DNA, 12 bp, Homo sapiens
acacacacacac

SEQ ID NO: 6603626 - DNA, 15 bp, Homo sapiens
acacacacacacaaa

SEQ ID NO: 6603627 - DNA, 16 bp, Homo sapiens
acacacacacacaaat

SEQ ID NO: 6603628 - DNA, 17 bp, Homo sapiens
acacacacacacacgat

SEQ ID NO: 6603629 - DNA, 14 bp, Homo sapiens
acacacacacacag

SEQ ID NO: 6603630 - DNA, 15 bp, Homo sapiens
acacacacacacata

SEQ ID NO: 6603631 - DNA, 15 bp, Homo sapiens
acacacacacacatc

SEQ ID NO: 6603632 - DNA, 15 bp, Homo sapiens
acacacacacagcca

SEQ ID NO: 6603633 - DNA, 13 bp, Homo sapiens
acacacacacagg

SEQ ID NO: 6603634 - DNA, 12 bp, Homo sapiens
acacacacacat

SEQ ID NO: 6603635 - DNA, 15 bp, Homo sapiens
acacacacacgatgc

SEQ ID NO: 6603636 - DNA, 13 bp, Homo sapiens
acacacacacgca

SEQ ID NO: 6603637 - DNA, 14 bp, Homo sapiens
acacacacacgcac

SEQ ID NO: 6603638 - DNA, 15 bp, Homo sapiens
acacacacacgcaga

SEQ ID NO: 6603639 - DNA, 12 bp, Homo sapiens
acacacacacta

SEQ ID NO: 6603640 - DNA, 12 bp, Homo sapiens
acacacacactc

SEQ ID NO: 6603641 - DNA, 10 bp, Homo sapiens
acacacacag

SEQ ID NO: 6603642 - DNA, 15 bp, Homo sapiens
acacacacagaaaat

SEQ ID NO: 6603643 - DNA, 13 bp, Homo sapiens
acacacacagaca

SEQ ID NO: 6603644 - DNA, 12 bp, Homo sapiens
acacacacagcc

SEQ ID NO: 6603645 - DNA, 14 bp, Homo sapiens
acacacacagccag

SEQ ID NO: 6603646 - DNA, 15 bp, Homo sapiens
acacacacagccatt

SEQ ID NO: 6603647 - DNA, 13 bp, Homo sapiens
acacacacagctt

SEQ ID NO: 6603648 - DNA, 11 bp, Homo sapiens
acacacacagg

SEQ ID NO: 6603649 - DNA, 15 bp, Homo sapiens
acacacacaggtggg

SEQ ID NO: 6603650 - DNA, 13 bp, Homo sapiens
acacacacataca

SEQ ID NO: 6603651 - DNA, 14 bp, Homo sapiens
acacacacatatac

SEQ ID NO: 6603652 - DNA, 14 bp, Homo sapiens
acacacacatatat

SEQ ID NO: 6603653 - DNA, 11 bp, Homo sapiens
acacacacatg

SEQ ID NO: 6603654 - DNA, 12 bp, Homo sapiens
acacacacatgc

SEQ ID NO: 6603655 - DNA, 13 bp, Homo sapiens
acacacacatgca

SEQ ID NO: 6603656 - DNA, 14 bp, Homo sapiens
acacacacatgcac

SEQ ID NO: 6603657 - DNA, 15 bp, Homo sapiens
acacacacatgcaca

SEQ ID NO: 6603658 - DNA, 14 bp, Homo sapiens
acacacacatgcat

SEQ ID NO: 6603659 - DNA, 16 bp, Homo sapiens
acacacacatgcatac

SEQ ID NO: 6603660 - DNA, 17 bp, Homo sapiens
acacacaccacacatac

SEQ ID NO: 6603661 - DNA, 12 bp, Homo sapiens
acacacacccag

SEQ ID NO: 6603662 - DNA, 15 bp, Homo sapiens
acacacacctgtctg

SEQ ID NO: 6603663 - DNA, 20 bp, Homo sapiens
acacacacctgtctgtgcag

SEQ ID NO: 6603664 - DNA, 21 bp, Homo sapiens
acacacacgcactctccccgc

SEQ ID NO: 6603665 - DNA, 17 bp, Homo sapiens
acacacacgcagacaca

SEQ ID NO: 6603666 - DNA, 15 bp, Homo sapiens
acacacacgccagct

SEQ ID NO: 6603667 - DNA, 21 bp, Homo sapiens
acacacacgcgtccacataca

SEQ ID NO: 6603668 - DNA, 14 bp, Homo sapiens
acacacactcacca

SEQ ID NO: 6603669 - DNA, 15 bp, Homo sapiens
acacacactcaccag

SEQ ID NO: 6603670 - DNA, 23 bp, Homo sapiens
acacacactcaccagtggccttt

SEQ ID NO: 6603671 - DNA, 13 bp, Homo sapiens
acacacactccct

SEQ ID NO: 6603672 - DNA, 18 bp, Homo sapiens
acacacactccttcccct

SEQ ID NO: 6603673 - DNA, 16 bp, Homo sapiens
acacacactgcctccc

SEQ ID NO: 6603674 - DNA, 13 bp, Homo sapiens
acacacactggct

SEQ ID NO: 6603675 - DNA, 21 bp, Homo sapiens
acacacagaaaatatactgta

SEQ ID NO: 6603676 - DNA, 19 bp, Homo sapiens
acacacagaaatgtgtcaa

SEQ ID NO: 6603677 - DNA, 18 bp, Homo sapiens
acacacagacacacaagc

SEQ ID NO: 6603678 - DNA, 19 bp, Homo sapiens
acacacagactacagccag

SEQ ID NO: 6603679 - DNA, 22 bp, Homo sapiens
acacacagaggaagagcaggca

SEQ ID NO: 6603680 - DNA, 13 bp, Homo sapiens
acacacagatgac

SEQ ID NO: 6603681 - DNA, 22 bp, Homo sapiens
acacacagatggtcacacagag

SEQ ID NO: 6603682 - DNA, 23 bp, Homo sapiens
acacacagatttgagctcagccc

SEQ ID NO: 6603683 - DNA, 18 bp, Homo sapiens
acacacagcagcactgca

SEQ ID NO: 6603684 - DNA, 14 bp, Homo sapiens
acacacagcagctc

SEQ ID NO: 6603685 - DNA, 16 bp, Homo sapiens
acacacagcagctcca

SEQ ID NO: 6603686 - DNA, 20 bp, Homo sapiens
acacacagcagctccaacct

SEQ ID NO: 6603687 - DNA, 13 bp, Homo sapiens
acacacagcagtg

SEQ ID NO: 6603688 - DNA, 17 bp, Homo sapiens
acacacagccacacaca

SEQ ID NO: 6603689 - DNA, 22 bp, Homo sapiens
acacacagccacacacacagaa

SEQ ID NO: 6603690 - DNA, 11 bp, Homo sapiens
acacacagcct

SEQ ID NO: 6603691 - DNA, 13 bp, Homo sapiens
acacacagcctgg

SEQ ID NO: 6603692 - DNA, 18 bp, Homo sapiens
acacacagcctggcctcc

SEQ ID NO: 6603693 - DNA, 11 bp, Homo sapiens
acacacagctc

SEQ ID NO: 6603694 - DNA, 13 bp, Homo sapiens
acacacagctctg

SEQ ID NO: 6603695 - DNA, 20 bp, Homo sapiens
acacacagctgggcaaagcc

SEQ ID NO: 6603696 - DNA, 21 bp, Homo sapiens
acacacagctgggcaaagcca

SEQ ID NO: 6603697 - DNA, 13 bp, Homo sapiens
acacacaggagga

SEQ ID NO: 6603698 - DNA, 11 bp, Homo sapiens
acacacaggcc

SEQ ID NO: 6603699 - DNA, 18 bp, Homo sapiens
acacacaggccatttcat

SEQ ID NO: 6603700 - DNA, 13 bp, Homo sapiens
acacacaggcctt

SEQ ID NO: 6603701 - DNA, 15 bp, Homo sapiens
acacacaggccttct

SEQ ID NO: 6603702 - DNA, 22 bp, Homo sapiens
acacacaggtggggactgggca

SEQ ID NO: 6603703 - DNA, 12 bp, Homo sapiens
acacacagtacg

SEQ ID NO: 6603704 - DNA, 12 bp, Homo sapiens
acacacatacac

SEQ ID NO: 6603705 - DNA, 14 bp, Homo sapiens
acacacatacataa

SEQ ID NO: 6603706 - DNA, 19 bp, Homo sapiens
acacacataccttcatgtg

SEQ ID NO: 6603707 - DNA, 19 bp, Homo sapiens
acacacatacgtgcacagg

SEQ ID NO: 6603708 - DNA, 13 bp, Homo sapiens
acacacatataca

SEQ ID NO: 6603709 - DNA, 15 bp, Homo sapiens
acacacatatacata

SEQ ID NO: 6603710 - DNA, 19 bp, Homo sapiens
acacacatatacatatata

SEQ ID NO: 6603711 - DNA, 23 bp, Homo sapiens
acacacatatacattatttctgt

SEQ ID NO: 6603712 - DNA, 13 bp, Homo sapiens
acacacatatata

SEQ ID NO: 6603713 - DNA, 21 bp, Homo sapiens
acacacatatatacatacgca

SEQ ID NO: 6603714 - DNA, 21 bp, Homo sapiens
acacacatgcatacacacaca

SEQ ID NO: 6603715 - DNA, 15 bp, Homo sapiens
acacacatggaaggt

SEQ ID NO: 6603716 - DNA, 17 bp, Homo sapiens
acacacattctgccttg

SEQ ID NO: 6603717 - DNA, 14 bp, Homo sapiens
acacaccagagccc

SEQ ID NO: 6603718 - DNA, 20 bp, Homo sapiens
acacaccagagcccaccttg

SEQ ID NO: 6603719 - DNA, 23 bp, Homo sapiens
acacacccaggcccatgccaagg

SEQ ID NO: 6603720 - DNA, 22 bp, Homo sapiens
acacacccatgtaaccactgca

SEQ ID NO: 6603721 - DNA, 19 bp, Homo sapiens
acacaccccacaccccagc

SEQ ID NO: 6603722 - DNA, 23 bp, Homo sapiens
acacaccccacaccccagcccac

SEQ ID NO: 6603723 - DNA, 18 bp, Homo sapiens
acacacccccaagccaca

SEQ ID NO: 6603724 - DNA, 20 bp, Homo sapiens
acacacccccaagccacagg

SEQ ID NO: 6603725 - DNA, 17 bp, Homo sapiens
acacaccctccagcaca

SEQ ID NO: 6603726 - DNA, 19 bp, Homo sapiens
acacaccctccagcacaga

SEQ ID NO: 6603727 - DNA, 14 bp, Homo sapiens
acacaccctgcccc

SEQ ID NO: 6603728 - DNA, 16 bp, Homo sapiens
acacaccctgcccctg

SEQ ID NO: 6603729 - DNA, 12 bp, Homo sapiens
acacacccttcc

SEQ ID NO: 6603730 - DNA, 17 bp, Homo sapiens
acacaccggtcaccgag

SEQ ID NO: 6603731 - DNA, 21 bp, Homo sapiens
acacacctaagggacatgttt

SEQ ID NO: 6603732 - DNA, 16 bp, Homo sapiens
acacacctctgcccct

SEQ ID NO: 6603733 - DNA, 17 bp, Homo sapiens
acacacctgagaatgtg

SEQ ID NO: 6603734 - DNA, 11 bp, Homo sapiens
acacacctgca

SEQ ID NO: 6603735 - DNA, 20 bp, Homo sapiens
acacacctgcacaccgtccc

SEQ ID NO: 6603736 - DNA, 13 bp, Homo sapiens
acacacctgcctg

SEQ ID NO: 6603737 - DNA, 14 bp, Homo sapiens
acacacctgtctgt

SEQ ID NO: 6603738 - DNA, 19 bp, Homo sapiens
acacacctgtctgtgcaga

SEQ ID NO: 6603739 - DNA, 14 bp, Homo sapiens
acacaccttaaaac

SEQ ID NO: 6603740 - DNA, 17 bp, Homo sapiens
acacacctttaagtaga

SEQ ID NO: 6603741 - DNA, 11 bp, Homo sapiens
acacacgatgc

SEQ ID NO: 6603742 - DNA, 13 bp, Homo sapiens
acacacgatgcat

SEQ ID NO: 6603743 - DNA, 14 bp, Homo sapiens
acacacgatgcatt

SEQ ID NO: 6603744 - DNA, 18 bp, Homo sapiens
acacacgatgcatttaat

SEQ ID NO: 6603745 - DNA, 19 bp, Homo sapiens
acacacgatgcatttaata

SEQ ID NO: 6603746 - DNA, 21 bp, Homo sapiens
acacacgatgcatttaataaa

SEQ ID NO: 6603747 - DNA, 22 bp, Homo sapiens
acacacgcacggcttcctataa

SEQ ID NO: 6603748 - DNA, 10 bp, Homo sapiens
acacacgcag

SEQ ID NO: 6603749 - DNA, 14 bp, Homo sapiens
acacacgcagacac

SEQ ID NO: 6603750 - DNA, 21 bp, Homo sapiens
acacacgcaggaactcccagc

SEQ ID NO: 6603751 - DNA, 20 bp, Homo sapiens
acacacgccagctcctctct

SEQ ID NO: 6603752 - DNA, 15 bp, Homo sapiens
acacacgccttcatg

SEQ ID NO: 6603753 - DNA, 19 bp, Homo sapiens
acacacgctccctggaagc

SEQ ID NO: 6603754 - DNA, 13 bp, Homo sapiens
acacacgctgcct

SEQ ID NO: 6603755 - DNA, 16 bp, Homo sapiens
acacacggaccatgtg

SEQ ID NO: 6603756 - DNA, 14 bp, Homo sapiens
acacacggatgcac

SEQ ID NO: 6603757 - DNA, 22 bp, Homo sapiens
acacacggggcacccagcccaa

SEQ ID NO: 6603758 - DNA, 23 bp, Homo sapiens
acacacggtgcctttatttccac

SEQ ID NO: 6603759 - DNA, 19 bp, Homo sapiens
acacacggttttggcagct

SEQ ID NO: 6603760 - DNA, 20 bp, Homo sapiens
acacacggttttggcagctg

SEQ ID NO: 6603761 - DNA, 21 bp, Homo sapiens
acacacgtgcgtgcgagcaca

SEQ ID NO: 6603762 - DNA, 22 bp, Homo sapiens
acacacgtgcgtgcgagcacac

SEQ ID NO: 6603763 - DNA, 20 bp, Homo sapiens
acacacgtgctgtgggcctc

SEQ ID NO: 6603764 - DNA, 18 bp, Homo sapiens
acacacgtgtgatgtatg

SEQ ID NO: 6603765 - DNA, 21 bp, Homo sapiens
acacacgtgtgatgtatgttg

SEQ ID NO: 6603766 - DNA, 17 bp, Homo sapiens
acacactaaactctggg

SEQ ID NO: 6603767 - DNA, 16 bp, Homo sapiens
acacactacaccacac

SEQ ID NO: 6603768 - DNA, 20 bp, Homo sapiens
acacactaccgaatgtgtct

SEQ ID NO: 6603769 - DNA, 14 bp, Homo sapiens
acacactactacct

SEQ ID NO: 6603770 - DNA, 19 bp, Homo sapiens
acacactactggatagtga

SEQ ID NO: 6603771 - DNA, 20 bp, Homo sapiens
acacactcaaatcaagaaac

SEQ ID NO: 6603772 - DNA, 20 bp, Homo sapiens
acacactcacaatttaaaat

SEQ ID NO: 6603773 - DNA, 22 bp, Homo sapiens
acacactcacaatttaaaatat

SEQ ID NO: 6603774 - DNA, 15 bp, Homo sapiens
acacactcaccattt

SEQ ID NO: 6603775 - DNA, 15 bp, Homo sapiens
acacactcagcagcc

SEQ ID NO: 6603776 - DNA, 15 bp, Homo sapiens
acacactcagccaca

SEQ ID NO: 6603777 - DNA, 16 bp, Homo sapiens
acacactcagccacaa

SEQ ID NO: 6603778 - DNA, 14 bp, Homo sapiens
acacactccctgct

SEQ ID NO: 6603779 - DNA, 14 bp, Homo sapiens
acacactccttccc

SEQ ID NO: 6603780 - DNA, 22 bp, Homo sapiens
acacactcgggttaagaaatac

SEQ ID NO: 6603781 - DNA, 21 bp, Homo sapiens
acacactctcatgtccccttc

SEQ ID NO: 6603782 - DNA, 23 bp, Homo sapiens
acacactctcatgtccccttcct

SEQ ID NO: 6603783 - DNA, 14 bp, Homo sapiens
acacactcttcaag

SEQ ID NO: 6603784 - DNA, 13 bp, Homo sapiens
acacactgaaaag

SEQ ID NO: 6603785 - DNA, 17 bp, Homo sapiens
acacactgatgcttaga

SEQ ID NO: 6603786 - DNA, 13 bp, Homo sapiens
acacactggaccc

SEQ ID NO: 6603787 - DNA, 20 bp, Homo sapiens
acacactggaccccactggc

SEQ ID NO: 6603788 - DNA, 21 bp, Homo sapiens
acacactgtaaatatccacag

SEQ ID NO: 6603789 - DNA, 20 bp, Homo sapiens
acacactgtacacataagcc

SEQ ID NO: 6603790 - DNA, 11 bp, Homo sapiens
acacactgtgc

SEQ ID NO: 6603791 - DNA, 16 bp, Homo sapiens
acacactgtgctttct

SEQ ID NO: 6603792 - DNA, 20 bp, Homo sapiens
acacactgttacacgtgcct

SEQ ID NO: 6603793 - DNA, 19 bp, Homo sapiens
acacacttagaatactaca

SEQ ID NO: 6603794 - DNA, 21 bp, Homo sapiens
acacactttccatctctgcct

SEQ ID NO: 6603795 - DNA, 15 bp, Homo sapiens
acacactttctcttc

SEQ ID NO: 6603796 - DNA, 21 bp, Homo sapiens
acacacttttctttttaaatg

SEQ ID NO: 6603797 - DNA, 17 bp, Homo sapiens
acacactttttattaga

SEQ ID NO: 6603798 - DNA, 14 bp, Homo sapiens
acacagaaaatata

SEQ ID NO: 6603799 - DNA, 18 bp, Homo sapiens
acacagaaaatgttgaga

SEQ ID NO: 6603800 - DNA, 19 bp, Homo sapiens
acacagaaaatgttgagaa

SEQ ID NO: 6603801 - DNA, 14 bp, Homo sapiens
acacagaaacactg

SEQ ID NO: 6603802 - DNA, 19 bp, Homo sapiens
acacagaaacctttttaaa

SEQ ID NO: 6603803 - DNA, 12 bp, Homo sapiens
acacagaaatat

SEQ ID NO: 6603804 - DNA, 15 bp, Homo sapiens
acacagaaatgaatg

SEQ ID NO: 6603805 - DNA, 21 bp, Homo sapiens
acacagaaatgctgctggcca

SEQ ID NO: 6603806 - DNA, 17 bp, Homo sapiens
acacagaacaggaacta

SEQ ID NO: 6603807 - DNA, 14 bp, Homo sapiens
acacagaagtccct

SEQ ID NO: 6603808 - DNA, 22 bp, Homo sapiens
acacagaagtccctaggaggga

SEQ ID NO: 6603809 - DNA, 16 bp, Homo sapiens
acacagaatagtttac

SEQ ID NO: 6603810 - DNA, 19 bp, Homo sapiens
acacagaatagtttacaca

SEQ ID NO: 6603811 - DNA, 20 bp, Homo sapiens
acacagaatataggataaga

SEQ ID NO: 6603812 - DNA, 12 bp, Homo sapiens
acacagacattt

SEQ ID NO: 6603813 - DNA, 21 bp, Homo sapiens
acacagaccgcgcccctggga

SEQ ID NO: 6603814 - DNA, 22 bp, Homo sapiens
acacagaccgcgcccctgggac

SEQ ID NO: 6603815 - DNA, 17 bp, Homo sapiens
acacagacggcctaggg

SEQ ID NO: 6603816 - DNA, 15 bp, Homo sapiens
acacagactcatatt

SEQ ID NO: 6603817 - DNA, 16 bp, Homo sapiens
acacagactcatatta

SEQ ID NO: 6603818 - DNA, 19 bp, Homo sapiens
acacagactctgtgagatt

SEQ ID NO: 6603819 - DNA, 18 bp, Homo sapiens
acacagactgacgaaact

SEQ ID NO: 6603820 - DNA, 17 bp, Homo sapiens
acacagactggcaataa

SEQ ID NO: 6603821 - DNA, 21 bp, Homo sapiens
acacagactggcaataaactc

SEQ ID NO: 6603822 - DNA, 21 bp, Homo sapiens
acacagactgttgtccctgca

SEQ ID NO: 6603823 - DNA, 15 bp, Homo sapiens
acacagagaaggcta

SEQ ID NO: 6603824 - DNA, 17 bp, Homo sapiens
acacagagaagggaaga

SEQ ID NO: 6603825 - DNA, 15 bp, Homo sapiens
acacagagctaaggc

SEQ ID NO: 6603826 - DNA, 17 bp, Homo sapiens
acacagaggaagagcag

SEQ ID NO: 6603827 - DNA, 20 bp, Homo sapiens
acacagaggttttaaacagt

SEQ ID NO: 6603828 - DNA, 21 bp, Homo sapiens
acacagaggttttaaacagtc

SEQ ID NO: 6603829 - DNA, 14 bp, Homo sapiens
acacagagtgtgtt

SEQ ID NO: 6603830 - DNA, 15 bp, Homo sapiens
acacagagtgtgttt

SEQ ID NO: 6603831 - DNA, 16 bp, Homo sapiens
acacagagtgtgtttt

SEQ ID NO: 6603832 - DNA, 17 bp, Homo sapiens
acacagagtgtgttttt

SEQ ID NO: 6603833 - DNA, 16 bp, Homo sapiens
acacagatagaccttt

SEQ ID NO: 6603834 - DNA, 14 bp, Homo sapiens
acacagatgaaaca

SEQ ID NO: 6603835 - DNA, 15 bp, Homo sapiens
acacagatggcacct

SEQ ID NO: 6603836 - DNA, 19 bp, Homo sapiens
acacagattatgttcctgc

SEQ ID NO: 6603837 - DNA, 22 bp, Homo sapiens
acacagattatgttcctgctgt

SEQ ID NO: 6603838 - DNA, 17 bp, Homo sapiens
acacagatttgagctca

SEQ ID NO: 6603839 - DNA, 16 bp, Homo sapiens
acacagcaattttgta

SEQ ID NO: 6603840 - DNA, 11 bp, Homo sapiens
acacagcacaa

SEQ ID NO: 6603841 - DNA, 22 bp, Homo sapiens
acacagcagaggcccagatatt

SEQ ID NO: 6603842 - DNA, 14 bp, Homo sapiens
acacagcagcagtt

SEQ ID NO: 6603843 - DNA, 12 bp, Homo sapiens
acacagcagtgt

SEQ ID NO: 6603844 - DNA, 13 bp, Homo sapiens
acacagcatgcat

SEQ ID NO: 6603845 - DNA, 17 bp, Homo sapiens
acacagcattgtatatg

SEQ ID NO: 6603846 - DNA, 20 bp, Homo sapiens
acacagcattgtatatgtga

SEQ ID NO: 6603847 - DNA, 14 bp, Homo sapiens
acacagcatttcaa

SEQ ID NO: 6603848 - DNA, 21 bp, Homo sapiens
acacagccaaggggatattta

SEQ ID NO: 6603849 - DNA, 11 bp, Homo sapiens
acacagccaca

SEQ ID NO: 6603850 - DNA, 19 bp, Homo sapiens
acacagccacacacacaga

SEQ ID NO: 6603851 - DNA, 15 bp, Homo sapiens
acacagcccaccctc

SEQ ID NO: 6603852 - DNA, 16 bp, Homo sapiens
acacagcccagaaggc

SEQ ID NO: 6603853 - DNA, 19 bp, Homo sapiens
acacagcccagagactgaa

SEQ ID NO: 6603854 - DNA, 12 bp, Homo sapiens
acacagcccgag

SEQ ID NO: 6603855 - DNA, 23 bp, Homo sapiens
acacagcctaaagctaaaaatat

SEQ ID NO: 6603856 - DNA, 16 bp, Homo sapiens
acacagcctccctgag

SEQ ID NO: 6603857 - DNA, 12 bp, Homo sapiens
acacagcctggc

SEQ ID NO: 6603858 - DNA, 14 bp, Homo sapiens
acacagcctgggcc

SEQ ID NO: 6603859 - DNA, 19 bp, Homo sapiens
acacagcctgggccccagc

SEQ ID NO: 6603860 - DNA, 17 bp, Homo sapiens
acacagcctgtcttcag

SEQ ID NO: 6603861 - DNA, 14 bp, Homo sapiens
acacagcctgtgtg

SEQ ID NO: 6603862 - DNA, 12 bp, Homo sapiens
acacagccttcc

SEQ ID NO: 6603863 - DNA, 14 bp, Homo sapiens
acacagcctttctg

SEQ ID NO: 6603864 - DNA, 16 bp, Homo sapiens
acacagcggctgcctc

SEQ ID NO: 6603865 - DNA, 17 bp, Homo sapiens
acacagcgtccctagca

SEQ ID NO: 6603866 - DNA, 18 bp, Homo sapiens
acacagcgtccctagcag

SEQ ID NO: 6603867 - DNA, 21 bp, Homo sapiens
acacagctaacacacagctcc

SEQ ID NO: 6603868 - DNA, 23 bp, Homo sapiens
acacagctaataaaagtcagagc

SEQ ID NO: 6603869 - DNA, 17 bp, Homo sapiens
acacagctaggcatgcc

SEQ ID NO: 6603870 - DNA, 18 bp, Homo sapiens
acacagctaggcatgcct

SEQ ID NO: 6603871 - DNA, 19 bp, Homo sapiens
acacagctaggcatgcctg

SEQ ID NO: 6603872 - DNA, 21 bp, Homo sapiens
acacagctaggcatgcctggg

SEQ ID NO: 6603873 - DNA, 11 bp, Homo sapiens
acacagctctg

SEQ ID NO: 6603874 - DNA, 15 bp, Homo sapiens
acacagctcttcatt

SEQ ID NO: 6603875 - DNA, 18 bp, Homo sapiens
acacagctcttcattcca

SEQ ID NO: 6603876 - DNA, 19 bp, Homo sapiens
acacagctcttctccaggc

SEQ ID NO: 6603877 - DNA, 19 bp, Homo sapiens
acacagctgcagagacaga

SEQ ID NO: 6603878 - DNA, 22 bp, Homo sapiens
acacagctgccctagctgaccc

SEQ ID NO: 6603879 - DNA, 13 bp, Homo sapiens
acacagctgcttt

SEQ ID NO: 6603880 - DNA, 12 bp, Homo sapiens
acacagctgggc

SEQ ID NO: 6603881 - DNA, 13 bp, Homo sapiens
acacagctgggca

SEQ ID NO: 6603882 - DNA, 14 bp, Homo sapiens
acacagctgggcaa

SEQ ID NO: 6603883 - DNA, 17 bp, Homo sapiens
acacagctgggcaaagc

SEQ ID NO: 6603884 - DNA, 11 bp, Homo sapiens
acacagctgtt

SEQ ID NO: 6603885 - DNA, 16 bp, Homo sapiens
acacagcttgtctctt

SEQ ID NO: 6603886 - DNA, 17 bp, Homo sapiens
acacagcttgtctcttg

SEQ ID NO: 6603887 - DNA, 15 bp, Homo sapiens
acacagcttgtgaat

SEQ ID NO: 6603888 - DNA, 18 bp, Homo sapiens
acacagcttgtgaatgtt

SEQ ID NO: 6603889 - DNA, 13 bp, Homo sapiens
acacaggaaacaa

SEQ ID NO: 6603890 - DNA, 13 bp, Homo sapiens
acacaggaagaat

SEQ ID NO: 6603891 - DNA, 22 bp, Homo sapiens
acacaggacttattatatcaga

SEQ ID NO: 6603892 - DNA, 17 bp, Homo sapiens
acacaggagaccacccc

SEQ ID NO: 6603893 - DNA, 14 bp, Homo sapiens
acacaggaggagaa

SEQ ID NO: 6603894 - DNA, 23 bp, Homo sapiens
acacaggatagataactctttgg

SEQ ID NO: 6603895 - DNA, 19 bp, Homo sapiens
acacaggatcctggcctga

SEQ ID NO: 6603896 - DNA, 20 bp, Homo sapiens
acacaggcaaagaggtgctg

SEQ ID NO: 6603897 - DNA, 17 bp, Homo sapiens
acacaggcacgggtccc

SEQ ID NO: 6603898 - DNA, 20 bp, Homo sapiens
acacaggcacgggtccctgc

SEQ ID NO: 6603899 - DNA, 16 bp, Homo sapiens
acacaggcagccagcc

SEQ ID NO: 6603900 - DNA, 17 bp, Homo sapiens
acacaggcagccagccg

SEQ ID NO: 6603901 - DNA, 20 bp, Homo sapiens
acacaggcagccagccgtgg

SEQ ID NO: 6603902 - DNA, 15 bp, Homo sapiens
acacaggcagctttc

SEQ ID NO: 6603903 - DNA, 11 bp, Homo sapiens
acacaggcagg

SEQ ID NO: 6603904 - DNA, 16 bp, Homo sapiens
acacaggcagggcctg

SEQ ID NO: 6603905 - DNA, 18 bp, Homo sapiens
acacaggcagggcctggc

SEQ ID NO: 6603906 - DNA, 16 bp, Homo sapiens
acacaggcatttcctg

SEQ ID NO: 6603907 - DNA, 20 bp, Homo sapiens
acacaggcatttcctgggtg

SEQ ID NO: 6603908 - DNA, 16 bp, Homo sapiens
acacaggccaccctgt

SEQ ID NO: 6603909 - DNA, 15 bp, Homo sapiens
acacaggccagcccc

SEQ ID NO: 6603910 - DNA, 16 bp, Homo sapiens
acacaggccagcccca

SEQ ID NO: 6603911 - DNA, 11 bp, Homo sapiens
acacaggccca

SEQ ID NO: 6603912 - DNA, 12 bp, Homo sapiens
acacaggcccat

SEQ ID NO: 6603913 - DNA, 16 bp, Homo sapiens
acacaggcccggctcc

SEQ ID NO: 6603914 - DNA, 18 bp, Homo sapiens
acacaggcccggctccag

SEQ ID NO: 6603915 - DNA, 20 bp, Homo sapiens
acacaggcccggctccaggc

SEQ ID NO: 6603916 - DNA, 21 bp, Homo sapiens
acacaggcccggctccaggct

SEQ ID NO: 6603917 - DNA, 10 bp, Homo sapiens
acacaggcct

SEQ ID NO: 6603918 - DNA, 17 bp, Homo sapiens
acacaggcctggcccag

SEQ ID NO: 6603919 - DNA, 18 bp, Homo sapiens
acacaggcctggcccagc

SEQ ID NO: 6603920 - DNA, 19 bp, Homo sapiens
acacaggcctggcccagcc

SEQ ID NO: 6603921 - DNA, 21 bp, Homo sapiens
acacaggcctggcccagccag

SEQ ID NO: 6603922 - DNA, 13 bp, Homo sapiens
acacaggcctgtg

SEQ ID NO: 6603923 - DNA, 13 bp, Homo sapiens
acacaggctgccg

SEQ ID NO: 6603924 - DNA, 15 bp, Homo sapiens
acacagggacttgaa

SEQ ID NO: 6603925 - DNA, 15 bp, Homo sapiens
acacagggaggctgt

SEQ ID NO: 6603926 - DNA, 11 bp, Homo sapiens
acacagggcac

SEQ ID NO: 6603927 - DNA, 13 bp, Homo sapiens
acacagggcactg

SEQ ID NO: 6603928 - DNA, 11 bp, Homo sapiens
acacagggcct

SEQ ID NO: 6603929 - DNA, 11 bp, Homo sapiens
acacagggctc

SEQ ID NO: 6603930 - DNA, 14 bp, Homo sapiens
acacagggctcaca

SEQ ID NO: 6603931 - DNA, 17 bp, Homo sapiens
acacagggctcacaggg

SEQ ID NO: 6603932 - DNA, 19 bp, Homo sapiens
acacagggctcacagggca

SEQ ID NO: 6603933 - DNA, 22 bp, Homo sapiens
acacagggctcacagggcaggc

SEQ ID NO: 6603934 - DNA, 17 bp, Homo sapiens
acacaggggaggtgata

SEQ ID NO: 6603935 - DNA, 21 bp, Homo sapiens
acacaggggaggtgatagcat

SEQ ID NO: 6603936 - DNA, 20 bp, Homo sapiens
acacaggggccctgtacagt

SEQ ID NO: 6603937 - DNA, 21 bp, Homo sapiens
acacaggggccctgtacagtg

SEQ ID NO: 6603938 - DNA, 13 bp, Homo sapiens
acacaggggcctt

SEQ ID NO: 6603939 - DNA, 16 bp, Homo sapiens
acacaggggcttgact

SEQ ID NO: 6603940 - DNA, 23 bp, Homo sapiens
acacaggggtggagtttctgacg

SEQ ID NO: 6603941 - DNA, 15 bp, Homo sapiens
acacagggttttgta

SEQ ID NO: 6603942 - DNA, 19 bp, Homo sapiens
acacaggtctcattgcttc

SEQ ID NO: 6603943 - DNA, 14 bp, Homo sapiens
acacaggtctttcc

SEQ ID NO: 6603944 - DNA, 13 bp, Homo sapiens
acacaggtgggga

SEQ ID NO: 6603945 - DNA, 17 bp, Homo sapiens
acacaggtggtgtcact

SEQ ID NO: 6603946 - DNA, 19 bp, Homo sapiens
acacaggtggtgtcactgt

SEQ ID NO: 6603947 - DNA, 20 bp, Homo sapiens
acacaggtggtgtcactgtc

SEQ ID NO: 6603948 - DNA, 24 bp, Homo sapiens
acacagtaaaaacttgtactatgt

SEQ ID NO: 6603949 - DNA, 19 bp, Homo sapiens
acacagtaccatttaatgg

SEQ ID NO: 6603950 - DNA, 15 bp, Homo sapiens
acacagtacctaaga

SEQ ID NO: 6603951 - DNA, 21 bp, Homo sapiens
acacagtacttcctcccagca

SEQ ID NO: 6603952 - DNA, 17 bp, Homo sapiens
acacagtatagataaat

SEQ ID NO: 6603953 - DNA, 19 bp, Homo sapiens
acacagtattacttctgct

SEQ ID NO: 6603954 - DNA, 13 bp, Homo sapiens
acacagtattatg

SEQ ID NO: 6603955 - DNA, 17 bp, Homo sapiens
acacagtattgtagaaa

SEQ ID NO: 6603956 - DNA, 18 bp, Homo sapiens
acacagtcaaaataattc

SEQ ID NO: 6603957 - DNA, 19 bp, Homo sapiens
acacagtcacccctccctc

SEQ ID NO: 6603958 - DNA, 16 bp, Homo sapiens
acacagtcagcatgct

SEQ ID NO: 6603959 - DNA, 22 bp, Homo sapiens
acacagtcagggcggggctggc

SEQ ID NO: 6603960 - DNA, 13 bp, Homo sapiens
acacagtccccag

SEQ ID NO: 6603961 - DNA, 20 bp, Homo sapiens
acacagtcctcacacacgga

SEQ ID NO: 6603962 - DNA, 23 bp, Homo sapiens
acacagtctcacccagactccag

SEQ ID NO: 6603963 - DNA, 16 bp, Homo sapiens
acacagtctcagtcca

SEQ ID NO: 6603964 - DNA, 16 bp, Homo sapiens
acacagtctgcaagat

SEQ ID NO: 6603965 - DNA, 19 bp, Homo sapiens
acacagtgagactgtacat

SEQ ID NO: 6603966 - DNA, 22 bp, Homo sapiens
acacagtgagactgtacataat

SEQ ID NO: 6603967 - DNA, 17 bp, Homo sapiens
acacagtgattccctcc

SEQ ID NO: 6603968 - DNA, 20 bp, Homo sapiens
acacagtgccttcaataaat

SEQ ID NO: 6603969 - DNA, 19 bp, Homo sapiens
acacagtgctcgaccttga

SEQ ID NO: 6603970 - DNA, 17 bp, Homo sapiens
acacagtggccggggct

SEQ ID NO: 6603971 - DNA, 19 bp, Homo sapiens
acacagtgggaactctgac

SEQ ID NO: 6603972 - DNA, 22 bp, Homo sapiens
acacagtgggccggccccaggc

SEQ ID NO: 6603973 - DNA, 14 bp, Homo sapiens
acacagtgtctggc

SEQ ID NO: 6603974 - DNA, 20 bp, Homo sapiens
acacagtgttagtgctggtc

SEQ ID NO: 6603975 - DNA, 21 bp, Homo sapiens
acacagtgttccagctgcctg

SEQ ID NO: 6603976 - DNA, 14 bp, Homo sapiens
acacagtgtttcaa

SEQ ID NO: 6603977 - DNA, 23 bp, Homo sapiens
acacagtgtttcctgagtagcag

SEQ ID NO: 6603978 - DNA, 21 bp, Homo sapiens
acacagtgtttttgtaaagtg

SEQ ID NO: 6603979 - DNA, 18 bp, Homo sapiens
acacagttacacttgtgc

SEQ ID NO: 6603980 - DNA, 18 bp, Homo sapiens
acacagttactgacttag

SEQ ID NO: 6603981 - DNA, 18 bp, Homo sapiens
acacagttcctgggaaca

SEQ ID NO: 6603982 - DNA, 19 bp, Homo sapiens
acacagttctgggcaaaga

SEQ ID NO: 6603983 - DNA, 22 bp, Homo sapiens
acacagttgaccctattttttg

SEQ ID NO: 6603984 - DNA, 23 bp, Homo sapiens
acacagttgaccctattttttga

SEQ ID NO: 6603985 - DNA, 15 bp, Homo sapiens
acacagttgctgtca

SEQ ID NO: 6603986 - DNA, 20 bp, Homo sapiens
acacagttgggacccaaaac

SEQ ID NO: 6603987 - DNA, 15 bp, Homo sapiens
acacagtttaaaaaa

SEQ ID NO: 6603988 - DNA, 14 bp, Homo sapiens
acacataaaagtaa

SEQ ID NO: 6603989 - DNA, 17 bp, Homo sapiens
acacataaaagtaatta

SEQ ID NO: 6603990 - DNA, 14 bp, Homo sapiens
acacataaagtaaa

SEQ ID NO: 6603991 - DNA, 13 bp, Homo sapiens
acacataaatctg

SEQ ID NO: 6603992 - DNA, 15 bp, Homo sapiens
acacataacacacat

SEQ ID NO: 6603993 - DNA, 14 bp, Homo sapiens
acacataagaaaat

SEQ ID NO: 6603994 - DNA, 15 bp, Homo sapiens
acacataatttctgt

SEQ ID NO: 6603995 - DNA, 12 bp, Homo sapiens
acacatacacac

SEQ ID NO: 6603996 - DNA, 15 bp, Homo sapiens
acacatacacacaca

SEQ ID NO: 6603997 - DNA, 19 bp, Homo sapiens
acacatacagaaagaagca

SEQ ID NO: 6603998 - DNA, 21 bp, Homo sapiens
acacatacagaaagaagcagt

SEQ ID NO: 6603999 - DNA, 17 bp, Homo sapiens
acacatacagttttatg

SEQ ID NO: 6604000 - DNA, 22 bp, Homo sapiens
acacatacagttttatgctctt

SEQ ID NO: 6604001 - DNA, 16 bp, Homo sapiens
acacatacataatggt

SEQ ID NO: 6604002 - DNA, 15 bp, Homo sapiens
acacatacatacaca

SEQ ID NO: 6604003 - DNA, 17 bp, Homo sapiens
acacatacatacacata

SEQ ID NO: 6604004 - DNA, 14 bp, Homo sapiens
acacatacatatat

SEQ ID NO: 6604005 - DNA, 17 bp, Homo sapiens
acacatacatatataca

SEQ ID NO: 6604006 - DNA, 19 bp, Homo sapiens
acacatacatatatacatt

SEQ ID NO: 6604007 - DNA, 16 bp, Homo sapiens
acacatacatgtcaca

SEQ ID NO: 6604008 - DNA, 15 bp, Homo sapiens
acacataccctcttc

SEQ ID NO: 6604009 - DNA, 14 bp, Homo sapiens
acacatacctttgg

SEQ ID NO: 6604010 - DNA, 19 bp, Homo sapiens
acacatacgtgcacagggt

SEQ ID NO: 6604011 - DNA, 11 bp, Homo sapiens
acacatagata

SEQ ID NO: 6604012 - DNA, 22 bp, Homo sapiens
acacatagattaatggcactga

SEQ ID NO: 6604013 - DNA, 23 bp, Homo sapiens
acacatagattaatggcactgat

SEQ ID NO: 6604014 - DNA, 17 bp, Homo sapiens
acacatagcatgtaatg

SEQ ID NO: 6604015 - DNA, 21 bp, Homo sapiens
acacatagcgccgtgctgtaa

SEQ ID NO: 6604016 - DNA, 13 bp, Homo sapiens
acacatataaaaa

SEQ ID NO: 6604017 - DNA, 14 bp, Homo sapiens
acacatataaacac

SEQ ID NO: 6604018 - DNA, 14 bp, Homo sapiens
acacatataaacat

SEQ ID NO: 6604019 - DNA, 15 bp, Homo sapiens
acacatatacacgaa

SEQ ID NO: 6604020 - DNA, 12 bp, Homo sapiens
acacatatacat

SEQ ID NO: 6604021 - DNA, 13 bp, Homo sapiens
acacatatataca

SEQ ID NO: 6604022 - DNA, 15 bp, Homo sapiens
acacatatatacata

SEQ ID NO: 6604023 - DNA, 18 bp, Homo sapiens
acacatatatacatacgc

SEQ ID NO: 6604024 - DNA, 12 bp, Homo sapiens
acacatatgaac

SEQ ID NO: 6604025 - DNA, 16 bp, Homo sapiens
acacatatgtcatata

SEQ ID NO: 6604026 - DNA, 16 bp, Homo sapiens
acacatatgtgcttct

SEQ ID NO: 6604027 - DNA, 19 bp, Homo sapiens
acacatcaagactatctac

SEQ ID NO: 6604028 - DNA, 21 bp, Homo sapiens
acacatcaagactatctacaa

SEQ ID NO: 6604029 - DNA, 14 bp, Homo sapiens
acacatcaagcttt

SEQ ID NO: 6604030 - DNA, 14 bp, Homo sapiens
acacatcaataaat

SEQ ID NO: 6604031 - DNA, 18 bp, Homo sapiens
acacatcagcatgttttc

SEQ ID NO: 6604032 - DNA, 19 bp, Homo sapiens
acacatcagcatgttttct

SEQ ID NO: 6604033 - DNA, 16 bp, Homo sapiens
acacatcatctgtaag

SEQ ID NO: 6604034 - DNA, 17 bp, Homo sapiens
acacatccagacatcat

SEQ ID NO: 6604035 - DNA, 20 bp, Homo sapiens
acacatccagacatcatgaa

SEQ ID NO: 6604036 - DNA, 17 bp, Homo sapiens
acacatccctaatgtgt

SEQ ID NO: 6604037 - DNA, 19 bp, Homo sapiens
acacatccgccttttgtat

SEQ ID NO: 6604038 - DNA, 21 bp, Homo sapiens
acacatccgccttttgtatac

SEQ ID NO: 6604039 - DNA, 23 bp, Homo sapiens
acacatccgccttttgtatacat

SEQ ID NO: 6604040 - DNA, 18 bp, Homo sapiens
acacatcgttgccgcagc

SEQ ID NO: 6604041 - DNA, 21 bp, Homo sapiens
acacatctattgcagagactc

SEQ ID NO: 6604042 - DNA, 16 bp, Homo sapiens
acacatctctgtcagt

SEQ ID NO: 6604043 - DNA, 19 bp, Homo sapiens
acacatctctgtcagtgtg

SEQ ID NO: 6604044 - DNA, 13 bp, Homo sapiens
acacatctggccc

SEQ ID NO: 6604045 - DNA, 15 bp, Homo sapiens
acacatctggccctg

SEQ ID NO: 6604046 - DNA, 23 bp, Homo sapiens
acacatctggctgcacaggctga

SEQ ID NO: 6604047 - DNA, 17 bp, Homo sapiens
acacatctgggtgccct

SEQ ID NO: 6604048 - DNA, 18 bp, Homo sapiens
acacatctgggtgccctg

SEQ ID NO: 6604049 - DNA, 13 bp, Homo sapiens
acacatctgtgga

SEQ ID NO: 6604050 - DNA, 16 bp, Homo sapiens
acacatcttaaaagtg

SEQ ID NO: 6604051 - DNA, 13 bp, Homo sapiens
acacatcttccct

SEQ ID NO: 6604052 - DNA, 19 bp, Homo sapiens
acacatgaaggtaaataaa

SEQ ID NO: 6604053 - DNA, 21 bp, Homo sapiens
acacatgacgccagataaaat

SEQ ID NO: 6604054 - DNA, 19 bp, Homo sapiens
acacatgcaaggtcatttt

SEQ ID NO: 6604055 - DNA, 11 bp, Homo sapiens
acacatgcaca

SEQ ID NO: 6604056 - DNA, 22 bp, Homo sapiens
acacatgccaacacttaatcat

SEQ ID NO: 6604057 - DNA, 20 bp, Homo sapiens
acacatgcctatattatcat

SEQ ID NO: 6604058 - DNA, 14 bp, Homo sapiens
acacatgctctcaa

SEQ ID NO: 6604059 - DNA, 18 bp, Homo sapiens
acacatggaaaacaccag

SEQ ID NO: 6604060 - DNA, 14 bp, Homo sapiens
acacatggaaaccc

SEQ ID NO: 6604061 - DNA, 18 bp, Homo sapiens
acacatggaaacccatag

SEQ ID NO: 6604062 - DNA, 19 bp, Homo sapiens
acacatggaaacccatagg

SEQ ID NO: 6604063 - DNA, 15 bp, Homo sapiens
acacatgggcagccc

SEQ ID NO: 6604064 - DNA, 14 bp, Homo sapiens
acacatgggtgcta

SEQ ID NO: 6604065 - DNA, 13 bp, Homo sapiens
acacatgtaaaat

SEQ ID NO: 6604066 - DNA, 18 bp, Homo sapiens
acacatgtccaagaagcc

SEQ ID NO: 6604067 - DNA, 21 bp, Homo sapiens
acacatgtccaagaagcccag

SEQ ID NO: 6604068 - DNA, 23 bp, Homo sapiens
acacatgtcctatccaaaggaat

SEQ ID NO: 6604069 - DNA, 16 bp, Homo sapiens
acacatgtgggagagg

SEQ ID NO: 6604070 - DNA, 12 bp, Homo sapiens
acacatgtgtgc

SEQ ID NO: 6604071 - DNA, 19 bp, Homo sapiens
acacatgtgttatctacct

SEQ ID NO: 6604072 - DNA, 22 bp, Homo sapiens
acacattaaacaggattttaca

SEQ ID NO: 6604073 - DNA, 19 bp, Homo sapiens
acacattaaagtaaagtac

SEQ ID NO: 6604074 - DNA, 15 bp, Homo sapiens
acacattaagcaaat

SEQ ID NO: 6604075 - DNA, 14 bp, Homo sapiens
acacattaatgata

SEQ ID NO: 6604076 - DNA, 15 bp, Homo sapiens
acacattaatgataa

SEQ ID NO: 6604077 - DNA, 16 bp, Homo sapiens
acacattacaaagcca

SEQ ID NO: 6604078 - DNA, 23 bp, Homo sapiens
acacattacaaagttaaaattgt

SEQ ID NO: 6604079 - DNA, 15 bp, Homo sapiens
acacattacttgcac

SEQ ID NO: 6604080 - DNA, 17 bp, Homo sapiens
acacattacttgcacaa

SEQ ID NO: 6604081 - DNA, 18 bp, Homo sapiens
acacattatagaaattac

SEQ ID NO: 6604082 - DNA, 19 bp, Homo sapiens
acacattatagaaattact

SEQ ID NO: 6604083 - DNA, 14 bp, Homo sapiens
acacattatgtatc

SEQ ID NO: 6604084 - DNA, 18 bp, Homo sapiens
acacattatgtatcttag

SEQ ID NO: 6604085 - DNA, 17 bp, Homo sapiens
acacattcaataagcat

SEQ ID NO: 6604086 - DNA, 15 bp, Homo sapiens
acacattccagccag

SEQ ID NO: 6604087 - DNA, 18 bp, Homo sapiens
acacattccagccaggcc

SEQ ID NO: 6604088 - DNA, 19 bp, Homo sapiens
acacattccagccaggccc

SEQ ID NO: 6604089 - DNA, 21 bp, Homo sapiens
acacattccagccaggcccag

SEQ ID NO: 6604090 - DNA, 13 bp, Homo sapiens
acacattccaggg

SEQ ID NO: 6604091 - DNA, 17 bp, Homo sapiens
acacattccagggctgg

SEQ ID NO: 6604092 - DNA, 13 bp, Homo sapiens
acacattctcctg

SEQ ID NO: 6604093 - DNA, 17 bp, Homo sapiens
acacattcttgcttgtg

SEQ ID NO: 6604094 - DNA, 16 bp, Homo sapiens
acacattctttataaa

SEQ ID NO: 6604095 - DNA, 19 bp, Homo sapiens
acacattgaaactgtattt

SEQ ID NO: 6604096 - DNA, 21 bp, Homo sapiens
acacattgaatgcgctttatt

SEQ ID NO: 6604097 - DNA, 15 bp, Homo sapiens
acacattgacaatga

SEQ ID NO: 6604098 - DNA, 20 bp, Homo sapiens
acacattgcagcttcaactt

SEQ ID NO: 6604099 - DNA, 12 bp, Homo sapiens
acacattgcctt

SEQ ID NO: 6604100 - DNA, 21 bp, Homo sapiens
acacattgctgtgaacaggaa

SEQ ID NO: 6604101 - DNA, 17 bp, Homo sapiens
acacattgtgcttggcc

SEQ ID NO: 6604102 - DNA, 21 bp, Homo sapiens
acacattgtgtcacatcatga

SEQ ID NO: 6604103 - DNA, 18 bp, Homo sapiens
acacattgtgttaactta

SEQ ID NO: 6604104 - DNA, 14 bp, Homo sapiens
acacattgttattt

SEQ ID NO: 6604105 - DNA, 12 bp, Homo sapiens
acacatttaaaa

SEQ ID NO: 6604106 - DNA, 16 bp, Homo sapiens
acacatttacactaga

SEQ ID NO: 6604107 - DNA, 14 bp, Homo sapiens
acacatttaccaaa

SEQ ID NO: 6604108 - DNA, 18 bp, Homo sapiens
acacatttcactgtctgt

SEQ ID NO: 6604109 - DNA, 17 bp, Homo sapiens
acacatttcacttttct

SEQ ID NO: 6604110 - DNA, 19 bp, Homo sapiens
acacatttccctattttag

SEQ ID NO: 6604111 - DNA, 14 bp, Homo sapiens
acacatttgaaaca

SEQ ID NO: 6604112 - DNA, 16 bp, Homo sapiens
acacatttgctactgt

SEQ ID NO: 6604113 - DNA, 17 bp, Homo sapiens
acacatttgctactgtt

SEQ ID NO: 6604114 - DNA, 19 bp, Homo sapiens
acacatttgctactgttgt

SEQ ID NO: 6604115 - DNA, 17 bp, Homo sapiens
acacatttgctttttgt

SEQ ID NO: 6604116 - DNA, 19 bp, Homo sapiens
acacatttggccacaaaac

SEQ ID NO: 6604117 - DNA, 18 bp, Homo sapiens
acacatttgtacagaatt

SEQ ID NO: 6604118 - DNA, 12 bp, Homo sapiens
acacattttatg

SEQ ID NO: 6604119 - DNA, 19 bp, Homo sapiens
acacattttattttattat

SEQ ID NO: 6604120 - DNA, 20 bp, Homo sapiens
acacattttccatatttgga

SEQ ID NO: 6604121 - DNA, 22 bp, Homo sapiens
acacattttccatatttggatg

SEQ ID NO: 6604122 - DNA, 21 bp, Homo sapiens
acacattttctcctaggagaa

SEQ ID NO: 6604123 - DNA, 23 bp, Homo sapiens
acacattttctcctaggagaagc

SEQ ID NO: 6604124 - DNA, 17 bp, Homo sapiens
acacattttgtaaatct

SEQ ID NO: 6604125 - DNA, 18 bp, Homo sapiens
acacattttgtaaatctg

SEQ ID NO: 6604126 - DNA, 21 bp, Homo sapiens
acacattttgtaaatctgtac

SEQ ID NO: 6604127 - DNA, 23 bp, Homo sapiens
acacattttgtaaatctgtactt

SEQ ID NO: 6604128 - DNA, 18 bp, Homo sapiens
acacatttttaaaacaac

SEQ ID NO: 6604129 - DNA, 15 bp, Homo sapiens
acacatttttaaatt

SEQ ID NO: 6604130 - DNA, 15 bp, Homo sapiens
acacatttttaagat

SEQ ID NO: 6604131 - DNA, 14 bp, Homo sapiens
acacatttttcaga

SEQ ID NO: 6604132 - DNA, 20 bp, Homo sapiens
acacatttttggatttctgt

SEQ ID NO: 6604133 - DNA, 14 bp, Homo sapiens
acacattttttaaa

SEQ ID NO: 6604134 - DNA, 16 bp, Homo sapiens
acacattttttaggaa

SEQ ID NO: 6604135 - DNA, 13 bp, Homo sapiens
acaccaaaaaaat

SEQ ID NO: 6604136 - DNA, 19 bp, Homo sapiens
acaccaaaaaaatccagaa

SEQ ID NO: 6604137 - DNA, 18 bp, Homo sapiens
acaccaaacatttctgtg

SEQ ID NO: 6604138 - DNA, 14 bp, Homo sapiens
acaccaaagttcta

SEQ ID NO: 6604139 - DNA, 14 bp, Homo sapiens
acaccaaataaata

SEQ ID NO: 6604140 - DNA, 22 bp, Homo sapiens
acaccaaatagcttttcacttc

SEQ ID NO: 6604141 - DNA, 20 bp, Homo sapiens
acaccaaatataacaagtat

SEQ ID NO: 6604142 - DNA, 19 bp, Homo sapiens
acaccaaatattttcaagc

SEQ ID NO: 6604143 - DNA, 15 bp, Homo sapiens
acaccaaattgctga

SEQ ID NO: 6604144 - DNA, 19 bp, Homo sapiens
acaccaaattgctgagatg

SEQ ID NO: 6604145 - DNA, 20 bp, Homo sapiens
acaccaaattgctgagatgt

SEQ ID NO: 6604146 - DNA, 18 bp, Homo sapiens
acaccaacataaaaatga

SEQ ID NO: 6604147 - DNA, 16 bp, Homo sapiens
acaccaaccagacagc

SEQ ID NO: 6604148 - DNA, 17 bp, Homo sapiens
acaccaaccaggccttc

SEQ ID NO: 6604149 - DNA, 18 bp, Homo sapiens
acaccaagcacagcagcc

SEQ ID NO: 6604150 - DNA, 22 bp, Homo sapiens
acaccaagcccgcctccagcac

SEQ ID NO: 6604151 - DNA, 16 bp, Homo sapiens
acaccaagctcaccct

SEQ ID NO: 6604152 - DNA, 17 bp, Homo sapiens
acaccaagctcaccctt

SEQ ID NO: 6604153 - DNA, 16 bp, Homo sapiens
acaccaagctgtgcca

SEQ ID NO: 6604154 - DNA, 20 bp, Homo sapiens
acaccaagctgtgccaccct

SEQ ID NO: 6604155 - DNA, 12 bp, Homo sapiens
acaccaaggaag

SEQ ID NO: 6604156 - DNA, 13 bp, Homo sapiens
acaccaaggccct

SEQ ID NO: 6604157 - DNA, 22 bp, Homo sapiens
acaccaaggtttatgccaccag

SEQ ID NO: 6604158 - DNA, 14 bp, Homo sapiens
acaccaagtggctg

SEQ ID NO: 6604159 - DNA, 23 bp, Homo sapiens
acaccaagtggctgggtgccctc

SEQ ID NO: 6604160 - DNA, 19 bp, Homo sapiens
acaccaagtggtaatgaaa

SEQ ID NO: 6604161 - DNA, 23 bp, Homo sapiens
acaccaataaatgtttgttattt

SEQ ID NO: 6604162 - DNA, 15 bp, Homo sapiens
acaccaatcagagag

SEQ ID NO: 6604163 - DNA, 17 bp, Homo sapiens
acaccaatcagagagcc

SEQ ID NO: 6604164 - DNA, 19 bp, Homo sapiens
acaccaatcagagagccta

SEQ ID NO: 6604165 - DNA, 15 bp, Homo sapiens
acaccaatcccaggg

SEQ ID NO: 6604166 - DNA, 18 bp, Homo sapiens
acaccaatcttactttgt

SEQ ID NO: 6604167 - DNA, 22 bp, Homo sapiens
acaccaatcttactttgtaaat

SEQ ID NO: 6604168 - DNA, 21 bp, Homo sapiens
acaccaatttagaatgaatat

SEQ ID NO: 6604169 - DNA, 11 bp, Homo sapiens
acaccacacac

SEQ ID NO: 6604170 - DNA, 16 bp, Homo sapiens
acaccacacacaacag

SEQ ID NO: 6604171 - DNA, 13 bp, Homo sapiens
acaccacacccag

SEQ ID NO: 6604172 - DNA, 18 bp, Homo sapiens
acaccacacccagcctca

SEQ ID NO: 6604173 - DNA, 15 bp, Homo sapiens
acaccacactgacca

SEQ ID NO: 6604174 - DNA, 18 bp, Homo sapiens
acaccacacttgttttct

SEQ ID NO: 6604175 - DNA, 13 bp, Homo sapiens
acaccacagacac

SEQ ID NO: 6604176 - DNA, 14 bp, Homo sapiens
acaccacagacaca

SEQ ID NO: 6604177 - DNA, 15 bp, Homo sapiens
acaccacagcctccc

SEQ ID NO: 6604178 - DNA, 15 bp, Homo sapiens
acaccacaggatctg

SEQ ID NO: 6604179 - DNA, 20 bp, Homo sapiens
acaccacaggatctgaactt

SEQ ID NO: 6604180 - DNA, 16 bp, Homo sapiens
acaccaccactgtgtc

SEQ ID NO: 6604181 - DNA, 20 bp, Homo sapiens
acaccacccagagcaccctc

SEQ ID NO: 6604182 - DNA, 22 bp, Homo sapiens
acaccaccgaatatattactga

SEQ ID NO: 6604183 - DNA, 13 bp, Homo sapiens
acaccacctggag

SEQ ID NO: 6604184 - DNA, 15 bp, Homo sapiens
acaccacctggagtg

SEQ ID NO: 6604185 - DNA, 14 bp, Homo sapiens
acaccaccttatta

SEQ ID NO: 6604186 - DNA, 16 bp, Homo sapiens
acaccacgctggagct

SEQ ID NO: 6604187 - DNA, 21 bp, Homo sapiens
acaccacgctggagctgtgta

SEQ ID NO: 6604188 - DNA, 22 bp, Homo sapiens
acaccacgtccttattggaata

SEQ ID NO: 6604189 - DNA, 18 bp, Homo sapiens
acaccactaaccatcccc

SEQ ID NO: 6604190 - DNA, 17 bp, Homo sapiens
acaccactacattctgt

SEQ ID NO: 6604191 - DNA, 20 bp, Homo sapiens
acaccactacattctgttaa

SEQ ID NO: 6604192 - DNA, 18 bp, Homo sapiens
acaccactctggcagcca

SEQ ID NO: 6604193 - DNA, 22 bp, Homo sapiens
acaccactctggcagccacact

SEQ ID NO: 6604194 - DNA, 16 bp, Homo sapiens
acaccactgaacagaa

SEQ ID NO: 6604195 - DNA, 16 bp, Homo sapiens
acaccactgcactcca

SEQ ID NO: 6604196 - DNA, 13 bp, Homo sapiens
acaccactgccct

SEQ ID NO: 6604197 - DNA, 16 bp, Homo sapiens
acaccactgccctgcc

SEQ ID NO: 6604198 - DNA, 17 bp, Homo sapiens
acaccactgccctgcct

SEQ ID NO: 6604199 - DNA, 17 bp, Homo sapiens
acaccactgttgccttt

SEQ ID NO: 6604200 - DNA, 20 bp, Homo sapiens
acaccacttaatcttctctc

SEQ ID NO: 6604201 - DNA, 18 bp, Homo sapiens
acaccacttagatttaaa

SEQ ID NO: 6604202 - DNA, 17 bp, Homo sapiens
acaccactttcccacac

SEQ ID NO: 6604203 - DNA, 18 bp, Homo sapiens
acaccactttcccacact

SEQ ID NO: 6604204 - DNA, 15 bp, Homo sapiens
acaccagaataatga

SEQ ID NO: 6604205 - DNA, 18 bp, Homo sapiens
acaccagaataatgagtc

SEQ ID NO: 6604206 - DNA, 13 bp, Homo sapiens
acaccagagcaga

SEQ ID NO: 6604207 - DNA, 13 bp, Homo sapiens
acaccagagctgc

SEQ ID NO: 6604208 - DNA, 20 bp, Homo sapiens
acaccagagtgtatgcatac

SEQ ID NO: 6604209 - DNA, 22 bp, Homo sapiens
acaccagatgcttttgtgagaa

SEQ ID NO: 6604210 - DNA, 19 bp, Homo sapiens
acaccagcattccttttga

SEQ ID NO: 6604211 - DNA, 22 bp, Homo sapiens
acaccagccaggctctgtgctg

SEQ ID NO: 6604212 - DNA, 15 bp, Homo sapiens
acaccagcccccagg

SEQ ID NO: 6604213 - DNA, 20 bp, Homo sapiens
acaccagcccccaggaagac

SEQ ID NO: 6604214 - DNA, 21 bp, Homo sapiens
acaccagcccctgccccagcc

SEQ ID NO: 6604215 - DNA, 22 bp, Homo sapiens
acaccagccctgctgcttccta

SEQ ID NO: 6604216 - DNA, 13 bp, Homo sapiens
acaccagccctgg

SEQ ID NO: 6604217 - DNA, 13 bp, Homo sapiens
acaccagcctcct

SEQ ID NO: 6604218 - DNA, 15 bp, Homo sapiens
acaccagcctcctgg

SEQ ID NO: 6604219 - DNA, 12 bp, Homo sapiens
acaccaggactt

SEQ ID NO: 6604220 - DNA, 13 bp, Homo sapiens
acaccaggactta

SEQ ID NO: 6604221 - DNA, 17 bp, Homo sapiens
acaccaggactttaatc

SEQ ID NO: 6604222 - DNA, 21 bp, Homo sapiens
acaccaggctgcagatgatca

SEQ ID NO: 6604223 - DNA, 12 bp, Homo sapiens
acaccaggctgt

SEQ ID NO: 6604224 - DNA, 20 bp, Homo sapiens
acaccagtaataaaaagcca

SEQ ID NO: 6604225 - DNA, 15 bp, Homo sapiens
acaccagtcacacat

SEQ ID NO: 6604226 - DNA, 10 bp, Homo sapiens
acaccagtgt

SEQ ID NO: 6604227 - DNA, 20 bp, Homo sapiens
acaccagtttgactgtgcta

SEQ ID NO: 6604228 - DNA, 17 bp, Homo sapiens
acaccataggtagaatg

SEQ ID NO: 6604229 - DNA, 16 bp, Homo sapiens
acaccatagtttacaa

SEQ ID NO: 6604230 - DNA, 21 bp, Homo sapiens
acaccatcacagcttgttttg

SEQ ID NO: 6604231 - DNA, 15 bp, Homo sapiens
acaccatcctggcta

SEQ ID NO: 6604232 - DNA, 22 bp, Homo sapiens
acaccatctggagtcttcctgt

SEQ ID NO: 6604233 - DNA, 20 bp, Homo sapiens
acaccatctggcccaggctg

SEQ ID NO: 6604234 - DNA, 18 bp, Homo sapiens
acaccatcttttattctt

SEQ ID NO: 6604235 - DNA, 14 bp, Homo sapiens
acaccatcttttgt

SEQ ID NO: 6604236 - DNA, 23 bp, Homo sapiens
acaccatggagatgaaatgcctt

SEQ ID NO: 6604237 - DNA, 16 bp, Homo sapiens
acaccatgtgcaataa

SEQ ID NO: 6604238 - DNA, 18 bp, Homo sapiens
acaccatgttcccagctc

SEQ ID NO: 6604239 - DNA, 19 bp, Homo sapiens
acaccatgttcccagctca

SEQ ID NO: 6604240 - DNA, 23 bp, Homo sapiens
acaccatgtttgagctcagaccc

SEQ ID NO: 6604241 - DNA, 16 bp, Homo sapiens
acaccattaccaaaat

SEQ ID NO: 6604242 - DNA, 17 bp, Homo sapiens
acaccattatgtgcgct

SEQ ID NO: 6604243 - DNA, 21 bp, Homo sapiens
acaccattatgtgcgctgata

SEQ ID NO: 6604244 - DNA, 18 bp, Homo sapiens
acaccattatgtttaaga

SEQ ID NO: 6604245 - DNA, 17 bp, Homo sapiens
acaccattctcctgcct

SEQ ID NO: 6604246 - DNA, 22 bp, Homo sapiens
acaccattctcctgcctcaccc

SEQ ID NO: 6604247 - DNA, 22 bp, Homo sapiens
acacccaaaaatatctcctcca

SEQ ID NO: 6604248 - DNA, 19 bp, Homo sapiens
acacccaaagaggtattta

SEQ ID NO: 6604249 - DNA, 20 bp, Homo sapiens
acacccaaagaggtatttat

SEQ ID NO: 6604250 - DNA, 13 bp, Homo sapiens
acacccaaagctg

SEQ ID NO: 6604251 - DNA, 14 bp, Homo sapiens
acacccaaagctga

SEQ ID NO: 6604252 - DNA, 19 bp, Homo sapiens
acacccaaagctgagcctg

SEQ ID NO: 6604253 - DNA, 17 bp, Homo sapiens
acacccaagagggctgc

SEQ ID NO: 6604254 - DNA, 15 bp, Homo sapiens
acacccaatgctgct

SEQ ID NO: 6604255 - DNA, 21 bp, Homo sapiens
acacccaattttaaaaaataa

SEQ ID NO: 6604256 - DNA, 12 bp, Homo sapiens
acacccaccccc

SEQ ID NO: 6604257 - DNA, 15 bp, Homo sapiens
acacccaccccctgc

SEQ ID NO: 6604258 - DNA, 21 bp, Homo sapiens
acacccaccctgtgccatcac

SEQ ID NO: 6604259 - DNA, 21 bp, Homo sapiens
acacccaccgtccgccctgct

SEQ ID NO: 6604260 - DNA, 15 bp, Homo sapiens
acacccacctgctgc

SEQ ID NO: 6604261 - DNA, 17 bp, Homo sapiens
acacccactcagctccg

SEQ ID NO: 6604262 - DNA, 17 bp, Homo sapiens
acacccactgccccgtg

SEQ ID NO: 6604263 - DNA, 12 bp, Homo sapiens
acacccactggc

SEQ ID NO: 6604264 - DNA, 14 bp, Homo sapiens
acacccactggcca

SEQ ID NO: 6604265 - DNA, 14 bp, Homo sapiens
acacccagaccttc

SEQ ID NO: 6604266 - DNA, 20 bp, Homo sapiens
acacccagatggcctgaagc

SEQ ID NO: 6604267 - DNA, 13 bp, Homo sapiens
acacccagcccac

SEQ ID NO: 6604268 - DNA, 17 bp, Homo sapiens
acacccagcccccacat

SEQ ID NO: 6604269 - DNA, 12 bp, Homo sapiens
acacccagcctg

SEQ ID NO: 6604270 - DNA, 15 bp, Homo sapiens
acacccaggaaggga

SEQ ID NO: 6604271 - DNA, 16 bp, Homo sapiens
acacccaggcccgagc

SEQ ID NO: 6604272 - DNA, 23 bp, Homo sapiens
acacccaggggaaggccctgagg

SEQ ID NO: 6604273 - DNA, 14 bp, Homo sapiens
acacccagggtcta

SEQ ID NO: 6604274 - DNA, 22 bp, Homo sapiens
acacccagggtctagccgctgc

SEQ ID NO: 6604275 - DNA, 18 bp, Homo sapiens
acacccaggtctcttcct

SEQ ID NO: 6604276 - DNA, 19 bp, Homo sapiens
acacccaggtgatttcctc

SEQ ID NO: 6604277 - DNA, 15 bp, Homo sapiens
acacccatctgtttt

SEQ ID NO: 6604278 - DNA, 22 bp, Homo sapiens
acacccatgactgaggaccaat

SEQ ID NO: 6604279 - DNA, 16 bp, Homo sapiens
acacccatgccagaga

SEQ ID NO: 6604280 - DNA, 15 bp, Homo sapiens
acacccatggcctca

SEQ ID NO: 6604281 - DNA, 21 bp, Homo sapiens
acaccccaacttggcagcttt

SEQ ID NO: 6604282 - DNA, 12 bp, Homo sapiens
acaccccaaggg

SEQ ID NO: 6604283 - DNA, 13 bp, Homo sapiens
acaccccaaggga

SEQ ID NO: 6604284 - DNA, 13 bp, Homo sapiens
acaccccacctgc

SEQ ID NO: 6604285 - DNA, 16 bp, Homo sapiens
acaccccacctgcgct

SEQ ID NO: 6604286 - DNA, 12 bp, Homo sapiens
acaccccagact

SEQ ID NO: 6604287 - DNA, 19 bp, Homo sapiens
acaccccagactccaggcc

SEQ ID NO: 6604288 - DNA, 21 bp, Homo sapiens
acaccccagactccaggcccc

SEQ ID NO: 6604289 - DNA, 13 bp, Homo sapiens
acaccccagccca

SEQ ID NO: 6604290 - DNA, 13 bp, Homo sapiens
acaccccagcgcc

SEQ ID NO: 6604291 - DNA, 12 bp, Homo sapiens
acaccccctccc

SEQ ID NO: 6604292 - DNA, 21 bp, Homo sapiens
acaccccctccccgcccctgt

SEQ ID NO: 6604293 - DNA, 16 bp, Homo sapiens
acacccctacacacac

SEQ ID NO: 6604294 - DNA, 17 bp, Homo sapiens
acacccctacacacacc

SEQ ID NO: 6604295 - DNA, 21 bp, Homo sapiens
acacccctcagttgtgcagct

SEQ ID NO: 6604296 - DNA, 14 bp, Homo sapiens
acacccctctgctg

SEQ ID NO: 6604297 - DNA, 14 bp, Homo sapiens
acacccctctgtct

SEQ ID NO: 6604298 - DNA, 13 bp, Homo sapiens
acacccctgctct

SEQ ID NO: 6604299 - DNA, 16 bp, Homo sapiens
acacccgaagtcctgt

SEQ ID NO: 6604300 - DNA, 24 bp, Homo sapiens
acacccgaagtcctgtcactgagc

SEQ ID NO: 6604301 - DNA, 21 bp, Homo sapiens
acacccgacaccagccctgct

SEQ ID NO: 6604302 - DNA, 14 bp, Homo sapiens
acacccggctcccc

SEQ ID NO: 6604303 - DNA, 17 bp, Homo sapiens
acacccggctccccctg

SEQ ID NO: 6604304 - DNA, 21 bp, Homo sapiens
acacccgtgagcgcctgtgca

SEQ ID NO: 6604305 - DNA, 22 bp, Homo sapiens
acacccgtgtggtaccttcagc

SEQ ID NO: 6604306 - DNA, 16 bp, Homo sapiens
acaccctaactcttgc

SEQ ID NO: 6604307 - DNA, 13 bp, Homo sapiens
acaccctaataag

SEQ ID NO: 6604308 - DNA, 19 bp, Homo sapiens
acaccctacagcagatcca

SEQ ID NO: 6604309 - DNA, 14 bp, Homo sapiens
acaccctaccttcc

SEQ ID NO: 6604310 - DNA, 20 bp, Homo sapiens
acaccctaccttccccagac

SEQ ID NO: 6604311 - DNA, 18 bp, Homo sapiens
acaccctcaacctcttct

SEQ ID NO: 6604312 - DNA, 16 bp, Homo sapiens
acaccctcacactggg

SEQ ID NO: 6604313 - DNA, 17 bp, Homo sapiens
acaccctcactctgcca

SEQ ID NO: 6604314 - DNA, 16 bp, Homo sapiens
acaccctccactctga

SEQ ID NO: 6604315 - DNA, 19 bp, Homo sapiens
acaccctccactctgaggt

SEQ ID NO: 6604316 - DNA, 17 bp, Homo sapiens
acaccctccccattcag

SEQ ID NO: 6604317 - DNA, 16 bp, Homo sapiens
acaccctcctggcaca

SEQ ID NO: 6604318 - DNA, 22 bp, Homo sapiens
acaccctcggggggtcacaggc

SEQ ID NO: 6604319 - DNA, 13 bp, Homo sapiens
acaccctctccca

SEQ ID NO: 6604320 - DNA, 15 bp, Homo sapiens
acaccctctctgtcc

SEQ ID NO: 6604321 - DNA, 20 bp, Homo sapiens
acaccctctgggggtcctct

SEQ ID NO: 6604322 - DNA, 23 bp, Homo sapiens
acaccctctgggggtcctctctg

SEQ ID NO: 6604323 - DNA, 15 bp, Homo sapiens
acaccctgcccctgc

SEQ ID NO: 6604324 - DNA, 17 bp, Homo sapiens
acaccctgcccctggtg

SEQ ID NO: 6604325 - DNA, 23 bp, Homo sapiens
acaccctgcctcgcccccacttt

SEQ ID NO: 6604326 - DNA, 16 bp, Homo sapiens
acaccctgcctgctgt

SEQ ID NO: 6604327 - DNA, 13 bp, Homo sapiens
acaccctgcttct

SEQ ID NO: 6604328 - DNA, 17 bp, Homo sapiens
acaccctgcttctcccg

SEQ ID NO: 6604329 - DNA, 18 bp, Homo sapiens
acaccctgcttctcccgg

SEQ ID NO: 6604330 - DNA, 13 bp, Homo sapiens
acaccctggatgc

SEQ ID NO: 6604331 - DNA, 11 bp, Homo sapiens
acaccctggcc

SEQ ID NO: 6604332 - DNA, 12 bp, Homo sapiens
acaccctggcct

SEQ ID NO: 6604333 - DNA, 21 bp, Homo sapiens
acaccctgggatggaacctca

SEQ ID NO: 6604334 - DNA, 22 bp, Homo sapiens
acaccctgtactgttctgtgtc

SEQ ID NO: 6604335 - DNA, 19 bp, Homo sapiens
acaccctgtgatggggccc

SEQ ID NO: 6604336 - DNA, 11 bp, Homo sapiens
acacccttccc

SEQ ID NO: 6604337 - DNA, 19 bp, Homo sapiens
acacccttccccactcccg

SEQ ID NO: 6604338 - DNA, 11 bp, Homo sapiens
acacccttcct

SEQ ID NO: 6604339 - DNA, 17 bp, Homo sapiens
acacccttctcccactc

SEQ ID NO: 6604340 - DNA, 15 bp, Homo sapiens
acacccttgaaaata

SEQ ID NO: 6604341 - DNA, 16 bp, Homo sapiens
acacccttgaaaatat

SEQ ID NO: 6604342 - DNA, 18 bp, Homo sapiens
acacccttggacttgagg

SEQ ID NO: 6604343 - DNA, 18 bp, Homo sapiens
acacccttggagctctga

SEQ ID NO: 6604344 - DNA, 16 bp, Homo sapiens
acaccctttcatctca

SEQ ID NO: 6604345 - DNA, 22 bp, Homo sapiens
acaccctttcatctcagagtcc

SEQ ID NO: 6604346 - DNA, 13 bp, Homo sapiens
acaccgactagcc

SEQ ID NO: 6604347 - DNA, 22 bp, Homo sapiens
acaccgccacatggcttcctcc

SEQ ID NO: 6604348 - DNA, 14 bp, Homo sapiens
acaccgccagcagc

SEQ ID NO: 6604349 - DNA, 23 bp, Homo sapiens
acaccgcgtcccagctcccctct

SEQ ID NO: 6604350 - DNA, 16 bp, Homo sapiens
acaccgctcagtatta

SEQ ID NO: 6604351 - DNA, 24 bp, Homo sapiens
acaccgctcagtattactttctgc

SEQ ID NO: 6604352 - DNA, 13 bp, Homo sapiens
acaccgctggctc

SEQ ID NO: 6604353 - DNA, 15 bp, Homo sapiens
acaccgctggctccg

SEQ ID NO: 6604354 - DNA, 20 bp, Homo sapiens
acaccgctggtccctgccct

SEQ ID NO: 6604355 - DNA, 20 bp, Homo sapiens
acaccggcactgtgcactct

SEQ ID NO: 6604356 - DNA, 20 bp, Homo sapiens
acaccggctggcagggctgg

SEQ ID NO: 6604357 - DNA, 21 bp, Homo sapiens
acaccgggccaagtgaagaat

SEQ ID NO: 6604358 - DNA, 18 bp, Homo sapiens
acaccgtacatctgcaat

SEQ ID NO: 6604359 - DNA, 17 bp, Homo sapiens
acaccgtcccagggctc

SEQ ID NO: 6604360 - DNA, 18 bp, Homo sapiens
acaccgtggggaaggggt

SEQ ID NO: 6604361 - DNA, 17 bp, Homo sapiens
acaccgtgtaaaccaaa

SEQ ID NO: 6604362 - DNA, 13 bp, Homo sapiens
acacctaaattaa

SEQ ID NO: 6604363 - DNA, 18 bp, Homo sapiens
acacctaaattaacaaat

SEQ ID NO: 6604364 - DNA, 19 bp, Homo sapiens
acacctaaattaacaaatt

SEQ ID NO: 6604365 - DNA, 16 bp, Homo sapiens
acacctaaccccaggg

SEQ ID NO: 6604366 - DNA, 14 bp, Homo sapiens
acacctaagggaca

SEQ ID NO: 6604367 - DNA, 14 bp, Homo sapiens
acacctacagcagc

SEQ ID NO: 6604368 - DNA, 15 bp, Homo sapiens
acacctacagcagca

SEQ ID NO: 6604369 - DNA, 15 bp, Homo sapiens
acacctaccatgctg

SEQ ID NO: 6604370 - DNA, 15 bp, Homo sapiens
acacctagcatctca

SEQ ID NO: 6604371 - DNA, 22 bp, Homo sapiens
acacctagccagctgtcaaggg

SEQ ID NO: 6604372 - DNA, 18 bp, Homo sapiens
acacctagctttattctt

SEQ ID NO: 6604373 - DNA, 20 bp, Homo sapiens
acacctatgtcatttcattt

SEQ ID NO: 6604374 - DNA, 22 bp, Homo sapiens
acacctattatcccagctgcct

SEQ ID NO: 6604375 - DNA, 22 bp, Homo sapiens
acacctattttagacaaatcta

SEQ ID NO: 6604376 - DNA, 15 bp, Homo sapiens
acacctcaaatacat

SEQ ID NO: 6604377 - DNA, 18 bp, Homo sapiens
acacctcactgaggaagg

SEQ ID NO: 6604378 - DNA, 12 bp, Homo sapiens
acacctcactgt

SEQ ID NO: 6604379 - DNA, 22 bp, Homo sapiens
acacctcactgtcatctgccag

SEQ ID NO: 6604380 - DNA, 13 bp, Homo sapiens
acacctcagaaaa

SEQ ID NO: 6604381 - DNA, 18 bp, Homo sapiens
acacctcagagccccgca

SEQ ID NO: 6604382 - DNA, 11 bp, Homo sapiens
acacctcatgc

SEQ ID NO: 6604383 - DNA, 13 bp, Homo sapiens
acacctccacccg

SEQ ID NO: 6604384 - DNA, 12 bp, Homo sapiens
acacctcccagg

SEQ ID NO: 6604385 - DNA, 13 bp, Homo sapiens
acacctcccagga

SEQ ID NO: 6604386 - DNA, 12 bp, Homo sapiens
acacctccccct

SEQ ID NO: 6604387 - DNA, 17 bp, Homo sapiens
acacctccccctaccca

SEQ ID NO: 6604388 - DNA, 14 bp, Homo sapiens
acacctccccctgc

SEQ ID NO: 6604389 - DNA, 17 bp, Homo sapiens
acacctccccctgcgcc

SEQ ID NO: 6604390 - DNA, 13 bp, Homo sapiens
acacctccccctt

SEQ ID NO: 6604391 - DNA, 22 bp, Homo sapiens
acacctccccctttcacactgg

SEQ ID NO: 6604392 - DNA, 13 bp, Homo sapiens
acacctccctgaa

SEQ ID NO: 6604393 - DNA, 22 bp, Homo sapiens
acacctccctgaaccatccctg

SEQ ID NO: 6604394 - DNA, 20 bp, Homo sapiens
acacctcccttcgtgtgtgc

SEQ ID NO: 6604395 - DNA, 15 bp, Homo sapiens
acacctcctcccgaa

SEQ ID NO: 6604396 - DNA, 17 bp, Homo sapiens
acacctcctcctgctgc

SEQ ID NO: 6604397 - DNA, 18 bp, Homo sapiens
acacctcctctcactccc

SEQ ID NO: 6604398 - DNA, 18 bp, Homo sapiens
acacctccttccctctct

SEQ ID NO: 6604399 - DNA, 22 bp, Homo sapiens
acacctccttccctctctggag

SEQ ID NO: 6604400 - DNA, 17 bp, Homo sapiens
acacctccttgctttgc

SEQ ID NO: 6604401 - DNA, 23 bp, Homo sapiens
acacctcgctgttgtcacatctc

SEQ ID NO: 6604402 - DNA, 22 bp, Homo sapiens
acacctcggccgtacatctctg

SEQ ID NO: 6604403 - DNA, 18 bp, Homo sapiens
acacctcgttagggaaga

SEQ ID NO: 6604404 - DNA, 21 bp, Homo sapiens
acacctctgcacaagctgcac

SEQ ID NO: 6604405 - DNA, 13 bp, Homo sapiens
acacctctgccag

SEQ ID NO: 6604406 - DNA, 13 bp, Homo sapiens
acacctctgcccc

SEQ ID NO: 6604407 - DNA, 15 bp, Homo sapiens
acacctctgctttct

SEQ ID NO: 6604408 - DNA, 12 bp, Homo sapiens
acacctctgggc

SEQ ID NO: 6604409 - DNA, 13 bp, Homo sapiens
acacctctgggct

SEQ ID NO: 6604410 - DNA, 13 bp, Homo sapiens
acacctctggggg

SEQ ID NO: 6604411 - DNA, 14 bp, Homo sapiens
acacctgactctga

SEQ ID NO: 6604412 - DNA, 13 bp, Homo sapiens
acacctgagaatg

SEQ ID NO: 6604413 - DNA, 15 bp, Homo sapiens
acacctgagaatgtg

SEQ ID NO: 6604414 - DNA, 20 bp, Homo sapiens
acacctgagcgctgtggact

SEQ ID NO: 6604415 - DNA, 22 bp, Homo sapiens
acacctgagcgctgtggactgt

SEQ ID NO: 6604416 - DNA, 20 bp, Homo sapiens
acacctgaggctgaggcagg

SEQ ID NO: 6604417 - DNA, 14 bp, Homo sapiens
acacctgatgtgta

SEQ ID NO: 6604418 - DNA, 15 bp, Homo sapiens
acacctgatgtgtac

SEQ ID NO: 6604419 - DNA, 16 bp, Homo sapiens
acacctgcacacccct

SEQ ID NO: 6604420 - DNA, 17 bp, Homo sapiens
acacctgcacacccctg

SEQ ID NO: 6604421 - DNA, 15 bp, Homo sapiens
acacctgcacaccgt

SEQ ID NO: 6604422 - DNA, 12 bp, Homo sapiens
acacctgcacct

SEQ ID NO: 6604423 - DNA, 18 bp, Homo sapiens
acacctgcacctcccccc

SEQ ID NO: 6604424 - DNA, 19 bp, Homo sapiens
acacctgcagcctccctcc

SEQ ID NO: 6604425 - DNA, 19 bp, Homo sapiens
acacctgccccagcgcggc

SEQ ID NO: 6604426 - DNA, 14 bp, Homo sapiens
acacctgccctaaa

SEQ ID NO: 6604427 - DNA, 14 bp, Homo sapiens
acacctgccctgcc

SEQ ID NO: 6604428 - DNA, 17 bp, Homo sapiens
acacctgccctgccctg

SEQ ID NO: 6604429 - DNA, 18 bp, Homo sapiens
acacctgccctgccctgc

SEQ ID NO: 6604430 - DNA, 18 bp, Homo sapiens
acacctgccgctgcttga

SEQ ID NO: 6604431 - DNA, 19 bp, Homo sapiens
acacctgccgctgcttgag

SEQ ID NO: 6604432 - DNA, 22 bp, Homo sapiens
acacctgcctctgaccccagca

SEQ ID NO: 6604433 - DNA, 16 bp, Homo sapiens
acacctgcctgcagag

SEQ ID NO: 6604434 - DNA, 13 bp, Homo sapiens
acacctgcctgcg

SEQ ID NO: 6604435 - DNA, 17 bp, Homo sapiens
acacctgccttctaccc

SEQ ID NO: 6604436 - DNA, 19 bp, Homo sapiens
acacctgcggggccaccca

SEQ ID NO: 6604437 - DNA, 13 bp, Homo sapiens
acacctggaatgt

SEQ ID NO: 6604438 - DNA, 15 bp, Homo sapiens
acacctggactgagc

SEQ ID NO: 6604439 - DNA, 17 bp, Homo sapiens
acacctggccctggggc

SEQ ID NO: 6604440 - DNA, 20 bp, Homo sapiens
acacctggccctggggcctg

SEQ ID NO: 6604441 - DNA, 18 bp, Homo sapiens
acacctggccgcctccag

SEQ ID NO: 6604442 - DNA, 18 bp, Homo sapiens
acacctggtctgttttct

SEQ ID NO: 6604443 - DNA, 16 bp, Homo sapiens
acacctgtactggaga

SEQ ID NO: 6604444 - DNA, 16 bp, Homo sapiens
acacctgtccttctca

SEQ ID NO: 6604445 - DNA, 14 bp, Homo sapiens
acacctgtctgtgc

SEQ ID NO: 6604446 - DNA, 16 bp, Homo sapiens
acacctgtctgtgcag

SEQ ID NO: 6604447 - DNA, 18 bp, Homo sapiens
acacctgtcttgaataag

SEQ ID NO: 6604448 - DNA, 21 bp, Homo sapiens
acacctgtgtggcccagttct

SEQ ID NO: 6604449 - DNA, 22 bp, Homo sapiens
acacctgttcacagaaaaagca

SEQ ID NO: 6604450 - DNA, 23 bp, Homo sapiens
acacctgttcacagaaaaagcat

SEQ ID NO: 6604451 - DNA, 17 bp, Homo sapiens
acacctgttgcacctca

SEQ ID NO: 6604452 - DNA, 21 bp, Homo sapiens
acaccttagacggaggtgcct

SEQ ID NO: 6604453 - DNA, 17 bp, Homo sapiens
acaccttaggttgacat

SEQ ID NO: 6604454 - DNA, 14 bp, Homo sapiens
acaccttcattttg

SEQ ID NO: 6604455 - DNA, 15 bp, Homo sapiens
acaccttccagggcc

SEQ ID NO: 6604456 - DNA, 14 bp, Homo sapiens
acaccttccccacc

SEQ ID NO: 6604457 - DNA, 18 bp, Homo sapiens
acaccttcctcctgcaga

SEQ ID NO: 6604458 - DNA, 20 bp, Homo sapiens
acaccttcttggcttctggg

SEQ ID NO: 6604459 - DNA, 14 bp, Homo sapiens
acaccttgacaggg

SEQ ID NO: 6604460 - DNA, 21 bp, Homo sapiens
acaccttgtgaccttctctat

SEQ ID NO: 6604461 - DNA, 22 bp, Homo sapiens
acaccttgtgaccttctctata

SEQ ID NO: 6604462 - DNA, 15 bp, Homo sapiens
acacctttaggttct

SEQ ID NO: 6604463 - DNA, 24 bp, Homo sapiens
acacctttattcagaactttagta

SEQ ID NO: 6604464 - DNA, 14 bp, Homo sapiens
acacctttatttta

SEQ ID NO: 6604465 - DNA, 14 bp, Homo sapiens
acacctttctcctt

SEQ ID NO: 6604466 - DNA, 22 bp, Homo sapiens
acacctttctcctttgtacttt

SEQ ID NO: 6604467 - DNA, 16 bp, Homo sapiens
acacctttgcaggcat

SEQ ID NO: 6604468 - DNA, 22 bp, Homo sapiens
acacctttgcaggcatgcatgt

SEQ ID NO: 6604469 - DNA, 21 bp, Homo sapiens
acaccttttattgacacagaa

SEQ ID NO: 6604470 - DNA, 23 bp, Homo sapiens
acaccttttccccaaccacagag

SEQ ID NO: 6604471 - DNA, 15 bp, Homo sapiens
acaccttttccccag

SEQ ID NO: 6604472 - DNA, 18 bp, Homo sapiens
acaccttttccccaggag

SEQ ID NO: 6604473 - DNA, 14 bp, Homo sapiens
acacgaaagaaatg

SEQ ID NO: 6604474 - DNA, 15 bp, Homo sapiens
acacgaactgaaatg

SEQ ID NO: 6604475 - DNA, 18 bp, Homo sapiens
acacgaatagacatcaaa

SEQ ID NO: 6604476 - DNA, 16 bp, Homo sapiens
acacgactgcaacata

SEQ ID NO: 6604477 - DNA, 21 bp, Homo sapiens
acacgagatttcttttttatg

SEQ ID NO: 6604478 - DNA, 22 bp, Homo sapiens
acacgagatttcttttttatgt

SEQ ID NO: 6604479 - DNA, 20 bp, Homo sapiens
acacgagcaaacccagaggt

SEQ ID NO: 6604480 - DNA, 14 bp, Homo sapiens
acacgagcaggcta

SEQ ID NO: 6604481 - DNA, 21 bp, Homo sapiens
acacgagcaggctactgtcag

SEQ ID NO: 6604482 - DNA, 18 bp, Homo sapiens
acacgagcgaatgattta

SEQ ID NO: 6604483 - DNA, 22 bp, Homo sapiens
acacgaggtatgaggtctagga

SEQ ID NO: 6604484 - DNA, 14 bp, Homo sapiens
acacgatccgcaac

SEQ ID NO: 6604485 - DNA, 14 bp, Homo sapiens
acacgatgccgaga

SEQ ID NO: 6604486 - DNA, 23 bp, Homo sapiens
acacgatgttgtcaaggatggtt

SEQ ID NO: 6604487 - DNA, 15 bp, Homo sapiens
acacgattgagaact

SEQ ID NO: 6604488 - DNA, 14 bp, Homo sapiens
acacgattttattg

SEQ ID NO: 6604489 - DNA, 23 bp, Homo sapiens
acacgcaaaccaacctttctgac

SEQ ID NO: 6604490 - DNA, 21 bp, Homo sapiens
acacgcacaaacacacacact

SEQ ID NO: 6604491 - DNA, 16 bp, Homo sapiens
acacgcacgcacacac

SEQ ID NO: 6604492 - DNA, 16 bp, Homo sapiens
acacgcacttctgggg

SEQ ID NO: 6604493 - DNA, 23 bp, Homo sapiens
acacgcacttctggggccagccc

SEQ ID NO: 6604494 - DNA, 16 bp, Homo sapiens
acacgcagacacacac

SEQ ID NO: 6604495 - DNA, 17 bp, Homo sapiens
acacgcagacacacaca

SEQ ID NO: 6604496 - DNA, 18 bp, Homo sapiens
acacgcaggcggccaggg

SEQ ID NO: 6604497 - DNA, 13 bp, Homo sapiens
acacgccagctcc

SEQ ID NO: 6604498 - DNA, 16 bp, Homo sapiens
acacgccagctcctct

SEQ ID NO: 6604499 - DNA, 20 bp, Homo sapiens
acacgccccaattttcaggt

SEQ ID NO: 6604500 - DNA, 19 bp, Homo sapiens
acacgccccggtcccccag

SEQ ID NO: 6604501 - DNA, 23 bp, Homo sapiens
acacgccccggtcccccagagca

SEQ ID NO: 6604502 - DNA, 19 bp, Homo sapiens
acacgcccgactctctcca

SEQ ID NO: 6604503 - DNA, 18 bp, Homo sapiens
acacgccggggctggccc

SEQ ID NO: 6604504 - DNA, 22 bp, Homo sapiens
acacgccggggctggccctgcc

SEQ ID NO: 6604505 - DNA, 22 bp, Homo sapiens
acacgcctgcaaacgctgcctg

SEQ ID NO: 6604506 - DNA, 23 bp, Homo sapiens
acacgcgcccccctcccagaggc

SEQ ID NO: 6604507 - DNA, 22 bp, Homo sapiens
acacgcgcgcacacacacacat

SEQ ID NO: 6604508 - DNA, 14 bp, Homo sapiens
acacgcgctctcca

SEQ ID NO: 6604509 - DNA, 20 bp, Homo sapiens
acacgctccctccccctgcc

SEQ ID NO: 6604510 - DNA, 23 bp, Homo sapiens
acacgctcctctgcccttccttt

SEQ ID NO: 6604511 - DNA, 14 bp, Homo sapiens
acacgctccttcct

SEQ ID NO: 6604512 - DNA, 13 bp, Homo sapiens
acacgctgcccag

SEQ ID NO: 6604513 - DNA, 15 bp, Homo sapiens
acacgctgcccaggc

SEQ ID NO: 6604514 - DNA, 20 bp, Homo sapiens
acacgctgcccaggctctgc

SEQ ID NO: 6604515 - DNA, 18 bp, Homo sapiens
acacgctgctctgcccca

SEQ ID NO: 6604516 - DNA, 23 bp, Homo sapiens
acacgctgctctgccccagcttg

SEQ ID NO: 6604517 - DNA, 19 bp, Homo sapiens
acacgcttaaaacctagaa

SEQ ID NO: 6604518 - DNA, 17 bp, Homo sapiens
acacgcttttgtgatgg

SEQ ID NO: 6604519 - DNA, 14 bp, Homo sapiens
acacggaccctgtg

SEQ ID NO: 6604520 - DNA, 16 bp, Homo sapiens
acacggaccctgtgtg

SEQ ID NO: 6604521 - DNA, 21 bp, Homo sapiens
acacggactcccgggccacgc

SEQ ID NO: 6604522 - DNA, 23 bp, Homo sapiens
acacggagcggattgcaaagcaa

SEQ ID NO: 6604523 - DNA, 15 bp, Homo sapiens
acacggaggccagac

SEQ ID NO: 6604524 - DNA, 16 bp, Homo sapiens
acacggaggccagaca

SEQ ID NO: 6604525 - DNA, 21 bp, Homo sapiens
acacggatctgagaatcttta

SEQ ID NO: 6604526 - DNA, 21 bp, Homo sapiens
acacggatctgctgggctctg

SEQ ID NO: 6604527 - DNA, 17 bp, Homo sapiens
acacggccctcctggga

SEQ ID NO: 6604528 - DNA, 19 bp, Homo sapiens
acacggccctgccccatcc

SEQ ID NO: 6604529 - DNA, 12 bp, Homo sapiens
acacggcctctg

SEQ ID NO: 6604530 - DNA, 17 bp, Homo sapiens
acacggctcccccaggc

SEQ ID NO: 6604531 - DNA, 19 bp, Homo sapiens
acacggctcccccaggcct

SEQ ID NO: 6604532 - DNA, 19 bp, Homo sapiens
acacggctggtcactctgc

SEQ ID NO: 6604533 - DNA, 21 bp, Homo sapiens
acacggctggtcactctgccc

SEQ ID NO: 6604534 - DNA, 14 bp, Homo sapiens
acacggcttcactg

SEQ ID NO: 6604535 - DNA, 24 bp, Homo sapiens
acacggcttcactgaccagcggct

SEQ ID NO: 6604536 - DNA, 15 bp, Homo sapiens
acacgggcctgtcca

SEQ ID NO: 6604537 - DNA, 20 bp, Homo sapiens
acacgggcgagctttctctc

SEQ ID NO: 6604538 - DNA, 22 bp, Homo sapiens
acacggggatcatctctgtgac

SEQ ID NO: 6604539 - DNA, 16 bp, Homo sapiens
acacgggggcagctga

SEQ ID NO: 6604540 - DNA, 17 bp, Homo sapiens
acacggggtattttagg

SEQ ID NO: 6604541 - DNA, 16 bp, Homo sapiens
acacggtaggccaagc

SEQ ID NO: 6604542 - DNA, 23 bp, Homo sapiens
acacggtcggggcatctggcctg

SEQ ID NO: 6604543 - DNA, 22 bp, Homo sapiens
acacggtgaaatccaggtctcg

SEQ ID NO: 6604544 - DNA, 21 bp, Homo sapiens
acacggtttaactgtcccagc

SEQ ID NO: 6604545 - DNA, 22 bp, Homo sapiens
acacggtttaactgtcccagcg

SEQ ID NO: 6604546 - DNA, 19 bp, Homo sapiens
acacgtaaaagaaatgtat

SEQ ID NO: 6604547 - DNA, 19 bp, Homo sapiens
acacgtacctctcatcagt

SEQ ID NO: 6604548 - DNA, 18 bp, Homo sapiens
acacgtaccttcatgtga

SEQ ID NO: 6604549 - DNA, 13 bp, Homo sapiens
acacgtatttata

SEQ ID NO: 6604550 - DNA, 12 bp, Homo sapiens
acacgtcattgt

SEQ ID NO: 6604551 - DNA, 14 bp, Homo sapiens
acacgtcattgtgt

SEQ ID NO: 6604552 - DNA, 19 bp, Homo sapiens
acacgtcgttctaattaaa

SEQ ID NO: 6604553 - DNA, 18 bp, Homo sapiens
acacgtctatgcaattgt

SEQ ID NO: 6604554 - DNA, 22 bp, Homo sapiens
acacgtctatgcaattgtacaa

SEQ ID NO: 6604555 - DNA, 11 bp, Homo sapiens
acacgtgaagg

SEQ ID NO: 6604556 - DNA, 13 bp, Homo sapiens
acacgtgagaatc

SEQ ID NO: 6604557 - DNA, 16 bp, Homo sapiens
acacgtgagaatccct

SEQ ID NO: 6604558 - DNA, 15 bp, Homo sapiens
acacgtgatgtgata

SEQ ID NO: 6604559 - DNA, 23 bp, Homo sapiens
acacgtgcaatttgtttgtgctt

SEQ ID NO: 6604560 - DNA, 16 bp, Homo sapiens
acacgtgctcgcagcc

SEQ ID NO: 6604561 - DNA, 18 bp, Homo sapiens
acacgtgctcgcagcctg

SEQ ID NO: 6604562 - DNA, 20 bp, Homo sapiens
acacgtgctcgcagcctggc

SEQ ID NO: 6604563 - DNA, 18 bp, Homo sapiens
acacgtgctgtgggcctc

SEQ ID NO: 6604564 - DNA, 23 bp, Homo sapiens
acacgtgctgtgggcctcaggcg

SEQ ID NO: 6604565 - DNA, 21 bp, Homo sapiens
acacgtggaggtgaagtccct

SEQ ID NO: 6604566 - DNA, 23 bp, Homo sapiens
acacgtggccaagagaaacttcc

SEQ ID NO: 6604567 - DNA, 14 bp, Homo sapiens
acacgtggcctgca

SEQ ID NO: 6604568 - DNA, 18 bp, Homo sapiens
acacgtgggctcccctct

SEQ ID NO: 6604569 - DNA, 20 bp, Homo sapiens
acacgtgggctcccctcttc

SEQ ID NO: 6604570 - DNA, 23 bp, Homo sapiens
acacgtgggctcccctcttcctc

SEQ ID NO: 6604571 - DNA, 13 bp, Homo sapiens
acacgtgtatatg

SEQ ID NO: 6604572 - DNA, 23 bp, Homo sapiens
acacgttcacccatcttatcaag

SEQ ID NO: 6604573 - DNA, 17 bp, Homo sapiens
acacgttctgatttctg

SEQ ID NO: 6604574 - DNA, 21 bp, Homo sapiens
acacgttctgatttctgccct

SEQ ID NO: 6604575 - DNA, 15 bp, Homo sapiens
acacgttggagtata

SEQ ID NO: 6604576 - DNA, 17 bp, Homo sapiens
acacgtttaatcccagc

SEQ ID NO: 6604577 - DNA, 19 bp, Homo sapiens
acacgtttaatcccagcac

SEQ ID NO: 6604578 - DNA, 14 bp, Homo sapiens
acacgtttttacat

SEQ ID NO: 6604579 - DNA, 20 bp, Homo sapiens
acactaaaacaagaggacac

SEQ ID NO: 6604580 - DNA, 17 bp, Homo sapiens
acactaaaacattgtct

SEQ ID NO: 6604581 - DNA, 23 bp, Homo sapiens
acactaaaagcagcgtcactcta

SEQ ID NO: 6604582 - DNA, 14 bp, Homo sapiens
acactaaaatttaa

SEQ ID NO: 6604583 - DNA, 16 bp, Homo sapiens
acactaaaatttaaat

SEQ ID NO: 6604584 - DNA, 14 bp, Homo sapiens
acactaaaatttta

SEQ ID NO: 6604585 - DNA, 15 bp, Homo sapiens
acactaaaattttag

SEQ ID NO: 6604586 - DNA, 18 bp, Homo sapiens
acactaaaattttaggca

SEQ ID NO: 6604587 - DNA, 17 bp, Homo sapiens
acactaaagatccaaga

SEQ ID NO: 6604588 - DNA, 12 bp, Homo sapiens
acactaaattat

SEQ ID NO: 6604589 - DNA, 13 bp, Homo sapiens
acactaaattatt

SEQ ID NO: 6604590 - DNA, 23 bp, Homo sapiens
acactaaattattagcatttgtt

SEQ ID NO: 6604591 - DNA, 23 bp, Homo sapiens
acactaaattgcagtttacagta

SEQ ID NO: 6604592 - DNA, 14 bp, Homo sapiens
acactaaccaaatc

SEQ ID NO: 6604593 - DNA, 17 bp, Homo sapiens
acactaacgaaatatca

SEQ ID NO: 6604594 - DNA, 18 bp, Homo sapiens
acactaagagagaatgag

SEQ ID NO: 6604595 - DNA, 21 bp, Homo sapiens
acactaagctctctgggcctg

SEQ ID NO: 6604596 - DNA, 15 bp, Homo sapiens
acactaatacactaa

SEQ ID NO: 6604597 - DNA, 19 bp, Homo sapiens
acactaatatatggaccta

SEQ ID NO: 6604598 - DNA, 22 bp, Homo sapiens
acactaatatatggacctagct

SEQ ID NO: 6604599 - DNA, 20 bp, Homo sapiens
acactaatatatttaaaaat

SEQ ID NO: 6604600 - DNA, 13 bp, Homo sapiens
acactaattcata

SEQ ID NO: 6604601 - DNA, 12 bp, Homo sapiens
acactaattcct

SEQ ID NO: 6604602 - DNA, 13 bp, Homo sapiens
acactaattctgt

SEQ ID NO: 6604603 - DNA, 17 bp, Homo sapiens
acactaattgtccacag

SEQ ID NO: 6604604 - DNA, 19 bp, Homo sapiens
acactaatttgaataaact

SEQ ID NO: 6604605 - DNA, 13 bp, Homo sapiens
acactacaaacat

SEQ ID NO: 6604606 - DNA, 18 bp, Homo sapiens
acactacaagtttataag

SEQ ID NO: 6604607 - DNA, 14 bp, Homo sapiens
acactacaccacac

SEQ ID NO: 6604608 - DNA, 15 bp, Homo sapiens
acactacaccacaca

SEQ ID NO: 6604609 - DNA, 17 bp, Homo sapiens
acactacaccacacaca

SEQ ID NO: 6604610 - DNA, 16 bp, Homo sapiens
acactacacgcaccca

SEQ ID NO: 6604611 - DNA, 17 bp, Homo sapiens
acactacagagcagctc

SEQ ID NO: 6604612 - DNA, 21 bp, Homo sapiens
acactacagagcagctcccca

SEQ ID NO: 6604613 - DNA, 21 bp, Homo sapiens
acactacagaggattctgtct

SEQ ID NO: 6604614 - DNA, 13 bp, Homo sapiens
acactacagatca

SEQ ID NO: 6604615 - DNA, 20 bp, Homo sapiens
acactaccccatatacacct

SEQ ID NO: 6604616 - DNA, 21 bp, Homo sapiens
acactacctcttttgagactt

SEQ ID NO: 6604617 - DNA, 16 bp, Homo sapiens
acactaccttatcagg

SEQ ID NO: 6604618 - DNA, 15 bp, Homo sapiens
acactacgcagaaga

SEQ ID NO: 6604619 - DNA, 22 bp, Homo sapiens
acactacgcagaagagaaagta

SEQ ID NO: 6604620 - DNA, 17 bp, Homo sapiens
acactactgctaaatcc

SEQ ID NO: 6604621 - DNA, 18 bp, Homo sapiens
acactactgctaaatcct

SEQ ID NO: 6604622 - DNA, 19 bp, Homo sapiens
acactactgctaaatcctc

SEQ ID NO: 6604623 - DNA, 20 bp, Homo sapiens
acactactgtatttcattat

SEQ ID NO: 6604624 - DNA, 17 bp, Homo sapiens
acactacttgagaaaat

SEQ ID NO: 6604625 - DNA, 23 bp, Homo sapiens
acactacttgagaaaatgcagga

SEQ ID NO: 6604626 - DNA, 16 bp, Homo sapiens
acactagaggccaggg

SEQ ID NO: 6604627 - DNA, 18 bp, Homo sapiens
acactagaggccagggat

SEQ ID NO: 6604628 - DNA, 15 bp, Homo sapiens
acactagatgatatt

SEQ ID NO: 6604629 - DNA, 19 bp, Homo sapiens
acactagccagacactctg

SEQ ID NO: 6604630 - DNA, 15 bp, Homo sapiens
acactagcctctcca

SEQ ID NO: 6604631 - DNA, 23 bp, Homo sapiens
acactagggaaaggtaaatacaa

SEQ ID NO: 6604632 - DNA, 21 bp, Homo sapiens
acactagggactatcaggtaa

SEQ ID NO: 6604633 - DNA, 17 bp, Homo sapiens
acactagggtcaggcgg

SEQ ID NO: 6604634 - DNA, 18 bp, Homo sapiens
acactagtagagcaaaga

SEQ ID NO: 6604635 - DNA, 23 bp, Homo sapiens
acactagtagagcaaagacttaa

SEQ ID NO: 6604636 - DNA, 16 bp, Homo sapiens
acactagtagctgttt

SEQ ID NO: 6604637 - DNA, 23 bp, Homo sapiens
acactagtctgtgtaactttaaa

SEQ ID NO: 6604638 - DNA, 19 bp, Homo sapiens
acactagttttgtgccagc

SEQ ID NO: 6604639 - DNA, 23 bp, Homo sapiens
acactagttttgtgccagccgtg

SEQ ID NO: 6604640 - DNA, 16 bp, Homo sapiens
acactatataaataag

SEQ ID NO: 6604641 - DNA, 21 bp, Homo sapiens
acactatatctgtatataaaa

SEQ ID NO: 6604642 - DNA, 18 bp, Homo sapiens
acactatcatagttaaca

SEQ ID NO: 6604643 - DNA, 19 bp, Homo sapiens
acactatgcactgctgtaa

SEQ ID NO: 6604644 - DNA, 18 bp, Homo sapiens
acactatggtatttgagt

SEQ ID NO: 6604645 - DNA, 14 bp, Homo sapiens
acactatgtgtgtt

SEQ ID NO: 6604646 - DNA, 22 bp, Homo sapiens
acactatgtgtgttgtttccat

SEQ ID NO: 6604647 - DNA, 13 bp, Homo sapiens
acactattctcca

SEQ ID NO: 6604648 - DNA, 15 bp, Homo sapiens
acactatttctggaa

SEQ ID NO: 6604649 - DNA, 23 bp, Homo sapiens
acactatttctggaatgcttctg

SEQ ID NO: 6604650 - DNA, 22 bp, Homo sapiens
acactatttgagttggccaaga

SEQ ID NO: 6604651 - DNA, 15 bp, Homo sapiens
acactatttgtgact

SEQ ID NO: 6604652 - DNA, 13 bp, Homo sapiens
acactattttatg

SEQ ID NO: 6604653 - DNA, 16 bp, Homo sapiens
acactattttcagaat

SEQ ID NO: 6604654 - DNA, 16 bp, Homo sapiens
acactcaaaagacaaa

SEQ ID NO: 6604655 - DNA, 15 bp, Homo sapiens
acactcaaaagctgg

SEQ ID NO: 6604656 - DNA, 13 bp, Homo sapiens
acactcaaaatga

SEQ ID NO: 6604657 - DNA, 15 bp, Homo sapiens
acactcaagaagcag

SEQ ID NO: 6604658 - DNA, 18 bp, Homo sapiens
acactcaaggaaaagatg

SEQ ID NO: 6604659 - DNA, 15 bp, Homo sapiens
acactcaaggacagg

SEQ ID NO: 6604660 - DNA, 16 bp, Homo sapiens
acactcaaggacagga

SEQ ID NO: 6604661 - DNA, 17 bp, Homo sapiens
acactcaaggacaggag

SEQ ID NO: 6604662 - DNA, 21 bp, Homo sapiens
acactcaaggacaggagcctg

SEQ ID NO: 6604663 - DNA, 22 bp, Homo sapiens
acactcaaggacaggagcctgg

SEQ ID NO: 6604664 - DNA, 21 bp, Homo sapiens
acactcaagtgccattcatcc

SEQ ID NO: 6604665 - DNA, 20 bp, Homo sapiens
acactcaccagtggcctttc

SEQ ID NO: 6604666 - DNA, 14 bp, Homo sapiens
acactcaccattta

SEQ ID NO: 6604667 - DNA, 19 bp, Homo sapiens
acactcaccccagcctcat

SEQ ID NO: 6604668 - DNA, 17 bp, Homo sapiens
acactcaccgagaggaa

SEQ ID NO: 6604669 - DNA, 18 bp, Homo sapiens
acactcacctctaaaaca

SEQ ID NO: 6604670 - DNA, 19 bp, Homo sapiens
acactcacctctaaaacag

SEQ ID NO: 6604671 - DNA, 16 bp, Homo sapiens
acactcactcctgaga

SEQ ID NO: 6604672 - DNA, 15 bp, Homo sapiens
acactcactgcctgc

SEQ ID NO: 6604673 - DNA, 20 bp, Homo sapiens
acactcagaaaattccctgg

SEQ ID NO: 6604674 - DNA, 19 bp, Homo sapiens
acactcagatcctcctcat

SEQ ID NO: 6604675 - DNA, 20 bp, Homo sapiens
acactcagcacccccttctc

SEQ ID NO: 6604676 - DNA, 18 bp, Homo sapiens
acactcaggcctgtgccc

SEQ ID NO: 6604677 - DNA, 13 bp, Homo sapiens
acactcagggcag

SEQ ID NO: 6604678 - DNA, 18 bp, Homo sapiens
acactcagggcagctgcc

SEQ ID NO: 6604679 - DNA, 20 bp, Homo sapiens
acactcagtgggccaattgt

SEQ ID NO: 6604680 - DNA, 21 bp, Homo sapiens
acactcatgcggcccagccat

SEQ ID NO: 6604681 - DNA, 13 bp, Homo sapiens
acactcatgctga

SEQ ID NO: 6604682 - DNA, 14 bp, Homo sapiens
acactcatgctgaa

SEQ ID NO: 6604683 - DNA, 18 bp, Homo sapiens
acactcattgaaatgtaa

SEQ ID NO: 6604684 - DNA, 17 bp, Homo sapiens
acactcattgacctgag

SEQ ID NO: 6604685 - DNA, 16 bp, Homo sapiens
acactccaactctaca

SEQ ID NO: 6604686 - DNA, 14 bp, Homo sapiens
acactccaagatat

SEQ ID NO: 6604687 - DNA, 16 bp, Homo sapiens
acactccaattaagga

SEQ ID NO: 6604688 - DNA, 17 bp, Homo sapiens
acactccaattaaggat

SEQ ID NO: 6604689 - DNA, 14 bp, Homo sapiens
acactccacagtgt

SEQ ID NO: 6604690 - DNA, 19 bp, Homo sapiens
acactccaccccctccagc

SEQ ID NO: 6604691 - DNA, 20 bp, Homo sapiens
acactccaccccctccagct

SEQ ID NO: 6604692 - DNA, 23 bp, Homo sapiens
acactccaccccctccagctcca

SEQ ID NO: 6604693 - DNA, 13 bp, Homo sapiens
acactccactctg

SEQ ID NO: 6604694 - DNA, 17 bp, Homo sapiens
acactccactctgattc

SEQ ID NO: 6604695 - DNA, 11 bp, Homo sapiens
acactccactg

SEQ ID NO: 6604696 - DNA, 21 bp, Homo sapiens
acactccagaattacccttcc

SEQ ID NO: 6604697 - DNA, 12 bp, Homo sapiens
acactccagcct

SEQ ID NO: 6604698 - DNA, 13 bp, Homo sapiens
acactccagcctg

SEQ ID NO: 6604699 - DNA, 16 bp, Homo sapiens
acactccagcctgagc

SEQ ID NO: 6604700 - DNA, 17 bp, Homo sapiens
acactccagcctgagca

SEQ ID NO: 6604701 - DNA, 15 bp, Homo sapiens
acactccagcctggg

SEQ ID NO: 6604702 - DNA, 16 bp, Homo sapiens
acactccagcctgggc

SEQ ID NO: 6604703 - DNA, 11 bp, Homo sapiens
acactccaggc

SEQ ID NO: 6604704 - DNA, 12 bp, Homo sapiens
acactccaggcc

SEQ ID NO: 6604705 - DNA, 17 bp, Homo sapiens
acactccaggccctgcc

SEQ ID NO: 6604706 - DNA, 21 bp, Homo sapiens
acactccaggccctgccccct

SEQ ID NO: 6604707 - DNA, 17 bp, Homo sapiens
acactccaggcctctag

SEQ ID NO: 6604708 - DNA, 14 bp, Homo sapiens
acactccagtgaga

SEQ ID NO: 6604709 - DNA, 14 bp, Homo sapiens
acactccagtgcca

SEQ ID NO: 6604710 - DNA, 13 bp, Homo sapiens
acactccagttgc

SEQ ID NO: 6604711 - DNA, 13 bp, Homo sapiens
acactccatctcc

SEQ ID NO: 6604712 - DNA, 23 bp, Homo sapiens
acactccatctcctgctcaccac

SEQ ID NO: 6604713 - DNA, 14 bp, Homo sapiens
acactccccacggg

SEQ ID NO: 6604714 - DNA, 16 bp, Homo sapiens
acactccccacgggaa

SEQ ID NO: 6604715 - DNA, 15 bp, Homo sapiens
acactccccgaagtc

SEQ ID NO: 6604716 - DNA, 20 bp, Homo sapiens
acactccccgccttagagcc

SEQ ID NO: 6604717 - DNA, 23 bp, Homo sapiens
acactccccgccttagagcctcg

SEQ ID NO: 6604718 - DNA, 14 bp, Homo sapiens
acactccctctcct

SEQ ID NO: 6604719 - DNA, 18 bp, Homo sapiens
acactcctcctcggaaga

SEQ ID NO: 6604720 - DNA, 15 bp, Homo sapiens
acactcctcctgcca

SEQ ID NO: 6604721 - DNA, 21 bp, Homo sapiens
acactccttccccttgtccct

SEQ ID NO: 6604722 - DNA, 14 bp, Homo sapiens
acactccttgaaat

SEQ ID NO: 6604723 - DNA, 23 bp, Homo sapiens
acactcgcccgcccactgtcctg

SEQ ID NO: 6604724 - DNA, 15 bp, Homo sapiens
acactcgggttaaga

SEQ ID NO: 6604725 - DNA, 17 bp, Homo sapiens
acactcgggttaagaaa

SEQ ID NO: 6604726 - DNA, 18 bp, Homo sapiens
acactcgggttaagaaat

SEQ ID NO: 6604727 - DNA, 16 bp, Homo sapiens
acactcgtgtgcatga

SEQ ID NO: 6604728 - DNA, 20 bp, Homo sapiens
acactctagtgacttcctgg

SEQ ID NO: 6604729 - DNA, 22 bp, Homo sapiens
acactctagtgacttcctggtg

SEQ ID NO: 6604730 - DNA, 15 bp, Homo sapiens
acactctataacaaa

SEQ ID NO: 6604731 - DNA, 11 bp, Homo sapiens
acactctcctg

SEQ ID NO: 6604732 - DNA, 12 bp, Homo sapiens
acactctcctgg

SEQ ID NO: 6604733 - DNA, 22 bp, Homo sapiens
acactctcctgggcccctccct

SEQ ID NO: 6604734 - DNA, 18 bp, Homo sapiens
acactctcgtggtatgta

SEQ ID NO: 6604735 - DNA, 17 bp, Homo sapiens
acactctctgcagccca

SEQ ID NO: 6604736 - DNA, 23 bp, Homo sapiens
acactctctggaagccctggaga

SEQ ID NO: 6604737 - DNA, 15 bp, Homo sapiens
acactctctgtacaa

SEQ ID NO: 6604738 - DNA, 20 bp, Homo sapiens
acactctgaattccaagtag

SEQ ID NO: 6604739 - DNA, 19 bp, Homo sapiens
acactctgccagcaaagag

SEQ ID NO: 6604740 - DNA, 16 bp, Homo sapiens
acactctgctgtttga

SEQ ID NO: 6604741 - DNA, 13 bp, Homo sapiens
acactctgtaatt

SEQ ID NO: 6604742 - DNA, 23 bp, Homo sapiens
acactctgtattgaaaatggctt

SEQ ID NO: 6604743 - DNA, 21 bp, Homo sapiens
acactcttcagtgactcctgc

SEQ ID NO: 6604744 - DNA, 22 bp, Homo sapiens
acactcttctatgacccagcat

SEQ ID NO: 6604745 - DNA, 23 bp, Homo sapiens
acactcttctccattccctccac

SEQ ID NO: 6604746 - DNA, 13 bp, Homo sapiens
acactcttcttga

SEQ ID NO: 6604747 - DNA, 16 bp, Homo sapiens
acactctttgtaagag

SEQ ID NO: 6604748 - DNA, 15 bp, Homo sapiens
acactgaaaaaatac

SEQ ID NO: 6604749 - DNA, 23 bp, Homo sapiens
acactgaaaaatctaagtgatat

SEQ ID NO: 6604750 - DNA, 13 bp, Homo sapiens
acactgaaaaatt

SEQ ID NO: 6604751 - DNA, 12 bp, Homo sapiens
acactgaaaatg

SEQ ID NO: 6604752 - DNA, 14 bp, Homo sapiens
acactgaaagtttt

SEQ ID NO: 6604753 - DNA, 20 bp, Homo sapiens
acactgaaagttttgtaaaa

SEQ ID NO: 6604754 - DNA, 13 bp, Homo sapiens
acactgaaatcca

SEQ ID NO: 6604755 - DNA, 22 bp, Homo sapiens
acactgaaatgaaatcttccca

SEQ ID NO: 6604756 - DNA, 15 bp, Homo sapiens
acactgaaattgcct

SEQ ID NO: 6604757 - DNA, 12 bp, Homo sapiens
acactgaactta

SEQ ID NO: 6604758 - DNA, 14 bp, Homo sapiens
acactgaaggcaaa

SEQ ID NO: 6604759 - DNA, 18 bp, Homo sapiens
acactgaatatttatatt

SEQ ID NO: 6604760 - DNA, 15 bp, Homo sapiens
acactgaatcatgtt

SEQ ID NO: 6604761 - DNA, 16 bp, Homo sapiens
acactgaattgaatct

SEQ ID NO: 6604762 - DNA, 20 bp, Homo sapiens
acactgaattgaatctacaa

SEQ ID NO: 6604763 - DNA, 14 bp, Homo sapiens
acactgaatttttc

SEQ ID NO: 6604764 - DNA, 20 bp, Homo sapiens
acactgacttaggtttcagg

SEQ ID NO: 6604765 - DNA, 23 bp, Homo sapiens
acactgacttaggtttcaggaag

SEQ ID NO: 6604766 - DNA, 19 bp, Homo sapiens
acactgagaaagaggcagg

SEQ ID NO: 6604767 - DNA, 19 bp, Homo sapiens
acactgagaatgtaagaac

SEQ ID NO: 6604768 - DNA, 19 bp, Homo sapiens
acactgagcaagatcttgt

SEQ ID NO: 6604769 - DNA, 14 bp, Homo sapiens
acactgagccccac

SEQ ID NO: 6604770 - DNA, 14 bp, Homo sapiens
acactgagctgtca

SEQ ID NO: 6604771 - DNA, 14 bp, Homo sapiens
acactgaggcagcc

SEQ ID NO: 6604772 - DNA, 15 bp, Homo sapiens
acactgagtgaaata

SEQ ID NO: 6604773 - DNA, 19 bp, Homo sapiens
acactgagttctatcagtt

SEQ ID NO: 6604774 - DNA, 13 bp, Homo sapiens
acactgataatca

SEQ ID NO: 6604775 - DNA, 18 bp, Homo sapiens
acactgatacataaaaat

SEQ ID NO: 6604776 - DNA, 20 bp, Homo sapiens
acactgatacataaaaatta

SEQ ID NO: 6604777 - DNA, 18 bp, Homo sapiens
acactgatcccccagatg

SEQ ID NO: 6604778 - DNA, 18 bp, Homo sapiens
acactgatctgaacatct

SEQ ID NO: 6604779 - DNA, 19 bp, Homo sapiens
acactgatgagtttcactg

SEQ ID NO: 6604780 - DNA, 21 bp, Homo sapiens
acactgatgagtttcactgta

SEQ ID NO: 6604781 - DNA, 18 bp, Homo sapiens
acactgatgataggttaa

SEQ ID NO: 6604782 - DNA, 23 bp, Homo sapiens
acactgatgcaaggattacagaa

SEQ ID NO: 6604783 - DNA, 22 bp, Homo sapiens
acactgatgcttagatgttcca

SEQ ID NO: 6604784 - DNA, 16 bp, Homo sapiens
acactgatgggtcctg

SEQ ID NO: 6604785 - DNA, 20 bp, Homo sapiens
acactgatgggtcctgctgc

SEQ ID NO: 6604786 - DNA, 22 bp, Homo sapiens
acactgatgggtcctgctgctc

SEQ ID NO: 6604787 - DNA, 22 bp, Homo sapiens
acactgatttccccttttgcat

SEQ ID NO: 6604788 - DNA, 15 bp, Homo sapiens
acactgcaagaagtc

SEQ ID NO: 6604789 - DNA, 15 bp, Homo sapiens
acactgcaatcatat

SEQ ID NO: 6604790 - DNA, 16 bp, Homo sapiens
acactgcaatcatatg

SEQ ID NO: 6604791 - DNA, 22 bp, Homo sapiens
acactgcacacagtgacttcct

SEQ ID NO: 6604792 - DNA, 18 bp, Homo sapiens
acactgcaccctccacag

SEQ ID NO: 6604793 - DNA, 22 bp, Homo sapiens
acactgcactcttaagcttccg

SEQ ID NO: 6604794 - DNA, 15 bp, Homo sapiens
acactgcactttgtt

SEQ ID NO: 6604795 - DNA, 18 bp, Homo sapiens
acactgcactttgtttag

SEQ ID NO: 6604796 - DNA, 16 bp, Homo sapiens
acactgcagccctctc

SEQ ID NO: 6604797 - DNA, 13 bp, Homo sapiens
acactgcaggaca

SEQ ID NO: 6604798 - DNA, 21 bp, Homo sapiens
acactgcaggcatcacagcta

SEQ ID NO: 6604799 - DNA, 18 bp, Homo sapiens
acactgcagggaggagtg

SEQ ID NO: 6604800 - DNA, 18 bp, Homo sapiens
acactgcagggctgctgt

SEQ ID NO: 6604801 - DNA, 20 bp, Homo sapiens
acactgcagtgaccacttat

SEQ ID NO: 6604802 - DNA, 14 bp, Homo sapiens
acactgcatgtttg

SEQ ID NO: 6604803 - DNA, 15 bp, Homo sapiens
acactgcattcgttg

SEQ ID NO: 6604804 - DNA, 21 bp, Homo sapiens
acactgccaactgatctgtta

SEQ ID NO: 6604805 - DNA, 18 bp, Homo sapiens
acactgccaagagccgac

SEQ ID NO: 6604806 - DNA, 22 bp, Homo sapiens
acactgccaagccaaccctgga

SEQ ID NO: 6604807 - DNA, 16 bp, Homo sapiens
acactgccagaagaga

SEQ ID NO: 6604808 - DNA, 19 bp, Homo sapiens
acactgccatattgtgtaa

SEQ ID NO: 6604809 - DNA, 16 bp, Homo sapiens
acactgcctatatatg

SEQ ID NO: 6604810 - DNA, 15 bp, Homo sapiens
acactgcctgcctta

SEQ ID NO: 6604811 - DNA, 15 bp, Homo sapiens
acactgcctgggctg

SEQ ID NO: 6604812 - DNA, 15 bp, Homo sapiens
acactgcctggtact

SEQ ID NO: 6604813 - DNA, 16 bp, Homo sapiens
acactgcctgtatact

SEQ ID NO: 6604814 - DNA, 19 bp, Homo sapiens
acactgcctgtatacttta

SEQ ID NO: 6604815 - DNA, 18 bp, Homo sapiens
acactgccttagcctctt

SEQ ID NO: 6604816 - DNA, 23 bp, Homo sapiens
acactgccttattacataactga

SEQ ID NO: 6604817 - DNA, 13 bp, Homo sapiens
acactgcgccccg

SEQ ID NO: 6604818 - DNA, 23 bp, Homo sapiens
acactgcgccccgcctgacctgg

SEQ ID NO: 6604819 - DNA, 15 bp, Homo sapiens
acactgcggaagcca

SEQ ID NO: 6604820 - DNA, 16 bp, Homo sapiens
acactgcggaagccaa

SEQ ID NO: 6604821 - DNA, 20 bp, Homo sapiens
acactgcggaagccaaaggc

SEQ ID NO: 6604822 - DNA, 18 bp, Homo sapiens
acactgcggggcttggct

SEQ ID NO: 6604823 - DNA, 23 bp, Homo sapiens
acactgctaggtgggccagcccc

SEQ ID NO: 6604824 - DNA, 13 bp, Homo sapiens
acactgctcacag

SEQ ID NO: 6604825 - DNA, 13 bp, Homo sapiens
acactgctcattt

SEQ ID NO: 6604826 - DNA, 17 bp, Homo sapiens
acactgctctaacagcc

SEQ ID NO: 6604827 - DNA, 11 bp, Homo sapiens
acactgctgta

SEQ ID NO: 6604828 - DNA, 14 bp, Homo sapiens
acactgctgtaccc

SEQ ID NO: 6604829 - DNA, 15 bp, Homo sapiens
acactgctgtaccca

SEQ ID NO: 6604830 - DNA, 22 bp, Homo sapiens
acactgctgtacccagatgcct

SEQ ID NO: 6604831 - DNA, 16 bp, Homo sapiens
acactgctgtcctctc

SEQ ID NO: 6604832 - DNA, 22 bp, Homo sapiens
acactgctgtcctctccccctt

SEQ ID NO: 6604833 - DNA, 14 bp, Homo sapiens
acactgcttaagga

SEQ ID NO: 6604834 - DNA, 22 bp, Homo sapiens
acactgcttaaggaaaagagaa

SEQ ID NO: 6604835 - DNA, 14 bp, Homo sapiens
acactgcttctcgg

SEQ ID NO: 6604836 - DNA, 16 bp, Homo sapiens
acactgcttctcggag

SEQ ID NO: 6604837 - DNA, 19 bp, Homo sapiens
acactgcttggcccttcaa

SEQ ID NO: 6604838 - DNA, 23 bp, Homo sapiens
acactgcttgtgtttttaactca

SEQ ID NO: 6604839 - DNA, 17 bp, Homo sapiens
acactggaatataaaac

SEQ ID NO: 6604840 - DNA, 21 bp, Homo sapiens
acactggaatataaaacagtc

SEQ ID NO: 6604841 - DNA, 18 bp, Homo sapiens
acactggacatggcccat

SEQ ID NO: 6604842 - DNA, 17 bp, Homo sapiens
acactggaccccactgg

SEQ ID NO: 6604843 - DNA, 23 bp, Homo sapiens
acactggaccccactggctgaga

SEQ ID NO: 6604844 - DNA, 16 bp, Homo sapiens
acactggacctttggg

SEQ ID NO: 6604845 - DNA, 21 bp, Homo sapiens
acactggatccatcttgagcc

SEQ ID NO: 6604846 - DNA, 13 bp, Homo sapiens
acactggatgttt

SEQ ID NO: 6604847 - DNA, 22 bp, Homo sapiens
acactggcacactgctcttaag

SEQ ID NO: 6604848 - DNA, 17 bp, Homo sapiens
acactggccccacagga

SEQ ID NO: 6604849 - DNA, 13 bp, Homo sapiens
acactggcccctc

SEQ ID NO: 6604850 - DNA, 20 bp, Homo sapiens
acactggcgtctggactgtt

SEQ ID NO: 6604851 - DNA, 23 bp, Homo sapiens
acactggcgtctggactgttctg

SEQ ID NO: 6604852 - DNA, 24 bp, Homo sapiens
acactggcgtctggactgttctgt

SEQ ID NO: 6604853 - DNA, 22 bp, Homo sapiens
acactggctaaagataattgct

SEQ ID NO: 6604854 - DNA, 15 bp, Homo sapiens
acactggctctggga

SEQ ID NO: 6604855 - DNA, 16 bp, Homo sapiens
acactggctgccagct

SEQ ID NO: 6604856 - DNA, 15 bp, Homo sapiens
acactggctttacat

SEQ ID NO: 6604857 - DNA, 23 bp, Homo sapiens
acactggctttgggtagtgccat

SEQ ID NO: 6604858 - DNA, 13 bp, Homo sapiens
acactgggacttg

SEQ ID NO: 6604859 - DNA, 14 bp, Homo sapiens
acactgggagaaga

SEQ ID NO: 6604860 - DNA, 16 bp, Homo sapiens
acactgggagaagaga

SEQ ID NO: 6604861 - DNA, 19 bp, Homo sapiens
acactgggagaagagaacc

SEQ ID NO: 6604862 - DNA, 23 bp, Homo sapiens
acactgggagaggtgccagcaac

SEQ ID NO: 6604863 - DNA, 14 bp, Homo sapiens
acactgggaggcca

SEQ ID NO: 6604864 - DNA, 16 bp, Homo sapiens
acactgggctcacatt

SEQ ID NO: 6604865 - DNA, 17 bp, Homo sapiens
acactgggctctgagga

SEQ ID NO: 6604866 - DNA, 14 bp, Homo sapiens
acactgggctgggt

SEQ ID NO: 6604867 - DNA, 18 bp, Homo sapiens
acactggggacttggcct

SEQ ID NO: 6604868 - DNA, 21 bp, Homo sapiens
acactggggctgacacccagg

SEQ ID NO: 6604869 - DNA, 15 bp, Homo sapiens
acactgggggagggg

SEQ ID NO: 6604870 - DNA, 14 bp, Homo sapiens
acactggggtctgt

SEQ ID NO: 6604871 - DNA, 20 bp, Homo sapiens
acactggggtgccgcctgcc

SEQ ID NO: 6604872 - DNA, 21 bp, Homo sapiens
acactggggtgccgcctgccc

SEQ ID NO: 6604873 - DNA, 18 bp, Homo sapiens
acactgggtagtagctaa

SEQ ID NO: 6604874 - DNA, 16 bp, Homo sapiens
acactgggtgcgtctc

SEQ ID NO: 6604875 - DNA, 18 bp, Homo sapiens
acactgggtggtggcctg

SEQ ID NO: 6604876 - DNA, 19 bp, Homo sapiens
acactgggtggtggcctgg

SEQ ID NO: 6604877 - DNA, 15 bp, Homo sapiens
acactggtctaatgt

SEQ ID NO: 6604878 - DNA, 20 bp, Homo sapiens
acactggtctaatgtttgtg

SEQ ID NO: 6604879 - DNA, 16 bp, Homo sapiens
acactggtctgctgtc

SEQ ID NO: 6604880 - DNA, 20 bp, Homo sapiens
acactggtctgctgttccag

SEQ ID NO: 6604881 - DNA, 14 bp, Homo sapiens
acactggtggagga

SEQ ID NO: 6604882 - DNA, 14 bp, Homo sapiens
acactggtgtatct

SEQ ID NO: 6604883 - DNA, 15 bp, Homo sapiens
acactggtgtgtccc

SEQ ID NO: 6604884 - DNA, 14 bp, Homo sapiens
acactggttctcaa

SEQ ID NO: 6604885 - DNA, 19 bp, Homo sapiens
acactggttctcaatgaaa

SEQ ID NO: 6604886 - DNA, 17 bp, Homo sapiens
acactggtttgccaggc

SEQ ID NO: 6604887 - DNA, 16 bp, Homo sapiens
acactgtaaacccctg

SEQ ID NO: 6604888 - DNA, 19 bp, Homo sapiens
acactgtaaatatccacag

SEQ ID NO: 6604889 - DNA, 13 bp, Homo sapiens
acactgtaagaaa

SEQ ID NO: 6604890 - DNA, 19 bp, Homo sapiens
acactgtaagctttgttct

SEQ ID NO: 6604891 - DNA, 21 bp, Homo sapiens
acactgtaagctttgttctgg

SEQ ID NO: 6604892 - DNA, 22 bp, Homo sapiens
acactgtaagcttttaagaaaa

SEQ ID NO: 6604893 - DNA, 15 bp, Homo sapiens
acactgtaatatctt

SEQ ID NO: 6604894 - DNA, 16 bp, Homo sapiens
acactgtaatatcttt

SEQ ID NO: 6604895 - DNA, 17 bp, Homo sapiens
acactgtaatatcttta

SEQ ID NO: 6604896 - DNA, 18 bp, Homo sapiens
acactgtaatatctttaa

SEQ ID NO: 6604897 - DNA, 15 bp, Homo sapiens
acactgtactgcaat

SEQ ID NO: 6604898 - DNA, 18 bp, Homo sapiens
acactgtagctacatttt

SEQ ID NO: 6604899 - DNA, 15 bp, Homo sapiens
acactgtataactgt

SEQ ID NO: 6604900 - DNA, 15 bp, Homo sapiens
acactgtatctaaaa

SEQ ID NO: 6604901 - DNA, 16 bp, Homo sapiens
acactgtatctaaaaa

SEQ ID NO: 6604902 - DNA, 19 bp, Homo sapiens
acactgtatgactctcctc

SEQ ID NO: 6604903 - DNA, 22 bp, Homo sapiens
acactgtcaagattaagttata

SEQ ID NO: 6604904 - DNA, 14 bp, Homo sapiens
acactgtcaatgag

SEQ ID NO: 6604905 - DNA, 23 bp, Homo sapiens
acactgtcaatggactgcacctt

SEQ ID NO: 6604906 - DNA, 15 bp, Homo sapiens
acactgtcagagctg

SEQ ID NO: 6604907 - DNA, 21 bp, Homo sapiens
acactgtcatgcttcatcatt

SEQ ID NO: 6604908 - DNA, 19 bp, Homo sapiens
acactgtccccacagcagg

SEQ ID NO: 6604909 - DNA, 17 bp, Homo sapiens
acactgtccttccctgc

SEQ ID NO: 6604910 - DNA, 18 bp, Homo sapiens
acactgtccttccctgcc

SEQ ID NO: 6604911 - DNA, 20 bp, Homo sapiens
acactgtccttccctgccac

SEQ ID NO: 6604912 - DNA, 18 bp, Homo sapiens
acactgtctgctgcccca

SEQ ID NO: 6604913 - DNA, 18 bp, Homo sapiens
acactgtctggggcccca

SEQ ID NO: 6604914 - DNA, 13 bp, Homo sapiens
acactgtcttccc

SEQ ID NO: 6604915 - DNA, 14 bp, Homo sapiens
acactgtcttcccg

SEQ ID NO: 6604916 - DNA, 15 bp, Homo sapiens
acactgtcttcccga

SEQ ID NO: 6604917 - DNA, 19 bp, Homo sapiens
acactgtgaactcaatctc

SEQ ID NO: 6604918 - DNA, 13 bp, Homo sapiens
acactgtgacaca

SEQ ID NO: 6604919 - DNA, 15 bp, Homo sapiens
acactgtgacacact

SEQ ID NO: 6604920 - DNA, 16 bp, Homo sapiens
acactgtgacatctct

SEQ ID NO: 6604921 - DNA, 17 bp, Homo sapiens
acactgtgaccctgggt

SEQ ID NO: 6604922 - DNA, 21 bp, Homo sapiens
acactgtgagagttgtctctg

SEQ ID NO: 6604923 - DNA, 22 bp, Homo sapiens
acactgtgcaggcccaggcagg

SEQ ID NO: 6604924 - DNA, 12 bp, Homo sapiens
acactgtgccct

SEQ ID NO: 6604925 - DNA, 14 bp, Homo sapiens
acactgtgccctgg

SEQ ID NO: 6604926 - DNA, 14 bp, Homo sapiens
acactgtgctttct

SEQ ID NO: 6604927 - DNA, 11 bp, Homo sapiens
acactgtggaa

SEQ ID NO: 6604928 - DNA, 13 bp, Homo sapiens
acactgtggcagc

SEQ ID NO: 6604929 - DNA, 16 bp, Homo sapiens
acactgtggcagcagg

SEQ ID NO: 6604930 - DNA, 19 bp, Homo sapiens
acactgtggcagcaggagg

SEQ ID NO: 6604931 - DNA, 12 bp, Homo sapiens
acactgtggcca

SEQ ID NO: 6604932 - DNA, 19 bp, Homo sapiens
acactgtgggtgtgtgact

SEQ ID NO: 6604933 - DNA, 17 bp, Homo sapiens
acactgtgtacacctca

SEQ ID NO: 6604934 - DNA, 18 bp, Homo sapiens
acactgtgtactgcagtt

SEQ ID NO: 6604935 - DNA, 17 bp, Homo sapiens
acactgtgtcacatcac

SEQ ID NO: 6604936 - DNA, 20 bp, Homo sapiens
acactgtgtcctggtgctct

SEQ ID NO: 6604937 - DNA, 21 bp, Homo sapiens
acactgtgtcctggtgctctc

SEQ ID NO: 6604938 - DNA, 14 bp, Homo sapiens
acactgtgtctcta

SEQ ID NO: 6604939 - DNA, 20 bp, Homo sapiens
acactgtgtctctatgtgaa

SEQ ID NO: 6604940 - DNA, 23 bp, Homo sapiens
acactgttaatcatgggttcctc

SEQ ID NO: 6604941 - DNA, 19 bp, Homo sapiens
acactgttagaacactatt

SEQ ID NO: 6604942 - DNA, 20 bp, Homo sapiens
acactgttagaacactattt

SEQ ID NO: 6604943 - DNA, 21 bp, Homo sapiens
acactgttagaacactatttt

SEQ ID NO: 6604944 - DNA, 22 bp, Homo sapiens
acactgttagaacactattttc

SEQ ID NO: 6604945 - DNA, 21 bp, Homo sapiens
acactgttattttcagcatga

SEQ ID NO: 6604946 - DNA, 18 bp, Homo sapiens
acactgttcttagctcaa

SEQ ID NO: 6604947 - DNA, 19 bp, Homo sapiens
acactgttgataaaaactc

SEQ ID NO: 6604948 - DNA, 13 bp, Homo sapiens
acactgttgcaaa

SEQ ID NO: 6604949 - DNA, 22 bp, Homo sapiens
acactgttggaagaaaagagat

SEQ ID NO: 6604950 - DNA, 14 bp, Homo sapiens
acactgttggcact

SEQ ID NO: 6604951 - DNA, 16 bp, Homo sapiens
acactgttgtttagtt

SEQ ID NO: 6604952 - DNA, 21 bp, Homo sapiens
acactgtttacaagaaaaaat

SEQ ID NO: 6604953 - DNA, 16 bp, Homo sapiens
acactgtttcaaactt

SEQ ID NO: 6604954 - DNA, 20 bp, Homo sapiens
acactgtttcaaactttact

SEQ ID NO: 6604955 - DNA, 15 bp, Homo sapiens
acactgtttcatctc

SEQ ID NO: 6604956 - DNA, 22 bp, Homo sapiens
acactgtttcatctcagctttt

SEQ ID NO: 6604957 - DNA, 13 bp, Homo sapiens
acactgttttcct

SEQ ID NO: 6604958 - DNA, 16 bp, Homo sapiens
acactgtttttcatac

SEQ ID NO: 6604959 - DNA, 21 bp, Homo sapiens
acactgttttttggcttgctt

SEQ ID NO: 6604960 - DNA, 13 bp, Homo sapiens
acacttaaaaatg

SEQ ID NO: 6604961 - DNA, 16 bp, Homo sapiens
acacttaaaattgtaa

SEQ ID NO: 6604962 - DNA, 23 bp, Homo sapiens
acacttaaaattgtaacctgcat

SEQ ID NO: 6604963 - DNA, 18 bp, Homo sapiens
acacttaaacttgcacat

SEQ ID NO: 6604964 - DNA, 11 bp, Homo sapiens
acacttaacag

SEQ ID NO: 6604965 - DNA, 16 bp, Homo sapiens
acacttaacagatgca

SEQ ID NO: 6604966 - DNA, 13 bp, Homo sapiens
acacttaactaaa

SEQ ID NO: 6604967 - DNA, 14 bp, Homo sapiens
acacttaactaaaa

SEQ ID NO: 6604968 - DNA, 15 bp, Homo sapiens
acacttaagcagagc

SEQ ID NO: 6604969 - DNA, 14 bp, Homo sapiens
acacttaatactac

SEQ ID NO: 6604970 - DNA, 16 bp, Homo sapiens
acacttaattctgttc

SEQ ID NO: 6604971 - DNA, 17 bp, Homo sapiens
acacttactgtaagaca

SEQ ID NO: 6604972 - DNA, 23 bp, Homo sapiens
acacttactgttgtcctatggga

SEQ ID NO: 6604973 - DNA, 20 bp, Homo sapiens
acacttagattaagatttta

SEQ ID NO: 6604974 - DNA, 15 bp, Homo sapiens
acacttagctggaga

SEQ ID NO: 6604975 - DNA, 13 bp, Homo sapiens
acacttaggaaga

SEQ ID NO: 6604976 - DNA, 17 bp, Homo sapiens
acacttaggaagaaatc

SEQ ID NO: 6604977 - DNA, 13 bp, Homo sapiens
acacttataaaat

SEQ ID NO: 6604978 - DNA, 15 bp, Homo sapiens
acacttataaaataa

SEQ ID NO: 6604979 - DNA, 16 bp, Homo sapiens
acacttatattttatg

SEQ ID NO: 6604980 - DNA, 21 bp, Homo sapiens
acacttatattttatgaacat

SEQ ID NO: 6604981 - DNA, 19 bp, Homo sapiens
acacttatattttgatttt

SEQ ID NO: 6604982 - DNA, 16 bp, Homo sapiens
acacttatcagcagca

SEQ ID NO: 6604983 - DNA, 16 bp, Homo sapiens
acacttatcttctgga

SEQ ID NO: 6604984 - DNA, 19 bp, Homo sapiens
acacttatcttctggatta

SEQ ID NO: 6604985 - DNA, 20 bp, Homo sapiens
acacttattgctttgaaact

SEQ ID NO: 6604986 - DNA, 17 bp, Homo sapiens
acacttatttatgaatt

SEQ ID NO: 6604987 - DNA, 18 bp, Homo sapiens
acacttatttatgaattg

SEQ ID NO: 6604988 - DNA, 19 bp, Homo sapiens
acacttatttatgaattgt

SEQ ID NO: 6604989 - DNA, 21 bp, Homo sapiens
acacttattttctgaattcat

SEQ ID NO: 6604990 - DNA, 20 bp, Homo sapiens
acacttcacctccttctgca

SEQ ID NO: 6604991 - DNA, 15 bp, Homo sapiens
acacttcagacacag

SEQ ID NO: 6604992 - DNA, 13 bp, Homo sapiens
acacttcagactg

SEQ ID NO: 6604993 - DNA, 13 bp, Homo sapiens
acacttcagagag

SEQ ID NO: 6604994 - DNA, 17 bp, Homo sapiens
acacttcagagagctgg

SEQ ID NO: 6604995 - DNA, 19 bp, Homo sapiens
acacttcagagagctggta

SEQ ID NO: 6604996 - DNA, 17 bp, Homo sapiens
acacttcagcctgtgca

SEQ ID NO: 6604997 - DNA, 17 bp, Homo sapiens
acacttcagttatcttg

SEQ ID NO: 6604998 - DNA, 19 bp, Homo sapiens
acacttcatggaccaagaa

SEQ ID NO: 6604999 - DNA, 16 bp, Homo sapiens
acacttcattctttat

SEQ ID NO: 6605000 - DNA, 15 bp, Homo sapiens
acacttccaccagcc

SEQ ID NO: 6605001 - DNA, 17 bp, Homo sapiens
acacttccaccagcctg

SEQ ID NO: 6605002 - DNA, 21 bp, Homo sapiens
acacttccaccagcctgcact

SEQ ID NO: 6605003 - DNA, 24 bp, Homo sapiens
acacttccacccttttttctaagt

SEQ ID NO: 6605004 - DNA, 12 bp, Homo sapiens
acacttccagac

SEQ ID NO: 6605005 - DNA, 14 bp, Homo sapiens
acacttccagtctg

SEQ ID NO: 6605006 - DNA, 19 bp, Homo sapiens
acacttcccacccccaggc

SEQ ID NO: 6605007 - DNA, 13 bp, Homo sapiens
acacttccccttg

SEQ ID NO: 6605008 - DNA, 22 bp, Homo sapiens
acacttccctctgtttctcttt

SEQ ID NO: 6605009 - DNA, 11 bp, Homo sapiens
acacttccctg

SEQ ID NO: 6605010 - DNA, 12 bp, Homo sapiens
acacttccctgg

SEQ ID NO: 6605011 - DNA, 14 bp, Homo sapiens
acacttcctgccta

SEQ ID NO: 6605012 - DNA, 19 bp, Homo sapiens
acacttcctgtccagagag

SEQ ID NO: 6605013 - DNA, 15 bp, Homo sapiens
acacttctccttaac

SEQ ID NO: 6605014 - DNA, 16 bp, Homo sapiens
acacttctccttaacc

SEQ ID NO: 6605015 - DNA, 12 bp, Homo sapiens
acacttctgatc

SEQ ID NO: 6605016 - DNA, 18 bp, Homo sapiens
acacttctgtatgcatca

SEQ ID NO: 6605017 - DNA, 17 bp, Homo sapiens
acacttctgtcctgtga

SEQ ID NO: 6605018 - DNA, 19 bp, Homo sapiens
acacttcttacgcaatgct

SEQ ID NO: 6605019 - DNA, 14 bp, Homo sapiens
acacttcttccaaa

SEQ ID NO: 6605020 - DNA, 13 bp, Homo sapiens
acacttcttttga

SEQ ID NO: 6605021 - DNA, 15 bp, Homo sapiens
acacttgaaaagtgt

SEQ ID NO: 6605022 - DNA, 14 bp, Homo sapiens
acacttgaaacctt

SEQ ID NO: 6605023 - DNA, 18 bp, Homo sapiens
acacttgaacctgggagg

SEQ ID NO: 6605024 - DNA, 16 bp, Homo sapiens
acacttgagaggatga

SEQ ID NO: 6605025 - DNA, 21 bp, Homo sapiens
acacttgagaggatgaatgta

SEQ ID NO: 6605026 - DNA, 21 bp, Homo sapiens
acacttgcagagctgctggag

SEQ ID NO: 6605027 - DNA, 21 bp, Homo sapiens
acacttgcaggggtccctgct

SEQ ID NO: 6605028 - DNA, 22 bp, Homo sapiens
acacttgcaggggtccctgcta

SEQ ID NO: 6605029 - DNA, 14 bp, Homo sapiens
acacttgccctgct

SEQ ID NO: 6605030 - DNA, 18 bp, Homo sapiens
acacttgccttcttcacc

SEQ ID NO: 6605031 - DNA, 21 bp, Homo sapiens
acacttgctgagtgaaggaaa

SEQ ID NO: 6605032 - DNA, 12 bp, Homo sapiens
acacttgcttta

SEQ ID NO: 6605033 - DNA, 19 bp, Homo sapiens
acacttgctttatttttca

SEQ ID NO: 6605034 - DNA, 19 bp, Homo sapiens
acacttggaacagtgttta

SEQ ID NO: 6605035 - DNA, 13 bp, Homo sapiens
acacttggagccc

SEQ ID NO: 6605036 - DNA, 18 bp, Homo sapiens
acacttggagcccgtgca

SEQ ID NO: 6605037 - DNA, 16 bp, Homo sapiens
acacttggcatacaaa

SEQ ID NO: 6605038 - DNA, 17 bp, Homo sapiens
acacttggcatacaaaa

SEQ ID NO: 6605039 - DNA, 22 bp, Homo sapiens
acacttggcatacaaaatattt

SEQ ID NO: 6605040 - DNA, 20 bp, Homo sapiens
acacttgggctggcacccac

SEQ ID NO: 6605041 - DNA, 22 bp, Homo sapiens
acacttgggctggcacccactg

SEQ ID NO: 6605042 - DNA, 23 bp, Homo sapiens
acacttgggtaattaaaaataaa

SEQ ID NO: 6605043 - DNA, 15 bp, Homo sapiens
acacttggtgctggg

SEQ ID NO: 6605044 - DNA, 17 bp, Homo sapiens
acacttggtgctgggaa

SEQ ID NO: 6605045 - DNA, 19 bp, Homo sapiens
acacttggtgctgggaacc

SEQ ID NO: 6605046 - DNA, 15 bp, Homo sapiens
acacttggtgtactg

SEQ ID NO: 6605047 - DNA, 20 bp, Homo sapiens
acacttggttagacgccttc

SEQ ID NO: 6605048 - DNA, 17 bp, Homo sapiens
acacttggttgggtcct

SEQ ID NO: 6605049 - DNA, 22 bp, Homo sapiens
acacttggttgggtcctcacat

SEQ ID NO: 6605050 - DNA, 14 bp, Homo sapiens
acacttgtcggctc

SEQ ID NO: 6605051 - DNA, 14 bp, Homo sapiens
acacttgtgacttt

SEQ ID NO: 6605052 - DNA, 15 bp, Homo sapiens
acacttgtgactttt

SEQ ID NO: 6605053 - DNA, 18 bp, Homo sapiens
acacttgtgacttttgct

SEQ ID NO: 6605054 - DNA, 22 bp, Homo sapiens
acacttgtgattataaaattaa

SEQ ID NO: 6605055 - DNA, 19 bp, Homo sapiens
acacttgtgtgccacagag

SEQ ID NO: 6605056 - DNA, 22 bp, Homo sapiens
acacttgtgtgtgggctgtgag

SEQ ID NO: 6605057 - DNA, 18 bp, Homo sapiens
acacttgtgttgctttct

SEQ ID NO: 6605058 - DNA, 23 bp, Homo sapiens
acacttgttcaacagtttctcaa

SEQ ID NO: 6605059 - DNA, 20 bp, Homo sapiens
acacttgttccagctctttg

SEQ ID NO: 6605060 - DNA, 17 bp, Homo sapiens
acacttgttttctttgt

SEQ ID NO: 6605061 - DNA, 20 bp, Homo sapiens
acactttaaaaccagttacc

SEQ ID NO: 6605062 - DNA, 13 bp, Homo sapiens
acactttaatggg

SEQ ID NO: 6605063 - DNA, 12 bp, Homo sapiens
acactttacaat

SEQ ID NO: 6605064 - DNA, 13 bp, Homo sapiens
acactttacaatg

SEQ ID NO: 6605065 - DNA, 14 bp, Homo sapiens
acactttacctctt

SEQ ID NO: 6605066 - DNA, 13 bp, Homo sapiens
acactttatggta

SEQ ID NO: 6605067 - DNA, 21 bp, Homo sapiens
acactttcatgcagtgctctt

SEQ ID NO: 6605068 - DNA, 14 bp, Homo sapiens
acactttccatctc

SEQ ID NO: 6605069 - DNA, 18 bp, Homo sapiens
acactttcctggataaaa

SEQ ID NO: 6605070 - DNA, 14 bp, Homo sapiens
acactttctgactg

SEQ ID NO: 6605071 - DNA, 14 bp, Homo sapiens
acactttctgctgg

SEQ ID NO: 6605072 - DNA, 14 bp, Homo sapiens
acactttctggcaa

SEQ ID NO: 6605073 - DNA, 18 bp, Homo sapiens
acactttgaaggtaataa

SEQ ID NO: 6605074 - DNA, 19 bp, Homo sapiens
acactttgcactgatatat

SEQ ID NO: 6605075 - DNA, 21 bp, Homo sapiens
acactttgccatttgcttgta

SEQ ID NO: 6605076 - DNA, 21 bp, Homo sapiens
acactttggccaagcaagagg

SEQ ID NO: 6605077 - DNA, 22 bp, Homo sapiens
acactttggtattcaatttgat

SEQ ID NO: 6605078 - DNA, 15 bp, Homo sapiens
acactttggtttatg

SEQ ID NO: 6605079 - DNA, 13 bp, Homo sapiens
acactttgtatta

SEQ ID NO: 6605080 - DNA, 16 bp, Homo sapiens
acacttttaaaaaaca

SEQ ID NO: 6605081 - DNA, 18 bp, Homo sapiens
acacttttatatttgaaa

SEQ ID NO: 6605082 - DNA, 11 bp, Homo sapiens
acacttttatg

SEQ ID NO: 6605083 - DNA, 19 bp, Homo sapiens
acacttttcacctccttca

SEQ ID NO: 6605084 - DNA, 17 bp, Homo sapiens
acacttttcatatcatt

SEQ ID NO: 6605085 - DNA, 18 bp, Homo sapiens
acacttttcatatcattt

SEQ ID NO: 6605086 - DNA, 15 bp, Homo sapiens
acacttttgaaaatg

SEQ ID NO: 6605087 - DNA, 22 bp, Homo sapiens
acacttttgaaaatgtacatgt

SEQ ID NO: 6605088 - DNA, 17 bp, Homo sapiens
acacttttgctctgcag

SEQ ID NO: 6605089 - DNA, 20 bp, Homo sapiens
acacttttgggaggtccagg

SEQ ID NO: 6605090 - DNA, 13 bp, Homo sapiens
acacttttggtta

SEQ ID NO: 6605091 - DNA, 20 bp, Homo sapiens
acactttttacagcagcaat

SEQ ID NO: 6605092 - DNA, 22 bp, Homo sapiens
acactttttacagcagcaatat

SEQ ID NO: 6605093 - DNA, 16 bp, Homo sapiens
acactttttgtatttt

SEQ ID NO: 6605094 - DNA, 16 bp, Homo sapiens
acagaaaaaaaacaca

SEQ ID NO: 6605095 - DNA, 21 bp, Homo sapiens
acagaaaaacagacaaaacaa

SEQ ID NO: 6605096 - DNA, 21 bp, Homo sapiens
acagaaaaagaaggttgaggg

SEQ ID NO: 6605097 - DNA, 17 bp, Homo sapiens
acagaaaaagcatgatg

SEQ ID NO: 6605098 - DNA, 15 bp, Homo sapiens
acagaaaaaggatgt

SEQ ID NO: 6605099 - DNA, 14 bp, Homo sapiens
acagaaaaataagt

SEQ ID NO: 6605100 - DNA, 10 bp, Homo sapiens
acagaaaaca

SEQ ID NO: 6605101 - DNA, 20 bp, Homo sapiens
acagaaaacaaaagagagaa

SEQ ID NO: 6605102 - DNA, 17 bp, Homo sapiens
acagaaaacaacaaaaa

SEQ ID NO: 6605103 - DNA, 19 bp, Homo sapiens
acagaaaacaacaaaaaat

SEQ ID NO: 6605104 - DNA, 16 bp, Homo sapiens
acagaaaacattgact

SEQ ID NO: 6605105 - DNA, 13 bp, Homo sapiens
acagaaaaccgag

SEQ ID NO: 6605106 - DNA, 19 bp, Homo sapiens
acagaaaaccgagaatatt

SEQ ID NO: 6605107 - DNA, 13 bp, Homo sapiens
acagaaaacctca

SEQ ID NO: 6605108 - DNA, 13 bp, Homo sapiens
acagaaaactaga

SEQ ID NO: 6605109 - DNA, 22 bp, Homo sapiens
acagaaaactcccaatacaaag

SEQ ID NO: 6605110 - DNA, 19 bp, Homo sapiens
acagaaaagagaagaaaga

SEQ ID NO: 6605111 - DNA, 22 bp, Homo sapiens
acagaaaataatctggtgttct

SEQ ID NO: 6605112 - DNA, 17 bp, Homo sapiens
acagaaaatatactgta

SEQ ID NO: 6605113 - DNA, 13 bp, Homo sapiens
acagaaaatgcaa

SEQ ID NO: 6605114 - DNA, 20 bp, Homo sapiens
acagaaaatggaagacagct

SEQ ID NO: 6605115 - DNA, 17 bp, Homo sapiens
acagaaaattcttctcc

SEQ ID NO: 6605116 - DNA, 17 bp, Homo sapiens
acagaaaatttaactta

SEQ ID NO: 6605117 - DNA, 18 bp, Homo sapiens
acagaaaatttgcaacat

SEQ ID NO: 6605118 - DNA, 17 bp, Homo sapiens
acagaaacaactgccaa

SEQ ID NO: 6605119 - DNA, 21 bp, Homo sapiens
acagaaacaactgccaaataa

SEQ ID NO: 6605120 - DNA, 23 bp, Homo sapiens
acagaaacacggagtttccattt

SEQ ID NO: 6605121 - DNA, 18 bp, Homo sapiens
acagaaacactgcctttt

SEQ ID NO: 6605122 - DNA, 18 bp, Homo sapiens
acagaaacctctactaaa

SEQ ID NO: 6605123 - DNA, 12 bp, Homo sapiens
acagaaaccttt

SEQ ID NO: 6605124 - DNA, 15 bp, Homo sapiens
acagaaaccttttta

SEQ ID NO: 6605125 - DNA, 16 bp, Homo sapiens
acagaaacgtgttaaa

SEQ ID NO: 6605126 - DNA, 10 bp, Homo sapiens
acagaaacta

SEQ ID NO: 6605127 - DNA, 23 bp, Homo sapiens
acagaaactaaactcttaccata

SEQ ID NO: 6605128 - DNA, 16 bp, Homo sapiens
acagaaacttgaactc

SEQ ID NO: 6605129 - DNA, 22 bp, Homo sapiens
acagaaagcaaatcagacacaa

SEQ ID NO: 6605130 - DNA, 13 bp, Homo sapiens
acagaaagcacaa

SEQ ID NO: 6605131 - DNA, 16 bp, Homo sapiens
acagaaagcatagacg

SEQ ID NO: 6605132 - DNA, 12 bp, Homo sapiens
acagaaagcctc

SEQ ID NO: 6605133 - DNA, 21 bp, Homo sapiens
acagaaagctagatatgcctt

SEQ ID NO: 6605134 - DNA, 14 bp, Homo sapiens
acagaaagtggtgc

SEQ ID NO: 6605135 - DNA, 18 bp, Homo sapiens
acagaaagttggaaagga

SEQ ID NO: 6605136 - DNA, 21 bp, Homo sapiens
acagaaagttggaaaggaaaa

SEQ ID NO: 6605137 - DNA, 17 bp, Homo sapiens
acagaaagtttgtaaaa

SEQ ID NO: 6605138 - DNA, 15 bp, Homo sapiens
acagaaatactgctc

SEQ ID NO: 6605139 - DNA, 17 bp, Homo sapiens
acagaaatactgctctg

SEQ ID NO: 6605140 - DNA, 19 bp, Homo sapiens
acagaaatataataaaatg

SEQ ID NO: 6605141 - DNA, 14 bp, Homo sapiens
acagaaatatatat

SEQ ID NO: 6605142 - DNA, 19 bp, Homo sapiens
acagaaatatatatacata

SEQ ID NO: 6605143 - DNA, 14 bp, Homo sapiens
acagaaatctctca

SEQ ID NO: 6605144 - DNA, 22 bp, Homo sapiens
acagaaatgactgtggtgtgga

SEQ ID NO: 6605145 - DNA, 15 bp, Homo sapiens
acagaaatgctgctg

SEQ ID NO: 6605146 - DNA, 16 bp, Homo sapiens
acagaaatgctgctgg

SEQ ID NO: 6605147 - DNA, 21 bp, Homo sapiens
acagaaatgctgctggccaaa

SEQ ID NO: 6605148 - DNA, 14 bp, Homo sapiens
acagaaatgtgtca

SEQ ID NO: 6605149 - DNA, 19 bp, Homo sapiens
acagaaatgtgtcaatgta

SEQ ID NO: 6605150 - DNA, 16 bp, Homo sapiens
acagaaatgtttctgt

SEQ ID NO: 6605151 - DNA, 17 bp, Homo sapiens
acagaaattagccgggc

SEQ ID NO: 6605152 - DNA, 17 bp, Homo sapiens
acagaaattgaaaatga

SEQ ID NO: 6605153 - DNA, 13 bp, Homo sapiens
acagaaattgcaa

SEQ ID NO: 6605154 - DNA, 13 bp, Homo sapiens
acagaaattgcat

SEQ ID NO: 6605155 - DNA, 15 bp, Homo sapiens
acagaacaacaacaa

SEQ ID NO: 6605156 - DNA, 16 bp, Homo sapiens
acagaacaacccacca

SEQ ID NO: 6605157 - DNA, 22 bp, Homo sapiens
acagaacaattaaacagccaaa

SEQ ID NO: 6605158 - DNA, 12 bp, Homo sapiens
acagaacactgt

SEQ ID NO: 6605159 - DNA, 12 bp, Homo sapiens
acagaacactta

SEQ ID NO: 6605160 - DNA, 16 bp, Homo sapiens
acagaacagaataata

SEQ ID NO: 6605161 - DNA, 14 bp, Homo sapiens
acagaacagcttca

SEQ ID NO: 6605162 - DNA, 15 bp, Homo sapiens
acagaacagcttcag

SEQ ID NO: 6605163 - DNA, 16 bp, Homo sapiens
acagaacagcttcagg

SEQ ID NO: 6605164 - DNA, 17 bp, Homo sapiens
acagaacagcttcaggt

SEQ ID NO: 6605165 - DNA, 15 bp, Homo sapiens
acagaacaggaacta

SEQ ID NO: 6605166 - DNA, 20 bp, Homo sapiens
acagaacaggaggtgtgaat

SEQ ID NO: 6605167 - DNA, 13 bp, Homo sapiens
acagaacagggtc

SEQ ID NO: 6605168 - DNA, 15 bp, Homo sapiens
acagaacagggtcat

SEQ ID NO: 6605169 - DNA, 16 bp, Homo sapiens
acagaacatgctgtta

SEQ ID NO: 6605170 - DNA, 23 bp, Homo sapiens
acagaacatttctcatgtgcttt

SEQ ID NO: 6605171 - DNA, 16 bp, Homo sapiens
acagaaccaaatcgtg

SEQ ID NO: 6605172 - DNA, 15 bp, Homo sapiens
acagaaccagagggt

SEQ ID NO: 6605173 - DNA, 19 bp, Homo sapiens
acagaaccagcactcccag

SEQ ID NO: 6605174 - DNA, 17 bp, Homo sapiens
acagaacccacagtaga

SEQ ID NO: 6605175 - DNA, 13 bp, Homo sapiens
acagaaccctttg

SEQ ID NO: 6605176 - DNA, 14 bp, Homo sapiens
acagaacctcccaa

SEQ ID NO: 6605177 - DNA, 15 bp, Homo sapiens
acagaacctcccaaa

SEQ ID NO: 6605178 - DNA, 18 bp, Homo sapiens
acagaaccttcaacccag

SEQ ID NO: 6605179 - DNA, 21 bp, Homo sapiens
acagaaccttcaacccagtgg

SEQ ID NO: 6605180 - DNA, 19 bp, Homo sapiens
acagaaccttgttatttct

SEQ ID NO: 6605181 - DNA, 16 bp, Homo sapiens
acagaacctttgtcaa

SEQ ID NO: 6605182 - DNA, 12 bp, Homo sapiens
acagaactaaaa

SEQ ID NO: 6605183 - DNA, 14 bp, Homo sapiens
acagaactaaatgt

SEQ ID NO: 6605184 - DNA, 15 bp, Homo sapiens
acagaactaaatgtt

SEQ ID NO: 6605185 - DNA, 16 bp, Homo sapiens
acagaactaaatgttc

SEQ ID NO: 6605186 - DNA, 22 bp, Homo sapiens
acagaactatctcagcatcaga

SEQ ID NO: 6605187 - DNA, 13 bp, Homo sapiens
acagaactccctt

SEQ ID NO: 6605188 - DNA, 22 bp, Homo sapiens
acagaactcggtgtccccacca

SEQ ID NO: 6605189 - DNA, 18 bp, Homo sapiens
acagaactggcaggagcc

SEQ ID NO: 6605190 - DNA, 20 bp, Homo sapiens
acagaacttcagaaagactt

SEQ ID NO: 6605191 - DNA, 19 bp, Homo sapiens
acagaacttgaatgtgtca

SEQ ID NO: 6605192 - DNA, 12 bp, Homo sapiens
acagaagaaaca

SEQ ID NO: 6605193 - DNA, 14 bp, Homo sapiens
acagaagaaacaag

SEQ ID NO: 6605194 - DNA, 15 bp, Homo sapiens
acagaagaaactggg

SEQ ID NO: 6605195 - DNA, 20 bp, Homo sapiens
acagaagaaggcagcaggtg

SEQ ID NO: 6605196 - DNA, 23 bp, Homo sapiens
acagaagacacgtgtttttgtat

SEQ ID NO: 6605197 - DNA, 17 bp, Homo sapiens
acagaagagaaggaagc

SEQ ID NO: 6605198 - DNA, 22 bp, Homo sapiens
acagaagaggagggacctactg

SEQ ID NO: 6605199 - DNA, 18 bp, Homo sapiens
acagaagattaagacaga

SEQ ID NO: 6605200 - DNA, 18 bp, Homo sapiens
acagaagcacatgcacct

SEQ ID NO: 6605201 - DNA, 18 bp, Homo sapiens
acagaagcaggctggagg

SEQ ID NO: 6605202 - DNA, 14 bp, Homo sapiens
acagaagcatttgt

SEQ ID NO: 6605203 - DNA, 15 bp, Homo sapiens
acagaagcatttgta

SEQ ID NO: 6605204 - DNA, 16 bp, Homo sapiens
acagaagcatttgtat

SEQ ID NO: 6605205 - DNA, 17 bp, Homo sapiens
acagaagcatttgtatt

SEQ ID NO: 6605206 - DNA, 21 bp, Homo sapiens
acagaagccaagctccctgga

SEQ ID NO: 6605207 - DNA, 13 bp, Homo sapiens
acagaagccagga

SEQ ID NO: 6605208 - DNA, 18 bp, Homo sapiens
acagaagccaggagcaaa

SEQ ID NO: 6605209 - DNA, 21 bp, Homo sapiens
acagaagctgaagtgcatcca

SEQ ID NO: 6605210 - DNA, 19 bp, Homo sapiens
acagaagcttcagaagttt

SEQ ID NO: 6605211 - DNA, 17 bp, Homo sapiens
acagaaggactggtgcg

SEQ ID NO: 6605212 - DNA, 12 bp, Homo sapiens
acagaaggcaaa

SEQ ID NO: 6605213 - DNA, 24 bp, Homo sapiens
acagaaggcaaagtttacagatgt

SEQ ID NO: 6605214 - DNA, 20 bp, Homo sapiens
acagaaggcccgaggaggcc

SEQ ID NO: 6605215 - DNA, 16 bp, Homo sapiens
acagaagggagggcag

SEQ ID NO: 6605216 - DNA, 22 bp, Homo sapiens
acagaagggagggcagagctgg

SEQ ID NO: 6605217 - DNA, 23 bp, Homo sapiens
acagaagggagggcagagctggt

SEQ ID NO: 6605218 - DNA, 13 bp, Homo sapiens
acagaaggggatg

SEQ ID NO: 6605219 - DNA, 20 bp, Homo sapiens
acagaaggggatgggaaata

SEQ ID NO: 6605220 - DNA, 13 bp, Homo sapiens
acagaagtcaggt

SEQ ID NO: 6605221 - DNA, 20 bp, Homo sapiens
acagaagtccctaggaggga

SEQ ID NO: 6605222 - DNA, 13 bp, Homo sapiens
acagaagtcctgt

SEQ ID NO: 6605223 - DNA, 20 bp, Homo sapiens
acagaagtccttaagcagag

SEQ ID NO: 6605224 - DNA, 16 bp, Homo sapiens
acagaagtgactgatg

SEQ ID NO: 6605225 - DNA, 17 bp, Homo sapiens
acagaagtgaggatgag

SEQ ID NO: 6605226 - DNA, 18 bp, Homo sapiens
acagaagtgtagtatgct

SEQ ID NO: 6605227 - DNA, 20 bp, Homo sapiens
acagaagtgtagtatgctgt

SEQ ID NO: 6605228 - DNA, 15 bp, Homo sapiens
acagaagttgtgaaa

SEQ ID NO: 6605229 - DNA, 14 bp, Homo sapiens
acagaataaagcag

SEQ ID NO: 6605230 - DNA, 15 bp, Homo sapiens
acagaataaagcagc

SEQ ID NO: 6605231 - DNA, 21 bp, Homo sapiens
acagaataaagcagcctgatt

SEQ ID NO: 6605232 - DNA, 23 bp, Homo sapiens
acagaataatccagtattgctga

SEQ ID NO: 6605233 - DNA, 14 bp, Homo sapiens
acagaatatacaca

SEQ ID NO: 6605234 - DNA, 19 bp, Homo sapiens
acagaatatacacattttg

SEQ ID NO: 6605235 - DNA, 21 bp, Homo sapiens
acagaatatacacattttgta

SEQ ID NO: 6605236 - DNA, 22 bp, Homo sapiens
acagaatatacacattttgtaa

SEQ ID NO: 6605237 - DNA, 15 bp, Homo sapiens
acagaatataggata

SEQ ID NO: 6605238 - DNA, 16 bp, Homo sapiens
acagaatattaaatat

SEQ ID NO: 6605239 - DNA, 19 bp, Homo sapiens
acagaatattaaatattat

SEQ ID NO: 6605240 - DNA, 21 bp, Homo sapiens
acagaatatttctattgaatt

SEQ ID NO: 6605241 - DNA, 16 bp, Homo sapiens
acagaatatttttata

SEQ ID NO: 6605242 - DNA, 16 bp, Homo sapiens
acagaatcattgctta

SEQ ID NO: 6605243 - DNA, 16 bp, Homo sapiens
acagaatctccatttc

SEQ ID NO: 6605244 - DNA, 15 bp, Homo sapiens
acagaatcttctggg

SEQ ID NO: 6605245 - DNA, 14 bp, Homo sapiens
acagaatcttgtat

SEQ ID NO: 6605246 - DNA, 16 bp, Homo sapiens
acagaatgaaaaatga

SEQ ID NO: 6605247 - DNA, 18 bp, Homo sapiens
acagaatgaaaaatgaaa

SEQ ID NO: 6605248 - DNA, 17 bp, Homo sapiens
acagaatgagagagaaa

SEQ ID NO: 6605249 - DNA, 17 bp, Homo sapiens
acagaatgcattaaaaa

SEQ ID NO: 6605250 - DNA, 16 bp, Homo sapiens
acagaatgctatttca

SEQ ID NO: 6605251 - DNA, 15 bp, Homo sapiens
acagaatgctcaggg

SEQ ID NO: 6605252 - DNA, 17 bp, Homo sapiens
acagaatgctgttttaa

SEQ ID NO: 6605253 - DNA, 18 bp, Homo sapiens
acagaatgctgttttaaa

SEQ ID NO: 6605254 - DNA, 17 bp, Homo sapiens
acagaatgggagaaaat

SEQ ID NO: 6605255 - DNA, 17 bp, Homo sapiens
acagaatggtgccatgc

SEQ ID NO: 6605256 - DNA, 14 bp, Homo sapiens
acagaatgtatctg

SEQ ID NO: 6605257 - DNA, 20 bp, Homo sapiens
acagaatgttttactgtgaa

SEQ ID NO: 6605258 - DNA, 20 bp, Homo sapiens
acagaattatagatgtctga

SEQ ID NO: 6605259 - DNA, 15 bp, Homo sapiens
acagaattcaacagt

SEQ ID NO: 6605260 - DNA, 16 bp, Homo sapiens
acagaattcactgtct

SEQ ID NO: 6605261 - DNA, 19 bp, Homo sapiens
acagaattcactgtctgtt

SEQ ID NO: 6605262 - DNA, 19 bp, Homo sapiens
acagaattgactgcagttg

SEQ ID NO: 6605263 - DNA, 21 bp, Homo sapiens
acagaattgactgcagttgaa

SEQ ID NO: 6605264 - DNA, 16 bp, Homo sapiens
acagaattgcttgttt

SEQ ID NO: 6605265 - DNA, 23 bp, Homo sapiens
acagaattgggcccttagaatgt

SEQ ID NO: 6605266 - DNA, 18 bp, Homo sapiens
acagaattgtgtctgcag

SEQ ID NO: 6605267 - DNA, 13 bp, Homo sapiens
acagaatttgaat

SEQ ID NO: 6605268 - DNA, 21 bp, Homo sapiens
acagaatttgagaaccttgga

SEQ ID NO: 6605269 - DNA, 18 bp, Homo sapiens
acagaattttatggtgca

SEQ ID NO: 6605270 - DNA, 13 bp, Homo sapiens
acagaatttttaa

SEQ ID NO: 6605271 - DNA, 19 bp, Homo sapiens
acagacaaaaacagcctca

SEQ ID NO: 6605272 - DNA, 20 bp, Homo sapiens
acagacaaacttgatttctt

SEQ ID NO: 6605273 - DNA, 17 bp, Homo sapiens
acagacaaagagagtgg

SEQ ID NO: 6605274 - DNA, 13 bp, Homo sapiens
acagacaaagcgt

SEQ ID NO: 6605275 - DNA, 14 bp, Homo sapiens
acagacaaggagga

SEQ ID NO: 6605276 - DNA, 17 bp, Homo sapiens
acagacacaatatgtat

SEQ ID NO: 6605277 - DNA, 23 bp, Homo sapiens
acagacacaatatgtatgctttt

SEQ ID NO: 6605278 - DNA, 14 bp, Homo sapiens
acagacacaattta

SEQ ID NO: 6605279 - DNA, 14 bp, Homo sapiens
acagacacacacac

SEQ ID NO: 6605280 - DNA, 15 bp, Homo sapiens
acagacacacacacg

SEQ ID NO: 6605281 - DNA, 16 bp, Homo sapiens
acagacacacacacgc

SEQ ID NO: 6605282 - DNA, 17 bp, Homo sapiens
acagacacacacacgca

SEQ ID NO: 6605283 - DNA, 11 bp, Homo sapiens
acagacacagg

SEQ ID NO: 6605284 - DNA, 13 bp, Homo sapiens
acagacacaggcc

SEQ ID NO: 6605285 - DNA, 16 bp, Homo sapiens
acagacaccacagcct

SEQ ID NO: 6605286 - DNA, 21 bp, Homo sapiens
acagacaccacagcctcccct

SEQ ID NO: 6605287 - DNA, 14 bp, Homo sapiens
acagacaccctcca

SEQ ID NO: 6605288 - DNA, 23 bp, Homo sapiens
acagacaccctccactctgaggt

SEQ ID NO: 6605289 - DNA, 13 bp, Homo sapiens
acagacacctccc

SEQ ID NO: 6605290 - DNA, 15 bp, Homo sapiens
acagacacctccccc

SEQ ID NO: 6605291 - DNA, 16 bp, Homo sapiens
acagacacctccccct

SEQ ID NO: 6605292 - DNA, 18 bp, Homo sapiens
acagacacctccccctac

SEQ ID NO: 6605293 - DNA, 23 bp, Homo sapiens
acagacacctccccctacccata

SEQ ID NO: 6605294 - DNA, 20 bp, Homo sapiens
acagacactacatatctaaa

SEQ ID NO: 6605295 - DNA, 21 bp, Homo sapiens
acagacactcccacttggcat

SEQ ID NO: 6605296 - DNA, 15 bp, Homo sapiens
acagacactgtaaaa

SEQ ID NO: 6605297 - DNA, 15 bp, Homo sapiens
acagacagaagagaa

SEQ ID NO: 6605298 - DNA, 18 bp, Homo sapiens
acagacagaagagaagga

SEQ ID NO: 6605299 - DNA, 21 bp, Homo sapiens
acagacagagaaggcagcagg

SEQ ID NO: 6605300 - DNA, 12 bp, Homo sapiens
acagacagcagc

SEQ ID NO: 6605301 - DNA, 16 bp, Homo sapiens
acagacagcagctgga

SEQ ID NO: 6605302 - DNA, 22 bp, Homo sapiens
acagacagcttacaggagccag

SEQ ID NO: 6605303 - DNA, 13 bp, Homo sapiens
acagacaggaccc

SEQ ID NO: 6605304 - DNA, 13 bp, Homo sapiens
acagacaggagaa

SEQ ID NO: 6605305 - DNA, 20 bp, Homo sapiens
acagacagtatgtctactcc

SEQ ID NO: 6605306 - DNA, 13 bp, Homo sapiens
acagacagttaat

SEQ ID NO: 6605307 - DNA, 21 bp, Homo sapiens
acagacatccttgcagtttaa

SEQ ID NO: 6605308 - DNA, 22 bp, Homo sapiens
acagacatggaccttctctcca

SEQ ID NO: 6605309 - DNA, 17 bp, Homo sapiens
acagacattaaacctgg

SEQ ID NO: 6605310 - DNA, 16 bp, Homo sapiens
acagacattcaatgaa

SEQ ID NO: 6605311 - DNA, 11 bp, Homo sapiens
acagacattgt

SEQ ID NO: 6605312 - DNA, 19 bp, Homo sapiens
acagacattttcaataatg

SEQ ID NO: 6605313 - DNA, 16 bp, Homo sapiens
acagaccaatagacat

SEQ ID NO: 6605314 - DNA, 21 bp, Homo sapiens
acagaccacatctttatctgt

SEQ ID NO: 6605315 - DNA, 22 bp, Homo sapiens
acagaccacatctttatctgtt

SEQ ID NO: 6605316 - DNA, 20 bp, Homo sapiens
acagaccacctgcttctgaa

SEQ ID NO: 6605317 - DNA, 14 bp, Homo sapiens
acagaccacttgcc

SEQ ID NO: 6605318 - DNA, 14 bp, Homo sapiens
acagaccagcagca

SEQ ID NO: 6605319 - DNA, 16 bp, Homo sapiens
acagaccagcatagtt

SEQ ID NO: 6605320 - DNA, 21 bp, Homo sapiens
acagaccagtgaccccagaaa

SEQ ID NO: 6605321 - DNA, 18 bp, Homo sapiens
acagacccaaaccatacc

SEQ ID NO: 6605322 - DNA, 12 bp, Homo sapiens
acagacccacac

SEQ ID NO: 6605323 - DNA, 13 bp, Homo sapiens
acagacccaggtc

SEQ ID NO: 6605324 - DNA, 18 bp, Homo sapiens
acagacccaggtcttcca

SEQ ID NO: 6605325 - DNA, 20 bp, Homo sapiens
acagacccaggtcttccaga

SEQ ID NO: 6605326 - DNA, 14 bp, Homo sapiens
acagaccccagctg

SEQ ID NO: 6605327 - DNA, 15 bp, Homo sapiens
acagacccctaggga

SEQ ID NO: 6605328 - DNA, 22 bp, Homo sapiens
acagacccctcccctcgtgtca

SEQ ID NO: 6605329 - DNA, 13 bp, Homo sapiens
acagacccctgcc

SEQ ID NO: 6605330 - DNA, 14 bp, Homo sapiens
acagacccctggga

SEQ ID NO: 6605331 - DNA, 15 bp, Homo sapiens
acagacccctgggag

SEQ ID NO: 6605332 - DNA, 16 bp, Homo sapiens
acagacccctgggagc

SEQ ID NO: 6605333 - DNA, 15 bp, Homo sapiens
acagacccctggggg

SEQ ID NO: 6605334 - DNA, 14 bp, Homo sapiens
acagaccctgccca

SEQ ID NO: 6605335 - DNA, 15 bp, Homo sapiens
acagaccctgcccac

SEQ ID NO: 6605336 - DNA, 15 bp, Homo sapiens
acagaccctgccctg

SEQ ID NO: 6605337 - DNA, 17 bp, Homo sapiens
acagaccctgccctgtg

SEQ ID NO: 6605338 - DNA, 20 bp, Homo sapiens
acagaccctgccctgtgggc

SEQ ID NO: 6605339 - DNA, 18 bp, Homo sapiens
acagaccgagaggccagt

SEQ ID NO: 6605340 - DNA, 18 bp, Homo sapiens
acagaccgcgcccctggg

SEQ ID NO: 6605341 - DNA, 19 bp, Homo sapiens
acagaccgcgcccctggga

SEQ ID NO: 6605342 - DNA, 20 bp, Homo sapiens
acagaccgcgcccctgggac

SEQ ID NO: 6605343 - DNA, 16 bp, Homo sapiens
acagacctaatatcat

SEQ ID NO: 6605344 - DNA, 16 bp, Homo sapiens
acagacctaatgctcc

SEQ ID NO: 6605345 - DNA, 16 bp, Homo sapiens
acagacctcagagatg

SEQ ID NO: 6605346 - DNA, 21 bp, Homo sapiens
acagacctccagattattttc

SEQ ID NO: 6605347 - DNA, 17 bp, Homo sapiens
acagacctcgagtttct

SEQ ID NO: 6605348 - DNA, 13 bp, Homo sapiens
acagacctcggct

SEQ ID NO: 6605349 - DNA, 14 bp, Homo sapiens
acagacctctccca

SEQ ID NO: 6605350 - DNA, 15 bp, Homo sapiens
acagacctctcccac

SEQ ID NO: 6605351 - DNA, 13 bp, Homo sapiens
acagacctctgct

SEQ ID NO: 6605352 - DNA, 16 bp, Homo sapiens
acagacctctgcttgg

SEQ ID NO: 6605353 - DNA, 13 bp, Homo sapiens
acagacctgcagt

SEQ ID NO: 6605354 - DNA, 17 bp, Homo sapiens
acagacctgctttttga

SEQ ID NO: 6605355 - DNA, 21 bp, Homo sapiens
acagacctgctttttgaaatg

SEQ ID NO: 6605356 - DNA, 21 bp, Homo sapiens
acagacctggagcccctgggt

SEQ ID NO: 6605357 - DNA, 17 bp, Homo sapiens
acagacctggtgctcta

SEQ ID NO: 6605358 - DNA, 15 bp, Homo sapiens
acagaccttcacaga

SEQ ID NO: 6605359 - DNA, 14 bp, Homo sapiens
acagacctttgaac

SEQ ID NO: 6605360 - DNA, 16 bp, Homo sapiens
acagacgccacctggc

SEQ ID NO: 6605361 - DNA, 21 bp, Homo sapiens
acagacgcctgcttttgcaaa

SEQ ID NO: 6605362 - DNA, 22 bp, Homo sapiens
acagacgcctgcttttgcaaat

SEQ ID NO: 6605363 - DNA, 20 bp, Homo sapiens
acagacgtatgcttatttta

SEQ ID NO: 6605364 - DNA, 21 bp, Homo sapiens
acagacgtctcaagactgaaa

SEQ ID NO: 6605365 - DNA, 23 bp, Homo sapiens
acagacgttaggcatttcctgct

SEQ ID NO: 6605366 - DNA, 14 bp, Homo sapiens
acagactatttgct

SEQ ID NO: 6605367 - DNA, 20 bp, Homo sapiens
acagactcaaatgctcagac

SEQ ID NO: 6605368 - DNA, 15 bp, Homo sapiens
acagactcactggga

SEQ ID NO: 6605369 - DNA, 18 bp, Homo sapiens
acagactcccactcagta

SEQ ID NO: 6605370 - DNA, 23 bp, Homo sapiens
acagactccctcccctgccccca

SEQ ID NO: 6605371 - DNA, 23 bp, Homo sapiens
acagactcctgaggacagctgtc

SEQ ID NO: 6605372 - DNA, 22 bp, Homo sapiens
acagactctgctagtgaaaaga

SEQ ID NO: 6605373 - DNA, 15 bp, Homo sapiens
acagactcttccacc

SEQ ID NO: 6605374 - DNA, 12 bp, Homo sapiens
acagactgaaag

SEQ ID NO: 6605375 - DNA, 11 bp, Homo sapiens
acagactgcaa

SEQ ID NO: 6605376 - DNA, 20 bp, Homo sapiens
acagactgcagacattctca

SEQ ID NO: 6605377 - DNA, 13 bp, Homo sapiens
acagactgcccca

SEQ ID NO: 6605378 - DNA, 16 bp, Homo sapiens
acagactgccccagcc

SEQ ID NO: 6605379 - DNA, 21 bp, Homo sapiens
acagactggaagcacagcttc

SEQ ID NO: 6605380 - DNA, 15 bp, Homo sapiens
acagactggcaataa

SEQ ID NO: 6605381 - DNA, 16 bp, Homo sapiens
acagactggcaataaa

SEQ ID NO: 6605382 - DNA, 20 bp, Homo sapiens
acagactggccgggcaggcg

SEQ ID NO: 6605383 - DNA, 12 bp, Homo sapiens
acagactgtagc

SEQ ID NO: 6605384 - DNA, 23 bp, Homo sapiens
acagactgtagcttctcttgctc

SEQ ID NO: 6605385 - DNA, 23 bp, Homo sapiens
acagactgttccctccaaggtcc

SEQ ID NO: 6605386 - DNA, 12 bp, Homo sapiens
acagactgtttt

SEQ ID NO: 6605387 - DNA, 18 bp, Homo sapiens
acagactgttttactgtt

SEQ ID NO: 6605388 - DNA, 19 bp, Homo sapiens
acagactgttttactgttt

SEQ ID NO: 6605389 - DNA, 16 bp, Homo sapiens
acagacttcacagcgt

SEQ ID NO: 6605390 - DNA, 18 bp, Homo sapiens
acagacttcacagcgtct

SEQ ID NO: 6605391 - DNA, 16 bp, Homo sapiens
acagacttctccagac

SEQ ID NO: 6605392 - DNA, 19 bp, Homo sapiens
acagacttctggaaggctg

SEQ ID NO: 6605393 - DNA, 20 bp, Homo sapiens
acagacttgaaggagtttaa

SEQ ID NO: 6605394 - DNA, 15 bp, Homo sapiens
acagacttgcactga

SEQ ID NO: 6605395 - DNA, 14 bp, Homo sapiens
acagactttagctt

SEQ ID NO: 6605396 - DNA, 19 bp, Homo sapiens
acagactttagctttctga

SEQ ID NO: 6605397 - DNA, 21 bp, Homo sapiens
acagactttctgtgacgcaga

SEQ ID NO: 6605398 - DNA, 21 bp, Homo sapiens
acagactttggacagtggcct

SEQ ID NO: 6605399 - DNA, 17 bp, Homo sapiens
acagagaaaacttgcct

SEQ ID NO: 6605400 - DNA, 14 bp, Homo sapiens
acagagaaaagcag

SEQ ID NO: 6605401 - DNA, 14 bp, Homo sapiens
acagagaaaccagc

SEQ ID NO: 6605402 - DNA, 15 bp, Homo sapiens
acagagaaaccagct

SEQ ID NO: 6605403 - DNA, 19 bp, Homo sapiens
acagagaaaccagcttcct

SEQ ID NO: 6605404 - DNA, 22 bp, Homo sapiens
acagagaaaccagcttccttca

SEQ ID NO: 6605405 - DNA, 10 bp, Homo sapiens
acagagaaag

SEQ ID NO: 6605406 - DNA, 14 bp, Homo sapiens
acagagaaagaaat

SEQ ID NO: 6605407 - DNA, 17 bp, Homo sapiens
acagagaaagagagaga

SEQ ID NO: 6605408 - DNA, 16 bp, Homo sapiens
acagagaaatacaaaa

SEQ ID NO: 6605409 - DNA, 17 bp, Homo sapiens
acagagaaatacaaaat

SEQ ID NO: 6605410 - DNA, 22 bp, Homo sapiens
acagagaaatacaaaataaaga

SEQ ID NO: 6605411 - DNA, 18 bp, Homo sapiens
acagagaaattctgtggt

SEQ ID NO: 6605412 - DNA, 14 bp, Homo sapiens
acagagaacctgga

SEQ ID NO: 6605413 - DNA, 19 bp, Homo sapiens
acagagaactaacactatt

SEQ ID NO: 6605414 - DNA, 9 bp, Homo sapiens
acagagaag

SEQ ID NO: 6605415 - DNA, 16 bp, Homo sapiens
acagagaagacaaaat

SEQ ID NO: 6605416 - DNA, 12 bp, Homo sapiens
acagagaagcca

SEQ ID NO: 6605417 - DNA, 21 bp, Homo sapiens
acagagaagccatcacctcag

SEQ ID NO: 6605418 - DNA, 16 bp, Homo sapiens
acagagaagccttcaa

SEQ ID NO: 6605419 - DNA, 21 bp, Homo sapiens
acagagaaggaatgtctttgg

SEQ ID NO: 6605420 - DNA, 14 bp, Homo sapiens
acagagaaggcagg

SEQ ID NO: 6605421 - DNA, 21 bp, Homo sapiens
acagagaagtttgtagccagg

SEQ ID NO: 6605422 - DNA, 22 bp, Homo sapiens
acagagaagtttgtagccaggt

SEQ ID NO: 6605423 - DNA, 12 bp, Homo sapiens
acagagaatctg

SEQ ID NO: 6605424 - DNA, 16 bp, Homo sapiens
acagagaatttctaaa

SEQ ID NO: 6605425 - DNA, 21 bp, Homo sapiens
acagagacacctgcacctccc

SEQ ID NO: 6605426 - DNA, 23 bp, Homo sapiens
acagagacagaaacagagagaga

SEQ ID NO: 6605427 - DNA, 23 bp, Homo sapiens
acagagacaggcccaagagatga

SEQ ID NO: 6605428 - DNA, 14 bp, Homo sapiens
acagagacagtgaa

SEQ ID NO: 6605429 - DNA, 18 bp, Homo sapiens
acagagacagtgaaagtt

SEQ ID NO: 6605430 - DNA, 17 bp, Homo sapiens
acagagacattcctccg

SEQ ID NO: 6605431 - DNA, 13 bp, Homo sapiens
acagagaccaaga

SEQ ID NO: 6605432 - DNA, 22 bp, Homo sapiens
acagagacctgccctcaagagc

SEQ ID NO: 6605433 - DNA, 16 bp, Homo sapiens
acagagacggtctgga

SEQ ID NO: 6605434 - DNA, 23 bp, Homo sapiens
acagagactcagcgctcctcctg

SEQ ID NO: 6605435 - DNA, 16 bp, Homo sapiens
acagagactctccctg

SEQ ID NO: 6605436 - DNA, 13 bp, Homo sapiens
acagagagaaaaa

SEQ ID NO: 6605437 - DNA, 19 bp, Homo sapiens
acagagagagatactctgg

SEQ ID NO: 6605438 - DNA, 20 bp, Homo sapiens
acagagagagatactctggg

SEQ ID NO: 6605439 - DNA, 16 bp, Homo sapiens
acagagagccaagcta

SEQ ID NO: 6605440 - DNA, 16 bp, Homo sapiens
acagagaggagaaaca

SEQ ID NO: 6605441 - DNA, 19 bp, Homo sapiens
acagagaggatacatttaa

SEQ ID NO: 6605442 - DNA, 22 bp, Homo sapiens
acagagaggatacatttaataa

SEQ ID NO: 6605443 - DNA, 21 bp, Homo sapiens
acagagagggggccacctccc

SEQ ID NO: 6605444 - DNA, 22 bp, Homo sapiens
acagagagtcccactgcctcag

SEQ ID NO: 6605445 - DNA, 21 bp, Homo sapiens
acagagagttctggtgagata

SEQ ID NO: 6605446 - DNA, 16 bp, Homo sapiens
acagagatcataaaga

SEQ ID NO: 6605447 - DNA, 21 bp, Homo sapiens
acagagatgcatgcgcaggct

SEQ ID NO: 6605448 - DNA, 22 bp, Homo sapiens
acagagatgcatgcgcaggctc

SEQ ID NO: 6605449 - DNA, 23 bp, Homo sapiens
acagagatggaggccgagccaat

SEQ ID NO: 6605450 - DNA, 15 bp, Homo sapiens
acagagatggcagag

SEQ ID NO: 6605451 - DNA, 17 bp, Homo sapiens
acagagatggcagagcc

SEQ ID NO: 6605452 - DNA, 18 bp, Homo sapiens
acagagatggcagagcca

SEQ ID NO: 6605453 - DNA, 22 bp, Homo sapiens
acagagatggtgtgttctgcaa

SEQ ID NO: 6605454 - DNA, 14 bp, Homo sapiens
acagagattctgga

SEQ ID NO: 6605455 - DNA, 17 bp, Homo sapiens
acagagattctggatct

SEQ ID NO: 6605456 - DNA, 16 bp, Homo sapiens
acagagcaacccctgg

SEQ ID NO: 6605457 - DNA, 20 bp, Homo sapiens
acagagcaacccctggaccc

SEQ ID NO: 6605458 - DNA, 15 bp, Homo sapiens
acagagcaagactct

SEQ ID NO: 6605459 - DNA, 15 bp, Homo sapiens
acagagcaagcgaaa

SEQ ID NO: 6605460 - DNA, 21 bp, Homo sapiens
acagagcaagtgagaccctgt

SEQ ID NO: 6605461 - DNA, 18 bp, Homo sapiens
acagagcaagtgatttat

SEQ ID NO: 6605462 - DNA, 18 bp, Homo sapiens
acagagcacacttattta

SEQ ID NO: 6605463 - DNA, 19 bp, Homo sapiens
acagagcacatttgtcagt

SEQ ID NO: 6605464 - DNA, 12 bp, Homo sapiens
acagagcacgcc

SEQ ID NO: 6605465 - DNA, 13 bp, Homo sapiens
acagagcacgcct

SEQ ID NO: 6605466 - DNA, 12 bp, Homo sapiens
acagagcacttg

SEQ ID NO: 6605467 - DNA, 13 bp, Homo sapiens
acagagcagatca

SEQ ID NO: 6605468 - DNA, 12 bp, Homo sapiens
acagagcagcaa

SEQ ID NO: 6605469 - DNA, 23 bp, Homo sapiens
acagagcagctaactccgagagc

SEQ ID NO: 6605470 - DNA, 13 bp, Homo sapiens
acagagcaggctt

SEQ ID NO: 6605471 - DNA, 20 bp, Homo sapiens
acagagcaggctttgtgaga

SEQ ID NO: 6605472 - DNA, 22 bp, Homo sapiens
acagagcaggctttgtgagaga

SEQ ID NO: 6605473 - DNA, 22 bp, Homo sapiens
acagagcaggtctgcaggccac

SEQ ID NO: 6605474 - DNA, 14 bp, Homo sapiens
acagagcatcagaa

SEQ ID NO: 6605475 - DNA, 18 bp, Homo sapiens
acagagccaagcactgct

SEQ ID NO: 6605476 - DNA, 12 bp, Homo sapiens
acagagccactc

SEQ ID NO: 6605477 - DNA, 14 bp, Homo sapiens
acagagccactctt

SEQ ID NO: 6605478 - DNA, 14 bp, Homo sapiens
acagagccagaggc

SEQ ID NO: 6605479 - DNA, 22 bp, Homo sapiens
acagagccagcggctccaactc

SEQ ID NO: 6605480 - DNA, 14 bp, Homo sapiens
acagagccaggaga

SEQ ID NO: 6605481 - DNA, 16 bp, Homo sapiens
acagagccaggagaag

SEQ ID NO: 6605482 - DNA, 18 bp, Homo sapiens
acagagcccacgccccca

SEQ ID NO: 6605483 - DNA, 20 bp, Homo sapiens
acagagcccacgcccccact

SEQ ID NO: 6605484 - DNA, 16 bp, Homo sapiens
acagagccccacgctg

SEQ ID NO: 6605485 - DNA, 15 bp, Homo sapiens
acagagcccccaagc

SEQ ID NO: 6605486 - DNA, 17 bp, Homo sapiens
acagagccgtaaaaact

SEQ ID NO: 6605487 - DNA, 11 bp, Homo sapiens
acagagcctcc

SEQ ID NO: 6605488 - DNA, 21 bp, Homo sapiens
acagagcctcgggacatcaaa

SEQ ID NO: 6605489 - DNA, 22 bp, Homo sapiens
acagagcctgaatttgtaagca

SEQ ID NO: 6605490 - DNA, 15 bp, Homo sapiens
acagagcctgcccca

SEQ ID NO: 6605491 - DNA, 18 bp, Homo sapiens
acagagcctgcctaacca

SEQ ID NO: 6605492 - DNA, 22 bp, Homo sapiens
acagagcctgcctaaccaggcc

SEQ ID NO: 6605493 - DNA, 14 bp, Homo sapiens
acagagcctggccc

SEQ ID NO: 6605494 - DNA, 20 bp, Homo sapiens
acagagcctggccccaggcc

SEQ ID NO: 6605495 - DNA, 13 bp, Homo sapiens
acagagcctgttt

SEQ ID NO: 6605496 - DNA, 17 bp, Homo sapiens
acagagccttcacaacc

SEQ ID NO: 6605497 - DNA, 23 bp, Homo sapiens
acagagccttctgaggacattcc

SEQ ID NO: 6605498 - DNA, 17 bp, Homo sapiens
acagagcgacagagcag

SEQ ID NO: 6605499 - DNA, 20 bp, Homo sapiens
acagagcgagactccatctc

SEQ ID NO: 6605500 - DNA, 15 bp, Homo sapiens
acagagcgagacttt

SEQ ID NO: 6605501 - DNA, 15 bp, Homo sapiens
acagagcgcccctcc

SEQ ID NO: 6605502 - DNA, 14 bp, Homo sapiens
acagagcgggcctc

SEQ ID NO: 6605503 - DNA, 19 bp, Homo sapiens
acagagcgggcctcttccc

SEQ ID NO: 6605504 - DNA, 23 bp, Homo sapiens
acagagcgggcctcttccctcag

SEQ ID NO: 6605505 - DNA, 16 bp, Homo sapiens
acagagctaaggccaa

SEQ ID NO: 6605506 - DNA, 21 bp, Homo sapiens
acagagctactgagacttgga

SEQ ID NO: 6605507 - DNA, 14 bp, Homo sapiens
acagagctctgggt

SEQ ID NO: 6605508 - DNA, 16 bp, Homo sapiens
acagagctgacaaaat

SEQ ID NO: 6605509 - DNA, 10 bp, Homo sapiens
acagagctgg

SEQ ID NO: 6605510 - DNA, 23 bp, Homo sapiens
acagagctggagatgaggccaga

SEQ ID NO: 6605511 - DNA, 17 bp, Homo sapiens
acagagctggatgctga

SEQ ID NO: 6605512 - DNA, 15 bp, Homo sapiens
acagagctggctgtc

SEQ ID NO: 6605513 - DNA, 16 bp, Homo sapiens
acagagctggctgtct

SEQ ID NO: 6605514 - DNA, 19 bp, Homo sapiens
acagagctggctgtcttcc

SEQ ID NO: 6605515 - DNA, 18 bp, Homo sapiens
acagagctgggatgtttc

SEQ ID NO: 6605516 - DNA, 14 bp, Homo sapiens
acagagcttccctg

SEQ ID NO: 6605517 - DNA, 12 bp, Homo sapiens
acagaggaaagg

SEQ ID NO: 6605518 - DNA, 20 bp, Homo sapiens
acagaggaaagggctggctc

SEQ ID NO: 6605519 - DNA, 20 bp, Homo sapiens
acagaggaagaatttgttat

SEQ ID NO: 6605520 - DNA, 12 bp, Homo sapiens
acagaggacagt

SEQ ID NO: 6605521 - DNA, 20 bp, Homo sapiens
acagaggacataccactgcc

SEQ ID NO: 6605522 - DNA, 15 bp, Homo sapiens
acagaggaccagcac

SEQ ID NO: 6605523 - DNA, 22 bp, Homo sapiens
acagaggacccttacgtgagaa

SEQ ID NO: 6605524 - DNA, 18 bp, Homo sapiens
acagaggagaaaggtgaa

SEQ ID NO: 6605525 - DNA, 22 bp, Homo sapiens
acagaggaggatgtaaggcctt

SEQ ID NO: 6605526 - DNA, 18 bp, Homo sapiens
acagaggaggcctcaaag

SEQ ID NO: 6605527 - DNA, 20 bp, Homo sapiens
acagaggagggcgtgactca

SEQ ID NO: 6605528 - DNA, 16 bp, Homo sapiens
acagaggaggtcagca

SEQ ID NO: 6605529 - DNA, 21 bp, Homo sapiens
acagaggatgccttttctgtg

SEQ ID NO: 6605530 - DNA, 16 bp, Homo sapiens
acagaggatgctgaag

SEQ ID NO: 6605531 - DNA, 18 bp, Homo sapiens
acagaggatgctgaagta

SEQ ID NO: 6605532 - DNA, 15 bp, Homo sapiens
acagaggatttctgc

SEQ ID NO: 6605533 - DNA, 13 bp, Homo sapiens
acagaggcagccc

SEQ ID NO: 6605534 - DNA, 14 bp, Homo sapiens
acagaggcagcccc

SEQ ID NO: 6605535 - DNA, 23 bp, Homo sapiens
acagaggcagccccattctgcct

SEQ ID NO: 6605536 - DNA, 17 bp, Homo sapiens
acagaggcagtggcagc

SEQ ID NO: 6605537 - DNA, 11 bp, Homo sapiens
acagaggccaa

SEQ ID NO: 6605538 - DNA, 15 bp, Homo sapiens
acagaggccaggcat

SEQ ID NO: 6605539 - DNA, 10 bp, Homo sapiens
acagaggccc

SEQ ID NO: 6605540 - DNA, 18 bp, Homo sapiens
acagaggccccagcctcc

SEQ ID NO: 6605541 - DNA, 21 bp, Homo sapiens
acagaggccctgccacgtccc

SEQ ID NO: 6605542 - DNA, 15 bp, Homo sapiens
acagaggcctgactg

SEQ ID NO: 6605543 - DNA, 17 bp, Homo sapiens
acagaggctattgtccc

SEQ ID NO: 6605544 - DNA, 23 bp, Homo sapiens
acagaggctggcactgagcctgc

SEQ ID NO: 6605545 - DNA, 17 bp, Homo sapiens
acagaggctgtggtcag

SEQ ID NO: 6605546 - DNA, 20 bp, Homo sapiens
acagagggaagaaaagagct

SEQ ID NO: 6605547 - DNA, 14 bp, Homo sapiens
acagagggaagcca

SEQ ID NO: 6605548 - DNA, 21 bp, Homo sapiens
acagagggaagccagtcaggg

SEQ ID NO: 6605549 - DNA, 17 bp, Homo sapiens
acagagggaagccatgt

SEQ ID NO: 6605550 - DNA, 21 bp, Homo sapiens
acagagggaagtttaaaaccc

SEQ ID NO: 6605551 - DNA, 22 bp, Homo sapiens
acagagggaagtttaaaaccca

SEQ ID NO: 6605552 - DNA, 21 bp, Homo sapiens
acagagggacagtgggctatg

SEQ ID NO: 6605553 - DNA, 13 bp, Homo sapiens
acagagggattta

SEQ ID NO: 6605554 - DNA, 14 bp, Homo sapiens
acagagggccagag

SEQ ID NO: 6605555 - DNA, 23 bp, Homo sapiens
acagagggccagagctagggctg

SEQ ID NO: 6605556 - DNA, 17 bp, Homo sapiens
acagagggcgctcctgt

SEQ ID NO: 6605557 - DNA, 16 bp, Homo sapiens
acagaggggactctgg

SEQ ID NO: 6605558 - DNA, 20 bp, Homo sapiens
acagaggggactctgggcta

SEQ ID NO: 6605559 - DNA, 12 bp, Homo sapiens
acagaggggagc

SEQ ID NO: 6605560 - DNA, 19 bp, Homo sapiens
acagagggggtggcctccc

SEQ ID NO: 6605561 - DNA, 22 bp, Homo sapiens
acagagggtcacagtgtttaca

SEQ ID NO: 6605562 - DNA, 17 bp, Homo sapiens
acagagggtcccattgt

SEQ ID NO: 6605563 - DNA, 14 bp, Homo sapiens
acagaggtaaaaaa

SEQ ID NO: 6605564 - DNA, 21 bp, Homo sapiens
acagaggtaaaaaaaagaagt

SEQ ID NO: 6605565 - DNA, 20 bp, Homo sapiens
acagaggtccgggtttagta

SEQ ID NO: 6605566 - DNA, 15 bp, Homo sapiens
acagagtaagacatt

SEQ ID NO: 6605567 - DNA, 18 bp, Homo sapiens
acagagtacgttaaaagc

SEQ ID NO: 6605568 - DNA, 19 bp, Homo sapiens
acagagtagccaggttctg

SEQ ID NO: 6605569 - DNA, 13 bp, Homo sapiens
acagagtatatat

SEQ ID NO: 6605570 - DNA, 16 bp, Homo sapiens
acagagtatatatgta

SEQ ID NO: 6605571 - DNA, 18 bp, Homo sapiens
acagagtcaaggcctgct

SEQ ID NO: 6605572 - DNA, 19 bp, Homo sapiens
acagagtccaatttaagga

SEQ ID NO: 6605573 - DNA, 13 bp, Homo sapiens
acagagtctgggt

SEQ ID NO: 6605574 - DNA, 21 bp, Homo sapiens
acagagtcttcactaaccttt

SEQ ID NO: 6605575 - DNA, 17 bp, Homo sapiens
acagagtgagactccat

SEQ ID NO: 6605576 - DNA, 15 bp, Homo sapiens
acagagtgagactct

SEQ ID NO: 6605577 - DNA, 17 bp, Homo sapiens
acagagtgagccagtga

SEQ ID NO: 6605578 - DNA, 19 bp, Homo sapiens
acagagtgagccagtgagg

SEQ ID NO: 6605579 - DNA, 16 bp, Homo sapiens
acagagtgcttttctg

SEQ ID NO: 6605580 - DNA, 22 bp, Homo sapiens
acagagtggaataagacagaga

SEQ ID NO: 6605581 - DNA, 23 bp, Homo sapiens
acagagtggaataagacagagac

SEQ ID NO: 6605582 - DNA, 18 bp, Homo sapiens
acagagtggagccctcag

SEQ ID NO: 6605583 - DNA, 19 bp, Homo sapiens
acagagtggcccctcacct

SEQ ID NO: 6605584 - DNA, 18 bp, Homo sapiens
acagagtggcctccctgc

SEQ ID NO: 6605585 - DNA, 20 bp, Homo sapiens
acagagtggcctccctgctg

SEQ ID NO: 6605586 - DNA, 15 bp, Homo sapiens
acagagtgggccccg

SEQ ID NO: 6605587 - DNA, 19 bp, Homo sapiens
acagagtgggccccgggct

SEQ ID NO: 6605588 - DNA, 13 bp, Homo sapiens
acagagtgtagcc

SEQ ID NO: 6605589 - DNA, 18 bp, Homo sapiens
acagagtgtgctgctatt

SEQ ID NO: 6605590 - DNA, 17 bp, Homo sapiens
acagagtgtgctggagg

SEQ ID NO: 6605591 - DNA, 15 bp, Homo sapiens
acagagtgtgttttt

SEQ ID NO: 6605592 - DNA, 18 bp, Homo sapiens
acagagttcacaggaggc

SEQ ID NO: 6605593 - DNA, 21 bp, Homo sapiens
acagagttcagggaggggctg

SEQ ID NO: 6605594 - DNA, 16 bp, Homo sapiens
acagagttgatttttt

SEQ ID NO: 6605595 - DNA, 18 bp, Homo sapiens
acagagttggtgttcata

SEQ ID NO: 6605596 - DNA, 20 bp, Homo sapiens
acagagttggtgttcataat

SEQ ID NO: 6605597 - DNA, 15 bp, Homo sapiens
acagagttgttacat

SEQ ID NO: 6605598 - DNA, 16 bp, Homo sapiens
acagagttttttaaac

SEQ ID NO: 6605599 - DNA, 13 bp, Homo sapiens
acagataaaatgt

SEQ ID NO: 6605600 - DNA, 13 bp, Homo sapiens
acagataaacaaa

SEQ ID NO: 6605601 - DNA, 13 bp, Homo sapiens
acagataaagatt

SEQ ID NO: 6605602 - DNA, 22 bp, Homo sapiens
acagataacattaggttgtcct

SEQ ID NO: 6605603 - DNA, 15 bp, Homo sapiens
acagataagcaagag

SEQ ID NO: 6605604 - DNA, 19 bp, Homo sapiens
acagataagcaagagagat

SEQ ID NO: 6605605 - DNA, 20 bp, Homo sapiens
acagataagcaagagagatg

SEQ ID NO: 6605606 - DNA, 18 bp, Homo sapiens
acagataagtgttcttca

SEQ ID NO: 6605607 - DNA, 22 bp, Homo sapiens
acagataataatgggtttcttt

SEQ ID NO: 6605608 - DNA, 14 bp, Homo sapiens
acagataatcagtg

SEQ ID NO: 6605609 - DNA, 20 bp, Homo sapiens
acagataatgatagtgtttt

SEQ ID NO: 6605610 - DNA, 17 bp, Homo sapiens
acagatacatagatgga

SEQ ID NO: 6605611 - DNA, 19 bp, Homo sapiens
acagataccagacctcttc

SEQ ID NO: 6605612 - DNA, 14 bp, Homo sapiens
acagataccataaa

SEQ ID NO: 6605613 - DNA, 23 bp, Homo sapiens
acagataccccacgttctatata

SEQ ID NO: 6605614 - DNA, 13 bp, Homo sapiens
acagatacctcca

SEQ ID NO: 6605615 - DNA, 19 bp, Homo sapiens
acagatacctccaaccctg

SEQ ID NO: 6605616 - DNA, 21 bp, Homo sapiens
acagatacctccaaccctgcc

SEQ ID NO: 6605617 - DNA, 20 bp, Homo sapiens
acagatactgtgagcttaca

SEQ ID NO: 6605618 - DNA, 23 bp, Homo sapiens
acagatagtcaaaccataaactt

SEQ ID NO: 6605619 - DNA, 13 bp, Homo sapiens
acagatagttgtg

SEQ ID NO: 6605620 - DNA, 12 bp, Homo sapiens
acagatatattt

SEQ ID NO: 6605621 - DNA, 18 bp, Homo sapiens
acagatatctttttcatt

SEQ ID NO: 6605622 - DNA, 14 bp, Homo sapiens
acagatatgcaaat

SEQ ID NO: 6605623 - DNA, 14 bp, Homo sapiens
acagatatgcacac

SEQ ID NO: 6605624 - DNA, 19 bp, Homo sapiens
acagatatgcacacacatg

SEQ ID NO: 6605625 - DNA, 21 bp, Homo sapiens
acagatatgcacacacatgga

SEQ ID NO: 6605626 - DNA, 23 bp, Homo sapiens
acagatatgggtgtttttaataa

SEQ ID NO: 6605627 - DNA, 22 bp, Homo sapiens
acagatattacagcttattttt

SEQ ID NO: 6605628 - DNA, 14 bp, Homo sapiens
acagatattccaga

SEQ ID NO: 6605629 - DNA, 20 bp, Homo sapiens
acagatatttagctctgtgg

SEQ ID NO: 6605630 - DNA, 18 bp, Homo sapiens
acagatcaagctgtgaga

SEQ ID NO: 6605631 - DNA, 19 bp, Homo sapiens
acagatcacatgcccctct

SEQ ID NO: 6605632 - DNA, 18 bp, Homo sapiens
acagatcaggctagccct

SEQ ID NO: 6605633 - DNA, 21 bp, Homo sapiens
acagatcatagatttctgatt

SEQ ID NO: 6605634 - DNA, 20 bp, Homo sapiens
acagatcataggaagtggct

SEQ ID NO: 6605635 - DNA, 12 bp, Homo sapiens
acagatccatcc

SEQ ID NO: 6605636 - DNA, 23 bp, Homo sapiens
acagatccccagcccctcctccc

SEQ ID NO: 6605637 - DNA, 22 bp, Homo sapiens
acagatcccctggaaacccacc

SEQ ID NO: 6605638 - DNA, 23 bp, Homo sapiens
acagatcgaaccgttttgaagct

SEQ ID NO: 6605639 - DNA, 16 bp, Homo sapiens
acagatcgcatttcct

SEQ ID NO: 6605640 - DNA, 17 bp, Homo sapiens
acagatcgcatttccta

SEQ ID NO: 6605641 - DNA, 22 bp, Homo sapiens
acagatctctgctttggaaatc

SEQ ID NO: 6605642 - DNA, 22 bp, Homo sapiens
acagatctgcaccaccatgccc

SEQ ID NO: 6605643 - DNA, 14 bp, Homo sapiens
acagatctggaacc

SEQ ID NO: 6605644 - DNA, 21 bp, Homo sapiens
acagatctggaacctcagcct

SEQ ID NO: 6605645 - DNA, 22 bp, Homo sapiens
acagatctggaacctcagcctg

SEQ ID NO: 6605646 - DNA, 17 bp, Homo sapiens
acagatcttgagcaagg

SEQ ID NO: 6605647 - DNA, 15 bp, Homo sapiens
acagatgaaaatttg

SEQ ID NO: 6605648 - DNA, 16 bp, Homo sapiens
acagatgaaaatttga

SEQ ID NO: 6605649 - DNA, 20 bp, Homo sapiens
acagatgaaacacaaacaat

SEQ ID NO: 6605650 - DNA, 17 bp, Homo sapiens
acagatgaatgtattta

SEQ ID NO: 6605651 - DNA, 18 bp, Homo sapiens
acagatgaccaaagtccc

SEQ ID NO: 6605652 - DNA, 17 bp, Homo sapiens
acagatgaccataattt

SEQ ID NO: 6605653 - DNA, 17 bp, Homo sapiens
acagatgaccgcaataa

SEQ ID NO: 6605654 - DNA, 22 bp, Homo sapiens
acagatgaccgcaataatgaat

SEQ ID NO: 6605655 - DNA, 20 bp, Homo sapiens
acagatgaccgtgtacaata

SEQ ID NO: 6605656 - DNA, 17 bp, Homo sapiens
acagatgagcaggagct

SEQ ID NO: 6605657 - DNA, 21 bp, Homo sapiens
acagatgagcaggagcttggg

SEQ ID NO: 6605658 - DNA, 16 bp, Homo sapiens
acagatgaggcccccg

SEQ ID NO: 6605659 - DNA, 22 bp, Homo sapiens
acagatgataaatatttatgct

SEQ ID NO: 6605660 - DNA, 18 bp, Homo sapiens
acagatgatacttccaag

SEQ ID NO: 6605661 - DNA, 16 bp, Homo sapiens
acagatgatgaagaaa

SEQ ID NO: 6605662 - DNA, 19 bp, Homo sapiens
acagatgatgagaatttct

SEQ ID NO: 6605663 - DNA, 20 bp, Homo sapiens
acagatgatgagaatttcta

SEQ ID NO: 6605664 - DNA, 18 bp, Homo sapiens
acagatgatgtaaaaata

SEQ ID NO: 6605665 - DNA, 21 bp, Homo sapiens
acagatgcacacacagatgca

SEQ ID NO: 6605666 - DNA, 14 bp, Homo sapiens
acagatgcacccca

SEQ ID NO: 6605667 - DNA, 15 bp, Homo sapiens
acagatgccaacttc

SEQ ID NO: 6605668 - DNA, 14 bp, Homo sapiens
acagatgcccacgt

SEQ ID NO: 6605669 - DNA, 16 bp, Homo sapiens
acagatgccccagagc

SEQ ID NO: 6605670 - DNA, 19 bp, Homo sapiens
acagatgccccagagctgt

SEQ ID NO: 6605671 - DNA, 22 bp, Homo sapiens
acagatgccccagagctgttta

SEQ ID NO: 6605672 - DNA, 17 bp, Homo sapiens
acagatgcctccttcct

SEQ ID NO: 6605673 - DNA, 22 bp, Homo sapiens
acagatgcctccttcctctttt

SEQ ID NO: 6605674 - DNA, 19 bp, Homo sapiens
acagatgccttttttgtag

SEQ ID NO: 6605675 - DNA, 17 bp, Homo sapiens
acagatgctaataaact

SEQ ID NO: 6605676 - DNA, 12 bp, Homo sapiens
acagatgctcca

SEQ ID NO: 6605677 - DNA, 16 bp, Homo sapiens
acagatgctgagccat

SEQ ID NO: 6605678 - DNA, 14 bp, Homo sapiens
acagatgctggcct

SEQ ID NO: 6605679 - DNA, 15 bp, Homo sapiens
acagatgctggcctc

SEQ ID NO: 6605680 - DNA, 18 bp, Homo sapiens
acagatgctggtggagga

SEQ ID NO: 6605681 - DNA, 20 bp, Homo sapiens
acagatggaagaagttttaa

SEQ ID NO: 6605682 - DNA, 16 bp, Homo sapiens
acagatggaccaaaag

SEQ ID NO: 6605683 - DNA, 20 bp, Homo sapiens
acagatggcacctgtggcca

SEQ ID NO: 6605684 - DNA, 14 bp, Homo sapiens
acagatggcccaag

SEQ ID NO: 6605685 - DNA, 16 bp, Homo sapiens
acagatggcccaaggg

SEQ ID NO: 6605686 - DNA, 21 bp, Homo sapiens
acagatggcccaagggatggc

SEQ ID NO: 6605687 - DNA, 16 bp, Homo sapiens
acagatgggcaaatta

SEQ ID NO: 6605688 - DNA, 20 bp, Homo sapiens
acagatggggtctgtgactg

SEQ ID NO: 6605689 - DNA, 16 bp, Homo sapiens
acagatggtagagaga

SEQ ID NO: 6605690 - DNA, 21 bp, Homo sapiens
acagatggtgtcctgcatgta

SEQ ID NO: 6605691 - DNA, 13 bp, Homo sapiens
acagatgtaaatc

SEQ ID NO: 6605692 - DNA, 22 bp, Homo sapiens
acagatgtaaatcgggaaggat

SEQ ID NO: 6605693 - DNA, 19 bp, Homo sapiens
acagatgtaaattaactca

SEQ ID NO: 6605694 - DNA, 21 bp, Homo sapiens
acagatgtaattatgttttca

SEQ ID NO: 6605695 - DNA, 23 bp, Homo sapiens
acagatgtagatataaatataaa

SEQ ID NO: 6605696 - DNA, 22 bp, Homo sapiens
acagatgtcagcttcccagcca

SEQ ID NO: 6605697 - DNA, 21 bp, Homo sapiens
acagatgtccatcagatgaca

SEQ ID NO: 6605698 - DNA, 15 bp, Homo sapiens
acagatgtctctggg

SEQ ID NO: 6605699 - DNA, 13 bp, Homo sapiens
acagatgtgaaaa

SEQ ID NO: 6605700 - DNA, 19 bp, Homo sapiens
acagatgtgaaaataaagc

SEQ ID NO: 6605701 - DNA, 13 bp, Homo sapiens
acagatgtgccca

SEQ ID NO: 6605702 - DNA, 17 bp, Homo sapiens
acagatgtgctgacaag

SEQ ID NO: 6605703 - DNA, 23 bp, Homo sapiens
acagatgtggacatgcacccgca

SEQ ID NO: 6605704 - DNA, 22 bp, Homo sapiens
acagatgtgtctgggagagcct

SEQ ID NO: 6605705 - DNA, 14 bp, Homo sapiens
acagatgttccatc

SEQ ID NO: 6605706 - DNA, 12 bp, Homo sapiens
acagatgttgaa

SEQ ID NO: 6605707 - DNA, 23 bp, Homo sapiens
acagatgtttcttttgtatgtaa

SEQ ID NO: 6605708 - DNA, 15 bp, Homo sapiens
acagattaaacttca

SEQ ID NO: 6605709 - DNA, 23 bp, Homo sapiens
acagattaacctgaaagaacata

SEQ ID NO: 6605710 - DNA, 17 bp, Homo sapiens
acagattataataaatt

SEQ ID NO: 6605711 - DNA, 20 bp, Homo sapiens
acagattataataaattgtc

SEQ ID NO: 6605712 - DNA, 21 bp, Homo sapiens
acagattatcacattaattta

SEQ ID NO: 6605713 - DNA, 20 bp, Homo sapiens
acagattatgttcctgctgt

SEQ ID NO: 6605714 - DNA, 19 bp, Homo sapiens
acagattcactttgtttat

SEQ ID NO: 6605715 - DNA, 23 bp, Homo sapiens
acagattcaggccagcccagcca

SEQ ID NO: 6605716 - DNA, 13 bp, Homo sapiens
acagattcagtct

SEQ ID NO: 6605717 - DNA, 15 bp, Homo sapiens
acagattcagtcttg

SEQ ID NO: 6605718 - DNA, 17 bp, Homo sapiens
acagattcagtcttgcc

SEQ ID NO: 6605719 - DNA, 18 bp, Homo sapiens
acagattcagtcttgcct

SEQ ID NO: 6605720 - DNA, 12 bp, Homo sapiens
acagattccatt

SEQ ID NO: 6605721 - DNA, 13 bp, Homo sapiens
acagattccatta

SEQ ID NO: 6605722 - DNA, 14 bp, Homo sapiens
acagattcccaggc

SEQ ID NO: 6605723 - DNA, 15 bp, Homo sapiens
acagattcccaggcc

SEQ ID NO: 6605724 - DNA, 20 bp, Homo sapiens
acagattctttcagttcttt

SEQ ID NO: 6605725 - DNA, 21 bp, Homo sapiens
acagattctttcagttctttg

SEQ ID NO: 6605726 - DNA, 17 bp, Homo sapiens
acagattgaagaatctg

SEQ ID NO: 6605727 - DNA, 21 bp, Homo sapiens
acagattgaagaatctgcccc

SEQ ID NO: 6605728 - DNA, 12 bp, Homo sapiens
acagattgaatt

SEQ ID NO: 6605729 - DNA, 17 bp, Homo sapiens
acagattgctgcttctg

SEQ ID NO: 6605730 - DNA, 15 bp, Homo sapiens
acagattggatttta

SEQ ID NO: 6605731 - DNA, 17 bp, Homo sapiens
acagattggattttatg

SEQ ID NO: 6605732 - DNA, 21 bp, Homo sapiens
acagattggattttatgttga

SEQ ID NO: 6605733 - DNA, 22 bp, Homo sapiens
acagattggattttatgttgac

SEQ ID NO: 6605734 - DNA, 20 bp, Homo sapiens
acagattgggcggggcttct

SEQ ID NO: 6605735 - DNA, 16 bp, Homo sapiens
acagattgtttctata

SEQ ID NO: 6605736 - DNA, 18 bp, Homo sapiens
acagattgtttctataca

SEQ ID NO: 6605737 - DNA, 14 bp, Homo sapiens
acagattgtttgca

SEQ ID NO: 6605738 - DNA, 15 bp, Homo sapiens
acagattgtttgcaa

SEQ ID NO: 6605739 - DNA, 19 bp, Homo sapiens
acagatttaagccttgaca

SEQ ID NO: 6605740 - DNA, 21 bp, Homo sapiens
acagatttaagccttgacaca

SEQ ID NO: 6605741 - DNA, 20 bp, Homo sapiens
acagatttaatacagtttat

SEQ ID NO: 6605742 - DNA, 19 bp, Homo sapiens
acagatttcaaaaaaaaac

SEQ ID NO: 6605743 - DNA, 18 bp, Homo sapiens
acagatttcggtcataaa

SEQ ID NO: 6605744 - DNA, 19 bp, Homo sapiens
acagatttctcactatata

SEQ ID NO: 6605745 - DNA, 16 bp, Homo sapiens
acagatttgaggactg

SEQ ID NO: 6605746 - DNA, 12 bp, Homo sapiens
acagatttgtga

SEQ ID NO: 6605747 - DNA, 15 bp, Homo sapiens
acagatttgtgaact

SEQ ID NO: 6605748 - DNA, 22 bp, Homo sapiens
acagatttgtgaactcagccaa

SEQ ID NO: 6605749 - DNA, 21 bp, Homo sapiens
acagatttgtgcccattccta

SEQ ID NO: 6605750 - DNA, 18 bp, Homo sapiens
acagattttaattgtcat

SEQ ID NO: 6605751 - DNA, 19 bp, Homo sapiens
acagattttaattgtcatg

SEQ ID NO: 6605752 - DNA, 14 bp, Homo sapiens
acagattttaccta

SEQ ID NO: 6605753 - DNA, 23 bp, Homo sapiens
acagattttagacttaccttgaa

SEQ ID NO: 6605754 - DNA, 17 bp, Homo sapiens
acagattttattaatca

SEQ ID NO: 6605755 - DNA, 17 bp, Homo sapiens
acagattttcggaacac

SEQ ID NO: 6605756 - DNA, 17 bp, Homo sapiens
acagattttgatagcaa

SEQ ID NO: 6605757 - DNA, 19 bp, Homo sapiens
acagattttgatagcaaag

SEQ ID NO: 6605758 - DNA, 20 bp, Homo sapiens
acagattttggggttgtgtt

SEQ ID NO: 6605759 - DNA, 22 bp, Homo sapiens
acagattttggggttgtgttgt

SEQ ID NO: 6605760 - DNA, 19 bp, Homo sapiens
acagatttttacactaata

SEQ ID NO: 6605761 - DNA, 20 bp, Homo sapiens
acagatttttacactaatat

SEQ ID NO: 6605762 - DNA, 16 bp, Homo sapiens
acagatttttttgtaa

SEQ ID NO: 6605763 - DNA, 21 bp, Homo sapiens
acagcaaaaaaagcaactttt

SEQ ID NO: 6605764 - DNA, 15 bp, Homo sapiens
acagcaaaaccattg

SEQ ID NO: 6605765 - DNA, 12 bp, Homo sapiens
acagcaaacaca

SEQ ID NO: 6605766 - DNA, 20 bp, Homo sapiens
acagcaaacacagtcactgt

SEQ ID NO: 6605767 - DNA, 16 bp, Homo sapiens
acagcaaaccaagaga

SEQ ID NO: 6605768 - DNA, 15 bp, Homo sapiens
acagcaaagccatat

SEQ ID NO: 6605769 - DNA, 23 bp, Homo sapiens
acagcaaagccatattctaaatt

SEQ ID NO: 6605770 - DNA, 10 bp, Homo sapiens
acagcaaatt

SEQ ID NO: 6605771 - DNA, 13 bp, Homo sapiens
acagcaaattaat

SEQ ID NO: 6605772 - DNA, 20 bp, Homo sapiens
acagcaacaatttatgaatt

SEQ ID NO: 6605773 - DNA, 17 bp, Homo sapiens
acagcaacacaaagctt

SEQ ID NO: 6605774 - DNA, 20 bp, Homo sapiens
acagcaacacaaagcttttg

SEQ ID NO: 6605775 - DNA, 17 bp, Homo sapiens
acagcaacactctactt

SEQ ID NO: 6605776 - DNA, 19 bp, Homo sapiens
acagcaacagcaagaaata

SEQ ID NO: 6605777 - DNA, 19 bp, Homo sapiens
acagcaacaggaatctcag

SEQ ID NO: 6605778 - DNA, 13 bp, Homo sapiens
acagcaacatttt

SEQ ID NO: 6605779 - DNA, 21 bp, Homo sapiens
acagcaacgatcacaaatgac

SEQ ID NO: 6605780 - DNA, 16 bp, Homo sapiens
acagcaagatgtttct

SEQ ID NO: 6605781 - DNA, 17 bp, Homo sapiens
acagcaagccggccccc

SEQ ID NO: 6605782 - DNA, 13 bp, Homo sapiens
acagcaaggaaac

SEQ ID NO: 6605783 - DNA, 17 bp, Homo sapiens
acagcaaggaggctggc

SEQ ID NO: 6605784 - DNA, 21 bp, Homo sapiens
acagcaaggaggctggctggg

SEQ ID NO: 6605785 - DNA, 23 bp, Homo sapiens
acagcaaggtgtggaggctcctg

SEQ ID NO: 6605786 - DNA, 19 bp, Homo sapiens
acagcaagtacagcggctc

SEQ ID NO: 6605787 - DNA, 12 bp, Homo sapiens
acagcaagtcag

SEQ ID NO: 6605788 - DNA, 16 bp, Homo sapiens
acagcaagtgagcaga

SEQ ID NO: 6605789 - DNA, 16 bp, Homo sapiens
acagcaatatttaaca

SEQ ID NO: 6605790 - DNA, 21 bp, Homo sapiens
acagcaatctgtgtactgaac

SEQ ID NO: 6605791 - DNA, 22 bp, Homo sapiens
acagcaattaataatgtttata

SEQ ID NO: 6605792 - DNA, 17 bp, Homo sapiens
acagcaattcatggttc

SEQ ID NO: 6605793 - DNA, 23 bp, Homo sapiens
acagcaattcatggttcaagtat

SEQ ID NO: 6605794 - DNA, 15 bp, Homo sapiens
acagcaattcctcag

SEQ ID NO: 6605795 - DNA, 22 bp, Homo sapiens
acagcaattttcataataaaag

SEQ ID NO: 6605796 - DNA, 14 bp, Homo sapiens
acagcacaaacaca

SEQ ID NO: 6605797 - DNA, 16 bp, Homo sapiens
acagcacaaccggtcc

SEQ ID NO: 6605798 - DNA, 14 bp, Homo sapiens
acagcacaccagcc

SEQ ID NO: 6605799 - DNA, 21 bp, Homo sapiens
acagcacagagaagacaaaat

SEQ ID NO: 6605800 - DNA, 14 bp, Homo sapiens
acagcacagatgtg

SEQ ID NO: 6605801 - DNA, 17 bp, Homo sapiens
acagcacagatgtgaag

SEQ ID NO: 6605802 - DNA, 12 bp, Homo sapiens
acagcacaggca

SEQ ID NO: 6605803 - DNA, 12 bp, Homo sapiens
acagcacatgct

SEQ ID NO: 6605804 - DNA, 18 bp, Homo sapiens
acagcacatgctggccag

SEQ ID NO: 6605805 - DNA, 21 bp, Homo sapiens
acagcacatgctggccagcct

SEQ ID NO: 6605806 - DNA, 15 bp, Homo sapiens
acagcacatttgtta

SEQ ID NO: 6605807 - DNA, 23 bp, Homo sapiens
acagcaccaccatttaatttcat

SEQ ID NO: 6605808 - DNA, 12 bp, Homo sapiens
acagcacccagg

SEQ ID NO: 6605809 - DNA, 19 bp, Homo sapiens
acagcaccgggggagaggg

SEQ ID NO: 6605810 - DNA, 19 bp, Homo sapiens
acagcacgggggccaagga

SEQ ID NO: 6605811 - DNA, 20 bp, Homo sapiens
acagcactactctgtgccag

SEQ ID NO: 6605812 - DNA, 16 bp, Homo sapiens
acagcactactgggtg

SEQ ID NO: 6605813 - DNA, 22 bp, Homo sapiens
acagcactactgggtgtcattt

SEQ ID NO: 6605814 - DNA, 15 bp, Homo sapiens
acagcactcctcggc

SEQ ID NO: 6605815 - DNA, 17 bp, Homo sapiens
acagcactcctcggcag

SEQ ID NO: 6605816 - DNA, 12 bp, Homo sapiens
acagcactgcct

SEQ ID NO: 6605817 - DNA, 16 bp, Homo sapiens
acagcacttcaaagaa

SEQ ID NO: 6605818 - DNA, 12 bp, Homo sapiens
acagcacttgtt

SEQ ID NO: 6605819 - DNA, 16 bp, Homo sapiens
acagcactttggtttt

SEQ ID NO: 6605820 - DNA, 19 bp, Homo sapiens
acagcacttttcctcttct

SEQ ID NO: 6605821 - DNA, 13 bp, Homo sapiens
acagcagaaagac

SEQ ID NO: 6605822 - DNA, 12 bp, Homo sapiens
acagcagaagcc

SEQ ID NO: 6605823 - DNA, 13 bp, Homo sapiens
acagcagaagcct

SEQ ID NO: 6605824 - DNA, 21 bp, Homo sapiens
acagcagacaccattcattcc

SEQ ID NO: 6605825 - DNA, 13 bp, Homo sapiens
acagcagactcag

SEQ ID NO: 6605826 - DNA, 19 bp, Homo sapiens
acagcagactcagctctga

SEQ ID NO: 6605827 - DNA, 17 bp, Homo sapiens
acagcagagccatctgc

SEQ ID NO: 6605828 - DNA, 21 bp, Homo sapiens
acagcagataacaatgcagca

SEQ ID NO: 6605829 - DNA, 18 bp, Homo sapiens
acagcagatccacctgca

SEQ ID NO: 6605830 - DNA, 19 bp, Homo sapiens
acagcagattccacaggac

SEQ ID NO: 6605831 - DNA, 17 bp, Homo sapiens
acagcagcaagaaaaaa

SEQ ID NO: 6605832 - DNA, 17 bp, Homo sapiens
acagcagcacccaccca

SEQ ID NO: 6605833 - DNA, 17 bp, Homo sapiens
acagcagcagcctgcac

SEQ ID NO: 6605834 - DNA, 13 bp, Homo sapiens
acagcagcagctc

SEQ ID NO: 6605835 - DNA, 18 bp, Homo sapiens
acagcagccccaggagaa

SEQ ID NO: 6605836 - DNA, 19 bp, Homo sapiens
acagcagccccccagcact

SEQ ID NO: 6605837 - DNA, 17 bp, Homo sapiens
acagcagcccctgcaca

SEQ ID NO: 6605838 - DNA, 17 bp, Homo sapiens
acagcagcctctgaagt

SEQ ID NO: 6605839 - DNA, 18 bp, Homo sapiens
acagcagcctctgaagtt

SEQ ID NO: 6605840 - DNA, 14 bp, Homo sapiens
acagcagcctgtat

SEQ ID NO: 6605841 - DNA, 17 bp, Homo sapiens
acagcagcctgtatgtg

SEQ ID NO: 6605842 - DNA, 14 bp, Homo sapiens
acagcagcctgtga

SEQ ID NO: 6605843 - DNA, 15 bp, Homo sapiens
acagcagcctgtgag

SEQ ID NO: 6605844 - DNA, 14 bp, Homo sapiens
acagcagcgcagcc

SEQ ID NO: 6605845 - DNA, 14 bp, Homo sapiens
acagcagctcaggc

SEQ ID NO: 6605846 - DNA, 12 bp, Homo sapiens
acagcagctcca

SEQ ID NO: 6605847 - DNA, 13 bp, Homo sapiens
acagcagctccaa

SEQ ID NO: 6605848 - DNA, 17 bp, Homo sapiens
acagcagctctgtcccc

SEQ ID NO: 6605849 - DNA, 14 bp, Homo sapiens
acagcagctgaaca

SEQ ID NO: 6605850 - DNA, 16 bp, Homo sapiens
acagcagctgcagggg

SEQ ID NO: 6605851 - DNA, 14 bp, Homo sapiens
acagcagctggact

SEQ ID NO: 6605852 - DNA, 15 bp, Homo sapiens
acagcagctggactg

SEQ ID NO: 6605853 - DNA, 21 bp, Homo sapiens
acagcagctggtgccccacct

SEQ ID NO: 6605854 - DNA, 16 bp, Homo sapiens
acagcagcttcaccag

SEQ ID NO: 6605855 - DNA, 17 bp, Homo sapiens
acagcagcttcaccaga

SEQ ID NO: 6605856 - DNA, 18 bp, Homo sapiens
acagcaggacctgtgctt

SEQ ID NO: 6605857 - DNA, 19 bp, Homo sapiens
acagcaggactgaggacag

SEQ ID NO: 6605858 - DNA, 15 bp, Homo sapiens
acagcaggaggcaca

SEQ ID NO: 6605859 - DNA, 16 bp, Homo sapiens
acagcaggaggcacag

SEQ ID NO: 6605860 - DNA, 18 bp, Homo sapiens
acagcaggaggcacagca

SEQ ID NO: 6605861 - DNA, 21 bp, Homo sapiens
acagcaggatcgaagggtttt

SEQ ID NO: 6605862 - DNA, 17 bp, Homo sapiens
acagcaggccactagtg

SEQ ID NO: 6605863 - DNA, 18 bp, Homo sapiens
acagcaggccactagtga

SEQ ID NO: 6605864 - DNA, 15 bp, Homo sapiens
acagcaggcccacct

SEQ ID NO: 6605865 - DNA, 19 bp, Homo sapiens
acagcaggcccacctacct

SEQ ID NO: 6605866 - DNA, 14 bp, Homo sapiens
acagcaggctgcca

SEQ ID NO: 6605867 - DNA, 16 bp, Homo sapiens
acagcaggctgccagt

SEQ ID NO: 6605868 - DNA, 22 bp, Homo sapiens
acagcaggggagccctgatttt

SEQ ID NO: 6605869 - DNA, 18 bp, Homo sapiens
acagcagggtcttgctgt

SEQ ID NO: 6605870 - DNA, 16 bp, Homo sapiens
acagcagggtttgagc

SEQ ID NO: 6605871 - DNA, 19 bp, Homo sapiens
acagcagggtttgagcaca

SEQ ID NO: 6605872 - DNA, 17 bp, Homo sapiens
acagcagtaatcctggg

SEQ ID NO: 6605873 - DNA, 17 bp, Homo sapiens
acagcagtacttgctca

SEQ ID NO: 6605874 - DNA, 13 bp, Homo sapiens
acagcagtagaca

SEQ ID NO: 6605875 - DNA, 17 bp, Homo sapiens
acagcagtcacaggccc

SEQ ID NO: 6605876 - DNA, 20 bp, Homo sapiens
acagcagtcacaggcccagg

SEQ ID NO: 6605877 - DNA, 22 bp, Homo sapiens
acagcagtcttcttcacccgct

SEQ ID NO: 6605878 - DNA, 21 bp, Homo sapiens
acagcagtgagactggggcca

SEQ ID NO: 6605879 - DNA, 21 bp, Homo sapiens
acagcagtgatctcagggcag

SEQ ID NO: 6605880 - DNA, 22 bp, Homo sapiens
acagcagtgatctcagggcaga

SEQ ID NO: 6605881 - DNA, 16 bp, Homo sapiens
acagcagtgtcatcag

SEQ ID NO: 6605882 - DNA, 14 bp, Homo sapiens
acagcagtgtcccc

SEQ ID NO: 6605883 - DNA, 21 bp, Homo sapiens
acagcagtgtcccctgcccca

SEQ ID NO: 6605884 - DNA, 16 bp, Homo sapiens
acagcagtgtgagggt

SEQ ID NO: 6605885 - DNA, 12 bp, Homo sapiens
acagcagtgtgg

SEQ ID NO: 6605886 - DNA, 22 bp, Homo sapiens
acagcagttgaaaagactccaa

SEQ ID NO: 6605887 - DNA, 16 bp, Homo sapiens
acagcagtttcaggta

SEQ ID NO: 6605888 - DNA, 22 bp, Homo sapiens
acagcataacaaggtccaagat

SEQ ID NO: 6605889 - DNA, 22 bp, Homo sapiens
acagcatatgatttcttgcttt

SEQ ID NO: 6605890 - DNA, 21 bp, Homo sapiens
acagcatccccaaaacaaagt

SEQ ID NO: 6605891 - DNA, 12 bp, Homo sapiens
acagcatcctct

SEQ ID NO: 6605892 - DNA, 14 bp, Homo sapiens
acagcatcctctct

SEQ ID NO: 6605893 - DNA, 14 bp, Homo sapiens
acagcatctcagct

SEQ ID NO: 6605894 - DNA, 22 bp, Homo sapiens
acagcatctccaagcagcttag

SEQ ID NO: 6605895 - DNA, 20 bp, Homo sapiens
acagcatctgttacggttaa

SEQ ID NO: 6605896 - DNA, 15 bp, Homo sapiens
acagcatgaataaaa

SEQ ID NO: 6605897 - DNA, 23 bp, Homo sapiens
acagcatgaataaaacactcatc

SEQ ID NO: 6605898 - DNA, 20 bp, Homo sapiens
acagcatgagaggctctgtg

SEQ ID NO: 6605899 - DNA, 18 bp, Homo sapiens
acagcatgagattgtaca

SEQ ID NO: 6605900 - DNA, 13 bp, Homo sapiens
acagcatgcccct

SEQ ID NO: 6605901 - DNA, 15 bp, Homo sapiens
acagcatgccccttg

SEQ ID NO: 6605902 - DNA, 17 bp, Homo sapiens
acagcatgccccttggc

SEQ ID NO: 6605903 - DNA, 19 bp, Homo sapiens
acagcatgccccttggctg

SEQ ID NO: 6605904 - DNA, 16 bp, Homo sapiens
acagcatggaaaaggt

SEQ ID NO: 6605905 - DNA, 17 bp, Homo sapiens
acagcatggcactccct

SEQ ID NO: 6605906 - DNA, 12 bp, Homo sapiens
acagcatgtgca

SEQ ID NO: 6605907 - DNA, 15 bp, Homo sapiens
acagcatgtgccctc

SEQ ID NO: 6605908 - DNA, 16 bp, Homo sapiens
acagcatgtgccctcc

SEQ ID NO: 6605909 - DNA, 22 bp, Homo sapiens
acagcatgtgctcagccccaga

SEQ ID NO: 6605910 - DNA, 23 bp, Homo sapiens
acagcatgtgggtgtcagtgtca

SEQ ID NO: 6605911 - DNA, 13 bp, Homo sapiens
acagcatgtgtat

SEQ ID NO: 6605912 - DNA, 12 bp, Homo sapiens
acagcattagat

SEQ ID NO: 6605913 - DNA, 16 bp, Homo sapiens
acagcattcctccatc

SEQ ID NO: 6605914 - DNA, 19 bp, Homo sapiens
acagcattcttgtcacaat

SEQ ID NO: 6605915 - DNA, 19 bp, Homo sapiens
acagcattgatctcctgga

SEQ ID NO: 6605916 - DNA, 15 bp, Homo sapiens
acagcattgctttct

SEQ ID NO: 6605917 - DNA, 20 bp, Homo sapiens
acagcattggcctggccaga

SEQ ID NO: 6605918 - DNA, 13 bp, Homo sapiens
acagcattgtctt

SEQ ID NO: 6605919 - DNA, 14 bp, Homo sapiens
acagcattgtcttt

SEQ ID NO: 6605920 - DNA, 17 bp, Homo sapiens
acagcattgtgtggaat

SEQ ID NO: 6605921 - DNA, 19 bp, Homo sapiens
acagcatttgctttcctct

SEQ ID NO: 6605922 - DNA, 21 bp, Homo sapiens
acagcatttgctttcctctga

SEQ ID NO: 6605923 - DNA, 20 bp, Homo sapiens
acagcattttaaggttctca

SEQ ID NO: 6605924 - DNA, 22 bp, Homo sapiens
acagcattttaaggttctcaga

SEQ ID NO: 6605925 - DNA, 19 bp, Homo sapiens
acagcattttcctctgctt

SEQ ID NO: 6605926 - DNA, 21 bp, Homo sapiens
acagccaaagaaactcagaag

SEQ ID NO: 6605927 - DNA, 20 bp, Homo sapiens
acagccaacacgcacctgcc

SEQ ID NO: 6605928 - DNA, 18 bp, Homo sapiens
acagccaacgagacacat

SEQ ID NO: 6605929 - DNA, 18 bp, Homo sapiens
acagccaactagcccctg

SEQ ID NO: 6605930 - DNA, 20 bp, Homo sapiens
acagccaactagcccctggg

SEQ ID NO: 6605931 - DNA, 17 bp, Homo sapiens
acagccaagcccaccct

SEQ ID NO: 6605932 - DNA, 20 bp, Homo sapiens
acagccaagcccaccctggg

SEQ ID NO: 6605933 - DNA, 21 bp, Homo sapiens
acagccaagcccaccctggga

SEQ ID NO: 6605934 - DNA, 23 bp, Homo sapiens
acagccaaggggatatttactgc

SEQ ID NO: 6605935 - DNA, 13 bp, Homo sapiens
acagccaagtgcc

SEQ ID NO: 6605936 - DNA, 18 bp, Homo sapiens
acagccaagtgccaaatg

SEQ ID NO: 6605937 - DNA, 12 bp, Homo sapiens
acagccaagtgt

SEQ ID NO: 6605938 - DNA, 13 bp, Homo sapiens
acagccacaaaat

SEQ ID NO: 6605939 - DNA, 11 bp, Homo sapiens
acagccacaca

SEQ ID NO: 6605940 - DNA, 12 bp, Homo sapiens
acagccacacac

SEQ ID NO: 6605941 - DNA, 15 bp, Homo sapiens
acagccacacacaca

SEQ ID NO: 6605942 - DNA, 16 bp, Homo sapiens
acagccacacacacag

SEQ ID NO: 6605943 - DNA, 17 bp, Homo sapiens
acagccacacacacaga

SEQ ID NO: 6605944 - DNA, 21 bp, Homo sapiens
acagccacacacacagaaaat

SEQ ID NO: 6605945 - DNA, 19 bp, Homo sapiens
acagccacaccgtggcagc

SEQ ID NO: 6605946 - DNA, 16 bp, Homo sapiens
acagccaccacctgga

SEQ ID NO: 6605947 - DNA, 14 bp, Homo sapiens
acagccaccctcac

SEQ ID NO: 6605948 - DNA, 22 bp, Homo sapiens
acagccaccctgcccagtctgg

SEQ ID NO: 6605949 - DNA, 12 bp, Homo sapiens
acagccacctcc

SEQ ID NO: 6605950 - DNA, 13 bp, Homo sapiens
acagccacctcca

SEQ ID NO: 6605951 - DNA, 22 bp, Homo sapiens
acagccacctccacccccaaga

SEQ ID NO: 6605952 - DNA, 17 bp, Homo sapiens
acagccacctccgccag

SEQ ID NO: 6605953 - DNA, 14 bp, Homo sapiens
acagccactcagaa

SEQ ID NO: 6605954 - DNA, 20 bp, Homo sapiens
acagccactcccctccactc

SEQ ID NO: 6605955 - DNA, 13 bp, Homo sapiens
acagccagaagcc

SEQ ID NO: 6605956 - DNA, 24 bp, Homo sapiens
acagccagaaggggctgcttgctt

SEQ ID NO: 6605957 - DNA, 16 bp, Homo sapiens
acagccagactggcac

SEQ ID NO: 6605958 - DNA, 15 bp, Homo sapiens
acagccagagcctgt

SEQ ID NO: 6605959 - DNA, 17 bp, Homo sapiens
acagccagagcctgtct

SEQ ID NO: 6605960 - DNA, 12 bp, Homo sapiens
acagccagagga

SEQ ID NO: 6605961 - DNA, 13 bp, Homo sapiens
acagccagaggag

SEQ ID NO: 6605962 - DNA, 14 bp, Homo sapiens
acagccagcccagc

SEQ ID NO: 6605963 - DNA, 15 bp, Homo sapiens
acagccagcccagct

SEQ ID NO: 6605964 - DNA, 21 bp, Homo sapiens
acagccaggtggcacctgcag

SEQ ID NO: 6605965 - DNA, 20 bp, Homo sapiens
acagccagtaaggcagctct

SEQ ID NO: 6605966 - DNA, 14 bp, Homo sapiens
acagccatacttcc

SEQ ID NO: 6605967 - DNA, 22 bp, Homo sapiens
acagccatacttccagcgaaat

SEQ ID NO: 6605968 - DNA, 15 bp, Homo sapiens
acagccatcccagcc

SEQ ID NO: 6605969 - DNA, 15 bp, Homo sapiens
acagccatgcgtggc

SEQ ID NO: 6605970 - DNA, 18 bp, Homo sapiens
acagccatgcgtggccac

SEQ ID NO: 6605971 - DNA, 22 bp, Homo sapiens
acagccattcatctgggctggc

SEQ ID NO: 6605972 - DNA, 22 bp, Homo sapiens
acagccattgcggccccaggag

SEQ ID NO: 6605973 - DNA, 13 bp, Homo sapiens
acagccatttcaa

SEQ ID NO: 6605974 - DNA, 17 bp, Homo sapiens
acagccatttgtaatga

SEQ ID NO: 6605975 - DNA, 20 bp, Homo sapiens
acagccatttgtaatgaatt

SEQ ID NO: 6605976 - DNA, 20 bp, Homo sapiens
acagccattttgtttttaat

SEQ ID NO: 6605977 - DNA, 16 bp, Homo sapiens
acagcccaaagaagga

SEQ ID NO: 6605978 - DNA, 17 bp, Homo sapiens
acagcccaaagaaggaa

SEQ ID NO: 6605979 - DNA, 18 bp, Homo sapiens
acagcccaaagaaggaaa

SEQ ID NO: 6605980 - DNA, 18 bp, Homo sapiens
acagcccaaccaggaggg

SEQ ID NO: 6605981 - DNA, 16 bp, Homo sapiens
acagcccaccctctgt

SEQ ID NO: 6605982 - DNA, 20 bp, Homo sapiens
acagcccacgtcctgtcagt

SEQ ID NO: 6605983 - DNA, 14 bp, Homo sapiens
acagcccagaacca

SEQ ID NO: 6605984 - DNA, 22 bp, Homo sapiens
acagcccagaaccacagatgtg

SEQ ID NO: 6605985 - DNA, 16 bp, Homo sapiens
acagcccagaaggcca

SEQ ID NO: 6605986 - DNA, 16 bp, Homo sapiens
acagcccagccacgga

SEQ ID NO: 6605987 - DNA, 14 bp, Homo sapiens
acagcccagcctag

SEQ ID NO: 6605988 - DNA, 19 bp, Homo sapiens
acagcccagcgccatcctg

SEQ ID NO: 6605989 - DNA, 20 bp, Homo sapiens
acagcccaggatactggcac

SEQ ID NO: 6605990 - DNA, 15 bp, Homo sapiens
acagcccaggcctcc

SEQ ID NO: 6605991 - DNA, 20 bp, Homo sapiens
acagcccaggcctccagctc

SEQ ID NO: 6605992 - DNA, 21 bp, Homo sapiens
acagcccaggcctccagctca

SEQ ID NO: 6605993 - DNA, 15 bp, Homo sapiens
acagcccagggcctg

SEQ ID NO: 6605994 - DNA, 17 bp, Homo sapiens
acagcccatcacctcta

SEQ ID NO: 6605995 - DNA, 13 bp, Homo sapiens
acagccccacagc

SEQ ID NO: 6605996 - DNA, 15 bp, Homo sapiens
acagccccacagcac

SEQ ID NO: 6605997 - DNA, 14 bp, Homo sapiens
acagccccaccctt

SEQ ID NO: 6605998 - DNA, 14 bp, Homo sapiens
acagccccagggcc

SEQ ID NO: 6605999 - DNA, 14 bp, Homo sapiens
acagcccccacccc

SEQ ID NO: 6606000 - DNA, 19 bp, Homo sapiens
acagcccccaccccagcac

SEQ ID NO: 6606001 - DNA, 17 bp, Homo sapiens
acagcccccactccagt

SEQ ID NO: 6606002 - DNA, 16 bp, Homo sapiens
acagcccccgggacac

SEQ ID NO: 6606003 - DNA, 15 bp, Homo sapiens
acagccccctgcccc

SEQ ID NO: 6606004 - DNA, 11 bp, Homo sapiens
acagccccctt

SEQ ID NO: 6606005 - DNA, 20 bp, Homo sapiens
acagcccccttgccctccgc

SEQ ID NO: 6606006 - DNA, 14 bp, Homo sapiens
acagcccctggagc

SEQ ID NO: 6606007 - DNA, 16 bp, Homo sapiens
acagcccctggcactg

SEQ ID NO: 6606008 - DNA, 17 bp, Homo sapiens
acagccccttgcttcta

SEQ ID NO: 6606009 - DNA, 16 bp, Homo sapiens
acagcccgatcctccc

SEQ ID NO: 6606010 - DNA, 21 bp, Homo sapiens
acagcccgatcctcccctgga

SEQ ID NO: 6606011 - DNA, 15 bp, Homo sapiens
acagcccgcatgcag

SEQ ID NO: 6606012 - DNA, 20 bp, Homo sapiens
acagcccgcatgcagcagct

SEQ ID NO: 6606013 - DNA, 13 bp, Homo sapiens
acagcccgggagc

SEQ ID NO: 6606014 - DNA, 22 bp, Homo sapiens
acagcccgggctctgcctccca

SEQ ID NO: 6606015 - DNA, 18 bp, Homo sapiens
acagccctatttcttgat

SEQ ID NO: 6606016 - DNA, 23 bp, Homo sapiens
acagccctccatctaaactgccc

SEQ ID NO: 6606017 - DNA, 15 bp, Homo sapiens
acagccctcccgccc

SEQ ID NO: 6606018 - DNA, 18 bp, Homo sapiens
acagccctcccgcccctt

SEQ ID NO: 6606019 - DNA, 21 bp, Homo sapiens
acagccctgaaacgagaagtg

SEQ ID NO: 6606020 - DNA, 21 bp, Homo sapiens
acagccctgagtgtcccaagc

SEQ ID NO: 6606021 - DNA, 13 bp, Homo sapiens
acagccctgccta

SEQ ID NO: 6606022 - DNA, 15 bp, Homo sapiens
acagccctgcctgag

SEQ ID NO: 6606023 - DNA, 10 bp, Homo sapiens
acagccctgg

SEQ ID NO: 6606024 - DNA, 12 bp, Homo sapiens
acagccctggca

SEQ ID NO: 6606025 - DNA, 12 bp, Homo sapiens
acagccctggga

SEQ ID NO: 6606026 - DNA, 13 bp, Homo sapiens
acagccctgggag

SEQ ID NO: 6606027 - DNA, 17 bp, Homo sapiens
acagccctgtcagcatg

SEQ ID NO: 6606028 - DNA, 18 bp, Homo sapiens
acagccctgtcagcatga

SEQ ID NO: 6606029 - DNA, 21 bp, Homo sapiens
acagccctgtcagcatgaatt

SEQ ID NO: 6606030 - DNA, 19 bp, Homo sapiens
acagcccttccttggggaa

SEQ ID NO: 6606031 - DNA, 20 bp, Homo sapiens
acagcccttctttccacaga

SEQ ID NO: 6606032 - DNA, 15 bp, Homo sapiens
acagcccttttgtct

SEQ ID NO: 6606033 - DNA, 19 bp, Homo sapiens
acagccgcgggccaggagg

SEQ ID NO: 6606034 - DNA, 13 bp, Homo sapiens
acagccgctccag

SEQ ID NO: 6606035 - DNA, 15 bp, Homo sapiens
acagccgctccagag

SEQ ID NO: 6606036 - DNA, 14 bp, Homo sapiens
acagccgctcctgt

SEQ ID NO: 6606037 - DNA, 24 bp, Homo sapiens
acagccgctcctgtctgccagcca

SEQ ID NO: 6606038 - DNA, 20 bp, Homo sapiens
acagccggtcagaggagcgc

SEQ ID NO: 6606039 - DNA, 17 bp, Homo sapiens
acagccgtcagccaaat

SEQ ID NO: 6606040 - DNA, 20 bp, Homo sapiens
acagccgtcagccaaatgta

SEQ ID NO: 6606041 - DNA, 22 bp, Homo sapiens
acagcctaggaccagttttgta

SEQ ID NO: 6606042 - DNA, 18 bp, Homo sapiens
acagcctatagtaaatgt

SEQ ID NO: 6606043 - DNA, 14 bp, Homo sapiens
acagcctcacagaa

SEQ ID NO: 6606044 - DNA, 15 bp, Homo sapiens
acagcctcacccctg

SEQ ID NO: 6606045 - DNA, 19 bp, Homo sapiens
acagcctcacccctgcagg

SEQ ID NO: 6606046 - DNA, 14 bp, Homo sapiens
acagcctcacttgg

SEQ ID NO: 6606047 - DNA, 22 bp, Homo sapiens
acagcctcacttggtctgccag

SEQ ID NO: 6606048 - DNA, 23 bp, Homo sapiens
acagcctcacttggtctgccagg

SEQ ID NO: 6606049 - DNA, 16 bp, Homo sapiens
acagcctccccaccca

SEQ ID NO: 6606050 - DNA, 12 bp, Homo sapiens
acagcctccccc

SEQ ID NO: 6606051 - DNA, 12 bp, Homo sapiens
acagcctcccct

SEQ ID NO: 6606052 - DNA, 21 bp, Homo sapiens
acagcctcccctgccagggca

SEQ ID NO: 6606053 - DNA, 22 bp, Homo sapiens
acagcctcccctgccagggcag

SEQ ID NO: 6606054 - DNA, 13 bp, Homo sapiens
acagcctcccctt

SEQ ID NO: 6606055 - DNA, 15 bp, Homo sapiens
acagcctccccttcc

SEQ ID NO: 6606056 - DNA, 18 bp, Homo sapiens
acagcctccccttcccag

SEQ ID NO: 6606057 - DNA, 14 bp, Homo sapiens
acagcctccctgag

SEQ ID NO: 6606058 - DNA, 19 bp, Homo sapiens
acagcctccgccaagatct

SEQ ID NO: 6606059 - DNA, 13 bp, Homo sapiens
acagcctcctagg

SEQ ID NO: 6606060 - DNA, 14 bp, Homo sapiens
acagcctcctaggc

SEQ ID NO: 6606061 - DNA, 21 bp, Homo sapiens
acagcctcctaggctccctga

SEQ ID NO: 6606062 - DNA, 17 bp, Homo sapiens
acagcctcctctgtctg

SEQ ID NO: 6606063 - DNA, 19 bp, Homo sapiens
acagcctcctctgtctgcc

SEQ ID NO: 6606064 - DNA, 13 bp, Homo sapiens
acagcctcgggga

SEQ ID NO: 6606065 - DNA, 14 bp, Homo sapiens
acagcctcggggat

SEQ ID NO: 6606066 - DNA, 21 bp, Homo sapiens
acagcctcggggatggggagg

SEQ ID NO: 6606067 - DNA, 22 bp, Homo sapiens
acagcctcggggatggggaggg

SEQ ID NO: 6606068 - DNA, 12 bp, Homo sapiens
acagcctctatc

SEQ ID NO: 6606069 - DNA, 17 bp, Homo sapiens
acagcctctctcttttc

SEQ ID NO: 6606070 - DNA, 12 bp, Homo sapiens
acagcctctgac

SEQ ID NO: 6606071 - DNA, 16 bp, Homo sapiens
acagcctctggctcca

SEQ ID NO: 6606072 - DNA, 17 bp, Homo sapiens
acagcctctggctccac

SEQ ID NO: 6606073 - DNA, 18 bp, Homo sapiens
acagcctctggctccaca

SEQ ID NO: 6606074 - DNA, 22 bp, Homo sapiens
acagcctctggctccacacctc

SEQ ID NO: 6606075 - DNA, 15 bp, Homo sapiens
acagcctcttcagcc

SEQ ID NO: 6606076 - DNA, 22 bp, Homo sapiens
acagcctcttcagccccttctc

SEQ ID NO: 6606077 - DNA, 12 bp, Homo sapiens
acagcctcttcc

SEQ ID NO: 6606078 - DNA, 14 bp, Homo sapiens
acagcctcttgccc

SEQ ID NO: 6606079 - DNA, 18 bp, Homo sapiens
acagcctgaataaaccaa

SEQ ID NO: 6606080 - DNA, 22 bp, Homo sapiens
acagcctgaataaaccaagaca

SEQ ID NO: 6606081 - DNA, 11 bp, Homo sapiens
acagcctgaga

SEQ ID NO: 6606082 - DNA, 12 bp, Homo sapiens
acagcctgagaa

SEQ ID NO: 6606083 - DNA, 13 bp, Homo sapiens
acagcctgagccg

SEQ ID NO: 6606084 - DNA, 15 bp, Homo sapiens
acagcctgcaagtca

SEQ ID NO: 6606085 - DNA, 13 bp, Homo sapiens
acagcctgcacag

SEQ ID NO: 6606086 - DNA, 15 bp, Homo sapiens
acagcctgcctctgc

SEQ ID NO: 6606087 - DNA, 12 bp, Homo sapiens
acagcctgctgg

SEQ ID NO: 6606088 - DNA, 17 bp, Homo sapiens
acagcctgctggcaggg

SEQ ID NO: 6606089 - DNA, 21 bp, Homo sapiens
acagcctgctggcagggccag

SEQ ID NO: 6606090 - DNA, 15 bp, Homo sapiens
acagcctggcacagg

SEQ ID NO: 6606091 - DNA, 13 bp, Homo sapiens
acagcctggcctc

SEQ ID NO: 6606092 - DNA, 22 bp, Homo sapiens
acagcctggcctcccctgcgga

SEQ ID NO: 6606093 - DNA, 23 bp, Homo sapiens
acagcctggcctcccctgcggag

SEQ ID NO: 6606094 - DNA, 18 bp, Homo sapiens
acagcctgggaccagggc

SEQ ID NO: 6606095 - DNA, 13 bp, Homo sapiens
acagcctgggggg

SEQ ID NO: 6606096 - DNA, 19 bp, Homo sapiens
acagcctgggtaggaaaat

SEQ ID NO: 6606097 - DNA, 16 bp, Homo sapiens
acagcctggttttcac

SEQ ID NO: 6606098 - DNA, 16 bp, Homo sapiens
acagcctgtgtgcagt

SEQ ID NO: 6606099 - DNA, 21 bp, Homo sapiens
acagcctgtttctatcctgtt

SEQ ID NO: 6606100 - DNA, 16 bp, Homo sapiens
acagccttagctgcca

SEQ ID NO: 6606101 - DNA, 18 bp, Homo sapiens
acagccttagctgccagt

SEQ ID NO: 6606102 - DNA, 21 bp, Homo sapiens
acagccttagctgccagtgct

SEQ ID NO: 6606103 - DNA, 10 bp, Homo sapiens
acagccttca

SEQ ID NO: 6606104 - DNA, 13 bp, Homo sapiens
acagccttcccca

SEQ ID NO: 6606105 - DNA, 15 bp, Homo sapiens
acagccttccttctg

SEQ ID NO: 6606106 - DNA, 19 bp, Homo sapiens
acagccttccttctgctcc

SEQ ID NO: 6606107 - DNA, 19 bp, Homo sapiens
acagccttgcagcggctcc

SEQ ID NO: 6606108 - DNA, 23 bp, Homo sapiens
acagccttgcagcggctcctgca

SEQ ID NO: 6606109 - DNA, 14 bp, Homo sapiens
acagccttggctcc

SEQ ID NO: 6606110 - DNA, 16 bp, Homo sapiens
acagccttggctcctg

SEQ ID NO: 6606111 - DNA, 19 bp, Homo sapiens
acagccttgggcctttcag

SEQ ID NO: 6606112 - DNA, 14 bp, Homo sapiens
acagcctttctgag

SEQ ID NO: 6606113 - DNA, 15 bp, Homo sapiens
acagcctttgaatgt

SEQ ID NO: 6606114 - DNA, 19 bp, Homo sapiens
acagcctttgaatgtaacc

SEQ ID NO: 6606115 - DNA, 21 bp, Homo sapiens
acagccttttttcctgggcca

SEQ ID NO: 6606116 - DNA, 20 bp, Homo sapiens
acagcgacatagcccatccc

SEQ ID NO: 6606117 - DNA, 20 bp, Homo sapiens
acagcgacgctcccctgaga

SEQ ID NO: 6606118 - DNA, 21 bp, Homo sapiens
acagcgagaaaacttcgtaag

SEQ ID NO: 6606119 - DNA, 18 bp, Homo sapiens
acagcgagactccgtctc

SEQ ID NO: 6606120 - DNA, 12 bp, Homo sapiens
acagcgagcctg

SEQ ID NO: 6606121 - DNA, 18 bp, Homo sapiens
acagcgagcctgtgcctt

SEQ ID NO: 6606122 - DNA, 21 bp, Homo sapiens
acagcgagcctgtgccttcct

SEQ ID NO: 6606123 - DNA, 14 bp, Homo sapiens
acagcgagggcagc

SEQ ID NO: 6606124 - DNA, 19 bp, Homo sapiens
acagcgatggcaggcctga

SEQ ID NO: 6606125 - DNA, 20 bp, Homo sapiens
acagcgatggcaggcctgac

SEQ ID NO: 6606126 - DNA, 21 bp, Homo sapiens
acagcgatggcaggcctgacc

SEQ ID NO: 6606127 - DNA, 22 bp, Homo sapiens
acagcgatggcaggcctgaccc

SEQ ID NO: 6606128 - DNA, 18 bp, Homo sapiens
acagcgccagcctcagac

SEQ ID NO: 6606129 - DNA, 16 bp, Homo sapiens
acagcgcccctgctgt

SEQ ID NO: 6606130 - DNA, 17 bp, Homo sapiens
acagcgcccctgctgtc

SEQ ID NO: 6606131 - DNA, 14 bp, Homo sapiens
acagcgcctcctgg

SEQ ID NO: 6606132 - DNA, 15 bp, Homo sapiens
acagcgcctcctgga

SEQ ID NO: 6606133 - DNA, 17 bp, Homo sapiens
acagcgcgggcggaggc

SEQ ID NO: 6606134 - DNA, 16 bp, Homo sapiens
acagcgctgagcatgg

SEQ ID NO: 6606135 - DNA, 12 bp, Homo sapiens
acagcgctgggt

SEQ ID NO: 6606136 - DNA, 23 bp, Homo sapiens
acagcggaggagaccagctcaga

SEQ ID NO: 6606137 - DNA, 19 bp, Homo sapiens
acagcggcccggcccacgc

SEQ ID NO: 6606138 - DNA, 20 bp, Homo sapiens
acagcggcccggcccacgca

SEQ ID NO: 6606139 - DNA, 12 bp, Homo sapiens
acagcggccttg

SEQ ID NO: 6606140 - DNA, 19 bp, Homo sapiens
acagcggctcccctctgct

SEQ ID NO: 6606141 - DNA, 13 bp, Homo sapiens
acagcggctgcct

SEQ ID NO: 6606142 - DNA, 21 bp, Homo sapiens
acagcggctgcctcctgatgt

SEQ ID NO: 6606143 - DNA, 13 bp, Homo sapiens
acagcgggctgtg

SEQ ID NO: 6606144 - DNA, 22 bp, Homo sapiens
acagcggtcagatagcatcaga

SEQ ID NO: 6606145 - DNA, 14 bp, Homo sapiens
acagcggtcccagg

SEQ ID NO: 6606146 - DNA, 15 bp, Homo sapiens
acagcggttgtaaat

SEQ ID NO: 6606147 - DNA, 19 bp, Homo sapiens
acagcgtccctagcagtga

SEQ ID NO: 6606148 - DNA, 14 bp, Homo sapiens
acagcgtccctggc

SEQ ID NO: 6606149 - DNA, 17 bp, Homo sapiens
acagcgtccctggcgca

SEQ ID NO: 6606150 - DNA, 12 bp, Homo sapiens
acagcgtctgct

SEQ ID NO: 6606151 - DNA, 13 bp, Homo sapiens
acagcgtctgctc

SEQ ID NO: 6606152 - DNA, 23 bp, Homo sapiens
acagcgtctgctcataggacctg

SEQ ID NO: 6606153 - DNA, 17 bp, Homo sapiens
acagcgtttaagactgt

SEQ ID NO: 6606154 - DNA, 14 bp, Homo sapiens
acagcgtttttaac

SEQ ID NO: 6606155 - DNA, 22 bp, Homo sapiens
acagctaaatcatttgagattt

SEQ ID NO: 6606156 - DNA, 15 bp, Homo sapiens
acagctaacacacag

SEQ ID NO: 6606157 - DNA, 22 bp, Homo sapiens
acagctaaccacttcgcacaca

SEQ ID NO: 6606158 - DNA, 21 bp, Homo sapiens
acagctaataaaagtcagagc

SEQ ID NO: 6606159 - DNA, 23 bp, Homo sapiens
acagctaataaaagtcagagctc

SEQ ID NO: 6606160 - DNA, 17 bp, Homo sapiens
acagctaatagcatggt

SEQ ID NO: 6606161 - DNA, 20 bp, Homo sapiens
acagctaatcagcattctca

SEQ ID NO: 6606162 - DNA, 15 bp, Homo sapiens
acagctaatgggaca

SEQ ID NO: 6606163 - DNA, 16 bp, Homo sapiens
acagctaatgggacac

SEQ ID NO: 6606164 - DNA, 16 bp, Homo sapiens
acagctacaacagcct

SEQ ID NO: 6606165 - DNA, 18 bp, Homo sapiens
acagctacaacagcctca

SEQ ID NO: 6606166 - DNA, 14 bp, Homo sapiens
acagctacaaccct

SEQ ID NO: 6606167 - DNA, 24 bp, Homo sapiens
acagctacaaccctaccctggcag

SEQ ID NO: 6606168 - DNA, 13 bp, Homo sapiens
acagctacacaga

SEQ ID NO: 6606169 - DNA, 16 bp, Homo sapiens
acagctaccatgacaa

SEQ ID NO: 6606170 - DNA, 20 bp, Homo sapiens
acagctactaacctggagac

SEQ ID NO: 6606171 - DNA, 20 bp, Homo sapiens
acagctactcagtggggctg

SEQ ID NO: 6606172 - DNA, 22 bp, Homo sapiens
acagctactcagtggggctggc

SEQ ID NO: 6606173 - DNA, 23 bp, Homo sapiens
acagctactctccccacgagggc

SEQ ID NO: 6606174 - DNA, 16 bp, Homo sapiens
acagctacttctggga

SEQ ID NO: 6606175 - DNA, 22 bp, Homo sapiens
acagctacttctgggaaaaaca

SEQ ID NO: 6606176 - DNA, 21 bp, Homo sapiens
acagctacttggtttgtgttc

SEQ ID NO: 6606177 - DNA, 19 bp, Homo sapiens
acagctaggcatgcctggg

SEQ ID NO: 6606178 - DNA, 18 bp, Homo sapiens
acagctaggctgagatgc

SEQ ID NO: 6606179 - DNA, 19 bp, Homo sapiens
acagctagtgaagaccaga

SEQ ID NO: 6606180 - DNA, 23 bp, Homo sapiens
acagctagtgaagaccagagcag

SEQ ID NO: 6606181 - DNA, 22 bp, Homo sapiens
acagctatatcctgatgctgga

SEQ ID NO: 6606182 - DNA, 17 bp, Homo sapiens
acagctatatttgatta

SEQ ID NO: 6606183 - DNA, 22 bp, Homo sapiens
acagctatcgaacttcacaact

SEQ ID NO: 6606184 - DNA, 20 bp, Homo sapiens
acagctatctagatagctga

SEQ ID NO: 6606185 - DNA, 14 bp, Homo sapiens
acagctatgaagaa

SEQ ID NO: 6606186 - DNA, 17 bp, Homo sapiens
acagctattaaaatgta

SEQ ID NO: 6606187 - DNA, 15 bp, Homo sapiens
acagctatttaaggg

SEQ ID NO: 6606188 - DNA, 17 bp, Homo sapiens
acagctatttaaggggg

SEQ ID NO: 6606189 - DNA, 23 bp, Homo sapiens
acagctcaactcgggggcgcctg

SEQ ID NO: 6606190 - DNA, 20 bp, Homo sapiens
acagctcaagtcttccctga

SEQ ID NO: 6606191 - DNA, 23 bp, Homo sapiens
acagctcaagtcttccctgatca

SEQ ID NO: 6606192 - DNA, 16 bp, Homo sapiens
acagctcactgcagcc

SEQ ID NO: 6606193 - DNA, 19 bp, Homo sapiens
acagctcagcagacatcca

SEQ ID NO: 6606194 - DNA, 13 bp, Homo sapiens
acagctcagctgc

SEQ ID NO: 6606195 - DNA, 15 bp, Homo sapiens
acagctcagctgccc

SEQ ID NO: 6606196 - DNA, 16 bp, Homo sapiens
acagctcagctgccca

SEQ ID NO: 6606197 - DNA, 21 bp, Homo sapiens
acagctcaggatctcttagca

SEQ ID NO: 6606198 - DNA, 17 bp, Homo sapiens
acagctcattaaacttt

SEQ ID NO: 6606199 - DNA, 18 bp, Homo sapiens
acagctcattcgctccag

SEQ ID NO: 6606200 - DNA, 15 bp, Homo sapiens
acagctccaagaatt

SEQ ID NO: 6606201 - DNA, 16 bp, Homo sapiens
acagctccacacgccc

SEQ ID NO: 6606202 - DNA, 18 bp, Homo sapiens
acagctccacacgccccg

SEQ ID NO: 6606203 - DNA, 14 bp, Homo sapiens
acagctccaggaca

SEQ ID NO: 6606204 - DNA, 16 bp, Homo sapiens
acagctccatacttct

SEQ ID NO: 6606205 - DNA, 19 bp, Homo sapiens
acagctcccaaacggaaga

SEQ ID NO: 6606206 - DNA, 22 bp, Homo sapiens
acagctcccaccccaccccctt

SEQ ID NO: 6606207 - DNA, 17 bp, Homo sapiens
acagctccctctgcctg

SEQ ID NO: 6606208 - DNA, 16 bp, Homo sapiens
acagctccgagctgta

SEQ ID NO: 6606209 - DNA, 22 bp, Homo sapiens
acagctccgagctgtaggagag

SEQ ID NO: 6606210 - DNA, 14 bp, Homo sapiens
acagctcctcccct

SEQ ID NO: 6606211 - DNA, 17 bp, Homo sapiens
acagctcctcccctgcc

SEQ ID NO: 6606212 - DNA, 23 bp, Homo sapiens
acagctcctcttaccgtagcctc

SEQ ID NO: 6606213 - DNA, 12 bp, Homo sapiens
acagctcctgcc

SEQ ID NO: 6606214 - DNA, 15 bp, Homo sapiens
acagctcctgccagg

SEQ ID NO: 6606215 - DNA, 19 bp, Homo sapiens
acagctcctggaccaggcc

SEQ ID NO: 6606216 - DNA, 21 bp, Homo sapiens
acagctcctggaccaggccca

SEQ ID NO: 6606217 - DNA, 15 bp, Homo sapiens
acagctccttctgtc

SEQ ID NO: 6606218 - DNA, 14 bp, Homo sapiens
acagctccttggga

SEQ ID NO: 6606219 - DNA, 17 bp, Homo sapiens
acagctccttgggagga

SEQ ID NO: 6606220 - DNA, 19 bp, Homo sapiens
acagctccttgggaggaag

SEQ ID NO: 6606221 - DNA, 22 bp, Homo sapiens
acagctccttgggaggaagcag

SEQ ID NO: 6606222 - DNA, 23 bp, Homo sapiens
acagctccttgggaggaagcaga

SEQ ID NO: 6606223 - DNA, 23 bp, Homo sapiens
acagctccttgtgagtgtgtgca

SEQ ID NO: 6606224 - DNA, 15 bp, Homo sapiens
acagctctcctccag

SEQ ID NO: 6606225 - DNA, 17 bp, Homo sapiens
acagctctcctccagcc

SEQ ID NO: 6606226 - DNA, 20 bp, Homo sapiens
acagctctcctccagccctg

SEQ ID NO: 6606227 - DNA, 15 bp, Homo sapiens
acagctctgacttta

SEQ ID NO: 6606228 - DNA, 17 bp, Homo sapiens
acagctctgactttaca

SEQ ID NO: 6606229 - DNA, 16 bp, Homo sapiens
acagctctgctggaag

SEQ ID NO: 6606230 - DNA, 17 bp, Homo sapiens
acagctctgctggaaga

SEQ ID NO: 6606231 - DNA, 14 bp, Homo sapiens
acagctctggggta

SEQ ID NO: 6606232 - DNA, 14 bp, Homo sapiens
acagctctgtcctg

SEQ ID NO: 6606233 - DNA, 20 bp, Homo sapiens
acagctctgtgttgccatgt

SEQ ID NO: 6606234 - DNA, 19 bp, Homo sapiens
acagctcttccagggcagc

SEQ ID NO: 6606235 - DNA, 22 bp, Homo sapiens
acagctcttccagggcagcggc

SEQ ID NO: 6606236 - DNA, 19 bp, Homo sapiens
acagctcttctcagtgtct

SEQ ID NO: 6606237 - DNA, 16 bp, Homo sapiens
acagctcttctccagg

SEQ ID NO: 6606238 - DNA, 17 bp, Homo sapiens
acagctcttctccaggc

SEQ ID NO: 6606239 - DNA, 20 bp, Homo sapiens
acagctcttctccaggctgt

SEQ ID NO: 6606240 - DNA, 12 bp, Homo sapiens
acagctcttgtt

SEQ ID NO: 6606241 - DNA, 16 bp, Homo sapiens
acagctgaattatcta

SEQ ID NO: 6606242 - DNA, 23 bp, Homo sapiens
acagctgacggtttctccccgga

SEQ ID NO: 6606243 - DNA, 17 bp, Homo sapiens
acagctgactgaatgca

SEQ ID NO: 6606244 - DNA, 16 bp, Homo sapiens
acagctgagcacttag

SEQ ID NO: 6606245 - DNA, 17 bp, Homo sapiens
acagctgaggaccctca

SEQ ID NO: 6606246 - DNA, 18 bp, Homo sapiens
acagctgaggaccctcag

SEQ ID NO: 6606247 - DNA, 19 bp, Homo sapiens
acagctgaggaccctcagc

SEQ ID NO: 6606248 - DNA, 22 bp, Homo sapiens
acagctgaggtctcttgaggga

SEQ ID NO: 6606249 - DNA, 16 bp, Homo sapiens
acagctgatacttcat

SEQ ID NO: 6606250 - DNA, 10 bp, Homo sapiens
acagctgcaa

SEQ ID NO: 6606251 - DNA, 19 bp, Homo sapiens
acagctgcaagccagggat

SEQ ID NO: 6606252 - DNA, 19 bp, Homo sapiens
acagctgcaattccctgga

SEQ ID NO: 6606253 - DNA, 13 bp, Homo sapiens
acagctgcactga

SEQ ID NO: 6606254 - DNA, 21 bp, Homo sapiens
acagctgcagagacagagagg

SEQ ID NO: 6606255 - DNA, 15 bp, Homo sapiens
acagctgcagcccat

SEQ ID NO: 6606256 - DNA, 13 bp, Homo sapiens
acagctgcagctg

SEQ ID NO: 6606257 - DNA, 15 bp, Homo sapiens
acagctgcagctgat

SEQ ID NO: 6606258 - DNA, 14 bp, Homo sapiens
acagctgcagctgg

SEQ ID NO: 6606259 - DNA, 16 bp, Homo sapiens
acagctgcagctgggc

SEQ ID NO: 6606260 - DNA, 16 bp, Homo sapiens
acagctgcattagaaa

SEQ ID NO: 6606261 - DNA, 10 bp, Homo sapiens
acagctgccc

SEQ ID NO: 6606262 - DNA, 12 bp, Homo sapiens
acagctgcccag

SEQ ID NO: 6606263 - DNA, 16 bp, Homo sapiens
acagctgcccagacac

SEQ ID NO: 6606264 - DNA, 15 bp, Homo sapiens
acagctgccctagct

SEQ ID NO: 6606265 - DNA, 12 bp, Homo sapiens
acagctgccctg

SEQ ID NO: 6606266 - DNA, 13 bp, Homo sapiens
acagctgccctgc

SEQ ID NO: 6606267 - DNA, 14 bp, Homo sapiens
acagctgccctgct

SEQ ID NO: 6606268 - DNA, 19 bp, Homo sapiens
acagctgccctgctgccac

SEQ ID NO: 6606269 - DNA, 17 bp, Homo sapiens
acagctgcctccgggcc

SEQ ID NO: 6606270 - DNA, 16 bp, Homo sapiens
acagctgcctgcagta

SEQ ID NO: 6606271 - DNA, 13 bp, Homo sapiens
acagctgcctggg

SEQ ID NO: 6606272 - DNA, 14 bp, Homo sapiens
acagctgcctggga

SEQ ID NO: 6606273 - DNA, 12 bp, Homo sapiens
acagctgcctta

SEQ ID NO: 6606274 - DNA, 14 bp, Homo sapiens
acagctgccttagc

SEQ ID NO: 6606275 - DNA, 19 bp, Homo sapiens
acagctgccttagcttcag

SEQ ID NO: 6606276 - DNA, 22 bp, Homo sapiens
acagctgcctttcgtgatctta

SEQ ID NO: 6606277 - DNA, 23 bp, Homo sapiens
acagctgcggcagcccctcccag

SEQ ID NO: 6606278 - DNA, 17 bp, Homo sapiens
acagctgctcagagcca

SEQ ID NO: 6606279 - DNA, 22 bp, Homo sapiens
acagctgctcctagagggaggg

SEQ ID NO: 6606280 - DNA, 23 bp, Homo sapiens
acagctgctcctagagggagggg

SEQ ID NO: 6606281 - DNA, 18 bp, Homo sapiens
acagctgctgaagaggca

SEQ ID NO: 6606282 - DNA, 11 bp, Homo sapiens
acagctgctgg

SEQ ID NO: 6606283 - DNA, 14 bp, Homo sapiens
acagctgctggaga

SEQ ID NO: 6606284 - DNA, 15 bp, Homo sapiens
acagctgcttctccc

SEQ ID NO: 6606285 - DNA, 18 bp, Homo sapiens
acagctgcttctcccccc

SEQ ID NO: 6606286 - DNA, 19 bp, Homo sapiens
acagctgcttgtcctgctc

SEQ ID NO: 6606287 - DNA, 15 bp, Homo sapiens
acagctgctttatga

SEQ ID NO: 6606288 - DNA, 23 bp, Homo sapiens
acagctgctttctgttgtcattg

SEQ ID NO: 6606289 - DNA, 21 bp, Homo sapiens
acagctggaccctgcttcacc

SEQ ID NO: 6606290 - DNA, 19 bp, Homo sapiens
acagctggagaaatggcat

SEQ ID NO: 6606291 - DNA, 18 bp, Homo sapiens
acagctggatctgcttgt

SEQ ID NO: 6606292 - DNA, 21 bp, Homo sapiens
acagctggcggaggctgctcg

SEQ ID NO: 6606293 - DNA, 14 bp, Homo sapiens
acagctggctgctg

SEQ ID NO: 6606294 - DNA, 12 bp, Homo sapiens
acagctggctgg

SEQ ID NO: 6606295 - DNA, 16 bp, Homo sapiens
acagctgggagcctgg

SEQ ID NO: 6606296 - DNA, 17 bp, Homo sapiens
acagctgggcaaagcca

SEQ ID NO: 6606297 - DNA, 16 bp, Homo sapiens
acagctgggcagggtg

SEQ ID NO: 6606298 - DNA, 13 bp, Homo sapiens
acagctgggctgt

SEQ ID NO: 6606299 - DNA, 11 bp, Homo sapiens
acagctggggc

SEQ ID NO: 6606300 - DNA, 21 bp, Homo sapiens
acagctggggtgcagggatgt

SEQ ID NO: 6606301 - DNA, 16 bp, Homo sapiens
acagctgggtggcact

SEQ ID NO: 6606302 - DNA, 23 bp, Homo sapiens
acagctgggtggcactgccatgc

SEQ ID NO: 6606303 - DNA, 12 bp, Homo sapiens
acagctggtcct

SEQ ID NO: 6606304 - DNA, 22 bp, Homo sapiens
acagctggtgcaaattcagaac

SEQ ID NO: 6606305 - DNA, 20 bp, Homo sapiens
acagctggtgccctgctttc

SEQ ID NO: 6606306 - DNA, 12 bp, Homo sapiens
acagctggtgta

SEQ ID NO: 6606307 - DNA, 22 bp, Homo sapiens
acagctggtgtagctacagaga

SEQ ID NO: 6606308 - DNA, 20 bp, Homo sapiens
acagctgtatgattcccagc

SEQ ID NO: 6606309 - DNA, 16 bp, Homo sapiens
acagctgtattatctt

SEQ ID NO: 6606310 - DNA, 17 bp, Homo sapiens
acagctgtattgtctga

SEQ ID NO: 6606311 - DNA, 15 bp, Homo sapiens
acagctgtatttata

SEQ ID NO: 6606312 - DNA, 14 bp, Homo sapiens
acagctgtctgcca

SEQ ID NO: 6606313 - DNA, 16 bp, Homo sapiens
acagctgtctgccagg

SEQ ID NO: 6606314 - DNA, 17 bp, Homo sapiens
acagctgtgagccatgc

SEQ ID NO: 6606315 - DNA, 22 bp, Homo sapiens
acagctgtgagccatgcctccc

SEQ ID NO: 6606316 - DNA, 20 bp, Homo sapiens
acagctgtgaggacagacag

SEQ ID NO: 6606317 - DNA, 21 bp, Homo sapiens
acagctgtgaggacagacaga

SEQ ID NO: 6606318 - DNA, 20 bp, Homo sapiens
acagctgtgccgggaggcag

SEQ ID NO: 6606319 - DNA, 11 bp, Homo sapiens
acagctgtgct

SEQ ID NO: 6606320 - DNA, 23 bp, Homo sapiens
acagctgtggtgaggttgggcag

SEQ ID NO: 6606321 - DNA, 10 bp, Homo sapiens
acagctgtgt

SEQ ID NO: 6606322 - DNA, 12 bp, Homo sapiens
acagctgtgtct

SEQ ID NO: 6606323 - DNA, 14 bp, Homo sapiens
acagctgtgtctgc

SEQ ID NO: 6606324 - DNA, 16 bp, Homo sapiens
acagctgtgtctgcca

SEQ ID NO: 6606325 - DNA, 12 bp, Homo sapiens
acagctgttcct

SEQ ID NO: 6606326 - DNA, 15 bp, Homo sapiens
acagctgttcctgtg

SEQ ID NO: 6606327 - DNA, 16 bp, Homo sapiens
acagctgttcttctgt

SEQ ID NO: 6606328 - DNA, 21 bp, Homo sapiens
acagctgttcttctgttctgc

SEQ ID NO: 6606329 - DNA, 13 bp, Homo sapiens
acagctgttgact

SEQ ID NO: 6606330 - DNA, 14 bp, Homo sapiens
acagctgttgactc

SEQ ID NO: 6606331 - DNA, 17 bp, Homo sapiens
acagctgtttacagaca

SEQ ID NO: 6606332 - DNA, 12 bp, Homo sapiens
acagctgtttga

SEQ ID NO: 6606333 - DNA, 15 bp, Homo sapiens
acagctgtttgaaat

SEQ ID NO: 6606334 - DNA, 16 bp, Homo sapiens
acagctgtttgaaatg

SEQ ID NO: 6606335 - DNA, 18 bp, Homo sapiens
acagcttaacaatgcaac

SEQ ID NO: 6606336 - DNA, 23 bp, Homo sapiens
acagcttaatagtagttagctta

SEQ ID NO: 6606337 - DNA, 17 bp, Homo sapiens
acagcttacaggagcca

SEQ ID NO: 6606338 - DNA, 19 bp, Homo sapiens
acagcttacctagtcttgt

SEQ ID NO: 6606339 - DNA, 20 bp, Homo sapiens
acagcttacctagtcttgta

SEQ ID NO: 6606340 - DNA, 12 bp, Homo sapiens
acagcttagaat

SEQ ID NO: 6606341 - DNA, 14 bp, Homo sapiens
acagcttagatttc

SEQ ID NO: 6606342 - DNA, 21 bp, Homo sapiens
acagcttcacttaaaatcaaa

SEQ ID NO: 6606343 - DNA, 21 bp, Homo sapiens
acagcttcagccaggagctgg

SEQ ID NO: 6606344 - DNA, 17 bp, Homo sapiens
acagcttcatttcctgt

SEQ ID NO: 6606345 - DNA, 22 bp, Homo sapiens
acagcttccccatcgccttctg

SEQ ID NO: 6606346 - DNA, 22 bp, Homo sapiens
acagcttcccctctctcctcct

SEQ ID NO: 6606347 - DNA, 16 bp, Homo sapiens
acagcttcctcacacc

SEQ ID NO: 6606348 - DNA, 20 bp, Homo sapiens
acagcttcctcacacccctg

SEQ ID NO: 6606349 - DNA, 11 bp, Homo sapiens
acagcttcctg

SEQ ID NO: 6606350 - DNA, 17 bp, Homo sapiens
acagcttctattcatta

SEQ ID NO: 6606351 - DNA, 16 bp, Homo sapiens
acagcttctccaagca

SEQ ID NO: 6606352 - DNA, 14 bp, Homo sapiens
acagcttctctgca

SEQ ID NO: 6606353 - DNA, 17 bp, Homo sapiens
acagcttctctgcagta

SEQ ID NO: 6606354 - DNA, 15 bp, Homo sapiens
acagcttctgagaat

SEQ ID NO: 6606355 - DNA, 17 bp, Homo sapiens
acagcttctgagaattg

SEQ ID NO: 6606356 - DNA, 14 bp, Homo sapiens
acagcttgaccaga

SEQ ID NO: 6606357 - DNA, 18 bp, Homo sapiens
acagcttgaccagaccta

SEQ ID NO: 6606358 - DNA, 17 bp, Homo sapiens
acagcttgaccgtgagg

SEQ ID NO: 6606359 - DNA, 20 bp, Homo sapiens
acagcttgaccgtgaggcca

SEQ ID NO: 6606360 - DNA, 22 bp, Homo sapiens
acagcttgaccgtgaggccaga

SEQ ID NO: 6606361 - DNA, 21 bp, Homo sapiens
acagcttgacctgaggctgtg

SEQ ID NO: 6606362 - DNA, 23 bp, Homo sapiens
acagcttgacctgaggctgtggt

SEQ ID NO: 6606363 - DNA, 22 bp, Homo sapiens
acagcttgactctactcccagc

SEQ ID NO: 6606364 - DNA, 18 bp, Homo sapiens
acagcttgaggaaagagc

SEQ ID NO: 6606365 - DNA, 14 bp, Homo sapiens
acagcttgccaggg

SEQ ID NO: 6606366 - DNA, 22 bp, Homo sapiens
acagcttgctgtcacttcttca

SEQ ID NO: 6606367 - DNA, 18 bp, Homo sapiens
acagcttgtgaatgttta

SEQ ID NO: 6606368 - DNA, 22 bp, Homo sapiens
acagcttgttttggactttgtt

SEQ ID NO: 6606369 - DNA, 17 bp, Homo sapiens
acagctttatcaccaga

SEQ ID NO: 6606370 - DNA, 16 bp, Homo sapiens
acagctttcccaggta

SEQ ID NO: 6606371 - DNA, 14 bp, Homo sapiens
acagctttcctggg

SEQ ID NO: 6606372 - DNA, 21 bp, Homo sapiens
acagctttctaactcacaggc

SEQ ID NO: 6606373 - DNA, 14 bp, Homo sapiens
acagctttctgacc

SEQ ID NO: 6606374 - DNA, 15 bp, Homo sapiens
acagctttctgacct

SEQ ID NO: 6606375 - DNA, 17 bp, Homo sapiens
acagctttctgaccttc

SEQ ID NO: 6606376 - DNA, 21 bp, Homo sapiens
acagctttcttgctcccttca

SEQ ID NO: 6606377 - DNA, 15 bp, Homo sapiens
acagctttgaggaac

SEQ ID NO: 6606378 - DNA, 13 bp, Homo sapiens
acagctttgcacc

SEQ ID NO: 6606379 - DNA, 14 bp, Homo sapiens
acagctttgccttg

SEQ ID NO: 6606380 - DNA, 16 bp, Homo sapiens
acagctttgctccgct

SEQ ID NO: 6606381 - DNA, 19 bp, Homo sapiens
acagctttgctccgctccc

SEQ ID NO: 6606382 - DNA, 20 bp, Homo sapiens
acagctttgctccgctccca

SEQ ID NO: 6606383 - DNA, 22 bp, Homo sapiens
acagctttgctccgctcccacc

SEQ ID NO: 6606384 - DNA, 22 bp, Homo sapiens
acagctttggggtgtctttttt

SEQ ID NO: 6606385 - DNA, 22 bp, Homo sapiens
acagctttgggtcatttttaac

SEQ ID NO: 6606386 - DNA, 21 bp, Homo sapiens
acagctttgtatgtttatgaa

SEQ ID NO: 6606387 - DNA, 16 bp, Homo sapiens
acagctttgtctccaa

SEQ ID NO: 6606388 - DNA, 21 bp, Homo sapiens
acagctttgtctccaaagaag

SEQ ID NO: 6606389 - DNA, 23 bp, Homo sapiens
acagctttgtctccaaagaagat

SEQ ID NO: 6606390 - DNA, 21 bp, Homo sapiens
acagctttgtgactgtatata

SEQ ID NO: 6606391 - DNA, 15 bp, Homo sapiens
acagcttttccaaaa

SEQ ID NO: 6606392 - DNA, 18 bp, Homo sapiens
acagcttttcccaggaga

SEQ ID NO: 6606393 - DNA, 14 bp, Homo sapiens
acagcttttcttga

SEQ ID NO: 6606394 - DNA, 12 bp, Homo sapiens
acagcttttgca

SEQ ID NO: 6606395 - DNA, 23 bp, Homo sapiens
acaggaaaaaaacttttataaat

SEQ ID NO: 6606396 - DNA, 14 bp, Homo sapiens
acaggaaaaataaa

SEQ ID NO: 6606397 - DNA, 12 bp, Homo sapiens
acaggaaaagag

SEQ ID NO: 6606398 - DNA, 19 bp, Homo sapiens
acaggaaaagcatgtctta

SEQ ID NO: 6606399 - DNA, 18 bp, Homo sapiens
acaggaaaagctgctgac

SEQ ID NO: 6606400 - DNA, 19 bp, Homo sapiens
acaggaaaagctgctgaca

SEQ ID NO: 6606401 - DNA, 16 bp, Homo sapiens
acaggaaaatcctctg

SEQ ID NO: 6606402 - DNA, 13 bp, Homo sapiens
acaggaaacaaac

SEQ ID NO: 6606403 - DNA, 22 bp, Homo sapiens
acaggaaactcctgtgaccaca

SEQ ID NO: 6606404 - DNA, 16 bp, Homo sapiens
acaggaaagagctagg

SEQ ID NO: 6606405 - DNA, 16 bp, Homo sapiens
acaggaaagccctccc

SEQ ID NO: 6606406 - DNA, 19 bp, Homo sapiens
acaggaaagggaaggcccc

SEQ ID NO: 6606407 - DNA, 18 bp, Homo sapiens
acaggaaagtggatgcca

SEQ ID NO: 6606408 - DNA, 18 bp, Homo sapiens
acaggaaagttcagagtt

SEQ ID NO: 6606409 - DNA, 14 bp, Homo sapiens
acaggaaatgcaaa

SEQ ID NO: 6606410 - DNA, 23 bp, Homo sapiens
acaggaaatgggaaaaaacttaa

SEQ ID NO: 6606411 - DNA, 18 bp, Homo sapiens
acaggaaattgcaaagaa

SEQ ID NO: 6606412 - DNA, 14 bp, Homo sapiens
acaggaacacccag

SEQ ID NO: 6606413 - DNA, 16 bp, Homo sapiens
acaggaacccagccag

SEQ ID NO: 6606414 - DNA, 21 bp, Homo sapiens
acaggaacccatcactgtgtc

SEQ ID NO: 6606415 - DNA, 23 bp, Homo sapiens
acaggaacccatcactgtgtctc

SEQ ID NO: 6606416 - DNA, 22 bp, Homo sapiens
acaggaacccttgcatccattg

SEQ ID NO: 6606417 - DNA, 14 bp, Homo sapiens
acaggaaccttaag

SEQ ID NO: 6606418 - DNA, 17 bp, Homo sapiens
acaggaacggccctgca

SEQ ID NO: 6606419 - DNA, 16 bp, Homo sapiens
acaggaactctgtgtg

SEQ ID NO: 6606420 - DNA, 20 bp, Homo sapiens
acaggaactctgtgtgagag

SEQ ID NO: 6606421 - DNA, 14 bp, Homo sapiens
acaggaagaaagag

SEQ ID NO: 6606422 - DNA, 15 bp, Homo sapiens
acaggaagactggag

SEQ ID NO: 6606423 - DNA, 16 bp, Homo sapiens
acaggaagagaagaat

SEQ ID NO: 6606424 - DNA, 12 bp, Homo sapiens
acaggaagcctc

SEQ ID NO: 6606425 - DNA, 21 bp, Homo sapiens
acaggaagctggcagaacgga

SEQ ID NO: 6606426 - DNA, 20 bp, Homo sapiens
acaggaaggaaacaacattt

SEQ ID NO: 6606427 - DNA, 14 bp, Homo sapiens
acaggaaggaagca

SEQ ID NO: 6606428 - DNA, 14 bp, Homo sapiens
acaggaaggagggg

SEQ ID NO: 6606429 - DNA, 22 bp, Homo sapiens
acaggaaggcaggaggggtgag

SEQ ID NO: 6606430 - DNA, 17 bp, Homo sapiens
acaggaaggtctgattt

SEQ ID NO: 6606431 - DNA, 20 bp, Homo sapiens
acaggaaggtctgatttgca

SEQ ID NO: 6606432 - DNA, 21 bp, Homo sapiens
acaggaaggtctgatttgcag

SEQ ID NO: 6606433 - DNA, 15 bp, Homo sapiens
acaggaaggtgcctg

SEQ ID NO: 6606434 - DNA, 17 bp, Homo sapiens
acaggaaggtgcctggc

SEQ ID NO: 6606435 - DNA, 19 bp, Homo sapiens
acaggaaggtgcctggcca

SEQ ID NO: 6606436 - DNA, 16 bp, Homo sapiens
acaggaagtagttcta

SEQ ID NO: 6606437 - DNA, 13 bp, Homo sapiens
acaggaatcctta

SEQ ID NO: 6606438 - DNA, 17 bp, Homo sapiens
acaggaatccttactga

SEQ ID NO: 6606439 - DNA, 15 bp, Homo sapiens
acaggaatctcagag

SEQ ID NO: 6606440 - DNA, 16 bp, Homo sapiens
acaggaatgtctggag

SEQ ID NO: 6606441 - DNA, 15 bp, Homo sapiens
acaggacacagtcag

SEQ ID NO: 6606442 - DNA, 15 bp, Homo sapiens
acaggacacctggcc

SEQ ID NO: 6606443 - DNA, 15 bp, Homo sapiens
acaggacacgaaggc

SEQ ID NO: 6606444 - DNA, 18 bp, Homo sapiens
acaggacacgaaggctgc

SEQ ID NO: 6606445 - DNA, 15 bp, Homo sapiens
acaggacagagttca

SEQ ID NO: 6606446 - DNA, 20 bp, Homo sapiens
acaggacagagttcacagga

SEQ ID NO: 6606447 - DNA, 20 bp, Homo sapiens
acaggacagcatggtgcatg

SEQ ID NO: 6606448 - DNA, 17 bp, Homo sapiens
acaggacagtgcttcag

SEQ ID NO: 6606449 - DNA, 23 bp, Homo sapiens
acaggacagttgatggagcccca

SEQ ID NO: 6606450 - DNA, 17 bp, Homo sapiens
acaggacatatattttt

SEQ ID NO: 6606451 - DNA, 14 bp, Homo sapiens
acaggaccacctcc

SEQ ID NO: 6606452 - DNA, 12 bp, Homo sapiens
acaggaccagga

SEQ ID NO: 6606453 - DNA, 13 bp, Homo sapiens
acaggaccaggag

SEQ ID NO: 6606454 - DNA, 16 bp, Homo sapiens
acaggaccaggagcca

SEQ ID NO: 6606455 - DNA, 16 bp, Homo sapiens
acaggaccccagctct

SEQ ID NO: 6606456 - DNA, 16 bp, Homo sapiens
acaggactaacactca

SEQ ID NO: 6606457 - DNA, 20 bp, Homo sapiens
acaggactaacactcagaag

SEQ ID NO: 6606458 - DNA, 23 bp, Homo sapiens
acaggactaacactcagaagcct

SEQ ID NO: 6606459 - DNA, 24 bp, Homo sapiens
acaggactaacactcagaagcctg

SEQ ID NO: 6606460 - DNA, 16 bp, Homo sapiens
acaggactctgcctcc

SEQ ID NO: 6606461 - DNA, 17 bp, Homo sapiens
acaggactgagccctct

SEQ ID NO: 6606462 - DNA, 15 bp, Homo sapiens
acaggactgtaaaga

SEQ ID NO: 6606463 - DNA, 17 bp, Homo sapiens
acaggactgtaaagatt

SEQ ID NO: 6606464 - DNA, 20 bp, Homo sapiens
acaggactgtaaagatttgt

SEQ ID NO: 6606465 - DNA, 21 bp, Homo sapiens
acaggagaaaaattattccca

SEQ ID NO: 6606466 - DNA, 16 bp, Homo sapiens
acaggagaccaccccc

SEQ ID NO: 6606467 - DNA, 18 bp, Homo sapiens
acaggagaccacccccga

SEQ ID NO: 6606468 - DNA, 19 bp, Homo sapiens
acaggagacccaacaatga

SEQ ID NO: 6606469 - DNA, 22 bp, Homo sapiens
acaggagacccacctgaggctc

SEQ ID NO: 6606470 - DNA, 14 bp, Homo sapiens
acaggagaggcagc

SEQ ID NO: 6606471 - DNA, 22 bp, Homo sapiens
acaggagaggcagcatgcttgg

SEQ ID NO: 6606472 - DNA, 22 bp, Homo sapiens
acaggagagttagtcgccctac

SEQ ID NO: 6606473 - DNA, 18 bp, Homo sapiens
acaggagcaatcacagga

SEQ ID NO: 6606474 - DNA, 20 bp, Homo sapiens
acaggagcaatcacaggaaa

SEQ ID NO: 6606475 - DNA, 16 bp, Homo sapiens
acaggagcagacagag

SEQ ID NO: 6606476 - DNA, 18 bp, Homo sapiens
acaggagcagacagagaa

SEQ ID NO: 6606477 - DNA, 19 bp, Homo sapiens
acaggagcagacagagaaa

SEQ ID NO: 6606478 - DNA, 12 bp, Homo sapiens
acaggagccagc

SEQ ID NO: 6606479 - DNA, 15 bp, Homo sapiens
acaggagccagcctg

SEQ ID NO: 6606480 - DNA, 20 bp, Homo sapiens
acaggagccccacccccatg

SEQ ID NO: 6606481 - DNA, 13 bp, Homo sapiens
acaggagctacct

SEQ ID NO: 6606482 - DNA, 12 bp, Homo sapiens
acaggagctttt

SEQ ID NO: 6606483 - DNA, 14 bp, Homo sapiens
acaggaggaactgg

SEQ ID NO: 6606484 - DNA, 16 bp, Homo sapiens
acaggaggacaattca

SEQ ID NO: 6606485 - DNA, 20 bp, Homo sapiens
acaggaggacaattcatgaa

SEQ ID NO: 6606486 - DNA, 19 bp, Homo sapiens
acaggaggaggagatggcc

SEQ ID NO: 6606487 - DNA, 14 bp, Homo sapiens
acaggaggaggtga

SEQ ID NO: 6606488 - DNA, 22 bp, Homo sapiens
acaggaggagtgggacagacag

SEQ ID NO: 6606489 - DNA, 17 bp, Homo sapiens
acaggaggccagtgggc

SEQ ID NO: 6606490 - DNA, 15 bp, Homo sapiens
acaggaggccatgcc

SEQ ID NO: 6606491 - DNA, 20 bp, Homo sapiens
acaggaggcggcccggccag

SEQ ID NO: 6606492 - DNA, 22 bp, Homo sapiens
acaggaggcggcccggccagcg

SEQ ID NO: 6606493 - DNA, 15 bp, Homo sapiens
acaggaggctccggc

SEQ ID NO: 6606494 - DNA, 16 bp, Homo sapiens
acaggaggctccgtga

SEQ ID NO: 6606495 - DNA, 22 bp, Homo sapiens
acaggaggctccgtgagccctt

SEQ ID NO: 6606496 - DNA, 20 bp, Homo sapiens
acaggagggaacatttccga

SEQ ID NO: 6606497 - DNA, 19 bp, Homo sapiens
acaggagggagagaactta

SEQ ID NO: 6606498 - DNA, 18 bp, Homo sapiens
acaggagggcaagggcca

SEQ ID NO: 6606499 - DNA, 14 bp, Homo sapiens
acaggagggcccgg

SEQ ID NO: 6606500 - DNA, 20 bp, Homo sapiens
acaggagggcggcctccttc

SEQ ID NO: 6606501 - DNA, 17 bp, Homo sapiens
acaggaggttgtggatg

SEQ ID NO: 6606502 - DNA, 23 bp, Homo sapiens
acaggaggttgtggatgctccag

SEQ ID NO: 6606503 - DNA, 21 bp, Homo sapiens
acaggagtcagtctctttctg

SEQ ID NO: 6606504 - DNA, 20 bp, Homo sapiens
acaggagtcttcagacccag

SEQ ID NO: 6606505 - DNA, 20 bp, Homo sapiens
acaggagtctttgtaatgct

SEQ ID NO: 6606506 - DNA, 22 bp, Homo sapiens
acaggagtgactctggctgcca

SEQ ID NO: 6606507 - DNA, 21 bp, Homo sapiens
acaggagttcagcggagctag

SEQ ID NO: 6606508 - DNA, 20 bp, Homo sapiens
acaggagttgtgagccctct

SEQ ID NO: 6606509 - DNA, 18 bp, Homo sapiens
acaggatatgctttaaga

SEQ ID NO: 6606510 - DNA, 19 bp, Homo sapiens
acaggatcatgtaaatgct

SEQ ID NO: 6606511 - DNA, 12 bp, Homo sapiens
acaggatccagg

SEQ ID NO: 6606512 - DNA, 21 bp, Homo sapiens
acaggatcctattctcaccag

SEQ ID NO: 6606513 - DNA, 22 bp, Homo sapiens
acaggatctataggcagcttct

SEQ ID NO: 6606514 - DNA, 16 bp, Homo sapiens
acaggatctgaacttt

SEQ ID NO: 6606515 - DNA, 15 bp, Homo sapiens
acaggatgcatatta

SEQ ID NO: 6606516 - DNA, 19 bp, Homo sapiens
acaggatgcatattaaaga

SEQ ID NO: 6606517 - DNA, 23 bp, Homo sapiens
acaggatgccagcccctgcctgg

SEQ ID NO: 6606518 - DNA, 14 bp, Homo sapiens
acaggatgctgtgt

SEQ ID NO: 6606519 - DNA, 16 bp, Homo sapiens
acaggatggtctctgc

SEQ ID NO: 6606520 - DNA, 16 bp, Homo sapiens
acaggatgtggcactg

SEQ ID NO: 6606521 - DNA, 16 bp, Homo sapiens
acaggatgtgtttgct

SEQ ID NO: 6606522 - DNA, 22 bp, Homo sapiens
acaggatgtgtttgctttctga

SEQ ID NO: 6606523 - DNA, 15 bp, Homo sapiens
acaggattagacagt

SEQ ID NO: 6606524 - DNA, 14 bp, Homo sapiens
acaggattattttg

SEQ ID NO: 6606525 - DNA, 15 bp, Homo sapiens
acaggattattttga

SEQ ID NO: 6606526 - DNA, 17 bp, Homo sapiens
acaggattctcttctca

SEQ ID NO: 6606527 - DNA, 15 bp, Homo sapiens
acaggattgggccaa

SEQ ID NO: 6606528 - DNA, 13 bp, Homo sapiens
acaggattgtctg

SEQ ID NO: 6606529 - DNA, 16 bp, Homo sapiens
acaggatttggccaca

SEQ ID NO: 6606530 - DNA, 15 bp, Homo sapiens
acaggattttcaagt

SEQ ID NO: 6606531 - DNA, 23 bp, Homo sapiens
acaggattttcaagttattcaga

SEQ ID NO: 6606532 - DNA, 19 bp, Homo sapiens
acaggcaaaatccttgctt

SEQ ID NO: 6606533 - DNA, 14 bp, Homo sapiens
acaggcaaacattt

SEQ ID NO: 6606534 - DNA, 17 bp, Homo sapiens
acaggcaaaccaataca

SEQ ID NO: 6606535 - DNA, 21 bp, Homo sapiens
acaggcaaaccaatacagaat

SEQ ID NO: 6606536 - DNA, 18 bp, Homo sapiens
acaggcaaagaggtgctg

SEQ ID NO: 6606537 - DNA, 16 bp, Homo sapiens
acaggcaaagttttac

SEQ ID NO: 6606538 - DNA, 23 bp, Homo sapiens
acaggcaaatccgaaatcagcag

SEQ ID NO: 6606539 - DNA, 17 bp, Homo sapiens
acaggcaacattacaaa

SEQ ID NO: 6606540 - DNA, 18 bp, Homo sapiens
acaggcaacattacaaac

SEQ ID NO: 6606541 - DNA, 19 bp, Homo sapiens
acaggcaactgaggcagac

SEQ ID NO: 6606542 - DNA, 16 bp, Homo sapiens
acaggcaagcacctcc

SEQ ID NO: 6606543 - DNA, 20 bp, Homo sapiens
acaggcaagtccaccccata

SEQ ID NO: 6606544 - DNA, 15 bp, Homo sapiens
acaggcaatgctggc

SEQ ID NO: 6606545 - DNA, 17 bp, Homo sapiens
acaggcaatgctggctg

SEQ ID NO: 6606546 - DNA, 18 bp, Homo sapiens
acaggcaatgctggctgt

SEQ ID NO: 6606547 - DNA, 23 bp, Homo sapiens
acaggcaatgctggctgttggct

SEQ ID NO: 6606548 - DNA, 12 bp, Homo sapiens
acaggcaattcc

SEQ ID NO: 6606549 - DNA, 13 bp, Homo sapiens
acaggcaattccg

SEQ ID NO: 6606550 - DNA, 12 bp, Homo sapiens
acaggcacaaaa

SEQ ID NO: 6606551 - DNA, 17 bp, Homo sapiens
acaggcacaaaatgtga

SEQ ID NO: 6606552 - DNA, 17 bp, Homo sapiens
acaggcacacagggccc

SEQ ID NO: 6606553 - DNA, 17 bp, Homo sapiens
acaggcacattaactgt

SEQ ID NO: 6606554 - DNA, 18 bp, Homo sapiens
acaggcaccatgctgggc

SEQ ID NO: 6606555 - DNA, 20 bp, Homo sapiens
acaggcaccatgctgggccg

SEQ ID NO: 6606556 - DNA, 14 bp, Homo sapiens
acaggcacccacca

SEQ ID NO: 6606557 - DNA, 13 bp, Homo sapiens
acaggcacgggtc

SEQ ID NO: 6606558 - DNA, 20 bp, Homo sapiens
acaggcactgaacaggctgg

SEQ ID NO: 6606559 - DNA, 13 bp, Homo sapiens
acaggcacttggc

SEQ ID NO: 6606560 - DNA, 20 bp, Homo sapiens
acaggcacttggcagccttg

SEQ ID NO: 6606561 - DNA, 12 bp, Homo sapiens
acaggcactttg

SEQ ID NO: 6606562 - DNA, 12 bp, Homo sapiens
acaggcagaaag

SEQ ID NO: 6606563 - DNA, 9 bp, Homo sapiens
acaggcagc

SEQ ID NO: 6606564 - DNA, 12 bp, Homo sapiens
acaggcagcaga

SEQ ID NO: 6606565 - DNA, 14 bp, Homo sapiens
acaggcagcagaga

SEQ ID NO: 6606566 - DNA, 11 bp, Homo sapiens
acaggcagccc

SEQ ID NO: 6606567 - DNA, 14 bp, Homo sapiens
acaggcagcccagc

SEQ ID NO: 6606568 - DNA, 17 bp, Homo sapiens
acaggcagcctcctttg

SEQ ID NO: 6606569 - DNA, 22 bp, Homo sapiens
acaggcagcgatggtctcagaa

SEQ ID NO: 6606570 - DNA, 17 bp, Homo sapiens
acaggcagctttctaga

SEQ ID NO: 6606571 - DNA, 17 bp, Homo sapiens
acaggcaggaagagaga

SEQ ID NO: 6606572 - DNA, 13 bp, Homo sapiens
acaggcagggcag

SEQ ID NO: 6606573 - DNA, 21 bp, Homo sapiens
acaggcagggcaggaccagcc

SEQ ID NO: 6606574 - DNA, 13 bp, Homo sapiens
acaggcagggcct

SEQ ID NO: 6606575 - DNA, 14 bp, Homo sapiens
acaggcagggcctg

SEQ ID NO: 6606576 - DNA, 12 bp, Homo sapiens
acaggcaggggc

SEQ ID NO: 6606577 - DNA, 15 bp, Homo sapiens
acaggcaggtcacag

SEQ ID NO: 6606578 - DNA, 14 bp, Homo sapiens
acaggcaggtccag

SEQ ID NO: 6606579 - DNA, 12 bp, Homo sapiens
acaggcagtgca

SEQ ID NO: 6606580 - DNA, 18 bp, Homo sapiens
acaggcagtgcatgtgaa

SEQ ID NO: 6606581 - DNA, 17 bp, Homo sapiens
acaggcagtttcagaga

SEQ ID NO: 6606582 - DNA, 21 bp, Homo sapiens
acaggcatctacacagcctgg

SEQ ID NO: 6606583 - DNA, 12 bp, Homo sapiens
acaggcatgagc

SEQ ID NO: 6606584 - DNA, 22 bp, Homo sapiens
acaggcatgaggaatctgggag

SEQ ID NO: 6606585 - DNA, 22 bp, Homo sapiens
acaggcatgtgccaccacgccc

SEQ ID NO: 6606586 - DNA, 14 bp, Homo sapiens
acaggcatgttctc

SEQ ID NO: 6606587 - DNA, 15 bp, Homo sapiens
acaggcatgttctct

SEQ ID NO: 6606588 - DNA, 18 bp, Homo sapiens
acaggcattgcactaaaa

SEQ ID NO: 6606589 - DNA, 22 bp, Homo sapiens
acaggcattgcactaaaagtga

SEQ ID NO: 6606590 - DNA, 19 bp, Homo sapiens
acaggccacacgctgccca

SEQ ID NO: 6606591 - DNA, 16 bp, Homo sapiens
acaggccacttgctca

SEQ ID NO: 6606592 - DNA, 12 bp, Homo sapiens
acaggccagccc

SEQ ID NO: 6606593 - DNA, 14 bp, Homo sapiens
acaggccagcccca

SEQ ID NO: 6606594 - DNA, 15 bp, Homo sapiens
acaggccagccccat

SEQ ID NO: 6606595 - DNA, 16 bp, Homo sapiens
acaggccagccccatc

SEQ ID NO: 6606596 - DNA, 20 bp, Homo sapiens
acaggccaggggatctgggt

SEQ ID NO: 6606597 - DNA, 22 bp, Homo sapiens
acaggcccaagagatgaagagt

SEQ ID NO: 6606598 - DNA, 11 bp, Homo sapiens
acaggcccaga

SEQ ID NO: 6606599 - DNA, 12 bp, Homo sapiens
acaggcccagca

SEQ ID NO: 6606600 - DNA, 13 bp, Homo sapiens
acaggcccagcat

SEQ ID NO: 6606601 - DNA, 23 bp, Homo sapiens
acaggcccagcattgctggttct

SEQ ID NO: 6606602 - DNA, 16 bp, Homo sapiens
acaggcccaggaaggc

SEQ ID NO: 6606603 - DNA, 15 bp, Homo sapiens
acaggcccagggagg

SEQ ID NO: 6606604 - DNA, 18 bp, Homo sapiens
acaggccccacgccctct

SEQ ID NO: 6606605 - DNA, 19 bp, Homo sapiens
acaggccccacgccctctc

SEQ ID NO: 6606606 - DNA, 24 bp, Homo sapiens
acaggccccccgcagcaccctgca

SEQ ID NO: 6606607 - DNA, 17 bp, Homo sapiens
acaggcccctgggtttc

SEQ ID NO: 6606608 - DNA, 19 bp, Homo sapiens
acaggcccgccctctgcct

SEQ ID NO: 6606609 - DNA, 22 bp, Homo sapiens
acaggcccggcgcggtggctca

SEQ ID NO: 6606610 - DNA, 13 bp, Homo sapiens
acaggccctagct

SEQ ID NO: 6606611 - DNA, 17 bp, Homo sapiens
acaggccctccctgtct

SEQ ID NO: 6606612 - DNA, 13 bp, Homo sapiens
acaggccctctgt

SEQ ID NO: 6606613 - DNA, 12 bp, Homo sapiens
acaggccctggc

SEQ ID NO: 6606614 - DNA, 22 bp, Homo sapiens
acaggcccttcctctccactgc

SEQ ID NO: 6606615 - DNA, 12 bp, Homo sapiens
acaggcccttgg

SEQ ID NO: 6606616 - DNA, 13 bp, Homo sapiens
acaggcccttggg

SEQ ID NO: 6606617 - DNA, 18 bp, Homo sapiens
acaggccgaggcaggagg

SEQ ID NO: 6606618 - DNA, 20 bp, Homo sapiens
acaggccgtgggacccaggc

SEQ ID NO: 6606619 - DNA, 22 bp, Homo sapiens
acaggccgtgggacccaggctc

SEQ ID NO: 6606620 - DNA, 14 bp, Homo sapiens
acaggcctcagggc

SEQ ID NO: 6606621 - DNA, 20 bp, Homo sapiens
acaggcctctcttttccccg

SEQ ID NO: 6606622 - DNA, 21 bp, Homo sapiens
acaggcctctgcctgctgggg

SEQ ID NO: 6606623 - DNA, 14 bp, Homo sapiens
acaggcctgaagat

SEQ ID NO: 6606624 - DNA, 15 bp, Homo sapiens
acaggcctgaagata

SEQ ID NO: 6606625 - DNA, 17 bp, Homo sapiens
acaggcctggcccagcc

SEQ ID NO: 6606626 - DNA, 18 bp, Homo sapiens
acaggcctggcccagcca

SEQ ID NO: 6606627 - DNA, 19 bp, Homo sapiens
acaggcctggcccagccag

SEQ ID NO: 6606628 - DNA, 13 bp, Homo sapiens
acaggcctggcct

SEQ ID NO: 6606629 - DNA, 15 bp, Homo sapiens
acaggcctggcctca

SEQ ID NO: 6606630 - DNA, 16 bp, Homo sapiens
acaggccttcctcctc

SEQ ID NO: 6606631 - DNA, 17 bp, Homo sapiens
acaggccttcctcctct

SEQ ID NO: 6606632 - DNA, 20 bp, Homo sapiens
acaggccttcctcctctcaa

SEQ ID NO: 6606633 - DNA, 12 bp, Homo sapiens
acaggccttctg

SEQ ID NO: 6606634 - DNA, 19 bp, Homo sapiens
acaggccttctgtggggct

SEQ ID NO: 6606635 - DNA, 20 bp, Homo sapiens
acaggccttctgtggggctg

SEQ ID NO: 6606636 - DNA, 20 bp, Homo sapiens
acaggcctttccctgccggc

SEQ ID NO: 6606637 - DNA, 14 bp, Homo sapiens
acaggcgagagagg

SEQ ID NO: 6606638 - DNA, 21 bp, Homo sapiens
acaggcgagagaggagccaga

SEQ ID NO: 6606639 - DNA, 14 bp, Homo sapiens
acaggcgaggcctg

SEQ ID NO: 6606640 - DNA, 14 bp, Homo sapiens
acaggcgggctcgg

SEQ ID NO: 6606641 - DNA, 15 bp, Homo sapiens
acaggcgggctcgga

SEQ ID NO: 6606642 - DNA, 18 bp, Homo sapiens
acaggcgggctcggaggc

SEQ ID NO: 6606643 - DNA, 21 bp, Homo sapiens
acaggcggggcccagcgctct

SEQ ID NO: 6606644 - DNA, 15 bp, Homo sapiens
acaggcgtgagccac

SEQ ID NO: 6606645 - DNA, 22 bp, Homo sapiens
acaggcgtgagccactgttccc

SEQ ID NO: 6606646 - DNA, 16 bp, Homo sapiens
acaggctatcaacatg

SEQ ID NO: 6606647 - DNA, 20 bp, Homo sapiens
acaggctcaaacaatgacaa

SEQ ID NO: 6606648 - DNA, 12 bp, Homo sapiens
acaggctcaggc

SEQ ID NO: 6606649 - DNA, 20 bp, Homo sapiens
acaggctccaagaggctgag

SEQ ID NO: 6606650 - DNA, 12 bp, Homo sapiens
acaggctcctgc

SEQ ID NO: 6606651 - DNA, 13 bp, Homo sapiens
acaggctcctgcc

SEQ ID NO: 6606652 - DNA, 15 bp, Homo sapiens
acaggctcctgccac

SEQ ID NO: 6606653 - DNA, 22 bp, Homo sapiens
acaggctcctgccaccacgccc

SEQ ID NO: 6606654 - DNA, 17 bp, Homo sapiens
acaggctcgtcagccac

SEQ ID NO: 6606655 - DNA, 21 bp, Homo sapiens
acaggctcgtcagccacctgg

SEQ ID NO: 6606656 - DNA, 18 bp, Homo sapiens
acaggctctagagagagg

SEQ ID NO: 6606657 - DNA, 22 bp, Homo sapiens
acaggctctcctggctgtccta

SEQ ID NO: 6606658 - DNA, 16 bp, Homo sapiens
acaggctctgaggggc

SEQ ID NO: 6606659 - DNA, 19 bp, Homo sapiens
acaggctcttctttcccaa

SEQ ID NO: 6606660 - DNA, 22 bp, Homo sapiens
acaggctgaaatatccacccag

SEQ ID NO: 6606661 - DNA, 19 bp, Homo sapiens
acaggctgaagagagggac

SEQ ID NO: 6606662 - DNA, 16 bp, Homo sapiens
acaggctgagtgcagg

SEQ ID NO: 6606663 - DNA, 23 bp, Homo sapiens
acaggctgagtgcaggcccaccc

SEQ ID NO: 6606664 - DNA, 21 bp, Homo sapiens
acaggctgcaagctgcaggga

SEQ ID NO: 6606665 - DNA, 18 bp, Homo sapiens
acaggctggaagatagct

SEQ ID NO: 6606666 - DNA, 20 bp, Homo sapiens
acaggctggaatgagggagg

SEQ ID NO: 6606667 - DNA, 14 bp, Homo sapiens
acaggctggcgggg

SEQ ID NO: 6606668 - DNA, 17 bp, Homo sapiens
acaggctgggctgggca

SEQ ID NO: 6606669 - DNA, 21 bp, Homo sapiens
acaggctgggctgggcactgc

SEQ ID NO: 6606670 - DNA, 22 bp, Homo sapiens
acaggctgggcttcagtggcag

SEQ ID NO: 6606671 - DNA, 16 bp, Homo sapiens
acaggctggggccttt

SEQ ID NO: 6606672 - DNA, 14 bp, Homo sapiens
acaggctgggtcaa

SEQ ID NO: 6606673 - DNA, 17 bp, Homo sapiens
acaggctgggtcctgcc

SEQ ID NO: 6606674 - DNA, 23 bp, Homo sapiens
acaggctgggtcctgccagctgg

SEQ ID NO: 6606675 - DNA, 14 bp, Homo sapiens
acaggctggttctg

SEQ ID NO: 6606676 - DNA, 19 bp, Homo sapiens
acaggctgtaaattgaact

SEQ ID NO: 6606677 - DNA, 23 bp, Homo sapiens
acaggctgtccttaacccacctc

SEQ ID NO: 6606678 - DNA, 17 bp, Homo sapiens
acaggctgtgactcttc

SEQ ID NO: 6606679 - DNA, 22 bp, Homo sapiens
acaggcttacgctgctctcctg

SEQ ID NO: 6606680 - DNA, 23 bp, Homo sapiens
acaggcttacgctgctctcctga

SEQ ID NO: 6606681 - DNA, 14 bp, Homo sapiens
acaggcttagtgat

SEQ ID NO: 6606682 - DNA, 15 bp, Homo sapiens
acagggaaaaaaaga

SEQ ID NO: 6606683 - DNA, 17 bp, Homo sapiens
acagggaaaaaaagaaa

SEQ ID NO: 6606684 - DNA, 17 bp, Homo sapiens
acagggaaacctttttt

SEQ ID NO: 6606685 - DNA, 16 bp, Homo sapiens
acagggaaatgtgtat

SEQ ID NO: 6606686 - DNA, 20 bp, Homo sapiens
acagggaacattggagctga

SEQ ID NO: 6606687 - DNA, 15 bp, Homo sapiens
acagggaagaaatca

SEQ ID NO: 6606688 - DNA, 15 bp, Homo sapiens
acagggaagagcaga

SEQ ID NO: 6606689 - DNA, 13 bp, Homo sapiens
acagggaagctac

SEQ ID NO: 6606690 - DNA, 23 bp, Homo sapiens
acagggaagctacaggttacaac

SEQ ID NO: 6606691 - DNA, 23 bp, Homo sapiens
acagggaaggcaggcagggctct

SEQ ID NO: 6606692 - DNA, 22 bp, Homo sapiens
acagggaagggcttggccagcg

SEQ ID NO: 6606693 - DNA, 17 bp, Homo sapiens
acagggaatgctgaggc

SEQ ID NO: 6606694 - DNA, 22 bp, Homo sapiens
acagggaatggccacaaacctg

SEQ ID NO: 6606695 - DNA, 17 bp, Homo sapiens
acagggacacagtctgg

SEQ ID NO: 6606696 - DNA, 20 bp, Homo sapiens
acagggacacagtctggtgc

SEQ ID NO: 6606697 - DNA, 16 bp, Homo sapiens
acagggaccacatcca

SEQ ID NO: 6606698 - DNA, 14 bp, Homo sapiens
acagggaccagctc

SEQ ID NO: 6606699 - DNA, 17 bp, Homo sapiens
acagggaccagctcccc

SEQ ID NO: 6606700 - DNA, 12 bp, Homo sapiens
acagggacccac

SEQ ID NO: 6606701 - DNA, 19 bp, Homo sapiens
acagggactacgtattttt

SEQ ID NO: 6606702 - DNA, 17 bp, Homo sapiens
acagggactttgctggt

SEQ ID NO: 6606703 - DNA, 18 bp, Homo sapiens
acagggagaattgaaact

SEQ ID NO: 6606704 - DNA, 16 bp, Homo sapiens
acagggagccacacag

SEQ ID NO: 6606705 - DNA, 17 bp, Homo sapiens
acagggagcccctagga

SEQ ID NO: 6606706 - DNA, 18 bp, Homo sapiens
acagggagcccctaggaa

SEQ ID NO: 6606707 - DNA, 21 bp, Homo sapiens
acagggagcccctaggaaagc

SEQ ID NO: 6606708 - DNA, 13 bp, Homo sapiens
acagggagcctcc

SEQ ID NO: 6606709 - DNA, 13 bp, Homo sapiens
acagggagctggc

SEQ ID NO: 6606710 - DNA, 16 bp, Homo sapiens
acagggagctgggaca

SEQ ID NO: 6606711 - DNA, 17 bp, Homo sapiens
acagggaggccacacgc

SEQ ID NO: 6606712 - DNA, 19 bp, Homo sapiens
acagggaggccacacgcac

SEQ ID NO: 6606713 - DNA, 14 bp, Homo sapiens
acagggaggctccc

SEQ ID NO: 6606714 - DNA, 23 bp, Homo sapiens
acagggaggctcccggggcctgg

SEQ ID NO: 6606715 - DNA, 14 bp, Homo sapiens
acagggaggctgta

SEQ ID NO: 6606716 - DNA, 10 bp, Homo sapiens
acagggaggg

SEQ ID NO: 6606717 - DNA, 12 bp, Homo sapiens
acagggaggggg

SEQ ID NO: 6606718 - DNA, 23 bp, Homo sapiens
acagggatctgtttgaacactta

SEQ ID NO: 6606719 - DNA, 13 bp, Homo sapiens
acagggatgagca

SEQ ID NO: 6606720 - DNA, 14 bp, Homo sapiens
acagggatgagcat

SEQ ID NO: 6606721 - DNA, 17 bp, Homo sapiens
acagggatggcgaggcc

SEQ ID NO: 6606722 - DNA, 21 bp, Homo sapiens
acagggatggcgaggcctctc

SEQ ID NO: 6606723 - DNA, 16 bp, Homo sapiens
acagggattctcacaa

SEQ ID NO: 6606724 - DNA, 15 bp, Homo sapiens
acagggcaaaatgaa

SEQ ID NO: 6606725 - DNA, 14 bp, Homo sapiens
acagggcaatcttg

SEQ ID NO: 6606726 - DNA, 19 bp, Homo sapiens
acagggcaatcttgtccac

SEQ ID NO: 6606727 - DNA, 12 bp, Homo sapiens
acagggcacacc

SEQ ID NO: 6606728 - DNA, 22 bp, Homo sapiens
acagggcacaccgggcactcag

SEQ ID NO: 6606729 - DNA, 13 bp, Homo sapiens
acagggcaccaga

SEQ ID NO: 6606730 - DNA, 14 bp, Homo sapiens
acagggcaccagag

SEQ ID NO: 6606731 - DNA, 17 bp, Homo sapiens
acagggcacctgccacc

SEQ ID NO: 6606732 - DNA, 21 bp, Homo sapiens
acagggcagctgggcccaacc

SEQ ID NO: 6606733 - DNA, 17 bp, Homo sapiens
acagggcaggagctgct

SEQ ID NO: 6606734 - DNA, 19 bp, Homo sapiens
acagggcaggagctgctgt

SEQ ID NO: 6606735 - DNA, 22 bp, Homo sapiens
acagggcaggagctgctgtggt

SEQ ID NO: 6606736 - DNA, 21 bp, Homo sapiens
acagggcaggccttgctgggg

SEQ ID NO: 6606737 - DNA, 14 bp, Homo sapiens
acagggcagtgaca

SEQ ID NO: 6606738 - DNA, 23 bp, Homo sapiens
acagggcatgccccggccacctc

SEQ ID NO: 6606739 - DNA, 24 bp, Homo sapiens
acagggcatgccccggccacctct

SEQ ID NO: 6606740 - DNA, 17 bp, Homo sapiens
acagggcatgcctggcc

SEQ ID NO: 6606741 - DNA, 13 bp, Homo sapiens
acagggccagggt

SEQ ID NO: 6606742 - DNA, 14 bp, Homo sapiens
acagggccagggtt

SEQ ID NO: 6606743 - DNA, 15 bp, Homo sapiens
acagggccagggttg

SEQ ID NO: 6606744 - DNA, 20 bp, Homo sapiens
acagggccagtggggcctgt

SEQ ID NO: 6606745 - DNA, 23 bp, Homo sapiens
acagggccagtggggcctgtgga

SEQ ID NO: 6606746 - DNA, 21 bp, Homo sapiens
acagggcccaggaatctgtgt

SEQ ID NO: 6606747 - DNA, 18 bp, Homo sapiens
acagggcccagttaaata

SEQ ID NO: 6606748 - DNA, 12 bp, Homo sapiens
acagggcccgca

SEQ ID NO: 6606749 - DNA, 19 bp, Homo sapiens
acagggcccgcagtgctgg

SEQ ID NO: 6606750 - DNA, 20 bp, Homo sapiens
acagggcccgggcccaggca

SEQ ID NO: 6606751 - DNA, 13 bp, Homo sapiens
acagggcctggcc

SEQ ID NO: 6606752 - DNA, 15 bp, Homo sapiens
acagggcctggccca

SEQ ID NO: 6606753 - DNA, 14 bp, Homo sapiens
acagggcggggggg

SEQ ID NO: 6606754 - DNA, 21 bp, Homo sapiens
acagggcgggggggggggcgg

SEQ ID NO: 6606755 - DNA, 23 bp, Homo sapiens
acagggcggtaccttgtgcccag

SEQ ID NO: 6606756 - DNA, 13 bp, Homo sapiens
acagggcgtcctc

SEQ ID NO: 6606757 - DNA, 15 bp, Homo sapiens
acagggcgtcctctc

SEQ ID NO: 6606758 - DNA, 13 bp, Homo sapiens
acagggctcacag

SEQ ID NO: 6606759 - DNA, 18 bp, Homo sapiens
acagggctcacagggcag

SEQ ID NO: 6606760 - DNA, 19 bp, Homo sapiens
acagggctcacagggcagg

SEQ ID NO: 6606761 - DNA, 12 bp, Homo sapiens
acagggctccag

SEQ ID NO: 6606762 - DNA, 22 bp, Homo sapiens
acagggctctttgatggaccca

SEQ ID NO: 6606763 - DNA, 16 bp, Homo sapiens
acagggctgccttctg

SEQ ID NO: 6606764 - DNA, 14 bp, Homo sapiens
acagggctgctccc

SEQ ID NO: 6606765 - DNA, 15 bp, Homo sapiens
acagggctggcccag

SEQ ID NO: 6606766 - DNA, 16 bp, Homo sapiens
acagggctggcccagc

SEQ ID NO: 6606767 - DNA, 24 bp, Homo sapiens
acagggctggcccagccctgctgg

SEQ ID NO: 6606768 - DNA, 11 bp, Homo sapiens
acagggcttct

SEQ ID NO: 6606769 - DNA, 16 bp, Homo sapiens
acagggcttctcctgc

SEQ ID NO: 6606770 - DNA, 18 bp, Homo sapiens
acagggcttctcttttta

SEQ ID NO: 6606771 - DNA, 19 bp, Homo sapiens
acagggcttggggagcagg

SEQ ID NO: 6606772 - DNA, 13 bp, Homo sapiens
acagggcttgtcc

SEQ ID NO: 6606773 - DNA, 13 bp, Homo sapiens
acagggcttgttt

SEQ ID NO: 6606774 - DNA, 22 bp, Homo sapiens
acaggggaaggaaataacattg

SEQ ID NO: 6606775 - DNA, 14 bp, Homo sapiens
acaggggaggaaaa

SEQ ID NO: 6606776 - DNA, 14 bp, Homo sapiens
acaggggaggctga

SEQ ID NO: 6606777 - DNA, 15 bp, Homo sapiens
acaggggaggggcgc

SEQ ID NO: 6606778 - DNA, 21 bp, Homo sapiens
acaggggcaaaagtcattgct

SEQ ID NO: 6606779 - DNA, 17 bp, Homo sapiens
acaggggcaccctccaa

SEQ ID NO: 6606780 - DNA, 15 bp, Homo sapiens
acaggggcaggcctg

SEQ ID NO: 6606781 - DNA, 17 bp, Homo sapiens
acaggggcaggcctggg

SEQ ID NO: 6606782 - DNA, 12 bp, Homo sapiens
acaggggccaga

SEQ ID NO: 6606783 - DNA, 14 bp, Homo sapiens
acaggggccatgcc

SEQ ID NO: 6606784 - DNA, 23 bp, Homo sapiens
acaggggccccagatctgcctgg

SEQ ID NO: 6606785 - DNA, 12 bp, Homo sapiens
acaggggccctg

SEQ ID NO: 6606786 - DNA, 13 bp, Homo sapiens
acaggggccctgt

SEQ ID NO: 6606787 - DNA, 19 bp, Homo sapiens
acaggggcggggcaggaat

SEQ ID NO: 6606788 - DNA, 14 bp, Homo sapiens
acaggggctcagga

SEQ ID NO: 6606789 - DNA, 19 bp, Homo sapiens
acaggggctggtgggcacc

SEQ ID NO: 6606790 - DNA, 22 bp, Homo sapiens
acagggggattctgagcagtgc

SEQ ID NO: 6606791 - DNA, 16 bp, Homo sapiens
acaggggggtcggaag

SEQ ID NO: 6606792 - DNA, 22 bp, Homo sapiens
acaggggggtcggaagcctgtc

SEQ ID NO: 6606793 - DNA, 13 bp, Homo sapiens
acagggggtctgg

SEQ ID NO: 6606794 - DNA, 17 bp, Homo sapiens
acagggggtctggctgg

SEQ ID NO: 6606795 - DNA, 19 bp, Homo sapiens
acagggggtctggctggtg

SEQ ID NO: 6606796 - DNA, 20 bp, Homo sapiens
acagggggtctggctggtgt

SEQ ID NO: 6606797 - DNA, 13 bp, Homo sapiens
acaggggttcctt

SEQ ID NO: 6606798 - DNA, 23 bp, Homo sapiens
acagggtaactgtgctgaatgct

SEQ ID NO: 6606799 - DNA, 18 bp, Homo sapiens
acagggtaccaggataaa

SEQ ID NO: 6606800 - DNA, 23 bp, Homo sapiens
acagggtaccaggataaagccga

SEQ ID NO: 6606801 - DNA, 19 bp, Homo sapiens
acagggtactaaaagaaac

SEQ ID NO: 6606802 - DNA, 17 bp, Homo sapiens
acagggtccaggaatgg

SEQ ID NO: 6606803 - DNA, 18 bp, Homo sapiens
acagggtccccgagtgcc

SEQ ID NO: 6606804 - DNA, 14 bp, Homo sapiens
acagggtcctgcta

SEQ ID NO: 6606805 - DNA, 22 bp, Homo sapiens
acagggtcgggggggtccccat

SEQ ID NO: 6606806 - DNA, 16 bp, Homo sapiens
acagggtctcactgtg

SEQ ID NO: 6606807 - DNA, 19 bp, Homo sapiens
acagggtctcactgtgttg

SEQ ID NO: 6606808 - DNA, 23 bp, Homo sapiens
acagggtctctagtgctgtgaaa

SEQ ID NO: 6606809 - DNA, 14 bp, Homo sapiens
acagggtctgctct

SEQ ID NO: 6606810 - DNA, 24 bp, Homo sapiens
acagggtctgctctttctctgcca

SEQ ID NO: 6606811 - DNA, 20 bp, Homo sapiens
acagggtcttgctctgtccc

SEQ ID NO: 6606812 - DNA, 14 bp, Homo sapiens
acagggtctttttt

SEQ ID NO: 6606813 - DNA, 21 bp, Homo sapiens
acagggtgagggccacctcca

SEQ ID NO: 6606814 - DNA, 9 bp, Homo sapiens
acagggtgc

SEQ ID NO: 6606815 - DNA, 22 bp, Homo sapiens
acagggtggaccccctgagtca

SEQ ID NO: 6606816 - DNA, 14 bp, Homo sapiens
acagggtggcaccc

SEQ ID NO: 6606817 - DNA, 16 bp, Homo sapiens
acagggtggcacccac

SEQ ID NO: 6606818 - DNA, 17 bp, Homo sapiens
acagggtggcacccacc

SEQ ID NO: 6606819 - DNA, 21 bp, Homo sapiens
acagggtggcacccaccactc

SEQ ID NO: 6606820 - DNA, 12 bp, Homo sapiens
acagggtgggag

SEQ ID NO: 6606821 - DNA, 20 bp, Homo sapiens
acagggtgggatgagcctct

SEQ ID NO: 6606822 - DNA, 14 bp, Homo sapiens
acagggtgggcctc

SEQ ID NO: 6606823 - DNA, 21 bp, Homo sapiens
acagggtggggcttagaatgg

SEQ ID NO: 6606824 - DNA, 23 bp, Homo sapiens
acagggtgtggtatgagggggtg

SEQ ID NO: 6606825 - DNA, 22 bp, Homo sapiens
acagggtttggctgtgtctaaa

SEQ ID NO: 6606826 - DNA, 13 bp, Homo sapiens
acagggttttgta

SEQ ID NO: 6606827 - DNA, 22 bp, Homo sapiens
acaggtaaaacagggccacata

SEQ ID NO: 6606828 - DNA, 21 bp, Homo sapiens
acaggtaaacacataaatgaa

SEQ ID NO: 6606829 - DNA, 22 bp, Homo sapiens
acaggtaaacacataaatgaaa

SEQ ID NO: 6606830 - DNA, 17 bp, Homo sapiens
acaggtaagtggcagga

SEQ ID NO: 6606831 - DNA, 17 bp, Homo sapiens
acaggtaccagttcttt

SEQ ID NO: 6606832 - DNA, 14 bp, Homo sapiens
acaggtacttggag

SEQ ID NO: 6606833 - DNA, 22 bp, Homo sapiens
acaggtagaattatctaattta

SEQ ID NO: 6606834 - DNA, 23 bp, Homo sapiens
acaggtatcaggcacaggcagga

SEQ ID NO: 6606835 - DNA, 12 bp, Homo sapiens
acaggtattttg

SEQ ID NO: 6606836 - DNA, 21 bp, Homo sapiens
acaggtattttgtttctttta

SEQ ID NO: 6606837 - DNA, 17 bp, Homo sapiens
acaggtatttttttaaa

SEQ ID NO: 6606838 - DNA, 19 bp, Homo sapiens
acaggtatttttttaaatc

SEQ ID NO: 6606839 - DNA, 21 bp, Homo sapiens
acaggtatttttttaaatcaa

SEQ ID NO: 6606840 - DNA, 19 bp, Homo sapiens
acaggtcaaagatgtgttc

SEQ ID NO: 6606841 - DNA, 23 bp, Homo sapiens
acaggtcaagaaatagcgcagtg

SEQ ID NO: 6606842 - DNA, 22 bp, Homo sapiens
acaggtcaatacagtacaggca

SEQ ID NO: 6606843 - DNA, 18 bp, Homo sapiens
acaggtcaccattatgct

SEQ ID NO: 6606844 - DNA, 18 bp, Homo sapiens
acaggtcacccatcagga

SEQ ID NO: 6606845 - DNA, 15 bp, Homo sapiens
acaggtcagggctca

SEQ ID NO: 6606846 - DNA, 22 bp, Homo sapiens
acaggtcagtttatgaaacaga

SEQ ID NO: 6606847 - DNA, 14 bp, Homo sapiens
acaggtccaaggac

SEQ ID NO: 6606848 - DNA, 13 bp, Homo sapiens
acaggtcccacct

SEQ ID NO: 6606849 - DNA, 18 bp, Homo sapiens
acaggtcccacctccagc

SEQ ID NO: 6606850 - DNA, 13 bp, Homo sapiens
acaggtccctccc

SEQ ID NO: 6606851 - DNA, 22 bp, Homo sapiens
acaggtccgtttccttacacat

SEQ ID NO: 6606852 - DNA, 21 bp, Homo sapiens
acaggtcctccatcacccctg

SEQ ID NO: 6606853 - DNA, 17 bp, Homo sapiens
acaggtcgagctgtgct

SEQ ID NO: 6606854 - DNA, 19 bp, Homo sapiens
acaggtcgagctgtgctcg

SEQ ID NO: 6606855 - DNA, 13 bp, Homo sapiens
acaggtctagact

SEQ ID NO: 6606856 - DNA, 18 bp, Homo sapiens
acaggtctcctcttaaaa

SEQ ID NO: 6606857 - DNA, 18 bp, Homo sapiens
acaggtctctgagacagg

SEQ ID NO: 6606858 - DNA, 12 bp, Homo sapiens
acaggtctctgt

SEQ ID NO: 6606859 - DNA, 16 bp, Homo sapiens
acaggtctctgtttag

SEQ ID NO: 6606860 - DNA, 19 bp, Homo sapiens
acaggtcttcactgcccag

SEQ ID NO: 6606861 - DNA, 16 bp, Homo sapiens
acaggtcttcatcgaa

SEQ ID NO: 6606862 - DNA, 23 bp, Homo sapiens
acaggtcttctttaaggaagaat

SEQ ID NO: 6606863 - DNA, 13 bp, Homo sapiens
acaggtctttgaa

SEQ ID NO: 6606864 - DNA, 17 bp, Homo sapiens
acaggtctttgaaatat

SEQ ID NO: 6606865 - DNA, 21 bp, Homo sapiens
acaggtgaaagtttttctgaa

SEQ ID NO: 6606866 - DNA, 19 bp, Homo sapiens
acaggtgacagtggctgct

SEQ ID NO: 6606867 - DNA, 14 bp, Homo sapiens
acaggtgatgctct

SEQ ID NO: 6606868 - DNA, 17 bp, Homo sapiens
acaggtgatgctctggc

SEQ ID NO: 6606869 - DNA, 16 bp, Homo sapiens
acaggtgcctggggct

SEQ ID NO: 6606870 - DNA, 16 bp, Homo sapiens
acaggtgcgcccctgg

SEQ ID NO: 6606871 - DNA, 17 bp, Homo sapiens
acaggtgcgggaccatc

SEQ ID NO: 6606872 - DNA, 20 bp, Homo sapiens
acaggtgcgggaccatctga

SEQ ID NO: 6606873 - DNA, 14 bp, Homo sapiens
acaggtgctggccc

SEQ ID NO: 6606874 - DNA, 15 bp, Homo sapiens
acaggtgctggccca

SEQ ID NO: 6606875 - DNA, 19 bp, Homo sapiens
acaggtgctggcccagcat

SEQ ID NO: 6606876 - DNA, 21 bp, Homo sapiens
acaggtgctggcccagcatgg

SEQ ID NO: 6606877 - DNA, 22 bp, Homo sapiens
acaggtgctggcccagcatgga

SEQ ID NO: 6606878 - DNA, 18 bp, Homo sapiens
acaggtggacacacaagg

SEQ ID NO: 6606879 - DNA, 19 bp, Homo sapiens
acaggtggaggcgagccag

SEQ ID NO: 6606880 - DNA, 19 bp, Homo sapiens
acaggtggcaggaccagga

SEQ ID NO: 6606881 - DNA, 13 bp, Homo sapiens
acaggtggctgtt

SEQ ID NO: 6606882 - DNA, 14 bp, Homo sapiens
acaggtgggagatg

SEQ ID NO: 6606883 - DNA, 22 bp, Homo sapiens
acaggtgggaggaaagggcctg

SEQ ID NO: 6606884 - DNA, 13 bp, Homo sapiens
acaggtgggcctg

SEQ ID NO: 6606885 - DNA, 12 bp, Homo sapiens
acaggtggggac

SEQ ID NO: 6606886 - DNA, 16 bp, Homo sapiens
acaggtggggcctcag

SEQ ID NO: 6606887 - DNA, 23 bp, Homo sapiens
acaggtggtgtcactgtccctcc

SEQ ID NO: 6606888 - DNA, 13 bp, Homo sapiens
acaggtggttttt

SEQ ID NO: 6606889 - DNA, 17 bp, Homo sapiens
acaggtgtccccagccc

SEQ ID NO: 6606890 - DNA, 15 bp, Homo sapiens
acaggtgtctgccta

SEQ ID NO: 6606891 - DNA, 18 bp, Homo sapiens
acaggtgtctgcctagat

SEQ ID NO: 6606892 - DNA, 21 bp, Homo sapiens
acaggtgtgagccaccacgcc

SEQ ID NO: 6606893 - DNA, 20 bp, Homo sapiens
acaggtgtgagccactgcgc

SEQ ID NO: 6606894 - DNA, 19 bp, Homo sapiens
acaggtgtgagccactgtg

SEQ ID NO: 6606895 - DNA, 22 bp, Homo sapiens
acaggtgtgagtcaccaagccc

SEQ ID NO: 6606896 - DNA, 18 bp, Homo sapiens
acaggtgtggggacacag

SEQ ID NO: 6606897 - DNA, 13 bp, Homo sapiens
acaggtgtgtatg

SEQ ID NO: 6606898 - DNA, 15 bp, Homo sapiens
acaggtgtgtatgta

SEQ ID NO: 6606899 - DNA, 17 bp, Homo sapiens
acaggtgtgtgtgaact

SEQ ID NO: 6606900 - DNA, 20 bp, Homo sapiens
acaggttaaatatataaaca

SEQ ID NO: 6606901 - DNA, 13 bp, Homo sapiens
acaggttacaaca

SEQ ID NO: 6606902 - DNA, 14 bp, Homo sapiens
acaggttacaacag

SEQ ID NO: 6606903 - DNA, 16 bp, Homo sapiens
acaggttacaacagat

SEQ ID NO: 6606904 - DNA, 19 bp, Homo sapiens
acaggttacaacagatttg

SEQ ID NO: 6606905 - DNA, 23 bp, Homo sapiens
acaggttacaacagatttgtgaa

SEQ ID NO: 6606906 - DNA, 21 bp, Homo sapiens
acaggttactaccctcaccct

SEQ ID NO: 6606907 - DNA, 15 bp, Homo sapiens
acaggttataacagt

SEQ ID NO: 6606908 - DNA, 14 bp, Homo sapiens
acaggttattttag

SEQ ID NO: 6606909 - DNA, 22 bp, Homo sapiens
acaggttattttagtttctgtt

SEQ ID NO: 6606910 - DNA, 16 bp, Homo sapiens
acaggttcccagcagc

SEQ ID NO: 6606911 - DNA, 18 bp, Homo sapiens
acaggttcccagcagctg

SEQ ID NO: 6606912 - DNA, 22 bp, Homo sapiens
acaggttcccagcagctgggcc

SEQ ID NO: 6606913 - DNA, 23 bp, Homo sapiens
acaggttcctgtggagacactga

SEQ ID NO: 6606914 - DNA, 15 bp, Homo sapiens
acaggttccttttaa

SEQ ID NO: 6606915 - DNA, 16 bp, Homo sapiens
acaggttccttttgaa

SEQ ID NO: 6606916 - DNA, 16 bp, Homo sapiens
acaggttgaggctaaa

SEQ ID NO: 6606917 - DNA, 15 bp, Homo sapiens
acaggttggaagaga

SEQ ID NO: 6606918 - DNA, 16 bp, Homo sapiens
acaggttggaagagaa

SEQ ID NO: 6606919 - DNA, 14 bp, Homo sapiens
acaggtttaaaaat

SEQ ID NO: 6606920 - DNA, 22 bp, Homo sapiens
acaggtttggggagggggaaga

SEQ ID NO: 6606921 - DNA, 18 bp, Homo sapiens
acaggttttaaaagcctt

SEQ ID NO: 6606922 - DNA, 12 bp, Homo sapiens
acaggttttaag

SEQ ID NO: 6606923 - DNA, 14 bp, Homo sapiens
acaggttttaagga

SEQ ID NO: 6606924 - DNA, 21 bp, Homo sapiens
acaggtttttagtttgttctt

SEQ ID NO: 6606925 - DNA, 19 bp, Homo sapiens
acaggtttttttggattta

SEQ ID NO: 6606926 - DNA, 22 bp, Homo sapiens
acagtaaaaacttgtactatgt

SEQ ID NO: 6606927 - DNA, 23 bp, Homo sapiens
acagtaaaaacttgtactatgtt

SEQ ID NO: 6606928 - DNA, 14 bp, Homo sapiens
acagtaaaaataaa

SEQ ID NO: 6606929 - DNA, 16 bp, Homo sapiens
acagtaaaacaggctg

SEQ ID NO: 6606930 - DNA, 17 bp, Homo sapiens
acagtaaaccactgaaa

SEQ ID NO: 6606931 - DNA, 17 bp, Homo sapiens
acagtaaagaccattta

SEQ ID NO: 6606932 - DNA, 18 bp, Homo sapiens
acagtaaagaggcttcca

SEQ ID NO: 6606933 - DNA, 13 bp, Homo sapiens
acagtaaataaat

SEQ ID NO: 6606934 - DNA, 14 bp, Homo sapiens
acagtaaataaatt

SEQ ID NO: 6606935 - DNA, 16 bp, Homo sapiens
acagtaaatacactgt

SEQ ID NO: 6606936 - DNA, 18 bp, Homo sapiens
acagtaaatacactgtga

SEQ ID NO: 6606937 - DNA, 13 bp, Homo sapiens
acagtaaatatac

SEQ ID NO: 6606938 - DNA, 15 bp, Homo sapiens
acagtaaatatacac

SEQ ID NO: 6606939 - DNA, 21 bp, Homo sapiens
acagtaaatatcccaaactgt

SEQ ID NO: 6606940 - DNA, 23 bp, Homo sapiens
acagtaaatatcccaaactgtga

SEQ ID NO: 6606941 - DNA, 21 bp, Homo sapiens
acagtaacatagctgtgattt

SEQ ID NO: 6606942 - DNA, 17 bp, Homo sapiens
acagtaacgcaggggaa

SEQ ID NO: 6606943 - DNA, 17 bp, Homo sapiens
acagtaactaagcacat

SEQ ID NO: 6606944 - DNA, 22 bp, Homo sapiens
acagtaactaagcacattatgt

SEQ ID NO: 6606945 - DNA, 15 bp, Homo sapiens
acagtaagagtttac

SEQ ID NO: 6606946 - DNA, 14 bp, Homo sapiens
acagtaagcatgct

SEQ ID NO: 6606947 - DNA, 14 bp, Homo sapiens
acagtaagctgctc

SEQ ID NO: 6606948 - DNA, 16 bp, Homo sapiens
acagtaagttcctact

SEQ ID NO: 6606949 - DNA, 13 bp, Homo sapiens
acagtaataggag

SEQ ID NO: 6606950 - DNA, 19 bp, Homo sapiens
acagtaatatgtttaatgt

SEQ ID NO: 6606951 - DNA, 22 bp, Homo sapiens
acagtaatctatgtgtttctgt

SEQ ID NO: 6606952 - DNA, 19 bp, Homo sapiens
acagtaatgaaatgtttac

SEQ ID NO: 6606953 - DNA, 15 bp, Homo sapiens
acagtaatgtagaaa

SEQ ID NO: 6606954 - DNA, 17 bp, Homo sapiens
acagtaatgtagaaatg

SEQ ID NO: 6606955 - DNA, 21 bp, Homo sapiens
acagtaattattatttaactc

SEQ ID NO: 6606956 - DNA, 12 bp, Homo sapiens
acagtacaataa

SEQ ID NO: 6606957 - DNA, 19 bp, Homo sapiens
acagtacaataatgtactc

SEQ ID NO: 6606958 - DNA, 16 bp, Homo sapiens
acagtacaggcagcac

SEQ ID NO: 6606959 - DNA, 13 bp, Homo sapiens
acagtacatatgt

SEQ ID NO: 6606960 - DNA, 22 bp, Homo sapiens
acagtaccagtgtaaattcagt

SEQ ID NO: 6606961 - DNA, 15 bp, Homo sapiens
acagtaccatctgaa

SEQ ID NO: 6606962 - DNA, 19 bp, Homo sapiens
acagtacctcgtttctaca

SEQ ID NO: 6606963 - DNA, 16 bp, Homo sapiens
acagtactatgtaaat

SEQ ID NO: 6606964 - DNA, 21 bp, Homo sapiens
acagtactggttactttcaaa

SEQ ID NO: 6606965 - DNA, 22 bp, Homo sapiens
acagtactttattgtacagact

SEQ ID NO: 6606966 - DNA, 18 bp, Homo sapiens
acagtagaactgtctgtg

SEQ ID NO: 6606967 - DNA, 13 bp, Homo sapiens
acagtagagccag

SEQ ID NO: 6606968 - DNA, 14 bp, Homo sapiens
acagtagagccagc

SEQ ID NO: 6606969 - DNA, 23 bp, Homo sapiens
acagtagaggggtctcatgtctc

SEQ ID NO: 6606970 - DNA, 22 bp, Homo sapiens
acagtagcagggaattgatcca

SEQ ID NO: 6606971 - DNA, 16 bp, Homo sapiens
acagtagctcttagac

SEQ ID NO: 6606972 - DNA, 13 bp, Homo sapiens
acagtagctgtgg

SEQ ID NO: 6606973 - DNA, 21 bp, Homo sapiens
acagtagctgtggggagctgg

SEQ ID NO: 6606974 - DNA, 22 bp, Homo sapiens
acagtagctgtggggagctggt

SEQ ID NO: 6606975 - DNA, 18 bp, Homo sapiens
acagtagcttaaataaat

SEQ ID NO: 6606976 - DNA, 22 bp, Homo sapiens
acagtagcttaaataaattcaa

SEQ ID NO: 6606977 - DNA, 16 bp, Homo sapiens
acagtaggaattggaa

SEQ ID NO: 6606978 - DNA, 22 bp, Homo sapiens
acagtaggaattggaaataatt

SEQ ID NO: 6606979 - DNA, 14 bp, Homo sapiens
acagtaggagccca

SEQ ID NO: 6606980 - DNA, 15 bp, Homo sapiens
acagtaggattgctg

SEQ ID NO: 6606981 - DNA, 18 bp, Homo sapiens
acagtaggtcccggccag

SEQ ID NO: 6606982 - DNA, 23 bp, Homo sapiens
acagtagtcttgatgaccaaagt

SEQ ID NO: 6606983 - DNA, 18 bp, Homo sapiens
acagtagtgagaagaata

SEQ ID NO: 6606984 - DNA, 20 bp, Homo sapiens
acagtagtgagaagaatatt

SEQ ID NO: 6606985 - DNA, 19 bp, Homo sapiens
acagtagtgttgggtggag

SEQ ID NO: 6606986 - DNA, 14 bp, Homo sapiens
acagtagtttccct

SEQ ID NO: 6606987 - DNA, 23 bp, Homo sapiens
acagtagtttctcagggtcactg

SEQ ID NO: 6606988 - DNA, 18 bp, Homo sapiens
acagtataatttgacaaa

SEQ ID NO: 6606989 - DNA, 17 bp, Homo sapiens
acagtatagataaatcc

SEQ ID NO: 6606990 - DNA, 14 bp, Homo sapiens
acagtatataagct

SEQ ID NO: 6606991 - DNA, 17 bp, Homo sapiens
acagtatatcttaagat

SEQ ID NO: 6606992 - DNA, 18 bp, Homo sapiens
acagtatattctttggtt

SEQ ID NO: 6606993 - DNA, 13 bp, Homo sapiens
acagtatatttta

SEQ ID NO: 6606994 - DNA, 17 bp, Homo sapiens
acagtatattttatttc

SEQ ID NO: 6606995 - DNA, 15 bp, Homo sapiens
acagtatctgctgtt

SEQ ID NO: 6606996 - DNA, 21 bp, Homo sapiens
acagtatctgctgttcttcag

SEQ ID NO: 6606997 - DNA, 13 bp, Homo sapiens
acagtatcttcaa

SEQ ID NO: 6606998 - DNA, 14 bp, Homo sapiens
acagtatcttcaaa

SEQ ID NO: 6606999 - DNA, 22 bp, Homo sapiens
acagtatcttcaaaaatacaga

SEQ ID NO: 6607000 - DNA, 19 bp, Homo sapiens
acagtatgagaagaaaaat

SEQ ID NO: 6607001 - DNA, 21 bp, Homo sapiens
acagtatgagtcaatgtgcag

SEQ ID NO: 6607002 - DNA, 14 bp, Homo sapiens
acagtatgatgaaa

SEQ ID NO: 6607003 - DNA, 17 bp, Homo sapiens
acagtatgatgaaaata

SEQ ID NO: 6607004 - DNA, 23 bp, Homo sapiens
acagtatgatgaaaataattttc

SEQ ID NO: 6607005 - DNA, 10 bp, Homo sapiens
acagtatgtg

SEQ ID NO: 6607006 - DNA, 19 bp, Homo sapiens
acagtattaacatcaaaga

SEQ ID NO: 6607007 - DNA, 15 bp, Homo sapiens
acagtattatagaca

SEQ ID NO: 6607008 - DNA, 22 bp, Homo sapiens
acagtattatctgtgttaaaat

SEQ ID NO: 6607009 - DNA, 14 bp, Homo sapiens
acagtattatttag

SEQ ID NO: 6607010 - DNA, 14 bp, Homo sapiens
acagtattcagagt

SEQ ID NO: 6607011 - DNA, 14 bp, Homo sapiens
acagtattctgtac

SEQ ID NO: 6607012 - DNA, 12 bp, Homo sapiens
acagtattgcca

SEQ ID NO: 6607013 - DNA, 13 bp, Homo sapiens
acagtattgccac

SEQ ID NO: 6607014 - DNA, 16 bp, Homo sapiens
acagtattgctcaccc

SEQ ID NO: 6607015 - DNA, 14 bp, Homo sapiens
acagtattgggcag

SEQ ID NO: 6607016 - DNA, 14 bp, Homo sapiens
acagtattgtggca

SEQ ID NO: 6607017 - DNA, 19 bp, Homo sapiens
acagtatttattggtgggt

SEQ ID NO: 6607018 - DNA, 16 bp, Homo sapiens
acagtatttattttgt

SEQ ID NO: 6607019 - DNA, 18 bp, Homo sapiens
acagtatttattttgtaa

SEQ ID NO: 6607020 - DNA, 19 bp, Homo sapiens
acagtatttctacattaca

SEQ ID NO: 6607021 - DNA, 12 bp, Homo sapiens
acagtatttctt

SEQ ID NO: 6607022 - DNA, 21 bp, Homo sapiens
acagtatttctttgttataca

SEQ ID NO: 6607023 - DNA, 18 bp, Homo sapiens
acagtatttgtacaaata

SEQ ID NO: 6607024 - DNA, 12 bp, Homo sapiens
acagtattttaa

SEQ ID NO: 6607025 - DNA, 16 bp, Homo sapiens
acagtattttaagaag

SEQ ID NO: 6607026 - DNA, 14 bp, Homo sapiens
acagtattttccca

SEQ ID NO: 6607027 - DNA, 23 bp, Homo sapiens
acagtatttttcagatataaata

SEQ ID NO: 6607028 - DNA, 17 bp, Homo sapiens
acagtcaaaacagagat

SEQ ID NO: 6607029 - DNA, 18 bp, Homo sapiens
acagtcaaaacagagatg

SEQ ID NO: 6607030 - DNA, 17 bp, Homo sapiens
acagtcaaatttacatt

SEQ ID NO: 6607031 - DNA, 22 bp, Homo sapiens
acagtcaaatttacatttatct

SEQ ID NO: 6607032 - DNA, 15 bp, Homo sapiens
acagtcaacaagcct

SEQ ID NO: 6607033 - DNA, 22 bp, Homo sapiens
acagtcaaggagtggcttacta

SEQ ID NO: 6607034 - DNA, 13 bp, Homo sapiens
acagtcacaaatt

SEQ ID NO: 6607035 - DNA, 15 bp, Homo sapiens
acagtcaccaagtgt

SEQ ID NO: 6607036 - DNA, 16 bp, Homo sapiens
acagtcacccctccct

SEQ ID NO: 6607037 - DNA, 18 bp, Homo sapiens
acagtcacccctccctcc

SEQ ID NO: 6607038 - DNA, 13 bp, Homo sapiens
acagtcacctcac

SEQ ID NO: 6607039 - DNA, 16 bp, Homo sapiens
acagtcacctcatgga

SEQ ID NO: 6607040 - DNA, 16 bp, Homo sapiens
acagtcactgcatttg

SEQ ID NO: 6607041 - DNA, 15 bp, Homo sapiens
acagtcagcacagaa

SEQ ID NO: 6607042 - DNA, 16 bp, Homo sapiens
acagtcagctcttcat

SEQ ID NO: 6607043 - DNA, 20 bp, Homo sapiens
acagtcaggctactaaaata

SEQ ID NO: 6607044 - DNA, 20 bp, Homo sapiens
acagtcagggcggggctggc

SEQ ID NO: 6607045 - DNA, 21 bp, Homo sapiens
acagtcagggcggggctggcc

SEQ ID NO: 6607046 - DNA, 22 bp, Homo sapiens
acagtcagggcggggctggcca

SEQ ID NO: 6607047 - DNA, 14 bp, Homo sapiens
acagtcaggggctg

SEQ ID NO: 6607048 - DNA, 22 bp, Homo sapiens
acagtcaggggctgggcatccc

SEQ ID NO: 6607049 - DNA, 22 bp, Homo sapiens
acagtcagtggagagatgtttg

SEQ ID NO: 6607050 - DNA, 17 bp, Homo sapiens
acagtcatcatcagggc

SEQ ID NO: 6607051 - DNA, 15 bp, Homo sapiens
acagtcatcatttat

SEQ ID NO: 6607052 - DNA, 16 bp, Homo sapiens
acagtcatgtatgcaa

SEQ ID NO: 6607053 - DNA, 15 bp, Homo sapiens
acagtcattctagga

SEQ ID NO: 6607054 - DNA, 21 bp, Homo sapiens
acagtcattctaggatgtgga

SEQ ID NO: 6607055 - DNA, 21 bp, Homo sapiens
acagtcatttcctacccttta

SEQ ID NO: 6607056 - DNA, 18 bp, Homo sapiens
acagtccaaactgttctg

SEQ ID NO: 6607057 - DNA, 14 bp, Homo sapiens
acagtccaaccaga

SEQ ID NO: 6607058 - DNA, 17 bp, Homo sapiens
acagtccaaccagaaac

SEQ ID NO: 6607059 - DNA, 13 bp, Homo sapiens
acagtccacagct

SEQ ID NO: 6607060 - DNA, 19 bp, Homo sapiens
acagtccacagctgaagag

SEQ ID NO: 6607061 - DNA, 14 bp, Homo sapiens
acagtccagcctgg

SEQ ID NO: 6607062 - DNA, 15 bp, Homo sapiens
acagtccagcctgga

SEQ ID NO: 6607063 - DNA, 16 bp, Homo sapiens
acagtccagcctggag

SEQ ID NO: 6607064 - DNA, 18 bp, Homo sapiens
acagtccagcctggagat

SEQ ID NO: 6607065 - DNA, 18 bp, Homo sapiens
acagtccaggaacaagct

SEQ ID NO: 6607066 - DNA, 21 bp, Homo sapiens
acagtccagtgtcacctctct

SEQ ID NO: 6607067 - DNA, 15 bp, Homo sapiens
acagtcccactgtgc

SEQ ID NO: 6607068 - DNA, 17 bp, Homo sapiens
acagtcccccacccacc

SEQ ID NO: 6607069 - DNA, 18 bp, Homo sapiens
acagtcccccacccacct

SEQ ID NO: 6607070 - DNA, 23 bp, Homo sapiens
acagtcccccacccacctcctgc

SEQ ID NO: 6607071 - DNA, 16 bp, Homo sapiens
acagtccctcacctcc

SEQ ID NO: 6607072 - DNA, 12 bp, Homo sapiens
acagtccctgcc

SEQ ID NO: 6607073 - DNA, 12 bp, Homo sapiens
acagtccctgct

SEQ ID NO: 6607074 - DNA, 14 bp, Homo sapiens
acagtccctgctgg

SEQ ID NO: 6607075 - DNA, 15 bp, Homo sapiens
acagtcccttatgag

SEQ ID NO: 6607076 - DNA, 20 bp, Homo sapiens
acagtccctttggacaaatg

SEQ ID NO: 6607077 - DNA, 12 bp, Homo sapiens
acagtcctccat

SEQ ID NO: 6607078 - DNA, 15 bp, Homo sapiens
acagtcctccatcca

SEQ ID NO: 6607079 - DNA, 14 bp, Homo sapiens
acagtcctcccatc

SEQ ID NO: 6607080 - DNA, 15 bp, Homo sapiens
acagtcctcccatct

SEQ ID NO: 6607081 - DNA, 17 bp, Homo sapiens
acagtcctcccatctca

SEQ ID NO: 6607082 - DNA, 12 bp, Homo sapiens
acagtcctggga

SEQ ID NO: 6607083 - DNA, 13 bp, Homo sapiens
acagtcctggtta

SEQ ID NO: 6607084 - DNA, 18 bp, Homo sapiens
acagtccttaaaaatcac

SEQ ID NO: 6607085 - DNA, 18 bp, Homo sapiens
acagtcctttaaattttg

SEQ ID NO: 6607086 - DNA, 14 bp, Homo sapiens
acagtcggaaaagc

SEQ ID NO: 6607087 - DNA, 23 bp, Homo sapiens
acagtcggaaaagcgtctttaag

SEQ ID NO: 6607088 - DNA, 12 bp, Homo sapiens
acagtctaaagc

SEQ ID NO: 6607089 - DNA, 15 bp, Homo sapiens
acagtctaaagctgg

SEQ ID NO: 6607090 - DNA, 14 bp, Homo sapiens
acagtctagtgcaa

SEQ ID NO: 6607091 - DNA, 15 bp, Homo sapiens
acagtctcaaatttt

SEQ ID NO: 6607092 - DNA, 14 bp, Homo sapiens
acagtctcaatttt

SEQ ID NO: 6607093 - DNA, 18 bp, Homo sapiens
acagtctcaccatttccc

SEQ ID NO: 6607094 - DNA, 13 bp, Homo sapiens
acagtctcaggaa

SEQ ID NO: 6607095 - DNA, 14 bp, Homo sapiens
acagtctcaggaaa

SEQ ID NO: 6607096 - DNA, 16 bp, Homo sapiens
acagtctcagtccaga

SEQ ID NO: 6607097 - DNA, 14 bp, Homo sapiens
acagtctcattaca

SEQ ID NO: 6607098 - DNA, 20 bp, Homo sapiens
acagtctcattacagattta

SEQ ID NO: 6607099 - DNA, 22 bp, Homo sapiens
acagtctccctgatggaccctc

SEQ ID NO: 6607100 - DNA, 12 bp, Homo sapiens
acagtctctggg

SEQ ID NO: 6607101 - DNA, 20 bp, Homo sapiens
acagtctctttcttcctttc

SEQ ID NO: 6607102 - DNA, 20 bp, Homo sapiens
acagtctgatcgtgacgctg

SEQ ID NO: 6607103 - DNA, 22 bp, Homo sapiens
acagtctgatcgtgacgctgaa

SEQ ID NO: 6607104 - DNA, 22 bp, Homo sapiens
acagtctgcatcatcatcacaa

SEQ ID NO: 6607105 - DNA, 16 bp, Homo sapiens
acagtctggagaaggt

SEQ ID NO: 6607106 - DNA, 18 bp, Homo sapiens
acagtctggaggtcccag

SEQ ID NO: 6607107 - DNA, 20 bp, Homo sapiens
acagtctggaggtcccagac

SEQ ID NO: 6607108 - DNA, 13 bp, Homo sapiens
acagtctgtcatg

SEQ ID NO: 6607109 - DNA, 17 bp, Homo sapiens
acagtctgtcttctgta

SEQ ID NO: 6607110 - DNA, 18 bp, Homo sapiens
acagtctgtcttctgtat

SEQ ID NO: 6607111 - DNA, 19 bp, Homo sapiens
acagtctgtcttctgtata

SEQ ID NO: 6607112 - DNA, 20 bp, Homo sapiens
acagtctgtcttctgtatat

SEQ ID NO: 6607113 - DNA, 23 bp, Homo sapiens
acagtcttactctgtctcccagg

SEQ ID NO: 6607114 - DNA, 14 bp, Homo sapiens
acagtcttgtatta

SEQ ID NO: 6607115 - DNA, 20 bp, Homo sapiens
acagtctttgatcatcatgt

SEQ ID NO: 6607116 - DNA, 18 bp, Homo sapiens
acagtgaaaatgtaagct

SEQ ID NO: 6607117 - DNA, 19 bp, Homo sapiens
acagtgaaacaaatttaca

SEQ ID NO: 6607118 - DNA, 20 bp, Homo sapiens
acagtgaaagaaaataacaa

SEQ ID NO: 6607119 - DNA, 16 bp, Homo sapiens
acagtgaaaggcctgc

SEQ ID NO: 6607120 - DNA, 17 bp, Homo sapiens
acagtgaaaggcctgct

SEQ ID NO: 6607121 - DNA, 22 bp, Homo sapiens
acagtgaaatgagcagccctta

SEQ ID NO: 6607122 - DNA, 16 bp, Homo sapiens
acagtgaacagcttca

SEQ ID NO: 6607123 - DNA, 18 bp, Homo sapiens
acagtgaagacagaagtt

SEQ ID NO: 6607124 - DNA, 21 bp, Homo sapiens
acagtgaagcagcactgtgag

SEQ ID NO: 6607125 - DNA, 13 bp, Homo sapiens
acagtgaagtgcc

SEQ ID NO: 6607126 - DNA, 21 bp, Homo sapiens
acagtgaatggtgccattttc

SEQ ID NO: 6607127 - DNA, 18 bp, Homo sapiens
acagtgaatgtgtgtatg

SEQ ID NO: 6607128 - DNA, 19 bp, Homo sapiens
acagtgaatgtgtgtatgt

SEQ ID NO: 6607129 - DNA, 14 bp, Homo sapiens
acagtgaattgtct

SEQ ID NO: 6607130 - DNA, 17 bp, Homo sapiens
acagtgaatttaagcat

SEQ ID NO: 6607131 - DNA, 14 bp, Homo sapiens
acagtgacaaaagg

SEQ ID NO: 6607132 - DNA, 13 bp, Homo sapiens
acagtgaccaagg

SEQ ID NO: 6607133 - DNA, 14 bp, Homo sapiens
acagtgacccttcc

SEQ ID NO: 6607134 - DNA, 16 bp, Homo sapiens
acagtgaccttttctt

SEQ ID NO: 6607135 - DNA, 19 bp, Homo sapiens
acagtgaccttttcttcat

SEQ ID NO: 6607136 - DNA, 17 bp, Homo sapiens
acagtgactccctggga

SEQ ID NO: 6607137 - DNA, 19 bp, Homo sapiens
acagtgactccctgggagc

SEQ ID NO: 6607138 - DNA, 18 bp, Homo sapiens
acagtgactcgggctcct

SEQ ID NO: 6607139 - DNA, 20 bp, Homo sapiens
acagtgactcgggctcctgt

SEQ ID NO: 6607140 - DNA, 15 bp, Homo sapiens
acagtgactgggccc

SEQ ID NO: 6607141 - DNA, 18 bp, Homo sapiens
acagtgactgggccctgt

SEQ ID NO: 6607142 - DNA, 20 bp, Homo sapiens
acagtgactgggccctgtcc

SEQ ID NO: 6607143 - DNA, 22 bp, Homo sapiens
acagtgactgtcgtgtttacaa

SEQ ID NO: 6607144 - DNA, 17 bp, Homo sapiens
acagtgacttctgagat

SEQ ID NO: 6607145 - DNA, 17 bp, Homo sapiens
acagtgacttggcccca

SEQ ID NO: 6607146 - DNA, 18 bp, Homo sapiens
acagtgagactctgtctc

SEQ ID NO: 6607147 - DNA, 16 bp, Homo sapiens
acagtgagactgtaca

SEQ ID NO: 6607148 - DNA, 17 bp, Homo sapiens
acagtgagactgtacat

SEQ ID NO: 6607149 - DNA, 19 bp, Homo sapiens
acagtgagactgtacataa

SEQ ID NO: 6607150 - DNA, 24 bp, Homo sapiens
acagtgagactgtacataattgca

SEQ ID NO: 6607151 - DNA, 23 bp, Homo sapiens
acagtgagagactccatagtttg

SEQ ID NO: 6607152 - DNA, 21 bp, Homo sapiens
acagtgagagcagggctgggc

SEQ ID NO: 6607153 - DNA, 20 bp, Homo sapiens
acagtgagagtactcacttt

SEQ ID NO: 6607154 - DNA, 13 bp, Homo sapiens
acagtgagccaag

SEQ ID NO: 6607155 - DNA, 16 bp, Homo sapiens
acagtgagccaagagt

SEQ ID NO: 6607156 - DNA, 14 bp, Homo sapiens
acagtgagcctgaa

SEQ ID NO: 6607157 - DNA, 15 bp, Homo sapiens
acagtgaggactcgg

SEQ ID NO: 6607158 - DNA, 18 bp, Homo sapiens
acagtgaggactcggcca

SEQ ID NO: 6607159 - DNA, 21 bp, Homo sapiens
acagtgaggactcggccactg

SEQ ID NO: 6607160 - DNA, 18 bp, Homo sapiens
acagtgaggcaggagaag

SEQ ID NO: 6607161 - DNA, 15 bp, Homo sapiens
acagtgaggctggga

SEQ ID NO: 6607162 - DNA, 18 bp, Homo sapiens
acagtgagggagatccca

SEQ ID NO: 6607163 - DNA, 19 bp, Homo sapiens
acagtgaggtcctgggggc

SEQ ID NO: 6607164 - DNA, 23 bp, Homo sapiens
acagtgagtcgaggacagggagg

SEQ ID NO: 6607165 - DNA, 23 bp, Homo sapiens
acagtgatcaagttatttttaat

SEQ ID NO: 6607166 - DNA, 14 bp, Homo sapiens
acagtgatctccat

SEQ ID NO: 6607167 - DNA, 22 bp, Homo sapiens
acagtgatctccatatgttaca

SEQ ID NO: 6607168 - DNA, 15 bp, Homo sapiens
acagtgatgaatgta

SEQ ID NO: 6607169 - DNA, 17 bp, Homo sapiens
acagtgatgatgcatgg

SEQ ID NO: 6607170 - DNA, 20 bp, Homo sapiens
acagtgatgccatgaagaca

SEQ ID NO: 6607171 - DNA, 14 bp, Homo sapiens
acagtgatgccggg

SEQ ID NO: 6607172 - DNA, 21 bp, Homo sapiens
acagtgatgcctgcccgcacc

SEQ ID NO: 6607173 - DNA, 19 bp, Homo sapiens
acagtgcagagccttctca

SEQ ID NO: 6607174 - DNA, 20 bp, Homo sapiens
acagtgcagagccttctcag

SEQ ID NO: 6607175 - DNA, 16 bp, Homo sapiens
acagtgcagaggctct

SEQ ID NO: 6607176 - DNA, 19 bp, Homo sapiens
acagtgcagggcaaaatat

SEQ ID NO: 6607177 - DNA, 14 bp, Homo sapiens
acagtgccaaatgc

SEQ ID NO: 6607178 - DNA, 22 bp, Homo sapiens
acagtgccaaatgctggggcag

SEQ ID NO: 6607179 - DNA, 23 bp, Homo sapiens
acagtgccaaatgctggggcagg

SEQ ID NO: 6607180 - DNA, 18 bp, Homo sapiens
acagtgccaactcctcac

SEQ ID NO: 6607181 - DNA, 18 bp, Homo sapiens
acagtgccaggaaagagt

SEQ ID NO: 6607182 - DNA, 19 bp, Homo sapiens
acagtgccaggaaagagtg

SEQ ID NO: 6607183 - DNA, 15 bp, Homo sapiens
acagtgccattgtct

SEQ ID NO: 6607184 - DNA, 13 bp, Homo sapiens
acagtgcccaaga

SEQ ID NO: 6607185 - DNA, 18 bp, Homo sapiens
acagtgcccaagagtggg

SEQ ID NO: 6607186 - DNA, 12 bp, Homo sapiens
acagtgcccacc

SEQ ID NO: 6607187 - DNA, 14 bp, Homo sapiens
acagtgcccaccgc

SEQ ID NO: 6607188 - DNA, 19 bp, Homo sapiens
acagtgcccaccgccctcc

SEQ ID NO: 6607189 - DNA, 22 bp, Homo sapiens
acagtgcccaccgccctcctcc

SEQ ID NO: 6607190 - DNA, 17 bp, Homo sapiens
acagtgcccagctaatt

SEQ ID NO: 6607191 - DNA, 13 bp, Homo sapiens
acagtgcctcttc

SEQ ID NO: 6607192 - DNA, 23 bp, Homo sapiens
acagtgcctcttccagtgaacat

SEQ ID NO: 6607193 - DNA, 18 bp, Homo sapiens
acagtgcctgggaatgta

SEQ ID NO: 6607194 - DNA, 21 bp, Homo sapiens
acagtgcctgggaatgtatta

SEQ ID NO: 6607195 - DNA, 17 bp, Homo sapiens
acagtgccttcaataaa

SEQ ID NO: 6607196 - DNA, 20 bp, Homo sapiens
acagtgccttcaataaatgg

SEQ ID NO: 6607197 - DNA, 13 bp, Homo sapiens
acagtgccttgct

SEQ ID NO: 6607198 - DNA, 14 bp, Homo sapiens
acagtgccttgctc

SEQ ID NO: 6607199 - DNA, 15 bp, Homo sapiens
acagtgctattctga

SEQ ID NO: 6607200 - DNA, 15 bp, Homo sapiens
acagtgctctaggct

SEQ ID NO: 6607201 - DNA, 15 bp, Homo sapiens
acagtgctctgcctc

SEQ ID NO: 6607202 - DNA, 16 bp, Homo sapiens
acagtgctctgcctct

SEQ ID NO: 6607203 - DNA, 17 bp, Homo sapiens
acagtgctcttttctcc

SEQ ID NO: 6607204 - DNA, 21 bp, Homo sapiens
acagtgctcttttctcctcac

SEQ ID NO: 6607205 - DNA, 16 bp, Homo sapiens
acagtgctgaccccag

SEQ ID NO: 6607206 - DNA, 18 bp, Homo sapiens
acagtgctgaccccagga

SEQ ID NO: 6607207 - DNA, 20 bp, Homo sapiens
acagtgctgcagctccctgg

SEQ ID NO: 6607208 - DNA, 19 bp, Homo sapiens
acagtgctgccccttgcaa

SEQ ID NO: 6607209 - DNA, 22 bp, Homo sapiens
acagtgctgccccttgcaagcc

SEQ ID NO: 6607210 - DNA, 15 bp, Homo sapiens
acagtgctgccctgc

SEQ ID NO: 6607211 - DNA, 15 bp, Homo sapiens
acagtgctgcttctc

SEQ ID NO: 6607212 - DNA, 11 bp, Homo sapiens
acagtgctggg

SEQ ID NO: 6607213 - DNA, 14 bp, Homo sapiens
acagtgctgtctga

SEQ ID NO: 6607214 - DNA, 16 bp, Homo sapiens
acagtgctgttctgga

SEQ ID NO: 6607215 - DNA, 13 bp, Homo sapiens
acagtgcttacat

SEQ ID NO: 6607216 - DNA, 17 bp, Homo sapiens
acagtgcttcagcctga

SEQ ID NO: 6607217 - DNA, 20 bp, Homo sapiens
acagtgcttcagcctgaggc

SEQ ID NO: 6607218 - DNA, 21 bp, Homo sapiens
acagtgcttcagcctgaggct

SEQ ID NO: 6607219 - DNA, 21 bp, Homo sapiens
acagtgcttgcatcctatttg

SEQ ID NO: 6607220 - DNA, 22 bp, Homo sapiens
acagtgcttgcatcctatttgg

SEQ ID NO: 6607221 - DNA, 14 bp, Homo sapiens
acagtgctttatgg

SEQ ID NO: 6607222 - DNA, 21 bp, Homo sapiens
acagtgcttttaagtgaaaat

SEQ ID NO: 6607223 - DNA, 21 bp, Homo sapiens
acagtggacagtctttgatca

SEQ ID NO: 6607224 - DNA, 14 bp, Homo sapiens
acagtggagaaata

SEQ ID NO: 6607225 - DNA, 16 bp, Homo sapiens
acagtggagaaatatt

SEQ ID NO: 6607226 - DNA, 16 bp, Homo sapiens
acagtggagagggcta

SEQ ID NO: 6607227 - DNA, 23 bp, Homo sapiens
acagtggagagggctacaaagga

SEQ ID NO: 6607228 - DNA, 22 bp, Homo sapiens
acagtggagggagactgaccca

SEQ ID NO: 6607229 - DNA, 13 bp, Homo sapiens
acagtggagtgag

SEQ ID NO: 6607230 - DNA, 19 bp, Homo sapiens
acagtggagtgcaaaaggc

SEQ ID NO: 6607231 - DNA, 23 bp, Homo sapiens
acagtggatatgacccacactgc

SEQ ID NO: 6607232 - DNA, 17 bp, Homo sapiens
acagtggatcacaaagt

SEQ ID NO: 6607233 - DNA, 15 bp, Homo sapiens
acagtggattgctca

SEQ ID NO: 6607234 - DNA, 15 bp, Homo sapiens
acagtggcaagctac

SEQ ID NO: 6607235 - DNA, 14 bp, Homo sapiens
acagtggcactaaa

SEQ ID NO: 6607236 - DNA, 19 bp, Homo sapiens
acagtggcactaaaatgtt

SEQ ID NO: 6607237 - DNA, 21 bp, Homo sapiens
acagtggcactaaaatgttta

SEQ ID NO: 6607238 - DNA, 16 bp, Homo sapiens
acagtggcagcaaagg

SEQ ID NO: 6607239 - DNA, 18 bp, Homo sapiens
acagtggcagcaaaggaa

SEQ ID NO: 6607240 - DNA, 12 bp, Homo sapiens
acagtggcagga

SEQ ID NO: 6607241 - DNA, 13 bp, Homo sapiens
acagtggcaggac

SEQ ID NO: 6607242 - DNA, 15 bp, Homo sapiens
acagtggcagtattg

SEQ ID NO: 6607243 - DNA, 21 bp, Homo sapiens
acagtggccaagatcacagtg

SEQ ID NO: 6607244 - DNA, 13 bp, Homo sapiens
acagtggccacgg

SEQ ID NO: 6607245 - DNA, 21 bp, Homo sapiens
acagtggccggggctgaagcc

SEQ ID NO: 6607246 - DNA, 18 bp, Homo sapiens
acagtggctcacacctgt

SEQ ID NO: 6607247 - DNA, 15 bp, Homo sapiens
acagtggctgctctg

SEQ ID NO: 6607248 - DNA, 13 bp, Homo sapiens
acagtggctgggt

SEQ ID NO: 6607249 - DNA, 19 bp, Homo sapiens
acagtggctgggtgggccc

SEQ ID NO: 6607250 - DNA, 19 bp, Homo sapiens
acagtgggaactctgacaa

SEQ ID NO: 6607251 - DNA, 14 bp, Homo sapiens
acagtgggagccag

SEQ ID NO: 6607252 - DNA, 17 bp, Homo sapiens
acagtgggagccagggc

SEQ ID NO: 6607253 - DNA, 17 bp, Homo sapiens
acagtgggcaggaggcc

SEQ ID NO: 6607254 - DNA, 24 bp, Homo sapiens
acagtgggcaggaggccccaggct

SEQ ID NO: 6607255 - DNA, 22 bp, Homo sapiens
acagtgggccggccccaggctc

SEQ ID NO: 6607256 - DNA, 23 bp, Homo sapiens
acagtgggcgttgggagcctagc

SEQ ID NO: 6607257 - DNA, 22 bp, Homo sapiens
acagtgggctatgccactaggc

SEQ ID NO: 6607258 - DNA, 19 bp, Homo sapiens
acagtggggaatgaagata

SEQ ID NO: 6607259 - DNA, 16 bp, Homo sapiens
acagtggggcccatgg

SEQ ID NO: 6607260 - DNA, 23 bp, Homo sapiens
acagtggggcccatggccccagc

SEQ ID NO: 6607261 - DNA, 21 bp, Homo sapiens
acagtggggctgcaggcaggc

SEQ ID NO: 6607262 - DNA, 17 bp, Homo sapiens
acagtgggtggcacctc

SEQ ID NO: 6607263 - DNA, 18 bp, Homo sapiens
acagtggtactctgtgtc

SEQ ID NO: 6607264 - DNA, 20 bp, Homo sapiens
acagtggtactctgtgtctg

SEQ ID NO: 6607265 - DNA, 23 bp, Homo sapiens
acagtggtcagcgattcctgcca

SEQ ID NO: 6607266 - DNA, 16 bp, Homo sapiens
acagtggtccagggtc

SEQ ID NO: 6607267 - DNA, 15 bp, Homo sapiens
acagtggtggcaggg

SEQ ID NO: 6607268 - DNA, 16 bp, Homo sapiens
acagtggtggcagggc

SEQ ID NO: 6607269 - DNA, 14 bp, Homo sapiens
acagtggtgtgtgg

SEQ ID NO: 6607270 - DNA, 14 bp, Homo sapiens
acagtggttcttat

SEQ ID NO: 6607271 - DNA, 16 bp, Homo sapiens
acagtggttgcctggg

SEQ ID NO: 6607272 - DNA, 20 bp, Homo sapiens
acagtggttgttttttcatt

SEQ ID NO: 6607273 - DNA, 16 bp, Homo sapiens
acagtgtaaagttaat

SEQ ID NO: 6607274 - DNA, 15 bp, Homo sapiens
acagtgtacagtctt

SEQ ID NO: 6607275 - DNA, 18 bp, Homo sapiens
acagtgtacagtcttgta

SEQ ID NO: 6607276 - DNA, 15 bp, Homo sapiens
acagtgtacatgtac

SEQ ID NO: 6607277 - DNA, 20 bp, Homo sapiens
acagtgtaccattaaaatat

SEQ ID NO: 6607278 - DNA, 16 bp, Homo sapiens
acagtgtaccttttaa

SEQ ID NO: 6607279 - DNA, 20 bp, Homo sapiens
acagtgtactttgttaaaaa

SEQ ID NO: 6607280 - DNA, 21 bp, Homo sapiens
acagtgtactttgttaaaaac

SEQ ID NO: 6607281 - DNA, 22 bp, Homo sapiens
acagtgtactttgttaaaaaca

SEQ ID NO: 6607282 - DNA, 23 bp, Homo sapiens
acagtgtactttgttaaaaacac

SEQ ID NO: 6607283 - DNA, 18 bp, Homo sapiens
acagtgtatattgaaatt

SEQ ID NO: 6607284 - DNA, 17 bp, Homo sapiens
acagtgtcactggtcag

SEQ ID NO: 6607285 - DNA, 15 bp, Homo sapiens
acagtgtcccccagg

SEQ ID NO: 6607286 - DNA, 16 bp, Homo sapiens
acagtgtctgtgtgtg

SEQ ID NO: 6607287 - DNA, 15 bp, Homo sapiens
acagtgtctgttcag

SEQ ID NO: 6607288 - DNA, 17 bp, Homo sapiens
acagtgtctttctagcc

SEQ ID NO: 6607289 - DNA, 19 bp, Homo sapiens
acagtgtctttctagccat

SEQ ID NO: 6607290 - DNA, 24 bp, Homo sapiens
acagtgtgaagacactgtgcaggc

SEQ ID NO: 6607291 - DNA, 14 bp, Homo sapiens
acagtgtgattttg

SEQ ID NO: 6607292 - DNA, 22 bp, Homo sapiens
acagtgtgcaaggcagccgtgg

SEQ ID NO: 6607293 - DNA, 19 bp, Homo sapiens
acagtgtgcctggttaata

SEQ ID NO: 6607294 - DNA, 18 bp, Homo sapiens
acagtgtggatgtaaatt

SEQ ID NO: 6607295 - DNA, 18 bp, Homo sapiens
acagtgtgggacaggctc

SEQ ID NO: 6607296 - DNA, 22 bp, Homo sapiens
acagtgtgggacaggctcttct

SEQ ID NO: 6607297 - DNA, 19 bp, Homo sapiens
acagtgtggggcagccgtc

SEQ ID NO: 6607298 - DNA, 20 bp, Homo sapiens
acagtgtggggcagccgtcc

SEQ ID NO: 6607299 - DNA, 22 bp, Homo sapiens
acagtgtggtttgggaaagatg

SEQ ID NO: 6607300 - DNA, 13 bp, Homo sapiens
acagtgtgtaaac

SEQ ID NO: 6607301 - DNA, 13 bp, Homo sapiens
acagtgtgtagtt

SEQ ID NO: 6607302 - DNA, 22 bp, Homo sapiens
acagtgtgtgaactgctttcaa

SEQ ID NO: 6607303 - DNA, 21 bp, Homo sapiens
acagtgtgtggtcaacatttc

SEQ ID NO: 6607304 - DNA, 14 bp, Homo sapiens
acagtgtgttggtg

SEQ ID NO: 6607305 - DNA, 19 bp, Homo sapiens
acagtgttaggcctggcac

SEQ ID NO: 6607306 - DNA, 22 bp, Homo sapiens
acagtgttaggcctggcacagt

SEQ ID NO: 6607307 - DNA, 23 bp, Homo sapiens
acagtgttaggcctggcacagtg

SEQ ID NO: 6607308 - DNA, 17 bp, Homo sapiens
acagtgttagtgctggt

SEQ ID NO: 6607309 - DNA, 19 bp, Homo sapiens
acagtgttagtgctggtca

SEQ ID NO: 6607310 - DNA, 22 bp, Homo sapiens
acagtgttattttctttgaaat

SEQ ID NO: 6607311 - DNA, 16 bp, Homo sapiens
acagtgttcaaattct

SEQ ID NO: 6607312 - DNA, 19 bp, Homo sapiens
acagtgttcaaattctgat

SEQ ID NO: 6607313 - DNA, 11 bp, Homo sapiens
acagtgttccg

SEQ ID NO: 6607314 - DNA, 16 bp, Homo sapiens
acagtgttctgtttaa

SEQ ID NO: 6607315 - DNA, 22 bp, Homo sapiens
acagtgttctgtttaatactca

SEQ ID NO: 6607316 - DNA, 19 bp, Homo sapiens
acagtgttgaaaatgttca

SEQ ID NO: 6607317 - DNA, 21 bp, Homo sapiens
acagtgttgaaaatgttcaga

SEQ ID NO: 6607318 - DNA, 9 bp, Homo sapiens
acagtgttt

SEQ ID NO: 6607319 - DNA, 14 bp, Homo sapiens
acagtgtttatgac

SEQ ID NO: 6607320 - DNA, 23 bp, Homo sapiens
acagtgtttcccataattttctt

SEQ ID NO: 6607321 - DNA, 17 bp, Homo sapiens
acagtgtttggtgacat

SEQ ID NO: 6607322 - DNA, 14 bp, Homo sapiens
acagtgttttcaga

SEQ ID NO: 6607323 - DNA, 14 bp, Homo sapiens
acagtgttttgcac

SEQ ID NO: 6607324 - DNA, 16 bp, Homo sapiens
acagtgtttttgtaaa

SEQ ID NO: 6607325 - DNA, 20 bp, Homo sapiens
acagtgtttttgtaaagtgt

SEQ ID NO: 6607326 - DNA, 16 bp, Homo sapiens
acagttaaacttgcaa

SEQ ID NO: 6607327 - DNA, 13 bp, Homo sapiens
acagttaaataaa

SEQ ID NO: 6607328 - DNA, 15 bp, Homo sapiens
acagttaagagaaat

SEQ ID NO: 6607329 - DNA, 16 bp, Homo sapiens
acagttacatgaaagt

SEQ ID NO: 6607330 - DNA, 23 bp, Homo sapiens
acagttacttaagattcagtttt

SEQ ID NO: 6607331 - DNA, 14 bp, Homo sapiens
acagttacttttcc

SEQ ID NO: 6607332 - DNA, 16 bp, Homo sapiens
acagttacttttcctt

SEQ ID NO: 6607333 - DNA, 23 bp, Homo sapiens
acagttacttttccttgcataca

SEQ ID NO: 6607334 - DNA, 17 bp, Homo sapiens
acagttagcagggatgt

SEQ ID NO: 6607335 - DNA, 18 bp, Homo sapiens
acagttagggttttgcaa

SEQ ID NO: 6607336 - DNA, 19 bp, Homo sapiens
acagttataaaattaaaag

SEQ ID NO: 6607337 - DNA, 13 bp, Homo sapiens
acagttataaaga

SEQ ID NO: 6607338 - DNA, 15 bp, Homo sapiens
acagttataaagaaa

SEQ ID NO: 6607339 - DNA, 18 bp, Homo sapiens
acagttataaagaaagat

SEQ ID NO: 6607340 - DNA, 19 bp, Homo sapiens
acagttataaagaaagatt

SEQ ID NO: 6607341 - DNA, 13 bp, Homo sapiens
acagttatacata

SEQ ID NO: 6607342 - DNA, 22 bp, Homo sapiens
acagttatatttttgtgttttc

SEQ ID NO: 6607343 - DNA, 15 bp, Homo sapiens
acagttatcctgcaa

SEQ ID NO: 6607344 - DNA, 18 bp, Homo sapiens
acagttattaattaaaga

SEQ ID NO: 6607345 - DNA, 13 bp, Homo sapiens
acagttattacat

SEQ ID NO: 6607346 - DNA, 14 bp, Homo sapiens
acagttattttgga

SEQ ID NO: 6607347 - DNA, 15 bp, Homo sapiens
acagttattttggat

SEQ ID NO: 6607348 - DNA, 20 bp, Homo sapiens
acagttcaattctcatttgt

SEQ ID NO: 6607349 - DNA, 12 bp, Homo sapiens
acagttcataat

SEQ ID NO: 6607350 - DNA, 17 bp, Homo sapiens
acagttcataattcacc

SEQ ID NO: 6607351 - DNA, 21 bp, Homo sapiens
acagttcataattcaccaaaa

SEQ ID NO: 6607352 - DNA, 22 bp, Homo sapiens
acagttccacaattttgtctct

SEQ ID NO: 6607353 - DNA, 20 bp, Homo sapiens
acagttcccagagtgggctt

SEQ ID NO: 6607354 - DNA, 18 bp, Homo sapiens
acagttcccctatgtgga

SEQ ID NO: 6607355 - DNA, 22 bp, Homo sapiens
acagttccctttatttcacata

SEQ ID NO: 6607356 - DNA, 12 bp, Homo sapiens
acagttcctcgc

SEQ ID NO: 6607357 - DNA, 13 bp, Homo sapiens
acagttccttcag

SEQ ID NO: 6607358 - DNA, 13 bp, Homo sapiens
acagttctaggtg

SEQ ID NO: 6607359 - DNA, 16 bp, Homo sapiens
acagttctcactggga

SEQ ID NO: 6607360 - DNA, 18 bp, Homo sapiens
acagttctgagctgtaat

SEQ ID NO: 6607361 - DNA, 20 bp, Homo sapiens
acagttctgcactcttgtac

SEQ ID NO: 6607362 - DNA, 21 bp, Homo sapiens
acagttctgctctggttgttt

SEQ ID NO: 6607363 - DNA, 13 bp, Homo sapiens
acagttctgtaat

SEQ ID NO: 6607364 - DNA, 15 bp, Homo sapiens
acagttctgtaatgt

SEQ ID NO: 6607365 - DNA, 16 bp, Homo sapiens
acagttctgtaatgta

SEQ ID NO: 6607366 - DNA, 15 bp, Homo sapiens
acagttcttaataca

SEQ ID NO: 6607367 - DNA, 19 bp, Homo sapiens
acagttcttggtgactgtc

SEQ ID NO: 6607368 - DNA, 23 bp, Homo sapiens
acagttcttgtgtggtttggccc

SEQ ID NO: 6607369 - DNA, 13 bp, Homo sapiens
acagttctttcct

SEQ ID NO: 6607370 - DNA, 20 bp, Homo sapiens
acagttctttcctctttctg

SEQ ID NO: 6607371 - DNA, 18 bp, Homo sapiens
acagttctttgggccaga

SEQ ID NO: 6607372 - DNA, 21 bp, Homo sapiens
acagttctttgggccagacat

SEQ ID NO: 6607373 - DNA, 15 bp, Homo sapiens
acagttgaaaaacag

SEQ ID NO: 6607374 - DNA, 16 bp, Homo sapiens
acagttgaaaaacagc

SEQ ID NO: 6607375 - DNA, 18 bp, Homo sapiens
acagttgaaaacttgtaa

SEQ ID NO: 6607376 - DNA, 21 bp, Homo sapiens
acagttgaagaaaaaatggca

SEQ ID NO: 6607377 - DNA, 16 bp, Homo sapiens
acagttgagctcaggt

SEQ ID NO: 6607378 - DNA, 15 bp, Homo sapiens
acagttgatggagcc

SEQ ID NO: 6607379 - DNA, 20 bp, Homo sapiens
acagttgatggagccccagg

SEQ ID NO: 6607380 - DNA, 15 bp, Homo sapiens
acagttgcacagcat

SEQ ID NO: 6607381 - DNA, 23 bp, Homo sapiens
acagttgcacagcatctcagctc

SEQ ID NO: 6607382 - DNA, 14 bp, Homo sapiens
acagttgcaggagc

SEQ ID NO: 6607383 - DNA, 16 bp, Homo sapiens
acagttgcaggagcgt

SEQ ID NO: 6607384 - DNA, 22 bp, Homo sapiens
acagttgcaggagcgtgaagga

SEQ ID NO: 6607385 - DNA, 22 bp, Homo sapiens
acagttgcatcaggcctgaacc

SEQ ID NO: 6607386 - DNA, 13 bp, Homo sapiens
acagttgcatgta

SEQ ID NO: 6607387 - DNA, 21 bp, Homo sapiens
acagttgccacatttagtcct

SEQ ID NO: 6607388 - DNA, 20 bp, Homo sapiens
acagttgccaccacctctgt

SEQ ID NO: 6607389 - DNA, 22 bp, Homo sapiens
acagttgccaccacctctgtgg

SEQ ID NO: 6607390 - DNA, 23 bp, Homo sapiens
acagttgctgtgaactttcatgt

SEQ ID NO: 6607391 - DNA, 21 bp, Homo sapiens
acagttggagggaaagccagc

SEQ ID NO: 6607392 - DNA, 20 bp, Homo sapiens
acagttggcacttctgccat

SEQ ID NO: 6607393 - DNA, 21 bp, Homo sapiens
acagttggcagagaaggcctc

SEQ ID NO: 6607394 - DNA, 20 bp, Homo sapiens
acagttggccgattagaagg

SEQ ID NO: 6607395 - DNA, 16 bp, Homo sapiens
acagttggccttcaga

SEQ ID NO: 6607396 - DNA, 20 bp, Homo sapiens
acagttgggaagtctcagcc

SEQ ID NO: 6607397 - DNA, 21 bp, Homo sapiens
acagttgggaagtctcagcct

SEQ ID NO: 6607398 - DNA, 18 bp, Homo sapiens
acagttgggttttttaag

SEQ ID NO: 6607399 - DNA, 14 bp, Homo sapiens
acagttggtaactt

SEQ ID NO: 6607400 - DNA, 23 bp, Homo sapiens
acagttggttttgcatgtctgca

SEQ ID NO: 6607401 - DNA, 23 bp, Homo sapiens
acagttgtaccactgctaataaa

SEQ ID NO: 6607402 - DNA, 20 bp, Homo sapiens
acagttgtataaactgtatt

SEQ ID NO: 6607403 - DNA, 19 bp, Homo sapiens
acagttgtctattctgagc

SEQ ID NO: 6607404 - DNA, 17 bp, Homo sapiens
acagttgtgcaggaggt

SEQ ID NO: 6607405 - DNA, 24 bp, Homo sapiens
acagttgtttcagaaagagctctc

SEQ ID NO: 6607406 - DNA, 13 bp, Homo sapiens
acagttgtttgat

SEQ ID NO: 6607407 - DNA, 17 bp, Homo sapiens
acagttgtttggagaac

SEQ ID NO: 6607408 - DNA, 14 bp, Homo sapiens
acagtttaaaaaat

SEQ ID NO: 6607409 - DNA, 12 bp, Homo sapiens
acagtttaacag

SEQ ID NO: 6607410 - DNA, 18 bp, Homo sapiens
acagtttaagaagtggtg

SEQ ID NO: 6607411 - DNA, 19 bp, Homo sapiens
acagtttaatgaagatcta

SEQ ID NO: 6607412 - DNA, 19 bp, Homo sapiens
acagtttaccagttgcctt

SEQ ID NO: 6607413 - DNA, 16 bp, Homo sapiens
acagtttactttgcca

SEQ ID NO: 6607414 - DNA, 18 bp, Homo sapiens
acagtttatattgtggaa

SEQ ID NO: 6607415 - DNA, 16 bp, Homo sapiens
acagtttatcatgaag

SEQ ID NO: 6607416 - DNA, 18 bp, Homo sapiens
acagtttatcatgaagcc

SEQ ID NO: 6607417 - DNA, 23 bp, Homo sapiens
acagtttattttctgtgtaaaat

SEQ ID NO: 6607418 - DNA, 24 bp, Homo sapiens
acagtttcagagagtcaatgtcat

SEQ ID NO: 6607419 - DNA, 13 bp, Homo sapiens
acagtttcatcta

SEQ ID NO: 6607420 - DNA, 16 bp, Homo sapiens
acagtttccagtcatg

SEQ ID NO: 6607421 - DNA, 20 bp, Homo sapiens
acagtttcttagctttttaa

SEQ ID NO: 6607422 - DNA, 16 bp, Homo sapiens
acagtttcttcatgca

SEQ ID NO: 6607423 - DNA, 13 bp, Homo sapiens
acagtttcttgca

SEQ ID NO: 6607424 - DNA, 19 bp, Homo sapiens
acagtttcttgcttggaag

SEQ ID NO: 6607425 - DNA, 23 bp, Homo sapiens
acagtttcttgcttggaagccag

SEQ ID NO: 6607426 - DNA, 22 bp, Homo sapiens
acagtttcttttgtgttcctat

SEQ ID NO: 6607427 - DNA, 13 bp, Homo sapiens
acagtttgaaata

SEQ ID NO: 6607428 - DNA, 14 bp, Homo sapiens
acagtttgaaataa

SEQ ID NO: 6607429 - DNA, 14 bp, Homo sapiens
acagtttgcctgct

SEQ ID NO: 6607430 - DNA, 15 bp, Homo sapiens
acagtttgcctgctg

SEQ ID NO: 6607431 - DNA, 14 bp, Homo sapiens
acagtttgctctag

SEQ ID NO: 6607432 - DNA, 16 bp, Homo sapiens
acagtttgtaaatgtt

SEQ ID NO: 6607433 - DNA, 14 bp, Homo sapiens
acagtttgttcagt

SEQ ID NO: 6607434 - DNA, 14 bp, Homo sapiens
acagtttgtttaca

SEQ ID NO: 6607435 - DNA, 16 bp, Homo sapiens
acagtttgtttacaca

SEQ ID NO: 6607436 - DNA, 22 bp, Homo sapiens
acagtttgtttacacacgtgca

SEQ ID NO: 6607437 - DNA, 20 bp, Homo sapiens
acagtttgtttcctgtctga

SEQ ID NO: 6607438 - DNA, 21 bp, Homo sapiens
acagtttgtttcctgtctgat

SEQ ID NO: 6607439 - DNA, 12 bp, Homo sapiens
acagttttaata

SEQ ID NO: 6607440 - DNA, 19 bp, Homo sapiens
acagttttaataagaacag

SEQ ID NO: 6607441 - DNA, 22 bp, Homo sapiens
acagttttagaataaggaggag

SEQ ID NO: 6607442 - DNA, 17 bp, Homo sapiens
acagttttccatgaaaa

SEQ ID NO: 6607443 - DNA, 21 bp, Homo sapiens
acagttttccatgaaaacgtt

SEQ ID NO: 6607444 - DNA, 20 bp, Homo sapiens
acagttttcctatgctttga

SEQ ID NO: 6607445 - DNA, 21 bp, Homo sapiens
acagttttccttatcagaggc

SEQ ID NO: 6607446 - DNA, 22 bp, Homo sapiens
acagttttccttctcatctgtg

SEQ ID NO: 6607447 - DNA, 16 bp, Homo sapiens
acagttttctgagaaa

SEQ ID NO: 6607448 - DNA, 19 bp, Homo sapiens
acagttttctgagaaagac

SEQ ID NO: 6607449 - DNA, 21 bp, Homo sapiens
acagttttctggctggagcct

SEQ ID NO: 6607450 - DNA, 15 bp, Homo sapiens
acagttttgaaagaa

SEQ ID NO: 6607451 - DNA, 18 bp, Homo sapiens
acagttttggttgcttta

SEQ ID NO: 6607452 - DNA, 24 bp, Homo sapiens
acagttttggttgctttaatatca

SEQ ID NO: 6607453 - DNA, 11 bp, Homo sapiens
acagttttgtg

SEQ ID NO: 6607454 - DNA, 12 bp, Homo sapiens
acagtttttaaa

SEQ ID NO: 6607455 - DNA, 21 bp, Homo sapiens
acagtttttatttagcatggg

SEQ ID NO: 6607456 - DNA, 21 bp, Homo sapiens
acagtttttgacatttatatt

SEQ ID NO: 6607457 - DNA, 13 bp, Homo sapiens
acataaaaaccaa

SEQ ID NO: 6607458 - DNA, 20 bp, Homo sapiens
acataaaaagcagaatttta

SEQ ID NO: 6607459 - DNA, 23 bp, Homo sapiens
acataaaaagcagaattttaatg

SEQ ID NO: 6607460 - DNA, 13 bp, Homo sapiens
acataaaaagtta

SEQ ID NO: 6607461 - DNA, 12 bp, Homo sapiens
acataaaacaaa

SEQ ID NO: 6607462 - DNA, 18 bp, Homo sapiens
acataaaacaaaaccaag

SEQ ID NO: 6607463 - DNA, 21 bp, Homo sapiens
acataaaacacccttgaaaat

SEQ ID NO: 6607464 - DNA, 21 bp, Homo sapiens
acataaaacgtatagtcaata

SEQ ID NO: 6607465 - DNA, 16 bp, Homo sapiens
acataaaactttaaaa

SEQ ID NO: 6607466 - DNA, 14 bp, Homo sapiens
acataaaagaaata

SEQ ID NO: 6607467 - DNA, 15 bp, Homo sapiens
acataaaagaaataa

SEQ ID NO: 6607468 - DNA, 13 bp, Homo sapiens
acataaaagaaga

SEQ ID NO: 6607469 - DNA, 17 bp, Homo sapiens
acataaaagaagaaact

SEQ ID NO: 6607470 - DNA, 18 bp, Homo sapiens
acataaaagccccagctt

SEQ ID NO: 6607471 - DNA, 21 bp, Homo sapiens
acataaaatccaatattgtaa

SEQ ID NO: 6607472 - DNA, 13 bp, Homo sapiens
acataaaattaaa

SEQ ID NO: 6607473 - DNA, 17 bp, Homo sapiens
acataaaatttacattt

SEQ ID NO: 6607474 - DNA, 18 bp, Homo sapiens
acataaaatttacattta

SEQ ID NO: 6607475 - DNA, 13 bp, Homo sapiens
acataaaattttc

SEQ ID NO: 6607476 - DNA, 13 bp, Homo sapiens
acataaacaatga

SEQ ID NO: 6607477 - DNA, 16 bp, Homo sapiens
acataaacaattcatg

SEQ ID NO: 6607478 - DNA, 21 bp, Homo sapiens
acataaacacttctccttaac

SEQ ID NO: 6607479 - DNA, 22 bp, Homo sapiens
acataaacacttctccttaacc

SEQ ID NO: 6607480 - DNA, 16 bp, Homo sapiens
acataaaccatttttg

SEQ ID NO: 6607481 - DNA, 18 bp, Homo sapiens
acataaagaaattcaaga

SEQ ID NO: 6607482 - DNA, 23 bp, Homo sapiens
acataaagaagaaacttgtaaat

SEQ ID NO: 6607483 - DNA, 21 bp, Homo sapiens
acataaagactgtgctgagaa

SEQ ID NO: 6607484 - DNA, 15 bp, Homo sapiens
acataaagcaaatag

SEQ ID NO: 6607485 - DNA, 18 bp, Homo sapiens
acataaagcaaatagaca

SEQ ID NO: 6607486 - DNA, 21 bp, Homo sapiens
acataaagcaaatagacacag

SEQ ID NO: 6607487 - DNA, 14 bp, Homo sapiens
acataaagcctctg

SEQ ID NO: 6607488 - DNA, 21 bp, Homo sapiens
acataaagccttttgctttat

SEQ ID NO: 6607489 - DNA, 15 bp, Homo sapiens
acataaagctccctt

SEQ ID NO: 6607490 - DNA, 20 bp, Homo sapiens
acataaaggaaaagacacat

SEQ ID NO: 6607491 - DNA, 17 bp, Homo sapiens
acataaaggaacatggt

SEQ ID NO: 6607492 - DNA, 23 bp, Homo sapiens
acataaaggtgaccctgatgaaa

SEQ ID NO: 6607493 - DNA, 18 bp, Homo sapiens
acataaaggttattttct

SEQ ID NO: 6607494 - DNA, 17 bp, Homo sapiens
acataaagtaaatgcta

SEQ ID NO: 6607495 - DNA, 24 bp, Homo sapiens
acataaagtaataactgttagaat

SEQ ID NO: 6607496 - DNA, 15 bp, Homo sapiens
acataaagtcatcaa

SEQ ID NO: 6607497 - DNA, 23 bp, Homo sapiens
acataaatagtagaaaaatcaga

SEQ ID NO: 6607498 - DNA, 13 bp, Homo sapiens
acataaatctgtc

SEQ ID NO: 6607499 - DNA, 14 bp, Homo sapiens
acataaatctgtga

SEQ ID NO: 6607500 - DNA, 16 bp, Homo sapiens
acataaatgcagccca

SEQ ID NO: 6607501 - DNA, 17 bp, Homo sapiens
acataaatgttcacttt

SEQ ID NO: 6607502 - DNA, 20 bp, Homo sapiens
acataaattgcataaagcat

SEQ ID NO: 6607503 - DNA, 12 bp, Homo sapiens
acataaattgta

SEQ ID NO: 6607504 - DNA, 15 bp, Homo sapiens
acataaattgtaatt

SEQ ID NO: 6607505 - DNA, 13 bp, Homo sapiens
acataaattttaa

SEQ ID NO: 6607506 - DNA, 14 bp, Homo sapiens
acataacaaaatca

SEQ ID NO: 6607507 - DNA, 14 bp, Homo sapiens
acataacaaagggc

SEQ ID NO: 6607508 - DNA, 18 bp, Homo sapiens
acataacaacaacagtta

SEQ ID NO: 6607509 - DNA, 17 bp, Homo sapiens
acataacaggcattgca

SEQ ID NO: 6607510 - DNA, 18 bp, Homo sapiens
acataacaggcattgcac

SEQ ID NO: 6607511 - DNA, 18 bp, Homo sapiens
acataaccaatttgtaat

SEQ ID NO: 6607512 - DNA, 20 bp, Homo sapiens
acataaccaatttgtaatga

SEQ ID NO: 6607513 - DNA, 16 bp, Homo sapiens
acataacggaaagttt

SEQ ID NO: 6607514 - DNA, 16 bp, Homo sapiens
acataacgtttttcct

SEQ ID NO: 6607515 - DNA, 20 bp, Homo sapiens
acataactcacacccctgcc

SEQ ID NO: 6607516 - DNA, 18 bp, Homo sapiens
acataactgatctattta

SEQ ID NO: 6607517 - DNA, 18 bp, Homo sapiens
acataactgcttcttgga

SEQ ID NO: 6607518 - DNA, 14 bp, Homo sapiens
acataactggattt

SEQ ID NO: 6607519 - DNA, 15 bp, Homo sapiens
acataacttcagtgc

SEQ ID NO: 6607520 - DNA, 17 bp, Homo sapiens
acataacttctcatgta

SEQ ID NO: 6607521 - DNA, 14 bp, Homo sapiens
acataagaaggcaa

SEQ ID NO: 6607522 - DNA, 21 bp, Homo sapiens
acataagaaggcaattttagt

SEQ ID NO: 6607523 - DNA, 16 bp, Homo sapiens
acataagcaatcattt

SEQ ID NO: 6607524 - DNA, 12 bp, Homo sapiens
acataagctatt

SEQ ID NO: 6607525 - DNA, 13 bp, Homo sapiens
acataagctattt

SEQ ID NO: 6607526 - DNA, 20 bp, Homo sapiens
acataagctatttttctaac

SEQ ID NO: 6607527 - DNA, 16 bp, Homo sapiens
acataagcttctcaat

SEQ ID NO: 6607528 - DNA, 15 bp, Homo sapiens
acataaggagaatgt

SEQ ID NO: 6607529 - DNA, 15 bp, Homo sapiens
acataaggatgactt

SEQ ID NO: 6607530 - DNA, 13 bp, Homo sapiens
acataaggctgga

SEQ ID NO: 6607531 - DNA, 17 bp, Homo sapiens
acataagtaacttttaa

SEQ ID NO: 6607532 - DNA, 21 bp, Homo sapiens
acataagtaattcaagaaaac

SEQ ID NO: 6607533 - DNA, 16 bp, Homo sapiens
acataagttaatagaa

SEQ ID NO: 6607534 - DNA, 24 bp, Homo sapiens
acataagttgcatttagaaatcaa

SEQ ID NO: 6607535 - DNA, 19 bp, Homo sapiens
acataagtttaggataaaa

SEQ ID NO: 6607536 - DNA, 23 bp, Homo sapiens
acataataaaaaattatgacaat

SEQ ID NO: 6607537 - DNA, 23 bp, Homo sapiens
acataataaacgatgttgtgatg

SEQ ID NO: 6607538 - DNA, 14 bp, Homo sapiens
acataataaagtat

SEQ ID NO: 6607539 - DNA, 20 bp, Homo sapiens
acataataaagtggtgattt

SEQ ID NO: 6607540 - DNA, 18 bp, Homo sapiens
acataataaatcacacat

SEQ ID NO: 6607541 - DNA, 14 bp, Homo sapiens
acataatacaatgt

SEQ ID NO: 6607542 - DNA, 22 bp, Homo sapiens
acataatacacttgccctgctc

SEQ ID NO: 6607543 - DNA, 18 bp, Homo sapiens
acataatactgaaccact

SEQ ID NO: 6607544 - DNA, 16 bp, Homo sapiens
acataatataagaatc

SEQ ID NO: 6607545 - DNA, 16 bp, Homo sapiens
acataatcaaagctac

SEQ ID NO: 6607546 - DNA, 19 bp, Homo sapiens
acataatcacaagtaaagg

SEQ ID NO: 6607547 - DNA, 20 bp, Homo sapiens
acataatcagtatatttggt

SEQ ID NO: 6607548 - DNA, 21 bp, Homo sapiens
acataatccacgctcatcttg

SEQ ID NO: 6607549 - DNA, 22 bp, Homo sapiens
acataatctagtttacagaaaa

SEQ ID NO: 6607550 - DNA, 14 bp, Homo sapiens
acataatctctgga

SEQ ID NO: 6607551 - DNA, 16 bp, Homo sapiens
acataatctctggaaa

SEQ ID NO: 6607552 - DNA, 13 bp, Homo sapiens
acataatgaaaat

SEQ ID NO: 6607553 - DNA, 19 bp, Homo sapiens
acataatgaaaatattttt

SEQ ID NO: 6607554 - DNA, 19 bp, Homo sapiens
acataatgaacagaattta

SEQ ID NO: 6607555 - DNA, 20 bp, Homo sapiens
acataatgaacagaatttat

SEQ ID NO: 6607556 - DNA, 21 bp, Homo sapiens
acataatgcgtgcataccact

SEQ ID NO: 6607557 - DNA, 23 bp, Homo sapiens
acataatgcgtgcataccacttt

SEQ ID NO: 6607558 - DNA, 18 bp, Homo sapiens
acataatggttgtgaaat

SEQ ID NO: 6607559 - DNA, 23 bp, Homo sapiens
acataatgtagtgagtgtagact

SEQ ID NO: 6607560 - DNA, 20 bp, Homo sapiens
acataatgtttttcctttct

SEQ ID NO: 6607561 - DNA, 13 bp, Homo sapiens
acataattaaagt

SEQ ID NO: 6607562 - DNA, 15 bp, Homo sapiens
acataattaaagtgt

SEQ ID NO: 6607563 - DNA, 16 bp, Homo sapiens
acataattaaagtgtc

SEQ ID NO: 6607564 - DNA, 18 bp, Homo sapiens
acataattcactctgagt

SEQ ID NO: 6607565 - DNA, 20 bp, Homo sapiens
acataattcaggaagcagct

SEQ ID NO: 6607566 - DNA, 14 bp, Homo sapiens
acataattcattaa

SEQ ID NO: 6607567 - DNA, 19 bp, Homo sapiens
acataattcttccttccct

SEQ ID NO: 6607568 - DNA, 16 bp, Homo sapiens
acataattgattaaaa

SEQ ID NO: 6607569 - DNA, 15 bp, Homo sapiens
acataattgcatgaa

SEQ ID NO: 6607570 - DNA, 17 bp, Homo sapiens
acataattgcatgaaaa

SEQ ID NO: 6607571 - DNA, 19 bp, Homo sapiens
acataattgcatgaaaata

SEQ ID NO: 6607572 - DNA, 19 bp, Homo sapiens
acataatttaaaataaata

SEQ ID NO: 6607573 - DNA, 19 bp, Homo sapiens
acataatttagttgtttct

SEQ ID NO: 6607574 - DNA, 15 bp, Homo sapiens
acataatttgcataa

SEQ ID NO: 6607575 - DNA, 16 bp, Homo sapiens
acataatttttatttt

SEQ ID NO: 6607576 - DNA, 17 bp, Homo sapiens
acataatttttgtacat

SEQ ID NO: 6607577 - DNA, 18 bp, Homo sapiens
acataatttttgtacatc

SEQ ID NO: 6607578 - DNA, 15 bp, Homo sapiens
acatacaaatatatg

SEQ ID NO: 6607579 - DNA, 18 bp, Homo sapiens
acatacaacacaaagaga

SEQ ID NO: 6607580 - DNA, 14 bp, Homo sapiens
acatacaacttttt

SEQ ID NO: 6607581 - DNA, 13 bp, Homo sapiens
acatacaagaaaa

SEQ ID NO: 6607582 - DNA, 18 bp, Homo sapiens
acatacaagaaaatgtat

SEQ ID NO: 6607583 - DNA, 12 bp, Homo sapiens
acatacaattta

SEQ ID NO: 6607584 - DNA, 14 bp, Homo sapiens
acatacaatttgca

SEQ ID NO: 6607585 - DNA, 12 bp, Homo sapiens
acatacacacac

SEQ ID NO: 6607586 - DNA, 14 bp, Homo sapiens
acatacaccagcat

SEQ ID NO: 6607587 - DNA, 14 bp, Homo sapiens
acatacactgcatt

SEQ ID NO: 6607588 - DNA, 22 bp, Homo sapiens
acatacactgtatgttatagaa

SEQ ID NO: 6607589 - DNA, 16 bp, Homo sapiens
acatacacttgtataa

SEQ ID NO: 6607590 - DNA, 20 bp, Homo sapiens
acatacacttgtataaatgt

SEQ ID NO: 6607591 - DNA, 20 bp, Homo sapiens
acatacagagatatacaaat

SEQ ID NO: 6607592 - DNA, 19 bp, Homo sapiens
acatacagagattgtagta

SEQ ID NO: 6607593 - DNA, 13 bp, Homo sapiens
acatacagagtgg

SEQ ID NO: 6607594 - DNA, 15 bp, Homo sapiens
acatacagagtgggc

SEQ ID NO: 6607595 - DNA, 18 bp, Homo sapiens
acatacagattttaccta

SEQ ID NO: 6607596 - DNA, 12 bp, Homo sapiens
acatacagtgat

SEQ ID NO: 6607597 - DNA, 17 bp, Homo sapiens
acatacataatacaatg

SEQ ID NO: 6607598 - DNA, 15 bp, Homo sapiens
acatacatacaaata

SEQ ID NO: 6607599 - DNA, 14 bp, Homo sapiens
acatacatacacat

SEQ ID NO: 6607600 - DNA, 12 bp, Homo sapiens
acatacatacat

SEQ ID NO: 6607601 - DNA, 13 bp, Homo sapiens
acatacatacata

SEQ ID NO: 6607602 - DNA, 15 bp, Homo sapiens
acatacatacataca

SEQ ID NO: 6607603 - DNA, 17 bp, Homo sapiens
acatacatacatacata

SEQ ID NO: 6607604 - DNA, 15 bp, Homo sapiens
acatacatacatata

SEQ ID NO: 6607605 - DNA, 19 bp, Homo sapiens
acatacatagagagagaca

SEQ ID NO: 6607606 - DNA, 13 bp, Homo sapiens
acatacatatata

SEQ ID NO: 6607607 - DNA, 15 bp, Homo sapiens
acatacatatataca

SEQ ID NO: 6607608 - DNA, 17 bp, Homo sapiens
acatacatatatatctg

SEQ ID NO: 6607609 - DNA, 16 bp, Homo sapiens
acatacattcatactg

SEQ ID NO: 6607610 - DNA, 10 bp, Homo sapiens
acatacattg

SEQ ID NO: 6607611 - DNA, 12 bp, Homo sapiens
acatacatttaa

SEQ ID NO: 6607612 - DNA, 14 bp, Homo sapiens
acatacatttaaaa

SEQ ID NO: 6607613 - DNA, 21 bp, Homo sapiens
acataccatgtggatgcagca

SEQ ID NO: 6607614 - DNA, 17 bp, Homo sapiens
acataccccactgggca

SEQ ID NO: 6607615 - DNA, 21 bp, Homo sapiens
acatacccgcctagctgctgt

SEQ ID NO: 6607616 - DNA, 14 bp, Homo sapiens
acataccctccccc

SEQ ID NO: 6607617 - DNA, 21 bp, Homo sapiens
acataccctggccgccccctg

SEQ ID NO: 6607618 - DNA, 14 bp, Homo sapiens
acatacctaagaag

SEQ ID NO: 6607619 - DNA, 16 bp, Homo sapiens
acatacctaagcaaac

SEQ ID NO: 6607620 - DNA, 20 bp, Homo sapiens
acataccttagactgaaaaa

SEQ ID NO: 6607621 - DNA, 17 bp, Homo sapiens
acatacgaaacacaaac

SEQ ID NO: 6607622 - DNA, 20 bp, Homo sapiens
acatacgcaaaaacttcctt

SEQ ID NO: 6607623 - DNA, 22 bp, Homo sapiens
acatacggtcaggtttaacatt

SEQ ID NO: 6607624 - DNA, 15 bp, Homo sapiens
acatacggttctgtt

SEQ ID NO: 6607625 - DNA, 16 bp, Homo sapiens
acatacgtgtgcatgt

SEQ ID NO: 6607626 - DNA, 18 bp, Homo sapiens
acatactaatgaagtatt

SEQ ID NO: 6607627 - DNA, 14 bp, Homo sapiens
acatactagaaagc

SEQ ID NO: 6607628 - DNA, 17 bp, Homo sapiens
acatactaggtgccttt

SEQ ID NO: 6607629 - DNA, 21 bp, Homo sapiens
acatactcaggataacagaga

SEQ ID NO: 6607630 - DNA, 13 bp, Homo sapiens
acatactcccatc

SEQ ID NO: 6607631 - DNA, 17 bp, Homo sapiens
acatactcccatctgtg

SEQ ID NO: 6607632 - DNA, 17 bp, Homo sapiens
acatactccccaattta

SEQ ID NO: 6607633 - DNA, 24 bp, Homo sapiens
acatactccttccatcaaatagaa

SEQ ID NO: 6607634 - DNA, 13 bp, Homo sapiens
acatactgctgga

SEQ ID NO: 6607635 - DNA, 13 bp, Homo sapiens
acatactgcttga

SEQ ID NO: 6607636 - DNA, 20 bp, Homo sapiens
acatactgcttgattttaat

SEQ ID NO: 6607637 - DNA, 14 bp, Homo sapiens
acatactggcctct

SEQ ID NO: 6607638 - DNA, 15 bp, Homo sapiens
acatactggcctctg

SEQ ID NO: 6607639 - DNA, 16 bp, Homo sapiens
acatactggcctctgt

SEQ ID NO: 6607640 - DNA, 17 bp, Homo sapiens
acatactggcctctgtg

SEQ ID NO: 6607641 - DNA, 18 bp, Homo sapiens
acatactggcctggactg

SEQ ID NO: 6607642 - DNA, 14 bp, Homo sapiens
acatactgtaatca

SEQ ID NO: 6607643 - DNA, 18 bp, Homo sapiens
acatactgtaatcaaaag

SEQ ID NO: 6607644 - DNA, 14 bp, Homo sapiens
acatactgttcact

SEQ ID NO: 6607645 - DNA, 15 bp, Homo sapiens
acatactgttctcaa

SEQ ID NO: 6607646 - DNA, 15 bp, Homo sapiens
acatacttacatttc

SEQ ID NO: 6607647 - DNA, 23 bp, Homo sapiens
acatacttacatttcagacatat

SEQ ID NO: 6607648 - DNA, 12 bp, Homo sapiens
acatacttcagc

SEQ ID NO: 6607649 - DNA, 17 bp, Homo sapiens
acatacttctttcaaga

SEQ ID NO: 6607650 - DNA, 15 bp, Homo sapiens
acatacttgaagggc

SEQ ID NO: 6607651 - DNA, 15 bp, Homo sapiens
acatactttatcaat

SEQ ID NO: 6607652 - DNA, 23 bp, Homo sapiens
acatactttcatcctgactctgc

SEQ ID NO: 6607653 - DNA, 16 bp, Homo sapiens
acatacttttgcaaaa

SEQ ID NO: 6607654 - DNA, 16 bp, Homo sapiens
acatactttttcaaga

SEQ ID NO: 6607655 - DNA, 13 bp, Homo sapiens
acatactttttgg

SEQ ID NO: 6607656 - DNA, 14 bp, Homo sapiens
acatagaaaaatga

SEQ ID NO: 6607657 - DNA, 22 bp, Homo sapiens
acatagaaaaatgatgtcttta

SEQ ID NO: 6607658 - DNA, 15 bp, Homo sapiens
acatagaaacataca

SEQ ID NO: 6607659 - DNA, 17 bp, Homo sapiens
acatagaaagttcatgg

SEQ ID NO: 6607660 - DNA, 22 bp, Homo sapiens
acatagaaatggaaattttgct

SEQ ID NO: 6607661 - DNA, 15 bp, Homo sapiens
acatagaacatgtgt

SEQ ID NO: 6607662 - DNA, 14 bp, Homo sapiens
acatagaatctgtg

SEQ ID NO: 6607663 - DNA, 16 bp, Homo sapiens
acatagacagatgtgg

SEQ ID NO: 6607664 - DNA, 13 bp, Homo sapiens
acatagacattcc

SEQ ID NO: 6607665 - DNA, 17 bp, Homo sapiens
acatagacatttcaaaa

SEQ ID NO: 6607666 - DNA, 13 bp, Homo sapiens
acatagaccctct

SEQ ID NO: 6607667 - DNA, 17 bp, Homo sapiens
acatagactagagaaac

SEQ ID NO: 6607668 - DNA, 20 bp, Homo sapiens
acatagactgaagatttatt

SEQ ID NO: 6607669 - DNA, 18 bp, Homo sapiens
acatagacttaggcatta

SEQ ID NO: 6607670 - DNA, 22 bp, Homo sapiens
acatagacttaggcattaacat

SEQ ID NO: 6607671 - DNA, 14 bp, Homo sapiens
acatagagcaatgt

SEQ ID NO: 6607672 - DNA, 19 bp, Homo sapiens
acatagagccgggtgtccc

SEQ ID NO: 6607673 - DNA, 15 bp, Homo sapiens
acatagagcttttta

SEQ ID NO: 6607674 - DNA, 22 bp, Homo sapiens
acatagagctttttaatagcac

SEQ ID NO: 6607675 - DNA, 14 bp, Homo sapiens
acatagaggtatat

SEQ ID NO: 6607676 - DNA, 16 bp, Homo sapiens
acatagaggtatattg

SEQ ID NO: 6607677 - DNA, 20 bp, Homo sapiens
acatagaggtatattggaag

SEQ ID NO: 6607678 - DNA, 15 bp, Homo sapiens
acatagagtatataa

SEQ ID NO: 6607679 - DNA, 15 bp, Homo sapiens
acatagatattttca

SEQ ID NO: 6607680 - DNA, 14 bp, Homo sapiens
acatagatcagcca

SEQ ID NO: 6607681 - DNA, 17 bp, Homo sapiens
acatagatctagtctga

SEQ ID NO: 6607682 - DNA, 16 bp, Homo sapiens
acatagatgcctgggc

SEQ ID NO: 6607683 - DNA, 14 bp, Homo sapiens
acatagatgctaca

SEQ ID NO: 6607684 - DNA, 22 bp, Homo sapiens
acatagatttatttttcagttc

SEQ ID NO: 6607685 - DNA, 22 bp, Homo sapiens
acatagcaaataaaataaatga

SEQ ID NO: 6607686 - DNA, 20 bp, Homo sapiens
acatagcaggggcaccttcc

SEQ ID NO: 6607687 - DNA, 16 bp, Homo sapiens
acatagcatgcttcct

SEQ ID NO: 6607688 - DNA, 19 bp, Homo sapiens
acatagcatgtcaactttt

SEQ ID NO: 6607689 - DNA, 20 bp, Homo sapiens
acatagccaatggacaagca

SEQ ID NO: 6607690 - DNA, 14 bp, Homo sapiens
acatagccagatgt

SEQ ID NO: 6607691 - DNA, 16 bp, Homo sapiens
acatagcccacttaca

SEQ ID NO: 6607692 - DNA, 14 bp, Homo sapiens
acatagcccatccc

SEQ ID NO: 6607693 - DNA, 22 bp, Homo sapiens
acatagcccatccctgcctggt

SEQ ID NO: 6607694 - DNA, 12 bp, Homo sapiens
acatagcccctg

SEQ ID NO: 6607695 - DNA, 21 bp, Homo sapiens
acatagccctggtgctcctgc

SEQ ID NO: 6607696 - DNA, 20 bp, Homo sapiens
acatagccctgttgacctgc

SEQ ID NO: 6607697 - DNA, 16 bp, Homo sapiens
acatagcctatattta

SEQ ID NO: 6607698 - DNA, 12 bp, Homo sapiens
acatagcctcat

SEQ ID NO: 6607699 - DNA, 19 bp, Homo sapiens
acatagcgccgtgctgtaa

SEQ ID NO: 6607700 - DNA, 21 bp, Homo sapiens
acatagctacccaaaagagaa

SEQ ID NO: 6607701 - DNA, 14 bp, Homo sapiens
acatagctgtgatt

SEQ ID NO: 6607702 - DNA, 12 bp, Homo sapiens
acataggaaagt

SEQ ID NO: 6607703 - DNA, 21 bp, Homo sapiens
acataggaagttaaaagcaca

SEQ ID NO: 6607704 - DNA, 18 bp, Homo sapiens
acataggcaaattggaaa

SEQ ID NO: 6607705 - DNA, 20 bp, Homo sapiens
acataggcaatatctttaat

SEQ ID NO: 6607706 - DNA, 18 bp, Homo sapiens
acataggccaaggcccaa

SEQ ID NO: 6607707 - DNA, 18 bp, Homo sapiens
acataggccgagctgtgg

SEQ ID NO: 6607708 - DNA, 16 bp, Homo sapiens
acataggcttctatta

SEQ ID NO: 6607709 - DNA, 15 bp, Homo sapiens
acataggtataatta

SEQ ID NO: 6607710 - DNA, 19 bp, Homo sapiens
acataggtcataaagcatt

SEQ ID NO: 6607711 - DNA, 20 bp, Homo sapiens
acataggtctgtatggctgt

SEQ ID NO: 6607712 - DNA, 20 bp, Homo sapiens
acataggttagattctcatt

SEQ ID NO: 6607713 - DNA, 13 bp, Homo sapiens
acatagtaaagta

SEQ ID NO: 6607714 - DNA, 18 bp, Homo sapiens
acatagtaaagtattttt

SEQ ID NO: 6607715 - DNA, 12 bp, Homo sapiens
acatagtcacaa

SEQ ID NO: 6607716 - DNA, 14 bp, Homo sapiens
acatagtcacaaaa

SEQ ID NO: 6607717 - DNA, 17 bp, Homo sapiens
acatagtccagagaact

SEQ ID NO: 6607718 - DNA, 15 bp, Homo sapiens
acatagtcctcaggg

SEQ ID NO: 6607719 - DNA, 18 bp, Homo sapiens
acatagtgaaaattgttt

SEQ ID NO: 6607720 - DNA, 23 bp, Homo sapiens
acatagtgaaaattgtttagtga

SEQ ID NO: 6607721 - DNA, 16 bp, Homo sapiens
acatagtgaaagttta

SEQ ID NO: 6607722 - DNA, 13 bp, Homo sapiens
acatagtgaaata

SEQ ID NO: 6607723 - DNA, 13 bp, Homo sapiens
acatagtgacatg

SEQ ID NO: 6607724 - DNA, 21 bp, Homo sapiens
acatagtgatggttcccctgt

SEQ ID NO: 6607725 - DNA, 22 bp, Homo sapiens
acatagtgcattgtttctgtgg

SEQ ID NO: 6607726 - DNA, 18 bp, Homo sapiens
acatagtggatggacaga

SEQ ID NO: 6607727 - DNA, 16 bp, Homo sapiens
acatagtggtatttta

SEQ ID NO: 6607728 - DNA, 20 bp, Homo sapiens
acatagtggtattttaacat

SEQ ID NO: 6607729 - DNA, 12 bp, Homo sapiens
acatagtgtaat

SEQ ID NO: 6607730 - DNA, 19 bp, Homo sapiens
acatagtgtaggctttact

SEQ ID NO: 6607731 - DNA, 23 bp, Homo sapiens
acatagtgtaggctttacttagc

SEQ ID NO: 6607732 - DNA, 23 bp, Homo sapiens
acatagttctccagttgtatgga

SEQ ID NO: 6607733 - DNA, 18 bp, Homo sapiens
acatagttctgtaataaa

SEQ ID NO: 6607734 - DNA, 21 bp, Homo sapiens
acatagttggtaatgcttgga

SEQ ID NO: 6607735 - DNA, 12 bp, Homo sapiens
acatagtttctt

SEQ ID NO: 6607736 - DNA, 21 bp, Homo sapiens
acatagttttaaactcatttt

SEQ ID NO: 6607737 - DNA, 14 bp, Homo sapiens
acatataaaaacaa

SEQ ID NO: 6607738 - DNA, 13 bp, Homo sapiens
acatataaaataa

SEQ ID NO: 6607739 - DNA, 13 bp, Homo sapiens
acatataaacaca

SEQ ID NO: 6607740 - DNA, 13 bp, Homo sapiens
acatataaattaa

SEQ ID NO: 6607741 - DNA, 22 bp, Homo sapiens
acatataaattaatacataagt

SEQ ID NO: 6607742 - DNA, 17 bp, Homo sapiens
acatataaattgtctta

SEQ ID NO: 6607743 - DNA, 14 bp, Homo sapiens
acatataacatgca

SEQ ID NO: 6607744 - DNA, 22 bp, Homo sapiens
acatataacatgcaaacaggtt

SEQ ID NO: 6607745 - DNA, 14 bp, Homo sapiens
acatataactattg

SEQ ID NO: 6607746 - DNA, 15 bp, Homo sapiens
acatatacacaaaga

SEQ ID NO: 6607747 - DNA, 20 bp, Homo sapiens
acatatacacgaatagacat

SEQ ID NO: 6607748 - DNA, 17 bp, Homo sapiens
acatatacatacttaca

SEQ ID NO: 6607749 - DNA, 22 bp, Homo sapiens
acatatacatacttacatgtgt

SEQ ID NO: 6607750 - DNA, 15 bp, Homo sapiens
acatatacatatgag

SEQ ID NO: 6607751 - DNA, 17 bp, Homo sapiens
acatatacatatgatca

SEQ ID NO: 6607752 - DNA, 14 bp, Homo sapiens
acatatacattatt

SEQ ID NO: 6607753 - DNA, 19 bp, Homo sapiens
acatatacattatttctgt

SEQ ID NO: 6607754 - DNA, 21 bp, Homo sapiens
acatatacctataatgtgtgt

SEQ ID NO: 6607755 - DNA, 17 bp, Homo sapiens
acatatactgattctgt

SEQ ID NO: 6607756 - DNA, 20 bp, Homo sapiens
acatatactgattctgtgta

SEQ ID NO: 6607757 - DNA, 16 bp, Homo sapiens
acatatagaatgcaga

SEQ ID NO: 6607758 - DNA, 22 bp, Homo sapiens
acatatagccctttccccactc

SEQ ID NO: 6607759 - DNA, 16 bp, Homo sapiens
acatataggagcaata

SEQ ID NO: 6607760 - DNA, 14 bp, Homo sapiens
acatatagtgtaca

SEQ ID NO: 6607761 - DNA, 22 bp, Homo sapiens
acatatataggcagttgcatgc

SEQ ID NO: 6607762 - DNA, 15 bp, Homo sapiens
acatatatatataca

SEQ ID NO: 6607763 - DNA, 20 bp, Homo sapiens
acatatatatatacacatac

SEQ ID NO: 6607764 - DNA, 23 bp, Homo sapiens
acatatatatatacacatacata

SEQ ID NO: 6607765 - DNA, 15 bp, Homo sapiens
acatatatatatata

SEQ ID NO: 6607766 - DNA, 17 bp, Homo sapiens
acatatatatatataac

SEQ ID NO: 6607767 - DNA, 18 bp, Homo sapiens
acatatatatcctatttg

SEQ ID NO: 6607768 - DNA, 21 bp, Homo sapiens
acatatatatgccttatgtaa

SEQ ID NO: 6607769 - DNA, 22 bp, Homo sapiens
acatatatatgccttatgtaat

SEQ ID NO: 6607770 - DNA, 14 bp, Homo sapiens
acatatatctacac

SEQ ID NO: 6607771 - DNA, 23 bp, Homo sapiens
acatatatctacacatacagaaa

SEQ ID NO: 6607772 - DNA, 19 bp, Homo sapiens
acatatatcttatccaatt

SEQ ID NO: 6607773 - DNA, 23 bp, Homo sapiens
acatatatgtataatatatatct

SEQ ID NO: 6607774 - DNA, 14 bp, Homo sapiens
acatatatgtatat

SEQ ID NO: 6607775 - DNA, 15 bp, Homo sapiens
acatatatgtatata

SEQ ID NO: 6607776 - DNA, 16 bp, Homo sapiens
acatatattatttatt

SEQ ID NO: 6607777 - DNA, 20 bp, Homo sapiens
acatatattttttaaaataa

SEQ ID NO: 6607778 - DNA, 22 bp, Homo sapiens
acatatcaaaataggatttctt

SEQ ID NO: 6607779 - DNA, 12 bp, Homo sapiens
acatatcaattc

SEQ ID NO: 6607780 - DNA, 16 bp, Homo sapiens
acatatcaattcaaca

SEQ ID NO: 6607781 - DNA, 19 bp, Homo sapiens
acatatcaattcaacacat

SEQ ID NO: 6607782 - DNA, 20 bp, Homo sapiens
acatatcaattcaacacatt

SEQ ID NO: 6607783 - DNA, 14 bp, Homo sapiens
acatatcagaaaag

SEQ ID NO: 6607784 - DNA, 19 bp, Homo sapiens
acatatcagaaaagtagaa

SEQ ID NO: 6607785 - DNA, 21 bp, Homo sapiens
acatatcagaaaagtagaatt

SEQ ID NO: 6607786 - DNA, 14 bp, Homo sapiens
acatatcagaatag

SEQ ID NO: 6607787 - DNA, 19 bp, Homo sapiens
acatatcagaataggaaga

SEQ ID NO: 6607788 - DNA, 23 bp, Homo sapiens
acatatcagcaggagtaataaat

SEQ ID NO: 6607789 - DNA, 13 bp, Homo sapiens
acatatcatggta

SEQ ID NO: 6607790 - DNA, 15 bp, Homo sapiens
acatatcatggtaat

SEQ ID NO: 6607791 - DNA, 16 bp, Homo sapiens
acatatcatggtaatg

SEQ ID NO: 6607792 - DNA, 23 bp, Homo sapiens
acatatcatggtaatgacagatg

SEQ ID NO: 6607793 - DNA, 15 bp, Homo sapiens
acatatcattcagaa

SEQ ID NO: 6607794 - DNA, 21 bp, Homo sapiens
acatatcattctgtgattaaa

SEQ ID NO: 6607795 - DNA, 17 bp, Homo sapiens
acatatcatttgtgaag

SEQ ID NO: 6607796 - DNA, 18 bp, Homo sapiens
acatatcatttgtgaaga

SEQ ID NO: 6607797 - DNA, 13 bp, Homo sapiens
acatatcattttt

SEQ ID NO: 6607798 - DNA, 24 bp, Homo sapiens
acatatccaaagggaatactcaca

SEQ ID NO: 6607799 - DNA, 16 bp, Homo sapiens
acatatcccttccaga

SEQ ID NO: 6607800 - DNA, 23 bp, Homo sapiens
acatatctagtatgaaattatat

SEQ ID NO: 6607801 - DNA, 13 bp, Homo sapiens
acatatctctgcc

SEQ ID NO: 6607802 - DNA, 14 bp, Homo sapiens
acatatctgatatt

SEQ ID NO: 6607803 - DNA, 21 bp, Homo sapiens
acatatctgtcccctgctact

SEQ ID NO: 6607804 - DNA, 15 bp, Homo sapiens
acatatcttagatgg

SEQ ID NO: 6607805 - DNA, 18 bp, Homo sapiens
acatatctttattaatca

SEQ ID NO: 6607806 - DNA, 21 bp, Homo sapiens
acatatgaaatataaattatc

SEQ ID NO: 6607807 - DNA, 23 bp, Homo sapiens
acatatgaaatataaattatctg

SEQ ID NO: 6607808 - DNA, 18 bp, Homo sapiens
acatatgaaatttaatat

SEQ ID NO: 6607809 - DNA, 13 bp, Homo sapiens
acatatgaacaca

SEQ ID NO: 6607810 - DNA, 15 bp, Homo sapiens
acatatgaacacaga

SEQ ID NO: 6607811 - DNA, 14 bp, Homo sapiens
acatatgaggggga

SEQ ID NO: 6607812 - DNA, 22 bp, Homo sapiens
acatatgatttcactagaaaag

SEQ ID NO: 6607813 - DNA, 13 bp, Homo sapiens
acatatgcaaaca

SEQ ID NO: 6607814 - DNA, 17 bp, Homo sapiens
acatatgcaccttgtgt

SEQ ID NO: 6607815 - DNA, 18 bp, Homo sapiens
acatatgcaccttgtgtc

SEQ ID NO: 6607816 - DNA, 19 bp, Homo sapiens
acatatggaaatcctgtta

SEQ ID NO: 6607817 - DNA, 15 bp, Homo sapiens
acatatggaaatgtt

SEQ ID NO: 6607818 - DNA, 13 bp, Homo sapiens
acatatggaattt

SEQ ID NO: 6607819 - DNA, 17 bp, Homo sapiens
acatatggaattttgca

SEQ ID NO: 6607820 - DNA, 20 bp, Homo sapiens
acatatggaattttgcaaag

SEQ ID NO: 6607821 - DNA, 13 bp, Homo sapiens
acatatggatgtt

SEQ ID NO: 6607822 - DNA, 14 bp, Homo sapiens
acatatggatgtta

SEQ ID NO: 6607823 - DNA, 15 bp, Homo sapiens
acatatggatgttac

SEQ ID NO: 6607824 - DNA, 16 bp, Homo sapiens
acatatggatgttact

SEQ ID NO: 6607825 - DNA, 18 bp, Homo sapiens
acatatggatgttactct

SEQ ID NO: 6607826 - DNA, 23 bp, Homo sapiens
acatatgggaactatgaggagcc

SEQ ID NO: 6607827 - DNA, 18 bp, Homo sapiens
acatatgggtgctggcag

SEQ ID NO: 6607828 - DNA, 21 bp, Homo sapiens
acatatgtaaaatattgttac

SEQ ID NO: 6607829 - DNA, 22 bp, Homo sapiens
acatatgtaaaatattgttact

SEQ ID NO: 6607830 - DNA, 21 bp, Homo sapiens
acatatgtaacagtcaaatat

SEQ ID NO: 6607831 - DNA, 18 bp, Homo sapiens
acatatgtagaaacattt

SEQ ID NO: 6607832 - DNA, 16 bp, Homo sapiens
acatatgtagactata

SEQ ID NO: 6607833 - DNA, 20 bp, Homo sapiens
acatatgtaggaaaattttc

SEQ ID NO: 6607834 - DNA, 14 bp, Homo sapiens
acatatgtatactt

SEQ ID NO: 6607835 - DNA, 21 bp, Homo sapiens
acatatgtatctttggggaaa

SEQ ID NO: 6607836 - DNA, 15 bp, Homo sapiens
acatatgtatgtgtg

SEQ ID NO: 6607837 - DNA, 14 bp, Homo sapiens
acatatgtctgtat

SEQ ID NO: 6607838 - DNA, 20 bp, Homo sapiens
acatatgtcttactacttta

SEQ ID NO: 6607839 - DNA, 22 bp, Homo sapiens
acatatgttaataaactgcaaa

SEQ ID NO: 6607840 - DNA, 23 bp, Homo sapiens
acatatgttaataaactgcaaat

SEQ ID NO: 6607841 - DNA, 15 bp, Homo sapiens
acatatgttcctaat

SEQ ID NO: 6607842 - DNA, 19 bp, Homo sapiens
acatattactgttgcattt

SEQ ID NO: 6607843 - DNA, 20 bp, Homo sapiens
acatattactgttgcattta

SEQ ID NO: 6607844 - DNA, 12 bp, Homo sapiens
acatattataaa

SEQ ID NO: 6607845 - DNA, 16 bp, Homo sapiens
acatattataaataaa

SEQ ID NO: 6607846 - DNA, 19 bp, Homo sapiens
acatattataaataaatgc

SEQ ID NO: 6607847 - DNA, 20 bp, Homo sapiens
acatattataaataaatgcc

SEQ ID NO: 6607848 - DNA, 21 bp, Homo sapiens
acatattatgcctgaatgact

SEQ ID NO: 6607849 - DNA, 23 bp, Homo sapiens
acatattattggtcaagaaaagc

SEQ ID NO: 6607850 - DNA, 15 bp, Homo sapiens
acatattcaaatcag

SEQ ID NO: 6607851 - DNA, 18 bp, Homo sapiens
acatattcaaatcagcaa

SEQ ID NO: 6607852 - DNA, 16 bp, Homo sapiens
acatattcaagtgata

SEQ ID NO: 6607853 - DNA, 14 bp, Homo sapiens
acatattcatgaaa

SEQ ID NO: 6607854 - DNA, 13 bp, Homo sapiens
acatattcctttg

SEQ ID NO: 6607855 - DNA, 21 bp, Homo sapiens
acatattcctttgaccaaata

SEQ ID NO: 6607856 - DNA, 13 bp, Homo sapiens
acatattctaaat

SEQ ID NO: 6607857 - DNA, 16 bp, Homo sapiens
acatattcttggagaa

SEQ ID NO: 6607858 - DNA, 22 bp, Homo sapiens
acatattgagaacctaatgcac

SEQ ID NO: 6607859 - DNA, 22 bp, Homo sapiens
acatattgatttccgttaaaat

SEQ ID NO: 6607860 - DNA, 17 bp, Homo sapiens
acatattggaaaggtca

SEQ ID NO: 6607861 - DNA, 13 bp, Homo sapiens
acatatttaactg

SEQ ID NO: 6607862 - DNA, 18 bp, Homo sapiens
acatatttaactggtgca

SEQ ID NO: 6607863 - DNA, 13 bp, Homo sapiens
acatatttaatgt

SEQ ID NO: 6607864 - DNA, 15 bp, Homo sapiens
acatatttaatgttt

SEQ ID NO: 6607865 - DNA, 17 bp, Homo sapiens
acatatttaatgtttta

SEQ ID NO: 6607866 - DNA, 21 bp, Homo sapiens
acatatttaatgttttaaatg

SEQ ID NO: 6607867 - DNA, 13 bp, Homo sapiens
acatatttattgt

SEQ ID NO: 6607868 - DNA, 16 bp, Homo sapiens
acatatttattgtgca

SEQ ID NO: 6607869 - DNA, 18 bp, Homo sapiens
acatatttcacatgttta

SEQ ID NO: 6607870 - DNA, 18 bp, Homo sapiens
acatatttccaagaagtt

SEQ ID NO: 6607871 - DNA, 13 bp, Homo sapiens
acatatttgcaaa

SEQ ID NO: 6607872 - DNA, 17 bp, Homo sapiens
acatatttgtggaataa

SEQ ID NO: 6607873 - DNA, 14 bp, Homo sapiens
acatatttgttaaa

SEQ ID NO: 6607874 - DNA, 17 bp, Homo sapiens
acatattttacatctga

SEQ ID NO: 6607875 - DNA, 16 bp, Homo sapiens
acatattttatagaac

SEQ ID NO: 6607876 - DNA, 17 bp, Homo sapiens
acatattttcctttaga

SEQ ID NO: 6607877 - DNA, 20 bp, Homo sapiens
acatatttttatactttatt

SEQ ID NO: 6607878 - DNA, 14 bp, Homo sapiens
acatcaaaaatggg

SEQ ID NO: 6607879 - DNA, 13 bp, Homo sapiens
acatcaaaatcaa

SEQ ID NO: 6607880 - DNA, 13 bp, Homo sapiens
acatcaaaatgag

SEQ ID NO: 6607881 - DNA, 13 bp, Homo sapiens
acatcaaaccttt

SEQ ID NO: 6607882 - DNA, 16 bp, Homo sapiens
acatcaaagcttcttc

SEQ ID NO: 6607883 - DNA, 19 bp, Homo sapiens
acatcaaataaatttctgg

SEQ ID NO: 6607884 - DNA, 23 bp, Homo sapiens
acatcaaataattgaagagacaa

SEQ ID NO: 6607885 - DNA, 20 bp, Homo sapiens
acatcaacattccagggatg

SEQ ID NO: 6607886 - DNA, 17 bp, Homo sapiens
acatcaagcatgcaata

SEQ ID NO: 6607887 - DNA, 13 bp, Homo sapiens
acatcaagccatc

SEQ ID NO: 6607888 - DNA, 18 bp, Homo sapiens
acatcaaggagttatgct

SEQ ID NO: 6607889 - DNA, 22 bp, Homo sapiens
acatcaagtccatctgacaaaa

SEQ ID NO: 6607890 - DNA, 14 bp, Homo sapiens
acatcaagtgtaat

SEQ ID NO: 6607891 - DNA, 17 bp, Homo sapiens
acatcaagtgtaattag

SEQ ID NO: 6607892 - DNA, 20 bp, Homo sapiens
acatcaatattgtcattcct

SEQ ID NO: 6607893 - DNA, 15 bp, Homo sapiens
acatcaatcctggta

SEQ ID NO: 6607894 - DNA, 12 bp, Homo sapiens
acatcaatgaaa

SEQ ID NO: 6607895 - DNA, 22 bp, Homo sapiens
acatcaatgataatgctaattt

SEQ ID NO: 6607896 - DNA, 18 bp, Homo sapiens
acatcaatggctttgtac

SEQ ID NO: 6607897 - DNA, 15 bp, Homo sapiens
acatcaatgttcatt

SEQ ID NO: 6607898 - DNA, 17 bp, Homo sapiens
acatcaatgttcattgt

SEQ ID NO: 6607899 - DNA, 14 bp, Homo sapiens
acatcacaagacta

SEQ ID NO: 6607900 - DNA, 17 bp, Homo sapiens
acatcacaatattcagt

SEQ ID NO: 6607901 - DNA, 17 bp, Homo sapiens
acatcacacagtatact

SEQ ID NO: 6607902 - DNA, 13 bp, Homo sapiens
acatcacagatga

SEQ ID NO: 6607903 - DNA, 15 bp, Homo sapiens
acatcacagcagaat

SEQ ID NO: 6607904 - DNA, 20 bp, Homo sapiens
acatcacagcagaatgaaga

SEQ ID NO: 6607905 - DNA, 22 bp, Homo sapiens
acatcacagcagaatgaagacc

SEQ ID NO: 6607906 - DNA, 14 bp, Homo sapiens
acatcacagcccag

SEQ ID NO: 6607907 - DNA, 16 bp, Homo sapiens
acatcacagcccagcc

SEQ ID NO: 6607908 - DNA, 17 bp, Homo sapiens
acatcacagggcctcag

SEQ ID NO: 6607909 - DNA, 19 bp, Homo sapiens
acatcacagggcctcagtt

SEQ ID NO: 6607910 - DNA, 15 bp, Homo sapiens
acatcacagggtggg

SEQ ID NO: 6607911 - DNA, 19 bp, Homo sapiens
acatcacagggtgggcctc

SEQ ID NO: 6607912 - DNA, 18 bp, Homo sapiens
acatcacatccctctcct

SEQ ID NO: 6607913 - DNA, 22 bp, Homo sapiens
acatcacatcttatttatttta

SEQ ID NO: 6607914 - DNA, 18 bp, Homo sapiens
acatcacatggcatgttt

SEQ ID NO: 6607915 - DNA, 21 bp, Homo sapiens
acatcaccagtgccacgtcat

SEQ ID NO: 6607916 - DNA, 18 bp, Homo sapiens
acatcaccctatatataa

SEQ ID NO: 6607917 - DNA, 15 bp, Homo sapiens
acatcaccctttgcc

SEQ ID NO: 6607918 - DNA, 22 bp, Homo sapiens
acatcaccgacgcgtctcctgt

SEQ ID NO: 6607919 - DNA, 18 bp, Homo sapiens
acatcacctatttaatgt

SEQ ID NO: 6607920 - DNA, 21 bp, Homo sapiens
acatcaccttcctgaattctt

SEQ ID NO: 6607921 - DNA, 20 bp, Homo sapiens
acatcacctttttgactttt

SEQ ID NO: 6607922 - DNA, 17 bp, Homo sapiens
acatcacgaaggaaaac

SEQ ID NO: 6607923 - DNA, 17 bp, Homo sapiens
acatcactacaaaaaga

SEQ ID NO: 6607924 - DNA, 20 bp, Homo sapiens
acatcactacaaaaagaaga

SEQ ID NO: 6607925 - DNA, 16 bp, Homo sapiens
acatcactatcaattt

SEQ ID NO: 6607926 - DNA, 17 bp, Homo sapiens
acatcactatcaatttt

SEQ ID NO: 6607927 - DNA, 22 bp, Homo sapiens
acatcactatccatgcaccaaa

SEQ ID NO: 6607928 - DNA, 23 bp, Homo sapiens
acatcactgaaacctttaagaaa

SEQ ID NO: 6607929 - DNA, 23 bp, Homo sapiens
acatcactgagaagatggcactg

SEQ ID NO: 6607930 - DNA, 14 bp, Homo sapiens
acatcactggcatg

SEQ ID NO: 6607931 - DNA, 15 bp, Homo sapiens
acatcactggggtca

SEQ ID NO: 6607932 - DNA, 13 bp, Homo sapiens
acatcactgtata

SEQ ID NO: 6607933 - DNA, 11 bp, Homo sapiens
acatcagaaag

SEQ ID NO: 6607934 - DNA, 17 bp, Homo sapiens
acatcagaactgaaata

SEQ ID NO: 6607935 - DNA, 17 bp, Homo sapiens
acatcagaagtttgcat

SEQ ID NO: 6607936 - DNA, 16 bp, Homo sapiens
acatcagacctgtctt

SEQ ID NO: 6607937 - DNA, 20 bp, Homo sapiens
acatcagacctgtcttccaa

SEQ ID NO: 6607938 - DNA, 21 bp, Homo sapiens
acatcagacctgtcttccaag

SEQ ID NO: 6607939 - DNA, 22 bp, Homo sapiens
acatcagagtgacatccaggag

SEQ ID NO: 6607940 - DNA, 11 bp, Homo sapiens
acatcagattt

SEQ ID NO: 6607941 - DNA, 16 bp, Homo sapiens
acatcagatttcttaa

SEQ ID NO: 6607942 - DNA, 17 bp, Homo sapiens
acatcagatttcttaat

SEQ ID NO: 6607943 - DNA, 13 bp, Homo sapiens
acatcagcaaaca

SEQ ID NO: 6607944 - DNA, 17 bp, Homo sapiens
acatcagcaatttcaga

SEQ ID NO: 6607945 - DNA, 15 bp, Homo sapiens
acatcagcacgattt

SEQ ID NO: 6607946 - DNA, 17 bp, Homo sapiens
acatcagcacgatttct

SEQ ID NO: 6607947 - DNA, 19 bp, Homo sapiens
acatcagcacgatttctgt

SEQ ID NO: 6607948 - DNA, 18 bp, Homo sapiens
acatcagcatgttttctg

SEQ ID NO: 6607949 - DNA, 19 bp, Homo sapiens
acatcagcatgttttctgc

SEQ ID NO: 6607950 - DNA, 15 bp, Homo sapiens
acatcagccagctgc

SEQ ID NO: 6607951 - DNA, 12 bp, Homo sapiens
acatcagccctt

SEQ ID NO: 6607952 - DNA, 20 bp, Homo sapiens
acatcagcctccttctttca

SEQ ID NO: 6607953 - DNA, 22 bp, Homo sapiens
acatcagctggtcaaacaaact

SEQ ID NO: 6607954 - DNA, 15 bp, Homo sapiens
acatcaggaaagaga

SEQ ID NO: 6607955 - DNA, 16 bp, Homo sapiens
acatcaggaaagagag

SEQ ID NO: 6607956 - DNA, 18 bp, Homo sapiens
acatcaggaaagagagca

SEQ ID NO: 6607957 - DNA, 16 bp, Homo sapiens
acatcaggtttttccc

SEQ ID NO: 6607958 - DNA, 23 bp, Homo sapiens
acatcagtggcatggctccagtc

SEQ ID NO: 6607959 - DNA, 11 bp, Homo sapiens
acatcagttcc

SEQ ID NO: 6607960 - DNA, 22 bp, Homo sapiens
acatcagttgggatccctcctc

SEQ ID NO: 6607961 - DNA, 13 bp, Homo sapiens
acatcagtttgat

SEQ ID NO: 6607962 - DNA, 15 bp, Homo sapiens
acatcagttttaacg

SEQ ID NO: 6607963 - DNA, 20 bp, Homo sapiens
acatcataaaatttttatat

SEQ ID NO: 6607964 - DNA, 14 bp, Homo sapiens
acatcataattaca

SEQ ID NO: 6607965 - DNA, 15 bp, Homo sapiens
acatcataattacat

SEQ ID NO: 6607966 - DNA, 22 bp, Homo sapiens
acatcatataaaaagcagcaga

SEQ ID NO: 6607967 - DNA, 23 bp, Homo sapiens
acatcatataaaaagcagcagag

SEQ ID NO: 6607968 - DNA, 20 bp, Homo sapiens
acatcatcaaggcactgcct

SEQ ID NO: 6607969 - DNA, 21 bp, Homo sapiens
acatcatcaggaagcctgtgg

SEQ ID NO: 6607970 - DNA, 14 bp, Homo sapiens
acatcatcctcctt

SEQ ID NO: 6607971 - DNA, 14 bp, Homo sapiens
acatcatctgtaag

SEQ ID NO: 6607972 - DNA, 14 bp, Homo sapiens
acatcatgagcctt

SEQ ID NO: 6607973 - DNA, 15 bp, Homo sapiens
acatcatgcattcac

SEQ ID NO: 6607974 - DNA, 17 bp, Homo sapiens
acatcatgcattcacaa

SEQ ID NO: 6607975 - DNA, 12 bp, Homo sapiens
acatcatggacc

SEQ ID NO: 6607976 - DNA, 22 bp, Homo sapiens
acatcatggcaacccctaagaa

SEQ ID NO: 6607977 - DNA, 14 bp, Homo sapiens
acatcatgttactt

SEQ ID NO: 6607978 - DNA, 16 bp, Homo sapiens
acatcatgttacttga

SEQ ID NO: 6607979 - DNA, 20 bp, Homo sapiens
acatcatgttacttgagaag

SEQ ID NO: 6607980 - DNA, 14 bp, Homo sapiens
acatcatgttattt

SEQ ID NO: 6607981 - DNA, 16 bp, Homo sapiens
acatcatgttatttta

SEQ ID NO: 6607982 - DNA, 14 bp, Homo sapiens
acatcattcattca

SEQ ID NO: 6607983 - DNA, 18 bp, Homo sapiens
acatcattcattcactgt

SEQ ID NO: 6607984 - DNA, 20 bp, Homo sapiens
acatcattcattcactgtat

SEQ ID NO: 6607985 - DNA, 17 bp, Homo sapiens
acatcattccaaaaaga

SEQ ID NO: 6607986 - DNA, 17 bp, Homo sapiens
acatcattcctttttat

SEQ ID NO: 6607987 - DNA, 22 bp, Homo sapiens
acatcattcctttttatttata

SEQ ID NO: 6607988 - DNA, 21 bp, Homo sapiens
acatcattctacataatggaa

SEQ ID NO: 6607989 - DNA, 12 bp, Homo sapiens
acatcatttgta

SEQ ID NO: 6607990 - DNA, 13 bp, Homo sapiens
acatcatttgtat

SEQ ID NO: 6607991 - DNA, 23 bp, Homo sapiens
acatcatttgtattatgttccaa

SEQ ID NO: 6607992 - DNA, 12 bp, Homo sapiens
acatcattttgt

SEQ ID NO: 6607993 - DNA, 17 bp, Homo sapiens
acatccaaagcagacag

SEQ ID NO: 6607994 - DNA, 18 bp, Homo sapiens
acatccaaagcagacagc

SEQ ID NO: 6607995 - DNA, 16 bp, Homo sapiens
acatccaactccagca

SEQ ID NO: 6607996 - DNA, 15 bp, Homo sapiens
acatccaactggaaa

SEQ ID NO: 6607997 - DNA, 16 bp, Homo sapiens
acatccaagccagagt

SEQ ID NO: 6607998 - DNA, 20 bp, Homo sapiens
acatccaatattttctttaa

SEQ ID NO: 6607999 - DNA, 15 bp, Homo sapiens
acatccacagtctcc

SEQ ID NO: 6608000 - DNA, 18 bp, Homo sapiens
acatccacatgcacatgt

SEQ ID NO: 6608001 - DNA, 21 bp, Homo sapiens
acatccacatgcacatgtatt

SEQ ID NO: 6608002 - DNA, 19 bp, Homo sapiens
acatccaccaaactcctgc

SEQ ID NO: 6608003 - DNA, 12 bp, Homo sapiens
acatccacccca

SEQ ID NO: 6608004 - DNA, 14 bp, Homo sapiens
acatccaccccagc

SEQ ID NO: 6608005 - DNA, 19 bp, Homo sapiens
acatccactctctcttgtt

SEQ ID NO: 6608006 - DNA, 15 bp, Homo sapiens
acatccactgtttgc

SEQ ID NO: 6608007 - DNA, 23 bp, Homo sapiens
acatccagcagtccaaggtattg

SEQ ID NO: 6608008 - DNA, 19 bp, Homo sapiens
acatccagctgcccctccc

SEQ ID NO: 6608009 - DNA, 18 bp, Homo sapiens
acatccatcagcacccca

SEQ ID NO: 6608010 - DNA, 15 bp, Homo sapiens
acatccatccctcca

SEQ ID NO: 6608011 - DNA, 11 bp, Homo sapiens
acatccatcta

SEQ ID NO: 6608012 - DNA, 13 bp, Homo sapiens
acatccattccca

SEQ ID NO: 6608013 - DNA, 16 bp, Homo sapiens
acatccattgtctctt

SEQ ID NO: 6608014 - DNA, 20 bp, Homo sapiens
acatcccaaaggatgagaat

SEQ ID NO: 6608015 - DNA, 21 bp, Homo sapiens
acatcccaagaaaatcacatc

SEQ ID NO: 6608016 - DNA, 18 bp, Homo sapiens
acatcccaataaagtcct

SEQ ID NO: 6608017 - DNA, 22 bp, Homo sapiens
acatcccaataaagtcctcttc

SEQ ID NO: 6608018 - DNA, 14 bp, Homo sapiens
acatcccacagtgg

SEQ ID NO: 6608019 - DNA, 20 bp, Homo sapiens
acatcccaccccatcctcca

SEQ ID NO: 6608020 - DNA, 16 bp, Homo sapiens
acatcccactgactgt

SEQ ID NO: 6608021 - DNA, 16 bp, Homo sapiens
acatcccactggatct

SEQ ID NO: 6608022 - DNA, 18 bp, Homo sapiens
acatcccactggatctgg

SEQ ID NO: 6608023 - DNA, 22 bp, Homo sapiens
acatcccactggatctggctta

SEQ ID NO: 6608024 - DNA, 16 bp, Homo sapiens
acatcccagaccagcc

SEQ ID NO: 6608025 - DNA, 17 bp, Homo sapiens
acatcccagcagcccaa

SEQ ID NO: 6608026 - DNA, 18 bp, Homo sapiens
acatcccagcctgtggtt

SEQ ID NO: 6608027 - DNA, 18 bp, Homo sapiens
acatcccatcatggctgc

SEQ ID NO: 6608028 - DNA, 16 bp, Homo sapiens
acatcccatgtaacag

SEQ ID NO: 6608029 - DNA, 18 bp, Homo sapiens
acatcccatgtaacagaa

SEQ ID NO: 6608030 - DNA, 13 bp, Homo sapiens
acatcccattggg

SEQ ID NO: 6608031 - DNA, 12 bp, Homo sapiens
acatccccacct

SEQ ID NO: 6608032 - DNA, 20 bp, Homo sapiens
acatccccaccttccaagga

SEQ ID NO: 6608033 - DNA, 21 bp, Homo sapiens
acatccccagaatccataaat

SEQ ID NO: 6608034 - DNA, 13 bp, Homo sapiens
acatccccagagc

SEQ ID NO: 6608035 - DNA, 22 bp, Homo sapiens
acatccccagagcccagctctt

SEQ ID NO: 6608036 - DNA, 23 bp, Homo sapiens
acatccccagagcccagctcttg

SEQ ID NO: 6608037 - DNA, 18 bp, Homo sapiens
acatcccccaatgacctt

SEQ ID NO: 6608038 - DNA, 23 bp, Homo sapiens
acatcccccaatgaccttagccc

SEQ ID NO: 6608039 - DNA, 17 bp, Homo sapiens
acatccccgctggctgg

SEQ ID NO: 6608040 - DNA, 17 bp, Homo sapiens
acatcccgggcctcagt

SEQ ID NO: 6608041 - DNA, 19 bp, Homo sapiens
acatcccgggcctcagtgc

SEQ ID NO: 6608042 - DNA, 23 bp, Homo sapiens
acatccctacaaaaaattagaaa

SEQ ID NO: 6608043 - DNA, 13 bp, Homo sapiens
acatccctccccc

SEQ ID NO: 6608044 - DNA, 18 bp, Homo sapiens
acatccctcctgctttta

SEQ ID NO: 6608045 - DNA, 17 bp, Homo sapiens
acatccctgagcaggaa

SEQ ID NO: 6608046 - DNA, 16 bp, Homo sapiens
acatccctgggcctgc

SEQ ID NO: 6608047 - DNA, 20 bp, Homo sapiens
acatccgccttttgtataca

SEQ ID NO: 6608048 - DNA, 23 bp, Homo sapiens
acatccgcgtgtgcctgtgtgcg

SEQ ID NO: 6608049 - DNA, 21 bp, Homo sapiens
acatccggaacagccaaagaa

SEQ ID NO: 6608050 - DNA, 22 bp, Homo sapiens
acatcctaatagaaagaaatta

SEQ ID NO: 6608051 - DNA, 15 bp, Homo sapiens
acatcctagccccac

SEQ ID NO: 6608052 - DNA, 22 bp, Homo sapiens
acatcctagccccacccagagg

SEQ ID NO: 6608053 - DNA, 20 bp, Homo sapiens
acatcctcatggcccatcag

SEQ ID NO: 6608054 - DNA, 19 bp, Homo sapiens
acatcctcctgcccagctc

SEQ ID NO: 6608055 - DNA, 19 bp, Homo sapiens
acatcctctccaggaaggg

SEQ ID NO: 6608056 - DNA, 13 bp, Homo sapiens
acatcctcttctg

SEQ ID NO: 6608057 - DNA, 15 bp, Homo sapiens
acatcctcttctgct

SEQ ID NO: 6608058 - DNA, 12 bp, Homo sapiens
acatcctgactt

SEQ ID NO: 6608059 - DNA, 13 bp, Homo sapiens
acatcctgcagct

SEQ ID NO: 6608060 - DNA, 19 bp, Homo sapiens
acatcctgggatccagtgt

SEQ ID NO: 6608061 - DNA, 23 bp, Homo sapiens
acatcctgggatccagtgtataa

SEQ ID NO: 6608062 - DNA, 13 bp, Homo sapiens
acatcctgggtaa

SEQ ID NO: 6608063 - DNA, 11 bp, Homo sapiens
acatcctgtga

SEQ ID NO: 6608064 - DNA, 16 bp, Homo sapiens
acatcctgtgtcagaa

SEQ ID NO: 6608065 - DNA, 14 bp, Homo sapiens
acatcctgtgtttc

SEQ ID NO: 6608066 - DNA, 14 bp, Homo sapiens
acatccttccttcc

SEQ ID NO: 6608067 - DNA, 17 bp, Homo sapiens
acatccttctcactgcc

SEQ ID NO: 6608068 - DNA, 18 bp, Homo sapiens
acatccttctcactgcca

SEQ ID NO: 6608069 - DNA, 20 bp, Homo sapiens
acatccttcttggcttcctg

SEQ ID NO: 6608070 - DNA, 21 bp, Homo sapiens
acatccttcttggcttcctgg

SEQ ID NO: 6608071 - DNA, 18 bp, Homo sapiens
acatccttgattacttcc

SEQ ID NO: 6608072 - DNA, 20 bp, Homo sapiens
acatccttgattacttccac

SEQ ID NO: 6608073 - DNA, 18 bp, Homo sapiens
acatccttggactgagaa

SEQ ID NO: 6608074 - DNA, 18 bp, Homo sapiens
acatccttgtggcacatt

SEQ ID NO: 6608075 - DNA, 20 bp, Homo sapiens
acatccttgtggcacatttt

SEQ ID NO: 6608076 - DNA, 19 bp, Homo sapiens
acatcctttgcagggcagc

SEQ ID NO: 6608077 - DNA, 20 bp, Homo sapiens
acatcctttgcagggcagcc

SEQ ID NO: 6608078 - DNA, 21 bp, Homo sapiens
acatcctttgcagggcagccc

SEQ ID NO: 6608079 - DNA, 17 bp, Homo sapiens
acatcctttttctgcta

SEQ ID NO: 6608080 - DNA, 19 bp, Homo sapiens
acatcgatatacatttatt

SEQ ID NO: 6608081 - DNA, 14 bp, Homo sapiens
acatcgatatgtat

SEQ ID NO: 6608082 - DNA, 18 bp, Homo sapiens
acatcgatatgtatatca

SEQ ID NO: 6608083 - DNA, 22 bp, Homo sapiens
acatcgcaatagttttttactt

SEQ ID NO: 6608084 - DNA, 14 bp, Homo sapiens
acatcgcacactgg

SEQ ID NO: 6608085 - DNA, 15 bp, Homo sapiens
acatcgcactgtgga

SEQ ID NO: 6608086 - DNA, 21 bp, Homo sapiens
acatcgccaaggactgactga

SEQ ID NO: 6608087 - DNA, 22 bp, Homo sapiens
acatcgccagccctgggcctgg

SEQ ID NO: 6608088 - DNA, 14 bp, Homo sapiens
acatcggaaaaata

SEQ ID NO: 6608089 - DNA, 14 bp, Homo sapiens
acatcgggctcacc

SEQ ID NO: 6608090 - DNA, 17 bp, Homo sapiens
acatcgtaggcagccac

SEQ ID NO: 6608091 - DNA, 15 bp, Homo sapiens
acatcgtttactttt

SEQ ID NO: 6608092 - DNA, 13 bp, Homo sapiens
acatctaaagctt

SEQ ID NO: 6608093 - DNA, 14 bp, Homo sapiens
acatctaaagcttt

SEQ ID NO: 6608094 - DNA, 15 bp, Homo sapiens
acatctaaagcttta

SEQ ID NO: 6608095 - DNA, 17 bp, Homo sapiens
acatctaaagctttatc

SEQ ID NO: 6608096 - DNA, 12 bp, Homo sapiens
acatctaaattg

SEQ ID NO: 6608097 - DNA, 18 bp, Homo sapiens
acatctaaattgatcatt

SEQ ID NO: 6608098 - DNA, 22 bp, Homo sapiens
acatctaaattgatcattcata

SEQ ID NO: 6608099 - DNA, 16 bp, Homo sapiens
acatctaacctcatct

SEQ ID NO: 6608100 - DNA, 13 bp, Homo sapiens
acatctaagcctg

SEQ ID NO: 6608101 - DNA, 18 bp, Homo sapiens
acatctaagcctgttgag

SEQ ID NO: 6608102 - DNA, 22 bp, Homo sapiens
acatctaagtcagtttcacata

SEQ ID NO: 6608103 - DNA, 21 bp, Homo sapiens
acatctaatgtctcttcctct

SEQ ID NO: 6608104 - DNA, 23 bp, Homo sapiens
acatctaatgtctcttcctctgt

SEQ ID NO: 6608105 - DNA, 16 bp, Homo sapiens
acatctaattaaatgt

SEQ ID NO: 6608106 - DNA, 18 bp, Homo sapiens
acatctacctatacttaa

SEQ ID NO: 6608107 - DNA, 23 bp, Homo sapiens
acatctacgaagccacaggcctg

SEQ ID NO: 6608108 - DNA, 18 bp, Homo sapiens
acatctagcacagctgtg

SEQ ID NO: 6608109 - DNA, 20 bp, Homo sapiens
acatctagcagtaaatactt

SEQ ID NO: 6608110 - DNA, 19 bp, Homo sapiens
acatctatccacactgtca

SEQ ID NO: 6608111 - DNA, 19 bp, Homo sapiens
acatctcacttcagttgtg

SEQ ID NO: 6608112 - DNA, 23 bp, Homo sapiens
acatctcacttcagttgtggcct

SEQ ID NO: 6608113 - DNA, 14 bp, Homo sapiens
acatctcactttgc

SEQ ID NO: 6608114 - DNA, 22 bp, Homo sapiens
acatctcagaccctttagccaa

SEQ ID NO: 6608115 - DNA, 19 bp, Homo sapiens
acatctcaggggccagagg

SEQ ID NO: 6608116 - DNA, 16 bp, Homo sapiens
acatctcatccatcaa

SEQ ID NO: 6608117 - DNA, 23 bp, Homo sapiens
acatctccaaatatcagtgggct

SEQ ID NO: 6608118 - DNA, 11 bp, Homo sapiens
acatctccaga

SEQ ID NO: 6608119 - DNA, 22 bp, Homo sapiens
acatctccagaaaaatgaaaag

SEQ ID NO: 6608120 - DNA, 17 bp, Homo sapiens
acatctcccctttgcta

SEQ ID NO: 6608121 - DNA, 18 bp, Homo sapiens
acatctcccttccacctc

SEQ ID NO: 6608122 - DNA, 12 bp, Homo sapiens
acatctcctggc

SEQ ID NO: 6608123 - DNA, 14 bp, Homo sapiens
acatctcctggcta

SEQ ID NO: 6608124 - DNA, 15 bp, Homo sapiens
acatctccttagaaa

SEQ ID NO: 6608125 - DNA, 20 bp, Homo sapiens
acatctcgagccccctggat

SEQ ID NO: 6608126 - DNA, 12 bp, Homo sapiens
acatctcgggag

SEQ ID NO: 6608127 - DNA, 23 bp, Homo sapiens
acatctctagtgtagctgccaca

SEQ ID NO: 6608128 - DNA, 15 bp, Homo sapiens
acatctctattcccc

SEQ ID NO: 6608129 - DNA, 12 bp, Homo sapiens
acatctctcccc

SEQ ID NO: 6608130 - DNA, 21 bp, Homo sapiens
acatctctccccaaccctagg

SEQ ID NO: 6608131 - DNA, 15 bp, Homo sapiens
acatctctctggctt

SEQ ID NO: 6608132 - DNA, 16 bp, Homo sapiens
acatctctctggcttc

SEQ ID NO: 6608133 - DNA, 15 bp, Homo sapiens
acatctctggagcca

SEQ ID NO: 6608134 - DNA, 16 bp, Homo sapiens
acatctctggagccag

SEQ ID NO: 6608135 - DNA, 19 bp, Homo sapiens
acatctctggagccagaga

SEQ ID NO: 6608136 - DNA, 18 bp, Homo sapiens
acatctctggcccagaaa

SEQ ID NO: 6608137 - DNA, 14 bp, Homo sapiens
acatctctgtcagt

SEQ ID NO: 6608138 - DNA, 21 bp, Homo sapiens
acatctcttgaaacctgttaa

SEQ ID NO: 6608139 - DNA, 14 bp, Homo sapiens
acatctcttgagtg

SEQ ID NO: 6608140 - DNA, 23 bp, Homo sapiens
acatctctttgaattttctgtgt

SEQ ID NO: 6608141 - DNA, 14 bp, Homo sapiens
acatctgaaatcta

SEQ ID NO: 6608142 - DNA, 15 bp, Homo sapiens
acatctgaagtgtct

SEQ ID NO: 6608143 - DNA, 21 bp, Homo sapiens
acatctgaggttttatttcat

SEQ ID NO: 6608144 - DNA, 15 bp, Homo sapiens
acatctgatatcagg

SEQ ID NO: 6608145 - DNA, 14 bp, Homo sapiens
acatctgatttctg

SEQ ID NO: 6608146 - DNA, 17 bp, Homo sapiens
acatctgcacactctct

SEQ ID NO: 6608147 - DNA, 23 bp, Homo sapiens
acatctgcacactctcttctcca

SEQ ID NO: 6608148 - DNA, 12 bp, Homo sapiens
acatctgcaccc

SEQ ID NO: 6608149 - DNA, 18 bp, Homo sapiens
acatctgcagtgttctgt

SEQ ID NO: 6608150 - DNA, 14 bp, Homo sapiens
acatctgccagacc

SEQ ID NO: 6608151 - DNA, 15 bp, Homo sapiens
acatctgccagacct

SEQ ID NO: 6608152 - DNA, 13 bp, Homo sapiens
acatctgccttaa

SEQ ID NO: 6608153 - DNA, 12 bp, Homo sapiens
acatctgctgtg

SEQ ID NO: 6608154 - DNA, 14 bp, Homo sapiens
acatctggcatggc

SEQ ID NO: 6608155 - DNA, 18 bp, Homo sapiens
acatctggctgcacaggc

SEQ ID NO: 6608156 - DNA, 13 bp, Homo sapiens
acatctgtaaaga

SEQ ID NO: 6608157 - DNA, 14 bp, Homo sapiens
acatctgtaaagaa

SEQ ID NO: 6608158 - DNA, 22 bp, Homo sapiens
acatctgtagggaattcttctg

SEQ ID NO: 6608159 - DNA, 18 bp, Homo sapiens
acatctgtatatcagctc

SEQ ID NO: 6608160 - DNA, 21 bp, Homo sapiens
acatctgtgatgactggttgt

SEQ ID NO: 6608161 - DNA, 13 bp, Homo sapiens
acatctgtgtctg

SEQ ID NO: 6608162 - DNA, 16 bp, Homo sapiens
acatctgtgtcttgtt

SEQ ID NO: 6608163 - DNA, 16 bp, Homo sapiens
acatctgttttaaatt

SEQ ID NO: 6608164 - DNA, 15 bp, Homo sapiens
acatcttaaattcat

SEQ ID NO: 6608165 - DNA, 15 bp, Homo sapiens
acatcttacttgtcc

SEQ ID NO: 6608166 - DNA, 22 bp, Homo sapiens
acatcttagcaagcaccaaaaa

SEQ ID NO: 6608167 - DNA, 22 bp, Homo sapiens
acatcttaggcactttttaaca

SEQ ID NO: 6608168 - DNA, 17 bp, Homo sapiens
acatcttattgaataaa

SEQ ID NO: 6608169 - DNA, 20 bp, Homo sapiens
acatcttatttattttagca

SEQ ID NO: 6608170 - DNA, 15 bp, Homo sapiens
acatcttcagctccc

SEQ ID NO: 6608171 - DNA, 17 bp, Homo sapiens
acatcttcagctcccat

SEQ ID NO: 6608172 - DNA, 14 bp, Homo sapiens
acatcttcatataa

SEQ ID NO: 6608173 - DNA, 13 bp, Homo sapiens
acatcttcatgtg

SEQ ID NO: 6608174 - DNA, 13 bp, Homo sapiens
acatcttcattaa

SEQ ID NO: 6608175 - DNA, 21 bp, Homo sapiens
acatcttcattaatactgtgt

SEQ ID NO: 6608176 - DNA, 11 bp, Homo sapiens
acatcttccac

SEQ ID NO: 6608177 - DNA, 24 bp, Homo sapiens
acatcttccatttccatgtcccct

SEQ ID NO: 6608178 - DNA, 20 bp, Homo sapiens
acatcttctgtgaaatataa

SEQ ID NO: 6608179 - DNA, 15 bp, Homo sapiens
acatcttctttggaa

SEQ ID NO: 6608180 - DNA, 17 bp, Homo sapiens
acatcttgaaaatgcca

SEQ ID NO: 6608181 - DNA, 18 bp, Homo sapiens
acatcttgaaaatgccac

SEQ ID NO: 6608182 - DNA, 14 bp, Homo sapiens
acatcttgaatcct

SEQ ID NO: 6608183 - DNA, 22 bp, Homo sapiens
acatcttgactaggtattgtct

SEQ ID NO: 6608184 - DNA, 21 bp, Homo sapiens
acatcttgatctgctcagccc

SEQ ID NO: 6608185 - DNA, 18 bp, Homo sapiens
acatcttgcctacttttc

SEQ ID NO: 6608186 - DNA, 14 bp, Homo sapiens
acatcttgctctgc

SEQ ID NO: 6608187 - DNA, 21 bp, Homo sapiens
acatcttgctctgcatttata

SEQ ID NO: 6608188 - DNA, 16 bp, Homo sapiens
acatcttgctctgctg

SEQ ID NO: 6608189 - DNA, 13 bp, Homo sapiens
acatcttggcagg

SEQ ID NO: 6608190 - DNA, 12 bp, Homo sapiens
acatcttgtgca

SEQ ID NO: 6608191 - DNA, 16 bp, Homo sapiens
acatcttgtgcatgca

SEQ ID NO: 6608192 - DNA, 23 bp, Homo sapiens
acatcttgtgcatgcaaaaatga

SEQ ID NO: 6608193 - DNA, 13 bp, Homo sapiens
acatcttgtttct

SEQ ID NO: 6608194 - DNA, 15 bp, Homo sapiens
acatcttgtttctga

SEQ ID NO: 6608195 - DNA, 20 bp, Homo sapiens
acatctttaacttagtattt

SEQ ID NO: 6608196 - DNA, 13 bp, Homo sapiens
acatctttaagta

SEQ ID NO: 6608197 - DNA, 15 bp, Homo sapiens
acatctttactcagg

SEQ ID NO: 6608198 - DNA, 18 bp, Homo sapiens
acatctttatcattaaac

SEQ ID NO: 6608199 - DNA, 20 bp, Homo sapiens
acatctttatcattaaacat

SEQ ID NO: 6608200 - DNA, 13 bp, Homo sapiens
acatctttatccg

SEQ ID NO: 6608201 - DNA, 17 bp, Homo sapiens
acatctttatctgttct

SEQ ID NO: 6608202 - DNA, 14 bp, Homo sapiens
acatctttattaac

SEQ ID NO: 6608203 - DNA, 22 bp, Homo sapiens
acatctttattaacctcagcat

SEQ ID NO: 6608204 - DNA, 15 bp, Homo sapiens
acatctttcacattg

SEQ ID NO: 6608205 - DNA, 18 bp, Homo sapiens
acatctttctcttttcta

SEQ ID NO: 6608206 - DNA, 14 bp, Homo sapiens
acatctttgaaatt

SEQ ID NO: 6608207 - DNA, 17 bp, Homo sapiens
acatctttgaaattatg

SEQ ID NO: 6608208 - DNA, 23 bp, Homo sapiens
acatctttgaaattatgtaaatt

SEQ ID NO: 6608209 - DNA, 14 bp, Homo sapiens
acatcttttcctga

SEQ ID NO: 6608210 - DNA, 15 bp, Homo sapiens
acatcttttcctgat

SEQ ID NO: 6608211 - DNA, 21 bp, Homo sapiens
acatcttttctaatcacagtg

SEQ ID NO: 6608212 - DNA, 17 bp, Homo sapiens
acatcttttgataattg

SEQ ID NO: 6608213 - DNA, 18 bp, Homo sapiens
acatctttttaaagctta

SEQ ID NO: 6608214 - DNA, 15 bp, Homo sapiens
acatcttttttcaca

SEQ ID NO: 6608215 - DNA, 17 bp, Homo sapiens
acatgaaaaacaaacaa

SEQ ID NO: 6608216 - DNA, 15 bp, Homo sapiens
acatgaaaaatttta

SEQ ID NO: 6608217 - DNA, 18 bp, Homo sapiens
acatgaaaacaagaaaga

SEQ ID NO: 6608218 - DNA, 20 bp, Homo sapiens
acatgaaaacaagaaagaaa

SEQ ID NO: 6608219 - DNA, 22 bp, Homo sapiens
acatgaaaacaagaaagaaatg

SEQ ID NO: 6608220 - DNA, 23 bp, Homo sapiens
acatgaaaacacatttttcttag

SEQ ID NO: 6608221 - DNA, 17 bp, Homo sapiens
acatgaaaacattgatg

SEQ ID NO: 6608222 - DNA, 23 bp, Homo sapiens
acatgaaaagataggtttgagtt

SEQ ID NO: 6608223 - DNA, 15 bp, Homo sapiens
acatgaaaagttatt

SEQ ID NO: 6608224 - DNA, 15 bp, Homo sapiens
acatgaaacagaaac

SEQ ID NO: 6608225 - DNA, 23 bp, Homo sapiens
acatgaaacctacacactgtcat

SEQ ID NO: 6608226 - DNA, 14 bp, Homo sapiens
acatgaaactgcct

SEQ ID NO: 6608227 - DNA, 17 bp, Homo sapiens
acatgaaaggaccctgt

SEQ ID NO: 6608228 - DNA, 17 bp, Homo sapiens
acatgaaataaaagctt

SEQ ID NO: 6608229 - DNA, 15 bp, Homo sapiens
acatgaaataaagaa

SEQ ID NO: 6608230 - DNA, 19 bp, Homo sapiens
acatgaaataaagaattta

SEQ ID NO: 6608231 - DNA, 13 bp, Homo sapiens
acatgaaatgata

SEQ ID NO: 6608232 - DNA, 13 bp, Homo sapiens
acatgaaatgccc

SEQ ID NO: 6608233 - DNA, 22 bp, Homo sapiens
acatgaaatgccctcctaaatg

SEQ ID NO: 6608234 - DNA, 18 bp, Homo sapiens
acatgaaatgcttccaag

SEQ ID NO: 6608235 - DNA, 18 bp, Homo sapiens
acatgaaatttttgtaaa

SEQ ID NO: 6608236 - DNA, 22 bp, Homo sapiens
acatgaacacagctgctgaaga

SEQ ID NO: 6608237 - DNA, 19 bp, Homo sapiens
acatgaacttagattttac

SEQ ID NO: 6608238 - DNA, 18 bp, Homo sapiens
acatgaacttcatatact

SEQ ID NO: 6608239 - DNA, 22 bp, Homo sapiens
acatgaacttcatatactaagg

SEQ ID NO: 6608240 - DNA, 16 bp, Homo sapiens
acatgaagaagctaaa

SEQ ID NO: 6608241 - DNA, 20 bp, Homo sapiens
acatgaagaatgcattcaaa

SEQ ID NO: 6608242 - DNA, 18 bp, Homo sapiens
acatgaagacaccatctc

SEQ ID NO: 6608243 - DNA, 14 bp, Homo sapiens
acatgaagaccttt

SEQ ID NO: 6608244 - DNA, 21 bp, Homo sapiens
acatgaagacctttttctgca

SEQ ID NO: 6608245 - DNA, 15 bp, Homo sapiens
acatgaagattcttt

SEQ ID NO: 6608246 - DNA, 17 bp, Homo sapiens
acatgaagattctttcc

SEQ ID NO: 6608247 - DNA, 18 bp, Homo sapiens
acatgaagattctttccc

SEQ ID NO: 6608248 - DNA, 22 bp, Homo sapiens
acatgaagattctttcccaatt

SEQ ID NO: 6608249 - DNA, 22 bp, Homo sapiens
acatgaagcaattagtctgaaa

SEQ ID NO: 6608250 - DNA, 16 bp, Homo sapiens
acatgaagcagaacct

SEQ ID NO: 6608251 - DNA, 16 bp, Homo sapiens
acatgaagcataattt

SEQ ID NO: 6608252 - DNA, 13 bp, Homo sapiens
acatgaagctgtt

SEQ ID NO: 6608253 - DNA, 20 bp, Homo sapiens
acatgaagcttcatgcactt

SEQ ID NO: 6608254 - DNA, 11 bp, Homo sapiens
acatgaaggaa

SEQ ID NO: 6608255 - DNA, 19 bp, Homo sapiens
acatgaaggagacagcagc

SEQ ID NO: 6608256 - DNA, 13 bp, Homo sapiens
acatgaaggtaaa

SEQ ID NO: 6608257 - DNA, 14 bp, Homo sapiens
acatgaagtatttt

SEQ ID NO: 6608258 - DNA, 21 bp, Homo sapiens
acatgaagtgtgtttccttca

SEQ ID NO: 6608259 - DNA, 19 bp, Homo sapiens
acatgaagttgtaagaaaa

SEQ ID NO: 6608260 - DNA, 23 bp, Homo sapiens
acatgaataaagcctttgtatct

SEQ ID NO: 6608261 - DNA, 20 bp, Homo sapiens
acatgaatatttagtgttca

SEQ ID NO: 6608262 - DNA, 20 bp, Homo sapiens
acatgaatcccacccacatg

SEQ ID NO: 6608263 - DNA, 15 bp, Homo sapiens
acatgaatgcacact

SEQ ID NO: 6608264 - DNA, 13 bp, Homo sapiens
acatgaatgcagt

SEQ ID NO: 6608265 - DNA, 18 bp, Homo sapiens
acatgaatttaatgtcta

SEQ ID NO: 6608266 - DNA, 18 bp, Homo sapiens
acatgaattttagctttt

SEQ ID NO: 6608267 - DNA, 14 bp, Homo sapiens
acatgacacagctt

SEQ ID NO: 6608268 - DNA, 11 bp, Homo sapiens
acatgacactg

SEQ ID NO: 6608269 - DNA, 14 bp, Homo sapiens
acatgacactgacc

SEQ ID NO: 6608270 - DNA, 19 bp, Homo sapiens
acatgacagatattttatc

SEQ ID NO: 6608271 - DNA, 22 bp, Homo sapiens
acatgacagtggttatatttca

SEQ ID NO: 6608272 - DNA, 19 bp, Homo sapiens
acatgacatccacatgcac

SEQ ID NO: 6608273 - DNA, 21 bp, Homo sapiens
acatgacatttgtcctgcaga

SEQ ID NO: 6608274 - DNA, 15 bp, Homo sapiens
acatgaccagaaaac

SEQ ID NO: 6608275 - DNA, 20 bp, Homo sapiens
acatgaccagaaaacaaatc

SEQ ID NO: 6608276 - DNA, 17 bp, Homo sapiens
acatgacccgtacacac

SEQ ID NO: 6608277 - DNA, 18 bp, Homo sapiens
acatgacccgtacacacc

SEQ ID NO: 6608278 - DNA, 19 bp, Homo sapiens
acatgaccctaaatcttga

SEQ ID NO: 6608279 - DNA, 21 bp, Homo sapiens
acatgaccctaaatcttgact

SEQ ID NO: 6608280 - DNA, 16 bp, Homo sapiens
acatgaccctctgtcc

SEQ ID NO: 6608281 - DNA, 13 bp, Homo sapiens
acatgacctccat

SEQ ID NO: 6608282 - DNA, 22 bp, Homo sapiens
acatgacgccagataaaatgtt

SEQ ID NO: 6608283 - DNA, 19 bp, Homo sapiens
acatgacgtggtaaaatgt

SEQ ID NO: 6608284 - DNA, 22 bp, Homo sapiens
acatgacgtggtaaaatgtgaa

SEQ ID NO: 6608285 - DNA, 22 bp, Homo sapiens
acatgactctttattgtctgta

SEQ ID NO: 6608286 - DNA, 17 bp, Homo sapiens
acatgactgaagggact

SEQ ID NO: 6608287 - DNA, 14 bp, Homo sapiens
acatgactgcaact

SEQ ID NO: 6608288 - DNA, 13 bp, Homo sapiens
acatgactgggcc

SEQ ID NO: 6608289 - DNA, 16 bp, Homo sapiens
acatgactgggcctcc

SEQ ID NO: 6608290 - DNA, 18 bp, Homo sapiens
acatgactgggcctccct

SEQ ID NO: 6608291 - DNA, 21 bp, Homo sapiens
acatgacttccttatttctga

SEQ ID NO: 6608292 - DNA, 22 bp, Homo sapiens
acatgacttccttatttctgaa

SEQ ID NO: 6608293 - DNA, 23 bp, Homo sapiens
acatgacttccttatttctgaac

SEQ ID NO: 6608294 - DNA, 15 bp, Homo sapiens
acatgagaaagatgt

SEQ ID NO: 6608295 - DNA, 14 bp, Homo sapiens
acatgagaaatgtg

SEQ ID NO: 6608296 - DNA, 17 bp, Homo sapiens
acatgagactaagagaa

SEQ ID NO: 6608297 - DNA, 18 bp, Homo sapiens
acatgagactaagagaaa

SEQ ID NO: 6608298 - DNA, 23 bp, Homo sapiens
acatgagactaagagaaaccttg

SEQ ID NO: 6608299 - DNA, 20 bp, Homo sapiens
acatgagaggactgatgaat

SEQ ID NO: 6608300 - DNA, 15 bp, Homo sapiens
acatgagatcagggc

SEQ ID NO: 6608301 - DNA, 23 bp, Homo sapiens
acatgagatcagggcctgccccc

SEQ ID NO: 6608302 - DNA, 18 bp, Homo sapiens
acatgagatggagaggct

SEQ ID NO: 6608303 - DNA, 18 bp, Homo sapiens
acatgagatgtgtggact

SEQ ID NO: 6608304 - DNA, 14 bp, Homo sapiens
acatgagatttata

SEQ ID NO: 6608305 - DNA, 13 bp, Homo sapiens
acatgagcatcag

SEQ ID NO: 6608306 - DNA, 9 bp, Homo sapiens
acatgagcc

SEQ ID NO: 6608307 - DNA, 10 bp, Homo sapiens
acatgagcct

SEQ ID NO: 6608308 - DNA, 21 bp, Homo sapiens
acatgaggaactgtagatgat

SEQ ID NO: 6608309 - DNA, 22 bp, Homo sapiens
acatgaggaactgtagatgatg

SEQ ID NO: 6608310 - DNA, 18 bp, Homo sapiens
acatgaggaagtagctgt

SEQ ID NO: 6608311 - DNA, 15 bp, Homo sapiens
acatgaggacagaag

SEQ ID NO: 6608312 - DNA, 18 bp, Homo sapiens
acatgaggacagaaggac

SEQ ID NO: 6608313 - DNA, 21 bp, Homo sapiens
acatgaggacatgatggagcg

SEQ ID NO: 6608314 - DNA, 19 bp, Homo sapiens
acatgaggccatctcagga

SEQ ID NO: 6608315 - DNA, 22 bp, Homo sapiens
acatgagtagataatttcaggg

SEQ ID NO: 6608316 - DNA, 15 bp, Homo sapiens
acatgagtcaaaaca

SEQ ID NO: 6608317 - DNA, 18 bp, Homo sapiens
acatgagtcccagtggga

SEQ ID NO: 6608318 - DNA, 16 bp, Homo sapiens
acatgagtctccagat

SEQ ID NO: 6608319 - DNA, 22 bp, Homo sapiens
acatgagtctgtaggagcaagg

SEQ ID NO: 6608320 - DNA, 19 bp, Homo sapiens
acatgagttattcataaag

SEQ ID NO: 6608321 - DNA, 22 bp, Homo sapiens
acatgagttattcataaagaga

SEQ ID NO: 6608322 - DNA, 13 bp, Homo sapiens
acatgataagaca

SEQ ID NO: 6608323 - DNA, 15 bp, Homo sapiens
acatgataagacatt

SEQ ID NO: 6608324 - DNA, 15 bp, Homo sapiens
acatgatacattttt

SEQ ID NO: 6608325 - DNA, 19 bp, Homo sapiens
acatgatcctgcaattcca

SEQ ID NO: 6608326 - DNA, 18 bp, Homo sapiens
acatgatgaaaaattata

SEQ ID NO: 6608327 - DNA, 17 bp, Homo sapiens
acatgatgcaaactgtg

SEQ ID NO: 6608328 - DNA, 13 bp, Homo sapiens
acatgatgggcct

SEQ ID NO: 6608329 - DNA, 14 bp, Homo sapiens
acatgatgtgagat

SEQ ID NO: 6608330 - DNA, 15 bp, Homo sapiens
acatgatgttaactt

SEQ ID NO: 6608331 - DNA, 14 bp, Homo sapiens
acatgatgttatgt

SEQ ID NO: 6608332 - DNA, 19 bp, Homo sapiens
acatgattccagccatcac

SEQ ID NO: 6608333 - DNA, 16 bp, Homo sapiens
acatgattgtataagc

SEQ ID NO: 6608334 - DNA, 21 bp, Homo sapiens
acatgattgtataagcatgct

SEQ ID NO: 6608335 - DNA, 12 bp, Homo sapiens
acatgatttaaa

SEQ ID NO: 6608336 - DNA, 16 bp, Homo sapiens
acatgatttaaagact

SEQ ID NO: 6608337 - DNA, 19 bp, Homo sapiens
acatgatttagggaagcag

SEQ ID NO: 6608338 - DNA, 21 bp, Homo sapiens
acatgatttagggaagcaggg

SEQ ID NO: 6608339 - DNA, 14 bp, Homo sapiens
acatgatttcacaa

SEQ ID NO: 6608340 - DNA, 15 bp, Homo sapiens
acatgatttcacaaa

SEQ ID NO: 6608341 - DNA, 17 bp, Homo sapiens
acatgatttcacaaata

SEQ ID NO: 6608342 - DNA, 20 bp, Homo sapiens
acatgatttcacaaatatta

SEQ ID NO: 6608343 - DNA, 17 bp, Homo sapiens
acatgatttccttgaat

SEQ ID NO: 6608344 - DNA, 12 bp, Homo sapiens
acatgattttct

SEQ ID NO: 6608345 - DNA, 15 bp, Homo sapiens
acatgcaaaaagaaa

SEQ ID NO: 6608346 - DNA, 23 bp, Homo sapiens
acatgcaaaaagaaatgactaat

SEQ ID NO: 6608347 - DNA, 17 bp, Homo sapiens
acatgcaacaaaaatgt

SEQ ID NO: 6608348 - DNA, 12 bp, Homo sapiens
acatgcaacaga

SEQ ID NO: 6608349 - DNA, 12 bp, Homo sapiens
acatgcaagaat

SEQ ID NO: 6608350 - DNA, 14 bp, Homo sapiens
acatgcaagaattt

SEQ ID NO: 6608351 - DNA, 22 bp, Homo sapiens
acatgcaagaatttctggaaga

SEQ ID NO: 6608352 - DNA, 20 bp, Homo sapiens
acatgcaattggggaagaaa

SEQ ID NO: 6608353 - DNA, 15 bp, Homo sapiens
acatgcacacacttg

SEQ ID NO: 6608354 - DNA, 14 bp, Homo sapiens
acatgcacatgtat

SEQ ID NO: 6608355 - DNA, 21 bp, Homo sapiens
acatgcacattcatcctcaca

SEQ ID NO: 6608356 - DNA, 19 bp, Homo sapiens
acatgcacatttatatata

SEQ ID NO: 6608357 - DNA, 20 bp, Homo sapiens
acatgcacccgcatgtacaa

SEQ ID NO: 6608358 - DNA, 23 bp, Homo sapiens
acatgcaccttatatttctgtgt

SEQ ID NO: 6608359 - DNA, 23 bp, Homo sapiens
acatgcaccttgctcccaatggt

SEQ ID NO: 6608360 - DNA, 18 bp, Homo sapiens
acatgcactactgaaatt

SEQ ID NO: 6608361 - DNA, 17 bp, Homo sapiens
acatgcactatgaggaa

SEQ ID NO: 6608362 - DNA, 15 bp, Homo sapiens
acatgcactcagtgt

SEQ ID NO: 6608363 - DNA, 12 bp, Homo sapiens
acatgcactgac

SEQ ID NO: 6608364 - DNA, 18 bp, Homo sapiens
acatgcacttggctgcat

SEQ ID NO: 6608365 - DNA, 20 bp, Homo sapiens
acatgcagaaattgacctga

SEQ ID NO: 6608366 - DNA, 23 bp, Homo sapiens
acatgcagccacttaggacaaat

SEQ ID NO: 6608367 - DNA, 18 bp, Homo sapiens
acatgcagcccatgccca

SEQ ID NO: 6608368 - DNA, 16 bp, Homo sapiens
acatgcagctctgcag

SEQ ID NO: 6608369 - DNA, 20 bp, Homo sapiens
acatgcagtatttggttttc

SEQ ID NO: 6608370 - DNA, 15 bp, Homo sapiens
acatgcagttcatta

SEQ ID NO: 6608371 - DNA, 12 bp, Homo sapiens
acatgcagtttg

SEQ ID NO: 6608372 - DNA, 16 bp, Homo sapiens
acatgcagtttgaaat

SEQ ID NO: 6608373 - DNA, 19 bp, Homo sapiens
acatgcagtttgaaattct

SEQ ID NO: 6608374 - DNA, 14 bp, Homo sapiens
acatgcataagaaa

SEQ ID NO: 6608375 - DNA, 18 bp, Homo sapiens
acatgcataagaaatgta

SEQ ID NO: 6608376 - DNA, 17 bp, Homo sapiens
acatgcatacttacaga

SEQ ID NO: 6608377 - DNA, 16 bp, Homo sapiens
acatgcatacttcaaa

SEQ ID NO: 6608378 - DNA, 17 bp, Homo sapiens
acatgcatacttcaaaa

SEQ ID NO: 6608379 - DNA, 19 bp, Homo sapiens
acatgcatacttcaaaagt

SEQ ID NO: 6608380 - DNA, 21 bp, Homo sapiens
acatgcatacttcaaaagtat

SEQ ID NO: 6608381 - DNA, 16 bp, Homo sapiens
acatgcatactttatt

SEQ ID NO: 6608382 - DNA, 15 bp, Homo sapiens
acatgcatgagcacc

SEQ ID NO: 6608383 - DNA, 15 bp, Homo sapiens
acatgcatgtctgcc

SEQ ID NO: 6608384 - DNA, 20 bp, Homo sapiens
acatgcatgtctgcctatgc

SEQ ID NO: 6608385 - DNA, 20 bp, Homo sapiens
acatgcattactgcatgcac

SEQ ID NO: 6608386 - DNA, 18 bp, Homo sapiens
acatgcattcacatatct

SEQ ID NO: 6608387 - DNA, 21 bp, Homo sapiens
acatgcattcacatatctgct

SEQ ID NO: 6608388 - DNA, 22 bp, Homo sapiens
acatgccaacacttaatcattt

SEQ ID NO: 6608389 - DNA, 14 bp, Homo sapiens
acatgccaagcact

SEQ ID NO: 6608390 - DNA, 15 bp, Homo sapiens
acatgccaccctctc

SEQ ID NO: 6608391 - DNA, 18 bp, Homo sapiens
acatgccaccctctccat

SEQ ID NO: 6608392 - DNA, 22 bp, Homo sapiens
acatgccaccctctccatgccc

SEQ ID NO: 6608393 - DNA, 13 bp, Homo sapiens
acatgccactgcc

SEQ ID NO: 6608394 - DNA, 14 bp, Homo sapiens
acatgccagggaaa

SEQ ID NO: 6608395 - DNA, 21 bp, Homo sapiens
acatgcccacaacttgtcacc

SEQ ID NO: 6608396 - DNA, 16 bp, Homo sapiens
acatgcccccacttcc

SEQ ID NO: 6608397 - DNA, 19 bp, Homo sapiens
acatgccccctcccttcac

SEQ ID NO: 6608398 - DNA, 23 bp, Homo sapiens
acatgccccctcccttcacaggg

SEQ ID NO: 6608399 - DNA, 21 bp, Homo sapiens
acatgcccctcccccagctgc

SEQ ID NO: 6608400 - DNA, 22 bp, Homo sapiens
acatgcccctcccccagctgcg

SEQ ID NO: 6608401 - DNA, 21 bp, Homo sapiens
acatgcccctcttagaagaaa

SEQ ID NO: 6608402 - DNA, 21 bp, Homo sapiens
acatgcccgctgtcccagggg

SEQ ID NO: 6608403 - DNA, 14 bp, Homo sapiens
acatgccctcaggc

SEQ ID NO: 6608404 - DNA, 14 bp, Homo sapiens
acatgccctccctt

SEQ ID NO: 6608405 - DNA, 14 bp, Homo sapiens
acatgccctcctgg

SEQ ID NO: 6608406 - DNA, 21 bp, Homo sapiens
acatgccctcggtcactgagt

SEQ ID NO: 6608407 - DNA, 16 bp, Homo sapiens
acatgccctgtgtggc

SEQ ID NO: 6608408 - DNA, 17 bp, Homo sapiens
acatgccctgtgtggct

SEQ ID NO: 6608409 - DNA, 22 bp, Homo sapiens
acatgccgcgggcggccaggca

SEQ ID NO: 6608410 - DNA, 19 bp, Homo sapiens
acatgcctaccaatattta

SEQ ID NO: 6608411 - DNA, 13 bp, Homo sapiens
acatgcctcctcc

SEQ ID NO: 6608412 - DNA, 14 bp, Homo sapiens
acatgcctcctcct

SEQ ID NO: 6608413 - DNA, 16 bp, Homo sapiens
acatgcctcctcctgc

SEQ ID NO: 6608414 - DNA, 20 bp, Homo sapiens
acatgcctcctcctgccctc

SEQ ID NO: 6608415 - DNA, 19 bp, Homo sapiens
acatgcctctctcaggcca

SEQ ID NO: 6608416 - DNA, 23 bp, Homo sapiens
acatgcctgattttaaaaggttg

SEQ ID NO: 6608417 - DNA, 15 bp, Homo sapiens
acatgcctgccccaa

SEQ ID NO: 6608418 - DNA, 21 bp, Homo sapiens
acatgcctgccccaaacaaat

SEQ ID NO: 6608419 - DNA, 13 bp, Homo sapiens
acatgcctgtcct

SEQ ID NO: 6608420 - DNA, 15 bp, Homo sapiens
acatgcctgtcctga

SEQ ID NO: 6608421 - DNA, 23 bp, Homo sapiens
acatgcctgtcctgaaagcggct

SEQ ID NO: 6608422 - DNA, 21 bp, Homo sapiens
acatgcctttccagtgctgct

SEQ ID NO: 6608423 - DNA, 14 bp, Homo sapiens
acatgcgaccccga

SEQ ID NO: 6608424 - DNA, 23 bp, Homo sapiens
acatgcggagaacaaatgtgaag

SEQ ID NO: 6608425 - DNA, 19 bp, Homo sapiens
acatgcggcttccgagggc

SEQ ID NO: 6608426 - DNA, 17 bp, Homo sapiens
acatgcgggctcgccca

SEQ ID NO: 6608427 - DNA, 14 bp, Homo sapiens
acatgcgggctggg

SEQ ID NO: 6608428 - DNA, 19 bp, Homo sapiens
acatgcgggctgggcagct

SEQ ID NO: 6608429 - DNA, 22 bp, Homo sapiens
acatgcgggctgggcagctgtt

SEQ ID NO: 6608430 - DNA, 17 bp, Homo sapiens
acatgcggtagccagca

SEQ ID NO: 6608431 - DNA, 19 bp, Homo sapiens
acatgctaagaaagcaaat

SEQ ID NO: 6608432 - DNA, 19 bp, Homo sapiens
acatgctaagagaagtaga

SEQ ID NO: 6608433 - DNA, 15 bp, Homo sapiens
acatgctacacactg

SEQ ID NO: 6608434 - DNA, 21 bp, Homo sapiens
acatgctacacactgcatgtt

SEQ ID NO: 6608435 - DNA, 22 bp, Homo sapiens
acatgctatgttctgtcttccc

SEQ ID NO: 6608436 - DNA, 16 bp, Homo sapiens
acatgctcacctctag

SEQ ID NO: 6608437 - DNA, 20 bp, Homo sapiens
acatgctcagtacctgtgtt

SEQ ID NO: 6608438 - DNA, 19 bp, Homo sapiens
acatgctcatcccaaaagc

SEQ ID NO: 6608439 - DNA, 16 bp, Homo sapiens
acatgctccagattag

SEQ ID NO: 6608440 - DNA, 17 bp, Homo sapiens
acatgctgaagccaaag

SEQ ID NO: 6608441 - DNA, 22 bp, Homo sapiens
acatgctgaggttttgaataaa

SEQ ID NO: 6608442 - DNA, 16 bp, Homo sapiens
acatgctgcccacccc

SEQ ID NO: 6608443 - DNA, 23 bp, Homo sapiens
acatgctgcccaccccctgctgg

SEQ ID NO: 6608444 - DNA, 23 bp, Homo sapiens
acatgctgcctggcacagaccag

SEQ ID NO: 6608445 - DNA, 18 bp, Homo sapiens
acatgctgctatacacaa

SEQ ID NO: 6608446 - DNA, 22 bp, Homo sapiens
acatgctggacaggtctgggag

SEQ ID NO: 6608447 - DNA, 19 bp, Homo sapiens
acatgctggccagcctggg

SEQ ID NO: 6608448 - DNA, 16 bp, Homo sapiens
acatgctggctcctga

SEQ ID NO: 6608449 - DNA, 14 bp, Homo sapiens
acatgctgtctggc

SEQ ID NO: 6608450 - DNA, 19 bp, Homo sapiens
acatgctgtgtaagctgtg

SEQ ID NO: 6608451 - DNA, 20 bp, Homo sapiens
acatgcttaagggggtgtaa

SEQ ID NO: 6608452 - DNA, 14 bp, Homo sapiens
acatgcttactttt

SEQ ID NO: 6608453 - DNA, 23 bp, Homo sapiens
acatgcttagcagtccccttccc

SEQ ID NO: 6608454 - DNA, 22 bp, Homo sapiens
acatgcttagcttatctttctt

SEQ ID NO: 6608455 - DNA, 15 bp, Homo sapiens
acatgcttataacat

SEQ ID NO: 6608456 - DNA, 18 bp, Homo sapiens
acatgcttataacattaa

SEQ ID NO: 6608457 - DNA, 15 bp, Homo sapiens
acatgcttattccat

SEQ ID NO: 6608458 - DNA, 17 bp, Homo sapiens
acatgcttattccatga

SEQ ID NO: 6608459 - DNA, 18 bp, Homo sapiens
acatgcttattccatgac

SEQ ID NO: 6608460 - DNA, 21 bp, Homo sapiens
acatgcttattccatgactgc

SEQ ID NO: 6608461 - DNA, 19 bp, Homo sapiens
acatgcttccctttcctga

SEQ ID NO: 6608462 - DNA, 16 bp, Homo sapiens
acatgcttgaataact

SEQ ID NO: 6608463 - DNA, 15 bp, Homo sapiens
acatgcttgaatgga

SEQ ID NO: 6608464 - DNA, 13 bp, Homo sapiens
acatgctttgttt

SEQ ID NO: 6608465 - DNA, 18 bp, Homo sapiens
acatgcttttactttatt

SEQ ID NO: 6608466 - DNA, 15 bp, Homo sapiens
acatgcttttccaaa

SEQ ID NO: 6608467 - DNA, 15 bp, Homo sapiens
acatggaaacccata

SEQ ID NO: 6608468 - DNA, 15 bp, Homo sapiens
acatggaaagggaga

SEQ ID NO: 6608469 - DNA, 16 bp, Homo sapiens
acatggaacttaaaac

SEQ ID NO: 6608470 - DNA, 19 bp, Homo sapiens
acatggaacttaaaacata

SEQ ID NO: 6608471 - DNA, 22 bp, Homo sapiens
acatggaacttaaaacatatgg

SEQ ID NO: 6608472 - DNA, 13 bp, Homo sapiens
acatggaagaagt

SEQ ID NO: 6608473 - DNA, 17 bp, Homo sapiens
acatggaaggttagagg

SEQ ID NO: 6608474 - DNA, 14 bp, Homo sapiens
acatggacacagac

SEQ ID NO: 6608475 - DNA, 15 bp, Homo sapiens
acatggacagaattt

SEQ ID NO: 6608476 - DNA, 19 bp, Homo sapiens
acatggacccactaccctt

SEQ ID NO: 6608477 - DNA, 22 bp, Homo sapiens
acatggacccggagctaacact

SEQ ID NO: 6608478 - DNA, 17 bp, Homo sapiens
acatggacctccaggct

SEQ ID NO: 6608479 - DNA, 15 bp, Homo sapiens
acatggactcagaga

SEQ ID NO: 6608480 - DNA, 14 bp, Homo sapiens
acatggacttgtat

SEQ ID NO: 6608481 - DNA, 15 bp, Homo sapiens
acatggacttgtata

SEQ ID NO: 6608482 - DNA, 17 bp, Homo sapiens
acatggacttgtatatt

SEQ ID NO: 6608483 - DNA, 18 bp, Homo sapiens
acatggacttgtatattt

SEQ ID NO: 6608484 - DNA, 23 bp, Homo sapiens
acatggacttgtatatttgtaca

SEQ ID NO: 6608485 - DNA, 15 bp, Homo sapiens
acatggagactcctg

SEQ ID NO: 6608486 - DNA, 16 bp, Homo sapiens
acatggagactcctgc

SEQ ID NO: 6608487 - DNA, 11 bp, Homo sapiens
acatggagctc

SEQ ID NO: 6608488 - DNA, 15 bp, Homo sapiens
acatggagctcttgt

SEQ ID NO: 6608489 - DNA, 15 bp, Homo sapiens
acatggagctgtcat

SEQ ID NO: 6608490 - DNA, 16 bp, Homo sapiens
acatggagctgtcatc

SEQ ID NO: 6608491 - DNA, 15 bp, Homo sapiens
acatggaggttctaa

SEQ ID NO: 6608492 - DNA, 19 bp, Homo sapiens
acatggaggttctaaggcc

SEQ ID NO: 6608493 - DNA, 14 bp, Homo sapiens
acatggatatgtat

SEQ ID NO: 6608494 - DNA, 18 bp, Homo sapiens
acatggatgcacgcacat

SEQ ID NO: 6608495 - DNA, 19 bp, Homo sapiens
acatggattcagtttctaa

SEQ ID NO: 6608496 - DNA, 18 bp, Homo sapiens
acatggattccaaagcat

SEQ ID NO: 6608497 - DNA, 19 bp, Homo sapiens
acatggattccaaagcatt

SEQ ID NO: 6608498 - DNA, 20 bp, Homo sapiens
acatggattccaaagcattt

SEQ ID NO: 6608499 - DNA, 19 bp, Homo sapiens
acatggattgattaaaagc

SEQ ID NO: 6608500 - DNA, 20 bp, Homo sapiens
acatggattttggcagggcg

SEQ ID NO: 6608501 - DNA, 13 bp, Homo sapiens
acatggcacagag

SEQ ID NO: 6608502 - DNA, 13 bp, Homo sapiens
acatggcacaggc

SEQ ID NO: 6608503 - DNA, 21 bp, Homo sapiens
acatggcacttggaagaaaaa

SEQ ID NO: 6608504 - DNA, 17 bp, Homo sapiens
acatggccaatagtcat

SEQ ID NO: 6608505 - DNA, 21 bp, Homo sapiens
acatggccaatagtcatatgt

SEQ ID NO: 6608506 - DNA, 23 bp, Homo sapiens
acatggccatagaggcccaggca

SEQ ID NO: 6608507 - DNA, 17 bp, Homo sapiens
acatggccatcttcttt

SEQ ID NO: 6608508 - DNA, 18 bp, Homo sapiens
acatggcctatgcacata

SEQ ID NO: 6608509 - DNA, 20 bp, Homo sapiens
acatggcctatgcacatatg

SEQ ID NO: 6608510 - DNA, 14 bp, Homo sapiens
acatggctagcctt

SEQ ID NO: 6608511 - DNA, 22 bp, Homo sapiens
acatggctatcctagagaggct

SEQ ID NO: 6608512 - DNA, 19 bp, Homo sapiens
acatggctctggactctaa

SEQ ID NO: 6608513 - DNA, 20 bp, Homo sapiens
acatggctctggactctaaa

SEQ ID NO: 6608514 - DNA, 13 bp, Homo sapiens
acatggctggcct

SEQ ID NO: 6608515 - DNA, 14 bp, Homo sapiens
acatggctggcctg

SEQ ID NO: 6608516 - DNA, 15 bp, Homo sapiens
acatggctggcctgg

SEQ ID NO: 6608517 - DNA, 16 bp, Homo sapiens
acatggctggcctggt

SEQ ID NO: 6608518 - DNA, 13 bp, Homo sapiens
acatggcttctcc

SEQ ID NO: 6608519 - DNA, 16 bp, Homo sapiens
acatggcttctccttt

SEQ ID NO: 6608520 - DNA, 13 bp, Homo sapiens
acatggcttttga

SEQ ID NO: 6608521 - DNA, 14 bp, Homo sapiens
acatgggacatttg

SEQ ID NO: 6608522 - DNA, 18 bp, Homo sapiens
acatgggactatgctttt

SEQ ID NO: 6608523 - DNA, 13 bp, Homo sapiens
acatgggagcagt

SEQ ID NO: 6608524 - DNA, 20 bp, Homo sapiens
acatgggagcagtccatgca

SEQ ID NO: 6608525 - DNA, 21 bp, Homo sapiens
acatgggagcttattgctaat

SEQ ID NO: 6608526 - DNA, 21 bp, Homo sapiens
acatgggaggaaggcccaggg

SEQ ID NO: 6608527 - DNA, 15 bp, Homo sapiens
acatgggagggatca

SEQ ID NO: 6608528 - DNA, 16 bp, Homo sapiens
acatgggagggatcag

SEQ ID NO: 6608529 - DNA, 17 bp, Homo sapiens
acatgggagggatcagc

SEQ ID NO: 6608530 - DNA, 18 bp, Homo sapiens
acatgggagggatcagcc

SEQ ID NO: 6608531 - DNA, 14 bp, Homo sapiens
acatgggccagccc

SEQ ID NO: 6608532 - DNA, 16 bp, Homo sapiens
acatgggccagccctt

SEQ ID NO: 6608533 - DNA, 15 bp, Homo sapiens
acatgggctgggggc

SEQ ID NO: 6608534 - DNA, 18 bp, Homo sapiens
acatggggaaggcagagg

SEQ ID NO: 6608535 - DNA, 11 bp, Homo sapiens
acatggggagg

SEQ ID NO: 6608536 - DNA, 16 bp, Homo sapiens
acatggggaggaagga

SEQ ID NO: 6608537 - DNA, 15 bp, Homo sapiens
acatggggaggagga

SEQ ID NO: 6608538 - DNA, 15 bp, Homo sapiens
acatggggcaagcca

SEQ ID NO: 6608539 - DNA, 18 bp, Homo sapiens
acatggggcaagccaggg

SEQ ID NO: 6608540 - DNA, 22 bp, Homo sapiens
acatggggcctggcccacgccc

SEQ ID NO: 6608541 - DNA, 17 bp, Homo sapiens
acatggggttcctggtt

SEQ ID NO: 6608542 - DNA, 16 bp, Homo sapiens
acatgggtagcttctg

SEQ ID NO: 6608543 - DNA, 16 bp, Homo sapiens
acatgggtattttata

SEQ ID NO: 6608544 - DNA, 16 bp, Homo sapiens
acatgggtgaattatg

SEQ ID NO: 6608545 - DNA, 18 bp, Homo sapiens
acatgggtgactatctcc

SEQ ID NO: 6608546 - DNA, 23 bp, Homo sapiens
acatgggtgctattggggttggg

SEQ ID NO: 6608547 - DNA, 20 bp, Homo sapiens
acatggtactcttgttgagt

SEQ ID NO: 6608548 - DNA, 23 bp, Homo sapiens
acatggtactcttgttgagttct

SEQ ID NO: 6608549 - DNA, 22 bp, Homo sapiens
acatggtagccagttgaattta

SEQ ID NO: 6608550 - DNA, 21 bp, Homo sapiens
acatggtccatttcatgtgat

SEQ ID NO: 6608551 - DNA, 14 bp, Homo sapiens
acatggtctcctct

SEQ ID NO: 6608552 - DNA, 15 bp, Homo sapiens
acatggtctgtcctg

SEQ ID NO: 6608553 - DNA, 20 bp, Homo sapiens
acatggtgagcctagccctg

SEQ ID NO: 6608554 - DNA, 21 bp, Homo sapiens
acatggtgagtctatttttaa

SEQ ID NO: 6608555 - DNA, 22 bp, Homo sapiens
acatggtgcctatatctgagag

SEQ ID NO: 6608556 - DNA, 14 bp, Homo sapiens
acatggtgctgtgt

SEQ ID NO: 6608557 - DNA, 21 bp, Homo sapiens
acatggtggcatgcacctgca

SEQ ID NO: 6608558 - DNA, 14 bp, Homo sapiens
acatggttggggga

SEQ ID NO: 6608559 - DNA, 18 bp, Homo sapiens
acatggttgtaatatgcg

SEQ ID NO: 6608560 - DNA, 21 bp, Homo sapiens
acatggtttaaaagaaaaaat

SEQ ID NO: 6608561 - DNA, 20 bp, Homo sapiens
acatggtttaaatatgaatg

SEQ ID NO: 6608562 - DNA, 15 bp, Homo sapiens
acatgtaaaaagaca

SEQ ID NO: 6608563 - DNA, 17 bp, Homo sapiens
acatgtaaaaatgtttc

SEQ ID NO: 6608564 - DNA, 21 bp, Homo sapiens
acatgtaaaatcttgatagct

SEQ ID NO: 6608565 - DNA, 16 bp, Homo sapiens
acatgtaaacaaatat

SEQ ID NO: 6608566 - DNA, 13 bp, Homo sapiens
acatgtaaagctg

SEQ ID NO: 6608567 - DNA, 21 bp, Homo sapiens
acatgtaaagctgttaaaata

SEQ ID NO: 6608568 - DNA, 17 bp, Homo sapiens
acatgtaacatagattt

SEQ ID NO: 6608569 - DNA, 15 bp, Homo sapiens
acatgtaagaaaatg

SEQ ID NO: 6608570 - DNA, 16 bp, Homo sapiens
acatgtaagaaaatgt

SEQ ID NO: 6608571 - DNA, 18 bp, Homo sapiens
acatgtaagaaaatgtta

SEQ ID NO: 6608572 - DNA, 23 bp, Homo sapiens
acatgtaagtgtggttttgtaat

SEQ ID NO: 6608573 - DNA, 17 bp, Homo sapiens
acatgtaataaaaagta

SEQ ID NO: 6608574 - DNA, 20 bp, Homo sapiens
acatgtaataaaaagtatat

SEQ ID NO: 6608575 - DNA, 18 bp, Homo sapiens
acatgtaataaattcaaa

SEQ ID NO: 6608576 - DNA, 19 bp, Homo sapiens
acatgtaataaattcaaaa

SEQ ID NO: 6608577 - DNA, 14 bp, Homo sapiens
acatgtaatgacac

SEQ ID NO: 6608578 - DNA, 18 bp, Homo sapiens
acatgtaatgacacttct

SEQ ID NO: 6608579 - DNA, 17 bp, Homo sapiens
acatgtaattaagtact

SEQ ID NO: 6608580 - DNA, 19 bp, Homo sapiens
acatgtaattaagtactat

SEQ ID NO: 6608581 - DNA, 13 bp, Homo sapiens
acatgtacagaga

SEQ ID NO: 6608582 - DNA, 21 bp, Homo sapiens
acatgtacatgcatttttcta

SEQ ID NO: 6608583 - DNA, 19 bp, Homo sapiens
acatgtaccccctttccct

SEQ ID NO: 6608584 - DNA, 23 bp, Homo sapiens
acatgtactacagctatatttga

SEQ ID NO: 6608585 - DNA, 15 bp, Homo sapiens
acatgtactccagag

SEQ ID NO: 6608586 - DNA, 16 bp, Homo sapiens
acatgtactccagagg

SEQ ID NO: 6608587 - DNA, 21 bp, Homo sapiens
acatgtagaattcgcagtgat

SEQ ID NO: 6608588 - DNA, 14 bp, Homo sapiens
acatgtataatatt

SEQ ID NO: 6608589 - DNA, 19 bp, Homo sapiens
acatgtataatatttttaa

SEQ ID NO: 6608590 - DNA, 22 bp, Homo sapiens
acatgtatactccatagaaact

SEQ ID NO: 6608591 - DNA, 15 bp, Homo sapiens
acatgtatagtgagt

SEQ ID NO: 6608592 - DNA, 17 bp, Homo sapiens
acatgtatcactcactg

SEQ ID NO: 6608593 - DNA, 19 bp, Homo sapiens
acatgtatctgtctacttt

SEQ ID NO: 6608594 - DNA, 20 bp, Homo sapiens
acatgtatctgtctactttc

SEQ ID NO: 6608595 - DNA, 22 bp, Homo sapiens
acatgtatctgtctactttctc

SEQ ID NO: 6608596 - DNA, 23 bp, Homo sapiens
acatgtatggacgtgtgtgaatg

SEQ ID NO: 6608597 - DNA, 22 bp, Homo sapiens
acatgtatggttactaaaaagt

SEQ ID NO: 6608598 - DNA, 23 bp, Homo sapiens
acatgtatggttactaaaaagta

SEQ ID NO: 6608599 - DNA, 18 bp, Homo sapiens
acatgtatgtaaatagct

SEQ ID NO: 6608600 - DNA, 11 bp, Homo sapiens
acatgtatgtg

SEQ ID NO: 6608601 - DNA, 15 bp, Homo sapiens
acatgtatgtggata

SEQ ID NO: 6608602 - DNA, 18 bp, Homo sapiens
acatgtatgtggatacag

SEQ ID NO: 6608603 - DNA, 11 bp, Homo sapiens
acatgtatgtt

SEQ ID NO: 6608604 - DNA, 15 bp, Homo sapiens
acatgtatgttcttg

SEQ ID NO: 6608605 - DNA, 14 bp, Homo sapiens
acatgtatgttttg

SEQ ID NO: 6608606 - DNA, 19 bp, Homo sapiens
acatgtattaaattacatt

SEQ ID NO: 6608607 - DNA, 20 bp, Homo sapiens
acatgtattaaattacattt

SEQ ID NO: 6608608 - DNA, 19 bp, Homo sapiens
acatgtattgcacattgta

SEQ ID NO: 6608609 - DNA, 12 bp, Homo sapiens
acatgtcaatct

SEQ ID NO: 6608610 - DNA, 17 bp, Homo sapiens
acatgtcacaatacagt

SEQ ID NO: 6608611 - DNA, 19 bp, Homo sapiens
acatgtcagtaccttcaaa

SEQ ID NO: 6608612 - DNA, 15 bp, Homo sapiens
acatgtcagttttat

SEQ ID NO: 6608613 - DNA, 12 bp, Homo sapiens
acatgtcatgta

SEQ ID NO: 6608614 - DNA, 21 bp, Homo sapiens
acatgtcattgcccacttctg

SEQ ID NO: 6608615 - DNA, 21 bp, Homo sapiens
acatgtcatttgactgtctca

SEQ ID NO: 6608616 - DNA, 21 bp, Homo sapiens
acatgtccaagaagcccagga

SEQ ID NO: 6608617 - DNA, 23 bp, Homo sapiens
acatgtccagcaccttgtgcctg

SEQ ID NO: 6608618 - DNA, 12 bp, Homo sapiens
acatgtcccaga

SEQ ID NO: 6608619 - DNA, 13 bp, Homo sapiens
acatgtccccttc

SEQ ID NO: 6608620 - DNA, 15 bp, Homo sapiens
acatgtccctacacc

SEQ ID NO: 6608621 - DNA, 19 bp, Homo sapiens
acatgtcctaattcttctg

SEQ ID NO: 6608622 - DNA, 20 bp, Homo sapiens
acatgtcctaattcttctgt

SEQ ID NO: 6608623 - DNA, 23 bp, Homo sapiens
acatgtcctgcctattatctgtc

SEQ ID NO: 6608624 - DNA, 15 bp, Homo sapiens
acatgtctcatattt

SEQ ID NO: 6608625 - DNA, 16 bp, Homo sapiens
acatgtctcatatttt

SEQ ID NO: 6608626 - DNA, 18 bp, Homo sapiens
acatgtctcatattttca

SEQ ID NO: 6608627 - DNA, 18 bp, Homo sapiens
acatgtctgtcctcagag

SEQ ID NO: 6608628 - DNA, 12 bp, Homo sapiens
acatgtcttaat

SEQ ID NO: 6608629 - DNA, 23 bp, Homo sapiens
acatgtcttaatgaagtttgaat

SEQ ID NO: 6608630 - DNA, 20 bp, Homo sapiens
acatgtcttccatgtatctt

SEQ ID NO: 6608631 - DNA, 13 bp, Homo sapiens
acatgtcttgtac

SEQ ID NO: 6608632 - DNA, 14 bp, Homo sapiens
acatgtcttgtaca

SEQ ID NO: 6608633 - DNA, 23 bp, Homo sapiens
acatgtctttggcttcagaattg

SEQ ID NO: 6608634 - DNA, 14 bp, Homo sapiens
acatgtgaaaagct

SEQ ID NO: 6608635 - DNA, 12 bp, Homo sapiens
acatgtgaaacc

SEQ ID NO: 6608636 - DNA, 17 bp, Homo sapiens
acatgtgaaaccttttt

SEQ ID NO: 6608637 - DNA, 23 bp, Homo sapiens
acatgtgaaaccttttttaagat

SEQ ID NO: 6608638 - DNA, 16 bp, Homo sapiens
acatgtgaagctattt

SEQ ID NO: 6608639 - DNA, 13 bp, Homo sapiens
acatgtgacattt

SEQ ID NO: 6608640 - DNA, 16 bp, Homo sapiens
acatgtgagatagttt

SEQ ID NO: 6608641 - DNA, 20 bp, Homo sapiens
acatgtgagatagttttcat

SEQ ID NO: 6608642 - DNA, 21 bp, Homo sapiens
acatgtgagatagttttcatt

SEQ ID NO: 6608643 - DNA, 22 bp, Homo sapiens
acatgtgagatagttttcattt

SEQ ID NO: 6608644 - DNA, 19 bp, Homo sapiens
acatgtgaggaggaaaagg

SEQ ID NO: 6608645 - DNA, 17 bp, Homo sapiens
acatgtgatacattttt

SEQ ID NO: 6608646 - DNA, 18 bp, Homo sapiens
acatgtgcaactcttgta

SEQ ID NO: 6608647 - DNA, 17 bp, Homo sapiens
acatgtgccaccaacat

SEQ ID NO: 6608648 - DNA, 14 bp, Homo sapiens
acatgtgccactgt

SEQ ID NO: 6608649 - DNA, 12 bp, Homo sapiens
acatgtgcccct

SEQ ID NO: 6608650 - DNA, 13 bp, Homo sapiens
acatgtgccctgc

SEQ ID NO: 6608651 - DNA, 17 bp, Homo sapiens
acatgtgccgaatgtgc

SEQ ID NO: 6608652 - DNA, 19 bp, Homo sapiens
acatgtgccgaatgtgcag

SEQ ID NO: 6608653 - DNA, 18 bp, Homo sapiens
acatgtgccttttctgaa

SEQ ID NO: 6608654 - DNA, 22 bp, Homo sapiens
acatgtgctattgaactgagcc

SEQ ID NO: 6608655 - DNA, 18 bp, Homo sapiens
acatgtgctgccctacag

SEQ ID NO: 6608656 - DNA, 13 bp, Homo sapiens
acatgtgcttcat

SEQ ID NO: 6608657 - DNA, 19 bp, Homo sapiens
acatgtggaaagtgaattt

SEQ ID NO: 6608658 - DNA, 21 bp, Homo sapiens
acatgtggcaaaatatggttt

SEQ ID NO: 6608659 - DNA, 16 bp, Homo sapiens
acatgtggcagcaggc

SEQ ID NO: 6608660 - DNA, 20 bp, Homo sapiens
acatgtggcttgaattaaga

SEQ ID NO: 6608661 - DNA, 18 bp, Homo sapiens
acatgtggggacagggct

SEQ ID NO: 6608662 - DNA, 14 bp, Homo sapiens
acatgtgtaaaggt

SEQ ID NO: 6608663 - DNA, 16 bp, Homo sapiens
acatgtgtaagacact

SEQ ID NO: 6608664 - DNA, 12 bp, Homo sapiens
acatgtgtacat

SEQ ID NO: 6608665 - DNA, 18 bp, Homo sapiens
acatgtgtacatatatgt

SEQ ID NO: 6608666 - DNA, 19 bp, Homo sapiens
acatgtgtacatatatgta

SEQ ID NO: 6608667 - DNA, 21 bp, Homo sapiens
acatgtgtacatatatgtata

SEQ ID NO: 6608668 - DNA, 17 bp, Homo sapiens
acatgtgtagcctgtgc

SEQ ID NO: 6608669 - DNA, 18 bp, Homo sapiens
acatgtgtatattccttt

SEQ ID NO: 6608670 - DNA, 20 bp, Homo sapiens
acatgtgtcccagccacagt

SEQ ID NO: 6608671 - DNA, 14 bp, Homo sapiens
acatgtgtgcagag

SEQ ID NO: 6608672 - DNA, 19 bp, Homo sapiens
acatgtgtgcagagcagac

SEQ ID NO: 6608673 - DNA, 14 bp, Homo sapiens
acatgtgtgtatat

SEQ ID NO: 6608674 - DNA, 17 bp, Homo sapiens
acatgtgtgtatatatg

SEQ ID NO: 6608675 - DNA, 20 bp, Homo sapiens
acatgtgttaagtattttca

SEQ ID NO: 6608676 - DNA, 17 bp, Homo sapiens
acatgtgttggcagcct

SEQ ID NO: 6608677 - DNA, 23 bp, Homo sapiens
acatgtgtttattcatccagcag

SEQ ID NO: 6608678 - DNA, 14 bp, Homo sapiens
acatgtgtttctga

SEQ ID NO: 6608679 - DNA, 21 bp, Homo sapiens
acatgtgttttaattccaata

SEQ ID NO: 6608680 - DNA, 20 bp, Homo sapiens
acatgtgttttcatcatttc

SEQ ID NO: 6608681 - DNA, 16 bp, Homo sapiens
acatgttaaaccatgg

SEQ ID NO: 6608682 - DNA, 16 bp, Homo sapiens
acatgttaatgacaat

SEQ ID NO: 6608683 - DNA, 13 bp, Homo sapiens
acatgttactgct

SEQ ID NO: 6608684 - DNA, 21 bp, Homo sapiens
acatgttactggataaattgt

SEQ ID NO: 6608685 - DNA, 17 bp, Homo sapiens
acatgttagtcaaggac

SEQ ID NO: 6608686 - DNA, 19 bp, Homo sapiens
acatgttagtcaaggactg

SEQ ID NO: 6608687 - DNA, 16 bp, Homo sapiens
acatgttattgttttc

SEQ ID NO: 6608688 - DNA, 21 bp, Homo sapiens
acatgttcatctggaagtatt

SEQ ID NO: 6608689 - DNA, 18 bp, Homo sapiens
acatgttcccaaaacaat

SEQ ID NO: 6608690 - DNA, 21 bp, Homo sapiens
acatgttcccaaaacaatggt

SEQ ID NO: 6608691 - DNA, 23 bp, Homo sapiens
acatgttcccaaaacaatggtgt

SEQ ID NO: 6608692 - DNA, 14 bp, Homo sapiens
acatgttcttccag

SEQ ID NO: 6608693 - DNA, 17 bp, Homo sapiens
acatgttggaaatgtgt

SEQ ID NO: 6608694 - DNA, 18 bp, Homo sapiens
acatgttggtatttatct

SEQ ID NO: 6608695 - DNA, 17 bp, Homo sapiens
acatgtttaaatagcct

SEQ ID NO: 6608696 - DNA, 20 bp, Homo sapiens
acatgtttaaatagcctaaa

SEQ ID NO: 6608697 - DNA, 23 bp, Homo sapiens
acatgtttaaattgtaaatttta

SEQ ID NO: 6608698 - DNA, 21 bp, Homo sapiens
acatgtttacttttcagggca

SEQ ID NO: 6608699 - DNA, 13 bp, Homo sapiens
acatgtttataaa

SEQ ID NO: 6608700 - DNA, 13 bp, Homo sapiens
acatgtttcacaa

SEQ ID NO: 6608701 - DNA, 14 bp, Homo sapiens
acatgtttcacaac

SEQ ID NO: 6608702 - DNA, 13 bp, Homo sapiens
acatgtttccatc

SEQ ID NO: 6608703 - DNA, 22 bp, Homo sapiens
acatgtttctctataaagtatg

SEQ ID NO: 6608704 - DNA, 17 bp, Homo sapiens
acatgtttctgttttgt

SEQ ID NO: 6608705 - DNA, 23 bp, Homo sapiens
acatgtttctttgtaatgaaaac

SEQ ID NO: 6608706 - DNA, 22 bp, Homo sapiens
acatgtttgcacctttctagtt

SEQ ID NO: 6608707 - DNA, 13 bp, Homo sapiens
acatgttttacaa

SEQ ID NO: 6608708 - DNA, 15 bp, Homo sapiens
acatgttttacaaag

SEQ ID NO: 6608709 - DNA, 19 bp, Homo sapiens
acatgttttacaaagaaac

SEQ ID NO: 6608710 - DNA, 21 bp, Homo sapiens
acatgttttagacaaatactc

SEQ ID NO: 6608711 - DNA, 13 bp, Homo sapiens
acatgttttcaaa

SEQ ID NO: 6608712 - DNA, 19 bp, Homo sapiens
acatgtttttatacaaaat

SEQ ID NO: 6608713 - DNA, 19 bp, Homo sapiens
acatgtttttcttctccct

SEQ ID NO: 6608714 - DNA, 21 bp, Homo sapiens
acattaaaaagccttacagtt

SEQ ID NO: 6608715 - DNA, 15 bp, Homo sapiens
acattaaaaatggaa

SEQ ID NO: 6608716 - DNA, 13 bp, Homo sapiens
acattaaaataaa

SEQ ID NO: 6608717 - DNA, 15 bp, Homo sapiens
acattaaaataaacc

SEQ ID NO: 6608718 - DNA, 16 bp, Homo sapiens
acattaaaataaacca

SEQ ID NO: 6608719 - DNA, 21 bp, Homo sapiens
acattaaaatagcacatgatt

SEQ ID NO: 6608720 - DNA, 20 bp, Homo sapiens
acattaaaatatagagacag

SEQ ID NO: 6608721 - DNA, 12 bp, Homo sapiens
acattaaaatga

SEQ ID NO: 6608722 - DNA, 13 bp, Homo sapiens
acattaaaatgac

SEQ ID NO: 6608723 - DNA, 14 bp, Homo sapiens
acattaaaatgaca

SEQ ID NO: 6608724 - DNA, 17 bp, Homo sapiens
acattaaaatgacaaac

SEQ ID NO: 6608725 - DNA, 18 bp, Homo sapiens
acattaaaatgacaaaca

SEQ ID NO: 6608726 - DNA, 18 bp, Homo sapiens
acattaaacaatgatcac

SEQ ID NO: 6608727 - DNA, 12 bp, Homo sapiens
acattaaacaca

SEQ ID NO: 6608728 - DNA, 20 bp, Homo sapiens
acattaaacactgtaatctt

SEQ ID NO: 6608729 - DNA, 21 bp, Homo sapiens
acattaaacactgtaatctta

SEQ ID NO: 6608730 - DNA, 11 bp, Homo sapiens
acattaaagaa

SEQ ID NO: 6608731 - DNA, 17 bp, Homo sapiens
acattaaagaaatttaa

SEQ ID NO: 6608732 - DNA, 18 bp, Homo sapiens
acattaaagatttctgct

SEQ ID NO: 6608733 - DNA, 18 bp, Homo sapiens
acattaaagcaatctgtt

SEQ ID NO: 6608734 - DNA, 21 bp, Homo sapiens
acattaaaggcataaatgact

SEQ ID NO: 6608735 - DNA, 13 bp, Homo sapiens
acattaaaggtac

SEQ ID NO: 6608736 - DNA, 13 bp, Homo sapiens
acattaaagttaa

SEQ ID NO: 6608737 - DNA, 14 bp, Homo sapiens
acattaaatcacag

SEQ ID NO: 6608738 - DNA, 15 bp, Homo sapiens
acattaaatgcaata

SEQ ID NO: 6608739 - DNA, 21 bp, Homo sapiens
acattaaatgtggaaggaaaa

SEQ ID NO: 6608740 - DNA, 13 bp, Homo sapiens
acattaaattgat

SEQ ID NO: 6608741 - DNA, 22 bp, Homo sapiens
acattaaattttttttacattt

SEQ ID NO: 6608742 - DNA, 13 bp, Homo sapiens
acattaacaggca

SEQ ID NO: 6608743 - DNA, 20 bp, Homo sapiens
acattaacagttttccatga

SEQ ID NO: 6608744 - DNA, 15 bp, Homo sapiens
acattaacatctatt

SEQ ID NO: 6608745 - DNA, 23 bp, Homo sapiens
acattaactaattcaattcatgt

SEQ ID NO: 6608746 - DNA, 13 bp, Homo sapiens
acattaactcagg

SEQ ID NO: 6608747 - DNA, 18 bp, Homo sapiens
acattaactcagtggaag

SEQ ID NO: 6608748 - DNA, 13 bp, Homo sapiens
acattaactcatt

SEQ ID NO: 6608749 - DNA, 15 bp, Homo sapiens
acattaactccctcc

SEQ ID NO: 6608750 - DNA, 16 bp, Homo sapiens
acattaactccctcca

SEQ ID NO: 6608751 - DNA, 12 bp, Homo sapiens
acattaagaaaa

SEQ ID NO: 6608752 - DNA, 16 bp, Homo sapiens
acattaagaaaatatt

SEQ ID NO: 6608753 - DNA, 21 bp, Homo sapiens
acattaagaaaatcatattgc

SEQ ID NO: 6608754 - DNA, 17 bp, Homo sapiens
acattaagaagagcaga

SEQ ID NO: 6608755 - DNA, 14 bp, Homo sapiens
acattaagaatgtt

SEQ ID NO: 6608756 - DNA, 15 bp, Homo sapiens
acattaagaatgttg

SEQ ID NO: 6608757 - DNA, 20 bp, Homo sapiens
acattaagagaacaaagagt

SEQ ID NO: 6608758 - DNA, 14 bp, Homo sapiens
acattaaggaattt

SEQ ID NO: 6608759 - DNA, 21 bp, Homo sapiens
acattaatcaatcatctgtgt

SEQ ID NO: 6608760 - DNA, 15 bp, Homo sapiens
acattaatctcaaag

SEQ ID NO: 6608761 - DNA, 22 bp, Homo sapiens
acattaatgagaagagttttct

SEQ ID NO: 6608762 - DNA, 16 bp, Homo sapiens
acattaatgcccagcc

SEQ ID NO: 6608763 - DNA, 19 bp, Homo sapiens
acattaatgcccagccagc

SEQ ID NO: 6608764 - DNA, 22 bp, Homo sapiens
acattaatgttaattcagcact

SEQ ID NO: 6608765 - DNA, 18 bp, Homo sapiens
acattaatgttgatttct

SEQ ID NO: 6608766 - DNA, 15 bp, Homo sapiens
acattaattagattt

SEQ ID NO: 6608767 - DNA, 12 bp, Homo sapiens
acattaatttaa

SEQ ID NO: 6608768 - DNA, 17 bp, Homo sapiens
acattaatttatgcaga

SEQ ID NO: 6608769 - DNA, 13 bp, Homo sapiens
acattaattttat

SEQ ID NO: 6608770 - DNA, 13 bp, Homo sapiens
acattaattttgt

SEQ ID NO: 6608771 - DNA, 17 bp, Homo sapiens
acattaattttgtgcat

SEQ ID NO: 6608772 - DNA, 21 bp, Homo sapiens
acattaattttgtgcattctt

SEQ ID NO: 6608773 - DNA, 23 bp, Homo sapiens
acattaattttgtgcattctttg

SEQ ID NO: 6608774 - DNA, 13 bp, Homo sapiens
acattacaaacaa

SEQ ID NO: 6608775 - DNA, 18 bp, Homo sapiens
acattacaaacaaaggat

SEQ ID NO: 6608776 - DNA, 15 bp, Homo sapiens
acattacaacagtag

SEQ ID NO: 6608777 - DNA, 18 bp, Homo sapiens
acattacagaccatggat

SEQ ID NO: 6608778 - DNA, 17 bp, Homo sapiens
acattacatgtaaatta

SEQ ID NO: 6608779 - DNA, 20 bp, Homo sapiens
acattaccctaatggctgct

SEQ ID NO: 6608780 - DNA, 16 bp, Homo sapiens
acattaccttgtcttt

SEQ ID NO: 6608781 - DNA, 19 bp, Homo sapiens
acattactctgcctctgta

SEQ ID NO: 6608782 - DNA, 14 bp, Homo sapiens
acattactgccttc

SEQ ID NO: 6608783 - DNA, 14 bp, Homo sapiens
acattacttattta

SEQ ID NO: 6608784 - DNA, 14 bp, Homo sapiens
acattacttgcaca

SEQ ID NO: 6608785 - DNA, 14 bp, Homo sapiens
acattactttttat

SEQ ID NO: 6608786 - DNA, 13 bp, Homo sapiens
acattagaaaaaa

SEQ ID NO: 6608787 - DNA, 18 bp, Homo sapiens
acattagaagaaaacata

SEQ ID NO: 6608788 - DNA, 19 bp, Homo sapiens
acattagaagaaaacatat

SEQ ID NO: 6608789 - DNA, 14 bp, Homo sapiens
acattagaagacaa

SEQ ID NO: 6608790 - DNA, 20 bp, Homo sapiens
acattagaagacaattgaca

SEQ ID NO: 6608791 - DNA, 16 bp, Homo sapiens
acattagaatattgta

SEQ ID NO: 6608792 - DNA, 14 bp, Homo sapiens
acattagacacaca

SEQ ID NO: 6608793 - DNA, 16 bp, Homo sapiens
acattagagaaaacct

SEQ ID NO: 6608794 - DNA, 22 bp, Homo sapiens
acattagagaaaaccttaaaag

SEQ ID NO: 6608795 - DNA, 18 bp, Homo sapiens
acattagataaattacta

SEQ ID NO: 6608796 - DNA, 19 bp, Homo sapiens
acattagataaattactat

SEQ ID NO: 6608797 - DNA, 14 bp, Homo sapiens
acattagatgtcat

SEQ ID NO: 6608798 - DNA, 15 bp, Homo sapiens
acattagcagctatg

SEQ ID NO: 6608799 - DNA, 19 bp, Homo sapiens
acattaggaagatatcatg

SEQ ID NO: 6608800 - DNA, 22 bp, Homo sapiens
acattaggagtaactttcaacc

SEQ ID NO: 6608801 - DNA, 21 bp, Homo sapiens
acattaggctgtgtcaccatt

SEQ ID NO: 6608802 - DNA, 22 bp, Homo sapiens
acattagggtgggcgtgctgcg

SEQ ID NO: 6608803 - DNA, 16 bp, Homo sapiens
acattagtaaatgtct

SEQ ID NO: 6608804 - DNA, 17 bp, Homo sapiens
acattagtaaatgtctt

SEQ ID NO: 6608805 - DNA, 22 bp, Homo sapiens
acattagtaaatgtctttgtaa

SEQ ID NO: 6608806 - DNA, 24 bp, Homo sapiens
acattagtaaatgtctttgtaagt

SEQ ID NO: 6608807 - DNA, 16 bp, Homo sapiens
acattagtactttata

SEQ ID NO: 6608808 - DNA, 19 bp, Homo sapiens
acattagtactttatagaa

SEQ ID NO: 6608809 - DNA, 13 bp, Homo sapiens
acattagtatagt

SEQ ID NO: 6608810 - DNA, 17 bp, Homo sapiens
acattagtatcccacta

SEQ ID NO: 6608811 - DNA, 19 bp, Homo sapiens
acattagtgaaaattctgt

SEQ ID NO: 6608812 - DNA, 20 bp, Homo sapiens
acattagtgaaaattctgtt

SEQ ID NO: 6608813 - DNA, 15 bp, Homo sapiens
acattagtgattcca

SEQ ID NO: 6608814 - DNA, 20 bp, Homo sapiens
acattagtgtgttgtctctt

SEQ ID NO: 6608815 - DNA, 21 bp, Homo sapiens
acattagtgttctttatatac

SEQ ID NO: 6608816 - DNA, 16 bp, Homo sapiens
acattagttttaaaaa

SEQ ID NO: 6608817 - DNA, 14 bp, Homo sapiens
acattataaacgct

SEQ ID NO: 6608818 - DNA, 13 bp, Homo sapiens
acattataaatga

SEQ ID NO: 6608819 - DNA, 20 bp, Homo sapiens
acattataaatgacagatct

SEQ ID NO: 6608820 - DNA, 21 bp, Homo sapiens
acattataacaactatttact

SEQ ID NO: 6608821 - DNA, 17 bp, Homo sapiens
acattataccgcagagt

SEQ ID NO: 6608822 - DNA, 15 bp, Homo sapiens
acattatagattttc

SEQ ID NO: 6608823 - DNA, 12 bp, Homo sapiens
acattatataac

SEQ ID NO: 6608824 - DNA, 14 bp, Homo sapiens
acattatataacaa

SEQ ID NO: 6608825 - DNA, 15 bp, Homo sapiens
acattatataacaaa

SEQ ID NO: 6608826 - DNA, 16 bp, Homo sapiens
acattatataacaaaa

SEQ ID NO: 6608827 - DNA, 15 bp, Homo sapiens
acattatattcctct

SEQ ID NO: 6608828 - DNA, 17 bp, Homo sapiens
acattatattgcaatga

SEQ ID NO: 6608829 - DNA, 20 bp, Homo sapiens
acattatatttctattttat

SEQ ID NO: 6608830 - DNA, 23 bp, Homo sapiens
acattatatttgagtttctttca

SEQ ID NO: 6608831 - DNA, 20 bp, Homo sapiens
acattatcactgaaaaaatg

SEQ ID NO: 6608832 - DNA, 23 bp, Homo sapiens
acattatcttttggctctgaaga

SEQ ID NO: 6608833 - DNA, 13 bp, Homo sapiens
acattatgaagaa

SEQ ID NO: 6608834 - DNA, 18 bp, Homo sapiens
acattatgatctaataaa

SEQ ID NO: 6608835 - DNA, 22 bp, Homo sapiens
acattatgtatcttagttacat

SEQ ID NO: 6608836 - DNA, 19 bp, Homo sapiens
acattatgtgtgcatgtgt

SEQ ID NO: 6608837 - DNA, 21 bp, Homo sapiens
acattatgtgtgcatgtgtgt

SEQ ID NO: 6608838 - DNA, 23 bp, Homo sapiens
acattatgtgtgcatgtgtgtat

SEQ ID NO: 6608839 - DNA, 17 bp, Homo sapiens
acattatgttattggaa

SEQ ID NO: 6608840 - DNA, 21 bp, Homo sapiens
acattatgttattggaatttt

SEQ ID NO: 6608841 - DNA, 22 bp, Homo sapiens
acattatgttttatttaaatgc

SEQ ID NO: 6608842 - DNA, 15 bp, Homo sapiens
acattattaaagttt

SEQ ID NO: 6608843 - DNA, 18 bp, Homo sapiens
acattattaaagttttca

SEQ ID NO: 6608844 - DNA, 14 bp, Homo sapiens
acattattaagcac

SEQ ID NO: 6608845 - DNA, 22 bp, Homo sapiens
acattattagaatataaaaaat

SEQ ID NO: 6608846 - DNA, 14 bp, Homo sapiens
acattattcttctt

SEQ ID NO: 6608847 - DNA, 15 bp, Homo sapiens
acattattgcttatt

SEQ ID NO: 6608848 - DNA, 18 bp, Homo sapiens
acattatttatatgggga

SEQ ID NO: 6608849 - DNA, 19 bp, Homo sapiens
acattatttattaaaaatg

SEQ ID NO: 6608850 - DNA, 12 bp, Homo sapiens
acattatttctg

SEQ ID NO: 6608851 - DNA, 21 bp, Homo sapiens
acattatttctgtatatagat

SEQ ID NO: 6608852 - DNA, 16 bp, Homo sapiens
acattattttaaaatc

SEQ ID NO: 6608853 - DNA, 15 bp, Homo sapiens
acattcaaaacagtt

SEQ ID NO: 6608854 - DNA, 20 bp, Homo sapiens
acattcaaaacgtgatgttt

SEQ ID NO: 6608855 - DNA, 21 bp, Homo sapiens
acattcaaattctttttttat

SEQ ID NO: 6608856 - DNA, 18 bp, Homo sapiens
acattcaaccctggagag

SEQ ID NO: 6608857 - DNA, 11 bp, Homo sapiens
acattcaactc

SEQ ID NO: 6608858 - DNA, 13 bp, Homo sapiens
acattcaaggcat

SEQ ID NO: 6608859 - DNA, 15 bp, Homo sapiens
acattcaataagcat

SEQ ID NO: 6608860 - DNA, 23 bp, Homo sapiens
acattcaataagcatcaaactct

SEQ ID NO: 6608861 - DNA, 15 bp, Homo sapiens
acattcaatcttgcc

SEQ ID NO: 6608862 - DNA, 16 bp, Homo sapiens
acattcaatcttgccg

SEQ ID NO: 6608863 - DNA, 12 bp, Homo sapiens
acattcaatgtt

SEQ ID NO: 6608864 - DNA, 12 bp, Homo sapiens
acattcacagcc

SEQ ID NO: 6608865 - DNA, 13 bp, Homo sapiens
acattcacagccc

SEQ ID NO: 6608866 - DNA, 15 bp, Homo sapiens
acattcacagcccag

SEQ ID NO: 6608867 - DNA, 16 bp, Homo sapiens
acattcacagcccaga

SEQ ID NO: 6608868 - DNA, 14 bp, Homo sapiens
acattcaccaacaa

SEQ ID NO: 6608869 - DNA, 17 bp, Homo sapiens
acattcaccaacaacag

SEQ ID NO: 6608870 - DNA, 17 bp, Homo sapiens
acattcactgctgattt

SEQ ID NO: 6608871 - DNA, 16 bp, Homo sapiens
acattcacttttgtta

SEQ ID NO: 6608872 - DNA, 16 bp, Homo sapiens
acattcagaacaccaa

SEQ ID NO: 6608873 - DNA, 15 bp, Homo sapiens
acattcagctctgga

SEQ ID NO: 6608874 - DNA, 16 bp, Homo sapiens
acattcagctctggag

SEQ ID NO: 6608875 - DNA, 17 bp, Homo sapiens
acattcagcttcctgct

SEQ ID NO: 6608876 - DNA, 16 bp, Homo sapiens
acattcaggaagatga

SEQ ID NO: 6608877 - DNA, 13 bp, Homo sapiens
acattcataagga

SEQ ID NO: 6608878 - DNA, 14 bp, Homo sapiens
acattcatatctta

SEQ ID NO: 6608879 - DNA, 15 bp, Homo sapiens
acattcatatcttaa

SEQ ID NO: 6608880 - DNA, 18 bp, Homo sapiens
acattcatcctcacatgt

SEQ ID NO: 6608881 - DNA, 18 bp, Homo sapiens
acattcatctggaggctg

SEQ ID NO: 6608882 - DNA, 20 bp, Homo sapiens
acattcatctggaggctgcg

SEQ ID NO: 6608883 - DNA, 15 bp, Homo sapiens
acattcatgcctggc

SEQ ID NO: 6608884 - DNA, 14 bp, Homo sapiens
acattcatgtaact

SEQ ID NO: 6608885 - DNA, 17 bp, Homo sapiens
acattcattttctcagt

SEQ ID NO: 6608886 - DNA, 15 bp, Homo sapiens
acattccaactcgta

SEQ ID NO: 6608887 - DNA, 22 bp, Homo sapiens
acattccaactcgtatagcatg

SEQ ID NO: 6608888 - DNA, 14 bp, Homo sapiens
acattccaagacag

SEQ ID NO: 6608889 - DNA, 16 bp, Homo sapiens
acattccacagctgcc

SEQ ID NO: 6608890 - DNA, 19 bp, Homo sapiens
acattccagccaggcccag

SEQ ID NO: 6608891 - DNA, 22 bp, Homo sapiens
acattccagccaggcccaggcc

SEQ ID NO: 6608892 - DNA, 13 bp, Homo sapiens
acattccagggct

SEQ ID NO: 6608893 - DNA, 13 bp, Homo sapiens
acattccagtaga

SEQ ID NO: 6608894 - DNA, 19 bp, Homo sapiens
acattccatcacagccagc

SEQ ID NO: 6608895 - DNA, 22 bp, Homo sapiens
acattccatcacagccagccca

SEQ ID NO: 6608896 - DNA, 16 bp, Homo sapiens
acattccatgacgaca

SEQ ID NO: 6608897 - DNA, 19 bp, Homo sapiens
acattccatgacgcaggag

SEQ ID NO: 6608898 - DNA, 16 bp, Homo sapiens
acattcccagcccagc

SEQ ID NO: 6608899 - DNA, 20 bp, Homo sapiens
acattcccatgaatatcaag

SEQ ID NO: 6608900 - DNA, 19 bp, Homo sapiens
acattcccctggggaccca

SEQ ID NO: 6608901 - DNA, 19 bp, Homo sapiens
acattccctatcaaaacat

SEQ ID NO: 6608902 - DNA, 20 bp, Homo sapiens
acattccctatcaaaacata

SEQ ID NO: 6608903 - DNA, 21 bp, Homo sapiens
acattccctatcaaaacatat

SEQ ID NO: 6608904 - DNA, 13 bp, Homo sapiens
acattccctctcc

SEQ ID NO: 6608905 - DNA, 19 bp, Homo sapiens
acattccctctcctgccca

SEQ ID NO: 6608906 - DNA, 21 bp, Homo sapiens
acattccctctcctgcccaga

SEQ ID NO: 6608907 - DNA, 20 bp, Homo sapiens
acattccctgcatccaatct

SEQ ID NO: 6608908 - DNA, 22 bp, Homo sapiens
acattccctggccgcttctccc

SEQ ID NO: 6608909 - DNA, 16 bp, Homo sapiens
acattccgtttacatt

SEQ ID NO: 6608910 - DNA, 23 bp, Homo sapiens
acattccgtttacattttagaca

SEQ ID NO: 6608911 - DNA, 20 bp, Homo sapiens
acattcctaaactatctttt

SEQ ID NO: 6608912 - DNA, 23 bp, Homo sapiens
acattcctaagagtggaggagga

SEQ ID NO: 6608913 - DNA, 23 bp, Homo sapiens
acattcctagagagcagaaataa

SEQ ID NO: 6608914 - DNA, 16 bp, Homo sapiens
acattcctcagctgcc

SEQ ID NO: 6608915 - DNA, 22 bp, Homo sapiens
acattcctcagctgccaagcac

SEQ ID NO: 6608916 - DNA, 12 bp, Homo sapiens
acattcctccag

SEQ ID NO: 6608917 - DNA, 17 bp, Homo sapiens
acattcctccagcctcc

SEQ ID NO: 6608918 - DNA, 23 bp, Homo sapiens
acattcctccagcctcccctccc

SEQ ID NO: 6608919 - DNA, 14 bp, Homo sapiens
acattcctgaacag

SEQ ID NO: 6608920 - DNA, 11 bp, Homo sapiens
acattcctgac

SEQ ID NO: 6608921 - DNA, 17 bp, Homo sapiens
acattcctgagattctg

SEQ ID NO: 6608922 - DNA, 16 bp, Homo sapiens
acattcctgatactgg

SEQ ID NO: 6608923 - DNA, 14 bp, Homo sapiens
acattcctgatgct

SEQ ID NO: 6608924 - DNA, 17 bp, Homo sapiens
acattccttctacatgt

SEQ ID NO: 6608925 - DNA, 14 bp, Homo sapiens
acattccttgctga

SEQ ID NO: 6608926 - DNA, 18 bp, Homo sapiens
acattccttgtcaccagc

SEQ ID NO: 6608927 - DNA, 17 bp, Homo sapiens
acattcctttgggtatg

SEQ ID NO: 6608928 - DNA, 20 bp, Homo sapiens
acattcggctccctggagcc

SEQ ID NO: 6608929 - DNA, 20 bp, Homo sapiens
acattcgggaccaatatata

SEQ ID NO: 6608930 - DNA, 15 bp, Homo sapiens
acattcgtgagctgg

SEQ ID NO: 6608931 - DNA, 16 bp, Homo sapiens
acattcgtgagctggg

SEQ ID NO: 6608932 - DNA, 19 bp, Homo sapiens
acattctaatgcatattta

SEQ ID NO: 6608933 - DNA, 14 bp, Homo sapiens
acattctacagttg

SEQ ID NO: 6608934 - DNA, 19 bp, Homo sapiens
acattctacttcagctttg

SEQ ID NO: 6608935 - DNA, 12 bp, Homo sapiens
acattctagttc

SEQ ID NO: 6608936 - DNA, 14 bp, Homo sapiens
acattctagttcag

SEQ ID NO: 6608937 - DNA, 17 bp, Homo sapiens
acattctatgacatttt

SEQ ID NO: 6608938 - DNA, 18 bp, Homo sapiens
acattctcacaattgtaa

SEQ ID NO: 6608939 - DNA, 19 bp, Homo sapiens
acattctcgcttccctgaa

SEQ ID NO: 6608940 - DNA, 18 bp, Homo sapiens
acattctcgttgcctctg

SEQ ID NO: 6608941 - DNA, 14 bp, Homo sapiens
acattctctatttt

SEQ ID NO: 6608942 - DNA, 21 bp, Homo sapiens
acattctcttactttttgtaa

SEQ ID NO: 6608943 - DNA, 23 bp, Homo sapiens
acattctcttactttttgtaaat

SEQ ID NO: 6608944 - DNA, 13 bp, Homo sapiens
acattctctttga

SEQ ID NO: 6608945 - DNA, 14 bp, Homo sapiens
acattctctttgat

SEQ ID NO: 6608946 - DNA, 20 bp, Homo sapiens
acattctctttgataacaaa

SEQ ID NO: 6608947 - DNA, 15 bp, Homo sapiens
acattctgaatgctt

SEQ ID NO: 6608948 - DNA, 18 bp, Homo sapiens
acattctgaatgcttcta

SEQ ID NO: 6608949 - DNA, 23 bp, Homo sapiens
acattctgattcgaatgacactg

SEQ ID NO: 6608950 - DNA, 19 bp, Homo sapiens
acattctgcaatggcagca

SEQ ID NO: 6608951 - DNA, 18 bp, Homo sapiens
acattctgcctagagtgt

SEQ ID NO: 6608952 - DNA, 22 bp, Homo sapiens
acattctgcctagagtgtagcc

SEQ ID NO: 6608953 - DNA, 12 bp, Homo sapiens
acattctgctat

SEQ ID NO: 6608954 - DNA, 14 bp, Homo sapiens
acattctgctctgc

SEQ ID NO: 6608955 - DNA, 15 bp, Homo sapiens
acattctgctctgcc

SEQ ID NO: 6608956 - DNA, 21 bp, Homo sapiens
acattctgctgcccccagacc

SEQ ID NO: 6608957 - DNA, 12 bp, Homo sapiens
acattctgcttt

SEQ ID NO: 6608958 - DNA, 18 bp, Homo sapiens
acattctggtctcgtctt

SEQ ID NO: 6608959 - DNA, 20 bp, Homo sapiens
acattctggtctcgtcttcc

SEQ ID NO: 6608960 - DNA, 22 bp, Homo sapiens
acattctggtctcgtcttccgt

SEQ ID NO: 6608961 - DNA, 18 bp, Homo sapiens
acattctgtctttcaaaa

SEQ ID NO: 6608962 - DNA, 12 bp, Homo sapiens
acattctgttaa

SEQ ID NO: 6608963 - DNA, 13 bp, Homo sapiens
acattcttaaaaa

SEQ ID NO: 6608964 - DNA, 22 bp, Homo sapiens
acattcttagctgtaacttaac

SEQ ID NO: 6608965 - DNA, 14 bp, Homo sapiens
acattcttataaat

SEQ ID NO: 6608966 - DNA, 16 bp, Homo sapiens
acattcttataaatat

SEQ ID NO: 6608967 - DNA, 16 bp, Homo sapiens
acattcttatatttca

SEQ ID NO: 6608968 - DNA, 15 bp, Homo sapiens
acattcttatatttt

SEQ ID NO: 6608969 - DNA, 17 bp, Homo sapiens
acattcttattaattct

SEQ ID NO: 6608970 - DNA, 14 bp, Homo sapiens
acattcttcaaaga

SEQ ID NO: 6608971 - DNA, 15 bp, Homo sapiens
acattcttccatcat

SEQ ID NO: 6608972 - DNA, 22 bp, Homo sapiens
acattcttccatcatcactgta

SEQ ID NO: 6608973 - DNA, 15 bp, Homo sapiens
acattcttgctctgc

SEQ ID NO: 6608974 - DNA, 22 bp, Homo sapiens
acattcttggcttaatcatttt

SEQ ID NO: 6608975 - DNA, 19 bp, Homo sapiens
acattcttggttgttaatt

SEQ ID NO: 6608976 - DNA, 20 bp, Homo sapiens
acattcttgtgtctgtttta

SEQ ID NO: 6608977 - DNA, 11 bp, Homo sapiens
acattctttat

SEQ ID NO: 6608978 - DNA, 18 bp, Homo sapiens
acattctttataaaatgt

SEQ ID NO: 6608979 - DNA, 19 bp, Homo sapiens
acattctttcctaaatata

SEQ ID NO: 6608980 - DNA, 18 bp, Homo sapiens
acattgaaactgtattta

SEQ ID NO: 6608981 - DNA, 20 bp, Homo sapiens
acattgaaactgtatttact

SEQ ID NO: 6608982 - DNA, 12 bp, Homo sapiens
acattgaaagag

SEQ ID NO: 6608983 - DNA, 15 bp, Homo sapiens
acattgaaagctcta

SEQ ID NO: 6608984 - DNA, 14 bp, Homo sapiens
acattgaaagtgag

SEQ ID NO: 6608985 - DNA, 12 bp, Homo sapiens
acattgaaatac

SEQ ID NO: 6608986 - DNA, 13 bp, Homo sapiens
acattgaaatcta

SEQ ID NO: 6608987 - DNA, 15 bp, Homo sapiens
acattgaagtaatga

SEQ ID NO: 6608988 - DNA, 19 bp, Homo sapiens
acattgaagtaatgaattt

SEQ ID NO: 6608989 - DNA, 22 bp, Homo sapiens
acattgaatagtggaacatttt

SEQ ID NO: 6608990 - DNA, 22 bp, Homo sapiens
acattgaatatcagttgacaga

SEQ ID NO: 6608991 - DNA, 18 bp, Homo sapiens
acattgaatggatcaata

SEQ ID NO: 6608992 - DNA, 20 bp, Homo sapiens
acattgaatggatcaataca

SEQ ID NO: 6608993 - DNA, 14 bp, Homo sapiens
acattgaattagaa

SEQ ID NO: 6608994 - DNA, 18 bp, Homo sapiens
acattgaattagaaacat

SEQ ID NO: 6608995 - DNA, 13 bp, Homo sapiens
acattgaattcat

SEQ ID NO: 6608996 - DNA, 24 bp, Homo sapiens
acattgacacacagaaatgtgtca

SEQ ID NO: 6608997 - DNA, 12 bp, Homo sapiens
acattgacagca

SEQ ID NO: 6608998 - DNA, 15 bp, Homo sapiens
acattgacagcaatt

SEQ ID NO: 6608999 - DNA, 16 bp, Homo sapiens
acattgaccaagaact

SEQ ID NO: 6609000 - DNA, 18 bp, Homo sapiens
acattgaccaagaactgc

SEQ ID NO: 6609001 - DNA, 19 bp, Homo sapiens
acattgaccaagaactgca

SEQ ID NO: 6609002 - DNA, 21 bp, Homo sapiens
acattgaccgcaactcacaca

SEQ ID NO: 6609003 - DNA, 22 bp, Homo sapiens
acattgaccgcaactcacacat

SEQ ID NO: 6609004 - DNA, 17 bp, Homo sapiens
acattgacgattccttc

SEQ ID NO: 6609005 - DNA, 20 bp, Homo sapiens
acattgagctgatataaatt

SEQ ID NO: 6609006 - DNA, 22 bp, Homo sapiens
acattgagggaacacaaattta

SEQ ID NO: 6609007 - DNA, 19 bp, Homo sapiens
acattgagtttacttataa

SEQ ID NO: 6609008 - DNA, 18 bp, Homo sapiens
acattgataattcaacat

SEQ ID NO: 6609009 - DNA, 17 bp, Homo sapiens
acattgatacaaagtac

SEQ ID NO: 6609010 - DNA, 23 bp, Homo sapiens
acattgatacaaagtacagaaaa

SEQ ID NO: 6609011 - DNA, 16 bp, Homo sapiens
acattgattggataaa

SEQ ID NO: 6609012 - DNA, 16 bp, Homo sapiens
acattgatttgatttt

SEQ ID NO: 6609013 - DNA, 12 bp, Homo sapiens
acattgatttta

SEQ ID NO: 6609014 - DNA, 19 bp, Homo sapiens
acattgatttttctataat

SEQ ID NO: 6609015 - DNA, 22 bp, Homo sapiens
acattgatttttctataatcac

SEQ ID NO: 6609016 - DNA, 14 bp, Homo sapiens
acattgcaatagaa

SEQ ID NO: 6609017 - DNA, 15 bp, Homo sapiens
acattgcaatagaaa

SEQ ID NO: 6609018 - DNA, 20 bp, Homo sapiens
acattgcactttataaacac

SEQ ID NO: 6609019 - DNA, 21 bp, Homo sapiens
acattgcactttataaacact

SEQ ID NO: 6609020 - DNA, 23 bp, Homo sapiens
acattgcagagtggcctagagca

SEQ ID NO: 6609021 - DNA, 17 bp, Homo sapiens
acattgcattctattgc

SEQ ID NO: 6609022 - DNA, 16 bp, Homo sapiens
acattgcattgtgact

SEQ ID NO: 6609023 - DNA, 16 bp, Homo sapiens
acattgcccacacctg

SEQ ID NO: 6609024 - DNA, 12 bp, Homo sapiens
acattgccccaa

SEQ ID NO: 6609025 - DNA, 13 bp, Homo sapiens
acattgccccaag

SEQ ID NO: 6609026 - DNA, 18 bp, Homo sapiens
acattgcccctctgcctt

SEQ ID NO: 6609027 - DNA, 21 bp, Homo sapiens
acattgcccctctgccttgcc

SEQ ID NO: 6609028 - DNA, 23 bp, Homo sapiens
acattgccctgaggggcctgcca

SEQ ID NO: 6609029 - DNA, 15 bp, Homo sapiens
acattgcctccacct

SEQ ID NO: 6609030 - DNA, 23 bp, Homo sapiens
acattgcctccacctctccttgg

SEQ ID NO: 6609031 - DNA, 12 bp, Homo sapiens
acattgccttct

SEQ ID NO: 6609032 - DNA, 18 bp, Homo sapiens
acattgccttgcatttgt

SEQ ID NO: 6609033 - DNA, 16 bp, Homo sapiens
acattgcctttgaatg

SEQ ID NO: 6609034 - DNA, 18 bp, Homo sapiens
acattgctctatgtctgc

SEQ ID NO: 6609035 - DNA, 14 bp, Homo sapiens
acattgctctctgg

SEQ ID NO: 6609036 - DNA, 18 bp, Homo sapiens
acattgctgatgtagtat

SEQ ID NO: 6609037 - DNA, 13 bp, Homo sapiens
acattgctgcctt

SEQ ID NO: 6609038 - DNA, 15 bp, Homo sapiens
acattgctggctgcc

SEQ ID NO: 6609039 - DNA, 21 bp, Homo sapiens
acattgctggtcttgtaagag

SEQ ID NO: 6609040 - DNA, 12 bp, Homo sapiens
acattgctgtat

SEQ ID NO: 6609041 - DNA, 13 bp, Homo sapiens
acattgctgtatt

SEQ ID NO: 6609042 - DNA, 22 bp, Homo sapiens
acattgcttaaaatatatagtg

SEQ ID NO: 6609043 - DNA, 21 bp, Homo sapiens
acattgctttactgtcaaaat

SEQ ID NO: 6609044 - DNA, 20 bp, Homo sapiens
acattggaagcaggttaaat

SEQ ID NO: 6609045 - DNA, 21 bp, Homo sapiens
acattggaagcaggttaaatg

SEQ ID NO: 6609046 - DNA, 22 bp, Homo sapiens
acattggaagcaggttaaatgt

SEQ ID NO: 6609047 - DNA, 17 bp, Homo sapiens
acattggaagcctgagc

SEQ ID NO: 6609048 - DNA, 15 bp, Homo sapiens
acattggaagctccc

SEQ ID NO: 6609049 - DNA, 15 bp, Homo sapiens
acattggaatgttct

SEQ ID NO: 6609050 - DNA, 17 bp, Homo sapiens
acattggaatgttctca

SEQ ID NO: 6609051 - DNA, 17 bp, Homo sapiens
acattggacagaaaatg

SEQ ID NO: 6609052 - DNA, 20 bp, Homo sapiens
acattggacagaaaatgcaa

SEQ ID NO: 6609053 - DNA, 14 bp, Homo sapiens
acattggacttcct

SEQ ID NO: 6609054 - DNA, 22 bp, Homo sapiens
acattggagacatcacttgcca

SEQ ID NO: 6609055 - DNA, 23 bp, Homo sapiens
acattggagtctcatttgggcta

SEQ ID NO: 6609056 - DNA, 22 bp, Homo sapiens
acattggcacctaatccaggca

SEQ ID NO: 6609057 - DNA, 17 bp, Homo sapiens
acattggcagtgtgtca

SEQ ID NO: 6609058 - DNA, 15 bp, Homo sapiens
acattggctttttaa

SEQ ID NO: 6609059 - DNA, 15 bp, Homo sapiens
acattgggaagggga

SEQ ID NO: 6609060 - DNA, 23 bp, Homo sapiens
acattggggaaatttttaagttt

SEQ ID NO: 6609061 - DNA, 22 bp, Homo sapiens
acattgggtctattccagctca

SEQ ID NO: 6609062 - DNA, 22 bp, Homo sapiens
acattggtatatttccattcat

SEQ ID NO: 6609063 - DNA, 19 bp, Homo sapiens
acattggtgaaggatccag

SEQ ID NO: 6609064 - DNA, 14 bp, Homo sapiens
acattggtgttgta

SEQ ID NO: 6609065 - DNA, 16 bp, Homo sapiens
acattggttcttgtat

SEQ ID NO: 6609066 - DNA, 21 bp, Homo sapiens
acattggttcttgtattaaga

SEQ ID NO: 6609067 - DNA, 16 bp, Homo sapiens
acattggttttgaaat

SEQ ID NO: 6609068 - DNA, 19 bp, Homo sapiens
acattgtaaatagtatttg

SEQ ID NO: 6609069 - DNA, 21 bp, Homo sapiens
acattgtaaatagtatttgag

SEQ ID NO: 6609070 - DNA, 23 bp, Homo sapiens
acattgtaaatatttactctttg

SEQ ID NO: 6609071 - DNA, 23 bp, Homo sapiens
acattgtaagagagatgagcact

SEQ ID NO: 6609072 - DNA, 14 bp, Homo sapiens
acattgtacttaaa

SEQ ID NO: 6609073 - DNA, 16 bp, Homo sapiens
acattgtagcctaata

SEQ ID NO: 6609074 - DNA, 21 bp, Homo sapiens
acattgtagcctaatattcat

SEQ ID NO: 6609075 - DNA, 15 bp, Homo sapiens
acattgtataggcca

SEQ ID NO: 6609076 - DNA, 18 bp, Homo sapiens
acattgtataggccatct

SEQ ID NO: 6609077 - DNA, 22 bp, Homo sapiens
acattgtataggccatctgtaa

SEQ ID NO: 6609078 - DNA, 23 bp, Homo sapiens
acattgtattttactttgtgcaa

SEQ ID NO: 6609079 - DNA, 12 bp, Homo sapiens
acattgtcaata

SEQ ID NO: 6609080 - DNA, 13 bp, Homo sapiens
acattgtcagaat

SEQ ID NO: 6609081 - DNA, 14 bp, Homo sapiens
acattgtcagaatg

SEQ ID NO: 6609082 - DNA, 19 bp, Homo sapiens
acattgtcatttatataga

SEQ ID NO: 6609083 - DNA, 23 bp, Homo sapiens
acattgtccccaatgaatatact

SEQ ID NO: 6609084 - DNA, 13 bp, Homo sapiens
acattgtctcccg

SEQ ID NO: 6609085 - DNA, 13 bp, Homo sapiens
acattgtgactgt

SEQ ID NO: 6609086 - DNA, 16 bp, Homo sapiens
acattgtgactgtgtt

SEQ ID NO: 6609087 - DNA, 22 bp, Homo sapiens
acattgtgactttgctttgaga

SEQ ID NO: 6609088 - DNA, 14 bp, Homo sapiens
acattgtgagctct

SEQ ID NO: 6609089 - DNA, 18 bp, Homo sapiens
acattgtgccctgtagct

SEQ ID NO: 6609090 - DNA, 19 bp, Homo sapiens
acattgtgccctgtagctc

SEQ ID NO: 6609091 - DNA, 23 bp, Homo sapiens
acattgtgcccttgatttttatc

SEQ ID NO: 6609092 - DNA, 17 bp, Homo sapiens
acattgtggcacattct

SEQ ID NO: 6609093 - DNA, 15 bp, Homo sapiens
acattgtgtctagga

SEQ ID NO: 6609094 - DNA, 22 bp, Homo sapiens
acattgtgttaacttatgtctc

SEQ ID NO: 6609095 - DNA, 17 bp, Homo sapiens
acattgtgttttcctaa

SEQ ID NO: 6609096 - DNA, 22 bp, Homo sapiens
acattgttatgcacttttcccc

SEQ ID NO: 6609097 - DNA, 16 bp, Homo sapiens
acattgttatttctgt

SEQ ID NO: 6609098 - DNA, 21 bp, Homo sapiens
acattgttcacctttgtagca

SEQ ID NO: 6609099 - DNA, 18 bp, Homo sapiens
acattgttcattcttgtt

SEQ ID NO: 6609100 - DNA, 14 bp, Homo sapiens
acattgttgttttt

SEQ ID NO: 6609101 - DNA, 20 bp, Homo sapiens
acattgttgtttttttaata

SEQ ID NO: 6609102 - DNA, 16 bp, Homo sapiens
acattgtttggatttc

SEQ ID NO: 6609103 - DNA, 15 bp, Homo sapiens
acattgttttaaaaa

SEQ ID NO: 6609104 - DNA, 21 bp, Homo sapiens
acattgttttgccaacattgc

SEQ ID NO: 6609105 - DNA, 19 bp, Homo sapiens
acattgtttttgtatattg

SEQ ID NO: 6609106 - DNA, 12 bp, Homo sapiens
acatttaaaaca

SEQ ID NO: 6609107 - DNA, 18 bp, Homo sapiens
acatttaaaacattaaaa

SEQ ID NO: 6609108 - DNA, 16 bp, Homo sapiens
acatttaaaacatttg

SEQ ID NO: 6609109 - DNA, 18 bp, Homo sapiens
acatttaaaacatttgaa

SEQ ID NO: 6609110 - DNA, 14 bp, Homo sapiens
acatttaaaactta

SEQ ID NO: 6609111 - DNA, 23 bp, Homo sapiens
acatttaaaatagttttctaaat

SEQ ID NO: 6609112 - DNA, 20 bp, Homo sapiens
acatttaaaattaaataaat

SEQ ID NO: 6609113 - DNA, 17 bp, Homo sapiens
acatttaaaattgctat

SEQ ID NO: 6609114 - DNA, 16 bp, Homo sapiens
acatttaaacctttta

SEQ ID NO: 6609115 - DNA, 13 bp, Homo sapiens
acatttaaagaca

SEQ ID NO: 6609116 - DNA, 13 bp, Homo sapiens
acatttaaagaga

SEQ ID NO: 6609117 - DNA, 18 bp, Homo sapiens
acatttaaagagatttcc

SEQ ID NO: 6609118 - DNA, 21 bp, Homo sapiens
acatttaaatacaaagttctt

SEQ ID NO: 6609119 - DNA, 14 bp, Homo sapiens
acatttaaatcctt

SEQ ID NO: 6609120 - DNA, 23 bp, Homo sapiens
acatttaaattttaccctttaga

SEQ ID NO: 6609121 - DNA, 20 bp, Homo sapiens
acatttaagcaggaatgcaa

SEQ ID NO: 6609122 - DNA, 14 bp, Homo sapiens
acatttaagtggtt

SEQ ID NO: 6609123 - DNA, 17 bp, Homo sapiens
acatttaatacagataa

SEQ ID NO: 6609124 - DNA, 16 bp, Homo sapiens
acatttaatacagcag

SEQ ID NO: 6609125 - DNA, 16 bp, Homo sapiens
acatttaatgaacaca

SEQ ID NO: 6609126 - DNA, 15 bp, Homo sapiens
acatttaattgagaa

SEQ ID NO: 6609127 - DNA, 15 bp, Homo sapiens
acatttaatttagtg

SEQ ID NO: 6609128 - DNA, 19 bp, Homo sapiens
acatttaatttagtgatct

SEQ ID NO: 6609129 - DNA, 16 bp, Homo sapiens
acatttacaaactgaa

SEQ ID NO: 6609130 - DNA, 20 bp, Homo sapiens
acatttacaccacactttca

SEQ ID NO: 6609131 - DNA, 21 bp, Homo sapiens
acatttacagtccttcaaaat

SEQ ID NO: 6609132 - DNA, 14 bp, Homo sapiens
acatttacatgtat

SEQ ID NO: 6609133 - DNA, 19 bp, Homo sapiens
acatttaccaaattgcttg

SEQ ID NO: 6609134 - DNA, 15 bp, Homo sapiens
acatttaccaatcat

SEQ ID NO: 6609135 - DNA, 14 bp, Homo sapiens
acatttaccagcaa

SEQ ID NO: 6609136 - DNA, 22 bp, Homo sapiens
acatttaccctttggccccact

SEQ ID NO: 6609137 - DNA, 22 bp, Homo sapiens
acatttactttaatttccttga

SEQ ID NO: 6609138 - DNA, 13 bp, Homo sapiens
acatttagaaaag

SEQ ID NO: 6609139 - DNA, 22 bp, Homo sapiens
acatttagaacctgcatttaag

SEQ ID NO: 6609140 - DNA, 14 bp, Homo sapiens
acatttagaacttt

SEQ ID NO: 6609141 - DNA, 13 bp, Homo sapiens
acatttagagtat

SEQ ID NO: 6609142 - DNA, 14 bp, Homo sapiens
acatttagagtatt

SEQ ID NO: 6609143 - DNA, 23 bp, Homo sapiens
acatttagatcctggtttcataa

SEQ ID NO: 6609144 - DNA, 19 bp, Homo sapiens
acatttagccaaagttgag

SEQ ID NO: 6609145 - DNA, 17 bp, Homo sapiens
acatttagcccctctct

SEQ ID NO: 6609146 - DNA, 16 bp, Homo sapiens
acatttaggagaagtt

SEQ ID NO: 6609147 - DNA, 17 bp, Homo sapiens
acatttaggataatctt

SEQ ID NO: 6609148 - DNA, 21 bp, Homo sapiens
acatttagtaaatgctgaaat

SEQ ID NO: 6609149 - DNA, 19 bp, Homo sapiens
acatttagtaccctgcagg

SEQ ID NO: 6609150 - DNA, 20 bp, Homo sapiens
acatttagtaccctgcaggc

SEQ ID NO: 6609151 - DNA, 19 bp, Homo sapiens
acatttagtccaatgaaga

SEQ ID NO: 6609152 - DNA, 14 bp, Homo sapiens
acatttagtcctgt

SEQ ID NO: 6609153 - DNA, 20 bp, Homo sapiens
acatttataatgtttgctat

SEQ ID NO: 6609154 - DNA, 12 bp, Homo sapiens
acatttataatt

SEQ ID NO: 6609155 - DNA, 13 bp, Homo sapiens
acatttataattg

SEQ ID NO: 6609156 - DNA, 19 bp, Homo sapiens
acatttatatatatatgta

SEQ ID NO: 6609157 - DNA, 13 bp, Homo sapiens
acatttatatatt

SEQ ID NO: 6609158 - DNA, 13 bp, Homo sapiens
acatttatatttg

SEQ ID NO: 6609159 - DNA, 23 bp, Homo sapiens
acatttatcaatcagtataattc

SEQ ID NO: 6609160 - DNA, 15 bp, Homo sapiens
acatttatctaaaag

SEQ ID NO: 6609161 - DNA, 16 bp, Homo sapiens
acatttatcttctgtt

SEQ ID NO: 6609162 - DNA, 22 bp, Homo sapiens
acatttatgacaagctgtatca

SEQ ID NO: 6609163 - DNA, 15 bp, Homo sapiens
acatttatgatttaa

SEQ ID NO: 6609164 - DNA, 19 bp, Homo sapiens
acatttatgatttaataaa

SEQ ID NO: 6609165 - DNA, 20 bp, Homo sapiens
acatttatgatttaataaaa

SEQ ID NO: 6609166 - DNA, 15 bp, Homo sapiens
acatttatgtacaaa

SEQ ID NO: 6609167 - DNA, 17 bp, Homo sapiens
acatttatgtacaaaat

SEQ ID NO: 6609168 - DNA, 20 bp, Homo sapiens
acatttatgtacaaaatgaa

SEQ ID NO: 6609169 - DNA, 17 bp, Homo sapiens
acatttatgtgctgtta

SEQ ID NO: 6609170 - DNA, 14 bp, Homo sapiens
acatttatgtgtga

SEQ ID NO: 6609171 - DNA, 15 bp, Homo sapiens
acatttatgttcctt

SEQ ID NO: 6609172 - DNA, 14 bp, Homo sapiens
acatttattctgct

SEQ ID NO: 6609173 - DNA, 18 bp, Homo sapiens
acatttatttattactgt

SEQ ID NO: 6609174 - DNA, 19 bp, Homo sapiens
acatttatttcaaactatt

SEQ ID NO: 6609175 - DNA, 15 bp, Homo sapiens
acatttatttcctcc

SEQ ID NO: 6609176 - DNA, 17 bp, Homo sapiens
acatttattttatgaga

SEQ ID NO: 6609177 - DNA, 15 bp, Homo sapiens
acatttattttcatt

SEQ ID NO: 6609178 - DNA, 16 bp, Homo sapiens
acatttattttgacat

SEQ ID NO: 6609179 - DNA, 22 bp, Homo sapiens
acatttattttttttaaagaaa

SEQ ID NO: 6609180 - DNA, 14 bp, Homo sapiens
acatttcaaaatta

SEQ ID NO: 6609181 - DNA, 16 bp, Homo sapiens
acatttcaaagctgag

SEQ ID NO: 6609182 - DNA, 23 bp, Homo sapiens
acatttcaaggtaaaatgtagct

SEQ ID NO: 6609183 - DNA, 14 bp, Homo sapiens
acatttcaagttta

SEQ ID NO: 6609184 - DNA, 15 bp, Homo sapiens
acatttcaagtttac

SEQ ID NO: 6609185 - DNA, 18 bp, Homo sapiens
acatttcacattgaatca

SEQ ID NO: 6609186 - DNA, 16 bp, Homo sapiens
acatttcaccatggcc

SEQ ID NO: 6609187 - DNA, 16 bp, Homo sapiens
acatttcactaaaagt

SEQ ID NO: 6609188 - DNA, 22 bp, Homo sapiens
acatttcactgtctgtctggtc

SEQ ID NO: 6609189 - DNA, 18 bp, Homo sapiens
acatttcagggagaaact

SEQ ID NO: 6609190 - DNA, 20 bp, Homo sapiens
acatttcataaggcctgccc

SEQ ID NO: 6609191 - DNA, 21 bp, Homo sapiens
acatttcatagcctacatttt

SEQ ID NO: 6609192 - DNA, 16 bp, Homo sapiens
acatttcatctaattt

SEQ ID NO: 6609193 - DNA, 23 bp, Homo sapiens
acatttcattaaccaaagaaagt

SEQ ID NO: 6609194 - DNA, 15 bp, Homo sapiens
acatttcattgtaca

SEQ ID NO: 6609195 - DNA, 16 bp, Homo sapiens
acatttcattgtacaa

SEQ ID NO: 6609196 - DNA, 15 bp, Homo sapiens
acatttcatttatac

SEQ ID NO: 6609197 - DNA, 13 bp, Homo sapiens
acatttccaaatg

SEQ ID NO: 6609198 - DNA, 16 bp, Homo sapiens
acatttccaacttgat

SEQ ID NO: 6609199 - DNA, 13 bp, Homo sapiens
acatttccattta

SEQ ID NO: 6609200 - DNA, 20 bp, Homo sapiens
acatttcccccgagctcttg

SEQ ID NO: 6609201 - DNA, 17 bp, Homo sapiens
acatttcctaaatatat

SEQ ID NO: 6609202 - DNA, 14 bp, Homo sapiens
acatttcctcaggc

SEQ ID NO: 6609203 - DNA, 18 bp, Homo sapiens
acatttcctctctatctt

SEQ ID NO: 6609204 - DNA, 13 bp, Homo sapiens
acatttcctctta

SEQ ID NO: 6609205 - DNA, 15 bp, Homo sapiens
acatttcctcttata

SEQ ID NO: 6609206 - DNA, 22 bp, Homo sapiens
acatttcctttaccctccacac

SEQ ID NO: 6609207 - DNA, 19 bp, Homo sapiens
acatttcctttttctattt

SEQ ID NO: 6609208 - DNA, 20 bp, Homo sapiens
acatttcctttttctatttt

SEQ ID NO: 6609209 - DNA, 14 bp, Homo sapiens
acatttctaacata

SEQ ID NO: 6609210 - DNA, 22 bp, Homo sapiens
acatttctaagactactaaggc

SEQ ID NO: 6609211 - DNA, 23 bp, Homo sapiens
acatttctactatgatcagaaga

SEQ ID NO: 6609212 - DNA, 20 bp, Homo sapiens
acatttctactctagatggc

SEQ ID NO: 6609213 - DNA, 21 bp, Homo sapiens
acatttctactctagatggca

SEQ ID NO: 6609214 - DNA, 12 bp, Homo sapiens
acatttctagaa

SEQ ID NO: 6609215 - DNA, 18 bp, Homo sapiens
acatttctattttgcaaa

SEQ ID NO: 6609216 - DNA, 13 bp, Homo sapiens
acatttctcatgt

SEQ ID NO: 6609217 - DNA, 22 bp, Homo sapiens
acatttctcatgtgctttgtag

SEQ ID NO: 6609218 - DNA, 23 bp, Homo sapiens
acatttctctaagagaacaatgt

SEQ ID NO: 6609219 - DNA, 11 bp, Homo sapiens
acatttctctc

SEQ ID NO: 6609220 - DNA, 20 bp, Homo sapiens
acatttctcttcagtgtgtt

SEQ ID NO: 6609221 - DNA, 20 bp, Homo sapiens
acatttctcttccccttaga

SEQ ID NO: 6609222 - DNA, 22 bp, Homo sapiens
acatttctcttccccttagaaa

SEQ ID NO: 6609223 - DNA, 13 bp, Homo sapiens
acatttctgaatt

SEQ ID NO: 6609224 - DNA, 14 bp, Homo sapiens
acatttctggacag

SEQ ID NO: 6609225 - DNA, 12 bp, Homo sapiens
acatttctggat

SEQ ID NO: 6609226 - DNA, 12 bp, Homo sapiens
acatttctgtat

SEQ ID NO: 6609227 - DNA, 15 bp, Homo sapiens
acatttctgtatact

SEQ ID NO: 6609228 - DNA, 18 bp, Homo sapiens
acatttctgtgaaactat

SEQ ID NO: 6609229 - DNA, 19 bp, Homo sapiens
acatttctgtgaaactatc

SEQ ID NO: 6609230 - DNA, 12 bp, Homo sapiens
acatttctgttc

SEQ ID NO: 6609231 - DNA, 16 bp, Homo sapiens
acatttcttaaaacac

SEQ ID NO: 6609232 - DNA, 18 bp, Homo sapiens
acatttcttaaaacacat

SEQ ID NO: 6609233 - DNA, 18 bp, Homo sapiens
acatttcttaaaacttta

SEQ ID NO: 6609234 - DNA, 23 bp, Homo sapiens
acatttcttagactacatttaga

SEQ ID NO: 6609235 - DNA, 13 bp, Homo sapiens
acatttctttctt

SEQ ID NO: 6609236 - DNA, 18 bp, Homo sapiens
acatttctttgcattcca

SEQ ID NO: 6609237 - DNA, 13 bp, Homo sapiens
acatttctttgga

SEQ ID NO: 6609238 - DNA, 14 bp, Homo sapiens
acatttctttggaa

SEQ ID NO: 6609239 - DNA, 22 bp, Homo sapiens
acatttgaaagaaagtgttaaa

SEQ ID NO: 6609240 - DNA, 15 bp, Homo sapiens
acatttgaaataaag

SEQ ID NO: 6609241 - DNA, 19 bp, Homo sapiens
acatttgaaataaagtaat

SEQ ID NO: 6609242 - DNA, 17 bp, Homo sapiens
acatttgaacagggcaa

SEQ ID NO: 6609243 - DNA, 18 bp, Homo sapiens
acatttgaaggacctaaa

SEQ ID NO: 6609244 - DNA, 17 bp, Homo sapiens
acatttgaataatgtct

SEQ ID NO: 6609245 - DNA, 19 bp, Homo sapiens
acatttgaattcatttgct

SEQ ID NO: 6609246 - DNA, 22 bp, Homo sapiens
acatttgaattcttgatctcta

SEQ ID NO: 6609247 - DNA, 19 bp, Homo sapiens
acatttgacacataaaagt

SEQ ID NO: 6609248 - DNA, 22 bp, Homo sapiens
acatttgacatgagtctccaga

SEQ ID NO: 6609249 - DNA, 15 bp, Homo sapiens
acatttgataatttt

SEQ ID NO: 6609250 - DNA, 19 bp, Homo sapiens
acatttgatagaaaggaac

SEQ ID NO: 6609251 - DNA, 20 bp, Homo sapiens
acatttgatagaaaggaaca

SEQ ID NO: 6609252 - DNA, 12 bp, Homo sapiens
acatttgatatt

SEQ ID NO: 6609253 - DNA, 13 bp, Homo sapiens
acatttgatattt

SEQ ID NO: 6609254 - DNA, 20 bp, Homo sapiens
acatttgatatttttccatt

SEQ ID NO: 6609255 - DNA, 18 bp, Homo sapiens
acatttgatcttgtaaaa

SEQ ID NO: 6609256 - DNA, 17 bp, Homo sapiens
acatttgatgcatgtct

SEQ ID NO: 6609257 - DNA, 20 bp, Homo sapiens
acatttgatgcatgtctttt

SEQ ID NO: 6609258 - DNA, 12 bp, Homo sapiens
acatttgatgta

SEQ ID NO: 6609259 - DNA, 13 bp, Homo sapiens
acatttgatgtac

SEQ ID NO: 6609260 - DNA, 19 bp, Homo sapiens
acatttgatgtacatgtgt

SEQ ID NO: 6609261 - DNA, 18 bp, Homo sapiens
acatttgattaataaaat

SEQ ID NO: 6609262 - DNA, 24 bp, Homo sapiens
acatttgattaataaaatatctat

SEQ ID NO: 6609263 - DNA, 17 bp, Homo sapiens
acatttgcaaaatggaa

SEQ ID NO: 6609264 - DNA, 15 bp, Homo sapiens
acatttgcatgcctt

SEQ ID NO: 6609265 - DNA, 17 bp, Homo sapiens
acatttgccttcagtct

SEQ ID NO: 6609266 - DNA, 17 bp, Homo sapiens
acatttgccttgcagaa

SEQ ID NO: 6609267 - DNA, 20 bp, Homo sapiens
acatttgccttgcagaactg

SEQ ID NO: 6609268 - DNA, 15 bp, Homo sapiens
acatttgctcatgga

SEQ ID NO: 6609269 - DNA, 21 bp, Homo sapiens
acatttgctgaactcagcaca

SEQ ID NO: 6609270 - DNA, 16 bp, Homo sapiens
acatttgctgaatatg

SEQ ID NO: 6609271 - DNA, 19 bp, Homo sapiens
acatttgctgaatatgcaa

SEQ ID NO: 6609272 - DNA, 15 bp, Homo sapiens
acatttgctgccatt

SEQ ID NO: 6609273 - DNA, 22 bp, Homo sapiens
acatttgctgttttaaacatta

SEQ ID NO: 6609274 - DNA, 23 bp, Homo sapiens
acatttgctttttgtgatatgca

SEQ ID NO: 6609275 - DNA, 15 bp, Homo sapiens
acatttggaacagtg

SEQ ID NO: 6609276 - DNA, 23 bp, Homo sapiens
acatttggaacagtgacaataaa

SEQ ID NO: 6609277 - DNA, 14 bp, Homo sapiens
acatttggaatgca

SEQ ID NO: 6609278 - DNA, 18 bp, Homo sapiens
acatttgggactgtcttg

SEQ ID NO: 6609279 - DNA, 21 bp, Homo sapiens
acatttgggagacatgtgaca

SEQ ID NO: 6609280 - DNA, 20 bp, Homo sapiens
acatttgggagtttttatga

SEQ ID NO: 6609281 - DNA, 14 bp, Homo sapiens
acatttgggctcag

SEQ ID NO: 6609282 - DNA, 15 bp, Homo sapiens
acatttgggctcagg

SEQ ID NO: 6609283 - DNA, 23 bp, Homo sapiens
acatttggtggtactttattctt

SEQ ID NO: 6609284 - DNA, 21 bp, Homo sapiens
acatttgtaagtgtaaaaaat

SEQ ID NO: 6609285 - DNA, 13 bp, Homo sapiens
acatttgtacatt

SEQ ID NO: 6609286 - DNA, 16 bp, Homo sapiens
acatttgtacattcct

SEQ ID NO: 6609287 - DNA, 13 bp, Homo sapiens
acatttgtacttt

SEQ ID NO: 6609288 - DNA, 21 bp, Homo sapiens
acatttgtactttatttttgt

SEQ ID NO: 6609289 - DNA, 14 bp, Homo sapiens
acatttgtataaaa

SEQ ID NO: 6609290 - DNA, 19 bp, Homo sapiens
acatttgtataaaataatt

SEQ ID NO: 6609291 - DNA, 15 bp, Homo sapiens
acatttgtatattgt

SEQ ID NO: 6609292 - DNA, 18 bp, Homo sapiens
acatttgtatattgtgga

SEQ ID NO: 6609293 - DNA, 20 bp, Homo sapiens
acatttgtatgttgtgaaga

SEQ ID NO: 6609294 - DNA, 14 bp, Homo sapiens
acatttgtcactga

SEQ ID NO: 6609295 - DNA, 14 bp, Homo sapiens
acatttgtcagtat

SEQ ID NO: 6609296 - DNA, 16 bp, Homo sapiens
acatttgtcattttca

SEQ ID NO: 6609297 - DNA, 18 bp, Homo sapiens
acatttgtcattttcatt

SEQ ID NO: 6609298 - DNA, 15 bp, Homo sapiens
acatttgtgtggaaa

SEQ ID NO: 6609299 - DNA, 17 bp, Homo sapiens
acatttgttaatgattc

SEQ ID NO: 6609300 - DNA, 15 bp, Homo sapiens
acatttgttcctgga

SEQ ID NO: 6609301 - DNA, 16 bp, Homo sapiens
acattttaaaagtgcc

SEQ ID NO: 6609302 - DNA, 18 bp, Homo sapiens
acattttaaaatcaactt

SEQ ID NO: 6609303 - DNA, 16 bp, Homo sapiens
acattttaaacacatt

SEQ ID NO: 6609304 - DNA, 12 bp, Homo sapiens
acattttaaata

SEQ ID NO: 6609305 - DNA, 15 bp, Homo sapiens
acattttaaataaaa

SEQ ID NO: 6609306 - DNA, 18 bp, Homo sapiens
acattttaaatggacaga

SEQ ID NO: 6609307 - DNA, 14 bp, Homo sapiens
acattttaaatgtt

SEQ ID NO: 6609308 - DNA, 13 bp, Homo sapiens
acattttaacaag

SEQ ID NO: 6609309 - DNA, 14 bp, Homo sapiens
acattttaacaaga

SEQ ID NO: 6609310 - DNA, 17 bp, Homo sapiens
acattttaacaagaaga

SEQ ID NO: 6609311 - DNA, 20 bp, Homo sapiens
acattttaacagtacctgtg

SEQ ID NO: 6609312 - DNA, 12 bp, Homo sapiens
acattttaacat

SEQ ID NO: 6609313 - DNA, 16 bp, Homo sapiens
acattttacacactgt

SEQ ID NO: 6609314 - DNA, 18 bp, Homo sapiens
acattttacagattttat

SEQ ID NO: 6609315 - DNA, 12 bp, Homo sapiens
acattttacagt

SEQ ID NO: 6609316 - DNA, 18 bp, Homo sapiens
acattttacattaaattt

SEQ ID NO: 6609317 - DNA, 22 bp, Homo sapiens
acattttactgattaacaaata

SEQ ID NO: 6609318 - DNA, 12 bp, Homo sapiens
acattttactgt

SEQ ID NO: 6609319 - DNA, 13 bp, Homo sapiens
acattttactgtt

SEQ ID NO: 6609320 - DNA, 21 bp, Homo sapiens
acattttacttagctggagaa

SEQ ID NO: 6609321 - DNA, 13 bp, Homo sapiens
acattttaggatc

SEQ ID NO: 6609322 - DNA, 11 bp, Homo sapiens
acattttagtt

SEQ ID NO: 6609323 - DNA, 17 bp, Homo sapiens
acattttagttactgaa

SEQ ID NO: 6609324 - DNA, 15 bp, Homo sapiens
acattttagttcttt

SEQ ID NO: 6609325 - DNA, 16 bp, Homo sapiens
acattttatacaattt

SEQ ID NO: 6609326 - DNA, 18 bp, Homo sapiens
acattttatactgtacat

SEQ ID NO: 6609327 - DNA, 19 bp, Homo sapiens
acattttatactgtacatg

SEQ ID NO: 6609328 - DNA, 21 bp, Homo sapiens
acattttatatttttgtacat

SEQ ID NO: 6609329 - DNA, 14 bp, Homo sapiens
acattttatgagag

SEQ ID NO: 6609330 - DNA, 13 bp, Homo sapiens
acattttattaaa

SEQ ID NO: 6609331 - DNA, 19 bp, Homo sapiens
acattttattttattatgc

SEQ ID NO: 6609332 - DNA, 13 bp, Homo sapiens
acattttcacaca

SEQ ID NO: 6609333 - DNA, 15 bp, Homo sapiens
acattttcacacaat

SEQ ID NO: 6609334 - DNA, 22 bp, Homo sapiens
acattttcagaaatattcatga

SEQ ID NO: 6609335 - DNA, 19 bp, Homo sapiens
acattttcagaagttaaca

SEQ ID NO: 6609336 - DNA, 17 bp, Homo sapiens
acattttcagtaccaaa

SEQ ID NO: 6609337 - DNA, 18 bp, Homo sapiens
acattttcagtaccaaag

SEQ ID NO: 6609338 - DNA, 19 bp, Homo sapiens
acattttcagtaccaaaga

SEQ ID NO: 6609339 - DNA, 12 bp, Homo sapiens
acattttcattt

SEQ ID NO: 6609340 - DNA, 20 bp, Homo sapiens
acattttccacggaaacaga

SEQ ID NO: 6609341 - DNA, 19 bp, Homo sapiens
acattttcgtcctgtagca

SEQ ID NO: 6609342 - DNA, 23 bp, Homo sapiens
acattttcgtcctgtagcacgct

SEQ ID NO: 6609343 - DNA, 19 bp, Homo sapiens
acattttctaaataaaaat

SEQ ID NO: 6609344 - DNA, 18 bp, Homo sapiens
acattttctaagaaacat

SEQ ID NO: 6609345 - DNA, 17 bp, Homo sapiens
acattttctccctggat

SEQ ID NO: 6609346 - DNA, 20 bp, Homo sapiens
acattttctcctaggagaag

SEQ ID NO: 6609347 - DNA, 13 bp, Homo sapiens
acattttctctta

SEQ ID NO: 6609348 - DNA, 16 bp, Homo sapiens
acattttctcttagag

SEQ ID NO: 6609349 - DNA, 17 bp, Homo sapiens
acattttctctttaaaa

SEQ ID NO: 6609350 - DNA, 16 bp, Homo sapiens
acattttctggattct

SEQ ID NO: 6609351 - DNA, 19 bp, Homo sapiens
acattttcttgaaagggga

SEQ ID NO: 6609352 - DNA, 17 bp, Homo sapiens
acattttcttgaatttt

SEQ ID NO: 6609353 - DNA, 20 bp, Homo sapiens
acattttcttttattatcag

SEQ ID NO: 6609354 - DNA, 19 bp, Homo sapiens
acattttgaaataaaaatg

SEQ ID NO: 6609355 - DNA, 13 bp, Homo sapiens
acattttgaagtg

SEQ ID NO: 6609356 - DNA, 15 bp, Homo sapiens
acattttgagaacaa

SEQ ID NO: 6609357 - DNA, 22 bp, Homo sapiens
acattttgagctatttccttcc

SEQ ID NO: 6609358 - DNA, 13 bp, Homo sapiens
acattttgcttgc

SEQ ID NO: 6609359 - DNA, 17 bp, Homo sapiens
acattttggatttcttt

SEQ ID NO: 6609360 - DNA, 16 bp, Homo sapiens
acattttgtaaaatat

SEQ ID NO: 6609361 - DNA, 22 bp, Homo sapiens
acattttgtaaatctgtacttt

SEQ ID NO: 6609362 - DNA, 12 bp, Homo sapiens
acattttgtaca

SEQ ID NO: 6609363 - DNA, 13 bp, Homo sapiens
acattttgtacat

SEQ ID NO: 6609364 - DNA, 14 bp, Homo sapiens
acattttgtacatt

SEQ ID NO: 6609365 - DNA, 16 bp, Homo sapiens
acattttgtagctagt

SEQ ID NO: 6609366 - DNA, 11 bp, Homo sapiens
acattttgtat

SEQ ID NO: 6609367 - DNA, 12 bp, Homo sapiens
acattttgtata

SEQ ID NO: 6609368 - DNA, 13 bp, Homo sapiens
acattttgtataa

SEQ ID NO: 6609369 - DNA, 22 bp, Homo sapiens
acattttgtataccctgaagaa

SEQ ID NO: 6609370 - DNA, 20 bp, Homo sapiens
acattttgtatgctgcatga

SEQ ID NO: 6609371 - DNA, 14 bp, Homo sapiens
acattttgtgcagt

SEQ ID NO: 6609372 - DNA, 14 bp, Homo sapiens
acattttgttctta

SEQ ID NO: 6609373 - DNA, 19 bp, Homo sapiens
acattttgttcttacacat

SEQ ID NO: 6609374 - DNA, 15 bp, Homo sapiens
acattttgttgcagg

SEQ ID NO: 6609375 - DNA, 15 bp, Homo sapiens
acattttgttgtaaa

SEQ ID NO: 6609376 - DNA, 17 bp, Homo sapiens
acattttgtttccaaag

SEQ ID NO: 6609377 - DNA, 21 bp, Homo sapiens
acattttgtttttactgtatg

SEQ ID NO: 6609378 - DNA, 14 bp, Homo sapiens
acatttttaaattg

SEQ ID NO: 6609379 - DNA, 22 bp, Homo sapiens
acatttttaagtgctgcattta

SEQ ID NO: 6609380 - DNA, 17 bp, Homo sapiens
acatttttaatttaaca

SEQ ID NO: 6609381 - DNA, 22 bp, Homo sapiens
acatttttacaaataggtagag

SEQ ID NO: 6609382 - DNA, 21 bp, Homo sapiens
acatttttatacctgtttaaa

SEQ ID NO: 6609383 - DNA, 21 bp, Homo sapiens
acatttttatttagttgaaaa

SEQ ID NO: 6609384 - DNA, 14 bp, Homo sapiens
acatttttcaactt

SEQ ID NO: 6609385 - DNA, 15 bp, Homo sapiens
acatttttcaacttt

SEQ ID NO: 6609386 - DNA, 17 bp, Homo sapiens
acatttttcattcatga

SEQ ID NO: 6609387 - DNA, 21 bp, Homo sapiens
acatttttcattcatgaatat

SEQ ID NO: 6609388 - DNA, 19 bp, Homo sapiens
acatttttccgtttgcttt

SEQ ID NO: 6609389 - DNA, 20 bp, Homo sapiens
acatttttcctctctgcaaa

SEQ ID NO: 6609390 - DNA, 16 bp, Homo sapiens
acatttttctgatggg

SEQ ID NO: 6609391 - DNA, 15 bp, Homo sapiens
acatttttgaataca

SEQ ID NO: 6609392 - DNA, 23 bp, Homo sapiens
acatttttgatcaaatgtacatc

SEQ ID NO: 6609393 - DNA, 14 bp, Homo sapiens
acatttttgggggg

SEQ ID NO: 6609394 - DNA, 19 bp, Homo sapiens
acatttttggggggagaga

SEQ ID NO: 6609395 - DNA, 15 bp, Homo sapiens
acatttttgtaatgc

SEQ ID NO: 6609396 - DNA, 20 bp, Homo sapiens
acatttttgtacattatgtt

SEQ ID NO: 6609397 - DNA, 18 bp, Homo sapiens
acatttttgtatgtgtgt

SEQ ID NO: 6609398 - DNA, 19 bp, Homo sapiens
acatttttgtctgtcctac

SEQ ID NO: 6609399 - DNA, 22 bp, Homo sapiens
acatttttgtctttatctcaag

SEQ ID NO: 6609400 - DNA, 16 bp, Homo sapiens
acatttttgtgccatt

SEQ ID NO: 6609401 - DNA, 18 bp, Homo sapiens
acattttttaaaactgaa

SEQ ID NO: 6609402 - DNA, 20 bp, Homo sapiens
acattttttaagaaaacatt

SEQ ID NO: 6609403 - DNA, 16 bp, Homo sapiens
acattttttaggaaat

SEQ ID NO: 6609404 - DNA, 18 bp, Homo sapiens
acattttttagtctgtaa

SEQ ID NO: 6609405 - DNA, 14 bp, Homo sapiens
acattttttataca

SEQ ID NO: 6609406 - DNA, 16 bp, Homo sapiens
acattttttatacatt

SEQ ID NO: 6609407 - DNA, 17 bp, Homo sapiens
acattttttctaataaa

SEQ ID NO: 6609408 - DNA, 14 bp, Homo sapiens
acattttttcttct

SEQ ID NO: 6609409 - DNA, 20 bp, Homo sapiens
acattttttgaaatgctgaa

SEQ ID NO: 6609410 - DNA, 23 bp, Homo sapiens
acattttttttttcaataaaact

SEQ ID NO: 6609411 - DNA, 19 bp, Homo sapiens
accaaaaaaaaaaaaggaa

SEQ ID NO: 6609412 - DNA, 19 bp, Homo sapiens
accaaaaaaaagcatgaat

SEQ ID NO: 6609413 - DNA, 15 bp, Homo sapiens
accaaaaaaaggaag

SEQ ID NO: 6609414 - DNA, 20 bp, Homo sapiens
accaaaaaaatacttgagct

SEQ ID NO: 6609415 - DNA, 17 bp, Homo sapiens
accaaaaaagtattttt

SEQ ID NO: 6609416 - DNA, 13 bp, Homo sapiens
accaaaaacattt

SEQ ID NO: 6609417 - DNA, 14 bp, Homo sapiens
accaaaaacatttg

SEQ ID NO: 6609418 - DNA, 16 bp, Homo sapiens
accaaaaacatttgat

SEQ ID NO: 6609419 - DNA, 18 bp, Homo sapiens
accaaaaaccaaaagtgc

SEQ ID NO: 6609420 - DNA, 19 bp, Homo sapiens
accaaaaactgaaagtgaa

SEQ ID NO: 6609421 - DNA, 14 bp, Homo sapiens
accaaaaagaaaaa

SEQ ID NO: 6609422 - DNA, 17 bp, Homo sapiens
accaaaaagaccagact

SEQ ID NO: 6609423 - DNA, 19 bp, Homo sapiens
accaaaaatcaacctatca

SEQ ID NO: 6609424 - DNA, 24 bp, Homo sapiens
accaaaacaccccaacttggcagc

SEQ ID NO: 6609425 - DNA, 16 bp, Homo sapiens
accaaaacagttaatc

SEQ ID NO: 6609426 - DNA, 12 bp, Homo sapiens
accaaaacatcc

SEQ ID NO: 6609427 - DNA, 12 bp, Homo sapiens
accaaaacatgt

SEQ ID NO: 6609428 - DNA, 13 bp, Homo sapiens
accaaaactgcct

SEQ ID NO: 6609429 - DNA, 14 bp, Homo sapiens
accaaaacttccaa

SEQ ID NO: 6609430 - DNA, 21 bp, Homo sapiens
accaaaagaagtaaaagcaaa

SEQ ID NO: 6609431 - DNA, 12 bp, Homo sapiens
accaaaagacat

SEQ ID NO: 6609432 - DNA, 12 bp, Homo sapiens
accaaaagctca

SEQ ID NO: 6609433 - DNA, 14 bp, Homo sapiens
accaaaagctcagg

SEQ ID NO: 6609434 - DNA, 19 bp, Homo sapiens
accaaaaggccgtgtgttt

SEQ ID NO: 6609435 - DNA, 13 bp, Homo sapiens
accaaaagggagg

SEQ ID NO: 6609436 - DNA, 16 bp, Homo sapiens
accaaaagtgcattca

SEQ ID NO: 6609437 - DNA, 21 bp, Homo sapiens
accaaaagtgcattcaacctt

SEQ ID NO: 6609438 - DNA, 18 bp, Homo sapiens
accaaaagttattaaaat

SEQ ID NO: 6609439 - DNA, 22 bp, Homo sapiens
accaaaagttattaaaattgtt

SEQ ID NO: 6609440 - DNA, 18 bp, Homo sapiens
accaaaataaaaattgaa

SEQ ID NO: 6609441 - DNA, 22 bp, Homo sapiens
accaaaataaatcatctttatt

SEQ ID NO: 6609442 - DNA, 13 bp, Homo sapiens
accaaaataagaa

SEQ ID NO: 6609443 - DNA, 18 bp, Homo sapiens
accaaaataagaaaagat

SEQ ID NO: 6609444 - DNA, 16 bp, Homo sapiens
accaaaataatacaac

SEQ ID NO: 6609445 - DNA, 17 bp, Homo sapiens
accaaaatatagttaat

SEQ ID NO: 6609446 - DNA, 16 bp, Homo sapiens
accaaaattatttcag

SEQ ID NO: 6609447 - DNA, 21 bp, Homo sapiens
accaaaatttctttttttaaa

SEQ ID NO: 6609448 - DNA, 18 bp, Homo sapiens
accaaaattttaaaaaag

SEQ ID NO: 6609449 - DNA, 12 bp, Homo sapiens
accaaaattttt

SEQ ID NO: 6609450 - DNA, 17 bp, Homo sapiens
accaaacaacttcagaa

SEQ ID NO: 6609451 - DNA, 14 bp, Homo sapiens
accaaacaattatt

SEQ ID NO: 6609452 - DNA, 14 bp, Homo sapiens
accaaacacccaga

SEQ ID NO: 6609453 - DNA, 19 bp, Homo sapiens
accaaacacccagaggtct

SEQ ID NO: 6609454 - DNA, 14 bp, Homo sapiens
accaaacactcagt

SEQ ID NO: 6609455 - DNA, 19 bp, Homo sapiens
accaaacatcccccaatga

SEQ ID NO: 6609456 - DNA, 13 bp, Homo sapiens
accaaacatttct

SEQ ID NO: 6609457 - DNA, 16 bp, Homo sapiens
accaaacatttctgtg

SEQ ID NO: 6609458 - DNA, 22 bp, Homo sapiens
accaaacccaccctttctactt

SEQ ID NO: 6609459 - DNA, 20 bp, Homo sapiens
accaaaccccacttcccctc

SEQ ID NO: 6609460 - DNA, 15 bp, Homo sapiens
accaaactcccatca

SEQ ID NO: 6609461 - DNA, 21 bp, Homo sapiens
accaaactcctatttcaatga

SEQ ID NO: 6609462 - DNA, 18 bp, Homo sapiens
accaaactctgtgtcagc

SEQ ID NO: 6609463 - DNA, 21 bp, Homo sapiens
accaaactgggtcttcagctt

SEQ ID NO: 6609464 - DNA, 18 bp, Homo sapiens
accaaactttatttttct

SEQ ID NO: 6609465 - DNA, 21 bp, Homo sapiens
accaaagaacgtaataaacca

SEQ ID NO: 6609466 - DNA, 12 bp, Homo sapiens
accaaagaagaa

SEQ ID NO: 6609467 - DNA, 13 bp, Homo sapiens
accaaagaagagt

SEQ ID NO: 6609468 - DNA, 16 bp, Homo sapiens
accaaagaagagttta

SEQ ID NO: 6609469 - DNA, 19 bp, Homo sapiens
accaaagaatgcatgttct

SEQ ID NO: 6609470 - DNA, 17 bp, Homo sapiens
accaaagacatcagtct

SEQ ID NO: 6609471 - DNA, 14 bp, Homo sapiens
accaaagactgcag

SEQ ID NO: 6609472 - DNA, 20 bp, Homo sapiens
accaaagacttgttaaatgt

SEQ ID NO: 6609473 - DNA, 18 bp, Homo sapiens
accaaagagacagggccc

SEQ ID NO: 6609474 - DNA, 18 bp, Homo sapiens
accaaagagggcttcctc

SEQ ID NO: 6609475 - DNA, 13 bp, Homo sapiens
accaaagagtatt

SEQ ID NO: 6609476 - DNA, 16 bp, Homo sapiens
accaaagataaggact

SEQ ID NO: 6609477 - DNA, 22 bp, Homo sapiens
accaaagatatatacacaggat

SEQ ID NO: 6609478 - DNA, 18 bp, Homo sapiens
accaaagccacctgctgc

SEQ ID NO: 6609479 - DNA, 19 bp, Homo sapiens
accaaagccacctgctgcg

SEQ ID NO: 6609480 - DNA, 12 bp, Homo sapiens
accaaagctgcc

SEQ ID NO: 6609481 - DNA, 14 bp, Homo sapiens
accaaagctgccca

SEQ ID NO: 6609482 - DNA, 18 bp, Homo sapiens
accaaagctgcccactgt

SEQ ID NO: 6609483 - DNA, 19 bp, Homo sapiens
accaaagctgcccactgtt

SEQ ID NO: 6609484 - DNA, 12 bp, Homo sapiens
accaaagctgtt

SEQ ID NO: 6609485 - DNA, 18 bp, Homo sapiens
accaaagctgtttttata

SEQ ID NO: 6609486 - DNA, 13 bp, Homo sapiens
accaaaggaagga

SEQ ID NO: 6609487 - DNA, 21 bp, Homo sapiens
accaaaggaatcgtttcaaat

SEQ ID NO: 6609488 - DNA, 21 bp, Homo sapiens
accaaagggaaaactcttcat

SEQ ID NO: 6609489 - DNA, 18 bp, Homo sapiens
accaaaggtgaaggaata

SEQ ID NO: 6609490 - DNA, 21 bp, Homo sapiens
accaaaggtgaaggaatatat

SEQ ID NO: 6609491 - DNA, 19 bp, Homo sapiens
accaaagttagttcagtag

SEQ ID NO: 6609492 - DNA, 11 bp, Homo sapiens
accaaagttct

SEQ ID NO: 6609493 - DNA, 21 bp, Homo sapiens
accaaagttctaataatttct

SEQ ID NO: 6609494 - DNA, 20 bp, Homo sapiens
accaaatacaattcaaatgc

SEQ ID NO: 6609495 - DNA, 15 bp, Homo sapiens
accaaatacctcaat

SEQ ID NO: 6609496 - DNA, 17 bp, Homo sapiens
accaaatataaacttgt

SEQ ID NO: 6609497 - DNA, 22 bp, Homo sapiens
accaaatatatgccttactatt

SEQ ID NO: 6609498 - DNA, 16 bp, Homo sapiens
accaaatattaaagat

SEQ ID NO: 6609499 - DNA, 15 bp, Homo sapiens
accaaatattttagc

SEQ ID NO: 6609500 - DNA, 15 bp, Homo sapiens
accaaatcaaaatct

SEQ ID NO: 6609501 - DNA, 20 bp, Homo sapiens
accaaatcaaaatctctcca

SEQ ID NO: 6609502 - DNA, 22 bp, Homo sapiens
accaaatcaaaatctctccact

SEQ ID NO: 6609503 - DNA, 23 bp, Homo sapiens
accaaatcaaaatctctccactt

SEQ ID NO: 6609504 - DNA, 17 bp, Homo sapiens
accaaatcatcctgaat

SEQ ID NO: 6609505 - DNA, 23 bp, Homo sapiens
accaaatctcaaaatatcctaag

SEQ ID NO: 6609506 - DNA, 20 bp, Homo sapiens
accaaatctctcaaatctgt

SEQ ID NO: 6609507 - DNA, 20 bp, Homo sapiens
accaaatgcctctgccttga

SEQ ID NO: 6609508 - DNA, 13 bp, Homo sapiens
accaaatgcttta

SEQ ID NO: 6609509 - DNA, 23 bp, Homo sapiens
accaaatggcacttttgatgaaa

SEQ ID NO: 6609510 - DNA, 13 bp, Homo sapiens
accaaatggtaca

SEQ ID NO: 6609511 - DNA, 23 bp, Homo sapiens
accaaatgtaaaatatttataaa

SEQ ID NO: 6609512 - DNA, 23 bp, Homo sapiens
accaaattaaaaatttttttaag

SEQ ID NO: 6609513 - DNA, 20 bp, Homo sapiens
accaaattacatgaagattt

SEQ ID NO: 6609514 - DNA, 12 bp, Homo sapiens
accaaattctga

SEQ ID NO: 6609515 - DNA, 15 bp, Homo sapiens
accaaattgcactga

SEQ ID NO: 6609516 - DNA, 14 bp, Homo sapiens
accaaattgctgag

SEQ ID NO: 6609517 - DNA, 13 bp, Homo sapiens
accaaattgcttc

SEQ ID NO: 6609518 - DNA, 15 bp, Homo sapiens
accaaattgcttcta

SEQ ID NO: 6609519 - DNA, 13 bp, Homo sapiens
accaaattttaaa

SEQ ID NO: 6609520 - DNA, 13 bp, Homo sapiens
accaaattttaat

SEQ ID NO: 6609521 - DNA, 12 bp, Homo sapiens
accaaattttga

SEQ ID NO: 6609522 - DNA, 21 bp, Homo sapiens
accaaattttgaggtctttta

SEQ ID NO: 6609523 - DNA, 21 bp, Homo sapiens
accaacaactcagaatggggg

SEQ ID NO: 6609524 - DNA, 18 bp, Homo sapiens
accaacaagaaccactcc

SEQ ID NO: 6609525 - DNA, 13 bp, Homo sapiens
accaacaatgtga

SEQ ID NO: 6609526 - DNA, 14 bp, Homo sapiens
accaacacgagcag

SEQ ID NO: 6609527 - DNA, 17 bp, Homo sapiens
accaacactgtaacatt

SEQ ID NO: 6609528 - DNA, 20 bp, Homo sapiens
accaacaggtttatctgaag

SEQ ID NO: 6609529 - DNA, 16 bp, Homo sapiens
accaacagttccttca

SEQ ID NO: 6609530 - DNA, 23 bp, Homo sapiens
accaacataaaaatgatctaaac

SEQ ID NO: 6609531 - DNA, 15 bp, Homo sapiens
accaacataaaacaa

SEQ ID NO: 6609532 - DNA, 16 bp, Homo sapiens
accaacataaaacaaa

SEQ ID NO: 6609533 - DNA, 21 bp, Homo sapiens
accaacataaaacaaaaccaa

SEQ ID NO: 6609534 - DNA, 13 bp, Homo sapiens
accaacatctttg

SEQ ID NO: 6609535 - DNA, 19 bp, Homo sapiens
accaacatgtatctgtcta

SEQ ID NO: 6609536 - DNA, 18 bp, Homo sapiens
accaacattgttcattct

SEQ ID NO: 6609537 - DNA, 20 bp, Homo sapiens
accaaccactgcgaccacaa

SEQ ID NO: 6609538 - DNA, 13 bp, Homo sapiens
accaaccagacag

SEQ ID NO: 6609539 - DNA, 14 bp, Homo sapiens
accaaccagacagc

SEQ ID NO: 6609540 - DNA, 15 bp, Homo sapiens
accaacccactgccc

SEQ ID NO: 6609541 - DNA, 19 bp, Homo sapiens
accaacccagccgctgccc

SEQ ID NO: 6609542 - DNA, 18 bp, Homo sapiens
accaacccatgccctgcc

SEQ ID NO: 6609543 - DNA, 21 bp, Homo sapiens
accaacccccatctccctagc

SEQ ID NO: 6609544 - DNA, 13 bp, Homo sapiens
accaaccctcagg

SEQ ID NO: 6609545 - DNA, 14 bp, Homo sapiens
accaaccctcaggg

SEQ ID NO: 6609546 - DNA, 15 bp, Homo sapiens
accaaccctcagggc

SEQ ID NO: 6609547 - DNA, 16 bp, Homo sapiens
accaaccctcagggca

SEQ ID NO: 6609548 - DNA, 14 bp, Homo sapiens
accaaccctgtggg

SEQ ID NO: 6609549 - DNA, 17 bp, Homo sapiens
accaaccctgtttcctg

SEQ ID NO: 6609550 - DNA, 16 bp, Homo sapiens
accaaccgaacatgac

SEQ ID NO: 6609551 - DNA, 15 bp, Homo sapiens
accaacctcactgcc

SEQ ID NO: 6609552 - DNA, 14 bp, Homo sapiens
accaacctccagac

SEQ ID NO: 6609553 - DNA, 15 bp, Homo sapiens
accaacctccagact

SEQ ID NO: 6609554 - DNA, 15 bp, Homo sapiens
accaacctccccgca

SEQ ID NO: 6609555 - DNA, 22 bp, Homo sapiens
accaacctccccgcagagctcc

SEQ ID NO: 6609556 - DNA, 12 bp, Homo sapiens
accaacctgaaa

SEQ ID NO: 6609557 - DNA, 13 bp, Homo sapiens
accaacctgaaag

SEQ ID NO: 6609558 - DNA, 15 bp, Homo sapiens
accaacctgaaagtt

SEQ ID NO: 6609559 - DNA, 19 bp, Homo sapiens
accaacctgaagacaccgt

SEQ ID NO: 6609560 - DNA, 12 bp, Homo sapiens
accaacctgacc

SEQ ID NO: 6609561 - DNA, 15 bp, Homo sapiens
accaacctggccaac

SEQ ID NO: 6609562 - DNA, 23 bp, Homo sapiens
accaacctgggcaacatagtgag

SEQ ID NO: 6609563 - DNA, 20 bp, Homo sapiens
accaaccttccattcacacc

SEQ ID NO: 6609564 - DNA, 19 bp, Homo sapiens
accaacctttctgacatca

SEQ ID NO: 6609565 - DNA, 23 bp, Homo sapiens
accaacgcgaaaccaattcctca

SEQ ID NO: 6609566 - DNA, 23 bp, Homo sapiens
accaacgggaccccctggccctg

SEQ ID NO: 6609567 - DNA, 14 bp, Homo sapiens
accaacgggtctgt

SEQ ID NO: 6609568 - DNA, 16 bp, Homo sapiens
accaacgggtctgtgg

SEQ ID NO: 6609569 - DNA, 14 bp, Homo sapiens
accaacgtctgtgc

SEQ ID NO: 6609570 - DNA, 21 bp, Homo sapiens
accaacgtctgtgccattttg

SEQ ID NO: 6609571 - DNA, 21 bp, Homo sapiens
accaacgttactcagggctcc

SEQ ID NO: 6609572 - DNA, 21 bp, Homo sapiens
accaactatgcgtaaatcaac

SEQ ID NO: 6609573 - DNA, 23 bp, Homo sapiens
accaactcctagttctagaaaaa

SEQ ID NO: 6609574 - DNA, 15 bp, Homo sapiens
accaactctaatatt

SEQ ID NO: 6609575 - DNA, 22 bp, Homo sapiens
accaactctatactcaatcaag

SEQ ID NO: 6609576 - DNA, 14 bp, Homo sapiens
accaactctctctg

SEQ ID NO: 6609577 - DNA, 15 bp, Homo sapiens
accaactctgcactc

SEQ ID NO: 6609578 - DNA, 18 bp, Homo sapiens
accaactgctctcaaaat

SEQ ID NO: 6609579 - DNA, 13 bp, Homo sapiens
accaactggaagc

SEQ ID NO: 6609580 - DNA, 14 bp, Homo sapiens
accaactggcttct

SEQ ID NO: 6609581 - DNA, 19 bp, Homo sapiens
accaactggcttctgtgca

SEQ ID NO: 6609582 - DNA, 14 bp, Homo sapiens
accaactgggccca

SEQ ID NO: 6609583 - DNA, 13 bp, Homo sapiens
accaactgggcct

SEQ ID NO: 6609584 - DNA, 15 bp, Homo sapiens
accaactgtcactgt

SEQ ID NO: 6609585 - DNA, 16 bp, Homo sapiens
accaactgtgttgtat

SEQ ID NO: 6609586 - DNA, 18 bp, Homo sapiens
accaactgtgttgtatta

SEQ ID NO: 6609587 - DNA, 13 bp, Homo sapiens
accaacttgccac

SEQ ID NO: 6609588 - DNA, 20 bp, Homo sapiens
accaacttgtatccaggcct

SEQ ID NO: 6609589 - DNA, 18 bp, Homo sapiens
accaactttctgtaaact

SEQ ID NO: 6609590 - DNA, 17 bp, Homo sapiens
accaagaaaaccagtgg

SEQ ID NO: 6609591 - DNA, 15 bp, Homo sapiens
accaagaaagctcac

SEQ ID NO: 6609592 - DNA, 12 bp, Homo sapiens
accaagaactgc

SEQ ID NO: 6609593 - DNA, 13 bp, Homo sapiens
accaagaagcaaa

SEQ ID NO: 6609594 - DNA, 24 bp, Homo sapiens
accaagaagcctttcctgtagcct

SEQ ID NO: 6609595 - DNA, 16 bp, Homo sapiens
accaagagattgctaa

SEQ ID NO: 6609596 - DNA, 19 bp, Homo sapiens
accaagagcaatttacctg

SEQ ID NO: 6609597 - DNA, 19 bp, Homo sapiens
accaagagcacattcttaa

SEQ ID NO: 6609598 - DNA, 18 bp, Homo sapiens
accaagagccaaaaatga

SEQ ID NO: 6609599 - DNA, 15 bp, Homo sapiens
accaagaggctggtt

SEQ ID NO: 6609600 - DNA, 19 bp, Homo sapiens
accaagagtagcaccttca

SEQ ID NO: 6609601 - DNA, 21 bp, Homo sapiens
accaagatacttaagtgctgc

SEQ ID NO: 6609602 - DNA, 19 bp, Homo sapiens
accaagatcacaaatagtg

SEQ ID NO: 6609603 - DNA, 16 bp, Homo sapiens
accaagatgatcacat

SEQ ID NO: 6609604 - DNA, 22 bp, Homo sapiens
accaagatgggcacatgaggag

SEQ ID NO: 6609605 - DNA, 12 bp, Homo sapiens
accaagatgtca

SEQ ID NO: 6609606 - DNA, 19 bp, Homo sapiens
accaagattggcctgaggc

SEQ ID NO: 6609607 - DNA, 14 bp, Homo sapiens
accaagatttacca

SEQ ID NO: 6609608 - DNA, 9 bp, Homo sapiens
accaagcag

SEQ ID NO: 6609609 - DNA, 12 bp, Homo sapiens
accaagcagctt

SEQ ID NO: 6609610 - DNA, 20 bp, Homo sapiens
accaagccaccgcagctgct

SEQ ID NO: 6609611 - DNA, 23 bp, Homo sapiens
accaagccaccgcagctgctgcc

SEQ ID NO: 6609612 - DNA, 16 bp, Homo sapiens
accaagccgtggcttc

SEQ ID NO: 6609613 - DNA, 19 bp, Homo sapiens
accaagcctggtcagccca

SEQ ID NO: 6609614 - DNA, 16 bp, Homo sapiens
accaagcgaccaagga

SEQ ID NO: 6609615 - DNA, 20 bp, Homo sapiens
accaagcgtgattcctgctg

SEQ ID NO: 6609616 - DNA, 17 bp, Homo sapiens
accaagctatcctggct

SEQ ID NO: 6609617 - DNA, 14 bp, Homo sapiens
accaagctattcct

SEQ ID NO: 6609618 - DNA, 22 bp, Homo sapiens
accaagctattcctttcccttc

SEQ ID NO: 6609619 - DNA, 17 bp, Homo sapiens
accaagctcacagttcc

SEQ ID NO: 6609620 - DNA, 13 bp, Homo sapiens
accaagctgagca

SEQ ID NO: 6609621 - DNA, 19 bp, Homo sapiens
accaagctgagtttcctat

SEQ ID NO: 6609622 - DNA, 21 bp, Homo sapiens
accaagctgctctccttcact

SEQ ID NO: 6609623 - DNA, 13 bp, Homo sapiens
accaagctgtgcc

SEQ ID NO: 6609624 - DNA, 14 bp, Homo sapiens
accaagctgtgcca

SEQ ID NO: 6609625 - DNA, 18 bp, Homo sapiens
accaagctgtgccaccct

SEQ ID NO: 6609626 - DNA, 19 bp, Homo sapiens
accaagctgtgccaccctg

SEQ ID NO: 6609627 - DNA, 20 bp, Homo sapiens
accaagctgtgccaccctgg

SEQ ID NO: 6609628 - DNA, 23 bp, Homo sapiens
accaagctgtgccaccctgggct

SEQ ID NO: 6609629 - DNA, 23 bp, Homo sapiens
accaagctgttccacttctctag

SEQ ID NO: 6609630 - DNA, 17 bp, Homo sapiens
accaagcttaaggagag

SEQ ID NO: 6609631 - DNA, 21 bp, Homo sapiens
accaagcttaaggagaggaga

SEQ ID NO: 6609632 - DNA, 18 bp, Homo sapiens
accaagcttagaagccac

SEQ ID NO: 6609633 - DNA, 20 bp, Homo sapiens
accaagcttagtcctgggag

SEQ ID NO: 6609634 - DNA, 21 bp, Homo sapiens
accaagcttcaatatttttct

SEQ ID NO: 6609635 - DNA, 14 bp, Homo sapiens
accaagcttcagag

SEQ ID NO: 6609636 - DNA, 15 bp, Homo sapiens
accaagcttcagagc

SEQ ID NO: 6609637 - DNA, 16 bp, Homo sapiens
accaagcttcagagcc

SEQ ID NO: 6609638 - DNA, 23 bp, Homo sapiens
accaagcttcagagcctagccac

SEQ ID NO: 6609639 - DNA, 19 bp, Homo sapiens
accaagcttgtttccctgc

SEQ ID NO: 6609640 - DNA, 21 bp, Homo sapiens
accaaggaaacgctacctctc

SEQ ID NO: 6609641 - DNA, 14 bp, Homo sapiens
accaaggaaggagc

SEQ ID NO: 6609642 - DNA, 16 bp, Homo sapiens
accaaggaatttaaaa

SEQ ID NO: 6609643 - DNA, 19 bp, Homo sapiens
accaaggaatttaaaactg

SEQ ID NO: 6609644 - DNA, 22 bp, Homo sapiens
accaaggacggaaaatgcttaa

SEQ ID NO: 6609645 - DNA, 17 bp, Homo sapiens
accaaggagatgaagca

SEQ ID NO: 6609646 - DNA, 21 bp, Homo sapiens
accaaggcaacggcaccattg

SEQ ID NO: 6609647 - DNA, 22 bp, Homo sapiens
accaaggcaacggcaccattgg

SEQ ID NO: 6609648 - DNA, 17 bp, Homo sapiens
accaaggcaaggcaggt

SEQ ID NO: 6609649 - DNA, 15 bp, Homo sapiens
accaaggcagcctcc

SEQ ID NO: 6609650 - DNA, 15 bp, Homo sapiens
accaaggccctgcat

SEQ ID NO: 6609651 - DNA, 21 bp, Homo sapiens
accaaggctgagacagtgaat

SEQ ID NO: 6609652 - DNA, 19 bp, Homo sapiens
accaaggctgattaaacca

SEQ ID NO: 6609653 - DNA, 20 bp, Homo sapiens
accaaggctgattaaaccaa

SEQ ID NO: 6609654 - DNA, 14 bp, Homo sapiens
accaaggctgcctg

SEQ ID NO: 6609655 - DNA, 17 bp, Homo sapiens
accaaggctttctctac

SEQ ID NO: 6609656 - DNA, 23 bp, Homo sapiens
accaaggctttctctactgattc

SEQ ID NO: 6609657 - DNA, 18 bp, Homo sapiens
accaagggatgggacctg

SEQ ID NO: 6609658 - DNA, 12 bp, Homo sapiens
accaagggcaga

SEQ ID NO: 6609659 - DNA, 20 bp, Homo sapiens
accaagggtacagatcccca

SEQ ID NO: 6609660 - DNA, 18 bp, Homo sapiens
accaagggtatctgctgc

SEQ ID NO: 6609661 - DNA, 24 bp, Homo sapiens
accaaggtggcttctccttggctg

SEQ ID NO: 6609662 - DNA, 17 bp, Homo sapiens
accaagtaaatctatct

SEQ ID NO: 6609663 - DNA, 17 bp, Homo sapiens
accaagtaaatttgtat

SEQ ID NO: 6609664 - DNA, 22 bp, Homo sapiens
accaagtattaaactgtaaatc

SEQ ID NO: 6609665 - DNA, 23 bp, Homo sapiens
accaagtattaaactgtaaatca

SEQ ID NO: 6609666 - DNA, 14 bp, Homo sapiens
accaagtcaggcca

SEQ ID NO: 6609667 - DNA, 17 bp, Homo sapiens
accaagtcaggccaggt

SEQ ID NO: 6609668 - DNA, 17 bp, Homo sapiens
accaagtcctcaaagca

SEQ ID NO: 6609669 - DNA, 13 bp, Homo sapiens
accaagtcctggc

SEQ ID NO: 6609670 - DNA, 23 bp, Homo sapiens
accaagtctaaaaagacctggcc

SEQ ID NO: 6609671 - DNA, 17 bp, Homo sapiens
accaagtctctctaaga

SEQ ID NO: 6609672 - DNA, 21 bp, Homo sapiens
accaagtgcaatatgggcggg

SEQ ID NO: 6609673 - DNA, 20 bp, Homo sapiens
accaagtgccttgagctgcc

SEQ ID NO: 6609674 - DNA, 23 bp, Homo sapiens
accaagtggctgggtgccctctc

SEQ ID NO: 6609675 - DNA, 15 bp, Homo sapiens
accaagtgggctggt

SEQ ID NO: 6609676 - DNA, 15 bp, Homo sapiens
accaagtggtaatga

SEQ ID NO: 6609677 - DNA, 14 bp, Homo sapiens
accaagtgtctaga

SEQ ID NO: 6609678 - DNA, 18 bp, Homo sapiens
accaagtgtgctaaaaat

SEQ ID NO: 6609679 - DNA, 13 bp, Homo sapiens
accaagttatata

SEQ ID NO: 6609680 - DNA, 22 bp, Homo sapiens
accaagttatataaagagaaaa

SEQ ID NO: 6609681 - DNA, 22 bp, Homo sapiens
accaagttgaaaaatagcatat

SEQ ID NO: 6609682 - DNA, 21 bp, Homo sapiens
accaagttggtcttactttgt

SEQ ID NO: 6609683 - DNA, 19 bp, Homo sapiens
accaagttgtttattccaa

SEQ ID NO: 6609684 - DNA, 17 bp, Homo sapiens
accaataaaacaagaat

SEQ ID NO: 6609685 - DNA, 13 bp, Homo sapiens
accaataaactga

SEQ ID NO: 6609686 - DNA, 12 bp, Homo sapiens
accaataaactt

SEQ ID NO: 6609687 - DNA, 11 bp, Homo sapiens
accaataaagg

SEQ ID NO: 6609688 - DNA, 21 bp, Homo sapiens
accaataaaggaggaatcaga

SEQ ID NO: 6609689 - DNA, 12 bp, Homo sapiens
accaataaagtg

SEQ ID NO: 6609690 - DNA, 15 bp, Homo sapiens
accaataaatgtttg

SEQ ID NO: 6609691 - DNA, 15 bp, Homo sapiens
accaataaatttgta

SEQ ID NO: 6609692 - DNA, 18 bp, Homo sapiens
accaataataagagccct

SEQ ID NO: 6609693 - DNA, 15 bp, Homo sapiens
accaatacaaattga

SEQ ID NO: 6609694 - DNA, 12 bp, Homo sapiens
accaatacagaa

SEQ ID NO: 6609695 - DNA, 15 bp, Homo sapiens
accaatacatttgta

SEQ ID NO: 6609696 - DNA, 18 bp, Homo sapiens
accaataccttcaaggct

SEQ ID NO: 6609697 - DNA, 15 bp, Homo sapiens
accaatactactgta

SEQ ID NO: 6609698 - DNA, 22 bp, Homo sapiens
accaatactactgtaaatgtat

SEQ ID NO: 6609699 - DNA, 19 bp, Homo sapiens
accaatagcctgaatttga

SEQ ID NO: 6609700 - DNA, 23 bp, Homo sapiens
accaatagggctgagctctctgt

SEQ ID NO: 6609701 - DNA, 20 bp, Homo sapiens
accaatagtccccatcagca

SEQ ID NO: 6609702 - DNA, 22 bp, Homo sapiens
accaatagttgccaatctaaaa

SEQ ID NO: 6609703 - DNA, 20 bp, Homo sapiens
accaatatcatgtgtagata

SEQ ID NO: 6609704 - DNA, 13 bp, Homo sapiens
accaatatttgta

SEQ ID NO: 6609705 - DNA, 20 bp, Homo sapiens
accaatcaacagcatgtcta

SEQ ID NO: 6609706 - DNA, 19 bp, Homo sapiens
accaatcagagagcctaga

SEQ ID NO: 6609707 - DNA, 13 bp, Homo sapiens
accaatcagcact

SEQ ID NO: 6609708 - DNA, 13 bp, Homo sapiens
accaatcatgaat

SEQ ID NO: 6609709 - DNA, 15 bp, Homo sapiens
accaatcatgaatta

SEQ ID NO: 6609710 - DNA, 12 bp, Homo sapiens
accaatcatttt

SEQ ID NO: 6609711 - DNA, 17 bp, Homo sapiens
accaatcccagggctgg

SEQ ID NO: 6609712 - DNA, 21 bp, Homo sapiens
accaatcccagggctggctct

SEQ ID NO: 6609713 - DNA, 15 bp, Homo sapiens
accaatccccagcct

SEQ ID NO: 6609714 - DNA, 16 bp, Homo sapiens
accaatccccagccta

SEQ ID NO: 6609715 - DNA, 23 bp, Homo sapiens
accaatcccgtgaaagaattatt

SEQ ID NO: 6609716 - DNA, 15 bp, Homo sapiens
accaatcctggcagg

SEQ ID NO: 6609717 - DNA, 18 bp, Homo sapiens
accaatcctgtttttcct

SEQ ID NO: 6609718 - DNA, 15 bp, Homo sapiens
accaatcgcaaagca

SEQ ID NO: 6609719 - DNA, 14 bp, Homo sapiens
accaatctctgctc

SEQ ID NO: 6609720 - DNA, 15 bp, Homo sapiens
accaatctctgctct

SEQ ID NO: 6609721 - DNA, 19 bp, Homo sapiens
accaatctctgctctctat

SEQ ID NO: 6609722 - DNA, 16 bp, Homo sapiens
accaatctctgtgact

SEQ ID NO: 6609723 - DNA, 14 bp, Homo sapiens
accaatctgtgaga

SEQ ID NO: 6609724 - DNA, 23 bp, Homo sapiens
accaatcttactttgtaaattct

SEQ ID NO: 6609725 - DNA, 15 bp, Homo sapiens
accaatcttgtttat

SEQ ID NO: 6609726 - DNA, 19 bp, Homo sapiens
accaatcttgtttatagca

SEQ ID NO: 6609727 - DNA, 14 bp, Homo sapiens
accaatgaaaaaat

SEQ ID NO: 6609728 - DNA, 17 bp, Homo sapiens
accaatgaaaaaatgta

SEQ ID NO: 6609729 - DNA, 22 bp, Homo sapiens
accaatgaaaacatgtactaca

SEQ ID NO: 6609730 - DNA, 16 bp, Homo sapiens
accaatgaaattttga

SEQ ID NO: 6609731 - DNA, 13 bp, Homo sapiens
accaatgagcctt

SEQ ID NO: 6609732 - DNA, 14 bp, Homo sapiens
accaatgcactgag

SEQ ID NO: 6609733 - DNA, 22 bp, Homo sapiens
accaatgcactgagtgaaggaa

SEQ ID NO: 6609734 - DNA, 18 bp, Homo sapiens
accaatgcatgcagccac

SEQ ID NO: 6609735 - DNA, 20 bp, Homo sapiens
accaatgcatgcagccactg

SEQ ID NO: 6609736 - DNA, 13 bp, Homo sapiens
accaatgcccagc

SEQ ID NO: 6609737 - DNA, 22 bp, Homo sapiens
accaatgcccagcaggggaggt

SEQ ID NO: 6609738 - DNA, 21 bp, Homo sapiens
accaatgccgccgtgtttcct

SEQ ID NO: 6609739 - DNA, 13 bp, Homo sapiens
accaatgcctttt

SEQ ID NO: 6609740 - DNA, 16 bp, Homo sapiens
accaatgctgttgtaa

SEQ ID NO: 6609741 - DNA, 14 bp, Homo sapiens
accaatgcttgcat

SEQ ID NO: 6609742 - DNA, 19 bp, Homo sapiens
accaatgcttttatcaaac

SEQ ID NO: 6609743 - DNA, 16 bp, Homo sapiens
accaatggcattatta

SEQ ID NO: 6609744 - DNA, 22 bp, Homo sapiens
accaatggcattattaggtctt

SEQ ID NO: 6609745 - DNA, 23 bp, Homo sapiens
accaatggctgcatcaaatgcat

SEQ ID NO: 6609746 - DNA, 14 bp, Homo sapiens
accaatgtacccac

SEQ ID NO: 6609747 - DNA, 12 bp, Homo sapiens
accaatgtcttg

SEQ ID NO: 6609748 - DNA, 14 bp, Homo sapiens
accaatgtgaagac

SEQ ID NO: 6609749 - DNA, 18 bp, Homo sapiens
accaatgtgaagacacta

SEQ ID NO: 6609750 - DNA, 16 bp, Homo sapiens
accaatgttgtgatta

SEQ ID NO: 6609751 - DNA, 15 bp, Homo sapiens
accaattaagtgttg

SEQ ID NO: 6609752 - DNA, 22 bp, Homo sapiens
accaattaagtgttgaaaaata

SEQ ID NO: 6609753 - DNA, 21 bp, Homo sapiens
accaattataacttattagca

SEQ ID NO: 6609754 - DNA, 23 bp, Homo sapiens
accaattataagggcaaattgga

SEQ ID NO: 6609755 - DNA, 16 bp, Homo sapiens
accaattattttcatc

SEQ ID NO: 6609756 - DNA, 18 bp, Homo sapiens
accaattcaccaacacag

SEQ ID NO: 6609757 - DNA, 13 bp, Homo sapiens
accaattcaccca

SEQ ID NO: 6609758 - DNA, 24 bp, Homo sapiens
accaattgatgttttacgtgcaaa

SEQ ID NO: 6609759 - DNA, 14 bp, Homo sapiens
accaattgccaaag

SEQ ID NO: 6609760 - DNA, 15 bp, Homo sapiens
accaattgccctgcc

SEQ ID NO: 6609761 - DNA, 20 bp, Homo sapiens
accaattgccctgccaggct

SEQ ID NO: 6609762 - DNA, 18 bp, Homo sapiens
accaattgtcaaattacc

SEQ ID NO: 6609763 - DNA, 20 bp, Homo sapiens
accaattgtgagaattactg

SEQ ID NO: 6609764 - DNA, 23 bp, Homo sapiens
accaattgtgagaattactgttt

SEQ ID NO: 6609765 - DNA, 20 bp, Homo sapiens
accaattgtgtcctgaaaat

SEQ ID NO: 6609766 - DNA, 18 bp, Homo sapiens
accaatttacactgccat

SEQ ID NO: 6609767 - DNA, 17 bp, Homo sapiens
accaatttcttccttcc

SEQ ID NO: 6609768 - DNA, 13 bp, Homo sapiens
accaatttgcacc

SEQ ID NO: 6609769 - DNA, 22 bp, Homo sapiens
accaatttggtaaaaatgctgc

SEQ ID NO: 6609770 - DNA, 23 bp, Homo sapiens
accaatttggtaaaaatgctgct

SEQ ID NO: 6609771 - DNA, 17 bp, Homo sapiens
accaatttgttctgtgc

SEQ ID NO: 6609772 - DNA, 18 bp, Homo sapiens
accaattttttgttcttc

SEQ ID NO: 6609773 - DNA, 14 bp, Homo sapiens
accacaaaaatgaa

SEQ ID NO: 6609774 - DNA, 14 bp, Homo sapiens
accacaaaaattga

SEQ ID NO: 6609775 - DNA, 13 bp, Homo sapiens
accacaaacacag

SEQ ID NO: 6609776 - DNA, 14 bp, Homo sapiens
accacaaactgtaa

SEQ ID NO: 6609777 - DNA, 18 bp, Homo sapiens
accacaaactgtaataca

SEQ ID NO: 6609778 - DNA, 22 bp, Homo sapiens
accacaaactgtaatacaatga

SEQ ID NO: 6609779 - DNA, 21 bp, Homo sapiens
accacaaaggccaaactgctg

SEQ ID NO: 6609780 - DNA, 14 bp, Homo sapiens
accacaaatgcata

SEQ ID NO: 6609781 - DNA, 18 bp, Homo sapiens
accacaaccctgttgcta

SEQ ID NO: 6609782 - DNA, 16 bp, Homo sapiens
accacaactgacacag

SEQ ID NO: 6609783 - DNA, 14 bp, Homo sapiens
accacaagactctt

SEQ ID NO: 6609784 - DNA, 13 bp, Homo sapiens
accacaagagctc

SEQ ID NO: 6609785 - DNA, 13 bp, Homo sapiens
accacaagcatct

SEQ ID NO: 6609786 - DNA, 15 bp, Homo sapiens
accacaagcctgaga

SEQ ID NO: 6609787 - DNA, 16 bp, Homo sapiens
accacaagcctgagaa

SEQ ID NO: 6609788 - DNA, 11 bp, Homo sapiens
accacaagtat

SEQ ID NO: 6609789 - DNA, 22 bp, Homo sapiens
accacaagtgaatctttctcct

SEQ ID NO: 6609790 - DNA, 14 bp, Homo sapiens
accacaatgacaga

SEQ ID NO: 6609791 - DNA, 17 bp, Homo sapiens
accacaatgtttcttca

SEQ ID NO: 6609792 - DNA, 18 bp, Homo sapiens
accacaatgtttcttcat

SEQ ID NO: 6609793 - DNA, 21 bp, Homo sapiens
accacaattctccctatcttg

SEQ ID NO: 6609794 - DNA, 23 bp, Homo sapiens
accacacaacatccaagtggcct

SEQ ID NO: 6609795 - DNA, 14 bp, Homo sapiens
accacacacaacag

SEQ ID NO: 6609796 - DNA, 15 bp, Homo sapiens
accacacacaacagc

SEQ ID NO: 6609797 - DNA, 18 bp, Homo sapiens
accacacacaacagccaa

SEQ ID NO: 6609798 - DNA, 13 bp, Homo sapiens
accacacacaccc

SEQ ID NO: 6609799 - DNA, 18 bp, Homo sapiens
accacacacacccttccc

SEQ ID NO: 6609800 - DNA, 19 bp, Homo sapiens
accacacacacctgtctgt

SEQ ID NO: 6609801 - DNA, 22 bp, Homo sapiens
accacacacacctgtctgtgca

SEQ ID NO: 6609802 - DNA, 15 bp, Homo sapiens
accacacacagcctg

SEQ ID NO: 6609803 - DNA, 18 bp, Homo sapiens
accacacacctcaccaga

SEQ ID NO: 6609804 - DNA, 15 bp, Homo sapiens
accacacagcctaca

SEQ ID NO: 6609805 - DNA, 13 bp, Homo sapiens
accacacatccca

SEQ ID NO: 6609806 - DNA, 16 bp, Homo sapiens
accacacatctgtgga

SEQ ID NO: 6609807 - DNA, 13 bp, Homo sapiens
accacaccacagg

SEQ ID NO: 6609808 - DNA, 14 bp, Homo sapiens
accacaccagcctc

SEQ ID NO: 6609809 - DNA, 18 bp, Homo sapiens
accacaccagcctcctgg

SEQ ID NO: 6609810 - DNA, 17 bp, Homo sapiens
accacacccagcctcag

SEQ ID NO: 6609811 - DNA, 16 bp, Homo sapiens
accacacccaggtctc

SEQ ID NO: 6609812 - DNA, 22 bp, Homo sapiens
accacacccgaagtcctgtcac

SEQ ID NO: 6609813 - DNA, 21 bp, Homo sapiens
accacaccctgcctgctgtgg

SEQ ID NO: 6609814 - DNA, 15 bp, Homo sapiens
accacacctaaatta

SEQ ID NO: 6609815 - DNA, 19 bp, Homo sapiens
accacacctggctaatttt

SEQ ID NO: 6609816 - DNA, 14 bp, Homo sapiens
accacacctggctt

SEQ ID NO: 6609817 - DNA, 20 bp, Homo sapiens
accacactcaccccagcctc

SEQ ID NO: 6609818 - DNA, 20 bp, Homo sapiens
accacactccccgcctgtcc

SEQ ID NO: 6609819 - DNA, 21 bp, Homo sapiens
accacactggactccggccct

SEQ ID NO: 6609820 - DNA, 23 bp, Homo sapiens
accacactgggtgcgtctccagt

SEQ ID NO: 6609821 - DNA, 17 bp, Homo sapiens
accacactgttgagttg

SEQ ID NO: 6609822 - DNA, 16 bp, Homo sapiens
accacacttaaaagat

SEQ ID NO: 6609823 - DNA, 13 bp, Homo sapiens
accacacttcctg

SEQ ID NO: 6609824 - DNA, 16 bp, Homo sapiens
accacacttcctgtcc

SEQ ID NO: 6609825 - DNA, 21 bp, Homo sapiens
accacacttcctgtccagaga

SEQ ID NO: 6609826 - DNA, 22 bp, Homo sapiens
accacacttcctgtccagagag

SEQ ID NO: 6609827 - DNA, 22 bp, Homo sapiens
accacagaagcttgtattatca

SEQ ID NO: 6609828 - DNA, 22 bp, Homo sapiens
accacagacacaatatgtatgc

SEQ ID NO: 6609829 - DNA, 17 bp, Homo sapiens
accacagacactcctgg

SEQ ID NO: 6609830 - DNA, 22 bp, Homo sapiens
accacagacatactaaccagca

SEQ ID NO: 6609831 - DNA, 18 bp, Homo sapiens
accacagacgccacctgg

SEQ ID NO: 6609832 - DNA, 14 bp, Homo sapiens
accacagacttgca

SEQ ID NO: 6609833 - DNA, 23 bp, Homo sapiens
accacagacttgcactgaagccg

SEQ ID NO: 6609834 - DNA, 18 bp, Homo sapiens
accacagaggctgtggtc

SEQ ID NO: 6609835 - DNA, 14 bp, Homo sapiens
accacagagttttt

SEQ ID NO: 6609836 - DNA, 21 bp, Homo sapiens
accacagatgtgtctgggaga

SEQ ID NO: 6609837 - DNA, 22 bp, Homo sapiens
accacagatgtgtctgggagag

SEQ ID NO: 6609838 - DNA, 23 bp, Homo sapiens
accacagatttgtgcccattcct

SEQ ID NO: 6609839 - DNA, 15 bp, Homo sapiens
accacagcaactgac

SEQ ID NO: 6609840 - DNA, 18 bp, Homo sapiens
accacagcaactgacctg

SEQ ID NO: 6609841 - DNA, 19 bp, Homo sapiens
accacagcaaggcacctgc

SEQ ID NO: 6609842 - DNA, 13 bp, Homo sapiens
accacagcagaca

SEQ ID NO: 6609843 - DNA, 11 bp, Homo sapiens
accacagcagc

SEQ ID NO: 6609844 - DNA, 21 bp, Homo sapiens
accacagcagcacctcctcca

SEQ ID NO: 6609845 - DNA, 16 bp, Homo sapiens
accacagcagctgaac

SEQ ID NO: 6609846 - DNA, 19 bp, Homo sapiens
accacagcaggtgtcatat

SEQ ID NO: 6609847 - DNA, 23 bp, Homo sapiens
accacagcatcgggagcacccag

SEQ ID NO: 6609848 - DNA, 17 bp, Homo sapiens
accacagccagcacctg

SEQ ID NO: 6609849 - DNA, 13 bp, Homo sapiens
accacagccctgt

SEQ ID NO: 6609850 - DNA, 17 bp, Homo sapiens
accacagccctgtcagt

SEQ ID NO: 6609851 - DNA, 19 bp, Homo sapiens
accacagcctccccttccc

SEQ ID NO: 6609852 - DNA, 21 bp, Homo sapiens
accacagcctccccttcccag

SEQ ID NO: 6609853 - DNA, 22 bp, Homo sapiens
accacagcctccccttcccaga

SEQ ID NO: 6609854 - DNA, 13 bp, Homo sapiens
accacagcgtccc

SEQ ID NO: 6609855 - DNA, 21 bp, Homo sapiens
accacagctccttttccagag

SEQ ID NO: 6609856 - DNA, 14 bp, Homo sapiens
accacagctgcctc

SEQ ID NO: 6609857 - DNA, 15 bp, Homo sapiens
accacagctgcctcc

SEQ ID NO: 6609858 - DNA, 19 bp, Homo sapiens
accacaggaagatgggagg

SEQ ID NO: 6609859 - DNA, 21 bp, Homo sapiens
accacaggcatctacacagcc

SEQ ID NO: 6609860 - DNA, 22 bp, Homo sapiens
accacaggcatctacacagcct

SEQ ID NO: 6609861 - DNA, 16 bp, Homo sapiens
accacaggcccttggg

SEQ ID NO: 6609862 - DNA, 21 bp, Homo sapiens
accacaggccctttcctcagg

SEQ ID NO: 6609863 - DNA, 16 bp, Homo sapiens
accacagggccagagg

SEQ ID NO: 6609864 - DNA, 22 bp, Homo sapiens
accacaggttcatgccaccatg

SEQ ID NO: 6609865 - DNA, 18 bp, Homo sapiens
accacaggttctcactag

SEQ ID NO: 6609866 - DNA, 10 bp, Homo sapiens
accacagtca

SEQ ID NO: 6609867 - DNA, 17 bp, Homo sapiens
accacagtcagtggaga

SEQ ID NO: 6609868 - DNA, 19 bp, Homo sapiens
accacagtcagtggagaga

SEQ ID NO: 6609869 - DNA, 17 bp, Homo sapiens
accacagtccctcacct

SEQ ID NO: 6609870 - DNA, 16 bp, Homo sapiens
accacagtgccaccaa

SEQ ID NO: 6609871 - DNA, 22 bp, Homo sapiens
accacagtgtaccattaaaata

SEQ ID NO: 6609872 - DNA, 20 bp, Homo sapiens
accacagtttcttctgtaaa

SEQ ID NO: 6609873 - DNA, 21 bp, Homo sapiens
accacataatttttgtacatc

SEQ ID NO: 6609874 - DNA, 23 bp, Homo sapiens
accacatagactttatgcaataa

SEQ ID NO: 6609875 - DNA, 18 bp, Homo sapiens
accacatccaccccagcc

SEQ ID NO: 6609876 - DNA, 21 bp, Homo sapiens
accacatcctccgtccagccg

SEQ ID NO: 6609877 - DNA, 20 bp, Homo sapiens
accacatctaagcctgaagg

SEQ ID NO: 6609878 - DNA, 14 bp, Homo sapiens
accacatctacaat

SEQ ID NO: 6609879 - DNA, 18 bp, Homo sapiens
accacatctgccagacct

SEQ ID NO: 6609880 - DNA, 19 bp, Homo sapiens
accacatctgctctaggga

SEQ ID NO: 6609881 - DNA, 14 bp, Homo sapiens
accacatctgtcct

SEQ ID NO: 6609882 - DNA, 16 bp, Homo sapiens
accacatcttgctctg

SEQ ID NO: 6609883 - DNA, 17 bp, Homo sapiens
accacatcttgctctgc

SEQ ID NO: 6609884 - DNA, 19 bp, Homo sapiens
accacatcttgctctgctg

SEQ ID NO: 6609885 - DNA, 15 bp, Homo sapiens
accacatgccactgc

SEQ ID NO: 6609886 - DNA, 19 bp, Homo sapiens
accacatgcgctcctggct

SEQ ID NO: 6609887 - DNA, 21 bp, Homo sapiens
accacatgcgctcctggcttt

SEQ ID NO: 6609888 - DNA, 17 bp, Homo sapiens
accacatgctattgtct

SEQ ID NO: 6609889 - DNA, 19 bp, Homo sapiens
accacatggaacttaaaac

SEQ ID NO: 6609890 - DNA, 18 bp, Homo sapiens
accacatggccttgcctc

SEQ ID NO: 6609891 - DNA, 16 bp, Homo sapiens
accacatgggctgggg

SEQ ID NO: 6609892 - DNA, 20 bp, Homo sapiens
accacatggtccatttcatg

SEQ ID NO: 6609893 - DNA, 15 bp, Homo sapiens
accacattaattaat

SEQ ID NO: 6609894 - DNA, 15 bp, Homo sapiens
accaccaaaaacaaa

SEQ ID NO: 6609895 - DNA, 13 bp, Homo sapiens
accaccaaaatta

SEQ ID NO: 6609896 - DNA, 15 bp, Homo sapiens
accaccaaaattata

SEQ ID NO: 6609897 - DNA, 12 bp, Homo sapiens
accaccaacaca

SEQ ID NO: 6609898 - DNA, 15 bp, Homo sapiens
accaccaacacacag

SEQ ID NO: 6609899 - DNA, 15 bp, Homo sapiens
accaccaacaggcgt

SEQ ID NO: 6609900 - DNA, 16 bp, Homo sapiens
accaccaagccaaggg

SEQ ID NO: 6609901 - DNA, 12 bp, Homo sapiens
accaccaagcct

SEQ ID NO: 6609902 - DNA, 14 bp, Homo sapiens
accaccaagccttg

SEQ ID NO: 6609903 - DNA, 15 bp, Homo sapiens
accaccaagccttga

SEQ ID NO: 6609904 - DNA, 22 bp, Homo sapiens
accaccaagtattaaactgtaa

SEQ ID NO: 6609905 - DNA, 15 bp, Homo sapiens
accaccacacccagc

SEQ ID NO: 6609906 - DNA, 20 bp, Homo sapiens
accaccacacccagcccact

SEQ ID NO: 6609907 - DNA, 16 bp, Homo sapiens
accaccacacccctgc

SEQ ID NO: 6609908 - DNA, 12 bp, Homo sapiens
accaccacccct

SEQ ID NO: 6609909 - DNA, 16 bp, Homo sapiens
accaccacgcctggct

SEQ ID NO: 6609910 - DNA, 23 bp, Homo sapiens
accaccactggccaccaggctgg

SEQ ID NO: 6609911 - DNA, 17 bp, Homo sapiens
accaccactgtgtccca

SEQ ID NO: 6609912 - DNA, 23 bp, Homo sapiens
accaccacttatgcccctagaag

SEQ ID NO: 6609913 - DNA, 21 bp, Homo sapiens
accaccagcgttcccttctcc

SEQ ID NO: 6609914 - DNA, 13 bp, Homo sapiens
accaccagctgtg

SEQ ID NO: 6609915 - DNA, 15 bp, Homo sapiens
accaccagctgtgtc

SEQ ID NO: 6609916 - DNA, 16 bp, Homo sapiens
accaccaggagcagca

SEQ ID NO: 6609917 - DNA, 21 bp, Homo sapiens
accaccagggcatctctgggc

SEQ ID NO: 6609918 - DNA, 22 bp, Homo sapiens
accaccagggcatctctgggct

SEQ ID NO: 6609919 - DNA, 17 bp, Homo sapiens
accaccagggtggacca

SEQ ID NO: 6609920 - DNA, 18 bp, Homo sapiens
accaccagggtggaccag

SEQ ID NO: 6609921 - DNA, 13 bp, Homo sapiens
accaccaggtctc

SEQ ID NO: 6609922 - DNA, 17 bp, Homo sapiens
accaccatccaccgctg

SEQ ID NO: 6609923 - DNA, 19 bp, Homo sapiens
accaccatccaccgctgct

SEQ ID NO: 6609924 - DNA, 21 bp, Homo sapiens
accaccatccaccgctgctcc

SEQ ID NO: 6609925 - DNA, 14 bp, Homo sapiens
accaccatttaatt

SEQ ID NO: 6609926 - DNA, 15 bp, Homo sapiens
accaccatttaattt

SEQ ID NO: 6609927 - DNA, 15 bp, Homo sapiens
accacccacaaagaa

SEQ ID NO: 6609928 - DNA, 13 bp, Homo sapiens
accacccacaatc

SEQ ID NO: 6609929 - DNA, 13 bp, Homo sapiens
accacccacctga

SEQ ID NO: 6609930 - DNA, 12 bp, Homo sapiens
accacccagagc

SEQ ID NO: 6609931 - DNA, 22 bp, Homo sapiens
accaccccagctgctcccctcc

SEQ ID NO: 6609932 - DNA, 14 bp, Homo sapiens
accaccccatctgc

SEQ ID NO: 6609933 - DNA, 18 bp, Homo sapiens
accaccccatctgcattc

SEQ ID NO: 6609934 - DNA, 20 bp, Homo sapiens
accacccccgagcttgcctc

SEQ ID NO: 6609935 - DNA, 16 bp, Homo sapiens
accaccccctgttccc

SEQ ID NO: 6609936 - DNA, 22 bp, Homo sapiens
accaccccgcctgccctcatgg

SEQ ID NO: 6609937 - DNA, 11 bp, Homo sapiens
accacccctcc

SEQ ID NO: 6609938 - DNA, 15 bp, Homo sapiens
accacccctccctct

SEQ ID NO: 6609939 - DNA, 16 bp, Homo sapiens
accacccctccctctg

SEQ ID NO: 6609940 - DNA, 22 bp, Homo sapiens
accacccctgcctccaccctct

SEQ ID NO: 6609941 - DNA, 15 bp, Homo sapiens
accaccccttcctgt

SEQ ID NO: 6609942 - DNA, 17 bp, Homo sapiens
accacccgaaatgccac

SEQ ID NO: 6609943 - DNA, 16 bp, Homo sapiens
accacccgaggggggc

SEQ ID NO: 6609944 - DNA, 23 bp, Homo sapiens
accacccggcattctctgcccac

SEQ ID NO: 6609945 - DNA, 17 bp, Homo sapiens
accacccggtccccact

SEQ ID NO: 6609946 - DNA, 21 bp, Homo sapiens
accaccctagtcccttcccct

SEQ ID NO: 6609947 - DNA, 18 bp, Homo sapiens
accaccctcaggtgcctc

SEQ ID NO: 6609948 - DNA, 19 bp, Homo sapiens
accaccctcaggtgcctcc

SEQ ID NO: 6609949 - DNA, 11 bp, Homo sapiens
accaccctccc

SEQ ID NO: 6609950 - DNA, 15 bp, Homo sapiens
accaccctcccacca

SEQ ID NO: 6609951 - DNA, 23 bp, Homo sapiens
accaccctcccctctcttgcacc

SEQ ID NO: 6609952 - DNA, 21 bp, Homo sapiens
accaccctcgctgccacccac

SEQ ID NO: 6609953 - DNA, 14 bp, Homo sapiens
accaccctctgggg

SEQ ID NO: 6609954 - DNA, 13 bp, Homo sapiens
accaccctgaggc

SEQ ID NO: 6609955 - DNA, 13 bp, Homo sapiens
accaccctgccaa

SEQ ID NO: 6609956 - DNA, 12 bp, Homo sapiens
accaccctgcct

SEQ ID NO: 6609957 - DNA, 17 bp, Homo sapiens
accaccctgcctgtgga

SEQ ID NO: 6609958 - DNA, 14 bp, Homo sapiens
accaccctgctcat

SEQ ID NO: 6609959 - DNA, 13 bp, Homo sapiens
accaccctgtctt

SEQ ID NO: 6609960 - DNA, 15 bp, Homo sapiens
accaccgagctctgt

SEQ ID NO: 6609961 - DNA, 17 bp, Homo sapiens
accaccgagctctgtgg

SEQ ID NO: 6609962 - DNA, 17 bp, Homo sapiens
accaccgcatatgcatg

SEQ ID NO: 6609963 - DNA, 18 bp, Homo sapiens
accaccgcccgtctgtgt

SEQ ID NO: 6609964 - DNA, 15 bp, Homo sapiens
accaccgccctcctc

SEQ ID NO: 6609965 - DNA, 13 bp, Homo sapiens
accaccgctcccc

SEQ ID NO: 6609966 - DNA, 17 bp, Homo sapiens
accaccgctccccagcc

SEQ ID NO: 6609967 - DNA, 15 bp, Homo sapiens
accacctaatgttta

SEQ ID NO: 6609968 - DNA, 16 bp, Homo sapiens
accacctacacaggag

SEQ ID NO: 6609969 - DNA, 13 bp, Homo sapiens
accacctacccct

SEQ ID NO: 6609970 - DNA, 21 bp, Homo sapiens
accacctaggccactcctcca

SEQ ID NO: 6609971 - DNA, 17 bp, Homo sapiens
accacctcaaatttaaa

SEQ ID NO: 6609972 - DNA, 11 bp, Homo sapiens
accacctcagg

SEQ ID NO: 6609973 - DNA, 17 bp, Homo sapiens
accacctcaggtgactt

SEQ ID NO: 6609974 - DNA, 20 bp, Homo sapiens
accacctcaggtgacttttt

SEQ ID NO: 6609975 - DNA, 13 bp, Homo sapiens
accacctccaacc

SEQ ID NO: 6609976 - DNA, 23 bp, Homo sapiens
accacctcctctgccagcaggaa

SEQ ID NO: 6609977 - DNA, 16 bp, Homo sapiens
accacctctctgtctt

SEQ ID NO: 6609978 - DNA, 13 bp, Homo sapiens
accacctctggcc

SEQ ID NO: 6609979 - DNA, 13 bp, Homo sapiens
accacctctgtgg

SEQ ID NO: 6609980 - DNA, 14 bp, Homo sapiens
accacctctgtggc

SEQ ID NO: 6609981 - DNA, 15 bp, Homo sapiens
accacctctgtgggc

SEQ ID NO: 6609982 - DNA, 12 bp, Homo sapiens
accacctgccag

SEQ ID NO: 6609983 - DNA, 13 bp, Homo sapiens
accacctgccagc

SEQ ID NO: 6609984 - DNA, 14 bp, Homo sapiens
accacctgccagcc

SEQ ID NO: 6609985 - DNA, 14 bp, Homo sapiens
accacctgcctcta

SEQ ID NO: 6609986 - DNA, 16 bp, Homo sapiens
accacctgctcactgg

SEQ ID NO: 6609987 - DNA, 23 bp, Homo sapiens
accacctggatggatctgctcca

SEQ ID NO: 6609988 - DNA, 14 bp, Homo sapiens
accaccttaaaaca

SEQ ID NO: 6609989 - DNA, 15 bp, Homo sapiens
accaccttatacatc

SEQ ID NO: 6609990 - DNA, 23 bp, Homo sapiens
accaccttatacatcacttcctg

SEQ ID NO: 6609991 - DNA, 13 bp, Homo sapiens
accaccttcccag

SEQ ID NO: 6609992 - DNA, 16 bp, Homo sapiens
accaccttcccagctc

SEQ ID NO: 6609993 - DNA, 20 bp, Homo sapiens
accaccttcccagctctccc

SEQ ID NO: 6609994 - DNA, 18 bp, Homo sapiens
accaccttccctctttct

SEQ ID NO: 6609995 - DNA, 23 bp, Homo sapiens
accaccttctgtccccagccctg

SEQ ID NO: 6609996 - DNA, 20 bp, Homo sapiens
accaccttgccaatggtgta

SEQ ID NO: 6609997 - DNA, 22 bp, Homo sapiens
accaccttggactcctcccaca

SEQ ID NO: 6609998 - DNA, 14 bp, Homo sapiens
accacctttactgt

SEQ ID NO: 6609999 - DNA, 15 bp, Homo sapiens
accacctttggctgg

SEQ ID NO: 6610000 - DNA, 16 bp, Homo sapiens
accacctttgtctctg

SEQ ID NO: 6610001 - DNA, 20 bp, Homo sapiens
accacctttgtttctccccc

SEQ ID NO: 6610002 - DNA, 24 bp, Homo sapiens
accacgactggccagggccacgct

SEQ ID NO: 6610003 - DNA, 15 bp, Homo sapiens
accacgaggctgccc

SEQ ID NO: 6610004 - DNA, 19 bp, Homo sapiens
accacgatgacgcctctgg

SEQ ID NO: 6610005 - DNA, 20 bp, Homo sapiens
accacgatgacgcctctgga

SEQ ID NO: 6610006 - DNA, 22 bp, Homo sapiens
accacgatgtggccctggcctg

SEQ ID NO: 6610007 - DNA, 23 bp, Homo sapiens
accacgattccaacccaggtctg

SEQ ID NO: 6610008 - DNA, 14 bp, Homo sapiens
accacgcagccgcc

SEQ ID NO: 6610009 - DNA, 13 bp, Homo sapiens
accacgccatgag

SEQ ID NO: 6610010 - DNA, 16 bp, Homo sapiens
accacgcccctgcctg

SEQ ID NO: 6610011 - DNA, 20 bp, Homo sapiens
accacgcccggctaattttt

SEQ ID NO: 6610012 - DNA, 20 bp, Homo sapiens
accacgccgccctccatccg

SEQ ID NO: 6610013 - DNA, 16 bp, Homo sapiens
accacgctggaccttg

SEQ ID NO: 6610014 - DNA, 14 bp, Homo sapiens
accacgctggagct

SEQ ID NO: 6610015 - DNA, 14 bp, Homo sapiens
accacggaaaagag

SEQ ID NO: 6610016 - DNA, 18 bp, Homo sapiens
accacggaaaagagcgca

SEQ ID NO: 6610017 - DNA, 20 bp, Homo sapiens
accacggacgtttccatcag

SEQ ID NO: 6610018 - DNA, 18 bp, Homo sapiens
accacggagggagcgaca

SEQ ID NO: 6610019 - DNA, 18 bp, Homo sapiens
accacggccactggccat

SEQ ID NO: 6610020 - DNA, 17 bp, Homo sapiens
accacgggcctcagttt

SEQ ID NO: 6610021 - DNA, 14 bp, Homo sapiens
accacggtcacacc

SEQ ID NO: 6610022 - DNA, 20 bp, Homo sapiens
accacggtccaatccagcct

SEQ ID NO: 6610023 - DNA, 15 bp, Homo sapiens
accacggtgtggggg

SEQ ID NO: 6610024 - DNA, 18 bp, Homo sapiens
accacggttatttaagca

SEQ ID NO: 6610025 - DNA, 14 bp, Homo sapiens
accacgtccagctg

SEQ ID NO: 6610026 - DNA, 22 bp, Homo sapiens
accacgtcgggcttccctggcc

SEQ ID NO: 6610027 - DNA, 23 bp, Homo sapiens
accacgtctatttcatcagaaca

SEQ ID NO: 6610028 - DNA, 21 bp, Homo sapiens
accacgtctccctggccccag

SEQ ID NO: 6610029 - DNA, 24 bp, Homo sapiens
accacgtctccctggccccagtga

SEQ ID NO: 6610030 - DNA, 15 bp, Homo sapiens
accacgtctgccagg

SEQ ID NO: 6610031 - DNA, 17 bp, Homo sapiens
accacgtctgccaggcc

SEQ ID NO: 6610032 - DNA, 18 bp, Homo sapiens
accacgtctgccaggccc

SEQ ID NO: 6610033 - DNA, 22 bp, Homo sapiens
accacgtctgccaggcccatct

SEQ ID NO: 6610034 - DNA, 17 bp, Homo sapiens
accacgtctggctccct

SEQ ID NO: 6610035 - DNA, 17 bp, Homo sapiens
accacgtctgtcttcac

SEQ ID NO: 6610036 - DNA, 18 bp, Homo sapiens
accacgtctgtcttcaca

SEQ ID NO: 6610037 - DNA, 18 bp, Homo sapiens
accacgtgaaactgctgt

SEQ ID NO: 6610038 - DNA, 19 bp, Homo sapiens
accacgtgaaactgctgtt

SEQ ID NO: 6610039 - DNA, 23 bp, Homo sapiens
accactaaaagatcgcagtttgc

SEQ ID NO: 6610040 - DNA, 22 bp, Homo sapiens
accactaatgcttgccaagaaa

SEQ ID NO: 6610041 - DNA, 23 bp, Homo sapiens
accactaatttgtcactggaacc

SEQ ID NO: 6610042 - DNA, 18 bp, Homo sapiens
accactacactccagcct

SEQ ID NO: 6610043 - DNA, 14 bp, Homo sapiens
accactagagctga

SEQ ID NO: 6610044 - DNA, 16 bp, Homo sapiens
accactagagctgaga

SEQ ID NO: 6610045 - DNA, 19 bp, Homo sapiens
accactagctaagcaagcc

SEQ ID NO: 6610046 - DNA, 17 bp, Homo sapiens
accactaggactctgag

SEQ ID NO: 6610047 - DNA, 19 bp, Homo sapiens
accactagttgcttacaaa

SEQ ID NO: 6610048 - DNA, 20 bp, Homo sapiens
accactagttgcttacaaaa

SEQ ID NO: 6610049 - DNA, 14 bp, Homo sapiens
accactatttaagt

SEQ ID NO: 6610050 - DNA, 14 bp, Homo sapiens
accactcagagaca

SEQ ID NO: 6610051 - DNA, 14 bp, Homo sapiens
accactcagcccct

SEQ ID NO: 6610052 - DNA, 18 bp, Homo sapiens
accactccccaacccctc

SEQ ID NO: 6610053 - DNA, 21 bp, Homo sapiens
accactccccaacccctctcc

SEQ ID NO: 6610054 - DNA, 13 bp, Homo sapiens
accactcctcagg

SEQ ID NO: 6610055 - DNA, 22 bp, Homo sapiens
accactcctgaatgagacttaa

SEQ ID NO: 6610056 - DNA, 11 bp, Homo sapiens
accactcctgc

SEQ ID NO: 6610057 - DNA, 12 bp, Homo sapiens
accactcctgcc

SEQ ID NO: 6610058 - DNA, 13 bp, Homo sapiens
accactcctgcca

SEQ ID NO: 6610059 - DNA, 14 bp, Homo sapiens
accactcctgccag

SEQ ID NO: 6610060 - DNA, 17 bp, Homo sapiens
accactcctgccagccc

SEQ ID NO: 6610061 - DNA, 18 bp, Homo sapiens
accactcctgccagcccg

SEQ ID NO: 6610062 - DNA, 19 bp, Homo sapiens
accactcctgccagcccgg

SEQ ID NO: 6610063 - DNA, 14 bp, Homo sapiens
accactcctgcctg

SEQ ID NO: 6610064 - DNA, 22 bp, Homo sapiens
accactcctgtccctgtagctc

SEQ ID NO: 6610065 - DNA, 16 bp, Homo sapiens
accactcgaggcctgc

SEQ ID NO: 6610066 - DNA, 14 bp, Homo sapiens
accactctcaggac

SEQ ID NO: 6610067 - DNA, 12 bp, Homo sapiens
accactctggca

SEQ ID NO: 6610068 - DNA, 13 bp, Homo sapiens
accactctggcag

SEQ ID NO: 6610069 - DNA, 15 bp, Homo sapiens
accactctggcagcc

SEQ ID NO: 6610070 - DNA, 18 bp, Homo sapiens
accactctggcagccaca

SEQ ID NO: 6610071 - DNA, 21 bp, Homo sapiens
accactcttctctccaaggaa

SEQ ID NO: 6610072 - DNA, 22 bp, Homo sapiens
accactcttctttaagccatag

SEQ ID NO: 6610073 - DNA, 15 bp, Homo sapiens
accactgaacagaaa

SEQ ID NO: 6610074 - DNA, 21 bp, Homo sapiens
accactgaagatagaagaaaa

SEQ ID NO: 6610075 - DNA, 15 bp, Homo sapiens
accactgaattcact

SEQ ID NO: 6610076 - DNA, 21 bp, Homo sapiens
accactgaattcactccagtc

SEQ ID NO: 6610077 - DNA, 15 bp, Homo sapiens
accactgagcccttg

SEQ ID NO: 6610078 - DNA, 13 bp, Homo sapiens
accactgagctct

SEQ ID NO: 6610079 - DNA, 16 bp, Homo sapiens
accactgagctctgcc

SEQ ID NO: 6610080 - DNA, 17 bp, Homo sapiens
accactgagctctgcct

SEQ ID NO: 6610081 - DNA, 12 bp, Homo sapiens
accactgatatc

SEQ ID NO: 6610082 - DNA, 21 bp, Homo sapiens
accactgcactccagcctggg

SEQ ID NO: 6610083 - DNA, 19 bp, Homo sapiens
accactgcagaagacagta

SEQ ID NO: 6610084 - DNA, 16 bp, Homo sapiens
accactgccaatgctg

SEQ ID NO: 6610085 - DNA, 20 bp, Homo sapiens
accactgccattacccagtg

SEQ ID NO: 6610086 - DNA, 14 bp, Homo sapiens
accactgccctgcc

SEQ ID NO: 6610087 - DNA, 18 bp, Homo sapiens
accactgccctgcctgcc

SEQ ID NO: 6610088 - DNA, 13 bp, Homo sapiens
accactgcctgac

SEQ ID NO: 6610089 - DNA, 16 bp, Homo sapiens
accactgcctgactgc

SEQ ID NO: 6610090 - DNA, 17 bp, Homo sapiens
accactgctaataaatg

SEQ ID NO: 6610091 - DNA, 20 bp, Homo sapiens
accactgctatgccatttct

SEQ ID NO: 6610092 - DNA, 15 bp, Homo sapiens
accactgctctgatg

SEQ ID NO: 6610093 - DNA, 21 bp, Homo sapiens
accactgctgatattttctct

SEQ ID NO: 6610094 - DNA, 17 bp, Homo sapiens
accactgcttcccactg

SEQ ID NO: 6610095 - DNA, 14 bp, Homo sapiens
accactggaagcag

SEQ ID NO: 6610096 - DNA, 12 bp, Homo sapiens
accactggccac

SEQ ID NO: 6610097 - DNA, 14 bp, Homo sapiens
accactggccacca

SEQ ID NO: 6610098 - DNA, 23 bp, Homo sapiens
accactggcctacccctttctcc

SEQ ID NO: 6610099 - DNA, 23 bp, Homo sapiens
accactgggaaccaagggccctc

SEQ ID NO: 6610100 - DNA, 12 bp, Homo sapiens
accactgggccc

SEQ ID NO: 6610101 - DNA, 14 bp, Homo sapiens
accactgggcccct

SEQ ID NO: 6610102 - DNA, 15 bp, Homo sapiens
accactgggcccctc

SEQ ID NO: 6610103 - DNA, 14 bp, Homo sapiens
accactgggcctgc

SEQ ID NO: 6610104 - DNA, 17 bp, Homo sapiens
accactggtcccagagc

SEQ ID NO: 6610105 - DNA, 16 bp, Homo sapiens
accactggtctgtagg

SEQ ID NO: 6610106 - DNA, 19 bp, Homo sapiens
accactggtgtaaaaaaca

SEQ ID NO: 6610107 - DNA, 20 bp, Homo sapiens
accactggtgtaaaaaacaa

SEQ ID NO: 6610108 - DNA, 13 bp, Homo sapiens
accactgtacata

SEQ ID NO: 6610109 - DNA, 14 bp, Homo sapiens
accactgtacatat

SEQ ID NO: 6610110 - DNA, 19 bp, Homo sapiens
accactgtccctaccactg

SEQ ID NO: 6610111 - DNA, 21 bp, Homo sapiens
accactgtcctggctgctctc

SEQ ID NO: 6610112 - DNA, 21 bp, Homo sapiens
accactgtctgtccctgaact

SEQ ID NO: 6610113 - DNA, 15 bp, Homo sapiens
accactgtcttcttc

SEQ ID NO: 6610114 - DNA, 18 bp, Homo sapiens
accactgtgccactgact

SEQ ID NO: 6610115 - DNA, 20 bp, Homo sapiens
accactgtggaagtccctca

SEQ ID NO: 6610116 - DNA, 23 bp, Homo sapiens
accactgtggaagtccctcagag

SEQ ID NO: 6610117 - DNA, 16 bp, Homo sapiens
accactgtggccttct

SEQ ID NO: 6610118 - DNA, 16 bp, Homo sapiens
accactgtgtatttaa

SEQ ID NO: 6610119 - DNA, 13 bp, Homo sapiens
accactgtgtccc

SEQ ID NO: 6610120 - DNA, 18 bp, Homo sapiens
accactgtgtcccagtgt

SEQ ID NO: 6610121 - DNA, 13 bp, Homo sapiens
accactgtttctt

SEQ ID NO: 6610122 - DNA, 16 bp, Homo sapiens
accactgtttcttgct

SEQ ID NO: 6610123 - DNA, 18 bp, Homo sapiens
accactgtttcttgcttg

SEQ ID NO: 6610124 - DNA, 13 bp, Homo sapiens
accacttaatctt

SEQ ID NO: 6610125 - DNA, 14 bp, Homo sapiens
accacttacctcaa

SEQ ID NO: 6610126 - DNA, 20 bp, Homo sapiens
accacttatttattgttgcc

SEQ ID NO: 6610127 - DNA, 21 bp, Homo sapiens
accacttatttattgttgcct

SEQ ID NO: 6610128 - DNA, 15 bp, Homo sapiens
accacttatttctaa

SEQ ID NO: 6610129 - DNA, 13 bp, Homo sapiens
accacttcagctg

SEQ ID NO: 6610130 - DNA, 17 bp, Homo sapiens
accacttcaggggatgg

SEQ ID NO: 6610131 - DNA, 24 bp, Homo sapiens
accacttcaggggatgggtgtgga

SEQ ID NO: 6610132 - DNA, 15 bp, Homo sapiens
accacttccagagcc

SEQ ID NO: 6610133 - DNA, 14 bp, Homo sapiens
accacttccagggg

SEQ ID NO: 6610134 - DNA, 17 bp, Homo sapiens
accacttccttaacagc

SEQ ID NO: 6610135 - DNA, 15 bp, Homo sapiens
accacttcgcacaca

SEQ ID NO: 6610136 - DNA, 16 bp, Homo sapiens
accacttctccatgct

SEQ ID NO: 6610137 - DNA, 19 bp, Homo sapiens
accacttctctgctgcctc

SEQ ID NO: 6610138 - DNA, 15 bp, Homo sapiens
accacttctgtgggc

SEQ ID NO: 6610139 - DNA, 21 bp, Homo sapiens
accacttgaatttattgatat

SEQ ID NO: 6610140 - DNA, 16 bp, Homo sapiens
accacttgcctggggc

SEQ ID NO: 6610141 - DNA, 13 bp, Homo sapiens
accacttggaaat

SEQ ID NO: 6610142 - DNA, 16 bp, Homo sapiens
accacttggctgctca

SEQ ID NO: 6610143 - DNA, 13 bp, Homo sapiens
accacttgtagat

SEQ ID NO: 6610144 - DNA, 14 bp, Homo sapiens
accacttgtagatt

SEQ ID NO: 6610145 - DNA, 16 bp, Homo sapiens
accacttgtagatttg

SEQ ID NO: 6610146 - DNA, 14 bp, Homo sapiens
accacttgtcacta

SEQ ID NO: 6610147 - DNA, 18 bp, Homo sapiens
accacttgtgttttgcaa

SEQ ID NO: 6610148 - DNA, 23 bp, Homo sapiens
accacttgtgttttgcaagccag

SEQ ID NO: 6610149 - DNA, 21 bp, Homo sapiens
accactttctcaggcttctca

SEQ ID NO: 6610150 - DNA, 13 bp, Homo sapiens
accactttgatat

SEQ ID NO: 6610151 - DNA, 22 bp, Homo sapiens
accacttttctgctgttgcctc

SEQ ID NO: 6610152 - DNA, 13 bp, Homo sapiens
accactttttgca

SEQ ID NO: 6610153 - DNA, 14 bp, Homo sapiens
accactttttgcag

SEQ ID NO: 6610154 - DNA, 16 bp, Homo sapiens
accactttttgcagct

SEQ ID NO: 6610155 - DNA, 18 bp, Homo sapiens
accactttttttaaccat

SEQ ID NO: 6610156 - DNA, 18 bp, Homo sapiens
accagaaaaaataaatgt

SEQ ID NO: 6610157 - DNA, 20 bp, Homo sapiens
accagaaaacaaatcttcaa

SEQ ID NO: 6610158 - DNA, 17 bp, Homo sapiens
accagaaaagcccaagt

SEQ ID NO: 6610159 - DNA, 20 bp, Homo sapiens
accagaaaatttttgtcttt

SEQ ID NO: 6610160 - DNA, 22 bp, Homo sapiens
accagaaacacccctctgtcta

SEQ ID NO: 6610161 - DNA, 16 bp, Homo sapiens
accagaaacagggaca

SEQ ID NO: 6610162 - DNA, 19 bp, Homo sapiens
accagaaacctgggagaga

SEQ ID NO: 6610163 - DNA, 13 bp, Homo sapiens
accagaaagagga

SEQ ID NO: 6610164 - DNA, 14 bp, Homo sapiens
accagaaagctcta

SEQ ID NO: 6610165 - DNA, 19 bp, Homo sapiens
accagaaagctctacattt

SEQ ID NO: 6610166 - DNA, 13 bp, Homo sapiens
accagaacaaggt

SEQ ID NO: 6610167 - DNA, 19 bp, Homo sapiens
accagaacagcatggcccg

SEQ ID NO: 6610168 - DNA, 18 bp, Homo sapiens
accagaacagtatgaatt

SEQ ID NO: 6610169 - DNA, 19 bp, Homo sapiens
accagaaccagtctttcaa

SEQ ID NO: 6610170 - DNA, 16 bp, Homo sapiens
accagaacgcacccca

SEQ ID NO: 6610171 - DNA, 19 bp, Homo sapiens
accagaacgcaccccactg

SEQ ID NO: 6610172 - DNA, 17 bp, Homo sapiens
accagaactttttcctc

SEQ ID NO: 6610173 - DNA, 19 bp, Homo sapiens
accagaactttttcctctc

SEQ ID NO: 6610174 - DNA, 14 bp, Homo sapiens
accagaagaaaaga

SEQ ID NO: 6610175 - DNA, 15 bp, Homo sapiens
accagaagaaaagac

SEQ ID NO: 6610176 - DNA, 15 bp, Homo sapiens
accagaagcaacaga

SEQ ID NO: 6610177 - DNA, 13 bp, Homo sapiens
accagaagcccag

SEQ ID NO: 6610178 - DNA, 16 bp, Homo sapiens
accagaagcccagaat

SEQ ID NO: 6610179 - DNA, 15 bp, Homo sapiens
accagaagccttgga

SEQ ID NO: 6610180 - DNA, 19 bp, Homo sapiens
accagaagctcccccagca

SEQ ID NO: 6610181 - DNA, 20 bp, Homo sapiens
accagaagctgttgggagaa

SEQ ID NO: 6610182 - DNA, 21 bp, Homo sapiens
accagaaggcaatcaagagct

SEQ ID NO: 6610183 - DNA, 22 bp, Homo sapiens
accagaaggcccttaactatca

SEQ ID NO: 6610184 - DNA, 13 bp, Homo sapiens
accagaagggaaa

SEQ ID NO: 6610185 - DNA, 16 bp, Homo sapiens
accagaagggaaacag

SEQ ID NO: 6610186 - DNA, 17 bp, Homo sapiens
accagaagttaaaccat

SEQ ID NO: 6610187 - DNA, 18 bp, Homo sapiens
accagaagtttaaatctt

SEQ ID NO: 6610188 - DNA, 23 bp, Homo sapiens
accagaatcataattttcaagag

SEQ ID NO: 6610189 - DNA, 21 bp, Homo sapiens
accagaatgaggcacatgaca

SEQ ID NO: 6610190 - DNA, 23 bp, Homo sapiens
accagaatgaggcacatgacagt

SEQ ID NO: 6610191 - DNA, 16 bp, Homo sapiens
accagaatgattttga

SEQ ID NO: 6610192 - DNA, 22 bp, Homo sapiens
accagaattagtcctcacagcc

SEQ ID NO: 6610193 - DNA, 21 bp, Homo sapiens
accagacaaaaaaatttaaaa

SEQ ID NO: 6610194 - DNA, 14 bp, Homo sapiens
accagacaagctgt

SEQ ID NO: 6610195 - DNA, 13 bp, Homo sapiens
accagacacaaac

SEQ ID NO: 6610196 - DNA, 15 bp, Homo sapiens
accagacacccagga

SEQ ID NO: 6610197 - DNA, 22 bp, Homo sapiens
accagacaccttgacagggcac

SEQ ID NO: 6610198 - DNA, 22 bp, Homo sapiens
accagaccaaggcagggcccag

SEQ ID NO: 6610199 - DNA, 15 bp, Homo sapiens
accagacccacctgg

SEQ ID NO: 6610200 - DNA, 20 bp, Homo sapiens
accagacctagacctgggcc

SEQ ID NO: 6610201 - DNA, 23 bp, Homo sapiens
accagacctggaagaacaggcct

SEQ ID NO: 6610202 - DNA, 21 bp, Homo sapiens
accagacgccttcctctctgg

SEQ ID NO: 6610203 - DNA, 22 bp, Homo sapiens
accagactagatggacctgcct

SEQ ID NO: 6610204 - DNA, 20 bp, Homo sapiens
accagactcgccaacatggt

SEQ ID NO: 6610205 - DNA, 13 bp, Homo sapiens
accagactgcagg

SEQ ID NO: 6610206 - DNA, 16 bp, Homo sapiens
accagactgcaggttg

SEQ ID NO: 6610207 - DNA, 13 bp, Homo sapiens
accagactgtgga

SEQ ID NO: 6610208 - DNA, 18 bp, Homo sapiens
accagactgtggagaaat

SEQ ID NO: 6610209 - DNA, 13 bp, Homo sapiens
accagactttgag

SEQ ID NO: 6610210 - DNA, 21 bp, Homo sapiens
accagactttggctcccgctt

SEQ ID NO: 6610211 - DNA, 12 bp, Homo sapiens
accagacttttc

SEQ ID NO: 6610212 - DNA, 13 bp, Homo sapiens
accagagaatctt

SEQ ID NO: 6610213 - DNA, 19 bp, Homo sapiens
accagagagagcaaggaag

SEQ ID NO: 6610214 - DNA, 15 bp, Homo sapiens
accagagagagttgt

SEQ ID NO: 6610215 - DNA, 12 bp, Homo sapiens
accagagcaaaa

SEQ ID NO: 6610216 - DNA, 15 bp, Homo sapiens
accagagcactgtat

SEQ ID NO: 6610217 - DNA, 16 bp, Homo sapiens
accagagcactgtata

SEQ ID NO: 6610218 - DNA, 20 bp, Homo sapiens
accagagcactgtatacccc

SEQ ID NO: 6610219 - DNA, 15 bp, Homo sapiens
accagagcagagagc

SEQ ID NO: 6610220 - DNA, 15 bp, Homo sapiens
accagagcagatgca

SEQ ID NO: 6610221 - DNA, 21 bp, Homo sapiens
accagagccagatgcaggaca

SEQ ID NO: 6610222 - DNA, 22 bp, Homo sapiens
accagagccagatgcaggacag

SEQ ID NO: 6610223 - DNA, 23 bp, Homo sapiens
accagagccatggactctacact

SEQ ID NO: 6610224 - DNA, 10 bp, Homo sapiens
accagagccc

SEQ ID NO: 6610225 - DNA, 16 bp, Homo sapiens
accagagcccaccttg

SEQ ID NO: 6610226 - DNA, 17 bp, Homo sapiens
accagagcccaccttgg

SEQ ID NO: 6610227 - DNA, 12 bp, Homo sapiens
accagagcccat

SEQ ID NO: 6610228 - DNA, 20 bp, Homo sapiens
accagagccccacacggagg

SEQ ID NO: 6610229 - DNA, 20 bp, Homo sapiens
accagagccccccacaatga

SEQ ID NO: 6610230 - DNA, 16 bp, Homo sapiens
accagagccgggagga

SEQ ID NO: 6610231 - DNA, 17 bp, Homo sapiens
accagagccgggaggaa

SEQ ID NO: 6610232 - DNA, 21 bp, Homo sapiens
accagagcctatggaaagggt

SEQ ID NO: 6610233 - DNA, 15 bp, Homo sapiens
accagagcctccctc

SEQ ID NO: 6610234 - DNA, 20 bp, Homo sapiens
accagagcctccctcagcca

SEQ ID NO: 6610235 - DNA, 13 bp, Homo sapiens
accagagccttca

SEQ ID NO: 6610236 - DNA, 16 bp, Homo sapiens
accagagccttcaagt

SEQ ID NO: 6610237 - DNA, 19 bp, Homo sapiens
accagagccttcaagtgcc

SEQ ID NO: 6610238 - DNA, 23 bp, Homo sapiens
accagagccttcaagtgccaaac

SEQ ID NO: 6610239 - DNA, 17 bp, Homo sapiens
accagagctctggagcc

SEQ ID NO: 6610240 - DNA, 11 bp, Homo sapiens
accagagctgc

SEQ ID NO: 6610241 - DNA, 14 bp, Homo sapiens
accagagctgccac

SEQ ID NO: 6610242 - DNA, 16 bp, Homo sapiens
accagagctgccacct

SEQ ID NO: 6610243 - DNA, 13 bp, Homo sapiens
accagagctgcct

SEQ ID NO: 6610244 - DNA, 15 bp, Homo sapiens
accagagcttggaga

SEQ ID NO: 6610245 - DNA, 13 bp, Homo sapiens
accagaggaagcc

SEQ ID NO: 6610246 - DNA, 15 bp, Homo sapiens
accagaggaatcact

SEQ ID NO: 6610247 - DNA, 14 bp, Homo sapiens
accagaggagcctt

SEQ ID NO: 6610248 - DNA, 17 bp, Homo sapiens
accagaggagccttttt

SEQ ID NO: 6610249 - DNA, 22 bp, Homo sapiens
accagaggccgaaggtgcctca

SEQ ID NO: 6610250 - DNA, 15 bp, Homo sapiens
accagaggctgcaga

SEQ ID NO: 6610251 - DNA, 17 bp, Homo sapiens
accagagggaacacggc

SEQ ID NO: 6610252 - DNA, 21 bp, Homo sapiens
accagagggatgggagagtca

SEQ ID NO: 6610253 - DNA, 13 bp, Homo sapiens
accagagggcagt

SEQ ID NO: 6610254 - DNA, 16 bp, Homo sapiens
accagagggtgtggct

SEQ ID NO: 6610255 - DNA, 16 bp, Homo sapiens
accagaggtgcttctg

SEQ ID NO: 6610256 - DNA, 12 bp, Homo sapiens
accagaggtggg

SEQ ID NO: 6610257 - DNA, 17 bp, Homo sapiens
accagagtcagcacagg

SEQ ID NO: 6610258 - DNA, 17 bp, Homo sapiens
accagagtctggagctg

SEQ ID NO: 6610259 - DNA, 18 bp, Homo sapiens
accagagtctggagctga

SEQ ID NO: 6610260 - DNA, 22 bp, Homo sapiens
accagagtctgtatttttctaa

SEQ ID NO: 6610261 - DNA, 15 bp, Homo sapiens
accagagtgtatgca

SEQ ID NO: 6610262 - DNA, 20 bp, Homo sapiens
accagataaaattatagatg

SEQ ID NO: 6610263 - DNA, 13 bp, Homo sapiens
accagataacttt

SEQ ID NO: 6610264 - DNA, 21 bp, Homo sapiens
accagataagaatgctggttt

SEQ ID NO: 6610265 - DNA, 14 bp, Homo sapiens
accagatcactcaa

SEQ ID NO: 6610266 - DNA, 13 bp, Homo sapiens
accagatcattgt

SEQ ID NO: 6610267 - DNA, 19 bp, Homo sapiens
accagatccttttccatcc

SEQ ID NO: 6610268 - DNA, 21 bp, Homo sapiens
accagatctgtctccaagacc

SEQ ID NO: 6610269 - DNA, 17 bp, Homo sapiens
accagatctttctcttc

SEQ ID NO: 6610270 - DNA, 21 bp, Homo sapiens
accagatctttctcttccctg

SEQ ID NO: 6610271 - DNA, 22 bp, Homo sapiens
accagatctttctcttccctga

SEQ ID NO: 6610272 - DNA, 24 bp, Homo sapiens
accagatgagaagttaagcagcct

SEQ ID NO: 6610273 - DNA, 17 bp, Homo sapiens
accagatgatgggggag

SEQ ID NO: 6610274 - DNA, 20 bp, Homo sapiens
accagatgctgaaagagaaa

SEQ ID NO: 6610275 - DNA, 16 bp, Homo sapiens
accagatggttgtgta

SEQ ID NO: 6610276 - DNA, 21 bp, Homo sapiens
accagattctatcctcatctt

SEQ ID NO: 6610277 - DNA, 16 bp, Homo sapiens
accagcaaacagctga

SEQ ID NO: 6610278 - DNA, 23 bp, Homo sapiens
accagcaacatctcgagccccct

SEQ ID NO: 6610279 - DNA, 14 bp, Homo sapiens
accagcaacattat

SEQ ID NO: 6610280 - DNA, 16 bp, Homo sapiens
accagcaacttttctc

SEQ ID NO: 6610281 - DNA, 15 bp, Homo sapiens
accagcaagtcccag

SEQ ID NO: 6610282 - DNA, 17 bp, Homo sapiens
accagcaatgccctgcc

SEQ ID NO: 6610283 - DNA, 23 bp, Homo sapiens
accagcaattctctttcttttac

SEQ ID NO: 6610284 - DNA, 14 bp, Homo sapiens
accagcaatttaga

SEQ ID NO: 6610285 - DNA, 14 bp, Homo sapiens
accagcacactccc

SEQ ID NO: 6610286 - DNA, 16 bp, Homo sapiens
accagcacactcccga

SEQ ID NO: 6610287 - DNA, 17 bp, Homo sapiens
accagcacactcccgag

SEQ ID NO: 6610288 - DNA, 13 bp, Homo sapiens
accagcaccttca

SEQ ID NO: 6610289 - DNA, 13 bp, Homo sapiens
accagcactccca

SEQ ID NO: 6610290 - DNA, 14 bp, Homo sapiens
accagcactcccag

SEQ ID NO: 6610291 - DNA, 19 bp, Homo sapiens
accagcactcccagggccc

SEQ ID NO: 6610292 - DNA, 15 bp, Homo sapiens
accagcactgtctca

SEQ ID NO: 6610293 - DNA, 14 bp, Homo sapiens
accagcagaaaagt

SEQ ID NO: 6610294 - DNA, 13 bp, Homo sapiens
accagcagaaatg

SEQ ID NO: 6610295 - DNA, 19 bp, Homo sapiens
accagcagacagagccagg

SEQ ID NO: 6610296 - DNA, 13 bp, Homo sapiens
accagcagcacaa

SEQ ID NO: 6610297 - DNA, 14 bp, Homo sapiens
accagcagcactgg

SEQ ID NO: 6610298 - DNA, 17 bp, Homo sapiens
accagcagcctggaccc

SEQ ID NO: 6610299 - DNA, 13 bp, Homo sapiens
accagcaggctcc

SEQ ID NO: 6610300 - DNA, 14 bp, Homo sapiens
accagcaggctcct

SEQ ID NO: 6610301 - DNA, 15 bp, Homo sapiens
accagcaggctcctc

SEQ ID NO: 6610302 - DNA, 21 bp, Homo sapiens
accagcaggctcctcagccct

SEQ ID NO: 6610303 - DNA, 18 bp, Homo sapiens
accagcaggtgtggtggc

SEQ ID NO: 6610304 - DNA, 23 bp, Homo sapiens
accagcaggtgtggtggctcatg

SEQ ID NO: 6610305 - DNA, 16 bp, Homo sapiens
accagcagtgtttaaa

SEQ ID NO: 6610306 - DNA, 17 bp, Homo sapiens
accagcagtgtttaaaa

SEQ ID NO: 6610307 - DNA, 19 bp, Homo sapiens
accagcataccagttcttg

SEQ ID NO: 6610308 - DNA, 16 bp, Homo sapiens
accagcatccaccttg

SEQ ID NO: 6610309 - DNA, 14 bp, Homo sapiens
accagcatctggaa

SEQ ID NO: 6610310 - DNA, 20 bp, Homo sapiens
accagcatgttaactttatt

SEQ ID NO: 6610311 - DNA, 15 bp, Homo sapiens
accagcattccctac

SEQ ID NO: 6610312 - DNA, 16 bp, Homo sapiens
accagcattccctaca

SEQ ID NO: 6610313 - DNA, 15 bp, Homo sapiens
accagcattttacta

SEQ ID NO: 6610314 - DNA, 19 bp, Homo sapiens
accagcattttactacttg

SEQ ID NO: 6610315 - DNA, 16 bp, Homo sapiens
accagccacacagagc

SEQ ID NO: 6610316 - DNA, 21 bp, Homo sapiens
accagccacagtacatatgta

SEQ ID NO: 6610317 - DNA, 20 bp, Homo sapiens
accagccacgaacagcccgc

SEQ ID NO: 6610318 - DNA, 17 bp, Homo sapiens
accagccagccctggcc

SEQ ID NO: 6610319 - DNA, 14 bp, Homo sapiens
accagccagcctca

SEQ ID NO: 6610320 - DNA, 21 bp, Homo sapiens
accagccagcgtcccttggtg

SEQ ID NO: 6610321 - DNA, 13 bp, Homo sapiens
accagccaggcag

SEQ ID NO: 6610322 - DNA, 22 bp, Homo sapiens
accagccatcatgtgcctggaa

SEQ ID NO: 6610323 - DNA, 21 bp, Homo sapiens
accagcccacgctgactacag

SEQ ID NO: 6610324 - DNA, 15 bp, Homo sapiens
accagcccagaccct

SEQ ID NO: 6610325 - DNA, 14 bp, Homo sapiens
accagcccagcctg

SEQ ID NO: 6610326 - DNA, 21 bp, Homo sapiens
accagcccatcctgaggaaag

SEQ ID NO: 6610327 - DNA, 23 bp, Homo sapiens
accagcccattggccgagctcct

SEQ ID NO: 6610328 - DNA, 16 bp, Homo sapiens
accagccccaccctgt

SEQ ID NO: 6610329 - DNA, 19 bp, Homo sapiens
accagccccagtgcccaca

SEQ ID NO: 6610330 - DNA, 16 bp, Homo sapiens
accagccccatcagaa

SEQ ID NO: 6610331 - DNA, 13 bp, Homo sapiens
accagcccccagg

SEQ ID NO: 6610332 - DNA, 19 bp, Homo sapiens
accagccccccaccccaca

SEQ ID NO: 6610333 - DNA, 23 bp, Homo sapiens
accagccccccaccccacagatc

SEQ ID NO: 6610334 - DNA, 18 bp, Homo sapiens
accagccccccgcgcgcc

SEQ ID NO: 6610335 - DNA, 20 bp, Homo sapiens
accagcccccgccccagagt

SEQ ID NO: 6610336 - DNA, 23 bp, Homo sapiens
accagcccccgccccagagtggc

SEQ ID NO: 6610337 - DNA, 16 bp, Homo sapiens
accagccccctggatg

SEQ ID NO: 6610338 - DNA, 22 bp, Homo sapiens
accagcccctccccagactctc

SEQ ID NO: 6610339 - DNA, 12 bp, Homo sapiens
accagcccctgc

SEQ ID NO: 6610340 - DNA, 22 bp, Homo sapiens
accagcccgcaactctccagcc

SEQ ID NO: 6610341 - DNA, 14 bp, Homo sapiens
accagccctagctg

SEQ ID NO: 6610342 - DNA, 13 bp, Homo sapiens
accagccctccag

SEQ ID NO: 6610343 - DNA, 14 bp, Homo sapiens
accagccctccaga

SEQ ID NO: 6610344 - DNA, 16 bp, Homo sapiens
accagccctccagagc

SEQ ID NO: 6610345 - DNA, 11 bp, Homo sapiens
accagccctga

SEQ ID NO: 6610346 - DNA, 19 bp, Homo sapiens
accagccctgagccatggc

SEQ ID NO: 6610347 - DNA, 13 bp, Homo sapiens
accagcccttccc

SEQ ID NO: 6610348 - DNA, 16 bp, Homo sapiens
accagcccttccctgc

SEQ ID NO: 6610349 - DNA, 22 bp, Homo sapiens
accagcccttgagggagaactt

SEQ ID NO: 6610350 - DNA, 20 bp, Homo sapiens
accagccgaccggccctgcc

SEQ ID NO: 6610351 - DNA, 15 bp, Homo sapiens
accagccgccccagc

SEQ ID NO: 6610352 - DNA, 16 bp, Homo sapiens
accagccgccccagcc

SEQ ID NO: 6610353 - DNA, 15 bp, Homo sapiens
accagccgtatttta

SEQ ID NO: 6610354 - DNA, 16 bp, Homo sapiens
accagccgtattttac

SEQ ID NO: 6610355 - DNA, 21 bp, Homo sapiens
accagcctagcctggctctgc

SEQ ID NO: 6610356 - DNA, 11 bp, Homo sapiens
accagcctcag

SEQ ID NO: 6610357 - DNA, 12 bp, Homo sapiens
accagcctcagc

SEQ ID NO: 6610358 - DNA, 12 bp, Homo sapiens
accagcctcagt

SEQ ID NO: 6610359 - DNA, 15 bp, Homo sapiens
accagcctcagtgca

SEQ ID NO: 6610360 - DNA, 20 bp, Homo sapiens
accagcctccgtatttcaga

SEQ ID NO: 6610361 - DNA, 20 bp, Homo sapiens
accagcctcgccaacatggt

SEQ ID NO: 6610362 - DNA, 13 bp, Homo sapiens
accagcctgagcc

SEQ ID NO: 6610363 - DNA, 11 bp, Homo sapiens
accagcctggg

SEQ ID NO: 6610364 - DNA, 13 bp, Homo sapiens
accagcctgggca

SEQ ID NO: 6610365 - DNA, 18 bp, Homo sapiens
accagcctgggcaacata

SEQ ID NO: 6610366 - DNA, 20 bp, Homo sapiens
accagcctgggcaacatagt

SEQ ID NO: 6610367 - DNA, 14 bp, Homo sapiens
accagcctgggcag

SEQ ID NO: 6610368 - DNA, 13 bp, Homo sapiens
accagcctggggc

SEQ ID NO: 6610369 - DNA, 17 bp, Homo sapiens
accagcctggggccttc

SEQ ID NO: 6610370 - DNA, 23 bp, Homo sapiens
accagcctggggccttcctggct

SEQ ID NO: 6610371 - DNA, 20 bp, Homo sapiens
accagcctggtcaacatagt

SEQ ID NO: 6610372 - DNA, 20 bp, Homo sapiens
accagcctggtcaacatggt

SEQ ID NO: 6610373 - DNA, 23 bp, Homo sapiens
accagcctgtcacccagctcctc

SEQ ID NO: 6610374 - DNA, 15 bp, Homo sapiens
accagccttcggagc

SEQ ID NO: 6610375 - DNA, 12 bp, Homo sapiens
accagccttgct

SEQ ID NO: 6610376 - DNA, 19 bp, Homo sapiens
accagccttgctctcttca

SEQ ID NO: 6610377 - DNA, 20 bp, Homo sapiens
accagccttgctctcttcaa

SEQ ID NO: 6610378 - DNA, 23 bp, Homo sapiens
accagccttggtgccaccaaaag

SEQ ID NO: 6610379 - DNA, 12 bp, Homo sapiens
accagcctttct

SEQ ID NO: 6610380 - DNA, 14 bp, Homo sapiens
accagcctttcttc

SEQ ID NO: 6610381 - DNA, 23 bp, Homo sapiens
accagcctttgggtcctgggcag

SEQ ID NO: 6610382 - DNA, 23 bp, Homo sapiens
accagcgaggaggctccagaggg

SEQ ID NO: 6610383 - DNA, 20 bp, Homo sapiens
accagcgccaaatgttcatc

SEQ ID NO: 6610384 - DNA, 21 bp, Homo sapiens
accagcgcccccactcctcct

SEQ ID NO: 6610385 - DNA, 22 bp, Homo sapiens
accagcgcccccactcctcctc

SEQ ID NO: 6610386 - DNA, 13 bp, Homo sapiens
accagcgcccgct

SEQ ID NO: 6610387 - DNA, 19 bp, Homo sapiens
accagcgcccgctgggctg

SEQ ID NO: 6610388 - DNA, 20 bp, Homo sapiens
accagcgcccgctgggctga

SEQ ID NO: 6610389 - DNA, 17 bp, Homo sapiens
accagcgcccttgcaca

SEQ ID NO: 6610390 - DNA, 16 bp, Homo sapiens
accagcggctgctcaa

SEQ ID NO: 6610391 - DNA, 17 bp, Homo sapiens
accagcgttcccttctc

SEQ ID NO: 6610392 - DNA, 19 bp, Homo sapiens
accagcgttcccttctccc

SEQ ID NO: 6610393 - DNA, 22 bp, Homo sapiens
accagcgttcccttctccccct

SEQ ID NO: 6610394 - DNA, 22 bp, Homo sapiens
accagcgttgggtttgctcatg

SEQ ID NO: 6610395 - DNA, 18 bp, Homo sapiens
accagctagaaagtggca

SEQ ID NO: 6610396 - DNA, 19 bp, Homo sapiens
accagctatctgtcatctc

SEQ ID NO: 6610397 - DNA, 21 bp, Homo sapiens
accagctatctgtcatctctc

SEQ ID NO: 6610398 - DNA, 18 bp, Homo sapiens
accagctattggaacaga

SEQ ID NO: 6610399 - DNA, 14 bp, Homo sapiens
accagctcactccc

SEQ ID NO: 6610400 - DNA, 15 bp, Homo sapiens
accagctcactccct

SEQ ID NO: 6610401 - DNA, 13 bp, Homo sapiens
accagctcagcac

SEQ ID NO: 6610402 - DNA, 14 bp, Homo sapiens
accagctcagcact

SEQ ID NO: 6610403 - DNA, 21 bp, Homo sapiens
accagctcagccccggccact

SEQ ID NO: 6610404 - DNA, 14 bp, Homo sapiens
accagctcaggaca

SEQ ID NO: 6610405 - DNA, 22 bp, Homo sapiens
accagctcaggctactgccact

SEQ ID NO: 6610406 - DNA, 22 bp, Homo sapiens
accagctcaggggacactggcc

SEQ ID NO: 6610407 - DNA, 13 bp, Homo sapiens
accagctcatgtg

SEQ ID NO: 6610408 - DNA, 20 bp, Homo sapiens
accagctccacacattccag

SEQ ID NO: 6610409 - DNA, 15 bp, Homo sapiens
accagctcccagatg

SEQ ID NO: 6610410 - DNA, 13 bp, Homo sapiens
accagctcctcca

SEQ ID NO: 6610411 - DNA, 17 bp, Homo sapiens
accagctcctccagccc

SEQ ID NO: 6610412 - DNA, 21 bp, Homo sapiens
accagctcgtttttcagcacc

SEQ ID NO: 6610413 - DNA, 17 bp, Homo sapiens
accagctctcttcctgt

SEQ ID NO: 6610414 - DNA, 15 bp, Homo sapiens
accagctctgtggcc

SEQ ID NO: 6610415 - DNA, 19 bp, Homo sapiens
accagctctttggtgccag

SEQ ID NO: 6610416 - DNA, 12 bp, Homo sapiens
accagctgaaag

SEQ ID NO: 6610417 - DNA, 20 bp, Homo sapiens
accagctgaaagttgggact

SEQ ID NO: 6610418 - DNA, 12 bp, Homo sapiens
accagctgcaaa

SEQ ID NO: 6610419 - DNA, 16 bp, Homo sapiens
accagctgcaaagtgt

SEQ ID NO: 6610420 - DNA, 22 bp, Homo sapiens
accagctgcaaagtgttttgta

SEQ ID NO: 6610421 - DNA, 11 bp, Homo sapiens
accagctgcag

SEQ ID NO: 6610422 - DNA, 12 bp, Homo sapiens
accagctgcagc

SEQ ID NO: 6610423 - DNA, 16 bp, Homo sapiens
accagctgcctcttct

SEQ ID NO: 6610424 - DNA, 18 bp, Homo sapiens
accagctgcgcttgcttt

SEQ ID NO: 6610425 - DNA, 10 bp, Homo sapiens
accagctgct

SEQ ID NO: 6610426 - DNA, 15 bp, Homo sapiens
accagctgctctgcc

SEQ ID NO: 6610427 - DNA, 17 bp, Homo sapiens
accagctgctctgcccc

SEQ ID NO: 6610428 - DNA, 14 bp, Homo sapiens
accagctgctgctg

SEQ ID NO: 6610429 - DNA, 16 bp, Homo sapiens
accagctgctgtgccc

SEQ ID NO: 6610430 - DNA, 19 bp, Homo sapiens
accagctgctgtgccccac

SEQ ID NO: 6610431 - DNA, 13 bp, Homo sapiens
accagctggcctg

SEQ ID NO: 6610432 - DNA, 15 bp, Homo sapiens
accagctggcctggg

SEQ ID NO: 6610433 - DNA, 22 bp, Homo sapiens
accagctggcgggtgtggagac

SEQ ID NO: 6610434 - DNA, 13 bp, Homo sapiens
accagctggctct

SEQ ID NO: 6610435 - DNA, 15 bp, Homo sapiens
accagctggctctgc

SEQ ID NO: 6610436 - DNA, 20 bp, Homo sapiens
accagctggggcgtggggag

SEQ ID NO: 6610437 - DNA, 16 bp, Homo sapiens
accagctggtatattg

SEQ ID NO: 6610438 - DNA, 24 bp, Homo sapiens
accagcttaagcgttcatatgctc

SEQ ID NO: 6610439 - DNA, 16 bp, Homo sapiens
accagcttagatttta

SEQ ID NO: 6610440 - DNA, 20 bp, Homo sapiens
accagcttcactctctccgt

SEQ ID NO: 6610441 - DNA, 20 bp, Homo sapiens
accagcttccttcagagagc

SEQ ID NO: 6610442 - DNA, 21 bp, Homo sapiens
accagcttccttcagagagca

SEQ ID NO: 6610443 - DNA, 22 bp, Homo sapiens
accagcttccttcagagagcag

SEQ ID NO: 6610444 - DNA, 16 bp, Homo sapiens
accagcttctccaggc

SEQ ID NO: 6610445 - DNA, 21 bp, Homo sapiens
accagcttgttctgggctcag

SEQ ID NO: 6610446 - DNA, 13 bp, Homo sapiens
accagctttattt

SEQ ID NO: 6610447 - DNA, 19 bp, Homo sapiens
accagcttttaaccatctg

SEQ ID NO: 6610448 - DNA, 18 bp, Homo sapiens
accagctttttctctcag

SEQ ID NO: 6610449 - DNA, 21 bp, Homo sapiens
accaggaagaaggcccgggag

SEQ ID NO: 6610450 - DNA, 15 bp, Homo sapiens
accaggaagcacagg

SEQ ID NO: 6610451 - DNA, 19 bp, Homo sapiens
accaggaagcacaggtcca

SEQ ID NO: 6610452 - DNA, 20 bp, Homo sapiens
accaggaagctcggtgagtg

SEQ ID NO: 6610453 - DNA, 16 bp, Homo sapiens
accaggaaggaagagc

SEQ ID NO: 6610454 - DNA, 15 bp, Homo sapiens
accaggaagtgttta

SEQ ID NO: 6610455 - DNA, 20 bp, Homo sapiens
accaggaatgttaaagtcag

SEQ ID NO: 6610456 - DNA, 12 bp, Homo sapiens
accaggacccag

SEQ ID NO: 6610457 - DNA, 15 bp, Homo sapiens
accaggacccaggga

SEQ ID NO: 6610458 - DNA, 15 bp, Homo sapiens
accaggactccctcc

SEQ ID NO: 6610459 - DNA, 22 bp, Homo sapiens
accaggactctgccttccaggc

SEQ ID NO: 6610460 - DNA, 14 bp, Homo sapiens
accaggagaaccac

SEQ ID NO: 6610461 - DNA, 12 bp, Homo sapiens
accaggagacag

SEQ ID NO: 6610462 - DNA, 23 bp, Homo sapiens
accaggagcaaccgtgcagccac

SEQ ID NO: 6610463 - DNA, 13 bp, Homo sapiens
accaggagcagca

SEQ ID NO: 6610464 - DNA, 15 bp, Homo sapiens
accaggagcagcagc

SEQ ID NO: 6610465 - DNA, 19 bp, Homo sapiens
accaggagcagcagccagc

SEQ ID NO: 6610466 - DNA, 20 bp, Homo sapiens
accaggagcagcagccagca

SEQ ID NO: 6610467 - DNA, 18 bp, Homo sapiens
accaggagctagcccagt

SEQ ID NO: 6610468 - DNA, 14 bp, Homo sapiens
accaggagctgctc

SEQ ID NO: 6610469 - DNA, 16 bp, Homo sapiens
accaggagctgctcac

SEQ ID NO: 6610470 - DNA, 19 bp, Homo sapiens
accaggaggattgccttta

SEQ ID NO: 6610471 - DNA, 17 bp, Homo sapiens
accaggagggagagcct

SEQ ID NO: 6610472 - DNA, 15 bp, Homo sapiens
accaggaggggtctg

SEQ ID NO: 6610473 - DNA, 19 bp, Homo sapiens
accaggaggggtctgcctc

SEQ ID NO: 6610474 - DNA, 19 bp, Homo sapiens
accaggagggtaacagaag

SEQ ID NO: 6610475 - DNA, 17 bp, Homo sapiens
accaggagtccctggta

SEQ ID NO: 6610476 - DNA, 14 bp, Homo sapiens
accaggatagagac

SEQ ID NO: 6610477 - DNA, 16 bp, Homo sapiens
accaggatagagactg

SEQ ID NO: 6610478 - DNA, 24 bp, Homo sapiens
accaggatggagcaagctcttccc

SEQ ID NO: 6610479 - DNA, 18 bp, Homo sapiens
accaggatttattttgag

SEQ ID NO: 6610480 - DNA, 14 bp, Homo sapiens
accaggatttctaa

SEQ ID NO: 6610481 - DNA, 15 bp, Homo sapiens
accaggcaaattcac

SEQ ID NO: 6610482 - DNA, 21 bp, Homo sapiens
accaggcaccaaaagaagtaa

SEQ ID NO: 6610483 - DNA, 14 bp, Homo sapiens
accaggcaccccca

SEQ ID NO: 6610484 - DNA, 15 bp, Homo sapiens
accaggcacctcccc

SEQ ID NO: 6610485 - DNA, 23 bp, Homo sapiens
accaggcactaagtctctagcct

SEQ ID NO: 6610486 - DNA, 20 bp, Homo sapiens
accaggcagcctctgggggg

SEQ ID NO: 6610487 - DNA, 11 bp, Homo sapiens
accaggcagct

SEQ ID NO: 6610488 - DNA, 22 bp, Homo sapiens
accaggcagctgagaccagggt

SEQ ID NO: 6610489 - DNA, 23 bp, Homo sapiens
accaggcagctgagaccagggtc

SEQ ID NO: 6610490 - DNA, 11 bp, Homo sapiens
accaggcaggg

SEQ ID NO: 6610491 - DNA, 11 bp, Homo sapiens
accaggccacc

SEQ ID NO: 6610492 - DNA, 17 bp, Homo sapiens
accaggccagctcagga

SEQ ID NO: 6610493 - DNA, 15 bp, Homo sapiens
accaggccattctgc

SEQ ID NO: 6610494 - DNA, 19 bp, Homo sapiens
accaggcccacgaggagca

SEQ ID NO: 6610495 - DNA, 23 bp, Homo sapiens
accaggcccacgaggagcagcag

SEQ ID NO: 6610496 - DNA, 15 bp, Homo sapiens
accaggcccagccag

SEQ ID NO: 6610497 - DNA, 21 bp, Homo sapiens
accaggccccagcctccaggc

SEQ ID NO: 6610498 - DNA, 15 bp, Homo sapiens
accaggcccccctgt

SEQ ID NO: 6610499 - DNA, 12 bp, Homo sapiens
accaggccctgg

SEQ ID NO: 6610500 - DNA, 14 bp, Homo sapiens
accaggccgggctt

SEQ ID NO: 6610501 - DNA, 16 bp, Homo sapiens
accaggccgtcctccc

SEQ ID NO: 6610502 - DNA, 15 bp, Homo sapiens
accaggcctcactgg

SEQ ID NO: 6610503 - DNA, 20 bp, Homo sapiens
accaggcctcactggctcat

SEQ ID NO: 6610504 - DNA, 11 bp, Homo sapiens
accaggcctgg

SEQ ID NO: 6610505 - DNA, 12 bp, Homo sapiens
accaggcctgga

SEQ ID NO: 6610506 - DNA, 13 bp, Homo sapiens
accaggcctggag

SEQ ID NO: 6610507 - DNA, 14 bp, Homo sapiens
accaggcctggagg

SEQ ID NO: 6610508 - DNA, 17 bp, Homo sapiens
accaggcctggagggca

SEQ ID NO: 6610509 - DNA, 15 bp, Homo sapiens
accaggcctggcctc

SEQ ID NO: 6610510 - DNA, 16 bp, Homo sapiens
accaggcctggcctct

SEQ ID NO: 6610511 - DNA, 18 bp, Homo sapiens
accaggcctggcctctgg

SEQ ID NO: 6610512 - DNA, 19 bp, Homo sapiens
accaggcctggcctctggg

SEQ ID NO: 6610513 - DNA, 23 bp, Homo sapiens
accaggcgagagacttgtggcct

SEQ ID NO: 6610514 - DNA, 12 bp, Homo sapiens
accaggctgcag

SEQ ID NO: 6610515 - DNA, 15 bp, Homo sapiens
accaggctgcagcct

SEQ ID NO: 6610516 - DNA, 19 bp, Homo sapiens
accaggctggacaccctct

SEQ ID NO: 6610517 - DNA, 21 bp, Homo sapiens
accaggctggacaccctctgc

SEQ ID NO: 6610518 - DNA, 23 bp, Homo sapiens
accaggctggacaccctctgccg

SEQ ID NO: 6610519 - DNA, 19 bp, Homo sapiens
accaggctggagtgcagtg

SEQ ID NO: 6610520 - DNA, 16 bp, Homo sapiens
accaggctggcgcagc

SEQ ID NO: 6610521 - DNA, 22 bp, Homo sapiens
accaggctggcgcagccaaggc

SEQ ID NO: 6610522 - DNA, 14 bp, Homo sapiens
accaggctgggcat

SEQ ID NO: 6610523 - DNA, 13 bp, Homo sapiens
accaggcttccca

SEQ ID NO: 6610524 - DNA, 19 bp, Homo sapiens
accaggcttgcctgcaggc

SEQ ID NO: 6610525 - DNA, 23 bp, Homo sapiens
accagggaagaagatcaacgcct

SEQ ID NO: 6610526 - DNA, 14 bp, Homo sapiens
accagggacacctc

SEQ ID NO: 6610527 - DNA, 23 bp, Homo sapiens
accagggaccagcccagcctgca

SEQ ID NO: 6610528 - DNA, 17 bp, Homo sapiens
accagggactgcagctg

SEQ ID NO: 6610529 - DNA, 22 bp, Homo sapiens
accagggagcttcctggctctg

SEQ ID NO: 6610530 - DNA, 14 bp, Homo sapiens
accagggaggagag

SEQ ID NO: 6610531 - DNA, 9 bp, Homo sapiens
accagggat

SEQ ID NO: 6610532 - DNA, 21 bp, Homo sapiens
accagggatgatgcaacatcc

SEQ ID NO: 6610533 - DNA, 13 bp, Homo sapiens
accagggatgctg

SEQ ID NO: 6610534 - DNA, 14 bp, Homo sapiens
accagggatgctgg

SEQ ID NO: 6610535 - DNA, 21 bp, Homo sapiens
accagggatgctgggctgggc

SEQ ID NO: 6610536 - DNA, 19 bp, Homo sapiens
accagggattgtttctgtt

SEQ ID NO: 6610537 - DNA, 19 bp, Homo sapiens
accagggcaaggccccttc

SEQ ID NO: 6610538 - DNA, 18 bp, Homo sapiens
accagggcaccaagccca

SEQ ID NO: 6610539 - DNA, 21 bp, Homo sapiens
accagggcatctctgggctgg

SEQ ID NO: 6610540 - DNA, 18 bp, Homo sapiens
accagggcattcgggcca

SEQ ID NO: 6610541 - DNA, 21 bp, Homo sapiens
accagggcattcgggccacag

SEQ ID NO: 6610542 - DNA, 22 bp, Homo sapiens
accagggcattcgggccacagg

SEQ ID NO: 6610543 - DNA, 14 bp, Homo sapiens
accagggccagagc

SEQ ID NO: 6610544 - DNA, 18 bp, Homo sapiens
accagggccagagcagct

SEQ ID NO: 6610545 - DNA, 22 bp, Homo sapiens
accagggccagagcagctccac

SEQ ID NO: 6610546 - DNA, 22 bp, Homo sapiens
accagggcgaacgacaatagct

SEQ ID NO: 6610547 - DNA, 14 bp, Homo sapiens
accagggcgcaagc

SEQ ID NO: 6610548 - DNA, 16 bp, Homo sapiens
accagggcgcaagcct

SEQ ID NO: 6610549 - DNA, 18 bp, Homo sapiens
accagggcgctgggaagg

SEQ ID NO: 6610550 - DNA, 14 bp, Homo sapiens
accagggctcagct

SEQ ID NO: 6610551 - DNA, 12 bp, Homo sapiens
accagggctctg

SEQ ID NO: 6610552 - DNA, 22 bp, Homo sapiens
accagggctctgtattctgcaa

SEQ ID NO: 6610553 - DNA, 15 bp, Homo sapiens
accagggctgctctt

SEQ ID NO: 6610554 - DNA, 16 bp, Homo sapiens
accaggggaggcagtg

SEQ ID NO: 6610555 - DNA, 18 bp, Homo sapiens
accaggggcaggcacagc

SEQ ID NO: 6610556 - DNA, 20 bp, Homo sapiens
accaggggccaacctcaggc

SEQ ID NO: 6610557 - DNA, 23 bp, Homo sapiens
accaggggccaacctcaggctcc

SEQ ID NO: 6610558 - DNA, 21 bp, Homo sapiens
accaggggcccaccctctgcc

SEQ ID NO: 6610559 - DNA, 21 bp, Homo sapiens
accaggggccctacctgggga

SEQ ID NO: 6610560 - DNA, 24 bp, Homo sapiens
accaggggtgatttcagagagggc

SEQ ID NO: 6610561 - DNA, 17 bp, Homo sapiens
accaggggtgcacaata

SEQ ID NO: 6610562 - DNA, 14 bp, Homo sapiens
accaggggtttctc

SEQ ID NO: 6610563 - DNA, 17 bp, Homo sapiens
accaggggtttctcgca

SEQ ID NO: 6610564 - DNA, 19 bp, Homo sapiens
accagggtcccaggaagcc

SEQ ID NO: 6610565 - DNA, 20 bp, Homo sapiens
accagggtccgcaccagctg

SEQ ID NO: 6610566 - DNA, 16 bp, Homo sapiens
accagggtctctcagg

SEQ ID NO: 6610567 - DNA, 17 bp, Homo sapiens
accagggtctctcaggg

SEQ ID NO: 6610568 - DNA, 22 bp, Homo sapiens
accagggtcttacctctctggg

SEQ ID NO: 6610569 - DNA, 20 bp, Homo sapiens
accagggtgagttaaagaga

SEQ ID NO: 6610570 - DNA, 20 bp, Homo sapiens
accagggtgcatggcttggg

SEQ ID NO: 6610571 - DNA, 22 bp, Homo sapiens
accagggtgcatggcttgggga

SEQ ID NO: 6610572 - DNA, 18 bp, Homo sapiens
accagggtggaccaggcc

SEQ ID NO: 6610573 - DNA, 21 bp, Homo sapiens
accagggtggaccaggcctgg

SEQ ID NO: 6610574 - DNA, 14 bp, Homo sapiens
accagggtggccac

SEQ ID NO: 6610575 - DNA, 23 bp, Homo sapiens
accagggtggccacacaggcagg

SEQ ID NO: 6610576 - DNA, 14 bp, Homo sapiens
accagggtttagtt

SEQ ID NO: 6610577 - DNA, 16 bp, Homo sapiens
accaggtatcaaatca

SEQ ID NO: 6610578 - DNA, 17 bp, Homo sapiens
accaggtcaccatcctc

SEQ ID NO: 6610579 - DNA, 16 bp, Homo sapiens
accaggtcactctgac

SEQ ID NO: 6610580 - DNA, 20 bp, Homo sapiens
accaggtcactctgacctta

SEQ ID NO: 6610581 - DNA, 18 bp, Homo sapiens
accaggtccaatgagctt

SEQ ID NO: 6610582 - DNA, 19 bp, Homo sapiens
accaggtccaatgagcttt

SEQ ID NO: 6610583 - DNA, 20 bp, Homo sapiens
accaggtctcctccaccgcc

SEQ ID NO: 6610584 - DNA, 13 bp, Homo sapiens
accaggtctgtgg

SEQ ID NO: 6610585 - DNA, 17 bp, Homo sapiens
accaggtcttgacctga

SEQ ID NO: 6610586 - DNA, 22 bp, Homo sapiens
accaggtcttggagctgagcct

SEQ ID NO: 6610587 - DNA, 21 bp, Homo sapiens
accaggtcttgttcaagcagc

SEQ ID NO: 6610588 - DNA, 23 bp, Homo sapiens
accaggtgcctttcaaatttaga

SEQ ID NO: 6610589 - DNA, 21 bp, Homo sapiens
accaggtgctagggtgcctgc

SEQ ID NO: 6610590 - DNA, 22 bp, Homo sapiens
accaggtgctagggtgcctgct

SEQ ID NO: 6610591 - DNA, 19 bp, Homo sapiens
accaggtgttaaaaaccat

SEQ ID NO: 6610592 - DNA, 21 bp, Homo sapiens
accaggtgttaaaaaccatta

SEQ ID NO: 6610593 - DNA, 19 bp, Homo sapiens
accaggtgttctacactca

SEQ ID NO: 6610594 - DNA, 20 bp, Homo sapiens
accaggtgttctacactcat

SEQ ID NO: 6610595 - DNA, 14 bp, Homo sapiens
accaggttgaaaga

SEQ ID NO: 6610596 - DNA, 15 bp, Homo sapiens
accagtaataaaaag

SEQ ID NO: 6610597 - DNA, 16 bp, Homo sapiens
accagtaataaaaagc

SEQ ID NO: 6610598 - DNA, 18 bp, Homo sapiens
accagtaataaaaagcca

SEQ ID NO: 6610599 - DNA, 19 bp, Homo sapiens
accagtaataaaaagccac

SEQ ID NO: 6610600 - DNA, 17 bp, Homo sapiens
accagtacattctcagt

SEQ ID NO: 6610601 - DNA, 18 bp, Homo sapiens
accagtacattctcagtt

SEQ ID NO: 6610602 - DNA, 17 bp, Homo sapiens
accagtacttctaagag

SEQ ID NO: 6610603 - DNA, 14 bp, Homo sapiens
accagtagcttccc

SEQ ID NO: 6610604 - DNA, 18 bp, Homo sapiens
accagtaggatatttcta

SEQ ID NO: 6610605 - DNA, 20 bp, Homo sapiens
accagtagtcacctctgggc

SEQ ID NO: 6610606 - DNA, 13 bp, Homo sapiens
accagtagtgacc

SEQ ID NO: 6610607 - DNA, 14 bp, Homo sapiens
accagtagtgacca

SEQ ID NO: 6610608 - DNA, 14 bp, Homo sapiens
accagtatggaagg

SEQ ID NO: 6610609 - DNA, 21 bp, Homo sapiens
accagtatggaagggaggggt

SEQ ID NO: 6610610 - DNA, 20 bp, Homo sapiens
accagtattgtacaaagtat

SEQ ID NO: 6610611 - DNA, 23 bp, Homo sapiens
accagtattgtacaaagtattaa

SEQ ID NO: 6610612 - DNA, 18 bp, Homo sapiens
accagtatttaacttctg

SEQ ID NO: 6610613 - DNA, 15 bp, Homo sapiens
accagtatttaagct

SEQ ID NO: 6610614 - DNA, 22 bp, Homo sapiens
accagtatttaagctttaaatg

SEQ ID NO: 6610615 - DNA, 18 bp, Homo sapiens
accagtatttagaagcca

SEQ ID NO: 6610616 - DNA, 16 bp, Homo sapiens
accagtatttttgctg

SEQ ID NO: 6610617 - DNA, 21 bp, Homo sapiens
accagtatttttgctgcttct

SEQ ID NO: 6610618 - DNA, 16 bp, Homo sapiens
accagtcacacattat

SEQ ID NO: 6610619 - DNA, 14 bp, Homo sapiens
accagtcacagcca

SEQ ID NO: 6610620 - DNA, 13 bp, Homo sapiens
accagtcagatgg

SEQ ID NO: 6610621 - DNA, 21 bp, Homo sapiens
accagtcagggacagcagcct

SEQ ID NO: 6610622 - DNA, 19 bp, Homo sapiens
accagtcatcagctattca

SEQ ID NO: 6610623 - DNA, 17 bp, Homo sapiens
accagtccacgccgggt

SEQ ID NO: 6610624 - DNA, 22 bp, Homo sapiens
accagtcccatgctggctgaag

SEQ ID NO: 6610625 - DNA, 17 bp, Homo sapiens
accagtccccccaccct

SEQ ID NO: 6610626 - DNA, 18 bp, Homo sapiens
accagtccctctgagtga

SEQ ID NO: 6610627 - DNA, 20 bp, Homo sapiens
accagtccctctgagtgaag

SEQ ID NO: 6610628 - DNA, 13 bp, Homo sapiens
accagtccctgtc

SEQ ID NO: 6610629 - DNA, 17 bp, Homo sapiens
accagtcctgctgcctg

SEQ ID NO: 6610630 - DNA, 18 bp, Homo sapiens
accagtcctgctgcctgg

SEQ ID NO: 6610631 - DNA, 21 bp, Homo sapiens
accagtcctgctgcctggagt

SEQ ID NO: 6610632 - DNA, 15 bp, Homo sapiens
accagtcgccctctg

SEQ ID NO: 6610633 - DNA, 16 bp, Homo sapiens
accagtcgccctctgt

SEQ ID NO: 6610634 - DNA, 18 bp, Homo sapiens
accagtcgccctctgtgc

SEQ ID NO: 6610635 - DNA, 11 bp, Homo sapiens
accagtctatt

SEQ ID NO: 6610636 - DNA, 13 bp, Homo sapiens
accagtctcctca

SEQ ID NO: 6610637 - DNA, 17 bp, Homo sapiens
accagtctcctcactct

SEQ ID NO: 6610638 - DNA, 14 bp, Homo sapiens
accagtctgactgt

SEQ ID NO: 6610639 - DNA, 18 bp, Homo sapiens
accagtctgtaaaataca

SEQ ID NO: 6610640 - DNA, 12 bp, Homo sapiens
accagtctgtct

SEQ ID NO: 6610641 - DNA, 14 bp, Homo sapiens
accagtctgtctac

SEQ ID NO: 6610642 - DNA, 15 bp, Homo sapiens
accagtctgtctact

SEQ ID NO: 6610643 - DNA, 19 bp, Homo sapiens
accagtctgtctactgtgg

SEQ ID NO: 6610644 - DNA, 19 bp, Homo sapiens
accagtctgtgtttacaga

SEQ ID NO: 6610645 - DNA, 19 bp, Homo sapiens
accagtcttaccaaacaat

SEQ ID NO: 6610646 - DNA, 15 bp, Homo sapiens
accagtcttctccct

SEQ ID NO: 6610647 - DNA, 20 bp, Homo sapiens
accagtctttaaaggcccag

SEQ ID NO: 6610648 - DNA, 22 bp, Homo sapiens
accagtctttaaaggcccagcc

SEQ ID NO: 6610649 - DNA, 15 bp, Homo sapiens
accagtcttttgaaa

SEQ ID NO: 6610650 - DNA, 15 bp, Homo sapiens
accagtgaaagaagc

SEQ ID NO: 6610651 - DNA, 17 bp, Homo sapiens
accagtgaaccaaagag

SEQ ID NO: 6610652 - DNA, 18 bp, Homo sapiens
accagtgaaccaaagaga

SEQ ID NO: 6610653 - DNA, 19 bp, Homo sapiens
accagtgaatttttgcaat

SEQ ID NO: 6610654 - DNA, 15 bp, Homo sapiens
accagtgacgctgct

SEQ ID NO: 6610655 - DNA, 17 bp, Homo sapiens
accagtgactaattttg

SEQ ID NO: 6610656 - DNA, 14 bp, Homo sapiens
accagtgagcgctt

SEQ ID NO: 6610657 - DNA, 18 bp, Homo sapiens
accagtgagtggccccac

SEQ ID NO: 6610658 - DNA, 23 bp, Homo sapiens
accagtgataatgccccaaggac

SEQ ID NO: 6610659 - DNA, 16 bp, Homo sapiens
accagtgcaagtgacc

SEQ ID NO: 6610660 - DNA, 21 bp, Homo sapiens
accagtgcaggctggccagcc

SEQ ID NO: 6610661 - DNA, 22 bp, Homo sapiens
accagtgcaggctggccagccg

SEQ ID NO: 6610662 - DNA, 13 bp, Homo sapiens
accagtgccaagg

SEQ ID NO: 6610663 - DNA, 14 bp, Homo sapiens
accagtgccaagga

SEQ ID NO: 6610664 - DNA, 16 bp, Homo sapiens
accagtgccaaggacc

SEQ ID NO: 6610665 - DNA, 22 bp, Homo sapiens
accagtgcccaaagtctgtgtg

SEQ ID NO: 6610666 - DNA, 13 bp, Homo sapiens
accagtgcctctc

SEQ ID NO: 6610667 - DNA, 22 bp, Homo sapiens
accagtgcctctccctgctgct

SEQ ID NO: 6610668 - DNA, 14 bp, Homo sapiens
accagtgcctgtga

SEQ ID NO: 6610669 - DNA, 14 bp, Homo sapiens
accagtggcctttc

SEQ ID NO: 6610670 - DNA, 22 bp, Homo sapiens
accagtggcgttgttgcatgtt

SEQ ID NO: 6610671 - DNA, 23 bp, Homo sapiens
accagtggcgttgttgcatgttt

SEQ ID NO: 6610672 - DNA, 15 bp, Homo sapiens
accagtggctggtct

SEQ ID NO: 6610673 - DNA, 19 bp, Homo sapiens
accagtgggactgtggtga

SEQ ID NO: 6610674 - DNA, 19 bp, Homo sapiens
accagtgggatgggctcta

SEQ ID NO: 6610675 - DNA, 12 bp, Homo sapiens
accagtggtctc

SEQ ID NO: 6610676 - DNA, 18 bp, Homo sapiens
accagtgtactgctttca

SEQ ID NO: 6610677 - DNA, 19 bp, Homo sapiens
accagtgtactgctttcaa

SEQ ID NO: 6610678 - DNA, 19 bp, Homo sapiens
accagtgtagcatcttcct

SEQ ID NO: 6610679 - DNA, 23 bp, Homo sapiens
accagtgtatcaggtcagggact

SEQ ID NO: 6610680 - DNA, 21 bp, Homo sapiens
accagtgtcctccaagtgccc

SEQ ID NO: 6610681 - DNA, 16 bp, Homo sapiens
accagtgtctgaacca

SEQ ID NO: 6610682 - DNA, 22 bp, Homo sapiens
accagtgtgacaggaaagattc

SEQ ID NO: 6610683 - DNA, 21 bp, Homo sapiens
accagtgttagtgggaagagc

SEQ ID NO: 6610684 - DNA, 14 bp, Homo sapiens
accagtgttgggtt

SEQ ID NO: 6610685 - DNA, 21 bp, Homo sapiens
accagtgttgtggatttaaca

SEQ ID NO: 6610686 - DNA, 20 bp, Homo sapiens
accagttaagaatggaagaa

SEQ ID NO: 6610687 - DNA, 16 bp, Homo sapiens
accagttaatttttcc

SEQ ID NO: 6610688 - DNA, 18 bp, Homo sapiens
accagttacttgtgttca

SEQ ID NO: 6610689 - DNA, 19 bp, Homo sapiens
accagttacttgtgttcat

SEQ ID NO: 6610690 - DNA, 16 bp, Homo sapiens
accagttataaataca

SEQ ID NO: 6610691 - DNA, 17 bp, Homo sapiens
accagttatgtttgaat

SEQ ID NO: 6610692 - DNA, 19 bp, Homo sapiens
accagttatgtttgaatga

SEQ ID NO: 6610693 - DNA, 21 bp, Homo sapiens
accagttatgtttgaatgaac

SEQ ID NO: 6610694 - DNA, 16 bp, Homo sapiens
accagttcagacacta

SEQ ID NO: 6610695 - DNA, 17 bp, Homo sapiens
accagttccctcagccc

SEQ ID NO: 6610696 - DNA, 21 bp, Homo sapiens
accagttccctcagccctcat

SEQ ID NO: 6610697 - DNA, 22 bp, Homo sapiens
accagttctcgttttgggccag

SEQ ID NO: 6610698 - DNA, 23 bp, Homo sapiens
accagttctggccaggagctgga

SEQ ID NO: 6610699 - DNA, 16 bp, Homo sapiens
accagttcttgcaata

SEQ ID NO: 6610700 - DNA, 20 bp, Homo sapiens
accagttcttgcaataagat

SEQ ID NO: 6610701 - DNA, 24 bp, Homo sapiens
accagttgaataaaagtgcacacc

SEQ ID NO: 6610702 - DNA, 16 bp, Homo sapiens
accagttgcactacat

SEQ ID NO: 6610703 - DNA, 21 bp, Homo sapiens
accagttgcagtcactctagt

SEQ ID NO: 6610704 - DNA, 22 bp, Homo sapiens
accagttgccctagcccagact

SEQ ID NO: 6610705 - DNA, 14 bp, Homo sapiens
accagttgcctttt

SEQ ID NO: 6610706 - DNA, 14 bp, Homo sapiens
accagttgctgctg

SEQ ID NO: 6610707 - DNA, 18 bp, Homo sapiens
accagttgggagcactgg

SEQ ID NO: 6610708 - DNA, 19 bp, Homo sapiens
accagttgggagcactgga

SEQ ID NO: 6610709 - DNA, 21 bp, Homo sapiens
accagttgggagcactggagt

SEQ ID NO: 6610710 - DNA, 21 bp, Homo sapiens
accagtttaagccgcagacct

SEQ ID NO: 6610711 - DNA, 22 bp, Homo sapiens
accagtttaagccgcagacctg

SEQ ID NO: 6610712 - DNA, 22 bp, Homo sapiens
accagtttaaggaacttctgaa

SEQ ID NO: 6610713 - DNA, 15 bp, Homo sapiens
accagtttattctgt

SEQ ID NO: 6610714 - DNA, 12 bp, Homo sapiens
accagtttctta

SEQ ID NO: 6610715 - DNA, 17 bp, Homo sapiens
accagtttgactgtgct

SEQ ID NO: 6610716 - DNA, 16 bp, Homo sapiens
accagttttatccata

SEQ ID NO: 6610717 - DNA, 14 bp, Homo sapiens
accagttttgatat

SEQ ID NO: 6610718 - DNA, 12 bp, Homo sapiens
accagttttttc

SEQ ID NO: 6610719 - DNA, 13 bp, Homo sapiens
accataaacattt

SEQ ID NO: 6610720 - DNA, 21 bp, Homo sapiens
accataaactgtacaaatgaa

SEQ ID NO: 6610721 - DNA, 22 bp, Homo sapiens
accataaactgtacaaatgaaa

SEQ ID NO: 6610722 - DNA, 15 bp, Homo sapiens
accataaagccttta

SEQ ID NO: 6610723 - DNA, 18 bp, Homo sapiens
accataaagcctttaaaa

SEQ ID NO: 6610724 - DNA, 18 bp, Homo sapiens
accataaatgaatcatca

SEQ ID NO: 6610725 - DNA, 19 bp, Homo sapiens
accataaccccggaagcca

SEQ ID NO: 6610726 - DNA, 14 bp, Homo sapiens
accataagagaaac

SEQ ID NO: 6610727 - DNA, 22 bp, Homo sapiens
accataagagaaacctgccaag

SEQ ID NO: 6610728 - DNA, 15 bp, Homo sapiens
accataatcttagag

SEQ ID NO: 6610729 - DNA, 22 bp, Homo sapiens
accataatgagatgtgagcctt

SEQ ID NO: 6610730 - DNA, 13 bp, Homo sapiens
accataatgttac

SEQ ID NO: 6610731 - DNA, 18 bp, Homo sapiens
accataatgttacattat

SEQ ID NO: 6610732 - DNA, 16 bp, Homo sapiens
accatacagacagcac

SEQ ID NO: 6610733 - DNA, 20 bp, Homo sapiens
accataccactttgacacgc

SEQ ID NO: 6610734 - DNA, 14 bp, Homo sapiens
accatacccagcta

SEQ ID NO: 6610735 - DNA, 15 bp, Homo sapiens
accataccttccttc

SEQ ID NO: 6610736 - DNA, 16 bp, Homo sapiens
accataccttccttcc

SEQ ID NO: 6610737 - DNA, 17 bp, Homo sapiens
accataccttccttccc

SEQ ID NO: 6610738 - DNA, 16 bp, Homo sapiens
accatacgcggaggag

SEQ ID NO: 6610739 - DNA, 20 bp, Homo sapiens
accatactaataaatataat

SEQ ID NO: 6610740 - DNA, 12 bp, Homo sapiens
accatactgaaa

SEQ ID NO: 6610741 - DNA, 16 bp, Homo sapiens
accatactgtctctgg

SEQ ID NO: 6610742 - DNA, 19 bp, Homo sapiens
accatactgtctctggagt

SEQ ID NO: 6610743 - DNA, 13 bp, Homo sapiens
accatactttata

SEQ ID NO: 6610744 - DNA, 13 bp, Homo sapiens
accatagaactgt

SEQ ID NO: 6610745 - DNA, 14 bp, Homo sapiens
accatagaactgtc

SEQ ID NO: 6610746 - DNA, 20 bp, Homo sapiens
accatagaagaacagcagat

SEQ ID NO: 6610747 - DNA, 15 bp, Homo sapiens
accatagagtccaga

SEQ ID NO: 6610748 - DNA, 22 bp, Homo sapiens
accatagcacaggctaattttt

SEQ ID NO: 6610749 - DNA, 18 bp, Homo sapiens
accatagcgctgctctta

SEQ ID NO: 6610750 - DNA, 19 bp, Homo sapiens
accataggaagacataaaa

SEQ ID NO: 6610751 - DNA, 14 bp, Homo sapiens
accatagggctggg

SEQ ID NO: 6610752 - DNA, 16 bp, Homo sapiens
accatagggctgggga

SEQ ID NO: 6610753 - DNA, 21 bp, Homo sapiens
accatagtaccatttatacaa

SEQ ID NO: 6610754 - DNA, 22 bp, Homo sapiens
accatagttactgtaaaatgca

SEQ ID NO: 6610755 - DNA, 16 bp, Homo sapiens
accatagttttgttta

SEQ ID NO: 6610756 - DNA, 23 bp, Homo sapiens
accatataaagggggagggaaat

SEQ ID NO: 6610757 - DNA, 19 bp, Homo sapiens
accatataactgtgatgaa

SEQ ID NO: 6610758 - DNA, 21 bp, Homo sapiens
accatataactgtgatgaaat

SEQ ID NO: 6610759 - DNA, 23 bp, Homo sapiens
accatataactgtgatgaaatat

SEQ ID NO: 6610760 - DNA, 14 bp, Homo sapiens
accatatagcaaaa

SEQ ID NO: 6610761 - DNA, 12 bp, Homo sapiens
accatatgaatt

SEQ ID NO: 6610762 - DNA, 19 bp, Homo sapiens
accatatgatctgttttgt

SEQ ID NO: 6610763 - DNA, 19 bp, Homo sapiens
accatatgtagcattaaat

SEQ ID NO: 6610764 - DNA, 20 bp, Homo sapiens
accatatgtagcattaaata

SEQ ID NO: 6610765 - DNA, 21 bp, Homo sapiens
accatatgtagcattaaatat

SEQ ID NO: 6610766 - DNA, 22 bp, Homo sapiens
accatatgtagcattaaatata

SEQ ID NO: 6610767 - DNA, 17 bp, Homo sapiens
accatatgtctgcttct

SEQ ID NO: 6610768 - DNA, 20 bp, Homo sapiens
accatatgtctgcttctgtc

SEQ ID NO: 6610769 - DNA, 20 bp, Homo sapiens
accatattaccacagacata

SEQ ID NO: 6610770 - DNA, 19 bp, Homo sapiens
accatattcagtgctgtgg

SEQ ID NO: 6610771 - DNA, 17 bp, Homo sapiens
accatattgctcttaaa

SEQ ID NO: 6610772 - DNA, 22 bp, Homo sapiens
accatattgtgcttcacagtag

SEQ ID NO: 6610773 - DNA, 16 bp, Homo sapiens
accatatttactcttt

SEQ ID NO: 6610774 - DNA, 20 bp, Homo sapiens
accatattttattgtatttt

SEQ ID NO: 6610775 - DNA, 21 bp, Homo sapiens
accatattttattgtattttg

SEQ ID NO: 6610776 - DNA, 22 bp, Homo sapiens
accatattttattgtattttga

SEQ ID NO: 6610777 - DNA, 19 bp, Homo sapiens
accatcaaaggaatataag

SEQ ID NO: 6610778 - DNA, 14 bp, Homo sapiens
accatcaaatgctg

SEQ ID NO: 6610779 - DNA, 15 bp, Homo sapiens
accatcaagaaccta

SEQ ID NO: 6610780 - DNA, 17 bp, Homo sapiens
accatcaagttgtgcca

SEQ ID NO: 6610781 - DNA, 16 bp, Homo sapiens
accatcaccaccgcct

SEQ ID NO: 6610782 - DNA, 18 bp, Homo sapiens
accatcaccaccgcctct

SEQ ID NO: 6610783 - DNA, 19 bp, Homo sapiens
accatcaccaccgcctctg

SEQ ID NO: 6610784 - DNA, 22 bp, Homo sapiens
accatcaccagaattaatttta

SEQ ID NO: 6610785 - DNA, 17 bp, Homo sapiens
accatcaccctctgggc

SEQ ID NO: 6610786 - DNA, 18 bp, Homo sapiens
accatcaccctctgggca

SEQ ID NO: 6610787 - DNA, 23 bp, Homo sapiens
accatcagaaacaccctcacact

SEQ ID NO: 6610788 - DNA, 17 bp, Homo sapiens
accatcagctctgcctt

SEQ ID NO: 6610789 - DNA, 23 bp, Homo sapiens
accatcagttactggtttcagtt

SEQ ID NO: 6610790 - DNA, 19 bp, Homo sapiens
accatcatgccctctctcg

SEQ ID NO: 6610791 - DNA, 14 bp, Homo sapiens
accatcatgtctgg

SEQ ID NO: 6610792 - DNA, 12 bp, Homo sapiens
accatcattgaa

SEQ ID NO: 6610793 - DNA, 22 bp, Homo sapiens
accatccactctaccctcccac

SEQ ID NO: 6610794 - DNA, 15 bp, Homo sapiens
accatccagctcccc

SEQ ID NO: 6610795 - DNA, 22 bp, Homo sapiens
accatccagctccccagcccac

SEQ ID NO: 6610796 - DNA, 13 bp, Homo sapiens
accatccatccct

SEQ ID NO: 6610797 - DNA, 21 bp, Homo sapiens
accatccatccctggtgaaag

SEQ ID NO: 6610798 - DNA, 15 bp, Homo sapiens
accatcccactgata

SEQ ID NO: 6610799 - DNA, 17 bp, Homo sapiens
accatccccaactccat

SEQ ID NO: 6610800 - DNA, 12 bp, Homo sapiens
accatcccctcc

SEQ ID NO: 6610801 - DNA, 18 bp, Homo sapiens
accatcccctcctagcac

SEQ ID NO: 6610802 - DNA, 14 bp, Homo sapiens
accatccctgaaga

SEQ ID NO: 6610803 - DNA, 16 bp, Homo sapiens
accatccctgaaggcc

SEQ ID NO: 6610804 - DNA, 13 bp, Homo sapiens
accatccctgcca

SEQ ID NO: 6610805 - DNA, 19 bp, Homo sapiens
accatccctttttgaagtg

SEQ ID NO: 6610806 - DNA, 13 bp, Homo sapiens
accatcctattta

SEQ ID NO: 6610807 - DNA, 14 bp, Homo sapiens
accatcctcagagg

SEQ ID NO: 6610808 - DNA, 17 bp, Homo sapiens
accatcctcagaggctg

SEQ ID NO: 6610809 - DNA, 19 bp, Homo sapiens
accatcctggcccctccag

SEQ ID NO: 6610810 - DNA, 14 bp, Homo sapiens
accatcctggctgc

SEQ ID NO: 6610811 - DNA, 20 bp, Homo sapiens
accatccttccatcctgagg

SEQ ID NO: 6610812 - DNA, 15 bp, Homo sapiens
accatcctttactat

SEQ ID NO: 6610813 - DNA, 15 bp, Homo sapiens
accatcgctttattg

SEQ ID NO: 6610814 - DNA, 16 bp, Homo sapiens
accatcggtcagcagg

SEQ ID NO: 6610815 - DNA, 18 bp, Homo sapiens
accatcgtccagccctcc

SEQ ID NO: 6610816 - DNA, 22 bp, Homo sapiens
accatctactcttttgaagtgt

SEQ ID NO: 6610817 - DNA, 23 bp, Homo sapiens
accatctactcttttgaagtgtt

SEQ ID NO: 6610818 - DNA, 20 bp, Homo sapiens
accatctcagacctttactg

SEQ ID NO: 6610819 - DNA, 23 bp, Homo sapiens
accatctcatcctattacttttc

SEQ ID NO: 6610820 - DNA, 13 bp, Homo sapiens
accatctccctgg

SEQ ID NO: 6610821 - DNA, 18 bp, Homo sapiens
accatctctaccatcatc

SEQ ID NO: 6610822 - DNA, 15 bp, Homo sapiens
accatctctcttcca

SEQ ID NO: 6610823 - DNA, 11 bp, Homo sapiens
accatctctgt

SEQ ID NO: 6610824 - DNA, 22 bp, Homo sapiens
accatctctgtgattacctctc

SEQ ID NO: 6610825 - DNA, 23 bp, Homo sapiens
accatctcttcattcaaactgca

SEQ ID NO: 6610826 - DNA, 22 bp, Homo sapiens
accatctgaaagtggtacttga

SEQ ID NO: 6610827 - DNA, 11 bp, Homo sapiens
accatctgcat

SEQ ID NO: 6610828 - DNA, 13 bp, Homo sapiens
accatctgcatgg

SEQ ID NO: 6610829 - DNA, 15 bp, Homo sapiens
accatctgctgtctt

SEQ ID NO: 6610830 - DNA, 21 bp, Homo sapiens
accatctggagtcttcctgta

SEQ ID NO: 6610831 - DNA, 16 bp, Homo sapiens
accatctggcccaggc

SEQ ID NO: 6610832 - DNA, 22 bp, Homo sapiens
accatctggcctggcctggccc

SEQ ID NO: 6610833 - DNA, 20 bp, Homo sapiens
accatctggggcacctgctt

SEQ ID NO: 6610834 - DNA, 20 bp, Homo sapiens
accatctgtcttgccagcca

SEQ ID NO: 6610835 - DNA, 21 bp, Homo sapiens
accatctgtcttgccagccag

SEQ ID NO: 6610836 - DNA, 22 bp, Homo sapiens
accatctgtcttgccagccaga

SEQ ID NO: 6610837 - DNA, 23 bp, Homo sapiens
accatctgtcttgccagccagaa

SEQ ID NO: 6610838 - DNA, 12 bp, Homo sapiens
accatctgtgac

SEQ ID NO: 6610839 - DNA, 20 bp, Homo sapiens
accatcttaaatgacagtga

SEQ ID NO: 6610840 - DNA, 16 bp, Homo sapiens
accatcttaatcttta

SEQ ID NO: 6610841 - DNA, 21 bp, Homo sapiens
accatcttaatctttatttta

SEQ ID NO: 6610842 - DNA, 17 bp, Homo sapiens
accatcttctgtaccaa

SEQ ID NO: 6610843 - DNA, 21 bp, Homo sapiens
accatcttgggattcctcccc

SEQ ID NO: 6610844 - DNA, 20 bp, Homo sapiens
accatctttaatcaatgtga

SEQ ID NO: 6610845 - DNA, 16 bp, Homo sapiens
accatctttagcagtt

SEQ ID NO: 6610846 - DNA, 13 bp, Homo sapiens
accatctttctaa

SEQ ID NO: 6610847 - DNA, 12 bp, Homo sapiens
accatgaaagac

SEQ ID NO: 6610848 - DNA, 14 bp, Homo sapiens
accatgaaagactt

SEQ ID NO: 6610849 - DNA, 19 bp, Homo sapiens
accatgaaagacttctcta

SEQ ID NO: 6610850 - DNA, 18 bp, Homo sapiens
accatgaacagaaaacat

SEQ ID NO: 6610851 - DNA, 23 bp, Homo sapiens
accatgaacagaaaacattctga

SEQ ID NO: 6610852 - DNA, 12 bp, Homo sapiens
accatgaacttg

SEQ ID NO: 6610853 - DNA, 14 bp, Homo sapiens
accatgaagacagg

SEQ ID NO: 6610854 - DNA, 17 bp, Homo sapiens
accatgaagatgccatt

SEQ ID NO: 6610855 - DNA, 23 bp, Homo sapiens
accatgaagtctctaacaatgta

SEQ ID NO: 6610856 - DNA, 14 bp, Homo sapiens
accatgaagtgaaa

SEQ ID NO: 6610857 - DNA, 14 bp, Homo sapiens
accatgaatattta

SEQ ID NO: 6610858 - DNA, 21 bp, Homo sapiens
accatgaatgaacccctggct

SEQ ID NO: 6610859 - DNA, 16 bp, Homo sapiens
accatgaattcttgag

SEQ ID NO: 6610860 - DNA, 20 bp, Homo sapiens
accatgaattcttgagttta

SEQ ID NO: 6610861 - DNA, 23 bp, Homo sapiens
accatgacaaaatagcccagcct

SEQ ID NO: 6610862 - DNA, 12 bp, Homo sapiens
accatgacaaac

SEQ ID NO: 6610863 - DNA, 16 bp, Homo sapiens
accatgacaaacctag

SEQ ID NO: 6610864 - DNA, 23 bp, Homo sapiens
accatgacaaccctgtggtttcc

SEQ ID NO: 6610865 - DNA, 20 bp, Homo sapiens
accatgagaagagggcctgt

SEQ ID NO: 6610866 - DNA, 18 bp, Homo sapiens
accatgagatgagatgac

SEQ ID NO: 6610867 - DNA, 20 bp, Homo sapiens
accatgaggtaaaagagcca

SEQ ID NO: 6610868 - DNA, 15 bp, Homo sapiens
accatgattccttta

SEQ ID NO: 6610869 - DNA, 18 bp, Homo sapiens
accatgattcctttaaca

SEQ ID NO: 6610870 - DNA, 19 bp, Homo sapiens
accatgcaaattgtgaaat

SEQ ID NO: 6610871 - DNA, 11 bp, Homo sapiens
accatgcaagg

SEQ ID NO: 6610872 - DNA, 17 bp, Homo sapiens
accatgcacagagtcct

SEQ ID NO: 6610873 - DNA, 19 bp, Homo sapiens
accatgcactatatttgta

SEQ ID NO: 6610874 - DNA, 17 bp, Homo sapiens
accatgcactcaataaa

SEQ ID NO: 6610875 - DNA, 14 bp, Homo sapiens
accatgcactgtaa

SEQ ID NO: 6610876 - DNA, 16 bp, Homo sapiens
accatgcagcccctgg

SEQ ID NO: 6610877 - DNA, 20 bp, Homo sapiens
accatgcagcccctgggccc

SEQ ID NO: 6610878 - DNA, 18 bp, Homo sapiens
accatgcaggaaggaaaa

SEQ ID NO: 6610879 - DNA, 18 bp, Homo sapiens
accatgcattttaccatc

SEQ ID NO: 6610880 - DNA, 19 bp, Homo sapiens
accatgccagattctgcct

SEQ ID NO: 6610881 - DNA, 20 bp, Homo sapiens
accatgcccgactaattttt

SEQ ID NO: 6610882 - DNA, 20 bp, Homo sapiens
accatgcccggctaattttt

SEQ ID NO: 6610883 - DNA, 19 bp, Homo sapiens
accatgcctcactaatttt

SEQ ID NO: 6610884 - DNA, 16 bp, Homo sapiens
accatgcgctgctcaa

SEQ ID NO: 6610885 - DNA, 19 bp, Homo sapiens
accatgctcatctgctggt

SEQ ID NO: 6610886 - DNA, 14 bp, Homo sapiens
accatgctgagaca

SEQ ID NO: 6610887 - DNA, 21 bp, Homo sapiens
accatgctgagacatccctca

SEQ ID NO: 6610888 - DNA, 16 bp, Homo sapiens
accatgctgctgggga

SEQ ID NO: 6610889 - DNA, 17 bp, Homo sapiens
accatgctgctggggaa

SEQ ID NO: 6610890 - DNA, 23 bp, Homo sapiens
accatgctgctttttggcacagt

SEQ ID NO: 6610891 - DNA, 14 bp, Homo sapiens
accatgctggcggc

SEQ ID NO: 6610892 - DNA, 20 bp, Homo sapiens
accatgctggcggcgcagag

SEQ ID NO: 6610893 - DNA, 19 bp, Homo sapiens
accatgctgggccggggtg

SEQ ID NO: 6610894 - DNA, 21 bp, Homo sapiens
accatgctgtctggcacagcc

SEQ ID NO: 6610895 - DNA, 22 bp, Homo sapiens
accatgctgtctggcacagcct

SEQ ID NO: 6610896 - DNA, 16 bp, Homo sapiens
accatgcttgcctgaa

SEQ ID NO: 6610897 - DNA, 18 bp, Homo sapiens
accatggacacattttct

SEQ ID NO: 6610898 - DNA, 21 bp, Homo sapiens
accatggacactacacccagc

SEQ ID NO: 6610899 - DNA, 16 bp, Homo sapiens
accatggacctgcact

SEQ ID NO: 6610900 - DNA, 14 bp, Homo sapiens
accatggactttat

SEQ ID NO: 6610901 - DNA, 16 bp, Homo sapiens
accatggactttataa

SEQ ID NO: 6610902 - DNA, 14 bp, Homo sapiens
accatggaggcagg

SEQ ID NO: 6610903 - DNA, 21 bp, Homo sapiens
accatggagtggcagcccagc

SEQ ID NO: 6610904 - DNA, 18 bp, Homo sapiens
accatggatatgttgtat

SEQ ID NO: 6610905 - DNA, 18 bp, Homo sapiens
accatggatttttacaag

SEQ ID NO: 6610906 - DNA, 20 bp, Homo sapiens
accatggcacctttgagaga

SEQ ID NO: 6610907 - DNA, 16 bp, Homo sapiens
accatggccaattcag

SEQ ID NO: 6610908 - DNA, 18 bp, Homo sapiens
accatggccaattcagtt

SEQ ID NO: 6610909 - DNA, 20 bp, Homo sapiens
accatggccagctaattttt

SEQ ID NO: 6610910 - DNA, 21 bp, Homo sapiens
accatggctaaggcaccagcc

SEQ ID NO: 6610911 - DNA, 12 bp, Homo sapiens
accatgggacca

SEQ ID NO: 6610912 - DNA, 20 bp, Homo sapiens
accatgggaccaggtcttgg

SEQ ID NO: 6610913 - DNA, 19 bp, Homo sapiens
accatgggataaatgccat

SEQ ID NO: 6610914 - DNA, 14 bp, Homo sapiens
accatgggccaaga

SEQ ID NO: 6610915 - DNA, 14 bp, Homo sapiens
accatgggctcagg

SEQ ID NO: 6610916 - DNA, 15 bp, Homo sapiens
accatgggctcaggg

SEQ ID NO: 6610917 - DNA, 17 bp, Homo sapiens
accatgggctcagggcc

SEQ ID NO: 6610918 - DNA, 19 bp, Homo sapiens
accatgggtgtggatggca

SEQ ID NO: 6610919 - DNA, 22 bp, Homo sapiens
accatgggtgtggatggcagtg

SEQ ID NO: 6610920 - DNA, 22 bp, Homo sapiens
accatggtcatcaccacccttc

SEQ ID NO: 6610921 - DNA, 15 bp, Homo sapiens
accatggtttgatat

SEQ ID NO: 6610922 - DNA, 22 bp, Homo sapiens
accatgtaaaacaaaaaacaat

SEQ ID NO: 6610923 - DNA, 21 bp, Homo sapiens
accatgtaagcactctggatg

SEQ ID NO: 6610924 - DNA, 14 bp, Homo sapiens
accatgtacatagc

SEQ ID NO: 6610925 - DNA, 20 bp, Homo sapiens
accatgtacctaatccaaat

SEQ ID NO: 6610926 - DNA, 20 bp, Homo sapiens
accatgtagttttaacagaa

SEQ ID NO: 6610927 - DNA, 21 bp, Homo sapiens
accatgtagttttaacagaac

SEQ ID NO: 6610928 - DNA, 16 bp, Homo sapiens
accatgtatgtggtat

SEQ ID NO: 6610929 - DNA, 19 bp, Homo sapiens
accatgtattcatccagag

SEQ ID NO: 6610930 - DNA, 16 bp, Homo sapiens
accatgtattttgtaa

SEQ ID NO: 6610931 - DNA, 22 bp, Homo sapiens
accatgtcaagggttcaagatt

SEQ ID NO: 6610932 - DNA, 19 bp, Homo sapiens
accatgtcagcaaaaagca

SEQ ID NO: 6610933 - DNA, 21 bp, Homo sapiens
accatgtcagcaaaaagcaaa

SEQ ID NO: 6610934 - DNA, 19 bp, Homo sapiens
accatgtcgtagttactct

SEQ ID NO: 6610935 - DNA, 18 bp, Homo sapiens
accatgtgagctcttcct

SEQ ID NO: 6610936 - DNA, 19 bp, Homo sapiens
accatgtgagctcttccta

SEQ ID NO: 6610937 - DNA, 14 bp, Homo sapiens
accatgtgcaataa

SEQ ID NO: 6610938 - DNA, 17 bp, Homo sapiens
accatgtgcatcaggaa

SEQ ID NO: 6610939 - DNA, 16 bp, Homo sapiens
accatgtgcctgatcc

SEQ ID NO: 6610940 - DNA, 14 bp, Homo sapiens
accatgtggccaca

SEQ ID NO: 6610941 - DNA, 19 bp, Homo sapiens
accatgtgtcacttgtgct

SEQ ID NO: 6610942 - DNA, 21 bp, Homo sapiens
accatgtgtcacttgtgcttt

SEQ ID NO: 6610943 - DNA, 15 bp, Homo sapiens
accatgttagccagg

SEQ ID NO: 6610944 - DNA, 14 bp, Homo sapiens
accatgttcccagc

SEQ ID NO: 6610945 - DNA, 15 bp, Homo sapiens
accatgttcccagct

SEQ ID NO: 6610946 - DNA, 17 bp, Homo sapiens
accatgttcccagctca

SEQ ID NO: 6610947 - DNA, 23 bp, Homo sapiens
accatgttcccagctcagtgcca

SEQ ID NO: 6610948 - DNA, 15 bp, Homo sapiens
accatgttgcccaga

SEQ ID NO: 6610949 - DNA, 14 bp, Homo sapiens
accatgttgcgttc

SEQ ID NO: 6610950 - DNA, 18 bp, Homo sapiens
accatgttggccaggctg

SEQ ID NO: 6610951 - DNA, 22 bp, Homo sapiens
accatgttggtcaggctggtct

SEQ ID NO: 6610952 - DNA, 13 bp, Homo sapiens
accatgtttcaaa

SEQ ID NO: 6610953 - DNA, 15 bp, Homo sapiens
accatgtttcaaaca

SEQ ID NO: 6610954 - DNA, 12 bp, Homo sapiens
accattaaaact

SEQ ID NO: 6610955 - DNA, 20 bp, Homo sapiens
accattaaaactgaagtctg

SEQ ID NO: 6610956 - DNA, 18 bp, Homo sapiens
accattaaaactgctttt

SEQ ID NO: 6610957 - DNA, 19 bp, Homo sapiens
accattaaaactgcttttt

SEQ ID NO: 6610958 - DNA, 20 bp, Homo sapiens
accattaaaactgctttttt

SEQ ID NO: 6610959 - DNA, 14 bp, Homo sapiens
accattaaaccatc

SEQ ID NO: 6610960 - DNA, 13 bp, Homo sapiens
accattaaagtca

SEQ ID NO: 6610961 - DNA, 15 bp, Homo sapiens
accattaaagtcaga

SEQ ID NO: 6610962 - DNA, 13 bp, Homo sapiens
accattaaccaga

SEQ ID NO: 6610963 - DNA, 14 bp, Homo sapiens
accattaagaaatg

SEQ ID NO: 6610964 - DNA, 22 bp, Homo sapiens
accattaagtcatgtgtgaaca

SEQ ID NO: 6610965 - DNA, 14 bp, Homo sapiens
accattaataaaga

SEQ ID NO: 6610966 - DNA, 16 bp, Homo sapiens
accattaataaagaca

SEQ ID NO: 6610967 - DNA, 16 bp, Homo sapiens
accattaattacatac

SEQ ID NO: 6610968 - DNA, 22 bp, Homo sapiens
accattaattacatacagattt

SEQ ID NO: 6610969 - DNA, 13 bp, Homo sapiens
accattacatgtt

SEQ ID NO: 6610970 - DNA, 14 bp, Homo sapiens
accattaccaaaat

SEQ ID NO: 6610971 - DNA, 15 bp, Homo sapiens
accattactgagggg

SEQ ID NO: 6610972 - DNA, 19 bp, Homo sapiens
accattataaccttaattt

SEQ ID NO: 6610973 - DNA, 16 bp, Homo sapiens
accattataatgaatt

SEQ ID NO: 6610974 - DNA, 17 bp, Homo sapiens
accattatactttatat

SEQ ID NO: 6610975 - DNA, 16 bp, Homo sapiens
accattatagcctcag

SEQ ID NO: 6610976 - DNA, 18 bp, Homo sapiens
accattatgaagaagaga

SEQ ID NO: 6610977 - DNA, 14 bp, Homo sapiens
accattatgatcaa

SEQ ID NO: 6610978 - DNA, 20 bp, Homo sapiens
accattatggataaagatga

SEQ ID NO: 6610979 - DNA, 19 bp, Homo sapiens
accattatggctttgtgct

SEQ ID NO: 6610980 - DNA, 12 bp, Homo sapiens
accattattcac

SEQ ID NO: 6610981 - DNA, 17 bp, Homo sapiens
accattcacaataaaag

SEQ ID NO: 6610982 - DNA, 22 bp, Homo sapiens
accattcactactcatgcgtga

SEQ ID NO: 6610983 - DNA, 18 bp, Homo sapiens
accattccaaagttctta

SEQ ID NO: 6610984 - DNA, 22 bp, Homo sapiens
accattccaaagttcttatctc

SEQ ID NO: 6610985 - DNA, 15 bp, Homo sapiens
accattccccatggg

SEQ ID NO: 6610986 - DNA, 19 bp, Homo sapiens
accattccctgccttgctg

SEQ ID NO: 6610987 - DNA, 15 bp, Homo sapiens
accattcctgtccct

SEQ ID NO: 6610988 - DNA, 16 bp, Homo sapiens
accattccttcaaata

SEQ ID NO: 6610989 - DNA, 20 bp, Homo sapiens
accattccttcaaataaaga

SEQ ID NO: 6610990 - DNA, 23 bp, Homo sapiens
accattcctttaaattctccaac

SEQ ID NO: 6610991 - DNA, 21 bp, Homo sapiens
accattcgaagtcagctaatt

SEQ ID NO: 6610992 - DNA, 23 bp, Homo sapiens
accattctaggtgtttcaacaga

SEQ ID NO: 6610993 - DNA, 16 bp, Homo sapiens
accattctccacctgc

SEQ ID NO: 6610994 - DNA, 19 bp, Homo sapiens
accattctccacctgccag

SEQ ID NO: 6610995 - DNA, 13 bp, Homo sapiens
accattctcctgc

SEQ ID NO: 6610996 - DNA, 14 bp, Homo sapiens
accattctcctgcc

SEQ ID NO: 6610997 - DNA, 18 bp, Homo sapiens
accattctcctgcctcac

SEQ ID NO: 6610998 - DNA, 17 bp, Homo sapiens
accattctccttcccca

SEQ ID NO: 6610999 - DNA, 19 bp, Homo sapiens
accattctgcatttagctg

SEQ ID NO: 6611000 - DNA, 20 bp, Homo sapiens
accattctgttgggcaacaa

SEQ ID NO: 6611001 - DNA, 21 bp, Homo sapiens
accattgaaatcagcatgaca

SEQ ID NO: 6611002 - DNA, 17 bp, Homo sapiens
accattgacctcagctg

SEQ ID NO: 6611003 - DNA, 22 bp, Homo sapiens
accattgacctcagctgcacat

SEQ ID NO: 6611004 - DNA, 13 bp, Homo sapiens
accattggaaatt

SEQ ID NO: 6611005 - DNA, 15 bp, Homo sapiens
accattggaaatttc

SEQ ID NO: 6611006 - DNA, 19 bp, Homo sapiens
accattggaaatttcacgt

SEQ ID NO: 6611007 - DNA, 15 bp, Homo sapiens
accattggaatggac

SEQ ID NO: 6611008 - DNA, 20 bp, Homo sapiens
accattggacagatttcagt

SEQ ID NO: 6611009 - DNA, 18 bp, Homo sapiens
accattggacagtctccc

SEQ ID NO: 6611010 - DNA, 12 bp, Homo sapiens
accattggctgc

SEQ ID NO: 6611011 - DNA, 14 bp, Homo sapiens
accattggggagga

SEQ ID NO: 6611012 - DNA, 14 bp, Homo sapiens
accattgtctcaga

SEQ ID NO: 6611013 - DNA, 15 bp, Homo sapiens
accattgtctcagag

SEQ ID NO: 6611014 - DNA, 18 bp, Homo sapiens
accattgtctcagagcag

SEQ ID NO: 6611015 - DNA, 19 bp, Homo sapiens
accattgtctcagagcagg

SEQ ID NO: 6611016 - DNA, 16 bp, Homo sapiens
accattgtcttccaac

SEQ ID NO: 6611017 - DNA, 18 bp, Homo sapiens
accattgtcttccaaccc

SEQ ID NO: 6611018 - DNA, 13 bp, Homo sapiens
accattgtgcatt

SEQ ID NO: 6611019 - DNA, 14 bp, Homo sapiens
accatttaaaaatg

SEQ ID NO: 6611020 - DNA, 19 bp, Homo sapiens
accatttaataaagaaata

SEQ ID NO: 6611021 - DNA, 14 bp, Homo sapiens
accatttaattcat

SEQ ID NO: 6611022 - DNA, 15 bp, Homo sapiens
accatttaattcata

SEQ ID NO: 6611023 - DNA, 15 bp, Homo sapiens
accatttaatttcat

SEQ ID NO: 6611024 - DNA, 19 bp, Homo sapiens
accatttatacaaattaga

SEQ ID NO: 6611025 - DNA, 22 bp, Homo sapiens
accatttatctactatttgaaa

SEQ ID NO: 6611026 - DNA, 11 bp, Homo sapiens
accatttcaga

SEQ ID NO: 6611027 - DNA, 23 bp, Homo sapiens
accatttcagtaaacctgtctga

SEQ ID NO: 6611028 - DNA, 17 bp, Homo sapiens
accatttccccagggca

SEQ ID NO: 6611029 - DNA, 19 bp, Homo sapiens
accatttccccagggcacg

SEQ ID NO: 6611030 - DNA, 20 bp, Homo sapiens
accatttcccctgtggtttg

SEQ ID NO: 6611031 - DNA, 22 bp, Homo sapiens
accatttcccctgtggtttgtt

SEQ ID NO: 6611032 - DNA, 15 bp, Homo sapiens
accatttcctcagac

SEQ ID NO: 6611033 - DNA, 19 bp, Homo sapiens
accatttcctcagactcta

SEQ ID NO: 6611034 - DNA, 22 bp, Homo sapiens
accatttcctcagcttatctct

SEQ ID NO: 6611035 - DNA, 14 bp, Homo sapiens
accatttctagcct

SEQ ID NO: 6611036 - DNA, 17 bp, Homo sapiens
accatttctcactagtg

SEQ ID NO: 6611037 - DNA, 23 bp, Homo sapiens
accatttctgggggccgcagagg

SEQ ID NO: 6611038 - DNA, 16 bp, Homo sapiens
accatttgctactgta

SEQ ID NO: 6611039 - DNA, 23 bp, Homo sapiens
accatttggatcctgtgtggaga

SEQ ID NO: 6611040 - DNA, 13 bp, Homo sapiens
accatttgtaata

SEQ ID NO: 6611041 - DNA, 16 bp, Homo sapiens
accatttgtagtgagc

SEQ ID NO: 6611042 - DNA, 15 bp, Homo sapiens
accatttgtgttttg

SEQ ID NO: 6611043 - DNA, 15 bp, Homo sapiens
accatttgttaatat

SEQ ID NO: 6611044 - DNA, 22 bp, Homo sapiens
accattttaacctagatgttta

SEQ ID NO: 6611045 - DNA, 18 bp, Homo sapiens
accattttaacgctgcct

SEQ ID NO: 6611046 - DNA, 14 bp, Homo sapiens
accattttagtttt

SEQ ID NO: 6611047 - DNA, 15 bp, Homo sapiens
accattttataaagt

SEQ ID NO: 6611048 - DNA, 20 bp, Homo sapiens
accattttattttttgggcc

SEQ ID NO: 6611049 - DNA, 23 bp, Homo sapiens
accattttattttttgggccatt

SEQ ID NO: 6611050 - DNA, 15 bp, Homo sapiens
accattttcaatttg

SEQ ID NO: 6611051 - DNA, 15 bp, Homo sapiens
accattttcctgcat

SEQ ID NO: 6611052 - DNA, 15 bp, Homo sapiens
accattttgaaatat

SEQ ID NO: 6611053 - DNA, 18 bp, Homo sapiens
accattttgcgatgtgtt

SEQ ID NO: 6611054 - DNA, 21 bp, Homo sapiens
accattttgcgatgtgtttta

SEQ ID NO: 6611055 - DNA, 21 bp, Homo sapiens
accattttgtaaatgaaactt

SEQ ID NO: 6611056 - DNA, 21 bp, Homo sapiens
accatttttagaaggaaaaag

SEQ ID NO: 6611057 - DNA, 16 bp, Homo sapiens
accatttttgctgaat

SEQ ID NO: 6611058 - DNA, 19 bp, Homo sapiens
accatttttgctgaattca

SEQ ID NO: 6611059 - DNA, 22 bp, Homo sapiens
accattttttaaggaaacaata

SEQ ID NO: 6611060 - DNA, 17 bp, Homo sapiens
accattttttaatttac

SEQ ID NO: 6611061 - DNA, 23 bp, Homo sapiens
accattttttaatttacttgttt

SEQ ID NO: 6611062 - DNA, 18 bp, Homo sapiens
acccaaaaactgtcttta

SEQ ID NO: 6611063 - DNA, 17 bp, Homo sapiens
acccaaaaatatctcct

SEQ ID NO: 6611064 - DNA, 18 bp, Homo sapiens
acccaaaacacacaattt

SEQ ID NO: 6611065 - DNA, 18 bp, Homo sapiens
acccaaaaccctgaagcc

SEQ ID NO: 6611066 - DNA, 12 bp, Homo sapiens
acccaaaagcac

SEQ ID NO: 6611067 - DNA, 23 bp, Homo sapiens
acccaaaagtcaaaaggtgcctg

SEQ ID NO: 6611068 - DNA, 21 bp, Homo sapiens
acccaaacaaaaatgactcta

SEQ ID NO: 6611069 - DNA, 18 bp, Homo sapiens
acccaaacacttctgctt

SEQ ID NO: 6611070 - DNA, 14 bp, Homo sapiens
acccaaacccccaa

SEQ ID NO: 6611071 - DNA, 21 bp, Homo sapiens
acccaaaccccctgcagccca

SEQ ID NO: 6611072 - DNA, 14 bp, Homo sapiens
acccaaaccctagg

SEQ ID NO: 6611073 - DNA, 18 bp, Homo sapiens
acccaaagaggtatttat

SEQ ID NO: 6611074 - DNA, 13 bp, Homo sapiens
acccaaagcaaaa

SEQ ID NO: 6611075 - DNA, 16 bp, Homo sapiens
acccaaaggtggcctg

SEQ ID NO: 6611076 - DNA, 22 bp, Homo sapiens
acccaaatcacatctcacctcc

SEQ ID NO: 6611077 - DNA, 20 bp, Homo sapiens
acccaaatgttcatcaatga

SEQ ID NO: 6611078 - DNA, 15 bp, Homo sapiens
acccaaatttccctg

SEQ ID NO: 6611079 - DNA, 17 bp, Homo sapiens
acccaacagcctctgtg

SEQ ID NO: 6611080 - DNA, 15 bp, Homo sapiens
acccaacagtttatt

SEQ ID NO: 6611081 - DNA, 23 bp, Homo sapiens
acccaaccagtaggatatttcta

SEQ ID NO: 6611082 - DNA, 18 bp, Homo sapiens
acccaacccaaaccatga

SEQ ID NO: 6611083 - DNA, 18 bp, Homo sapiens
acccaaccctatctcctg

SEQ ID NO: 6611084 - DNA, 16 bp, Homo sapiens
acccaaccctgccctg

SEQ ID NO: 6611085 - DNA, 21 bp, Homo sapiens
acccaaccctgccctgcccca

SEQ ID NO: 6611086 - DNA, 15 bp, Homo sapiens
acccaacctgtcctt

SEQ ID NO: 6611087 - DNA, 23 bp, Homo sapiens
acccaacctgtccttactcagag

SEQ ID NO: 6611088 - DNA, 16 bp, Homo sapiens
acccaacgctccaaag

SEQ ID NO: 6611089 - DNA, 23 bp, Homo sapiens
acccaacggccctgcagccagct

SEQ ID NO: 6611090 - DNA, 16 bp, Homo sapiens
acccaactctcctgga

SEQ ID NO: 6611091 - DNA, 18 bp, Homo sapiens
acccaactgacctgccag

SEQ ID NO: 6611092 - DNA, 18 bp, Homo sapiens
acccaactgacttctgct

SEQ ID NO: 6611093 - DNA, 15 bp, Homo sapiens
acccaactgacttgt

SEQ ID NO: 6611094 - DNA, 18 bp, Homo sapiens
acccaactgggggcaaag

SEQ ID NO: 6611095 - DNA, 23 bp, Homo sapiens
acccaactttctcactgctgtca

SEQ ID NO: 6611096 - DNA, 16 bp, Homo sapiens
acccaagaaaacctgt

SEQ ID NO: 6611097 - DNA, 17 bp, Homo sapiens
acccaagagaggaagga

SEQ ID NO: 6611098 - DNA, 17 bp, Homo sapiens
acccaagagcaagggct

SEQ ID NO: 6611099 - DNA, 16 bp, Homo sapiens
acccaagaggtgggga

SEQ ID NO: 6611100 - DNA, 17 bp, Homo sapiens
acccaagatgtggcctt

SEQ ID NO: 6611101 - DNA, 22 bp, Homo sapiens
acccaagcctcatattttctgt

SEQ ID NO: 6611102 - DNA, 17 bp, Homo sapiens
acccaagcctgatccag

SEQ ID NO: 6611103 - DNA, 16 bp, Homo sapiens
acccaagcctgctggc

SEQ ID NO: 6611104 - DNA, 19 bp, Homo sapiens
acccaagcctgctggctgc

SEQ ID NO: 6611105 - DNA, 20 bp, Homo sapiens
acccaagcctgctggctgcg

SEQ ID NO: 6611106 - DNA, 17 bp, Homo sapiens
acccaagctctggggat

SEQ ID NO: 6611107 - DNA, 13 bp, Homo sapiens
acccaagctgtgg

SEQ ID NO: 6611108 - DNA, 21 bp, Homo sapiens
acccaagctgtggcagccgtc

SEQ ID NO: 6611109 - DNA, 18 bp, Homo sapiens
acccaagcttggcagccg

SEQ ID NO: 6611110 - DNA, 15 bp, Homo sapiens
acccaaggagcacag

SEQ ID NO: 6611111 - DNA, 16 bp, Homo sapiens
acccaaggagcacagg

SEQ ID NO: 6611112 - DNA, 19 bp, Homo sapiens
acccaagggcctggcctga

SEQ ID NO: 6611113 - DNA, 23 bp, Homo sapiens
acccaagggtcgcctatttttaa

SEQ ID NO: 6611114 - DNA, 18 bp, Homo sapiens
acccaaggtggtcttgga

SEQ ID NO: 6611115 - DNA, 17 bp, Homo sapiens
acccaagtactttccaa

SEQ ID NO: 6611116 - DNA, 17 bp, Homo sapiens
acccaagtagctgctac

SEQ ID NO: 6611117 - DNA, 20 bp, Homo sapiens
acccaagtatacaataaagt

SEQ ID NO: 6611118 - DNA, 12 bp, Homo sapiens
acccaagtccac

SEQ ID NO: 6611119 - DNA, 14 bp, Homo sapiens
acccaagtcttctc

SEQ ID NO: 6611120 - DNA, 16 bp, Homo sapiens
acccaagtgaaggttc

SEQ ID NO: 6611121 - DNA, 16 bp, Homo sapiens
acccaagtttatttct

SEQ ID NO: 6611122 - DNA, 12 bp, Homo sapiens
acccaataaaga

SEQ ID NO: 6611123 - DNA, 15 bp, Homo sapiens
acccaataattctgt

SEQ ID NO: 6611124 - DNA, 21 bp, Homo sapiens
acccaatagctgcccatttcg

SEQ ID NO: 6611125 - DNA, 13 bp, Homo sapiens
acccaatccaaat

SEQ ID NO: 6611126 - DNA, 15 bp, Homo sapiens
acccaatccctctcc

SEQ ID NO: 6611127 - DNA, 18 bp, Homo sapiens
acccaatccctctccact

SEQ ID NO: 6611128 - DNA, 22 bp, Homo sapiens
acccaatctgcacactccaggc

SEQ ID NO: 6611129 - DNA, 13 bp, Homo sapiens
acccaatgattca

SEQ ID NO: 6611130 - DNA, 20 bp, Homo sapiens
acccaatgcacacaaaacaa

SEQ ID NO: 6611131 - DNA, 22 bp, Homo sapiens
acccaattaagtcctactttac

SEQ ID NO: 6611132 - DNA, 12 bp, Homo sapiens
acccaatttccc

SEQ ID NO: 6611133 - DNA, 17 bp, Homo sapiens
acccaattttaaaaaat

SEQ ID NO: 6611134 - DNA, 15 bp, Homo sapiens
acccacaaactccag

SEQ ID NO: 6611135 - DNA, 17 bp, Homo sapiens
acccacaaactccaggc

SEQ ID NO: 6611136 - DNA, 17 bp, Homo sapiens
acccacaaactgcctgt

SEQ ID NO: 6611137 - DNA, 13 bp, Homo sapiens
acccacaaagaaa

SEQ ID NO: 6611138 - DNA, 15 bp, Homo sapiens
acccacaaccctggg

SEQ ID NO: 6611139 - DNA, 15 bp, Homo sapiens
acccacaagaaatga

SEQ ID NO: 6611140 - DNA, 13 bp, Homo sapiens
acccacaagcccg

SEQ ID NO: 6611141 - DNA, 14 bp, Homo sapiens
acccacaagctgcc

SEQ ID NO: 6611142 - DNA, 22 bp, Homo sapiens
acccacaagctgcctctgacag

SEQ ID NO: 6611143 - DNA, 17 bp, Homo sapiens
acccacaagtgccactg

SEQ ID NO: 6611144 - DNA, 15 bp, Homo sapiens
acccacaatctgagc

SEQ ID NO: 6611145 - DNA, 18 bp, Homo sapiens
acccacacagaggacctc

SEQ ID NO: 6611146 - DNA, 15 bp, Homo sapiens
acccacacagctgcc

SEQ ID NO: 6611147 - DNA, 20 bp, Homo sapiens
acccacacagctgccctagc

SEQ ID NO: 6611148 - DNA, 21 bp, Homo sapiens
acccacaccccgtctgcccct

SEQ ID NO: 6611149 - DNA, 19 bp, Homo sapiens
acccacaccctacagcaga

SEQ ID NO: 6611150 - DNA, 23 bp, Homo sapiens
acccacactacgcagaagagaaa

SEQ ID NO: 6611151 - DNA, 23 bp, Homo sapiens
acccacactcagatcctcctcat

SEQ ID NO: 6611152 - DNA, 12 bp, Homo sapiens
acccacagaact

SEQ ID NO: 6611153 - DNA, 23 bp, Homo sapiens
acccacagagtgccatccctgag

SEQ ID NO: 6611154 - DNA, 16 bp, Homo sapiens
acccacagagtgtggt

SEQ ID NO: 6611155 - DNA, 12 bp, Homo sapiens
acccacagccat

SEQ ID NO: 6611156 - DNA, 17 bp, Homo sapiens
acccacagccctgaaac

SEQ ID NO: 6611157 - DNA, 13 bp, Homo sapiens
acccacagcctct

SEQ ID NO: 6611158 - DNA, 22 bp, Homo sapiens
acccacagcgtcattttgaatc

SEQ ID NO: 6611159 - DNA, 11 bp, Homo sapiens
acccacagctc

SEQ ID NO: 6611160 - DNA, 16 bp, Homo sapiens
acccacagctcagctg

SEQ ID NO: 6611161 - DNA, 17 bp, Homo sapiens
acccacagctcagctgc

SEQ ID NO: 6611162 - DNA, 20 bp, Homo sapiens
acccacagctcagctgccca

SEQ ID NO: 6611163 - DNA, 13 bp, Homo sapiens
acccacagctctg

SEQ ID NO: 6611164 - DNA, 15 bp, Homo sapiens
acccacagctctggg

SEQ ID NO: 6611165 - DNA, 16 bp, Homo sapiens
acccacagctctgggc

SEQ ID NO: 6611166 - DNA, 17 bp, Homo sapiens
acccacagctctgggcc

SEQ ID NO: 6611167 - DNA, 18 bp, Homo sapiens
acccacagggcctgactt

SEQ ID NO: 6611168 - DNA, 20 bp, Homo sapiens
acccacaggtgaggggcagg

SEQ ID NO: 6611169 - DNA, 16 bp, Homo sapiens
acccacagtttgagac

SEQ ID NO: 6611170 - DNA, 13 bp, Homo sapiens
acccacataaaca

SEQ ID NO: 6611171 - DNA, 21 bp, Homo sapiens
acccacatatcttacagccag

SEQ ID NO: 6611172 - DNA, 20 bp, Homo sapiens
acccacatggggttcctggt

SEQ ID NO: 6611173 - DNA, 21 bp, Homo sapiens
acccacatggggttcctggtt

SEQ ID NO: 6611174 - DNA, 18 bp, Homo sapiens
acccacatgtaaatgata

SEQ ID NO: 6611175 - DNA, 15 bp, Homo sapiens
acccacatgtgacac

SEQ ID NO: 6611176 - DNA, 16 bp, Homo sapiens
acccacatgtgacaca

SEQ ID NO: 6611177 - DNA, 17 bp, Homo sapiens
acccaccaaactgcaca

SEQ ID NO: 6611178 - DNA, 20 bp, Homo sapiens
acccaccaaatgcctctgcc

SEQ ID NO: 6611179 - DNA, 12 bp, Homo sapiens
acccaccacaca

SEQ ID NO: 6611180 - DNA, 16 bp, Homo sapiens
acccaccactctcagg

SEQ ID NO: 6611181 - DNA, 12 bp, Homo sapiens
acccaccagcct

SEQ ID NO: 6611182 - DNA, 21 bp, Homo sapiens
acccaccagcctaagaagctc

SEQ ID NO: 6611183 - DNA, 12 bp, Homo sapiens
acccaccagctc

SEQ ID NO: 6611184 - DNA, 19 bp, Homo sapiens
acccaccagctccacacat

SEQ ID NO: 6611185 - DNA, 13 bp, Homo sapiens
acccaccaggcca

SEQ ID NO: 6611186 - DNA, 18 bp, Homo sapiens
acccaccaggccagctca

SEQ ID NO: 6611187 - DNA, 21 bp, Homo sapiens
acccaccaggccagctcagga

SEQ ID NO: 6611188 - DNA, 16 bp, Homo sapiens
acccaccagttgaatt

SEQ ID NO: 6611189 - DNA, 21 bp, Homo sapiens
acccacccaaaagtcacccag

SEQ ID NO: 6611190 - DNA, 15 bp, Homo sapiens
acccacccagaatga

SEQ ID NO: 6611191 - DNA, 22 bp, Homo sapiens
acccacccatcttcctgctgct

SEQ ID NO: 6611192 - DNA, 23 bp, Homo sapiens
acccacccatcttcctgctgctg

SEQ ID NO: 6611193 - DNA, 14 bp, Homo sapiens
acccaccccaaact

SEQ ID NO: 6611194 - DNA, 22 bp, Homo sapiens
acccaccccacacctgcagtgc

SEQ ID NO: 6611195 - DNA, 15 bp, Homo sapiens
acccaccccacagac

SEQ ID NO: 6611196 - DNA, 16 bp, Homo sapiens
acccaccccacctgca

SEQ ID NO: 6611197 - DNA, 17 bp, Homo sapiens
acccaccccacctgcag

SEQ ID NO: 6611198 - DNA, 23 bp, Homo sapiens
acccaccccacctgcagggctgc

SEQ ID NO: 6611199 - DNA, 15 bp, Homo sapiens
acccacccccaccca

SEQ ID NO: 6611200 - DNA, 16 bp, Homo sapiens
acccacccccagcctt

SEQ ID NO: 6611201 - DNA, 23 bp, Homo sapiens
acccacccccagccttgcccagc

SEQ ID NO: 6611202 - DNA, 17 bp, Homo sapiens
acccaccccctctttgt

SEQ ID NO: 6611203 - DNA, 14 bp, Homo sapiens
acccaccccctgcc

SEQ ID NO: 6611204 - DNA, 17 bp, Homo sapiens
acccaccccctgcctgg

SEQ ID NO: 6611205 - DNA, 18 bp, Homo sapiens
acccaccccctgcctggt

SEQ ID NO: 6611206 - DNA, 23 bp, Homo sapiens
acccaccccctttggtttgacaa

SEQ ID NO: 6611207 - DNA, 14 bp, Homo sapiens
acccacccctcctg

SEQ ID NO: 6611208 - DNA, 18 bp, Homo sapiens
acccacccctcctgggcc

SEQ ID NO: 6611209 - DNA, 14 bp, Homo sapiens
acccacccctgccc

SEQ ID NO: 6611210 - DNA, 15 bp, Homo sapiens
acccacccctgccca

SEQ ID NO: 6611211 - DNA, 13 bp, Homo sapiens
acccacccctgtg

SEQ ID NO: 6611212 - DNA, 14 bp, Homo sapiens
acccacccctgtgc

SEQ ID NO: 6611213 - DNA, 22 bp, Homo sapiens
acccacccgacctggctgcccc

SEQ ID NO: 6611214 - DNA, 22 bp, Homo sapiens
acccaccctctccacacccagc

SEQ ID NO: 6611215 - DNA, 13 bp, Homo sapiens
acccaccctctgg

SEQ ID NO: 6611216 - DNA, 18 bp, Homo sapiens
acccaccctctggtcctt

SEQ ID NO: 6611217 - DNA, 15 bp, Homo sapiens
acccaccctgtggct

SEQ ID NO: 6611218 - DNA, 18 bp, Homo sapiens
acccacccttacttcctg

SEQ ID NO: 6611219 - DNA, 15 bp, Homo sapiens
acccacccttctccc

SEQ ID NO: 6611220 - DNA, 21 bp, Homo sapiens
acccacccttctcccctgccc

SEQ ID NO: 6611221 - DNA, 14 bp, Homo sapiens
acccaccctttttt

SEQ ID NO: 6611222 - DNA, 22 bp, Homo sapiens
acccaccgatggagcccccaga

SEQ ID NO: 6611223 - DNA, 16 bp, Homo sapiens
acccaccgggccactc

SEQ ID NO: 6611224 - DNA, 18 bp, Homo sapiens
acccaccgggccactcct

SEQ ID NO: 6611225 - DNA, 19 bp, Homo sapiens
acccaccgggccactcctt

SEQ ID NO: 6611226 - DNA, 22 bp, Homo sapiens
acccaccgggccactccttcct

SEQ ID NO: 6611227 - DNA, 20 bp, Homo sapiens
acccaccgtccgccctgctc

SEQ ID NO: 6611228 - DNA, 23 bp, Homo sapiens
acccaccgtcctgtcagctcctt

SEQ ID NO: 6611229 - DNA, 21 bp, Homo sapiens
acccaccgtctcggccctgaa

SEQ ID NO: 6611230 - DNA, 15 bp, Homo sapiens
acccaccgtggagga

SEQ ID NO: 6611231 - DNA, 22 bp, Homo sapiens
acccaccgtggaggaggaaggc

SEQ ID NO: 6611232 - DNA, 23 bp, Homo sapiens
acccacctacttagatatttcat

SEQ ID NO: 6611233 - DNA, 13 bp, Homo sapiens
acccacctagaac

SEQ ID NO: 6611234 - DNA, 16 bp, Homo sapiens
acccacctcagcctcc

SEQ ID NO: 6611235 - DNA, 13 bp, Homo sapiens
acccacctccacc

SEQ ID NO: 6611236 - DNA, 15 bp, Homo sapiens
acccacctccaccca

SEQ ID NO: 6611237 - DNA, 18 bp, Homo sapiens
acccacctccccctcccc

SEQ ID NO: 6611238 - DNA, 23 bp, Homo sapiens
acccacctccccctccccggcca

SEQ ID NO: 6611239 - DNA, 14 bp, Homo sapiens
acccacctccctgc

SEQ ID NO: 6611240 - DNA, 13 bp, Homo sapiens
acccacctcctgc

SEQ ID NO: 6611241 - DNA, 12 bp, Homo sapiens
acccacctctgc

SEQ ID NO: 6611242 - DNA, 15 bp, Homo sapiens
acccacctctgccac

SEQ ID NO: 6611243 - DNA, 16 bp, Homo sapiens
acccacctctggccct

SEQ ID NO: 6611244 - DNA, 17 bp, Homo sapiens
acccacctctggccctg

SEQ ID NO: 6611245 - DNA, 19 bp, Homo sapiens
acccacctctggccctgtg

SEQ ID NO: 6611246 - DNA, 18 bp, Homo sapiens
acccacctgaaatgcagt

SEQ ID NO: 6611247 - DNA, 12 bp, Homo sapiens
acccacctgagc

SEQ ID NO: 6611248 - DNA, 18 bp, Homo sapiens
acccacctgagctttgga

SEQ ID NO: 6611249 - DNA, 14 bp, Homo sapiens
acccacctgctagt

SEQ ID NO: 6611250 - DNA, 21 bp, Homo sapiens
acccacctgctagtgtgaatt

SEQ ID NO: 6611251 - DNA, 16 bp, Homo sapiens
acccacctgctgctgt

SEQ ID NO: 6611252 - DNA, 17 bp, Homo sapiens
acccacctggagcccgc

SEQ ID NO: 6611253 - DNA, 14 bp, Homo sapiens
acccacctgggcca

SEQ ID NO: 6611254 - DNA, 19 bp, Homo sapiens
acccacctggtggcctctg

SEQ ID NO: 6611255 - DNA, 19 bp, Homo sapiens
acccacctgtggggcctgg

SEQ ID NO: 6611256 - DNA, 21 bp, Homo sapiens
acccacctgtggggcctgggg

SEQ ID NO: 6611257 - DNA, 19 bp, Homo sapiens
acccacctgttttctgaaa

SEQ ID NO: 6611258 - DNA, 15 bp, Homo sapiens
acccaccttccttgc

SEQ ID NO: 6611259 - DNA, 23 bp, Homo sapiens
acccaccttccttgcgaccacca

SEQ ID NO: 6611260 - DNA, 19 bp, Homo sapiens
acccaccttgttggagcct

SEQ ID NO: 6611261 - DNA, 17 bp, Homo sapiens
acccacgaggaggaacc

SEQ ID NO: 6611262 - DNA, 18 bp, Homo sapiens
acccacgaggaggaacca

SEQ ID NO: 6611263 - DNA, 18 bp, Homo sapiens
acccacgattttctccag

SEQ ID NO: 6611264 - DNA, 19 bp, Homo sapiens
acccacgattttctccagc

SEQ ID NO: 6611265 - DNA, 20 bp, Homo sapiens
acccacgattttctccagct

SEQ ID NO: 6611266 - DNA, 21 bp, Homo sapiens
acccacgtattcattcagtga

SEQ ID NO: 6611267 - DNA, 21 bp, Homo sapiens
acccacgtccacgcggccacc

SEQ ID NO: 6611268 - DNA, 13 bp, Homo sapiens
acccacgtggaga

SEQ ID NO: 6611269 - DNA, 13 bp, Homo sapiens
acccactaaagag

SEQ ID NO: 6611270 - DNA, 14 bp, Homo sapiens
acccactaaagagt

SEQ ID NO: 6611271 - DNA, 16 bp, Homo sapiens
acccactaccatacag

SEQ ID NO: 6611272 - DNA, 18 bp, Homo sapiens
acccactacccttctcct

SEQ ID NO: 6611273 - DNA, 15 bp, Homo sapiens
acccactagccctct

SEQ ID NO: 6611274 - DNA, 19 bp, Homo sapiens
acccactagccctctttct

SEQ ID NO: 6611275 - DNA, 15 bp, Homo sapiens
acccactcaccaggg

SEQ ID NO: 6611276 - DNA, 17 bp, Homo sapiens
acccactcaccagggtc

SEQ ID NO: 6611277 - DNA, 12 bp, Homo sapiens
acccactcagcc

SEQ ID NO: 6611278 - DNA, 20 bp, Homo sapiens
acccactccctgtagtgaat

SEQ ID NO: 6611279 - DNA, 23 bp, Homo sapiens
acccactccggattccggccctg

SEQ ID NO: 6611280 - DNA, 16 bp, Homo sapiens
acccactctggtggcc

SEQ ID NO: 6611281 - DNA, 17 bp, Homo sapiens
acccactctttgctaca

SEQ ID NO: 6611282 - DNA, 16 bp, Homo sapiens
acccactgacccaact

SEQ ID NO: 6611283 - DNA, 22 bp, Homo sapiens
acccactgacccaactgatcct

SEQ ID NO: 6611284 - DNA, 17 bp, Homo sapiens
acccactgcatgcagaa

SEQ ID NO: 6611285 - DNA, 12 bp, Homo sapiens
acccactgcccc

SEQ ID NO: 6611286 - DNA, 23 bp, Homo sapiens
acccactgccccgtgtgaatgta

SEQ ID NO: 6611287 - DNA, 13 bp, Homo sapiens
acccactgctctg

SEQ ID NO: 6611288 - DNA, 20 bp, Homo sapiens
acccactgctgaaaaagaaa

SEQ ID NO: 6611289 - DNA, 20 bp, Homo sapiens
acccactgcttttggtctgt

SEQ ID NO: 6611290 - DNA, 21 bp, Homo sapiens
acccactggactcacctcccc

SEQ ID NO: 6611291 - DNA, 14 bp, Homo sapiens
acccactggccagt

SEQ ID NO: 6611292 - DNA, 17 bp, Homo sapiens
acccactggccagtcct

SEQ ID NO: 6611293 - DNA, 23 bp, Homo sapiens
acccactggccagtcctagagct

SEQ ID NO: 6611294 - DNA, 16 bp, Homo sapiens
acccactgtccgcctc

SEQ ID NO: 6611295 - DNA, 17 bp, Homo sapiens
acccactgtccgcctct

SEQ ID NO: 6611296 - DNA, 18 bp, Homo sapiens
acccactgtccgcctctg

SEQ ID NO: 6611297 - DNA, 23 bp, Homo sapiens
acccactgtgaaagttggaatat

SEQ ID NO: 6611298 - DNA, 13 bp, Homo sapiens
acccactgtgcac

SEQ ID NO: 6611299 - DNA, 16 bp, Homo sapiens
acccactgtgcaccag

SEQ ID NO: 6611300 - DNA, 17 bp, Homo sapiens
acccacttccctgcaag

SEQ ID NO: 6611301 - DNA, 19 bp, Homo sapiens
acccacttccctgcaaggt

SEQ ID NO: 6611302 - DNA, 16 bp, Homo sapiens
acccacttccctgggc

SEQ ID NO: 6611303 - DNA, 17 bp, Homo sapiens
acccacttctcatcaca

SEQ ID NO: 6611304 - DNA, 19 bp, Homo sapiens
acccacttctcatcacaca

SEQ ID NO: 6611305 - DNA, 22 bp, Homo sapiens
acccacttctcatcacacacat

SEQ ID NO: 6611306 - DNA, 19 bp, Homo sapiens
acccacttctggcctccag

SEQ ID NO: 6611307 - DNA, 20 bp, Homo sapiens
acccacttctggcctccagc

SEQ ID NO: 6611308 - DNA, 12 bp, Homo sapiens
acccacttgcct

SEQ ID NO: 6611309 - DNA, 15 bp, Homo sapiens
acccacttgtcactg

SEQ ID NO: 6611310 - DNA, 23 bp, Homo sapiens
acccacttgtcactgacacaaag

SEQ ID NO: 6611311 - DNA, 17 bp, Homo sapiens
acccactttgtaatttt

SEQ ID NO: 6611312 - DNA, 24 bp, Homo sapiens
acccagaaatagccactattaaca

SEQ ID NO: 6611313 - DNA, 19 bp, Homo sapiens
acccagaaattccttccca

SEQ ID NO: 6611314 - DNA, 16 bp, Homo sapiens
acccagaagaaaatag

SEQ ID NO: 6611315 - DNA, 15 bp, Homo sapiens
acccagaaggaaccc

SEQ ID NO: 6611316 - DNA, 16 bp, Homo sapiens
acccagaatccctcta

SEQ ID NO: 6611317 - DNA, 18 bp, Homo sapiens
acccagaatgagacatcc

SEQ ID NO: 6611318 - DNA, 20 bp, Homo sapiens
acccagaatgagacatccag

SEQ ID NO: 6611319 - DNA, 18 bp, Homo sapiens
acccagaatggagcctgc

SEQ ID NO: 6611320 - DNA, 17 bp, Homo sapiens
acccagaatgtaaaaaa

SEQ ID NO: 6611321 - DNA, 15 bp, Homo sapiens
acccagacagctccc

SEQ ID NO: 6611322 - DNA, 19 bp, Homo sapiens
acccagacataaaggaaaa

SEQ ID NO: 6611323 - DNA, 19 bp, Homo sapiens
acccagacccaactcgcct

SEQ ID NO: 6611324 - DNA, 16 bp, Homo sapiens
acccagaccctccttc

SEQ ID NO: 6611325 - DNA, 18 bp, Homo sapiens
acccagaccctccttccc

SEQ ID NO: 6611326 - DNA, 15 bp, Homo sapiens
acccagactcagaca

SEQ ID NO: 6611327 - DNA, 18 bp, Homo sapiens
acccagactctaaatatt

SEQ ID NO: 6611328 - DNA, 19 bp, Homo sapiens
acccagactggagtgcagt

SEQ ID NO: 6611329 - DNA, 14 bp, Homo sapiens
acccagagaatata

SEQ ID NO: 6611330 - DNA, 15 bp, Homo sapiens
acccagagagaaaaa

SEQ ID NO: 6611331 - DNA, 19 bp, Homo sapiens
acccagagagaaaaagaga

SEQ ID NO: 6611332 - DNA, 21 bp, Homo sapiens
acccagagagaggggcctgca

SEQ ID NO: 6611333 - DNA, 22 bp, Homo sapiens
acccagagagaggggcctgcag

SEQ ID NO: 6611334 - DNA, 14 bp, Homo sapiens
acccagagatgcct

SEQ ID NO: 6611335 - DNA, 19 bp, Homo sapiens
acccagagcacaggagctg

SEQ ID NO: 6611336 - DNA, 23 bp, Homo sapiens
acccagagcattacgtgagccag

SEQ ID NO: 6611337 - DNA, 24 bp, Homo sapiens
acccagagcattacgtgagccagg

SEQ ID NO: 6611338 - DNA, 22 bp, Homo sapiens
acccagagccctctgagccgcc

SEQ ID NO: 6611339 - DNA, 16 bp, Homo sapiens
acccagagctgtattt

SEQ ID NO: 6611340 - DNA, 14 bp, Homo sapiens
acccagaggaggca

SEQ ID NO: 6611341 - DNA, 13 bp, Homo sapiens
acccagaggccct

SEQ ID NO: 6611342 - DNA, 18 bp, Homo sapiens
acccagaggggacgctga

SEQ ID NO: 6611343 - DNA, 22 bp, Homo sapiens
acccagaggggacgctgaggaa

SEQ ID NO: 6611344 - DNA, 22 bp, Homo sapiens
acccagagggtagggcagcaga

SEQ ID NO: 6611345 - DNA, 18 bp, Homo sapiens
acccagaggtccaggtcc

SEQ ID NO: 6611346 - DNA, 13 bp, Homo sapiens
acccagaggtctc

SEQ ID NO: 6611347 - DNA, 22 bp, Homo sapiens
acccagaggtctcatctcccag

SEQ ID NO: 6611348 - DNA, 16 bp, Homo sapiens
acccagaggtctccct

SEQ ID NO: 6611349 - DNA, 14 bp, Homo sapiens
acccagagtcagga

SEQ ID NO: 6611350 - DNA, 17 bp, Homo sapiens
acccagagtcaggaaga

SEQ ID NO: 6611351 - DNA, 19 bp, Homo sapiens
acccagagtggagtctgag

SEQ ID NO: 6611352 - DNA, 22 bp, Homo sapiens
acccagatatggaaacagaaga

SEQ ID NO: 6611353 - DNA, 14 bp, Homo sapiens
acccagatcaggaa

SEQ ID NO: 6611354 - DNA, 15 bp, Homo sapiens
acccagatcaggaac

SEQ ID NO: 6611355 - DNA, 16 bp, Homo sapiens
acccagatcaggaacc

SEQ ID NO: 6611356 - DNA, 17 bp, Homo sapiens
acccagatcgctgtgtt

SEQ ID NO: 6611357 - DNA, 11 bp, Homo sapiens
acccagatgcc

SEQ ID NO: 6611358 - DNA, 16 bp, Homo sapiens
acccagattgtgtaca

SEQ ID NO: 6611359 - DNA, 17 bp, Homo sapiens
acccagattgtgtacat

SEQ ID NO: 6611360 - DNA, 18 bp, Homo sapiens
acccagattgtgtacata

SEQ ID NO: 6611361 - DNA, 20 bp, Homo sapiens
acccagattgtgtacataga

SEQ ID NO: 6611362 - DNA, 16 bp, Homo sapiens
acccagcagcagcagc

SEQ ID NO: 6611363 - DNA, 13 bp, Homo sapiens
acccagcagcgcc

SEQ ID NO: 6611364 - DNA, 22 bp, Homo sapiens
acccagcaggaagccaggctga

SEQ ID NO: 6611365 - DNA, 14 bp, Homo sapiens
acccagcaggcaga

SEQ ID NO: 6611366 - DNA, 20 bp, Homo sapiens
acccagcaggggcagaagga

SEQ ID NO: 6611367 - DNA, 17 bp, Homo sapiens
acccagcagttctgtta

SEQ ID NO: 6611368 - DNA, 20 bp, Homo sapiens
acccagcatctcccagcaag

SEQ ID NO: 6611369 - DNA, 17 bp, Homo sapiens
acccagccaccttcctg

SEQ ID NO: 6611370 - DNA, 19 bp, Homo sapiens
acccagccacgactgccat

SEQ ID NO: 6611371 - DNA, 12 bp, Homo sapiens
acccagccagct

SEQ ID NO: 6611372 - DNA, 15 bp, Homo sapiens
acccagccagctcct

SEQ ID NO: 6611373 - DNA, 14 bp, Homo sapiens
acccagccagctgc

SEQ ID NO: 6611374 - DNA, 17 bp, Homo sapiens
acccagccagctgcagg

SEQ ID NO: 6611375 - DNA, 13 bp, Homo sapiens
acccagccatctg

SEQ ID NO: 6611376 - DNA, 19 bp, Homo sapiens
acccagccatctgcccagg

SEQ ID NO: 6611377 - DNA, 16 bp, Homo sapiens
acccagcccacccccg

SEQ ID NO: 6611378 - DNA, 20 bp, Homo sapiens
acccagccccaaggggtggc

SEQ ID NO: 6611379 - DNA, 22 bp, Homo sapiens
acccagccccaaggggtggccg

SEQ ID NO: 6611380 - DNA, 13 bp, Homo sapiens
acccagcccctgc

SEQ ID NO: 6611381 - DNA, 19 bp, Homo sapiens
acccagccccttcccctgg

SEQ ID NO: 6611382 - DNA, 17 bp, Homo sapiens
acccagccccttgagaa

SEQ ID NO: 6611383 - DNA, 15 bp, Homo sapiens
acccagccctcatcc

SEQ ID NO: 6611384 - DNA, 19 bp, Homo sapiens
acccagccctggtctcagc

SEQ ID NO: 6611385 - DNA, 21 bp, Homo sapiens
acccagccctggtctcagcag

SEQ ID NO: 6611386 - DNA, 12 bp, Homo sapiens
acccagcccttc

SEQ ID NO: 6611387 - DNA, 21 bp, Homo sapiens
acccagccgccatcagcccaa

SEQ ID NO: 6611388 - DNA, 23 bp, Homo sapiens
acccagccgtcgtctccctcgac

SEQ ID NO: 6611389 - DNA, 12 bp, Homo sapiens
acccagcctcag

SEQ ID NO: 6611390 - DNA, 17 bp, Homo sapiens
acccagcctcagtcctc

SEQ ID NO: 6611391 - DNA, 23 bp, Homo sapiens
acccagcctctgtagttcttttt

SEQ ID NO: 6611392 - DNA, 11 bp, Homo sapiens
acccagcctgg

SEQ ID NO: 6611393 - DNA, 13 bp, Homo sapiens
acccagcctgtcc

SEQ ID NO: 6611394 - DNA, 13 bp, Homo sapiens
acccagcgagccc

SEQ ID NO: 6611395 - DNA, 23 bp, Homo sapiens
acccagcgagccctggtggcagt

SEQ ID NO: 6611396 - DNA, 23 bp, Homo sapiens
acccagcggcttagccaagccct

SEQ ID NO: 6611397 - DNA, 14 bp, Homo sapiens
acccagcggtccaa

SEQ ID NO: 6611398 - DNA, 16 bp, Homo sapiens
acccagcgtggcccag

SEQ ID NO: 6611399 - DNA, 18 bp, Homo sapiens
acccagcgtggcccaggc

SEQ ID NO: 6611400 - DNA, 19 bp, Homo sapiens
acccagcgtggcccaggcc

SEQ ID NO: 6611401 - DNA, 17 bp, Homo sapiens
acccagctactctgtcc

SEQ ID NO: 6611402 - DNA, 22 bp, Homo sapiens
acccagctactctgtccaggcc

SEQ ID NO: 6611403 - DNA, 22 bp, Homo sapiens
acccagctactgaaccagccac

SEQ ID NO: 6611404 - DNA, 16 bp, Homo sapiens
acccagctccaggccc

SEQ ID NO: 6611405 - DNA, 14 bp, Homo sapiens
acccagctccaggg

SEQ ID NO: 6611406 - DNA, 20 bp, Homo sapiens
acccagctcccttcttccct

SEQ ID NO: 6611407 - DNA, 16 bp, Homo sapiens
acccagctcctctgag

SEQ ID NO: 6611408 - DNA, 21 bp, Homo sapiens
acccagctcctctgagccata

SEQ ID NO: 6611409 - DNA, 22 bp, Homo sapiens
acccagctccttttgtccccag

SEQ ID NO: 6611410 - DNA, 16 bp, Homo sapiens
acccagctctactcca

SEQ ID NO: 6611411 - DNA, 17 bp, Homo sapiens
acccagctctactccag

SEQ ID NO: 6611412 - DNA, 13 bp, Homo sapiens
acccagctctcag

SEQ ID NO: 6611413 - DNA, 22 bp, Homo sapiens
acccagctctcagggctgtctt

SEQ ID NO: 6611414 - DNA, 15 bp, Homo sapiens
acccagctctggtcc

SEQ ID NO: 6611415 - DNA, 19 bp, Homo sapiens
acccagctcttctccccca

SEQ ID NO: 6611416 - DNA, 14 bp, Homo sapiens
acccagctgatggg

SEQ ID NO: 6611417 - DNA, 17 bp, Homo sapiens
acccagctgccacctct

SEQ ID NO: 6611418 - DNA, 19 bp, Homo sapiens
acccagctggtcctgtgga

SEQ ID NO: 6611419 - DNA, 20 bp, Homo sapiens
acccagctggtcctgtggat

SEQ ID NO: 6611420 - DNA, 20 bp, Homo sapiens
acccagctgtgcccctcccc

SEQ ID NO: 6611421 - DNA, 20 bp, Homo sapiens
acccagcttagagttcttct

SEQ ID NO: 6611422 - DNA, 14 bp, Homo sapiens
acccaggaaaggag

SEQ ID NO: 6611423 - DNA, 21 bp, Homo sapiens
acccaggaagggaaagcgggc

SEQ ID NO: 6611424 - DNA, 15 bp, Homo sapiens
acccaggaatgaccc

SEQ ID NO: 6611425 - DNA, 14 bp, Homo sapiens
acccaggacaagca

SEQ ID NO: 6611426 - DNA, 17 bp, Homo sapiens
acccaggacaagcatgg

SEQ ID NO: 6611427 - DNA, 18 bp, Homo sapiens
acccaggacatctcctgg

SEQ ID NO: 6611428 - DNA, 15 bp, Homo sapiens
acccaggactcctcc

SEQ ID NO: 6611429 - DNA, 23 bp, Homo sapiens
acccaggagatggaagttgcagt

SEQ ID NO: 6611430 - DNA, 13 bp, Homo sapiens
acccaggagcccc

SEQ ID NO: 6611431 - DNA, 19 bp, Homo sapiens
acccaggagccccgaggcc

SEQ ID NO: 6611432 - DNA, 19 bp, Homo sapiens
acccaggagggagggggct

SEQ ID NO: 6611433 - DNA, 22 bp, Homo sapiens
acccaggaggtggaggttgcag

SEQ ID NO: 6611434 - DNA, 14 bp, Homo sapiens
acccaggagtccag

SEQ ID NO: 6611435 - DNA, 18 bp, Homo sapiens
acccaggagtccagaccc

SEQ ID NO: 6611436 - DNA, 23 bp, Homo sapiens
acccaggagtccagaccccccag

SEQ ID NO: 6611437 - DNA, 17 bp, Homo sapiens
acccaggagtgtggcca

SEQ ID NO: 6611438 - DNA, 20 bp, Homo sapiens
acccaggatatctgaaaata

SEQ ID NO: 6611439 - DNA, 15 bp, Homo sapiens
acccaggcacctgca

SEQ ID NO: 6611440 - DNA, 14 bp, Homo sapiens
acccaggcagctgg

SEQ ID NO: 6611441 - DNA, 17 bp, Homo sapiens
acccaggcagctggcag

SEQ ID NO: 6611442 - DNA, 17 bp, Homo sapiens
acccaggcaggtgcagg

SEQ ID NO: 6611443 - DNA, 21 bp, Homo sapiens
acccaggcaggtgcagggaag

SEQ ID NO: 6611444 - DNA, 21 bp, Homo sapiens
acccaggcccatgccaaggcc

SEQ ID NO: 6611445 - DNA, 12 bp, Homo sapiens
acccaggccctc

SEQ ID NO: 6611446 - DNA, 22 bp, Homo sapiens
acccaggccctccatgggctag

SEQ ID NO: 6611447 - DNA, 13 bp, Homo sapiens
acccaggccgcct

SEQ ID NO: 6611448 - DNA, 22 bp, Homo sapiens
acccaggcctccctgcagactc

SEQ ID NO: 6611449 - DNA, 24 bp, Homo sapiens
acccaggcctccctgcagactcca

SEQ ID NO: 6611450 - DNA, 11 bp, Homo sapiens
acccaggcctg

SEQ ID NO: 6611451 - DNA, 16 bp, Homo sapiens
acccaggcctgattca

SEQ ID NO: 6611452 - DNA, 14 bp, Homo sapiens
acccaggcgctgca

SEQ ID NO: 6611453 - DNA, 21 bp, Homo sapiens
acccaggcgctgcatacaggg

SEQ ID NO: 6611454 - DNA, 19 bp, Homo sapiens
acccaggctagagtgcagt

SEQ ID NO: 6611455 - DNA, 13 bp, Homo sapiens
acccaggctccat

SEQ ID NO: 6611456 - DNA, 16 bp, Homo sapiens
acccaggctccatggg

SEQ ID NO: 6611457 - DNA, 20 bp, Homo sapiens
acccaggctggagtgcaatg

SEQ ID NO: 6611458 - DNA, 20 bp, Homo sapiens
acccaggctggagtgcagtg

SEQ ID NO: 6611459 - DNA, 20 bp, Homo sapiens
acccaggctggagtgcggtg

SEQ ID NO: 6611460 - DNA, 20 bp, Homo sapiens
acccaggctgggcaaggagg

SEQ ID NO: 6611461 - DNA, 13 bp, Homo sapiens
acccagggaacag

SEQ ID NO: 6611462 - DNA, 22 bp, Homo sapiens
acccagggaacagccactcccc

SEQ ID NO: 6611463 - DNA, 17 bp, Homo sapiens
acccagggactctccaa

SEQ ID NO: 6611464 - DNA, 24 bp, Homo sapiens
acccagggcctgacttgagccact

SEQ ID NO: 6611465 - DNA, 15 bp, Homo sapiens
acccagggcctgcag

SEQ ID NO: 6611466 - DNA, 23 bp, Homo sapiens
acccagggctagtataaacatga

SEQ ID NO: 6611467 - DNA, 11 bp, Homo sapiens
acccagggctc

SEQ ID NO: 6611468 - DNA, 21 bp, Homo sapiens
acccagggctccctcctggag

SEQ ID NO: 6611469 - DNA, 22 bp, Homo sapiens
acccagggctccctcctggagc

SEQ ID NO: 6611470 - DNA, 15 bp, Homo sapiens
acccagggctctgca

SEQ ID NO: 6611471 - DNA, 16 bp, Homo sapiens
acccagggctctgccc

SEQ ID NO: 6611472 - DNA, 17 bp, Homo sapiens
acccagggctctgcccc

SEQ ID NO: 6611473 - DNA, 18 bp, Homo sapiens
acccaggggaaggccctg

SEQ ID NO: 6611474 - DNA, 20 bp, Homo sapiens
acccaggggaaggccctgag

SEQ ID NO: 6611475 - DNA, 17 bp, Homo sapiens
acccagggggctgaaac

SEQ ID NO: 6611476 - DNA, 15 bp, Homo sapiens
acccaggggtccagg

SEQ ID NO: 6611477 - DNA, 19 bp, Homo sapiens
acccagggtctagccgctg

SEQ ID NO: 6611478 - DNA, 15 bp, Homo sapiens
acccagggtggagtg

SEQ ID NO: 6611479 - DNA, 22 bp, Homo sapiens
acccagggtggtcttcaagcct

SEQ ID NO: 6611480 - DNA, 22 bp, Homo sapiens
acccaggtcccccgactgcctg

SEQ ID NO: 6611481 - DNA, 15 bp, Homo sapiens
acccaggtcccgagc

SEQ ID NO: 6611482 - DNA, 18 bp, Homo sapiens
acccaggtctgatgccaa

SEQ ID NO: 6611483 - DNA, 22 bp, Homo sapiens
acccaggtctgggtggggccca

SEQ ID NO: 6611484 - DNA, 18 bp, Homo sapiens
acccaggtcttccagacc

SEQ ID NO: 6611485 - DNA, 22 bp, Homo sapiens
acccaggtcttccagacctgct

SEQ ID NO: 6611486 - DNA, 21 bp, Homo sapiens
acccaggtgatttcctctaaa

SEQ ID NO: 6611487 - DNA, 18 bp, Homo sapiens
acccaggtggagggcaca

SEQ ID NO: 6611488 - DNA, 20 bp, Homo sapiens
acccaggtggagggcacagc

SEQ ID NO: 6611489 - DNA, 14 bp, Homo sapiens
acccaggtggcgga

SEQ ID NO: 6611490 - DNA, 13 bp, Homo sapiens
acccaggtgggtc

SEQ ID NO: 6611491 - DNA, 20 bp, Homo sapiens
acccaggtgtgcctgtgctc

SEQ ID NO: 6611492 - DNA, 15 bp, Homo sapiens
acccaggtgttgtcc

SEQ ID NO: 6611493 - DNA, 20 bp, Homo sapiens
acccaggttggagtgcagtg

SEQ ID NO: 6611494 - DNA, 17 bp, Homo sapiens
acccagtaactcatctg

SEQ ID NO: 6611495 - DNA, 15 bp, Homo sapiens
acccagtagcccaga

SEQ ID NO: 6611496 - DNA, 20 bp, Homo sapiens
acccagtagctgcccttcct

SEQ ID NO: 6611497 - DNA, 20 bp, Homo sapiens
acccagtcacctccccacat

SEQ ID NO: 6611498 - DNA, 18 bp, Homo sapiens
acccagtcacctctgtct

SEQ ID NO: 6611499 - DNA, 15 bp, Homo sapiens
acccagtccatgctc

SEQ ID NO: 6611500 - DNA, 21 bp, Homo sapiens
acccagtcccacactgtggcc

SEQ ID NO: 6611501 - DNA, 15 bp, Homo sapiens
acccagtcctctgcc

SEQ ID NO: 6611502 - DNA, 18 bp, Homo sapiens
acccagtcctctgcctcc

SEQ ID NO: 6611503 - DNA, 12 bp, Homo sapiens
acccagtcctgg

SEQ ID NO: 6611504 - DNA, 13 bp, Homo sapiens
acccagtcctggc

SEQ ID NO: 6611505 - DNA, 15 bp, Homo sapiens
acccagtcctggcca

SEQ ID NO: 6611506 - DNA, 22 bp, Homo sapiens
acccagtcctggccattttctt

SEQ ID NO: 6611507 - DNA, 17 bp, Homo sapiens
acccagtctcctctcca

SEQ ID NO: 6611508 - DNA, 18 bp, Homo sapiens
acccagtctcctctccat

SEQ ID NO: 6611509 - DNA, 15 bp, Homo sapiens
acccagtcttgtgga

SEQ ID NO: 6611510 - DNA, 14 bp, Homo sapiens
acccagtgaacaca

SEQ ID NO: 6611511 - DNA, 14 bp, Homo sapiens
acccagtgagcact

SEQ ID NO: 6611512 - DNA, 14 bp, Homo sapiens
acccagtgccctct

SEQ ID NO: 6611513 - DNA, 22 bp, Homo sapiens
acccagtgccctctcccctcag

SEQ ID NO: 6611514 - DNA, 14 bp, Homo sapiens
acccagtggaattc

SEQ ID NO: 6611515 - DNA, 15 bp, Homo sapiens
acccagtggcagggc

SEQ ID NO: 6611516 - DNA, 17 bp, Homo sapiens
acccagtggcagggcac

SEQ ID NO: 6611517 - DNA, 24 bp, Homo sapiens
acccagtggcagggcacagggcct

SEQ ID NO: 6611518 - DNA, 12 bp, Homo sapiens
acccagtggctg

SEQ ID NO: 6611519 - DNA, 15 bp, Homo sapiens
acccagtgggacaga

SEQ ID NO: 6611520 - DNA, 19 bp, Homo sapiens
acccagtggtcagcaggtg

SEQ ID NO: 6611521 - DNA, 21 bp, Homo sapiens
acccagtgtgtgctcagcagc

SEQ ID NO: 6611522 - DNA, 16 bp, Homo sapiens
acccagtgttcagcat

SEQ ID NO: 6611523 - DNA, 19 bp, Homo sapiens
acccagtgttttaggagca

SEQ ID NO: 6611524 - DNA, 22 bp, Homo sapiens
acccagttcttcatttggagga

SEQ ID NO: 6611525 - DNA, 16 bp, Homo sapiens
acccataaacagtaat

SEQ ID NO: 6611526 - DNA, 15 bp, Homo sapiens
acccataagtaatat

SEQ ID NO: 6611527 - DNA, 19 bp, Homo sapiens
acccataagtaatatttaa

SEQ ID NO: 6611528 - DNA, 16 bp, Homo sapiens
acccataatcctttct

SEQ ID NO: 6611529 - DNA, 17 bp, Homo sapiens
acccataatcctttctg

SEQ ID NO: 6611530 - DNA, 22 bp, Homo sapiens
acccatacaatgtatgtacaat

SEQ ID NO: 6611531 - DNA, 17 bp, Homo sapiens
acccatacctttccagg

SEQ ID NO: 6611532 - DNA, 22 bp, Homo sapiens
acccatagaaaacttgacatgt

SEQ ID NO: 6611533 - DNA, 13 bp, Homo sapiens
acccatagacagc

SEQ ID NO: 6611534 - DNA, 15 bp, Homo sapiens
acccatagcttccat

SEQ ID NO: 6611535 - DNA, 15 bp, Homo sapiens
acccataggcccaca

SEQ ID NO: 6611536 - DNA, 18 bp, Homo sapiens
acccataggcccacacac

SEQ ID NO: 6611537 - DNA, 20 bp, Homo sapiens
acccataggcccacacacag

SEQ ID NO: 6611538 - DNA, 21 bp, Homo sapiens
acccataggcccacacacagg

SEQ ID NO: 6611539 - DNA, 16 bp, Homo sapiens
acccatatatcttatg

SEQ ID NO: 6611540 - DNA, 11 bp, Homo sapiens
acccatatccc

SEQ ID NO: 6611541 - DNA, 15 bp, Homo sapiens
acccatatcccctct

SEQ ID NO: 6611542 - DNA, 21 bp, Homo sapiens
acccatatctgtgtgccctag

SEQ ID NO: 6611543 - DNA, 16 bp, Homo sapiens
acccatattgtaaaac

SEQ ID NO: 6611544 - DNA, 15 bp, Homo sapiens
acccatcactgtgtc

SEQ ID NO: 6611545 - DNA, 16 bp, Homo sapiens
acccatcactgtgtct

SEQ ID NO: 6611546 - DNA, 17 bp, Homo sapiens
acccatccccgcagtgt

SEQ ID NO: 6611547 - DNA, 17 bp, Homo sapiens
acccatccctgcctgga

SEQ ID NO: 6611548 - DNA, 19 bp, Homo sapiens
acccatccctgcctggagg

SEQ ID NO: 6611549 - DNA, 21 bp, Homo sapiens
acccatcctaccaatgcatgc

SEQ ID NO: 6611550 - DNA, 14 bp, Homo sapiens
acccatcctagaga

SEQ ID NO: 6611551 - DNA, 22 bp, Homo sapiens
acccatcctaggaaccagccaa

SEQ ID NO: 6611552 - DNA, 21 bp, Homo sapiens
acccatctatacaaaaaattt

SEQ ID NO: 6611553 - DNA, 13 bp, Homo sapiens
acccatctgtagt

SEQ ID NO: 6611554 - DNA, 19 bp, Homo sapiens
acccatcttcacgcctggg

SEQ ID NO: 6611555 - DNA, 17 bp, Homo sapiens
acccatcttcctgctgc

SEQ ID NO: 6611556 - DNA, 21 bp, Homo sapiens
acccatcttgcttccaagacc

SEQ ID NO: 6611557 - DNA, 19 bp, Homo sapiens
acccatcttttgttctcct

SEQ ID NO: 6611558 - DNA, 17 bp, Homo sapiens
acccatgaaacagcagc

SEQ ID NO: 6611559 - DNA, 20 bp, Homo sapiens
acccatgaaacagcagctga

SEQ ID NO: 6611560 - DNA, 22 bp, Homo sapiens
acccatgaaagaaaacttttat

SEQ ID NO: 6611561 - DNA, 19 bp, Homo sapiens
acccatgaagacaggacag

SEQ ID NO: 6611562 - DNA, 12 bp, Homo sapiens
acccatgaagat

SEQ ID NO: 6611563 - DNA, 13 bp, Homo sapiens
acccatgaagctg

SEQ ID NO: 6611564 - DNA, 17 bp, Homo sapiens
acccatgaagctggccc

SEQ ID NO: 6611565 - DNA, 21 bp, Homo sapiens
acccatgaagctggccctcag

SEQ ID NO: 6611566 - DNA, 22 bp, Homo sapiens
acccatgaagctggccctcagc

SEQ ID NO: 6611567 - DNA, 14 bp, Homo sapiens
acccatgaatcaaa

SEQ ID NO: 6611568 - DNA, 16 bp, Homo sapiens
acccatgacctttttc

SEQ ID NO: 6611569 - DNA, 15 bp, Homo sapiens
acccatgactctgta

SEQ ID NO: 6611570 - DNA, 15 bp, Homo sapiens
acccatgactgcccc

SEQ ID NO: 6611571 - DNA, 12 bp, Homo sapiens
acccatgagcct

SEQ ID NO: 6611572 - DNA, 13 bp, Homo sapiens
acccatgatactc

SEQ ID NO: 6611573 - DNA, 22 bp, Homo sapiens
acccatgatactccactcccag

SEQ ID NO: 6611574 - DNA, 23 bp, Homo sapiens
acccatgcacactcatgcacaca

SEQ ID NO: 6611575 - DNA, 14 bp, Homo sapiens
acccatgcacagaa

SEQ ID NO: 6611576 - DNA, 21 bp, Homo sapiens
acccatgcacagaacaagcca

SEQ ID NO: 6611577 - DNA, 18 bp, Homo sapiens
acccatgcatggcctccc

SEQ ID NO: 6611578 - DNA, 19 bp, Homo sapiens
acccatgcatggcctccca

SEQ ID NO: 6611579 - DNA, 21 bp, Homo sapiens
acccatgcatggcctcccagc

SEQ ID NO: 6611580 - DNA, 16 bp, Homo sapiens
acccatgccagagagg

SEQ ID NO: 6611581 - DNA, 20 bp, Homo sapiens
acccatgccccactctgctg

SEQ ID NO: 6611582 - DNA, 13 bp, Homo sapiens
acccatgccctgc

SEQ ID NO: 6611583 - DNA, 14 bp, Homo sapiens
acccatgccctgcc

SEQ ID NO: 6611584 - DNA, 16 bp, Homo sapiens
acccatgccctggacc

SEQ ID NO: 6611585 - DNA, 14 bp, Homo sapiens
acccatggagaggt

SEQ ID NO: 6611586 - DNA, 23 bp, Homo sapiens
acccatggagaggtttgtcaaca

SEQ ID NO: 6611587 - DNA, 20 bp, Homo sapiens
acccatggcctcagccctgc

SEQ ID NO: 6611588 - DNA, 14 bp, Homo sapiens
acccatgggcagga

SEQ ID NO: 6611589 - DNA, 16 bp, Homo sapiens
acccatgggcaggaga

SEQ ID NO: 6611590 - DNA, 18 bp, Homo sapiens
acccatgggcaggagact

SEQ ID NO: 6611591 - DNA, 14 bp, Homo sapiens
acccatgggctctg

SEQ ID NO: 6611592 - DNA, 16 bp, Homo sapiens
acccatggggaggaga

SEQ ID NO: 6611593 - DNA, 17 bp, Homo sapiens
acccatgggggctgtct

SEQ ID NO: 6611594 - DNA, 18 bp, Homo sapiens
acccatgggggctgtctt

SEQ ID NO: 6611595 - DNA, 24 bp, Homo sapiens
acccatgtaaataccagactgcag

SEQ ID NO: 6611596 - DNA, 24 bp, Homo sapiens
acccatgtgcacaagtgtgcacag

SEQ ID NO: 6611597 - DNA, 17 bp, Homo sapiens
acccatgtgccaaggtg

SEQ ID NO: 6611598 - DNA, 21 bp, Homo sapiens
acccatgtgctgggaaatgca

SEQ ID NO: 6611599 - DNA, 21 bp, Homo sapiens
acccatgtgggcgcccaccct

SEQ ID NO: 6611600 - DNA, 16 bp, Homo sapiens
acccatgtgttaaaat

SEQ ID NO: 6611601 - DNA, 15 bp, Homo sapiens
acccatgttgggaaa

SEQ ID NO: 6611602 - DNA, 21 bp, Homo sapiens
acccatgttgggaaaaactgg

SEQ ID NO: 6611603 - DNA, 13 bp, Homo sapiens
acccattcagaga

SEQ ID NO: 6611604 - DNA, 17 bp, Homo sapiens
acccattcctatttctt

SEQ ID NO: 6611605 - DNA, 21 bp, Homo sapiens
acccattctgttttcccccag

SEQ ID NO: 6611606 - DNA, 20 bp, Homo sapiens
acccattcttcagtgcctag

SEQ ID NO: 6611607 - DNA, 22 bp, Homo sapiens
acccattgccccagacctggaa

SEQ ID NO: 6611608 - DNA, 13 bp, Homo sapiens
acccattgctgtt

SEQ ID NO: 6611609 - DNA, 17 bp, Homo sapiens
acccattgttgtcaagg

SEQ ID NO: 6611610 - DNA, 14 bp, Homo sapiens
acccatttacttag

SEQ ID NO: 6611611 - DNA, 16 bp, Homo sapiens
acccatttcaggaggt

SEQ ID NO: 6611612 - DNA, 16 bp, Homo sapiens
acccatttgccaggat

SEQ ID NO: 6611613 - DNA, 16 bp, Homo sapiens
acccatttttgagcca

SEQ ID NO: 6611614 - DNA, 21 bp, Homo sapiens
acccatttttgctctatggga

SEQ ID NO: 6611615 - DNA, 21 bp, Homo sapiens
acccattttttaaaaaagcaa

SEQ ID NO: 6611616 - DNA, 23 bp, Homo sapiens
accccaaacaaatggaagagaag

SEQ ID NO: 6611617 - DNA, 16 bp, Homo sapiens
accccaaacaccttcc

SEQ ID NO: 6611618 - DNA, 18 bp, Homo sapiens
accccaaacaccttccag

SEQ ID NO: 6611619 - DNA, 18 bp, Homo sapiens
accccaaagactctggag

SEQ ID NO: 6611620 - DNA, 14 bp, Homo sapiens
accccaaagagaaa

SEQ ID NO: 6611621 - DNA, 19 bp, Homo sapiens
accccaaagagcctggaga

SEQ ID NO: 6611622 - DNA, 21 bp, Homo sapiens
accccaaagagcctggagaag

SEQ ID NO: 6611623 - DNA, 15 bp, Homo sapiens
accccaaagcccctt

SEQ ID NO: 6611624 - DNA, 16 bp, Homo sapiens
accccaaagccccttg

SEQ ID NO: 6611625 - DNA, 15 bp, Homo sapiens
accccaaagtccagg

SEQ ID NO: 6611626 - DNA, 13 bp, Homo sapiens
accccaacaccgg

SEQ ID NO: 6611627 - DNA, 18 bp, Homo sapiens
accccaacctctgttccc

SEQ ID NO: 6611628 - DNA, 15 bp, Homo sapiens
accccaacctgctct

SEQ ID NO: 6611629 - DNA, 17 bp, Homo sapiens
accccaacgcacaggaa

SEQ ID NO: 6611630 - DNA, 15 bp, Homo sapiens
accccaactccagta

SEQ ID NO: 6611631 - DNA, 20 bp, Homo sapiens
accccaactctccccagtgc

SEQ ID NO: 6611632 - DNA, 17 bp, Homo sapiens
accccaacttggcagct

SEQ ID NO: 6611633 - DNA, 16 bp, Homo sapiens
accccaagaccaagct

SEQ ID NO: 6611634 - DNA, 15 bp, Homo sapiens
accccaagactccca

SEQ ID NO: 6611635 - DNA, 16 bp, Homo sapiens
accccaagaggaagtt

SEQ ID NO: 6611636 - DNA, 19 bp, Homo sapiens
accccaagatttcagatat

SEQ ID NO: 6611637 - DNA, 16 bp, Homo sapiens
accccaagcttcccaa

SEQ ID NO: 6611638 - DNA, 19 bp, Homo sapiens
accccaaggacctgcctcc

SEQ ID NO: 6611639 - DNA, 19 bp, Homo sapiens
accccaagggggctgctgc

SEQ ID NO: 6611640 - DNA, 20 bp, Homo sapiens
accccaagtagtctgctcac

SEQ ID NO: 6611641 - DNA, 19 bp, Homo sapiens
accccaatatatgtatttt

SEQ ID NO: 6611642 - DNA, 23 bp, Homo sapiens
accccaatatatgtattttttga

SEQ ID NO: 6611643 - DNA, 16 bp, Homo sapiens
accccaatccctgcca

SEQ ID NO: 6611644 - DNA, 18 bp, Homo sapiens
accccaatccctgccact

SEQ ID NO: 6611645 - DNA, 20 bp, Homo sapiens
accccaatccctgccactgg

SEQ ID NO: 6611646 - DNA, 13 bp, Homo sapiens
accccaatcctcc

SEQ ID NO: 6611647 - DNA, 17 bp, Homo sapiens
accccaattccttgtag

SEQ ID NO: 6611648 - DNA, 20 bp, Homo sapiens
accccacaagcaccactctg

SEQ ID NO: 6611649 - DNA, 21 bp, Homo sapiens
accccacaagcaccactctgg

SEQ ID NO: 6611650 - DNA, 16 bp, Homo sapiens
accccacaatttcttt

SEQ ID NO: 6611651 - DNA, 21 bp, Homo sapiens
accccacaatttctttaaaaa

SEQ ID NO: 6611652 - DNA, 13 bp, Homo sapiens
accccacacctgc

SEQ ID NO: 6611653 - DNA, 16 bp, Homo sapiens
accccacacctgcagt

SEQ ID NO: 6611654 - DNA, 20 bp, Homo sapiens
accccacacgccggggctgg

SEQ ID NO: 6611655 - DNA, 11 bp, Homo sapiens
accccacactt

SEQ ID NO: 6611656 - DNA, 21 bp, Homo sapiens
accccacacttgttccagctc

SEQ ID NO: 6611657 - DNA, 11 bp, Homo sapiens
accccacagat

SEQ ID NO: 6611658 - DNA, 11 bp, Homo sapiens
accccacagct

SEQ ID NO: 6611659 - DNA, 19 bp, Homo sapiens
accccacattggacttcct

SEQ ID NO: 6611660 - DNA, 19 bp, Homo sapiens
accccaccacaaaaagaga

SEQ ID NO: 6611661 - DNA, 17 bp, Homo sapiens
accccacccacctttgc

SEQ ID NO: 6611662 - DNA, 12 bp, Homo sapiens
accccacccagc

SEQ ID NO: 6611663 - DNA, 20 bp, Homo sapiens
accccacccagctccaggcc

SEQ ID NO: 6611664 - DNA, 14 bp, Homo sapiens
accccaccccaccc

SEQ ID NO: 6611665 - DNA, 21 bp, Homo sapiens
accccacccccttcagtgccc

SEQ ID NO: 6611666 - DNA, 14 bp, Homo sapiens
accccaccctcagc

SEQ ID NO: 6611667 - DNA, 18 bp, Homo sapiens
accccaccctccctggag

SEQ ID NO: 6611668 - DNA, 14 bp, Homo sapiens
accccaccctgccc

SEQ ID NO: 6611669 - DNA, 17 bp, Homo sapiens
accccaccctgcccact

SEQ ID NO: 6611670 - DNA, 20 bp, Homo sapiens
accccaccctgtctgcaggc

SEQ ID NO: 6611671 - DNA, 13 bp, Homo sapiens
accccacccttcc

SEQ ID NO: 6611672 - DNA, 18 bp, Homo sapiens
accccacccttgcccacc

SEQ ID NO: 6611673 - DNA, 22 bp, Homo sapiens
accccacccttgcccaccccac

SEQ ID NO: 6611674 - DNA, 17 bp, Homo sapiens
accccacctcacagcta

SEQ ID NO: 6611675 - DNA, 22 bp, Homo sapiens
accccacctcatgcctggcccc

SEQ ID NO: 6611676 - DNA, 21 bp, Homo sapiens
accccacctccactcccacct

SEQ ID NO: 6611677 - DNA, 14 bp, Homo sapiens
accccacctgacct

SEQ ID NO: 6611678 - DNA, 11 bp, Homo sapiens
accccacctgc

SEQ ID NO: 6611679 - DNA, 12 bp, Homo sapiens
accccacctgca

SEQ ID NO: 6611680 - DNA, 18 bp, Homo sapiens
accccaccttgccaagct

SEQ ID NO: 6611681 - DNA, 22 bp, Homo sapiens
accccacgatttgtcttatccc

SEQ ID NO: 6611682 - DNA, 14 bp, Homo sapiens
accccacgcccgca

SEQ ID NO: 6611683 - DNA, 15 bp, Homo sapiens
accccacgccctgtt

SEQ ID NO: 6611684 - DNA, 16 bp, Homo sapiens
accccacgccttatcc

SEQ ID NO: 6611685 - DNA, 13 bp, Homo sapiens
accccacgggagg

SEQ ID NO: 6611686 - DNA, 15 bp, Homo sapiens
accccactccagccc

SEQ ID NO: 6611687 - DNA, 17 bp, Homo sapiens
accccactccagccctg

SEQ ID NO: 6611688 - DNA, 18 bp, Homo sapiens
accccactccagccctgt

SEQ ID NO: 6611689 - DNA, 12 bp, Homo sapiens
accccactccca

SEQ ID NO: 6611690 - DNA, 17 bp, Homo sapiens
accccactgagagctgc

SEQ ID NO: 6611691 - DNA, 20 bp, Homo sapiens
accccactgagagctgctcc

SEQ ID NO: 6611692 - DNA, 13 bp, Homo sapiens
accccactgggca

SEQ ID NO: 6611693 - DNA, 17 bp, Homo sapiens
accccacttatccctct

SEQ ID NO: 6611694 - DNA, 18 bp, Homo sapiens
accccacttatccctctc

SEQ ID NO: 6611695 - DNA, 13 bp, Homo sapiens
accccacttcaga

SEQ ID NO: 6611696 - DNA, 22 bp, Homo sapiens
accccacttcccatctccaggg

SEQ ID NO: 6611697 - DNA, 23 bp, Homo sapiens
accccacttcccatctccaggga

SEQ ID NO: 6611698 - DNA, 13 bp, Homo sapiens
accccagaaatca

SEQ ID NO: 6611699 - DNA, 19 bp, Homo sapiens
accccagaaatcactgtga

SEQ ID NO: 6611700 - DNA, 17 bp, Homo sapiens
accccagaaattctggc

SEQ ID NO: 6611701 - DNA, 22 bp, Homo sapiens
accccagaaattctggcccagc

SEQ ID NO: 6611702 - DNA, 16 bp, Homo sapiens
accccagaatcccctg

SEQ ID NO: 6611703 - DNA, 16 bp, Homo sapiens
accccagacctctgaa

SEQ ID NO: 6611704 - DNA, 16 bp, Homo sapiens
accccagactccaggc

SEQ ID NO: 6611705 - DNA, 17 bp, Homo sapiens
accccagactccaggcc

SEQ ID NO: 6611706 - DNA, 13 bp, Homo sapiens
accccagagccac

SEQ ID NO: 6611707 - DNA, 15 bp, Homo sapiens
accccagagccacac

SEQ ID NO: 6611708 - DNA, 16 bp, Homo sapiens
accccagagccacaca

SEQ ID NO: 6611709 - DNA, 23 bp, Homo sapiens
accccagaggcagaggttgcagt

SEQ ID NO: 6611710 - DNA, 17 bp, Homo sapiens
accccagagggaccagc

SEQ ID NO: 6611711 - DNA, 21 bp, Homo sapiens
accccagagggaccagctggg

SEQ ID NO: 6611712 - DNA, 23 bp, Homo sapiens
accccagagtgggagaggctggg

SEQ ID NO: 6611713 - DNA, 14 bp, Homo sapiens
accccagagttggg

SEQ ID NO: 6611714 - DNA, 20 bp, Homo sapiens
accccagatacctgtgagga

SEQ ID NO: 6611715 - DNA, 17 bp, Homo sapiens
accccagattcttcagc

SEQ ID NO: 6611716 - DNA, 24 bp, Homo sapiens
accccagattcttcagcttgatcc

SEQ ID NO: 6611717 - DNA, 20 bp, Homo sapiens
accccagcaattatgaaaat

SEQ ID NO: 6611718 - DNA, 14 bp, Homo sapiens
accccagcacagct

SEQ ID NO: 6611719 - DNA, 19 bp, Homo sapiens
accccagcacagctcctcc

SEQ ID NO: 6611720 - DNA, 19 bp, Homo sapiens
accccagcagtcctgggcc

SEQ ID NO: 6611721 - DNA, 20 bp, Homo sapiens
accccagcagtcctgggccc

SEQ ID NO: 6611722 - DNA, 11 bp, Homo sapiens
accccagccca

SEQ ID NO: 6611723 - DNA, 16 bp, Homo sapiens
accccagcccagacag

SEQ ID NO: 6611724 - DNA, 22 bp, Homo sapiens
accccagccccaaaactctcct

SEQ ID NO: 6611725 - DNA, 14 bp, Homo sapiens
accccagccccact

SEQ ID NO: 6611726 - DNA, 18 bp, Homo sapiens
accccagccccactgccc

SEQ ID NO: 6611727 - DNA, 20 bp, Homo sapiens
accccagccccactgccctc

SEQ ID NO: 6611728 - DNA, 12 bp, Homo sapiens
accccagccccc

SEQ ID NO: 6611729 - DNA, 13 bp, Homo sapiens
accccagccccca

SEQ ID NO: 6611730 - DNA, 16 bp, Homo sapiens
accccagcccccacag

SEQ ID NO: 6611731 - DNA, 22 bp, Homo sapiens
accccagcccccacagccctgg

SEQ ID NO: 6611732 - DNA, 20 bp, Homo sapiens
accccagcctcaaatccagg

SEQ ID NO: 6611733 - DNA, 17 bp, Homo sapiens
accccagcctcaagtag

SEQ ID NO: 6611734 - DNA, 14 bp, Homo sapiens
accccagcctcatt

SEQ ID NO: 6611735 - DNA, 20 bp, Homo sapiens
accccagcctcgcctgtcac

SEQ ID NO: 6611736 - DNA, 21 bp, Homo sapiens
accccagcctcgcctgtcacc

SEQ ID NO: 6611737 - DNA, 12 bp, Homo sapiens
accccagcctga

SEQ ID NO: 6611738 - DNA, 15 bp, Homo sapiens
accccagcctgacct

SEQ ID NO: 6611739 - DNA, 13 bp, Homo sapiens
accccagcggctg

SEQ ID NO: 6611740 - DNA, 18 bp, Homo sapiens
accccagctactctgatc

SEQ ID NO: 6611741 - DNA, 15 bp, Homo sapiens
accccagctagggct

SEQ ID NO: 6611742 - DNA, 18 bp, Homo sapiens
accccagctattttctga

SEQ ID NO: 6611743 - DNA, 10 bp, Homo sapiens
accccagctc

SEQ ID NO: 6611744 - DNA, 20 bp, Homo sapiens
accccagctcactttttcat

SEQ ID NO: 6611745 - DNA, 19 bp, Homo sapiens
accccagctccaggcagga

SEQ ID NO: 6611746 - DNA, 16 bp, Homo sapiens
accccagctccatcct

SEQ ID NO: 6611747 - DNA, 17 bp, Homo sapiens
accccagctccctagga

SEQ ID NO: 6611748 - DNA, 23 bp, Homo sapiens
accccagctccctaggagaccaa

SEQ ID NO: 6611749 - DNA, 23 bp, Homo sapiens
accccagctgctctaagcccagg

SEQ ID NO: 6611750 - DNA, 14 bp, Homo sapiens
accccagctggcct

SEQ ID NO: 6611751 - DNA, 12 bp, Homo sapiens
accccagctggg

SEQ ID NO: 6611752 - DNA, 13 bp, Homo sapiens
accccagctggga

SEQ ID NO: 6611753 - DNA, 17 bp, Homo sapiens
accccagctgggaggca

SEQ ID NO: 6611754 - DNA, 18 bp, Homo sapiens
accccagctgtgagcctt

SEQ ID NO: 6611755 - DNA, 20 bp, Homo sapiens
accccagctgtgagccttgg

SEQ ID NO: 6611756 - DNA, 20 bp, Homo sapiens
accccagcttttcttgccag

SEQ ID NO: 6611757 - DNA, 18 bp, Homo sapiens
accccaggacagtttatc

SEQ ID NO: 6611758 - DNA, 16 bp, Homo sapiens
accccaggcagctcct

SEQ ID NO: 6611759 - DNA, 17 bp, Homo sapiens
accccaggcagctcctg

SEQ ID NO: 6611760 - DNA, 21 bp, Homo sapiens
accccaggccataccaggtgc

SEQ ID NO: 6611761 - DNA, 13 bp, Homo sapiens
accccaggccccg

SEQ ID NO: 6611762 - DNA, 17 bp, Homo sapiens
accccaggccctgccag

SEQ ID NO: 6611763 - DNA, 10 bp, Homo sapiens
accccaggct

SEQ ID NO: 6611764 - DNA, 20 bp, Homo sapiens
accccaggctgaagcaggtt

SEQ ID NO: 6611765 - DNA, 12 bp, Homo sapiens
accccaggctgg

SEQ ID NO: 6611766 - DNA, 12 bp, Homo sapiens
accccagggcac

SEQ ID NO: 6611767 - DNA, 15 bp, Homo sapiens
accccagggcacagg

SEQ ID NO: 6611768 - DNA, 20 bp, Homo sapiens
accccagggcactgccagcc

SEQ ID NO: 6611769 - DNA, 16 bp, Homo sapiens
accccagggcagccag

SEQ ID NO: 6611770 - DNA, 21 bp, Homo sapiens
accccagggcagccagggaga

SEQ ID NO: 6611771 - DNA, 20 bp, Homo sapiens
accccagggcccccacaggc

SEQ ID NO: 6611772 - DNA, 15 bp, Homo sapiens
accccagggccctgg

SEQ ID NO: 6611773 - DNA, 17 bp, Homo sapiens
accccagggccctggcc

SEQ ID NO: 6611774 - DNA, 18 bp, Homo sapiens
accccagggccctggcca

SEQ ID NO: 6611775 - DNA, 19 bp, Homo sapiens
accccagggccctggccag

SEQ ID NO: 6611776 - DNA, 22 bp, Homo sapiens
accccagggccctggccagccg

SEQ ID NO: 6611777 - DNA, 12 bp, Homo sapiens
accccagggcct

SEQ ID NO: 6611778 - DNA, 11 bp, Homo sapiens
accccagggtc

SEQ ID NO: 6611779 - DNA, 16 bp, Homo sapiens
accccaggtcagccct

SEQ ID NO: 6611780 - DNA, 17 bp, Homo sapiens
accccaggtcagccctg

SEQ ID NO: 6611781 - DNA, 18 bp, Homo sapiens
accccaggtcaggggctc

SEQ ID NO: 6611782 - DNA, 22 bp, Homo sapiens
accccaggtcaggggctcccta

SEQ ID NO: 6611783 - DNA, 16 bp, Homo sapiens
accccaggtgagacct

SEQ ID NO: 6611784 - DNA, 17 bp, Homo sapiens
accccaggtgagacctc

SEQ ID NO: 6611785 - DNA, 14 bp, Homo sapiens
accccaggttttct

SEQ ID NO: 6611786 - DNA, 19 bp, Homo sapiens
accccaggtttttcatctg

SEQ ID NO: 6611787 - DNA, 22 bp, Homo sapiens
accccaggtttttcatctgaaa

SEQ ID NO: 6611788 - DNA, 17 bp, Homo sapiens
accccagtcaagctcct

SEQ ID NO: 6611789 - DNA, 17 bp, Homo sapiens
accccagtcccagggaa

SEQ ID NO: 6611790 - DNA, 14 bp, Homo sapiens
accccagtgcctgt

SEQ ID NO: 6611791 - DNA, 19 bp, Homo sapiens
accccagtgcctgtctgga

SEQ ID NO: 6611792 - DNA, 20 bp, Homo sapiens
accccagtgcggacccttcc

SEQ ID NO: 6611793 - DNA, 16 bp, Homo sapiens
accccagttcatctct

SEQ ID NO: 6611794 - DNA, 16 bp, Homo sapiens
accccagttcccttgg

SEQ ID NO: 6611795 - DNA, 12 bp, Homo sapiens
accccagttcct

SEQ ID NO: 6611796 - DNA, 16 bp, Homo sapiens
accccagttcctagca

SEQ ID NO: 6611797 - DNA, 15 bp, Homo sapiens
accccagttctaggg

SEQ ID NO: 6611798 - DNA, 19 bp, Homo sapiens
accccagttctaggggaga

SEQ ID NO: 6611799 - DNA, 16 bp, Homo sapiens
accccagttctgctcc

SEQ ID NO: 6611800 - DNA, 19 bp, Homo sapiens
accccagttctgctcctct

SEQ ID NO: 6611801 - DNA, 22 bp, Homo sapiens
accccagttctgctcctctcca

SEQ ID NO: 6611802 - DNA, 15 bp, Homo sapiens
accccagtttttgtt

SEQ ID NO: 6611803 - DNA, 17 bp, Homo sapiens
accccataagccctgag

SEQ ID NO: 6611804 - DNA, 18 bp, Homo sapiens
accccataagccctgaga

SEQ ID NO: 6611805 - DNA, 21 bp, Homo sapiens
accccataataaccctgccag

SEQ ID NO: 6611806 - DNA, 21 bp, Homo sapiens
accccataccccttattgctg

SEQ ID NO: 6611807 - DNA, 18 bp, Homo sapiens
accccatactctcctttt

SEQ ID NO: 6611808 - DNA, 15 bp, Homo sapiens
accccatccacctat

SEQ ID NO: 6611809 - DNA, 13 bp, Homo sapiens
accccatccagcc

SEQ ID NO: 6611810 - DNA, 16 bp, Homo sapiens
accccatccagccaga

SEQ ID NO: 6611811 - DNA, 15 bp, Homo sapiens
accccatcccacacc

SEQ ID NO: 6611812 - DNA, 16 bp, Homo sapiens
accccatcccaccagc

SEQ ID NO: 6611813 - DNA, 22 bp, Homo sapiens
accccatccctggctgacctgc

SEQ ID NO: 6611814 - DNA, 17 bp, Homo sapiens
accccatccctgtcttt

SEQ ID NO: 6611815 - DNA, 22 bp, Homo sapiens
accccatctctatcagaaatac

SEQ ID NO: 6611816 - DNA, 14 bp, Homo sapiens
accccatctctctt

SEQ ID NO: 6611817 - DNA, 16 bp, Homo sapiens
accccatctctcttcc

SEQ ID NO: 6611818 - DNA, 16 bp, Homo sapiens
accccatctctgctgc

SEQ ID NO: 6611819 - DNA, 16 bp, Homo sapiens
accccatctgcattcc

SEQ ID NO: 6611820 - DNA, 17 bp, Homo sapiens
accccatctgcattccc

SEQ ID NO: 6611821 - DNA, 13 bp, Homo sapiens
accccatctgccc

SEQ ID NO: 6611822 - DNA, 14 bp, Homo sapiens
accccatctgccca

SEQ ID NO: 6611823 - DNA, 15 bp, Homo sapiens
accccatctgcccag

SEQ ID NO: 6611824 - DNA, 16 bp, Homo sapiens
accccatctgcccagg

SEQ ID NO: 6611825 - DNA, 17 bp, Homo sapiens
accccatctgcccagga

SEQ ID NO: 6611826 - DNA, 21 bp, Homo sapiens
accccatctggctgtgacagc

SEQ ID NO: 6611827 - DNA, 23 bp, Homo sapiens
accccatgaccttatccttcctc

SEQ ID NO: 6611828 - DNA, 21 bp, Homo sapiens
accccatgcacctcagggcca

SEQ ID NO: 6611829 - DNA, 12 bp, Homo sapiens
accccatgctgt

SEQ ID NO: 6611830 - DNA, 20 bp, Homo sapiens
accccatgctgttgattgct

SEQ ID NO: 6611831 - DNA, 22 bp, Homo sapiens
accccatggcagtgggaaaaat

SEQ ID NO: 6611832 - DNA, 20 bp, Homo sapiens
accccatggccggctttcag

SEQ ID NO: 6611833 - DNA, 15 bp, Homo sapiens
accccattcccgcag

SEQ ID NO: 6611834 - DNA, 14 bp, Homo sapiens
accccattcctgat

SEQ ID NO: 6611835 - DNA, 14 bp, Homo sapiens
accccatttctctc

SEQ ID NO: 6611836 - DNA, 20 bp, Homo sapiens
acccccaaaatccaaaactt

SEQ ID NO: 6611837 - DNA, 15 bp, Homo sapiens
acccccaaacacaaa

SEQ ID NO: 6611838 - DNA, 18 bp, Homo sapiens
acccccaaatactctgaa

SEQ ID NO: 6611839 - DNA, 12 bp, Homo sapiens
acccccaacacc

SEQ ID NO: 6611840 - DNA, 15 bp, Homo sapiens
acccccaacaccacc

SEQ ID NO: 6611841 - DNA, 17 bp, Homo sapiens
acccccaacttcaccac

SEQ ID NO: 6611842 - DNA, 15 bp, Homo sapiens
acccccaagccacag

SEQ ID NO: 6611843 - DNA, 15 bp, Homo sapiens
acccccaagcctggg

SEQ ID NO: 6611844 - DNA, 21 bp, Homo sapiens
acccccaattaaacccagaac

SEQ ID NO: 6611845 - DNA, 22 bp, Homo sapiens
acccccaattaaacccagaacc

SEQ ID NO: 6611846 - DNA, 21 bp, Homo sapiens
acccccacaagctgtccctgc

SEQ ID NO: 6611847 - DNA, 23 bp, Homo sapiens
acccccacaagctgtccctgcag

SEQ ID NO: 6611848 - DNA, 13 bp, Homo sapiens
acccccacacaca

SEQ ID NO: 6611849 - DNA, 14 bp, Homo sapiens
acccccacacacac

SEQ ID NO: 6611850 - DNA, 20 bp, Homo sapiens
acccccacacacacacacat

SEQ ID NO: 6611851 - DNA, 12 bp, Homo sapiens
acccccacccaa

SEQ ID NO: 6611852 - DNA, 12 bp, Homo sapiens
acccccacccac

SEQ ID NO: 6611853 - DNA, 18 bp, Homo sapiens
acccccacccacctccac

SEQ ID NO: 6611854 - DNA, 21 bp, Homo sapiens
acccccacccacctccaccca

SEQ ID NO: 6611855 - DNA, 22 bp, Homo sapiens
acccccacccacctccacccag

SEQ ID NO: 6611856 - DNA, 16 bp, Homo sapiens
acccccacccccacca

SEQ ID NO: 6611857 - DNA, 14 bp, Homo sapiens
acccccacccccag

SEQ ID NO: 6611858 - DNA, 17 bp, Homo sapiens
acccccacccctgtacc

SEQ ID NO: 6611859 - DNA, 18 bp, Homo sapiens
acccccacccctgtaccc

SEQ ID NO: 6611860 - DNA, 19 bp, Homo sapiens
acccccacccctgtaccca

SEQ ID NO: 6611861 - DNA, 13 bp, Homo sapiens
acccccacccctt

SEQ ID NO: 6611862 - DNA, 16 bp, Homo sapiens
acccccaccccttgct

SEQ ID NO: 6611863 - DNA, 19 bp, Homo sapiens
acccccacccgttaattta

SEQ ID NO: 6611864 - DNA, 20 bp, Homo sapiens
acccccacccgttaatttaa

SEQ ID NO: 6611865 - DNA, 13 bp, Homo sapiens
acccccactctca

SEQ ID NO: 6611866 - DNA, 17 bp, Homo sapiens
acccccactctcattcc

SEQ ID NO: 6611867 - DNA, 13 bp, Homo sapiens
acccccactctgc

SEQ ID NO: 6611868 - DNA, 20 bp, Homo sapiens
acccccacttcccacttgca

SEQ ID NO: 6611869 - DNA, 21 bp, Homo sapiens
acccccactttcgcctcctcc

SEQ ID NO: 6611870 - DNA, 13 bp, Homo sapiens
acccccagagacc

SEQ ID NO: 6611871 - DNA, 14 bp, Homo sapiens
acccccagagacct

SEQ ID NO: 6611872 - DNA, 15 bp, Homo sapiens
acccccagagacctt

SEQ ID NO: 6611873 - DNA, 16 bp, Homo sapiens
acccccagcagctcac

SEQ ID NO: 6611874 - DNA, 14 bp, Homo sapiens
acccccagccaggc

SEQ ID NO: 6611875 - DNA, 18 bp, Homo sapiens
acccccagcccacagagc

SEQ ID NO: 6611876 - DNA, 17 bp, Homo sapiens
acccccagcccagcaga

SEQ ID NO: 6611877 - DNA, 14 bp, Homo sapiens
acccccagccccca

SEQ ID NO: 6611878 - DNA, 15 bp, Homo sapiens
acccccagcccccac

SEQ ID NO: 6611879 - DNA, 13 bp, Homo sapiens
acccccagccccg

SEQ ID NO: 6611880 - DNA, 20 bp, Homo sapiens
acccccagccccgactccag

SEQ ID NO: 6611881 - DNA, 22 bp, Homo sapiens
acccccagccccgactccagcc

SEQ ID NO: 6611882 - DNA, 12 bp, Homo sapiens
acccccagcctg

SEQ ID NO: 6611883 - DNA, 16 bp, Homo sapiens
acccccagcctgggcc

SEQ ID NO: 6611884 - DNA, 20 bp, Homo sapiens
acccccagccttgcccagct

SEQ ID NO: 6611885 - DNA, 12 bp, Homo sapiens
acccccagctca

SEQ ID NO: 6611886 - DNA, 13 bp, Homo sapiens
acccccagctcaa

SEQ ID NO: 6611887 - DNA, 21 bp, Homo sapiens
acccccagctcaatggactgg

SEQ ID NO: 6611888 - DNA, 12 bp, Homo sapiens
acccccagctcc

SEQ ID NO: 6611889 - DNA, 19 bp, Homo sapiens
acccccagctgcttgtgtc

SEQ ID NO: 6611890 - DNA, 19 bp, Homo sapiens
acccccaggaaggaaacag

SEQ ID NO: 6611891 - DNA, 20 bp, Homo sapiens
acccccaggaaggaaacaga

SEQ ID NO: 6611892 - DNA, 12 bp, Homo sapiens
acccccaggaca

SEQ ID NO: 6611893 - DNA, 12 bp, Homo sapiens
acccccaggacc

SEQ ID NO: 6611894 - DNA, 13 bp, Homo sapiens
acccccaggcctc

SEQ ID NO: 6611895 - DNA, 15 bp, Homo sapiens
acccccaggcctcct

SEQ ID NO: 6611896 - DNA, 16 bp, Homo sapiens
acccccaggcctccta

SEQ ID NO: 6611897 - DNA, 18 bp, Homo sapiens
acccccaggtattgtctt

SEQ ID NO: 6611898 - DNA, 13 bp, Homo sapiens
acccccaggtgca

SEQ ID NO: 6611899 - DNA, 18 bp, Homo sapiens
acccccaggtggcctgcg

SEQ ID NO: 6611900 - DNA, 14 bp, Homo sapiens
acccccagtcctca

SEQ ID NO: 6611901 - DNA, 16 bp, Homo sapiens
acccccagtcctcact

SEQ ID NO: 6611902 - DNA, 17 bp, Homo sapiens
acccccagtgccacaga

SEQ ID NO: 6611903 - DNA, 21 bp, Homo sapiens
acccccagtgccacagagaag

SEQ ID NO: 6611904 - DNA, 21 bp, Homo sapiens
acccccagtgctcacacaatc

SEQ ID NO: 6611905 - DNA, 17 bp, Homo sapiens
acccccagtgtattttg

SEQ ID NO: 6611906 - DNA, 20 bp, Homo sapiens
acccccagtgtggctgtctg

SEQ ID NO: 6611907 - DNA, 20 bp, Homo sapiens
acccccagttcctatgacac

SEQ ID NO: 6611908 - DNA, 15 bp, Homo sapiens
acccccatccagcct

SEQ ID NO: 6611909 - DNA, 16 bp, Homo sapiens
acccccatctccctag

SEQ ID NO: 6611910 - DNA, 19 bp, Homo sapiens
acccccatcttccacctgt

SEQ ID NO: 6611911 - DNA, 15 bp, Homo sapiens
acccccatgctgcct

SEQ ID NO: 6611912 - DNA, 17 bp, Homo sapiens
acccccatgctgccttc

SEQ ID NO: 6611913 - DNA, 17 bp, Homo sapiens
acccccatgtggcagcc

SEQ ID NO: 6611914 - DNA, 14 bp, Homo sapiens
acccccattgtgaa

SEQ ID NO: 6611915 - DNA, 17 bp, Homo sapiens
acccccatttctattta

SEQ ID NO: 6611916 - DNA, 14 bp, Homo sapiens
accccccacacaca

SEQ ID NO: 6611917 - DNA, 15 bp, Homo sapiens
accccccacacacac

SEQ ID NO: 6611918 - DNA, 13 bp, Homo sapiens
accccccactcag

SEQ ID NO: 6611919 - DNA, 14 bp, Homo sapiens
accccccactccct

SEQ ID NO: 6611920 - DNA, 19 bp, Homo sapiens
accccccagaacctgtcct

SEQ ID NO: 6611921 - DNA, 13 bp, Homo sapiens
accccccagcact

SEQ ID NO: 6611922 - DNA, 20 bp, Homo sapiens
accccccagcccctcctccc

SEQ ID NO: 6611923 - DNA, 12 bp, Homo sapiens
accccccaggcc

SEQ ID NO: 6611924 - DNA, 13 bp, Homo sapiens
accccccaggccc

SEQ ID NO: 6611925 - DNA, 23 bp, Homo sapiens
acccccccacaaggaaccctcag

SEQ ID NO: 6611926 - DNA, 19 bp, Homo sapiens
acccccccaccccaggccc

SEQ ID NO: 6611927 - DNA, 14 bp, Homo sapiens
acccccccaggcct

SEQ ID NO: 6611928 - DNA, 20 bp, Homo sapiens
acccccccttttctccccac

SEQ ID NO: 6611929 - DNA, 22 bp, Homo sapiens
accccccgcccccgcccaggcc

SEQ ID NO: 6611930 - DNA, 17 bp, Homo sapiens
acccccctcccagacag

SEQ ID NO: 6611931 - DNA, 20 bp, Homo sapiens
acccccctccccaactccct

SEQ ID NO: 6611932 - DNA, 21 bp, Homo sapiens
acccccctcctccccctttgg

SEQ ID NO: 6611933 - DNA, 13 bp, Homo sapiens
acccccctcctgc

SEQ ID NO: 6611934 - DNA, 21 bp, Homo sapiens
acccccctcctgctcctccct

SEQ ID NO: 6611935 - DNA, 17 bp, Homo sapiens
acccccctctctttctc

SEQ ID NO: 6611936 - DNA, 19 bp, Homo sapiens
acccccctctctttctctg

SEQ ID NO: 6611937 - DNA, 14 bp, Homo sapiens
acccccctctgctg

SEQ ID NO: 6611938 - DNA, 13 bp, Homo sapiens
acccccctgagag

SEQ ID NO: 6611939 - DNA, 22 bp, Homo sapiens
acccccctgtacacaactcact

SEQ ID NO: 6611940 - DNA, 14 bp, Homo sapiens
acccccctgtgcct

SEQ ID NO: 6611941 - DNA, 19 bp, Homo sapiens
acccccctgtgcctgctgg

SEQ ID NO: 6611942 - DNA, 14 bp, Homo sapiens
acccccctgttcta

SEQ ID NO: 6611943 - DNA, 22 bp, Homo sapiens
accccccttgcccatgcctcca

SEQ ID NO: 6611944 - DNA, 18 bp, Homo sapiens
acccccctttcacaggca

SEQ ID NO: 6611945 - DNA, 15 bp, Homo sapiens
acccccgaggggagg

SEQ ID NO: 6611946 - DNA, 17 bp, Homo sapiens
acccccgccacctcagg

SEQ ID NO: 6611947 - DNA, 19 bp, Homo sapiens
acccccgccacggccaccc

SEQ ID NO: 6611948 - DNA, 23 bp, Homo sapiens
acccccgccacggccaccctcct

SEQ ID NO: 6611949 - DNA, 16 bp, Homo sapiens
acccccgcccaggctg

SEQ ID NO: 6611950 - DNA, 15 bp, Homo sapiens
acccccgcccccacc

SEQ ID NO: 6611951 - DNA, 14 bp, Homo sapiens
acccccgccccctg

SEQ ID NO: 6611952 - DNA, 18 bp, Homo sapiens
acccccgccccctgccct

SEQ ID NO: 6611953 - DNA, 19 bp, Homo sapiens
acccccgccccctgccctc

SEQ ID NO: 6611954 - DNA, 20 bp, Homo sapiens
acccccgccccctgccctcc

SEQ ID NO: 6611955 - DNA, 21 bp, Homo sapiens
acccccgccccctgccctccc

SEQ ID NO: 6611956 - DNA, 15 bp, Homo sapiens
acccccgctccagat

SEQ ID NO: 6611957 - DNA, 17 bp, Homo sapiens
acccccgctccagatct

SEQ ID NO: 6611958 - DNA, 21 bp, Homo sapiens
acccccggcctccaggctggg

SEQ ID NO: 6611959 - DNA, 20 bp, Homo sapiens
acccccgggatcctgccccc

SEQ ID NO: 6611960 - DNA, 17 bp, Homo sapiens
acccccgtcaagagtga

SEQ ID NO: 6611961 - DNA, 21 bp, Homo sapiens
acccccgtcagctgcttctgc

SEQ ID NO: 6611962 - DNA, 19 bp, Homo sapiens
acccccgtggtctttgaat

SEQ ID NO: 6611963 - DNA, 16 bp, Homo sapiens
accccctcatccccca

SEQ ID NO: 6611964 - DNA, 16 bp, Homo sapiens
accccctcccaccccc

SEQ ID NO: 6611965 - DNA, 12 bp, Homo sapiens
accccctcccca

SEQ ID NO: 6611966 - DNA, 23 bp, Homo sapiens
accccctccccaaagccactgga

SEQ ID NO: 6611967 - DNA, 13 bp, Homo sapiens
accccctccccag

SEQ ID NO: 6611968 - DNA, 16 bp, Homo sapiens
accccctccccagggg

SEQ ID NO: 6611969 - DNA, 20 bp, Homo sapiens
accccctccctacacacaca

SEQ ID NO: 6611970 - DNA, 17 bp, Homo sapiens
accccctccctgtccca

SEQ ID NO: 6611971 - DNA, 12 bp, Homo sapiens
accccctccctt

SEQ ID NO: 6611972 - DNA, 16 bp, Homo sapiens
accccctcctgtcacc

SEQ ID NO: 6611973 - DNA, 17 bp, Homo sapiens
accccctccttcagaca

SEQ ID NO: 6611974 - DNA, 13 bp, Homo sapiens
accccctccttct

SEQ ID NO: 6611975 - DNA, 17 bp, Homo sapiens
accccctcgccagcttg

SEQ ID NO: 6611976 - DNA, 21 bp, Homo sapiens
accccctcgccagcttggctc

SEQ ID NO: 6611977 - DNA, 16 bp, Homo sapiens
accccctcggagcctg

SEQ ID NO: 6611978 - DNA, 23 bp, Homo sapiens
accccctctggagaaggcctgga

SEQ ID NO: 6611979 - DNA, 13 bp, Homo sapiens
accccctcttcaa

SEQ ID NO: 6611980 - DNA, 17 bp, Homo sapiens
accccctcttcaaagca

SEQ ID NO: 6611981 - DNA, 21 bp, Homo sapiens
accccctcttcaaagcagagt

SEQ ID NO: 6611982 - DNA, 20 bp, Homo sapiens
accccctcttctgagcacag

SEQ ID NO: 6611983 - DNA, 23 bp, Homo sapiens
accccctgaaagtgacagagacc

SEQ ID NO: 6611984 - DNA, 22 bp, Homo sapiens
accccctgagtcaactggagca

SEQ ID NO: 6611985 - DNA, 18 bp, Homo sapiens
accccctgcaaagcccag

SEQ ID NO: 6611986 - DNA, 12 bp, Homo sapiens
accccctgcagc

SEQ ID NO: 6611987 - DNA, 21 bp, Homo sapiens
accccctgcagcccaggccag

SEQ ID NO: 6611988 - DNA, 14 bp, Homo sapiens
accccctgccccag

SEQ ID NO: 6611989 - DNA, 17 bp, Homo sapiens
accccctgccccagaga

SEQ ID NO: 6611990 - DNA, 18 bp, Homo sapiens
accccctgccccagagaa

SEQ ID NO: 6611991 - DNA, 17 bp, Homo sapiens
accccctgcctggttct

SEQ ID NO: 6611992 - DNA, 13 bp, Homo sapiens
accccctggccct

SEQ ID NO: 6611993 - DNA, 22 bp, Homo sapiens
accccctggcttgaaccttcaa

SEQ ID NO: 6611994 - DNA, 14 bp, Homo sapiens
accccctgggcaga

SEQ ID NO: 6611995 - DNA, 13 bp, Homo sapiens
accccctgtccca

SEQ ID NO: 6611996 - DNA, 20 bp, Homo sapiens
accccctgtcccattctaga

SEQ ID NO: 6611997 - DNA, 13 bp, Homo sapiens
accccctgttccc

SEQ ID NO: 6611998 - DNA, 15 bp, Homo sapiens
acccccttccctggg

SEQ ID NO: 6611999 - DNA, 15 bp, Homo sapiens
acccccttcctgtcc

SEQ ID NO: 6612000 - DNA, 17 bp, Homo sapiens
acccccttcctgtcccc

SEQ ID NO: 6612001 - DNA, 18 bp, Homo sapiens
acccccttctccatccac

SEQ ID NO: 6612002 - DNA, 19 bp, Homo sapiens
acccccttctctgctccac

SEQ ID NO: 6612003 - DNA, 15 bp, Homo sapiens
acccccttctgggca

SEQ ID NO: 6612004 - DNA, 17 bp, Homo sapiens
acccccttctgggcatc

SEQ ID NO: 6612005 - DNA, 18 bp, Homo sapiens
acccccttgcccaggcct

SEQ ID NO: 6612006 - DNA, 17 bp, Homo sapiens
acccccttgtctgctgc

SEQ ID NO: 6612007 - DNA, 15 bp, Homo sapiens
accccctttcccttc

SEQ ID NO: 6612008 - DNA, 13 bp, Homo sapiens
accccctttgctg

SEQ ID NO: 6612009 - DNA, 18 bp, Homo sapiens
accccctttgctgtgagg

SEQ ID NO: 6612010 - DNA, 22 bp, Homo sapiens
acccccttttcagctgagccct

SEQ ID NO: 6612011 - DNA, 18 bp, Homo sapiens
acccccttttttatataa

SEQ ID NO: 6612012 - DNA, 19 bp, Homo sapiens
accccgagaaccctgagca

SEQ ID NO: 6612013 - DNA, 22 bp, Homo sapiens
accccgagaagtgctcttggct

SEQ ID NO: 6612014 - DNA, 14 bp, Homo sapiens
accccgagccctac

SEQ ID NO: 6612015 - DNA, 17 bp, Homo sapiens
accccgaggccctgcat

SEQ ID NO: 6612016 - DNA, 13 bp, Homo sapiens
accccgagggctg

SEQ ID NO: 6612017 - DNA, 15 bp, Homo sapiens
accccgcactgcaga

SEQ ID NO: 6612018 - DNA, 16 bp, Homo sapiens
accccgcactgcagac

SEQ ID NO: 6612019 - DNA, 12 bp, Homo sapiens
accccgcagccc

SEQ ID NO: 6612020 - DNA, 20 bp, Homo sapiens
accccgcaggatccctcctg

SEQ ID NO: 6612021 - DNA, 18 bp, Homo sapiens
accccgccatgcatgcag

SEQ ID NO: 6612022 - DNA, 18 bp, Homo sapiens
accccgcccctgcatgcc

SEQ ID NO: 6612023 - DNA, 17 bp, Homo sapiens
accccgccggaggaagg

SEQ ID NO: 6612024 - DNA, 20 bp, Homo sapiens
accccgccggaggaaggtcc

SEQ ID NO: 6612025 - DNA, 16 bp, Homo sapiens
accccgccgttccctg

SEQ ID NO: 6612026 - DNA, 20 bp, Homo sapiens
accccgcctcccagccccag

SEQ ID NO: 6612027 - DNA, 13 bp, Homo sapiens
accccgcctctgg

SEQ ID NO: 6612028 - DNA, 18 bp, Homo sapiens
accccgcctctgggctca

SEQ ID NO: 6612029 - DNA, 21 bp, Homo sapiens
accccgcctctgggctcacac

SEQ ID NO: 6612030 - DNA, 14 bp, Homo sapiens
accccgcggcccag

SEQ ID NO: 6612031 - DNA, 18 bp, Homo sapiens
accccgcggtgctctggc

SEQ ID NO: 6612032 - DNA, 23 bp, Homo sapiens
accccgctctgcatgcggcccag

SEQ ID NO: 6612033 - DNA, 14 bp, Homo sapiens
accccgctgcctgg

SEQ ID NO: 6612034 - DNA, 13 bp, Homo sapiens
accccggcaggcc

SEQ ID NO: 6612035 - DNA, 19 bp, Homo sapiens
accccggcaggccctgcag

SEQ ID NO: 6612036 - DNA, 21 bp, Homo sapiens
accccggcaggccctgcagtg

SEQ ID NO: 6612037 - DNA, 22 bp, Homo sapiens
accccggcaggccctgcagtgt

SEQ ID NO: 6612038 - DNA, 22 bp, Homo sapiens
accccggctccccctgccagca

SEQ ID NO: 6612039 - DNA, 20 bp, Homo sapiens
accccgggcccgggcccccg

SEQ ID NO: 6612040 - DNA, 21 bp, Homo sapiens
accccgggctctctgctgtac

SEQ ID NO: 6612041 - DNA, 18 bp, Homo sapiens
accccggggaccctgtga

SEQ ID NO: 6612042 - DNA, 13 bp, Homo sapiens
accccggggtgag

SEQ ID NO: 6612043 - DNA, 20 bp, Homo sapiens
accccgtcccggccccgcgc

SEQ ID NO: 6612044 - DNA, 13 bp, Homo sapiens
accccgtctgccc

SEQ ID NO: 6612045 - DNA, 16 bp, Homo sapiens
accccgtctgcccctt

SEQ ID NO: 6612046 - DNA, 15 bp, Homo sapiens
accccgtctgctcct

SEQ ID NO: 6612047 - DNA, 14 bp, Homo sapiens
accccgtgccaccc

SEQ ID NO: 6612048 - DNA, 14 bp, Homo sapiens
accccgtgcccctg

SEQ ID NO: 6612049 - DNA, 15 bp, Homo sapiens
accccgtgcccctgt

SEQ ID NO: 6612050 - DNA, 14 bp, Homo sapiens
accccgtgttcaaa

SEQ ID NO: 6612051 - DNA, 18 bp, Homo sapiens
accccgttacagctcccc

SEQ ID NO: 6612052 - DNA, 20 bp, Homo sapiens
accccgttacagctccccaa

SEQ ID NO: 6612053 - DNA, 18 bp, Homo sapiens
accccgttgttgtccctg

SEQ ID NO: 6612054 - DNA, 21 bp, Homo sapiens
accccgttgttgtccctgcag

SEQ ID NO: 6612055 - DNA, 16 bp, Homo sapiens
acccctaaaaacaaaa

SEQ ID NO: 6612056 - DNA, 17 bp, Homo sapiens
acccctaaactccaggg

SEQ ID NO: 6612057 - DNA, 19 bp, Homo sapiens
acccctaagactgccttca

SEQ ID NO: 6612058 - DNA, 17 bp, Homo sapiens
acccctaagtgcccaaa

SEQ ID NO: 6612059 - DNA, 14 bp, Homo sapiens
acccctacacacac

SEQ ID NO: 6612060 - DNA, 21 bp, Homo sapiens
acccctacacacacactccct

SEQ ID NO: 6612061 - DNA, 15 bp, Homo sapiens
acccctacactgtga

SEQ ID NO: 6612062 - DNA, 19 bp, Homo sapiens
acccctacagcctgcacac

SEQ ID NO: 6612063 - DNA, 19 bp, Homo sapiens
acccctacccccaaccctc

SEQ ID NO: 6612064 - DNA, 13 bp, Homo sapiens
acccctaccccct

SEQ ID NO: 6612065 - DNA, 14 bp, Homo sapiens
acccctaccccctc

SEQ ID NO: 6612066 - DNA, 15 bp, Homo sapiens
acccctaccccctca

SEQ ID NO: 6612067 - DNA, 15 bp, Homo sapiens
acccctaccctttcc

SEQ ID NO: 6612068 - DNA, 21 bp, Homo sapiens
acccctagccaccagtgtcct

SEQ ID NO: 6612069 - DNA, 12 bp, Homo sapiens
acccctaggact

SEQ ID NO: 6612070 - DNA, 19 bp, Homo sapiens
acccctagttccctctgct

SEQ ID NO: 6612071 - DNA, 15 bp, Homo sapiens
acccctcaagccagg

SEQ ID NO: 6612072 - DNA, 18 bp, Homo sapiens
acccctcaagccaggaga

SEQ ID NO: 6612073 - DNA, 13 bp, Homo sapiens
acccctcaccacc

SEQ ID NO: 6612074 - DNA, 14 bp, Homo sapiens
acccctcactcccc

SEQ ID NO: 6612075 - DNA, 15 bp, Homo sapiens
acccctcactcccca

SEQ ID NO: 6612076 - DNA, 15 bp, Homo sapiens
acccctcactttccc

SEQ ID NO: 6612077 - DNA, 11 bp, Homo sapiens
acccctcagtg

SEQ ID NO: 6612078 - DNA, 17 bp, Homo sapiens
acccctcagtgctcggc

SEQ ID NO: 6612079 - DNA, 18 bp, Homo sapiens
acccctccaaagccccac

SEQ ID NO: 6612080 - DNA, 20 bp, Homo sapiens
acccctccaaagccccacct

SEQ ID NO: 6612081 - DNA, 22 bp, Homo sapiens
acccctccaaagccccaccttt

SEQ ID NO: 6612082 - DNA, 16 bp, Homo sapiens
acccctcccaacctca

SEQ ID NO: 6612083 - DNA, 21 bp, Homo sapiens
acccctccccacccaccaccg

SEQ ID NO: 6612084 - DNA, 12 bp, Homo sapiens
acccctccccat

SEQ ID NO: 6612085 - DNA, 15 bp, Homo sapiens
acccctccccattca

SEQ ID NO: 6612086 - DNA, 22 bp, Homo sapiens
acccctccccattcacagagcc

SEQ ID NO: 6612087 - DNA, 22 bp, Homo sapiens
acccctcccccacgtctctctg

SEQ ID NO: 6612088 - DNA, 24 bp, Homo sapiens
acccctcccccacgtctctctgcc

SEQ ID NO: 6612089 - DNA, 18 bp, Homo sapiens
acccctcccctaatgcct

SEQ ID NO: 6612090 - DNA, 15 bp, Homo sapiens
acccctcccctcccc

SEQ ID NO: 6612091 - DNA, 17 bp, Homo sapiens
acccctcccctcccccc

SEQ ID NO: 6612092 - DNA, 14 bp, Homo sapiens
acccctcccctggg

SEQ ID NO: 6612093 - DNA, 22 bp, Homo sapiens
acccctccctcactcccacctg

SEQ ID NO: 6612094 - DNA, 15 bp, Homo sapiens
acccctccctccctc

SEQ ID NO: 6612095 - DNA, 16 bp, Homo sapiens
acccctccctgcaggg

SEQ ID NO: 6612096 - DNA, 18 bp, Homo sapiens
acccctccctgcaggggc

SEQ ID NO: 6612097 - DNA, 11 bp, Homo sapiens
acccctccctt

SEQ ID NO: 6612098 - DNA, 21 bp, Homo sapiens
acccctcccttgctcagtgcc

SEQ ID NO: 6612099 - DNA, 18 bp, Homo sapiens
acccctccctttctcccc

SEQ ID NO: 6612100 - DNA, 16 bp, Homo sapiens
acccctccggccccgt

SEQ ID NO: 6612101 - DNA, 17 bp, Homo sapiens
acccctcctcactggcc

SEQ ID NO: 6612102 - DNA, 21 bp, Homo sapiens
acccctcctcactggccatcc

SEQ ID NO: 6612103 - DNA, 11 bp, Homo sapiens
acccctcctcc

SEQ ID NO: 6612104 - DNA, 12 bp, Homo sapiens
acccctcctccc

SEQ ID NO: 6612105 - DNA, 14 bp, Homo sapiens
acccctcctccctc

SEQ ID NO: 6612106 - DNA, 15 bp, Homo sapiens
acccctcctccctca

SEQ ID NO: 6612107 - DNA, 15 bp, Homo sapiens
acccctcctccttgc

SEQ ID NO: 6612108 - DNA, 11 bp, Homo sapiens
acccctcctgg

SEQ ID NO: 6612109 - DNA, 14 bp, Homo sapiens
acccctcctggcct

SEQ ID NO: 6612110 - DNA, 14 bp, Homo sapiens
acccctcctggctg

SEQ ID NO: 6612111 - DNA, 16 bp, Homo sapiens
acccctcctggctgtg

SEQ ID NO: 6612112 - DNA, 21 bp, Homo sapiens
acccctcctgggcccaggcag

SEQ ID NO: 6612113 - DNA, 14 bp, Homo sapiens
acccctcctggggc

SEQ ID NO: 6612114 - DNA, 15 bp, Homo sapiens
acccctcctggggcc

SEQ ID NO: 6612115 - DNA, 17 bp, Homo sapiens
acccctcctggggccag

SEQ ID NO: 6612116 - DNA, 18 bp, Homo sapiens
acccctcctggggccagg

SEQ ID NO: 6612117 - DNA, 12 bp, Homo sapiens
acccctccttcc

SEQ ID NO: 6612118 - DNA, 21 bp, Homo sapiens
acccctccttccccagaccca

SEQ ID NO: 6612119 - DNA, 22 bp, Homo sapiens
acccctccttccccagacccag

SEQ ID NO: 6612120 - DNA, 23 bp, Homo sapiens
acccctccttccttgaccagcag

SEQ ID NO: 6612121 - DNA, 17 bp, Homo sapiens
acccctcgactcagcac

SEQ ID NO: 6612122 - DNA, 19 bp, Homo sapiens
acccctcgactcagcacca

SEQ ID NO: 6612123 - DNA, 17 bp, Homo sapiens
acccctcgcaaccctgc

SEQ ID NO: 6612124 - DNA, 20 bp, Homo sapiens
acccctcgcaaccctgcctg

SEQ ID NO: 6612125 - DNA, 23 bp, Homo sapiens
acccctcgcaaccctgcctgtca

SEQ ID NO: 6612126 - DNA, 18 bp, Homo sapiens
acccctcgccacctttca

SEQ ID NO: 6612127 - DNA, 19 bp, Homo sapiens
acccctcgcccagtcccag

SEQ ID NO: 6612128 - DNA, 13 bp, Homo sapiens
acccctcgcccca

SEQ ID NO: 6612129 - DNA, 15 bp, Homo sapiens
acccctcgtccaccc

SEQ ID NO: 6612130 - DNA, 21 bp, Homo sapiens
acccctcgtccaccccccaca

SEQ ID NO: 6612131 - DNA, 23 bp, Homo sapiens
acccctcgtccaccccccacaca

SEQ ID NO: 6612132 - DNA, 18 bp, Homo sapiens
acccctctaccaagctgt

SEQ ID NO: 6612133 - DNA, 18 bp, Homo sapiens
acccctctccaggcctgt

SEQ ID NO: 6612134 - DNA, 21 bp, Homo sapiens
acccctctcccttttcagata

SEQ ID NO: 6612135 - DNA, 17 bp, Homo sapiens
acccctctcgcctcatt

SEQ ID NO: 6612136 - DNA, 14 bp, Homo sapiens
acccctctggccag

SEQ ID NO: 6612137 - DNA, 15 bp, Homo sapiens
acccctctggccagg

SEQ ID NO: 6612138 - DNA, 22 bp, Homo sapiens
acccctctggtgtgtggtgagg

SEQ ID NO: 6612139 - DNA, 14 bp, Homo sapiens
acccctcttcccac

SEQ ID NO: 6612140 - DNA, 14 bp, Homo sapiens
acccctcttccccc

SEQ ID NO: 6612141 - DNA, 22 bp, Homo sapiens
acccctcttcccccttcccctg

SEQ ID NO: 6612142 - DNA, 18 bp, Homo sapiens
acccctgaactggcccca

SEQ ID NO: 6612143 - DNA, 21 bp, Homo sapiens
acccctgaactggccccagct

SEQ ID NO: 6612144 - DNA, 16 bp, Homo sapiens
acccctgactcatcat

SEQ ID NO: 6612145 - DNA, 23 bp, Homo sapiens
acccctgagttgggcagccagga

SEQ ID NO: 6612146 - DNA, 15 bp, Homo sapiens
acccctgcacacacc

SEQ ID NO: 6612147 - DNA, 17 bp, Homo sapiens
acccctgcacacacctg

SEQ ID NO: 6612148 - DNA, 20 bp, Homo sapiens
acccctgcaccagcccttcc

SEQ ID NO: 6612149 - DNA, 15 bp, Homo sapiens
acccctgcagctggg

SEQ ID NO: 6612150 - DNA, 18 bp, Homo sapiens
acccctgccactcaccct

SEQ ID NO: 6612151 - DNA, 20 bp, Homo sapiens
acccctgccagttctctgtg

SEQ ID NO: 6612152 - DNA, 12 bp, Homo sapiens
acccctgcccag

SEQ ID NO: 6612153 - DNA, 16 bp, Homo sapiens
acccctgcccagatca

SEQ ID NO: 6612154 - DNA, 11 bp, Homo sapiens
acccctgcccc

SEQ ID NO: 6612155 - DNA, 12 bp, Homo sapiens
acccctgccccc

SEQ ID NO: 6612156 - DNA, 17 bp, Homo sapiens
acccctgcccccagccc

SEQ ID NO: 6612157 - DNA, 16 bp, Homo sapiens
acccctgccctcggcc

SEQ ID NO: 6612158 - DNA, 18 bp, Homo sapiens
acccctgccctgctccta

SEQ ID NO: 6612159 - DNA, 15 bp, Homo sapiens
acccctgccctggga

SEQ ID NO: 6612160 - DNA, 17 bp, Homo sapiens
acccctgccggccttgg

SEQ ID NO: 6612161 - DNA, 16 bp, Homo sapiens
acccctgcctccaccc

SEQ ID NO: 6612162 - DNA, 20 bp, Homo sapiens
acccctgcctccaccctctg

SEQ ID NO: 6612163 - DNA, 22 bp, Homo sapiens
acccctgcctcccatgcctggt

SEQ ID NO: 6612164 - DNA, 14 bp, Homo sapiens
acccctgcctcctg

SEQ ID NO: 6612165 - DNA, 15 bp, Homo sapiens
acccctgcctcctgc

SEQ ID NO: 6612166 - DNA, 16 bp, Homo sapiens
acccctgcctcctgcc

SEQ ID NO: 6612167 - DNA, 19 bp, Homo sapiens
acccctgcctcctgcctcc

SEQ ID NO: 6612168 - DNA, 11 bp, Homo sapiens
acccctgcctg

SEQ ID NO: 6612169 - DNA, 13 bp, Homo sapiens
acccctgcctggg

SEQ ID NO: 6612170 - DNA, 19 bp, Homo sapiens
acccctgcctgggttttct

SEQ ID NO: 6612171 - DNA, 23 bp, Homo sapiens
acccctgcctgttggcaggccca

SEQ ID NO: 6612172 - DNA, 13 bp, Homo sapiens
acccctgccttcc

SEQ ID NO: 6612173 - DNA, 17 bp, Homo sapiens
acccctgctcccagcct

SEQ ID NO: 6612174 - DNA, 19 bp, Homo sapiens
acccctgctcccagcctgc

SEQ ID NO: 6612175 - DNA, 21 bp, Homo sapiens
acccctgctcccagcctgctg

SEQ ID NO: 6612176 - DNA, 22 bp, Homo sapiens
acccctgctcccattcctccct

SEQ ID NO: 6612177 - DNA, 16 bp, Homo sapiens
acccctgctttgcccc

SEQ ID NO: 6612178 - DNA, 12 bp, Homo sapiens
acccctggaccc

SEQ ID NO: 6612179 - DNA, 15 bp, Homo sapiens
acccctggccacagc

SEQ ID NO: 6612180 - DNA, 19 bp, Homo sapiens
acccctggccacagccttc

SEQ ID NO: 6612181 - DNA, 13 bp, Homo sapiens
acccctggccagc

SEQ ID NO: 6612182 - DNA, 14 bp, Homo sapiens
acccctggctacct

SEQ ID NO: 6612183 - DNA, 15 bp, Homo sapiens
acccctggctccttc

SEQ ID NO: 6612184 - DNA, 16 bp, Homo sapiens
acccctggctccttca

SEQ ID NO: 6612185 - DNA, 15 bp, Homo sapiens
acccctggctgtact

SEQ ID NO: 6612186 - DNA, 12 bp, Homo sapiens
acccctggcttt

SEQ ID NO: 6612187 - DNA, 18 bp, Homo sapiens
acccctggcttttcactg

SEQ ID NO: 6612188 - DNA, 19 bp, Homo sapiens
acccctggcttttcactgc

SEQ ID NO: 6612189 - DNA, 11 bp, Homo sapiens
acccctgggca

SEQ ID NO: 6612190 - DNA, 14 bp, Homo sapiens
acccctgggcaggc

SEQ ID NO: 6612191 - DNA, 21 bp, Homo sapiens
acccctgggcctcatcacagc

SEQ ID NO: 6612192 - DNA, 15 bp, Homo sapiens
acccctgggggaggc

SEQ ID NO: 6612193 - DNA, 16 bp, Homo sapiens
acccctgggggaggct

SEQ ID NO: 6612194 - DNA, 19 bp, Homo sapiens
acccctgggggaggcttcc

SEQ ID NO: 6612195 - DNA, 23 bp, Homo sapiens
acccctgggggaggcttccagct

SEQ ID NO: 6612196 - DNA, 18 bp, Homo sapiens
acccctggggtggccagg

SEQ ID NO: 6612197 - DNA, 21 bp, Homo sapiens
acccctgggtgggccctgccg

SEQ ID NO: 6612198 - DNA, 20 bp, Homo sapiens
acccctggtggctgcaggca

SEQ ID NO: 6612199 - DNA, 20 bp, Homo sapiens
acccctggtgtccctgcctg

SEQ ID NO: 6612200 - DNA, 22 bp, Homo sapiens
acccctggttctcatctttctt

SEQ ID NO: 6612201 - DNA, 20 bp, Homo sapiens
acccctgtaatcaggcaagg

SEQ ID NO: 6612202 - DNA, 10 bp, Homo sapiens
acccctgtac

SEQ ID NO: 6612203 - DNA, 12 bp, Homo sapiens
acccctgtaccc

SEQ ID NO: 6612204 - DNA, 18 bp, Homo sapiens
acccctgtacccagccac

SEQ ID NO: 6612205 - DNA, 20 bp, Homo sapiens
acccctgtacccagccacct

SEQ ID NO: 6612206 - DNA, 17 bp, Homo sapiens
acccctgtacccagctc

SEQ ID NO: 6612207 - DNA, 11 bp, Homo sapiens
acccctgtagg

SEQ ID NO: 6612208 - DNA, 16 bp, Homo sapiens
acccctgtaggcctca

SEQ ID NO: 6612209 - DNA, 17 bp, Homo sapiens
acccctgtaggcctcag

SEQ ID NO: 6612210 - DNA, 22 bp, Homo sapiens
acccctgtagggaaaccttgga

SEQ ID NO: 6612211 - DNA, 21 bp, Homo sapiens
acccctgtcccacccacacag

SEQ ID NO: 6612212 - DNA, 16 bp, Homo sapiens
acccctgtcctcactg

SEQ ID NO: 6612213 - DNA, 18 bp, Homo sapiens
acccctgtcctcactgct

SEQ ID NO: 6612214 - DNA, 19 bp, Homo sapiens
acccctgtcctcactgctc

SEQ ID NO: 6612215 - DNA, 18 bp, Homo sapiens
acccctgtgctcccctgc

SEQ ID NO: 6612216 - DNA, 14 bp, Homo sapiens
acccctgtgctccg

SEQ ID NO: 6612217 - DNA, 18 bp, Homo sapiens
acccctgtggagcccgca

SEQ ID NO: 6612218 - DNA, 19 bp, Homo sapiens
acccctgtggagcccgcac

SEQ ID NO: 6612219 - DNA, 13 bp, Homo sapiens
acccctgtttctg

SEQ ID NO: 6612220 - DNA, 18 bp, Homo sapiens
accccttaagccctggcc

SEQ ID NO: 6612221 - DNA, 14 bp, Homo sapiens
accccttacccatc

SEQ ID NO: 6612222 - DNA, 16 bp, Homo sapiens
accccttagcctccct

SEQ ID NO: 6612223 - DNA, 17 bp, Homo sapiens
accccttaggccccgtg

SEQ ID NO: 6612224 - DNA, 16 bp, Homo sapiens
accccttatccaggac

SEQ ID NO: 6612225 - DNA, 16 bp, Homo sapiens
accccttattgctgcc

SEQ ID NO: 6612226 - DNA, 18 bp, Homo sapiens
accccttattgctgccaa

SEQ ID NO: 6612227 - DNA, 19 bp, Homo sapiens
accccttcagccgagccca

SEQ ID NO: 6612228 - DNA, 16 bp, Homo sapiens
accccttccagatcac

SEQ ID NO: 6612229 - DNA, 15 bp, Homo sapiens
accccttccatgtgg

SEQ ID NO: 6612230 - DNA, 19 bp, Homo sapiens
accccttccatgtggagaa

SEQ ID NO: 6612231 - DNA, 10 bp, Homo sapiens
accccttccc

SEQ ID NO: 6612232 - DNA, 12 bp, Homo sapiens
accccttcccac

SEQ ID NO: 6612233 - DNA, 12 bp, Homo sapiens
accccttcccca

SEQ ID NO: 6612234 - DNA, 16 bp, Homo sapiens
accccttccccactgc

SEQ ID NO: 6612235 - DNA, 18 bp, Homo sapiens
accccttccccatttcct

SEQ ID NO: 6612236 - DNA, 10 bp, Homo sapiens
accccttcct

SEQ ID NO: 6612237 - DNA, 12 bp, Homo sapiens
accccttcctgt

SEQ ID NO: 6612238 - DNA, 14 bp, Homo sapiens
accccttcctgtcc

SEQ ID NO: 6612239 - DNA, 18 bp, Homo sapiens
accccttcctgtcctgcc

SEQ ID NO: 6612240 - DNA, 23 bp, Homo sapiens
accccttcctgtcctgcctcctc

SEQ ID NO: 6612241 - DNA, 14 bp, Homo sapiens
accccttcctgtct

SEQ ID NO: 6612242 - DNA, 20 bp, Homo sapiens
accccttcctgtctggccca

SEQ ID NO: 6612243 - DNA, 11 bp, Homo sapiens
accccttcctt

SEQ ID NO: 6612244 - DNA, 15 bp, Homo sapiens
accccttcctttcct

SEQ ID NO: 6612245 - DNA, 16 bp, Homo sapiens
accccttcctttcctc

SEQ ID NO: 6612246 - DNA, 18 bp, Homo sapiens
accccttcctttcctctg

SEQ ID NO: 6612247 - DNA, 22 bp, Homo sapiens
accccttcgacatgctgccagg

SEQ ID NO: 6612248 - DNA, 19 bp, Homo sapiens
accccttcgctcctgtgtc

SEQ ID NO: 6612249 - DNA, 15 bp, Homo sapiens
accccttctctcctc

SEQ ID NO: 6612250 - DNA, 14 bp, Homo sapiens
accccttctctgtg

SEQ ID NO: 6612251 - DNA, 17 bp, Homo sapiens
accccttctctgtgacc

SEQ ID NO: 6612252 - DNA, 20 bp, Homo sapiens
accccttctctgtgacccac

SEQ ID NO: 6612253 - DNA, 21 bp, Homo sapiens
accccttctctgtgacccact

SEQ ID NO: 6612254 - DNA, 13 bp, Homo sapiens
accccttgctctc

SEQ ID NO: 6612255 - DNA, 14 bp, Homo sapiens
accccttgctctct

SEQ ID NO: 6612256 - DNA, 16 bp, Homo sapiens
accccttgctctctgt

SEQ ID NO: 6612257 - DNA, 18 bp, Homo sapiens
accccttggaaatgtctg

SEQ ID NO: 6612258 - DNA, 20 bp, Homo sapiens
accccttggaaatgtctgct

SEQ ID NO: 6612259 - DNA, 18 bp, Homo sapiens
accccttggaggagagag

SEQ ID NO: 6612260 - DNA, 21 bp, Homo sapiens
accccttggaggagagagacc

SEQ ID NO: 6612261 - DNA, 22 bp, Homo sapiens
accccttggaggagagagaccc

SEQ ID NO: 6612262 - DNA, 16 bp, Homo sapiens
accccttggcactgtg

SEQ ID NO: 6612263 - DNA, 13 bp, Homo sapiens
accccttggcccc

SEQ ID NO: 6612264 - DNA, 15 bp, Homo sapiens
accccttggcccctc

SEQ ID NO: 6612265 - DNA, 16 bp, Homo sapiens
accccttgttgcactg

SEQ ID NO: 6612266 - DNA, 17 bp, Homo sapiens
accccttgttgcactgc

SEQ ID NO: 6612267 - DNA, 19 bp, Homo sapiens
accccttgttgcactgccc

SEQ ID NO: 6612268 - DNA, 20 bp, Homo sapiens
accccttgttgcactgcccc

SEQ ID NO: 6612269 - DNA, 22 bp, Homo sapiens
accccttgttgcactgccccct

SEQ ID NO: 6612270 - DNA, 14 bp, Homo sapiens
acccctttcactta

SEQ ID NO: 6612271 - DNA, 16 bp, Homo sapiens
acccctttcccacccc

SEQ ID NO: 6612272 - DNA, 16 bp, Homo sapiens
acccctttccccagcc

SEQ ID NO: 6612273 - DNA, 20 bp, Homo sapiens
acccctttcctccccataca

SEQ ID NO: 6612274 - DNA, 22 bp, Homo sapiens
acccctttcctccccatacaca

SEQ ID NO: 6612275 - DNA, 23 bp, Homo sapiens
acccctttcctccccatacacac

SEQ ID NO: 6612276 - DNA, 19 bp, Homo sapiens
acccctttctagaccaata

SEQ ID NO: 6612277 - DNA, 12 bp, Homo sapiens
acccctttgatt

SEQ ID NO: 6612278 - DNA, 17 bp, Homo sapiens
acccctttgcaggactt

SEQ ID NO: 6612279 - DNA, 12 bp, Homo sapiens
acccctttgctg

SEQ ID NO: 6612280 - DNA, 20 bp, Homo sapiens
accccttttcagcttctgct

SEQ ID NO: 6612281 - DNA, 13 bp, Homo sapiens
acccgaaatgcca

SEQ ID NO: 6612282 - DNA, 14 bp, Homo sapiens
acccgaaatgccac

SEQ ID NO: 6612283 - DNA, 18 bp, Homo sapiens
acccgaagcccaggctga

SEQ ID NO: 6612284 - DNA, 18 bp, Homo sapiens
acccgacaacatttctgc

SEQ ID NO: 6612285 - DNA, 19 bp, Homo sapiens
acccgacaccagccctgct

SEQ ID NO: 6612286 - DNA, 16 bp, Homo sapiens
acccgacagagggaag

SEQ ID NO: 6612287 - DNA, 17 bp, Homo sapiens
acccgacataagtcgag

SEQ ID NO: 6612288 - DNA, 19 bp, Homo sapiens
acccgagcccagctacatt

SEQ ID NO: 6612289 - DNA, 15 bp, Homo sapiens
acccgagctgggacc

SEQ ID NO: 6612290 - DNA, 17 bp, Homo sapiens
acccgaggctgcccact

SEQ ID NO: 6612291 - DNA, 17 bp, Homo sapiens
acccgagggttgattaa

SEQ ID NO: 6612292 - DNA, 23 bp, Homo sapiens
acccgagggttgattaaggcagt

SEQ ID NO: 6612293 - DNA, 18 bp, Homo sapiens
acccgagtacctccagtc

SEQ ID NO: 6612294 - DNA, 13 bp, Homo sapiens
acccgatgctgct

SEQ ID NO: 6612295 - DNA, 14 bp, Homo sapiens
acccgatgctgctt

SEQ ID NO: 6612296 - DNA, 22 bp, Homo sapiens
acccgatgctgctttcccctgt

SEQ ID NO: 6612297 - DNA, 23 bp, Homo sapiens
acccgattccaccaaatgtgctt

SEQ ID NO: 6612298 - DNA, 21 bp, Homo sapiens
acccgatttgtttatttgcaa

SEQ ID NO: 6612299 - DNA, 21 bp, Homo sapiens
acccgcatgtacaaaaacaca

SEQ ID NO: 6612300 - DNA, 12 bp, Homo sapiens
acccgccagccc

SEQ ID NO: 6612301 - DNA, 13 bp, Homo sapiens
acccgccagcccc

SEQ ID NO: 6612302 - DNA, 16 bp, Homo sapiens
acccgccagccccgct

SEQ ID NO: 6612303 - DNA, 15 bp, Homo sapiens
acccgccccactccc

SEQ ID NO: 6612304 - DNA, 14 bp, Homo sapiens
acccgccccagaga

SEQ ID NO: 6612305 - DNA, 15 bp, Homo sapiens
acccgccccgccccc

SEQ ID NO: 6612306 - DNA, 14 bp, Homo sapiens
acccgcccctgccc

SEQ ID NO: 6612307 - DNA, 15 bp, Homo sapiens
acccgcccctggact

SEQ ID NO: 6612308 - DNA, 14 bp, Homo sapiens
acccgcccgccccc

SEQ ID NO: 6612309 - DNA, 16 bp, Homo sapiens
acccgcccgcggccct

SEQ ID NO: 6612310 - DNA, 14 bp, Homo sapiens
acccgcccttccga

SEQ ID NO: 6612311 - DNA, 19 bp, Homo sapiens
acccgccctttccttgcct

SEQ ID NO: 6612312 - DNA, 20 bp, Homo sapiens
acccgcctgctcccatcctc

SEQ ID NO: 6612313 - DNA, 19 bp, Homo sapiens
acccgctaagagggaggga

SEQ ID NO: 6612314 - DNA, 15 bp, Homo sapiens
acccgctctggacca

SEQ ID NO: 6612315 - DNA, 15 bp, Homo sapiens
acccgctgcccctcc

SEQ ID NO: 6612316 - DNA, 22 bp, Homo sapiens
acccgctgcccctccccgtccc

SEQ ID NO: 6612317 - DNA, 15 bp, Homo sapiens
acccgctgcttccag

SEQ ID NO: 6612318 - DNA, 19 bp, Homo sapiens
acccgctggagcccacagc

SEQ ID NO: 6612319 - DNA, 24 bp, Homo sapiens
acccgctggagcccacagcgagcc

SEQ ID NO: 6612320 - DNA, 16 bp, Homo sapiens
acccgctgggggctgg

SEQ ID NO: 6612321 - DNA, 13 bp, Homo sapiens
acccgctgtggcc

SEQ ID NO: 6612322 - DNA, 16 bp, Homo sapiens
acccggagctaagtca

SEQ ID NO: 6612323 - DNA, 15 bp, Homo sapiens
acccggaggggcctg

SEQ ID NO: 6612324 - DNA, 21 bp, Homo sapiens
acccggaggggcctggcagcc

SEQ ID NO: 6612325 - DNA, 15 bp, Homo sapiens
acccggatctccagg

SEQ ID NO: 6612326 - DNA, 22 bp, Homo sapiens
acccggatctccaggcccagcc

SEQ ID NO: 6612327 - DNA, 20 bp, Homo sapiens
acccggatgaactcaatgca

SEQ ID NO: 6612328 - DNA, 15 bp, Homo sapiens
acccggattggccct

SEQ ID NO: 6612329 - DNA, 19 bp, Homo sapiens
acccggattggccctgccc

SEQ ID NO: 6612330 - DNA, 18 bp, Homo sapiens
acccggcaccccctgcag

SEQ ID NO: 6612331 - DNA, 17 bp, Homo sapiens
acccggcagccccccag

SEQ ID NO: 6612332 - DNA, 18 bp, Homo sapiens
acccggcattctctgccc

SEQ ID NO: 6612333 - DNA, 14 bp, Homo sapiens
acccggccacagct

SEQ ID NO: 6612334 - DNA, 20 bp, Homo sapiens
acccggcccaacccagccca

SEQ ID NO: 6612335 - DNA, 18 bp, Homo sapiens
acccggcccccgccctct

SEQ ID NO: 6612336 - DNA, 21 bp, Homo sapiens
acccggcccccgccctctgcc

SEQ ID NO: 6612337 - DNA, 14 bp, Homo sapiens
acccggcccctgct

SEQ ID NO: 6612338 - DNA, 13 bp, Homo sapiens
acccggcctctct

SEQ ID NO: 6612339 - DNA, 14 bp, Homo sapiens
acccggcctctctg

SEQ ID NO: 6612340 - DNA, 17 bp, Homo sapiens
acccggcctctctgccc

SEQ ID NO: 6612341 - DNA, 15 bp, Homo sapiens
acccggcggccctgc

SEQ ID NO: 6612342 - DNA, 13 bp, Homo sapiens
acccggctaattt

SEQ ID NO: 6612343 - DNA, 12 bp, Homo sapiens
acccggctcccc

SEQ ID NO: 6612344 - DNA, 21 bp, Homo sapiens
acccggctccccctgcttctc

SEQ ID NO: 6612345 - DNA, 20 bp, Homo sapiens
acccggctcgttcccccagg

SEQ ID NO: 6612346 - DNA, 13 bp, Homo sapiens
acccggctgggct

SEQ ID NO: 6612347 - DNA, 16 bp, Homo sapiens
acccggcttcctgtgc

SEQ ID NO: 6612348 - DNA, 23 bp, Homo sapiens
acccgggaacctccccagcctgc

SEQ ID NO: 6612349 - DNA, 20 bp, Homo sapiens
acccgggaagggggctggga

SEQ ID NO: 6612350 - DNA, 15 bp, Homo sapiens
acccgggaggcagag

SEQ ID NO: 6612351 - DNA, 17 bp, Homo sapiens
acccgggaggtggagct

SEQ ID NO: 6612352 - DNA, 23 bp, Homo sapiens
acccgggctcagggaccacagca

SEQ ID NO: 6612353 - DNA, 15 bp, Homo sapiens
acccgggctgcctgc

SEQ ID NO: 6612354 - DNA, 18 bp, Homo sapiens
acccgggctgcctgcccc

SEQ ID NO: 6612355 - DNA, 20 bp, Homo sapiens
acccggggacccccaactcc

SEQ ID NO: 6612356 - DNA, 15 bp, Homo sapiens
acccggggccagaga

SEQ ID NO: 6612357 - DNA, 15 bp, Homo sapiens
acccggggcccaggg

SEQ ID NO: 6612358 - DNA, 14 bp, Homo sapiens
acccgggggacaga

SEQ ID NO: 6612359 - DNA, 13 bp, Homo sapiens
acccgggggagcc

SEQ ID NO: 6612360 - DNA, 16 bp, Homo sapiens
acccggggtctcctgg

SEQ ID NO: 6612361 - DNA, 20 bp, Homo sapiens
acccgggtctggtgctgagg

SEQ ID NO: 6612362 - DNA, 14 bp, Homo sapiens
acccggtcccaggc

SEQ ID NO: 6612363 - DNA, 16 bp, Homo sapiens
acccggtcccaggccg

SEQ ID NO: 6612364 - DNA, 18 bp, Homo sapiens
acccggtgctccctctgt

SEQ ID NO: 6612365 - DNA, 19 bp, Homo sapiens
acccggtgctccctctgtc

SEQ ID NO: 6612366 - DNA, 20 bp, Homo sapiens
acccggttattcgcccaccc

SEQ ID NO: 6612367 - DNA, 17 bp, Homo sapiens
acccggttgcagtcact

SEQ ID NO: 6612368 - DNA, 19 bp, Homo sapiens
acccggtttctttttaagt

SEQ ID NO: 6612369 - DNA, 14 bp, Homo sapiens
acccgtacacacca

SEQ ID NO: 6612370 - DNA, 15 bp, Homo sapiens
acccgtaggcagcct

SEQ ID NO: 6612371 - DNA, 17 bp, Homo sapiens
acccgtaggcagcctct

SEQ ID NO: 6612372 - DNA, 16 bp, Homo sapiens
acccgtcctccctcag

SEQ ID NO: 6612373 - DNA, 17 bp, Homo sapiens
acccgtcctccctcagc

SEQ ID NO: 6612374 - DNA, 18 bp, Homo sapiens
acccgtcctccctcagcc

SEQ ID NO: 6612375 - DNA, 19 bp, Homo sapiens
acccgtcctccctcagcct

SEQ ID NO: 6612376 - DNA, 23 bp, Homo sapiens
acccgtcctccctcagcctcccc

SEQ ID NO: 6612377 - DNA, 19 bp, Homo sapiens
acccgtcttcaatctctgt

SEQ ID NO: 6612378 - DNA, 17 bp, Homo sapiens
acccgtgacagtggctg

SEQ ID NO: 6612379 - DNA, 19 bp, Homo sapiens
acccgtgacagtggctgac

SEQ ID NO: 6612380 - DNA, 18 bp, Homo sapiens
acccgtgccaagtccagg

SEQ ID NO: 6612381 - DNA, 18 bp, Homo sapiens
acccgtgccacgcgctct

SEQ ID NO: 6612382 - DNA, 22 bp, Homo sapiens
acccgtgccacgcgctctgcat

SEQ ID NO: 6612383 - DNA, 15 bp, Homo sapiens
acccgtgcctgggcc

SEQ ID NO: 6612384 - DNA, 20 bp, Homo sapiens
acccgtgcctgggcccctcc

SEQ ID NO: 6612385 - DNA, 21 bp, Homo sapiens
acccgtgcctgggcccctccc

SEQ ID NO: 6612386 - DNA, 17 bp, Homo sapiens
acccgtggaggctgctc

SEQ ID NO: 6612387 - DNA, 18 bp, Homo sapiens
acccgtgtctagaggcag

SEQ ID NO: 6612388 - DNA, 19 bp, Homo sapiens
acccgtgtctagaggcagg

SEQ ID NO: 6612389 - DNA, 13 bp, Homo sapiens
acccgttaattta

SEQ ID NO: 6612390 - DNA, 16 bp, Homo sapiens
acccgttcacattttt

SEQ ID NO: 6612391 - DNA, 18 bp, Homo sapiens
acccgttcatgggggagg

SEQ ID NO: 6612392 - DNA, 13 bp, Homo sapiens
acccgttccaaaa

SEQ ID NO: 6612393 - DNA, 22 bp, Homo sapiens
acccgttctgctggcctggatc

SEQ ID NO: 6612394 - DNA, 13 bp, Homo sapiens
acccgtttccaag

SEQ ID NO: 6612395 - DNA, 14 bp, Homo sapiens
acccgtttccaagc

SEQ ID NO: 6612396 - DNA, 22 bp, Homo sapiens
acccgttttatgatttactcat

SEQ ID NO: 6612397 - DNA, 19 bp, Homo sapiens
accctaaaaagcagagctt

SEQ ID NO: 6612398 - DNA, 19 bp, Homo sapiens
accctaaaattctagggga

SEQ ID NO: 6612399 - DNA, 14 bp, Homo sapiens
accctaaagtctca

SEQ ID NO: 6612400 - DNA, 15 bp, Homo sapiens
accctaaatctgagg

SEQ ID NO: 6612401 - DNA, 17 bp, Homo sapiens
accctaactcttgctca

SEQ ID NO: 6612402 - DNA, 19 bp, Homo sapiens
accctaactcttgctcact

SEQ ID NO: 6612403 - DNA, 21 bp, Homo sapiens
accctaactcttgctcactcc

SEQ ID NO: 6612404 - DNA, 18 bp, Homo sapiens
accctaagaatgctttgc

SEQ ID NO: 6612405 - DNA, 16 bp, Homo sapiens
accctaagactcctcg

SEQ ID NO: 6612406 - DNA, 14 bp, Homo sapiens
accctaagatgaag

SEQ ID NO: 6612407 - DNA, 16 bp, Homo sapiens
accctaagcctccttt

SEQ ID NO: 6612408 - DNA, 14 bp, Homo sapiens
accctaagggcagc

SEQ ID NO: 6612409 - DNA, 16 bp, Homo sapiens
accctaagtgtggatg

SEQ ID NO: 6612410 - DNA, 21 bp, Homo sapiens
accctaatagactaaatgaaa

SEQ ID NO: 6612411 - DNA, 17 bp, Homo sapiens
accctacacctctgggc

SEQ ID NO: 6612412 - DNA, 23 bp, Homo sapiens
accctacacctctgggccctgca

SEQ ID NO: 6612413 - DNA, 14 bp, Homo sapiens
accctacagacagc

SEQ ID NO: 6612414 - DNA, 16 bp, Homo sapiens
accctacagcagatcc

SEQ ID NO: 6612415 - DNA, 17 bp, Homo sapiens
accctacagcagatcca

SEQ ID NO: 6612416 - DNA, 18 bp, Homo sapiens
accctacagcagatccac

SEQ ID NO: 6612417 - DNA, 16 bp, Homo sapiens
accctacataaggctg

SEQ ID NO: 6612418 - DNA, 16 bp, Homo sapiens
accctacatgcatgtt

SEQ ID NO: 6612419 - DNA, 16 bp, Homo sapiens
accctaccagctcctc

SEQ ID NO: 6612420 - DNA, 17 bp, Homo sapiens
accctaccagctcctcc

SEQ ID NO: 6612421 - DNA, 21 bp, Homo sapiens
accctaccagctcctccagcc

SEQ ID NO: 6612422 - DNA, 13 bp, Homo sapiens
accctacctgtgc

SEQ ID NO: 6612423 - DNA, 16 bp, Homo sapiens
accctacctgtgcctg

SEQ ID NO: 6612424 - DNA, 20 bp, Homo sapiens
accctacgctcatctctgga

SEQ ID NO: 6612425 - DNA, 14 bp, Homo sapiens
accctactctggat

SEQ ID NO: 6612426 - DNA, 17 bp, Homo sapiens
accctactctggatggt

SEQ ID NO: 6612427 - DNA, 18 bp, Homo sapiens
accctacttcttttgctc

SEQ ID NO: 6612428 - DNA, 16 bp, Homo sapiens
accctactttgcttcc

SEQ ID NO: 6612429 - DNA, 20 bp, Homo sapiens
accctactttgcttccgcca

SEQ ID NO: 6612430 - DNA, 17 bp, Homo sapiens
accctagaagaaaaccc

SEQ ID NO: 6612431 - DNA, 23 bp, Homo sapiens
accctagaaggtggggacctggg

SEQ ID NO: 6612432 - DNA, 19 bp, Homo sapiens
accctagccagagaataga

SEQ ID NO: 6612433 - DNA, 19 bp, Homo sapiens
accctagccattcctggta

SEQ ID NO: 6612434 - DNA, 20 bp, Homo sapiens
accctagctttatattttgt

SEQ ID NO: 6612435 - DNA, 20 bp, Homo sapiens
accctaggtctccacccctc

SEQ ID NO: 6612436 - DNA, 23 bp, Homo sapiens
accctaggtctccacccctcaag

SEQ ID NO: 6612437 - DNA, 24 bp, Homo sapiens
accctaggtctccacccctcaagc

SEQ ID NO: 6612438 - DNA, 19 bp, Homo sapiens
accctaggttcccggtccc

SEQ ID NO: 6612439 - DNA, 22 bp, Homo sapiens
accctaggttcccggtcccgag

SEQ ID NO: 6612440 - DNA, 16 bp, Homo sapiens
accctaggttccctgt

SEQ ID NO: 6612441 - DNA, 18 bp, Homo sapiens
accctaggttccctgttc

SEQ ID NO: 6612442 - DNA, 23 bp, Homo sapiens
accctaggttccctgttcttcct

SEQ ID NO: 6612443 - DNA, 23 bp, Homo sapiens
accctatatataatttgagtgta

SEQ ID NO: 6612444 - DNA, 14 bp, Homo sapiens
accctatcatcagt

SEQ ID NO: 6612445 - DNA, 14 bp, Homo sapiens
accctatctcctga

SEQ ID NO: 6612446 - DNA, 15 bp, Homo sapiens
accctatctcctgac

SEQ ID NO: 6612447 - DNA, 22 bp, Homo sapiens
accctatctgtgattcccccaa

SEQ ID NO: 6612448 - DNA, 23 bp, Homo sapiens
accctatcttctcattgtttgtt

SEQ ID NO: 6612449 - DNA, 15 bp, Homo sapiens
accctatgccttttg

SEQ ID NO: 6612450 - DNA, 17 bp, Homo sapiens
accctatgccttttgta

SEQ ID NO: 6612451 - DNA, 21 bp, Homo sapiens
accctatgccttttgtagctg

SEQ ID NO: 6612452 - DNA, 19 bp, Homo sapiens
accctatggccactggccg

SEQ ID NO: 6612453 - DNA, 19 bp, Homo sapiens
accctattctatccatctc

SEQ ID NO: 6612454 - DNA, 22 bp, Homo sapiens
accctattctatccatctcctg

SEQ ID NO: 6612455 - DNA, 19 bp, Homo sapiens
accctatttaaatgaaagg

SEQ ID NO: 6612456 - DNA, 14 bp, Homo sapiens
accctcaaatgtca

SEQ ID NO: 6612457 - DNA, 22 bp, Homo sapiens
accctcaaatgtcagagctatg

SEQ ID NO: 6612458 - DNA, 21 bp, Homo sapiens
accctcaacctcttctggctc

SEQ ID NO: 6612459 - DNA, 22 bp, Homo sapiens
accctcaaggtgcggggagaag

SEQ ID NO: 6612460 - DNA, 13 bp, Homo sapiens
accctcacacaca

SEQ ID NO: 6612461 - DNA, 17 bp, Homo sapiens
accctcacacacacagc

SEQ ID NO: 6612462 - DNA, 21 bp, Homo sapiens
accctcacacacacagctggg

SEQ ID NO: 6612463 - DNA, 14 bp, Homo sapiens
accctcacactgct

SEQ ID NO: 6612464 - DNA, 15 bp, Homo sapiens
accctcacactggga

SEQ ID NO: 6612465 - DNA, 14 bp, Homo sapiens
accctcaccccctc

SEQ ID NO: 6612466 - DNA, 21 bp, Homo sapiens
accctcaccccctcctggcaa

SEQ ID NO: 6612467 - DNA, 15 bp, Homo sapiens
accctcactctgcca

SEQ ID NO: 6612468 - DNA, 21 bp, Homo sapiens
accctcactctgccagggcag

SEQ ID NO: 6612469 - DNA, 17 bp, Homo sapiens
accctcactgctgggga

SEQ ID NO: 6612470 - DNA, 22 bp, Homo sapiens
accctcactgctggggagtccc

SEQ ID NO: 6612471 - DNA, 15 bp, Homo sapiens
accctcactggctct

SEQ ID NO: 6612472 - DNA, 20 bp, Homo sapiens
accctcactgggactttgta

SEQ ID NO: 6612473 - DNA, 19 bp, Homo sapiens
accctcagaatattaagca

SEQ ID NO: 6612474 - DNA, 21 bp, Homo sapiens
accctcagaatattaagcaca

SEQ ID NO: 6612475 - DNA, 18 bp, Homo sapiens
accctcagagccacccct

SEQ ID NO: 6612476 - DNA, 17 bp, Homo sapiens
accctcagcaccccttc

SEQ ID NO: 6612477 - DNA, 14 bp, Homo sapiens
accctcagcagctc

SEQ ID NO: 6612478 - DNA, 22 bp, Homo sapiens
accctcagcagctctggctctg

SEQ ID NO: 6612479 - DNA, 19 bp, Homo sapiens
accctcagccccaggagaa

SEQ ID NO: 6612480 - DNA, 12 bp, Homo sapiens
accctcagccct

SEQ ID NO: 6612481 - DNA, 18 bp, Homo sapiens
accctcagccctggcctt

SEQ ID NO: 6612482 - DNA, 11 bp, Homo sapiens
accctcagcct

SEQ ID NO: 6612483 - DNA, 12 bp, Homo sapiens
accctcagcctt

SEQ ID NO: 6612484 - DNA, 16 bp, Homo sapiens
accctcaggcacacct

SEQ ID NO: 6612485 - DNA, 17 bp, Homo sapiens
accctcaggcacacctt

SEQ ID NO: 6612486 - DNA, 19 bp, Homo sapiens
accctcaggcacaccttgc

SEQ ID NO: 6612487 - DNA, 22 bp, Homo sapiens
accctcaggcacaccttgcaga

SEQ ID NO: 6612488 - DNA, 13 bp, Homo sapiens
accctcaggccac

SEQ ID NO: 6612489 - DNA, 18 bp, Homo sapiens
accctcaggccaccctcc

SEQ ID NO: 6612490 - DNA, 20 bp, Homo sapiens
accctcaggccaccctccac

SEQ ID NO: 6612491 - DNA, 18 bp, Homo sapiens
accctcagggagcctccc

SEQ ID NO: 6612492 - DNA, 18 bp, Homo sapiens
accctcagggcaaagcca

SEQ ID NO: 6612493 - DNA, 21 bp, Homo sapiens
accctcagggcaaagccaggt

SEQ ID NO: 6612494 - DNA, 13 bp, Homo sapiens
accctcaggtgcc

SEQ ID NO: 6612495 - DNA, 20 bp, Homo sapiens
accctcaggtgtagctgagc

SEQ ID NO: 6612496 - DNA, 16 bp, Homo sapiens
accctcatctgtctgg

SEQ ID NO: 6612497 - DNA, 13 bp, Homo sapiens
accctcatgctgt

SEQ ID NO: 6612498 - DNA, 17 bp, Homo sapiens
accctcatggcccccag

SEQ ID NO: 6612499 - DNA, 21 bp, Homo sapiens
accctcatggcccccaggggc

SEQ ID NO: 6612500 - DNA, 23 bp, Homo sapiens
accctcatggcccccaggggcag

SEQ ID NO: 6612501 - DNA, 17 bp, Homo sapiens
accctcattctactgaa

SEQ ID NO: 6612502 - DNA, 16 bp, Homo sapiens
accctcattgctgtct

SEQ ID NO: 6612503 - DNA, 18 bp, Homo sapiens
accctcatttctgccagc

SEQ ID NO: 6612504 - DNA, 22 bp, Homo sapiens
accctccaaaggaactctagag

SEQ ID NO: 6612505 - DNA, 12 bp, Homo sapiens
accctccaaggc

SEQ ID NO: 6612506 - DNA, 22 bp, Homo sapiens
accctccaagtctgtacctcaa

SEQ ID NO: 6612507 - DNA, 15 bp, Homo sapiens
accctccacaaagca

SEQ ID NO: 6612508 - DNA, 21 bp, Homo sapiens
accctccacacacttcttcca

SEQ ID NO: 6612509 - DNA, 16 bp, Homo sapiens
accctccacaggagcc

SEQ ID NO: 6612510 - DNA, 17 bp, Homo sapiens
accctccaccctgtccc

SEQ ID NO: 6612511 - DNA, 16 bp, Homo sapiens
accctccaccgagcca

SEQ ID NO: 6612512 - DNA, 15 bp, Homo sapiens
accctccacctctca

SEQ ID NO: 6612513 - DNA, 21 bp, Homo sapiens
accctccactcagctgtcctg

SEQ ID NO: 6612514 - DNA, 13 bp, Homo sapiens
accctccactctg

SEQ ID NO: 6612515 - DNA, 14 bp, Homo sapiens
accctccactctga

SEQ ID NO: 6612516 - DNA, 21 bp, Homo sapiens
accctccactctgaggtctca

SEQ ID NO: 6612517 - DNA, 21 bp, Homo sapiens
accctcccaccatgcgctgct

SEQ ID NO: 6612518 - DNA, 19 bp, Homo sapiens
accctcccactcccatctc

SEQ ID NO: 6612519 - DNA, 19 bp, Homo sapiens
accctcccagaaacatctc

SEQ ID NO: 6612520 - DNA, 23 bp, Homo sapiens
accctcccagaaacatctctggc

SEQ ID NO: 6612521 - DNA, 15 bp, Homo sapiens
accctcccagctctg

SEQ ID NO: 6612522 - DNA, 22 bp, Homo sapiens
accctcccaggtttcccactgc

SEQ ID NO: 6612523 - DNA, 11 bp, Homo sapiens
accctcccagt

SEQ ID NO: 6612524 - DNA, 14 bp, Homo sapiens
accctcccagtctc

SEQ ID NO: 6612525 - DNA, 19 bp, Homo sapiens
accctcccagtctcatctc

SEQ ID NO: 6612526 - DNA, 16 bp, Homo sapiens
accctcccatggcacc

SEQ ID NO: 6612527 - DNA, 23 bp, Homo sapiens
accctccccaaaacctttcccca

SEQ ID NO: 6612528 - DNA, 19 bp, Homo sapiens
accctccccaaggatgacc

SEQ ID NO: 6612529 - DNA, 21 bp, Homo sapiens
accctccccacagtgccaccc

SEQ ID NO: 6612530 - DNA, 22 bp, Homo sapiens
accctccccacagtgccaccca

SEQ ID NO: 6612531 - DNA, 14 bp, Homo sapiens
accctcccccacca

SEQ ID NO: 6612532 - DNA, 18 bp, Homo sapiens
accctcccccagacacag

SEQ ID NO: 6612533 - DNA, 20 bp, Homo sapiens
accctccccggcggtgccgc

SEQ ID NO: 6612534 - DNA, 22 bp, Homo sapiens
accctccccggcggtgccgcgc

SEQ ID NO: 6612535 - DNA, 13 bp, Homo sapiens
accctcccctccc

SEQ ID NO: 6612536 - DNA, 13 bp, Homo sapiens
accctcccctctc

SEQ ID NO: 6612537 - DNA, 18 bp, Homo sapiens
accctcccctctcctgag

SEQ ID NO: 6612538 - DNA, 19 bp, Homo sapiens
accctcccctctcttgcac

SEQ ID NO: 6612539 - DNA, 14 bp, Homo sapiens
accctcccctgcct

SEQ ID NO: 6612540 - DNA, 17 bp, Homo sapiens
accctcccctgcctccg

SEQ ID NO: 6612541 - DNA, 23 bp, Homo sapiens
accctcccctgtcttctctcaaa

SEQ ID NO: 6612542 - DNA, 15 bp, Homo sapiens
accctccccttccca

SEQ ID NO: 6612543 - DNA, 17 bp, Homo sapiens
accctccccttcccagg

SEQ ID NO: 6612544 - DNA, 17 bp, Homo sapiens
accctcccgctgcaagt

SEQ ID NO: 6612545 - DNA, 10 bp, Homo sapiens
accctccctg

SEQ ID NO: 6612546 - DNA, 11 bp, Homo sapiens
accctccctgc

SEQ ID NO: 6612547 - DNA, 15 bp, Homo sapiens
accctccctgctgtc

SEQ ID NO: 6612548 - DNA, 21 bp, Homo sapiens
accctccctgctgtcccctct

SEQ ID NO: 6612549 - DNA, 14 bp, Homo sapiens
accctccctggagt

SEQ ID NO: 6612550 - DNA, 15 bp, Homo sapiens
accctccctggagtg

SEQ ID NO: 6612551 - DNA, 15 bp, Homo sapiens
accctccgccttcac

SEQ ID NO: 6612552 - DNA, 18 bp, Homo sapiens
accctccggccagcgagt

SEQ ID NO: 6612553 - DNA, 23 bp, Homo sapiens
accctccggccagcgagtggtca

SEQ ID NO: 6612554 - DNA, 18 bp, Homo sapiens
accctcctagcctgctct

SEQ ID NO: 6612555 - DNA, 19 bp, Homo sapiens
accctcctccagaccattc

SEQ ID NO: 6612556 - DNA, 14 bp, Homo sapiens
accctcctccctcc

SEQ ID NO: 6612557 - DNA, 20 bp, Homo sapiens
accctcctccctccaagcct

SEQ ID NO: 6612558 - DNA, 22 bp, Homo sapiens
accctcctccctccaagcctgg

SEQ ID NO: 6612559 - DNA, 11 bp, Homo sapiens
accctcctcct

SEQ ID NO: 6612560 - DNA, 15 bp, Homo sapiens
accctcctctagcca

SEQ ID NO: 6612561 - DNA, 19 bp, Homo sapiens
accctcctctatttcttta

SEQ ID NO: 6612562 - DNA, 12 bp, Homo sapiens
accctcctctgc

SEQ ID NO: 6612563 - DNA, 16 bp, Homo sapiens
accctcctctgctggg

SEQ ID NO: 6612564 - DNA, 12 bp, Homo sapiens
accctcctgagc

SEQ ID NO: 6612565 - DNA, 13 bp, Homo sapiens
accctcctgcccc

SEQ ID NO: 6612566 - DNA, 15 bp, Homo sapiens
accctcctgccccac

SEQ ID NO: 6612567 - DNA, 16 bp, Homo sapiens
accctcctgccccaca

SEQ ID NO: 6612568 - DNA, 19 bp, Homo sapiens
accctcctgcccccccacc

SEQ ID NO: 6612569 - DNA, 11 bp, Homo sapiens
accctcctgcg

SEQ ID NO: 6612570 - DNA, 19 bp, Homo sapiens
accctcctgctgagctgcc

SEQ ID NO: 6612571 - DNA, 14 bp, Homo sapiens
accctcctggcctt

SEQ ID NO: 6612572 - DNA, 18 bp, Homo sapiens
accctcctggccttcctc

SEQ ID NO: 6612573 - DNA, 11 bp, Homo sapiens
accctcctggg

SEQ ID NO: 6612574 - DNA, 14 bp, Homo sapiens
accctcctgtaaat

SEQ ID NO: 6612575 - DNA, 21 bp, Homo sapiens
accctcctgtcttcccagggt

SEQ ID NO: 6612576 - DNA, 21 bp, Homo sapiens
accctcctgttgcacccagcc

SEQ ID NO: 6612577 - DNA, 15 bp, Homo sapiens
accctccttcccact

SEQ ID NO: 6612578 - DNA, 14 bp, Homo sapiens
accctccttcccca

SEQ ID NO: 6612579 - DNA, 20 bp, Homo sapiens
accctccttccccaccccat

SEQ ID NO: 6612580 - DNA, 21 bp, Homo sapiens
accctccttctattttcccta

SEQ ID NO: 6612581 - DNA, 18 bp, Homo sapiens
accctccttgagactgga

SEQ ID NO: 6612582 - DNA, 16 bp, Homo sapiens
accctccttggtgcct

SEQ ID NO: 6612583 - DNA, 18 bp, Homo sapiens
accctccttggtgcctct

SEQ ID NO: 6612584 - DNA, 16 bp, Homo sapiens
accctcgaccaccccc

SEQ ID NO: 6612585 - DNA, 19 bp, Homo sapiens
accctcgaggcggatcttt

SEQ ID NO: 6612586 - DNA, 23 bp, Homo sapiens
accctcgcagcaggtgcaagaga

SEQ ID NO: 6612587 - DNA, 20 bp, Homo sapiens
accctcgccctgtccctccc

SEQ ID NO: 6612588 - DNA, 13 bp, Homo sapiens
accctcgccggac

SEQ ID NO: 6612589 - DNA, 15 bp, Homo sapiens
accctcgctctctgt

SEQ ID NO: 6612590 - DNA, 17 bp, Homo sapiens
accctcgctctctgtct

SEQ ID NO: 6612591 - DNA, 15 bp, Homo sapiens
accctcgctgccacc

SEQ ID NO: 6612592 - DNA, 14 bp, Homo sapiens
accctcgctggccc

SEQ ID NO: 6612593 - DNA, 20 bp, Homo sapiens
accctcgctggcccccactg

SEQ ID NO: 6612594 - DNA, 12 bp, Homo sapiens
accctcggagcc

SEQ ID NO: 6612595 - DNA, 13 bp, Homo sapiens
accctcggagccc

SEQ ID NO: 6612596 - DNA, 22 bp, Homo sapiens
accctcggagccccccactcag

SEQ ID NO: 6612597 - DNA, 23 bp, Homo sapiens
accctcggagccccccactcagt

SEQ ID NO: 6612598 - DNA, 18 bp, Homo sapiens
accctcgggcccacctgg

SEQ ID NO: 6612599 - DNA, 20 bp, Homo sapiens
accctcgggcccacctggcc

SEQ ID NO: 6612600 - DNA, 21 bp, Homo sapiens
accctcgggcccacctggcca

SEQ ID NO: 6612601 - DNA, 23 bp, Homo sapiens
accctcggggatgtgtcctgaca

SEQ ID NO: 6612602 - DNA, 22 bp, Homo sapiens
accctcgtggacacctgccctg

SEQ ID NO: 6612603 - DNA, 23 bp, Homo sapiens
accctcgtggacacctgccctgc

SEQ ID NO: 6612604 - DNA, 14 bp, Homo sapiens
accctcgtggcctt

SEQ ID NO: 6612605 - DNA, 20 bp, Homo sapiens
accctctcactagtgccaat

SEQ ID NO: 6612606 - DNA, 15 bp, Homo sapiens
accctctcagctcca

SEQ ID NO: 6612607 - DNA, 18 bp, Homo sapiens
accctctcaggctgtccc

SEQ ID NO: 6612608 - DNA, 19 bp, Homo sapiens
accctctcaggctgtccca

SEQ ID NO: 6612609 - DNA, 19 bp, Homo sapiens
accctctccatctcccaag

SEQ ID NO: 6612610 - DNA, 15 bp, Homo sapiens
accctctcccaggac

SEQ ID NO: 6612611 - DNA, 22 bp, Homo sapiens
accctctccgcacacctctggc

SEQ ID NO: 6612612 - DNA, 23 bp, Homo sapiens
accctctctaatggcccctccat

SEQ ID NO: 6612613 - DNA, 12 bp, Homo sapiens
accctctctgtc

SEQ ID NO: 6612614 - DNA, 22 bp, Homo sapiens
accctctctgtccaatctgcaa

SEQ ID NO: 6612615 - DNA, 11 bp, Homo sapiens
accctctcttt

SEQ ID NO: 6612616 - DNA, 19 bp, Homo sapiens
accctctgaatggtccagg

SEQ ID NO: 6612617 - DNA, 18 bp, Homo sapiens
accctctgagctttgcat

SEQ ID NO: 6612618 - DNA, 14 bp, Homo sapiens
accctctgcagggc

SEQ ID NO: 6612619 - DNA, 23 bp, Homo sapiens
accctctgcagggcagcctgtgg

SEQ ID NO: 6612620 - DNA, 13 bp, Homo sapiens
accctctgccacc

SEQ ID NO: 6612621 - DNA, 18 bp, Homo sapiens
accctctgccccagaaca

SEQ ID NO: 6612622 - DNA, 15 bp, Homo sapiens
accctctgctatgtc

SEQ ID NO: 6612623 - DNA, 12 bp, Homo sapiens
accctctgctgc

SEQ ID NO: 6612624 - DNA, 16 bp, Homo sapiens
accctctgctgcacag

SEQ ID NO: 6612625 - DNA, 13 bp, Homo sapiens
accctctggaagt

SEQ ID NO: 6612626 - DNA, 23 bp, Homo sapiens
accctctggaggggtgtggctcc

SEQ ID NO: 6612627 - DNA, 12 bp, Homo sapiens
accctctgggaa

SEQ ID NO: 6612628 - DNA, 15 bp, Homo sapiens
accctctgggaacct

SEQ ID NO: 6612629 - DNA, 21 bp, Homo sapiens
accctctgggaacctcccaga

SEQ ID NO: 6612630 - DNA, 22 bp, Homo sapiens
accctctgggggtcctctctga

SEQ ID NO: 6612631 - DNA, 22 bp, Homo sapiens
accctctgggtctcagtgtcct

SEQ ID NO: 6612632 - DNA, 13 bp, Homo sapiens
accctctgtccca

SEQ ID NO: 6612633 - DNA, 13 bp, Homo sapiens
accctctgtcccc

SEQ ID NO: 6612634 - DNA, 16 bp, Homo sapiens
accctctgtccccacg

SEQ ID NO: 6612635 - DNA, 22 bp, Homo sapiens
accctctgtccccaggcctggc

SEQ ID NO: 6612636 - DNA, 23 bp, Homo sapiens
accctctgtccccaggcctggct

SEQ ID NO: 6612637 - DNA, 19 bp, Homo sapiens
accctctgtccttccccca

SEQ ID NO: 6612638 - DNA, 12 bp, Homo sapiens
accctctgtgaa

SEQ ID NO: 6612639 - DNA, 20 bp, Homo sapiens
accctctgtgaaatttgtaa

SEQ ID NO: 6612640 - DNA, 15 bp, Homo sapiens
accctcttcctgtga

SEQ ID NO: 6612641 - DNA, 20 bp, Homo sapiens
accctcttctcagctccact

SEQ ID NO: 6612642 - DNA, 18 bp, Homo sapiens
accctcttctcctctggc

SEQ ID NO: 6612643 - DNA, 16 bp, Homo sapiens
accctcttctctgggc

SEQ ID NO: 6612644 - DNA, 22 bp, Homo sapiens
accctcttctctgggcccagag

SEQ ID NO: 6612645 - DNA, 14 bp, Homo sapiens
accctcttgccatc

SEQ ID NO: 6612646 - DNA, 16 bp, Homo sapiens
accctcttgccatcct

SEQ ID NO: 6612647 - DNA, 17 bp, Homo sapiens
accctcttgccatcctg

SEQ ID NO: 6612648 - DNA, 18 bp, Homo sapiens
accctcttgccatcctga

SEQ ID NO: 6612649 - DNA, 19 bp, Homo sapiens
accctcttgccatcctgat

SEQ ID NO: 6612650 - DNA, 19 bp, Homo sapiens
accctctttcttgtttgtc

SEQ ID NO: 6612651 - DNA, 14 bp, Homo sapiens
accctctttgctga

SEQ ID NO: 6612652 - DNA, 16 bp, Homo sapiens
accctctttgctgcag

SEQ ID NO: 6612653 - DNA, 18 bp, Homo sapiens
accctcttttaccaactt

SEQ ID NO: 6612654 - DNA, 16 bp, Homo sapiens
accctgaaagccctga

SEQ ID NO: 6612655 - DNA, 11 bp, Homo sapiens
accctgaaatg

SEQ ID NO: 6612656 - DNA, 13 bp, Homo sapiens
accctgaaatgtg

SEQ ID NO: 6612657 - DNA, 23 bp, Homo sapiens
accctgaacaacgagccttttca

SEQ ID NO: 6612658 - DNA, 12 bp, Homo sapiens
accctgaagggg

SEQ ID NO: 6612659 - DNA, 17 bp, Homo sapiens
accctgaaggggccatg

SEQ ID NO: 6612660 - DNA, 22 bp, Homo sapiens
accctgaagtcagcgggcccag

SEQ ID NO: 6612661 - DNA, 13 bp, Homo sapiens
accctgaatcaga

SEQ ID NO: 6612662 - DNA, 22 bp, Homo sapiens
accctgaatggttccatgcctg

SEQ ID NO: 6612663 - DNA, 18 bp, Homo sapiens
accctgaatgtgtgccct

SEQ ID NO: 6612664 - DNA, 17 bp, Homo sapiens
accctgacccccttcct

SEQ ID NO: 6612665 - DNA, 17 bp, Homo sapiens
accctgacctccgcccc

SEQ ID NO: 6612666 - DNA, 13 bp, Homo sapiens
accctgacctggc

SEQ ID NO: 6612667 - DNA, 17 bp, Homo sapiens
accctgagactccagaa

SEQ ID NO: 6612668 - DNA, 17 bp, Homo sapiens
accctgagagtctgaga

SEQ ID NO: 6612669 - DNA, 16 bp, Homo sapiens
accctgagccccttcc

SEQ ID NO: 6612670 - DNA, 13 bp, Homo sapiens
accctgagcctga

SEQ ID NO: 6612671 - DNA, 16 bp, Homo sapiens
accctgagctcgggga

SEQ ID NO: 6612672 - DNA, 17 bp, Homo sapiens
accctgagctgaggcag

SEQ ID NO: 6612673 - DNA, 14 bp, Homo sapiens
accctgaggaggcc

SEQ ID NO: 6612674 - DNA, 13 bp, Homo sapiens
accctgaggagtc

SEQ ID NO: 6612675 - DNA, 19 bp, Homo sapiens
accctgaggagtctgaggt

SEQ ID NO: 6612676 - DNA, 13 bp, Homo sapiens
accctgaggccca

SEQ ID NO: 6612677 - DNA, 15 bp, Homo sapiens
accctgaggcccaga

SEQ ID NO: 6612678 - DNA, 19 bp, Homo sapiens
accctgaggcccagagggc

SEQ ID NO: 6612679 - DNA, 21 bp, Homo sapiens
accctgaggcccagagggcct

SEQ ID NO: 6612680 - DNA, 15 bp, Homo sapiens
accctgagggctcct

SEQ ID NO: 6612681 - DNA, 16 bp, Homo sapiens
accctgaggtaacagg

SEQ ID NO: 6612682 - DNA, 22 bp, Homo sapiens
accctgaggtatctgtgttaca

SEQ ID NO: 6612683 - DNA, 20 bp, Homo sapiens
accctgaggtcagggagtgc

SEQ ID NO: 6612684 - DNA, 17 bp, Homo sapiens
accctgagttttgtttt

SEQ ID NO: 6612685 - DNA, 18 bp, Homo sapiens
accctgatcacctcaggg

SEQ ID NO: 6612686 - DNA, 19 bp, Homo sapiens
accctgatcacctcagggc

SEQ ID NO: 6612687 - DNA, 22 bp, Homo sapiens
accctgatgcaggtcagcccat

SEQ ID NO: 6612688 - DNA, 23 bp, Homo sapiens
accctgatgcaggtcagcccatg

SEQ ID NO: 6612689 - DNA, 15 bp, Homo sapiens
accctgattcttgat

SEQ ID NO: 6612690 - DNA, 22 bp, Homo sapiens
accctgattcttgattcctggc

SEQ ID NO: 6612691 - DNA, 19 bp, Homo sapiens
accctgcaaacagaacagg

SEQ ID NO: 6612692 - DNA, 18 bp, Homo sapiens
accctgcaaaggactgtt

SEQ ID NO: 6612693 - DNA, 20 bp, Homo sapiens
accctgcaagaccacggagg

SEQ ID NO: 6612694 - DNA, 16 bp, Homo sapiens
accctgcacctgctgc

SEQ ID NO: 6612695 - DNA, 23 bp, Homo sapiens
accctgcagagcacacaggtaca

SEQ ID NO: 6612696 - DNA, 14 bp, Homo sapiens
accctgcagagcta

SEQ ID NO: 6612697 - DNA, 15 bp, Homo sapiens
accctgcagccagga

SEQ ID NO: 6612698 - DNA, 13 bp, Homo sapiens
accctgcagcttg

SEQ ID NO: 6612699 - DNA, 18 bp, Homo sapiens
accctgcaggacttgcca

SEQ ID NO: 6612700 - DNA, 14 bp, Homo sapiens
accctgcaggcagg

SEQ ID NO: 6612701 - DNA, 18 bp, Homo sapiens
accctgcaggcaggcaga

SEQ ID NO: 6612702 - DNA, 13 bp, Homo sapiens
accctgcaggcca

SEQ ID NO: 6612703 - DNA, 14 bp, Homo sapiens
accctgcaggccag

SEQ ID NO: 6612704 - DNA, 21 bp, Homo sapiens
accctgcattttcctcttgtc

SEQ ID NO: 6612705 - DNA, 22 bp, Homo sapiens
accctgccaagactcctcaggc

SEQ ID NO: 6612706 - DNA, 16 bp, Homo sapiens
accctgccacagccag

SEQ ID NO: 6612707 - DNA, 18 bp, Homo sapiens
accctgccacagccagag

SEQ ID NO: 6612708 - DNA, 19 bp, Homo sapiens
accctgccacagccagagg

SEQ ID NO: 6612709 - DNA, 16 bp, Homo sapiens
accctgccaccctctg

SEQ ID NO: 6612710 - DNA, 17 bp, Homo sapiens
accctgccaccctctgc

SEQ ID NO: 6612711 - DNA, 11 bp, Homo sapiens
accctgccagg

SEQ ID NO: 6612712 - DNA, 15 bp, Homo sapiens
accctgccaggcaca

SEQ ID NO: 6612713 - DNA, 16 bp, Homo sapiens
accctgcccaccccat

SEQ ID NO: 6612714 - DNA, 15 bp, Homo sapiens
accctgcccaccccc

SEQ ID NO: 6612715 - DNA, 15 bp, Homo sapiens
accctgcccactccc

SEQ ID NO: 6612716 - DNA, 21 bp, Homo sapiens
accctgcccacttcagcccag

SEQ ID NO: 6612717 - DNA, 16 bp, Homo sapiens
accctgcccagcctga

SEQ ID NO: 6612718 - DNA, 14 bp, Homo sapiens
accctgcccatacc

SEQ ID NO: 6612719 - DNA, 19 bp, Homo sapiens
accctgcccatacccctgc

SEQ ID NO: 6612720 - DNA, 10 bp, Homo sapiens
accctgcccc

SEQ ID NO: 6612721 - DNA, 20 bp, Homo sapiens
accctgccccaccccacctc

SEQ ID NO: 6612722 - DNA, 14 bp, Homo sapiens
accctgcccccact

SEQ ID NO: 6612723 - DNA, 12 bp, Homo sapiens
accctgccccta

SEQ ID NO: 6612724 - DNA, 17 bp, Homo sapiens
accctgcccctaagtta

SEQ ID NO: 6612725 - DNA, 18 bp, Homo sapiens
accctgcccctaagttat

SEQ ID NO: 6612726 - DNA, 20 bp, Homo sapiens
accctgcccctaagttatta

SEQ ID NO: 6612727 - DNA, 23 bp, Homo sapiens
accctgcccctccccaaaagaaa

SEQ ID NO: 6612728 - DNA, 13 bp, Homo sapiens
accctgcccctgc

SEQ ID NO: 6612729 - DNA, 15 bp, Homo sapiens
accctgcccctgcaa

SEQ ID NO: 6612730 - DNA, 19 bp, Homo sapiens
accctgcccctttcttccc

SEQ ID NO: 6612731 - DNA, 23 bp, Homo sapiens
accctgcccctttcttccccacc

SEQ ID NO: 6612732 - DNA, 13 bp, Homo sapiens
accctgcccgctc

SEQ ID NO: 6612733 - DNA, 16 bp, Homo sapiens
accctgccctcatggg

SEQ ID NO: 6612734 - DNA, 16 bp, Homo sapiens
accctgccctgcacct

SEQ ID NO: 6612735 - DNA, 18 bp, Homo sapiens
accctgccctgctgagca

SEQ ID NO: 6612736 - DNA, 15 bp, Homo sapiens
accctgccctggcct

SEQ ID NO: 6612737 - DNA, 16 bp, Homo sapiens
accctgccctgggcga

SEQ ID NO: 6612738 - DNA, 14 bp, Homo sapiens
accctgccctgtgg

SEQ ID NO: 6612739 - DNA, 22 bp, Homo sapiens
accctgccctgtgggcccccaa

SEQ ID NO: 6612740 - DNA, 11 bp, Homo sapiens
accctgccgag

SEQ ID NO: 6612741 - DNA, 18 bp, Homo sapiens
accctgccgagggggctg

SEQ ID NO: 6612742 - DNA, 17 bp, Homo sapiens
accctgccgtcaccacc

SEQ ID NO: 6612743 - DNA, 18 bp, Homo sapiens
accctgccgtcaccacca

SEQ ID NO: 6612744 - DNA, 17 bp, Homo sapiens
accctgcctacgccagg

SEQ ID NO: 6612745 - DNA, 14 bp, Homo sapiens
accctgcctcagct

SEQ ID NO: 6612746 - DNA, 15 bp, Homo sapiens
accctgcctcagctg

SEQ ID NO: 6612747 - DNA, 20 bp, Homo sapiens
accctgcctctacccaacca

SEQ ID NO: 6612748 - DNA, 17 bp, Homo sapiens
accctgcctctcagagg

SEQ ID NO: 6612749 - DNA, 15 bp, Homo sapiens
accctgcctgagccc

SEQ ID NO: 6612750 - DNA, 23 bp, Homo sapiens
accctgcctgagcccaggagctg

SEQ ID NO: 6612751 - DNA, 14 bp, Homo sapiens
accctgcctgcacc

SEQ ID NO: 6612752 - DNA, 12 bp, Homo sapiens
accctgcctgct

SEQ ID NO: 6612753 - DNA, 15 bp, Homo sapiens
accctgcctgctgtg

SEQ ID NO: 6612754 - DNA, 22 bp, Homo sapiens
accctgcctgctgtggagccca

SEQ ID NO: 6612755 - DNA, 13 bp, Homo sapiens
accctgcctgtca

SEQ ID NO: 6612756 - DNA, 19 bp, Homo sapiens
accctgcgaaggggccctg

SEQ ID NO: 6612757 - DNA, 12 bp, Homo sapiens
accctgcgcccc

SEQ ID NO: 6612758 - DNA, 17 bp, Homo sapiens
accctgcgcccctgccc

SEQ ID NO: 6612759 - DNA, 18 bp, Homo sapiens
accctgcgcccctgccca

SEQ ID NO: 6612760 - DNA, 21 bp, Homo sapiens
accctgcgcccctgcccagca

SEQ ID NO: 6612761 - DNA, 19 bp, Homo sapiens
accctgcgcctccagaggt

SEQ ID NO: 6612762 - DNA, 15 bp, Homo sapiens
accctgcgggccagg

SEQ ID NO: 6612763 - DNA, 15 bp, Homo sapiens
accctgcgtggggac

SEQ ID NO: 6612764 - DNA, 16 bp, Homo sapiens
accctgcgtggggaca

SEQ ID NO: 6612765 - DNA, 16 bp, Homo sapiens
accctgctcacaggca

SEQ ID NO: 6612766 - DNA, 18 bp, Homo sapiens
accctgctcacaggcagg

SEQ ID NO: 6612767 - DNA, 12 bp, Homo sapiens
accctgctccct

SEQ ID NO: 6612768 - DNA, 13 bp, Homo sapiens
accctgctccctg

SEQ ID NO: 6612769 - DNA, 14 bp, Homo sapiens
accctgctccctgc

SEQ ID NO: 6612770 - DNA, 15 bp, Homo sapiens
accctgctccctgct

SEQ ID NO: 6612771 - DNA, 18 bp, Homo sapiens
accctgctcctcctgccc

SEQ ID NO: 6612772 - DNA, 21 bp, Homo sapiens
accctgctcctcctgccctgt

SEQ ID NO: 6612773 - DNA, 14 bp, Homo sapiens
accctgctgaacac

SEQ ID NO: 6612774 - DNA, 14 bp, Homo sapiens
accctgctgactcg

SEQ ID NO: 6612775 - DNA, 13 bp, Homo sapiens
accctgcttcacc

SEQ ID NO: 6612776 - DNA, 13 bp, Homo sapiens
accctgcttctcc

SEQ ID NO: 6612777 - DNA, 16 bp, Homo sapiens
accctgcttggcccag

SEQ ID NO: 6612778 - DNA, 21 bp, Homo sapiens
accctgcttggggcctggcgt

SEQ ID NO: 6612779 - DNA, 23 bp, Homo sapiens
accctgcttggggcctggcgtgg

SEQ ID NO: 6612780 - DNA, 19 bp, Homo sapiens
accctggaaaggggagttg

SEQ ID NO: 6612781 - DNA, 22 bp, Homo sapiens
accctggaaccgggaagggtgg

SEQ ID NO: 6612782 - DNA, 11 bp, Homo sapiens
accctggaagc

SEQ ID NO: 6612783 - DNA, 18 bp, Homo sapiens
accctggaattcagcacc

SEQ ID NO: 6612784 - DNA, 19 bp, Homo sapiens
accctggagagtgcacatg

SEQ ID NO: 6612785 - DNA, 16 bp, Homo sapiens
accctggagccatccc

SEQ ID NO: 6612786 - DNA, 17 bp, Homo sapiens
accctggaggcacctgg

SEQ ID NO: 6612787 - DNA, 20 bp, Homo sapiens
accctggaggcacctggtgg

SEQ ID NO: 6612788 - DNA, 21 bp, Homo sapiens
accctggaggccccaaccctg

SEQ ID NO: 6612789 - DNA, 14 bp, Homo sapiens
accctggagtggca

SEQ ID NO: 6612790 - DNA, 15 bp, Homo sapiens
accctggagtggcat

SEQ ID NO: 6612791 - DNA, 18 bp, Homo sapiens
accctggagtggcatggt

SEQ ID NO: 6612792 - DNA, 18 bp, Homo sapiens
accctggagttcttggga

SEQ ID NO: 6612793 - DNA, 20 bp, Homo sapiens
accctggcaccgcattagag

SEQ ID NO: 6612794 - DNA, 23 bp, Homo sapiens
accctggcactataatgtaagct

SEQ ID NO: 6612795 - DNA, 18 bp, Homo sapiens
accctggcagagaagaga

SEQ ID NO: 6612796 - DNA, 14 bp, Homo sapiens
accctggcagggac

SEQ ID NO: 6612797 - DNA, 20 bp, Homo sapiens
accctggcagggacctgaga

SEQ ID NO: 6612798 - DNA, 21 bp, Homo sapiens
accctggcagggacctgagag

SEQ ID NO: 6612799 - DNA, 16 bp, Homo sapiens
accctggccaccaccc

SEQ ID NO: 6612800 - DNA, 17 bp, Homo sapiens
accctggccaccaccca

SEQ ID NO: 6612801 - DNA, 21 bp, Homo sapiens
accctggccaccacccaacct

SEQ ID NO: 6612802 - DNA, 14 bp, Homo sapiens
accctggcctggtc

SEQ ID NO: 6612803 - DNA, 19 bp, Homo sapiens
accctggcctggtccctgg

SEQ ID NO: 6612804 - DNA, 23 bp, Homo sapiens
accctggcctggtccctggtcct

SEQ ID NO: 6612805 - DNA, 16 bp, Homo sapiens
accctggctctgccag

SEQ ID NO: 6612806 - DNA, 15 bp, Homo sapiens
accctgggacccccc

SEQ ID NO: 6612807 - DNA, 15 bp, Homo sapiens
accctgggagagaag

SEQ ID NO: 6612808 - DNA, 20 bp, Homo sapiens
accctgggatgggccaccca

SEQ ID NO: 6612809 - DNA, 16 bp, Homo sapiens
accctgggcaacatga

SEQ ID NO: 6612810 - DNA, 18 bp, Homo sapiens
accctgggcaatgcagtg

SEQ ID NO: 6612811 - DNA, 21 bp, Homo sapiens
accctgggccacgccggccac

SEQ ID NO: 6612812 - DNA, 17 bp, Homo sapiens
accctgggccctgggct

SEQ ID NO: 6612813 - DNA, 18 bp, Homo sapiens
accctgggccctgggctg

SEQ ID NO: 6612814 - DNA, 20 bp, Homo sapiens
accctgggccctgggctgga

SEQ ID NO: 6612815 - DNA, 14 bp, Homo sapiens
accctgggcctgga

SEQ ID NO: 6612816 - DNA, 19 bp, Homo sapiens
accctgggctacagaaacc

SEQ ID NO: 6612817 - DNA, 13 bp, Homo sapiens
accctgggctcca

SEQ ID NO: 6612818 - DNA, 22 bp, Homo sapiens
accctgggctccacacagcagt

SEQ ID NO: 6612819 - DNA, 14 bp, Homo sapiens
accctgggctctgg

SEQ ID NO: 6612820 - DNA, 21 bp, Homo sapiens
accctgggctctgggagcagc

SEQ ID NO: 6612821 - DNA, 16 bp, Homo sapiens
accctgggctctggtc

SEQ ID NO: 6612822 - DNA, 18 bp, Homo sapiens
accctgggctctgtgggc

SEQ ID NO: 6612823 - DNA, 19 bp, Homo sapiens
accctgggctctgtgggct

SEQ ID NO: 6612824 - DNA, 13 bp, Homo sapiens
accctgggctgga

SEQ ID NO: 6612825 - DNA, 16 bp, Homo sapiens
accctgggctggggag

SEQ ID NO: 6612826 - DNA, 17 bp, Homo sapiens
accctgggctggggagg

SEQ ID NO: 6612827 - DNA, 22 bp, Homo sapiens
accctgggctggggaggaggag

SEQ ID NO: 6612828 - DNA, 23 bp, Homo sapiens
accctgggctggggaggaggaga

SEQ ID NO: 6612829 - DNA, 19 bp, Homo sapiens
accctgggctgtccagcct

SEQ ID NO: 6612830 - DNA, 20 bp, Homo sapiens
accctgggctgtccagcctt

SEQ ID NO: 6612831 - DNA, 19 bp, Homo sapiens
accctggggaaggagccag

SEQ ID NO: 6612832 - DNA, 13 bp, Homo sapiens
accctggggcctg

SEQ ID NO: 6612833 - DNA, 17 bp, Homo sapiens
accctggggcctggacc

SEQ ID NO: 6612834 - DNA, 18 bp, Homo sapiens
accctgggtcctcgggcc

SEQ ID NO: 6612835 - DNA, 21 bp, Homo sapiens
accctgggtcgggacagacca

SEQ ID NO: 6612836 - DNA, 20 bp, Homo sapiens
accctgggtgggctctgtgc

SEQ ID NO: 6612837 - DNA, 19 bp, Homo sapiens
accctgggtttggcccctg

SEQ ID NO: 6612838 - DNA, 22 bp, Homo sapiens
accctggtccagtcgggaggag

SEQ ID NO: 6612839 - DNA, 15 bp, Homo sapiens
accctggtctgtgga

SEQ ID NO: 6612840 - DNA, 17 bp, Homo sapiens
accctggtgacctcctg

SEQ ID NO: 6612841 - DNA, 22 bp, Homo sapiens
accctggtgacctcctgtcact

SEQ ID NO: 6612842 - DNA, 16 bp, Homo sapiens
accctggtgcctggct

SEQ ID NO: 6612843 - DNA, 21 bp, Homo sapiens
accctggtggtattttatttt

SEQ ID NO: 6612844 - DNA, 20 bp, Homo sapiens
accctggttcccaccattcc

SEQ ID NO: 6612845 - DNA, 20 bp, Homo sapiens
accctggtttttttcctgtg

SEQ ID NO: 6612846 - DNA, 15 bp, Homo sapiens
accctgtaaaagaca

SEQ ID NO: 6612847 - DNA, 19 bp, Homo sapiens
accctgtacatatgtaaac

SEQ ID NO: 6612848 - DNA, 20 bp, Homo sapiens
accctgtactgttctgtgtc

SEQ ID NO: 6612849 - DNA, 19 bp, Homo sapiens
accctgtatggagctagag

SEQ ID NO: 6612850 - DNA, 22 bp, Homo sapiens
accctgtatggagctagagagg

SEQ ID NO: 6612851 - DNA, 16 bp, Homo sapiens
accctgtcaaacatta

SEQ ID NO: 6612852 - DNA, 14 bp, Homo sapiens
accctgtcccccag

SEQ ID NO: 6612853 - DNA, 20 bp, Homo sapiens
accctgtcccccagctctgg

SEQ ID NO: 6612854 - DNA, 17 bp, Homo sapiens
accctgtcccctaggga

SEQ ID NO: 6612855 - DNA, 20 bp, Homo sapiens
accctgtcccctagggactg

SEQ ID NO: 6612856 - DNA, 18 bp, Homo sapiens
accctgtccggcccagtg

SEQ ID NO: 6612857 - DNA, 19 bp, Homo sapiens
accctgtccggcccagtgc

SEQ ID NO: 6612858 - DNA, 19 bp, Homo sapiens
accctgtcctgcagtccca

SEQ ID NO: 6612859 - DNA, 23 bp, Homo sapiens
accctgtctctactaaaaataca

SEQ ID NO: 6612860 - DNA, 14 bp, Homo sapiens
accctgtctgcagg

SEQ ID NO: 6612861 - DNA, 17 bp, Homo sapiens
accctgtctgcaggcca

SEQ ID NO: 6612862 - DNA, 13 bp, Homo sapiens
accctgtctgccc

SEQ ID NO: 6612863 - DNA, 22 bp, Homo sapiens
accctgtctgtagagggccctg

SEQ ID NO: 6612864 - DNA, 23 bp, Homo sapiens
accctgtctgtagagggccctgg

SEQ ID NO: 6612865 - DNA, 15 bp, Homo sapiens
accctgtctgtccct

SEQ ID NO: 6612866 - DNA, 17 bp, Homo sapiens
accctgtctgtcccttt

SEQ ID NO: 6612867 - DNA, 21 bp, Homo sapiens
accctgtctgtcccttttctt

SEQ ID NO: 6612868 - DNA, 16 bp, Homo sapiens
accctgtcttcctctg

SEQ ID NO: 6612869 - DNA, 20 bp, Homo sapiens
accctgtcttcctctgcaag

SEQ ID NO: 6612870 - DNA, 17 bp, Homo sapiens
accctgtcttctgggca

SEQ ID NO: 6612871 - DNA, 13 bp, Homo sapiens
accctgtctttaa

SEQ ID NO: 6612872 - DNA, 21 bp, Homo sapiens
accctgtgacatggtgcctga

SEQ ID NO: 6612873 - DNA, 19 bp, Homo sapiens
accctgtgatggggccctg

SEQ ID NO: 6612874 - DNA, 21 bp, Homo sapiens
accctgtgatggggccctgcc

SEQ ID NO: 6612875 - DNA, 22 bp, Homo sapiens
accctgtgcaattcagtctgct

SEQ ID NO: 6612876 - DNA, 17 bp, Homo sapiens
accctgtgcaggagcta

SEQ ID NO: 6612877 - DNA, 14 bp, Homo sapiens
accctgtgccccgc

SEQ ID NO: 6612878 - DNA, 14 bp, Homo sapiens
accctgtgctggtg

SEQ ID NO: 6612879 - DNA, 15 bp, Homo sapiens
accctgtgctggtgt

SEQ ID NO: 6612880 - DNA, 14 bp, Homo sapiens
accctgtggctcac

SEQ ID NO: 6612881 - DNA, 20 bp, Homo sapiens
accctgtgggaccgcctggc

SEQ ID NO: 6612882 - DNA, 21 bp, Homo sapiens
accctgtgggggcggctgtgg

SEQ ID NO: 6612883 - DNA, 22 bp, Homo sapiens
accctgtgggtgtctccctcgg

SEQ ID NO: 6612884 - DNA, 15 bp, Homo sapiens
accctgtgtcagagc

SEQ ID NO: 6612885 - DNA, 16 bp, Homo sapiens
accctgttcaggctgg

SEQ ID NO: 6612886 - DNA, 17 bp, Homo sapiens
accctgttcctgctgct

SEQ ID NO: 6612887 - DNA, 18 bp, Homo sapiens
accctgttcctgctgctg

SEQ ID NO: 6612888 - DNA, 15 bp, Homo sapiens
accctgttcctggag

SEQ ID NO: 6612889 - DNA, 11 bp, Homo sapiens
accctgttgag

SEQ ID NO: 6612890 - DNA, 19 bp, Homo sapiens
accctgttgagtatttgct

SEQ ID NO: 6612891 - DNA, 12 bp, Homo sapiens
accctgtttctg

SEQ ID NO: 6612892 - DNA, 17 bp, Homo sapiens
accctgtttctgtagaa

SEQ ID NO: 6612893 - DNA, 18 bp, Homo sapiens
accctgtttggattttta

SEQ ID NO: 6612894 - DNA, 16 bp, Homo sapiens
accctgttttatactg

SEQ ID NO: 6612895 - DNA, 17 bp, Homo sapiens
accctgttttccacacc

SEQ ID NO: 6612896 - DNA, 18 bp, Homo sapiens
accctgttttgagccctg

SEQ ID NO: 6612897 - DNA, 23 bp, Homo sapiens
acccttaaacagttgcacagcat

SEQ ID NO: 6612898 - DNA, 14 bp, Homo sapiens
acccttaacccaag

SEQ ID NO: 6612899 - DNA, 15 bp, Homo sapiens
acccttaacccaagg

SEQ ID NO: 6612900 - DNA, 17 bp, Homo sapiens
acccttaacccaaggag

SEQ ID NO: 6612901 - DNA, 14 bp, Homo sapiens
acccttaactgaca

SEQ ID NO: 6612902 - DNA, 19 bp, Homo sapiens
acccttacagtaggagccc

SEQ ID NO: 6612903 - DNA, 20 bp, Homo sapiens
acccttacttcctggcctct

SEQ ID NO: 6612904 - DNA, 12 bp, Homo sapiens
acccttagaaaa

SEQ ID NO: 6612905 - DNA, 13 bp, Homo sapiens
acccttagaaaat

SEQ ID NO: 6612906 - DNA, 19 bp, Homo sapiens
acccttagagattgcccca

SEQ ID NO: 6612907 - DNA, 16 bp, Homo sapiens
acccttagcagcccag

SEQ ID NO: 6612908 - DNA, 13 bp, Homo sapiens
acccttaggatgg

SEQ ID NO: 6612909 - DNA, 17 bp, Homo sapiens
acccttaggatggggct

SEQ ID NO: 6612910 - DNA, 23 bp, Homo sapiens
acccttaggatggggctcccagc

SEQ ID NO: 6612911 - DNA, 24 bp, Homo sapiens
acccttaggatggggctcccagct

SEQ ID NO: 6612912 - DNA, 15 bp, Homo sapiens
acccttaggcctttt

SEQ ID NO: 6612913 - DNA, 15 bp, Homo sapiens
acccttataaaatcc

SEQ ID NO: 6612914 - DNA, 14 bp, Homo sapiens
acccttatgactcc

SEQ ID NO: 6612915 - DNA, 19 bp, Homo sapiens
acccttattgctgtcctgg

SEQ ID NO: 6612916 - DNA, 22 bp, Homo sapiens
acccttcaacgtttcttcactt

SEQ ID NO: 6612917 - DNA, 14 bp, Homo sapiens
acccttcaactcct

SEQ ID NO: 6612918 - DNA, 17 bp, Homo sapiens
acccttcacgctggctt

SEQ ID NO: 6612919 - DNA, 16 bp, Homo sapiens
acccttcagaccccag

SEQ ID NO: 6612920 - DNA, 14 bp, Homo sapiens
acccttcagggcca

SEQ ID NO: 6612921 - DNA, 15 bp, Homo sapiens
acccttcagggccag

SEQ ID NO: 6612922 - DNA, 17 bp, Homo sapiens
acccttcagggccagaa

SEQ ID NO: 6612923 - DNA, 20 bp, Homo sapiens
acccttcatcttcctgtgtc

SEQ ID NO: 6612924 - DNA, 14 bp, Homo sapiens
acccttccacagtc

SEQ ID NO: 6612925 - DNA, 16 bp, Homo sapiens
acccttccagacatac

SEQ ID NO: 6612926 - DNA, 14 bp, Homo sapiens
acccttccatcagc

SEQ ID NO: 6612927 - DNA, 20 bp, Homo sapiens
acccttcccaatcagcactg

SEQ ID NO: 6612928 - DNA, 14 bp, Homo sapiens
acccttccccactc

SEQ ID NO: 6612929 - DNA, 17 bp, Homo sapiens
acccttccccactcccg

SEQ ID NO: 6612930 - DNA, 13 bp, Homo sapiens
acccttcccgccc

SEQ ID NO: 6612931 - DNA, 17 bp, Homo sapiens
acccttccctcttccct

SEQ ID NO: 6612932 - DNA, 20 bp, Homo sapiens
acccttccctcttccctctc

SEQ ID NO: 6612933 - DNA, 22 bp, Homo sapiens
acccttccctcttccctctccc

SEQ ID NO: 6612934 - DNA, 15 bp, Homo sapiens
acccttccctgcctc

SEQ ID NO: 6612935 - DNA, 21 bp, Homo sapiens
acccttccctgcctccagctg

SEQ ID NO: 6612936 - DNA, 15 bp, Homo sapiens
acccttcctcctcct

SEQ ID NO: 6612937 - DNA, 17 bp, Homo sapiens
acccttcctgccaagcc

SEQ ID NO: 6612938 - DNA, 18 bp, Homo sapiens
acccttcctgccaagcca

SEQ ID NO: 6612939 - DNA, 15 bp, Homo sapiens
acccttcctgctgct

SEQ ID NO: 6612940 - DNA, 23 bp, Homo sapiens
acccttcctgctgctgctactgc

SEQ ID NO: 6612941 - DNA, 13 bp, Homo sapiens
acccttcctggcc

SEQ ID NO: 6612942 - DNA, 11 bp, Homo sapiens
acccttccttc

SEQ ID NO: 6612943 - DNA, 20 bp, Homo sapiens
acccttctactttttccttc

SEQ ID NO: 6612944 - DNA, 16 bp, Homo sapiens
acccttctcccactct

SEQ ID NO: 6612945 - DNA, 20 bp, Homo sapiens
acccttctcccactctccta

SEQ ID NO: 6612946 - DNA, 16 bp, Homo sapiens
acccttctcctttcct

SEQ ID NO: 6612947 - DNA, 19 bp, Homo sapiens
acccttctcctttccttcc

SEQ ID NO: 6612948 - DNA, 21 bp, Homo sapiens
acccttctcctttccttccca

SEQ ID NO: 6612949 - DNA, 20 bp, Homo sapiens
acccttctctcacttctaaa

SEQ ID NO: 6612950 - DNA, 13 bp, Homo sapiens
acccttctcttct

SEQ ID NO: 6612951 - DNA, 14 bp, Homo sapiens
acccttctgtgccc

SEQ ID NO: 6612952 - DNA, 17 bp, Homo sapiens
acccttctgtgcccagc

SEQ ID NO: 6612953 - DNA, 14 bp, Homo sapiens
acccttcttcatgt

SEQ ID NO: 6612954 - DNA, 17 bp, Homo sapiens
acccttcttcatgttca

SEQ ID NO: 6612955 - DNA, 16 bp, Homo sapiens
acccttctttaaatca

SEQ ID NO: 6612956 - DNA, 20 bp, Homo sapiens
acccttctttccatttctct

SEQ ID NO: 6612957 - DNA, 14 bp, Homo sapiens
acccttctttcctc

SEQ ID NO: 6612958 - DNA, 20 bp, Homo sapiens
acccttcttttctcatgtgt

SEQ ID NO: 6612959 - DNA, 17 bp, Homo sapiens
acccttgaaaactctca

SEQ ID NO: 6612960 - DNA, 20 bp, Homo sapiens
acccttgaaaactctcagtc

SEQ ID NO: 6612961 - DNA, 14 bp, Homo sapiens
acccttgaatttct

SEQ ID NO: 6612962 - DNA, 12 bp, Homo sapiens
acccttgactgt

SEQ ID NO: 6612963 - DNA, 17 bp, Homo sapiens
acccttgattcattctg

SEQ ID NO: 6612964 - DNA, 21 bp, Homo sapiens
acccttgcatccattgttgtg

SEQ ID NO: 6612965 - DNA, 16 bp, Homo sapiens
acccttgcattagaaa

SEQ ID NO: 6612966 - DNA, 17 bp, Homo sapiens
acccttgcccaccccac

SEQ ID NO: 6612967 - DNA, 22 bp, Homo sapiens
acccttgcccggctgtgattgc

SEQ ID NO: 6612968 - DNA, 16 bp, Homo sapiens
acccttgcctgcctcc

SEQ ID NO: 6612969 - DNA, 17 bp, Homo sapiens
acccttgcctgcctcct

SEQ ID NO: 6612970 - DNA, 13 bp, Homo sapiens
acccttgctgctg

SEQ ID NO: 6612971 - DNA, 16 bp, Homo sapiens
acccttgctgtgaatt

SEQ ID NO: 6612972 - DNA, 21 bp, Homo sapiens
acccttggaaaacaaaagttt

SEQ ID NO: 6612973 - DNA, 18 bp, Homo sapiens
acccttggacttgaggat

SEQ ID NO: 6612974 - DNA, 14 bp, Homo sapiens
acccttggagctct

SEQ ID NO: 6612975 - DNA, 22 bp, Homo sapiens
acccttggcctccatttctgtc

SEQ ID NO: 6612976 - DNA, 13 bp, Homo sapiens
acccttggcctgt

SEQ ID NO: 6612977 - DNA, 17 bp, Homo sapiens
acccttgggccagaagt

SEQ ID NO: 6612978 - DNA, 20 bp, Homo sapiens
acccttgggccagaagtacc

SEQ ID NO: 6612979 - DNA, 16 bp, Homo sapiens
acccttggtgtttccc

SEQ ID NO: 6612980 - DNA, 16 bp, Homo sapiens
acccttggtttgcaca

SEQ ID NO: 6612981 - DNA, 20 bp, Homo sapiens
acccttggtttgcacataaa

SEQ ID NO: 6612982 - DNA, 15 bp, Homo sapiens
acccttgtaccccat

SEQ ID NO: 6612983 - DNA, 17 bp, Homo sapiens
acccttgtgcttggtgg

SEQ ID NO: 6612984 - DNA, 15 bp, Homo sapiens
acccttgtggtccca

SEQ ID NO: 6612985 - DNA, 20 bp, Homo sapiens
acccttgtggtcccacccca

SEQ ID NO: 6612986 - DNA, 23 bp, Homo sapiens
acccttgtggtcccaccccacac

SEQ ID NO: 6612987 - DNA, 24 bp, Homo sapiens
acccttgttattatctactagtaa

SEQ ID NO: 6612988 - DNA, 13 bp, Homo sapiens
acccttgttccag

SEQ ID NO: 6612989 - DNA, 18 bp, Homo sapiens
acccttgttggggagtgg

SEQ ID NO: 6612990 - DNA, 23 bp, Homo sapiens
accctttaaatggggacgcagat

SEQ ID NO: 6612991 - DNA, 17 bp, Homo sapiens
accctttaaatgtaaaa

SEQ ID NO: 6612992 - DNA, 19 bp, Homo sapiens
accctttaagatatccatc

SEQ ID NO: 6612993 - DNA, 20 bp, Homo sapiens
accctttaagatatccatct

SEQ ID NO: 6612994 - DNA, 21 bp, Homo sapiens
accctttagtgctttgtgata

SEQ ID NO: 6612995 - DNA, 13 bp, Homo sapiens
accctttcacaag

SEQ ID NO: 6612996 - DNA, 21 bp, Homo sapiens
accctttcagaatcttttcaa

SEQ ID NO: 6612997 - DNA, 21 bp, Homo sapiens
accctttcatagagaggcctg

SEQ ID NO: 6612998 - DNA, 21 bp, Homo sapiens
accctttccggcacactgcca

SEQ ID NO: 6612999 - DNA, 14 bp, Homo sapiens
accctttcctcccc

SEQ ID NO: 6613000 - DNA, 23 bp, Homo sapiens
accctttcctcccccagcgtcag

SEQ ID NO: 6613001 - DNA, 15 bp, Homo sapiens
accctttccttcctt

SEQ ID NO: 6613002 - DNA, 18 bp, Homo sapiens
accctttccttccttccc

SEQ ID NO: 6613003 - DNA, 19 bp, Homo sapiens
accctttccttccttccct

SEQ ID NO: 6613004 - DNA, 18 bp, Homo sapiens
accctttctacttccaag

SEQ ID NO: 6613005 - DNA, 11 bp, Homo sapiens
accctttctcc

SEQ ID NO: 6613006 - DNA, 15 bp, Homo sapiens
accctttctgttgcc

SEQ ID NO: 6613007 - DNA, 21 bp, Homo sapiens
accctttcttgacaaaaccta

SEQ ID NO: 6613008 - DNA, 23 bp, Homo sapiens
accctttcttttgaatcaatctg

SEQ ID NO: 6613009 - DNA, 20 bp, Homo sapiens
accctttgaattggacaata

SEQ ID NO: 6613010 - DNA, 23 bp, Homo sapiens
accctttgcctttcttctgccct

SEQ ID NO: 6613011 - DNA, 16 bp, Homo sapiens
accctttggccccact

SEQ ID NO: 6613012 - DNA, 23 bp, Homo sapiens
accctttggggggggcccgcctg

SEQ ID NO: 6613013 - DNA, 23 bp, Homo sapiens
accctttggttatttcagccccc

SEQ ID NO: 6613014 - DNA, 21 bp, Homo sapiens
accctttggtttttttcttct

SEQ ID NO: 6613015 - DNA, 23 bp, Homo sapiens
accctttggtttttttcttctgt

SEQ ID NO: 6613016 - DNA, 12 bp, Homo sapiens
accctttgtatt

SEQ ID NO: 6613017 - DNA, 19 bp, Homo sapiens
accctttgtattataattg

SEQ ID NO: 6613018 - DNA, 19 bp, Homo sapiens
accctttgtgtgctctcca

SEQ ID NO: 6613019 - DNA, 14 bp, Homo sapiens
accctttgttgaaa

SEQ ID NO: 6613020 - DNA, 18 bp, Homo sapiens
accctttgttgaaaaatg

SEQ ID NO: 6613021 - DNA, 20 bp, Homo sapiens
accctttgttgaaaaatgtt

SEQ ID NO: 6613022 - DNA, 14 bp, Homo sapiens
accctttgtttctt

SEQ ID NO: 6613023 - DNA, 17 bp, Homo sapiens
accctttgtttcttgtt

SEQ ID NO: 6613024 - DNA, 13 bp, Homo sapiens
acccttttaagca

SEQ ID NO: 6613025 - DNA, 12 bp, Homo sapiens
acccttttccag

SEQ ID NO: 6613026 - DNA, 14 bp, Homo sapiens
acccttttccccct

SEQ ID NO: 6613027 - DNA, 16 bp, Homo sapiens
acccttttcccccttc

SEQ ID NO: 6613028 - DNA, 19 bp, Homo sapiens
acccttttcccccttccca

SEQ ID NO: 6613029 - DNA, 19 bp, Homo sapiens
acccttttcctccagacag

SEQ ID NO: 6613030 - DNA, 12 bp, Homo sapiens
acccttttcctt

SEQ ID NO: 6613031 - DNA, 23 bp, Homo sapiens
acccttttctgggtttgaagctg

SEQ ID NO: 6613032 - DNA, 14 bp, Homo sapiens
acccttttggcccc

SEQ ID NO: 6613033 - DNA, 19 bp, Homo sapiens
acccttttgggtttctgcc

SEQ ID NO: 6613034 - DNA, 15 bp, Homo sapiens
accctttttcattta

SEQ ID NO: 6613035 - DNA, 19 bp, Homo sapiens
accctttttcatttaactt

SEQ ID NO: 6613036 - DNA, 20 bp, Homo sapiens
accctttttggactagccag

SEQ ID NO: 6613037 - DNA, 16 bp, Homo sapiens
acccttttttctaagt

SEQ ID NO: 6613038 - DNA, 19 bp, Homo sapiens
accgaaaaactaaaaataa

SEQ ID NO: 6613039 - DNA, 17 bp, Homo sapiens
accgaaaacgtggctgc

SEQ ID NO: 6613040 - DNA, 21 bp, Homo sapiens
accgaaaacgtggctgcttca

SEQ ID NO: 6613041 - DNA, 15 bp, Homo sapiens
accgaaaatggacat

SEQ ID NO: 6613042 - DNA, 12 bp, Homo sapiens
accgaaacagcg

SEQ ID NO: 6613043 - DNA, 14 bp, Homo sapiens
accgaaatgaaaat

SEQ ID NO: 6613044 - DNA, 23 bp, Homo sapiens
accgaacatatcatttgtgaaga

SEQ ID NO: 6613045 - DNA, 15 bp, Homo sapiens
accgaacatgaccaa

SEQ ID NO: 6613046 - DNA, 16 bp, Homo sapiens
accgaacatgaccaaa

SEQ ID NO: 6613047 - DNA, 17 bp, Homo sapiens
accgaacatgaccaaaa

SEQ ID NO: 6613048 - DNA, 20 bp, Homo sapiens
accgaactcgggattacaga

SEQ ID NO: 6613049 - DNA, 23 bp, Homo sapiens
accgaactcgggattacagaaac

SEQ ID NO: 6613050 - DNA, 21 bp, Homo sapiens
accgaactgatgtaagtaaac

SEQ ID NO: 6613051 - DNA, 13 bp, Homo sapiens
accgaagagccct

SEQ ID NO: 6613052 - DNA, 20 bp, Homo sapiens
accgaagagccctgagctca

SEQ ID NO: 6613053 - DNA, 20 bp, Homo sapiens
accgaagggacggggcccgc

SEQ ID NO: 6613054 - DNA, 13 bp, Homo sapiens
accgaaggtgaca

SEQ ID NO: 6613055 - DNA, 20 bp, Homo sapiens
accgaagtggactggcccct

SEQ ID NO: 6613056 - DNA, 12 bp, Homo sapiens
accgaataaatg

SEQ ID NO: 6613057 - DNA, 17 bp, Homo sapiens
accgaattttattttac

SEQ ID NO: 6613058 - DNA, 15 bp, Homo sapiens
accgacaaaattcca

SEQ ID NO: 6613059 - DNA, 16 bp, Homo sapiens
accgacaaaattccag

SEQ ID NO: 6613060 - DNA, 12 bp, Homo sapiens
accgaccaactc

SEQ ID NO: 6613061 - DNA, 15 bp, Homo sapiens
accgaccaactccag

SEQ ID NO: 6613062 - DNA, 16 bp, Homo sapiens
accgaccaactgccct

SEQ ID NO: 6613063 - DNA, 17 bp, Homo sapiens
accgaccaactgcccta

SEQ ID NO: 6613064 - DNA, 19 bp, Homo sapiens
accgaccatcgtccagccc

SEQ ID NO: 6613065 - DNA, 22 bp, Homo sapiens
accgaccatcgtccagccctcc

SEQ ID NO: 6613066 - DNA, 15 bp, Homo sapiens
accgaccccgggccg

SEQ ID NO: 6613067 - DNA, 13 bp, Homo sapiens
accgacgatccct

SEQ ID NO: 6613068 - DNA, 15 bp, Homo sapiens
accgacgcccctccg

SEQ ID NO: 6613069 - DNA, 21 bp, Homo sapiens
accgacgcccctccgggcaga

SEQ ID NO: 6613070 - DNA, 17 bp, Homo sapiens
accgacgcgtctcctgt

SEQ ID NO: 6613071 - DNA, 18 bp, Homo sapiens
accgacgttgccatcaaa

SEQ ID NO: 6613072 - DNA, 20 bp, Homo sapiens
accgactaccccagtcccag

SEQ ID NO: 6613073 - DNA, 15 bp, Homo sapiens
accgactagacacac

SEQ ID NO: 6613074 - DNA, 15 bp, Homo sapiens
accgactcacctgcg

SEQ ID NO: 6613075 - DNA, 13 bp, Homo sapiens
accgactgcccag

SEQ ID NO: 6613076 - DNA, 20 bp, Homo sapiens
accgacttcaatttcccacc

SEQ ID NO: 6613077 - DNA, 21 bp, Homo sapiens
accgacttcaatttcccaccc

SEQ ID NO: 6613078 - DNA, 14 bp, Homo sapiens
accgagaaaaggag

SEQ ID NO: 6613079 - DNA, 21 bp, Homo sapiens
accgagacggctggacctgca

SEQ ID NO: 6613080 - DNA, 14 bp, Homo sapiens
accgagactcagcc

SEQ ID NO: 6613081 - DNA, 15 bp, Homo sapiens
accgagactcagcct

SEQ ID NO: 6613082 - DNA, 17 bp, Homo sapiens
accgagactcagcctct

SEQ ID NO: 6613083 - DNA, 22 bp, Homo sapiens
accgagagcttggactacacaa

SEQ ID NO: 6613084 - DNA, 17 bp, Homo sapiens
accgagataggggaggg

SEQ ID NO: 6613085 - DNA, 18 bp, Homo sapiens
accgagataggggagggg

SEQ ID NO: 6613086 - DNA, 11 bp, Homo sapiens
accgagccagc

SEQ ID NO: 6613087 - DNA, 18 bp, Homo sapiens
accgagcccagcagatct

SEQ ID NO: 6613088 - DNA, 16 bp, Homo sapiens
accgagccctggagag

SEQ ID NO: 6613089 - DNA, 13 bp, Homo sapiens
accgagctggagc

SEQ ID NO: 6613090 - DNA, 23 bp, Homo sapiens
accgagctggagcggagaggaag

SEQ ID NO: 6613091 - DNA, 12 bp, Homo sapiens
accgaggacagc

SEQ ID NO: 6613092 - DNA, 17 bp, Homo sapiens
accgaggacagcctgcc

SEQ ID NO: 6613093 - DNA, 20 bp, Homo sapiens
accgaggacagcctgcctct

SEQ ID NO: 6613094 - DNA, 22 bp, Homo sapiens
accgaggacagcctgcctctgc

SEQ ID NO: 6613095 - DNA, 19 bp, Homo sapiens
accgaggactccaggggct

SEQ ID NO: 6613096 - DNA, 18 bp, Homo sapiens
accgaggagccccagccc

SEQ ID NO: 6613097 - DNA, 17 bp, Homo sapiens
accgaggagggagagtc

SEQ ID NO: 6613098 - DNA, 13 bp, Homo sapiens
accgaggcaggga

SEQ ID NO: 6613099 - DNA, 16 bp, Homo sapiens
accgaggccctcccaa

SEQ ID NO: 6613100 - DNA, 20 bp, Homo sapiens
accgaggcgatgccacgctt

SEQ ID NO: 6613101 - DNA, 17 bp, Homo sapiens
accgaggcgcgggggcc

SEQ ID NO: 6613102 - DNA, 17 bp, Homo sapiens
accgaggctacagctcc

SEQ ID NO: 6613103 - DNA, 17 bp, Homo sapiens
accgaggctggagctgg

SEQ ID NO: 6613104 - DNA, 19 bp, Homo sapiens
accgaggggctcaggaaaa

SEQ ID NO: 6613105 - DNA, 19 bp, Homo sapiens
accgagggggctgctccca

SEQ ID NO: 6613106 - DNA, 18 bp, Homo sapiens
accgagtagaaaatgtga

SEQ ID NO: 6613107 - DNA, 20 bp, Homo sapiens
accgagtagaaaatgtgacc

SEQ ID NO: 6613108 - DNA, 17 bp, Homo sapiens
accgagtctctgtataa

SEQ ID NO: 6613109 - DNA, 20 bp, Homo sapiens
accgagtctcttctccactg

SEQ ID NO: 6613110 - DNA, 14 bp, Homo sapiens
accgagtgaaccta

SEQ ID NO: 6613111 - DNA, 19 bp, Homo sapiens
accgagtgtggagctgctt

SEQ ID NO: 6613112 - DNA, 23 bp, Homo sapiens
accgagtgtggagctgcttccag

SEQ ID NO: 6613113 - DNA, 20 bp, Homo sapiens
accgataatgcatgaagcaa

SEQ ID NO: 6613114 - DNA, 16 bp, Homo sapiens
accgatggggaaaaaa

SEQ ID NO: 6613115 - DNA, 21 bp, Homo sapiens
accgatggtcccaggaagcag

SEQ ID NO: 6613116 - DNA, 22 bp, Homo sapiens
accgatggtgggtggggctgca

SEQ ID NO: 6613117 - DNA, 18 bp, Homo sapiens
accgatgtacacacacag

SEQ ID NO: 6613118 - DNA, 18 bp, Homo sapiens
accgatgtgtctcccaga

SEQ ID NO: 6613119 - DNA, 18 bp, Homo sapiens
accgattatgctttcttt

SEQ ID NO: 6613120 - DNA, 22 bp, Homo sapiens
accgattcatctctcagaaggg

SEQ ID NO: 6613121 - DNA, 16 bp, Homo sapiens
accgattcttccttgc

SEQ ID NO: 6613122 - DNA, 24 bp, Homo sapiens
accgattctttggagttgtcacat

SEQ ID NO: 6613123 - DNA, 18 bp, Homo sapiens
accgcacagctcaggagg

SEQ ID NO: 6613124 - DNA, 17 bp, Homo sapiens
accgcacatgcacacac

SEQ ID NO: 6613125 - DNA, 18 bp, Homo sapiens
accgcaccgggctggcct

SEQ ID NO: 6613126 - DNA, 23 bp, Homo sapiens
accgcagaagcctccccagctca

SEQ ID NO: 6613127 - DNA, 15 bp, Homo sapiens
accgcagaaggaagg

SEQ ID NO: 6613128 - DNA, 20 bp, Homo sapiens
accgcagacaggaccaggga

SEQ ID NO: 6613129 - DNA, 13 bp, Homo sapiens
accgcagcatgtg

SEQ ID NO: 6613130 - DNA, 14 bp, Homo sapiens
accgcagcatgtgg

SEQ ID NO: 6613131 - DNA, 15 bp, Homo sapiens
accgcagcgtccccc

SEQ ID NO: 6613132 - DNA, 12 bp, Homo sapiens
accgcagctact

SEQ ID NO: 6613133 - DNA, 23 bp, Homo sapiens
accgcagctactcccctttcttc

SEQ ID NO: 6613134 - DNA, 12 bp, Homo sapiens
accgcagctgct

SEQ ID NO: 6613135 - DNA, 13 bp, Homo sapiens
accgcagctgctg

SEQ ID NO: 6613136 - DNA, 16 bp, Homo sapiens
accgcaggaagctgct

SEQ ID NO: 6613137 - DNA, 13 bp, Homo sapiens
accgcaggcccgg

SEQ ID NO: 6613138 - DNA, 16 bp, Homo sapiens
accgcaggcccggact

SEQ ID NO: 6613139 - DNA, 20 bp, Homo sapiens
accgcaggggactgtctcag

SEQ ID NO: 6613140 - DNA, 22 bp, Homo sapiens
accgcaggtgctcatgctgctc

SEQ ID NO: 6613141 - DNA, 23 bp, Homo sapiens
accgcagtcgtcgcacagtctct

SEQ ID NO: 6613142 - DNA, 14 bp, Homo sapiens
accgcatatgcatg

SEQ ID NO: 6613143 - DNA, 16 bp, Homo sapiens
accgcatatgcatgcc

SEQ ID NO: 6613144 - DNA, 17 bp, Homo sapiens
accgcatatgcatgcca

SEQ ID NO: 6613145 - DNA, 19 bp, Homo sapiens
accgcatatgcatgccagg

SEQ ID NO: 6613146 - DNA, 21 bp, Homo sapiens
accgcatatgcatgccaggct

SEQ ID NO: 6613147 - DNA, 15 bp, Homo sapiens
accgcatcctccagg

SEQ ID NO: 6613148 - DNA, 14 bp, Homo sapiens
accgcatgccccct

SEQ ID NO: 6613149 - DNA, 15 bp, Homo sapiens
accgcatggcagctg

SEQ ID NO: 6613150 - DNA, 21 bp, Homo sapiens
accgccacacacacaggagca

SEQ ID NO: 6613151 - DNA, 12 bp, Homo sapiens
accgccacccca

SEQ ID NO: 6613152 - DNA, 13 bp, Homo sapiens
accgccaccccac

SEQ ID NO: 6613153 - DNA, 15 bp, Homo sapiens
accgccaccccactg

SEQ ID NO: 6613154 - DNA, 19 bp, Homo sapiens
accgccacgggtttccctc

SEQ ID NO: 6613155 - DNA, 16 bp, Homo sapiens
accgccacgtcccagc

SEQ ID NO: 6613156 - DNA, 17 bp, Homo sapiens
accgccacgtcccagca

SEQ ID NO: 6613157 - DNA, 16 bp, Homo sapiens
accgccagaggacaag

SEQ ID NO: 6613158 - DNA, 18 bp, Homo sapiens
accgccagaggacaagga

SEQ ID NO: 6613159 - DNA, 19 bp, Homo sapiens
accgccagagtgtcctgct

SEQ ID NO: 6613160 - DNA, 20 bp, Homo sapiens
accgccagatggggcctctg

SEQ ID NO: 6613161 - DNA, 14 bp, Homo sapiens
accgccagctctgt

SEQ ID NO: 6613162 - DNA, 14 bp, Homo sapiens
accgccatcctctg

SEQ ID NO: 6613163 - DNA, 20 bp, Homo sapiens
accgcccaacccccacctcc

SEQ ID NO: 6613164 - DNA, 20 bp, Homo sapiens
accgcccacccagcagcgcc

SEQ ID NO: 6613165 - DNA, 23 bp, Homo sapiens
accgcccactctccacctcacta

SEQ ID NO: 6613166 - DNA, 13 bp, Homo sapiens
accgcccagctca

SEQ ID NO: 6613167 - DNA, 14 bp, Homo sapiens
accgcccagctctc

SEQ ID NO: 6613168 - DNA, 17 bp, Homo sapiens
accgcccagctctccca

SEQ ID NO: 6613169 - DNA, 19 bp, Homo sapiens
accgcccagctctcccaca

SEQ ID NO: 6613170 - DNA, 14 bp, Homo sapiens
accgccccaaccct

SEQ ID NO: 6613171 - DNA, 16 bp, Homo sapiens
accgccccaaccctcg

SEQ ID NO: 6613172 - DNA, 20 bp, Homo sapiens
accgccccaaccctcggagc

SEQ ID NO: 6613173 - DNA, 14 bp, Homo sapiens
accgccccagggct

SEQ ID NO: 6613174 - DNA, 13 bp, Homo sapiens
accgcccccaccc

SEQ ID NO: 6613175 - DNA, 21 bp, Homo sapiens
accgcccccaccccttcccca

SEQ ID NO: 6613176 - DNA, 14 bp, Homo sapiens
accgccccctcctc

SEQ ID NO: 6613177 - DNA, 19 bp, Homo sapiens
accgccccctcctctagct

SEQ ID NO: 6613178 - DNA, 19 bp, Homo sapiens
accgccccctgtctctcag

SEQ ID NO: 6613179 - DNA, 19 bp, Homo sapiens
accgcccctggacaggctt

SEQ ID NO: 6613180 - DNA, 16 bp, Homo sapiens
accgcccgcctctgtc

SEQ ID NO: 6613181 - DNA, 21 bp, Homo sapiens
accgcccggcagccccttctg

SEQ ID NO: 6613182 - DNA, 11 bp, Homo sapiens
accgcccgtct

SEQ ID NO: 6613183 - DNA, 13 bp, Homo sapiens
accgcccgtctgt

SEQ ID NO: 6613184 - DNA, 21 bp, Homo sapiens
accgccctccgtcgggcccct

SEQ ID NO: 6613185 - DNA, 13 bp, Homo sapiens
accgccctcctga

SEQ ID NO: 6613186 - DNA, 21 bp, Homo sapiens
accgccctgcgggccacaggg

SEQ ID NO: 6613187 - DNA, 16 bp, Homo sapiens
accgccctgggctgga

SEQ ID NO: 6613188 - DNA, 17 bp, Homo sapiens
accgccctgggctggac

SEQ ID NO: 6613189 - DNA, 15 bp, Homo sapiens
accgccgatcccagg

SEQ ID NO: 6613190 - DNA, 21 bp, Homo sapiens
accgccgcagaagcagcccct

SEQ ID NO: 6613191 - DNA, 17 bp, Homo sapiens
accgccgccaccagccc

SEQ ID NO: 6613192 - DNA, 18 bp, Homo sapiens
accgccgccccctgcccc

SEQ ID NO: 6613193 - DNA, 18 bp, Homo sapiens
accgccggccagctggga

SEQ ID NO: 6613194 - DNA, 19 bp, Homo sapiens
accgccggctttcagggca

SEQ ID NO: 6613195 - DNA, 21 bp, Homo sapiens
accgccggctttcagggcagc

SEQ ID NO: 6613196 - DNA, 12 bp, Homo sapiens
accgccggggtc

SEQ ID NO: 6613197 - DNA, 19 bp, Homo sapiens
accgcctagtttactgttt

SEQ ID NO: 6613198 - DNA, 16 bp, Homo sapiens
accgcctcctgctctg

SEQ ID NO: 6613199 - DNA, 22 bp, Homo sapiens
accgcctcgtgccagcagcctc

SEQ ID NO: 6613200 - DNA, 12 bp, Homo sapiens
accgcctctggc

SEQ ID NO: 6613201 - DNA, 13 bp, Homo sapiens
accgcctctggcc

SEQ ID NO: 6613202 - DNA, 19 bp, Homo sapiens
accgcctgaaggcacagct

SEQ ID NO: 6613203 - DNA, 20 bp, Homo sapiens
accgcctgaaggcacagcta

SEQ ID NO: 6613204 - DNA, 23 bp, Homo sapiens
accgcctgccctcccgcaccttc

SEQ ID NO: 6613205 - DNA, 19 bp, Homo sapiens
accgcctgccctgcctggg

SEQ ID NO: 6613206 - DNA, 18 bp, Homo sapiens
accgcctgctacacaggc

SEQ ID NO: 6613207 - DNA, 22 bp, Homo sapiens
accgcctgctacacaggcagga

SEQ ID NO: 6613208 - DNA, 22 bp, Homo sapiens
accgcctggccctccctcccta

SEQ ID NO: 6613209 - DNA, 16 bp, Homo sapiens
accgcgactaatttca

SEQ ID NO: 6613210 - DNA, 20 bp, Homo sapiens
accgcgagactgagaggcag

SEQ ID NO: 6613211 - DNA, 19 bp, Homo sapiens
accgcgcatctcttcctga

SEQ ID NO: 6613212 - DNA, 13 bp, Homo sapiens
accgcgcccctct

SEQ ID NO: 6613213 - DNA, 14 bp, Homo sapiens
accgcgcccctctg

SEQ ID NO: 6613214 - DNA, 20 bp, Homo sapiens
accgcgcccctctgcgcccc

SEQ ID NO: 6613215 - DNA, 15 bp, Homo sapiens
accgcgcccctggga

SEQ ID NO: 6613216 - DNA, 16 bp, Homo sapiens
accgcgcccctgggac

SEQ ID NO: 6613217 - DNA, 18 bp, Homo sapiens
accgcgccctcctgccca

SEQ ID NO: 6613218 - DNA, 21 bp, Homo sapiens
accgcggaggaggctggtgac

SEQ ID NO: 6613219 - DNA, 16 bp, Homo sapiens
accgcgtaatgcgcca

SEQ ID NO: 6613220 - DNA, 19 bp, Homo sapiens
accgcgtagagagccgggc

SEQ ID NO: 6613221 - DNA, 17 bp, Homo sapiens
accgcgtcccagctccc

SEQ ID NO: 6613222 - DNA, 18 bp, Homo sapiens
accgcgtcccagctcccc

SEQ ID NO: 6613223 - DNA, 19 bp, Homo sapiens
accgcgtcccagctcccct

SEQ ID NO: 6613224 - DNA, 20 bp, Homo sapiens
accgcgtcccagctcccctc

SEQ ID NO: 6613225 - DNA, 21 bp, Homo sapiens
accgcgtcccagctcccctct

SEQ ID NO: 6613226 - DNA, 19 bp, Homo sapiens
accgcgtctaccctgggat

SEQ ID NO: 6613227 - DNA, 15 bp, Homo sapiens
accgcgtctggtgac

SEQ ID NO: 6613228 - DNA, 15 bp, Homo sapiens
accgcgttgtaaaat

SEQ ID NO: 6613229 - DNA, 23 bp, Homo sapiens
accgctacaagagggcaaagctg

SEQ ID NO: 6613230 - DNA, 14 bp, Homo sapiens
accgctacaccact

SEQ ID NO: 6613231 - DNA, 19 bp, Homo sapiens
accgctacaccactctggc

SEQ ID NO: 6613232 - DNA, 20 bp, Homo sapiens
accgctacaccactctggca

SEQ ID NO: 6613233 - DNA, 24 bp, Homo sapiens
accgctatttctccttggatggca

SEQ ID NO: 6613234 - DNA, 15 bp, Homo sapiens
accgctcacctagag

SEQ ID NO: 6613235 - DNA, 18 bp, Homo sapiens
accgctcacctagagcca

SEQ ID NO: 6613236 - DNA, 19 bp, Homo sapiens
accgctcacctagagccag

SEQ ID NO: 6613237 - DNA, 14 bp, Homo sapiens
accgctcagtatta

SEQ ID NO: 6613238 - DNA, 12 bp, Homo sapiens
accgctccaggt

SEQ ID NO: 6613239 - DNA, 14 bp, Homo sapiens
accgctccccagcc

SEQ ID NO: 6613240 - DNA, 20 bp, Homo sapiens
accgctccccagcccagggt

SEQ ID NO: 6613241 - DNA, 19 bp, Homo sapiens
accgctcccctctcctccg

SEQ ID NO: 6613242 - DNA, 20 bp, Homo sapiens
accgctcccctctcctccgc

SEQ ID NO: 6613243 - DNA, 20 bp, Homo sapiens
accgctgcctaagtggctgc

SEQ ID NO: 6613244 - DNA, 17 bp, Homo sapiens
accgctgcctcgtagag

SEQ ID NO: 6613245 - DNA, 13 bp, Homo sapiens
accgctgggtggt

SEQ ID NO: 6613246 - DNA, 20 bp, Homo sapiens
accgctgggttctgactctg

SEQ ID NO: 6613247 - DNA, 20 bp, Homo sapiens
accgctggtccctgccctcc

SEQ ID NO: 6613248 - DNA, 16 bp, Homo sapiens
accgcttcacccctgc

SEQ ID NO: 6613249 - DNA, 20 bp, Homo sapiens
accgcttcacccctgcactt

SEQ ID NO: 6613250 - DNA, 20 bp, Homo sapiens
accgcttccccgatgtgagc

SEQ ID NO: 6613251 - DNA, 19 bp, Homo sapiens
accgcttccctcctgcccg

SEQ ID NO: 6613252 - DNA, 14 bp, Homo sapiens
accgcttctggggc

SEQ ID NO: 6613253 - DNA, 17 bp, Homo sapiens
accgctttggcctgagt

SEQ ID NO: 6613254 - DNA, 14 bp, Homo sapiens
accgcttttggttt

SEQ ID NO: 6613255 - DNA, 15 bp, Homo sapiens
accggaaggaggcca

SEQ ID NO: 6613256 - DNA, 15 bp, Homo sapiens
accggaaggttttta

SEQ ID NO: 6613257 - DNA, 24 bp, Homo sapiens
accggacgctggagaccctgcgcc

SEQ ID NO: 6613258 - DNA, 19 bp, Homo sapiens
accggacttgtcacacgga

SEQ ID NO: 6613259 - DNA, 15 bp, Homo sapiens
accggagcggctgag

SEQ ID NO: 6613260 - DNA, 17 bp, Homo sapiens
accggagcggctgagga

SEQ ID NO: 6613261 - DNA, 20 bp, Homo sapiens
accggaggcaaaaggcagtg

SEQ ID NO: 6613262 - DNA, 24 bp, Homo sapiens
accggagtgtctggaattgtggct

SEQ ID NO: 6613263 - DNA, 14 bp, Homo sapiens
accggatcctgggt

SEQ ID NO: 6613264 - DNA, 16 bp, Homo sapiens
accggatcctgggtgg

SEQ ID NO: 6613265 - DNA, 15 bp, Homo sapiens
accggcaacctgtaa

SEQ ID NO: 6613266 - DNA, 18 bp, Homo sapiens
accggcaacctgtaactg

SEQ ID NO: 6613267 - DNA, 17 bp, Homo sapiens
accggcaatttccggcc

SEQ ID NO: 6613268 - DNA, 12 bp, Homo sapiens
accggcactcat

SEQ ID NO: 6613269 - DNA, 14 bp, Homo sapiens
accggcactgtgca

SEQ ID NO: 6613270 - DNA, 12 bp, Homo sapiens
accggcaggtgc

SEQ ID NO: 6613271 - DNA, 14 bp, Homo sapiens
accggcatgctggc

SEQ ID NO: 6613272 - DNA, 19 bp, Homo sapiens
accggcatgctggcctgtg

SEQ ID NO: 6613273 - DNA, 13 bp, Homo sapiens
accggccaggccg

SEQ ID NO: 6613274 - DNA, 21 bp, Homo sapiens
accggccaggccgcgcccagc

SEQ ID NO: 6613275 - DNA, 14 bp, Homo sapiens
accggcccctggca

SEQ ID NO: 6613276 - DNA, 12 bp, Homo sapiens
accggccctgcc

SEQ ID NO: 6613277 - DNA, 13 bp, Homo sapiens
accggcctgccag

SEQ ID NO: 6613278 - DNA, 15 bp, Homo sapiens
accggcctgccagga

SEQ ID NO: 6613279 - DNA, 18 bp, Homo sapiens
accggcctgtgggtctct

SEQ ID NO: 6613280 - DNA, 19 bp, Homo sapiens
accggcctgtgggtctctg

SEQ ID NO: 6613281 - DNA, 20 bp, Homo sapiens
accggcctgtgggtctctga

SEQ ID NO: 6613282 - DNA, 15 bp, Homo sapiens
accggcgctgcaggt

SEQ ID NO: 6613283 - DNA, 14 bp, Homo sapiens
accggctctcacct

SEQ ID NO: 6613284 - DNA, 20 bp, Homo sapiens
accggctgcttttccctaag

SEQ ID NO: 6613285 - DNA, 18 bp, Homo sapiens
accggctggcctggcccc

SEQ ID NO: 6613286 - DNA, 21 bp, Homo sapiens
accgggaaaggcatctaagac

SEQ ID NO: 6613287 - DNA, 14 bp, Homo sapiens
accgggacagacct

SEQ ID NO: 6613288 - DNA, 19 bp, Homo sapiens
accgggacagacctggaca

SEQ ID NO: 6613289 - DNA, 20 bp, Homo sapiens
accgggcactcagaagacac

SEQ ID NO: 6613290 - DNA, 15 bp, Homo sapiens
accgggcactcccgg

SEQ ID NO: 6613291 - DNA, 18 bp, Homo sapiens
accgggcatgtctgcctg

SEQ ID NO: 6613292 - DNA, 19 bp, Homo sapiens
accgggccaagtgaagaat

SEQ ID NO: 6613293 - DNA, 19 bp, Homo sapiens
accgggccactccttcctg

SEQ ID NO: 6613294 - DNA, 19 bp, Homo sapiens
accgggcctcccctccatg

SEQ ID NO: 6613295 - DNA, 13 bp, Homo sapiens
accgggctggggt

SEQ ID NO: 6613296 - DNA, 18 bp, Homo sapiens
accggggaccgggacccg

SEQ ID NO: 6613297 - DNA, 18 bp, Homo sapiens
accggggcaagagggaag

SEQ ID NO: 6613298 - DNA, 14 bp, Homo sapiens
accggggcactggc

SEQ ID NO: 6613299 - DNA, 13 bp, Homo sapiens
accggggcctggg

SEQ ID NO: 6613300 - DNA, 15 bp, Homo sapiens
accggggctcctctc

SEQ ID NO: 6613301 - DNA, 15 bp, Homo sapiens
accgggggctgctgg

SEQ ID NO: 6613302 - DNA, 16 bp, Homo sapiens
accgggggctgctggg

SEQ ID NO: 6613303 - DNA, 23 bp, Homo sapiens
accggggtcctgaggctggggct

SEQ ID NO: 6613304 - DNA, 14 bp, Homo sapiens
accgggtctgcttc

SEQ ID NO: 6613305 - DNA, 14 bp, Homo sapiens
accgggtgggcctg

SEQ ID NO: 6613306 - DNA, 15 bp, Homo sapiens
accgggtgggcctgg

SEQ ID NO: 6613307 - DNA, 16 bp, Homo sapiens
accgggtgggcctggc

SEQ ID NO: 6613308 - DNA, 23 bp, Homo sapiens
accgggtgggcctggcctgagct

SEQ ID NO: 6613309 - DNA, 15 bp, Homo sapiens
accggtcaccgagac

SEQ ID NO: 6613310 - DNA, 13 bp, Homo sapiens
accggtcagtgcc

SEQ ID NO: 6613311 - DNA, 15 bp, Homo sapiens
accggtcagtgcctt

SEQ ID NO: 6613312 - DNA, 15 bp, Homo sapiens
accggtccagctggc

SEQ ID NO: 6613313 - DNA, 16 bp, Homo sapiens
accggtccagctggcc

SEQ ID NO: 6613314 - DNA, 12 bp, Homo sapiens
accggtgccaaa

SEQ ID NO: 6613315 - DNA, 20 bp, Homo sapiens
accggtgccaaacccagccc

SEQ ID NO: 6613316 - DNA, 19 bp, Homo sapiens
accggtgcctcctctgggg

SEQ ID NO: 6613317 - DNA, 15 bp, Homo sapiens
accggtgcttttatt

SEQ ID NO: 6613318 - DNA, 14 bp, Homo sapiens
accggtggggctgg

SEQ ID NO: 6613319 - DNA, 12 bp, Homo sapiens
accgtaatttta

SEQ ID NO: 6613320 - DNA, 18 bp, Homo sapiens
accgtactccctgcaccg

SEQ ID NO: 6613321 - DNA, 19 bp, Homo sapiens
accgtactctcacatgtgg

SEQ ID NO: 6613322 - DNA, 17 bp, Homo sapiens
accgtagcgtatacatt

SEQ ID NO: 6613323 - DNA, 17 bp, Homo sapiens
accgtattagccaggat

SEQ ID NO: 6613324 - DNA, 12 bp, Homo sapiens
accgtcaatgtg

SEQ ID NO: 6613325 - DNA, 23 bp, Homo sapiens
accgtcatggcttaatgtttatt

SEQ ID NO: 6613326 - DNA, 14 bp, Homo sapiens
accgtcccagggct

SEQ ID NO: 6613327 - DNA, 22 bp, Homo sapiens
accgtcccagggctctgcaggc

SEQ ID NO: 6613328 - DNA, 19 bp, Homo sapiens
accgtccccggcccctgcc

SEQ ID NO: 6613329 - DNA, 18 bp, Homo sapiens
accgtcccctcccaggga

SEQ ID NO: 6613330 - DNA, 18 bp, Homo sapiens
accgtcccctccttccct

SEQ ID NO: 6613331 - DNA, 14 bp, Homo sapiens
accgtccctcagtg

SEQ ID NO: 6613332 - DNA, 15 bp, Homo sapiens
accgtccctctcccc

SEQ ID NO: 6613333 - DNA, 18 bp, Homo sapiens
accgtccctctccccgga

SEQ ID NO: 6613334 - DNA, 11 bp, Homo sapiens
accgtccctga

SEQ ID NO: 6613335 - DNA, 13 bp, Homo sapiens
accgtcctcaccc

SEQ ID NO: 6613336 - DNA, 20 bp, Homo sapiens
accgtcctgtcagctccttg

SEQ ID NO: 6613337 - DNA, 19 bp, Homo sapiens
accgtcctttcacacatct

SEQ ID NO: 6613338 - DNA, 17 bp, Homo sapiens
accgtctcactgtgtgt

SEQ ID NO: 6613339 - DNA, 16 bp, Homo sapiens
accgtctcggccctga

SEQ ID NO: 6613340 - DNA, 17 bp, Homo sapiens
accgtctcggccctgaa

SEQ ID NO: 6613341 - DNA, 18 bp, Homo sapiens
accgtctcggccctgaac

SEQ ID NO: 6613342 - DNA, 14 bp, Homo sapiens
accgtgaagatact

SEQ ID NO: 6613343 - DNA, 20 bp, Homo sapiens
accgtgaagatactttgtat

SEQ ID NO: 6613344 - DNA, 21 bp, Homo sapiens
accgtgagcaggaaggcctgg

SEQ ID NO: 6613345 - DNA, 22 bp, Homo sapiens
accgtgagcaggaaggcctggg

SEQ ID NO: 6613346 - DNA, 18 bp, Homo sapiens
accgtgagcgacaaagat

SEQ ID NO: 6613347 - DNA, 14 bp, Homo sapiens
accgtgaggccaga

SEQ ID NO: 6613348 - DNA, 23 bp, Homo sapiens
accgtgaggccagagacacaagc

SEQ ID NO: 6613349 - DNA, 19 bp, Homo sapiens
accgtgccccacctcccca

SEQ ID NO: 6613350 - DNA, 23 bp, Homo sapiens
accgtgccccacctccccacaca

SEQ ID NO: 6613351 - DNA, 11 bp, Homo sapiens
accgtgcctgg

SEQ ID NO: 6613352 - DNA, 15 bp, Homo sapiens
accgtgcgagctgcc

SEQ ID NO: 6613353 - DNA, 19 bp, Homo sapiens
accgtgctgggctccccct

SEQ ID NO: 6613354 - DNA, 18 bp, Homo sapiens
accgtggacaggcccagc

SEQ ID NO: 6613355 - DNA, 13 bp, Homo sapiens
accgtggactctt

SEQ ID NO: 6613356 - DNA, 18 bp, Homo sapiens
accgtggaggaggaaggc

SEQ ID NO: 6613357 - DNA, 22 bp, Homo sapiens
accgtggaggaggaaggcaaga

SEQ ID NO: 6613358 - DNA, 14 bp, Homo sapiens
accgtggatctcct

SEQ ID NO: 6613359 - DNA, 15 bp, Homo sapiens
accgtggatttgtac

SEQ ID NO: 6613360 - DNA, 22 bp, Homo sapiens
accgtggcccttcctggacagc

SEQ ID NO: 6613361 - DNA, 13 bp, Homo sapiens
accgtggcctggg

SEQ ID NO: 6613362 - DNA, 12 bp, Homo sapiens
accgtggctacc

SEQ ID NO: 6613363 - DNA, 18 bp, Homo sapiens
accgtgggcagtgccacc

SEQ ID NO: 6613364 - DNA, 21 bp, Homo sapiens
accgtgggggaactgacgctg

SEQ ID NO: 6613365 - DNA, 20 bp, Homo sapiens
accgtggtgtgaggcccccg

SEQ ID NO: 6613366 - DNA, 13 bp, Homo sapiens
accgtgtacaata

SEQ ID NO: 6613367 - DNA, 19 bp, Homo sapiens
accgtgtcaagctgctctg

SEQ ID NO: 6613368 - DNA, 23 bp, Homo sapiens
accgtgtccagcacagaaggaat

SEQ ID NO: 6613369 - DNA, 19 bp, Homo sapiens
accgtgtcccaaggagctg

SEQ ID NO: 6613370 - DNA, 17 bp, Homo sapiens
accgtgtcctcctctga

SEQ ID NO: 6613371 - DNA, 22 bp, Homo sapiens
accgtgtcctcctctgaggaag

SEQ ID NO: 6613372 - DNA, 16 bp, Homo sapiens
accgtgtgtcatgtca

SEQ ID NO: 6613373 - DNA, 23 bp, Homo sapiens
accgtgtgtccagcattgaagag

SEQ ID NO: 6613374 - DNA, 14 bp, Homo sapiens
accgtgttagccag

SEQ ID NO: 6613375 - DNA, 16 bp, Homo sapiens
accgtgttagccagga

SEQ ID NO: 6613376 - DNA, 16 bp, Homo sapiens
accgtgttggtctgta

SEQ ID NO: 6613377 - DNA, 21 bp, Homo sapiens
accgtgttggttttgactgga

SEQ ID NO: 6613378 - DNA, 20 bp, Homo sapiens
accgttaggattcaggcagc

SEQ ID NO: 6613379 - DNA, 16 bp, Homo sapiens
accgttcaagcgccag

SEQ ID NO: 6613380 - DNA, 15 bp, Homo sapiens
accgttcagtcattt

SEQ ID NO: 6613381 - DNA, 19 bp, Homo sapiens
accgttcagtgtcccaggc

SEQ ID NO: 6613382 - DNA, 16 bp, Homo sapiens
accgttggggccctta

SEQ ID NO: 6613383 - DNA, 13 bp, Homo sapiens
accgttgttgttt

SEQ ID NO: 6613384 - DNA, 13 bp, Homo sapiens
accgtttacagtg

SEQ ID NO: 6613385 - DNA, 19 bp, Homo sapiens
accgtttacagtgtattta

SEQ ID NO: 6613386 - DNA, 18 bp, Homo sapiens
accgttttcatcctggcc

SEQ ID NO: 6613387 - DNA, 19 bp, Homo sapiens
accgttttcatcctggcct

SEQ ID NO: 6613388 - DNA, 20 bp, Homo sapiens
accgttttcatcctggcctc

SEQ ID NO: 6613389 - DNA, 21 bp, Homo sapiens
accgttttcatcctggcctcc

SEQ ID NO: 6613390 - DNA, 14 bp, Homo sapiens
accgtttttcaaga

SEQ ID NO: 6613391 - DNA, 17 bp, Homo sapiens
acctaaaaaaagagaat

SEQ ID NO: 6613392 - DNA, 13 bp, Homo sapiens
acctaaaaatcaa

SEQ ID NO: 6613393 - DNA, 18 bp, Homo sapiens
acctaaaaatcaatcact

SEQ ID NO: 6613394 - DNA, 17 bp, Homo sapiens
acctaaaaattttgtga

SEQ ID NO: 6613395 - DNA, 22 bp, Homo sapiens
acctaaaaggaaatctcacccc

SEQ ID NO: 6613396 - DNA, 14 bp, Homo sapiens
acctaaaagtatta

SEQ ID NO: 6613397 - DNA, 21 bp, Homo sapiens
acctaaacagctgctttatga

SEQ ID NO: 6613398 - DNA, 18 bp, Homo sapiens
acctaaaccctctgtgaa

SEQ ID NO: 6613399 - DNA, 12 bp, Homo sapiens
acctaaacttac

SEQ ID NO: 6613400 - DNA, 17 bp, Homo sapiens
acctaaagaaaaacaaa

SEQ ID NO: 6613401 - DNA, 22 bp, Homo sapiens
acctaaagacgtctctttttgg

SEQ ID NO: 6613402 - DNA, 20 bp, Homo sapiens
acctaaagcattttttaaaa

SEQ ID NO: 6613403 - DNA, 21 bp, Homo sapiens
acctaaagcctaccctattct

SEQ ID NO: 6613404 - DNA, 22 bp, Homo sapiens
acctaaagtgcttgctttttgc

SEQ ID NO: 6613405 - DNA, 13 bp, Homo sapiens
acctaaataatta

SEQ ID NO: 6613406 - DNA, 17 bp, Homo sapiens
acctaaataattagaat

SEQ ID NO: 6613407 - DNA, 18 bp, Homo sapiens
acctaaatccattttcta

SEQ ID NO: 6613408 - DNA, 13 bp, Homo sapiens
acctaaatgaata

SEQ ID NO: 6613409 - DNA, 16 bp, Homo sapiens
acctaaatgacctcag

SEQ ID NO: 6613410 - DNA, 15 bp, Homo sapiens
acctaaatggcctca

SEQ ID NO: 6613411 - DNA, 22 bp, Homo sapiens
acctaaatttttgtaagaaaat

SEQ ID NO: 6613412 - DNA, 21 bp, Homo sapiens
acctaacacattaaatgtgga

SEQ ID NO: 6613413 - DNA, 11 bp, Homo sapiens
acctaacattc

SEQ ID NO: 6613414 - DNA, 14 bp, Homo sapiens
acctaaccagggcc

SEQ ID NO: 6613415 - DNA, 19 bp, Homo sapiens
acctaaccccagggcactg

SEQ ID NO: 6613416 - DNA, 15 bp, Homo sapiens
acctaacccctttcc

SEQ ID NO: 6613417 - DNA, 15 bp, Homo sapiens
acctaaccctctgtc

SEQ ID NO: 6613418 - DNA, 16 bp, Homo sapiens
acctaaccctctgtca

SEQ ID NO: 6613419 - DNA, 17 bp, Homo sapiens
acctaacctgtgtctgc

SEQ ID NO: 6613420 - DNA, 19 bp, Homo sapiens
acctaactcatgccattcc

SEQ ID NO: 6613421 - DNA, 21 bp, Homo sapiens
acctaactccctaggcctgag

SEQ ID NO: 6613422 - DNA, 18 bp, Homo sapiens
acctaactcttctttcat

SEQ ID NO: 6613423 - DNA, 14 bp, Homo sapiens
acctaactgtgaac

SEQ ID NO: 6613424 - DNA, 15 bp, Homo sapiens
acctaacttatggac

SEQ ID NO: 6613425 - DNA, 21 bp, Homo sapiens
acctaagaatttcactgtctt

SEQ ID NO: 6613426 - DNA, 23 bp, Homo sapiens
acctaagcaatcactgggcccag

SEQ ID NO: 6613427 - DNA, 18 bp, Homo sapiens
acctaagcacttctagaa

SEQ ID NO: 6613428 - DNA, 16 bp, Homo sapiens
acctaagggacatgtt

SEQ ID NO: 6613429 - DNA, 19 bp, Homo sapiens
acctaagggctaaggcctc

SEQ ID NO: 6613430 - DNA, 15 bp, Homo sapiens
acctaagtactgtaa

SEQ ID NO: 6613431 - DNA, 17 bp, Homo sapiens
acctaagtacttaaaag

SEQ ID NO: 6613432 - DNA, 16 bp, Homo sapiens
acctaagtctctgtga

SEQ ID NO: 6613433 - DNA, 14 bp, Homo sapiens
acctaagtgactac

SEQ ID NO: 6613434 - DNA, 13 bp, Homo sapiens
acctaagtgttga

SEQ ID NO: 6613435 - DNA, 20 bp, Homo sapiens
acctaataagtgctactttg

SEQ ID NO: 6613436 - DNA, 18 bp, Homo sapiens
acctaataattgtatcta

SEQ ID NO: 6613437 - DNA, 17 bp, Homo sapiens
acctaatacccagttta

SEQ ID NO: 6613438 - DNA, 15 bp, Homo sapiens
acctaatatcactta

SEQ ID NO: 6613439 - DNA, 22 bp, Homo sapiens
acctaatatcattttattcaca

SEQ ID NO: 6613440 - DNA, 15 bp, Homo sapiens
acctaatcactaatt

SEQ ID NO: 6613441 - DNA, 15 bp, Homo sapiens
acctaatccaggcag

SEQ ID NO: 6613442 - DNA, 20 bp, Homo sapiens
acctaatccaggcagatcca

SEQ ID NO: 6613443 - DNA, 21 bp, Homo sapiens
acctaatgctggcctgactgg

SEQ ID NO: 6613444 - DNA, 21 bp, Homo sapiens
acctaatgtctcactgttctg

SEQ ID NO: 6613445 - DNA, 23 bp, Homo sapiens
acctaatgtctcactgttctgca

SEQ ID NO: 6613446 - DNA, 12 bp, Homo sapiens
acctaatgttta

SEQ ID NO: 6613447 - DNA, 19 bp, Homo sapiens
acctaatgtttatgagcca

SEQ ID NO: 6613448 - DNA, 19 bp, Homo sapiens
acctaattagagcagatga

SEQ ID NO: 6613449 - DNA, 15 bp, Homo sapiens
acctaattgaaattt

SEQ ID NO: 6613450 - DNA, 17 bp, Homo sapiens
acctaattgaaatttaa

SEQ ID NO: 6613451 - DNA, 23 bp, Homo sapiens
acctaattgcacaacagagactg

SEQ ID NO: 6613452 - DNA, 23 bp, Homo sapiens
acctacaaaagcttgtgtatctt

SEQ ID NO: 6613453 - DNA, 21 bp, Homo sapiens
acctacaaggagataagaaag

SEQ ID NO: 6613454 - DNA, 23 bp, Homo sapiens
acctacacactgtcatgcttcat

SEQ ID NO: 6613455 - DNA, 15 bp, Homo sapiens
acctacacaggagtc

SEQ ID NO: 6613456 - DNA, 13 bp, Homo sapiens
acctacagaatac

SEQ ID NO: 6613457 - DNA, 17 bp, Homo sapiens
acctacagacaaggagg

SEQ ID NO: 6613458 - DNA, 14 bp, Homo sapiens
acctacagacctgg

SEQ ID NO: 6613459 - DNA, 21 bp, Homo sapiens
acctacagactccatctcttc

SEQ ID NO: 6613460 - DNA, 17 bp, Homo sapiens
acctacagggggtctgg

SEQ ID NO: 6613461 - DNA, 22 bp, Homo sapiens
acctacagggggtctggctggt

SEQ ID NO: 6613462 - DNA, 17 bp, Homo sapiens
acctacagtggagggag

SEQ ID NO: 6613463 - DNA, 20 bp, Homo sapiens
acctacagtgtacagtcttg

SEQ ID NO: 6613464 - DNA, 18 bp, Homo sapiens
acctacagttttaactgt

SEQ ID NO: 6613465 - DNA, 23 bp, Homo sapiens
acctacatatgctgatcttttaa

SEQ ID NO: 6613466 - DNA, 20 bp, Homo sapiens
acctacatattccatgtttg

SEQ ID NO: 6613467 - DNA, 13 bp, Homo sapiens
acctacatatttg

SEQ ID NO: 6613468 - DNA, 14 bp, Homo sapiens
acctacatccccag

SEQ ID NO: 6613469 - DNA, 14 bp, Homo sapiens
acctacatgtattt

SEQ ID NO: 6613470 - DNA, 23 bp, Homo sapiens
acctacattccaccctgttactt

SEQ ID NO: 6613471 - DNA, 23 bp, Homo sapiens
acctacattccctctcctgccca

SEQ ID NO: 6613472 - DNA, 14 bp, Homo sapiens
acctaccaaaatgg

SEQ ID NO: 6613473 - DNA, 15 bp, Homo sapiens
acctaccacagtgtc

SEQ ID NO: 6613474 - DNA, 12 bp, Homo sapiens
acctaccacatg

SEQ ID NO: 6613475 - DNA, 20 bp, Homo sapiens
acctaccaccacgcccggct

SEQ ID NO: 6613476 - DNA, 19 bp, Homo sapiens
acctaccaccccttcctgt

SEQ ID NO: 6613477 - DNA, 15 bp, Homo sapiens
acctaccactacatt

SEQ ID NO: 6613478 - DNA, 20 bp, Homo sapiens
acctaccactcacatgacac

SEQ ID NO: 6613479 - DNA, 14 bp, Homo sapiens
acctaccaggacag

SEQ ID NO: 6613480 - DNA, 14 bp, Homo sapiens
acctaccatcaggg

SEQ ID NO: 6613481 - DNA, 15 bp, Homo sapiens
acctaccatgctgct

SEQ ID NO: 6613482 - DNA, 13 bp, Homo sapiens
acctacccagctg

SEQ ID NO: 6613483 - DNA, 14 bp, Homo sapiens
acctaccccagcca

SEQ ID NO: 6613484 - DNA, 22 bp, Homo sapiens
acctaccccagttcatctctgc

SEQ ID NO: 6613485 - DNA, 14 bp, Homo sapiens
acctaccctggacc

SEQ ID NO: 6613486 - DNA, 22 bp, Homo sapiens
acctaccctggaccgagtggac

SEQ ID NO: 6613487 - DNA, 13 bp, Homo sapiens
acctacctcaggt

SEQ ID NO: 6613488 - DNA, 14 bp, Homo sapiens
acctacctcaggtt

SEQ ID NO: 6613489 - DNA, 15 bp, Homo sapiens
acctacctcaggttg

SEQ ID NO: 6613490 - DNA, 12 bp, Homo sapiens
acctacctccct

SEQ ID NO: 6613491 - DNA, 15 bp, Homo sapiens
acctacctccctccc

SEQ ID NO: 6613492 - DNA, 20 bp, Homo sapiens
acctaccttatagagcacaa

SEQ ID NO: 6613493 - DNA, 21 bp, Homo sapiens
acctaccttatagagcacaat

SEQ ID NO: 6613494 - DNA, 15 bp, Homo sapiens
acctacgaccccaga

SEQ ID NO: 6613495 - DNA, 22 bp, Homo sapiens
acctacgagggaggaacacctg

SEQ ID NO: 6613496 - DNA, 20 bp, Homo sapiens
acctacgcacataccttcat

SEQ ID NO: 6613497 - DNA, 17 bp, Homo sapiens
acctacgtttgcaccgc

SEQ ID NO: 6613498 - DNA, 17 bp, Homo sapiens
acctactaaaaaagtta

SEQ ID NO: 6613499 - DNA, 18 bp, Homo sapiens
acctactatgtgctgggt

SEQ ID NO: 6613500 - DNA, 22 bp, Homo sapiens
acctactcctccccctcctcca

SEQ ID NO: 6613501 - DNA, 16 bp, Homo sapiens
acctactgactgatga

SEQ ID NO: 6613502 - DNA, 11 bp, Homo sapiens
acctactgagt

SEQ ID NO: 6613503 - DNA, 22 bp, Homo sapiens
acctactgcccacatttgggct

SEQ ID NO: 6613504 - DNA, 17 bp, Homo sapiens
acctactggtgtaatct

SEQ ID NO: 6613505 - DNA, 14 bp, Homo sapiens
acctactgtctaag

SEQ ID NO: 6613506 - DNA, 15 bp, Homo sapiens
acctactgtctaagc

SEQ ID NO: 6613507 - DNA, 17 bp, Homo sapiens
acctactgttcctttca

SEQ ID NO: 6613508 - DNA, 18 bp, Homo sapiens
acctactgttctaaagct

SEQ ID NO: 6613509 - DNA, 20 bp, Homo sapiens
acctacttgtgactgaaggg

SEQ ID NO: 6613510 - DNA, 13 bp, Homo sapiens
acctactttcttc

SEQ ID NO: 6613511 - DNA, 21 bp, Homo sapiens
acctactttgactttttgcat

SEQ ID NO: 6613512 - DNA, 12 bp, Homo sapiens
acctagaaaaca

SEQ ID NO: 6613513 - DNA, 22 bp, Homo sapiens
acctagaaacctttatccctgc

SEQ ID NO: 6613514 - DNA, 15 bp, Homo sapiens
acctagaaatctatc

SEQ ID NO: 6613515 - DNA, 21 bp, Homo sapiens
acctagaacctccctcctttc

SEQ ID NO: 6613516 - DNA, 22 bp, Homo sapiens
acctagaacgtgcatccttgta

SEQ ID NO: 6613517 - DNA, 15 bp, Homo sapiens
acctagaacttcaaa

SEQ ID NO: 6613518 - DNA, 14 bp, Homo sapiens
acctagaagggcta

SEQ ID NO: 6613519 - DNA, 20 bp, Homo sapiens
acctagaagtaagaagagga

SEQ ID NO: 6613520 - DNA, 15 bp, Homo sapiens
acctagaagtctccc

SEQ ID NO: 6613521 - DNA, 18 bp, Homo sapiens
acctagaagtctccctgc

SEQ ID NO: 6613522 - DNA, 22 bp, Homo sapiens
acctagaatagccatgtactat

SEQ ID NO: 6613523 - DNA, 15 bp, Homo sapiens
acctagaatgtcaga

SEQ ID NO: 6613524 - DNA, 14 bp, Homo sapiens
acctagacctgggc

SEQ ID NO: 6613525 - DNA, 15 bp, Homo sapiens
acctagacctgggcc

SEQ ID NO: 6613526 - DNA, 17 bp, Homo sapiens
acctagagaagataatt

SEQ ID NO: 6613527 - DNA, 20 bp, Homo sapiens
acctagagacttcacccggg

SEQ ID NO: 6613528 - DNA, 13 bp, Homo sapiens
acctagagccaga

SEQ ID NO: 6613529 - DNA, 21 bp, Homo sapiens
acctagatgtataactaggag

SEQ ID NO: 6613530 - DNA, 21 bp, Homo sapiens
acctagattatagtcttagta

SEQ ID NO: 6613531 - DNA, 13 bp, Homo sapiens
acctagatttaat

SEQ ID NO: 6613532 - DNA, 14 bp, Homo sapiens
acctagcaattcca

SEQ ID NO: 6613533 - DNA, 23 bp, Homo sapiens
acctagcacacctgaatcagctg

SEQ ID NO: 6613534 - DNA, 21 bp, Homo sapiens
acctagcagcaccgttctgtg

SEQ ID NO: 6613535 - DNA, 14 bp, Homo sapiens
acctagcaggctgt

SEQ ID NO: 6613536 - DNA, 12 bp, Homo sapiens
acctagcccagg

SEQ ID NO: 6613537 - DNA, 12 bp, Homo sapiens
acctagcctgga

SEQ ID NO: 6613538 - DNA, 17 bp, Homo sapiens
acctagcctggatggcc

SEQ ID NO: 6613539 - DNA, 23 bp, Homo sapiens
acctagcctggatggcccctcct

SEQ ID NO: 6613540 - DNA, 13 bp, Homo sapiens
acctagccttaga

SEQ ID NO: 6613541 - DNA, 18 bp, Homo sapiens
acctagctgaatgttttt

SEQ ID NO: 6613542 - DNA, 20 bp, Homo sapiens
acctagctgaatgtttttct

SEQ ID NO: 6613543 - DNA, 18 bp, Homo sapiens
acctagctggctctgtga

SEQ ID NO: 6613544 - DNA, 14 bp, Homo sapiens
acctagctgtgccc

SEQ ID NO: 6613545 - DNA, 20 bp, Homo sapiens
acctagcttttaaaaaatat

SEQ ID NO: 6613546 - DNA, 17 bp, Homo sapiens
acctaggagcagtgggc

SEQ ID NO: 6613547 - DNA, 12 bp, Homo sapiens
acctaggaggat

SEQ ID NO: 6613548 - DNA, 19 bp, Homo sapiens
acctaggcagtaggccggt

SEQ ID NO: 6613549 - DNA, 12 bp, Homo sapiens
acctaggcagtg

SEQ ID NO: 6613550 - DNA, 18 bp, Homo sapiens
acctaggcagtgggaggc

SEQ ID NO: 6613551 - DNA, 17 bp, Homo sapiens
acctaggccactcctcc

SEQ ID NO: 6613552 - DNA, 12 bp, Homo sapiens
acctaggctagg

SEQ ID NO: 6613553 - DNA, 22 bp, Homo sapiens
acctagggggacggggctgaca

SEQ ID NO: 6613554 - DNA, 15 bp, Homo sapiens
acctagggtctattt

SEQ ID NO: 6613555 - DNA, 20 bp, Homo sapiens
acctaggtcgccagtgaaat

SEQ ID NO: 6613556 - DNA, 20 bp, Homo sapiens
acctaggtggggcctggggt

SEQ ID NO: 6613557 - DNA, 18 bp, Homo sapiens
acctagtactctctgctc

SEQ ID NO: 6613558 - DNA, 16 bp, Homo sapiens
acctagtcgacactaa

SEQ ID NO: 6613559 - DNA, 19 bp, Homo sapiens
acctagtgaaacttttcta

SEQ ID NO: 6613560 - DNA, 16 bp, Homo sapiens
acctagtgccccagac

SEQ ID NO: 6613561 - DNA, 19 bp, Homo sapiens
acctagtggctgtccagtg

SEQ ID NO: 6613562 - DNA, 21 bp, Homo sapiens
acctagtggctgtccagtgcc

SEQ ID NO: 6613563 - DNA, 22 bp, Homo sapiens
acctagtggctgtccagtgccc

SEQ ID NO: 6613564 - DNA, 23 bp, Homo sapiens
acctagtggctgtccagtgccca

SEQ ID NO: 6613565 - DNA, 18 bp, Homo sapiens
acctagttaaagaaagga

SEQ ID NO: 6613566 - DNA, 23 bp, Homo sapiens
  misc_feature (6)..(6): n is a, c, g or t
  misc_feature (13)..(13): n is a, c, g or t
acctanccccccnacccccagtg

SEQ ID NO: 6613567 - DNA, 15 bp, Homo sapiens
acctataaaacaggt

SEQ ID NO: 6613568 - DNA, 17 bp, Homo sapiens
acctataaaattatgaa

SEQ ID NO: 6613569 - DNA, 19 bp, Homo sapiens
acctataaaattatgaaaa

SEQ ID NO: 6613570 - DNA, 16 bp, Homo sapiens
acctataaagtaaagc

SEQ ID NO: 6613571 - DNA, 13 bp, Homo sapiens
acctataaatact

SEQ ID NO: 6613572 - DNA, 14 bp, Homo sapiens
acctataaatacta

SEQ ID NO: 6613573 - DNA, 15 bp, Homo sapiens
acctataatgtgtgt

SEQ ID NO: 6613574 - DNA, 22 bp, Homo sapiens
acctatacaatgtatgtaattt

SEQ ID NO: 6613575 - DNA, 23 bp, Homo sapiens
acctatacagaacagagggccag

SEQ ID NO: 6613576 - DNA, 18 bp, Homo sapiens
acctatacctgtgtttct

SEQ ID NO: 6613577 - DNA, 19 bp, Homo sapiens
acctatactgaaagatctc

SEQ ID NO: 6613578 - DNA, 20 bp, Homo sapiens
acctatactgaaagatctct

SEQ ID NO: 6613579 - DNA, 14 bp, Homo sapiens
acctatagaaatgt

SEQ ID NO: 6613580 - DNA, 18 bp, Homo sapiens
acctataggaaagtctgt

SEQ ID NO: 6613581 - DNA, 22 bp, Homo sapiens
acctatagtcccagctactcag

SEQ ID NO: 6613582 - DNA, 13 bp, Homo sapiens
acctatatgattt

SEQ ID NO: 6613583 - DNA, 15 bp, Homo sapiens
acctatcacttacat

SEQ ID NO: 6613584 - DNA, 18 bp, Homo sapiens
acctatcacttacatttt

SEQ ID NO: 6613585 - DNA, 22 bp, Homo sapiens
acctatccagagagtattctaa

SEQ ID NO: 6613586 - DNA, 19 bp, Homo sapiens
acctatccgccctgcagca

SEQ ID NO: 6613587 - DNA, 13 bp, Homo sapiens
acctatctcaggg

SEQ ID NO: 6613588 - DNA, 14 bp, Homo sapiens
acctatctcaggga

SEQ ID NO: 6613589 - DNA, 18 bp, Homo sapiens
acctatctcgtgggagag

SEQ ID NO: 6613590 - DNA, 15 bp, Homo sapiens
acctatctgtaagag

SEQ ID NO: 6613591 - DNA, 16 bp, Homo sapiens
acctatctgtattggc

SEQ ID NO: 6613592 - DNA, 14 bp, Homo sapiens
acctatgacttttt

SEQ ID NO: 6613593 - DNA, 21 bp, Homo sapiens
acctatgagatggccatgctc

SEQ ID NO: 6613594 - DNA, 22 bp, Homo sapiens
acctatgagatggccatgctca

SEQ ID NO: 6613595 - DNA, 21 bp, Homo sapiens
acctatgcctgtggtgaagtg

SEQ ID NO: 6613596 - DNA, 16 bp, Homo sapiens
acctatggcccagcca

SEQ ID NO: 6613597 - DNA, 17 bp, Homo sapiens
acctatggcccagccac

SEQ ID NO: 6613598 - DNA, 18 bp, Homo sapiens
acctatggcccagccact

SEQ ID NO: 6613599 - DNA, 19 bp, Homo sapiens
acctatggcccagccactg

SEQ ID NO: 6613600 - DNA, 12 bp, Homo sapiens
acctatgtactt

SEQ ID NO: 6613601 - DNA, 18 bp, Homo sapiens
acctatgtacttgaaaat

SEQ ID NO: 6613602 - DNA, 12 bp, Homo sapiens
acctatgtcatt

SEQ ID NO: 6613603 - DNA, 16 bp, Homo sapiens
acctatgtcatttcat

SEQ ID NO: 6613604 - DNA, 22 bp, Homo sapiens
acctatgtcctaaggacacact

SEQ ID NO: 6613605 - DNA, 18 bp, Homo sapiens
acctatgtgagtttcaga

SEQ ID NO: 6613606 - DNA, 19 bp, Homo sapiens
acctatgtgagtttcagaa

SEQ ID NO: 6613607 - DNA, 20 bp, Homo sapiens
acctatgtgagtttcagaaa

SEQ ID NO: 6613608 - DNA, 21 bp, Homo sapiens
acctatgtgagtttcagaaat

SEQ ID NO: 6613609 - DNA, 18 bp, Homo sapiens
acctatgtggcatgtggt

SEQ ID NO: 6613610 - DNA, 21 bp, Homo sapiens
acctatgttattttgtgtaca

SEQ ID NO: 6613611 - DNA, 23 bp, Homo sapiens
acctatgttattttgtgtacaag

SEQ ID NO: 6613612 - DNA, 12 bp, Homo sapiens
acctatgtttgc

SEQ ID NO: 6613613 - DNA, 20 bp, Homo sapiens
acctattaagtcatcatctc

SEQ ID NO: 6613614 - DNA, 12 bp, Homo sapiens
acctattaggtg

SEQ ID NO: 6613615 - DNA, 16 bp, Homo sapiens
acctattcctcctggg

SEQ ID NO: 6613616 - DNA, 20 bp, Homo sapiens
acctattctgaaaaagacat

SEQ ID NO: 6613617 - DNA, 14 bp, Homo sapiens
acctattgaattac

SEQ ID NO: 6613618 - DNA, 16 bp, Homo sapiens
acctattgaattacca

SEQ ID NO: 6613619 - DNA, 13 bp, Homo sapiens
acctattgccagg

SEQ ID NO: 6613620 - DNA, 21 bp, Homo sapiens
acctattgggacagcatgact

SEQ ID NO: 6613621 - DNA, 12 bp, Homo sapiens
acctatttaatg

SEQ ID NO: 6613622 - DNA, 12 bp, Homo sapiens
acctatttccat

SEQ ID NO: 6613623 - DNA, 15 bp, Homo sapiens
acctatttctgatga

SEQ ID NO: 6613624 - DNA, 19 bp, Homo sapiens
acctatttctgatgatgtc

SEQ ID NO: 6613625 - DNA, 12 bp, Homo sapiens
acctatttcttt

SEQ ID NO: 6613626 - DNA, 14 bp, Homo sapiens
acctatttgactgc

SEQ ID NO: 6613627 - DNA, 18 bp, Homo sapiens
acctatttgactgcttca

SEQ ID NO: 6613628 - DNA, 18 bp, Homo sapiens
acctattttcatttgtac

SEQ ID NO: 6613629 - DNA, 14 bp, Homo sapiens
acctattttgaaag

SEQ ID NO: 6613630 - DNA, 13 bp, Homo sapiens
acctatttttcct

SEQ ID NO: 6613631 - DNA, 14 bp, Homo sapiens
acctattttttaaa

SEQ ID NO: 6613632 - DNA, 14 bp, Homo sapiens
acctcaaaacactt

SEQ ID NO: 6613633 - DNA, 15 bp, Homo sapiens
acctcaaaacacttt

SEQ ID NO: 6613634 - DNA, 15 bp, Homo sapiens
acctcaaaagaaaat

SEQ ID NO: 6613635 - DNA, 19 bp, Homo sapiens
acctcaaaatgtctaagat

SEQ ID NO: 6613636 - DNA, 14 bp, Homo sapiens
acctcaaagggcag

SEQ ID NO: 6613637 - DNA, 19 bp, Homo sapiens
acctcaaagtaaaaattga

SEQ ID NO: 6613638 - DNA, 15 bp, Homo sapiens
acctcaaatttaaag

SEQ ID NO: 6613639 - DNA, 20 bp, Homo sapiens
acctcaacatttcagtgttt

SEQ ID NO: 6613640 - DNA, 15 bp, Homo sapiens
acctcaacctgtaaa

SEQ ID NO: 6613641 - DNA, 19 bp, Homo sapiens
acctcaacctgtaaattat

SEQ ID NO: 6613642 - DNA, 23 bp, Homo sapiens
acctcaacctgtaaattatttta

SEQ ID NO: 6613643 - DNA, 16 bp, Homo sapiens
acctcaactgcctact

SEQ ID NO: 6613644 - DNA, 14 bp, Homo sapiens
acctcaagccccat

SEQ ID NO: 6613645 - DNA, 20 bp, Homo sapiens
acctcaagccccatttcctc

SEQ ID NO: 6613646 - DNA, 15 bp, Homo sapiens
acctcaaggaagcta

SEQ ID NO: 6613647 - DNA, 10 bp, Homo sapiens
acctcaaggg

SEQ ID NO: 6613648 - DNA, 20 bp, Homo sapiens
acctcaagggggactgtctt

SEQ ID NO: 6613649 - DNA, 19 bp, Homo sapiens
acctcaaggtaacaagagt

SEQ ID NO: 6613650 - DNA, 16 bp, Homo sapiens
acctcaagtgtcctga

SEQ ID NO: 6613651 - DNA, 19 bp, Homo sapiens
acctcaagtttttgttttg

SEQ ID NO: 6613652 - DNA, 18 bp, Homo sapiens
acctcaatgccctgccat

SEQ ID NO: 6613653 - DNA, 16 bp, Homo sapiens
acctcaatggaggttt

SEQ ID NO: 6613654 - DNA, 17 bp, Homo sapiens
acctcaatggaggtttg

SEQ ID NO: 6613655 - DNA, 12 bp, Homo sapiens
acctcacaacag

SEQ ID NO: 6613656 - DNA, 14 bp, Homo sapiens
acctcacaactcct

SEQ ID NO: 6613657 - DNA, 16 bp, Homo sapiens
acctcacaactccttc

SEQ ID NO: 6613658 - DNA, 20 bp, Homo sapiens
acctcacaactccttccatc

SEQ ID NO: 6613659 - DNA, 17 bp, Homo sapiens
acctcacacacctctgc

SEQ ID NO: 6613660 - DNA, 19 bp, Homo sapiens
acctcacacacctctgccc

SEQ ID NO: 6613661 - DNA, 21 bp, Homo sapiens
acctcacacacctctgcccct

SEQ ID NO: 6613662 - DNA, 12 bp, Homo sapiens
acctcacagcta

SEQ ID NO: 6613663 - DNA, 14 bp, Homo sapiens
acctcaccaaacta

SEQ ID NO: 6613664 - DNA, 24 bp, Homo sapiens
acctcaccaaactagtatcatttt

SEQ ID NO: 6613665 - DNA, 19 bp, Homo sapiens
acctcaccaactcctagtt

SEQ ID NO: 6613666 - DNA, 17 bp, Homo sapiens
acctcaccaagctgctg

SEQ ID NO: 6613667 - DNA, 19 bp, Homo sapiens
acctcaccattgtgaagca

SEQ ID NO: 6613668 - DNA, 22 bp, Homo sapiens
acctcaccattgtgaagcacct

SEQ ID NO: 6613669 - DNA, 18 bp, Homo sapiens
acctcaccccgaggccct

SEQ ID NO: 6613670 - DNA, 20 bp, Homo sapiens
acctcaccccgaggccctgc

SEQ ID NO: 6613671 - DNA, 20 bp, Homo sapiens
acctcaccccgttacagctc

SEQ ID NO: 6613672 - DNA, 14 bp, Homo sapiens
acctcacccctcct

SEQ ID NO: 6613673 - DNA, 19 bp, Homo sapiens
acctcacccgaggctgccc

SEQ ID NO: 6613674 - DNA, 18 bp, Homo sapiens
acctcacccggcctcttc

SEQ ID NO: 6613675 - DNA, 14 bp, Homo sapiens
acctcaccctgcta

SEQ ID NO: 6613676 - DNA, 21 bp, Homo sapiens
acctcacctcccgaagccacc

SEQ ID NO: 6613677 - DNA, 15 bp, Homo sapiens
acctcacctctttgt

SEQ ID NO: 6613678 - DNA, 13 bp, Homo sapiens
acctcacctggtc

SEQ ID NO: 6613679 - DNA, 15 bp, Homo sapiens
acctcacctggtcct

SEQ ID NO: 6613680 - DNA, 19 bp, Homo sapiens
acctcaccttcctgtgggt

SEQ ID NO: 6613681 - DNA, 16 bp, Homo sapiens
acctcactatggtatg

SEQ ID NO: 6613682 - DNA, 17 bp, Homo sapiens
acctcactcagcaccac

SEQ ID NO: 6613683 - DNA, 14 bp, Homo sapiens
acctcactcctgtt

SEQ ID NO: 6613684 - DNA, 16 bp, Homo sapiens
acctcactctgctacc

SEQ ID NO: 6613685 - DNA, 24 bp, Homo sapiens
acctcactctgctaccttgcccca

SEQ ID NO: 6613686 - DNA, 15 bp, Homo sapiens
acctcactcttgcca

SEQ ID NO: 6613687 - DNA, 16 bp, Homo sapiens
acctcactcttgccaa

SEQ ID NO: 6613688 - DNA, 20 bp, Homo sapiens
acctcactgaaaacatctgg

SEQ ID NO: 6613689 - DNA, 16 bp, Homo sapiens
acctcactgccctccc

SEQ ID NO: 6613690 - DNA, 20 bp, Homo sapiens
acctcactgccctccctcgg

SEQ ID NO: 6613691 - DNA, 12 bp, Homo sapiens
acctcactgcct

SEQ ID NO: 6613692 - DNA, 17 bp, Homo sapiens
acctcactgctttgtag

SEQ ID NO: 6613693 - DNA, 16 bp, Homo sapiens
acctcactggcctgcc

SEQ ID NO: 6613694 - DNA, 18 bp, Homo sapiens
acctcactggcctgccat

SEQ ID NO: 6613695 - DNA, 21 bp, Homo sapiens
acctcactgggcctttccaga

SEQ ID NO: 6613696 - DNA, 21 bp, Homo sapiens
acctcactggggtcctggggc

SEQ ID NO: 6613697 - DNA, 23 bp, Homo sapiens
acctcactggggtcctggggcct

SEQ ID NO: 6613698 - DNA, 19 bp, Homo sapiens
acctcactggtgcatttaa

SEQ ID NO: 6613699 - DNA, 12 bp, Homo sapiens
acctcactgtca

SEQ ID NO: 6613700 - DNA, 20 bp, Homo sapiens
acctcactgtcatctgccag

SEQ ID NO: 6613701 - DNA, 21 bp, Homo sapiens
acctcactgtcatctgccagg

SEQ ID NO: 6613702 - DNA, 12 bp, Homo sapiens
acctcactgtcc

SEQ ID NO: 6613703 - DNA, 23 bp, Homo sapiens
acctcactgtccaatatgaaaac

SEQ ID NO: 6613704 - DNA, 15 bp, Homo sapiens
acctcactgtcctgt

SEQ ID NO: 6613705 - DNA, 17 bp, Homo sapiens
acctcactgtcctgtga

SEQ ID NO: 6613706 - DNA, 19 bp, Homo sapiens
acctcacttctggcactgt

SEQ ID NO: 6613707 - DNA, 20 bp, Homo sapiens
acctcactttacataagaaa

SEQ ID NO: 6613708 - DNA, 17 bp, Homo sapiens
acctcactttggttttg

SEQ ID NO: 6613709 - DNA, 15 bp, Homo sapiens
acctcacttttgaat

SEQ ID NO: 6613710 - DNA, 20 bp, Homo sapiens
acctcacttttgaatctata

SEQ ID NO: 6613711 - DNA, 15 bp, Homo sapiens
acctcagaaaactta

SEQ ID NO: 6613712 - DNA, 18 bp, Homo sapiens
acctcagaacataaaaag

SEQ ID NO: 6613713 - DNA, 12 bp, Homo sapiens
acctcagagcag

SEQ ID NO: 6613714 - DNA, 16 bp, Homo sapiens
acctcagagcagggcc

SEQ ID NO: 6613715 - DNA, 20 bp, Homo sapiens
acctcagagcagggccaaag

SEQ ID NO: 6613716 - DNA, 12 bp, Homo sapiens
acctcagaggca

SEQ ID NO: 6613717 - DNA, 22 bp, Homo sapiens
acctcagaggcagcttcaagtg

SEQ ID NO: 6613718 - DNA, 18 bp, Homo sapiens
acctcagaggccacttgc

SEQ ID NO: 6613719 - DNA, 21 bp, Homo sapiens
acctcagagggataaggcagt

SEQ ID NO: 6613720 - DNA, 22 bp, Homo sapiens
acctcagagggataaggcagtt

SEQ ID NO: 6613721 - DNA, 20 bp, Homo sapiens
acctcagagtccaggcccca

SEQ ID NO: 6613722 - DNA, 23 bp, Homo sapiens
acctcagagtggagttgaaactg

SEQ ID NO: 6613723 - DNA, 15 bp, Homo sapiens
acctcagatggcagc

SEQ ID NO: 6613724 - DNA, 18 bp, Homo sapiens
acctcagatggcagcttt

SEQ ID NO: 6613725 - DNA, 14 bp, Homo sapiens
acctcagcaagctg

SEQ ID NO: 6613726 - DNA, 21 bp, Homo sapiens
acctcagcaagctgcccagcc

SEQ ID NO: 6613727 - DNA, 23 bp, Homo sapiens
acctcagccatgaggagttgctg

SEQ ID NO: 6613728 - DNA, 13 bp, Homo sapiens
acctcagccctgg

SEQ ID NO: 6613729 - DNA, 15 bp, Homo sapiens
acctcagccctggcc

SEQ ID NO: 6613730 - DNA, 19 bp, Homo sapiens
acctcagccctggccctgc

SEQ ID NO: 6613731 - DNA, 16 bp, Homo sapiens
acctcagcctcccaga

SEQ ID NO: 6613732 - DNA, 15 bp, Homo sapiens
acctcagcctcctgt

SEQ ID NO: 6613733 - DNA, 12 bp, Homo sapiens
acctcagcctgc

SEQ ID NO: 6613734 - DNA, 13 bp, Homo sapiens
acctcagcctgca

SEQ ID NO: 6613735 - DNA, 14 bp, Homo sapiens
acctcagcctgcac

SEQ ID NO: 6613736 - DNA, 23 bp, Homo sapiens
acctcagcctgcacagtgtcccc

SEQ ID NO: 6613737 - DNA, 15 bp, Homo sapiens
acctcagcctgcacc

SEQ ID NO: 6613738 - DNA, 14 bp, Homo sapiens
acctcagcctggag

SEQ ID NO: 6613739 - DNA, 15 bp, Homo sapiens
acctcagcctggaga

SEQ ID NO: 6613740 - DNA, 21 bp, Homo sapiens
acctcagcctggagaggcctg

SEQ ID NO: 6613741 - DNA, 22 bp, Homo sapiens
acctcagcctggagaggcctgg

SEQ ID NO: 6613742 - DNA, 14 bp, Homo sapiens
acctcagcctggcc

SEQ ID NO: 6613743 - DNA, 16 bp, Homo sapiens
acctcagcctggccag

SEQ ID NO: 6613744 - DNA, 13 bp, Homo sapiens
acctcagcctggg

SEQ ID NO: 6613745 - DNA, 14 bp, Homo sapiens
acctcagcctgggc

SEQ ID NO: 6613746 - DNA, 15 bp, Homo sapiens
acctcagcctgggcg

SEQ ID NO: 6613747 - DNA, 19 bp, Homo sapiens
acctcagcctgtgctgccc

SEQ ID NO: 6613748 - DNA, 14 bp, Homo sapiens
acctcagccttgga

SEQ ID NO: 6613749 - DNA, 18 bp, Homo sapiens
acctcagctctgggagag

SEQ ID NO: 6613750 - DNA, 13 bp, Homo sapiens
acctcagctgcac

SEQ ID NO: 6613751 - DNA, 13 bp, Homo sapiens
acctcagctgctt

SEQ ID NO: 6613752 - DNA, 16 bp, Homo sapiens
acctcaggaaagaata

SEQ ID NO: 6613753 - DNA, 13 bp, Homo sapiens
acctcaggacccc

SEQ ID NO: 6613754 - DNA, 16 bp, Homo sapiens
acctcaggaccccaga

SEQ ID NO: 6613755 - DNA, 18 bp, Homo sapiens
acctcaggaccccagagg

SEQ ID NO: 6613756 - DNA, 21 bp, Homo sapiens
acctcaggaccccagagggac

SEQ ID NO: 6613757 - DNA, 15 bp, Homo sapiens
acctcaggagggcag

SEQ ID NO: 6613758 - DNA, 20 bp, Homo sapiens
acctcaggagggcaggctga

SEQ ID NO: 6613759 - DNA, 17 bp, Homo sapiens
acctcaggcactagcct

SEQ ID NO: 6613760 - DNA, 12 bp, Homo sapiens
acctcaggcagg

SEQ ID NO: 6613761 - DNA, 13 bp, Homo sapiens
acctcaggccagg

SEQ ID NO: 6613762 - DNA, 22 bp, Homo sapiens
acctcaggcctgggggctgggc

SEQ ID NO: 6613763 - DNA, 19 bp, Homo sapiens
acctcagggacaacatttt

SEQ ID NO: 6613764 - DNA, 16 bp, Homo sapiens
acctcagggagtgcag

SEQ ID NO: 6613765 - DNA, 12 bp, Homo sapiens
acctcagggcac

SEQ ID NO: 6613766 - DNA, 21 bp, Homo sapiens
acctcagggcacgcaggacca

SEQ ID NO: 6613767 - DNA, 22 bp, Homo sapiens
acctcagggcacgcaggaccag

SEQ ID NO: 6613768 - DNA, 12 bp, Homo sapiens
acctcagggctc

SEQ ID NO: 6613769 - DNA, 13 bp, Homo sapiens
acctcagggctcc

SEQ ID NO: 6613770 - DNA, 17 bp, Homo sapiens
acctcagggctcccagg

SEQ ID NO: 6613771 - DNA, 20 bp, Homo sapiens
acctcagggctcccaggggt

SEQ ID NO: 6613772 - DNA, 21 bp, Homo sapiens
acctcagggctgtcccagccc

SEQ ID NO: 6613773 - DNA, 14 bp, Homo sapiens
acctcaggggagac

SEQ ID NO: 6613774 - DNA, 18 bp, Homo sapiens
acctcaggggcacctccg

SEQ ID NO: 6613775 - DNA, 19 bp, Homo sapiens
acctcagggtattgcttgc

SEQ ID NO: 6613776 - DNA, 15 bp, Homo sapiens
acctcaggtgacttt

SEQ ID NO: 6613777 - DNA, 22 bp, Homo sapiens
acctcaggtgatccgcccacct

SEQ ID NO: 6613778 - DNA, 17 bp, Homo sapiens
acctcaggtgtgcctgt

SEQ ID NO: 6613779 - DNA, 18 bp, Homo sapiens
acctcaggtgtgcctgtt

SEQ ID NO: 6613780 - DNA, 15 bp, Homo sapiens
acctcaggttccaaa

SEQ ID NO: 6613781 - DNA, 15 bp, Homo sapiens
acctcaggttgctgg

SEQ ID NO: 6613782 - DNA, 19 bp, Homo sapiens
acctcaggttgctggttgc

SEQ ID NO: 6613783 - DNA, 21 bp, Homo sapiens
acctcagtaatttagaaatca

SEQ ID NO: 6613784 - DNA, 12 bp, Homo sapiens
acctcagtagaa

SEQ ID NO: 6613785 - DNA, 20 bp, Homo sapiens
acctcagtcaggcactggct

SEQ ID NO: 6613786 - DNA, 15 bp, Homo sapiens
acctcagtcagtatt

SEQ ID NO: 6613787 - DNA, 17 bp, Homo sapiens
acctcagtcagtattgt

SEQ ID NO: 6613788 - DNA, 20 bp, Homo sapiens
acctcagtctcacctgccgg

SEQ ID NO: 6613789 - DNA, 15 bp, Homo sapiens
acctcagtgggaaga

SEQ ID NO: 6613790 - DNA, 21 bp, Homo sapiens
acctcagtgtcatttatgaaa

SEQ ID NO: 6613791 - DNA, 18 bp, Homo sapiens
acctcagttcattgtggt

SEQ ID NO: 6613792 - DNA, 16 bp, Homo sapiens
acctcagttccacggt

SEQ ID NO: 6613793 - DNA, 16 bp, Homo sapiens
acctcagttcccttgg

SEQ ID NO: 6613794 - DNA, 23 bp, Homo sapiens
acctcagttcccttggcctcaga

SEQ ID NO: 6613795 - DNA, 22 bp, Homo sapiens
acctcagttgaaaatgcaactc

SEQ ID NO: 6613796 - DNA, 16 bp, Homo sapiens
acctcagttggcctct

SEQ ID NO: 6613797 - DNA, 12 bp, Homo sapiens
acctcagtttcc

SEQ ID NO: 6613798 - DNA, 18 bp, Homo sapiens
acctcagtttccctctgt

SEQ ID NO: 6613799 - DNA, 13 bp, Homo sapiens
acctcagtttcct

SEQ ID NO: 6613800 - DNA, 21 bp, Homo sapiens
acctcagtttcctcatctgca

SEQ ID NO: 6613801 - DNA, 23 bp, Homo sapiens
acctcagtttcctcatctgcaga

SEQ ID NO: 6613802 - DNA, 13 bp, Homo sapiens
acctcagtttctc

SEQ ID NO: 6613803 - DNA, 14 bp, Homo sapiens
acctcagtttctgt

SEQ ID NO: 6613804 - DNA, 15 bp, Homo sapiens
acctcagtttctgtt

SEQ ID NO: 6613805 - DNA, 21 bp, Homo sapiens
acctcagtttctgttgtttct

SEQ ID NO: 6613806 - DNA, 15 bp, Homo sapiens
acctcatcactggac

SEQ ID NO: 6613807 - DNA, 16 bp, Homo sapiens
acctcatcactggact

SEQ ID NO: 6613808 - DNA, 21 bp, Homo sapiens
acctcatcactggactgcatg

SEQ ID NO: 6613809 - DNA, 13 bp, Homo sapiens
acctcatcagcct

SEQ ID NO: 6613810 - DNA, 16 bp, Homo sapiens
acctcatcagccttgg

SEQ ID NO: 6613811 - DNA, 22 bp, Homo sapiens
acctcatcatccacccgctgcc

SEQ ID NO: 6613812 - DNA, 13 bp, Homo sapiens
acctcatccaaac

SEQ ID NO: 6613813 - DNA, 21 bp, Homo sapiens
acctcatccccaccccacctc

SEQ ID NO: 6613814 - DNA, 11 bp, Homo sapiens
acctcatcctg

SEQ ID NO: 6613815 - DNA, 13 bp, Homo sapiens
acctcatcctgct

SEQ ID NO: 6613816 - DNA, 14 bp, Homo sapiens
acctcatcctgctc

SEQ ID NO: 6613817 - DNA, 19 bp, Homo sapiens
acctcatctccaagatagc

SEQ ID NO: 6613818 - DNA, 18 bp, Homo sapiens
acctcatctgcctgcagt

SEQ ID NO: 6613819 - DNA, 22 bp, Homo sapiens
acctcatctgtggagctgccac

SEQ ID NO: 6613820 - DNA, 16 bp, Homo sapiens
acctcatctttctcct

SEQ ID NO: 6613821 - DNA, 16 bp, Homo sapiens
acctcatgacagccag

SEQ ID NO: 6613822 - DNA, 18 bp, Homo sapiens
acctcatgacagccagag

SEQ ID NO: 6613823 - DNA, 18 bp, Homo sapiens
acctcatgcatctccacc

SEQ ID NO: 6613824 - DNA, 19 bp, Homo sapiens
acctcatgcatctccacct

SEQ ID NO: 6613825 - DNA, 20 bp, Homo sapiens
acctcatgcatctccacctg

SEQ ID NO: 6613826 - DNA, 19 bp, Homo sapiens
acctcatgccatggtcttt

SEQ ID NO: 6613827 - DNA, 23 bp, Homo sapiens
acctcatgcccaccccctgccct

SEQ ID NO: 6613828 - DNA, 16 bp, Homo sapiens
acctcatgcccagctc

SEQ ID NO: 6613829 - DNA, 18 bp, Homo sapiens
acctcatgccgctgtgtc

SEQ ID NO: 6613830 - DNA, 19 bp, Homo sapiens
acctcatggattgccacag

SEQ ID NO: 6613831 - DNA, 21 bp, Homo sapiens
acctcatggattgccacagct

SEQ ID NO: 6613832 - DNA, 22 bp, Homo sapiens
acctcatggattgccacagctc

SEQ ID NO: 6613833 - DNA, 11 bp, Homo sapiens
acctcatgttt

SEQ ID NO: 6613834 - DNA, 15 bp, Homo sapiens
acctcattcgcctgt

SEQ ID NO: 6613835 - DNA, 15 bp, Homo sapiens
acctcattctggttc

SEQ ID NO: 6613836 - DNA, 16 bp, Homo sapiens
acctcattgctaccac

SEQ ID NO: 6613837 - DNA, 14 bp, Homo sapiens
acctcattggccag

SEQ ID NO: 6613838 - DNA, 18 bp, Homo sapiens
acctcatttttcatactg

SEQ ID NO: 6613839 - DNA, 20 bp, Homo sapiens
acctccaaaactcctgcccc

SEQ ID NO: 6613840 - DNA, 21 bp, Homo sapiens
acctccaaaactcctgcccct

SEQ ID NO: 6613841 - DNA, 12 bp, Homo sapiens
acctccaagcat

SEQ ID NO: 6613842 - DNA, 18 bp, Homo sapiens
acctccaagcatttcatg

SEQ ID NO: 6613843 - DNA, 21 bp, Homo sapiens
acctccaataaagtgccttct

SEQ ID NO: 6613844 - DNA, 20 bp, Homo sapiens
acctccacacccaccccctc

SEQ ID NO: 6613845 - DNA, 11 bp, Homo sapiens
acctccacagc

SEQ ID NO: 6613846 - DNA, 12 bp, Homo sapiens
acctccacagct

SEQ ID NO: 6613847 - DNA, 19 bp, Homo sapiens
acctccacagttcagtggc

SEQ ID NO: 6613848 - DNA, 20 bp, Homo sapiens
acctccacagttcagtggca

SEQ ID NO: 6613849 - DNA, 21 bp, Homo sapiens
acctccacatcccatgttgaa

SEQ ID NO: 6613850 - DNA, 16 bp, Homo sapiens
acctccacatcctcca

SEQ ID NO: 6613851 - DNA, 19 bp, Homo sapiens
acctccaccacatctgcca

SEQ ID NO: 6613852 - DNA, 23 bp, Homo sapiens
acctccaccacatctgccagacc

SEQ ID NO: 6613853 - DNA, 12 bp, Homo sapiens
acctccacccac

SEQ ID NO: 6613854 - DNA, 14 bp, Homo sapiens
acctccacccagcc

SEQ ID NO: 6613855 - DNA, 17 bp, Homo sapiens
acctccacccagcccct

SEQ ID NO: 6613856 - DNA, 11 bp, Homo sapiens
acctccacccg

SEQ ID NO: 6613857 - DNA, 21 bp, Homo sapiens
acctccaccctgcattttcct

SEQ ID NO: 6613858 - DNA, 14 bp, Homo sapiens
acctccacctccgg

SEQ ID NO: 6613859 - DNA, 15 bp, Homo sapiens
acctccacctcctgg

SEQ ID NO: 6613860 - DNA, 14 bp, Homo sapiens
acctccacctggga

SEQ ID NO: 6613861 - DNA, 16 bp, Homo sapiens
acctccaccttccagg

SEQ ID NO: 6613862 - DNA, 20 bp, Homo sapiens
acctccactcagcactctgg

SEQ ID NO: 6613863 - DNA, 11 bp, Homo sapiens
acctccactcc

SEQ ID NO: 6613864 - DNA, 16 bp, Homo sapiens
acctccactccacatc

SEQ ID NO: 6613865 - DNA, 14 bp, Homo sapiens
acctccactcccac

SEQ ID NO: 6613866 - DNA, 19 bp, Homo sapiens
acctccactcccacctcac

SEQ ID NO: 6613867 - DNA, 15 bp, Homo sapiens
acctccacttgctta

SEQ ID NO: 6613868 - DNA, 13 bp, Homo sapiens
acctccagaagtc

SEQ ID NO: 6613869 - DNA, 12 bp, Homo sapiens
acctccagactc

SEQ ID NO: 6613870 - DNA, 15 bp, Homo sapiens
acctccagacttcaa

SEQ ID NO: 6613871 - DNA, 15 bp, Homo sapiens
acctccagagctgtc

SEQ ID NO: 6613872 - DNA, 19 bp, Homo sapiens
acctccagattattttcta

SEQ ID NO: 6613873 - DNA, 15 bp, Homo sapiens
acctccagcagactc

SEQ ID NO: 6613874 - DNA, 20 bp, Homo sapiens
acctccagcccacagtgctc

SEQ ID NO: 6613875 - DNA, 23 bp, Homo sapiens
acctccagcccacagtgctcagt

SEQ ID NO: 6613876 - DNA, 19 bp, Homo sapiens
acctccagcccgggagcct

SEQ ID NO: 6613877 - DNA, 22 bp, Homo sapiens
acctccagcccgggagcctagg

SEQ ID NO: 6613878 - DNA, 11 bp, Homo sapiens
acctccagcct

SEQ ID NO: 6613879 - DNA, 23 bp, Homo sapiens
acctccagcctccctgtctccag

SEQ ID NO: 6613880 - DNA, 16 bp, Homo sapiens
acctccagctctcagt

SEQ ID NO: 6613881 - DNA, 23 bp, Homo sapiens
acctccaggaagggaccccactg

SEQ ID NO: 6613882 - DNA, 15 bp, Homo sapiens
acctccaggcctgtt

SEQ ID NO: 6613883 - DNA, 13 bp, Homo sapiens
acctccaggctcc

SEQ ID NO: 6613884 - DNA, 19 bp, Homo sapiens
acctccagggaatcagaaa

SEQ ID NO: 6613885 - DNA, 20 bp, Homo sapiens
acctccagggaatcagaaag

SEQ ID NO: 6613886 - DNA, 17 bp, Homo sapiens
acctccaggggctcctg

SEQ ID NO: 6613887 - DNA, 22 bp, Homo sapiens
acctccaggggctcctgggttg

SEQ ID NO: 6613888 - DNA, 17 bp, Homo sapiens
acctccagtcacactcc

SEQ ID NO: 6613889 - DNA, 19 bp, Homo sapiens
acctccagtcctgctggcc

SEQ ID NO: 6613890 - DNA, 22 bp, Homo sapiens
acctccatactcaagctgtctc

SEQ ID NO: 6613891 - DNA, 12 bp, Homo sapiens
acctccatgccc

SEQ ID NO: 6613892 - DNA, 14 bp, Homo sapiens
acctccatgtcatc

SEQ ID NO: 6613893 - DNA, 16 bp, Homo sapiens
acctccatgtcatccg

SEQ ID NO: 6613894 - DNA, 16 bp, Homo sapiens
acctccattaaagtct

SEQ ID NO: 6613895 - DNA, 20 bp, Homo sapiens
acctccattaaagtctgaat

SEQ ID NO: 6613896 - DNA, 14 bp, Homo sapiens
acctccattaaatg

SEQ ID NO: 6613897 - DNA, 16 bp, Homo sapiens
acctccattaaatggt

SEQ ID NO: 6613898 - DNA, 22 bp, Homo sapiens
acctcccaaggactttccagtg

SEQ ID NO: 6613899 - DNA, 13 bp, Homo sapiens
acctcccacccca

SEQ ID NO: 6613900 - DNA, 22 bp, Homo sapiens
acctcccaccccactccagccc

SEQ ID NO: 6613901 - DNA, 23 bp, Homo sapiens
acctcccacctatccgccctgca

SEQ ID NO: 6613902 - DNA, 12 bp, Homo sapiens
acctcccacctt

SEQ ID NO: 6613903 - DNA, 16 bp, Homo sapiens
acctcccacctttggt

SEQ ID NO: 6613904 - DNA, 17 bp, Homo sapiens
acctcccactttgggga

SEQ ID NO: 6613905 - DNA, 22 bp, Homo sapiens
acctcccactttgtctgtacat

SEQ ID NO: 6613906 - DNA, 23 bp, Homo sapiens
acctcccactttgtctgtacata

SEQ ID NO: 6613907 - DNA, 16 bp, Homo sapiens
acctcccagaggtcca

SEQ ID NO: 6613908 - DNA, 20 bp, Homo sapiens
acctcccagaggtccagccc

SEQ ID NO: 6613909 - DNA, 22 bp, Homo sapiens
acctcccagaggtccagcccat

SEQ ID NO: 6613910 - DNA, 15 bp, Homo sapiens
acctcccagccctat

SEQ ID NO: 6613911 - DNA, 19 bp, Homo sapiens
acctcccagccctatggat

SEQ ID NO: 6613912 - DNA, 20 bp, Homo sapiens
acctcccagccctatggatg

SEQ ID NO: 6613913 - DNA, 21 bp, Homo sapiens
acctcccagccctatggatgt

SEQ ID NO: 6613914 - DNA, 13 bp, Homo sapiens
acctcccagggga

SEQ ID NO: 6613915 - DNA, 15 bp, Homo sapiens
acctcccaggggact

SEQ ID NO: 6613916 - DNA, 20 bp, Homo sapiens
acctcccaggggctccacct

SEQ ID NO: 6613917 - DNA, 14 bp, Homo sapiens
acctcccatcccac

SEQ ID NO: 6613918 - DNA, 20 bp, Homo sapiens
acctcccatttctgttgctg

SEQ ID NO: 6613919 - DNA, 16 bp, Homo sapiens
acctccccacacacag

SEQ ID NO: 6613920 - DNA, 19 bp, Homo sapiens
acctccccacacacaggcc

SEQ ID NO: 6613921 - DNA, 23 bp, Homo sapiens
acctccccacacacaggccttct

SEQ ID NO: 6613922 - DNA, 12 bp, Homo sapiens
acctccccacat

SEQ ID NO: 6613923 - DNA, 21 bp, Homo sapiens
acctccccacatcgcacactg

SEQ ID NO: 6613924 - DNA, 23 bp, Homo sapiens
acctccccacccccgctgggggt

SEQ ID NO: 6613925 - DNA, 19 bp, Homo sapiens
acctccccacgccctcccc

SEQ ID NO: 6613926 - DNA, 17 bp, Homo sapiens
acctccccactccagca

SEQ ID NO: 6613927 - DNA, 18 bp, Homo sapiens
acctccccactccagcag

SEQ ID NO: 6613928 - DNA, 14 bp, Homo sapiens
acctccccagacag

SEQ ID NO: 6613929 - DNA, 17 bp, Homo sapiens
acctccccagacagggc

SEQ ID NO: 6613930 - DNA, 18 bp, Homo sapiens
acctccccagagccctgc

SEQ ID NO: 6613931 - DNA, 17 bp, Homo sapiens
acctccccagcccagga

SEQ ID NO: 6613932 - DNA, 14 bp, Homo sapiens
acctccccagcctg

SEQ ID NO: 6613933 - DNA, 14 bp, Homo sapiens
acctccccaggccg

SEQ ID NO: 6613934 - DNA, 20 bp, Homo sapiens
acctccccaggccgtggctg

SEQ ID NO: 6613935 - DNA, 14 bp, Homo sapiens
acctccccccactg

SEQ ID NO: 6613936 - DNA, 16 bp, Homo sapiens
acctccccccactgca

SEQ ID NO: 6613937 - DNA, 17 bp, Homo sapiens
acctccccccactgcag

SEQ ID NO: 6613938 - DNA, 22 bp, Homo sapiens
acctccccccactgcaggcccc

SEQ ID NO: 6613939 - DNA, 14 bp, Homo sapiens
acctccccctaccc

SEQ ID NO: 6613940 - DNA, 16 bp, Homo sapiens
acctccccctacccat

SEQ ID NO: 6613941 - DNA, 20 bp, Homo sapiens
acctccccctacccatatcc

SEQ ID NO: 6613942 - DNA, 15 bp, Homo sapiens
acctccccctcactt

SEQ ID NO: 6613943 - DNA, 12 bp, Homo sapiens
acctccccctcc

SEQ ID NO: 6613944 - DNA, 21 bp, Homo sapiens
acctccccctcccccttctcc

SEQ ID NO: 6613945 - DNA, 15 bp, Homo sapiens
acctccccctccttc

SEQ ID NO: 6613946 - DNA, 16 bp, Homo sapiens
acctccccctccttcc

SEQ ID NO: 6613947 - DNA, 13 bp, Homo sapiens
acctccccctctt

SEQ ID NO: 6613948 - DNA, 16 bp, Homo sapiens
acctccccctgcgccc

SEQ ID NO: 6613949 - DNA, 21 bp, Homo sapiens
acctccccctgcgccccgcac

SEQ ID NO: 6613950 - DNA, 14 bp, Homo sapiens
acctccccctgtgt

SEQ ID NO: 6613951 - DNA, 20 bp, Homo sapiens
acctccccctgtgtggccct

SEQ ID NO: 6613952 - DNA, 15 bp, Homo sapiens
acctcccccttcccc

SEQ ID NO: 6613953 - DNA, 22 bp, Homo sapiens
acctccccgctctccctgtcac

SEQ ID NO: 6613954 - DNA, 20 bp, Homo sapiens
acctcccctatccacccagc

SEQ ID NO: 6613955 - DNA, 21 bp, Homo sapiens
acctcccctatccacccagcc

SEQ ID NO: 6613956 - DNA, 16 bp, Homo sapiens
acctcccctccccagc

SEQ ID NO: 6613957 - DNA, 20 bp, Homo sapiens
acctcccctccccgccccct

SEQ ID NO: 6613958 - DNA, 22 bp, Homo sapiens
acctcccctccccgccccctga

SEQ ID NO: 6613959 - DNA, 13 bp, Homo sapiens
acctcccctcctt

SEQ ID NO: 6613960 - DNA, 18 bp, Homo sapiens
acctcccctcttcctgga

SEQ ID NO: 6613961 - DNA, 16 bp, Homo sapiens
acctcccctgccaggg

SEQ ID NO: 6613962 - DNA, 15 bp, Homo sapiens
acctcccctgccttg

SEQ ID NO: 6613963 - DNA, 13 bp, Homo sapiens
acctcccctgcgt

SEQ ID NO: 6613964 - DNA, 18 bp, Homo sapiens
acctcccctggtcctgca

SEQ ID NO: 6613965 - DNA, 17 bp, Homo sapiens
acctccccttgccagct

SEQ ID NO: 6613966 - DNA, 14 bp, Homo sapiens
acctccccttgggc

SEQ ID NO: 6613967 - DNA, 22 bp, Homo sapiens
acctccccttgggcccacacct

SEQ ID NO: 6613968 - DNA, 15 bp, Homo sapiens
acctcccgccctcac

SEQ ID NO: 6613969 - DNA, 17 bp, Homo sapiens
acctccctaccaaaaat

SEQ ID NO: 6613970 - DNA, 14 bp, Homo sapiens
acctccctactccc

SEQ ID NO: 6613971 - DNA, 11 bp, Homo sapiens
acctccctccc

SEQ ID NO: 6613972 - DNA, 14 bp, Homo sapiens
acctccctccccag

SEQ ID NO: 6613973 - DNA, 15 bp, Homo sapiens
acctccctcccggca

SEQ ID NO: 6613974 - DNA, 14 bp, Homo sapiens
acctccctccctct

SEQ ID NO: 6613975 - DNA, 14 bp, Homo sapiens
acctccctcctcag

SEQ ID NO: 6613976 - DNA, 13 bp, Homo sapiens
acctccctccttt

SEQ ID NO: 6613977 - DNA, 13 bp, Homo sapiens
acctccctcgccc

SEQ ID NO: 6613978 - DNA, 20 bp, Homo sapiens
acctccctgaaccatccctg

SEQ ID NO: 6613979 - DNA, 12 bp, Homo sapiens
acctccctgcaa

SEQ ID NO: 6613980 - DNA, 13 bp, Homo sapiens
acctccctgccca

SEQ ID NO: 6613981 - DNA, 15 bp, Homo sapiens
acctccctgcccagg

SEQ ID NO: 6613982 - DNA, 13 bp, Homo sapiens
acctccctgccct

SEQ ID NO: 6613983 - DNA, 22 bp, Homo sapiens
acctccctgccctgtcctccag

SEQ ID NO: 6613984 - DNA, 13 bp, Homo sapiens
acctccctgtctc

SEQ ID NO: 6613985 - DNA, 15 bp, Homo sapiens
acctccctgtctccc

SEQ ID NO: 6613986 - DNA, 20 bp, Homo sapiens
acctccctgtctctacaaaa

SEQ ID NO: 6613987 - DNA, 21 bp, Homo sapiens
acctcccttaagcagcaacag

SEQ ID NO: 6613988 - DNA, 22 bp, Homo sapiens
acctcccttaagcagcaacagc

SEQ ID NO: 6613989 - DNA, 22 bp, Homo sapiens
acctcccttcagtcaccactcc

SEQ ID NO: 6613990 - DNA, 16 bp, Homo sapiens
acctcccttccctccc

SEQ ID NO: 6613991 - DNA, 20 bp, Homo sapiens
acctcccttccctccctgag

SEQ ID NO: 6613992 - DNA, 18 bp, Homo sapiens
acctcccttccgaccctc

SEQ ID NO: 6613993 - DNA, 12 bp, Homo sapiens
acctcccttggg

SEQ ID NO: 6613994 - DNA, 17 bp, Homo sapiens
acctccgagacagtcca

SEQ ID NO: 6613995 - DNA, 18 bp, Homo sapiens
acctccgagaggcagcca

SEQ ID NO: 6613996 - DNA, 23 bp, Homo sapiens
acctccgcccctgcccccgctcc

SEQ ID NO: 6613997 - DNA, 15 bp, Homo sapiens
acctccgcctcccag

SEQ ID NO: 6613998 - DNA, 16 bp, Homo sapiens
acctccgcctcccagg

SEQ ID NO: 6613999 - DNA, 22 bp, Homo sapiens
acctccggccaggtgcctcctg

SEQ ID NO: 6614000 - DNA, 21 bp, Homo sapiens
acctccggctgcctagccctc

SEQ ID NO: 6614001 - DNA, 19 bp, Homo sapiens
acctccggggagagcagag

SEQ ID NO: 6614002 - DNA, 22 bp, Homo sapiens
acctccggggagagcagagggt

SEQ ID NO: 6614003 - DNA, 19 bp, Homo sapiens
acctccgtcctctccccag

SEQ ID NO: 6614004 - DNA, 21 bp, Homo sapiens
acctccgtcctctccccagcc

SEQ ID NO: 6614005 - DNA, 24 bp, Homo sapiens
acctccgttgcggctgtgctcctg

SEQ ID NO: 6614006 - DNA, 19 bp, Homo sapiens
acctcctaccccttcctgt

SEQ ID NO: 6614007 - DNA, 23 bp, Homo sapiens
acctcctaccccttcctgtcctg

SEQ ID NO: 6614008 - DNA, 14 bp, Homo sapiens
acctcctaccctcc

SEQ ID NO: 6614009 - DNA, 18 bp, Homo sapiens
acctcctaccctcccacc

SEQ ID NO: 6614010 - DNA, 15 bp, Homo sapiens
acctcctagaggtgg

SEQ ID NO: 6614011 - DNA, 16 bp, Homo sapiens
acctcctatccttgga

SEQ ID NO: 6614012 - DNA, 14 bp, Homo sapiens
acctcctattttaa

SEQ ID NO: 6614013 - DNA, 13 bp, Homo sapiens
acctcctcacatt

SEQ ID NO: 6614014 - DNA, 15 bp, Homo sapiens
acctcctcagcctga

SEQ ID NO: 6614015 - DNA, 16 bp, Homo sapiens
acctcctccacaccag

SEQ ID NO: 6614016 - DNA, 10 bp, Homo sapiens
acctcctccc

SEQ ID NO: 6614017 - DNA, 16 bp, Homo sapiens
acctcctcccactgcc

SEQ ID NO: 6614018 - DNA, 19 bp, Homo sapiens
acctcctcccactgcccac

SEQ ID NO: 6614019 - DNA, 12 bp, Homo sapiens
acctcctccccc

SEQ ID NO: 6614020 - DNA, 14 bp, Homo sapiens
acctcctccccctg

SEQ ID NO: 6614021 - DNA, 17 bp, Homo sapiens
acctcctccccctgttc

SEQ ID NO: 6614022 - DNA, 14 bp, Homo sapiens
acctcctccctgtt

SEQ ID NO: 6614023 - DNA, 12 bp, Homo sapiens
acctcctcctgc

SEQ ID NO: 6614024 - DNA, 18 bp, Homo sapiens
acctcctctcactcccca

SEQ ID NO: 6614025 - DNA, 15 bp, Homo sapiens
acctcctctctgctg

SEQ ID NO: 6614026 - DNA, 15 bp, Homo sapiens
acctcctctcttgga

SEQ ID NO: 6614027 - DNA, 14 bp, Homo sapiens
acctcctctgggcc

SEQ ID NO: 6614028 - DNA, 20 bp, Homo sapiens
acctcctctgggccctgtcg

SEQ ID NO: 6614029 - DNA, 18 bp, Homo sapiens
acctcctctgtgaagcat

SEQ ID NO: 6614030 - DNA, 14 bp, Homo sapiens
acctcctcttcccc

SEQ ID NO: 6614031 - DNA, 17 bp, Homo sapiens
acctcctgacaacgtct

SEQ ID NO: 6614032 - DNA, 17 bp, Homo sapiens
acctcctgacacccttc

SEQ ID NO: 6614033 - DNA, 18 bp, Homo sapiens
acctcctgacacccttct

SEQ ID NO: 6614034 - DNA, 22 bp, Homo sapiens
acctcctgacacccttctccca

SEQ ID NO: 6614035 - DNA, 14 bp, Homo sapiens
acctcctgcccagg

SEQ ID NO: 6614036 - DNA, 23 bp, Homo sapiens
acctcctgcctcgaactggctgc

SEQ ID NO: 6614037 - DNA, 16 bp, Homo sapiens
acctcctgcggctcag

SEQ ID NO: 6614038 - DNA, 17 bp, Homo sapiens
acctcctgcggctcagc

SEQ ID NO: 6614039 - DNA, 23 bp, Homo sapiens
acctcctgcggctcagccttgca

SEQ ID NO: 6614040 - DNA, 17 bp, Homo sapiens
acctcctgtcagtgagg

SEQ ID NO: 6614041 - DNA, 15 bp, Homo sapiens
acctcctgtctctgg

SEQ ID NO: 6614042 - DNA, 16 bp, Homo sapiens
acctcctgtctctggc

SEQ ID NO: 6614043 - DNA, 17 bp, Homo sapiens
acctcctgtgggcctca

SEQ ID NO: 6614044 - DNA, 17 bp, Homo sapiens
acctccttacctggagt

SEQ ID NO: 6614045 - DNA, 19 bp, Homo sapiens
acctccttatctgctaact

SEQ ID NO: 6614046 - DNA, 12 bp, Homo sapiens
acctccttcccc

SEQ ID NO: 6614047 - DNA, 14 bp, Homo sapiens
acctccttccccag

SEQ ID NO: 6614048 - DNA, 18 bp, Homo sapiens
acctccttccccagctcc

SEQ ID NO: 6614049 - DNA, 19 bp, Homo sapiens
acctccttccccagctccc

SEQ ID NO: 6614050 - DNA, 14 bp, Homo sapiens
acctccttccctct

SEQ ID NO: 6614051 - DNA, 12 bp, Homo sapiens
acctccttcctc

SEQ ID NO: 6614052 - DNA, 22 bp, Homo sapiens
acctccttcctcagtcctggaa

SEQ ID NO: 6614053 - DNA, 12 bp, Homo sapiens
acctccttctgc

SEQ ID NO: 6614054 - DNA, 14 bp, Homo sapiens
acctccttggcacc

SEQ ID NO: 6614055 - DNA, 19 bp, Homo sapiens
acctcctttcatcacactg

SEQ ID NO: 6614056 - DNA, 21 bp, Homo sapiens
acctcctttcctatctttaca

SEQ ID NO: 6614057 - DNA, 14 bp, Homo sapiens
acctccttttcttc

SEQ ID NO: 6614058 - DNA, 15 bp, Homo sapiens
acctccttttcttct

SEQ ID NO: 6614059 - DNA, 15 bp, Homo sapiens
acctcgaagctgttc

SEQ ID NO: 6614060 - DNA, 20 bp, Homo sapiens
acctcgaagctgttctctgc

SEQ ID NO: 6614061 - DNA, 14 bp, Homo sapiens
acctcgagatgggt

SEQ ID NO: 6614062 - DNA, 23 bp, Homo sapiens
acctcgagatgggtgctggtcct

SEQ ID NO: 6614063 - DNA, 20 bp, Homo sapiens
acctcgaggaactccaggac

SEQ ID NO: 6614064 - DNA, 23 bp, Homo sapiens
acctcgcccagcggcatcaggct

SEQ ID NO: 6614065 - DNA, 17 bp, Homo sapiens
acctcgccctctccttt

SEQ ID NO: 6614066 - DNA, 14 bp, Homo sapiens
acctcgccctctct

SEQ ID NO: 6614067 - DNA, 16 bp, Homo sapiens
acctcgccctctctca

SEQ ID NO: 6614068 - DNA, 20 bp, Homo sapiens
acctcgccctctctcaccag

SEQ ID NO: 6614069 - DNA, 21 bp, Homo sapiens
acctcgccctctctcaccagc

SEQ ID NO: 6614070 - DNA, 19 bp, Homo sapiens
acctcgcccttcagcccac

SEQ ID NO: 6614071 - DNA, 15 bp, Homo sapiens
acctcgccgtgtctt

SEQ ID NO: 6614072 - DNA, 19 bp, Homo sapiens
acctcgctccaactccaac

SEQ ID NO: 6614073 - DNA, 16 bp, Homo sapiens
acctcgctggactctc

SEQ ID NO: 6614074 - DNA, 18 bp, Homo sapiens
acctcggacagagccccc

SEQ ID NO: 6614075 - DNA, 20 bp, Homo sapiens
acctcggacagagcccccct

SEQ ID NO: 6614076 - DNA, 18 bp, Homo sapiens
acctcggagacgggaccc

SEQ ID NO: 6614077 - DNA, 21 bp, Homo sapiens
acctcggagcatggtgttttc

SEQ ID NO: 6614078 - DNA, 20 bp, Homo sapiens
acctcggccgtacatctctg

SEQ ID NO: 6614079 - DNA, 14 bp, Homo sapiens
acctcggctcctgg

SEQ ID NO: 6614080 - DNA, 15 bp, Homo sapiens
acctcggctcctgga

SEQ ID NO: 6614081 - DNA, 20 bp, Homo sapiens
acctcggctgtgtggggagg

SEQ ID NO: 6614082 - DNA, 18 bp, Homo sapiens
acctcggcttgtgggctg

SEQ ID NO: 6614083 - DNA, 23 bp, Homo sapiens
acctcgggctgttctggtggccc

SEQ ID NO: 6614084 - DNA, 14 bp, Homo sapiens
acctcggggagagg

SEQ ID NO: 6614085 - DNA, 13 bp, Homo sapiens
acctcggggtggg

SEQ ID NO: 6614086 - DNA, 18 bp, Homo sapiens
acctcggtgatgccttcc

SEQ ID NO: 6614087 - DNA, 19 bp, Homo sapiens
acctcgtcaagagcatgca

SEQ ID NO: 6614088 - DNA, 23 bp, Homo sapiens
acctcgtccatttaaacccggct

SEQ ID NO: 6614089 - DNA, 14 bp, Homo sapiens
acctcgtcctcccc

SEQ ID NO: 6614090 - DNA, 15 bp, Homo sapiens
acctcgtcctccccc

SEQ ID NO: 6614091 - DNA, 18 bp, Homo sapiens
acctcgtcctccccctgc

SEQ ID NO: 6614092 - DNA, 15 bp, Homo sapiens
acctcgtctccctgg

SEQ ID NO: 6614093 - DNA, 23 bp, Homo sapiens
acctcgtctccctggtgcctctg

SEQ ID NO: 6614094 - DNA, 23 bp, Homo sapiens
acctcgtgatccgcctgcctctg

SEQ ID NO: 6614095 - DNA, 23 bp, Homo sapiens
acctcgtgccaccccgagggctg

SEQ ID NO: 6614096 - DNA, 14 bp, Homo sapiens
acctcgtgctttaa

SEQ ID NO: 6614097 - DNA, 17 bp, Homo sapiens
acctcgtgctttaagtg

SEQ ID NO: 6614098 - DNA, 19 bp, Homo sapiens
acctcgtggagaattttta

SEQ ID NO: 6614099 - DNA, 15 bp, Homo sapiens
acctcgttctgctca

SEQ ID NO: 6614100 - DNA, 14 bp, Homo sapiens
acctctaaattctt

SEQ ID NO: 6614101 - DNA, 21 bp, Homo sapiens
acctctaacaccacactgacc

SEQ ID NO: 6614102 - DNA, 13 bp, Homo sapiens
acctctaactgtg

SEQ ID NO: 6614103 - DNA, 18 bp, Homo sapiens
acctctaatagaggcagt

SEQ ID NO: 6614104 - DNA, 17 bp, Homo sapiens
acctctaatagtataaa

SEQ ID NO: 6614105 - DNA, 18 bp, Homo sapiens
acctctaatttattttgt

SEQ ID NO: 6614106 - DNA, 14 bp, Homo sapiens
acctctactgtctc

SEQ ID NO: 6614107 - DNA, 14 bp, Homo sapiens
acctctactttcca

SEQ ID NO: 6614108 - DNA, 18 bp, Homo sapiens
acctctagaatcccagca

SEQ ID NO: 6614109 - DNA, 23 bp, Homo sapiens
acctctagaatcccagcagcaga

SEQ ID NO: 6614110 - DNA, 15 bp, Homo sapiens
acctctagagctgga

SEQ ID NO: 6614111 - DNA, 16 bp, Homo sapiens
acctctagccctgccc

SEQ ID NO: 6614112 - DNA, 16 bp, Homo sapiens
acctctaggcctcagt

SEQ ID NO: 6614113 - DNA, 18 bp, Homo sapiens
acctctaggcctcagtgt

SEQ ID NO: 6614114 - DNA, 16 bp, Homo sapiens
acctctagtagctgaa

SEQ ID NO: 6614115 - DNA, 21 bp, Homo sapiens
acctctagtgctactgctaga

SEQ ID NO: 6614116 - DNA, 20 bp, Homo sapiens
acctctataattgccactga

SEQ ID NO: 6614117 - DNA, 20 bp, Homo sapiens
acctctatatgttgctgaaa

SEQ ID NO: 6614118 - DNA, 22 bp, Homo sapiens
acctctatatgttgctgaaaca

SEQ ID NO: 6614119 - DNA, 22 bp, Homo sapiens
acctctattcttgggaaacacc

SEQ ID NO: 6614120 - DNA, 23 bp, Homo sapiens
acctctcaatattcaataaagct

SEQ ID NO: 6614121 - DNA, 18 bp, Homo sapiens
acctctcacgggccctgc

SEQ ID NO: 6614122 - DNA, 18 bp, Homo sapiens
acctctcagagcaagcct

SEQ ID NO: 6614123 - DNA, 20 bp, Homo sapiens
acctctcagagcaagccttt

SEQ ID NO: 6614124 - DNA, 22 bp, Homo sapiens
acctctcagagcaagcctttga

SEQ ID NO: 6614125 - DNA, 14 bp, Homo sapiens
acctctcagatccc

SEQ ID NO: 6614126 - DNA, 20 bp, Homo sapiens
acctctcagcagaaacacac

SEQ ID NO: 6614127 - DNA, 21 bp, Homo sapiens
acctctcagcccctcagagaa

SEQ ID NO: 6614128 - DNA, 14 bp, Homo sapiens
acctctcagggcct

SEQ ID NO: 6614129 - DNA, 21 bp, Homo sapiens
acctctcagggcctggcaggc

SEQ ID NO: 6614130 - DNA, 14 bp, Homo sapiens
acctctcatgcgtg

SEQ ID NO: 6614131 - DNA, 17 bp, Homo sapiens
acctctcattagaaagg

SEQ ID NO: 6614132 - DNA, 20 bp, Homo sapiens
acctctccaagggcttctgc

SEQ ID NO: 6614133 - DNA, 18 bp, Homo sapiens
acctctccaagtctctct

SEQ ID NO: 6614134 - DNA, 22 bp, Homo sapiens
acctctccaagtctctctgtga

SEQ ID NO: 6614135 - DNA, 23 bp, Homo sapiens
acctctccaagtctctctgtgaa

SEQ ID NO: 6614136 - DNA, 24 bp, Homo sapiens
acctctccagcatcccagcctcag

SEQ ID NO: 6614137 - DNA, 18 bp, Homo sapiens
acctctccagcctcagct

SEQ ID NO: 6614138 - DNA, 22 bp, Homo sapiens
acctctccagcctcagctctca

SEQ ID NO: 6614139 - DNA, 22 bp, Homo sapiens
acctctccagctctggcttcct

SEQ ID NO: 6614140 - DNA, 12 bp, Homo sapiens
acctctccaggt

SEQ ID NO: 6614141 - DNA, 15 bp, Homo sapiens
acctctccatcttca

SEQ ID NO: 6614142 - DNA, 20 bp, Homo sapiens
acctctccatcttcagcttc

SEQ ID NO: 6614143 - DNA, 12 bp, Homo sapiens
acctctcccacg

SEQ ID NO: 6614144 - DNA, 15 bp, Homo sapiens
acctctcccacggga

SEQ ID NO: 6614145 - DNA, 15 bp, Homo sapiens
acctctcccagccct

SEQ ID NO: 6614146 - DNA, 20 bp, Homo sapiens
acctctcccagccctcagca

SEQ ID NO: 6614147 - DNA, 21 bp, Homo sapiens
acctctcccctggaactgtct

SEQ ID NO: 6614148 - DNA, 15 bp, Homo sapiens
acctctccctcaaca

SEQ ID NO: 6614149 - DNA, 22 bp, Homo sapiens
acctctccctgaccctgtatat

SEQ ID NO: 6614150 - DNA, 18 bp, Homo sapiens
acctctccggcctggcct

SEQ ID NO: 6614151 - DNA, 15 bp, Homo sapiens
acctctcctgacccc

SEQ ID NO: 6614152 - DNA, 17 bp, Homo sapiens
acctctcctgacccctg

SEQ ID NO: 6614153 - DNA, 13 bp, Homo sapiens
acctctccttgga

SEQ ID NO: 6614154 - DNA, 22 bp, Homo sapiens
acctctcgcaagagggtctctt

SEQ ID NO: 6614155 - DNA, 23 bp, Homo sapiens
acctctcgcaagagggtctcttt

SEQ ID NO: 6614156 - DNA, 21 bp, Homo sapiens
acctctcgccatgatcagaca

SEQ ID NO: 6614157 - DNA, 23 bp, Homo sapiens
acctctcgcttcctcagcctcca

SEQ ID NO: 6614158 - DNA, 16 bp, Homo sapiens
acctctcgtttctgcc

SEQ ID NO: 6614159 - DNA, 15 bp, Homo sapiens
acctctctaagccac

SEQ ID NO: 6614160 - DNA, 20 bp, Homo sapiens
acctctctaagccacagctt

SEQ ID NO: 6614161 - DNA, 17 bp, Homo sapiens
acctctctacttcccct

SEQ ID NO: 6614162 - DNA, 13 bp, Homo sapiens
acctctctcagag

SEQ ID NO: 6614163 - DNA, 14 bp, Homo sapiens
acctctctcctctc

SEQ ID NO: 6614164 - DNA, 12 bp, Homo sapiens
acctctctcctt

SEQ ID NO: 6614165 - DNA, 23 bp, Homo sapiens
acctctctcctttgctgaggcct

SEQ ID NO: 6614166 - DNA, 13 bp, Homo sapiens
acctctctctggg

SEQ ID NO: 6614167 - DNA, 18 bp, Homo sapiens
acctctctgcctctcttc

SEQ ID NO: 6614168 - DNA, 19 bp, Homo sapiens
acctctctgtagtttatgg

SEQ ID NO: 6614169 - DNA, 14 bp, Homo sapiens
acctctctgtcatg

SEQ ID NO: 6614170 - DNA, 12 bp, Homo sapiens
acctctctgtcc

SEQ ID NO: 6614171 - DNA, 16 bp, Homo sapiens
acctctctgtcccttg

SEQ ID NO: 6614172 - DNA, 13 bp, Homo sapiens
acctctctgtctt

SEQ ID NO: 6614173 - DNA, 22 bp, Homo sapiens
acctctcttatagaatatttat

SEQ ID NO: 6614174 - DNA, 14 bp, Homo sapiens
acctctcttcagcc

SEQ ID NO: 6614175 - DNA, 14 bp, Homo sapiens
acctctctttctca

SEQ ID NO: 6614176 - DNA, 20 bp, Homo sapiens
acctctcttttcctctctgt

SEQ ID NO: 6614177 - DNA, 23 bp, Homo sapiens
acctctcttttcctctctgtctg

SEQ ID NO: 6614178 - DNA, 20 bp, Homo sapiens
acctctgaaaacggccctct

SEQ ID NO: 6614179 - DNA, 17 bp, Homo sapiens
acctctgaagagctgag

SEQ ID NO: 6614180 - DNA, 15 bp, Homo sapiens
acctctgaagtctct

SEQ ID NO: 6614181 - DNA, 15 bp, Homo sapiens
acctctgaatgtccc

SEQ ID NO: 6614182 - DNA, 18 bp, Homo sapiens
acctctgaatgtcccaga

SEQ ID NO: 6614183 - DNA, 14 bp, Homo sapiens
acctctgacagcag

SEQ ID NO: 6614184 - DNA, 17 bp, Homo sapiens
acctctgacagcagcat

SEQ ID NO: 6614185 - DNA, 12 bp, Homo sapiens
acctctgatccc

SEQ ID NO: 6614186 - DNA, 17 bp, Homo sapiens
acctctgatttattttg

SEQ ID NO: 6614187 - DNA, 18 bp, Homo sapiens
acctctgatttattttgt

SEQ ID NO: 6614188 - DNA, 12 bp, Homo sapiens
acctctgcacaa

SEQ ID NO: 6614189 - DNA, 21 bp, Homo sapiens
acctctgcacaagctgcaccc

SEQ ID NO: 6614190 - DNA, 21 bp, Homo sapiens
acctctgcactactgacatgt

SEQ ID NO: 6614191 - DNA, 20 bp, Homo sapiens
acctctgcagcaataaagca

SEQ ID NO: 6614192 - DNA, 12 bp, Homo sapiens
acctctgccaga

SEQ ID NO: 6614193 - DNA, 20 bp, Homo sapiens
acctctgccccccaagttca

SEQ ID NO: 6614194 - DNA, 21 bp, Homo sapiens
acctctgccccttgggcctcc

SEQ ID NO: 6614195 - DNA, 14 bp, Homo sapiens
acctctgcccttcc

SEQ ID NO: 6614196 - DNA, 15 bp, Homo sapiens
acctctgcccttccc

SEQ ID NO: 6614197 - DNA, 18 bp, Homo sapiens
acctctgcccttcccctc

SEQ ID NO: 6614198 - DNA, 11 bp, Homo sapiens
acctctgcctc

SEQ ID NO: 6614199 - DNA, 12 bp, Homo sapiens
acctctgcctca

SEQ ID NO: 6614200 - DNA, 14 bp, Homo sapiens
acctctgcctcaat

SEQ ID NO: 6614201 - DNA, 17 bp, Homo sapiens
acctctgcctcagaaaa

SEQ ID NO: 6614202 - DNA, 12 bp, Homo sapiens
acctctgcctcc

SEQ ID NO: 6614203 - DNA, 18 bp, Homo sapiens
acctctgcctcccaggtt

SEQ ID NO: 6614204 - DNA, 14 bp, Homo sapiens
acctctgcctcctg

SEQ ID NO: 6614205 - DNA, 20 bp, Homo sapiens
acctctgcctcctgggttca

SEQ ID NO: 6614206 - DNA, 23 bp, Homo sapiens
acctctgcctgaagtcacacagt

SEQ ID NO: 6614207 - DNA, 19 bp, Homo sapiens
acctctgcctttgtggtga

SEQ ID NO: 6614208 - DNA, 17 bp, Homo sapiens
acctctgcggaccccag

SEQ ID NO: 6614209 - DNA, 19 bp, Homo sapiens
acctctgctgagtgctggg

SEQ ID NO: 6614210 - DNA, 22 bp, Homo sapiens
acctctgctgcccacggccacc

SEQ ID NO: 6614211 - DNA, 15 bp, Homo sapiens
acctctgctgcctcc

SEQ ID NO: 6614212 - DNA, 15 bp, Homo sapiens
acctctgcttctgac

SEQ ID NO: 6614213 - DNA, 13 bp, Homo sapiens
acctctggagtgc

SEQ ID NO: 6614214 - DNA, 17 bp, Homo sapiens
acctctggatccctgga

SEQ ID NO: 6614215 - DNA, 14 bp, Homo sapiens
acctctggcccttg

SEQ ID NO: 6614216 - DNA, 15 bp, Homo sapiens
acctctggcccttgg

SEQ ID NO: 6614217 - DNA, 14 bp, Homo sapiens
acctctggctagag

SEQ ID NO: 6614218 - DNA, 18 bp, Homo sapiens
acctctggctagagccga

SEQ ID NO: 6614219 - DNA, 20 bp, Homo sapiens
acctctggctagagccgagg

SEQ ID NO: 6614220 - DNA, 16 bp, Homo sapiens
acctctggctccttca

SEQ ID NO: 6614221 - DNA, 23 bp, Homo sapiens
acctctggctccttcagcagcta

SEQ ID NO: 6614222 - DNA, 18 bp, Homo sapiens
acctctgggaccccagct

SEQ ID NO: 6614223 - DNA, 20 bp, Homo sapiens
acctctgggaccccagctgc

SEQ ID NO: 6614224 - DNA, 16 bp, Homo sapiens
acctctgggccctgca

SEQ ID NO: 6614225 - DNA, 19 bp, Homo sapiens
acctctgggccctgcagga

SEQ ID NO: 6614226 - DNA, 12 bp, Homo sapiens
acctctgggctt

SEQ ID NO: 6614227 - DNA, 22 bp, Homo sapiens
acctctggggggataatgtccc

SEQ ID NO: 6614228 - DNA, 17 bp, Homo sapiens
acctctggtccacacta

SEQ ID NO: 6614229 - DNA, 19 bp, Homo sapiens
acctctggtccacactaga

SEQ ID NO: 6614230 - DNA, 21 bp, Homo sapiens
acctctgtaggcagcagagag

SEQ ID NO: 6614231 - DNA, 17 bp, Homo sapiens
acctctgtatagaaatc

SEQ ID NO: 6614232 - DNA, 22 bp, Homo sapiens
acctctgtatttgaatcagcct

SEQ ID NO: 6614233 - DNA, 15 bp, Homo sapiens
acctctgtcatttgt

SEQ ID NO: 6614234 - DNA, 13 bp, Homo sapiens
acctctgtctcat

SEQ ID NO: 6614235 - DNA, 15 bp, Homo sapiens
acctctgtctcatcc

SEQ ID NO: 6614236 - DNA, 20 bp, Homo sapiens
acctctgtctcatcctcctg

SEQ ID NO: 6614237 - DNA, 23 bp, Homo sapiens
acctctgtctgagacaggtgcct

SEQ ID NO: 6614238 - DNA, 22 bp, Homo sapiens
acctctgtcttggctttcatgt

SEQ ID NO: 6614239 - DNA, 15 bp, Homo sapiens
acctctgtgaccaac

SEQ ID NO: 6614240 - DNA, 15 bp, Homo sapiens
acctctgtgaccccc

SEQ ID NO: 6614241 - DNA, 19 bp, Homo sapiens
acctctgtgacccctcctt

SEQ ID NO: 6614242 - DNA, 14 bp, Homo sapiens
acctctgtgacctc

SEQ ID NO: 6614243 - DNA, 15 bp, Homo sapiens
acctctgtgacctca

SEQ ID NO: 6614244 - DNA, 17 bp, Homo sapiens
acctctgtgacctcagg

SEQ ID NO: 6614245 - DNA, 15 bp, Homo sapiens
acctctgtgcagggc

SEQ ID NO: 6614246 - DNA, 19 bp, Homo sapiens
acctctgtgccagggcagc

SEQ ID NO: 6614247 - DNA, 18 bp, Homo sapiens
acctctgtgctgcatccc

SEQ ID NO: 6614248 - DNA, 17 bp, Homo sapiens
acctctgtggtcaccca

SEQ ID NO: 6614249 - DNA, 21 bp, Homo sapiens
acctctgtggtcacccatgca

SEQ ID NO: 6614250 - DNA, 14 bp, Homo sapiens
acctctgttcagtg

SEQ ID NO: 6614251 - DNA, 18 bp, Homo sapiens
acctctgttcagtgtaaa

SEQ ID NO: 6614252 - DNA, 23 bp, Homo sapiens
acctctgttcatttcacacagtg

SEQ ID NO: 6614253 - DNA, 19 bp, Homo sapiens
acctctgttccccacccag

SEQ ID NO: 6614254 - DNA, 14 bp, Homo sapiens
acctctgttctcat

SEQ ID NO: 6614255 - DNA, 20 bp, Homo sapiens
acctcttaacaatttctgtc

SEQ ID NO: 6614256 - DNA, 17 bp, Homo sapiens
acctcttagcttttctg

SEQ ID NO: 6614257 - DNA, 22 bp, Homo sapiens
acctcttatcactaagaaagaa

SEQ ID NO: 6614258 - DNA, 17 bp, Homo sapiens
acctcttcagaggccct

SEQ ID NO: 6614259 - DNA, 15 bp, Homo sapiens
acctcttcagctgct

SEQ ID NO: 6614260 - DNA, 16 bp, Homo sapiens
acctcttcagctgctg

SEQ ID NO: 6614261 - DNA, 15 bp, Homo sapiens
acctcttcagctggg

SEQ ID NO: 6614262 - DNA, 17 bp, Homo sapiens
acctcttcccacaagaa

SEQ ID NO: 6614263 - DNA, 14 bp, Homo sapiens
acctcttcccatga

SEQ ID NO: 6614264 - DNA, 15 bp, Homo sapiens
acctcttcccatgac

SEQ ID NO: 6614265 - DNA, 14 bp, Homo sapiens
acctcttccctctg

SEQ ID NO: 6614266 - DNA, 15 bp, Homo sapiens
acctcttccctctgg

SEQ ID NO: 6614267 - DNA, 16 bp, Homo sapiens
acctcttccctctggg

SEQ ID NO: 6614268 - DNA, 17 bp, Homo sapiens
acctcttccctctgggc

SEQ ID NO: 6614269 - DNA, 21 bp, Homo sapiens
acctcttccctctgggcctgt

SEQ ID NO: 6614270 - DNA, 19 bp, Homo sapiens
acctcttccggagatgtag

SEQ ID NO: 6614271 - DNA, 15 bp, Homo sapiens
acctcttcctcctgg

SEQ ID NO: 6614272 - DNA, 20 bp, Homo sapiens
acctcttctaccctcatcat

SEQ ID NO: 6614273 - DNA, 15 bp, Homo sapiens
acctcttctatgcaa

SEQ ID NO: 6614274 - DNA, 17 bp, Homo sapiens
acctcttctcttcctgt

SEQ ID NO: 6614275 - DNA, 21 bp, Homo sapiens
acctcttctgaagctagaaac

SEQ ID NO: 6614276 - DNA, 14 bp, Homo sapiens
acctcttctgccag

SEQ ID NO: 6614277 - DNA, 14 bp, Homo sapiens
acctcttctggctc

SEQ ID NO: 6614278 - DNA, 10 bp, Homo sapiens
acctcttgcc

SEQ ID NO: 6614279 - DNA, 11 bp, Homo sapiens
acctcttgcct

SEQ ID NO: 6614280 - DNA, 14 bp, Homo sapiens
acctcttgctgcca

SEQ ID NO: 6614281 - DNA, 16 bp, Homo sapiens
acctcttgctgtctct

SEQ ID NO: 6614282 - DNA, 15 bp, Homo sapiens
acctcttgtgcaagg

SEQ ID NO: 6614283 - DNA, 22 bp, Homo sapiens
acctctttaagtattgattctg

SEQ ID NO: 6614284 - DNA, 16 bp, Homo sapiens
acctctttccaaaggc

SEQ ID NO: 6614285 - DNA, 14 bp, Homo sapiens
acctctttccccag

SEQ ID NO: 6614286 - DNA, 17 bp, Homo sapiens
acctctttcggaaatga

SEQ ID NO: 6614287 - DNA, 14 bp, Homo sapiens
acctctttgctccc

SEQ ID NO: 6614288 - DNA, 17 bp, Homo sapiens
acctctttttcctcctg

SEQ ID NO: 6614289 - DNA, 19 bp, Homo sapiens
acctctttttcctcctgga

SEQ ID NO: 6614290 - DNA, 18 bp, Homo sapiens
acctgaaaaaaagtttac

SEQ ID NO: 6614291 - DNA, 21 bp, Homo sapiens
acctgaaaaaaagtttacaag

SEQ ID NO: 6614292 - DNA, 18 bp, Homo sapiens
acctgaaaacactgtgca

SEQ ID NO: 6614293 - DNA, 12 bp, Homo sapiens
acctgaaacact

SEQ ID NO: 6614294 - DNA, 16 bp, Homo sapiens
acctgaaacactggac

SEQ ID NO: 6614295 - DNA, 17 bp, Homo sapiens
acctgaaacactggacc

SEQ ID NO: 6614296 - DNA, 18 bp, Homo sapiens
acctgaaagagaggactg

SEQ ID NO: 6614297 - DNA, 16 bp, Homo sapiens
acctgaaagagccttc

SEQ ID NO: 6614298 - DNA, 15 bp, Homo sapiens
acctgaaagcctgtc

SEQ ID NO: 6614299 - DNA, 21 bp, Homo sapiens
acctgaaataatatatttctt

SEQ ID NO: 6614300 - DNA, 22 bp, Homo sapiens
acctgaaatatattttaaatgt

SEQ ID NO: 6614301 - DNA, 11 bp, Homo sapiens
acctgaaatgc

SEQ ID NO: 6614302 - DNA, 19 bp, Homo sapiens
acctgaaattccaaagtct

SEQ ID NO: 6614303 - DNA, 20 bp, Homo sapiens
acctgaaattccaaagtctc

SEQ ID NO: 6614304 - DNA, 16 bp, Homo sapiens
acctgaacaaaccctt

SEQ ID NO: 6614305 - DNA, 18 bp, Homo sapiens
acctgaacacttattgct

SEQ ID NO: 6614306 - DNA, 20 bp, Homo sapiens
acctgaacacttattgcttt

SEQ ID NO: 6614307 - DNA, 13 bp, Homo sapiens
acctgaaccactg

SEQ ID NO: 6614308 - DNA, 19 bp, Homo sapiens
acctgaaccactgtggcct

SEQ ID NO: 6614309 - DNA, 16 bp, Homo sapiens
acctgaaccccagagg

SEQ ID NO: 6614310 - DNA, 14 bp, Homo sapiens
acctgaacttgcct

SEQ ID NO: 6614311 - DNA, 11 bp, Homo sapiens
acctgaagaat

SEQ ID NO: 6614312 - DNA, 13 bp, Homo sapiens
acctgaagactga

SEQ ID NO: 6614313 - DNA, 16 bp, Homo sapiens
acctgaagactgagga

SEQ ID NO: 6614314 - DNA, 15 bp, Homo sapiens
acctgaagatgtctc

SEQ ID NO: 6614315 - DNA, 17 bp, Homo sapiens
acctgaagatgtctcct

SEQ ID NO: 6614316 - DNA, 16 bp, Homo sapiens
acctgaaggcagggct

SEQ ID NO: 6614317 - DNA, 18 bp, Homo sapiens
acctgaaggcagggctcc

SEQ ID NO: 6614318 - DNA, 22 bp, Homo sapiens
acctgaaggcagggctcctccc

SEQ ID NO: 6614319 - DNA, 19 bp, Homo sapiens
acctgaagggtgacatccc

SEQ ID NO: 6614320 - DNA, 20 bp, Homo sapiens
acctgaagggtgacatccca

SEQ ID NO: 6614321 - DNA, 20 bp, Homo sapiens
acctgaaggtattggcctgt

SEQ ID NO: 6614322 - DNA, 21 bp, Homo sapiens
acctgaaggtattggcctgtt

SEQ ID NO: 6614323 - DNA, 21 bp, Homo sapiens
acctgaaggtcccctggcagt

SEQ ID NO: 6614324 - DNA, 22 bp, Homo sapiens
acctgaaggtcccctggcagtg

SEQ ID NO: 6614325 - DNA, 21 bp, Homo sapiens
acctgaagtttttttgctgct

SEQ ID NO: 6614326 - DNA, 20 bp, Homo sapiens
acctgaataccacttacctc

SEQ ID NO: 6614327 - DNA, 16 bp, Homo sapiens
acctgaatcagctgga

SEQ ID NO: 6614328 - DNA, 16 bp, Homo sapiens
acctgaattaaagtct

SEQ ID NO: 6614329 - DNA, 19 bp, Homo sapiens
acctgaattaaagtctaca

SEQ ID NO: 6614330 - DNA, 13 bp, Homo sapiens
acctgaatttgta

SEQ ID NO: 6614331 - DNA, 15 bp, Homo sapiens
acctgaatttgtata

SEQ ID NO: 6614332 - DNA, 20 bp, Homo sapiens
acctgaatttgtatatgact

SEQ ID NO: 6614333 - DNA, 22 bp, Homo sapiens
acctgaatttgtatatgactgc

SEQ ID NO: 6614334 - DNA, 13 bp, Homo sapiens
acctgacaaatgg

SEQ ID NO: 6614335 - DNA, 18 bp, Homo sapiens
acctgacaacttctgaat

SEQ ID NO: 6614336 - DNA, 19 bp, Homo sapiens
acctgacaccgtccctcag

SEQ ID NO: 6614337 - DNA, 22 bp, Homo sapiens
acctgacaccgtccctcagtga

SEQ ID NO: 6614338 - DNA, 12 bp, Homo sapiens
acctgacacctg

SEQ ID NO: 6614339 - DNA, 15 bp, Homo sapiens
acctgacacctgccg

SEQ ID NO: 6614340 - DNA, 18 bp, Homo sapiens
acctgacacctgccgctg

SEQ ID NO: 6614341 - DNA, 19 bp, Homo sapiens
acctgacacctgccgctgc

SEQ ID NO: 6614342 - DNA, 16 bp, Homo sapiens
acctgacactcccttg

SEQ ID NO: 6614343 - DNA, 12 bp, Homo sapiens
acctgacagatg

SEQ ID NO: 6614344 - DNA, 22 bp, Homo sapiens
acctgacagatgtcagccgagc

SEQ ID NO: 6614345 - DNA, 18 bp, Homo sapiens
acctgacagcaaacacag

SEQ ID NO: 6614346 - DNA, 17 bp, Homo sapiens
acctgacagcccctccc

SEQ ID NO: 6614347 - DNA, 17 bp, Homo sapiens
acctgaccaacatggag

SEQ ID NO: 6614348 - DNA, 17 bp, Homo sapiens
acctgaccccattcctg

SEQ ID NO: 6614349 - DNA, 17 bp, Homo sapiens
acctgacccctgacccc

SEQ ID NO: 6614350 - DNA, 15 bp, Homo sapiens
acctgacccctgctc

SEQ ID NO: 6614351 - DNA, 16 bp, Homo sapiens
acctgacccctgctca

SEQ ID NO: 6614352 - DNA, 23 bp, Homo sapiens
acctgacccctgctcagtaaagc

SEQ ID NO: 6614353 - DNA, 18 bp, Homo sapiens
acctgaccgctgcccagg

SEQ ID NO: 6614354 - DNA, 22 bp, Homo sapiens
acctgaccgctgcccaggtggg

SEQ ID NO: 6614355 - DNA, 17 bp, Homo sapiens
acctgaccggcacctgc

SEQ ID NO: 6614356 - DNA, 23 bp, Homo sapiens
acctgacctcctttatggttaat

SEQ ID NO: 6614357 - DNA, 17 bp, Homo sapiens
acctgacctctgaagag

SEQ ID NO: 6614358 - DNA, 16 bp, Homo sapiens
acctgacctctgcaag

SEQ ID NO: 6614359 - DNA, 19 bp, Homo sapiens
acctgacctcttgctgtct

SEQ ID NO: 6614360 - DNA, 21 bp, Homo sapiens
acctgacctcttgctgtctct

SEQ ID NO: 6614361 - DNA, 19 bp, Homo sapiens
acctgacgatcttccccct

SEQ ID NO: 6614362 - DNA, 20 bp, Homo sapiens
acctgacgatcttccccctt

SEQ ID NO: 6614363 - DNA, 20 bp, Homo sapiens
acctgactaggttctgtaga

SEQ ID NO: 6614364 - DNA, 20 bp, Homo sapiens
acctgactattgaagttgca

SEQ ID NO: 6614365 - DNA, 14 bp, Homo sapiens
acctgactctgaaa

SEQ ID NO: 6614366 - DNA, 15 bp, Homo sapiens
acctgactctgaaat

SEQ ID NO: 6614367 - DNA, 20 bp, Homo sapiens
acctgactggttaacagcag

SEQ ID NO: 6614368 - DNA, 15 bp, Homo sapiens
acctgagacatatta

SEQ ID NO: 6614369 - DNA, 16 bp, Homo sapiens
acctgagaccctggga

SEQ ID NO: 6614370 - DNA, 15 bp, Homo sapiens
acctgagacctgaag

SEQ ID NO: 6614371 - DNA, 23 bp, Homo sapiens
acctgagacgggcatcgcaggag

SEQ ID NO: 6614372 - DNA, 21 bp, Homo sapiens
acctgagatactgaagtgcag

SEQ ID NO: 6614373 - DNA, 18 bp, Homo sapiens
acctgagatgctgggagg

SEQ ID NO: 6614374 - DNA, 20 bp, Homo sapiens
acctgagatgctgggagggc

SEQ ID NO: 6614375 - DNA, 16 bp, Homo sapiens
acctgagatggagctg

SEQ ID NO: 6614376 - DNA, 15 bp, Homo sapiens
acctgagatgtgtga

SEQ ID NO: 6614377 - DNA, 15 bp, Homo sapiens
acctgagatttatta

SEQ ID NO: 6614378 - DNA, 18 bp, Homo sapiens
acctgagatttattaaag

SEQ ID NO: 6614379 - DNA, 20 bp, Homo sapiens
acctgagatttattaaagaa

SEQ ID NO: 6614380 - DNA, 18 bp, Homo sapiens
acctgagcaggacctctg

SEQ ID NO: 6614381 - DNA, 14 bp, Homo sapiens
acctgagcattcag

SEQ ID NO: 6614382 - DNA, 12 bp, Homo sapiens
acctgagcccca

SEQ ID NO: 6614383 - DNA, 18 bp, Homo sapiens
acctgagcccgcagccca

SEQ ID NO: 6614384 - DNA, 23 bp, Homo sapiens
acctgagcccggatgcttctcca

SEQ ID NO: 6614385 - DNA, 17 bp, Homo sapiens
acctgagcctgccgagc

SEQ ID NO: 6614386 - DNA, 14 bp, Homo sapiens
acctgagcctggcc

SEQ ID NO: 6614387 - DNA, 18 bp, Homo sapiens
acctgagcggcaccctgg

SEQ ID NO: 6614388 - DNA, 21 bp, Homo sapiens
acctgagcggcaccctggtct

SEQ ID NO: 6614389 - DNA, 18 bp, Homo sapiens
acctgagcgggagtcagg

SEQ ID NO: 6614390 - DNA, 19 bp, Homo sapiens
acctgagctattttcctct

SEQ ID NO: 6614391 - DNA, 15 bp, Homo sapiens
acctgagctccccac

SEQ ID NO: 6614392 - DNA, 18 bp, Homo sapiens
acctgagctgccatccag

SEQ ID NO: 6614393 - DNA, 15 bp, Homo sapiens
acctgagctggccag

SEQ ID NO: 6614394 - DNA, 13 bp, Homo sapiens
acctgagctttgg

SEQ ID NO: 6614395 - DNA, 13 bp, Homo sapiens
acctgaggaagcg

SEQ ID NO: 6614396 - DNA, 17 bp, Homo sapiens
acctgaggcaggagggc

SEQ ID NO: 6614397 - DNA, 18 bp, Homo sapiens
acctgaggcaggagggca

SEQ ID NO: 6614398 - DNA, 22 bp, Homo sapiens
acctgaggcaggagggcatgtg

SEQ ID NO: 6614399 - DNA, 15 bp, Homo sapiens
acctgaggccaaata

SEQ ID NO: 6614400 - DNA, 19 bp, Homo sapiens
acctgaggcccagcagagc

SEQ ID NO: 6614401 - DNA, 21 bp, Homo sapiens
acctgaggcccagcagagccg

SEQ ID NO: 6614402 - DNA, 23 bp, Homo sapiens
acctgaggccctcactgagcctc

SEQ ID NO: 6614403 - DNA, 20 bp, Homo sapiens
acctgaggcccttctctcca

SEQ ID NO: 6614404 - DNA, 21 bp, Homo sapiens
acctgaggcccttctctccag

SEQ ID NO: 6614405 - DNA, 23 bp, Homo sapiens
acctgaggcccttctctccagcc

SEQ ID NO: 6614406 - DNA, 15 bp, Homo sapiens
acctgaggcctgaag

SEQ ID NO: 6614407 - DNA, 16 bp, Homo sapiens
acctgaggctcagccc

SEQ ID NO: 6614408 - DNA, 17 bp, Homo sapiens
acctgaggctcagccct

SEQ ID NO: 6614409 - DNA, 19 bp, Homo sapiens
acctgaggctcctgtgcta

SEQ ID NO: 6614410 - DNA, 12 bp, Homo sapiens
acctgaggctgt

SEQ ID NO: 6614411 - DNA, 12 bp, Homo sapiens
acctgagggcaa

SEQ ID NO: 6614412 - DNA, 20 bp, Homo sapiens
acctgagggggaaaaaacag

SEQ ID NO: 6614413 - DNA, 17 bp, Homo sapiens
acctgagggtctgtagg

SEQ ID NO: 6614414 - DNA, 15 bp, Homo sapiens
acctgaggtcaggag

SEQ ID NO: 6614415 - DNA, 19 bp, Homo sapiens
acctgaggtcaggagttca

SEQ ID NO: 6614416 - DNA, 23 bp, Homo sapiens
acctgaggtcgggagttggagac

SEQ ID NO: 6614417 - DNA, 19 bp, Homo sapiens
acctgaggtcgggagtttg

SEQ ID NO: 6614418 - DNA, 14 bp, Homo sapiens
acctgaggtgggcc

SEQ ID NO: 6614419 - DNA, 17 bp, Homo sapiens
acctgaggtgggcccag

SEQ ID NO: 6614420 - DNA, 19 bp, Homo sapiens
acctgaggtgggcccagga

SEQ ID NO: 6614421 - DNA, 23 bp, Homo sapiens
acctgaggtgggcccaggaccag

SEQ ID NO: 6614422 - DNA, 24 bp, Homo sapiens
acctgaggtgggcccaggaccagc

SEQ ID NO: 6614423 - DNA, 17 bp, Homo sapiens
acctgagttcccgggag

SEQ ID NO: 6614424 - DNA, 14 bp, Homo sapiens
acctgagttgaaga

SEQ ID NO: 6614425 - DNA, 15 bp, Homo sapiens
acctgataagggaga

SEQ ID NO: 6614426 - DNA, 17 bp, Homo sapiens
acctgataagggagagg

SEQ ID NO: 6614427 - DNA, 20 bp, Homo sapiens
acctgatcaatgacagagcc

SEQ ID NO: 6614428 - DNA, 14 bp, Homo sapiens
acctgatcacctct

SEQ ID NO: 6614429 - DNA, 18 bp, Homo sapiens
acctgatcactagcctgt

SEQ ID NO: 6614430 - DNA, 12 bp, Homo sapiens
acctgatcactt

SEQ ID NO: 6614431 - DNA, 15 bp, Homo sapiens
acctgatcccactcc

SEQ ID NO: 6614432 - DNA, 20 bp, Homo sapiens
acctgatcctggaggcccag

SEQ ID NO: 6614433 - DNA, 14 bp, Homo sapiens
acctgatcttacag

SEQ ID NO: 6614434 - DNA, 18 bp, Homo sapiens
acctgatgaaaataaaga

SEQ ID NO: 6614435 - DNA, 21 bp, Homo sapiens
acctgatgaaaataaagaatg

SEQ ID NO: 6614436 - DNA, 22 bp, Homo sapiens
acctgatgaaaataaagaatgg

SEQ ID NO: 6614437 - DNA, 14 bp, Homo sapiens
acctgatggagagt

SEQ ID NO: 6614438 - DNA, 21 bp, Homo sapiens
acctgatgttaaaattccatc

SEQ ID NO: 6614439 - DNA, 21 bp, Homo sapiens
acctgattgatcacacagtgt

SEQ ID NO: 6614440 - DNA, 14 bp, Homo sapiens
acctgattgtaaac

SEQ ID NO: 6614441 - DNA, 23 bp, Homo sapiens
acctgattgtattttttttttaa

SEQ ID NO: 6614442 - DNA, 15 bp, Homo sapiens
acctgattgtgtctc

SEQ ID NO: 6614443 - DNA, 18 bp, Homo sapiens
acctgattgtgtctcttg

SEQ ID NO: 6614444 - DNA, 15 bp, Homo sapiens
acctgatttacagtt

SEQ ID NO: 6614445 - DNA, 18 bp, Homo sapiens
acctgatttattgaaatt

SEQ ID NO: 6614446 - DNA, 13 bp, Homo sapiens
acctgatttcagc

SEQ ID NO: 6614447 - DNA, 15 bp, Homo sapiens
acctgatttctcctg

SEQ ID NO: 6614448 - DNA, 11 bp, Homo sapiens
acctgattttt

SEQ ID NO: 6614449 - DNA, 15 bp, Homo sapiens
acctgcaagatggac

SEQ ID NO: 6614450 - DNA, 14 bp, Homo sapiens
acctgcaagcccca

SEQ ID NO: 6614451 - DNA, 15 bp, Homo sapiens
acctgcaagccccag

SEQ ID NO: 6614452 - DNA, 18 bp, Homo sapiens
acctgcaagccccagggc

SEQ ID NO: 6614453 - DNA, 15 bp, Homo sapiens
acctgcaaggcaaag

SEQ ID NO: 6614454 - DNA, 20 bp, Homo sapiens
acctgcaagggctccccact

SEQ ID NO: 6614455 - DNA, 17 bp, Homo sapiens
acctgcaagtatccaga

SEQ ID NO: 6614456 - DNA, 21 bp, Homo sapiens
acctgcaagtgcccgccctgc

SEQ ID NO: 6614457 - DNA, 22 bp, Homo sapiens
acctgcaagtgcccgccctgcc

SEQ ID NO: 6614458 - DNA, 12 bp, Homo sapiens
acctgcaagttg

SEQ ID NO: 6614459 - DNA, 16 bp, Homo sapiens
acctgcaatcccagca

SEQ ID NO: 6614460 - DNA, 13 bp, Homo sapiens
acctgcacaaaca

SEQ ID NO: 6614461 - DNA, 17 bp, Homo sapiens
acctgcacacccctgca

SEQ ID NO: 6614462 - DNA, 18 bp, Homo sapiens
acctgcacaccgtccctc

SEQ ID NO: 6614463 - DNA, 17 bp, Homo sapiens
acctgcacactccatct

SEQ ID NO: 6614464 - DNA, 15 bp, Homo sapiens
acctgcacagggccc

SEQ ID NO: 6614465 - DNA, 20 bp, Homo sapiens
acctgcacagggccctctga

SEQ ID NO: 6614466 - DNA, 18 bp, Homo sapiens
acctgcacctccccccac

SEQ ID NO: 6614467 - DNA, 21 bp, Homo sapiens
acctgcacctccccccactgc

SEQ ID NO: 6614468 - DNA, 16 bp, Homo sapiens
acctgcacgccaccgc

SEQ ID NO: 6614469 - DNA, 19 bp, Homo sapiens
acctgcacggggcattcct

SEQ ID NO: 6614470 - DNA, 20 bp, Homo sapiens
acctgcacgtgatctgctgg

SEQ ID NO: 6614471 - DNA, 17 bp, Homo sapiens
acctgcacgttcataac

SEQ ID NO: 6614472 - DNA, 17 bp, Homo sapiens
acctgcactaacagagt

SEQ ID NO: 6614473 - DNA, 15 bp, Homo sapiens
acctgcagccccagg

SEQ ID NO: 6614474 - DNA, 18 bp, Homo sapiens
acctgcagccccaggcct

SEQ ID NO: 6614475 - DNA, 15 bp, Homo sapiens
acctgcagcccctcc

SEQ ID NO: 6614476 - DNA, 19 bp, Homo sapiens
acctgcagcccctcctcct

SEQ ID NO: 6614477 - DNA, 19 bp, Homo sapiens
acctgcagcggctgccctc

SEQ ID NO: 6614478 - DNA, 18 bp, Homo sapiens
acctgcagcgggcaaaga

SEQ ID NO: 6614479 - DNA, 13 bp, Homo sapiens
acctgcaggactc

SEQ ID NO: 6614480 - DNA, 19 bp, Homo sapiens
acctgcaggactcgggcta

SEQ ID NO: 6614481 - DNA, 17 bp, Homo sapiens
acctgcaggcggggctc

SEQ ID NO: 6614482 - DNA, 20 bp, Homo sapiens
acctgcaggcggggctcctc

SEQ ID NO: 6614483 - DNA, 22 bp, Homo sapiens
acctgcaggcggggctcctcct

SEQ ID NO: 6614484 - DNA, 23 bp, Homo sapiens
acctgcaggctgagccactctct

SEQ ID NO: 6614485 - DNA, 14 bp, Homo sapiens
acctgcagggagca

SEQ ID NO: 6614486 - DNA, 15 bp, Homo sapiens
acctgcagggagcag

SEQ ID NO: 6614487 - DNA, 18 bp, Homo sapiens
acctgcagtcagggccca

SEQ ID NO: 6614488 - DNA, 19 bp, Homo sapiens
acctgcagtgccagctccc

SEQ ID NO: 6614489 - DNA, 21 bp, Homo sapiens
acctgcagtgccagctccctc

SEQ ID NO: 6614490 - DNA, 15 bp, Homo sapiens
acctgcagttaacag

SEQ ID NO: 6614491 - DNA, 18 bp, Homo sapiens
acctgcagttaacaggat

SEQ ID NO: 6614492 - DNA, 20 bp, Homo sapiens
acctgcatcagcctctggcc

SEQ ID NO: 6614493 - DNA, 22 bp, Homo sapiens
acctgcatcagcctctggccag

SEQ ID NO: 6614494 - DNA, 15 bp, Homo sapiens
acctgcatcctctcc

SEQ ID NO: 6614495 - DNA, 19 bp, Homo sapiens
acctgcatcctctccccca

SEQ ID NO: 6614496 - DNA, 20 bp, Homo sapiens
acctgcatccttcctgggga

SEQ ID NO: 6614497 - DNA, 17 bp, Homo sapiens
acctgcatctttagtgc

SEQ ID NO: 6614498 - DNA, 18 bp, Homo sapiens
acctgcatgaaagcattc

SEQ ID NO: 6614499 - DNA, 11 bp, Homo sapiens
acctgcatgca

SEQ ID NO: 6614500 - DNA, 17 bp, Homo sapiens
acctgcatgcagcaaca

SEQ ID NO: 6614501 - DNA, 14 bp, Homo sapiens
acctgcatggtcaa

SEQ ID NO: 6614502 - DNA, 20 bp, Homo sapiens
acctgcatggtcaagcctct

SEQ ID NO: 6614503 - DNA, 19 bp, Homo sapiens
acctgcatttaagaacaga

SEQ ID NO: 6614504 - DNA, 21 bp, Homo sapiens
acctgcatttgtatgtgtccc

SEQ ID NO: 6614505 - DNA, 15 bp, Homo sapiens
acctgccaagagtca

SEQ ID NO: 6614506 - DNA, 18 bp, Homo sapiens
acctgccaaggagcatcc

SEQ ID NO: 6614507 - DNA, 23 bp, Homo sapiens
acctgccaaggagcatccttggc

SEQ ID NO: 6614508 - DNA, 14 bp, Homo sapiens
acctgccacaatgt

SEQ ID NO: 6614509 - DNA, 17 bp, Homo sapiens
acctgccaccagggagc

SEQ ID NO: 6614510 - DNA, 23 bp, Homo sapiens
acctgccaccagggagcttcctg

SEQ ID NO: 6614511 - DNA, 16 bp, Homo sapiens
acctgccacccccagg

SEQ ID NO: 6614512 - DNA, 18 bp, Homo sapiens
acctgccacccccaggtc

SEQ ID NO: 6614513 - DNA, 24 bp, Homo sapiens
acctgccacccccaggtcttcctg

SEQ ID NO: 6614514 - DNA, 22 bp, Homo sapiens
acctgccacccccttccctggg

SEQ ID NO: 6614515 - DNA, 12 bp, Homo sapiens
acctgccaccgc

SEQ ID NO: 6614516 - DNA, 14 bp, Homo sapiens
acctgccactcaca

SEQ ID NO: 6614517 - DNA, 13 bp, Homo sapiens
acctgccacttcc

SEQ ID NO: 6614518 - DNA, 13 bp, Homo sapiens
acctgccagccac

SEQ ID NO: 6614519 - DNA, 20 bp, Homo sapiens
acctgccagccactgtcacc

SEQ ID NO: 6614520 - DNA, 21 bp, Homo sapiens
acctgccagccactgtcaccg

SEQ ID NO: 6614521 - DNA, 13 bp, Homo sapiens
acctgccagccat

SEQ ID NO: 6614522 - DNA, 15 bp, Homo sapiens
acctgccagcctggc

SEQ ID NO: 6614523 - DNA, 21 bp, Homo sapiens
acctgccagcggtttcctggt

SEQ ID NO: 6614524 - DNA, 12 bp, Homo sapiens
acctgccaggaa

SEQ ID NO: 6614525 - DNA, 22 bp, Homo sapiens
acctgccaggaagccagcaggc

SEQ ID NO: 6614526 - DNA, 13 bp, Homo sapiens
acctgccaggcag

SEQ ID NO: 6614527 - DNA, 18 bp, Homo sapiens
acctgccaggcaggggtg

SEQ ID NO: 6614528 - DNA, 20 bp, Homo sapiens
acctgccaggcaggggtggg

SEQ ID NO: 6614529 - DNA, 13 bp, Homo sapiens
acctgccaggcct

SEQ ID NO: 6614530 - DNA, 19 bp, Homo sapiens
acctgccaggcctccctcg

SEQ ID NO: 6614531 - DNA, 13 bp, Homo sapiens
acctgccaggctg

SEQ ID NO: 6614532 - DNA, 18 bp, Homo sapiens
acctgccagggcccgacc

SEQ ID NO: 6614533 - DNA, 22 bp, Homo sapiens
acctgccagggcccgacctggg

SEQ ID NO: 6614534 - DNA, 14 bp, Homo sapiens
acctgccagtccca

SEQ ID NO: 6614535 - DNA, 18 bp, Homo sapiens
acctgcccagctccccaa

SEQ ID NO: 6614536 - DNA, 11 bp, Homo sapiens
acctgccccaa

SEQ ID NO: 6614537 - DNA, 19 bp, Homo sapiens
acctgccccacttgtcctt

SEQ ID NO: 6614538 - DNA, 23 bp, Homo sapiens
acctgccccacttgtccttagcc

SEQ ID NO: 6614539 - DNA, 17 bp, Homo sapiens
acctgccccagcactca

SEQ ID NO: 6614540 - DNA, 19 bp, Homo sapiens
acctgccccagcactcaca

SEQ ID NO: 6614541 - DNA, 14 bp, Homo sapiens
acctgccccagcgc

SEQ ID NO: 6614542 - DNA, 14 bp, Homo sapiens
acctgccccaggct

SEQ ID NO: 6614543 - DNA, 13 bp, Homo sapiens
acctgccccatcc

SEQ ID NO: 6614544 - DNA, 14 bp, Homo sapiens
acctgccccatccc

SEQ ID NO: 6614545 - DNA, 14 bp, Homo sapiens
acctgcccccacag

SEQ ID NO: 6614546 - DNA, 16 bp, Homo sapiens
acctgcccccacagct

SEQ ID NO: 6614547 - DNA, 22 bp, Homo sapiens
acctgcccccacagctccttgc

SEQ ID NO: 6614548 - DNA, 23 bp, Homo sapiens
acctgcccccacagctccttgca

SEQ ID NO: 6614549 - DNA, 23 bp, Homo sapiens
acctgcccccgcatcccctgcct

SEQ ID NO: 6614550 - DNA, 19 bp, Homo sapiens
acctgcccccgctctgcca

SEQ ID NO: 6614551 - DNA, 15 bp, Homo sapiens
acctgccccctggtg

SEQ ID NO: 6614552 - DNA, 12 bp, Homo sapiens
acctgccccctt

SEQ ID NO: 6614553 - DNA, 18 bp, Homo sapiens
acctgcccccttctccca

SEQ ID NO: 6614554 - DNA, 20 bp, Homo sapiens
acctgccccgtagagaatgt

SEQ ID NO: 6614555 - DNA, 12 bp, Homo sapiens
acctgcccctca

SEQ ID NO: 6614556 - DNA, 15 bp, Homo sapiens
acctgcccctcaact

SEQ ID NO: 6614557 - DNA, 23 bp, Homo sapiens
acctgcccctcaactctcctcca

SEQ ID NO: 6614558 - DNA, 16 bp, Homo sapiens
acctgcccctccctct

SEQ ID NO: 6614559 - DNA, 22 bp, Homo sapiens
acctgcccctcctctctgccct

SEQ ID NO: 6614560 - DNA, 22 bp, Homo sapiens
acctgcccctctgttctctccc

SEQ ID NO: 6614561 - DNA, 23 bp, Homo sapiens
acctgcccctctgttctctcccc

SEQ ID NO: 6614562 - DNA, 17 bp, Homo sapiens
acctgcccggcccagga

SEQ ID NO: 6614563 - DNA, 17 bp, Homo sapiens
acctgccctaaaccctg

SEQ ID NO: 6614564 - DNA, 19 bp, Homo sapiens
acctgccctacatatctaa

SEQ ID NO: 6614565 - DNA, 18 bp, Homo sapiens
acctgccctacctgcccc

SEQ ID NO: 6614566 - DNA, 19 bp, Homo sapiens
acctgccctacctgcccca

SEQ ID NO: 6614567 - DNA, 17 bp, Homo sapiens
acctgccctcaagggtg

SEQ ID NO: 6614568 - DNA, 15 bp, Homo sapiens
acctgccctccctca

SEQ ID NO: 6614569 - DNA, 18 bp, Homo sapiens
acctgccctctatttatt

SEQ ID NO: 6614570 - DNA, 21 bp, Homo sapiens
acctgccctctatttattagc

SEQ ID NO: 6614571 - DNA, 13 bp, Homo sapiens
acctgccctctct

SEQ ID NO: 6614572 - DNA, 15 bp, Homo sapiens
acctgccctctctca

SEQ ID NO: 6614573 - DNA, 16 bp, Homo sapiens
acctgccctctctcag

SEQ ID NO: 6614574 - DNA, 14 bp, Homo sapiens
acctgccctctctg

SEQ ID NO: 6614575 - DNA, 15 bp, Homo sapiens
acctgccctctctgc

SEQ ID NO: 6614576 - DNA, 19 bp, Homo sapiens
acctgccctggccccagcc

SEQ ID NO: 6614577 - DNA, 18 bp, Homo sapiens
acctgcccttttttctgc

SEQ ID NO: 6614578 - DNA, 23 bp, Homo sapiens
acctgcccttttttctgcctcct

SEQ ID NO: 6614579 - DNA, 12 bp, Homo sapiens
acctgccgacct

SEQ ID NO: 6614580 - DNA, 20 bp, Homo sapiens
acctgccgacctcgtcctcc

SEQ ID NO: 6614581 - DNA, 23 bp, Homo sapiens
acctgccgagagtccatcagcct

SEQ ID NO: 6614582 - DNA, 18 bp, Homo sapiens
acctgccgccctgtggga

SEQ ID NO: 6614583 - DNA, 14 bp, Homo sapiens
acctgccgcctggg

SEQ ID NO: 6614584 - DNA, 18 bp, Homo sapiens
acctgccggctctgggct

SEQ ID NO: 6614585 - DNA, 23 bp, Homo sapiens
acctgccggctctgggctggctg

SEQ ID NO: 6614586 - DNA, 21 bp, Homo sapiens
acctgccgtaagttactggct

SEQ ID NO: 6614587 - DNA, 22 bp, Homo sapiens
acctgcctaaaatatgatgttt

SEQ ID NO: 6614588 - DNA, 22 bp, Homo sapiens
acctgcctaaattaaattgggc

SEQ ID NO: 6614589 - DNA, 19 bp, Homo sapiens
acctgcctagcatggggtc

SEQ ID NO: 6614590 - DNA, 17 bp, Homo sapiens
acctgcctagctcttgg

SEQ ID NO: 6614591 - DNA, 21 bp, Homo sapiens
acctgcctagctcttgggcct

SEQ ID NO: 6614592 - DNA, 18 bp, Homo sapiens
acctgcctcagctaccta

SEQ ID NO: 6614593 - DNA, 13 bp, Homo sapiens
acctgcctcagga

SEQ ID NO: 6614594 - DNA, 16 bp, Homo sapiens
acctgcctccaccagc

SEQ ID NO: 6614595 - DNA, 16 bp, Homo sapiens
acctgcctccagccgc

SEQ ID NO: 6614596 - DNA, 22 bp, Homo sapiens
acctgcctccccggaagtgcct

SEQ ID NO: 6614597 - DNA, 14 bp, Homo sapiens
acctgcctcctgcc

SEQ ID NO: 6614598 - DNA, 17 bp, Homo sapiens
acctgcctcctgcctgc

SEQ ID NO: 6614599 - DNA, 19 bp, Homo sapiens
acctgcctctcacacacat

SEQ ID NO: 6614600 - DNA, 22 bp, Homo sapiens
acctgcctctcacacacataga

SEQ ID NO: 6614601 - DNA, 23 bp, Homo sapiens
acctgcctctcacacacatagat

SEQ ID NO: 6614602 - DNA, 21 bp, Homo sapiens
acctgcctctgaactgctgct

SEQ ID NO: 6614603 - DNA, 21 bp, Homo sapiens
acctgcctgacatttggagtg

SEQ ID NO: 6614604 - DNA, 21 bp, Homo sapiens
acctgcctgccgctgcaggaa

SEQ ID NO: 6614605 - DNA, 11 bp, Homo sapiens
acctgcctgcg

SEQ ID NO: 6614606 - DNA, 15 bp, Homo sapiens
acctgcctgctgcag

SEQ ID NO: 6614607 - DNA, 14 bp, Homo sapiens
acctgcctggccgg

SEQ ID NO: 6614608 - DNA, 17 bp, Homo sapiens
acctgcctggccggcca

SEQ ID NO: 6614609 - DNA, 18 bp, Homo sapiens
acctgcctggccggccag

SEQ ID NO: 6614610 - DNA, 20 bp, Homo sapiens
acctgcctggccggccagcc

SEQ ID NO: 6614611 - DNA, 16 bp, Homo sapiens
acctgcctgggacagc

SEQ ID NO: 6614612 - DNA, 20 bp, Homo sapiens
acctgcctggtgcattgctg

SEQ ID NO: 6614613 - DNA, 13 bp, Homo sapiens
acctgcctgtacc

SEQ ID NO: 6614614 - DNA, 14 bp, Homo sapiens
acctgcctgtagcc

SEQ ID NO: 6614615 - DNA, 19 bp, Homo sapiens
acctgcctttgtatgtgga

SEQ ID NO: 6614616 - DNA, 21 bp, Homo sapiens
acctgcgagggccgcccgctc

SEQ ID NO: 6614617 - DNA, 23 bp, Homo sapiens
acctgcgcaaagggcgggcctgt

SEQ ID NO: 6614618 - DNA, 16 bp, Homo sapiens
acctgcgcaagtgcct

SEQ ID NO: 6614619 - DNA, 18 bp, Homo sapiens
acctgcgcaagtgcctgg

SEQ ID NO: 6614620 - DNA, 17 bp, Homo sapiens
acctgcgcacaggtggg

SEQ ID NO: 6614621 - DNA, 19 bp, Homo sapiens
acctgcgcagggccctctg

SEQ ID NO: 6614622 - DNA, 23 bp, Homo sapiens
acctgcgcagggccctctggggc

SEQ ID NO: 6614623 - DNA, 14 bp, Homo sapiens
acctgcgcctggct

SEQ ID NO: 6614624 - DNA, 17 bp, Homo sapiens
acctgcgcttctgctgg

SEQ ID NO: 6614625 - DNA, 18 bp, Homo sapiens
acctgcgcttctgctgga

SEQ ID NO: 6614626 - DNA, 17 bp, Homo sapiens
acctgcggccgcccccc

SEQ ID NO: 6614627 - DNA, 18 bp, Homo sapiens
acctgcgggtcctcagct

SEQ ID NO: 6614628 - DNA, 20 bp, Homo sapiens
acctgcgggtcctcagctgc

SEQ ID NO: 6614629 - DNA, 21 bp, Homo sapiens
acctgcgtctcatactcacct

SEQ ID NO: 6614630 - DNA, 16 bp, Homo sapiens
acctgctagaacctct

SEQ ID NO: 6614631 - DNA, 21 bp, Homo sapiens
acctgctaggccagagcccac

SEQ ID NO: 6614632 - DNA, 15 bp, Homo sapiens
acctgctatcagcag

SEQ ID NO: 6614633 - DNA, 20 bp, Homo sapiens
acctgctcacgtcaaatgca

SEQ ID NO: 6614634 - DNA, 17 bp, Homo sapiens
acctgctcactgttcta

SEQ ID NO: 6614635 - DNA, 11 bp, Homo sapiens
acctgctcagg

SEQ ID NO: 6614636 - DNA, 13 bp, Homo sapiens
acctgctcaggcg

SEQ ID NO: 6614637 - DNA, 17 bp, Homo sapiens
acctgctccagaagatg

SEQ ID NO: 6614638 - DNA, 22 bp, Homo sapiens
acctgctccagaagatgccagc

SEQ ID NO: 6614639 - DNA, 23 bp, Homo sapiens
acctgctccagaagatgccagct

SEQ ID NO: 6614640 - DNA, 12 bp, Homo sapiens
acctgctcccac

SEQ ID NO: 6614641 - DNA, 13 bp, Homo sapiens
acctgctcccaca

SEQ ID NO: 6614642 - DNA, 13 bp, Homo sapiens
acctgctcccagg

SEQ ID NO: 6614643 - DNA, 14 bp, Homo sapiens
acctgctcccaggc

SEQ ID NO: 6614644 - DNA, 18 bp, Homo sapiens
acctgctccgccaggaaa

SEQ ID NO: 6614645 - DNA, 16 bp, Homo sapiens
acctgctccgctgctc

SEQ ID NO: 6614646 - DNA, 14 bp, Homo sapiens
acctgctcctgccc

SEQ ID NO: 6614647 - DNA, 16 bp, Homo sapiens
acctgctcctgcccac

SEQ ID NO: 6614648 - DNA, 22 bp, Homo sapiens
acctgctctccggcgcagacag

SEQ ID NO: 6614649 - DNA, 14 bp, Homo sapiens
acctgctctcctct

SEQ ID NO: 6614650 - DNA, 17 bp, Homo sapiens
acctgctctcctcttct

SEQ ID NO: 6614651 - DNA, 16 bp, Homo sapiens
acctgctctcttgtaa

SEQ ID NO: 6614652 - DNA, 12 bp, Homo sapiens
acctgctctgct

SEQ ID NO: 6614653 - DNA, 13 bp, Homo sapiens
acctgctctgctg

SEQ ID NO: 6614654 - DNA, 13 bp, Homo sapiens
acctgctctgtcc

SEQ ID NO: 6614655 - DNA, 22 bp, Homo sapiens
acctgctgaattgtttataatg

SEQ ID NO: 6614656 - DNA, 22 bp, Homo sapiens
acctgctgagagacccaaggag

SEQ ID NO: 6614657 - DNA, 14 bp, Homo sapiens
acctgctgagctct

SEQ ID NO: 6614658 - DNA, 17 bp, Homo sapiens
acctgctgagctctgag

SEQ ID NO: 6614659 - DNA, 23 bp, Homo sapiens
acctgctgagggaccagccaaga

SEQ ID NO: 6614660 - DNA, 21 bp, Homo sapiens
acctgctgagggggctctttc

SEQ ID NO: 6614661 - DNA, 19 bp, Homo sapiens
acctgctgcccgtgaggag

SEQ ID NO: 6614662 - DNA, 12 bp, Homo sapiens
acctgctgcgct

SEQ ID NO: 6614663 - DNA, 14 bp, Homo sapiens
acctgctgcgtccc

SEQ ID NO: 6614664 - DNA, 19 bp, Homo sapiens
acctgctgcgtccccactc

SEQ ID NO: 6614665 - DNA, 10 bp, Homo sapiens
acctgctgct

SEQ ID NO: 6614666 - DNA, 16 bp, Homo sapiens
acctgctgctccatgg

SEQ ID NO: 6614667 - DNA, 14 bp, Homo sapiens
acctgctggacagc

SEQ ID NO: 6614668 - DNA, 17 bp, Homo sapiens
acctgctggcccctcac

SEQ ID NO: 6614669 - DNA, 21 bp, Homo sapiens
acctgctggttgttgccaggt

SEQ ID NO: 6614670 - DNA, 20 bp, Homo sapiens
acctgctgtgcaccttacat

SEQ ID NO: 6614671 - DNA, 23 bp, Homo sapiens
acctgctgtgcaccttacattcc

SEQ ID NO: 6614672 - DNA, 12 bp, Homo sapiens
acctgctgtgga

SEQ ID NO: 6614673 - DNA, 20 bp, Homo sapiens
acctgctgtggatgtcccta

SEQ ID NO: 6614674 - DNA, 21 bp, Homo sapiens
acctgcttccccaaaggccaa

SEQ ID NO: 6614675 - DNA, 14 bp, Homo sapiens
acctgcttccccca

SEQ ID NO: 6614676 - DNA, 20 bp, Homo sapiens
acctgcttcctgaaataaac

SEQ ID NO: 6614677 - DNA, 17 bp, Homo sapiens
acctgcttcctggctca

SEQ ID NO: 6614678 - DNA, 15 bp, Homo sapiens
acctgcttctgaact

SEQ ID NO: 6614679 - DNA, 23 bp, Homo sapiens
acctgcttctgaactcaagctgc

SEQ ID NO: 6614680 - DNA, 23 bp, Homo sapiens
acctgcttgagctttctgtgcat

SEQ ID NO: 6614681 - DNA, 24 bp, Homo sapiens
acctgcttgagctttctgtgcatg

SEQ ID NO: 6614682 - DNA, 18 bp, Homo sapiens
acctgcttgggtggagaa

SEQ ID NO: 6614683 - DNA, 21 bp, Homo sapiens
acctgcttgggtggagaagcc

SEQ ID NO: 6614684 - DNA, 15 bp, Homo sapiens
acctgcttggtcttt

SEQ ID NO: 6614685 - DNA, 23 bp, Homo sapiens
acctgcttggtgtgtaggttccg

SEQ ID NO: 6614686 - DNA, 21 bp, Homo sapiens
acctgcttgtgttgggcccca

SEQ ID NO: 6614687 - DNA, 22 bp, Homo sapiens
acctgcttgtgttgggccccag

SEQ ID NO: 6614688 - DNA, 15 bp, Homo sapiens
acctgctttcaagac

SEQ ID NO: 6614689 - DNA, 15 bp, Homo sapiens
acctgctttgactga

SEQ ID NO: 6614690 - DNA, 19 bp, Homo sapiens
acctgcttttcaatgtgtt

SEQ ID NO: 6614691 - DNA, 18 bp, Homo sapiens
acctgctttttgaaatga

SEQ ID NO: 6614692 - DNA, 23 bp, Homo sapiens
acctgctttttgaaatgaaattt

SEQ ID NO: 6614693 - DNA, 14 bp, Homo sapiens
acctggaaaaacat

SEQ ID NO: 6614694 - DNA, 17 bp, Homo sapiens
acctggaaaaattccag

SEQ ID NO: 6614695 - DNA, 18 bp, Homo sapiens
acctggaaacagaccaat

SEQ ID NO: 6614696 - DNA, 16 bp, Homo sapiens
acctggaaagccaggt

SEQ ID NO: 6614697 - DNA, 14 bp, Homo sapiens
acctggaaatgatg

SEQ ID NO: 6614698 - DNA, 15 bp, Homo sapiens
acctggaaatgatgt

SEQ ID NO: 6614699 - DNA, 17 bp, Homo sapiens
acctggaacacctgatg

SEQ ID NO: 6614700 - DNA, 16 bp, Homo sapiens
acctggaacatctcac

SEQ ID NO: 6614701 - DNA, 19 bp, Homo sapiens
acctggaaccagagccaca

SEQ ID NO: 6614702 - DNA, 23 bp, Homo sapiens
acctggaagaacaggcctctcca

SEQ ID NO: 6614703 - DNA, 18 bp, Homo sapiens
acctggaagagctgggta

SEQ ID NO: 6614704 - DNA, 18 bp, Homo sapiens
acctggaagcatttgttt

SEQ ID NO: 6614705 - DNA, 23 bp, Homo sapiens
acctggaagcatttgtttctact

SEQ ID NO: 6614706 - DNA, 18 bp, Homo sapiens
acctggaaggcccagcac

SEQ ID NO: 6614707 - DNA, 19 bp, Homo sapiens
acctggaaggcccagcacc

SEQ ID NO: 6614708 - DNA, 17 bp, Homo sapiens
acctggaatatataacc

SEQ ID NO: 6614709 - DNA, 20 bp, Homo sapiens
acctggaatctacaagccaa

SEQ ID NO: 6614710 - DNA, 14 bp, Homo sapiens
acctggacacacac

SEQ ID NO: 6614711 - DNA, 15 bp, Homo sapiens
acctggacacacact

SEQ ID NO: 6614712 - DNA, 14 bp, Homo sapiens
acctggacacaggc

SEQ ID NO: 6614713 - DNA, 18 bp, Homo sapiens
acctggaccccagccttg

SEQ ID NO: 6614714 - DNA, 15 bp, Homo sapiens
acctggacccctgca

SEQ ID NO: 6614715 - DNA, 16 bp, Homo sapiens
acctggacccctgcat

SEQ ID NO: 6614716 - DNA, 20 bp, Homo sapiens
acctggacccctgcattgga

SEQ ID NO: 6614717 - DNA, 21 bp, Homo sapiens
acctggacccctgcattggaa

SEQ ID NO: 6614718 - DNA, 15 bp, Homo sapiens
acctggacctggaac

SEQ ID NO: 6614719 - DNA, 22 bp, Homo sapiens
acctggactgagccaaggaggc

SEQ ID NO: 6614720 - DNA, 14 bp, Homo sapiens
acctggacttcctg

SEQ ID NO: 6614721 - DNA, 23 bp, Homo sapiens
acctggagaactagaacctggag

SEQ ID NO: 6614722 - DNA, 20 bp, Homo sapiens
acctggagagccagaacctg

SEQ ID NO: 6614723 - DNA, 23 bp, Homo sapiens
acctggagagccagaacctggag

SEQ ID NO: 6614724 - DNA, 20 bp, Homo sapiens
acctggagagctagaacctg

SEQ ID NO: 6614725 - DNA, 22 bp, Homo sapiens
acctggagagctagaacctgga

SEQ ID NO: 6614726 - DNA, 18 bp, Homo sapiens
acctggagcagaggaggg

SEQ ID NO: 6614727 - DNA, 14 bp, Homo sapiens
acctggagcccctg

SEQ ID NO: 6614728 - DNA, 18 bp, Homo sapiens
acctggagcccctgggtg

SEQ ID NO: 6614729 - DNA, 13 bp, Homo sapiens
acctggagcccgc

SEQ ID NO: 6614730 - DNA, 14 bp, Homo sapiens
acctggagcccgct

SEQ ID NO: 6614731 - DNA, 22 bp, Homo sapiens
acctggagcccgcttcaagctc

SEQ ID NO: 6614732 - DNA, 23 bp, Homo sapiens
acctggagcccgcttcaagctct

SEQ ID NO: 6614733 - DNA, 13 bp, Homo sapiens
acctggagctgag

SEQ ID NO: 6614734 - DNA, 13 bp, Homo sapiens
acctggagctgcc

SEQ ID NO: 6614735 - DNA, 20 bp, Homo sapiens
acctggagcttcagccaggt

SEQ ID NO: 6614736 - DNA, 19 bp, Homo sapiens
acctggaggcaagagggag

SEQ ID NO: 6614737 - DNA, 21 bp, Homo sapiens
acctggaggcaagagggaggg

SEQ ID NO: 6614738 - DNA, 12 bp, Homo sapiens
acctggaggctg

SEQ ID NO: 6614739 - DNA, 13 bp, Homo sapiens
acctggaggctgg

SEQ ID NO: 6614740 - DNA, 22 bp, Homo sapiens
acctggaggctggaccaactgc

SEQ ID NO: 6614741 - DNA, 10 bp, Homo sapiens
acctggaggg

SEQ ID NO: 6614742 - DNA, 14 bp, Homo sapiens
acctggagggaaga

SEQ ID NO: 6614743 - DNA, 16 bp, Homo sapiens
acctggagggaagagt

SEQ ID NO: 6614744 - DNA, 21 bp, Homo sapiens
acctggagggctagaacctag

SEQ ID NO: 6614745 - DNA, 22 bp, Homo sapiens
acctggagggctagaacctgga

SEQ ID NO: 6614746 - DNA, 22 bp, Homo sapiens
acctggagggctagaacctggc

SEQ ID NO: 6614747 - DNA, 14 bp, Homo sapiens
acctggaggggaga

SEQ ID NO: 6614748 - DNA, 21 bp, Homo sapiens
acctggaggggagaggtcagc

SEQ ID NO: 6614749 - DNA, 24 bp, Homo sapiens
acctggagggttgatatattcttt

SEQ ID NO: 6614750 - DNA, 18 bp, Homo sapiens
acctggatagttaagggc

SEQ ID NO: 6614751 - DNA, 20 bp, Homo sapiens
acctggatatccatgagctg

SEQ ID NO: 6614752 - DNA, 21 bp, Homo sapiens
acctggatccagccattcctg

SEQ ID NO: 6614753 - DNA, 17 bp, Homo sapiens
acctggatggatctgct

SEQ ID NO: 6614754 - DNA, 20 bp, Homo sapiens
acctggatggatctgctcca

SEQ ID NO: 6614755 - DNA, 14 bp, Homo sapiens
acctggatggggca

SEQ ID NO: 6614756 - DNA, 22 bp, Homo sapiens
acctggattgtgcctaatgtgt

SEQ ID NO: 6614757 - DNA, 16 bp, Homo sapiens
acctggcaaaggaccc

SEQ ID NO: 6614758 - DNA, 18 bp, Homo sapiens
acctggcactgctgtgct

SEQ ID NO: 6614759 - DNA, 14 bp, Homo sapiens
acctggcactggga

SEQ ID NO: 6614760 - DNA, 16 bp, Homo sapiens
acctggcactgggagg

SEQ ID NO: 6614761 - DNA, 19 bp, Homo sapiens
acctggcactgggaggcag

SEQ ID NO: 6614762 - DNA, 20 bp, Homo sapiens
acctggcagcaaactgctgc

SEQ ID NO: 6614763 - DNA, 15 bp, Homo sapiens
acctggcaggccctg

SEQ ID NO: 6614764 - DNA, 17 bp, Homo sapiens
acctggcaggccctgcc

SEQ ID NO: 6614765 - DNA, 19 bp, Homo sapiens
acctggcaggccctgccca

SEQ ID NO: 6614766 - DNA, 20 bp, Homo sapiens
acctggcaggccctgcccag

SEQ ID NO: 6614767 - DNA, 21 bp, Homo sapiens
acctggcagggctcacactcc

SEQ ID NO: 6614768 - DNA, 19 bp, Homo sapiens
acctggcagtggctctcag

SEQ ID NO: 6614769 - DNA, 18 bp, Homo sapiens
acctggcatcatggtgga

SEQ ID NO: 6614770 - DNA, 23 bp, Homo sapiens
acctggcatcttggaaatcattg

SEQ ID NO: 6614771 - DNA, 21 bp, Homo sapiens
acctggcatggtgcagggaga

SEQ ID NO: 6614772 - DNA, 16 bp, Homo sapiens
acctggccacctgagg

SEQ ID NO: 6614773 - DNA, 20 bp, Homo sapiens
acctggccacctgaggtggg

SEQ ID NO: 6614774 - DNA, 22 bp, Homo sapiens
acctggccactgtccctgtcct

SEQ ID NO: 6614775 - DNA, 15 bp, Homo sapiens
acctggccagaggca

SEQ ID NO: 6614776 - DNA, 23 bp, Homo sapiens
acctggcccagtgcaatctgtcc

SEQ ID NO: 6614777 - DNA, 17 bp, Homo sapiens
acctggcccatcagggt

SEQ ID NO: 6614778 - DNA, 20 bp, Homo sapiens
acctggccccctcagctctg

SEQ ID NO: 6614779 - DNA, 18 bp, Homo sapiens
acctggcccctgagctct

SEQ ID NO: 6614780 - DNA, 18 bp, Homo sapiens
acctggccctctctgaag

SEQ ID NO: 6614781 - DNA, 15 bp, Homo sapiens
acctggccctggggc

SEQ ID NO: 6614782 - DNA, 20 bp, Homo sapiens
acctggccgcctccaggagc

SEQ ID NO: 6614783 - DNA, 20 bp, Homo sapiens
acctggccgcggagcctgca

SEQ ID NO: 6614784 - DNA, 17 bp, Homo sapiens
acctggccgctaagttg

SEQ ID NO: 6614785 - DNA, 13 bp, Homo sapiens
acctggcctagaa

SEQ ID NO: 6614786 - DNA, 17 bp, Homo sapiens
acctggcctagaaaggg

SEQ ID NO: 6614787 - DNA, 16 bp, Homo sapiens
acctggcctcatttaa

SEQ ID NO: 6614788 - DNA, 14 bp, Homo sapiens
acctggcctctgcc

SEQ ID NO: 6614789 - DNA, 19 bp, Homo sapiens
acctggcctctgccatcct

SEQ ID NO: 6614790 - DNA, 23 bp, Homo sapiens
acctggcctgccaccctcctgcg

SEQ ID NO: 6614791 - DNA, 12 bp, Homo sapiens
acctggcctgct

SEQ ID NO: 6614792 - DNA, 15 bp, Homo sapiens
acctggcctgctggg

SEQ ID NO: 6614793 - DNA, 15 bp, Homo sapiens
acctggcctgggcca

SEQ ID NO: 6614794 - DNA, 20 bp, Homo sapiens
acctggcggagctctcctcc

SEQ ID NO: 6614795 - DNA, 17 bp, Homo sapiens
acctggcggcaggaagc

SEQ ID NO: 6614796 - DNA, 17 bp, Homo sapiens
acctggcgtgctcagac

SEQ ID NO: 6614797 - DNA, 13 bp, Homo sapiens
acctggctccccc

SEQ ID NO: 6614798 - DNA, 20 bp, Homo sapiens
acctggctccctcccaccca

SEQ ID NO: 6614799 - DNA, 14 bp, Homo sapiens
acctggctctcaga

SEQ ID NO: 6614800 - DNA, 13 bp, Homo sapiens
acctggctgaggt

SEQ ID NO: 6614801 - DNA, 19 bp, Homo sapiens
acctggctgaggttcctct

SEQ ID NO: 6614802 - DNA, 21 bp, Homo sapiens
acctggctgaggttcctctgc

SEQ ID NO: 6614803 - DNA, 23 bp, Homo sapiens
acctggctgaggttcctctgcct

SEQ ID NO: 6614804 - DNA, 16 bp, Homo sapiens
acctggctgccatact

SEQ ID NO: 6614805 - DNA, 20 bp, Homo sapiens
acctggctgcgaactgtgca

SEQ ID NO: 6614806 - DNA, 15 bp, Homo sapiens
acctggctgctaggc

SEQ ID NO: 6614807 - DNA, 17 bp, Homo sapiens
acctggctgctaggcca

SEQ ID NO: 6614808 - DNA, 18 bp, Homo sapiens
acctggctgggcctgggc

SEQ ID NO: 6614809 - DNA, 19 bp, Homo sapiens
acctggctgggcctgggct

SEQ ID NO: 6614810 - DNA, 14 bp, Homo sapiens
acctggcttcccag

SEQ ID NO: 6614811 - DNA, 17 bp, Homo sapiens
acctggcttcccaggac

SEQ ID NO: 6614812 - DNA, 18 bp, Homo sapiens
acctggcttcccaggacc

SEQ ID NO: 6614813 - DNA, 19 bp, Homo sapiens
acctggcttcccaggaccc

SEQ ID NO: 6614814 - DNA, 20 bp, Homo sapiens
acctggcttcccaggaccct

SEQ ID NO: 6614815 - DNA, 18 bp, Homo sapiens
acctggcttttactttat

SEQ ID NO: 6614816 - DNA, 19 bp, Homo sapiens
acctggcttttactttatt

SEQ ID NO: 6614817 - DNA, 14 bp, Homo sapiens
acctggctttttaa

SEQ ID NO: 6614818 - DNA, 17 bp, Homo sapiens
acctgggaaaacagagg

SEQ ID NO: 6614819 - DNA, 24 bp, Homo sapiens
acctgggaaaggacccacccatct

SEQ ID NO: 6614820 - DNA, 14 bp, Homo sapiens
acctgggaacacag

SEQ ID NO: 6614821 - DNA, 21 bp, Homo sapiens
acctgggaacacagttctggg

SEQ ID NO: 6614822 - DNA, 15 bp, Homo sapiens
acctgggaatttcag

SEQ ID NO: 6614823 - DNA, 12 bp, Homo sapiens
acctgggacccc

SEQ ID NO: 6614824 - DNA, 23 bp, Homo sapiens
acctgggagagacttggatgagg

SEQ ID NO: 6614825 - DNA, 17 bp, Homo sapiens
acctgggcaagctggcg

SEQ ID NO: 6614826 - DNA, 15 bp, Homo sapiens
acctgggcagctcct

SEQ ID NO: 6614827 - DNA, 18 bp, Homo sapiens
acctgggcagctcctccc

SEQ ID NO: 6614828 - DNA, 23 bp, Homo sapiens
acctgggccaaaagggcagccag

SEQ ID NO: 6614829 - DNA, 16 bp, Homo sapiens
acctgggcccacagag

SEQ ID NO: 6614830 - DNA, 19 bp, Homo sapiens
acctgggcccacagagcct

SEQ ID NO: 6614831 - DNA, 20 bp, Homo sapiens
acctgggcccacagagcctg

SEQ ID NO: 6614832 - DNA, 11 bp, Homo sapiens
acctgggcccc

SEQ ID NO: 6614833 - DNA, 17 bp, Homo sapiens
acctgggccccactgga

SEQ ID NO: 6614834 - DNA, 20 bp, Homo sapiens
acctgggccccactggacaa

SEQ ID NO: 6614835 - DNA, 16 bp, Homo sapiens
acctgggccctggggc

SEQ ID NO: 6614836 - DNA, 22 bp, Homo sapiens
acctgggccctggttcccccag

SEQ ID NO: 6614837 - DNA, 23 bp, Homo sapiens
acctgggcctcccatagtgctgg

SEQ ID NO: 6614838 - DNA, 18 bp, Homo sapiens
acctgggcctttcctgtg

SEQ ID NO: 6614839 - DNA, 15 bp, Homo sapiens
acctgggctcagcct

SEQ ID NO: 6614840 - DNA, 20 bp, Homo sapiens
acctggggaaagcctgaagg

SEQ ID NO: 6614841 - DNA, 14 bp, Homo sapiens
acctggggagccag

SEQ ID NO: 6614842 - DNA, 13 bp, Homo sapiens
acctggggagtgg

SEQ ID NO: 6614843 - DNA, 24 bp, Homo sapiens
acctggggagtgggacagagtctg

SEQ ID NO: 6614844 - DNA, 18 bp, Homo sapiens
acctggggctgctggcct

SEQ ID NO: 6614845 - DNA, 20 bp, Homo sapiens
acctggggctgctggcctga

SEQ ID NO: 6614846 - DNA, 17 bp, Homo sapiens
acctgggggagccgacc

SEQ ID NO: 6614847 - DNA, 15 bp, Homo sapiens
acctggggggaggga

SEQ ID NO: 6614848 - DNA, 17 bp, Homo sapiens
acctggggtcccccctc

SEQ ID NO: 6614849 - DNA, 20 bp, Homo sapiens
acctggggtgctgcctctca

SEQ ID NO: 6614850 - DNA, 15 bp, Homo sapiens
acctggggtggggag

SEQ ID NO: 6614851 - DNA, 22 bp, Homo sapiens
acctggggtggggaggcagagg

SEQ ID NO: 6614852 - DNA, 20 bp, Homo sapiens
acctggggtgtggttccaga

SEQ ID NO: 6614853 - DNA, 16 bp, Homo sapiens
acctggggttgtcagc

SEQ ID NO: 6614854 - DNA, 21 bp, Homo sapiens
acctggggttgtcagctctca

SEQ ID NO: 6614855 - DNA, 21 bp, Homo sapiens
acctgggtaactagggaagat

SEQ ID NO: 6614856 - DNA, 20 bp, Homo sapiens
acctgggtatagtgcagaaa

SEQ ID NO: 6614857 - DNA, 21 bp, Homo sapiens
acctgggtatcccctgcctcc

SEQ ID NO: 6614858 - DNA, 22 bp, Homo sapiens
acctgggtatcccctgcctcct

SEQ ID NO: 6614859 - DNA, 14 bp, Homo sapiens
acctgggtccaaat

SEQ ID NO: 6614860 - DNA, 17 bp, Homo sapiens
acctgggtccaaataaa

SEQ ID NO: 6614861 - DNA, 18 bp, Homo sapiens
acctgggtgtgctccagg

SEQ ID NO: 6614862 - DNA, 16 bp, Homo sapiens
acctgggttccccacc

SEQ ID NO: 6614863 - DNA, 17 bp, Homo sapiens
acctgggttccctttcc

SEQ ID NO: 6614864 - DNA, 20 bp, Homo sapiens
acctgggtttccagggcaca

SEQ ID NO: 6614865 - DNA, 22 bp, Homo sapiens
acctggtaagcaaaactttcct

SEQ ID NO: 6614866 - DNA, 14 bp, Homo sapiens
acctggtaattatc

SEQ ID NO: 6614867 - DNA, 16 bp, Homo sapiens
acctggtaccctcctg

SEQ ID NO: 6614868 - DNA, 17 bp, Homo sapiens
acctggtactccctctc

SEQ ID NO: 6614869 - DNA, 23 bp, Homo sapiens
acctggtcacaggactctgcctc

SEQ ID NO: 6614870 - DNA, 17 bp, Homo sapiens
acctggtccacagggca

SEQ ID NO: 6614871 - DNA, 22 bp, Homo sapiens
acctggtcctccgcctactgtc

SEQ ID NO: 6614872 - DNA, 14 bp, Homo sapiens
acctggtctctcct

SEQ ID NO: 6614873 - DNA, 20 bp, Homo sapiens
acctggtgagtaacttagaa

SEQ ID NO: 6614874 - DNA, 15 bp, Homo sapiens
acctggtgcccctgc

SEQ ID NO: 6614875 - DNA, 19 bp, Homo sapiens
acctggtgcgggcctggcc

SEQ ID NO: 6614876 - DNA, 23 bp, Homo sapiens
acctggtgctcgggaagggaggg

SEQ ID NO: 6614877 - DNA, 22 bp, Homo sapiens
acctggtgctggatattttcaa

SEQ ID NO: 6614878 - DNA, 20 bp, Homo sapiens
acctggtggcaccagatgca

SEQ ID NO: 6614879 - DNA, 13 bp, Homo sapiens
acctggtggctgg

SEQ ID NO: 6614880 - DNA, 15 bp, Homo sapiens
acctggtggctggag

SEQ ID NO: 6614881 - DNA, 18 bp, Homo sapiens
acctggtggctggaggca

SEQ ID NO: 6614882 - DNA, 20 bp, Homo sapiens
acctggtgtgcggaggcagg

SEQ ID NO: 6614883 - DNA, 16 bp, Homo sapiens
acctggtgtgtttctt

SEQ ID NO: 6614884 - DNA, 19 bp, Homo sapiens
acctggttgtccaggtcta

SEQ ID NO: 6614885 - DNA, 13 bp, Homo sapiens
acctggttttcat

SEQ ID NO: 6614886 - DNA, 14 bp, Homo sapiens
acctggttttcatt

SEQ ID NO: 6614887 - DNA, 22 bp, Homo sapiens
acctggttttcattattttccc

SEQ ID NO: 6614888 - DNA, 16 bp, Homo sapiens
acctgtaaaactttat

SEQ ID NO: 6614889 - DNA, 21 bp, Homo sapiens
acctgtaaaactttattttat

SEQ ID NO: 6614890 - DNA, 18 bp, Homo sapiens
acctgtaaattattttaa

SEQ ID NO: 6614891 - DNA, 11 bp, Homo sapiens
acctgtaactg

SEQ ID NO: 6614892 - DNA, 20 bp, Homo sapiens
acctgtaatcccaacacttt

SEQ ID NO: 6614893 - DNA, 15 bp, Homo sapiens
acctgtaatcccagc

SEQ ID NO: 6614894 - DNA, 20 bp, Homo sapiens
acctgtaatgacaggcctgt

SEQ ID NO: 6614895 - DNA, 16 bp, Homo sapiens
acctgtaattagttta

SEQ ID NO: 6614896 - DNA, 17 bp, Homo sapiens
acctgtaattagtttaa

SEQ ID NO: 6614897 - DNA, 13 bp, Homo sapiens
acctgtacacaca

SEQ ID NO: 6614898 - DNA, 15 bp, Homo sapiens
acctgtacacacaca

SEQ ID NO: 6614899 - DNA, 23 bp, Homo sapiens
acctgtacacacacagacacaca

SEQ ID NO: 6614900 - DNA, 12 bp, Homo sapiens
acctgtactcag

SEQ ID NO: 6614901 - DNA, 14 bp, Homo sapiens
acctgtactggaga

SEQ ID NO: 6614902 - DNA, 15 bp, Homo sapiens
acctgtactggagag

SEQ ID NO: 6614903 - DNA, 20 bp, Homo sapiens
acctgtagatgcagaaaaag

SEQ ID NO: 6614904 - DNA, 19 bp, Homo sapiens
acctgtagtcccagcactt

SEQ ID NO: 6614905 - DNA, 16 bp, Homo sapiens
acctgtagtcccagct

SEQ ID NO: 6614906 - DNA, 17 bp, Homo sapiens
acctgtagtcccagcta

SEQ ID NO: 6614907 - DNA, 21 bp, Homo sapiens
acctgtataagtggaggcact

SEQ ID NO: 6614908 - DNA, 17 bp, Homo sapiens
acctgtatactcttgaa

SEQ ID NO: 6614909 - DNA, 21 bp, Homo sapiens
acctgtatatttgtaaagcta

SEQ ID NO: 6614910 - DNA, 23 bp, Homo sapiens
acctgtatgtcaataaacaacag

SEQ ID NO: 6614911 - DNA, 17 bp, Homo sapiens
acctgtatgtctccagt

SEQ ID NO: 6614912 - DNA, 12 bp, Homo sapiens
acctgtatttaa

SEQ ID NO: 6614913 - DNA, 15 bp, Homo sapiens
acctgtatttaagca

SEQ ID NO: 6614914 - DNA, 18 bp, Homo sapiens
acctgtatttaagcaaat

SEQ ID NO: 6614915 - DNA, 21 bp, Homo sapiens
acctgtatttaagcaaatact

SEQ ID NO: 6614916 - DNA, 21 bp, Homo sapiens
acctgtcaaaaattttgaatg

SEQ ID NO: 6614917 - DNA, 20 bp, Homo sapiens
acctgtcaaacaaagccaga

SEQ ID NO: 6614918 - DNA, 21 bp, Homo sapiens
acctgtcaacctgaattaaag

SEQ ID NO: 6614919 - DNA, 12 bp, Homo sapiens
acctgtcaatac

SEQ ID NO: 6614920 - DNA, 17 bp, Homo sapiens
acctgtcacattgcatt

SEQ ID NO: 6614921 - DNA, 17 bp, Homo sapiens
acctgtcaccctgcagg

SEQ ID NO: 6614922 - DNA, 21 bp, Homo sapiens
acctgtcagaataaaaatgtg

SEQ ID NO: 6614923 - DNA, 19 bp, Homo sapiens
acctgtcatgcccccctca

SEQ ID NO: 6614924 - DNA, 20 bp, Homo sapiens
acctgtcatgcccccctcaa

SEQ ID NO: 6614925 - DNA, 17 bp, Homo sapiens
acctgtcattttgcact

SEQ ID NO: 6614926 - DNA, 12 bp, Homo sapiens
acctgtccaggt

SEQ ID NO: 6614927 - DNA, 14 bp, Homo sapiens
acctgtccccaccc

SEQ ID NO: 6614928 - DNA, 13 bp, Homo sapiens
acctgtcccccac

SEQ ID NO: 6614929 - DNA, 16 bp, Homo sapiens
acctgtcccccactct

SEQ ID NO: 6614930 - DNA, 17 bp, Homo sapiens
acctgtccctccaggcc

SEQ ID NO: 6614931 - DNA, 22 bp, Homo sapiens
acctgtcctaaggaaccttcct

SEQ ID NO: 6614932 - DNA, 15 bp, Homo sapiens
acctgtcctcctggt

SEQ ID NO: 6614933 - DNA, 15 bp, Homo sapiens
acctgtcctctttgt

SEQ ID NO: 6614934 - DNA, 17 bp, Homo sapiens
acctgtcctgtctttga

SEQ ID NO: 6614935 - DNA, 18 bp, Homo sapiens
acctgtcctgtctttgat

SEQ ID NO: 6614936 - DNA, 17 bp, Homo sapiens
acctgtccttactcaga

SEQ ID NO: 6614937 - DNA, 21 bp, Homo sapiens
acctgtccttactcagagctg

SEQ ID NO: 6614938 - DNA, 12 bp, Homo sapiens
acctgtcgccca

SEQ ID NO: 6614939 - DNA, 16 bp, Homo sapiens
acctgtcgcccagtgc

SEQ ID NO: 6614940 - DNA, 16 bp, Homo sapiens
acctgtctaagcaata

SEQ ID NO: 6614941 - DNA, 18 bp, Homo sapiens
acctgtctatactacagt

SEQ ID NO: 6614942 - DNA, 13 bp, Homo sapiens
acctgtctcacca

SEQ ID NO: 6614943 - DNA, 16 bp, Homo sapiens
acctgtctcagctgtt

SEQ ID NO: 6614944 - DNA, 19 bp, Homo sapiens
acctgtctccattgtgtga

SEQ ID NO: 6614945 - DNA, 13 bp, Homo sapiens
acctgtctcctcc

SEQ ID NO: 6614946 - DNA, 17 bp, Homo sapiens
acctgtctcctggcggt

SEQ ID NO: 6614947 - DNA, 13 bp, Homo sapiens
acctgtctctctc

SEQ ID NO: 6614948 - DNA, 23 bp, Homo sapiens
acctgtctctctcttctctctag

SEQ ID NO: 6614949 - DNA, 18 bp, Homo sapiens
acctgtctgactgtagct

SEQ ID NO: 6614950 - DNA, 11 bp, Homo sapiens
acctgtctgct

SEQ ID NO: 6614951 - DNA, 17 bp, Homo sapiens
acctgtctgtcgctggg

SEQ ID NO: 6614952 - DNA, 15 bp, Homo sapiens
acctgtctgtgcaga

SEQ ID NO: 6614953 - DNA, 12 bp, Homo sapiens
acctgtcttgct

SEQ ID NO: 6614954 - DNA, 15 bp, Homo sapiens
acctgtcttgctcct

SEQ ID NO: 6614955 - DNA, 18 bp, Homo sapiens
acctgtcttgctcctggg

SEQ ID NO: 6614956 - DNA, 21 bp, Homo sapiens
acctgtcttgctcctggggag

SEQ ID NO: 6614957 - DNA, 17 bp, Homo sapiens
acctgtcttggcctccc

SEQ ID NO: 6614958 - DNA, 15 bp, Homo sapiens
acctgtcttttggga

SEQ ID NO: 6614959 - DNA, 13 bp, Homo sapiens
acctgtgacagca

SEQ ID NO: 6614960 - DNA, 21 bp, Homo sapiens
acctgtgacagcagctctgtc

SEQ ID NO: 6614961 - DNA, 13 bp, Homo sapiens
acctgtgaccagc

SEQ ID NO: 6614962 - DNA, 14 bp, Homo sapiens
acctgtgaccagca

SEQ ID NO: 6614963 - DNA, 15 bp, Homo sapiens
acctgtgactcttag

SEQ ID NO: 6614964 - DNA, 17 bp, Homo sapiens
acctgtgagaaaggaaa

SEQ ID NO: 6614965 - DNA, 18 bp, Homo sapiens
acctgtgagaaaggaaaa

SEQ ID NO: 6614966 - DNA, 15 bp, Homo sapiens
acctgtgagcatcct

SEQ ID NO: 6614967 - DNA, 15 bp, Homo sapiens
acctgtgagcccagc

SEQ ID NO: 6614968 - DNA, 18 bp, Homo sapiens
acctgtgagcccagctgg

SEQ ID NO: 6614969 - DNA, 21 bp, Homo sapiens
acctgtgagctgcaccaggta

SEQ ID NO: 6614970 - DNA, 14 bp, Homo sapiens
acctgtgaggaaga

SEQ ID NO: 6614971 - DNA, 13 bp, Homo sapiens
acctgtgagggga

SEQ ID NO: 6614972 - DNA, 17 bp, Homo sapiens
acctgtgagtaaatatt

SEQ ID NO: 6614973 - DNA, 17 bp, Homo sapiens
acctgtgatttctgtgc

SEQ ID NO: 6614974 - DNA, 17 bp, Homo sapiens
acctgtgcaaaataaaa

SEQ ID NO: 6614975 - DNA, 18 bp, Homo sapiens
acctgtgcaccccatgag

SEQ ID NO: 6614976 - DNA, 19 bp, Homo sapiens
acctgtgcagggccctctg

SEQ ID NO: 6614977 - DNA, 20 bp, Homo sapiens
acctgtgcagggccctctgg

SEQ ID NO: 6614978 - DNA, 16 bp, Homo sapiens
acctgtgccaggctga

SEQ ID NO: 6614979 - DNA, 18 bp, Homo sapiens
acctgtgccctcaccacc

SEQ ID NO: 6614980 - DNA, 21 bp, Homo sapiens
acctgtgccctcaccaccaca

SEQ ID NO: 6614981 - DNA, 16 bp, Homo sapiens
acctgtgctacctcta

SEQ ID NO: 6614982 - DNA, 22 bp, Homo sapiens
acctgtgctgaacataacttct

SEQ ID NO: 6614983 - DNA, 13 bp, Homo sapiens
acctgtgctgctg

SEQ ID NO: 6614984 - DNA, 14 bp, Homo sapiens
acctgtgctggagc

SEQ ID NO: 6614985 - DNA, 23 bp, Homo sapiens
acctgtgcttcgggcccttccca

SEQ ID NO: 6614986 - DNA, 12 bp, Homo sapiens
acctgtgctttc

SEQ ID NO: 6614987 - DNA, 22 bp, Homo sapiens
acctgtgctttcatgtttaaga

SEQ ID NO: 6614988 - DNA, 13 bp, Homo sapiens
acctgtggaaagt

SEQ ID NO: 6614989 - DNA, 20 bp, Homo sapiens
acctgtggaacataaaaagg

SEQ ID NO: 6614990 - DNA, 20 bp, Homo sapiens
acctgtggataaaacattag

SEQ ID NO: 6614991 - DNA, 14 bp, Homo sapiens
acctgtggatattt

SEQ ID NO: 6614992 - DNA, 19 bp, Homo sapiens
acctgtggcctctcagtca

SEQ ID NO: 6614993 - DNA, 15 bp, Homo sapiens
acctgtggctcaggg

SEQ ID NO: 6614994 - DNA, 15 bp, Homo sapiens
acctgtggtcatgtg

SEQ ID NO: 6614995 - DNA, 13 bp, Homo sapiens
acctgtgtccccg

SEQ ID NO: 6614996 - DNA, 22 bp, Homo sapiens
acctgtgtctgcgaagtcctat

SEQ ID NO: 6614997 - DNA, 24 bp, Homo sapiens
acctgtgtgagattttattttgac

SEQ ID NO: 6614998 - DNA, 16 bp, Homo sapiens
acctgtgtgcccagca

SEQ ID NO: 6614999 - DNA, 20 bp, Homo sapiens
acctgtgtgcccagcacctg

SEQ ID NO: 6615000 - DNA, 16 bp, Homo sapiens
acctgtgtggacagga

SEQ ID NO: 6615001 - DNA, 19 bp, Homo sapiens
acctgtgtggacaggacta

SEQ ID NO: 6615002 - DNA, 21 bp, Homo sapiens
acctgtgtgtctccataaaag

SEQ ID NO: 6615003 - DNA, 15 bp, Homo sapiens
acctgtgtgttcttt

SEQ ID NO: 6615004 - DNA, 20 bp, Homo sapiens
acctgtgtgttcttttgata

SEQ ID NO: 6615005 - DNA, 23 bp, Homo sapiens
acctgtgtgttcttttgatacat

SEQ ID NO: 6615006 - DNA, 16 bp, Homo sapiens
acctgtgttcattctt

SEQ ID NO: 6615007 - DNA, 22 bp, Homo sapiens
acctgttaaggtggaaaatgga

SEQ ID NO: 6615008 - DNA, 21 bp, Homo sapiens
acctgttacactgggctgggt

SEQ ID NO: 6615009 - DNA, 19 bp, Homo sapiens
acctgttactattatctgt

SEQ ID NO: 6615010 - DNA, 23 bp, Homo sapiens
acctgttaggtctcatgcccact

SEQ ID NO: 6615011 - DNA, 14 bp, Homo sapiens
acctgttatgtatg

SEQ ID NO: 6615012 - DNA, 15 bp, Homo sapiens
acctgttatgtatga

SEQ ID NO: 6615013 - DNA, 13 bp, Homo sapiens
acctgttatttct

SEQ ID NO: 6615014 - DNA, 17 bp, Homo sapiens
acctgttcacagaaaaa

SEQ ID NO: 6615015 - DNA, 18 bp, Homo sapiens
acctgttcaggagctgaa

SEQ ID NO: 6615016 - DNA, 19 bp, Homo sapiens
acctgttcagtactctaca

SEQ ID NO: 6615017 - DNA, 16 bp, Homo sapiens
acctgttcctgactgt

SEQ ID NO: 6615018 - DNA, 19 bp, Homo sapiens
acctgttcctgactgttct

SEQ ID NO: 6615019 - DNA, 21 bp, Homo sapiens
acctgttctgtgttgcaagat

SEQ ID NO: 6615020 - DNA, 22 bp, Homo sapiens
acctgttcttagagtgtagctg

SEQ ID NO: 6615021 - DNA, 21 bp, Homo sapiens
acctgttgagcatcacagaat

SEQ ID NO: 6615022 - DNA, 22 bp, Homo sapiens
acctgttgagcatcacagaatg

SEQ ID NO: 6615023 - DNA, 15 bp, Homo sapiens
acctgttgcttacaa

SEQ ID NO: 6615024 - DNA, 17 bp, Homo sapiens
acctgttggcctgtggg

SEQ ID NO: 6615025 - DNA, 21 bp, Homo sapiens
acctgttggcctgtgggcctc

SEQ ID NO: 6615026 - DNA, 20 bp, Homo sapiens
acctgttggttagctggaca

SEQ ID NO: 6615027 - DNA, 14 bp, Homo sapiens
acctgttggttcca

SEQ ID NO: 6615028 - DNA, 13 bp, Homo sapiens
acctgttgtcctg

SEQ ID NO: 6615029 - DNA, 18 bp, Homo sapiens
acctgttgtcctgaactg

SEQ ID NO: 6615030 - DNA, 16 bp, Homo sapiens
acctgttgtgtgcctg

SEQ ID NO: 6615031 - DNA, 13 bp, Homo sapiens
acctgtttaaata

SEQ ID NO: 6615032 - DNA, 17 bp, Homo sapiens
acctgtttatataattt

SEQ ID NO: 6615033 - DNA, 21 bp, Homo sapiens
acctgtttatgagatgctggt

SEQ ID NO: 6615034 - DNA, 17 bp, Homo sapiens
acctgtttctacctata

SEQ ID NO: 6615035 - DNA, 18 bp, Homo sapiens
acctgtttctctttgtct

SEQ ID NO: 6615036 - DNA, 14 bp, Homo sapiens
acctgttttctgaa

SEQ ID NO: 6615037 - DNA, 21 bp, Homo sapiens
acctgttttctgaaacacacg

SEQ ID NO: 6615038 - DNA, 20 bp, Homo sapiens
acctgttttgcttttgtaac

SEQ ID NO: 6615039 - DNA, 18 bp, Homo sapiens
acctgttttttttctttt

SEQ ID NO: 6615040 - DNA, 17 bp, Homo sapiens
accttaaaaaatgtttc

SEQ ID NO: 6615041 - DNA, 15 bp, Homo sapiens
accttaaaaattaga

SEQ ID NO: 6615042 - DNA, 15 bp, Homo sapiens
accttaaaacagctg

SEQ ID NO: 6615043 - DNA, 12 bp, Homo sapiens
accttaaaacta

SEQ ID NO: 6615044 - DNA, 21 bp, Homo sapiens
accttaaaagacagctagatt

SEQ ID NO: 6615045 - DNA, 15 bp, Homo sapiens
accttaaaagtaata

SEQ ID NO: 6615046 - DNA, 16 bp, Homo sapiens
accttaaaagtaataa

SEQ ID NO: 6615047 - DNA, 18 bp, Homo sapiens
accttaaaagtaataaag

SEQ ID NO: 6615048 - DNA, 20 bp, Homo sapiens
accttaaaagtaataaagag

SEQ ID NO: 6615049 - DNA, 19 bp, Homo sapiens
accttaaaatgtgtacagt

SEQ ID NO: 6615050 - DNA, 11 bp, Homo sapiens
accttaaaatt

SEQ ID NO: 6615051 - DNA, 22 bp, Homo sapiens
accttaaaattgatattatatt

SEQ ID NO: 6615052 - DNA, 14 bp, Homo sapiens
accttaaaatttga

SEQ ID NO: 6615053 - DNA, 16 bp, Homo sapiens
accttaaacacccctc

SEQ ID NO: 6615054 - DNA, 22 bp, Homo sapiens
accttaaacacccctcagttgt

SEQ ID NO: 6615055 - DNA, 17 bp, Homo sapiens
accttaaagcaataagt

SEQ ID NO: 6615056 - DNA, 22 bp, Homo sapiens
accttaaaggccgtcatttcat

SEQ ID NO: 6615057 - DNA, 12 bp, Homo sapiens
accttaaattaa

SEQ ID NO: 6615058 - DNA, 17 bp, Homo sapiens
accttaaattaaacaat

SEQ ID NO: 6615059 - DNA, 13 bp, Homo sapiens
accttaactggag

SEQ ID NO: 6615060 - DNA, 14 bp, Homo sapiens
accttaactggaga

SEQ ID NO: 6615061 - DNA, 21 bp, Homo sapiens
accttaagacactgtgagagt

SEQ ID NO: 6615062 - DNA, 23 bp, Homo sapiens
accttaagagttctaaccatgcc

SEQ ID NO: 6615063 - DNA, 21 bp, Homo sapiens
accttaagctggcattgtgaa

SEQ ID NO: 6615064 - DNA, 17 bp, Homo sapiens
accttaatattattggg

SEQ ID NO: 6615065 - DNA, 22 bp, Homo sapiens
accttaatattattggggttgg

SEQ ID NO: 6615066 - DNA, 15 bp, Homo sapiens
accttaatatttctt

SEQ ID NO: 6615067 - DNA, 15 bp, Homo sapiens
accttaattattgca

SEQ ID NO: 6615068 - DNA, 15 bp, Homo sapiens
accttaatttaactt

SEQ ID NO: 6615069 - DNA, 11 bp, Homo sapiens
accttaatttc

SEQ ID NO: 6615070 - DNA, 21 bp, Homo sapiens
accttacaaccacatttctgg

SEQ ID NO: 6615071 - DNA, 20 bp, Homo sapiens
accttacaacgccgagtgca

SEQ ID NO: 6615072 - DNA, 15 bp, Homo sapiens
accttacattcctag

SEQ ID NO: 6615073 - DNA, 22 bp, Homo sapiens
accttacccctggctgtttgga

SEQ ID NO: 6615074 - DNA, 19 bp, Homo sapiens
accttacgatcaggcacag

SEQ ID NO: 6615075 - DNA, 21 bp, Homo sapiens
accttacgatcaggcacaggt

SEQ ID NO: 6615076 - DNA, 18 bp, Homo sapiens
accttactctgagctcat

SEQ ID NO: 6615077 - DNA, 21 bp, Homo sapiens
accttactgtggaggaaggat

SEQ ID NO: 6615078 - DNA, 17 bp, Homo sapiens
accttagacagtccctg

SEQ ID NO: 6615079 - DNA, 20 bp, Homo sapiens
accttagacagtccctgcca

SEQ ID NO: 6615080 - DNA, 20 bp, Homo sapiens
accttagaccaccaagcctt

SEQ ID NO: 6615081 - DNA, 18 bp, Homo sapiens
accttagacggaggtgcc

SEQ ID NO: 6615082 - DNA, 15 bp, Homo sapiens
accttagactgaaaa

SEQ ID NO: 6615083 - DNA, 17 bp, Homo sapiens
accttagattagctctg

SEQ ID NO: 6615084 - DNA, 18 bp, Homo sapiens
accttagattagctctgg

SEQ ID NO: 6615085 - DNA, 19 bp, Homo sapiens
accttagattagctctgga

SEQ ID NO: 6615086 - DNA, 15 bp, Homo sapiens
accttagccatcaga

SEQ ID NO: 6615087 - DNA, 20 bp, Homo sapiens
accttagccccattgctcca

SEQ ID NO: 6615088 - DNA, 13 bp, Homo sapiens
accttagcgttct

SEQ ID NO: 6615089 - DNA, 23 bp, Homo sapiens
accttagctacatagcagacttt

SEQ ID NO: 6615090 - DNA, 20 bp, Homo sapiens
accttagctccctcccgcac

SEQ ID NO: 6615091 - DNA, 20 bp, Homo sapiens
accttagctcccttgagctg

SEQ ID NO: 6615092 - DNA, 13 bp, Homo sapiens
accttagcttatt

SEQ ID NO: 6615093 - DNA, 18 bp, Homo sapiens
accttagcttattgatcc

SEQ ID NO: 6615094 - DNA, 15 bp, Homo sapiens
accttaggcagggaa

SEQ ID NO: 6615095 - DNA, 22 bp, Homo sapiens
accttaggcccggagctgcccc

SEQ ID NO: 6615096 - DNA, 14 bp, Homo sapiens
accttaggccttcc

SEQ ID NO: 6615097 - DNA, 15 bp, Homo sapiens
accttaggccttcct

SEQ ID NO: 6615098 - DNA, 20 bp, Homo sapiens
accttaggtagtaggaagaa

SEQ ID NO: 6615099 - DNA, 21 bp, Homo sapiens
accttagtgcagttatttgct

SEQ ID NO: 6615100 - DNA, 14 bp, Homo sapiens
accttagtggcttt

SEQ ID NO: 6615101 - DNA, 14 bp, Homo sapiens
accttagtgtttct

SEQ ID NO: 6615102 - DNA, 20 bp, Homo sapiens
accttagtgtttctgtgcat

SEQ ID NO: 6615103 - DNA, 12 bp, Homo sapiens
accttatacatc

SEQ ID NO: 6615104 - DNA, 22 bp, Homo sapiens
accttatagttactgtgtaatt

SEQ ID NO: 6615105 - DNA, 13 bp, Homo sapiens
accttatatttac

SEQ ID NO: 6615106 - DNA, 15 bp, Homo sapiens
accttatatttacaa

SEQ ID NO: 6615107 - DNA, 14 bp, Homo sapiens
accttatcaaggat

SEQ ID NO: 6615108 - DNA, 20 bp, Homo sapiens
accttatcaaggattttcat

SEQ ID NO: 6615109 - DNA, 11 bp, Homo sapiens
accttatctgt

SEQ ID NO: 6615110 - DNA, 11 bp, Homo sapiens
accttatctta

SEQ ID NO: 6615111 - DNA, 23 bp, Homo sapiens
accttatgctacacagacattaa

SEQ ID NO: 6615112 - DNA, 15 bp, Homo sapiens
accttatgtattatt

SEQ ID NO: 6615113 - DNA, 18 bp, Homo sapiens
accttatgttagagtcat

SEQ ID NO: 6615114 - DNA, 23 bp, Homo sapiens
accttattagctaaaaatatata

SEQ ID NO: 6615115 - DNA, 19 bp, Homo sapiens
accttatttaaaagatttt

SEQ ID NO: 6615116 - DNA, 16 bp, Homo sapiens
accttatttatttttg

SEQ ID NO: 6615117 - DNA, 19 bp, Homo sapiens
accttcaaagaaacttgaa

SEQ ID NO: 6615118 - DNA, 14 bp, Homo sapiens
accttcaagctgct

SEQ ID NO: 6615119 - DNA, 20 bp, Homo sapiens
accttcaagctgctttttgt

SEQ ID NO: 6615120 - DNA, 18 bp, Homo sapiens
accttcaaggctcttctt

SEQ ID NO: 6615121 - DNA, 21 bp, Homo sapiens
accttcaaggctcttcttcct

SEQ ID NO: 6615122 - DNA, 14 bp, Homo sapiens
accttcaataaagt

SEQ ID NO: 6615123 - DNA, 20 bp, Homo sapiens
accttcaataaagtatctac

SEQ ID NO: 6615124 - DNA, 23 bp, Homo sapiens
accttcaataaagtatctacatg

SEQ ID NO: 6615125 - DNA, 16 bp, Homo sapiens
accttcaattcctggg

SEQ ID NO: 6615126 - DNA, 17 bp, Homo sapiens
accttcaattcctgggc

SEQ ID NO: 6615127 - DNA, 19 bp, Homo sapiens
accttcacagatgcctact

SEQ ID NO: 6615128 - DNA, 16 bp, Homo sapiens
accttcacccagagct

SEQ ID NO: 6615129 - DNA, 15 bp, Homo sapiens
accttcacccagcac

SEQ ID NO: 6615130 - DNA, 18 bp, Homo sapiens
accttcactctaagatgt

SEQ ID NO: 6615131 - DNA, 14 bp, Homo sapiens
accttcagaataag

SEQ ID NO: 6615132 - DNA, 22 bp, Homo sapiens
accttcagatccttttattctc

SEQ ID NO: 6615133 - DNA, 16 bp, Homo sapiens
accttcagattcccca

SEQ ID NO: 6615134 - DNA, 14 bp, Homo sapiens
accttcagcagtta

SEQ ID NO: 6615135 - DNA, 12 bp, Homo sapiens
accttcagctca

SEQ ID NO: 6615136 - DNA, 23 bp, Homo sapiens
accttcagctttatttttcttta

SEQ ID NO: 6615137 - DNA, 19 bp, Homo sapiens
accttcagggagagctggg

SEQ ID NO: 6615138 - DNA, 18 bp, Homo sapiens
accttcatgcccttctga

SEQ ID NO: 6615139 - DNA, 18 bp, Homo sapiens
accttcatttcaggaggg

SEQ ID NO: 6615140 - DNA, 21 bp, Homo sapiens
accttcatttcaggagggatt

SEQ ID NO: 6615141 - DNA, 13 bp, Homo sapiens
accttcattttga

SEQ ID NO: 6615142 - DNA, 13 bp, Homo sapiens
accttccaacact

SEQ ID NO: 6615143 - DNA, 16 bp, Homo sapiens
accttccaagagcctg

SEQ ID NO: 6615144 - DNA, 12 bp, Homo sapiens
accttccaccca

SEQ ID NO: 6615145 - DNA, 14 bp, Homo sapiens
accttccaggaccc

SEQ ID NO: 6615146 - DNA, 12 bp, Homo sapiens
accttccagggc

SEQ ID NO: 6615147 - DNA, 16 bp, Homo sapiens
accttccatagcctcc

SEQ ID NO: 6615148 - DNA, 22 bp, Homo sapiens
accttccatctcaacctacctc

SEQ ID NO: 6615149 - DNA, 20 bp, Homo sapiens
accttccatgtcaagattca

SEQ ID NO: 6615150 - DNA, 19 bp, Homo sapiens
accttccatgtcaggccag

SEQ ID NO: 6615151 - DNA, 14 bp, Homo sapiens
accttcccacccct

SEQ ID NO: 6615152 - DNA, 11 bp, Homo sapiens
accttcccagc

SEQ ID NO: 6615153 - DNA, 18 bp, Homo sapiens
accttcccagctctccct

SEQ ID NO: 6615154 - DNA, 17 bp, Homo sapiens
accttcccatgcaggct

SEQ ID NO: 6615155 - DNA, 13 bp, Homo sapiens
accttccccaccc

SEQ ID NO: 6615156 - DNA, 16 bp, Homo sapiens
accttcccccagcttt

SEQ ID NO: 6615157 - DNA, 20 bp, Homo sapiens
accttcccccagctttccat

SEQ ID NO: 6615158 - DNA, 21 bp, Homo sapiens
accttcccccagctttccatc

SEQ ID NO: 6615159 - DNA, 17 bp, Homo sapiens
accttccccctccccca

SEQ ID NO: 6615160 - DNA, 16 bp, Homo sapiens
accttcccgcctcggc

SEQ ID NO: 6615161 - DNA, 13 bp, Homo sapiens
accttccctccaa

SEQ ID NO: 6615162 - DNA, 15 bp, Homo sapiens
accttccctctttct

SEQ ID NO: 6615163 - DNA, 22 bp, Homo sapiens
accttcccttctacaaggactc

SEQ ID NO: 6615164 - DNA, 17 bp, Homo sapiens
accttcctactggagct

SEQ ID NO: 6615165 - DNA, 17 bp, Homo sapiens
accttcctcacttccat

SEQ ID NO: 6615166 - DNA, 14 bp, Homo sapiens
accttcctcctccc

SEQ ID NO: 6615167 - DNA, 16 bp, Homo sapiens
accttcctcctccccg

SEQ ID NO: 6615168 - DNA, 17 bp, Homo sapiens
accttcctcgcagagag

SEQ ID NO: 6615169 - DNA, 15 bp, Homo sapiens
accttcctctggggc

SEQ ID NO: 6615170 - DNA, 15 bp, Homo sapiens
accttcctgaattct

SEQ ID NO: 6615171 - DNA, 20 bp, Homo sapiens
accttcctgggcagcccaga

SEQ ID NO: 6615172 - DNA, 21 bp, Homo sapiens
accttcctgggcagcccagag

SEQ ID NO: 6615173 - DNA, 13 bp, Homo sapiens
accttcctgtctt

SEQ ID NO: 6615174 - DNA, 22 bp, Homo sapiens
accttcctgtgggtgttctttc

SEQ ID NO: 6615175 - DNA, 17 bp, Homo sapiens
accttccttaagccagg

SEQ ID NO: 6615176 - DNA, 12 bp, Homo sapiens
accttccttccc

SEQ ID NO: 6615177 - DNA, 14 bp, Homo sapiens
accttccttccctg

SEQ ID NO: 6615178 - DNA, 14 bp, Homo sapiens
accttccttctaaa

SEQ ID NO: 6615179 - DNA, 13 bp, Homo sapiens
accttccttgaaa

SEQ ID NO: 6615180 - DNA, 22 bp, Homo sapiens
accttccttgaaatttctcagc

SEQ ID NO: 6615181 - DNA, 19 bp, Homo sapiens
accttccttgcgaccacca

SEQ ID NO: 6615182 - DNA, 21 bp, Homo sapiens
accttcctttctaaagttttt

SEQ ID NO: 6615183 - DNA, 13 bp, Homo sapiens
accttccttttac

SEQ ID NO: 6615184 - DNA, 23 bp, Homo sapiens
accttcctttttttaaattttct

SEQ ID NO: 6615185 - DNA, 11 bp, Homo sapiens
accttcgagta

SEQ ID NO: 6615186 - DNA, 17 bp, Homo sapiens
accttcggcagtggctg

SEQ ID NO: 6615187 - DNA, 20 bp, Homo sapiens
accttcggcagtggctgggg

SEQ ID NO: 6615188 - DNA, 16 bp, Homo sapiens
accttcgggctgtgcc

SEQ ID NO: 6615189 - DNA, 17 bp, Homo sapiens
accttcgggctgtgccc

SEQ ID NO: 6615190 - DNA, 18 bp, Homo sapiens
accttcggggcctgtctg

SEQ ID NO: 6615191 - DNA, 21 bp, Homo sapiens
accttcggggcctgtctgaag

SEQ ID NO: 6615192 - DNA, 23 bp, Homo sapiens
accttcgtttactatgcctgtgt

SEQ ID NO: 6615193 - DNA, 15 bp, Homo sapiens
accttctaccctggg

SEQ ID NO: 6615194 - DNA, 21 bp, Homo sapiens
accttctagtgagcctgggcc

SEQ ID NO: 6615195 - DNA, 22 bp, Homo sapiens
accttctagtgagcctgggcca

SEQ ID NO: 6615196 - DNA, 19 bp, Homo sapiens
accttctagttgcccccat

SEQ ID NO: 6615197 - DNA, 22 bp, Homo sapiens
accttctagttgcccccattcc

SEQ ID NO: 6615198 - DNA, 18 bp, Homo sapiens
accttctatagcatcact

SEQ ID NO: 6615199 - DNA, 17 bp, Homo sapiens
accttctatcctctgta

SEQ ID NO: 6615200 - DNA, 12 bp, Homo sapiens
accttctccagg

SEQ ID NO: 6615201 - DNA, 20 bp, Homo sapiens
accttctccagggacagaag

SEQ ID NO: 6615202 - DNA, 23 bp, Homo sapiens
accttctccagggacagaagcag

SEQ ID NO: 6615203 - DNA, 14 bp, Homo sapiens
accttctcccaggc

SEQ ID NO: 6615204 - DNA, 21 bp, Homo sapiens
accttctcccaggcctctgcc

SEQ ID NO: 6615205 - DNA, 19 bp, Homo sapiens
accttctccccagctccca

SEQ ID NO: 6615206 - DNA, 18 bp, Homo sapiens
accttctccctagccctt

SEQ ID NO: 6615207 - DNA, 14 bp, Homo sapiens
accttctccttcac

SEQ ID NO: 6615208 - DNA, 19 bp, Homo sapiens
accttctgaacatgagtgt

SEQ ID NO: 6615209 - DNA, 17 bp, Homo sapiens
accttctgaagatctca

SEQ ID NO: 6615210 - DNA, 16 bp, Homo sapiens
accttctgacctcccc

SEQ ID NO: 6615211 - DNA, 21 bp, Homo sapiens
accttctgacctccccacccc

SEQ ID NO: 6615212 - DNA, 20 bp, Homo sapiens
accttctgacgcagcctgag

SEQ ID NO: 6615213 - DNA, 21 bp, Homo sapiens
accttctgacgcagcctgaga

SEQ ID NO: 6615214 - DNA, 23 bp, Homo sapiens
accttctgacgcagcctgagaat

SEQ ID NO: 6615215 - DNA, 23 bp, Homo sapiens
accttctgccaaggccagcccac

SEQ ID NO: 6615216 - DNA, 23 bp, Homo sapiens
accttctgcccatcctgtctgtt

SEQ ID NO: 6615217 - DNA, 15 bp, Homo sapiens
accttctgccctcct

SEQ ID NO: 6615218 - DNA, 16 bp, Homo sapiens
accttctgccctcctg

SEQ ID NO: 6615219 - DNA, 17 bp, Homo sapiens
accttctgccctcctgc

SEQ ID NO: 6615220 - DNA, 18 bp, Homo sapiens
accttctgccctcctgcc

SEQ ID NO: 6615221 - DNA, 19 bp, Homo sapiens
accttctgcctttgatgtt

SEQ ID NO: 6615222 - DNA, 17 bp, Homo sapiens
accttctggtatcttgt

SEQ ID NO: 6615223 - DNA, 14 bp, Homo sapiens
accttctgtcccca

SEQ ID NO: 6615224 - DNA, 19 bp, Homo sapiens
accttctgtccccagccct

SEQ ID NO: 6615225 - DNA, 22 bp, Homo sapiens
accttctgtccccagccctgtc

SEQ ID NO: 6615226 - DNA, 19 bp, Homo sapiens
accttctgtcgtccccaga

SEQ ID NO: 6615227 - DNA, 21 bp, Homo sapiens
accttctgtcgtccccagacc

SEQ ID NO: 6615228 - DNA, 18 bp, Homo sapiens
accttcttatttaatctt

SEQ ID NO: 6615229 - DNA, 20 bp, Homo sapiens
accttcttcagccacctctc

SEQ ID NO: 6615230 - DNA, 18 bp, Homo sapiens
accttcttcaggctgcct

SEQ ID NO: 6615231 - DNA, 16 bp, Homo sapiens
accttcttctcctaca

SEQ ID NO: 6615232 - DNA, 14 bp, Homo sapiens
accttcttggcttc

SEQ ID NO: 6615233 - DNA, 16 bp, Homo sapiens
accttcttggcttctg

SEQ ID NO: 6615234 - DNA, 20 bp, Homo sapiens
accttcttggcttctgggac

SEQ ID NO: 6615235 - DNA, 23 bp, Homo sapiens
accttcttggcttctgggacctg

SEQ ID NO: 6615236 - DNA, 15 bp, Homo sapiens
accttcttgggactg

SEQ ID NO: 6615237 - DNA, 18 bp, Homo sapiens
accttctttattctgtgt

SEQ ID NO: 6615238 - DNA, 20 bp, Homo sapiens
accttctttattctgtgtta

SEQ ID NO: 6615239 - DNA, 17 bp, Homo sapiens
accttctttctaataca

SEQ ID NO: 6615240 - DNA, 22 bp, Homo sapiens
accttctttctaatacaagcat

SEQ ID NO: 6615241 - DNA, 18 bp, Homo sapiens
accttcttttcaatgcaa

SEQ ID NO: 6615242 - DNA, 10 bp, Homo sapiens
accttgaaaa

SEQ ID NO: 6615243 - DNA, 22 bp, Homo sapiens
accttgaaaaaaaacagtggat

SEQ ID NO: 6615244 - DNA, 12 bp, Homo sapiens
accttgaaatgg

SEQ ID NO: 6615245 - DNA, 18 bp, Homo sapiens
accttgaacactggggga

SEQ ID NO: 6615246 - DNA, 18 bp, Homo sapiens
accttgaactcctgggct

SEQ ID NO: 6615247 - DNA, 15 bp, Homo sapiens
accttgaactgaagg

SEQ ID NO: 6615248 - DNA, 14 bp, Homo sapiens
accttgaaggtctg

SEQ ID NO: 6615249 - DNA, 21 bp, Homo sapiens
accttgaagtgactgttgtac

SEQ ID NO: 6615250 - DNA, 17 bp, Homo sapiens
accttgaagttctgaaa

SEQ ID NO: 6615251 - DNA, 18 bp, Homo sapiens
accttgaagttctgaaat

SEQ ID NO: 6615252 - DNA, 20 bp, Homo sapiens
accttgaataaggcccactg

SEQ ID NO: 6615253 - DNA, 22 bp, Homo sapiens
accttgaataaggcccactgta

SEQ ID NO: 6615254 - DNA, 13 bp, Homo sapiens
accttgacagagc

SEQ ID NO: 6615255 - DNA, 22 bp, Homo sapiens
accttgaccaaaatcagctttg

SEQ ID NO: 6615256 - DNA, 18 bp, Homo sapiens
accttgacctttgtacag

SEQ ID NO: 6615257 - DNA, 19 bp, Homo sapiens
accttgacctttgtacagc

SEQ ID NO: 6615258 - DNA, 17 bp, Homo sapiens
accttgacgtttcttct

SEQ ID NO: 6615259 - DNA, 18 bp, Homo sapiens
accttgagaccctcttct

SEQ ID NO: 6615260 - DNA, 19 bp, Homo sapiens
accttgagaccctcttctc

SEQ ID NO: 6615261 - DNA, 22 bp, Homo sapiens
accttgaggaggggcaggtaaa

SEQ ID NO: 6615262 - DNA, 18 bp, Homo sapiens
accttgagggtgggccag

SEQ ID NO: 6615263 - DNA, 11 bp, Homo sapiens
accttgaggtc

SEQ ID NO: 6615264 - DNA, 18 bp, Homo sapiens
accttgagtcagaaaaca

SEQ ID NO: 6615265 - DNA, 17 bp, Homo sapiens
accttgatgagctgtgc

SEQ ID NO: 6615266 - DNA, 15 bp, Homo sapiens
accttgcaacacaca

SEQ ID NO: 6615267 - DNA, 21 bp, Homo sapiens
accttgcaacctcaccttcct

SEQ ID NO: 6615268 - DNA, 15 bp, Homo sapiens
accttgcaacttcat

SEQ ID NO: 6615269 - DNA, 13 bp, Homo sapiens
accttgcactcct

SEQ ID NO: 6615270 - DNA, 14 bp, Homo sapiens
accttgcactcctc

SEQ ID NO: 6615271 - DNA, 24 bp, Homo sapiens
accttgcagaaggcaaggccctgc

SEQ ID NO: 6615272 - DNA, 16 bp, Homo sapiens
accttgcagattttct

SEQ ID NO: 6615273 - DNA, 17 bp, Homo sapiens
accttgcagattttctt

SEQ ID NO: 6615274 - DNA, 20 bp, Homo sapiens
accttgcagattttcttaag

SEQ ID NO: 6615275 - DNA, 13 bp, Homo sapiens
accttgcagtatt

SEQ ID NO: 6615276 - DNA, 21 bp, Homo sapiens
accttgcattttagctaattt

SEQ ID NO: 6615277 - DNA, 20 bp, Homo sapiens
accttgccaagctttcttct

SEQ ID NO: 6615278 - DNA, 21 bp, Homo sapiens
accttgccaagctttcttcta

SEQ ID NO: 6615279 - DNA, 19 bp, Homo sapiens
accttgccacccattcttc

SEQ ID NO: 6615280 - DNA, 22 bp, Homo sapiens
accttgccacccattcttcccg

SEQ ID NO: 6615281 - DNA, 12 bp, Homo sapiens
accttgccaggg

SEQ ID NO: 6615282 - DNA, 14 bp, Homo sapiens
accttgccagggag

SEQ ID NO: 6615283 - DNA, 12 bp, Homo sapiens
accttgccccaa

SEQ ID NO: 6615284 - DNA, 14 bp, Homo sapiens
accttgccccaacc

SEQ ID NO: 6615285 - DNA, 18 bp, Homo sapiens
accttgccgagagaggcg

SEQ ID NO: 6615286 - DNA, 14 bp, Homo sapiens
accttgcctcccct

SEQ ID NO: 6615287 - DNA, 18 bp, Homo sapiens
accttgcctcccctcctc

SEQ ID NO: 6615288 - DNA, 23 bp, Homo sapiens
accttgcctgaacatccttcctt

SEQ ID NO: 6615289 - DNA, 24 bp, Homo sapiens
accttgcctgaacatccttccttc

SEQ ID NO: 6615290 - DNA, 15 bp, Homo sapiens
accttgcctggtaca

SEQ ID NO: 6615291 - DNA, 15 bp, Homo sapiens
accttgccttgaaat

SEQ ID NO: 6615292 - DNA, 15 bp, Homo sapiens
accttgctctcctca

SEQ ID NO: 6615293 - DNA, 20 bp, Homo sapiens
accttgctcttctttctgag

SEQ ID NO: 6615294 - DNA, 11 bp, Homo sapiens
accttgctgtc

SEQ ID NO: 6615295 - DNA, 12 bp, Homo sapiens
accttgctgtcc

SEQ ID NO: 6615296 - DNA, 16 bp, Homo sapiens
accttgcttccttctc

SEQ ID NO: 6615297 - DNA, 19 bp, Homo sapiens
accttgctttgatggaata

SEQ ID NO: 6615298 - DNA, 13 bp, Homo sapiens
accttgcttttgc

SEQ ID NO: 6615299 - DNA, 17 bp, Homo sapiens
accttgcttttgcttct

SEQ ID NO: 6615300 - DNA, 21 bp, Homo sapiens
accttggaaacagttggcact

SEQ ID NO: 6615301 - DNA, 19 bp, Homo sapiens
accttggacatcctcctcc

SEQ ID NO: 6615302 - DNA, 20 bp, Homo sapiens
accttggaccactcctgtcc

SEQ ID NO: 6615303 - DNA, 16 bp, Homo sapiens
accttggactcctccc

SEQ ID NO: 6615304 - DNA, 17 bp, Homo sapiens
accttggagagacacag

SEQ ID NO: 6615305 - DNA, 16 bp, Homo sapiens
accttggagaggagag

SEQ ID NO: 6615306 - DNA, 15 bp, Homo sapiens
accttggagcattta

SEQ ID NO: 6615307 - DNA, 16 bp, Homo sapiens
accttggagcatttat

SEQ ID NO: 6615308 - DNA, 14 bp, Homo sapiens
accttggaggagga

SEQ ID NO: 6615309 - DNA, 14 bp, Homo sapiens
accttggcaccaga

SEQ ID NO: 6615310 - DNA, 14 bp, Homo sapiens
accttggcagtgtg

SEQ ID NO: 6615311 - DNA, 17 bp, Homo sapiens
accttggcataagacag

SEQ ID NO: 6615312 - DNA, 13 bp, Homo sapiens
accttggcccagg

SEQ ID NO: 6615313 - DNA, 17 bp, Homo sapiens
accttggcccaggagct

SEQ ID NO: 6615314 - DNA, 20 bp, Homo sapiens
accttggcccaggagctctg

SEQ ID NO: 6615315 - DNA, 15 bp, Homo sapiens
accttggccttctcc

SEQ ID NO: 6615316 - DNA, 17 bp, Homo sapiens
accttggccttctcccc

SEQ ID NO: 6615317 - DNA, 20 bp, Homo sapiens
accttggccttctcccctct

SEQ ID NO: 6615318 - DNA, 12 bp, Homo sapiens
accttggctcaa

SEQ ID NO: 6615319 - DNA, 20 bp, Homo sapiens
accttggctctgccagtgga

SEQ ID NO: 6615320 - DNA, 16 bp, Homo sapiens
accttggcttgttatt

SEQ ID NO: 6615321 - DNA, 17 bp, Homo sapiens
accttgggacctgttta

SEQ ID NO: 6615322 - DNA, 23 bp, Homo sapiens
accttgggcacgggagagcgcca

SEQ ID NO: 6615323 - DNA, 12 bp, Homo sapiens
accttgggccaa

SEQ ID NO: 6615324 - DNA, 24 bp, Homo sapiens
accttggggctggggaagaggact

SEQ ID NO: 6615325 - DNA, 16 bp, Homo sapiens
accttgggtggcccct

SEQ ID NO: 6615326 - DNA, 23 bp, Homo sapiens
accttggttatcaaatacatctc

SEQ ID NO: 6615327 - DNA, 13 bp, Homo sapiens
accttggttcctg

SEQ ID NO: 6615328 - DNA, 15 bp, Homo sapiens
accttggttcctggg

SEQ ID NO: 6615329 - DNA, 15 bp, Homo sapiens
accttggttggaagg

SEQ ID NO: 6615330 - DNA, 10 bp, Homo sapiens
accttgtaaa

SEQ ID NO: 6615331 - DNA, 17 bp, Homo sapiens
accttgtaaaaaaagca

SEQ ID NO: 6615332 - DNA, 21 bp, Homo sapiens
accttgtaaaaaaagcaaaaa

SEQ ID NO: 6615333 - DNA, 12 bp, Homo sapiens
accttgtaaaag

SEQ ID NO: 6615334 - DNA, 22 bp, Homo sapiens
accttgtaatgtaactgctctt

SEQ ID NO: 6615335 - DNA, 14 bp, Homo sapiens
accttgtagcatgt

SEQ ID NO: 6615336 - DNA, 20 bp, Homo sapiens
accttgtagcatgtgaagaa

SEQ ID NO: 6615337 - DNA, 10 bp, Homo sapiens
accttgtatt

SEQ ID NO: 6615338 - DNA, 18 bp, Homo sapiens
accttgtattctctttac

SEQ ID NO: 6615339 - DNA, 11 bp, Homo sapiens
accttgtattg

SEQ ID NO: 6615340 - DNA, 21 bp, Homo sapiens
accttgtcaataaaaataaat

SEQ ID NO: 6615341 - DNA, 16 bp, Homo sapiens
accttgtcatgtacca

SEQ ID NO: 6615342 - DNA, 21 bp, Homo sapiens
accttgtcatgtaccatcaat

SEQ ID NO: 6615343 - DNA, 17 bp, Homo sapiens
accttgtcccagccagt

SEQ ID NO: 6615344 - DNA, 16 bp, Homo sapiens
accttgtctttcaaaa

SEQ ID NO: 6615345 - DNA, 17 bp, Homo sapiens
accttgtctttcaaaag

SEQ ID NO: 6615346 - DNA, 16 bp, Homo sapiens
accttgtgaacatcag

SEQ ID NO: 6615347 - DNA, 19 bp, Homo sapiens
accttgtgaacatcagaag

SEQ ID NO: 6615348 - DNA, 12 bp, Homo sapiens
accttgtgaagg

SEQ ID NO: 6615349 - DNA, 13 bp, Homo sapiens
accttgtgcccag

SEQ ID NO: 6615350 - DNA, 20 bp, Homo sapiens
accttgtggcaagcccctgc

SEQ ID NO: 6615351 - DNA, 15 bp, Homo sapiens
accttgtggccgcct

SEQ ID NO: 6615352 - DNA, 13 bp, Homo sapiens
accttgtgggaat

SEQ ID NO: 6615353 - DNA, 12 bp, Homo sapiens
accttgtggtct

SEQ ID NO: 6615354 - DNA, 13 bp, Homo sapiens
accttgtgtaaga

SEQ ID NO: 6615355 - DNA, 13 bp, Homo sapiens
accttgtgtctgt

SEQ ID NO: 6615356 - DNA, 15 bp, Homo sapiens
accttgtgtctgtac

SEQ ID NO: 6615357 - DNA, 21 bp, Homo sapiens
accttgtgtctgtacacgtgt

SEQ ID NO: 6615358 - DNA, 13 bp, Homo sapiens
accttgtgtggcg

SEQ ID NO: 6615359 - DNA, 15 bp, Homo sapiens
accttgttattaact

SEQ ID NO: 6615360 - DNA, 17 bp, Homo sapiens
accttgttggagcctgc

SEQ ID NO: 6615361 - DNA, 21 bp, Homo sapiens
accttgtttggggcacagtag

SEQ ID NO: 6615362 - DNA, 12 bp, Homo sapiens
accttgtttgtt

SEQ ID NO: 6615363 - DNA, 21 bp, Homo sapiens
accttgtttttaatctcctgt

SEQ ID NO: 6615364 - DNA, 22 bp, Homo sapiens
acctttaaaaaataatttagat

SEQ ID NO: 6615365 - DNA, 15 bp, Homo sapiens
acctttaaaaatgta

SEQ ID NO: 6615366 - DNA, 14 bp, Homo sapiens
acctttaaaataat

SEQ ID NO: 6615367 - DNA, 18 bp, Homo sapiens
acctttaaaattgtcacc

SEQ ID NO: 6615368 - DNA, 15 bp, Homo sapiens
acctttaaagagccc

SEQ ID NO: 6615369 - DNA, 16 bp, Homo sapiens
acctttaaatatcatt

SEQ ID NO: 6615370 - DNA, 16 bp, Homo sapiens
acctttaacacagacc

SEQ ID NO: 6615371 - DNA, 21 bp, Homo sapiens
acctttaagaaaaatgaaaac

SEQ ID NO: 6615372 - DNA, 14 bp, Homo sapiens
acctttaagaattt

SEQ ID NO: 6615373 - DNA, 21 bp, Homo sapiens
acctttaagaattttaaatat

SEQ ID NO: 6615374 - DNA, 22 bp, Homo sapiens
acctttaagaattttaaatatt

SEQ ID NO: 6615375 - DNA, 11 bp, Homo sapiens
acctttaatga

SEQ ID NO: 6615376 - DNA, 14 bp, Homo sapiens
acctttacagttag

SEQ ID NO: 6615377 - DNA, 16 bp, Homo sapiens
acctttactctgctct

SEQ ID NO: 6615378 - DNA, 13 bp, Homo sapiens
acctttagaatat

SEQ ID NO: 6615379 - DNA, 14 bp, Homo sapiens
acctttagggcagc

SEQ ID NO: 6615380 - DNA, 21 bp, Homo sapiens
acctttagggcagcttgcccc

SEQ ID NO: 6615381 - DNA, 22 bp, Homo sapiens
acctttaggtcaaactccctag

SEQ ID NO: 6615382 - DNA, 19 bp, Homo sapiens
acctttataggataactga

SEQ ID NO: 6615383 - DNA, 17 bp, Homo sapiens
acctttatccctgctta

SEQ ID NO: 6615384 - DNA, 16 bp, Homo sapiens
acctttatctttcacc

SEQ ID NO: 6615385 - DNA, 13 bp, Homo sapiens
acctttatgaggt

SEQ ID NO: 6615386 - DNA, 15 bp, Homo sapiens
acctttattaaaatc

SEQ ID NO: 6615387 - DNA, 17 bp, Homo sapiens
acctttattaaaatctt

SEQ ID NO: 6615388 - DNA, 21 bp, Homo sapiens
acctttattaatgaactgtga

SEQ ID NO: 6615389 - DNA, 17 bp, Homo sapiens
acctttattcacccctg

SEQ ID NO: 6615390 - DNA, 20 bp, Homo sapiens
acctttattcacccctgccc

SEQ ID NO: 6615391 - DNA, 15 bp, Homo sapiens
acctttattcagaac

SEQ ID NO: 6615392 - DNA, 18 bp, Homo sapiens
acctttattcagaacttt

SEQ ID NO: 6615393 - DNA, 12 bp, Homo sapiens
acctttattctg

SEQ ID NO: 6615394 - DNA, 14 bp, Homo sapiens
acctttatttatta

SEQ ID NO: 6615395 - DNA, 22 bp, Homo sapiens
acctttatttattaaacttcag

SEQ ID NO: 6615396 - DNA, 18 bp, Homo sapiens
acctttatttttctatct

SEQ ID NO: 6615397 - DNA, 19 bp, Homo sapiens
acctttatttttctatctg

SEQ ID NO: 6615398 - DNA, 15 bp, Homo sapiens
acctttcaaaatgga

SEQ ID NO: 6615399 - DNA, 16 bp, Homo sapiens
acctttcaaagaactc

SEQ ID NO: 6615400 - DNA, 15 bp, Homo sapiens
acctttcaaagccat

SEQ ID NO: 6615401 - DNA, 19 bp, Homo sapiens
acctttcaccctcatgaaa

SEQ ID NO: 6615402 - DNA, 20 bp, Homo sapiens
acctttcaccctcatgaaaa

SEQ ID NO: 6615403 - DNA, 18 bp, Homo sapiens
acctttcacctttgtgta

SEQ ID NO: 6615404 - DNA, 17 bp, Homo sapiens
acctttcagtactctta

SEQ ID NO: 6615405 - DNA, 19 bp, Homo sapiens
acctttcataatctttgct

SEQ ID NO: 6615406 - DNA, 20 bp, Homo sapiens
acctttcataatctttgctt

SEQ ID NO: 6615407 - DNA, 15 bp, Homo sapiens
acctttccacccaga

SEQ ID NO: 6615408 - DNA, 16 bp, Homo sapiens
acctttccacccagac

SEQ ID NO: 6615409 - DNA, 19 bp, Homo sapiens
acctttccacccagaccct

SEQ ID NO: 6615410 - DNA, 15 bp, Homo sapiens
acctttccactccca

SEQ ID NO: 6615411 - DNA, 21 bp, Homo sapiens
acctttccagggtcaaagtac

SEQ ID NO: 6615412 - DNA, 13 bp, Homo sapiens
acctttcccatct

SEQ ID NO: 6615413 - DNA, 18 bp, Homo sapiens
acctttcccatgctgaat

SEQ ID NO: 6615414 - DNA, 16 bp, Homo sapiens
acctttcccatttcgt

SEQ ID NO: 6615415 - DNA, 17 bp, Homo sapiens
acctttccccagacaca

SEQ ID NO: 6615416 - DNA, 15 bp, Homo sapiens
acctttccctaaaga

SEQ ID NO: 6615417 - DNA, 17 bp, Homo sapiens
acctttccctcaccccc

SEQ ID NO: 6615418 - DNA, 16 bp, Homo sapiens
acctttcctacatttt

SEQ ID NO: 6615419 - DNA, 18 bp, Homo sapiens
acctttcctacattttct

SEQ ID NO: 6615420 - DNA, 14 bp, Homo sapiens
acctttcctctccc

SEQ ID NO: 6615421 - DNA, 22 bp, Homo sapiens
acctttctaacccactaagtaa

SEQ ID NO: 6615422 - DNA, 11 bp, Homo sapiens
acctttctagt

SEQ ID NO: 6615423 - DNA, 15 bp, Homo sapiens
acctttctagttgaa

SEQ ID NO: 6615424 - DNA, 16 bp, Homo sapiens
acctttctccactggg

SEQ ID NO: 6615425 - DNA, 15 bp, Homo sapiens
acctttctcctttgt

SEQ ID NO: 6615426 - DNA, 19 bp, Homo sapiens
acctttctcctttgtactt

SEQ ID NO: 6615427 - DNA, 23 bp, Homo sapiens
acctttctcctttgtactttgtg

SEQ ID NO: 6615428 - DNA, 12 bp, Homo sapiens
acctttctgagt

SEQ ID NO: 6615429 - DNA, 13 bp, Homo sapiens
acctttctgggct

SEQ ID NO: 6615430 - DNA, 14 bp, Homo sapiens
acctttctgggctt

SEQ ID NO: 6615431 - DNA, 16 bp, Homo sapiens
acctttctgggctttc

SEQ ID NO: 6615432 - DNA, 21 bp, Homo sapiens
acctttctgggctttctcctg

SEQ ID NO: 6615433 - DNA, 23 bp, Homo sapiens
acctttctgggctttctcctgga

SEQ ID NO: 6615434 - DNA, 15 bp, Homo sapiens
acctttctgtagcct

SEQ ID NO: 6615435 - DNA, 17 bp, Homo sapiens
acctttgacaaaggtaa

SEQ ID NO: 6615436 - DNA, 18 bp, Homo sapiens
acctttgacaaaggtaaa

SEQ ID NO: 6615437 - DNA, 19 bp, Homo sapiens
acctttgatgaattcttcc

SEQ ID NO: 6615438 - DNA, 14 bp, Homo sapiens
acctttgcaggcat

SEQ ID NO: 6615439 - DNA, 15 bp, Homo sapiens
acctttgcccacaca

SEQ ID NO: 6615440 - DNA, 21 bp, Homo sapiens
acctttgcgtggatcaagctt

SEQ ID NO: 6615441 - DNA, 12 bp, Homo sapiens
acctttggaatt

SEQ ID NO: 6615442 - DNA, 18 bp, Homo sapiens
acctttggcttaattcca

SEQ ID NO: 6615443 - DNA, 19 bp, Homo sapiens
acctttgggatcagcctcc

SEQ ID NO: 6615444 - DNA, 21 bp, Homo sapiens
acctttgggatcagcctccgc

SEQ ID NO: 6615445 - DNA, 19 bp, Homo sapiens
acctttgggttctttctgg

SEQ ID NO: 6615446 - DNA, 19 bp, Homo sapiens
acctttgtaagaaaaccaa

SEQ ID NO: 6615447 - DNA, 16 bp, Homo sapiens
acctttgtaagacatt

SEQ ID NO: 6615448 - DNA, 19 bp, Homo sapiens
acctttgtaagacatttgt

SEQ ID NO: 6615449 - DNA, 17 bp, Homo sapiens
acctttgtacagcccag

SEQ ID NO: 6615450 - DNA, 22 bp, Homo sapiens
acctttgtagcactcaggctct

SEQ ID NO: 6615451 - DNA, 15 bp, Homo sapiens
acctttgtcaaaaag

SEQ ID NO: 6615452 - DNA, 13 bp, Homo sapiens
acctttgtcaact

SEQ ID NO: 6615453 - DNA, 17 bp, Homo sapiens
acctttgtccaggcctg

SEQ ID NO: 6615454 - DNA, 14 bp, Homo sapiens
acctttgtccccac

SEQ ID NO: 6615455 - DNA, 21 bp, Homo sapiens
acctttgtctcacgattccag

SEQ ID NO: 6615456 - DNA, 24 bp, Homo sapiens
acctttgtctcacgattccagtgc

SEQ ID NO: 6615457 - DNA, 23 bp, Homo sapiens
acctttgtggggtttttggagaa

SEQ ID NO: 6615458 - DNA, 22 bp, Homo sapiens
acctttgtttgcatctgaaaat

SEQ ID NO: 6615459 - DNA, 16 bp, Homo sapiens
acctttgttttttgtt

SEQ ID NO: 6615460 - DNA, 17 bp, Homo sapiens
accttttaaaaaaataa

SEQ ID NO: 6615461 - DNA, 14 bp, Homo sapiens
accttttaaaattg

SEQ ID NO: 6615462 - DNA, 21 bp, Homo sapiens
accttttaaagtgtttcagct

SEQ ID NO: 6615463 - DNA, 20 bp, Homo sapiens
accttttaaatcctgttgaa

SEQ ID NO: 6615464 - DNA, 23 bp, Homo sapiens
accttttaagttaatgaaataaa

SEQ ID NO: 6615465 - DNA, 17 bp, Homo sapiens
accttttacattgtgac

SEQ ID NO: 6615466 - DNA, 19 bp, Homo sapiens
accttttaccagcttttaa

SEQ ID NO: 6615467 - DNA, 20 bp, Homo sapiens
accttttaccagcttttaac

SEQ ID NO: 6615468 - DNA, 11 bp, Homo sapiens
accttttactg

SEQ ID NO: 6615469 - DNA, 20 bp, Homo sapiens
accttttactggttgcatgg

SEQ ID NO: 6615470 - DNA, 21 bp, Homo sapiens
accttttactggttgcatgga

SEQ ID NO: 6615471 - DNA, 16 bp, Homo sapiens
accttttactgtgatg

SEQ ID NO: 6615472 - DNA, 21 bp, Homo sapiens
accttttatcaataaagcact

SEQ ID NO: 6615473 - DNA, 15 bp, Homo sapiens
accttttatgtagca

SEQ ID NO: 6615474 - DNA, 20 bp, Homo sapiens
accttttatgtagtaattga

SEQ ID NO: 6615475 - DNA, 13 bp, Homo sapiens
accttttattata

SEQ ID NO: 6615476 - DNA, 16 bp, Homo sapiens
accttttattgacaca

SEQ ID NO: 6615477 - DNA, 15 bp, Homo sapiens
accttttcaaattaa

SEQ ID NO: 6615478 - DNA, 11 bp, Homo sapiens
accttttcagg

SEQ ID NO: 6615479 - DNA, 23 bp, Homo sapiens
accttttccccaaccacagagaa

SEQ ID NO: 6615480 - DNA, 14 bp, Homo sapiens
accttttccccagg

SEQ ID NO: 6615481 - DNA, 16 bp, Homo sapiens
accttttccccaggag

SEQ ID NO: 6615482 - DNA, 12 bp, Homo sapiens
accttttccctt

SEQ ID NO: 6615483 - DNA, 12 bp, Homo sapiens
accttttcctca

SEQ ID NO: 6615484 - DNA, 17 bp, Homo sapiens
accttttctataagttg

SEQ ID NO: 6615485 - DNA, 23 bp, Homo sapiens
accttttctataagttgtaccaa

SEQ ID NO: 6615486 - DNA, 13 bp, Homo sapiens
accttttctcttt

SEQ ID NO: 6615487 - DNA, 22 bp, Homo sapiens
accttttgataaaatgttcctt

SEQ ID NO: 6615488 - DNA, 22 bp, Homo sapiens
accttttggcctttgtaagaca

SEQ ID NO: 6615489 - DNA, 13 bp, Homo sapiens
accttttggggga

SEQ ID NO: 6615490 - DNA, 17 bp, Homo sapiens
accttttgggggagggc

SEQ ID NO: 6615491 - DNA, 18 bp, Homo sapiens
accttttggtcttcagcc

SEQ ID NO: 6615492 - DNA, 21 bp, Homo sapiens
accttttggtcttcagcctcc

SEQ ID NO: 6615493 - DNA, 23 bp, Homo sapiens
accttttgtagttttatttgtat

SEQ ID NO: 6615494 - DNA, 16 bp, Homo sapiens
accttttgtatttaaa

SEQ ID NO: 6615495 - DNA, 14 bp, Homo sapiens
accttttgttttct

SEQ ID NO: 6615496 - DNA, 18 bp, Homo sapiens
accttttgtttttccagt

SEQ ID NO: 6615497 - DNA, 14 bp, Homo sapiens
acctttttaataaa

SEQ ID NO: 6615498 - DNA, 19 bp, Homo sapiens
acctttttaatttccagaa

SEQ ID NO: 6615499 - DNA, 15 bp, Homo sapiens
acctttttatattta

SEQ ID NO: 6615500 - DNA, 14 bp, Homo sapiens
acctttttatctcc

SEQ ID NO: 6615501 - DNA, 15 bp, Homo sapiens
acctttttccttcct

SEQ ID NO: 6615502 - DNA, 23 bp, Homo sapiens
acctttttgcatgatatcttcaa

SEQ ID NO: 6615503 - DNA, 15 bp, Homo sapiens
acctttttgtaaata

SEQ ID NO: 6615504 - DNA, 17 bp, Homo sapiens
acctttttgtaaatact

SEQ ID NO: 6615505 - DNA, 16 bp, Homo sapiens
accttttttcacccca

SEQ ID NO: 6615506 - DNA, 15 bp, Homo sapiens
accttttttgttcca

SEQ ID NO: 6615507 - DNA, 19 bp, Homo sapiens
accttttttttacggaatt

SEQ ID NO: 6615508 - DNA, 22 bp, Homo sapiens
accttttttttacggaattcca

SEQ ID NO: 6615509 - DNA, 16 bp, Homo sapiens
acctttttttttgaaa

SEQ ID NO: 6615510 - DNA, 19 bp, Homo sapiens
acgaaaaagtgattgtgaa

SEQ ID NO: 6615511 - DNA, 14 bp, Homo sapiens
acgaaacaaagaca

SEQ ID NO: 6615512 - DNA, 15 bp, Homo sapiens
acgaaactccatctc

SEQ ID NO: 6615513 - DNA, 19 bp, Homo sapiens
acgaaacttgttattgtga

SEQ ID NO: 6615514 - DNA, 14 bp, Homo sapiens
acgaaagagagaga

SEQ ID NO: 6615515 - DNA, 23 bp, Homo sapiens
acgaaagagagagaaacaaactt

SEQ ID NO: 6615516 - DNA, 19 bp, Homo sapiens
acgaaagtaaagtaaagta

SEQ ID NO: 6615517 - DNA, 17 bp, Homo sapiens
acgaaatatcaaagtca

SEQ ID NO: 6615518 - DNA, 13 bp, Homo sapiens
acgaaatggaaac

SEQ ID NO: 6615519 - DNA, 14 bp, Homo sapiens
acgaaatggaaaca

SEQ ID NO: 6615520 - DNA, 20 bp, Homo sapiens
acgaaatggaaacacacaca

SEQ ID NO: 6615521 - DNA, 13 bp, Homo sapiens
acgaaatgttatt

SEQ ID NO: 6615522 - DNA, 13 bp, Homo sapiens
acgaacaaaacac

SEQ ID NO: 6615523 - DNA, 16 bp, Homo sapiens
acgaacacaagaaaaa

SEQ ID NO: 6615524 - DNA, 13 bp, Homo sapiens
acgaacaggggcc

SEQ ID NO: 6615525 - DNA, 17 bp, Homo sapiens
acgaacatggcatgtga

SEQ ID NO: 6615526 - DNA, 14 bp, Homo sapiens
acgaacccacctgc

SEQ ID NO: 6615527 - DNA, 16 bp, Homo sapiens
acgaacccacctgctg

SEQ ID NO: 6615528 - DNA, 17 bp, Homo sapiens
acgaacccactgtgctt

SEQ ID NO: 6615529 - DNA, 21 bp, Homo sapiens
acgaacccactgtgcttacag

SEQ ID NO: 6615530 - DNA, 16 bp, Homo sapiens
acgaacccctcccctc

SEQ ID NO: 6615531 - DNA, 21 bp, Homo sapiens
acgaacccctcccctcccccc

SEQ ID NO: 6615532 - DNA, 18 bp, Homo sapiens
acgaacctcggggtgggg

SEQ ID NO: 6615533 - DNA, 14 bp, Homo sapiens
acgaacgttttaaa

SEQ ID NO: 6615534 - DNA, 12 bp, Homo sapiens
acgaagaaaaaa

SEQ ID NO: 6615535 - DNA, 12 bp, Homo sapiens
acgaagaaatag

SEQ ID NO: 6615536 - DNA, 17 bp, Homo sapiens
acgaagaagagccacag

SEQ ID NO: 6615537 - DNA, 13 bp, Homo sapiens
acgaagacgccaa

SEQ ID NO: 6615538 - DNA, 14 bp, Homo sapiens
acgaagccacaggc

SEQ ID NO: 6615539 - DNA, 23 bp, Homo sapiens
acgaagccttaagccataggccc

SEQ ID NO: 6615540 - DNA, 16 bp, Homo sapiens
acgaagctcattccca

SEQ ID NO: 6615541 - DNA, 13 bp, Homo sapiens
acgaaggagccca

SEQ ID NO: 6615542 - DNA, 21 bp, Homo sapiens
acgaaggtaaaaagtattttt

SEQ ID NO: 6615543 - DNA, 22 bp, Homo sapiens
acgaatacttttgccctttgat

SEQ ID NO: 6615544 - DNA, 15 bp, Homo sapiens
acgaatagacatcaa

SEQ ID NO: 6615545 - DNA, 21 bp, Homo sapiens
acgaatataagcttaaaataa

SEQ ID NO: 6615546 - DNA, 22 bp, Homo sapiens
acgaatataagcttaaaataag

SEQ ID NO: 6615547 - DNA, 12 bp, Homo sapiens
acgaatatgaat

SEQ ID NO: 6615548 - DNA, 16 bp, Homo sapiens
acgaatatgaatgtca

SEQ ID NO: 6615549 - DNA, 15 bp, Homo sapiens
acgaatattgctgat

SEQ ID NO: 6615550 - DNA, 20 bp, Homo sapiens
acgaatcctgctctaaaata

SEQ ID NO: 6615551 - DNA, 21 bp, Homo sapiens
acgaatctcatccctcaactg

SEQ ID NO: 6615552 - DNA, 17 bp, Homo sapiens
acgaatcttatttttcc

SEQ ID NO: 6615553 - DNA, 23 bp, Homo sapiens
acgaatcttatttttcctgtcct

SEQ ID NO: 6615554 - DNA, 17 bp, Homo sapiens
acgaatgcatattcaac

SEQ ID NO: 6615555 - DNA, 19 bp, Homo sapiens
acgaatgcatattcaacac

SEQ ID NO: 6615556 - DNA, 21 bp, Homo sapiens
acgaatggtctttgctccaga

SEQ ID NO: 6615557 - DNA, 20 bp, Homo sapiens
acgaattatttttttaaact

SEQ ID NO: 6615558 - DNA, 21 bp, Homo sapiens
acgaattatttttttaaactt

SEQ ID NO: 6615559 - DNA, 17 bp, Homo sapiens
acgaatttctatagact

SEQ ID NO: 6615560 - DNA, 21 bp, Homo sapiens
acgaatttctgtgccctcctg

SEQ ID NO: 6615561 - DNA, 22 bp, Homo sapiens
acgaatttctgtgccctcctga

SEQ ID NO: 6615562 - DNA, 20 bp, Homo sapiens
acgaattttaaaacatggca

SEQ ID NO: 6615563 - DNA, 15 bp, Homo sapiens
acgacaaagctgcta

SEQ ID NO: 6615564 - DNA, 19 bp, Homo sapiens
acgacaaggaaaggcaaat

SEQ ID NO: 6615565 - DNA, 14 bp, Homo sapiens
acgacacactttga

SEQ ID NO: 6615566 - DNA, 23 bp, Homo sapiens
acgacacctagctctaagagcaa

SEQ ID NO: 6615567 - DNA, 21 bp, Homo sapiens
acgacacctggagactgtccc

SEQ ID NO: 6615568 - DNA, 20 bp, Homo sapiens
acgacacgggtggggaaagg

SEQ ID NO: 6615569 - DNA, 12 bp, Homo sapiens
acgacactgaag

SEQ ID NO: 6615570 - DNA, 14 bp, Homo sapiens
acgacactgcagcc

SEQ ID NO: 6615571 - DNA, 13 bp, Homo sapiens
acgaccaaactca

SEQ ID NO: 6615572 - DNA, 17 bp, Homo sapiens
acgacccttttgagcct

SEQ ID NO: 6615573 - DNA, 21 bp, Homo sapiens
acgaccggggccagcaccact

SEQ ID NO: 6615574 - DNA, 22 bp, Homo sapiens
acgaccgtcttttgaaaactca

SEQ ID NO: 6615575 - DNA, 21 bp, Homo sapiens
acgacctacatctgaaatcta

SEQ ID NO: 6615576 - DNA, 21 bp, Homo sapiens
acgacctaggcagtaggccgg

SEQ ID NO: 6615577 - DNA, 19 bp, Homo sapiens
acgacgtgggaatttcaat

SEQ ID NO: 6615578 - DNA, 11 bp, Homo sapiens
acgactacaga

SEQ ID NO: 6615579 - DNA, 16 bp, Homo sapiens
acgactcaaaatgaca

SEQ ID NO: 6615580 - DNA, 17 bp, Homo sapiens
acgactccgagaacaac

SEQ ID NO: 6615581 - DNA, 16 bp, Homo sapiens
acgactctaaacacac

SEQ ID NO: 6615582 - DNA, 11 bp, Homo sapiens
acgactcttcc

SEQ ID NO: 6615583 - DNA, 16 bp, Homo sapiens
acgactcttcctgcaa

SEQ ID NO: 6615584 - DNA, 18 bp, Homo sapiens
acgactgaagaaggacat

SEQ ID NO: 6615585 - DNA, 19 bp, Homo sapiens
acgactgcgggagccagac

SEQ ID NO: 6615586 - DNA, 14 bp, Homo sapiens
acgacttcagggca

SEQ ID NO: 6615587 - DNA, 21 bp, Homo sapiens
acgacttcttcggaggtggca

SEQ ID NO: 6615588 - DNA, 23 bp, Homo sapiens
acgacttcttcggaggtggcagc

SEQ ID NO: 6615589 - DNA, 17 bp, Homo sapiens
acgacttttttgagaca

SEQ ID NO: 6615590 - DNA, 14 bp, Homo sapiens
acgagaaaacaata

SEQ ID NO: 6615591 - DNA, 15 bp, Homo sapiens
acgagaaagatcatt

SEQ ID NO: 6615592 - DNA, 16 bp, Homo sapiens
acgagaagtgctttat

SEQ ID NO: 6615593 - DNA, 20 bp, Homo sapiens
acgagaattgcttgaacccg

SEQ ID NO: 6615594 - DNA, 20 bp, Homo sapiens
acgagacccccatccagcct

SEQ ID NO: 6615595 - DNA, 21 bp, Homo sapiens
acgagacccccatccagcctc

SEQ ID NO: 6615596 - DNA, 22 bp, Homo sapiens
acgagacccccatccagcctcc

SEQ ID NO: 6615597 - DNA, 14 bp, Homo sapiens
acgagactttctcc

SEQ ID NO: 6615598 - DNA, 15 bp, Homo sapiens
acgagagtgcctccc

SEQ ID NO: 6615599 - DNA, 13 bp, Homo sapiens
acgagatcttcct

SEQ ID NO: 6615600 - DNA, 15 bp, Homo sapiens
acgagcactggccag

SEQ ID NO: 6615601 - DNA, 18 bp, Homo sapiens
acgagcactggccagaga

SEQ ID NO: 6615602 - DNA, 18 bp, Homo sapiens
acgagcagagcgcagccc

SEQ ID NO: 6615603 - DNA, 13 bp, Homo sapiens
acgagcagcccag

SEQ ID NO: 6615604 - DNA, 22 bp, Homo sapiens
acgagcagcccagggcctagag

SEQ ID NO: 6615605 - DNA, 14 bp, Homo sapiens
acgagcatccccct

SEQ ID NO: 6615606 - DNA, 16 bp, Homo sapiens
acgagcatccccctcc

SEQ ID NO: 6615607 - DNA, 18 bp, Homo sapiens
acgagccacaagctgcac

SEQ ID NO: 6615608 - DNA, 20 bp, Homo sapiens
acgagccacaagctgcactg

SEQ ID NO: 6615609 - DNA, 22 bp, Homo sapiens
acgagccacaagctgcactgtg

SEQ ID NO: 6615610 - DNA, 15 bp, Homo sapiens
acgagcctcctcagg

SEQ ID NO: 6615611 - DNA, 16 bp, Homo sapiens
acgagcctcctcaggg

SEQ ID NO: 6615612 - DNA, 21 bp, Homo sapiens
acgagccttctcaccccagga

SEQ ID NO: 6615613 - DNA, 21 bp, Homo sapiens
acgagcctttgtttttctcca

SEQ ID NO: 6615614 - DNA, 22 bp, Homo sapiens
acgaggaaaagaacaaacaaaa

SEQ ID NO: 6615615 - DNA, 20 bp, Homo sapiens
acgaggaatctgtgggtctg

SEQ ID NO: 6615616 - DNA, 20 bp, Homo sapiens
acgaggacatttgtgggcaa

SEQ ID NO: 6615617 - DNA, 18 bp, Homo sapiens
acgaggagcttccagtgc

SEQ ID NO: 6615618 - DNA, 16 bp, Homo sapiens
acgaggccctcgggcc

SEQ ID NO: 6615619 - DNA, 15 bp, Homo sapiens
acgaggctgccccca

SEQ ID NO: 6615620 - DNA, 16 bp, Homo sapiens
acgaggctgcccccat

SEQ ID NO: 6615621 - DNA, 14 bp, Homo sapiens
acgaggctgggcca

SEQ ID NO: 6615622 - DNA, 14 bp, Homo sapiens
acgagggccaggca

SEQ ID NO: 6615623 - DNA, 15 bp, Homo sapiens
acgagggccaggcac

SEQ ID NO: 6615624 - DNA, 21 bp, Homo sapiens
acgagggctgatggaggaaaa

SEQ ID NO: 6615625 - DNA, 20 bp, Homo sapiens
acgagggctggctggcctca

SEQ ID NO: 6615626 - DNA, 10 bp, Homo sapiens
acgaggggac

SEQ ID NO: 6615627 - DNA, 17 bp, Homo sapiens
acgaggggacccatggg

SEQ ID NO: 6615628 - DNA, 20 bp, Homo sapiens
acgaggggcttcctctagag

SEQ ID NO: 6615629 - DNA, 19 bp, Homo sapiens
acgagggtctcccctcctg

SEQ ID NO: 6615630 - DNA, 21 bp, Homo sapiens
acgagtagaggtttaaagaaa

SEQ ID NO: 6615631 - DNA, 16 bp, Homo sapiens
acgagtcacctgcaag

SEQ ID NO: 6615632 - DNA, 16 bp, Homo sapiens
acgagtcaccttccag

SEQ ID NO: 6615633 - DNA, 17 bp, Homo sapiens
acgagtgttcctgtgct

SEQ ID NO: 6615634 - DNA, 21 bp, Homo sapiens
acgagttaatgatggcagagg

SEQ ID NO: 6615635 - DNA, 21 bp, Homo sapiens
acgagtttggatgttgtaaat

SEQ ID NO: 6615636 - DNA, 22 bp, Homo sapiens
acgagtttggatgttgtaaata

SEQ ID NO: 6615637 - DNA, 22 bp, Homo sapiens
acgataaaattacaaaagagca

SEQ ID NO: 6615638 - DNA, 21 bp, Homo sapiens
acgatagcctagctttctaaa

SEQ ID NO: 6615639 - DNA, 23 bp, Homo sapiens
acgataggtagaattgtggttcc

SEQ ID NO: 6615640 - DNA, 15 bp, Homo sapiens
acgatatatgtaaat

SEQ ID NO: 6615641 - DNA, 18 bp, Homo sapiens
acgatcacaaatgacttt

SEQ ID NO: 6615642 - DNA, 22 bp, Homo sapiens
acgatcattgtgcccacttacc

SEQ ID NO: 6615643 - DNA, 22 bp, Homo sapiens
acgatccccatggaacagccct

SEQ ID NO: 6615644 - DNA, 16 bp, Homo sapiens
acgatcccctccccca

SEQ ID NO: 6615645 - DNA, 20 bp, Homo sapiens
acgatcctgccaccctgtag

SEQ ID NO: 6615646 - DNA, 18 bp, Homo sapiens
acgatcttcccccttccc

SEQ ID NO: 6615647 - DNA, 15 bp, Homo sapiens
acgatgaatttcttc

SEQ ID NO: 6615648 - DNA, 14 bp, Homo sapiens
acgatgacagtgtt

SEQ ID NO: 6615649 - DNA, 20 bp, Homo sapiens
acgatgacgcctctggacct

SEQ ID NO: 6615650 - DNA, 15 bp, Homo sapiens
acgatgatgtacaga

SEQ ID NO: 6615651 - DNA, 13 bp, Homo sapiens
acgatgcctttga

SEQ ID NO: 6615652 - DNA, 15 bp, Homo sapiens
acgatggcacccagt

SEQ ID NO: 6615653 - DNA, 18 bp, Homo sapiens
acgatgggatcattattt

SEQ ID NO: 6615654 - DNA, 22 bp, Homo sapiens
acgatgggctttcccaacagct

SEQ ID NO: 6615655 - DNA, 12 bp, Homo sapiens
acgatgtaaatt

SEQ ID NO: 6615656 - DNA, 13 bp, Homo sapiens
acgatgtcttcat

SEQ ID NO: 6615657 - DNA, 17 bp, Homo sapiens
acgatgtggccctggcc

SEQ ID NO: 6615658 - DNA, 19 bp, Homo sapiens
acgatgtggccctggcctg

SEQ ID NO: 6615659 - DNA, 23 bp, Homo sapiens
acgatgtgtctgtatttcatgtg

SEQ ID NO: 6615660 - DNA, 22 bp, Homo sapiens
acgatgttaaaacaaattaaaa

SEQ ID NO: 6615661 - DNA, 22 bp, Homo sapiens
acgatgttgtattgatttttaa

SEQ ID NO: 6615662 - DNA, 12 bp, Homo sapiens
acgatgtttatg

SEQ ID NO: 6615663 - DNA, 14 bp, Homo sapiens
acgattagctttat

SEQ ID NO: 6615664 - DNA, 16 bp, Homo sapiens
acgattatttatttct

SEQ ID NO: 6615665 - DNA, 13 bp, Homo sapiens
acgattcacagcc

SEQ ID NO: 6615666 - DNA, 14 bp, Homo sapiens
acgattccagtgca

SEQ ID NO: 6615667 - DNA, 20 bp, Homo sapiens
acgattgacaccaaaatgaa

SEQ ID NO: 6615668 - DNA, 12 bp, Homo sapiens
acgattggccac

SEQ ID NO: 6615669 - DNA, 15 bp, Homo sapiens
acgatttaattctct

SEQ ID NO: 6615670 - DNA, 14 bp, Homo sapiens
acgatttaatttat

SEQ ID NO: 6615671 - DNA, 14 bp, Homo sapiens
acgatttctgttta

SEQ ID NO: 6615672 - DNA, 17 bp, Homo sapiens
acgatttctgtttagat

SEQ ID NO: 6615673 - DNA, 23 bp, Homo sapiens
acgatttctgtttagataataca

SEQ ID NO: 6615674 - DNA, 21 bp, Homo sapiens
acgatttgcaggattcccttc

SEQ ID NO: 6615675 - DNA, 13 bp, Homo sapiens
acgattttgcaca

SEQ ID NO: 6615676 - DNA, 18 bp, Homo sapiens
acgcaaaaccactttcct

SEQ ID NO: 6615677 - DNA, 21 bp, Homo sapiens
acgcaaaagcgactcccagct

SEQ ID NO: 6615678 - DNA, 18 bp, Homo sapiens
acgcaactcacacctcct

SEQ ID NO: 6615679 - DNA, 16 bp, Homo sapiens
acgcaaggctgtgctc

SEQ ID NO: 6615680 - DNA, 21 bp, Homo sapiens
acgcaaggctgtgctcttcct

SEQ ID NO: 6615681 - DNA, 17 bp, Homo sapiens
acgcaagggagaagaaa

SEQ ID NO: 6615682 - DNA, 15 bp, Homo sapiens
acgcaagttcccagt

SEQ ID NO: 6615683 - DNA, 14 bp, Homo sapiens
acgcaattgtatat

SEQ ID NO: 6615684 - DNA, 20 bp, Homo sapiens
acgcaattgtatatatatgt

SEQ ID NO: 6615685 - DNA, 19 bp, Homo sapiens
acgcaattttacctagttt

SEQ ID NO: 6615686 - DNA, 20 bp, Homo sapiens
acgcacaaacacacacacta

SEQ ID NO: 6615687 - DNA, 17 bp, Homo sapiens
acgcacaacatgcacat

SEQ ID NO: 6615688 - DNA, 12 bp, Homo sapiens
acgcacacacac

SEQ ID NO: 6615689 - DNA, 13 bp, Homo sapiens
acgcacacacaca

SEQ ID NO: 6615690 - DNA, 15 bp, Homo sapiens
acgcacacacacata

SEQ ID NO: 6615691 - DNA, 16 bp, Homo sapiens
acgcacacacacatac

SEQ ID NO: 6615692 - DNA, 18 bp, Homo sapiens
acgcacacacacatacag

SEQ ID NO: 6615693 - DNA, 21 bp, Homo sapiens
acgcacacacacgcaaataca

SEQ ID NO: 6615694 - DNA, 12 bp, Homo sapiens
acgcacacagct

SEQ ID NO: 6615695 - DNA, 16 bp, Homo sapiens
acgcacacagctgagc

SEQ ID NO: 6615696 - DNA, 13 bp, Homo sapiens
acgcacacagctt

SEQ ID NO: 6615697 - DNA, 15 bp, Homo sapiens
acgcacacatcagtg

SEQ ID NO: 6615698 - DNA, 20 bp, Homo sapiens
acgcacacatcttacctctc

SEQ ID NO: 6615699 - DNA, 19 bp, Homo sapiens
acgcacacatggacacaga

SEQ ID NO: 6615700 - DNA, 15 bp, Homo sapiens
acgcacacgcacaca

SEQ ID NO: 6615701 - DNA, 13 bp, Homo sapiens
acgcacagacagg

SEQ ID NO: 6615702 - DNA, 18 bp, Homo sapiens
acgcacagcactgcctgc

SEQ ID NO: 6615703 - DNA, 15 bp, Homo sapiens
acgcacagccaagga

SEQ ID NO: 6615704 - DNA, 14 bp, Homo sapiens
acgcacagtgcagt

SEQ ID NO: 6615705 - DNA, 15 bp, Homo sapiens
acgcacatgcgaccc

SEQ ID NO: 6615706 - DNA, 16 bp, Homo sapiens
acgcaccactgccaat

SEQ ID NO: 6615707 - DNA, 15 bp, Homo sapiens
acgcaccactgcttc

SEQ ID NO: 6615708 - DNA, 18 bp, Homo sapiens
acgcaccattttgtcagg

SEQ ID NO: 6615709 - DNA, 23 bp, Homo sapiens
acgcacccacaccctacagcaga

SEQ ID NO: 6615710 - DNA, 19 bp, Homo sapiens
acgcacccgtatctgccct

SEQ ID NO: 6615711 - DNA, 19 bp, Homo sapiens
acgcaccggcctggctgca

SEQ ID NO: 6615712 - DNA, 21 bp, Homo sapiens
acgcaccggcctggctgcagc

SEQ ID NO: 6615713 - DNA, 12 bp, Homo sapiens
acgcacctccac

SEQ ID NO: 6615714 - DNA, 19 bp, Homo sapiens
acgcacctcccatcctaat

SEQ ID NO: 6615715 - DNA, 18 bp, Homo sapiens
acgcacctgtagtcccag

SEQ ID NO: 6615716 - DNA, 14 bp, Homo sapiens
acgcaccttgctgc

SEQ ID NO: 6615717 - DNA, 19 bp, Homo sapiens
acgcaccttgctgcagtgt

SEQ ID NO: 6615718 - DNA, 19 bp, Homo sapiens
acgcacgcaacccttgctg

SEQ ID NO: 6615719 - DNA, 16 bp, Homo sapiens
acgcacgcacccacac

SEQ ID NO: 6615720 - DNA, 17 bp, Homo sapiens
acgcacgctcgctgcca

SEQ ID NO: 6615721 - DNA, 18 bp, Homo sapiens
acgcacgctcgctgccat

SEQ ID NO: 6615722 - DNA, 17 bp, Homo sapiens
acgcacggcagccacag

SEQ ID NO: 6615723 - DNA, 19 bp, Homo sapiens
acgcacgtgggtcttcagg

SEQ ID NO: 6615724 - DNA, 21 bp, Homo sapiens
acgcactgggccacggaggag

SEQ ID NO: 6615725 - DNA, 17 bp, Homo sapiens
acgcactggtgccaaaa

SEQ ID NO: 6615726 - DNA, 19 bp, Homo sapiens
acgcacttgcctgttggct

SEQ ID NO: 6615727 - DNA, 22 bp, Homo sapiens
acgcacttgcctgttggctgct

SEQ ID NO: 6615728 - DNA, 13 bp, Homo sapiens
acgcagacacaca

SEQ ID NO: 6615729 - DNA, 15 bp, Homo sapiens
acgcagacacacaca

SEQ ID NO: 6615730 - DNA, 21 bp, Homo sapiens
acgcagagattttcatctatt

SEQ ID NO: 6615731 - DNA, 19 bp, Homo sapiens
acgcagagccccggagcac

SEQ ID NO: 6615732 - DNA, 20 bp, Homo sapiens
acgcagagccccggagcacc

SEQ ID NO: 6615733 - DNA, 17 bp, Homo sapiens
acgcagattgggctggc

SEQ ID NO: 6615734 - DNA, 20 bp, Homo sapiens
acgcagattgggctggctct

SEQ ID NO: 6615735 - DNA, 19 bp, Homo sapiens
acgcagcaacgtttttaat

SEQ ID NO: 6615736 - DNA, 11 bp, Homo sapiens
acgcagcagct

SEQ ID NO: 6615737 - DNA, 22 bp, Homo sapiens
acgcagcagctgggacccctcc

SEQ ID NO: 6615738 - DNA, 15 bp, Homo sapiens
acgcagccacacagt

SEQ ID NO: 6615739 - DNA, 19 bp, Homo sapiens
acgcagccacacagtggcc

SEQ ID NO: 6615740 - DNA, 12 bp, Homo sapiens
acgcagccagga

SEQ ID NO: 6615741 - DNA, 15 bp, Homo sapiens
acgcagcccagagca

SEQ ID NO: 6615742 - DNA, 22 bp, Homo sapiens
acgcagccccccacgcttctgg

SEQ ID NO: 6615743 - DNA, 24 bp, Homo sapiens
acgcagccctagagcctgcctgga

SEQ ID NO: 6615744 - DNA, 22 bp, Homo sapiens
acgcagccctgctttgggctgc

SEQ ID NO: 6615745 - DNA, 12 bp, Homo sapiens
acgcagccctgg

SEQ ID NO: 6615746 - DNA, 23 bp, Homo sapiens
acgcagccgccgccgcccacgcc

SEQ ID NO: 6615747 - DNA, 14 bp, Homo sapiens
acgcagccggaggg

SEQ ID NO: 6615748 - DNA, 18 bp, Homo sapiens
acgcagccggagggaggc

SEQ ID NO: 6615749 - DNA, 19 bp, Homo sapiens
acgcagccggagggaggca

SEQ ID NO: 6615750 - DNA, 14 bp, Homo sapiens
acgcagcctccagt

SEQ ID NO: 6615751 - DNA, 15 bp, Homo sapiens
acgcagcctgagaat

SEQ ID NO: 6615752 - DNA, 21 bp, Homo sapiens
acgcagcctgagaatgacctg

SEQ ID NO: 6615753 - DNA, 16 bp, Homo sapiens
acgcagctggcagaga

SEQ ID NO: 6615754 - DNA, 14 bp, Homo sapiens
acgcaggaccagtt

SEQ ID NO: 6615755 - DNA, 21 bp, Homo sapiens
acgcaggagaatcactgcagc

SEQ ID NO: 6615756 - DNA, 13 bp, Homo sapiens
acgcaggagagag

SEQ ID NO: 6615757 - DNA, 15 bp, Homo sapiens
acgcaggagagagag

SEQ ID NO: 6615758 - DNA, 23 bp, Homo sapiens
acgcaggagagagagagagaaag

SEQ ID NO: 6615759 - DNA, 21 bp, Homo sapiens
acgcaggaggagaaaagaaat

SEQ ID NO: 6615760 - DNA, 16 bp, Homo sapiens
acgcaggcatctgatt

SEQ ID NO: 6615761 - DNA, 15 bp, Homo sapiens
acgcaggcccctctc

SEQ ID NO: 6615762 - DNA, 21 bp, Homo sapiens
acgcaggcccctctcctccgt

SEQ ID NO: 6615763 - DNA, 12 bp, Homo sapiens
acgcaggccctg

SEQ ID NO: 6615764 - DNA, 14 bp, Homo sapiens
acgcaggccctgtc

SEQ ID NO: 6615765 - DNA, 16 bp, Homo sapiens
acgcaggccctgtcca

SEQ ID NO: 6615766 - DNA, 20 bp, Homo sapiens
acgcaggccctgtccagccc

SEQ ID NO: 6615767 - DNA, 15 bp, Homo sapiens
acgcaggcggccagg

SEQ ID NO: 6615768 - DNA, 17 bp, Homo sapiens
acgcaggcggggcagta

SEQ ID NO: 6615769 - DNA, 16 bp, Homo sapiens
acgcaggctgagtcca

SEQ ID NO: 6615770 - DNA, 14 bp, Homo sapiens
acgcaggggctctg

SEQ ID NO: 6615771 - DNA, 13 bp, Homo sapiens
acgcaggtattta

SEQ ID NO: 6615772 - DNA, 20 bp, Homo sapiens
acgcaggtatttagaagcag

SEQ ID NO: 6615773 - DNA, 23 bp, Homo sapiens
acgcaggtatttagaagcagagg

SEQ ID NO: 6615774 - DNA, 11 bp, Homo sapiens
acgcaggtgct

SEQ ID NO: 6615775 - DNA, 19 bp, Homo sapiens
acgcagttactgaaatctt

SEQ ID NO: 6615776 - DNA, 19 bp, Homo sapiens
acgcagttgtgtggcccag

SEQ ID NO: 6615777 - DNA, 15 bp, Homo sapiens
acgcatctgtagttc

SEQ ID NO: 6615778 - DNA, 16 bp, Homo sapiens
acgcatgcagggcccc

SEQ ID NO: 6615779 - DNA, 19 bp, Homo sapiens
acgcatgtccctccaaggc

SEQ ID NO: 6615780 - DNA, 21 bp, Homo sapiens
acgcattaagggcctgctgga

SEQ ID NO: 6615781 - DNA, 16 bp, Homo sapiens
acgccaaccccagcag

SEQ ID NO: 6615782 - DNA, 22 bp, Homo sapiens
acgccaacttctcccacccctt

SEQ ID NO: 6615783 - DNA, 17 bp, Homo sapiens
acgccaataataaaaaa

SEQ ID NO: 6615784 - DNA, 20 bp, Homo sapiens
acgccaatgttatgccagct

SEQ ID NO: 6615785 - DNA, 19 bp, Homo sapiens
actacttgattttattgta

SEQ ID NO: 6615786 - DNA, 23 bp, Homo sapiens
actacttgtggggctaaggcagg

SEQ ID NO: 6615787 - DNA, 20 bp, Homo sapiens
actactttaataaagaatta

SEQ ID NO: 6615788 - DNA, 13 bp, Homo sapiens
actactttactaa

SEQ ID NO: 6615789 - DNA, 12 bp, Homo sapiens
actactttataa

SEQ ID NO: 6615790 - DNA, 23 bp, Homo sapiens
actactttcatgaattttttaat

SEQ ID NO: 6615791 - DNA, 13 bp, Homo sapiens
actactttctctt

SEQ ID NO: 6615792 - DNA, 15 bp, Homo sapiens
actactttctctttt

SEQ ID NO: 6615793 - DNA, 17 bp, Homo sapiens
actactttgcctcttca

SEQ ID NO: 6615794 - DNA, 13 bp, Homo sapiens
actactttgcctt

SEQ ID NO: 6615795 - DNA, 21 bp, Homo sapiens
actactttgccttcttttgta

SEQ ID NO: 6615796 - DNA, 12 bp, Homo sapiens
actactttgcta

SEQ ID NO: 6615797 - DNA, 15 bp, Homo sapiens
actactttttatact

SEQ ID NO: 6615798 - DNA, 16 bp, Homo sapiens
actagaaagctctgca

SEQ ID NO: 6615799 - DNA, 19 bp, Homo sapiens
actagaaagtgaataaaaa

SEQ ID NO: 6615800 - DNA, 17 bp, Homo sapiens
actagaaatatattcat

SEQ ID NO: 6615801 - DNA, 20 bp, Homo sapiens
actagaaatgggaatcatgg

SEQ ID NO: 6615802 - DNA, 13 bp, Homo sapiens
actagaaattctt

SEQ ID NO: 6615803 - DNA, 15 bp, Homo sapiens
actagaacacagaaa

SEQ ID NO: 6615804 - DNA, 18 bp, Homo sapiens
actagaacgcttcgggaa

SEQ ID NO: 6615805 - DNA, 13 bp, Homo sapiens
actagaactctcc

SEQ ID NO: 6615806 - DNA, 16 bp, Homo sapiens
actagaactgaatttt

SEQ ID NO: 6615807 - DNA, 18 bp, Homo sapiens
actagaactgaattttgt

SEQ ID NO: 6615808 - DNA, 19 bp, Homo sapiens
actagaactgaattttgtc

SEQ ID NO: 6615809 - DNA, 13 bp, Homo sapiens
actagaagatgaa

SEQ ID NO: 6615810 - DNA, 17 bp, Homo sapiens
actagaaggcttctctc

SEQ ID NO: 6615811 - DNA, 18 bp, Homo sapiens
actagaaggcttctctcc

SEQ ID NO: 6615812 - DNA, 16 bp, Homo sapiens
actagaagtcctgctg

SEQ ID NO: 6615813 - DNA, 18 bp, Homo sapiens
actagaatggtagcacta

SEQ ID NO: 6615814 - DNA, 17 bp, Homo sapiens
actagaattctagtgct

SEQ ID NO: 6615815 - DNA, 13 bp, Homo sapiens
actagacaaaagt

SEQ ID NO: 6615816 - DNA, 14 bp, Homo sapiens
actagacaaataac

SEQ ID NO: 6615817 - DNA, 16 bp, Homo sapiens
actagacaaataacta

SEQ ID NO: 6615818 - DNA, 13 bp, Homo sapiens
actagacacacaa

SEQ ID NO: 6615819 - DNA, 18 bp, Homo sapiens
actagacacacaaagcag

SEQ ID NO: 6615820 - DNA, 21 bp, Homo sapiens
actagacacacaaagcagttg

SEQ ID NO: 6615821 - DNA, 15 bp, Homo sapiens
actagacatctgctg

SEQ ID NO: 6615822 - DNA, 22 bp, Homo sapiens
actagacattattttgtatgga

SEQ ID NO: 6615823 - DNA, 15 bp, Homo sapiens
actagacattctgtc

SEQ ID NO: 6615824 - DNA, 17 bp, Homo sapiens
actagactactcaatat

SEQ ID NO: 6615825 - DNA, 15 bp, Homo sapiens
actagactcatactc

SEQ ID NO: 6615826 - DNA, 19 bp, Homo sapiens
actagactcccaagctgga

SEQ ID NO: 6615827 - DNA, 17 bp, Homo sapiens
actagactcttcactgt

SEQ ID NO: 6615828 - DNA, 12 bp, Homo sapiens
actagagaaaat

SEQ ID NO: 6615829 - DNA, 11 bp, Homo sapiens
actagagaaac

SEQ ID NO: 6615830 - DNA, 12 bp, Homo sapiens
actagagaaacc

SEQ ID NO: 6615831 - DNA, 19 bp, Homo sapiens
actagagaaagacaaaatg

SEQ ID NO: 6615832 - DNA, 18 bp, Homo sapiens
actagagactctgtgatc

SEQ ID NO: 6615833 - DNA, 16 bp, Homo sapiens
actagagatattttgt

SEQ ID NO: 6615834 - DNA, 18 bp, Homo sapiens
actagagatattttgtaa

SEQ ID NO: 6615835 - DNA, 21 bp, Homo sapiens
actagagatattttgtaaaat

SEQ ID NO: 6615836 - DNA, 17 bp, Homo sapiens
actagagatctggtttt

SEQ ID NO: 6615837 - DNA, 13 bp, Homo sapiens
actagagcaaaat

SEQ ID NO: 6615838 - DNA, 19 bp, Homo sapiens
actagagcacaacataatt

SEQ ID NO: 6615839 - DNA, 21 bp, Homo sapiens
actagagcacgggcgttatgt

SEQ ID NO: 6615840 - DNA, 23 bp, Homo sapiens
actagagcacgggcgttatgtaa

SEQ ID NO: 6615841 - DNA, 15 bp, Homo sapiens
actagagctttcttt

SEQ ID NO: 6615842 - DNA, 21 bp, Homo sapiens
actagaggaaaccagtttggt

SEQ ID NO: 6615843 - DNA, 15 bp, Homo sapiens
actagaggcagggag

SEQ ID NO: 6615844 - DNA, 16 bp, Homo sapiens
actagaggcagggagg

SEQ ID NO: 6615845 - DNA, 16 bp, Homo sapiens
actagaggccagggca

SEQ ID NO: 6615846 - DNA, 18 bp, Homo sapiens
actagagggacctctccc

SEQ ID NO: 6615847 - DNA, 20 bp, Homo sapiens
actagagggacctctcccag

SEQ ID NO: 6615848 - DNA, 14 bp, Homo sapiens
actagaggtgagaa

SEQ ID NO: 6615849 - DNA, 18 bp, Homo sapiens
actagaggtgagaaattt

SEQ ID NO: 6615850 - DNA, 21 bp, Homo sapiens
actagaggtgagaaatttaaa

SEQ ID NO: 6615851 - DNA, 16 bp, Homo sapiens
actagaggttttatga

SEQ ID NO: 6615852 - DNA, 13 bp, Homo sapiens
actagagtatgtg

SEQ ID NO: 6615853 - DNA, 14 bp, Homo sapiens
actagagtatgtgt

SEQ ID NO: 6615854 - DNA, 21 bp, Homo sapiens
actagagtcacccccccaggc

SEQ ID NO: 6615855 - DNA, 16 bp, Homo sapiens
actagagttagatatg

SEQ ID NO: 6615856 - DNA, 19 bp, Homo sapiens
actagataacatacttctt

SEQ ID NO: 6615857 - DNA, 22 bp, Homo sapiens
actagataacatacttcttact

SEQ ID NO: 6615858 - DNA, 17 bp, Homo sapiens
actagatactactttct

SEQ ID NO: 6615859 - DNA, 19 bp, Homo sapiens
actagatactcgtgtgtgg

SEQ ID NO: 6615860 - DNA, 14 bp, Homo sapiens
actagatcacaact

SEQ ID NO: 6615861 - DNA, 22 bp, Homo sapiens
actagatctagaatcagagctg

SEQ ID NO: 6615862 - DNA, 15 bp, Homo sapiens
actagatctcctgta

SEQ ID NO: 6615863 - DNA, 16 bp, Homo sapiens
actagatctcctgtaa

SEQ ID NO: 6615864 - DNA, 17 bp, Homo sapiens
actagatctcctgtaat

SEQ ID NO: 6615865 - DNA, 13 bp, Homo sapiens
actagatgacctc

SEQ ID NO: 6615866 - DNA, 18 bp, Homo sapiens
actagatgacctcattaa

SEQ ID NO: 6615867 - DNA, 13 bp, Homo sapiens
actagatgatgga

SEQ ID NO: 6615868 - DNA, 15 bp, Homo sapiens
actagatggcgagca

SEQ ID NO: 6615869 - DNA, 17 bp, Homo sapiens
actagattccacaggga

SEQ ID NO: 6615870 - DNA, 13 bp, Homo sapiens
actagattgacta

SEQ ID NO: 6615871 - DNA, 17 bp, Homo sapiens
actagatttataaatgc

SEQ ID NO: 6615872 - DNA, 15 bp, Homo sapiens
actagatttcaagct

SEQ ID NO: 6615873 - DNA, 13 bp, Homo sapiens
actagatttgtcc

SEQ ID NO: 6615874 - DNA, 16 bp, Homo sapiens
actagcaaacaaaaat

SEQ ID NO: 6615875 - DNA, 22 bp, Homo sapiens
actagcaaacaaaaatagaata

SEQ ID NO: 6615876 - DNA, 12 bp, Homo sapiens
actagcaactct

SEQ ID NO: 6615877 - DNA, 14 bp, Homo sapiens
actagcaataagtt

SEQ ID NO: 6615878 - DNA, 19 bp, Homo sapiens
actagcaataagttgaatg

SEQ ID NO: 6615879 - DNA, 23 bp, Homo sapiens
actagcaccattttaagtccctg

SEQ ID NO: 6615880 - DNA, 11 bp, Homo sapiens
actagcaggca

SEQ ID NO: 6615881 - DNA, 20 bp, Homo sapiens
actagcatagagaatgtgtt

SEQ ID NO: 6615882 - DNA, 16 bp, Homo sapiens
actagcattacattat

SEQ ID NO: 6615883 - DNA, 18 bp, Homo sapiens
actagcattacattatta

SEQ ID NO: 6615884 - DNA, 15 bp, Homo sapiens
actagccaaacctca

SEQ ID NO: 6615885 - DNA, 18 bp, Homo sapiens
actagccaaacctcacca

SEQ ID NO: 6615886 - DNA, 21 bp, Homo sapiens
actagccagccaggaagatga

SEQ ID NO: 6615887 - DNA, 18 bp, Homo sapiens
actagccatctcaagcaa

SEQ ID NO: 6615888 - DNA, 19 bp, Homo sapiens
actagccatctcaagcaag

SEQ ID NO: 6615889 - DNA, 19 bp, Homo sapiens
actagccatgctttatgtg

SEQ ID NO: 6615890 - DNA, 15 bp, Homo sapiens
actagcccaagtaat

SEQ ID NO: 6615891 - DNA, 17 bp, Homo sapiens
actagccccccagtggt

SEQ ID NO: 6615892 - DNA, 17 bp, Homo sapiens
actagccctctttctct

SEQ ID NO: 6615893 - DNA, 18 bp, Homo sapiens
actagccctctttctctc

SEQ ID NO: 6615894 - DNA, 22 bp, Homo sapiens
actagccctctttctctctgtg

SEQ ID NO: 6615895 - DNA, 15 bp, Homo sapiens
actagcctctccagg

SEQ ID NO: 6615896 - DNA, 15 bp, Homo sapiens
actagcctgtgatta

SEQ ID NO: 6615897 - DNA, 21 bp, Homo sapiens
actagccttcttttgtacttt

SEQ ID NO: 6615898 - DNA, 18 bp, Homo sapiens
actagcctttggctctgg

SEQ ID NO: 6615899 - DNA, 19 bp, Homo sapiens
actagcctttggctctgga

SEQ ID NO: 6615900 - DNA, 20 bp, Homo sapiens
actagcctttggctctggag

SEQ ID NO: 6615901 - DNA, 16 bp, Homo sapiens
actagcgcctggcctt

SEQ ID NO: 6615902 - DNA, 19 bp, Homo sapiens
actagctaactaattctgt

SEQ ID NO: 6615903 - DNA, 20 bp, Homo sapiens
actagctaagcaagccagga

SEQ ID NO: 6615904 - DNA, 14 bp, Homo sapiens
actagctgccttcg

SEQ ID NO: 6615905 - DNA, 16 bp, Homo sapiens
actagctgtctcagga

SEQ ID NO: 6615906 - DNA, 19 bp, Homo sapiens
actagcttacatgagaaca

SEQ ID NO: 6615907 - DNA, 20 bp, Homo sapiens
actagcttacatgagaacag

SEQ ID NO: 6615908 - DNA, 11 bp, Homo sapiens
actagctttgc

SEQ ID NO: 6615909 - DNA, 20 bp, Homo sapiens
actagctttgctctttagat

SEQ ID NO: 6615910 - DNA, 16 bp, Homo sapiens
actagcttttcaaaca

SEQ ID NO: 6615911 - DNA, 12 bp, Homo sapiens
actaggaaaagt

SEQ ID NO: 6615912 - DNA, 13 bp, Homo sapiens
actaggaaaagtt

SEQ ID NO: 6615913 - DNA, 15 bp, Homo sapiens
actaggaatcccaga

SEQ ID NO: 6615914 - DNA, 12 bp, Homo sapiens
actaggaattct

SEQ ID NO: 6615915 - DNA, 22 bp, Homo sapiens
actaggacctcatatcttcctc

SEQ ID NO: 6615916 - DNA, 14 bp, Homo sapiens
actaggactcagaa

SEQ ID NO: 6615917 - DNA, 17 bp, Homo sapiens
actaggactctgaggct

SEQ ID NO: 6615918 - DNA, 12 bp, Homo sapiens
actaggacttgg

SEQ ID NO: 6615919 - DNA, 19 bp, Homo sapiens
actaggagaccagaagtga

SEQ ID NO: 6615920 - DNA, 17 bp, Homo sapiens
actaggatacagaaatg

SEQ ID NO: 6615921 - DNA, 21 bp, Homo sapiens
actaggatacagaaatgcaaa

SEQ ID NO: 6615922 - DNA, 21 bp, Homo sapiens
actaggatattgaatgtgaaa

SEQ ID NO: 6615923 - DNA, 18 bp, Homo sapiens
actaggcaaattgttcaa

SEQ ID NO: 6615924 - DNA, 17 bp, Homo sapiens
actaggcatacactgta

SEQ ID NO: 6615925 - DNA, 22 bp, Homo sapiens
actaggcatgtcagaggacccc

SEQ ID NO: 6615926 - DNA, 12 bp, Homo sapiens
actaggccattt

SEQ ID NO: 6615927 - DNA, 20 bp, Homo sapiens
actaggcctgaaatgacatt

SEQ ID NO: 6615928 - DNA, 22 bp, Homo sapiens
actaggctctagtgttcagaat

SEQ ID NO: 6615929 - DNA, 22 bp, Homo sapiens
actaggctcttatgtgtgcctt

SEQ ID NO: 6615930 - DNA, 14 bp, Homo sapiens
actaggctgagcaa

SEQ ID NO: 6615931 - DNA, 23 bp, Homo sapiens
actaggctgagcaatctgaccct

SEQ ID NO: 6615932 - DNA, 19 bp, Homo sapiens
actaggctgggtgcccaca

SEQ ID NO: 6615933 - DNA, 20 bp, Homo sapiens
actaggctgggtgcccacag

SEQ ID NO: 6615934 - DNA, 21 bp, Homo sapiens
actaggctgggtgcccacagc

SEQ ID NO: 6615935 - DNA, 20 bp, Homo sapiens
actaggcttctgtaatcaat

SEQ ID NO: 6615936 - DNA, 21 bp, Homo sapiens
actagggaagaaagcagaaca

SEQ ID NO: 6615937 - DNA, 18 bp, Homo sapiens
actagggactatcaggta

SEQ ID NO: 6615938 - DNA, 17 bp, Homo sapiens
actagggagaaggtttc

SEQ ID NO: 6615939 - DNA, 15 bp, Homo sapiens
actagggagccatgt

SEQ ID NO: 6615940 - DNA, 19 bp, Homo sapiens
actagggagccatgtttca

SEQ ID NO: 6615941 - DNA, 19 bp, Homo sapiens
actagggaggctgaggcag

SEQ ID NO: 6615942 - DNA, 16 bp, Homo sapiens
actagggatccctcat

SEQ ID NO: 6615943 - DNA, 18 bp, Homo sapiens
actagggatccctcatct

SEQ ID NO: 6615944 - DNA, 19 bp, Homo sapiens
actagggatccctcatctg

SEQ ID NO: 6615945 - DNA, 12 bp, Homo sapiens
actagggcctcg

SEQ ID NO: 6615946 - DNA, 15 bp, Homo sapiens
actagggcctcggag

SEQ ID NO: 6615947 - DNA, 22 bp, Homo sapiens
actagggcctcggaggctcctc

SEQ ID NO: 6615948 - DNA, 23 bp, Homo sapiens
actagggcctcggaggctcctcc

SEQ ID NO: 6615949 - DNA, 11 bp, Homo sapiens
actagggctga

SEQ ID NO: 6615950 - DNA, 17 bp, Homo sapiens
actaggggacaaagcaa

SEQ ID NO: 6615951 - DNA, 22 bp, Homo sapiens
actaggggatataggagaggaa

SEQ ID NO: 6615952 - DNA, 18 bp, Homo sapiens
actagggtcctcaggcag

SEQ ID NO: 6615953 - DNA, 21 bp, Homo sapiens
actagggtgagggttttctgt

SEQ ID NO: 6615954 - DNA, 18 bp, Homo sapiens
actaggtaacttcatatt

SEQ ID NO: 6615955 - DNA, 16 bp, Homo sapiens
actaggtaatgttttg

SEQ ID NO: 6615956 - DNA, 22 bp, Homo sapiens
actaggtaatgttttgtatata

SEQ ID NO: 6615957 - DNA, 22 bp, Homo sapiens
actaggtattgtctactctgaa

SEQ ID NO: 6615958 - DNA, 13 bp, Homo sapiens
actaggtgccttt

SEQ ID NO: 6615959 - DNA, 17 bp, Homo sapiens
actaggtgctggcatgt

SEQ ID NO: 6615960 - DNA, 19 bp, Homo sapiens
actaggtgctggcatgtct

SEQ ID NO: 6615961 - DNA, 21 bp, Homo sapiens
actaggttcaattccctgaag

SEQ ID NO: 6615962 - DNA, 13 bp, Homo sapiens
actaggttctgta

SEQ ID NO: 6615963 - DNA, 20 bp, Homo sapiens
actaggttggacagccccct

SEQ ID NO: 6615964 - DNA, 14 bp, Homo sapiens
actagtaaagacat

SEQ ID NO: 6615965 - DNA, 15 bp, Homo sapiens
actagtaaagacata

SEQ ID NO: 6615966 - DNA, 15 bp, Homo sapiens
actagtaaaggagga

SEQ ID NO: 6615967 - DNA, 14 bp, Homo sapiens
actagtaataatgt

SEQ ID NO: 6615968 - DNA, 23 bp, Homo sapiens
actagtaataatgtaatactgta

SEQ ID NO: 6615969 - DNA, 18 bp, Homo sapiens
actagtaatgggccaatt

SEQ ID NO: 6615970 - DNA, 22 bp, Homo sapiens
actagtacaagtggtaattttt

SEQ ID NO: 6615971 - DNA, 23 bp, Homo sapiens
actagtaccttcagatcctaccc

SEQ ID NO: 6615972 - DNA, 18 bp, Homo sapiens
actagtactatttcttaa

SEQ ID NO: 6615973 - DNA, 13 bp, Homo sapiens
actagtactgtgt

SEQ ID NO: 6615974 - DNA, 17 bp, Homo sapiens
actagtagaagaagctt

SEQ ID NO: 6615975 - DNA, 14 bp, Homo sapiens
actagtagctgttt

SEQ ID NO: 6615976 - DNA, 19 bp, Homo sapiens
actagtatgaaataacgca

SEQ ID NO: 6615977 - DNA, 18 bp, Homo sapiens
actagtcaagaaaaatat

SEQ ID NO: 6615978 - DNA, 21 bp, Homo sapiens
actagtccaatcacccccagg

SEQ ID NO: 6615979 - DNA, 21 bp, Homo sapiens
actagtcctgacactgaattt

SEQ ID NO: 6615980 - DNA, 18 bp, Homo sapiens
actagtctgtgtaacttt

SEQ ID NO: 6615981 - DNA, 15 bp, Homo sapiens
actagtctgtgtgct

SEQ ID NO: 6615982 - DNA, 15 bp, Homo sapiens
actagtgacagtttc

SEQ ID NO: 6615983 - DNA, 21 bp, Homo sapiens
actagtgacagtttcttttgt

SEQ ID NO: 6615984 - DNA, 19 bp, Homo sapiens
actagtgaccccttccctg

SEQ ID NO: 6615985 - DNA, 20 bp, Homo sapiens
actagtgagtcagcaccttg

SEQ ID NO: 6615986 - DNA, 15 bp, Homo sapiens
actagtgctgaagct

SEQ ID NO: 6615987 - DNA, 11 bp, Homo sapiens
actagtggaaa

SEQ ID NO: 6615988 - DNA, 15 bp, Homo sapiens
actagtggaaagtca

SEQ ID NO: 6615989 - DNA, 11 bp, Homo sapiens
actagtgtccg

SEQ ID NO: 6615990 - DNA, 17 bp, Homo sapiens
actagtgtggtgtgttt

SEQ ID NO: 6615991 - DNA, 15 bp, Homo sapiens
actagtgttgcttgg

SEQ ID NO: 6615992 - DNA, 20 bp, Homo sapiens
actagtgtttctgcagaggc

SEQ ID NO: 6615993 - DNA, 21 bp, Homo sapiens
actagtgtttctgcagaggca

SEQ ID NO: 6615994 - DNA, 19 bp, Homo sapiens
actagtgtttggctcacct

SEQ ID NO: 6615995 - DNA, 15 bp, Homo sapiens
actagttacacatct

SEQ ID NO: 6615996 - DNA, 14 bp, Homo sapiens
actagttcagagga

SEQ ID NO: 6615997 - DNA, 22 bp, Homo sapiens
actagttgtctgaattgagaaa

SEQ ID NO: 6615998 - DNA, 17 bp, Homo sapiens
actagttgtgaccttag

SEQ ID NO: 6615999 - DNA, 14 bp, Homo sapiens
actagtttccagtg

SEQ ID NO: 6616000 - DNA, 19 bp, Homo sapiens
actagtttgattattatgt

SEQ ID NO: 6616001 - DNA, 18 bp, Homo sapiens
actagttttactttgaac

SEQ ID NO: 6616002 - DNA, 16 bp, Homo sapiens
actagtttttatagct

SEQ ID NO: 6616003 - DNA, 17 bp, Homo sapiens
actagtttttatagcta

SEQ ID NO: 6616004 - DNA, 23 bp, Homo sapiens
actagtttttatagctatcaaca

SEQ ID NO: 6616005 - DNA, 14 bp, Homo sapiens
actataaaaaagaa

SEQ ID NO: 6616006 - DNA, 19 bp, Homo sapiens
actataaaactaggtgctg

SEQ ID NO: 6616007 - DNA, 15 bp, Homo sapiens
actataaactactgt

SEQ ID NO: 6616008 - DNA, 18 bp, Homo sapiens
actataaactactgtaat

SEQ ID NO: 6616009 - DNA, 14 bp, Homo sapiens
actataaagagaag

SEQ ID NO: 6616010 - DNA, 14 bp, Homo sapiens
actataaagctgtt

SEQ ID NO: 6616011 - DNA, 12 bp, Homo sapiens
actataaataaa

SEQ ID NO: 6616012 - DNA, 12 bp, Homo sapiens
actataaataca

SEQ ID NO: 6616013 - DNA, 15 bp, Homo sapiens
actataaatacaaat

SEQ ID NO: 6616014 - DNA, 13 bp, Homo sapiens
actataaatatac

SEQ ID NO: 6616015 - DNA, 17 bp, Homo sapiens
actataaatatacatat

SEQ ID NO: 6616016 - DNA, 13 bp, Homo sapiens
actataaatatat

SEQ ID NO: 6616017 - DNA, 16 bp, Homo sapiens
actataaatgatatct

SEQ ID NO: 6616018 - DNA, 17 bp, Homo sapiens
actataaatgatatcta

SEQ ID NO: 6616019 - DNA, 15 bp, Homo sapiens
actataacaaaaaaa

SEQ ID NO: 6616020 - DNA, 17 bp, Homo sapiens
actataacaaaaaaaga

SEQ ID NO: 6616021 - DNA, 16 bp, Homo sapiens
actataacaatcactg

SEQ ID NO: 6616022 - DNA, 19 bp, Homo sapiens
actataacatagaattgca

SEQ ID NO: 6616023 - DNA, 17 bp, Homo sapiens
actataacatatgtaca

SEQ ID NO: 6616024 - DNA, 13 bp, Homo sapiens
actataacattca

SEQ ID NO: 6616025 - DNA, 20 bp, Homo sapiens
actataaccatcagttactg

SEQ ID NO: 6616026 - DNA, 22 bp, Homo sapiens
actataaccatcagttactggt

SEQ ID NO: 6616027 - DNA, 14 bp, Homo sapiens
actataagaacttt

SEQ ID NO: 6616028 - DNA, 15 bp, Homo sapiens
actataaggtgcctc

SEQ ID NO: 6616029 - DNA, 17 bp, Homo sapiens
actataaggtgcctcag

SEQ ID NO: 6616030 - DNA, 13 bp, Homo sapiens
actataagtagtt

SEQ ID NO: 6616031 - DNA, 14 bp, Homo sapiens
actataatcaaatg

SEQ ID NO: 6616032 - DNA, 15 bp, Homo sapiens
actataatcaaatga

SEQ ID NO: 6616033 - DNA, 11 bp, Homo sapiens
actataatgta

SEQ ID NO: 6616034 - DNA, 15 bp, Homo sapiens
actataatgtgatga

SEQ ID NO: 6616035 - DNA, 18 bp, Homo sapiens
actataattttacaaagt

SEQ ID NO: 6616036 - DNA, 13 bp, Homo sapiens
actatacaacaat

SEQ ID NO: 6616037 - DNA, 16 bp, Homo sapiens
actatacaattcagta

SEQ ID NO: 6616038 - DNA, 22 bp, Homo sapiens
actataccaactgggcctctga

SEQ ID NO: 6616039 - DNA, 15 bp, Homo sapiens
actatacttgaacaa

SEQ ID NO: 6616040 - DNA, 23 bp, Homo sapiens
actatacttgaacaaaagggtca

SEQ ID NO: 6616041 - DNA, 23 bp, Homo sapiens
actatagaccaaaaggagagatt

SEQ ID NO: 6616042 - DNA, 16 bp, Homo sapiens
actatagcagggctgg

SEQ ID NO: 6616043 - DNA, 14 bp, Homo sapiens
actatagccatttg

SEQ ID NO: 6616044 - DNA, 20 bp, Homo sapiens
actatagcccaggtcctctg

SEQ ID NO: 6616045 - DNA, 16 bp, Homo sapiens
actatagcccctggtg

SEQ ID NO: 6616046 - DNA, 18 bp, Homo sapiens
actatagcggcatataga

SEQ ID NO: 6616047 - DNA, 22 bp, Homo sapiens
actataggcatgcgccaccatg

SEQ ID NO: 6616048 - DNA, 20 bp, Homo sapiens
actatataaccctaggaatt

SEQ ID NO: 6616049 - DNA, 15 bp, Homo sapiens
actatataagacatt

SEQ ID NO: 6616050 - DNA, 16 bp, Homo sapiens
actatataagacatta

SEQ ID NO: 6616051 - DNA, 13 bp, Homo sapiens
actatatacatgt

SEQ ID NO: 6616052 - DNA, 14 bp, Homo sapiens
actatatacatgtg

SEQ ID NO: 6616053 - DNA, 17 bp, Homo sapiens
actatatacatgtgtgt

SEQ ID NO: 6616054 - DNA, 22 bp, Homo sapiens
actatatagaatttcctgtaat

SEQ ID NO: 6616055 - DNA, 16 bp, Homo sapiens
actatatagagatgtt

SEQ ID NO: 6616056 - DNA, 13 bp, Homo sapiens
actatatataatg

SEQ ID NO: 6616057 - DNA, 17 bp, Homo sapiens
actatatatataaatgt

SEQ ID NO: 6616058 - DNA, 15 bp, Homo sapiens
actatatatttctta

SEQ ID NO: 6616059 - DNA, 14 bp, Homo sapiens
actatatctgtata

SEQ ID NO: 6616060 - DNA, 17 bp, Homo sapiens
actatatctgtatataa

SEQ ID NO: 6616061 - DNA, 21 bp, Homo sapiens
actatatcttcccatttaaca

SEQ ID NO: 6616062 - DNA, 13 bp, Homo sapiens
actatatgcaaac

SEQ ID NO: 6616063 - DNA, 14 bp, Homo sapiens
actatatgcaaaca

SEQ ID NO: 6616064 - DNA, 17 bp, Homo sapiens
actatatgcataaacaa

SEQ ID NO: 6616065 - DNA, 22 bp, Homo sapiens
actatatgcataaacaacagta

SEQ ID NO: 6616066 - DNA, 21 bp, Homo sapiens
actatatgtgaaacatttttt

SEQ ID NO: 6616067 - DNA, 20 bp, Homo sapiens
actatatgttgaccattcca

SEQ ID NO: 6616068 - DNA, 15 bp, Homo sapiens
actatatgtttacac

SEQ ID NO: 6616069 - DNA, 19 bp, Homo sapiens
actatatgtttacacaatt

SEQ ID NO: 6616070 - DNA, 18 bp, Homo sapiens
actatattatcatgcaaa

SEQ ID NO: 6616071 - DNA, 19 bp, Homo sapiens
actatattcatttccactc

SEQ ID NO: 6616072 - DNA, 18 bp, Homo sapiens
actatattgcgagaaaca

SEQ ID NO: 6616073 - DNA, 19 bp, Homo sapiens
actatattgcgagaaacag

SEQ ID NO: 6616074 - DNA, 17 bp, Homo sapiens
actatattttagatgca

SEQ ID NO: 6616075 - DNA, 14 bp, Homo sapiens
actatattttccct

SEQ ID NO: 6616076 - DNA, 14 bp, Homo sapiens
actatcaaactgaa

SEQ ID NO: 6616077 - DNA, 18 bp, Homo sapiens
actatcaacactgcagca

SEQ ID NO: 6616078 - DNA, 16 bp, Homo sapiens
actatcaatatttaag

SEQ ID NO: 6616079 - DNA, 14 bp, Homo sapiens
actatcacacatga

SEQ ID NO: 6616080 - DNA, 18 bp, Homo sapiens
actatcacacatgaataa

SEQ ID NO: 6616081 - DNA, 16 bp, Homo sapiens
actatcacatacaatt

SEQ ID NO: 6616082 - DNA, 21 bp, Homo sapiens
actatcacatacaatttgcac

SEQ ID NO: 6616083 - DNA, 22 bp, Homo sapiens
actatcacatacaatttgcact

SEQ ID NO: 6616084 - DNA, 24 bp, Homo sapiens
actatcaccagtgcatcacatctg

SEQ ID NO: 6616085 - DNA, 17 bp, Homo sapiens
actatcactggtttggt

SEQ ID NO: 6616086 - DNA, 16 bp, Homo sapiens
actatcagcagcggca

SEQ ID NO: 6616087 - DNA, 20 bp, Homo sapiens
actatcagcccaagatgctt

SEQ ID NO: 6616088 - DNA, 19 bp, Homo sapiens
actatcagggcaagctcat

SEQ ID NO: 6616089 - DNA, 22 bp, Homo sapiens
actatcagtttgtcctgtagag

SEQ ID NO: 6616090 - DNA, 13 bp, Homo sapiens
actatcataaaat

SEQ ID NO: 6616091 - DNA, 13 bp, Homo sapiens
actatccaaataa

SEQ ID NO: 6616092 - DNA, 13 bp, Homo sapiens
actatccaagtgt

SEQ ID NO: 6616093 - DNA, 20 bp, Homo sapiens
actatccaattaaaattaag

SEQ ID NO: 6616094 - DNA, 22 bp, Homo sapiens
actatccatagtggacattgtt

SEQ ID NO: 6616095 - DNA, 14 bp, Homo sapiens
actatccatgtaat

SEQ ID NO: 6616096 - DNA, 16 bp, Homo sapiens
actatccatgtaataa

SEQ ID NO: 6616097 - DNA, 15 bp, Homo sapiens
actatccatttcttc

SEQ ID NO: 6616098 - DNA, 15 bp, Homo sapiens
actatccattttaca

SEQ ID NO: 6616099 - DNA, 19 bp, Homo sapiens
actatccattttacacttg

SEQ ID NO: 6616100 - DNA, 21 bp, Homo sapiens
actatcccaatcaaagaatta

SEQ ID NO: 6616101 - DNA, 17 bp, Homo sapiens
actatcccggctgccct

SEQ ID NO: 6616102 - DNA, 20 bp, Homo sapiens
actatcctatgccttcaaat

SEQ ID NO: 6616103 - DNA, 19 bp, Homo sapiens
actatcctgattccaaata

SEQ ID NO: 6616104 - DNA, 13 bp, Homo sapiens
actatcctggctt

SEQ ID NO: 6616105 - DNA, 22 bp, Homo sapiens
actatccttctctttcaatgtg

SEQ ID NO: 6616106 - DNA, 23 bp, Homo sapiens
actatccttttttattgaataac

SEQ ID NO: 6616107 - DNA, 15 bp, Homo sapiens
actatcggttcaagt

SEQ ID NO: 6616108 - DNA, 19 bp, Homo sapiens
actatcggttcaagttgat

SEQ ID NO: 6616109 - DNA, 21 bp, Homo sapiens
actatctaaatgttgaaagat

SEQ ID NO: 6616110 - DNA, 19 bp, Homo sapiens
actatctactctcctcatc

SEQ ID NO: 6616111 - DNA, 22 bp, Homo sapiens
actatctagggagccctgggcc

SEQ ID NO: 6616112 - DNA, 15 bp, Homo sapiens
actatctcacttcca

SEQ ID NO: 6616113 - DNA, 13 bp, Homo sapiens
actatctcagaga

SEQ ID NO: 6616114 - DNA, 22 bp, Homo sapiens
actatctcatgccagtgcctta

SEQ ID NO: 6616115 - DNA, 15 bp, Homo sapiens
actatctcatttcca

SEQ ID NO: 6616116 - DNA, 21 bp, Homo sapiens
actatctcttgtcatataaac

SEQ ID NO: 6616117 - DNA, 21 bp, Homo sapiens
actatctgtatttattatttg

SEQ ID NO: 6616118 - DNA, 16 bp, Homo sapiens
actatctgtgaagtta

SEQ ID NO: 6616119 - DNA, 14 bp, Homo sapiens
actatctgttcccc

SEQ ID NO: 6616120 - DNA, 14 bp, Homo sapiens
actatctgttccct

SEQ ID NO: 6616121 - DNA, 21 bp, Homo sapiens
actatctgttcccttcctctg

SEQ ID NO: 6616122 - DNA, 20 bp, Homo sapiens
actatcttactatttcacaa

SEQ ID NO: 6616123 - DNA, 13 bp, Homo sapiens
actatcttcatct

SEQ ID NO: 6616124 - DNA, 22 bp, Homo sapiens
actatcttctctatatttttat

SEQ ID NO: 6616125 - DNA, 15 bp, Homo sapiens
actatctttcaggaa

SEQ ID NO: 6616126 - DNA, 18 bp, Homo sapiens
actatctttcaggaaatt

SEQ ID NO: 6616127 - DNA, 16 bp, Homo sapiens
actatctttctgataa

SEQ ID NO: 6616128 - DNA, 23 bp, Homo sapiens
actatctttctgataacagaatt

SEQ ID NO: 6616129 - DNA, 13 bp, Homo sapiens
actatcttttcat

SEQ ID NO: 6616130 - DNA, 16 bp, Homo sapiens
actatcttttcatctc

SEQ ID NO: 6616131 - DNA, 15 bp, Homo sapiens
actatctttttgaaa

SEQ ID NO: 6616132 - DNA, 16 bp, Homo sapiens
actatgaaaagtgggc

SEQ ID NO: 6616133 - DNA, 13 bp, Homo sapiens
actatgaaacgaa

SEQ ID NO: 6616134 - DNA, 14 bp, Homo sapiens
actatgaaacgaat

SEQ ID NO: 6616135 - DNA, 17 bp, Homo sapiens
actatgaaatgaaagaa

SEQ ID NO: 6616136 - DNA, 22 bp, Homo sapiens
actatgaactacaggtgtttga

SEQ ID NO: 6616137 - DNA, 13 bp, Homo sapiens
actatgaatctat

SEQ ID NO: 6616138 - DNA, 22 bp, Homo sapiens
actatgaatctattatactgta

SEQ ID NO: 6616139 - DNA, 14 bp, Homo sapiens
actatgaatttgtc

SEQ ID NO: 6616140 - DNA, 22 bp, Homo sapiens
actatgacataaaaacaacttt

SEQ ID NO: 6616141 - DNA, 19 bp, Homo sapiens
actatgacccatttaattt

SEQ ID NO: 6616142 - DNA, 24 bp, Homo sapiens
actatgaccttccaagtttgactt

SEQ ID NO: 6616143 - DNA, 20 bp, Homo sapiens
actatgagctttcagactcc

SEQ ID NO: 6616144 - DNA, 16 bp, Homo sapiens
actatgagttcacatg

SEQ ID NO: 6616145 - DNA, 16 bp, Homo sapiens
actatgataaagttgt

SEQ ID NO: 6616146 - DNA, 16 bp, Homo sapiens
actatgataaattatg

SEQ ID NO: 6616147 - DNA, 16 bp, Homo sapiens
actatgatcacagtga

SEQ ID NO: 6616148 - DNA, 22 bp, Homo sapiens
actatgatcagaagaacatgat

SEQ ID NO: 6616149 - DNA, 17 bp, Homo sapiens
actatgatctcaggagc

SEQ ID NO: 6616150 - DNA, 16 bp, Homo sapiens
actatgattccaatta

SEQ ID NO: 6616151 - DNA, 15 bp, Homo sapiens
actatgcaaagaact

SEQ ID NO: 6616152 - DNA, 16 bp, Homo sapiens
actatgcacagagccc

SEQ ID NO: 6616153 - DNA, 15 bp, Homo sapiens
actatgcagtgtgct

SEQ ID NO: 6616154 - DNA, 22 bp, Homo sapiens
actatgcatggtgccccaggac

SEQ ID NO: 6616155 - DNA, 15 bp, Homo sapiens
actatgccacagatt

SEQ ID NO: 6616156 - DNA, 19 bp, Homo sapiens
actatgccacagattgtta

SEQ ID NO: 6616157 - DNA, 15 bp, Homo sapiens
actatgcccttttat

SEQ ID NO: 6616158 - DNA, 17 bp, Homo sapiens
actatgccgtgtagttt

SEQ ID NO: 6616159 - DNA, 16 bp, Homo sapiens
actatgcctgtgtctt

SEQ ID NO: 6616160 - DNA, 16 bp, Homo sapiens
actatgcctgttgatc

SEQ ID NO: 6616161 - DNA, 19 bp, Homo sapiens
actatgcgtggctggaacc

SEQ ID NO: 6616162 - DNA, 23 bp, Homo sapiens
actatgcgtggctggaaccacat

SEQ ID NO: 6616163 - DNA, 14 bp, Homo sapiens
actatgctaatttt

SEQ ID NO: 6616164 - DNA, 13 bp, Homo sapiens
actatggaaaatc

SEQ ID NO: 6616165 - DNA, 20 bp, Homo sapiens
actatggaaaatcagctgct

SEQ ID NO: 6616166 - DNA, 21 bp, Homo sapiens
actatggaaaatcagctgctc

SEQ ID NO: 6616167 - DNA, 22 bp, Homo sapiens
actatggaaaatcagctgctca

SEQ ID NO: 6616168 - DNA, 11 bp, Homo sapiens
actatggaaat

SEQ ID NO: 6616169 - DNA, 18 bp, Homo sapiens
actatggaagccacatca

SEQ ID NO: 6616170 - DNA, 19 bp, Homo sapiens
actatggaatgtcagtgtt

SEQ ID NO: 6616171 - DNA, 23 bp, Homo sapiens
actatggagcctggcacaggact

SEQ ID NO: 6616172 - DNA, 18 bp, Homo sapiens
actatggagtcttgtgaa

SEQ ID NO: 6616173 - DNA, 18 bp, Homo sapiens
actatggccagtctgccc

SEQ ID NO: 6616174 - DNA, 22 bp, Homo sapiens
actatggccctggcctagcata

SEQ ID NO: 6616175 - DNA, 16 bp, Homo sapiens
actatggctgagttct

SEQ ID NO: 6616176 - DNA, 13 bp, Homo sapiens
actatggctgttg

SEQ ID NO: 6616177 - DNA, 17 bp, Homo sapiens
actatgggaagctctgt

SEQ ID NO: 6616178 - DNA, 15 bp, Homo sapiens
actatgggagcctca

SEQ ID NO: 6616179 - DNA, 18 bp, Homo sapiens
actatggtaaataactgt

SEQ ID NO: 6616180 - DNA, 19 bp, Homo sapiens
actatggtaaataactgtg

SEQ ID NO: 6616181 - DNA, 21 bp, Homo sapiens
actatggtaaataactgtgac

SEQ ID NO: 6616182 - DNA, 22 bp, Homo sapiens
actatggtaacactttgctttc

SEQ ID NO: 6616183 - DNA, 20 bp, Homo sapiens
actatggtatatattttgaa

SEQ ID NO: 6616184 - DNA, 22 bp, Homo sapiens
actatggtatatattttgaaag

SEQ ID NO: 6616185 - DNA, 18 bp, Homo sapiens
actatggtatgctggcca

SEQ ID NO: 6616186 - DNA, 19 bp, Homo sapiens
actatggtatgctggccag

SEQ ID NO: 6616187 - DNA, 20 bp, Homo sapiens
actatggtatgctggccagc

SEQ ID NO: 6616188 - DNA, 22 bp, Homo sapiens
actatggtgctgccttgcttct

SEQ ID NO: 6616189 - DNA, 19 bp, Homo sapiens
actatggtgtgcttatgtt

SEQ ID NO: 6616190 - DNA, 15 bp, Homo sapiens
actatggttcccaat

SEQ ID NO: 6616191 - DNA, 17 bp, Homo sapiens
actatggttcccaataa

SEQ ID NO: 6616192 - DNA, 23 bp, Homo sapiens
actatggttcccaataaaagtga

SEQ ID NO: 6616193 - DNA, 17 bp, Homo sapiens
actatgtaaaaataacc

SEQ ID NO: 6616194 - DNA, 16 bp, Homo sapiens
actatgtaaactactt

SEQ ID NO: 6616195 - DNA, 15 bp, Homo sapiens
actatgtaagggctt

SEQ ID NO: 6616196 - DNA, 20 bp, Homo sapiens
actatgtaagggctttaaat

SEQ ID NO: 6616197 - DNA, 23 bp, Homo sapiens
actatgtaagggctttaaataaa

SEQ ID NO: 6616198 - DNA, 20 bp, Homo sapiens
actatgtaataatgtacaga

SEQ ID NO: 6616199 - DNA, 15 bp, Homo sapiens
actatgtacaatatt

SEQ ID NO: 6616200 - DNA, 19 bp, Homo sapiens
actatgtacaatattttaa

SEQ ID NO: 6616201 - DNA, 12 bp, Homo sapiens
actatgtatcaa

SEQ ID NO: 6616202 - DNA, 16 bp, Homo sapiens
actatgtatttttcta

SEQ ID NO: 6616203 - DNA, 17 bp, Homo sapiens
actatgtatttttctat

SEQ ID NO: 6616204 - DNA, 18 bp, Homo sapiens
actatgtatttttctatg

SEQ ID NO: 6616205 - DNA, 21 bp, Homo sapiens
actatgtctagagcctcttgg

SEQ ID NO: 6616206 - DNA, 17 bp, Homo sapiens
actatgtctgaacatag

SEQ ID NO: 6616207 - DNA, 17 bp, Homo sapiens
actatgtgccagttcct

SEQ ID NO: 6616208 - DNA, 23 bp, Homo sapiens
actatgtggctgaaaatgcaaag

SEQ ID NO: 6616209 - DNA, 22 bp, Homo sapiens
actatgtgggacacctcaaata

SEQ ID NO: 6616210 - DNA, 23 bp, Homo sapiens
actatgtgtgagctttttttaaa

SEQ ID NO: 6616211 - DNA, 11 bp, Homo sapiens
actatgtgtgt

SEQ ID NO: 6616212 - DNA, 21 bp, Homo sapiens
actatgtgtgttgtttccata

SEQ ID NO: 6616213 - DNA, 23 bp, Homo sapiens
actatgttcagaacttcatctgc

SEQ ID NO: 6616214 - DNA, 17 bp, Homo sapiens
actatgttcctaacaaa

SEQ ID NO: 6616215 - DNA, 16 bp, Homo sapiens
actatgttgcccaggc

SEQ ID NO: 6616216 - DNA, 19 bp, Homo sapiens
actatgttgcccaggcagg

SEQ ID NO: 6616217 - DNA, 22 bp, Homo sapiens
actatgttttatcgtccagtga

SEQ ID NO: 6616218 - DNA, 22 bp, Homo sapiens
actattaaatgttgcacatcat

SEQ ID NO: 6616219 - DNA, 13 bp, Homo sapiens
actattaacatga

SEQ ID NO: 6616220 - DNA, 14 bp, Homo sapiens
actattaacatgat

SEQ ID NO: 6616221 - DNA, 18 bp, Homo sapiens
actattaagagcaataaa

SEQ ID NO: 6616222 - DNA, 14 bp, Homo sapiens
actattaagaggca

SEQ ID NO: 6616223 - DNA, 21 bp, Homo sapiens
actattaagaggcagaaaatt

SEQ ID NO: 6616224 - DNA, 16 bp, Homo sapiens
actattaagggaaagg

SEQ ID NO: 6616225 - DNA, 13 bp, Homo sapiens
actattaattcca

SEQ ID NO: 6616226 - DNA, 15 bp, Homo sapiens
actattaattccatg

SEQ ID NO: 6616227 - DNA, 16 bp, Homo sapiens
actattacagtgttgg

SEQ ID NO: 6616228 - DNA, 16 bp, Homo sapiens
actattacttgaactt

SEQ ID NO: 6616229 - DNA, 16 bp, Homo sapiens
actattagagtatttc

SEQ ID NO: 6616230 - DNA, 17 bp, Homo sapiens
actattagcaagaatca

SEQ ID NO: 6616231 - DNA, 21 bp, Homo sapiens
actattataatttaatgcatg

SEQ ID NO: 6616232 - DNA, 18 bp, Homo sapiens
actattatccccatttct

SEQ ID NO: 6616233 - DNA, 20 bp, Homo sapiens
actattatgttgttagagaa

SEQ ID NO: 6616234 - DNA, 13 bp, Homo sapiens
actattcaaacag

SEQ ID NO: 6616235 - DNA, 18 bp, Homo sapiens
actattcaaacagtctca

SEQ ID NO: 6616236 - DNA, 19 bp, Homo sapiens
actattcagaacttgtaac

SEQ ID NO: 6616237 - DNA, 21 bp, Homo sapiens
actattcagaacttgtaacta

SEQ ID NO: 6616238 - DNA, 22 bp, Homo sapiens
actattcaggagagtagaacag

SEQ ID NO: 6616239 - DNA, 14 bp, Homo sapiens
actattcagttgtg

SEQ ID NO: 6616240 - DNA, 15 bp, Homo sapiens
actattcagttgtgt

SEQ ID NO: 6616241 - DNA, 15 bp, Homo sapiens
actattcatggctac

SEQ ID NO: 6616242 - DNA, 18 bp, Homo sapiens
actattcattaaatgttt

SEQ ID NO: 6616243 - DNA, 19 bp, Homo sapiens
actattcattaaatgtttg

SEQ ID NO: 6616244 - DNA, 23 bp, Homo sapiens
actattccacagggataccttaa

SEQ ID NO: 6616245 - DNA, 22 bp, Homo sapiens
actattccatcaataggcaaaa

SEQ ID NO: 6616246 - DNA, 14 bp, Homo sapiens
actattccatgttt

SEQ ID NO: 6616247 - DNA, 17 bp, Homo sapiens
actattcccactttcat

SEQ ID NO: 6616248 - DNA, 17 bp, Homo sapiens
actattccttttctgta

SEQ ID NO: 6616249 - DNA, 19 bp, Homo sapiens
actattccttttctgtata

SEQ ID NO: 6616250 - DNA, 23 bp, Homo sapiens
actattctaaggagcaaatacct

SEQ ID NO: 6616251 - DNA, 18 bp, Homo sapiens
actattctgagatgacta

SEQ ID NO: 6616252 - DNA, 15 bp, Homo sapiens
actattctgattaca

SEQ ID NO: 6616253 - DNA, 21 bp, Homo sapiens
actattctgattacacaaaac

SEQ ID NO: 6616254 - DNA, 16 bp, Homo sapiens
actattcttaagcact

SEQ ID NO: 6616255 - DNA, 14 bp, Homo sapiens
actattgaactgta

SEQ ID NO: 6616256 - DNA, 15 bp, Homo sapiens
actattgaactgtat

SEQ ID NO: 6616257 - DNA, 15 bp, Homo sapiens
actattgagccttgc

SEQ ID NO: 6616258 - DNA, 18 bp, Homo sapiens
actattgagccttgcatg

SEQ ID NO: 6616259 - DNA, 23 bp, Homo sapiens
actattgagccttgcatgtactt

SEQ ID NO: 6616260 - DNA, 22 bp, Homo sapiens
actattgcacatcatattctat

SEQ ID NO: 6616261 - DNA, 21 bp, Homo sapiens
actattggaagataaacttgt

SEQ ID NO: 6616262 - DNA, 13 bp, Homo sapiens
actattggacaga

SEQ ID NO: 6616263 - DNA, 19 bp, Homo sapiens
actattggagagaaaaaat

SEQ ID NO: 6616264 - DNA, 22 bp, Homo sapiens
actattggagagaaaaaattaa

SEQ ID NO: 6616265 - DNA, 13 bp, Homo sapiens
actattggcccta

SEQ ID NO: 6616266 - DNA, 21 bp, Homo sapiens
actattgggctgggaggattt

SEQ ID NO: 6616267 - DNA, 21 bp, Homo sapiens
actattgggtatgaactaaaa

SEQ ID NO: 6616268 - DNA, 23 bp, Homo sapiens
actattgtaatgccaatatgaca

SEQ ID NO: 6616269 - DNA, 15 bp, Homo sapiens
actattgtattatag

SEQ ID NO: 6616270 - DNA, 21 bp, Homo sapiens
actattgtgaatatttggaat

SEQ ID NO: 6616271 - DNA, 16 bp, Homo sapiens
actattgtgccaactg

SEQ ID NO: 6616272 - DNA, 19 bp, Homo sapiens
actattgtttaaaaacagg

SEQ ID NO: 6616273 - DNA, 15 bp, Homo sapiens
actattgtttgggga

SEQ ID NO: 6616274 - DNA, 18 bp, Homo sapiens
actatttaaaattggcac

SEQ ID NO: 6616275 - DNA, 18 bp, Homo sapiens
actatttaaacttataaa

SEQ ID NO: 6616276 - DNA, 21 bp, Homo sapiens
actatttaaacttataaatca

SEQ ID NO: 6616277 - DNA, 11 bp, Homo sapiens
actatttaaag

SEQ ID NO: 6616278 - DNA, 20 bp, Homo sapiens
actatttaaagcctcctcat

SEQ ID NO: 6616279 - DNA, 15 bp, Homo sapiens
actatttaactgact

SEQ ID NO: 6616280 - DNA, 14 bp, Homo sapiens
actatttaacttga

SEQ ID NO: 6616281 - DNA, 15 bp, Homo sapiens
actatttaacttgag

SEQ ID NO: 6616282 - DNA, 22 bp, Homo sapiens
actatttaacttgagctttaaa

SEQ ID NO: 6616283 - DNA, 16 bp, Homo sapiens
actatttaagatgtga

SEQ ID NO: 6616284 - DNA, 14 bp, Homo sapiens
actatttaagtact

SEQ ID NO: 6616285 - DNA, 16 bp, Homo sapiens
actatttaagtactat

SEQ ID NO: 6616286 - DNA, 22 bp, Homo sapiens
actatttaagtactatctttgt

SEQ ID NO: 6616287 - DNA, 17 bp, Homo sapiens
actatttacaatgtgta

SEQ ID NO: 6616288 - DNA, 19 bp, Homo sapiens
actatttacatataataaa

SEQ ID NO: 6616289 - DNA, 14 bp, Homo sapiens
actatttagagaat

SEQ ID NO: 6616290 - DNA, 19 bp, Homo sapiens
actatttagtgttagttat

SEQ ID NO: 6616291 - DNA, 21 bp, Homo sapiens
actatttagtttttgtaattt

SEQ ID NO: 6616292 - DNA, 14 bp, Homo sapiens
actatttatataca

SEQ ID NO: 6616293 - DNA, 15 bp, Homo sapiens
actatttatatcaca

SEQ ID NO: 6616294 - DNA, 19 bp, Homo sapiens
actatttatatcacacaat

SEQ ID NO: 6616295 - DNA, 14 bp, Homo sapiens
actatttattaaaa

SEQ ID NO: 6616296 - DNA, 19 bp, Homo sapiens
actatttattgactctggg

SEQ ID NO: 6616297 - DNA, 23 bp, Homo sapiens
actatttattgtgctgggtccca

SEQ ID NO: 6616298 - DNA, 18 bp, Homo sapiens
actatttatttacaaatg

SEQ ID NO: 6616299 - DNA, 19 bp, Homo sapiens
actatttatttacaaatgt

SEQ ID NO: 6616300 - DNA, 13 bp, Homo sapiens
actatttcaccat

SEQ ID NO: 6616301 - DNA, 12 bp, Homo sapiens
actatttccttt

SEQ ID NO: 6616302 - DNA, 22 bp, Homo sapiens
actatttctacacagtgggaac

SEQ ID NO: 6616303 - DNA, 11 bp, Homo sapiens
actatttctgt

SEQ ID NO: 6616304 - DNA, 21 bp, Homo sapiens
actatttcttatatatgtgaa

SEQ ID NO: 6616305 - DNA, 13 bp, Homo sapiens
actatttcttcag

SEQ ID NO: 6616306 - DNA, 14 bp, Homo sapiens
actatttgaccccc

SEQ ID NO: 6616307 - DNA, 16 bp, Homo sapiens
actatttgcagaggct

SEQ ID NO: 6616308 - DNA, 17 bp, Homo sapiens
actatttgctaatgtat

SEQ ID NO: 6616309 - DNA, 18 bp, Homo sapiens
actatttgctaatgtata

SEQ ID NO: 6616310 - DNA, 16 bp, Homo sapiens
actatttgtataaaaa

SEQ ID NO: 6616311 - DNA, 19 bp, Homo sapiens
actatttgtgactttttaa

SEQ ID NO: 6616312 - DNA, 20 bp, Homo sapiens
actattttaatttgtattga

SEQ ID NO: 6616313 - DNA, 15 bp, Homo sapiens
actattttatgcaaa

SEQ ID NO: 6616314 - DNA, 13 bp, Homo sapiens
actattttcaaag

SEQ ID NO: 6616315 - DNA, 12 bp, Homo sapiens
actattttcaga

SEQ ID NO: 6616316 - DNA, 16 bp, Homo sapiens
actattttcatttttg

SEQ ID NO: 6616317 - DNA, 13 bp, Homo sapiens
actattttctatt

SEQ ID NO: 6616318 - DNA, 12 bp, Homo sapiens
actatttttact

SEQ ID NO: 6616319 - DNA, 13 bp, Homo sapiens
actatttttactg

SEQ ID NO: 6616320 - DNA, 23 bp, Homo sapiens
actatttttattttcttatgtaa

SEQ ID NO: 6616321 - DNA, 20 bp, Homo sapiens
actatttttgtaaaagacat

SEQ ID NO: 6616322 - DNA, 17 bp, Homo sapiens
actatttttgtgtttga

SEQ ID NO: 6616323 - DNA, 20 bp, Homo sapiens
actatttttgtttttattaa

SEQ ID NO: 6616324 - DNA, 13 bp, Homo sapiens
actattttttaaa

SEQ ID NO: 6616325 - DNA, 17 bp, Homo sapiens
actatttttttcttaaa

SEQ ID NO: 6616326 - DNA, 15 bp, Homo sapiens
actcaaaaaaacaaa

SEQ ID NO: 6616327 - DNA, 16 bp, Homo sapiens
actcaaaaccatctct

SEQ ID NO: 6616328 - DNA, 19 bp, Homo sapiens
actcaaaaccatctctctt

SEQ ID NO: 6616329 - DNA, 17 bp, Homo sapiens
actcaaaacctggagat

SEQ ID NO: 6616330 - DNA, 13 bp, Homo sapiens
actcaaaagctgg

SEQ ID NO: 6616331 - DNA, 20 bp, Homo sapiens
actcaaaagctgggaaccag

SEQ ID NO: 6616332 - DNA, 18 bp, Homo sapiens
actcaaaatctgtcataa

SEQ ID NO: 6616333 - DNA, 21 bp, Homo sapiens
actcaaaatgatgcaaccaaa

SEQ ID NO: 6616334 - DNA, 18 bp, Homo sapiens
actcaaacacttattgtt

SEQ ID NO: 6616335 - DNA, 23 bp, Homo sapiens
actcaaacctggagctgaggaat

SEQ ID NO: 6616336 - DNA, 16 bp, Homo sapiens
actcaaactcttaaaa

SEQ ID NO: 6616337 - DNA, 21 bp, Homo sapiens
actcaaagagggtgagggcct

SEQ ID NO: 6616338 - DNA, 22 bp, Homo sapiens
actcaaagcatgggattattag

SEQ ID NO: 6616339 - DNA, 17 bp, Homo sapiens
actcaaaggactgacct

SEQ ID NO: 6616340 - DNA, 14 bp, Homo sapiens
actcaaaggccaga

SEQ ID NO: 6616341 - DNA, 17 bp, Homo sapiens
actcaaagggtggaata

SEQ ID NO: 6616342 - DNA, 16 bp, Homo sapiens
actcaaatacacattt

SEQ ID NO: 6616343 - DNA, 23 bp, Homo sapiens
actcaaatatgagtacaaatgcc

SEQ ID NO: 6616344 - DNA, 19 bp, Homo sapiens
actcaaatcgaatagggaa

SEQ ID NO: 6616345 - DNA, 22 bp, Homo sapiens
actcaaatcttaagaaataaat

SEQ ID NO: 6616346 - DNA, 22 bp, Homo sapiens
actcaaatgagccccttcatcc

SEQ ID NO: 6616347 - DNA, 12 bp, Homo sapiens
actcaaatgctt

SEQ ID NO: 6616348 - DNA, 17 bp, Homo sapiens
actcaaatggggccaga

SEQ ID NO: 6616349 - DNA, 18 bp, Homo sapiens
actcaaatggtgtcatgg

SEQ ID NO: 6616350 - DNA, 20 bp, Homo sapiens
actcaaatgtgagtgttttt

SEQ ID NO: 6616351 - DNA, 18 bp, Homo sapiens
actcaaatgttctaagtt

SEQ ID NO: 6616352 - DNA, 13 bp, Homo sapiens
actcaaattttgt

SEQ ID NO: 6616353 - DNA, 16 bp, Homo sapiens
actcaaattttgtacc

SEQ ID NO: 6616354 - DNA, 22 bp, Homo sapiens
actcaacaaaacccatgcattt

SEQ ID NO: 6616355 - DNA, 16 bp, Homo sapiens
actcaacaataaagac

SEQ ID NO: 6616356 - DNA, 20 bp, Homo sapiens
actcaacaatggttgaatga

SEQ ID NO: 6616357 - DNA, 15 bp, Homo sapiens
actcaacagagagga

SEQ ID NO: 6616358 - DNA, 15 bp, Homo sapiens
actcaacatgagtca

SEQ ID NO: 6616359 - DNA, 22 bp, Homo sapiens
actcaacatgttactgaccagc

SEQ ID NO: 6616360 - DNA, 23 bp, Homo sapiens
actcaacatgttactgaccagca

SEQ ID NO: 6616361 - DNA, 20 bp, Homo sapiens
actcaacatttgtctggtct

SEQ ID NO: 6616362 - DNA, 15 bp, Homo sapiens
actcaaccagagtca

SEQ ID NO: 6616363 - DNA, 23 bp, Homo sapiens
actcaaccttaagacctactgtt

SEQ ID NO: 6616364 - DNA, 13 bp, Homo sapiens
actcaagaagcag

SEQ ID NO: 6616365 - DNA, 12 bp, Homo sapiens
actcaagaagga

SEQ ID NO: 6616366 - DNA, 17 bp, Homo sapiens
actcaagaagtgaagaa

SEQ ID NO: 6616367 - DNA, 16 bp, Homo sapiens
actcaagaccaggctg

SEQ ID NO: 6616368 - DNA, 20 bp, Homo sapiens
actcaagacttccagagcct

SEQ ID NO: 6616369 - DNA, 14 bp, Homo sapiens
actcaagaggctga

SEQ ID NO: 6616370 - DNA, 15 bp, Homo sapiens
actcaagaggctgag

SEQ ID NO: 6616371 - DNA, 20 bp, Homo sapiens
actcaagagttcagtgctca

SEQ ID NO: 6616372 - DNA, 16 bp, Homo sapiens
actcaagattcccagg

SEQ ID NO: 6616373 - DNA, 19 bp, Homo sapiens
actcaagattcccaggagt

SEQ ID NO: 6616374 - DNA, 12 bp, Homo sapiens
actcaagcactg

SEQ ID NO: 6616375 - DNA, 15 bp, Homo sapiens
actcaagcagatctc

SEQ ID NO: 6616376 - DNA, 14 bp, Homo sapiens
actcaagccaagca

SEQ ID NO: 6616377 - DNA, 22 bp, Homo sapiens
actcaagccaagcagccaagct

SEQ ID NO: 6616378 - DNA, 14 bp, Homo sapiens
actcaagcccgcgg

SEQ ID NO: 6616379 - DNA, 21 bp, Homo sapiens
actcaagcgggtggctctggg

SEQ ID NO: 6616380 - DNA, 15 bp, Homo sapiens
actcaagctgtctct

SEQ ID NO: 6616381 - DNA, 17 bp, Homo sapiens
actcaaggactttgcag
